United States Patent 7,250,289 (METHODS OF GENETIC ANALYSIS OF MOUSE) - sequence listing, part 11

SEQ ID NO: 402967 - DNA, 25 bp, Mus musculus
gaaaacgttactcttcatctagaag

SEQ ID NO: 402968 - DNA, 25 bp, Mus musculus
gaaaacgttactgttcatctagaag

SEQ ID NO: 402969 - DNA, 25 bp, Mus musculus
gaaaactaacaacaaccagatcctt

SEQ ID NO: 402970 - DNA, 25 bp, Mus musculus
gaaaactaacaagaaccagatcctt

SEQ ID NO: 402971 - DNA, 25 bp, Mus musculus
gaaaactaacagcatggtggctcat

SEQ ID NO: 402972 - DNA, 25 bp, Mus musculus
gaaaactaacaggatggtggctcat

SEQ ID NO: 402973 - DNA, 25 bp, Mus musculus
gaaaactaaccacaccactatactt

SEQ ID NO: 402974 - DNA, 25 bp, Mus musculus
gaaaactaaccagaccactatactt

SEQ ID NO: 402975 - DNA, 25 bp, Mus musculus
gaaaactaagatctgcaggacccaa

SEQ ID NO: 402976 - DNA, 25 bp, Mus musculus
gaaaactaagatgtgcaggacccaa

SEQ ID NO: 402977 - DNA, 25 bp, Mus musculus
gaaaactacaagaaacccgtgactg

SEQ ID NO: 402978 - DNA, 25 bp, Mus musculus
gaaaactacaagtaacccgtgactg

SEQ ID NO: 402979 - DNA, 25 bp, Mus musculus
gaaaactacagtcctgacgacaaca

SEQ ID NO: 402980 - DNA, 25 bp, Mus musculus
gaaaactacagtgctgacgacaaca

SEQ ID NO: 402981 - DNA, 25 bp, Mus musculus
gaaaactaccacacagatacagaag

SEQ ID NO: 402982 - DNA, 25 bp, Mus musculus
gaaaactaccacacctaagaagcaa

SEQ ID NO: 402983 - DNA, 25 bp, Mus musculus
gaaaactaccactcagatacagaag

SEQ ID NO: 402984 - DNA, 25 bp, Mus musculus
gaaaactaccactcctaagaagcaa

SEQ ID NO: 402985 - DNA, 25 bp, Mus musculus
gaaaactaccagatgctcacattgg

SEQ ID NO: 402986 - DNA, 25 bp, Mus musculus
gaaaactaccagttgctcacattgg

SEQ ID NO: 402987 - DNA, 25 bp, Mus musculus
gaaaactaccgaacagttgccctct

SEQ ID NO: 402988 - DNA, 25 bp, Mus musculus
gaaaactaccgatcagttgccctct

SEQ ID NO: 402989 - DNA, 25 bp, Mus musculus
gaaaactacctgattggtttgctgc

SEQ ID NO: 402990 - DNA, 25 bp, Mus musculus
gaaaactacctgctgatgcaatttt

SEQ ID NO: 402991 - DNA, 25 bp, Mus musculus
gaaaactacctggtgatgcaatttt

SEQ ID NO: 402992 - DNA, 25 bp, Mus musculus
gaaaactacctgtttggtttgctgc

SEQ ID NO: 402993 - DNA, 25 bp, Mus musculus
gaaaactacgctaagttcagatcct

SEQ ID NO: 402994 - DNA, 25 bp, Mus musculus
gaaaactacgcttagttcagatcct

SEQ ID NO: 402995 - DNA, 25 bp, Mus musculus
gaaaactactgcatgaactgacatt

SEQ ID NO: 402996 - DNA, 25 bp, Mus musculus
gaaaactactgcttgaactgacatt

SEQ ID NO: 402997 - DNA, 25 bp, Mus musculus
gaaaactacttaatcccaccatggg

SEQ ID NO: 402998 - DNA, 25 bp, Mus musculus
gaaaactacttattcccaccatggg

SEQ ID NO: 402999 - DNA, 25 bp, Mus musculus
gaaaactagatcataatcacactgt

SEQ ID NO: 403000 - DNA, 25 bp, Mus musculus
gaaaactagatcttaatcacactgt

SEQ ID NO: 403001 - DNA, 25 bp, Mus musculus
gaaaactagccactctcaggttgat

SEQ ID NO: 403002 - DNA, 25 bp, Mus musculus
gaaaactagccagtctcaggttgat

SEQ ID NO: 403003 - DNA, 25 bp, Mus musculus
gaaaactagcctcgcatgtggtagc

SEQ ID NO: 403004 - DNA, 25 bp, Mus musculus
gaaaactagcctggcatgtggtagc

SEQ ID NO: 403005 - DNA, 25 bp, Mus musculus
gaaaactagctgaattttttcctga

SEQ ID NO: 403006 - DNA, 25 bp, Mus musculus
gaaaactagctgtattttttcctga

SEQ ID NO: 403007 - DNA, 25 bp, Mus musculus
gaaaactaggatactcactggaaca

SEQ ID NO: 403008 - DNA, 25 bp, Mus musculus
gaaaactaggattctcactggaaca

SEQ ID NO: 403009 - DNA, 25 bp, Mus musculus
gaaaactatgatctgtgcgcgcgtg

SEQ ID NO: 403010 - DNA, 25 bp, Mus musculus
gaaaactatgatgtgtgcgcgcgtg

SEQ ID NO: 403011 - DNA, 25 bp, Mus musculus
gaaaactattctactagatgagtac

SEQ ID NO: 403012 - DNA, 25 bp, Mus musculus
gaaaactattcttctagatgagtac

SEQ ID NO: 403013 - DNA, 25 bp, Mus musculus
gaaaactcaagcactttcctatgct

SEQ ID NO: 403014 - DNA, 25 bp, Mus musculus
gaaaactcaagctctttcctatgct

SEQ ID NO: 403015 - DNA, 25 bp, Mus musculus
gaaaactcaaggctcacttccaaaa

SEQ ID NO: 403016 - DNA, 25 bp, Mus musculus
gaaaactcaagggtcacttccaaaa

SEQ ID NO: 403017 - DNA, 25 bp, Mus musculus
gaaaactcacagcttttatcctagc

SEQ ID NO: 403018 - DNA, 25 bp, Mus musculus
gaaaactcacaggttttatcctagc

SEQ ID NO: 403019 - DNA, 25 bp, Mus musculus
gaaaactcatgaatcagacccaagg

SEQ ID NO: 403020 - DNA, 25 bp, Mus musculus
gaaaactcatgattcagacccaagg

SEQ ID NO: 403021 - DNA, 25 bp, Mus musculus
gaaaactcattactctgtatgctga

SEQ ID NO: 403022 - DNA, 25 bp, Mus musculus
gaaaactcattagtctgtatgctga

SEQ ID NO: 403023 - DNA, 25 bp, Mus musculus
gaaaactccaaaagtccctcaactg

SEQ ID NO: 403024 - DNA, 25 bp, Mus musculus
gaaaactccaaatgtccctcaactg

SEQ ID NO: 403025 - DNA, 25 bp, Mus musculus
gaaaactccaaccagccaatcataa

SEQ ID NO: 403026 - DNA, 25 bp, Mus musculus
gaaaactccaacgagccaatcataa

SEQ ID NO: 403027 - DNA, 25 bp, Mus musculus
gaaaactccactattcggcagtgtc

SEQ ID NO: 403028 - DNA, 25 bp, Mus musculus
gaaaactccacttttcggcagtgtc

SEQ ID NO: 403029 - DNA, 25 bp, Mus musculus
gaaaactccagccgaggaccccaga

SEQ ID NO: 403030 - DNA, 25 bp, Mus musculus
gaaaactccagcggaggaccccaga

SEQ ID NO: 403031 - DNA, 25 bp, Mus musculus
gaaaactcccaaattgcggtctcga

SEQ ID NO: 403032 - DNA, 25 bp, Mus musculus
gaaaactcccaatttgcggtctcga

SEQ ID NO: 403033 - DNA, 25 bp, Mus musculus
gaaaactcctcaacagccgaaattt

SEQ ID NO: 403034 - DNA, 25 bp, Mus musculus
gaaaactcctcatcagccgaaattt

SEQ ID NO: 403035 - DNA, 25 bp, Mus musculus
gaaaactcggtcactggacagacac

SEQ ID NO: 403036 - DNA, 25 bp, Mus musculus
gaaaactcggtctctggacagacac

SEQ ID NO: 403037 - DNA, 25 bp, Mus musculus
gaaaactctagtctcatcaggtgaa

SEQ ID NO: 403038 - DNA, 25 bp, Mus musculus
gaaaactctagtgtcatcaggtgaa

SEQ ID NO: 403039 - DNA, 25 bp, Mus musculus
gaaaactctattccttgaagctatg

SEQ ID NO: 403040 - DNA, 25 bp, Mus musculus
gaaaactctattgcttgaagctatg

SEQ ID NO: 403041 - DNA, 25 bp, Mus musculus
gaaaactctcaacaactgttccaaa

SEQ ID NO: 403042 - DNA, 25 bp, Mus musculus
gaaaactctcaagaactgttccaaa

SEQ ID NO: 403043 - DNA, 25 bp, Mus musculus
gaaaactctctcaggtccagtaact

SEQ ID NO: 403044 - DNA, 25 bp, Mus musculus
gaaaactctctctggtccagtaact

SEQ ID NO: 403045 - DNA, 25 bp, Mus musculus
gaaaactctcttataacaggtatag

SEQ ID NO: 403046 - DNA, 25 bp, Mus musculus
gaaaactctcttcagccgcggtggc

SEQ ID NO: 403047 - DNA, 25 bp, Mus musculus
gaaaactctcttctcaagatttctc

SEQ ID NO: 403048 - DNA, 25 bp, Mus musculus
gaaaactctcttgagccgcggtggc

SEQ ID NO: 403049 - DNA, 25 bp, Mus musculus
gaaaactctcttgtcaagatttctc

SEQ ID NO: 403050 - DNA, 25 bp, Mus musculus
gaaaactctcttttaacaggtatag

SEQ ID NO: 403051 - DNA, 25 bp, Mus musculus
gaaaactctgcactctatctgtgag

SEQ ID NO: 403052 - DNA, 25 bp, Mus musculus
gaaaactctgcagtctatctgtgag

SEQ ID NO: 403053 - DNA, 25 bp, Mus musculus
gaaaactctgctctatgtacataca

SEQ ID NO: 403054 - DNA, 25 bp, Mus musculus
gaaaactctgctgtatgtacataca

SEQ ID NO: 403055 - DNA, 25 bp, Mus musculus
gaaaactctgtactcagatctttaa

SEQ ID NO: 403056 - DNA, 25 bp, Mus musculus
gaaaactctgtagtcagatctttaa

SEQ ID NO: 403057 - DNA, 25 bp, Mus musculus
gaaaactctgttcgatggaacttta

SEQ ID NO: 403058 - DNA, 25 bp, Mus musculus
gaaaactctgttggatggaacttta

SEQ ID NO: 403059 - DNA, 25 bp, Mus musculus
gaaaactgaacccagtgttcactgg

SEQ ID NO: 403060 - DNA, 25 bp, Mus musculus
gaaaactgaaccgagtgttcactgg

SEQ ID NO: 403061 - DNA, 25 bp, Mus musculus
gaaaactgacccaaggttggttgct

SEQ ID NO: 403062 - DNA, 25 bp, Mus musculus
gaaaactgaccctaggttggttgct

SEQ ID NO: 403063 - DNA, 25 bp, Mus musculus
gaaaactgactaaccatctcaaaga

SEQ ID NO: 403064 - DNA, 25 bp, Mus musculus
gaaaactgactatccatctcaaaga

SEQ ID NO: 403065 - DNA, 25 bp, Mus musculus
gaaaactgaggcctaacccctacat

SEQ ID NO: 403066 - DNA, 25 bp, Mus musculus
gaaaactgaggcgtaacccctacat

SEQ ID NO: 403067 - DNA, 25 bp, Mus musculus
gaaaactgagttaacatttggcctt

SEQ ID NO: 403068 - DNA, 25 bp, Mus musculus
gaaaactgagtttacatttggcctt

SEQ ID NO: 403069 - DNA, 25 bp, Mus musculus
gaaaactgattcatactaacctgtt

SEQ ID NO: 403070 - DNA, 25 bp, Mus musculus
gaaaactgattcttactaacctgtt

SEQ ID NO: 403071 - DNA, 25 bp, Mus musculus
gaaaactgcagtaggtccagttcct

SEQ ID NO: 403072 - DNA, 25 bp, Mus musculus
gaaaactgcagttggtccagttcct

SEQ ID NO: 403073 - DNA, 25 bp, Mus musculus
gaaaactgccagagtaccaaaagtt

SEQ ID NO: 403074 - DNA, 25 bp, Mus musculus
gaaaactgccagtgtaccaaaagtt

SEQ ID NO: 403075 - DNA, 25 bp, Mus musculus
gaaaactgcccaatgagtacagaga

SEQ ID NO: 403076 - DNA, 25 bp, Mus musculus
gaaaactgcccattgagtacagaga

SEQ ID NO: 403077 - DNA, 25 bp, Mus musculus
gaaaactgcctcaggtgacttctat

SEQ ID NO: 403078 - DNA, 25 bp, Mus musculus
gaaaactgcctctggtgacttctat

SEQ ID NO: 403079 - DNA, 25 bp, Mus musculus
gaaaactgcgagcttcatcatctgt

SEQ ID NO: 403080 - DNA, 25 bp, Mus musculus
gaaaactgcgaggttcatcatctgt

SEQ ID NO: 403081 - DNA, 25 bp, Mus musculus
gaaaactgctctattgacaagggaa

SEQ ID NO: 403082 - DNA, 25 bp, Mus musculus
gaaaactgctcttttgacaagggaa

SEQ ID NO: 403083 - DNA, 25 bp, Mus musculus
gaaaactgctgtctaacttaaggga

SEQ ID NO: 403084 - DNA, 25 bp, Mus musculus
gaaaactgctgtgtaacttaaggga

SEQ ID NO: 403085 - DNA, 25 bp, Mus musculus
gaaaactgcttacaattccatcccc

SEQ ID NO: 403086 - DNA, 25 bp, Mus musculus
gaaaactgcttagaattccatcccc

SEQ ID NO: 403087 - DNA, 25 bp, Mus musculus
gaaaactgcttcagctggtcttggg

SEQ ID NO: 403088 - DNA, 25 bp, Mus musculus
gaaaactgcttctgctggtcttggg

SEQ ID NO: 403089 - DNA, 25 bp, Mus musculus
gaaaactgcttgcacatttaagatc

SEQ ID NO: 403090 - DNA, 25 bp, Mus musculus
gaaaactgcttggacatttaagatc

SEQ ID NO: 403091 - DNA, 25 bp, Mus musculus
gaaaactggaaacggcatggctcta

SEQ ID NO: 403092 - DNA, 25 bp, Mus musculus
gaaaactggaaagggcatggctcta

SEQ ID NO: 403093 - DNA, 25 bp, Mus musculus
gaaaactggccacagacctcctaaa

SEQ ID NO: 403094 - DNA, 25 bp, Mus musculus
gaaaactggccagagacctcctaaa

SEQ ID NO: 403095 - DNA, 25 bp, Mus musculus
gaaaactggcccaacatccaaggct

SEQ ID NO: 403096 - DNA, 25 bp, Mus musculus
gaaaactggccctacatccaaggct

SEQ ID NO: 403097 - DNA, 25 bp, Mus musculus
gaaaactggctaactgacatgtgca

SEQ ID NO: 403098 - DNA, 25 bp, Mus musculus
gaaaactggctatctgacatgtgca

SEQ ID NO: 403099 - DNA, 25 bp, Mus musculus
gaaaactggtcacttcagagcccaa

SEQ ID NO: 403100 - DNA, 25 bp, Mus musculus
gaaaactggtcagttcagagcccaa

SEQ ID NO: 403101 - DNA, 25 bp, Mus musculus
gaaaactggttcatcctctagtact

SEQ ID NO: 403102 - DNA, 25 bp, Mus musculus
gaaaactggttcttcctctagtact

SEQ ID NO: 403103 - DNA, 25 bp, Mus musculus
gaaaactgtaaaacctggtccgtga

SEQ ID NO: 403104 - DNA, 25 bp, Mus musculus
gaaaactgtaaatcctggtccgtga

SEQ ID NO: 403105 - DNA, 25 bp, Mus musculus
gaaaactgtccaactgcagagctga

SEQ ID NO: 403106 - DNA, 25 bp, Mus musculus
gaaaactgtccatctgcagagctga

SEQ ID NO: 403107 - DNA, 25 bp, Mus musculus
gaaaactgtcttaaattgatgacta

SEQ ID NO: 403108 - DNA, 25 bp, Mus musculus
gaaaactgtcttagtccttatggaa

SEQ ID NO: 403109 - DNA, 25 bp, Mus musculus
gaaaactgtctttaattgatgacta

SEQ ID NO: 403110 - DNA, 25 bp, Mus musculus
gaaaactgtctttgtccttatggaa

SEQ ID NO: 403111 - DNA, 25 bp, Mus musculus
gaaaactgtgacaacacccgaatga

SEQ ID NO: 403112 - DNA, 25 bp, Mus musculus
gaaaactgtgacacccagcggtgtg

SEQ ID NO: 403113 - DNA, 25 bp, Mus musculus
gaaaactgtgactacacccgaatga

SEQ ID NO: 403114 - DNA, 25 bp, Mus musculus
gaaaactgtgactcccagcggtgtg

SEQ ID NO: 403115 - DNA, 25 bp, Mus musculus
gaaaactgtgatattaggattacct

SEQ ID NO: 403116 - DNA, 25 bp, Mus musculus
gaaaactgtgattttaggattacct

SEQ ID NO: 403117 - DNA, 25 bp, Mus musculus
gaaaactgtgcgaacaaactgacat

SEQ ID NO: 403118 - DNA, 25 bp, Mus musculus
gaaaactgtgcgtacaaactgacat

SEQ ID NO: 403119 - DNA, 25 bp, Mus musculus
gaaaactgtgtcaagctgtgcatca

SEQ ID NO: 403120 - DNA, 25 bp, Mus musculus
gaaaactgtgtctagctgtgcatca

SEQ ID NO: 403121 - DNA, 25 bp, Mus musculus
gaaaactgttctccctgttctgtga

SEQ ID NO: 403122 - DNA, 25 bp, Mus musculus
gaaaactgttctgcctgttctgtga

SEQ ID NO: 403123 - DNA, 25 bp, Mus musculus
gaaaacttacatcgttgtgtgagaa

SEQ ID NO: 403124 - DNA, 25 bp, Mus musculus
gaaaacttacatggttgtgtgagaa

SEQ ID NO: 403125 - DNA, 25 bp, Mus musculus
gaaaacttatctcctaatccttgcc

SEQ ID NO: 403126 - DNA, 25 bp, Mus musculus
gaaaacttatctgctaatccttgcc

SEQ ID NO: 403127 - DNA, 25 bp, Mus musculus
gaaaacttcaaaccagaaggcacaa

SEQ ID NO: 403128 - DNA, 25 bp, Mus musculus
gaaaacttcaaagcagaaggcacaa

SEQ ID NO: 403129 - DNA, 25 bp, Mus musculus
gaaaacttcaataaccgacgcagac

SEQ ID NO: 403130 - DNA, 25 bp, Mus musculus
gaaaacttcaattaccgacgcagac

SEQ ID NO: 403131 - DNA, 25 bp, Mus musculus
gaaaacttcaccactaattcattgt

SEQ ID NO: 403132 - DNA, 25 bp, Mus musculus
gaaaacttcacctctaattcattgt

SEQ ID NO: 403133 - DNA, 25 bp, Mus musculus
gaaaacttcatccaagtcagcgtgg

SEQ ID NO: 403134 - DNA, 25 bp, Mus musculus
gaaaacttcatcgaagtcagcgtgg

SEQ ID NO: 403135 - DNA, 25 bp, Mus musculus
gaaaacttccacaaggatccttcct

SEQ ID NO: 403136 - DNA, 25 bp, Mus musculus
gaaaacttccactaggatccttcct

SEQ ID NO: 403137 - DNA, 25 bp, Mus musculus
gaaaacttcctcattgactgaactg

SEQ ID NO: 403138 - DNA, 25 bp, Mus musculus
gaaaacttcctctttgactgaactg

SEQ ID NO: 403139 - DNA, 25 bp, Mus musculus
gaaaacttcctgaactggcacgtca

SEQ ID NO: 403140 - DNA, 25 bp, Mus musculus
gaaaacttcctgtactggcacgtca

SEQ ID NO: 403141 - DNA, 25 bp, Mus musculus
gaaaacttccttcacttcagatgca

SEQ ID NO: 403142 - DNA, 25 bp, Mus musculus
gaaaacttccttctaagagctggat

SEQ ID NO: 403143 - DNA, 25 bp, Mus musculus
gaaaacttccttgacttcagatgca

SEQ ID NO: 403144 - DNA, 25 bp, Mus musculus
gaaaacttccttgtaagagctggat

SEQ ID NO: 403145 - DNA, 25 bp, Mus musculus
gaaaacttcgagctcaaactggaat

SEQ ID NO: 403146 - DNA, 25 bp, Mus musculus
gaaaacttcgaggtcaaactggaat

SEQ ID NO: 403147 - DNA, 25 bp, Mus musculus
gaaaacttcgtcaagcattaaccaa

SEQ ID NO: 403148 - DNA, 25 bp, Mus musculus
gaaaacttcgtctagcattaaccaa

SEQ ID NO: 403149 - DNA, 25 bp, Mus musculus
gaaaacttctctacgtggttgtggg

SEQ ID NO: 403150 - DNA, 25 bp, Mus musculus
gaaaacttctcttcgtggttgtggg

SEQ ID NO: 403151 - DNA, 25 bp, Mus musculus
gaaaacttctggcactgggactagg

SEQ ID NO: 403152 - DNA, 25 bp, Mus musculus
gaaaacttctgggactgggactagg

SEQ ID NO: 403153 - DNA, 25 bp, Mus musculus
gaaaacttgcaacttatggctatga

SEQ ID NO: 403154 - DNA, 25 bp, Mus musculus
gaaaacttgcaagttatggctatga

SEQ ID NO: 403155 - DNA, 25 bp, Mus musculus
gaaaacttgcctagactccaaaagc

SEQ ID NO: 403156 - DNA, 25 bp, Mus musculus
gaaaacttgccttgactccaaaagc

SEQ ID NO: 403157 - DNA, 25 bp, Mus musculus
gaaaacttgtccatggtgtaacaca

SEQ ID NO: 403158 - DNA, 25 bp, Mus musculus
gaaaacttgtccttggtgtaacaca

SEQ ID NO: 403159 - DNA, 25 bp, Mus musculus
gaaaacttgtctaggcctcattatt

SEQ ID NO: 403160 - DNA, 25 bp, Mus musculus
gaaaacttgtctatgcagaacagag

SEQ ID NO: 403161 - DNA, 25 bp, Mus musculus
gaaaacttgtcttggcctcattatt

SEQ ID NO: 403162 - DNA, 25 bp, Mus musculus
gaaaacttgtctttgcagaacagag

SEQ ID NO: 403163 - DNA, 25 bp, Mus musculus
gaaaactttataatacagcgggaat

SEQ ID NO: 403164 - DNA, 25 bp, Mus musculus
gaaaactttatattacagcgggaat

SEQ ID NO: 403165 - DNA, 25 bp, Mus musculus
gaaaactttcagcatcaactttgga

SEQ ID NO: 403166 - DNA, 25 bp, Mus musculus
gaaaactttcaggatcaactttgga

SEQ ID NO: 403167 - DNA, 25 bp, Mus musculus
gaaaactttccaagcgtactcgaag

SEQ ID NO: 403168 - DNA, 25 bp, Mus musculus
gaaaactttccatgcgtactcgaag

SEQ ID NO: 403169 - DNA, 25 bp, Mus musculus
gaaaactttccgagtagcagctctg

SEQ ID NO: 403170 - DNA, 25 bp, Mus musculus
gaaaactttccgtgtagcagctctg

SEQ ID NO: 403171 - DNA, 25 bp, Mus musculus
gaaaactttgacaatgaattggctt

SEQ ID NO: 403172 - DNA, 25 bp, Mus musculus
gaaaactttgactatgaattggctt

SEQ ID NO: 403173 - DNA, 25 bp, Mus musculus
gaaaactttgggagccttgaaggat

SEQ ID NO: 403174 - DNA, 25 bp, Mus musculus
gaaaactttgggtgccttgaaggat

SEQ ID NO: 403175 - DNA, 25 bp, Mus musculus
gaaaactttgtactggtagccactg

SEQ ID NO: 403176 - DNA, 25 bp, Mus musculus
gaaaactttgtagtggtagccactg

SEQ ID NO: 403177 - DNA, 25 bp, Mus musculus
gaaaactttttaagaatctgcctca

SEQ ID NO: 403178 - DNA, 25 bp, Mus musculus
gaaaactttttatgaatctgcctca

SEQ ID NO: 403179 - DNA, 25 bp, Mus musculus
gaaaactttttcagatggatattgt

SEQ ID NO: 403180 - DNA, 25 bp, Mus musculus
gaaaactttttctgatggatattgt

SEQ ID NO: 403181 - DNA, 25 bp, Mus musculus
gaaaagaaacttcctgaggaaagag

SEQ ID NO: 403182 - DNA, 25 bp, Mus musculus
gaaaagaaacttgctgaggaaagag

SEQ ID NO: 403183 - DNA, 25 bp, Mus musculus
gaaaagaaagacctccgagctccct

SEQ ID NO: 403184 - DNA, 25 bp, Mus musculus
gaaaagaaagacgtccgagctccct

SEQ ID NO: 403185 - DNA, 25 bp, Mus musculus
gaaaagaaagctccacgcgggcccc

SEQ ID NO: 403186 - DNA, 25 bp, Mus musculus
gaaaagaaagctgcacgcgggcccc

SEQ ID NO: 403187 - DNA, 25 bp, Mus musculus
gaaaagaaagtcacccagcattaga

SEQ ID NO: 403188 - DNA, 25 bp, Mus musculus
gaaaagaaagtctcccagcattaga

SEQ ID NO: 403189 - DNA, 25 bp, Mus musculus
gaaaagaaatcaccacaactctgag

SEQ ID NO: 403190 - DNA, 25 bp, Mus musculus
gaaaagaaatcagcacaactctgag

SEQ ID NO: 403191 - DNA, 25 bp, Mus musculus
gaaaagaacacaacgcgctattctg

SEQ ID NO: 403192 - DNA, 25 bp, Mus musculus
gaaaagaacacactaaagctccaga

SEQ ID NO: 403193 - DNA, 25 bp, Mus musculus
gaaaagaacacagtaaagctccaga

SEQ ID NO: 403194 - DNA, 25 bp, Mus musculus
gaaaagaacacatcgcgctattctg

SEQ ID NO: 403195 - DNA, 25 bp, Mus musculus
gaaaagaacaccctgagctgggcct

SEQ ID NO: 403196 - DNA, 25 bp, Mus musculus
gaaaagaacaccgtgagctgggcct

SEQ ID NO: 403197 - DNA, 25 bp, Mus musculus
gaaaagaacggcattgctccgaggc

SEQ ID NO: 403198 - DNA, 25 bp, Mus musculus
gaaaagaacggctttgctccgaggc

SEQ ID NO: 403199 - DNA, 25 bp, Mus musculus
gaaaagaacttaccgccaggtcctg

SEQ ID NO: 403200 - DNA, 25 bp, Mus musculus
gaaaagaacttagcgccaggtcctg

SEQ ID NO: 403201 - DNA, 25 bp, Mus musculus
gaaaagaagccactggcaacaaccc

SEQ ID NO: 403202 - DNA, 25 bp, Mus musculus
gaaaagaagccagtggcaacaaccc

SEQ ID NO: 403203 - DNA, 25 bp, Mus musculus
gaaaagaagcccaatctggagactt

SEQ ID NO: 403204 - DNA, 25 bp, Mus musculus
gaaaagaagccctatctggagactt

SEQ ID NO: 403205 - DNA, 25 bp, Mus musculus
gaaaagaagcctacgttgtgaactc

SEQ ID NO: 403206 - DNA, 25 bp, Mus musculus
gaaaagaagcctatctgcgtctgcc

SEQ ID NO: 403207 - DNA, 25 bp, Mus musculus
gaaaagaagccttcgttgtgaactc

SEQ ID NO: 403208 - DNA, 25 bp, Mus musculus
gaaaagaagcctttctgcgtctgcc

SEQ ID NO: 403209 - DNA, 25 bp, Mus musculus
gaaaagaaggtgccccaaccctcat

SEQ ID NO: 403210 - DNA, 25 bp, Mus musculus
gaaaagaaggtggcccaaccctcat

SEQ ID NO: 403211 - DNA, 25 bp, Mus musculus
gaaaagaagtttatcctggatccta

SEQ ID NO: 403212 - DNA, 25 bp, Mus musculus
gaaaagaagtttttcctggatccta

SEQ ID NO: 403213 - DNA, 25 bp, Mus musculus
gaaaagaatcatcaccaccactgta

SEQ ID NO: 403214 - DNA, 25 bp, Mus musculus
gaaaagaatcatgaccaccactgta

SEQ ID NO: 403215 - DNA, 25 bp, Mus musculus
gaaaagaatcctacttgtggtttga

SEQ ID NO: 403216 - DNA, 25 bp, Mus musculus
gaaaagaatccttcttgtggtttga

SEQ ID NO: 403217 - DNA, 25 bp, Mus musculus
gaaaagaatgctaccccctgagtca

SEQ ID NO: 403218 - DNA, 25 bp, Mus musculus
gaaaagaatgcttccccctgagtca

SEQ ID NO: 403219 - DNA, 25 bp, Mus musculus
gaaaagacaaacatgccagtcaaga

SEQ ID NO: 403220 - DNA, 25 bp, Mus musculus
gaaaagacaaacttgccagtcaaga

SEQ ID NO: 403221 - DNA, 25 bp, Mus musculus
gaaaagacacttactgaaacatcat

SEQ ID NO: 403222 - DNA, 25 bp, Mus musculus
gaaaagacactttctgaaacatcat

SEQ ID NO: 403223 - DNA, 25 bp, Mus musculus
gaaaagacagccaatagaatttaaa

SEQ ID NO: 403224 - DNA, 25 bp, Mus musculus
gaaaagacagcctatagaatttaaa

SEQ ID NO: 403225 - DNA, 25 bp, Mus musculus
gaaaagacaggcatcgttcacaact

SEQ ID NO: 403226 - DNA, 25 bp, Mus musculus
gaaaagacaggcttcgttcacaact

SEQ ID NO: 403227 - DNA, 25 bp, Mus musculus
gaaaagacatatctccttcatgaag

SEQ ID NO: 403228 - DNA, 25 bp, Mus musculus
gaaaagacatatgtccttcatgaag

SEQ ID NO: 403229 - DNA, 25 bp, Mus musculus
gaaaagacatttacatggcgtaaaa

SEQ ID NO: 403230 - DNA, 25 bp, Mus musculus
gaaaagacattttcatggcgtaaaa

SEQ ID NO: 403231 - DNA, 25 bp, Mus musculus
gaaaagaccggtaacttgcttgagt

SEQ ID NO: 403232 - DNA, 25 bp, Mus musculus
gaaaagaccggttacttgcttgagt

SEQ ID NO: 403233 - DNA, 25 bp, Mus musculus
gaaaagaccgtgctcgctgtgcgtc

SEQ ID NO: 403234 - DNA, 25 bp, Mus musculus
gaaaagaccgtggtcgctgtgcgtc

SEQ ID NO: 403235 - DNA, 25 bp, Mus musculus
gaaaagacctccacgctacaaggga

SEQ ID NO: 403236 - DNA, 25 bp, Mus musculus
gaaaagacctcctcgctacaaggga

SEQ ID NO: 403237 - DNA, 25 bp, Mus musculus
gaaaagacctgcaggctactgctgc

SEQ ID NO: 403238 - DNA, 25 bp, Mus musculus
gaaaagacctgctggctactgctgc

SEQ ID NO: 403239 - DNA, 25 bp, Mus musculus
gaaaagacggtaatgcagtgcagat

SEQ ID NO: 403240 - DNA, 25 bp, Mus musculus
gaaaagacggtattgcagtgcagat

SEQ ID NO: 403241 - DNA, 25 bp, Mus musculus
gaaaagactgggatccctggcagat

SEQ ID NO: 403242 - DNA, 25 bp, Mus musculus
gaaaagactgggttccctggcagat

SEQ ID NO: 403243 - DNA, 25 bp, Mus musculus
gaaaagactgtcctaacatttagaa

SEQ ID NO: 403244 - DNA, 25 bp, Mus musculus
gaaaagactgtcgtaacatttagaa

SEQ ID NO: 403245 - DNA, 25 bp, Mus musculus
gaaaagacttctatcctgaatgtaa

SEQ ID NO: 403246 - DNA, 25 bp, Mus musculus
gaaaagacttctttcctgaatgtaa

SEQ ID NO: 403247 - DNA, 25 bp, Mus musculus
gaaaagagatgtactggccataggg

SEQ ID NO: 403248 - DNA, 25 bp, Mus musculus
gaaaagagatgttctggccataggg

SEQ ID NO: 403249 - DNA, 25 bp, Mus musculus
gaaaagagattcaaaccccgtctgt

SEQ ID NO: 403250 - DNA, 25 bp, Mus musculus
gaaaagagattctaaccccgtctgt

SEQ ID NO: 403251 - DNA, 25 bp, Mus musculus
gaaaagagcctcagattcccggaac

SEQ ID NO: 403252 - DNA, 25 bp, Mus musculus
gaaaagagcctctgattcccggaac

SEQ ID NO: 403253 - DNA, 25 bp, Mus musculus
gaaaagagctgcatgcaccacacta

SEQ ID NO: 403254 - DNA, 25 bp, Mus musculus
gaaaagagctgcttgcaccacacta

SEQ ID NO: 403255 - DNA, 25 bp, Mus musculus
gaaaagaggccactccccaacaagg

SEQ ID NO: 403256 - DNA, 25 bp, Mus musculus
gaaaagaggccagtccccaacaagg

SEQ ID NO: 403257 - DNA, 25 bp, Mus musculus
gaaaagaggcccatggcgtcgagcc

SEQ ID NO: 403258 - DNA, 25 bp, Mus musculus
gaaaagaggcccattatctgatctt

SEQ ID NO: 403259 - DNA, 25 bp, Mus musculus
gaaaagaggcccttggcgtcgagcc

SEQ ID NO: 403260 - DNA, 25 bp, Mus musculus
gaaaagaggccctttatctgatctt

SEQ ID NO: 403261 - DNA, 25 bp, Mus musculus
gaaaagagtgaaccatctcccaaag

SEQ ID NO: 403262 - DNA, 25 bp, Mus musculus
gaaaagagtgaagcatctcccaaag

SEQ ID NO: 403263 - DNA, 25 bp, Mus musculus
gaaaagatacttacctccaccatat

SEQ ID NO: 403264 - DNA, 25 bp, Mus musculus
gaaaagatactttcctccaccatat

SEQ ID NO: 403265 - DNA, 25 bp, Mus musculus
gaaaagatagatatggccctggaac

SEQ ID NO: 403266 - DNA, 25 bp, Mus musculus
gaaaagatagatttggccctggaac

SEQ ID NO: 403267 - DNA, 25 bp, Mus musculus
gaaaagatcacgcataccggccagg

SEQ ID NO: 403268 - DNA, 25 bp, Mus musculus
gaaaagatcacggataccggccagg

SEQ ID NO: 403269 - DNA, 25 bp, Mus musculus
gaaaagatcatcctgcatgctgtaa

SEQ ID NO: 403270 - DNA, 25 bp, Mus musculus
gaaaagatcatcgtgcatgctgtaa

SEQ ID NO: 403271 - DNA, 25 bp, Mus musculus
gaaaagatcgccaacctgcaggaaa

SEQ ID NO: 403272 - DNA, 25 bp, Mus musculus
gaaaagatcgcctacctgcaggaaa

SEQ ID NO: 403273 - DNA, 25 bp, Mus musculus
gaaaagatctctcattagccaaata

SEQ ID NO: 403274 - DNA, 25 bp, Mus musculus
gaaaagatctctgattagccaaata

SEQ ID NO: 403275 - DNA, 25 bp, Mus musculus
gaaaagatctgcaaacctggagtca

SEQ ID NO: 403276 - DNA, 25 bp, Mus musculus
gaaaagatctgctaacctggagtca

SEQ ID NO: 403277 - DNA, 25 bp, Mus musculus
gaaaagatgatgcacctctggtatt

SEQ ID NO: 403278 - DNA, 25 bp, Mus musculus
gaaaagatgatggacctctggtatt

SEQ ID NO: 403279 - DNA, 25 bp, Mus musculus
gaaaagatgtaacctatgctcattg

SEQ ID NO: 403280 - DNA, 25 bp, Mus musculus
gaaaagatgtaagctatgctcattg

SEQ ID NO: 403281 - DNA, 25 bp, Mus musculus
gaaaagattgaaaggctggaaagcc

SEQ ID NO: 403282 - DNA, 25 bp, Mus musculus
gaaaagattgaatggctggaaagcc

SEQ ID NO: 403283 - DNA, 25 bp, Mus musculus
gaaaagatttccaatctcttcccat

SEQ ID NO: 403284 - DNA, 25 bp, Mus musculus
gaaaagatttccaattcacgcccca

SEQ ID NO: 403285 - DNA, 25 bp, Mus musculus
gaaaagatttcctatctcttcccat

SEQ ID NO: 403286 - DNA, 25 bp, Mus musculus
gaaaagatttcctattcacgcccca

SEQ ID NO: 403287 - DNA, 25 bp, Mus musculus
gaaaagatttgtcccacacccatgg

SEQ ID NO: 403288 - DNA, 25 bp, Mus musculus
gaaaagatttgtgccacacccatgg

SEQ ID NO: 403289 - DNA, 25 bp, Mus musculus
gaaaagcaaacaatcatccgtcctc

SEQ ID NO: 403290 - DNA, 25 bp, Mus musculus
gaaaagcaaacattcatccgtcctc

SEQ ID NO: 403291 - DNA, 25 bp, Mus musculus
gaaaagcaaacccttaccatggtct

SEQ ID NO: 403292 - DNA, 25 bp, Mus musculus
gaaaagcaaaccgttaccatggtct

SEQ ID NO: 403293 - DNA, 25 bp, Mus musculus
gaaaagcaaccacaggcctccatat

SEQ ID NO: 403294 - DNA, 25 bp, Mus musculus
gaaaagcaaccagaggcctccatat

SEQ ID NO: 403295 - DNA, 25 bp, Mus musculus
gaaaagcaactacctcagtactccc

SEQ ID NO: 403296 - DNA, 25 bp, Mus musculus
gaaaagcaactagctcagtactccc

SEQ ID NO: 403297 - DNA, 25 bp, Mus musculus
gaaaagcaagccagactggtactat

SEQ ID NO: 403298 - DNA, 25 bp, Mus musculus
gaaaagcaagcctgactggtactat

SEQ ID NO: 403299 - DNA, 25 bp, Mus musculus
gaaaagcaaggcagacagaaggatg

SEQ ID NO: 403300 - DNA, 25 bp, Mus musculus
gaaaagcaaggccaaccacttcctg

SEQ ID NO: 403301 - DNA, 25 bp, Mus musculus
gaaaagcaaggcgaaccacttcctg

SEQ ID NO: 403302 - DNA, 25 bp, Mus musculus
gaaaagcaaggctgacagaaggatg

SEQ ID NO: 403303 - DNA, 25 bp, Mus musculus
gaaaagcacaaactccctaaggaat

SEQ ID NO: 403304 - DNA, 25 bp, Mus musculus
gaaaagcacaaactctcttctgggc

SEQ ID NO: 403305 - DNA, 25 bp, Mus musculus
gaaaagcacaaagtccctaaggaat

SEQ ID NO: 403306 - DNA, 25 bp, Mus musculus
gaaaagcacaaagtctcttctgggc

SEQ ID NO: 403307 - DNA, 25 bp, Mus musculus
gaaaagcacaagcatgtcactaata

SEQ ID NO: 403308 - DNA, 25 bp, Mus musculus
gaaaagcacaaggatgtcactaata

SEQ ID NO: 403309 - DNA, 25 bp, Mus musculus
gaaaagcacaccatgtcactgcatt

SEQ ID NO: 403310 - DNA, 25 bp, Mus musculus
gaaaagcacaccttgtcactgcatt

SEQ ID NO: 403311 - DNA, 25 bp, Mus musculus
gaaaagcacattcccagagccaagt

SEQ ID NO: 403312 - DNA, 25 bp, Mus musculus
gaaaagcacattgccagagccaagt

SEQ ID NO: 403313 - DNA, 25 bp, Mus musculus
gaaaagcaccttaccttatgttgaa

SEQ ID NO: 403314 - DNA, 25 bp, Mus musculus
gaaaagcacctttccttatgttgaa

SEQ ID NO: 403315 - DNA, 25 bp, Mus musculus
gaaaagcacggtatgcatatctccc

SEQ ID NO: 403316 - DNA, 25 bp, Mus musculus
gaaaagcacggtttgcatatctccc

SEQ ID NO: 403317 - DNA, 25 bp, Mus musculus
gaaaagcacttcattcatggaggaa

SEQ ID NO: 403318 - DNA, 25 bp, Mus musculus
gaaaagcacttctttcatggaggaa

SEQ ID NO: 403319 - DNA, 25 bp, Mus musculus
gaaaagcagaatcgccacgcgttgt

SEQ ID NO: 403320 - DNA, 25 bp, Mus musculus
gaaaagcagaatggccacgcgttgt

SEQ ID NO: 403321 - DNA, 25 bp, Mus musculus
gaaaagcagacgcaccctgaccctg

SEQ ID NO: 403322 - DNA, 25 bp, Mus musculus
gaaaagcagacggaccctgaccctg

SEQ ID NO: 403323 - DNA, 25 bp, Mus musculus
gaaaagcagagtctggtccccacgt

SEQ ID NO: 403324 - DNA, 25 bp, Mus musculus
gaaaagcagagtgtggtccccacgt

SEQ ID NO: 403325 - DNA, 25 bp, Mus musculus
gaaaagcagctcatcatttctgcag

SEQ ID NO: 403326 - DNA, 25 bp, Mus musculus
gaaaagcagctcttcatttctgcag

SEQ ID NO: 403327 - DNA, 25 bp, Mus musculus
gaaaagcagcttcagcaccctgtgc

SEQ ID NO: 403328 - DNA, 25 bp, Mus musculus
gaaaagcagcttgagcaccctgtgc

SEQ ID NO: 403329 - DNA, 25 bp, Mus musculus
gaaaagcaggagagcccctgagagt

SEQ ID NO: 403330 - DNA, 25 bp, Mus musculus
gaaaagcaggagtgcccctgagagt

SEQ ID NO: 403331 - DNA, 25 bp, Mus musculus
gaaaagcaggataggttacagtgtc

SEQ ID NO: 403332 - DNA, 25 bp, Mus musculus
gaaaagcaggattggttacagtgtc

SEQ ID NO: 403333 - DNA, 25 bp, Mus musculus
gaaaagcagggcaggtcaccatgtg

SEQ ID NO: 403334 - DNA, 25 bp, Mus musculus
gaaaagcagggcatggccagcttta

SEQ ID NO: 403335 - DNA, 25 bp, Mus musculus
gaaaagcagggctggtcaccatgtg

SEQ ID NO: 403336 - DNA, 25 bp, Mus musculus
gaaaagcagggcttggccagcttta

SEQ ID NO: 403337 - DNA, 25 bp, Mus musculus
gaaaagcaggttactctagaaagag

SEQ ID NO: 403338 - DNA, 25 bp, Mus musculus
gaaaagcaggtttctctagaaagag

SEQ ID NO: 403339 - DNA, 25 bp, Mus musculus
gaaaagcagtccatgccctagtgat

SEQ ID NO: 403340 - DNA, 25 bp, Mus musculus
gaaaagcagtccttgccctagtgat

SEQ ID NO: 403341 - DNA, 25 bp, Mus musculus
gaaaagcagtctaataattcattag

SEQ ID NO: 403342 - DNA, 25 bp, Mus musculus
gaaaagcagtcttataattcattag

SEQ ID NO: 403343 - DNA, 25 bp, Mus musculus
gaaaagcagtttccactgattaaaa

SEQ ID NO: 403344 - DNA, 25 bp, Mus musculus
gaaaagcagtttgcactgattaaaa

SEQ ID NO: 403345 - DNA, 25 bp, Mus musculus
gaaaagcataccatgtcatttttga

SEQ ID NO: 403346 - DNA, 25 bp, Mus musculus
gaaaagcataccttgtcatttttga

SEQ ID NO: 403347 - DNA, 25 bp, Mus musculus
gaaaagcatctcacagggcacaaaa

SEQ ID NO: 403348 - DNA, 25 bp, Mus musculus
gaaaagcatctctcagggcacaaaa

SEQ ID NO: 403349 - DNA, 25 bp, Mus musculus
gaaaagcatcttattgcccacaaaa

SEQ ID NO: 403350 - DNA, 25 bp, Mus musculus
gaaaagcatcttctccagcaacagc

SEQ ID NO: 403351 - DNA, 25 bp, Mus musculus
gaaaagcatcttgtccagcaacagc

SEQ ID NO: 403352 - DNA, 25 bp, Mus musculus
gaaaagcatctttttgcccacaaaa

SEQ ID NO: 403353 - DNA, 25 bp, Mus musculus
gaaaagcatgatcgtgtttgtttaa

SEQ ID NO: 403354 - DNA, 25 bp, Mus musculus
gaaaagcatgatggtgtttgtttaa

SEQ ID NO: 403355 - DNA, 25 bp, Mus musculus
gaaaagcatgctaccctatgtgcat

SEQ ID NO: 403356 - DNA, 25 bp, Mus musculus
gaaaagcatgcttccctatgtgcat

SEQ ID NO: 403357 - DNA, 25 bp, Mus musculus
gaaaagcattagctctttcaccatt

SEQ ID NO: 403358 - DNA, 25 bp, Mus musculus
gaaaagcattaggtctttcaccatt

SEQ ID NO: 403359 - DNA, 25 bp, Mus musculus
gaaaagcattccatgcccaatggat

SEQ ID NO: 403360 - DNA, 25 bp, Mus musculus
gaaaagcattccttgcccaatggat

SEQ ID NO: 403361 - DNA, 25 bp, Mus musculus
gaaaagccaagtactagtcctctga

SEQ ID NO: 403362 - DNA, 25 bp, Mus musculus
gaaaagccaagttctagtcctctga

SEQ ID NO: 403363 - DNA, 25 bp, Mus musculus
gaaaagccacacctccttgacaata

SEQ ID NO: 403364 - DNA, 25 bp, Mus musculus
gaaaagccacacgtccttgacaata

SEQ ID NO: 403365 - DNA, 25 bp, Mus musculus
gaaaagccacagcatgctagcaaaa

SEQ ID NO: 403366 - DNA, 25 bp, Mus musculus
gaaaagccacaggatgctagcaaaa

SEQ ID NO: 403367 - DNA, 25 bp, Mus musculus
gaaaagccactcaacttggctcaca

SEQ ID NO: 403368 - DNA, 25 bp, Mus musculus
gaaaagccactctacttggctcaca

SEQ ID NO: 403369 - DNA, 25 bp, Mus musculus
gaaaagccagacattgccctgaagt

SEQ ID NO: 403370 - DNA, 25 bp, Mus musculus
gaaaagccagactttgccctgaagt

SEQ ID NO: 403371 - DNA, 25 bp, Mus musculus
gaaaagccagagcaatcaggaacac

SEQ ID NO: 403372 - DNA, 25 bp, Mus musculus
gaaaagccagaggaatcaggaacac

SEQ ID NO: 403373 - DNA, 25 bp, Mus musculus
gaaaagccatgtcggcccaaatcag

SEQ ID NO: 403374 - DNA, 25 bp, Mus musculus
gaaaagccatgtgggcccaaatcag

SEQ ID NO: 403375 - DNA, 25 bp, Mus musculus
gaaaagcccaacatcctgctagagg

SEQ ID NO: 403376 - DNA, 25 bp, Mus musculus
gaaaagcccaacttcctgctagagg

SEQ ID NO: 403377 - DNA, 25 bp, Mus musculus
gaaaagcccagacactccgatcttg

SEQ ID NO: 403378 - DNA, 25 bp, Mus musculus
gaaaagcccagagactccgatcttg

SEQ ID NO: 403379 - DNA, 25 bp, Mus musculus
gaaaagcccagtcccagcttccttc

SEQ ID NO: 403380 - DNA, 25 bp, Mus musculus
gaaaagcccagtgccagcttccttc

SEQ ID NO: 403381 - DNA, 25 bp, Mus musculus
gaaaagcccataatcctaacgctga

SEQ ID NO: 403382 - DNA, 25 bp, Mus musculus
gaaaagcccatattcctaacgctga

SEQ ID NO: 403383 - DNA, 25 bp, Mus musculus
gaaaagcccatcaagtgaaagtgaa

SEQ ID NO: 403384 - DNA, 25 bp, Mus musculus
gaaaagcccatctagtgaaagtgaa

SEQ ID NO: 403385 - DNA, 25 bp, Mus musculus
gaaaagccccggaaacaaagatgtg

SEQ ID NO: 403386 - DNA, 25 bp, Mus musculus
gaaaagccccggtaacaaagatgtg

SEQ ID NO: 403387 - DNA, 25 bp, Mus musculus
gaaaagcccctgcaaattcgtgtgg

SEQ ID NO: 403388 - DNA, 25 bp, Mus musculus
gaaaagcccctggaaattcgtgtgg

SEQ ID NO: 403389 - DNA, 25 bp, Mus musculus
gaaaagcccgagacctctggtggaa

SEQ ID NO: 403390 - DNA, 25 bp, Mus musculus
gaaaagcccgagtcctctggtggaa

SEQ ID NO: 403391 - DNA, 25 bp, Mus musculus
gaaaagcccttccacaggatgcgaa

SEQ ID NO: 403392 - DNA, 25 bp, Mus musculus
gaaaagcccttcgacaggatgcgaa

SEQ ID NO: 403393 - DNA, 25 bp, Mus musculus
gaaaagcccttgcaagcctgggtca

SEQ ID NO: 403394 - DNA, 25 bp, Mus musculus
gaaaagcccttgcttgggcctttct

SEQ ID NO: 403395 - DNA, 25 bp, Mus musculus
gaaaagcccttggaagcctgggtca

SEQ ID NO: 403396 - DNA, 25 bp, Mus musculus
gaaaagcccttggttgggcctttct

SEQ ID NO: 403397 - DNA, 25 bp, Mus musculus
gaaaagcctaaaagacatcacgaaa

SEQ ID NO: 403398 - DNA, 25 bp, Mus musculus
gaaaagcctaaatgacatcacgaaa

SEQ ID NO: 403399 - DNA, 25 bp, Mus musculus
gaaaagcctcacacagcatagataa

SEQ ID NO: 403400 - DNA, 25 bp, Mus musculus
gaaaagcctcactcagcatagataa

SEQ ID NO: 403401 - DNA, 25 bp, Mus musculus
gaaaagcctgagaccaagggcagca

SEQ ID NO: 403402 - DNA, 25 bp, Mus musculus
gaaaagcctgagtccaagggcagca

SEQ ID NO: 403403 - DNA, 25 bp, Mus musculus
gaaaagcctgcgatcttacagagaa

SEQ ID NO: 403404 - DNA, 25 bp, Mus musculus
gaaaagcctgcgttcttacagagaa

SEQ ID NO: 403405 - DNA, 25 bp, Mus musculus
gaaaagccttacaactgacattatc

SEQ ID NO: 403406 - DNA, 25 bp, Mus musculus
gaaaagccttactactgacattatc

SEQ ID NO: 403407 - DNA, 25 bp, Mus musculus
gaaaagccttctaccactagcagct

SEQ ID NO: 403408 - DNA, 25 bp, Mus musculus
gaaaagccttcttccactagcagct

SEQ ID NO: 403409 - DNA, 25 bp, Mus musculus
gaaaagcctttgatccgtgggatgg

SEQ ID NO: 403410 - DNA, 25 bp, Mus musculus
gaaaagcctttgttccgtgggatgg

SEQ ID NO: 403411 - DNA, 25 bp, Mus musculus
gaaaagcgagtcctgttttatggaa

SEQ ID NO: 403412 - DNA, 25 bp, Mus musculus
gaaaagcgagtcgtgttttatggaa

SEQ ID NO: 403413 - DNA, 25 bp, Mus musculus
gaaaagcgcaatcgtgtggataact

SEQ ID NO: 403414 - DNA, 25 bp, Mus musculus
gaaaagcgcaatggtgtggataact

SEQ ID NO: 403415 - DNA, 25 bp, Mus musculus
gaaaagcgcccaattgtgtgtgagc

SEQ ID NO: 403416 - DNA, 25 bp, Mus musculus
gaaaagcgcccatttgtgtgtgagc

SEQ ID NO: 403417 - DNA, 25 bp, Mus musculus
gaaaagcggaaaccaggcctgagta

SEQ ID NO: 403418 - DNA, 25 bp, Mus musculus
gaaaagcggaaagcaggcctgagta

SEQ ID NO: 403419 - DNA, 25 bp, Mus musculus
gaaaagcggacccagagagccatcg

SEQ ID NO: 403420 - DNA, 25 bp, Mus musculus
gaaaagcggaccgagagagccatcg

SEQ ID NO: 403421 - DNA, 25 bp, Mus musculus
gaaaagcggccaacttgagggtcat

SEQ ID NO: 403422 - DNA, 25 bp, Mus musculus
gaaaagcggccatcttgagggtcat

SEQ ID NO: 403423 - DNA, 25 bp, Mus musculus
gaaaagcgtacacggcactggactg

SEQ ID NO: 403424 - DNA, 25 bp, Mus musculus
gaaaagcgtacagggcactggactg

SEQ ID NO: 403425 - DNA, 25 bp, Mus musculus
gaaaagcgtggacctgagttgcccc

SEQ ID NO: 403426 - DNA, 25 bp, Mus musculus
gaaaagcgtggagctgagttgcccc

SEQ ID NO: 403427 - DNA, 25 bp, Mus musculus
gaaaagcgtgttcgccacaacttcc

SEQ ID NO: 403428 - DNA, 25 bp, Mus musculus
gaaaagcgtgttggccacaacttcc

SEQ ID NO: 403429 - DNA, 25 bp, Mus musculus
gaaaagctaaggaccacggtgacct

SEQ ID NO: 403430 - DNA, 25 bp, Mus musculus
gaaaagctaaggtccacggtgacct

SEQ ID NO: 403431 - DNA, 25 bp, Mus musculus
gaaaagctacacagggtggctccca

SEQ ID NO: 403432 - DNA, 25 bp, Mus musculus
gaaaagctacactgggtggctccca

SEQ ID NO: 403433 - DNA, 25 bp, Mus musculus
gaaaagctacttcaccaggaaggga

SEQ ID NO: 403434 - DNA, 25 bp, Mus musculus
gaaaagctacttgaccaggaaggga

SEQ ID NO: 403435 - DNA, 25 bp, Mus musculus
gaaaagctcacacaaacccacagtt

SEQ ID NO: 403436 - DNA, 25 bp, Mus musculus
gaaaagctcacagaaacccacagtt

SEQ ID NO: 403437 - DNA, 25 bp, Mus musculus
gaaaagctcaccaggatttccactg

SEQ ID NO: 403438 - DNA, 25 bp, Mus musculus
gaaaagctcacctggatttccactg

SEQ ID NO: 403439 - DNA, 25 bp, Mus musculus
gaaaagctcactatccaacattaaa

SEQ ID NO: 403440 - DNA, 25 bp, Mus musculus
gaaaagctcactttccaacattaaa

SEQ ID NO: 403441 - DNA, 25 bp, Mus musculus
gaaaagctccaacgccatgtggcac

SEQ ID NO: 403442 - DNA, 25 bp, Mus musculus
gaaaagctccaaggccatgtggcac

SEQ ID NO: 403443 - DNA, 25 bp, Mus musculus
gaaaagctccacaactttgctagtg

SEQ ID NO: 403444 - DNA, 25 bp, Mus musculus
gaaaagctccactactttgctagtg

SEQ ID NO: 403445 - DNA, 25 bp, Mus musculus
gaaaagctcctaacatcatcttgtg

SEQ ID NO: 403446 - DNA, 25 bp, Mus musculus
gaaaagctcctatcatcatcttgtg

SEQ ID NO: 403447 - DNA, 25 bp, Mus musculus
gaaaagctcgggaggactcagcaaa

SEQ ID NO: 403448 - DNA, 25 bp, Mus musculus
gaaaagctcgggtggactcagcaaa

SEQ ID NO: 403449 - DNA, 25 bp, Mus musculus
gaaaagctctgtaatgcaaaggaca

SEQ ID NO: 403450 - DNA, 25 bp, Mus musculus
gaaaagctctgttatgcaaaggaca

SEQ ID NO: 403451 - DNA, 25 bp, Mus musculus
gaaaagctcttgcttgggctgaaga

SEQ ID NO: 403452 - DNA, 25 bp, Mus musculus
gaaaagctcttggttgggctgaaga

SEQ ID NO: 403453 - DNA, 25 bp, Mus musculus
gaaaagctgataaccacggctctga

SEQ ID NO: 403454 - DNA, 25 bp, Mus musculus
gaaaagctgatatccacggctctga

SEQ ID NO: 403455 - DNA, 25 bp, Mus musculus
gaaaagctgatcacaccatccctag

SEQ ID NO: 403456 - DNA, 25 bp, Mus musculus
gaaaagctgatctcaccatccctag

SEQ ID NO: 403457 - DNA, 25 bp, Mus musculus
gaaaagctgcacatttttgtcatag

SEQ ID NO: 403458 - DNA, 25 bp, Mus musculus
gaaaagctgcacttttttgtcatag

SEQ ID NO: 403459 - DNA, 25 bp, Mus musculus
gaaaagctgcatagtcattttaaat

SEQ ID NO: 403460 - DNA, 25 bp, Mus musculus
gaaaagctgcattgtcattttaaat

SEQ ID NO: 403461 - DNA, 25 bp, Mus musculus
gaaaagctgcgtaccaaagaatgat

SEQ ID NO: 403462 - DNA, 25 bp, Mus musculus
gaaaagctgcgttccaaagaatgat

SEQ ID NO: 403463 - DNA, 25 bp, Mus musculus
gaaaagctgcttaataaatgtacat

SEQ ID NO: 403464 - DNA, 25 bp, Mus musculus
gaaaagctgctttataaatgtacat

SEQ ID NO: 403465 - DNA, 25 bp, Mus musculus
gaaaagctggagctatttgggaaat

SEQ ID NO: 403466 - DNA, 25 bp, Mus musculus
gaaaagctggaggtatttgggaaat

SEQ ID NO: 403467 - DNA, 25 bp, Mus musculus
gaaaagctggccaatgctagccttt

SEQ ID NO: 403468 - DNA, 25 bp, Mus musculus
gaaaagctggcctatgctagccttt

SEQ ID NO: 403469 - DNA, 25 bp, Mus musculus
gaaaagctggctactctagggcgga

SEQ ID NO: 403470 - DNA, 25 bp, Mus musculus
gaaaagctggcttctctagggcgga

SEQ ID NO: 403471 - DNA, 25 bp, Mus musculus
gaaaagctgtaacgtctgccttaga

SEQ ID NO: 403472 - DNA, 25 bp, Mus musculus
gaaaagctgtaaggtctgccttaga

SEQ ID NO: 403473 - DNA, 25 bp, Mus musculus
gaaaagctgtacatcccaggctgaa

SEQ ID NO: 403474 - DNA, 25 bp, Mus musculus
gaaaagctgtacttcccaggctgaa

SEQ ID NO: 403475 - DNA, 25 bp, Mus musculus
gaaaagctgtatcctactcagtagc

SEQ ID NO: 403476 - DNA, 25 bp, Mus musculus
gaaaagctgtatgctactcagtagc

SEQ ID NO: 403477 - DNA, 25 bp, Mus musculus
gaaaagctgtcactcaaacctggct

SEQ ID NO: 403478 - DNA, 25 bp, Mus musculus
gaaaagctgtcagtcaaacctggct

SEQ ID NO: 403479 - DNA, 25 bp, Mus musculus
gaaaagctgtgcatttacaccgaca

SEQ ID NO: 403480 - DNA, 25 bp, Mus musculus
gaaaagctgtgcttttacaccgaca

SEQ ID NO: 403481 - DNA, 25 bp, Mus musculus
gaaaagcttacactattatggaaga

SEQ ID NO: 403482 - DNA, 25 bp, Mus musculus
gaaaagcttacagtattatggaaga

SEQ ID NO: 403483 - DNA, 25 bp, Mus musculus
gaaaagcttatcatttgactcaagt

SEQ ID NO: 403484 - DNA, 25 bp, Mus musculus
gaaaagcttatcttttgactcaagt

SEQ ID NO: 403485 - DNA, 25 bp, Mus musculus
gaaaagcttcgtaattaatttgatt

SEQ ID NO: 403486 - DNA, 25 bp, Mus musculus
gaaaagcttcgttattaatttgatt

SEQ ID NO: 403487 - DNA, 25 bp, Mus musculus
gaaaagcttgttatgtcaggattca

SEQ ID NO: 403488 - DNA, 25 bp, Mus musculus
gaaaagcttgttttgtcaggattca

SEQ ID NO: 403489 - DNA, 25 bp, Mus musculus
gaaaagctttataactctaggtctg

SEQ ID NO: 403490 - DNA, 25 bp, Mus musculus
gaaaagctttatcggctggccaggc

SEQ ID NO: 403491 - DNA, 25 bp, Mus musculus
gaaaagctttatgggctggccaggc

SEQ ID NO: 403492 - DNA, 25 bp, Mus musculus
gaaaagctttattactctaggtctg

SEQ ID NO: 403493 - DNA, 25 bp, Mus musculus
gaaaagctttgcaccttaaagtcta

SEQ ID NO: 403494 - DNA, 25 bp, Mus musculus
gaaaagctttgctccttaaagtcta

SEQ ID NO: 403495 - DNA, 25 bp, Mus musculus
gaaaagctttggagtctgattcccc

SEQ ID NO: 403496 - DNA, 25 bp, Mus musculus
gaaaagctttggtgtctgattcccc

SEQ ID NO: 403497 - DNA, 25 bp, Mus musculus
gaaaagcttttcctctgaaaggcaa

SEQ ID NO: 403498 - DNA, 25 bp, Mus musculus
gaaaagcttttcgtctgaaaggcaa

SEQ ID NO: 403499 - DNA, 25 bp, Mus musculus
gaaaaggaacttactcgatagcaaa

SEQ ID NO: 403500 - DNA, 25 bp, Mus musculus
gaaaaggaactttctcgatagcaaa

SEQ ID NO: 403501 - DNA, 25 bp, Mus musculus
gaaaaggacaccacatttgattgaa

SEQ ID NO: 403502 - DNA, 25 bp, Mus musculus
gaaaaggacacctcatttgattgaa

SEQ ID NO: 403503 - DNA, 25 bp, Mus musculus
gaaaaggacacgctggtcttcccag

SEQ ID NO: 403504 - DNA, 25 bp, Mus musculus
gaaaaggacacggtggtcttcccag

SEQ ID NO: 403505 - DNA, 25 bp, Mus musculus
gaaaaggaccacagttagacacaac

SEQ ID NO: 403506 - DNA, 25 bp, Mus musculus
gaaaaggaccacctccacaatgtaa

SEQ ID NO: 403507 - DNA, 25 bp, Mus musculus
gaaaaggaccacgtccacaatgtaa

SEQ ID NO: 403508 - DNA, 25 bp, Mus musculus
gaaaaggaccactgttagacacaac

SEQ ID NO: 403509 - DNA, 25 bp, Mus musculus
gaaaaggacctaccattctgccttg

SEQ ID NO: 403510 - DNA, 25 bp, Mus musculus
gaaaaggacctagcattctgccttg

SEQ ID NO: 403511 - DNA, 25 bp, Mus musculus
gaaaaggagcagaccatctgcgccg

SEQ ID NO: 403512 - DNA, 25 bp, Mus musculus
gaaaaggagcagtccatctgcgccg

SEQ ID NO: 403513 - DNA, 25 bp, Mus musculus
gaaaaggagcttccgcctgaattct

SEQ ID NO: 403514 - DNA, 25 bp, Mus musculus
gaaaaggagcttcggccttgtgcct

SEQ ID NO: 403515 - DNA, 25 bp, Mus musculus
gaaaaggagcttgcgcctgaattct

SEQ ID NO: 403516 - DNA, 25 bp, Mus musculus
gaaaaggagcttgggccttgtgcct

SEQ ID NO: 403517 - DNA, 25 bp, Mus musculus
gaaaaggaggctaagccccggagca

SEQ ID NO: 403518 - DNA, 25 bp, Mus musculus
gaaaaggaggcttagccccggagca

SEQ ID NO: 403519 - DNA, 25 bp, Mus musculus
gaaaaggaggttattatgtagacca

SEQ ID NO: 403520 - DNA, 25 bp, Mus musculus
gaaaaggaggtttttatgtagacca

SEQ ID NO: 403521 - DNA, 25 bp, Mus musculus
gaaaaggagtctaactctcaccatt

SEQ ID NO: 403522 - DNA, 25 bp, Mus musculus
gaaaaggagtcttactctcaccatt

SEQ ID NO: 403523 - DNA, 25 bp, Mus musculus
gaaaaggagttcaagcctggatgcc

SEQ ID NO: 403524 - DNA, 25 bp, Mus musculus
gaaaaggagttctagcctggatgcc

SEQ ID NO: 403525 - DNA, 25 bp, Mus musculus
gaaaaggagtttctgacccattgac

SEQ ID NO: 403526 - DNA, 25 bp, Mus musculus
gaaaaggagtttgtgacccattgac

SEQ ID NO: 403527 - DNA, 25 bp, Mus musculus
gaaaaggatccaagttcatacagaa

SEQ ID NO: 403528 - DNA, 25 bp, Mus musculus
gaaaaggatccatgttcatacagaa

SEQ ID NO: 403529 - DNA, 25 bp, Mus musculus
gaaaaggatcctcctgatccgtata

SEQ ID NO: 403530 - DNA, 25 bp, Mus musculus
gaaaaggatcctgctgatccgtata

SEQ ID NO: 403531 - DNA, 25 bp, Mus musculus
gaaaaggatcgtcaccctggaaaca

SEQ ID NO: 403532 - DNA, 25 bp, Mus musculus
gaaaaggatcgtgaccctggaaaca

SEQ ID NO: 403533 - DNA, 25 bp, Mus musculus
gaaaaggattggcacccagtctccg

SEQ ID NO: 403534 - DNA, 25 bp, Mus musculus
gaaaaggattgggacccagtctccg

SEQ ID NO: 403535 - DNA, 25 bp, Mus musculus
gaaaaggcaaaacaacggatacatt

SEQ ID NO: 403536 - DNA, 25 bp, Mus musculus
gaaaaggcaaaagaacggatacatt

SEQ ID NO: 403537 - DNA, 25 bp, Mus musculus
gaaaaggcaaagataacagctgagt

SEQ ID NO: 403538 - DNA, 25 bp, Mus musculus
gaaaaggcaaagttaacagctgagt

SEQ ID NO: 403539 - DNA, 25 bp, Mus musculus
gaaaaggcaactcaagcgacagctt

SEQ ID NO: 403540 - DNA, 25 bp, Mus musculus
gaaaaggcaactgaagcgacagctt

SEQ ID NO: 403541 - DNA, 25 bp, Mus musculus
gaaaaggcaagacagccttcctgat

SEQ ID NO: 403542 - DNA, 25 bp, Mus musculus
gaaaaggcaagagagccttcctgat

SEQ ID NO: 403543 - DNA, 25 bp, Mus musculus
gaaaaggcagttctcatgaaaaaga

SEQ ID NO: 403544 - DNA, 25 bp, Mus musculus
gaaaaggcagttcttgatcgtgaca

SEQ ID NO: 403545 - DNA, 25 bp, Mus musculus
gaaaaggcagttgtcatgaaaaaga

SEQ ID NO: 403546 - DNA, 25 bp, Mus musculus
gaaaaggcagttgttgatcgtgaca

SEQ ID NO: 403547 - DNA, 25 bp, Mus musculus
gaaaaggcataaactgtgacataat

SEQ ID NO: 403548 - DNA, 25 bp, Mus musculus
gaaaaggcataatctgtgacataat

SEQ ID NO: 403549 - DNA, 25 bp, Mus musculus
gaaaaggcatcccagacaatcccgc

SEQ ID NO: 403550 - DNA, 25 bp, Mus musculus
gaaaaggcatccgagacaatcccgc

SEQ ID NO: 403551 - DNA, 25 bp, Mus musculus
gaaaaggccaatctatgctgtccct

SEQ ID NO: 403552 - DNA, 25 bp, Mus musculus
gaaaaggccaatgtatgctgtccct

SEQ ID NO: 403553 - DNA, 25 bp, Mus musculus
gaaaaggccactatggtcctggtgc

SEQ ID NO: 403554 - DNA, 25 bp, Mus musculus
gaaaaggccactttggtcctggtgc

SEQ ID NO: 403555 - DNA, 25 bp, Mus musculus
gaaaaggccagaaccatgagtgtat

SEQ ID NO: 403556 - DNA, 25 bp, Mus musculus
gaaaaggccagatccatgagtgtat

SEQ ID NO: 403557 - DNA, 25 bp, Mus musculus
gaaaaggccattcactattctgagg

SEQ ID NO: 403558 - DNA, 25 bp, Mus musculus
gaaaaggccattgactattctgagg

SEQ ID NO: 403559 - DNA, 25 bp, Mus musculus
gaaaaggcccagaatgcaagtgatg

SEQ ID NO: 403560 - DNA, 25 bp, Mus musculus
gaaaaggcccagtatgcaagtgatg

SEQ ID NO: 403561 - DNA, 25 bp, Mus musculus
gaaaaggccctgacagactacaggg

SEQ ID NO: 403562 - DNA, 25 bp, Mus musculus
gaaaaggccctgtcagactacaggg

SEQ ID NO: 403563 - DNA, 25 bp, Mus musculus
gaaaaggccgatacacctgagcttt

SEQ ID NO: 403564 - DNA, 25 bp, Mus musculus
gaaaaggccgattcacctgagcttt

SEQ ID NO: 403565 - DNA, 25 bp, Mus musculus
gaaaaggccgcccagatgcataaga

SEQ ID NO: 403566 - DNA, 25 bp, Mus musculus
gaaaaggccgccgagatgcataaga

SEQ ID NO: 403567 - DNA, 25 bp, Mus musculus
gaaaaggcctgtatagtctatatat

SEQ ID NO: 403568 - DNA, 25 bp, Mus musculus
gaaaaggcctgtttagtctatatat

SEQ ID NO: 403569 - DNA, 25 bp, Mus musculus
gaaaaggccttaaatccctacttag

SEQ ID NO: 403570 - DNA, 25 bp, Mus musculus
gaaaaggccttatatccctacttag

SEQ ID NO: 403571 - DNA, 25 bp, Mus musculus
gaaaaggcctttaccatgcggctga

SEQ ID NO: 403572 - DNA, 25 bp, Mus musculus
gaaaaggccttttccatgcggctga

SEQ ID NO: 403573 - DNA, 25 bp, Mus musculus
gaaaaggcgattccttcgaaaggtg

SEQ ID NO: 403574 - DNA, 25 bp, Mus musculus
gaaaaggcgattgcttcgaaaggtg

SEQ ID NO: 403575 - DNA, 25 bp, Mus musculus
gaaaaggcgtgcatggaccagtcat

SEQ ID NO: 403576 - DNA, 25 bp, Mus musculus
gaaaaggcgtgcttggaccagtcat

SEQ ID NO: 403577 - DNA, 25 bp, Mus musculus
gaaaaggctacgatcttcagaattc

SEQ ID NO: 403578 - DNA, 25 bp, Mus musculus
gaaaaggctacgttcttcagaattc

SEQ ID NO: 403579 - DNA, 25 bp, Mus musculus
gaaaaggctatacaatcctccagat

SEQ ID NO: 403580 - DNA, 25 bp, Mus musculus
gaaaaggctatagaatcctccagat

SEQ ID NO: 403581 - DNA, 25 bp, Mus musculus
gaaaaggctcatcacatagatccat

SEQ ID NO: 403582 - DNA, 25 bp, Mus musculus
gaaaaggctcatgacatagatccat

SEQ ID NO: 403583 - DNA, 25 bp, Mus musculus
gaaaaggctcccagacacccgtgga

SEQ ID NO: 403584 - DNA, 25 bp, Mus musculus
gaaaaggctcccatgacttccaagg

SEQ ID NO: 403585 - DNA, 25 bp, Mus musculus
gaaaaggctccctgacacccgtgga

SEQ ID NO: 403586 - DNA, 25 bp, Mus musculus
gaaaaggctcccttgacttccaagg

SEQ ID NO: 403587 - DNA, 25 bp, Mus musculus
gaaaaggctctcatggccattggca

SEQ ID NO: 403588 - DNA, 25 bp, Mus musculus
gaaaaggctctcttggccattggca

SEQ ID NO: 403589 - DNA, 25 bp, Mus musculus
gaaaaggctgaacagttagctgcca

SEQ ID NO: 403590 - DNA, 25 bp, Mus musculus
gaaaaggctgaagagttagctgcca

SEQ ID NO: 403591 - DNA, 25 bp, Mus musculus
gaaaaggctgacatctagtggttaa

SEQ ID NO: 403592 - DNA, 25 bp, Mus musculus
gaaaaggctgacttctagtggttaa

SEQ ID NO: 403593 - DNA, 25 bp, Mus musculus
gaaaaggctgctacagagtccctga

SEQ ID NO: 403594 - DNA, 25 bp, Mus musculus
gaaaaggctgcttcagagtccctga

SEQ ID NO: 403595 - DNA, 25 bp, Mus musculus
gaaaaggctggaactggtggccatt

SEQ ID NO: 403596 - DNA, 25 bp, Mus musculus
gaaaaggctggatctggtggccatt

SEQ ID NO: 403597 - DNA, 25 bp, Mus musculus
gaaaaggctggcatatattatatga

SEQ ID NO: 403598 - DNA, 25 bp, Mus musculus
gaaaaggctggcttatattatatga

SEQ ID NO: 403599 - DNA, 25 bp, Mus musculus
gaaaaggctgtcatcccagtagaat

SEQ ID NO: 403600 - DNA, 25 bp, Mus musculus
gaaaaggctgtcttcccagtagaat

SEQ ID NO: 403601 - DNA, 25 bp, Mus musculus
gaaaaggcttgccagtccatttatc

SEQ ID NO: 403602 - DNA, 25 bp, Mus musculus
gaaaaggcttgcgagtccatttatc

SEQ ID NO: 403603 - DNA, 25 bp, Mus musculus
gaaaaggctttacatgtgacaataa

SEQ ID NO: 403604 - DNA, 25 bp, Mus musculus
gaaaaggctttagatgtgacaataa

SEQ ID NO: 403605 - DNA, 25 bp, Mus musculus
gaaaagggacagacagctaggaccc

SEQ ID NO: 403606 - DNA, 25 bp, Mus musculus
gaaaagggacagtcagctaggaccc

SEQ ID NO: 403607 - DNA, 25 bp, Mus musculus
gaaaagggacttactgctccacaag

SEQ ID NO: 403608 - DNA, 25 bp, Mus musculus
gaaaagggactttctgctccacaag

SEQ ID NO: 403609 - DNA, 25 bp, Mus musculus
gaaaagggagccatgaacccagagc

SEQ ID NO: 403610 - DNA, 25 bp, Mus musculus
gaaaagggagccttgaacccagagc

SEQ ID NO: 403611 - DNA, 25 bp, Mus musculus
gaaaagggccccactaagttatcag

SEQ ID NO: 403612 - DNA, 25 bp, Mus musculus
gaaaagggccccaggcaactgcatt

SEQ ID NO: 403613 - DNA, 25 bp, Mus musculus
gaaaagggcccctctaagttatcag

SEQ ID NO: 403614 - DNA, 25 bp, Mus musculus
gaaaagggcccctggcaactgcatt

SEQ ID NO: 403615 - DNA, 25 bp, Mus musculus
gaaaaggggcatcgtctgccttgcc

SEQ ID NO: 403616 - DNA, 25 bp, Mus musculus
gaaaaggggcatggtctgccttgcc

SEQ ID NO: 403617 - DNA, 25 bp, Mus musculus
gaaaagggtcacataaagccgctcc

SEQ ID NO: 403618 - DNA, 25 bp, Mus musculus
gaaaagggtcacttaaagccgctcc

SEQ ID NO: 403619 - DNA, 25 bp, Mus musculus
gaaaagggtgctcggactctcttat

SEQ ID NO: 403620 - DNA, 25 bp, Mus musculus
gaaaagggtgctgggactctcttat

SEQ ID NO: 403621 - DNA, 25 bp, Mus musculus
gaaaagggttcaacgtccacactac

SEQ ID NO: 403622 - DNA, 25 bp, Mus musculus
gaaaagggttcatcgtccacactac

SEQ ID NO: 403623 - DNA, 25 bp, Mus musculus
gaaaagggttccagtcaccaagcct

SEQ ID NO: 403624 - DNA, 25 bp, Mus musculus
gaaaagggttcctgtcaccaagcct

SEQ ID NO: 403625 - DNA, 25 bp, Mus musculus
gaaaaggtaccaagtgtgctcgcta

SEQ ID NO: 403626 - DNA, 25 bp, Mus musculus
gaaaaggtaccatgtgtgctcgcta

SEQ ID NO: 403627 - DNA, 25 bp, Mus musculus
gaaaaggtacctactgactccagaa

SEQ ID NO: 403628 - DNA, 25 bp, Mus musculus
gaaaaggtaccttctgactccagaa

SEQ ID NO: 403629 - DNA, 25 bp, Mus musculus
gaaaaggtactaccagcgcactgca

SEQ ID NO: 403630 - DNA, 25 bp, Mus musculus
gaaaaggtactagcagcgcactgca

SEQ ID NO: 403631 - DNA, 25 bp, Mus musculus
gaaaaggtcagtatcctggcatcac

SEQ ID NO: 403632 - DNA, 25 bp, Mus musculus
gaaaaggtcagtttcctggcatcac

SEQ ID NO: 403633 - DNA, 25 bp, Mus musculus
gaaaaggtcatcctagggcctggcc

SEQ ID NO: 403634 - DNA, 25 bp, Mus musculus
gaaaaggtcatcgtagggcctggcc

SEQ ID NO: 403635 - DNA, 25 bp, Mus musculus
gaaaaggtcctgatcttcgaattga

SEQ ID NO: 403636 - DNA, 25 bp, Mus musculus
gaaaaggtcctgttcttcgaattga

SEQ ID NO: 403637 - DNA, 25 bp, Mus musculus
gaaaaggtctttcgcaatctggaga

SEQ ID NO: 403638 - DNA, 25 bp, Mus musculus
gaaaaggtctttggcaatctggaga

SEQ ID NO: 403639 - DNA, 25 bp, Mus musculus
gaaaaggtgcccactgctgacagca

SEQ ID NO: 403640 - DNA, 25 bp, Mus musculus
gaaaaggtgccctctgctgacagca

SEQ ID NO: 403641 - DNA, 25 bp, Mus musculus
gaaaaggtgtctccgctgactaccc

SEQ ID NO: 403642 - DNA, 25 bp, Mus musculus
gaaaaggtgtctgcgctgactaccc

SEQ ID NO: 403643 - DNA, 25 bp, Mus musculus
gaaaaggttactcttcctgtccagc

SEQ ID NO: 403644 - DNA, 25 bp, Mus musculus
gaaaaggttactgttcctgtccagc

SEQ ID NO: 403645 - DNA, 25 bp, Mus musculus
gaaaaggttccgacaggcctcaatc

SEQ ID NO: 403646 - DNA, 25 bp, Mus musculus
gaaaaggttccgctcatacaaaggg

SEQ ID NO: 403647 - DNA, 25 bp, Mus musculus
gaaaaggttccggtcatacaaaggg

SEQ ID NO: 403648 - DNA, 25 bp, Mus musculus
gaaaaggttccgtcaggcctcaatc

SEQ ID NO: 403649 - DNA, 25 bp, Mus musculus
gaaaaggttcgcacagctgtgcaga

SEQ ID NO: 403650 - DNA, 25 bp, Mus musculus
gaaaaggttcgctcagctgtgcaga

SEQ ID NO: 403651 - DNA, 25 bp, Mus musculus
gaaaaggttctgaggcgaacacgct

SEQ ID NO: 403652 - DNA, 25 bp, Mus musculus
gaaaaggttctgtggcgaacacgct

SEQ ID NO: 403653 - DNA, 25 bp, Mus musculus
gaaaaggttcttaccagcttgacca

SEQ ID NO: 403654 - DNA, 25 bp, Mus musculus
gaaaaggttctttccagcttgacca

SEQ ID NO: 403655 - DNA, 25 bp, Mus musculus
gaaaaggttttcagacaccaactgt

SEQ ID NO: 403656 - DNA, 25 bp, Mus musculus
gaaaaggttttctgacaccaactgt

SEQ ID NO: 403657 - DNA, 25 bp, Mus musculus
gaaaagtaaagccatggtccatgtt

SEQ ID NO: 403658 - DNA, 25 bp, Mus musculus
gaaaagtaaagcgatggtccatgtt

SEQ ID NO: 403659 - DNA, 25 bp, Mus musculus
gaaaagtaacaacctcacccttctc

SEQ ID NO: 403660 - DNA, 25 bp, Mus musculus
gaaaagtaacaagctcacccttctc

SEQ ID NO: 403661 - DNA, 25 bp, Mus musculus
gaaaagtaaccacagctgccatgag

SEQ ID NO: 403662 - DNA, 25 bp, Mus musculus
gaaaagtaaccagagctgccatgag

SEQ ID NO: 403663 - DNA, 25 bp, Mus musculus
gaaaagtaacttactgagacagagt

SEQ ID NO: 403664 - DNA, 25 bp, Mus musculus
gaaaagtaactttctgagacagagt

SEQ ID NO: 403665 - DNA, 25 bp, Mus musculus
gaaaagtaatagaagcagccgtgta

SEQ ID NO: 403666 - DNA, 25 bp, Mus musculus
gaaaagtaatagtagcagccgtgta

SEQ ID NO: 403667 - DNA, 25 bp, Mus musculus
gaaaagtacctaaccaggccttggg

SEQ ID NO: 403668 - DNA, 25 bp, Mus musculus
gaaaagtacctatccaggccttggg

SEQ ID NO: 403669 - DNA, 25 bp, Mus musculus
gaaaagtaccttcgctctagcataa

SEQ ID NO: 403670 - DNA, 25 bp, Mus musculus
gaaaagtaccttggctctagcataa

SEQ ID NO: 403671 - DNA, 25 bp, Mus musculus
gaaaagtacgagaagaccacagtta

SEQ ID NO: 403672 - DNA, 25 bp, Mus musculus
gaaaagtacgagtagaccacagtta

SEQ ID NO: 403673 - DNA, 25 bp, Mus musculus
gaaaagtagaatactccaggtgaga

SEQ ID NO: 403674 - DNA, 25 bp, Mus musculus
gaaaagtagaattctccaggtgaga

SEQ ID NO: 403675 - DNA, 25 bp, Mus musculus
gaaaagtagattcacttttcaagct

SEQ ID NO: 403676 - DNA, 25 bp, Mus musculus
gaaaagtagattgacttttcaagct

SEQ ID NO: 403677 - DNA, 25 bp, Mus musculus
gaaaagtagcagactgggctcagct

SEQ ID NO: 403678 - DNA, 25 bp, Mus musculus
gaaaagtagcagtctgggctcagct

SEQ ID NO: 403679 - DNA, 25 bp, Mus musculus
gaaaagtattagcttcctcagaaga

SEQ ID NO: 403680 - DNA, 25 bp, Mus musculus
gaaaagtattaggttcctcagaaga

SEQ ID NO: 403681 - DNA, 25 bp, Mus musculus
gaaaagtcaaacactaagctgatcg

SEQ ID NO: 403682 - DNA, 25 bp, Mus musculus
gaaaagtcaaactctaagctgatcg

SEQ ID NO: 403683 - DNA, 25 bp, Mus musculus
gaaaagtcaactaaggattcaccta

SEQ ID NO: 403684 - DNA, 25 bp, Mus musculus
gaaaagtcaacttaggattcaccta

SEQ ID NO: 403685 - DNA, 25 bp, Mus musculus
gaaaagtcactaacacactaggtga

SEQ ID NO: 403686 - DNA, 25 bp, Mus musculus
gaaaagtcactatcacactaggtga

SEQ ID NO: 403687 - DNA, 25 bp, Mus musculus
gaaaagtcatctacctcaagggctt

SEQ ID NO: 403688 - DNA, 25 bp, Mus musculus
gaaaagtcatcttcctcaagggctt

SEQ ID NO: 403689 - DNA, 25 bp, Mus musculus
gaaaagtcattccataaccgcgtgt

SEQ ID NO: 403690 - DNA, 25 bp, Mus musculus
gaaaagtcattcgataaccgcgtgt

SEQ ID NO: 403691 - DNA, 25 bp, Mus musculus
gaaaagtccaaaaacccaggagctg

SEQ ID NO: 403692 - DNA, 25 bp, Mus musculus
gaaaagtccaaatacccaggagctg

SEQ ID NO: 403693 - DNA, 25 bp, Mus musculus
gaaaagtccagcaggccacatccgg

SEQ ID NO: 403694 - DNA, 25 bp, Mus musculus
gaaaagtccagctggccacatccgg

SEQ ID NO: 403695 - DNA, 25 bp, Mus musculus
gaaaagtcccacctctcaaggtgag

SEQ ID NO: 403696 - DNA, 25 bp, Mus musculus
gaaaagtcccacgtctcaaggtgag

SEQ ID NO: 403697 - DNA, 25 bp, Mus musculus
gaaaagtcccataagatgctcatta

SEQ ID NO: 403698 - DNA, 25 bp, Mus musculus
gaaaagtcccatctaagcagcaaag

SEQ ID NO: 403699 - DNA, 25 bp, Mus musculus
gaaaagtcccatgtaagcagcaaag

SEQ ID NO: 403700 - DNA, 25 bp, Mus musculus
gaaaagtcccattagatgctcatta

SEQ ID NO: 403701 - DNA, 25 bp, Mus musculus
gaaaagtccgtccttgaactgtaca

SEQ ID NO: 403702 - DNA, 25 bp, Mus musculus
gaaaagtccgtcgttgaactgtaca

SEQ ID NO: 403703 - DNA, 25 bp, Mus musculus
gaaaagtccttccaacgtcttacag

SEQ ID NO: 403704 - DNA, 25 bp, Mus musculus
gaaaagtccttcgaacgtcttacag

SEQ ID NO: 403705 - DNA, 25 bp, Mus musculus
gaaaagtcgatcaatgttttgcagt

SEQ ID NO: 403706 - DNA, 25 bp, Mus musculus
gaaaagtcgatctatgttttgcagt

SEQ ID NO: 403707 - DNA, 25 bp, Mus musculus
gaaaagtctaaacggccagtgtcct

SEQ ID NO: 403708 - DNA, 25 bp, Mus musculus
gaaaagtctaaagggccagtgtcct

SEQ ID NO: 403709 - DNA, 25 bp, Mus musculus
gaaaagtctacactatcctctctct

SEQ ID NO: 403710 - DNA, 25 bp, Mus musculus
gaaaagtctacagtatcctctctct

SEQ ID NO: 403711 - DNA, 25 bp, Mus musculus
gaaaagtctaggctctctgaagcat

SEQ ID NO: 403712 - DNA, 25 bp, Mus musculus
gaaaagtctagggtctctgaagcat

SEQ ID NO: 403713 - DNA, 25 bp, Mus musculus
gaaaagtctcttactatctcaatta

SEQ ID NO: 403714 - DNA, 25 bp, Mus musculus
gaaaagtctctttctatctcaatta

SEQ ID NO: 403715 - DNA, 25 bp, Mus musculus
gaaaagtctgacaatatccggaaga

SEQ ID NO: 403716 - DNA, 25 bp, Mus musculus
gaaaagtctgactatatccggaaga

SEQ ID NO: 403717 - DNA, 25 bp, Mus musculus
gaaaagtctgccctgtactgaatag

SEQ ID NO: 403718 - DNA, 25 bp, Mus musculus
gaaaagtctgccgtgtactgaatag

SEQ ID NO: 403719 - DNA, 25 bp, Mus musculus
gaaaagtctggacagcttcctctgc

SEQ ID NO: 403720 - DNA, 25 bp, Mus musculus
gaaaagtctggagagcttcctctgc

SEQ ID NO: 403721 - DNA, 25 bp, Mus musculus
gaaaagtcttgcagctgtcgggtgt

SEQ ID NO: 403722 - DNA, 25 bp, Mus musculus
gaaaagtcttgctgctgtcgggtgt

SEQ ID NO: 403723 - DNA, 25 bp, Mus musculus
gaaaagtcttggacgacacctaaga

SEQ ID NO: 403724 - DNA, 25 bp, Mus musculus
gaaaagtcttggtcgacacctaaga

SEQ ID NO: 403725 - DNA, 25 bp, Mus musculus
gaaaagtgcctcagaacatttcctg

SEQ ID NO: 403726 - DNA, 25 bp, Mus musculus
gaaaagtgcctctgaacatttcctg

SEQ ID NO: 403727 - DNA, 25 bp, Mus musculus
gaaaagtgctccagcgctgacttcc

SEQ ID NO: 403728 - DNA, 25 bp, Mus musculus
gaaaagtgctcctgcgctgacttcc

SEQ ID NO: 403729 - DNA, 25 bp, Mus musculus
gaaaagtgtaaccagctaccagctg

SEQ ID NO: 403730 - DNA, 25 bp, Mus musculus
gaaaagtgtaacgagctaccagctg

SEQ ID NO: 403731 - DNA, 25 bp, Mus musculus
gaaaagtgtatgaagactccggcat

SEQ ID NO: 403732 - DNA, 25 bp, Mus musculus
gaaaagtgtatgtagactccggcat

SEQ ID NO: 403733 - DNA, 25 bp, Mus musculus
gaaaagttaatcatagagccactat

SEQ ID NO: 403734 - DNA, 25 bp, Mus musculus
gaaaagttaatcttagagccactat

SEQ ID NO: 403735 - DNA, 25 bp, Mus musculus
gaaaagttactccaattgctaaatt

SEQ ID NO: 403736 - DNA, 25 bp, Mus musculus
gaaaagttactcgaattgctaaatt

SEQ ID NO: 403737 - DNA, 25 bp, Mus musculus
gaaaagttacttacctctgtgtgct

SEQ ID NO: 403738 - DNA, 25 bp, Mus musculus
gaaaagttactttcctctgtgtgct

SEQ ID NO: 403739 - DNA, 25 bp, Mus musculus
gaaaagttagcaatatgtttgtggg

SEQ ID NO: 403740 - DNA, 25 bp, Mus musculus
gaaaagttagcattatgtttgtggg

SEQ ID NO: 403741 - DNA, 25 bp, Mus musculus
gaaaagttagttcctcccatggaag

SEQ ID NO: 403742 - DNA, 25 bp, Mus musculus
gaaaagttagttgctcccatggaag

SEQ ID NO: 403743 - DNA, 25 bp, Mus musculus
gaaaagttccatcactcaaatagaa

SEQ ID NO: 403744 - DNA, 25 bp, Mus musculus
gaaaagttccatgactcaaatagaa

SEQ ID NO: 403745 - DNA, 25 bp, Mus musculus
gaaaagttccccagtcaatggcaat

SEQ ID NO: 403746 - DNA, 25 bp, Mus musculus
gaaaagttcccctgtcaatggcaat

SEQ ID NO: 403747 - DNA, 25 bp, Mus musculus
gaaaagttctctaccaatgagctag

SEQ ID NO: 403748 - DNA, 25 bp, Mus musculus
gaaaagttctcttccaatgagctag

SEQ ID NO: 403749 - DNA, 25 bp, Mus musculus
gaaaagttgggacctggctcctaat

SEQ ID NO: 403750 - DNA, 25 bp, Mus musculus
gaaaagttgggagctggctcctaat

SEQ ID NO: 403751 - DNA, 25 bp, Mus musculus
gaaaagttgggtccccggctcttag

SEQ ID NO: 403752 - DNA, 25 bp, Mus musculus
gaaaagttgggtgcccggctcttag

SEQ ID NO: 403753 - DNA, 25 bp, Mus musculus
gaaaagtttcttcctgagcgtgcct

SEQ ID NO: 403754 - DNA, 25 bp, Mus musculus
gaaaagtttcttgctgagcgtgcct

SEQ ID NO: 403755 - DNA, 25 bp, Mus musculus
gaaaagtttggaacctgagaaagca

SEQ ID NO: 403756 - DNA, 25 bp, Mus musculus
gaaaagtttggatcctgagaaagca

SEQ ID NO: 403757 - DNA, 25 bp, Mus musculus
gaaaagtttgtaattatatccctct

SEQ ID NO: 403758 - DNA, 25 bp, Mus musculus
gaaaagtttgtatttatatccctct

SEQ ID NO: 403759 - DNA, 25 bp, Mus musculus
gaaaataaaaaaccgctgcagcata

SEQ ID NO: 403760 - DNA, 25 bp, Mus musculus
gaaaataaaaaagcgctgcagcata

SEQ ID NO: 403761 - DNA, 25 bp, Mus musculus
gaaaataaacacacagttccccact

SEQ ID NO: 403762 - DNA, 25 bp, Mus musculus
gaaaataaacactcagttccccact

SEQ ID NO: 403763 - DNA, 25 bp, Mus musculus
gaaaataaacccagagccacctcca

SEQ ID NO: 403764 - DNA, 25 bp, Mus musculus
gaaaataaacccatggtcctatatt

SEQ ID NO: 403765 - DNA, 25 bp, Mus musculus
gaaaataaaccctgagccacctcca

SEQ ID NO: 403766 - DNA, 25 bp, Mus musculus
gaaaataaacccttggtcctatatt

SEQ ID NO: 403767 - DNA, 25 bp, Mus musculus
gaaaataaccccatactgccatata

SEQ ID NO: 403768 - DNA, 25 bp, Mus musculus
gaaaataaccccttactgccatata

SEQ ID NO: 403769 - DNA, 25 bp, Mus musculus
gaaaataaccgaatcactgcccatg

SEQ ID NO: 403770 - DNA, 25 bp, Mus musculus
gaaaataaccgattcactgcccatg

SEQ ID NO: 403771 - DNA, 25 bp, Mus musculus
gaaaataacgtcaagtcctcccgtg

SEQ ID NO: 403772 - DNA, 25 bp, Mus musculus
gaaaataacgtctagtcctcccgtg

SEQ ID NO: 403773 - DNA, 25 bp, Mus musculus
gaaaataagcctcccgtggtcactg

SEQ ID NO: 403774 - DNA, 25 bp, Mus musculus
gaaaataagcctgccgtggtcactg

SEQ ID NO: 403775 - DNA, 25 bp, Mus musculus
gaaaataatccacccactacggagg

SEQ ID NO: 403776 - DNA, 25 bp, Mus musculus
gaaaataatccagccactacggagg

SEQ ID NO: 403777 - DNA, 25 bp, Mus musculus
gaaaatacaaggcttctccccttgt

SEQ ID NO: 403778 - DNA, 25 bp, Mus musculus
gaaaatacaagggttctccccttgt

SEQ ID NO: 403779 - DNA, 25 bp, Mus musculus
gaaaatacacagatcaagtgtgaat

SEQ ID NO: 403780 - DNA, 25 bp, Mus musculus
gaaaatacacagttcaagtgtgaat

SEQ ID NO: 403781 - DNA, 25 bp, Mus musculus
gaaaatacaccgcagaataccagaa

SEQ ID NO: 403782 - DNA, 25 bp, Mus musculus
gaaaatacaccggagaataccagaa

SEQ ID NO: 403783 - DNA, 25 bp, Mus musculus
gaaaatacacttctctgtactaaat

SEQ ID NO: 403784 - DNA, 25 bp, Mus musculus
gaaaatacacttgtctgtactaaat

SEQ ID NO: 403785 - DNA, 25 bp, Mus musculus
gaaaatacagaaataccgccacaga

SEQ ID NO: 403786 - DNA, 25 bp, Mus musculus
gaaaatacagaattaccgccacaga

SEQ ID NO: 403787 - DNA, 25 bp, Mus musculus
gaaaatacagctccctgcagaagtg

SEQ ID NO: 403788 - DNA, 25 bp, Mus musculus
gaaaatacagctgcctgcagaagtg

SEQ ID NO: 403789 - DNA, 25 bp, Mus musculus
gaaaatacagtcaacttacagtggt

SEQ ID NO: 403790 - DNA, 25 bp, Mus musculus
gaaaatacagtccataagtttgaaa

SEQ ID NO: 403791 - DNA, 25 bp, Mus musculus
gaaaatacagtcgataagtttgaaa

SEQ ID NO: 403792 - DNA, 25 bp, Mus musculus
gaaaatacagtctacttacagtggt

SEQ ID NO: 403793 - DNA, 25 bp, Mus musculus
gaaaatacatcgatgagtcctgaaa

SEQ ID NO: 403794 - DNA, 25 bp, Mus musculus
gaaaatacatcgttgagtcctgaaa

SEQ ID NO: 403795 - DNA, 25 bp, Mus musculus
gaaaataccactactactttatgat

SEQ ID NO: 403796 - DNA, 25 bp, Mus musculus
gaaaataccacttctactttatgat

SEQ ID NO: 403797 - DNA, 25 bp, Mus musculus
gaaaatacccacaggtgtgcccaga

SEQ ID NO: 403798 - DNA, 25 bp, Mus musculus
gaaaatacccactggtgtgcccaga

SEQ ID NO: 403799 - DNA, 25 bp, Mus musculus
gaaaataccccaagtcgcctttcat

SEQ ID NO: 403800 - DNA, 25 bp, Mus musculus
gaaaataccccatgtcgcctttcat

SEQ ID NO: 403801 - DNA, 25 bp, Mus musculus
gaaaataccctaaaggcttccttag

SEQ ID NO: 403802 - DNA, 25 bp, Mus musculus
gaaaataccctacaactggatctca

SEQ ID NO: 403803 - DNA, 25 bp, Mus musculus
gaaaataccctagaactggatctca

SEQ ID NO: 403804 - DNA, 25 bp, Mus musculus
gaaaataccctataggcttccttag

SEQ ID NO: 403805 - DNA, 25 bp, Mus musculus
gaaaataccggaagagcgtcctgaa

SEQ ID NO: 403806 - DNA, 25 bp, Mus musculus
gaaaataccggatgagcgtcctgaa

SEQ ID NO: 403807 - DNA, 25 bp, Mus musculus
gaaaatacctgtcagaaatatactt

SEQ ID NO: 403808 - DNA, 25 bp, Mus musculus
gaaaatacctgtgagaaatatactt

SEQ ID NO: 403809 - DNA, 25 bp, Mus musculus
gaaaataccttgactaagctccttt

SEQ ID NO: 403810 - DNA, 25 bp, Mus musculus
gaaaataccttgagagcagctagaa

SEQ ID NO: 403811 - DNA, 25 bp, Mus musculus
gaaaataccttgtctaagctccttt

SEQ ID NO: 403812 - DNA, 25 bp, Mus musculus
gaaaataccttgtgagcagctagaa

SEQ ID NO: 403813 - DNA, 25 bp, Mus musculus
gaaaatacctttcctcggtgacaga

SEQ ID NO: 403814 - DNA, 25 bp, Mus musculus
gaaaatacctttgctcggtgacaga

SEQ ID NO: 403815 - DNA, 25 bp, Mus musculus
gaaaatacgtgcaattacccaagga

SEQ ID NO: 403816 - DNA, 25 bp, Mus musculus
gaaaatacgtgctattacccaagga

SEQ ID NO: 403817 - DNA, 25 bp, Mus musculus
gaaaatactagacagcgtgggcatc

SEQ ID NO: 403818 - DNA, 25 bp, Mus musculus
gaaaatactagagagcgtgggcatc

SEQ ID NO: 403819 - DNA, 25 bp, Mus musculus
gaaaatactatactcctggattggc

SEQ ID NO: 403820 - DNA, 25 bp, Mus musculus
gaaaatactatagtcctggattggc

SEQ ID NO: 403821 - DNA, 25 bp, Mus musculus
gaaaatactcaaatccaccatccat

SEQ ID NO: 403822 - DNA, 25 bp, Mus musculus
gaaaatactcaattccaccatccat

SEQ ID NO: 403823 - DNA, 25 bp, Mus musculus
gaaaatactccaacctgggtcacac

SEQ ID NO: 403824 - DNA, 25 bp, Mus musculus
gaaaatactccatcctgggtcacac

SEQ ID NO: 403825 - DNA, 25 bp, Mus musculus
gaaaatactctcaatacttttgtct

SEQ ID NO: 403826 - DNA, 25 bp, Mus musculus
gaaaatactctctatacttttgtct

SEQ ID NO: 403827 - DNA, 25 bp, Mus musculus
gaaaatactcttcttagtccttcaa

SEQ ID NO: 403828 - DNA, 25 bp, Mus musculus
gaaaatactcttgttagtccttcaa

SEQ ID NO: 403829 - DNA, 25 bp, Mus musculus
gaaaatactgcaactatccatctgt

SEQ ID NO: 403830 - DNA, 25 bp, Mus musculus
gaaaatactgcatctatccatctgt

SEQ ID NO: 403831 - DNA, 25 bp, Mus musculus
gaaaatactgtaacaccttggtcaa

SEQ ID NO: 403832 - DNA, 25 bp, Mus musculus
gaaaatactgtatcaccttggtcaa

SEQ ID NO: 403833 - DNA, 25 bp, Mus musculus
gaaaatacttaaacacccactgagc

SEQ ID NO: 403834 - DNA, 25 bp, Mus musculus
gaaaatacttaatcacccactgagc

SEQ ID NO: 403835 - DNA, 25 bp, Mus musculus
gaaaatacttttctccctgaaacag

SEQ ID NO: 403836 - DNA, 25 bp, Mus musculus
gaaaatacttttgtccctgaaacag

SEQ ID NO: 403837 - DNA, 25 bp, Mus musculus
gaaaatagactaagccaggcggtgg

SEQ ID NO: 403838 - DNA, 25 bp, Mus musculus
gaaaatagactatgccaggcggtgg

SEQ ID NO: 403839 - DNA, 25 bp, Mus musculus
gaaaatagagtgcaagacccaaatt

SEQ ID NO: 403840 - DNA, 25 bp, Mus musculus
gaaaatagagtggaagacccaaatt

SEQ ID NO: 403841 - DNA, 25 bp, Mus musculus
gaaaatagccttccaggagatgtgt

SEQ ID NO: 403842 - DNA, 25 bp, Mus musculus
gaaaatagccttgcaggagatgtgt

SEQ ID NO: 403843 - DNA, 25 bp, Mus musculus
gaaaatagctcactgggtcctcaca

SEQ ID NO: 403844 - DNA, 25 bp, Mus musculus
gaaaatagctcagtgggtcctcaca

SEQ ID NO: 403845 - DNA, 25 bp, Mus musculus
gaaaataggaatcccctttacaaga

SEQ ID NO: 403846 - DNA, 25 bp, Mus musculus
gaaaataggaatgccctttacaaga

SEQ ID NO: 403847 - DNA, 25 bp, Mus musculus
gaaaataggacaccagagccaggaa

SEQ ID NO: 403848 - DNA, 25 bp, Mus musculus
gaaaataggacagcagagccaggaa

SEQ ID NO: 403849 - DNA, 25 bp, Mus musculus
gaaaataggtctctagctctccaca

SEQ ID NO: 403850 - DNA, 25 bp, Mus musculus
gaaaataggtctgtagctctccaca

SEQ ID NO: 403851 - DNA, 25 bp, Mus musculus
gaaaatagtagtcaccacctctcct

SEQ ID NO: 403852 - DNA, 25 bp, Mus musculus
gaaaatagtagtgaccacctctcct

SEQ ID NO: 403853 - DNA, 25 bp, Mus musculus
gaaaatagtattccaggccactgag

SEQ ID NO: 403854 - DNA, 25 bp, Mus musculus
gaaaatagtattgcaggccactgag

SEQ ID NO: 403855 - DNA, 25 bp, Mus musculus
gaaaatagtcagaaatcaccccagg

SEQ ID NO: 403856 - DNA, 25 bp, Mus musculus
gaaaatagtcagtaatcaccccagg

SEQ ID NO: 403857 - DNA, 25 bp, Mus musculus
gaaaatagtctactggcagcgggcc

SEQ ID NO: 403858 - DNA, 25 bp, Mus musculus
gaaaatagtctagtggcagcgggcc

SEQ ID NO: 403859 - DNA, 25 bp, Mus musculus
gaaaatagttacctcctctctgaaa

SEQ ID NO: 403860 - DNA, 25 bp, Mus musculus
gaaaatagttacgtcctctctgaaa

SEQ ID NO: 403861 - DNA, 25 bp, Mus musculus
gaaaatagttgcagtgtcctcaagt

SEQ ID NO: 403862 - DNA, 25 bp, Mus musculus
gaaaatagttgctgtgtcctcaagt

SEQ ID NO: 403863 - DNA, 25 bp, Mus musculus
gaaaatataaaccttaatagccttg

SEQ ID NO: 403864 - DNA, 25 bp, Mus musculus
gaaaatataaacgttaatagccttg

SEQ ID NO: 403865 - DNA, 25 bp, Mus musculus
gaaaatatacctcactaaaagtttg

SEQ ID NO: 403866 - DNA, 25 bp, Mus musculus
gaaaatatacctgactaaaagtttg

SEQ ID NO: 403867 - DNA, 25 bp, Mus musculus
gaaaatatattacgtcacatgatta

SEQ ID NO: 403868 - DNA, 25 bp, Mus musculus
gaaaatatattaggtcacatgatta

SEQ ID NO: 403869 - DNA, 25 bp, Mus musculus
gaaaatatcagaatgcacccctctc

SEQ ID NO: 403870 - DNA, 25 bp, Mus musculus
gaaaatatcagattgcacccctctc

SEQ ID NO: 403871 - DNA, 25 bp, Mus musculus
gaaaatatcagtactacacactgct

SEQ ID NO: 403872 - DNA, 25 bp, Mus musculus
gaaaatatcagttctacacactgct

SEQ ID NO: 403873 - DNA, 25 bp, Mus musculus
gaaaatatcatgcagagttctctgg

SEQ ID NO: 403874 - DNA, 25 bp, Mus musculus
gaaaatatcatggagagttctctgg

SEQ ID NO: 403875 - DNA, 25 bp, Mus musculus
gaaaatatcgacattctacctgccc

SEQ ID NO: 403876 - DNA, 25 bp, Mus musculus
gaaaatatcgactttctacctgccc

SEQ ID NO: 403877 - DNA, 25 bp, Mus musculus
gaaaatatgaccattgtgactgcgg

SEQ ID NO: 403878 - DNA, 25 bp, Mus musculus
gaaaatatgacctttgtgactgcgg

SEQ ID NO: 403879 - DNA, 25 bp, Mus musculus
gaaaatatgatccttataaaactag

SEQ ID NO: 403880 - DNA, 25 bp, Mus musculus
gaaaatatgatcgttataaaactag

SEQ ID NO: 403881 - DNA, 25 bp, Mus musculus
gaaaatatgcagctctggatgccaa

SEQ ID NO: 403882 - DNA, 25 bp, Mus musculus
gaaaatatgcaggtctggatgccaa

SEQ ID NO: 403883 - DNA, 25 bp, Mus musculus
gaaaatatgcctagatagtgtagcc

SEQ ID NO: 403884 - DNA, 25 bp, Mus musculus
gaaaatatgccttgatagtgtagcc

SEQ ID NO: 403885 - DNA, 25 bp, Mus musculus
gaaaatatggcacctgtcctcatgg

SEQ ID NO: 403886 - DNA, 25 bp, Mus musculus
gaaaatatggcagctgtcctcatgg

SEQ ID NO: 403887 - DNA, 25 bp, Mus musculus
gaaaatatgtttcctggttagacca

SEQ ID NO: 403888 - DNA, 25 bp, Mus musculus
gaaaatatgtttgctggttagacca

SEQ ID NO: 403889 - DNA, 25 bp, Mus musculus
gaaaatattatcatggtactatgca

SEQ ID NO: 403890 - DNA, 25 bp, Mus musculus
gaaaatattatcttggtactatgca

SEQ ID NO: 403891 - DNA, 25 bp, Mus musculus
gaaaatattgtgacgagctcttggt

SEQ ID NO: 403892 - DNA, 25 bp, Mus musculus
gaaaatattgtgtcgagctcttggt

SEQ ID NO: 403893 - DNA, 25 bp, Mus musculus
gaaaatatttgcattgtagtactca

SEQ ID NO: 403894 - DNA, 25 bp, Mus musculus
gaaaatatttgctttgtagtactca

SEQ ID NO: 403895 - DNA, 25 bp, Mus musculus
gaaaatattttcactgtttctcttt

SEQ ID NO: 403896 - DNA, 25 bp, Mus musculus
gaaaatattttctctgtttctcttt

SEQ ID NO: 403897 - DNA, 25 bp, Mus musculus
gaaaatcaaactaaacacccttatg

SEQ ID NO: 403898 - DNA, 25 bp, Mus musculus
gaaaatcaaactcaccaactggtcc

SEQ ID NO: 403899 - DNA, 25 bp, Mus musculus
gaaaatcaaactgaccaactggtcc

SEQ ID NO: 403900 - DNA, 25 bp, Mus musculus
gaaaatcaaacttaacacccttatg

SEQ ID NO: 403901 - DNA, 25 bp, Mus musculus
gaaaatcaactcatccagggtagct

SEQ ID NO: 403902 - DNA, 25 bp, Mus musculus
gaaaatcaactcttccagggtagct

SEQ ID NO: 403903 - DNA, 25 bp, Mus musculus
gaaaatcaagacattcctgggtggg

SEQ ID NO: 403904 - DNA, 25 bp, Mus musculus
gaaaatcaagactttcctgggtggg

SEQ ID NO: 403905 - DNA, 25 bp, Mus musculus
gaaaatcaatgacttgcgctaccca

SEQ ID NO: 403906 - DNA, 25 bp, Mus musculus
gaaaatcaatgagttgcgctaccca

SEQ ID NO: 403907 - DNA, 25 bp, Mus musculus
gaaaatcaattaaactgctgcagga

SEQ ID NO: 403908 - DNA, 25 bp, Mus musculus
gaaaatcaattatactgctgcagga

SEQ ID NO: 403909 - DNA, 25 bp, Mus musculus
gaaaatcacaggacttcaccaagct

SEQ ID NO: 403910 - DNA, 25 bp, Mus musculus
gaaaatcacaggtcttcaccaagct

SEQ ID NO: 403911 - DNA, 25 bp, Mus musculus
gaaaatcaccggcatgctgctggaa

SEQ ID NO: 403912 - DNA, 25 bp, Mus musculus
gaaaatcaccgggatgctgctggaa

SEQ ID NO: 403913 - DNA, 25 bp, Mus musculus
gaaaatcactccaagtactagcatt

SEQ ID NO: 403914 - DNA, 25 bp, Mus musculus
gaaaatcactccacaatccatcaat

SEQ ID NO: 403915 - DNA, 25 bp, Mus musculus
gaaaatcactcctagtactagcatt

SEQ ID NO: 403916 - DNA, 25 bp, Mus musculus
gaaaatcactcctcaatccatcaat

SEQ ID NO: 403917 - DNA, 25 bp, Mus musculus
gaaaatcactgaccccgaatggctt

SEQ ID NO: 403918 - DNA, 25 bp, Mus musculus
gaaaatcactgagcccgaatggctt

SEQ ID NO: 403919 - DNA, 25 bp, Mus musculus
gaaaatcagcacaccaatatccttg

SEQ ID NO: 403920 - DNA, 25 bp, Mus musculus
gaaaatcagcactccaatatccttg

SEQ ID NO: 403921 - DNA, 25 bp, Mus musculus
gaaaatcagcatattgccttgttgg

SEQ ID NO: 403922 - DNA, 25 bp, Mus musculus
gaaaatcagcattttgccttgttgg

SEQ ID NO: 403923 - DNA, 25 bp, Mus musculus
gaaaatcagcggcttttcttcctag

SEQ ID NO: 403924 - DNA, 25 bp, Mus musculus
gaaaatcagcgggttttcttcctag

SEQ ID NO: 403925 - DNA, 25 bp, Mus musculus
gaaaatcaggaaatcccgggcatct

SEQ ID NO: 403926 - DNA, 25 bp, Mus musculus
gaaaatcaggaattcccgggcatct

SEQ ID NO: 403927 - DNA, 25 bp, Mus musculus
gaaaatcaggataacaccgccattc

SEQ ID NO: 403928 - DNA, 25 bp, Mus musculus
gaaaatcaggattacaccgccattc

SEQ ID NO: 403929 - DNA, 25 bp, Mus musculus
gaaaatcagtgaattccatctggga

SEQ ID NO: 403930 - DNA, 25 bp, Mus musculus
gaaaatcagtgatttccatctggga

SEQ ID NO: 403931 - DNA, 25 bp, Mus musculus
gaaaatcatcccactcttgtatgta

SEQ ID NO: 403932 - DNA, 25 bp, Mus musculus
gaaaatcatccccactgtcaatgtc

SEQ ID NO: 403933 - DNA, 25 bp, Mus musculus
gaaaatcatcccgactgtcaatgtc

SEQ ID NO: 403934 - DNA, 25 bp, Mus musculus
gaaaatcatccctctcttgtatgta

SEQ ID NO: 403935 - DNA, 25 bp, Mus musculus
gaaaatcatctcattcagttaaagt

SEQ ID NO: 403936 - DNA, 25 bp, Mus musculus
gaaaatcatctctttcagttaaagt

SEQ ID NO: 403937 - DNA, 25 bp, Mus musculus
gaaaatcatctgacaggtgagcaac

SEQ ID NO: 403938 - DNA, 25 bp, Mus musculus
gaaaatcatctgtcaggtgagcaac

SEQ ID NO: 403939 - DNA, 25 bp, Mus musculus
gaaaatcatgcccaaagacccacaa

SEQ ID NO: 403940 - DNA, 25 bp, Mus musculus
gaaaatcatgccgaaagacccacaa

SEQ ID NO: 403941 - DNA, 25 bp, Mus musculus
gaaaatcatgctcaccaacagacag

SEQ ID NO: 403942 - DNA, 25 bp, Mus musculus
gaaaatcatgctgaccaacagacag

SEQ ID NO: 403943 - DNA, 25 bp, Mus musculus
gaaaatcatgtaccccagtatcctc

SEQ ID NO: 403944 - DNA, 25 bp, Mus musculus
gaaaatcatgtagcccagtatcctc

SEQ ID NO: 403945 - DNA, 25 bp, Mus musculus
gaaaatcatgtcagaagtacccaaa

SEQ ID NO: 403946 - DNA, 25 bp, Mus musculus
gaaaatcatgtctgaagtacccaaa

SEQ ID NO: 403947 - DNA, 25 bp, Mus musculus
gaaaatcattgtacttaaagccaaa

SEQ ID NO: 403948 - DNA, 25 bp, Mus musculus
gaaaatcattgttcttaaagccaaa

SEQ ID NO: 403949 - DNA, 25 bp, Mus musculus
gaaaatcatttaaccttctcagtgc

SEQ ID NO: 403950 - DNA, 25 bp, Mus musculus
gaaaatcatttatccttctcagtgc

SEQ ID NO: 403951 - DNA, 25 bp, Mus musculus
gaaaatccaaagatgtcccttgaaa

SEQ ID NO: 403952 - DNA, 25 bp, Mus musculus
gaaaatccaaagttgtcccttgaaa

SEQ ID NO: 403953 - DNA, 25 bp, Mus musculus
gaaaatccaactagtccacgataca

SEQ ID NO: 403954 - DNA, 25 bp, Mus musculus
gaaaatccaacttgtccacgataca

SEQ ID NO: 403955 - DNA, 25 bp, Mus musculus
gaaaatccacgcaggacctattaca

SEQ ID NO: 403956 - DNA, 25 bp, Mus musculus
gaaaatccacgctggacctattaca

SEQ ID NO: 403957 - DNA, 25 bp, Mus musculus
gaaaatccactcatgtttatctcat

SEQ ID NO: 403958 - DNA, 25 bp, Mus musculus
gaaaatccactcttgtttatctcat

SEQ ID NO: 403959 - DNA, 25 bp, Mus musculus
gaaaatccagggaaagaccttacag

SEQ ID NO: 403960 - DNA, 25 bp, Mus musculus
gaaaatccagggtaagaccttacag

SEQ ID NO: 403961 - DNA, 25 bp, Mus musculus
gaaaatcccaggaccacagcaaagg

SEQ ID NO: 403962 - DNA, 25 bp, Mus musculus
gaaaatcccaggtccacagcaaagg

SEQ ID NO: 403963 - DNA, 25 bp, Mus musculus
gaaaatcccattaggcagagctgct

SEQ ID NO: 403964 - DNA, 25 bp, Mus musculus
gaaaatcccatttggcagagctgct

SEQ ID NO: 403965 - DNA, 25 bp, Mus musculus
gaaaatccccaaagagactgcccag

SEQ ID NO: 403966 - DNA, 25 bp, Mus musculus
gaaaatccccaatgagactgcccag

SEQ ID NO: 403967 - DNA, 25 bp, Mus musculus
gaaaatccccacagggttctaacag

SEQ ID NO: 403968 - DNA, 25 bp, Mus musculus
gaaaatccccactgggttctaacag

SEQ ID NO: 403969 - DNA, 25 bp, Mus musculus
gaaaatcccctcagatgggcgctgg

SEQ ID NO: 403970 - DNA, 25 bp, Mus musculus
gaaaatcccctctgatgggcgctgg

SEQ ID NO: 403971 - DNA, 25 bp, Mus musculus
gaaaatccctatccacgtctggtgg

SEQ ID NO: 403972 - DNA, 25 bp, Mus musculus
gaaaatccctatgcacgtctggtgg

SEQ ID NO: 403973 - DNA, 25 bp, Mus musculus
gaaaatccctcacaaggctagctgt

SEQ ID NO: 403974 - DNA, 25 bp, Mus musculus
gaaaatccctcagaaggctagctgt

SEQ ID NO: 403975 - DNA, 25 bp, Mus musculus
gaaaatccctgcatcaaataattgt

SEQ ID NO: 403976 - DNA, 25 bp, Mus musculus
gaaaatccctgcttcaaataattgt

SEQ ID NO: 403977 - DNA, 25 bp, Mus musculus
gaaaatcccttcataacaaatatag

SEQ ID NO: 403978 - DNA, 25 bp, Mus musculus
gaaaatcccttcttaacaaatatag

SEQ ID NO: 403979 - DNA, 25 bp, Mus musculus
gaaaatccgagtcagcaggcagcag

SEQ ID NO: 403980 - DNA, 25 bp, Mus musculus
gaaaatccgagtgagcaggcagcag

SEQ ID NO: 403981 - DNA, 25 bp, Mus musculus
gaaaatccgtttcctcgagagcaat

SEQ ID NO: 403982 - DNA, 25 bp, Mus musculus
gaaaatccgtttgctcgagagcaat

SEQ ID NO: 403983 - DNA, 25 bp, Mus musculus
gaaaatcctaaaacagacccacatt

SEQ ID NO: 403984 - DNA, 25 bp, Mus musculus
gaaaatcctaaatcagacccacatt

SEQ ID NO: 403985 - DNA, 25 bp, Mus musculus
gaaaatcctaacaagtcctctgtgt

SEQ ID NO: 403986 - DNA, 25 bp, Mus musculus
gaaaatcctaactagtcctctgtgt

SEQ ID NO: 403987 - DNA, 25 bp, Mus musculus
gaaaatcctagaaagcctggacaga

SEQ ID NO: 403988 - DNA, 25 bp, Mus musculus
gaaaatcctagatagcctggacaga

SEQ ID NO: 403989 - DNA, 25 bp, Mus musculus
gaaaatcctatcacaatgacagtag

SEQ ID NO: 403990 - DNA, 25 bp, Mus musculus
gaaaatcctatctcaatgacagtag

SEQ ID NO: 403991 - DNA, 25 bp, Mus musculus
gaaaatcctgctacccaaaacataa

SEQ ID NO: 403992 - DNA, 25 bp, Mus musculus
gaaaatcctgcttcccaaaacataa

SEQ ID NO: 403993 - DNA, 25 bp, Mus musculus
gaaaatcctgttacatcattatgaa

SEQ ID NO: 403994 - DNA, 25 bp, Mus musculus
gaaaatcctgtttcatcattatgaa

SEQ ID NO: 403995 - DNA, 25 bp, Mus musculus
gaaaatccttcaaacagcctggcat

SEQ ID NO: 403996 - DNA, 25 bp, Mus musculus
gaaaatccttcatacagcctggcat

SEQ ID NO: 403997 - DNA, 25 bp, Mus musculus
gaaaatcctttgagccttgcagaaa

SEQ ID NO: 403998 - DNA, 25 bp, Mus musculus
gaaaatcctttgatgggttgggcat

SEQ ID NO: 403999 - DNA, 25 bp, Mus musculus
gaaaatcctttgtgccttgcagaaa

SEQ ID NO: 404000 - DNA, 25 bp, Mus musculus
gaaaatcctttgttgggttgggcat

SEQ ID NO: 404001 - DNA, 25 bp, Mus musculus
gaaaatcgagaaatacccactaaga

SEQ ID NO: 404002 - DNA, 25 bp, Mus musculus
gaaaatcgagaattacccactaaga

SEQ ID NO: 404003 - DNA, 25 bp, Mus musculus
gaaaatcgagttcccctctaagaat

SEQ ID NO: 404004 - DNA, 25 bp, Mus musculus
gaaaatcgagttgccctctaagaat

SEQ ID NO: 404005 - DNA, 25 bp, Mus musculus
gaaaatcgcaaaatccctggttcca

SEQ ID NO: 404006 - DNA, 25 bp, Mus musculus
gaaaatcgcaaattccctggttcca

SEQ ID NO: 404007 - DNA, 25 bp, Mus musculus
gaaaatcgcccaaagatcaaaattg

SEQ ID NO: 404008 - DNA, 25 bp, Mus musculus
gaaaatcgcccatagatcaaaattg

SEQ ID NO: 404009 - DNA, 25 bp, Mus musculus
gaaaatcggactattcgttgtccag

SEQ ID NO: 404010 - DNA, 25 bp, Mus musculus
gaaaatcggacttttcgttgtccag

SEQ ID NO: 404011 - DNA, 25 bp, Mus musculus
gaaaatctaaaacaaccggcatcta

SEQ ID NO: 404012 - DNA, 25 bp, Mus musculus
gaaaatctaaaagaaccggcatcta

SEQ ID NO: 404013 - DNA, 25 bp, Mus musculus
gaaaatctaagcctactattgaaaa

SEQ ID NO: 404014 - DNA, 25 bp, Mus musculus
gaaaatctaagcgtactattgaaaa

SEQ ID NO: 404015 - DNA, 25 bp, Mus musculus
gaaaatctacatccgtcaaccattg

SEQ ID NO: 404016 - DNA, 25 bp, Mus musculus
gaaaatctacatgcgtcaaccattg

SEQ ID NO: 404017 - DNA, 25 bp, Mus musculus
gaaaatctatgaaagccctggtttg

SEQ ID NO: 404018 - DNA, 25 bp, Mus musculus
gaaaatctatgatagccctggtttg

SEQ ID NO: 404019 - DNA, 25 bp, Mus musculus
gaaaatctcggtcattgttacagtg

SEQ ID NO: 404020 - DNA, 25 bp, Mus musculus
gaaaatctcggtgattgttacagtg

SEQ ID NO: 404021 - DNA, 25 bp, Mus musculus
gaaaatctctatccactgatctgat

SEQ ID NO: 404022 - DNA, 25 bp, Mus musculus
gaaaatctctatgcactgatctgat

SEQ ID NO: 404023 - DNA, 25 bp, Mus musculus
gaaaatctctgtccattgttcctgc

SEQ ID NO: 404024 - DNA, 25 bp, Mus musculus
gaaaatctctgtgcattgttcctgc

SEQ ID NO: 404025 - DNA, 25 bp, Mus musculus
gaaaatctgactacatcacaactga

SEQ ID NO: 404026 - DNA, 25 bp, Mus musculus
gaaaatctgacttcatcacaactga

SEQ ID NO: 404027 - DNA, 25 bp, Mus musculus
gaaaatctgcccatggacttaagaa

SEQ ID NO: 404028 - DNA, 25 bp, Mus musculus
gaaaatctgcccttggacttaagaa

SEQ ID NO: 404029 - DNA, 25 bp, Mus musculus
gaaaatctgccgagacttttggtca

SEQ ID NO: 404030 - DNA, 25 bp, Mus musculus
gaaaatctgccgcagcagggccttt

SEQ ID NO: 404031 - DNA, 25 bp, Mus musculus
gaaaatctgccggagcagggccttt

SEQ ID NO: 404032 - DNA, 25 bp, Mus musculus
gaaaatctgccgtgacttttggtca

SEQ ID NO: 404033 - DNA, 25 bp, Mus musculus
gaaaatctggccattcagacccggg

SEQ ID NO: 404034 - DNA, 25 bp, Mus musculus
gaaaatctggcctttcagacccggg

SEQ ID NO: 404035 - DNA, 25 bp, Mus musculus
gaaaatctgtcaagtccaccttgga

SEQ ID NO: 404036 - DNA, 25 bp, Mus musculus
gaaaatctgtcatgtccaccttgga

SEQ ID NO: 404037 - DNA, 25 bp, Mus musculus
gaaaatctgtctccacgacacagtg

SEQ ID NO: 404038 - DNA, 25 bp, Mus musculus
gaaaatctgtctgcacgacacagtg

SEQ ID NO: 404039 - DNA, 25 bp, Mus musculus
gaaaatctgtgtccgctgatccaaa

SEQ ID NO: 404040 - DNA, 25 bp, Mus musculus
gaaaatctgtgtgcgctgatccaaa

SEQ ID NO: 404041 - DNA, 25 bp, Mus musculus
gaaaatcttaaaaatcgcccaaatg

SEQ ID NO: 404042 - DNA, 25 bp, Mus musculus
gaaaatcttaaatatcgcccaaatg

SEQ ID NO: 404043 - DNA, 25 bp, Mus musculus
gaaaatcttagtatcgctcccataa

SEQ ID NO: 404044 - DNA, 25 bp, Mus musculus
gaaaatcttagtttcgctcccataa

SEQ ID NO: 404045 - DNA, 25 bp, Mus musculus
gaaaatcttcaaactctccaattta

SEQ ID NO: 404046 - DNA, 25 bp, Mus musculus
gaaaatcttcaatctctccaattta

SEQ ID NO: 404047 - DNA, 25 bp, Mus musculus
gaaaatcttctaacgaacctgccgg

SEQ ID NO: 404048 - DNA, 25 bp, Mus musculus
gaaaatcttctatcgaacctgccgg

SEQ ID NO: 404049 - DNA, 25 bp, Mus musculus
gaaaatcttgaaactctgtgagtct

SEQ ID NO: 404050 - DNA, 25 bp, Mus musculus
gaaaatcttgaatctctgtgagtct

SEQ ID NO: 404051 - DNA, 25 bp, Mus musculus
gaaaatcttgacactcctggcacaa

SEQ ID NO: 404052 - DNA, 25 bp, Mus musculus
gaaaatcttgactctcctggcacaa

SEQ ID NO: 404053 - DNA, 25 bp, Mus musculus
gaaaatctttcacccagtgtgccca

SEQ ID NO: 404054 - DNA, 25 bp, Mus musculus
gaaaatctttcagccagtgtgccca

SEQ ID NO: 404055 - DNA, 25 bp, Mus musculus
gaaaatcttttaatgcttgtgttta

SEQ ID NO: 404056 - DNA, 25 bp, Mus musculus
gaaaatcttttattgcttgtgttta

SEQ ID NO: 404057 - DNA, 25 bp, Mus musculus
gaaaatcttttcatgaatacaaact

SEQ ID NO: 404058 - DNA, 25 bp, Mus musculus
gaaaatcttttcttgaatacaaact

SEQ ID NO: 404059 - DNA, 25 bp, Mus musculus
gaaaatcttttgataatccatcttt

SEQ ID NO: 404060 - DNA, 25 bp, Mus musculus
gaaaatcttttgttaatccatcttt

SEQ ID NO: 404061 - DNA, 25 bp, Mus musculus
gaaaatgaagccaagcccaccttac

SEQ ID NO: 404062 - DNA, 25 bp, Mus musculus
gaaaatgaagcctagcccaccttac

SEQ ID NO: 404063 - DNA, 25 bp, Mus musculus
gaaaatgaaggtcaggttctttctc

SEQ ID NO: 404064 - DNA, 25 bp, Mus musculus
gaaaatgaaggtgaggttctttctc

SEQ ID NO: 404065 - DNA, 25 bp, Mus musculus
gaaaatgaataaaagctctttccat

SEQ ID NO: 404066 - DNA, 25 bp, Mus musculus
gaaaatgaataatagctctttccat

SEQ ID NO: 404067 - DNA, 25 bp, Mus musculus
gaaaatgaatctcctctctcctgga

SEQ ID NO: 404068 - DNA, 25 bp, Mus musculus
gaaaatgaatctgctctctcctgga

SEQ ID NO: 404069 - DNA, 25 bp, Mus musculus
gaaaatgacaccataggttcatagg

SEQ ID NO: 404070 - DNA, 25 bp, Mus musculus
gaaaatgacaccttaggttcatagg

SEQ ID NO: 404071 - DNA, 25 bp, Mus musculus
gaaaatgacactcatctgagtaatg

SEQ ID NO: 404072 - DNA, 25 bp, Mus musculus
gaaaatgacactgatctgagtaatg

SEQ ID NO: 404073 - DNA, 25 bp, Mus musculus
gaaaatgacagcatcgcgggcacca

SEQ ID NO: 404074 - DNA, 25 bp, Mus musculus
gaaaatgacagcttcgcgggcacca

SEQ ID NO: 404075 - DNA, 25 bp, Mus musculus
gaaaatgacagtacgggcagtcact

SEQ ID NO: 404076 - DNA, 25 bp, Mus musculus
gaaaatgacagttcgggcagtcact

SEQ ID NO: 404077 - DNA, 25 bp, Mus musculus
gaaaatgacatgattttcctggtta

SEQ ID NO: 404078 - DNA, 25 bp, Mus musculus
gaaaatgacatgtttttcctggtta

SEQ ID NO: 404079 - DNA, 25 bp, Mus musculus
gaaaatgacattcccctagaagttt

SEQ ID NO: 404080 - DNA, 25 bp, Mus musculus
gaaaatgacattgccctagaagttt

SEQ ID NO: 404081 - DNA, 25 bp, Mus musculus
gaaaatgacccaactcatatcccac

SEQ ID NO: 404082 - DNA, 25 bp, Mus musculus
gaaaatgacccatctcatatcccac

SEQ ID NO: 404083 - DNA, 25 bp, Mus musculus
gaaaatgaccccacttgtgttaaag

SEQ ID NO: 404084 - DNA, 25 bp, Mus musculus
gaaaatgacccctcttgtgttaaag

SEQ ID NO: 404085 - DNA, 25 bp, Mus musculus
gaaaatgaccgtccagctcgagacc

SEQ ID NO: 404086 - DNA, 25 bp, Mus musculus
gaaaatgaccgtgcagctcgagacc

SEQ ID NO: 404087 - DNA, 25 bp, Mus musculus
gaaaatgacggcacaccagaagaag

SEQ ID NO: 404088 - DNA, 25 bp, Mus musculus
gaaaatgacggctcaccagaagaag

SEQ ID NO: 404089 - DNA, 25 bp, Mus musculus
gaaaatgactcaattccctttcctc

SEQ ID NO: 404090 - DNA, 25 bp, Mus musculus
gaaaatgactcatttccctttcctc

SEQ ID NO: 404091 - DNA, 25 bp, Mus musculus
gaaaatgactgcaaacactgacggt

SEQ ID NO: 404092 - DNA, 25 bp, Mus musculus
gaaaatgactgctaacactgacggt

SEQ ID NO: 404093 - DNA, 25 bp, Mus musculus
gaaaatgactgtaagatgaacccat

SEQ ID NO: 404094 - DNA, 25 bp, Mus musculus
gaaaatgactgttagatgaacccat

SEQ ID NO: 404095 - DNA, 25 bp, Mus musculus
gaaaatgagaacacccagccactgc

SEQ ID NO: 404096 - DNA, 25 bp, Mus musculus
gaaaatgagaactcccagccactgc

SEQ ID NO: 404097 - DNA, 25 bp, Mus musculus
gaaaatgagcgcaaggctgagattg

SEQ ID NO: 404098 - DNA, 25 bp, Mus musculus
gaaaatgagcgctaggctgagattg

SEQ ID NO: 404099 - DNA, 25 bp, Mus musculus
gaaaatgagctgagcttgtctttag

SEQ ID NO: 404100 - DNA, 25 bp, Mus musculus
gaaaatgagctgtgcttgtctttag

SEQ ID NO: 404101 - DNA, 25 bp, Mus musculus
gaaaatgagtaaagtcccttcctag

SEQ ID NO: 404102 - DNA, 25 bp, Mus musculus
gaaaatgagtaatgtcccttcctag

SEQ ID NO: 404103 - DNA, 25 bp, Mus musculus
gaaaatgagtttcttcaccgctgtc

SEQ ID NO: 404104 - DNA, 25 bp, Mus musculus
gaaaatgagtttgttcaccgctgtc

SEQ ID NO: 404105 - DNA, 25 bp, Mus musculus
gaaaatgatctaagggcccaccaca

SEQ ID NO: 404106 - DNA, 25 bp, Mus musculus
gaaaatgatctatgggcccaccaca

SEQ ID NO: 404107 - DNA, 25 bp, Mus musculus
gaaaatgatgtcagtcttacgtact

SEQ ID NO: 404108 - DNA, 25 bp, Mus musculus
gaaaatgatgtctgtcttacgtact

SEQ ID NO: 404109 - DNA, 25 bp, Mus musculus
gaaaatgattagacagctcccagat

SEQ ID NO: 404110 - DNA, 25 bp, Mus musculus
gaaaatgattagtcagctcccagat

SEQ ID NO: 404111 - DNA, 25 bp, Mus musculus
gaaaatgcacacctggaactgctta

SEQ ID NO: 404112 - DNA, 25 bp, Mus musculus
gaaaatgcacacgtggaactgctta

SEQ ID NO: 404113 - DNA, 25 bp, Mus musculus
gaaaatgcaccacctatcactatta

SEQ ID NO: 404114 - DNA, 25 bp, Mus musculus
gaaaatgcaccagctatcactatta

SEQ ID NO: 404115 - DNA, 25 bp, Mus musculus
gaaaatgcaccgagttcatccaggg

SEQ ID NO: 404116 - DNA, 25 bp, Mus musculus
gaaaatgcaccgtgttcatccaggg

SEQ ID NO: 404117 - DNA, 25 bp, Mus musculus
gaaaatgcacctatatcacagtctg

SEQ ID NO: 404118 - DNA, 25 bp, Mus musculus
gaaaatgcacctttatcacagtctg

SEQ ID NO: 404119 - DNA, 25 bp, Mus musculus
gaaaatgcactcaaacttatgtgaa

SEQ ID NO: 404120 - DNA, 25 bp, Mus musculus
gaaaatgcactctaacttatgtgaa

SEQ ID NO: 404121 - DNA, 25 bp, Mus musculus
gaaaatgcactgaattccctgtgat

SEQ ID NO: 404122 - DNA, 25 bp, Mus musculus
gaaaatgcactgtattccctgtgat

SEQ ID NO: 404123 - DNA, 25 bp, Mus musculus
gaaaatgcagtgcacttcatccttc

SEQ ID NO: 404124 - DNA, 25 bp, Mus musculus
gaaaatgcagtggacttcatccttc

SEQ ID NO: 404125 - DNA, 25 bp, Mus musculus
gaaaatgcatcccttgtgtcctctc

SEQ ID NO: 404126 - DNA, 25 bp, Mus musculus
gaaaatgcatccgttgtgtcctctc

SEQ ID NO: 404127 - DNA, 25 bp, Mus musculus
gaaaatgcattcaggccacatggtg

SEQ ID NO: 404128 - DNA, 25 bp, Mus musculus
gaaaatgcattctggccacatggtg

SEQ ID NO: 404129 - DNA, 25 bp, Mus musculus
gaaaatgccaggaaatacacctagt

SEQ ID NO: 404130 - DNA, 25 bp, Mus musculus
gaaaatgccaggtaatacacctagt

SEQ ID NO: 404131 - DNA, 25 bp, Mus musculus
gaaaatgcccaaacccagactaaag

SEQ ID NO: 404132 - DNA, 25 bp, Mus musculus
gaaaatgcccaatcccagactaaag

SEQ ID NO: 404133 - DNA, 25 bp, Mus musculus
gaaaatgcccacacgtgatcaaccc

SEQ ID NO: 404134 - DNA, 25 bp, Mus musculus
gaaaatgcccactcgtgatcaaccc

SEQ ID NO: 404135 - DNA, 25 bp, Mus musculus
gaaaatgcccatacatgtccacaga

SEQ ID NO: 404136 - DNA, 25 bp, Mus musculus
gaaaatgcccattcatgtccacaga

SEQ ID NO: 404137 - DNA, 25 bp, Mus musculus
gaaaatgccccacatttcaggtgct

SEQ ID NO: 404138 - DNA, 25 bp, Mus musculus
gaaaatgccccagatttcaggtgct

SEQ ID NO: 404139 - DNA, 25 bp, Mus musculus
gaaaatgcccttcgagtgggcagct

SEQ ID NO: 404140 - DNA, 25 bp, Mus musculus
gaaaatgcccttggagtgggcagct

SEQ ID NO: 404141 - DNA, 25 bp, Mus musculus
gaaaatgccgacagtctttccgact

SEQ ID NO: 404142 - DNA, 25 bp, Mus musculus
gaaaatgccgactgtctttccgact

SEQ ID NO: 404143 - DNA, 25 bp, Mus musculus
gaaaatgcctgtcatctttagatca

SEQ ID NO: 404144 - DNA, 25 bp, Mus musculus
gaaaatgcctgtgatctttagatca

SEQ ID NO: 404145 - DNA, 25 bp, Mus musculus
gaaaatgccttacaagcctgcctaa

SEQ ID NO: 404146 - DNA, 25 bp, Mus musculus
gaaaatgccttagaagcctgcctaa

SEQ ID NO: 404147 - DNA, 25 bp, Mus musculus
gaaaatgccttgagttctgctacca

SEQ ID NO: 404148 - DNA, 25 bp, Mus musculus
gaaaatgccttgtgttctgctacca

SEQ ID NO: 404149 - DNA, 25 bp, Mus musculus
gaaaatgcctttcacatcatctacc

SEQ ID NO: 404150 - DNA, 25 bp, Mus musculus
gaaaatgcctttccctgcgaaccat

SEQ ID NO: 404151 - DNA, 25 bp, Mus musculus
gaaaatgcctttgacatcatctacc

SEQ ID NO: 404152 - DNA, 25 bp, Mus musculus
gaaaatgcctttgcctgcgaaccat

SEQ ID NO: 404153 - DNA, 25 bp, Mus musculus
gaaaatgcgcgcatcttccagcgaa

SEQ ID NO: 404154 - DNA, 25 bp, Mus musculus
gaaaatgcgcgcttcttccagcgaa

SEQ ID NO: 404155 - DNA, 25 bp, Mus musculus
gaaaatgcggacactcaagacttga

SEQ ID NO: 404156 - DNA, 25 bp, Mus musculus
gaaaatgcggactctcaagacttga

SEQ ID NO: 404157 - DNA, 25 bp, Mus musculus
gaaaatgctagtctgtgttgctcac

SEQ ID NO: 404158 - DNA, 25 bp, Mus musculus
gaaaatgctagtgtgtgttgctcac

SEQ ID NO: 404159 - DNA, 25 bp, Mus musculus
gaaaatgctattcctcttgctgcta

SEQ ID NO: 404160 - DNA, 25 bp, Mus musculus
gaaaatgctattctccaagaaacat

SEQ ID NO: 404161 - DNA, 25 bp, Mus musculus
gaaaatgctattgctcttgctgcta

SEQ ID NO: 404162 - DNA, 25 bp, Mus musculus
gaaaatgctattgtccaagaaacat

SEQ ID NO: 404163 - DNA, 25 bp, Mus musculus
gaaaatgctctacaggcctgcctat

SEQ ID NO: 404164 - DNA, 25 bp, Mus musculus
gaaaatgctctagaggcctgcctat

SEQ ID NO: 404165 - DNA, 25 bp, Mus musculus
gaaaatgctctgattacactcagga

SEQ ID NO: 404166 - DNA, 25 bp, Mus musculus
gaaaatgctctgtttacactcagga

SEQ ID NO: 404167 - DNA, 25 bp, Mus musculus
gaaaatgctgccaaagctcagacag

SEQ ID NO: 404168 - DNA, 25 bp, Mus musculus
gaaaatgctgcctaagctcagacag

SEQ ID NO: 404169 - DNA, 25 bp, Mus musculus
gaaaatgctgctaccacttctggtt

SEQ ID NO: 404170 - DNA, 25 bp, Mus musculus
gaaaatgctgcttccacttctggtt

SEQ ID NO: 404171 - DNA, 25 bp, Mus musculus
gaaaatgctgtacttctgaaccatg

SEQ ID NO: 404172 - DNA, 25 bp, Mus musculus
gaaaatgctgtagttctgaaccatg

SEQ ID NO: 404173 - DNA, 25 bp, Mus musculus
gaaaatgctgtgacttcactgccag

SEQ ID NO: 404174 - DNA, 25 bp, Mus musculus
gaaaatgctgtgtcttcactgccag

SEQ ID NO: 404175 - DNA, 25 bp, Mus musculus
gaaaatgctgttacctttaagcttt

SEQ ID NO: 404176 - DNA, 25 bp, Mus musculus
gaaaatgctgtttcctttaagcttt

SEQ ID NO: 404177 - DNA, 25 bp, Mus musculus
gaaaatgctttccaggtttgagatg

SEQ ID NO: 404178 - DNA, 25 bp, Mus musculus
gaaaatgctttcctcagtgagttta

SEQ ID NO: 404179 - DNA, 25 bp, Mus musculus
gaaaatgctttcgaggtttgagatg

SEQ ID NO: 404180 - DNA, 25 bp, Mus musculus
gaaaatgctttcgtcagtgagttta

SEQ ID NO: 404181 - DNA, 25 bp, Mus musculus
gaaaatggaaggacactacgttcac

SEQ ID NO: 404182 - DNA, 25 bp, Mus musculus
gaaaatggaaggtcactacgttcac

SEQ ID NO: 404183 - DNA, 25 bp, Mus musculus
gaaaatggaatgacccttctaccac

SEQ ID NO: 404184 - DNA, 25 bp, Mus musculus
gaaaatggaatgtcccttctaccac

SEQ ID NO: 404185 - DNA, 25 bp, Mus musculus
gaaaatggacctacgtcactcaagc

SEQ ID NO: 404186 - DNA, 25 bp, Mus musculus
gaaaatggaccttcgtcactcaagc

SEQ ID NO: 404187 - DNA, 25 bp, Mus musculus
gaaaatggactcatcaaaactgaca

SEQ ID NO: 404188 - DNA, 25 bp, Mus musculus
gaaaatggactcttcaaaactgaca

SEQ ID NO: 404189 - DNA, 25 bp, Mus musculus
gaaaatggatggacgctgaggtact

SEQ ID NO: 404190 - DNA, 25 bp, Mus musculus
gaaaatggatggtcgctgaggtact

SEQ ID NO: 404191 - DNA, 25 bp, Mus musculus
gaaaatggatttaagaactctccca

SEQ ID NO: 404192 - DNA, 25 bp, Mus musculus
gaaaatggattttagaactctccca

SEQ ID NO: 404193 - DNA, 25 bp, Mus musculus
gaaaatggcaatcctgttgctgggt

SEQ ID NO: 404194 - DNA, 25 bp, Mus musculus
gaaaatggcaatgctgttgctgggt

SEQ ID NO: 404195 - DNA, 25 bp, Mus musculus
gaaaatggcacaaaatgcttttatt

SEQ ID NO: 404196 - DNA, 25 bp, Mus musculus
gaaaatggcacataatgcttttatt

SEQ ID NO: 404197 - DNA, 25 bp, Mus musculus
gaaaatggcacccaagtctacattg

SEQ ID NO: 404198 - DNA, 25 bp, Mus musculus
gaaaatggcaccgaagtctacattg

SEQ ID NO: 404199 - DNA, 25 bp, Mus musculus
gaaaatggcagtattagcacctttt

SEQ ID NO: 404200 - DNA, 25 bp, Mus musculus
gaaaatggcagttttagcacctttt

SEQ ID NO: 404201 - DNA, 25 bp, Mus musculus
gaaaatggcctccaaaggatcaaag

SEQ ID NO: 404202 - DNA, 25 bp, Mus musculus
gaaaatggcctcgaaaggatcaaag

SEQ ID NO: 404203 - DNA, 25 bp, Mus musculus
gaaaatggcttgctgtccttgatca

SEQ ID NO: 404204 - DNA, 25 bp, Mus musculus
gaaaatggcttggtgtccttgatca

SEQ ID NO: 404205 - DNA, 25 bp, Mus musculus
gaaaatggctttactaccgttctct

SEQ ID NO: 404206 - DNA, 25 bp, Mus musculus
gaaaatggcttttctaccgttctct

SEQ ID NO: 404207 - DNA, 25 bp, Mus musculus
gaaaatgggcatatacacagggaca

SEQ ID NO: 404208 - DNA, 25 bp, Mus musculus
gaaaatgggcatttacacagggaca

SEQ ID NO: 404209 - DNA, 25 bp, Mus musculus
gaaaatgggcctctacttgtcatca

SEQ ID NO: 404210 - DNA, 25 bp, Mus musculus
gaaaatgggcctgtacttgtcatca

SEQ ID NO: 404211 - DNA, 25 bp, Mus musculus
gaaaatgggtgcacctttccgacct

SEQ ID NO: 404212 - DNA, 25 bp, Mus musculus
gaaaatgggtgctcctttccgacct

SEQ ID NO: 404213 - DNA, 25 bp, Mus musculus
gaaaatggtcctctctataactcat

SEQ ID NO: 404214 - DNA, 25 bp, Mus musculus
gaaaatggtcctgtctataactcat

SEQ ID NO: 404215 - DNA, 25 bp, Mus musculus
gaaaatggtcttcagcatacacgga

SEQ ID NO: 404216 - DNA, 25 bp, Mus musculus
gaaaatggtcttgagcatacacgga

SEQ ID NO: 404217 - DNA, 25 bp, Mus musculus
gaaaatggtgtccatactttatggt

SEQ ID NO: 404218 - DNA, 25 bp, Mus musculus
gaaaatggtgtcgatactttatggt

SEQ ID NO: 404219 - DNA, 25 bp, Mus musculus
gaaaatgtaaagattcccctgagta

SEQ ID NO: 404220 - DNA, 25 bp, Mus musculus
gaaaatgtaaagtttcccctgagta

SEQ ID NO: 404221 - DNA, 25 bp, Mus musculus
gaaaatgtacacagtccacccaaag

SEQ ID NO: 404222 - DNA, 25 bp, Mus musculus
gaaaatgtacactgtccacccaaag

SEQ ID NO: 404223 - DNA, 25 bp, Mus musculus
gaaaatgtacctacagatgtatgga

SEQ ID NO: 404224 - DNA, 25 bp, Mus musculus
gaaaatgtacctatccaatggctaa

SEQ ID NO: 404225 - DNA, 25 bp, Mus musculus
gaaaatgtacctctttcccttctat

SEQ ID NO: 404226 - DNA, 25 bp, Mus musculus
gaaaatgtacctgtttcccttctat

SEQ ID NO: 404227 - DNA, 25 bp, Mus musculus
gaaaatgtaccttcagatgtatgga

SEQ ID NO: 404228 - DNA, 25 bp, Mus musculus
gaaaatgtacctttccaatggctaa

SEQ ID NO: 404229 - DNA, 25 bp, Mus musculus
gaaaatgtacttactcactgacccc

SEQ ID NO: 404230 - DNA, 25 bp, Mus musculus
gaaaatgtactttctcactgacccc

SEQ ID NO: 404231 - DNA, 25 bp, Mus musculus
gaaaatgtcacaaccagcaagcaat

SEQ ID NO: 404232 - DNA, 25 bp, Mus musculus
gaaaatgtcacatccagcaagcaat

SEQ ID NO: 404233 - DNA, 25 bp, Mus musculus
gaaaatgtcagccatgctcataaat

SEQ ID NO: 404234 - DNA, 25 bp, Mus musculus
gaaaatgtcagcgatgctcataaat

SEQ ID NO: 404235 - DNA, 25 bp, Mus musculus
gaaaatgtcatacgatgtcatccga

SEQ ID NO: 404236 - DNA, 25 bp, Mus musculus
gaaaatgtcatacgccaggcacagt

SEQ ID NO: 404237 - DNA, 25 bp, Mus musculus
gaaaatgtcataggatgtcatccga

SEQ ID NO: 404238 - DNA, 25 bp, Mus musculus
gaaaatgtcataggccaggcacagt

SEQ ID NO: 404239 - DNA, 25 bp, Mus musculus
gaaaatgtccaaacacatcctgctt

SEQ ID NO: 404240 - DNA, 25 bp, Mus musculus
gaaaatgtccaatcacatcctgctt

SEQ ID NO: 404241 - DNA, 25 bp, Mus musculus
gaaaatgtccacactgtcattctag

SEQ ID NO: 404242 - DNA, 25 bp, Mus musculus
gaaaatgtccactctgtcattctag

SEQ ID NO: 404243 - DNA, 25 bp, Mus musculus
gaaaatgtcccgatagcccttccag

SEQ ID NO: 404244 - DNA, 25 bp, Mus musculus
gaaaatgtcccgttagcccttccag

SEQ ID NO: 404245 - DNA, 25 bp, Mus musculus
gaaaatgtccctctgcttacattct

SEQ ID NO: 404246 - DNA, 25 bp, Mus musculus
gaaaatgtccctgtgcttacattct

SEQ ID NO: 404247 - DNA, 25 bp, Mus musculus
gaaaatgtccgccttttgtgctcac

SEQ ID NO: 404248 - DNA, 25 bp, Mus musculus
gaaaatgtccgcgttttgtgctcac

SEQ ID NO: 404249 - DNA, 25 bp, Mus musculus
gaaaatgtcctcatcatctttggga

SEQ ID NO: 404250 - DNA, 25 bp, Mus musculus
gaaaatgtcctcttcatctttggga

SEQ ID NO: 404251 - DNA, 25 bp, Mus musculus
gaaaatgtctacaacacagtcccct

SEQ ID NO: 404252 - DNA, 25 bp, Mus musculus
gaaaatgtctactacacagtcccct

SEQ ID NO: 404253 - DNA, 25 bp, Mus musculus
gaaaatgtctcaagtagcaccccgt

SEQ ID NO: 404254 - DNA, 25 bp, Mus musculus
gaaaatgtctcatgtagcaccccgt

SEQ ID NO: 404255 - DNA, 25 bp, Mus musculus
gaaaatgtctgaaaggccctgtggt

SEQ ID NO: 404256 - DNA, 25 bp, Mus musculus
gaaaatgtctgataggccctgtggt

SEQ ID NO: 404257 - DNA, 25 bp, Mus musculus
gaaaatgtcttgatagtttgctatt

SEQ ID NO: 404258 - DNA, 25 bp, Mus musculus
gaaaatgtcttgttagtttgctatt

SEQ ID NO: 404259 - DNA, 25 bp, Mus musculus
gaaaatgtgaaaaggcctctgcccc

SEQ ID NO: 404260 - DNA, 25 bp, Mus musculus
gaaaatgtgaaatggcctctgcccc

SEQ ID NO: 404261 - DNA, 25 bp, Mus musculus
gaaaatgtgacaagcaagaggtcaa

SEQ ID NO: 404262 - DNA, 25 bp, Mus musculus
gaaaatgtgacatgcaagaggtcaa

SEQ ID NO: 404263 - DNA, 25 bp, Mus musculus
gaaaatgtgctcagcgttaccttag

SEQ ID NO: 404264 - DNA, 25 bp, Mus musculus
gaaaatgtgctctgcgttaccttag

SEQ ID NO: 404265 - DNA, 25 bp, Mus musculus
gaaaatgtggccatagtctcatatt

SEQ ID NO: 404266 - DNA, 25 bp, Mus musculus
gaaaatgtggccttagtctcatatt

SEQ ID NO: 404267 - DNA, 25 bp, Mus musculus
gaaaatgtgggtattgtgtgaactg

SEQ ID NO: 404268 - DNA, 25 bp, Mus musculus
gaaaatgtgggttttgtgtgaactg

SEQ ID NO: 404269 - DNA, 25 bp, Mus musculus
gaaaatgtgtagatcaccctgtaga

SEQ ID NO: 404270 - DNA, 25 bp, Mus musculus
gaaaatgtgtagttcaccctgtaga

SEQ ID NO: 404271 - DNA, 25 bp, Mus musculus
gaaaatgtgtggctctccttgagat

SEQ ID NO: 404272 - DNA, 25 bp, Mus musculus
gaaaatgtgtgggtctccttgagat

SEQ ID NO: 404273 - DNA, 25 bp, Mus musculus
gaaaatgttacacgtttaatatatc

SEQ ID NO: 404274 - DNA, 25 bp, Mus musculus
gaaaatgttacaggtttaatatatc

SEQ ID NO: 404275 - DNA, 25 bp, Mus musculus
gaaaatgttccccactcctaatgga

SEQ ID NO: 404276 - DNA, 25 bp, Mus musculus
gaaaatgttcccgactcctaatgga

SEQ ID NO: 404277 - DNA, 25 bp, Mus musculus
gaaaatgttgatccacagccccagt

SEQ ID NO: 404278 - DNA, 25 bp, Mus musculus
gaaaatgttgatgcacagccccagt

SEQ ID NO: 404279 - DNA, 25 bp, Mus musculus
gaaaatgttgctagagtctcacctt

SEQ ID NO: 404280 - DNA, 25 bp, Mus musculus
gaaaatgttgcttgagtctcacctt

SEQ ID NO: 404281 - DNA, 25 bp, Mus musculus
gaaaatgttggcagcccttgtcctg

SEQ ID NO: 404282 - DNA, 25 bp, Mus musculus
gaaaatgttggctgcccttgtcctg

SEQ ID NO: 404283 - DNA, 25 bp, Mus musculus
gaaaatgttgtcctagatgcaaact

SEQ ID NO: 404284 - DNA, 25 bp, Mus musculus
gaaaatgttgtcgtagatgcaaact

SEQ ID NO: 404285 - DNA, 25 bp, Mus musculus
gaaaatgttgttcctaacccaccag

SEQ ID NO: 404286 - DNA, 25 bp, Mus musculus
gaaaatgttgttgctaacccaccag

SEQ ID NO: 404287 - DNA, 25 bp, Mus musculus
gaaaatgtttctctgcaattggtac

SEQ ID NO: 404288 - DNA, 25 bp, Mus musculus
gaaaatgtttctgtgcaattggtac

SEQ ID NO: 404289 - DNA, 25 bp, Mus musculus
gaaaatgttttaactcacgactgag

SEQ ID NO: 404290 - DNA, 25 bp, Mus musculus
gaaaatgttttatctcacgactgag

SEQ ID NO: 404291 - DNA, 25 bp, Mus musculus
gaaaattaaagcatcgctccctcct

SEQ ID NO: 404292 - DNA, 25 bp, Mus musculus
gaaaattaaagcttcgctccctcct

SEQ ID NO: 404293 - DNA, 25 bp, Mus musculus
gaaaattaacttcgtttgtgcctga

SEQ ID NO: 404294 - DNA, 25 bp, Mus musculus
gaaaattaacttggtttgtgcctga

SEQ ID NO: 404295 - DNA, 25 bp, Mus musculus
gaaaattacaacactagtgcctaca

SEQ ID NO: 404296 - DNA, 25 bp, Mus musculus
gaaaattacaactctagtgcctaca

SEQ ID NO: 404297 - DNA, 25 bp, Mus musculus
gaaaattacagcacagcgtgccaga

SEQ ID NO: 404298 - DNA, 25 bp, Mus musculus
gaaaattacagctcagcgtgccaga

SEQ ID NO: 404299 - DNA, 25 bp, Mus musculus
gaaaattaccagctccttgaacaag

SEQ ID NO: 404300 - DNA, 25 bp, Mus musculus
gaaaattaccaggtccttgaacaag

SEQ ID NO: 404301 - DNA, 25 bp, Mus musculus
gaaaattactacattcaagggcttt

SEQ ID NO: 404302 - DNA, 25 bp, Mus musculus
gaaaattactactttcaagggcttt

SEQ ID NO: 404303 - DNA, 25 bp, Mus musculus
gaaaattactgacccacagtagcat

SEQ ID NO: 404304 - DNA, 25 bp, Mus musculus
gaaaattactgagccacagtagcat

SEQ ID NO: 404305 - DNA, 25 bp, Mus musculus
gaaaattaggttctgcttccactgc

SEQ ID NO: 404306 - DNA, 25 bp, Mus musculus
gaaaattaggttgtgcttccactgc

SEQ ID NO: 404307 - DNA, 25 bp, Mus musculus
gaaaattagtcacacggccccggag

SEQ ID NO: 404308 - DNA, 25 bp, Mus musculus
gaaaattagtcagacggccccggag

SEQ ID NO: 404309 - DNA, 25 bp, Mus musculus
gaaaattattttctagttcatagtt

SEQ ID NO: 404310 - DNA, 25 bp, Mus musculus
gaaaattattttgtagttcatagtt

SEQ ID NO: 404311 - DNA, 25 bp, Mus musculus
gaaaattcaactaggatgcaactga

SEQ ID NO: 404312 - DNA, 25 bp, Mus musculus
gaaaattcaacttggatgcaactga

SEQ ID NO: 404313 - DNA, 25 bp, Mus musculus
gaaaattcacctaggagtccgacat

SEQ ID NO: 404314 - DNA, 25 bp, Mus musculus
gaaaattcaccttggagtccgacat

SEQ ID NO: 404315 - DNA, 25 bp, Mus musculus
gaaaattcactacgcttcctgctgc

SEQ ID NO: 404316 - DNA, 25 bp, Mus musculus
gaaaattcactaggcttcctgctgc

SEQ ID NO: 404317 - DNA, 25 bp, Mus musculus
gaaaattcagtcagtcacaaactgg

SEQ ID NO: 404318 - DNA, 25 bp, Mus musculus
gaaaattcagtctgtcacaaactgg

SEQ ID NO: 404319 - DNA, 25 bp, Mus musculus
gaaaattcagttatatcgtcccagg

SEQ ID NO: 404320 - DNA, 25 bp, Mus musculus
gaaaattcagttttatcgtcccagg

SEQ ID NO: 404321 - DNA, 25 bp, Mus musculus
gaaaattcatccacagctcactgat

SEQ ID NO: 404322 - DNA, 25 bp, Mus musculus
gaaaattcatcctcagctcactgat

SEQ ID NO: 404323 - DNA, 25 bp, Mus musculus
gaaaattcatctagacctcatgcta

SEQ ID NO: 404324 - DNA, 25 bp, Mus musculus
gaaaattcatcttgacctcatgcta

SEQ ID NO: 404325 - DNA, 25 bp, Mus musculus
gaaaattcatggcacttcgtacacc

SEQ ID NO: 404326 - DNA, 25 bp, Mus musculus
gaaaattcatgggacttcgtacacc

SEQ ID NO: 404327 - DNA, 25 bp, Mus musculus
gaaaattcattaccttgttcttgga

SEQ ID NO: 404328 - DNA, 25 bp, Mus musculus
gaaaattcattagcttgttcttgga

SEQ ID NO: 404329 - DNA, 25 bp, Mus musculus
gaaaattcatttcaccttatcagag

SEQ ID NO: 404330 - DNA, 25 bp, Mus musculus
gaaaattcatttgaccttatcagag

SEQ ID NO: 404331 - DNA, 25 bp, Mus musculus
gaaaattccagcatacagaggacac

SEQ ID NO: 404332 - DNA, 25 bp, Mus musculus
gaaaattccagcttacagaggacac

SEQ ID NO: 404333 - DNA, 25 bp, Mus musculus
gaaaattccatgctttatatgtagt

SEQ ID NO: 404334 - DNA, 25 bp, Mus musculus
gaaaattccatggtttatatgtagt

SEQ ID NO: 404335 - DNA, 25 bp, Mus musculus
gaaaattcctctctctttacaaatg

SEQ ID NO: 404336 - DNA, 25 bp, Mus musculus
gaaaattcctctgtctttacaaatg

SEQ ID NO: 404337 - DNA, 25 bp, Mus musculus
gaaaattcctgaccattatgactgt

SEQ ID NO: 404338 - DNA, 25 bp, Mus musculus
gaaaattcctgagcattatgactgt

SEQ ID NO: 404339 - DNA, 25 bp, Mus musculus
gaaaattcctgtctttacagactgt

SEQ ID NO: 404340 - DNA, 25 bp, Mus musculus
gaaaattcctgtgtttacagactgt

SEQ ID NO: 404341 - DNA, 25 bp, Mus musculus
gaaaattcctttcacttagaacttg

SEQ ID NO: 404342 - DNA, 25 bp, Mus musculus
gaaaattcctttgacttagaacttg

SEQ ID NO: 404343 - DNA, 25 bp, Mus musculus
gaaaattctactctgaaacctcttg

SEQ ID NO: 404344 - DNA, 25 bp, Mus musculus
gaaaattctactgtgaaacctcttg

SEQ ID NO: 404345 - DNA, 25 bp, Mus musculus
gaaaattctatgacccagtagagag

SEQ ID NO: 404346 - DNA, 25 bp, Mus musculus
gaaaattctatgtcccagtagagag

SEQ ID NO: 404347 - DNA, 25 bp, Mus musculus
gaaaattctcaaatcaccaatatga

SEQ ID NO: 404348 - DNA, 25 bp, Mus musculus
gaaaattctcaattcaccaatatga

SEQ ID NO: 404349 - DNA, 25 bp, Mus musculus
gaaaattctctcatgaagttcggag

SEQ ID NO: 404350 - DNA, 25 bp, Mus musculus
gaaaattctctcttgaagttcggag

SEQ ID NO: 404351 - DNA, 25 bp, Mus musculus
gaaaattctctgctataccaatata

SEQ ID NO: 404352 - DNA, 25 bp, Mus musculus
gaaaattctctggtataccaatata

SEQ ID NO: 404353 - DNA, 25 bp, Mus musculus
gaaaattctcttcctagtatttatg

SEQ ID NO: 404354 - DNA, 25 bp, Mus musculus
gaaaattctcttgctagtatttatg

SEQ ID NO: 404355 - DNA, 25 bp, Mus musculus
gaaaattctgcaaactgacccacat

SEQ ID NO: 404356 - DNA, 25 bp, Mus musculus
gaaaattctgcaatcttcgtgtgat

SEQ ID NO: 404357 - DNA, 25 bp, Mus musculus
gaaaattctgcatactgacccacat

SEQ ID NO: 404358 - DNA, 25 bp, Mus musculus
gaaaattctgcattcttcgtgtgat

SEQ ID NO: 404359 - DNA, 25 bp, Mus musculus
gaaaattctgctatggaccgggcgt

SEQ ID NO: 404360 - DNA, 25 bp, Mus musculus
gaaaattctgctttggaccgggcgt

SEQ ID NO: 404361 - DNA, 25 bp, Mus musculus
gaaaattcttctatcctatcggagc

SEQ ID NO: 404362 - DNA, 25 bp, Mus musculus
gaaaattcttctttcctatcggagc

SEQ ID NO: 404363 - DNA, 25 bp, Mus musculus
gaaaattgaaatcagccagcacgcc

SEQ ID NO: 404364 - DNA, 25 bp, Mus musculus
gaaaattgaaatgagccagcacgcc

SEQ ID NO: 404365 - DNA, 25 bp, Mus musculus
gaaaattgaactaccaacacaactc

SEQ ID NO: 404366 - DNA, 25 bp, Mus musculus
gaaaattgaacttccaacacaactc

SEQ ID NO: 404367 - DNA, 25 bp, Mus musculus
gaaaattgaatactggcactccatc

SEQ ID NO: 404368 - DNA, 25 bp, Mus musculus
gaaaattgaatagtggcactccatc

SEQ ID NO: 404369 - DNA, 25 bp, Mus musculus
gaaaattgagatctgaagcgttgac

SEQ ID NO: 404370 - DNA, 25 bp, Mus musculus
gaaaattgagatgtgaagcgttgac

SEQ ID NO: 404371 - DNA, 25 bp, Mus musculus
gaaaattgcaggatcgagtccaact

SEQ ID NO: 404372 - DNA, 25 bp, Mus musculus
gaaaattgcaggttcgagtccaact

SEQ ID NO: 404373 - DNA, 25 bp, Mus musculus
gaaaattgccatccagctgtgtcta

SEQ ID NO: 404374 - DNA, 25 bp, Mus musculus
gaaaattgccatgcagctgtgtcta

SEQ ID NO: 404375 - DNA, 25 bp, Mus musculus
gaaaattgctttcatcgcgcatgac

SEQ ID NO: 404376 - DNA, 25 bp, Mus musculus
gaaaattgctttgatcgcgcatgac

SEQ ID NO: 404377 - DNA, 25 bp, Mus musculus
gaaaattggcgactctctgctagat

SEQ ID NO: 404378 - DNA, 25 bp, Mus musculus
gaaaattggcgagtctctgctagat

SEQ ID NO: 404379 - DNA, 25 bp, Mus musculus
gaaaattggttcaccaacttccctg

SEQ ID NO: 404380 - DNA, 25 bp, Mus musculus
gaaaattggttctccaacttccctg

SEQ ID NO: 404381 - DNA, 25 bp, Mus musculus
gaaaattggtttatgcatagtctgc

SEQ ID NO: 404382 - DNA, 25 bp, Mus musculus
gaaaattggtttttgcatagtctgc

SEQ ID NO: 404383 - DNA, 25 bp, Mus musculus
gaaaattgtcacagaccccataggt

SEQ ID NO: 404384 - DNA, 25 bp, Mus musculus
gaaaattgtcactgaccccataggt

SEQ ID NO: 404385 - DNA, 25 bp, Mus musculus
gaaaattgtcgcactgtttgaatta

SEQ ID NO: 404386 - DNA, 25 bp, Mus musculus
gaaaattgtcgctctgtttgaatta

SEQ ID NO: 404387 - DNA, 25 bp, Mus musculus
gaaaattgtcggagatctggcctcc

SEQ ID NO: 404388 - DNA, 25 bp, Mus musculus
gaaaattgtcggtgatctggcctcc

SEQ ID NO: 404389 - DNA, 25 bp, Mus musculus
gaaaattgtgccaaagcctacatac

SEQ ID NO: 404390 - DNA, 25 bp, Mus musculus
gaaaattgtgcctaagcctacatac

SEQ ID NO: 404391 - DNA, 25 bp, Mus musculus
gaaaatttacacagacctaccagag

SEQ ID NO: 404392 - DNA, 25 bp, Mus musculus
gaaaatttacactgacctaccagag

SEQ ID NO: 404393 - DNA, 25 bp, Mus musculus
gaaaatttaccaatctttcctgctt

SEQ ID NO: 404394 - DNA, 25 bp, Mus musculus
gaaaatttaccattctttcctgctt

SEQ ID NO: 404395 - DNA, 25 bp, Mus musculus
gaaaatttaccccctgcccatctat

SEQ ID NO: 404396 - DNA, 25 bp, Mus musculus
gaaaatttacccgctgcccatctat

SEQ ID NO: 404397 - DNA, 25 bp, Mus musculus
gaaaatttagcgacctctgtcccca

SEQ ID NO: 404398 - DNA, 25 bp, Mus musculus
gaaaatttagcgtcctctgtcccca

SEQ ID NO: 404399 - DNA, 25 bp, Mus musculus
gaaaatttatgacctacagacctac

SEQ ID NO: 404400 - DNA, 25 bp, Mus musculus
gaaaatttatgagctacagacctac

SEQ ID NO: 404401 - DNA, 25 bp, Mus musculus
gaaaatttatgcaccttccccagat

SEQ ID NO: 404402 - DNA, 25 bp, Mus musculus
gaaaatttatgctccttccccagat

SEQ ID NO: 404403 - DNA, 25 bp, Mus musculus
gaaaatttcagaagccgacaggtgt

SEQ ID NO: 404404 - DNA, 25 bp, Mus musculus
gaaaatttcagatgccgacaggtgt

SEQ ID NO: 404405 - DNA, 25 bp, Mus musculus
gaaaatttcatacctgccagtcatt

SEQ ID NO: 404406 - DNA, 25 bp, Mus musculus
gaaaatttcatagctgccagtcatt

SEQ ID NO: 404407 - DNA, 25 bp, Mus musculus
gaaaatttccgtataaccagtgaag

SEQ ID NO: 404408 - DNA, 25 bp, Mus musculus
gaaaatttccgtttaaccagtgaag

SEQ ID NO: 404409 - DNA, 25 bp, Mus musculus
gaaaatttcctaatctgtaagacag

SEQ ID NO: 404410 - DNA, 25 bp, Mus musculus
gaaaatttcctattctgtaagacag

SEQ ID NO: 404411 - DNA, 25 bp, Mus musculus
gaaaatttctgaactgtgccacaat

SEQ ID NO: 404412 - DNA, 25 bp, Mus musculus
gaaaatttctgatctgtgccacaat

SEQ ID NO: 404413 - DNA, 25 bp, Mus musculus
gaaaatttctttagcaaccttagag

SEQ ID NO: 404414 - DNA, 25 bp, Mus musculus
gaaaatttcttttgcaaccttagag

SEQ ID NO: 404415 - DNA, 25 bp, Mus musculus
gaaaatttgaagcatacctttttgg

SEQ ID NO: 404416 - DNA, 25 bp, Mus musculus
gaaaatttgaaggatacctttttgg

SEQ ID NO: 404417 - DNA, 25 bp, Mus musculus
gaaaatttgcaactaactttgtgct

SEQ ID NO: 404418 - DNA, 25 bp, Mus musculus
gaaaatttgcaagtaactttgtgct

SEQ ID NO: 404419 - DNA, 25 bp, Mus musculus
gaaaatttgctaatgggaaacagta

SEQ ID NO: 404420 - DNA, 25 bp, Mus musculus
gaaaatttgctattgggaaacagta

SEQ ID NO: 404421 - DNA, 25 bp, Mus musculus
gaaaatttgtcccagaagaagcatc

SEQ ID NO: 404422 - DNA, 25 bp, Mus musculus
gaaaatttgtccgagaagaagcatc

SEQ ID NO: 404423 - DNA, 25 bp, Mus musculus
gaaaatttgttcacaacgggctgca

SEQ ID NO: 404424 - DNA, 25 bp, Mus musculus
gaaaatttgttctcaacgggctgca

SEQ ID NO: 404425 - DNA, 25 bp, Mus musculus
gaaaatttgtttctgaacctgaaga

SEQ ID NO: 404426 - DNA, 25 bp, Mus musculus
gaaaatttgtttgtgaacctgaaga

SEQ ID NO: 404427 - DNA, 25 bp, Mus musculus
gaaaattttacccagtgcttgaaat

SEQ ID NO: 404428 - DNA, 25 bp, Mus musculus
gaaaattttaccgagtgcttgaaat

SEQ ID NO: 404429 - DNA, 25 bp, Mus musculus
gaaaattttcatctgtagacttcga

SEQ ID NO: 404430 - DNA, 25 bp, Mus musculus
gaaaattttcatgtgtagacttcga

SEQ ID NO: 404431 - DNA, 25 bp, Mus musculus
gaaaattttcgacacgttgtccaca

SEQ ID NO: 404432 - DNA, 25 bp, Mus musculus
gaaaattttcgagacgttgtccaca

SEQ ID NO: 404433 - DNA, 25 bp, Mus musculus
gaaaattttcttagatgacacacac

SEQ ID NO: 404434 - DNA, 25 bp, Mus musculus
gaaaattttctttgatgacacacac

SEQ ID NO: 404435 - DNA, 25 bp, Mus musculus
gaaaattttgcaacaccatctcctc

SEQ ID NO: 404436 - DNA, 25 bp, Mus musculus
gaaaattttgcatcaccatctcctc

SEQ ID NO: 404437 - DNA, 25 bp, Mus musculus
gaaaattttgccaactataacaata

SEQ ID NO: 404438 - DNA, 25 bp, Mus musculus
gaaaattttgcctactataacaata

SEQ ID NO: 404439 - DNA, 25 bp, Mus musculus
gaaacaaaacttagctccatgaaac

SEQ ID NO: 404440 - DNA, 25 bp, Mus musculus
gaaacaaaactttgctccatgaaac

SEQ ID NO: 404441 - DNA, 25 bp, Mus musculus
gaaacaaaagccaaccagttactga

SEQ ID NO: 404442 - DNA, 25 bp, Mus musculus
gaaacaaaagcctaccagttactga

SEQ ID NO: 404443 - DNA, 25 bp, Mus musculus
gaaacaaaatctagactcagagcag

SEQ ID NO: 404444 - DNA, 25 bp, Mus musculus
gaaacaaaatcttgactcagagcag

SEQ ID NO: 404445 - DNA, 25 bp, Mus musculus
gaaacaaacagtctgggcgtgcact

SEQ ID NO: 404446 - DNA, 25 bp, Mus musculus
gaaacaaacagtgtgggcgtgcact

SEQ ID NO: 404447 - DNA, 25 bp, Mus musculus
gaaacaaaccaactgtccatcaaaa

SEQ ID NO: 404448 - DNA, 25 bp, Mus musculus
gaaacaaaccaagtgtccatcaaaa

SEQ ID NO: 404449 - DNA, 25 bp, Mus musculus
gaaacaaaccagagaggccccacgg

SEQ ID NO: 404450 - DNA, 25 bp, Mus musculus
gaaacaaaccagaggcacttcaaga

SEQ ID NO: 404451 - DNA, 25 bp, Mus musculus
gaaacaaaccagtgaggccccacgg

SEQ ID NO: 404452 - DNA, 25 bp, Mus musculus
gaaacaaaccagtggcacttcaaga

SEQ ID NO: 404453 - DNA, 25 bp, Mus musculus
gaaacaaaccccagagcaggcagct

SEQ ID NO: 404454 - DNA, 25 bp, Mus musculus
gaaacaaacccctgagcaggcagct

SEQ ID NO: 404455 - DNA, 25 bp, Mus musculus
gaaacaaactgtaattagcttagaa

SEQ ID NO: 404456 - DNA, 25 bp, Mus musculus
gaaacaaactgttattagcttagaa

SEQ ID NO: 404457 - DNA, 25 bp, Mus musculus
gaaacaaacttaagattggccctgt

SEQ ID NO: 404458 - DNA, 25 bp, Mus musculus
gaaacaaacttatgattggccctgt

SEQ ID NO: 404459 - DNA, 25 bp, Mus musculus
gaaacaaactttacttcagagtctt

SEQ ID NO: 404460 - DNA, 25 bp, Mus musculus
gaaacaaacttttcttcagagtctt

SEQ ID NO: 404461 - DNA, 25 bp, Mus musculus
gaaacaaagacgcttctggccgctg

SEQ ID NO: 404462 - DNA, 25 bp, Mus musculus
gaaacaaagacggttctggccgctg

SEQ ID NO: 404463 - DNA, 25 bp, Mus musculus
gaaacaaagcagaaattaacaacat

SEQ ID NO: 404464 - DNA, 25 bp, Mus musculus
gaaacaaagcagctgtcttccggtc

SEQ ID NO: 404465 - DNA, 25 bp, Mus musculus
gaaacaaagcaggtgtcttccggtc

SEQ ID NO: 404466 - DNA, 25 bp, Mus musculus
gaaacaaagcagtaattaacaacat

SEQ ID NO: 404467 - DNA, 25 bp, Mus musculus
gaaacaaagccaagcatgtcagctc

SEQ ID NO: 404468 - DNA, 25 bp, Mus musculus
gaaacaaagccatgcatgtcagctc

SEQ ID NO: 404469 - DNA, 25 bp, Mus musculus
gaaacaaagcccaagtccacgtaat

SEQ ID NO: 404470 - DNA, 25 bp, Mus musculus
gaaacaaagccctagtccacgtaat

SEQ ID NO: 404471 - DNA, 25 bp, Mus musculus
gaaacaaagctaactctcttaggta

SEQ ID NO: 404472 - DNA, 25 bp, Mus musculus
gaaacaaagctatctctcttaggta

SEQ ID NO: 404473 - DNA, 25 bp, Mus musculus
gaaacaaagtggattaggcttgcct

SEQ ID NO: 404474 - DNA, 25 bp, Mus musculus
gaaacaaagtggtttaggcttgcct

SEQ ID NO: 404475 - DNA, 25 bp, Mus musculus
gaaacaaagtttacagacgagctct

SEQ ID NO: 404476 - DNA, 25 bp, Mus musculus
gaaacaaagttttcagacgagctct

SEQ ID NO: 404477 - DNA, 25 bp, Mus musculus
gaaacaaatccaaccacagagccag

SEQ ID NO: 404478 - DNA, 25 bp, Mus musculus
gaaacaaatccatccacagagccag

SEQ ID NO: 404479 - DNA, 25 bp, Mus musculus
gaaacaaattacatcccgtgcactt

SEQ ID NO: 404480 - DNA, 25 bp, Mus musculus
gaaacaaattacttcccgtgcactt

SEQ ID NO: 404481 - DNA, 25 bp, Mus musculus
gaaacaaattgacagcttgcttcat

SEQ ID NO: 404482 - DNA, 25 bp, Mus musculus
gaaacaaattgagagcttgcttcat

SEQ ID NO: 404483 - DNA, 25 bp, Mus musculus
gaaacaaattgtcggactccttcct

SEQ ID NO: 404484 - DNA, 25 bp, Mus musculus
gaaacaaattgtgggactccttcct

SEQ ID NO: 404485 - DNA, 25 bp, Mus musculus
gaaacaacaaggcatcatatcatac

SEQ ID NO: 404486 - DNA, 25 bp, Mus musculus
gaaacaacaagggatcatatcatac

SEQ ID NO: 404487 - DNA, 25 bp, Mus musculus
gaaacaacaccacagacttcttttg

SEQ ID NO: 404488 - DNA, 25 bp, Mus musculus
gaaacaacaccagagacttcttttg

SEQ ID NO: 404489 - DNA, 25 bp, Mus musculus
gaaacaacactaagcacttcccctg

SEQ ID NO: 404490 - DNA, 25 bp, Mus musculus
gaaacaacactatgcacttcccctg

SEQ ID NO: 404491 - DNA, 25 bp, Mus musculus
gaaacaacactgcatattaggttaa

SEQ ID NO: 404492 - DNA, 25 bp, Mus musculus
gaaacaacactggatattaggttaa

SEQ ID NO: 404493 - DNA, 25 bp, Mus musculus
gaaacaacagatctctacgatcgga

SEQ ID NO: 404494 - DNA, 25 bp, Mus musculus
gaaacaacagatgtctacgatcgga

SEQ ID NO: 404495 - DNA, 25 bp, Mus musculus
gaaacaacagccactgcagcaacag

SEQ ID NO: 404496 - DNA, 25 bp, Mus musculus
gaaacaacagccagctgctagagct

SEQ ID NO: 404497 - DNA, 25 bp, Mus musculus
gaaacaacagcctctgcagcaacag

SEQ ID NO: 404498 - DNA, 25 bp, Mus musculus
gaaacaacagcctgctgctagagct

SEQ ID NO: 404499 - DNA, 25 bp, Mus musculus
gaaacaacaggccaaacatatttgc

SEQ ID NO: 404500 - DNA, 25 bp, Mus musculus
gaaacaacaggcgaaacatatttgc

SEQ ID NO: 404501 - DNA, 25 bp, Mus musculus
gaaacaaccactcgagacgctccga

SEQ ID NO: 404502 - DNA, 25 bp, Mus musculus
gaaacaaccactggagacgctccga

SEQ ID NO: 404503 - DNA, 25 bp, Mus musculus
gaaacaacccagacagattcttgat

SEQ ID NO: 404504 - DNA, 25 bp, Mus musculus
gaaacaacccagcaacgcaggaaga

SEQ ID NO: 404505 - DNA, 25 bp, Mus musculus
gaaacaacccaggaacgcaggaaga

SEQ ID NO: 404506 - DNA, 25 bp, Mus musculus
gaaacaacccagtcagattcttgat

SEQ ID NO: 404507 - DNA, 25 bp, Mus musculus
gaaacaacctatcacctaggtctga

SEQ ID NO: 404508 - DNA, 25 bp, Mus musculus
gaaacaacctatgacctaggtctga

SEQ ID NO: 404509 - DNA, 25 bp, Mus musculus
gaaacaactgatcatgcttacatat

SEQ ID NO: 404510 - DNA, 25 bp, Mus musculus
gaaacaactgatgatgcttacatat

SEQ ID NO: 404511 - DNA, 25 bp, Mus musculus
gaaacaactggtcccctgttcctac

SEQ ID NO: 404512 - DNA, 25 bp, Mus musculus
gaaacaactggtgccctgttcctac

SEQ ID NO: 404513 - DNA, 25 bp, Mus musculus
gaaacaacttgtcatctggaggaca

SEQ ID NO: 404514 - DNA, 25 bp, Mus musculus
gaaacaacttgtgatctggaggaca

SEQ ID NO: 404515 - DNA, 25 bp, Mus musculus
gaaacaactttgctggagactacag

SEQ ID NO: 404516 - DNA, 25 bp, Mus musculus
gaaacaactttggtggagactacag

SEQ ID NO: 404517 - DNA, 25 bp, Mus musculus
gaaacaacttttcctcttcgagctg

SEQ ID NO: 404518 - DNA, 25 bp, Mus musculus
gaaacaacttttgctcttcgagctg

SEQ ID NO: 404519 - DNA, 25 bp, Mus musculus
gaaacaagaaggatggctgccagta

SEQ ID NO: 404520 - DNA, 25 bp, Mus musculus
gaaacaagaaggttggctgccagta

SEQ ID NO: 404521 - DNA, 25 bp, Mus musculus
gaaacaagacaacgctctgctgctg

SEQ ID NO: 404522 - DNA, 25 bp, Mus musculus
gaaacaagacaaggctctgctgctg

SEQ ID NO: 404523 - DNA, 25 bp, Mus musculus
gaaacaagacgaccctaagaagtag

SEQ ID NO: 404524 - DNA, 25 bp, Mus musculus
gaaacaagacgagcctaagaagtag

SEQ ID NO: 404525 - DNA, 25 bp, Mus musculus
gaaacaagactcagctgtcgctttg

SEQ ID NO: 404526 - DNA, 25 bp, Mus musculus
gaaacaagactctgctgtcgctttg

SEQ ID NO: 404527 - DNA, 25 bp, Mus musculus
gaaacaagactgatggtcgccactt

SEQ ID NO: 404528 - DNA, 25 bp, Mus musculus
gaaacaagactgttggtcgccactt

SEQ ID NO: 404529 - DNA, 25 bp, Mus musculus
gaaacaagagttatccgcgctctca

SEQ ID NO: 404530 - DNA, 25 bp, Mus musculus
gaaacaagagttttccgcgctctca

SEQ ID NO: 404531 - DNA, 25 bp, Mus musculus
gaaacaagatctagatctaagcaat

SEQ ID NO: 404532 - DNA, 25 bp, Mus musculus
gaaacaagatcttgatctaagcaat

SEQ ID NO: 404533 - DNA, 25 bp, Mus musculus
gaaacaagattacgccggtctccag

SEQ ID NO: 404534 - DNA, 25 bp, Mus musculus
gaaacaagattaggccggtctccag

SEQ ID NO: 404535 - DNA, 25 bp, Mus musculus
gaaacaagcctgctagcctatgtat

SEQ ID NO: 404536 - DNA, 25 bp, Mus musculus
gaaacaagcctggtagcctatgtat

SEQ ID NO: 404537 - DNA, 25 bp, Mus musculus
gaaacaagccttaaccactgtagcc

SEQ ID NO: 404538 - DNA, 25 bp, Mus musculus
gaaacaagcctttaccactgtagcc

SEQ ID NO: 404539 - DNA, 25 bp, Mus musculus
gaaacaagcggtccctcgctctgaa

SEQ ID NO: 404540 - DNA, 25 bp, Mus musculus
gaaacaagcggtgcctcgctctgaa

SEQ ID NO: 404541 - DNA, 25 bp, Mus musculus
gaaacaagcgtaccatgtccttagg

SEQ ID NO: 404542 - DNA, 25 bp, Mus musculus
gaaacaagcgtagcatgtccttagg

SEQ ID NO: 404543 - DNA, 25 bp, Mus musculus
gaaacaagctcgaggattccctaga

SEQ ID NO: 404544 - DNA, 25 bp, Mus musculus
gaaacaagctcgtggattccctaga

SEQ ID NO: 404545 - DNA, 25 bp, Mus musculus
gaaacaaggcatagcactgactccg

SEQ ID NO: 404546 - DNA, 25 bp, Mus musculus
gaaacaaggcattgcactgactccg

SEQ ID NO: 404547 - DNA, 25 bp, Mus musculus
gaaacaaggctaacagtctcctgaa

SEQ ID NO: 404548 - DNA, 25 bp, Mus musculus
gaaacaaggctaccgacatgtatcc

SEQ ID NO: 404549 - DNA, 25 bp, Mus musculus
gaaacaaggctagcgacatgtatcc

SEQ ID NO: 404550 - DNA, 25 bp, Mus musculus
gaaacaaggctatcagtctcctgaa

SEQ ID NO: 404551 - DNA, 25 bp, Mus musculus
gaaacaagggccacaatttgcgaaa

SEQ ID NO: 404552 - DNA, 25 bp, Mus musculus
gaaacaagggcctcaatttgcgaaa

SEQ ID NO: 404553 - DNA, 25 bp, Mus musculus
gaaacaagggctcggtaattgtcca

SEQ ID NO: 404554 - DNA, 25 bp, Mus musculus
gaaacaagggctgggtaattgtcca

SEQ ID NO: 404555 - DNA, 25 bp, Mus musculus
gaaacaaggtgcacccagaccacat

SEQ ID NO: 404556 - DNA, 25 bp, Mus musculus
gaaacaaggtgcattcttccactcc

SEQ ID NO: 404557 - DNA, 25 bp, Mus musculus
gaaacaaggtgctcccagaccacat

SEQ ID NO: 404558 - DNA, 25 bp, Mus musculus
gaaacaaggtgctttcttccactcc

SEQ ID NO: 404559 - DNA, 25 bp, Mus musculus
gaaacaaggtgtcaccacaagtctg

SEQ ID NO: 404560 - DNA, 25 bp, Mus musculus
gaaacaaggtgtgaccacaagtctg

SEQ ID NO: 404561 - DNA, 25 bp, Mus musculus
gaaacaagtaacagcctcactcgtg

SEQ ID NO: 404562 - DNA, 25 bp, Mus musculus
gaaacaagtaactgcctcactcgtg

SEQ ID NO: 404563 - DNA, 25 bp, Mus musculus
gaaacaagtcttagcttcacaatgg

SEQ ID NO: 404564 - DNA, 25 bp, Mus musculus
gaaacaagtctttgcttcacaatgg

SEQ ID NO: 404565 - DNA, 25 bp, Mus musculus
gaaacaagttctcggccagatggtg

SEQ ID NO: 404566 - DNA, 25 bp, Mus musculus
gaaacaagttctgggccagatggtg

SEQ ID NO: 404567 - DNA, 25 bp, Mus musculus
gaaacaatcaagaagccggaagaag

SEQ ID NO: 404568 - DNA, 25 bp, Mus musculus
gaaacaatcaagtagccggaagaag

SEQ ID NO: 404569 - DNA, 25 bp, Mus musculus
gaaacaatcctccacattgatgtgc

SEQ ID NO: 404570 - DNA, 25 bp, Mus musculus
gaaacaatcctcgacattgatgtgc

SEQ ID NO: 404571 - DNA, 25 bp, Mus musculus
gaaacaatctagaccattgcttccc

SEQ ID NO: 404572 - DNA, 25 bp, Mus musculus
gaaacaatctagtccattgcttccc

SEQ ID NO: 404573 - DNA, 25 bp, Mus musculus
gaaacaatcttgagctggttcagcc

SEQ ID NO: 404574 - DNA, 25 bp, Mus musculus
gaaacaatcttgtgctggttcagcc

SEQ ID NO: 404575 - DNA, 25 bp, Mus musculus
gaaacaatgaagaatgcggcagact

SEQ ID NO: 404576 - DNA, 25 bp, Mus musculus
gaaacaatgaagtatgcggcagact

SEQ ID NO: 404577 - DNA, 25 bp, Mus musculus
gaaacaatgcaaccatgacctcagc

SEQ ID NO: 404578 - DNA, 25 bp, Mus musculus
gaaacaatgcaagcatgacctcagc

SEQ ID NO: 404579 - DNA, 25 bp, Mus musculus
gaaacaatgcccatttccgggatgc

SEQ ID NO: 404580 - DNA, 25 bp, Mus musculus
gaaacaatgcccttttccgggatgc

SEQ ID NO: 404581 - DNA, 25 bp, Mus musculus
gaaacaatgctaaccatggccatga

SEQ ID NO: 404582 - DNA, 25 bp, Mus musculus
gaaacaatgctatccatggccatga

SEQ ID NO: 404583 - DNA, 25 bp, Mus musculus
gaaacaatggacacctcctgagctg

SEQ ID NO: 404584 - DNA, 25 bp, Mus musculus
gaaacaatggactcctcctgagctg

SEQ ID NO: 404585 - DNA, 25 bp, Mus musculus
gaaacaatggccatgacctaccagg

SEQ ID NO: 404586 - DNA, 25 bp, Mus musculus
gaaacaatggccttgacctaccagg

SEQ ID NO: 404587 - DNA, 25 bp, Mus musculus
gaaacaatggctcttctttgtagaa

SEQ ID NO: 404588 - DNA, 25 bp, Mus musculus
gaaacaatggctgttctttgtagaa

SEQ ID NO: 404589 - DNA, 25 bp, Mus musculus
gaaacaatgggcacttctgtgtgga

SEQ ID NO: 404590 - DNA, 25 bp, Mus musculus
gaaacaatgggctcttctgtgtgga

SEQ ID NO: 404591 - DNA, 25 bp, Mus musculus
gaaacaatgttccagctagctttaa

SEQ ID NO: 404592 - DNA, 25 bp, Mus musculus
gaaacaatgttcgagctagctttaa

SEQ ID NO: 404593 - DNA, 25 bp, Mus musculus
gaaacaattaatagagcttatgcca

SEQ ID NO: 404594 - DNA, 25 bp, Mus musculus
gaaacaattaattgagcttatgcca

SEQ ID NO: 404595 - DNA, 25 bp, Mus musculus
gaaacaattctaaccagactctgaa

SEQ ID NO: 404596 - DNA, 25 bp, Mus musculus
gaaacaattctatccagactctgaa

SEQ ID NO: 404597 - DNA, 25 bp, Mus musculus
gaaacaattggcaccagtcttccct

SEQ ID NO: 404598 - DNA, 25 bp, Mus musculus
gaaacaattggctccagtcttccct

SEQ ID NO: 404599 - DNA, 25 bp, Mus musculus
gaaacaattgtcagccctgcaggct

SEQ ID NO: 404600 - DNA, 25 bp, Mus musculus
gaaacaattgtctgccctgcaggct

SEQ ID NO: 404601 - DNA, 25 bp, Mus musculus
gaaacacaaaatcacacctagcaga

SEQ ID NO: 404602 - DNA, 25 bp, Mus musculus
gaaacacaaaatgacacctagcaga

SEQ ID NO: 404603 - DNA, 25 bp, Mus musculus
gaaacacaacacatgcccagtacct

SEQ ID NO: 404604 - DNA, 25 bp, Mus musculus
gaaacacaacacttgcccagtacct

SEQ ID NO: 404605 - DNA, 25 bp, Mus musculus
gaaacacaactgagaagcactacat

SEQ ID NO: 404606 - DNA, 25 bp, Mus musculus
gaaacacaactgtgaagcactacat

SEQ ID NO: 404607 - DNA, 25 bp, Mus musculus
gaaacacaagcaacgagccaaggag

SEQ ID NO: 404608 - DNA, 25 bp, Mus musculus
gaaacacaagcatcgagccaaggag

SEQ ID NO: 404609 - DNA, 25 bp, Mus musculus
gaaacacaagctatcggcttccatc

SEQ ID NO: 404610 - DNA, 25 bp, Mus musculus
gaaacacaagctttcggcttccatc

SEQ ID NO: 404611 - DNA, 25 bp, Mus musculus
gaaacacaagttcggatctttagat

SEQ ID NO: 404612 - DNA, 25 bp, Mus musculus
gaaacacaagttgggatctttagat

SEQ ID NO: 404613 - DNA, 25 bp, Mus musculus
gaaacacaatctatagggcgcccct

SEQ ID NO: 404614 - DNA, 25 bp, Mus musculus
gaaacacaatctttagggcgcccct

SEQ ID NO: 404615 - DNA, 25 bp, Mus musculus
gaaacacacaaactgacgagggcct

SEQ ID NO: 404616 - DNA, 25 bp, Mus musculus
gaaacacacaaagtgacgagggcct

SEQ ID NO: 404617 - DNA, 25 bp, Mus musculus
gaaacacacacgcatgctgaaggag

SEQ ID NO: 404618 - DNA, 25 bp, Mus musculus
gaaacacacacggatgctgaaggag

SEQ ID NO: 404619 - DNA, 25 bp, Mus musculus
gaaacacacaggacacgtaagcagt

SEQ ID NO: 404620 - DNA, 25 bp, Mus musculus
gaaacacacaggagcaaagcccttt

SEQ ID NO: 404621 - DNA, 25 bp, Mus musculus
gaaacacacaggtcacgtaagcagt

SEQ ID NO: 404622 - DNA, 25 bp, Mus musculus
gaaacacacaggtgcaaagcccttt

SEQ ID NO: 404623 - DNA, 25 bp, Mus musculus
gaaacacacagtactgtctccagtg

SEQ ID NO: 404624 - DNA, 25 bp, Mus musculus
gaaacacacagttctgtctccagtg

SEQ ID NO: 404625 - DNA, 25 bp, Mus musculus
gaaacacaccccagcacttagaagg

SEQ ID NO: 404626 - DNA, 25 bp, Mus musculus
gaaacacacccctgcacttagaagg

SEQ ID NO: 404627 - DNA, 25 bp, Mus musculus
gaaacacacccgcagagagtatgac

SEQ ID NO: 404628 - DNA, 25 bp, Mus musculus
gaaacacacccggagagagtatgac

SEQ ID NO: 404629 - DNA, 25 bp, Mus musculus
gaaacacaccgacattgcttcttgt

SEQ ID NO: 404630 - DNA, 25 bp, Mus musculus
gaaacacaccgagattgcttcttgt

SEQ ID NO: 404631 - DNA, 25 bp, Mus musculus
gaaacacacgtgaatgcctcttttg

SEQ ID NO: 404632 - DNA, 25 bp, Mus musculus
gaaacacacgtgtatgcctcttttg

SEQ ID NO: 404633 - DNA, 25 bp, Mus musculus
gaaacacactggacctggcttacta

SEQ ID NO: 404634 - DNA, 25 bp, Mus musculus
gaaacacactggtcctggcttacta

SEQ ID NO: 404635 - DNA, 25 bp, Mus musculus
gaaacacactgtctcaaatcataca

SEQ ID NO: 404636 - DNA, 25 bp, Mus musculus
gaaacacactgtgtcaaatcataca

SEQ ID NO: 404637 - DNA, 25 bp, Mus musculus
gaaacacactttactcggagaggaa

SEQ ID NO: 404638 - DNA, 25 bp, Mus musculus
gaaacacacttttctcggagaggaa

SEQ ID NO: 404639 - DNA, 25 bp, Mus musculus
gaaacacagacgcaacaagttcaga

SEQ ID NO: 404640 - DNA, 25 bp, Mus musculus
gaaacacagacggaacaagttcaga

SEQ ID NO: 404641 - DNA, 25 bp, Mus musculus
gaaacacagaggctggagtccatat

SEQ ID NO: 404642 - DNA, 25 bp, Mus musculus
gaaacacagagggtggagtccatat

SEQ ID NO: 404643 - DNA, 25 bp, Mus musculus
gaaacacagattattacactaatat

SEQ ID NO: 404644 - DNA, 25 bp, Mus musculus
gaaacacagatttttacactaatat

SEQ ID NO: 404645 - DNA, 25 bp, Mus musculus
gaaacacagcaaaggacgctcaaga

SEQ ID NO: 404646 - DNA, 25 bp, Mus musculus
gaaacacagcaatggacgctcaaga

SEQ ID NO: 404647 - DNA, 25 bp, Mus musculus
gaaacacagcatacttgtacagtat

SEQ ID NO: 404648 - DNA, 25 bp, Mus musculus
gaaacacagcattcttgtacagtat

SEQ ID NO: 404649 - DNA, 25 bp, Mus musculus
gaaacacagcgacgttgctggactg

SEQ ID NO: 404650 - DNA, 25 bp, Mus musculus
gaaacacagcgaggttgctggactg

SEQ ID NO: 404651 - DNA, 25 bp, Mus musculus
gaaacacagctcactagaaattttg

SEQ ID NO: 404652 - DNA, 25 bp, Mus musculus
gaaacacagctctctagaaattttg

SEQ ID NO: 404653 - DNA, 25 bp, Mus musculus
gaaacacagctgatagtcatattaa

SEQ ID NO: 404654 - DNA, 25 bp, Mus musculus
gaaacacagctgttagtcatattaa

SEQ ID NO: 404655 - DNA, 25 bp, Mus musculus
gaaacacagcttatactctggaata

SEQ ID NO: 404656 - DNA, 25 bp, Mus musculus
gaaacacagcttttactctggaata

SEQ ID NO: 404657 - DNA, 25 bp, Mus musculus
gaaacacaggacacctaggagcccg

SEQ ID NO: 404658 - DNA, 25 bp, Mus musculus
gaaacacaggactcctaggagcccg

SEQ ID NO: 404659 - DNA, 25 bp, Mus musculus
gaaacacaggcaacgctaccacctt

SEQ ID NO: 404660 - DNA, 25 bp, Mus musculus
gaaacacaggcatcgctaccacctt

SEQ ID NO: 404661 - DNA, 25 bp, Mus musculus
gaaacacagggaagccacgtgcctt

SEQ ID NO: 404662 - DNA, 25 bp, Mus musculus
gaaacacagggatgccacgtgcctt

SEQ ID NO: 404663 - DNA, 25 bp, Mus musculus
gaaacacagggcacaaacaattttt

SEQ ID NO: 404664 - DNA, 25 bp, Mus musculus
gaaacacagggcactttgtagctga

SEQ ID NO: 404665 - DNA, 25 bp, Mus musculus
gaaacacagggctcaaacaattttt

SEQ ID NO: 404666 - DNA, 25 bp, Mus musculus
gaaacacagggctctttgtagctga

SEQ ID NO: 404667 - DNA, 25 bp, Mus musculus
gaaacacaggttccctagcatgata

SEQ ID NO: 404668 - DNA, 25 bp, Mus musculus
gaaacacaggttgcctagcatgata

SEQ ID NO: 404669 - DNA, 25 bp, Mus musculus
gaaacacagtccacaggaggcaccc

SEQ ID NO: 404670 - DNA, 25 bp, Mus musculus
gaaacacagtcctcaggaggcaccc

SEQ ID NO: 404671 - DNA, 25 bp, Mus musculus
gaaacacagtggatttctccgattg

SEQ ID NO: 404672 - DNA, 25 bp, Mus musculus
gaaacacagtggctccctgtgacac

SEQ ID NO: 404673 - DNA, 25 bp, Mus musculus
gaaacacagtgggtccctgtgacac

SEQ ID NO: 404674 - DNA, 25 bp, Mus musculus
gaaacacagtggttttctccgattg

SEQ ID NO: 404675 - DNA, 25 bp, Mus musculus
gaaacacagtttcacattttacagg

SEQ ID NO: 404676 - DNA, 25 bp, Mus musculus
gaaacacagtttgacattttacagg

SEQ ID NO: 404677 - DNA, 25 bp, Mus musculus
gaaacacatactatgtccggcgctt

SEQ ID NO: 404678 - DNA, 25 bp, Mus musculus
gaaacacatactttgtccggcgctt

SEQ ID NO: 404679 - DNA, 25 bp, Mus musculus
gaaacacatagaattaacttactga

SEQ ID NO: 404680 - DNA, 25 bp, Mus musculus
gaaacacatagatttaacttactga

SEQ ID NO: 404681 - DNA, 25 bp, Mus musculus
gaaacacatagtcatgcttgccttt

SEQ ID NO: 404682 - DNA, 25 bp, Mus musculus
gaaacacatagtgatgcttgccttt

SEQ ID NO: 404683 - DNA, 25 bp, Mus musculus
gaaacacatcatctaatcccagaca

SEQ ID NO: 404684 - DNA, 25 bp, Mus musculus
gaaacacatcatgtaatcccagaca

SEQ ID NO: 404685 - DNA, 25 bp, Mus musculus
gaaacacatcctaatgtctgcttga

SEQ ID NO: 404686 - DNA, 25 bp, Mus musculus
gaaacacatccttatgtctgcttga

SEQ ID NO: 404687 - DNA, 25 bp, Mus musculus
gaaacacatctgagctcctcttgtc

SEQ ID NO: 404688 - DNA, 25 bp, Mus musculus
gaaacacatctgtgctcctcttgtc

SEQ ID NO: 404689 - DNA, 25 bp, Mus musculus
gaaacacatgcaatcacacacacta

SEQ ID NO: 404690 - DNA, 25 bp, Mus musculus
gaaacacatgcattcacacacacta

SEQ ID NO: 404691 - DNA, 25 bp, Mus musculus
gaaacacatgccaagattctcatga

SEQ ID NO: 404692 - DNA, 25 bp, Mus musculus
gaaacacatgccatgaatagtagaa

SEQ ID NO: 404693 - DNA, 25 bp, Mus musculus
gaaacacatgcctagattctcatga

SEQ ID NO: 404694 - DNA, 25 bp, Mus musculus
gaaacacatgccttgaatagtagaa

SEQ ID NO: 404695 - DNA, 25 bp, Mus musculus
gaaacacatgggattctatgtgcta

SEQ ID NO: 404696 - DNA, 25 bp, Mus musculus
gaaacacatgggtttctatgtgcta

SEQ ID NO: 404697 - DNA, 25 bp, Mus musculus
gaaacacatgtcctaccttgctggt

SEQ ID NO: 404698 - DNA, 25 bp, Mus musculus
gaaacacatgtcgtaccttgctggt

SEQ ID NO: 404699 - DNA, 25 bp, Mus musculus
gaaacacatgttagggcctttctga

SEQ ID NO: 404700 - DNA, 25 bp, Mus musculus
gaaacacatgtttgggcctttctga

SEQ ID NO: 404701 - DNA, 25 bp, Mus musculus
gaaacacattctcaagccatcagcg

SEQ ID NO: 404702 - DNA, 25 bp, Mus musculus
gaaacacattctgaagccatcagcg

SEQ ID NO: 404703 - DNA, 25 bp, Mus musculus
gaaacacattgtatgtgaactggag

SEQ ID NO: 404704 - DNA, 25 bp, Mus musculus
gaaacacattgtttgtgaactggag

SEQ ID NO: 404705 - DNA, 25 bp, Mus musculus
gaaacacatttaacacgtaggtcaa

SEQ ID NO: 404706 - DNA, 25 bp, Mus musculus
gaaacacatttatcacgtaggtcaa

SEQ ID NO: 404707 - DNA, 25 bp, Mus musculus
gaaacaccaaatagtatcccagcag

SEQ ID NO: 404708 - DNA, 25 bp, Mus musculus
gaaacaccaaattgtatcccagcag

SEQ ID NO: 404709 - DNA, 25 bp, Mus musculus
gaaacaccaacaactgtccgacctg

SEQ ID NO: 404710 - DNA, 25 bp, Mus musculus
gaaacaccaacatctgtccgacctg

SEQ ID NO: 404711 - DNA, 25 bp, Mus musculus
gaaacaccaagcaccagatggactc

SEQ ID NO: 404712 - DNA, 25 bp, Mus musculus
gaaacaccaagctccagatggactc

SEQ ID NO: 404713 - DNA, 25 bp, Mus musculus
gaaacaccacaacaagtattccaga

SEQ ID NO: 404714 - DNA, 25 bp, Mus musculus
gaaacaccacaagaagtattccaga

SEQ ID NO: 404715 - DNA, 25 bp, Mus musculus
gaaacaccacagaaccgtaagacct

SEQ ID NO: 404716 - DNA, 25 bp, Mus musculus
gaaacaccacagtaccgtaagacct

SEQ ID NO: 404717 - DNA, 25 bp, Mus musculus
gaaacaccacctagagagcctgcat

SEQ ID NO: 404718 - DNA, 25 bp, Mus musculus
gaaacaccaccttgagagcctgcat

SEQ ID NO: 404719 - DNA, 25 bp, Mus musculus
gaaacaccactaatgcttgcaataa

SEQ ID NO: 404720 - DNA, 25 bp, Mus musculus
gaaacaccactattgcttgcaataa

SEQ ID NO: 404721 - DNA, 25 bp, Mus musculus
gaaacaccacttaatcttctctctt

SEQ ID NO: 404722 - DNA, 25 bp, Mus musculus
gaaacaccactttatcttctctctt

SEQ ID NO: 404723 - DNA, 25 bp, Mus musculus
gaaacaccagaactattaatctcac

SEQ ID NO: 404724 - DNA, 25 bp, Mus musculus
gaaacaccagaacttggctgtgaaa

SEQ ID NO: 404725 - DNA, 25 bp, Mus musculus
gaaacaccagaagtattaatctcac

SEQ ID NO: 404726 - DNA, 25 bp, Mus musculus
gaaacaccagaagttggctgtgaaa

SEQ ID NO: 404727 - DNA, 25 bp, Mus musculus
gaaacaccagccagtgcttagaatt

SEQ ID NO: 404728 - DNA, 25 bp, Mus musculus
gaaacaccagcctgtgcttagaatt

SEQ ID NO: 404729 - DNA, 25 bp, Mus musculus
gaaacaccaggtccttggaacattt

SEQ ID NO: 404730 - DNA, 25 bp, Mus musculus
gaaacaccaggtgcttggaacattt

SEQ ID NO: 404731 - DNA, 25 bp, Mus musculus
gaaacaccatagaccttctgccgaa

SEQ ID NO: 404732 - DNA, 25 bp, Mus musculus
gaaacaccatagctcaagatccctg

SEQ ID NO: 404733 - DNA, 25 bp, Mus musculus
gaaacaccataggtcaagatccctg

SEQ ID NO: 404734 - DNA, 25 bp, Mus musculus
gaaacaccatagtccttctgccgaa

SEQ ID NO: 404735 - DNA, 25 bp, Mus musculus
gaaacaccatctctcaaagtctgat

SEQ ID NO: 404736 - DNA, 25 bp, Mus musculus
gaaacaccatctgtcaaagtctgat

SEQ ID NO: 404737 - DNA, 25 bp, Mus musculus
gaaacacccaaaactgagcattaga

SEQ ID NO: 404738 - DNA, 25 bp, Mus musculus
gaaacacccaaatctgagcattaga

SEQ ID NO: 404739 - DNA, 25 bp, Mus musculus
gaaacacccacacgtcaagccaatg

SEQ ID NO: 404740 - DNA, 25 bp, Mus musculus
gaaacacccacaggtcaagccaatg

SEQ ID NO: 404741 - DNA, 25 bp, Mus musculus
gaaacacccagacatgttggcaccc

SEQ ID NO: 404742 - DNA, 25 bp, Mus musculus
gaaacacccagactttaatccttga

SEQ ID NO: 404743 - DNA, 25 bp, Mus musculus
gaaacacccagagatgttggcaccc

SEQ ID NO: 404744 - DNA, 25 bp, Mus musculus
gaaacacccagagtttaatccttga

SEQ ID NO: 404745 - DNA, 25 bp, Mus musculus
gaaacacccagtctttgtttctcac

SEQ ID NO: 404746 - DNA, 25 bp, Mus musculus
gaaacacccagtgtttgtttctcac

SEQ ID NO: 404747 - DNA, 25 bp, Mus musculus
gaaacaccccgacgagatgtccata

SEQ ID NO: 404748 - DNA, 25 bp, Mus musculus
gaaacaccccgaggagatgtccata

SEQ ID NO: 404749 - DNA, 25 bp, Mus musculus
gaaacaccccttcacataccaaaga

SEQ ID NO: 404750 - DNA, 25 bp, Mus musculus
gaaacaccccttgacataccaaaga

SEQ ID NO: 404751 - DNA, 25 bp, Mus musculus
gaaacaccctctacatttgatagga

SEQ ID NO: 404752 - DNA, 25 bp, Mus musculus
gaaacaccctcttcatttgatagga

SEQ ID NO: 404753 - DNA, 25 bp, Mus musculus
gaaacaccctgtatcccataaatta

SEQ ID NO: 404754 - DNA, 25 bp, Mus musculus
gaaacaccctgtttcccataaatta

SEQ ID NO: 404755 - DNA, 25 bp, Mus musculus
gaaacaccgaagattgtgactacag

SEQ ID NO: 404756 - DNA, 25 bp, Mus musculus
gaaacaccgaagtttgtgactacag

SEQ ID NO: 404757 - DNA, 25 bp, Mus musculus
gaaacaccgagactacaaatcagct

SEQ ID NO: 404758 - DNA, 25 bp, Mus musculus
gaaacaccgagagtacaaatcagct

SEQ ID NO: 404759 - DNA, 25 bp, Mus musculus
gaaacaccgccaaactaatcatgaa

SEQ ID NO: 404760 - DNA, 25 bp, Mus musculus
gaaacaccgccatactaatcatgaa

SEQ ID NO: 404761 - DNA, 25 bp, Mus musculus
gaaacaccggcccaaagacaacttg

SEQ ID NO: 404762 - DNA, 25 bp, Mus musculus
gaaacaccggccgaaagacaacttg

SEQ ID NO: 404763 - DNA, 25 bp, Mus musculus
gaaacaccgtcactgcacagtctgt

SEQ ID NO: 404764 - DNA, 25 bp, Mus musculus
gaaacaccgtcagtgcacagtctgt

SEQ ID NO: 404765 - DNA, 25 bp, Mus musculus
gaaacaccgtctacagtgttgccta

SEQ ID NO: 404766 - DNA, 25 bp, Mus musculus
gaaacaccgtcttcagtgttgccta

SEQ ID NO: 404767 - DNA, 25 bp, Mus musculus
gaaacaccgtggcaactctgctctc

SEQ ID NO: 404768 - DNA, 25 bp, Mus musculus
gaaacaccgtgggaactctgctctc

SEQ ID NO: 404769 - DNA, 25 bp, Mus musculus
gaaacacctacgaacgtgaggcagt

SEQ ID NO: 404770 - DNA, 25 bp, Mus musculus
gaaacacctacgtacgtgaggcagt

SEQ ID NO: 404771 - DNA, 25 bp, Mus musculus
gaaacacctactcacttgcaattta

SEQ ID NO: 404772 - DNA, 25 bp, Mus musculus
gaaacacctactgacttgcaattta

SEQ ID NO: 404773 - DNA, 25 bp, Mus musculus
gaaacacctctgagagctgccaaag

SEQ ID NO: 404774 - DNA, 25 bp, Mus musculus
gaaacacctctgtgagctgccaaag

SEQ ID NO: 404775 - DNA, 25 bp, Mus musculus
gaaacacctgagacatactccctat

SEQ ID NO: 404776 - DNA, 25 bp, Mus musculus
gaaacacctgagtcatactccctat

SEQ ID NO: 404777 - DNA, 25 bp, Mus musculus
gaaacacctgcaatatttatgaaag

SEQ ID NO: 404778 - DNA, 25 bp, Mus musculus
gaaacacctgcattatttatgaaag

SEQ ID NO: 404779 - DNA, 25 bp, Mus musculus
gaaacacctgtaagaaggccttcga

SEQ ID NO: 404780 - DNA, 25 bp, Mus musculus
gaaacacctgtatgaaggccttcga

SEQ ID NO: 404781 - DNA, 25 bp, Mus musculus
gaaacacctgtcaacaacttcttta

SEQ ID NO: 404782 - DNA, 25 bp, Mus musculus
gaaacacctgtctacaacttcttta

SEQ ID NO: 404783 - DNA, 25 bp, Mus musculus
gaaacacctgtgagtgccttacatg

SEQ ID NO: 404784 - DNA, 25 bp, Mus musculus
gaaacacctgtgtgtgccttacatg

SEQ ID NO: 404785 - DNA, 25 bp, Mus musculus
gaaacacctgttcaactacgttcat

SEQ ID NO: 404786 - DNA, 25 bp, Mus musculus
gaaacacctgttgaactacgttcat

SEQ ID NO: 404787 - DNA, 25 bp, Mus musculus
gaaacaccttgacgccccgcataaa

SEQ ID NO: 404788 - DNA, 25 bp, Mus musculus
gaaacaccttgaggccccgcataaa

SEQ ID NO: 404789 - DNA, 25 bp, Mus musculus
gaaacacctttgagcttgtaaccta

SEQ ID NO: 404790 - DNA, 25 bp, Mus musculus
gaaacacctttgtgcttgtaaccta

SEQ ID NO: 404791 - DNA, 25 bp, Mus musculus
gaaacaccttttactacaagtgaag

SEQ ID NO: 404792 - DNA, 25 bp, Mus musculus
gaaacacctttttctacaagtgaag

SEQ ID NO: 404793 - DNA, 25 bp, Mus musculus
gaaacacgagaaacttttattaatg

SEQ ID NO: 404794 - DNA, 25 bp, Mus musculus
gaaacacgagaatcttttattaatg

SEQ ID NO: 404795 - DNA, 25 bp, Mus musculus
gaaacacgatacatcttgaccatga

SEQ ID NO: 404796 - DNA, 25 bp, Mus musculus
gaaacacgatacttcttgaccatga

SEQ ID NO: 404797 - DNA, 25 bp, Mus musculus
gaaacacgattgaaattcaccacag

SEQ ID NO: 404798 - DNA, 25 bp, Mus musculus
gaaacacgattgtaattcaccacag

SEQ ID NO: 404799 - DNA, 25 bp, Mus musculus
gaaacacgatttcctccatgctcag

SEQ ID NO: 404800 - DNA, 25 bp, Mus musculus
gaaacacgatttgctccatgctcag

SEQ ID NO: 404801 - DNA, 25 bp, Mus musculus
gaaacacgcaagcattacactgatt

SEQ ID NO: 404802 - DNA, 25 bp, Mus musculus
gaaacacgcaaggattacactgatt

SEQ ID NO: 404803 - DNA, 25 bp, Mus musculus
gaaacacgcggacgcatgtcttatg

SEQ ID NO: 404804 - DNA, 25 bp, Mus musculus
gaaacacgcggaggcatgtcttatg

SEQ ID NO: 404805 - DNA, 25 bp, Mus musculus
gaaacacgctgaactgtatacactt

SEQ ID NO: 404806 - DNA, 25 bp, Mus musculus
gaaacacgctgatctgtatacactt

SEQ ID NO: 404807 - DNA, 25 bp, Mus musculus
gaaacacgtgggagtcaggccctct

SEQ ID NO: 404808 - DNA, 25 bp, Mus musculus
gaaacacgtgggtgtcaggccctct

SEQ ID NO: 404809 - DNA, 25 bp, Mus musculus
gaaacacgtttcaggcggatttcct

SEQ ID NO: 404810 - DNA, 25 bp, Mus musculus
gaaacacgtttctggcggatttcct

SEQ ID NO: 404811 - DNA, 25 bp, Mus musculus
gaaacactacgaatgggcgtccgtt

SEQ ID NO: 404812 - DNA, 25 bp, Mus musculus
gaaacactacgattgggcgtccgtt

SEQ ID NO: 404813 - DNA, 25 bp, Mus musculus
gaaacactacttccttgtttgccgt

SEQ ID NO: 404814 - DNA, 25 bp, Mus musculus
gaaacactacttgcttgtttgccgt

SEQ ID NO: 404815 - DNA, 25 bp, Mus musculus
gaaacactatcacaggcattaagct

SEQ ID NO: 404816 - DNA, 25 bp, Mus musculus
gaaacactatcagaggcattaagct

SEQ ID NO: 404817 - DNA, 25 bp, Mus musculus
gaaacactattcacaaaagctgaaa

SEQ ID NO: 404818 - DNA, 25 bp, Mus musculus
gaaacactattctcaaaagctgaaa

SEQ ID NO: 404819 - DNA, 25 bp, Mus musculus
gaaacactatttccttcatgtgcag

SEQ ID NO: 404820 - DNA, 25 bp, Mus musculus
gaaacactatttcgtagctcaaata

SEQ ID NO: 404821 - DNA, 25 bp, Mus musculus
gaaacactatttgcttcatgtgcag

SEQ ID NO: 404822 - DNA, 25 bp, Mus musculus
gaaacactatttggtagctcaaata

SEQ ID NO: 404823 - DNA, 25 bp, Mus musculus
gaaacactcactatttatttactgg

SEQ ID NO: 404824 - DNA, 25 bp, Mus musculus
gaaacactcactttttatttactgg

SEQ ID NO: 404825 - DNA, 25 bp, Mus musculus
gaaacactccagagactgctacaag

SEQ ID NO: 404826 - DNA, 25 bp, Mus musculus
gaaacactccagtgactgctacaag

SEQ ID NO: 404827 - DNA, 25 bp, Mus musculus
gaaacactccctccctgcaaatgat

SEQ ID NO: 404828 - DNA, 25 bp, Mus musculus
gaaacactccctgcctgcaaatgat

SEQ ID NO: 404829 - DNA, 25 bp, Mus musculus
gaaacactcctcacacatttcagga

SEQ ID NO: 404830 - DNA, 25 bp, Mus musculus
gaaacactcctctcacatttcagga

SEQ ID NO: 404831 - DNA, 25 bp, Mus musculus
gaaacactcggactgctgttgtaaa

SEQ ID NO: 404832 - DNA, 25 bp, Mus musculus
gaaacactcggagtgctgttgtaaa

SEQ ID NO: 404833 - DNA, 25 bp, Mus musculus
gaaacactctctagtgctctctagg

SEQ ID NO: 404834 - DNA, 25 bp, Mus musculus
gaaacactctcttgtgctctctagg

SEQ ID NO: 404835 - DNA, 25 bp, Mus musculus
gaaacactgaacagggctcccaagc

SEQ ID NO: 404836 - DNA, 25 bp, Mus musculus
gaaacactgaactgggctcccaagc

SEQ ID NO: 404837 - DNA, 25 bp, Mus musculus
gaaacactgagcacactcgagcaga

SEQ ID NO: 404838 - DNA, 25 bp, Mus musculus
gaaacactgagctcactcgagcaga

SEQ ID NO: 404839 - DNA, 25 bp, Mus musculus
gaaacactgaggcattactaatgaa

SEQ ID NO: 404840 - DNA, 25 bp, Mus musculus
gaaacactgagggattactaatgaa

SEQ ID NO: 404841 - DNA, 25 bp, Mus musculus
gaaacactgattaccatcctggaga

SEQ ID NO: 404842 - DNA, 25 bp, Mus musculus
gaaacactgattcttcttgatcgac

SEQ ID NO: 404843 - DNA, 25 bp, Mus musculus
gaaacactgattgttcttgatcgac

SEQ ID NO: 404844 - DNA, 25 bp, Mus musculus
gaaacactgatttccatcctggaga

SEQ ID NO: 404845 - DNA, 25 bp, Mus musculus
gaaacactgcacagcgtagcaatgc

SEQ ID NO: 404846 - DNA, 25 bp, Mus musculus
gaaacactgcactgcgtagcaatgc

SEQ ID NO: 404847 - DNA, 25 bp, Mus musculus
gaaacactgcagatttttccaacct

SEQ ID NO: 404848 - DNA, 25 bp, Mus musculus
gaaacactgcagttttttccaacct

SEQ ID NO: 404849 - DNA, 25 bp, Mus musculus
gaaacactgccaccagggtttctgc

SEQ ID NO: 404850 - DNA, 25 bp, Mus musculus
gaaacactgccacctagtggcgtga

SEQ ID NO: 404851 - DNA, 25 bp, Mus musculus
gaaacactgccagcagggtttctgc

SEQ ID NO: 404852 - DNA, 25 bp, Mus musculus
gaaacactgccagctagtggcgtga

SEQ ID NO: 404853 - DNA, 25 bp, Mus musculus
gaaacactgcctaattgacattact

SEQ ID NO: 404854 - DNA, 25 bp, Mus musculus
gaaacactgcctcgattatatgaat

SEQ ID NO: 404855 - DNA, 25 bp, Mus musculus
gaaacactgcctggattatatgaat

SEQ ID NO: 404856 - DNA, 25 bp, Mus musculus
gaaacactgccttattgacattact

SEQ ID NO: 404857 - DNA, 25 bp, Mus musculus
gaaacactgcgcaagagtagacatc

SEQ ID NO: 404858 - DNA, 25 bp, Mus musculus
gaaacactgcgctagagtagacatc

SEQ ID NO: 404859 - DNA, 25 bp, Mus musculus
gaaacactgctgatttaacttaaat

SEQ ID NO: 404860 - DNA, 25 bp, Mus musculus
gaaacactgctgttttaacttaaat

SEQ ID NO: 404861 - DNA, 25 bp, Mus musculus
gaaacactggaaatattgctttcta

SEQ ID NO: 404862 - DNA, 25 bp, Mus musculus
gaaacactggaattattgctttcta

SEQ ID NO: 404863 - DNA, 25 bp, Mus musculus
gaaacactggatccagcccctttgt

SEQ ID NO: 404864 - DNA, 25 bp, Mus musculus
gaaacactggatgcagcccctttgt

SEQ ID NO: 404865 - DNA, 25 bp, Mus musculus
gaaacactggctcttaggctccctg

SEQ ID NO: 404866 - DNA, 25 bp, Mus musculus
gaaacactggctgttaggctccctg

SEQ ID NO: 404867 - DNA, 25 bp, Mus musculus
gaaacactgggaacattgctgagaa

SEQ ID NO: 404868 - DNA, 25 bp, Mus musculus
gaaacactgggaccttccgacaaga

SEQ ID NO: 404869 - DNA, 25 bp, Mus musculus
gaaacactgggagcttccgacaaga

SEQ ID NO: 404870 - DNA, 25 bp, Mus musculus
gaaacactgggatcattgctgagaa

SEQ ID NO: 404871 - DNA, 25 bp, Mus musculus
gaaacactgggcactcttctgttct

SEQ ID NO: 404872 - DNA, 25 bp, Mus musculus
gaaacactgggctctcttctgttct

SEQ ID NO: 404873 - DNA, 25 bp, Mus musculus
gaaacactggtcagtgaagtctgct

SEQ ID NO: 404874 - DNA, 25 bp, Mus musculus
gaaacactggtctgtgaagtctgct

SEQ ID NO: 404875 - DNA, 25 bp, Mus musculus
gaaacactgtagatcttagagttta

SEQ ID NO: 404876 - DNA, 25 bp, Mus musculus
gaaacactgtagttcttagagttta

SEQ ID NO: 404877 - DNA, 25 bp, Mus musculus
gaaacactgtccactactttttcct

SEQ ID NO: 404878 - DNA, 25 bp, Mus musculus
gaaacactgtcctctactttttcct

SEQ ID NO: 404879 - DNA, 25 bp, Mus musculus
gaaacactgtgccaactttcctcgg

SEQ ID NO: 404880 - DNA, 25 bp, Mus musculus
gaaacactgtgcgaactttcctcgg

SEQ ID NO: 404881 - DNA, 25 bp, Mus musculus
gaaacactgtgtcctttgtttaagg

SEQ ID NO: 404882 - DNA, 25 bp, Mus musculus
gaaacactgtgtgctttgtttaagg

SEQ ID NO: 404883 - DNA, 25 bp, Mus musculus
gaaacacttactccgtgcacagaga

SEQ ID NO: 404884 - DNA, 25 bp, Mus musculus
gaaacacttactgcgtgcacagaga

SEQ ID NO: 404885 - DNA, 25 bp, Mus musculus
gaaacacttagcctttaatatactg

SEQ ID NO: 404886 - DNA, 25 bp, Mus musculus
gaaacacttagcgtttaatatactg

SEQ ID NO: 404887 - DNA, 25 bp, Mus musculus
gaaacacttgaaactatgagggcca

SEQ ID NO: 404888 - DNA, 25 bp, Mus musculus
gaaacacttgaatctatgagggcca

SEQ ID NO: 404889 - DNA, 25 bp, Mus musculus
gaaacacttgcaaagcggactcata

SEQ ID NO: 404890 - DNA, 25 bp, Mus musculus
gaaacacttgcatagcggactcata

SEQ ID NO: 404891 - DNA, 25 bp, Mus musculus
gaaacacttgtcacttttctcccac

SEQ ID NO: 404892 - DNA, 25 bp, Mus musculus
gaaacacttgtctcttttctcccac

SEQ ID NO: 404893 - DNA, 25 bp, Mus musculus
gaaacactttggatgtcctaggaaa

SEQ ID NO: 404894 - DNA, 25 bp, Mus musculus
gaaacactttggttgtcctaggaaa

SEQ ID NO: 404895 - DNA, 25 bp, Mus musculus
gaaacactttttaccatacaggcac

SEQ ID NO: 404896 - DNA, 25 bp, Mus musculus
gaaacacttttttccatacaggcac

SEQ ID NO: 404897 - DNA, 25 bp, Mus musculus
gaaacagaacaaacgctgccctctg

SEQ ID NO: 404898 - DNA, 25 bp, Mus musculus
gaaacagaacaactttagtcccttg

SEQ ID NO: 404899 - DNA, 25 bp, Mus musculus
gaaacagaacaagtttagtcccttg

SEQ ID NO: 404900 - DNA, 25 bp, Mus musculus
gaaacagaacaatcgctgccctctg

SEQ ID NO: 404901 - DNA, 25 bp, Mus musculus
gaaacagaaccacctgagtgacatc

SEQ ID NO: 404902 - DNA, 25 bp, Mus musculus
gaaacagaaccagctgagtgacatc

SEQ ID NO: 404903 - DNA, 25 bp, Mus musculus
gaaacagaacctccattccattgct

SEQ ID NO: 404904 - DNA, 25 bp, Mus musculus
gaaacagaacctgcattccattgct

SEQ ID NO: 404905 - DNA, 25 bp, Mus musculus
gaaacagaagaccagacgcacgtga

SEQ ID NO: 404906 - DNA, 25 bp, Mus musculus
gaaacagaagacgagacgcacgtga

SEQ ID NO: 404907 - DNA, 25 bp, Mus musculus
gaaacagaaggtccagccctacctg

SEQ ID NO: 404908 - DNA, 25 bp, Mus musculus
gaaacagaaggtgcagccctacctg

SEQ ID NO: 404909 - DNA, 25 bp, Mus musculus
gaaacagaatgcagctgcccaggct

SEQ ID NO: 404910 - DNA, 25 bp, Mus musculus
gaaacagaatgctgctgcccaggct

SEQ ID NO: 404911 - DNA, 25 bp, Mus musculus
gaaacagacaacctcctgtcaggat

SEQ ID NO: 404912 - DNA, 25 bp, Mus musculus
gaaacagacaacgtcctgtcaggat

SEQ ID NO: 404913 - DNA, 25 bp, Mus musculus
gaaacagacagaacctgcaggctca

SEQ ID NO: 404914 - DNA, 25 bp, Mus musculus
gaaacagacagatcctgcaggctca

SEQ ID NO: 404915 - DNA, 25 bp, Mus musculus
gaaacagacagcactgtcttccccg

SEQ ID NO: 404916 - DNA, 25 bp, Mus musculus
gaaacagacagctctgtcttccccg

SEQ ID NO: 404917 - DNA, 25 bp, Mus musculus
gaaacagacagtatgctaaaaggca

SEQ ID NO: 404918 - DNA, 25 bp, Mus musculus
gaaacagacagtttgctaaaaggca

SEQ ID NO: 404919 - DNA, 25 bp, Mus musculus
gaaacagacatcaaattgttggaat

SEQ ID NO: 404920 - DNA, 25 bp, Mus musculus
gaaacagacatctaattgttggaat

SEQ ID NO: 404921 - DNA, 25 bp, Mus musculus
gaaacagaccacatttcaagttgag

SEQ ID NO: 404922 - DNA, 25 bp, Mus musculus
gaaacagaccacttttcaagttgag

SEQ ID NO: 404923 - DNA, 25 bp, Mus musculus
gaaacagacctcaaaagtgacctgt

SEQ ID NO: 404924 - DNA, 25 bp, Mus musculus
gaaacagacctctaaagtgacctgt

SEQ ID NO: 404925 - DNA, 25 bp, Mus musculus
gaaacagaccttctcagctggttag

SEQ ID NO: 404926 - DNA, 25 bp, Mus musculus
gaaacagaccttgtcagctggttag

SEQ ID NO: 404927 - DNA, 25 bp, Mus musculus
gaaacagactataatcccgtggagc

SEQ ID NO: 404928 - DNA, 25 bp, Mus musculus
gaaacagactattatcccgtggagc

SEQ ID NO: 404929 - DNA, 25 bp, Mus musculus
gaaacagactgaaaattgctcccgt

SEQ ID NO: 404930 - DNA, 25 bp, Mus musculus
gaaacagactgataattgctcccgt

SEQ ID NO: 404931 - DNA, 25 bp, Mus musculus
gaaacagagaccctggtgacccgag

SEQ ID NO: 404932 - DNA, 25 bp, Mus musculus
gaaacagagaccgtggtgacccgag

SEQ ID NO: 404933 - DNA, 25 bp, Mus musculus
gaaacagagctacccactgcagcgg

SEQ ID NO: 404934 - DNA, 25 bp, Mus musculus
gaaacagagctagccactgcagcgg

SEQ ID NO: 404935 - DNA, 25 bp, Mus musculus
gaaacagaggcgagtccccggcagc

SEQ ID NO: 404936 - DNA, 25 bp, Mus musculus
gaaacagaggcgtgtccccggcagc

SEQ ID NO: 404937 - DNA, 25 bp, Mus musculus
gaaacagaggttcttctaatctctc

SEQ ID NO: 404938 - DNA, 25 bp, Mus musculus
gaaacagaggttgttctaatctctc

SEQ ID NO: 404939 - DNA, 25 bp, Mus musculus
gaaacagagtcacggcaggaagccc

SEQ ID NO: 404940 - DNA, 25 bp, Mus musculus
gaaacagagtcagggcaggaagccc

SEQ ID NO: 404941 - DNA, 25 bp, Mus musculus
gaaacagagtggacagtgcccagcc

SEQ ID NO: 404942 - DNA, 25 bp, Mus musculus
gaaacagagtggtcagtgcccagcc

SEQ ID NO: 404943 - DNA, 25 bp, Mus musculus
gaaacagatcacaatcttgacacat

SEQ ID NO: 404944 - DNA, 25 bp, Mus musculus
gaaacagatcactatcttgacacat

SEQ ID NO: 404945 - DNA, 25 bp, Mus musculus
gaaacagatcctattttctatgact

SEQ ID NO: 404946 - DNA, 25 bp, Mus musculus
gaaacagatccttttttctatgact

SEQ ID NO: 404947 - DNA, 25 bp, Mus musculus
gaaacagatctactagtggccatac

SEQ ID NO: 404948 - DNA, 25 bp, Mus musculus
gaaacagatctagtagtggccatac

SEQ ID NO: 404949 - DNA, 25 bp, Mus musculus
gaaacagatctgcatgtcaatccaa

SEQ ID NO: 404950 - DNA, 25 bp, Mus musculus
gaaacagatctggatgtcaatccaa

SEQ ID NO: 404951 - DNA, 25 bp, Mus musculus
gaaacagatgttaaagctagataga

SEQ ID NO: 404952 - DNA, 25 bp, Mus musculus
gaaacagatgtttaagctagataga

SEQ ID NO: 404953 - DNA, 25 bp, Mus musculus
gaaacagcaagcattggagaacaaa

SEQ ID NO: 404954 - DNA, 25 bp, Mus musculus
gaaacagcaagctttggagaacaaa

SEQ ID NO: 404955 - DNA, 25 bp, Mus musculus
gaaacagcaaggaccctgtgtccat

SEQ ID NO: 404956 - DNA, 25 bp, Mus musculus
gaaacagcaaggtccctgtgtccat

SEQ ID NO: 404957 - DNA, 25 bp, Mus musculus
gaaacagcagacattagagaacctt

SEQ ID NO: 404958 - DNA, 25 bp, Mus musculus
gaaacagcagactttagagaacctt

SEQ ID NO: 404959 - DNA, 25 bp, Mus musculus
gaaacagcagagaggtcatcccata

SEQ ID NO: 404960 - DNA, 25 bp, Mus musculus
gaaacagcagagtggtcatcccata

SEQ ID NO: 404961 - DNA, 25 bp, Mus musculus
gaaacagcagttaccagagacaagg

SEQ ID NO: 404962 - DNA, 25 bp, Mus musculus
gaaacagcagtttccagagacaagg

SEQ ID NO: 404963 - DNA, 25 bp, Mus musculus
gaaacagcattaatggttctcccca

SEQ ID NO: 404964 - DNA, 25 bp, Mus musculus
gaaacagcattattggttctcccca

SEQ ID NO: 404965 - DNA, 25 bp, Mus musculus
gaaacagcatttccccgtctgaatg

SEQ ID NO: 404966 - DNA, 25 bp, Mus musculus
gaaacagcatttgcccgtctgaatg

SEQ ID NO: 404967 - DNA, 25 bp, Mus musculus
gaaacagccaaactgtacatcacat

SEQ ID NO: 404968 - DNA, 25 bp, Mus musculus
gaaacagccaaagtgtacatcacat

SEQ ID NO: 404969 - DNA, 25 bp, Mus musculus
gaaacagccacaagcataccgggag

SEQ ID NO: 404970 - DNA, 25 bp, Mus musculus
gaaacagccacatgcataccgggag

SEQ ID NO: 404971 - DNA, 25 bp, Mus musculus
gaaacagccagaccatagcatgtaa

SEQ ID NO: 404972 - DNA, 25 bp, Mus musculus
gaaacagccagacttcgctcaggtt

SEQ ID NO: 404973 - DNA, 25 bp, Mus musculus
gaaacagccagagcatagcatgtaa

SEQ ID NO: 404974 - DNA, 25 bp, Mus musculus
gaaacagccagagttcgctcaggtt

SEQ ID NO: 404975 - DNA, 25 bp, Mus musculus
gaaacagccaggcatctaccatgca

SEQ ID NO: 404976 - DNA, 25 bp, Mus musculus
gaaacagccagggatctaccatgca

SEQ ID NO: 404977 - DNA, 25 bp, Mus musculus
gaaacagccataaattttgccaaag

SEQ ID NO: 404978 - DNA, 25 bp, Mus musculus
gaaacagccatatattttgccaaag

SEQ ID NO: 404979 - DNA, 25 bp, Mus musculus
gaaacagcccctccttgaatggttt

SEQ ID NO: 404980 - DNA, 25 bp, Mus musculus
gaaacagcccctgcttgaatggttt

SEQ ID NO: 404981 - DNA, 25 bp, Mus musculus
gaaacagcccgaccggcaggttcac

SEQ ID NO: 404982 - DNA, 25 bp, Mus musculus
gaaacagcccgagcggcaggttcac

SEQ ID NO: 404983 - DNA, 25 bp, Mus musculus
gaaacagcccttcaagagtgaggta

SEQ ID NO: 404984 - DNA, 25 bp, Mus musculus
gaaacagcccttgaagagtgaggta

SEQ ID NO: 404985 - DNA, 25 bp, Mus musculus
gaaacagccgatccgtggagccatt

SEQ ID NO: 404986 - DNA, 25 bp, Mus musculus
gaaacagccgatgcgtggagccatt

SEQ ID NO: 404987 - DNA, 25 bp, Mus musculus
gaaacagcctccagtctaactggaa

SEQ ID NO: 404988 - DNA, 25 bp, Mus musculus
gaaacagcctcctgtctaactggaa

SEQ ID NO: 404989 - DNA, 25 bp, Mus musculus
gaaacagcctgtcctacttgagctt

SEQ ID NO: 404990 - DNA, 25 bp, Mus musculus
gaaacagcctgtgctacttgagctt

SEQ ID NO: 404991 - DNA, 25 bp, Mus musculus
gaaacagccttaactcctaagctca

SEQ ID NO: 404992 - DNA, 25 bp, Mus musculus
gaaacagccttatctcctaagctca

SEQ ID NO: 404993 - DNA, 25 bp, Mus musculus
gaaacagccttcataattaacccca

SEQ ID NO: 404994 - DNA, 25 bp, Mus musculus
gaaacagccttcttaattaacccca

SEQ ID NO: 404995 - DNA, 25 bp, Mus musculus
gaaacagcctttcttccatgatagg

SEQ ID NO: 404996 - DNA, 25 bp, Mus musculus
gaaacagcctttgttccatgatagg

SEQ ID NO: 404997 - DNA, 25 bp, Mus musculus
gaaacagcgagaactgccactgaga

SEQ ID NO: 404998 - DNA, 25 bp, Mus musculus
gaaacagcgagatctgccactgaga

SEQ ID NO: 404999 - DNA, 25 bp, Mus musculus
gaaacagcgctacatcttgcttgaa

SEQ ID NO: 405000 - DNA, 25 bp, Mus musculus
gaaacagcgctagatcttgcttgaa

SEQ ID NO: 405001 - DNA, 25 bp, Mus musculus
gaaacagctaagacaggatacaggg

SEQ ID NO: 405002 - DNA, 25 bp, Mus musculus
gaaacagctaagtcaggatacaggg

SEQ ID NO: 405003 - DNA, 25 bp, Mus musculus
gaaacagctccacagtcctagtgtg

SEQ ID NO: 405004 - DNA, 25 bp, Mus musculus
gaaacagctccagagtcctagtgtg

SEQ ID NO: 405005 - DNA, 25 bp, Mus musculus
gaaacagctcccaaacccttcatta

SEQ ID NO: 405006 - DNA, 25 bp, Mus musculus
gaaacagctccctaacccttcatta

SEQ ID NO: 405007 - DNA, 25 bp, Mus musculus
gaaacagctctaattaatcatctta

SEQ ID NO: 405008 - DNA, 25 bp, Mus musculus
gaaacagctctatttaatcatctta

SEQ ID NO: 405009 - DNA, 25 bp, Mus musculus
gaaacagctctgatctgcatggaac

SEQ ID NO: 405010 - DNA, 25 bp, Mus musculus
gaaacagctctgttctgcatggaac

SEQ ID NO: 405011 - DNA, 25 bp, Mus musculus
gaaacagctcttagatcatctcaag

SEQ ID NO: 405012 - DNA, 25 bp, Mus musculus
gaaacagctctttgatcatctcaag

SEQ ID NO: 405013 - DNA, 25 bp, Mus musculus
gaaacagctggcaacgcaagagtaa

SEQ ID NO: 405014 - DNA, 25 bp, Mus musculus
gaaacagctggcattccttggtgtc

SEQ ID NO: 405015 - DNA, 25 bp, Mus musculus
gaaacagctggctacgcaagagtaa

SEQ ID NO: 405016 - DNA, 25 bp, Mus musculus
gaaacagctggctttccttggtgtc

SEQ ID NO: 405017 - DNA, 25 bp, Mus musculus
gaaacagctgtcagtgagccagtct

SEQ ID NO: 405018 - DNA, 25 bp, Mus musculus
gaaacagctgtctgtgagccagtct

SEQ ID NO: 405019 - DNA, 25 bp, Mus musculus
gaaacagctgttactgtattatctt

SEQ ID NO: 405020 - DNA, 25 bp, Mus musculus
gaaacagctgtttctgtattatctt

SEQ ID NO: 405021 - DNA, 25 bp, Mus musculus
gaaacagcttacaataatggctcat

SEQ ID NO: 405022 - DNA, 25 bp, Mus musculus
gaaacagcttactataatggctcat

SEQ ID NO: 405023 - DNA, 25 bp, Mus musculus
gaaacagcttctagagaacttgaga

SEQ ID NO: 405024 - DNA, 25 bp, Mus musculus
gaaacagcttcttgagaacttgaga

SEQ ID NO: 405025 - DNA, 25 bp, Mus musculus
gaaacagcttgaaccagggcctgaa

SEQ ID NO: 405026 - DNA, 25 bp, Mus musculus
gaaacagcttgatccagggcctgaa

SEQ ID NO: 405027 - DNA, 25 bp, Mus musculus
gaaacaggacagaactcggctctct

SEQ ID NO: 405028 - DNA, 25 bp, Mus musculus
gaaacaggacagtactcggctctct

SEQ ID NO: 405029 - DNA, 25 bp, Mus musculus
gaaacaggacccagctctcaggtgt

SEQ ID NO: 405030 - DNA, 25 bp, Mus musculus
gaaacaggaccccagttcagagtgg

SEQ ID NO: 405031 - DNA, 25 bp, Mus musculus
gaaacaggacccgagttcagagtgg

SEQ ID NO: 405032 - DNA, 25 bp, Mus musculus
gaaacaggaccctgctctcaggtgt

SEQ ID NO: 405033 - DNA, 25 bp, Mus musculus
gaaacaggagacacggtttcctgac

SEQ ID NO: 405034 - DNA, 25 bp, Mus musculus
gaaacaggagactcggtttcctgac

SEQ ID NO: 405035 - DNA, 25 bp, Mus musculus
gaaacaggaggcaacaagtctcaga

SEQ ID NO: 405036 - DNA, 25 bp, Mus musculus
gaaacaggaggctacaagtctcaga

SEQ ID NO: 405037 - DNA, 25 bp, Mus musculus
gaaacaggagggatcccctagtgtg

SEQ ID NO: 405038 - DNA, 25 bp, Mus musculus
gaaacaggagggttcccctagtgtg

SEQ ID NO: 405039 - DNA, 25 bp, Mus musculus
gaaacaggaggtacccagggtctcg

SEQ ID NO: 405040 - DNA, 25 bp, Mus musculus
gaaacaggaggttcccagggtctcg

SEQ ID NO: 405041 - DNA, 25 bp, Mus musculus
gaaacaggatttcccaagagctgct

SEQ ID NO: 405042 - DNA, 25 bp, Mus musculus
gaaacaggatttgccaagagctgct

SEQ ID NO: 405043 - DNA, 25 bp, Mus musculus
gaaacaggcactcttaagccttagt

SEQ ID NO: 405044 - DNA, 25 bp, Mus musculus
gaaacaggcactgttaagccttagt

SEQ ID NO: 405045 - DNA, 25 bp, Mus musculus
gaaacaggccatattccaggaagac

SEQ ID NO: 405046 - DNA, 25 bp, Mus musculus
gaaacaggccattttccaggaagac

SEQ ID NO: 405047 - DNA, 25 bp, Mus musculus
gaaacaggctatcgccattgcttcc

SEQ ID NO: 405048 - DNA, 25 bp, Mus musculus
gaaacaggctatggccattgcttcc

SEQ ID NO: 405049 - DNA, 25 bp, Mus musculus
gaaacaggctcaagaaccatccagt

SEQ ID NO: 405050 - DNA, 25 bp, Mus musculus
gaaacaggctcatgaaccatccagt

SEQ ID NO: 405051 - DNA, 25 bp, Mus musculus
gaaacaggctcccagaccttagaaa

SEQ ID NO: 405052 - DNA, 25 bp, Mus musculus
gaaacaggctccgagaccttagaaa

SEQ ID NO: 405053 - DNA, 25 bp, Mus musculus
gaaacagggctacataaaaggctca

SEQ ID NO: 405054 - DNA, 25 bp, Mus musculus
gaaacagggctagataaaaggctca

SEQ ID NO: 405055 - DNA, 25 bp, Mus musculus
gaaacagggtaaccacagctggaga

SEQ ID NO: 405056 - DNA, 25 bp, Mus musculus
gaaacagggtaagcacagctggaga

SEQ ID NO: 405057 - DNA, 25 bp, Mus musculus
gaaacagggtgacagcagctctgcc

SEQ ID NO: 405058 - DNA, 25 bp, Mus musculus
gaaacagggtgacgtgctccatgct

SEQ ID NO: 405059 - DNA, 25 bp, Mus musculus
gaaacagggtgagagcagctctgcc

SEQ ID NO: 405060 - DNA, 25 bp, Mus musculus
gaaacagggtgaggtgctccatgct

SEQ ID NO: 405061 - DNA, 25 bp, Mus musculus
gaaacagggtttagacacaggctta

SEQ ID NO: 405062 - DNA, 25 bp, Mus musculus
gaaacagggttttgacacaggctta

SEQ ID NO: 405063 - DNA, 25 bp, Mus musculus
gaaacaggtctccaattactacaga

SEQ ID NO: 405064 - DNA, 25 bp, Mus musculus
gaaacaggtctcgaattactacaga

SEQ ID NO: 405065 - DNA, 25 bp, Mus musculus
gaaacaggtgtacacctcacgcctg

SEQ ID NO: 405066 - DNA, 25 bp, Mus musculus
gaaacaggtgtagacctcacgcctg

SEQ ID NO: 405067 - DNA, 25 bp, Mus musculus
gaaacaggttgtaccaggggctaag

SEQ ID NO: 405068 - DNA, 25 bp, Mus musculus
gaaacaggttgttccaggggctaag

SEQ ID NO: 405069 - DNA, 25 bp, Mus musculus
gaaacaggttttccgtggagcgaat

SEQ ID NO: 405070 - DNA, 25 bp, Mus musculus
gaaacaggttttgcgtggagcgaat

SEQ ID NO: 405071 - DNA, 25 bp, Mus musculus
gaaacagtagagattaagacagact

SEQ ID NO: 405072 - DNA, 25 bp, Mus musculus
gaaacagtagagtttaagacagact

SEQ ID NO: 405073 - DNA, 25 bp, Mus musculus
gaaacagtaggtacagacatacaac

SEQ ID NO: 405074 - DNA, 25 bp, Mus musculus
gaaacagtaggttcagacatacaac

SEQ ID NO: 405075 - DNA, 25 bp, Mus musculus
gaaacagtagtcattggaaggagag

SEQ ID NO: 405076 - DNA, 25 bp, Mus musculus
gaaacagtagtctttggaaggagag

SEQ ID NO: 405077 - DNA, 25 bp, Mus musculus
gaaacagtatctaagcccaagttct

SEQ ID NO: 405078 - DNA, 25 bp, Mus musculus
gaaacagtatctaccaatggaatcg

SEQ ID NO: 405079 - DNA, 25 bp, Mus musculus
gaaacagtatctctttatcttggca

SEQ ID NO: 405080 - DNA, 25 bp, Mus musculus
gaaacagtatctgtttatcttggca

SEQ ID NO: 405081 - DNA, 25 bp, Mus musculus
gaaacagtatcttagcccaagttct

SEQ ID NO: 405082 - DNA, 25 bp, Mus musculus
gaaacagtatcttccaatggaatcg

SEQ ID NO: 405083 - DNA, 25 bp, Mus musculus
gaaacagtatgtacccttaggagta

SEQ ID NO: 405084 - DNA, 25 bp, Mus musculus
gaaacagtatgtcctactgattgaa

SEQ ID NO: 405085 - DNA, 25 bp, Mus musculus
gaaacagtatgtgctactgattgaa

SEQ ID NO: 405086 - DNA, 25 bp, Mus musculus
gaaacagtatgttcccttaggagta

SEQ ID NO: 405087 - DNA, 25 bp, Mus musculus
gaaacagtcaacatattaccatctt

SEQ ID NO: 405088 - DNA, 25 bp, Mus musculus
gaaacagtcaacttattaccatctt

SEQ ID NO: 405089 - DNA, 25 bp, Mus musculus
gaaacagtcactattgctatctctt

SEQ ID NO: 405090 - DNA, 25 bp, Mus musculus
gaaacagtcacttttgctatctctt

SEQ ID NO: 405091 - DNA, 25 bp, Mus musculus
gaaacagtccaacgttccattgaat

SEQ ID NO: 405092 - DNA, 25 bp, Mus musculus
gaaacagtccaaggttccattgaat

SEQ ID NO: 405093 - DNA, 25 bp, Mus musculus
gaaacagtcccaaggaacgatcttt

SEQ ID NO: 405094 - DNA, 25 bp, Mus musculus
gaaacagtcccacaagcagtgcgcc

SEQ ID NO: 405095 - DNA, 25 bp, Mus musculus
gaaacagtcccagaagcagtgcgcc

SEQ ID NO: 405096 - DNA, 25 bp, Mus musculus
gaaacagtcccatggaacgatcttt

SEQ ID NO: 405097 - DNA, 25 bp, Mus musculus
gaaacagtccctatgtaccagtact

SEQ ID NO: 405098 - DNA, 25 bp, Mus musculus
gaaacagtccctcaatgacgtgtta

SEQ ID NO: 405099 - DNA, 25 bp, Mus musculus
gaaacagtccctccggcacgaggag

SEQ ID NO: 405100 - DNA, 25 bp, Mus musculus
gaaacagtccctgaatgacgtgtta

SEQ ID NO: 405101 - DNA, 25 bp, Mus musculus
gaaacagtccctgcggcacgaggag

SEQ ID NO: 405102 - DNA, 25 bp, Mus musculus
gaaacagtccctttgtaccagtact

SEQ ID NO: 405103 - DNA, 25 bp, Mus musculus
gaaacagtcctgctctggctgttat

SEQ ID NO: 405104 - DNA, 25 bp, Mus musculus
gaaacagtcctggtctggctgttat

SEQ ID NO: 405105 - DNA, 25 bp, Mus musculus
gaaacagtctatctccttctggaaa

SEQ ID NO: 405106 - DNA, 25 bp, Mus musculus
gaaacagtctatgtccttctggaaa

SEQ ID NO: 405107 - DNA, 25 bp, Mus musculus
gaaacagtctctagttcttgggaag

SEQ ID NO: 405108 - DNA, 25 bp, Mus musculus
gaaacagtctctccagcatcaggac

SEQ ID NO: 405109 - DNA, 25 bp, Mus musculus
gaaacagtctctgcagcatcaggac

SEQ ID NO: 405110 - DNA, 25 bp, Mus musculus
gaaacagtctcttgttcttgggaag

SEQ ID NO: 405111 - DNA, 25 bp, Mus musculus
gaaacagtctttacctaagcattat

SEQ ID NO: 405112 - DNA, 25 bp, Mus musculus
gaaacagtcttttcctaagcattat

SEQ ID NO: 405113 - DNA, 25 bp, Mus musculus
gaaacagtgaaactattccttcctt

SEQ ID NO: 405114 - DNA, 25 bp, Mus musculus
gaaacagtgaaagtattccttcctt

SEQ ID NO: 405115 - DNA, 25 bp, Mus musculus
gaaacagtgaggctctgccaatcac

SEQ ID NO: 405116 - DNA, 25 bp, Mus musculus
gaaacagtgagggtctgccaatcac

SEQ ID NO: 405117 - DNA, 25 bp, Mus musculus
gaaacagtgagtacccttttgccct

SEQ ID NO: 405118 - DNA, 25 bp, Mus musculus
gaaacagtgagttcccttttgccct

SEQ ID NO: 405119 - DNA, 25 bp, Mus musculus
gaaacagtgcacaactaattcatac

SEQ ID NO: 405120 - DNA, 25 bp, Mus musculus
gaaacagtgcactactaattcatac

SEQ ID NO: 405121 - DNA, 25 bp, Mus musculus
gaaacagtgcagactccattctgtc

SEQ ID NO: 405122 - DNA, 25 bp, Mus musculus
gaaacagtgcagtctccattctgtc

SEQ ID NO: 405123 - DNA, 25 bp, Mus musculus
gaaacagtgcggatccaaggaagag

SEQ ID NO: 405124 - DNA, 25 bp, Mus musculus
gaaacagtgcggttccaaggaagag

SEQ ID NO: 405125 - DNA, 25 bp, Mus musculus
gaaacagtgctgaattcgcttagga

SEQ ID NO: 405126 - DNA, 25 bp, Mus musculus
gaaacagtgctgtattcgcttagga

SEQ ID NO: 405127 - DNA, 25 bp, Mus musculus
gaaacagtgcttaagccaaattcca

SEQ ID NO: 405128 - DNA, 25 bp, Mus musculus
gaaacagtgcttataagcagattat

SEQ ID NO: 405129 - DNA, 25 bp, Mus musculus
gaaacagtgctttagccaaattcca

SEQ ID NO: 405130 - DNA, 25 bp, Mus musculus
gaaacagtgcttttaagcagattat

SEQ ID NO: 405131 - DNA, 25 bp, Mus musculus
gaaacagtggccctctgcaatgaat

SEQ ID NO: 405132 - DNA, 25 bp, Mus musculus
gaaacagtggccgtctgcaatgaat

SEQ ID NO: 405133 - DNA, 25 bp, Mus musculus
gaaacagtgggtcctgctttgctcc

SEQ ID NO: 405134 - DNA, 25 bp, Mus musculus
gaaacagtgggtgctgctttgctcc

SEQ ID NO: 405135 - DNA, 25 bp, Mus musculus
gaaacagtgtaaacaacagccaaac

SEQ ID NO: 405136 - DNA, 25 bp, Mus musculus
gaaacagtgtaatcaacagccaaac

SEQ ID NO: 405137 - DNA, 25 bp, Mus musculus
gaaacagtgttgacaggatcatctc

SEQ ID NO: 405138 - DNA, 25 bp, Mus musculus
gaaacagtgttgtcaggatcatctc

SEQ ID NO: 405139 - DNA, 25 bp, Mus musculus
gaaacagtgtttaacctgagcgcta

SEQ ID NO: 405140 - DNA, 25 bp, Mus musculus
gaaacagtgttttacctgagcgcta

SEQ ID NO: 405141 - DNA, 25 bp, Mus musculus
gaaacagttcggcatggctcccagc

SEQ ID NO: 405142 - DNA, 25 bp, Mus musculus
gaaacagttcgggatggctcccagc

SEQ ID NO: 405143 - DNA, 25 bp, Mus musculus
gaaacagttctcacagtacatcaag

SEQ ID NO: 405144 - DNA, 25 bp, Mus musculus
gaaacagttctctcagtacatcaag

SEQ ID NO: 405145 - DNA, 25 bp, Mus musculus
gaaacagttctgacactcagcctat

SEQ ID NO: 405146 - DNA, 25 bp, Mus musculus
gaaacagttctgtcactcagcctat

SEQ ID NO: 405147 - DNA, 25 bp, Mus musculus
gaaacagttcttcagcctgttcttt

SEQ ID NO: 405148 - DNA, 25 bp, Mus musculus
gaaacagttcttgagcctgttcttt

SEQ ID NO: 405149 - DNA, 25 bp, Mus musculus
gaaacagttgcaagtagtaacacta

SEQ ID NO: 405150 - DNA, 25 bp, Mus musculus
gaaacagttgcacccgctatcgaaa

SEQ ID NO: 405151 - DNA, 25 bp, Mus musculus
gaaacagttgcagccgctatcgaaa

SEQ ID NO: 405152 - DNA, 25 bp, Mus musculus
gaaacagttgcatgtagtaacacta

SEQ ID NO: 405153 - DNA, 25 bp, Mus musculus
gaaacagttggccatgtgccttgtc

SEQ ID NO: 405154 - DNA, 25 bp, Mus musculus
gaaacagttggcgatgtgccttgtc

SEQ ID NO: 405155 - DNA, 25 bp, Mus musculus
gaaacagttgggagagctctcaaat

SEQ ID NO: 405156 - DNA, 25 bp, Mus musculus
gaaacagttgggtgagctctcaaat

SEQ ID NO: 405157 - DNA, 25 bp, Mus musculus
gaaacagttggtcacctgctacaga

SEQ ID NO: 405158 - DNA, 25 bp, Mus musculus
gaaacagttggtgacctgctacaga

SEQ ID NO: 405159 - DNA, 25 bp, Mus musculus
gaaacagttgttcactactcttgag

SEQ ID NO: 405160 - DNA, 25 bp, Mus musculus
gaaacagttgttcttggtgcgttgt

SEQ ID NO: 405161 - DNA, 25 bp, Mus musculus
gaaacagttgttgactactcttgag

SEQ ID NO: 405162 - DNA, 25 bp, Mus musculus
gaaacagttgttgttggtgcgttgt

SEQ ID NO: 405163 - DNA, 25 bp, Mus musculus
gaaacagtttctagcttttcggaat

SEQ ID NO: 405164 - DNA, 25 bp, Mus musculus
gaaacagtttcttgcttttcggaat

SEQ ID NO: 405165 - DNA, 25 bp, Mus musculus
gaaacagttttgatttcaggtaact

SEQ ID NO: 405166 - DNA, 25 bp, Mus musculus
gaaacagttttgttttcaggtaact

SEQ ID NO: 405167 - DNA, 25 bp, Mus musculus
gaaacataatcacgaagtggccctc

SEQ ID NO: 405168 - DNA, 25 bp, Mus musculus
gaaacataatcaggaagtggccctc

SEQ ID NO: 405169 - DNA, 25 bp, Mus musculus
gaaacataatgacacccgccagtaa

SEQ ID NO: 405170 - DNA, 25 bp, Mus musculus
gaaacataatgagacccgccagtaa

SEQ ID NO: 405171 - DNA, 25 bp, Mus musculus
gaaacataatttcccagtagactta

SEQ ID NO: 405172 - DNA, 25 bp, Mus musculus
gaaacataatttgccagtagactta

SEQ ID NO: 405173 - DNA, 25 bp, Mus musculus
gaaacatacaaaaaccctccgctgc

SEQ ID NO: 405174 - DNA, 25 bp, Mus musculus
gaaacatacaaataccctccgctgc

SEQ ID NO: 405175 - DNA, 25 bp, Mus musculus
gaaacatacaggaacattgcataca

SEQ ID NO: 405176 - DNA, 25 bp, Mus musculus
gaaacatacaggtacattgcataca

SEQ ID NO: 405177 - DNA, 25 bp, Mus musculus
gaaacataccagcttagccaccatt

SEQ ID NO: 405178 - DNA, 25 bp, Mus musculus
gaaacataccaggttagccaccatt

SEQ ID NO: 405179 - DNA, 25 bp, Mus musculus
gaaacatacccacaagatcagctag

SEQ ID NO: 405180 - DNA, 25 bp, Mus musculus
gaaacatacccagaagatcagctag

SEQ ID NO: 405181 - DNA, 25 bp, Mus musculus
gaaacatacggcatacttgtacatt

SEQ ID NO: 405182 - DNA, 25 bp, Mus musculus
gaaacatacggcttacttgtacatt

SEQ ID NO: 405183 - DNA, 25 bp, Mus musculus
gaaacatactagaatttgaaagccc

SEQ ID NO: 405184 - DNA, 25 bp, Mus musculus
gaaacatactagtatttgaaagccc

SEQ ID NO: 405185 - DNA, 25 bp, Mus musculus
gaaacatactctccccatatggctt

SEQ ID NO: 405186 - DNA, 25 bp, Mus musculus
gaaacatactctgcccatatggctt

SEQ ID NO: 405187 - DNA, 25 bp, Mus musculus
gaaacatagcagaatgttaacccat

SEQ ID NO: 405188 - DNA, 25 bp, Mus musculus
gaaacatagcagcagtcccgggttg

SEQ ID NO: 405189 - DNA, 25 bp, Mus musculus
gaaacatagcaggagtcccgggttg

SEQ ID NO: 405190 - DNA, 25 bp, Mus musculus
gaaacatagcagtatgttaacccat

SEQ ID NO: 405191 - DNA, 25 bp, Mus musculus
gaaacataggagactacaagataca

SEQ ID NO: 405192 - DNA, 25 bp, Mus musculus
gaaacataggagtctacaagataca

SEQ ID NO: 405193 - DNA, 25 bp, Mus musculus
gaaacatatctcaatccatggctag

SEQ ID NO: 405194 - DNA, 25 bp, Mus musculus
gaaacatatctctatccatggctag

SEQ ID NO: 405195 - DNA, 25 bp, Mus musculus
gaaacatcaacacagtgcgcgccat

SEQ ID NO: 405196 - DNA, 25 bp, Mus musculus
gaaacatcaacagagtgcgcgccat

SEQ ID NO: 405197 - DNA, 25 bp, Mus musculus
gaaacatcaattctacctaggtcac

SEQ ID NO: 405198 - DNA, 25 bp, Mus musculus
gaaacatcaattgtacctaggtcac

SEQ ID NO: 405199 - DNA, 25 bp, Mus musculus
gaaacatcactcactaacagcacgt

SEQ ID NO: 405200 - DNA, 25 bp, Mus musculus
gaaacatcactctctaacagcacgt

SEQ ID NO: 405201 - DNA, 25 bp, Mus musculus
gaaacatcacttaaccagctacaag

SEQ ID NO: 405202 - DNA, 25 bp, Mus musculus
gaaacatcactttaccagctacaag

SEQ ID NO: 405203 - DNA, 25 bp, Mus musculus
gaaacatcagaacctaactcggaga

SEQ ID NO: 405204 - DNA, 25 bp, Mus musculus
gaaacatcagaagctaactcggaga

SEQ ID NO: 405205 - DNA, 25 bp, Mus musculus
gaaacatcagcaatcagcttgtgat

SEQ ID NO: 405206 - DNA, 25 bp, Mus musculus
gaaacatcagcattcagcttgtgat

SEQ ID NO: 405207 - DNA, 25 bp, Mus musculus
gaaacatcatccagtcacagtgcaa

SEQ ID NO: 405208 - DNA, 25 bp, Mus musculus
gaaacatcatccctataagtaacgg

SEQ ID NO: 405209 - DNA, 25 bp, Mus musculus
gaaacatcatccgtataagtaacgg

SEQ ID NO: 405210 - DNA, 25 bp, Mus musculus
gaaacatcatcctgtcacagtgcaa

SEQ ID NO: 405211 - DNA, 25 bp, Mus musculus
gaaacatcatgcaaagccaggcagt

SEQ ID NO: 405212 - DNA, 25 bp, Mus musculus
gaaacatcatgctaagccaggcagt

SEQ ID NO: 405213 - DNA, 25 bp, Mus musculus
gaaacatcatggactagcatcccca

SEQ ID NO: 405214 - DNA, 25 bp, Mus musculus
gaaacatcatggtctagcatcccca

SEQ ID NO: 405215 - DNA, 25 bp, Mus musculus
gaaacatccagtacaccaggacttc

SEQ ID NO: 405216 - DNA, 25 bp, Mus musculus
gaaacatccagttcaccaggacttc

SEQ ID NO: 405217 - DNA, 25 bp, Mus musculus
gaaacatccctgcattcccttctaa

SEQ ID NO: 405218 - DNA, 25 bp, Mus musculus
gaaacatccctggattcccttctaa

SEQ ID NO: 405219 - DNA, 25 bp, Mus musculus
gaaacatccgtacactcttgtagtg

SEQ ID NO: 405220 - DNA, 25 bp, Mus musculus
gaaacatccgtagactcttgtagtg

SEQ ID NO: 405221 - DNA, 25 bp, Mus musculus
gaaacatcctctccttggtaaatgg

SEQ ID NO: 405222 - DNA, 25 bp, Mus musculus
gaaacatcctctgcttggtaaatgg

SEQ ID NO: 405223 - DNA, 25 bp, Mus musculus
gaaacatctcacagcccaggtgtca

SEQ ID NO: 405224 - DNA, 25 bp, Mus musculus
gaaacatctcactgcccaggtgtca

SEQ ID NO: 405225 - DNA, 25 bp, Mus musculus
gaaacatctctgagccaaagaccaa

SEQ ID NO: 405226 - DNA, 25 bp, Mus musculus
gaaacatctctgtgccaaagaccaa

SEQ ID NO: 405227 - DNA, 25 bp, Mus musculus
gaaacatctgctcagtcattatact

SEQ ID NO: 405228 - DNA, 25 bp, Mus musculus
gaaacatctgctgagtcattatact

SEQ ID NO: 405229 - DNA, 25 bp, Mus musculus
gaaacatctggaaaccacgtctgcc

SEQ ID NO: 405230 - DNA, 25 bp, Mus musculus
gaaacatctggaacatcctgaggat

SEQ ID NO: 405231 - DNA, 25 bp, Mus musculus
gaaacatctggataccacgtctgcc

SEQ ID NO: 405232 - DNA, 25 bp, Mus musculus
gaaacatctggatcatcctgaggat

SEQ ID NO: 405233 - DNA, 25 bp, Mus musculus
gaaacatctgtcatggctgtagttg

SEQ ID NO: 405234 - DNA, 25 bp, Mus musculus
gaaacatctgtcttggctgtagttg

SEQ ID NO: 405235 - DNA, 25 bp, Mus musculus
gaaacatctgttaacattccaaatt

SEQ ID NO: 405236 - DNA, 25 bp, Mus musculus
gaaacatctgtttacattccaaatt

SEQ ID NO: 405237 - DNA, 25 bp, Mus musculus
gaaacatctttgacagcaggtgctg

SEQ ID NO: 405238 - DNA, 25 bp, Mus musculus
gaaacatctttgatggccacattaa

SEQ ID NO: 405239 - DNA, 25 bp, Mus musculus
gaaacatctttgtcagcaggtgctg

SEQ ID NO: 405240 - DNA, 25 bp, Mus musculus
gaaacatctttgttggccacattaa

SEQ ID NO: 405241 - DNA, 25 bp, Mus musculus
gaaacatgaaggactcccatcagag

SEQ ID NO: 405242 - DNA, 25 bp, Mus musculus
gaaacatgaaggtctcccatcagag

SEQ ID NO: 405243 - DNA, 25 bp, Mus musculus
gaaacatgaggcagagagagcctgt

SEQ ID NO: 405244 - DNA, 25 bp, Mus musculus
gaaacatgaggccttgatccatgtc

SEQ ID NO: 405245 - DNA, 25 bp, Mus musculus
gaaacatgaggcgttgatccatgtc

SEQ ID NO: 405246 - DNA, 25 bp, Mus musculus
gaaacatgaggctgagagagcctgt

SEQ ID NO: 405247 - DNA, 25 bp, Mus musculus
gaaacatgaggtaccctgccaagta

SEQ ID NO: 405248 - DNA, 25 bp, Mus musculus
gaaacatgaggttccctgccaagta

SEQ ID NO: 405249 - DNA, 25 bp, Mus musculus
gaaacatgatgtcctcattcccgct

SEQ ID NO: 405250 - DNA, 25 bp, Mus musculus
gaaacatgatgtgctcattcccgct

SEQ ID NO: 405251 - DNA, 25 bp, Mus musculus
gaaacatgcagaagctgggaactat

SEQ ID NO: 405252 - DNA, 25 bp, Mus musculus
gaaacatgcagaccttcctttacaa

SEQ ID NO: 405253 - DNA, 25 bp, Mus musculus
gaaacatgcagagcttcctttacaa

SEQ ID NO: 405254 - DNA, 25 bp, Mus musculus
gaaacatgcagatgctgggaactat

SEQ ID NO: 405255 - DNA, 25 bp, Mus musculus
gaaacatgccgaccaagctgtcttt

SEQ ID NO: 405256 - DNA, 25 bp, Mus musculus
gaaacatgccgagcaagctgtcttt

SEQ ID NO: 405257 - DNA, 25 bp, Mus musculus
gaaacatgcctgcattttctaagtt

SEQ ID NO: 405258 - DNA, 25 bp, Mus musculus
gaaacatgcctggattttctaagtt

SEQ ID NO: 405259 - DNA, 25 bp, Mus musculus
gaaacatgctacatggtggtgacct

SEQ ID NO: 405260 - DNA, 25 bp, Mus musculus
gaaacatgctacttggtggtgacct

SEQ ID NO: 405261 - DNA, 25 bp, Mus musculus
gaaacatgctgcctcttgcttctga

SEQ ID NO: 405262 - DNA, 25 bp, Mus musculus
gaaacatgctgcgtcttgcttctga

SEQ ID NO: 405263 - DNA, 25 bp, Mus musculus
gaaacatggaaccttcgtgcagaga

SEQ ID NO: 405264 - DNA, 25 bp, Mus musculus
gaaacatggaacgttcgtgcagaga

SEQ ID NO: 405265 - DNA, 25 bp, Mus musculus
gaaacatggcatacttaactaaaat

SEQ ID NO: 405266 - DNA, 25 bp, Mus musculus
gaaacatggcattcttaactaaaat

SEQ ID NO: 405267 - DNA, 25 bp, Mus musculus
gaaacatggcgtaggtctgctgtgc

SEQ ID NO: 405268 - DNA, 25 bp, Mus musculus
gaaacatggcgttggtctgctgtgc

SEQ ID NO: 405269 - DNA, 25 bp, Mus musculus
gaaacatggtctcaccatagccaag

SEQ ID NO: 405270 - DNA, 25 bp, Mus musculus
gaaacatggtctgaccatagccaag

SEQ ID NO: 405271 - DNA, 25 bp, Mus musculus
gaaacatggtggatccatcccagca

SEQ ID NO: 405272 - DNA, 25 bp, Mus musculus
gaaacatggtggttccatcccagca

SEQ ID NO: 405273 - DNA, 25 bp, Mus musculus
gaaacatgtagaacaatataccgat

SEQ ID NO: 405274 - DNA, 25 bp, Mus musculus
gaaacatgtagatcaatataccgat

SEQ ID NO: 405275 - DNA, 25 bp, Mus musculus
gaaacatgtagcatatcggcatttg

SEQ ID NO: 405276 - DNA, 25 bp, Mus musculus
gaaacatgtagcttatcggcatttg

SEQ ID NO: 405277 - DNA, 25 bp, Mus musculus
gaaacatgtcttagtattcctaatg

SEQ ID NO: 405278 - DNA, 25 bp, Mus musculus
gaaacatgtctttgtattcctaatg

SEQ ID NO: 405279 - DNA, 25 bp, Mus musculus
gaaacatgtgcgcaaacttcatgac

SEQ ID NO: 405280 - DNA, 25 bp, Mus musculus
gaaacatgtgcggaaacttcatgac

SEQ ID NO: 405281 - DNA, 25 bp, Mus musculus
gaaacatgtgctattacgcctccaa

SEQ ID NO: 405282 - DNA, 25 bp, Mus musculus
gaaacatgtgctcccttaactgagg

SEQ ID NO: 405283 - DNA, 25 bp, Mus musculus
gaaacatgtgctgccttaactgagg

SEQ ID NO: 405284 - DNA, 25 bp, Mus musculus
gaaacatgtgcttttacgcctccaa

SEQ ID NO: 405285 - DNA, 25 bp, Mus musculus
gaaacatgtgttctcttgcttataa

SEQ ID NO: 405286 - DNA, 25 bp, Mus musculus
gaaacatgtgttgtcttgcttataa

SEQ ID NO: 405287 - DNA, 25 bp, Mus musculus
gaaacatgtttaactatacccagag

SEQ ID NO: 405288 - DNA, 25 bp, Mus musculus
gaaacatgtttatctatacccagag

SEQ ID NO: 405289 - DNA, 25 bp, Mus musculus
gaaacattacatcctatagcagcgt

SEQ ID NO: 405290 - DNA, 25 bp, Mus musculus
gaaacattacatgctatagcagcgt

SEQ ID NO: 405291 - DNA, 25 bp, Mus musculus
gaaacattagaaagctctcgagccg

SEQ ID NO: 405292 - DNA, 25 bp, Mus musculus
gaaacattagaatgctctcgagccg

SEQ ID NO: 405293 - DNA, 25 bp, Mus musculus
gaaacattatgccacgatgtgagca

SEQ ID NO: 405294 - DNA, 25 bp, Mus musculus
gaaacattatgcgacgatgtgagca

SEQ ID NO: 405295 - DNA, 25 bp, Mus musculus
gaaacattattcctgcactgctgaa

SEQ ID NO: 405296 - DNA, 25 bp, Mus musculus
gaaacattattcgtgcactgctgaa

SEQ ID NO: 405297 - DNA, 25 bp, Mus musculus
gaaacattcaacaatcactgtcgta

SEQ ID NO: 405298 - DNA, 25 bp, Mus musculus
gaaacattcaactatcactgtcgta

SEQ ID NO: 405299 - DNA, 25 bp, Mus musculus
gaaacattcaggacaggtagtacaa

SEQ ID NO: 405300 - DNA, 25 bp, Mus musculus
gaaacattcaggctgttgtcccttc

SEQ ID NO: 405301 - DNA, 25 bp, Mus musculus
gaaacattcagggtgttgtcccttc

SEQ ID NO: 405302 - DNA, 25 bp, Mus musculus
gaaacattcaggtcaggtagtacaa

SEQ ID NO: 405303 - DNA, 25 bp, Mus musculus
gaaacattcagtctctttgccaaaa

SEQ ID NO: 405304 - DNA, 25 bp, Mus musculus
gaaacattcagtgtctttgccaaaa

SEQ ID NO: 405305 - DNA, 25 bp, Mus musculus
gaaacattcataaggcttttaggta

SEQ ID NO: 405306 - DNA, 25 bp, Mus musculus
gaaacattcatatggcttttaggta

SEQ ID NO: 405307 - DNA, 25 bp, Mus musculus
gaaacattcattaatcctgcgtaga

SEQ ID NO: 405308 - DNA, 25 bp, Mus musculus
gaaacattcatttatcctgcgtaga

SEQ ID NO: 405309 - DNA, 25 bp, Mus musculus
gaaacattccaacattggtgggtgt

SEQ ID NO: 405310 - DNA, 25 bp, Mus musculus
gaaacattccaagattggtgggtgt

SEQ ID NO: 405311 - DNA, 25 bp, Mus musculus
gaaacattccagacgactttgcgca

SEQ ID NO: 405312 - DNA, 25 bp, Mus musculus
gaaacattccagtcgactttgcgca

SEQ ID NO: 405313 - DNA, 25 bp, Mus musculus
gaaacattcccacctgtaatgttgt

SEQ ID NO: 405314 - DNA, 25 bp, Mus musculus
gaaacattcccagctgtaatgttgt

SEQ ID NO: 405315 - DNA, 25 bp, Mus musculus
gaaacattcctccaatgtttgttgt

SEQ ID NO: 405316 - DNA, 25 bp, Mus musculus
gaaacattcctccttcaccaggctg

SEQ ID NO: 405317 - DNA, 25 bp, Mus musculus
gaaacattcctcgaatgtttgttgt

SEQ ID NO: 405318 - DNA, 25 bp, Mus musculus
gaaacattcctcgttcaccaggctg

SEQ ID NO: 405319 - DNA, 25 bp, Mus musculus
gaaacattctctacgtattgtcaag

SEQ ID NO: 405320 - DNA, 25 bp, Mus musculus
gaaacattctcttcgtattgtcaag

SEQ ID NO: 405321 - DNA, 25 bp, Mus musculus
gaaacattctgacaagcttcctgga

SEQ ID NO: 405322 - DNA, 25 bp, Mus musculus
gaaacattctgagaagcttcctgga

SEQ ID NO: 405323 - DNA, 25 bp, Mus musculus
gaaacattctgtccttgatcaatta

SEQ ID NO: 405324 - DNA, 25 bp, Mus musculus
gaaacattctgtgcttgatcaatta

SEQ ID NO: 405325 - DNA, 25 bp, Mus musculus
gaaacattcttgcagcgtcacaaag

SEQ ID NO: 405326 - DNA, 25 bp, Mus musculus
gaaacattcttggagcgtcacaaag

SEQ ID NO: 405327 - DNA, 25 bp, Mus musculus
gaaacattgaccatgatgtacttct

SEQ ID NO: 405328 - DNA, 25 bp, Mus musculus
gaaacattgaccttgatgtacttct

SEQ ID NO: 405329 - DNA, 25 bp, Mus musculus
gaaacattgagcacctactgtccgc

SEQ ID NO: 405330 - DNA, 25 bp, Mus musculus
gaaacattgagctcctactgtccgc

SEQ ID NO: 405331 - DNA, 25 bp, Mus musculus
gaaacattgcatatgttggctgcat

SEQ ID NO: 405332 - DNA, 25 bp, Mus musculus
gaaacattgcatttgttggctgcat

SEQ ID NO: 405333 - DNA, 25 bp, Mus musculus
gaaacattgcctaaagggatacctt

SEQ ID NO: 405334 - DNA, 25 bp, Mus musculus
gaaacattgccttaagggatacctt

SEQ ID NO: 405335 - DNA, 25 bp, Mus musculus
gaaacattgctgctaacccacacat

SEQ ID NO: 405336 - DNA, 25 bp, Mus musculus
gaaacattgctggtaacccacacat

SEQ ID NO: 405337 - DNA, 25 bp, Mus musculus
gaaacattgcttagcatctttagtt

SEQ ID NO: 405338 - DNA, 25 bp, Mus musculus
gaaacattgcttcaaatcctcctct

SEQ ID NO: 405339 - DNA, 25 bp, Mus musculus
gaaacattgcttgaaatcctcctct

SEQ ID NO: 405340 - DNA, 25 bp, Mus musculus
gaaacattgctttgcatctttagtt

SEQ ID NO: 405341 - DNA, 25 bp, Mus musculus
gaaacattggatccactccgagcgc

SEQ ID NO: 405342 - DNA, 25 bp, Mus musculus
gaaacattggatgcactccgagcgc

SEQ ID NO: 405343 - DNA, 25 bp, Mus musculus
gaaacattggccctcaactggcaat

SEQ ID NO: 405344 - DNA, 25 bp, Mus musculus
gaaacattggccgtcaactggcaat

SEQ ID NO: 405345 - DNA, 25 bp, Mus musculus
gaaacattgtctcccaattctgcag

SEQ ID NO: 405346 - DNA, 25 bp, Mus musculus
gaaacattgtctgccaattctgcag

SEQ ID NO: 405347 - DNA, 25 bp, Mus musculus
gaaacatttaaaatgcctttaggct

SEQ ID NO: 405348 - DNA, 25 bp, Mus musculus
gaaacatttaaattgcctttaggct

SEQ ID NO: 405349 - DNA, 25 bp, Mus musculus
gaaacatttaagctgcacagtccag

SEQ ID NO: 405350 - DNA, 25 bp, Mus musculus
gaaacatttaaggtgcacagtccag

SEQ ID NO: 405351 - DNA, 25 bp, Mus musculus
gaaacatttagactgtactggctgg

SEQ ID NO: 405352 - DNA, 25 bp, Mus musculus
gaaacatttagagtgtactggctgg

SEQ ID NO: 405353 - DNA, 25 bp, Mus musculus
gaaacatttcaactaaccgtgctat

SEQ ID NO: 405354 - DNA, 25 bp, Mus musculus
gaaacatttcaagtaaccgtgctat

SEQ ID NO: 405355 - DNA, 25 bp, Mus musculus
gaaacatttccaataggtgctaacg

SEQ ID NO: 405356 - DNA, 25 bp, Mus musculus
gaaacatttccattaggtgctaacg

SEQ ID NO: 405357 - DNA, 25 bp, Mus musculus
gaaacatttcctattccaaaagctt

SEQ ID NO: 405358 - DNA, 25 bp, Mus musculus
gaaacatttcctcgcacccgtgtgt

SEQ ID NO: 405359 - DNA, 25 bp, Mus musculus
gaaacatttcctggcacccgtgtgt

SEQ ID NO: 405360 - DNA, 25 bp, Mus musculus
gaaacatttccttttccaaaagctt

SEQ ID NO: 405361 - DNA, 25 bp, Mus musculus
gaaacatttctgcttgaattgccgg

SEQ ID NO: 405362 - DNA, 25 bp, Mus musculus
gaaacatttctggttgaattgccgg

SEQ ID NO: 405363 - DNA, 25 bp, Mus musculus
gaaacatttgataacatcatttcta

SEQ ID NO: 405364 - DNA, 25 bp, Mus musculus
gaaacatttgattacatcatttcta

SEQ ID NO: 405365 - DNA, 25 bp, Mus musculus
gaaacatttgcaaacacatcgtctt

SEQ ID NO: 405366 - DNA, 25 bp, Mus musculus
gaaacatttgcatacacatcgtctt

SEQ ID NO: 405367 - DNA, 25 bp, Mus musculus
gaaacattttctccataacctcaga

SEQ ID NO: 405368 - DNA, 25 bp, Mus musculus
gaaacattttctgcataacctcaga

SEQ ID NO: 405369 - DNA, 25 bp, Mus musculus
gaaacattttgcactcacactacac

SEQ ID NO: 405370 - DNA, 25 bp, Mus musculus
gaaacattttgctctcacactacac

SEQ ID NO: 405371 - DNA, 25 bp, Mus musculus
gaaacatttttaaactcccctgtct

SEQ ID NO: 405372 - DNA, 25 bp, Mus musculus
gaaacatttttaagctcccaaatca

SEQ ID NO: 405373 - DNA, 25 bp, Mus musculus
gaaacatttttatactcccctgtct

SEQ ID NO: 405374 - DNA, 25 bp, Mus musculus
gaaacatttttatgctcccaaatca

SEQ ID NO: 405375 - DNA, 25 bp, Mus musculus
gaaacatttttcactattcccgttg

SEQ ID NO: 405376 - DNA, 25 bp, Mus musculus
gaaacatttttctctattcccgttg

SEQ ID NO: 405377 - DNA, 25 bp, Mus musculus
gaaaccaaaactctgtactgtcttt

SEQ ID NO: 405378 - DNA, 25 bp, Mus musculus
gaaaccaaaactgtgtactgtcttt

SEQ ID NO: 405379 - DNA, 25 bp, Mus musculus
gaaaccaaacgactccagggtcagt

SEQ ID NO: 405380 - DNA, 25 bp, Mus musculus
gaaaccaaacgagtccagggtcagt

SEQ ID NO: 405381 - DNA, 25 bp, Mus musculus
gaaaccaaagtcatactcctcaaga

SEQ ID NO: 405382 - DNA, 25 bp, Mus musculus
gaaaccaaagtcttactcctcaaga

SEQ ID NO: 405383 - DNA, 25 bp, Mus musculus
gaaaccaaatacactcttaaggcag

SEQ ID NO: 405384 - DNA, 25 bp, Mus musculus
gaaaccaaatactctcttaaggcag

SEQ ID NO: 405385 - DNA, 25 bp, Mus musculus
gaaaccaaatatccggccatgacag

SEQ ID NO: 405386 - DNA, 25 bp, Mus musculus
gaaaccaaatatgcggccatgacag

SEQ ID NO: 405387 - DNA, 25 bp, Mus musculus
gaaaccaaatcaatctacctcctgt

SEQ ID NO: 405388 - DNA, 25 bp, Mus musculus
gaaaccaaatcattctacctcctgt

SEQ ID NO: 405389 - DNA, 25 bp, Mus musculus
gaaaccaaatctactgcatgtgcat

SEQ ID NO: 405390 - DNA, 25 bp, Mus musculus
gaaaccaaatcttctgcatgtgcat

SEQ ID NO: 405391 - DNA, 25 bp, Mus musculus
gaaaccaaatgaccgcagatggcta

SEQ ID NO: 405392 - DNA, 25 bp, Mus musculus
gaaaccaaatgagcgcagatggcta

SEQ ID NO: 405393 - DNA, 25 bp, Mus musculus
gaaaccaacaataaatgttccaagt

SEQ ID NO: 405394 - DNA, 25 bp, Mus musculus
gaaaccaacaattaatgttccaagt

SEQ ID NO: 405395 - DNA, 25 bp, Mus musculus
gaaaccaacccgatacaatttgcca

SEQ ID NO: 405396 - DNA, 25 bp, Mus musculus
gaaaccaacccgttacaatttgcca

SEQ ID NO: 405397 - DNA, 25 bp, Mus musculus
gaaaccaagacgaaaggctctgtgt

SEQ ID NO: 405398 - DNA, 25 bp, Mus musculus
gaaaccaagacgtaaggctctgtgt

SEQ ID NO: 405399 - DNA, 25 bp, Mus musculus
gaaaccaagatcacatttgcagctt

SEQ ID NO: 405400 - DNA, 25 bp, Mus musculus
gaaaccaagatctcatttgcagctt

SEQ ID NO: 405401 - DNA, 25 bp, Mus musculus
gaaaccaagcaaccgtgttgtgcat

SEQ ID NO: 405402 - DNA, 25 bp, Mus musculus
gaaaccaagcaagcgtgttgtgcat

SEQ ID NO: 405403 - DNA, 25 bp, Mus musculus
gaaaccaagcagaggcctgtatcag

SEQ ID NO: 405404 - DNA, 25 bp, Mus musculus
gaaaccaagcagtggcctgtatcag

SEQ ID NO: 405405 - DNA, 25 bp, Mus musculus
gaaaccaagctacaaacattttgca

SEQ ID NO: 405406 - DNA, 25 bp, Mus musculus
gaaaccaagctagaaacattttgca

SEQ ID NO: 405407 - DNA, 25 bp, Mus musculus
gaaaccaagcttcggccttgcagtg

SEQ ID NO: 405408 - DNA, 25 bp, Mus musculus
gaaaccaagcttgggccttgcagtg

SEQ ID NO: 405409 - DNA, 25 bp, Mus musculus
gaaaccaagtgactggagcctccct

SEQ ID NO: 405410 - DNA, 25 bp, Mus musculus
gaaaccaagtgagtggagcctccct

SEQ ID NO: 405411 - DNA, 25 bp, Mus musculus
gaaaccaagtttatgaagctgaatg

SEQ ID NO: 405412 - DNA, 25 bp, Mus musculus
gaaaccaagtttttgaagctgaatg

SEQ ID NO: 405413 - DNA, 25 bp, Mus musculus
gaaaccaataccaaacatgcgctaa

SEQ ID NO: 405414 - DNA, 25 bp, Mus musculus
gaaaccaatacctaacatgcgctaa

SEQ ID NO: 405415 - DNA, 25 bp, Mus musculus
gaaaccaatggtattacataatttg

SEQ ID NO: 405416 - DNA, 25 bp, Mus musculus
gaaaccaatggtccgtgggtccaag

SEQ ID NO: 405417 - DNA, 25 bp, Mus musculus
gaaaccaatggtgcgtgggtccaag

SEQ ID NO: 405418 - DNA, 25 bp, Mus musculus
gaaaccaatggttttacataatttg

SEQ ID NO: 405419 - DNA, 25 bp, Mus musculus
gaaaccaatgtgatcgcagttacca

SEQ ID NO: 405420 - DNA, 25 bp, Mus musculus
gaaaccaatgtgttcgcagttacca

SEQ ID NO: 405421 - DNA, 25 bp, Mus musculus
gaaaccaattgcaatgccatacatg

SEQ ID NO: 405422 - DNA, 25 bp, Mus musculus
gaaaccaattgctatgccatacatg

SEQ ID NO: 405423 - DNA, 25 bp, Mus musculus
gaaaccaatttcaagctccccttag

SEQ ID NO: 405424 - DNA, 25 bp, Mus musculus
gaaaccaatttctagctccccttag

SEQ ID NO: 405425 - DNA, 25 bp, Mus musculus
gaaaccacaacaactgggcctttat

SEQ ID NO: 405426 - DNA, 25 bp, Mus musculus
gaaaccacaacatctgggcctttat

SEQ ID NO: 405427 - DNA, 25 bp, Mus musculus
gaaaccacacacacgacaagaacag

SEQ ID NO: 405428 - DNA, 25 bp, Mus musculus
gaaaccacacactcgacaagaacag

SEQ ID NO: 405429 - DNA, 25 bp, Mus musculus
gaaaccacactaatcatgcaaaagg

SEQ ID NO: 405430 - DNA, 25 bp, Mus musculus
gaaaccacactacgagaagctgcag

SEQ ID NO: 405431 - DNA, 25 bp, Mus musculus
gaaaccacactaggagaagctgcag

SEQ ID NO: 405432 - DNA, 25 bp, Mus musculus
gaaaccacactattcatgcaaaagg

SEQ ID NO: 405433 - DNA, 25 bp, Mus musculus
gaaaccacagacagttttctcgttg

SEQ ID NO: 405434 - DNA, 25 bp, Mus musculus
gaaaccacagactgttttctcgttg

SEQ ID NO: 405435 - DNA, 25 bp, Mus musculus
gaaaccacagagcatggtgtactat

SEQ ID NO: 405436 - DNA, 25 bp, Mus musculus
gaaaccacagaggatggtgtactat

SEQ ID NO: 405437 - DNA, 25 bp, Mus musculus
gaaaccacagctaacccaggaggag

SEQ ID NO: 405438 - DNA, 25 bp, Mus musculus
gaaaccacagcttacccaggaggag

SEQ ID NO: 405439 - DNA, 25 bp, Mus musculus
gaaaccacaggcaccgagagtgatg

SEQ ID NO: 405440 - DNA, 25 bp, Mus musculus
gaaaccacaggcactgagcagctta

SEQ ID NO: 405441 - DNA, 25 bp, Mus musculus
gaaaccacaggctccgagagtgatg

SEQ ID NO: 405442 - DNA, 25 bp, Mus musculus
gaaaccacaggctctgagcagctta

SEQ ID NO: 405443 - DNA, 25 bp, Mus musculus
gaaaccacagtactctagttccaga

SEQ ID NO: 405444 - DNA, 25 bp, Mus musculus
gaaaccacagtagtctagttccaga

SEQ ID NO: 405445 - DNA, 25 bp, Mus musculus
gaaaccacatccagaccagatacag

SEQ ID NO: 405446 - DNA, 25 bp, Mus musculus
gaaaccacatcctgaccagatacag

SEQ ID NO: 405447 - DNA, 25 bp, Mus musculus
gaaaccacattaactctttacgaca

SEQ ID NO: 405448 - DNA, 25 bp, Mus musculus
gaaaccacattatctctttacgaca

SEQ ID NO: 405449 - DNA, 25 bp, Mus musculus
gaaaccacatttaaaactctggaat

SEQ ID NO: 405450 - DNA, 25 bp, Mus musculus
gaaaccacattttaaactctggaat

SEQ ID NO: 405451 - DNA, 25 bp, Mus musculus
gaaaccaccaacactactgcaatga

SEQ ID NO: 405452 - DNA, 25 bp, Mus musculus
gaaaccaccaactctactgcaatga

SEQ ID NO: 405453 - DNA, 25 bp, Mus musculus
gaaaccaccagcagccttgtttagc

SEQ ID NO: 405454 - DNA, 25 bp, Mus musculus
gaaaccaccagctgccttgtttagc

SEQ ID NO: 405455 - DNA, 25 bp, Mus musculus
gaaaccaccagtcccaatatggctg

SEQ ID NO: 405456 - DNA, 25 bp, Mus musculus
gaaaccaccagtgccaatatggctg

SEQ ID NO: 405457 - DNA, 25 bp, Mus musculus
gaaaccaccatacatcccactggag

SEQ ID NO: 405458 - DNA, 25 bp, Mus musculus
gaaaccaccatagatcccactggag

SEQ ID NO: 405459 - DNA, 25 bp, Mus musculus
gaaaccaccatgcttttccttgtaa

SEQ ID NO: 405460 - DNA, 25 bp, Mus musculus
gaaaccaccatggttttccttgtaa

SEQ ID NO: 405461 - DNA, 25 bp, Mus musculus
gaaaccacccttatgaggttgagtg

SEQ ID NO: 405462 - DNA, 25 bp, Mus musculus
gaaaccacccttttgaggttgagtg

SEQ ID NO: 405463 - DNA, 25 bp, Mus musculus
gaaaccacctagcagcagacggagg

SEQ ID NO: 405464 - DNA, 25 bp, Mus musculus
gaaaccacctaggagcagacggagg

SEQ ID NO: 405465 - DNA, 25 bp, Mus musculus
gaaaccacctgcaatggcgagggct

SEQ ID NO: 405466 - DNA, 25 bp, Mus musculus
gaaaccacctgctatggcgagggct

SEQ ID NO: 405467 - DNA, 25 bp, Mus musculus
gaaaccacgggaagtgtcatctgtt

SEQ ID NO: 405468 - DNA, 25 bp, Mus musculus
gaaaccacgggatgtgtcatctgtt

SEQ ID NO: 405469 - DNA, 25 bp, Mus musculus
gaaaccacgtggatgtagtttttag

SEQ ID NO: 405470 - DNA, 25 bp, Mus musculus
gaaaccacgtggttgtagtttttag

SEQ ID NO: 405471 - DNA, 25 bp, Mus musculus
gaaaccactgttatcatggatcaaa

SEQ ID NO: 405472 - DNA, 25 bp, Mus musculus
gaaaccactgttttcatggatcaaa

SEQ ID NO: 405473 - DNA, 25 bp, Mus musculus
gaaaccacttcaatggacagttgca

SEQ ID NO: 405474 - DNA, 25 bp, Mus musculus
gaaaccacttcattggacagttgca

SEQ ID NO: 405475 - DNA, 25 bp, Mus musculus
gaaaccacttctacaggttggccag

SEQ ID NO: 405476 - DNA, 25 bp, Mus musculus
gaaaccacttcttcaggttggccag

SEQ ID NO: 405477 - DNA, 25 bp, Mus musculus
gaaaccacttgcacagccaacagat

SEQ ID NO: 405478 - DNA, 25 bp, Mus musculus
gaaaccacttgcattttggtgataa

SEQ ID NO: 405479 - DNA, 25 bp, Mus musculus
gaaaccacttgctcagccaacagat

SEQ ID NO: 405480 - DNA, 25 bp, Mus musculus
gaaaccacttgctttttggtgataa

SEQ ID NO: 405481 - DNA, 25 bp, Mus musculus
gaaaccagaacaaatcattgagcta

SEQ ID NO: 405482 - DNA, 25 bp, Mus musculus
gaaaccagaacatatcattgagcta

SEQ ID NO: 405483 - DNA, 25 bp, Mus musculus
gaaaccagacccataacactcaaga

SEQ ID NO: 405484 - DNA, 25 bp, Mus musculus
gaaaccagacccttaacactcaaga

SEQ ID NO: 405485 - DNA, 25 bp, Mus musculus
gaaaccagacctacaataactccca

SEQ ID NO: 405486 - DNA, 25 bp, Mus musculus
gaaaccagaccttcaataactccca

SEQ ID NO: 405487 - DNA, 25 bp, Mus musculus
gaaaccagactcagcaaagggactt

SEQ ID NO: 405488 - DNA, 25 bp, Mus musculus
gaaaccagactctgcaaagggactt

SEQ ID NO: 405489 - DNA, 25 bp, Mus musculus
gaaaccagacttcctaagtgctctg

SEQ ID NO: 405490 - DNA, 25 bp, Mus musculus
gaaaccagacttgctaagtgctctg

SEQ ID NO: 405491 - DNA, 25 bp, Mus musculus
gaaaccagagcaaacaggtctaatg

SEQ ID NO: 405492 - DNA, 25 bp, Mus musculus
gaaaccagagcatacaggtctaatg

SEQ ID NO: 405493 - DNA, 25 bp, Mus musculus
gaaaccagaggcacttaacagctga

SEQ ID NO: 405494 - DNA, 25 bp, Mus musculus
gaaaccagaggctcttaacagctga

SEQ ID NO: 405495 - DNA, 25 bp, Mus musculus
gaaaccagatgccttccaggacgaa

SEQ ID NO: 405496 - DNA, 25 bp, Mus musculus
gaaaccagatgcgttccaggacgaa

SEQ ID NO: 405497 - DNA, 25 bp, Mus musculus
gaaaccagcaggacagcaggccgag

SEQ ID NO: 405498 - DNA, 25 bp, Mus musculus
gaaaccagcaggtcagcaggccgag

SEQ ID NO: 405499 - DNA, 25 bp, Mus musculus
gaaaccagctacagtatggcccact

SEQ ID NO: 405500 - DNA, 25 bp, Mus musculus
gaaaccagctactgtatggcccact

SEQ ID NO: 405501 - DNA, 25 bp, Mus musculus
gaaaccagctataatggctttcctg

SEQ ID NO: 405502 - DNA, 25 bp, Mus musculus
gaaaccagctattatggctttcctg

SEQ ID NO: 405503 - DNA, 25 bp, Mus musculus
gaaaccagctccactgtacgagcag

SEQ ID NO: 405504 - DNA, 25 bp, Mus musculus
gaaaccagctcctctgtacgagcag

SEQ ID NO: 405505 - DNA, 25 bp, Mus musculus
gaaaccagctgtatagacactccct

SEQ ID NO: 405506 - DNA, 25 bp, Mus musculus
gaaaccagctgtttagacactccct

SEQ ID NO: 405507 - DNA, 25 bp, Mus musculus
gaaaccagctttcaaatgacacaat

SEQ ID NO: 405508 - DNA, 25 bp, Mus musculus
gaaaccagctttgaaatgacacaat

SEQ ID NO: 405509 - DNA, 25 bp, Mus musculus
gaaaccaggaagaagcgtccccact

SEQ ID NO: 405510 - DNA, 25 bp, Mus musculus
gaaaccaggaagtagcgtccccact

SEQ ID NO: 405511 - DNA, 25 bp, Mus musculus
gaaaccaggacaacgccagcagaga

SEQ ID NO: 405512 - DNA, 25 bp, Mus musculus
gaaaccaggacatcgccagcagaga

SEQ ID NO: 405513 - DNA, 25 bp, Mus musculus
gaaaccaggagaatccttccagagg

SEQ ID NO: 405514 - DNA, 25 bp, Mus musculus
gaaaccaggagattccttccagagg

SEQ ID NO: 405515 - DNA, 25 bp, Mus musculus
gaaaccaggagtaaggcttcagaga

SEQ ID NO: 405516 - DNA, 25 bp, Mus musculus
gaaaccaggagttaggcttcagaga

SEQ ID NO: 405517 - DNA, 25 bp, Mus musculus
gaaaccaggcacagaagtgacatac

SEQ ID NO: 405518 - DNA, 25 bp, Mus musculus
gaaaccaggcactgaagtgacatac

SEQ ID NO: 405519 - DNA, 25 bp, Mus musculus
gaaaccaggccaaccaaattggaag

SEQ ID NO: 405520 - DNA, 25 bp, Mus musculus
gaaaccaggccaagtcatataaaag

SEQ ID NO: 405521 - DNA, 25 bp, Mus musculus
gaaaccaggccatccaaattggaag

SEQ ID NO: 405522 - DNA, 25 bp, Mus musculus
gaaaccaggccatgtcatataaaag

SEQ ID NO: 405523 - DNA, 25 bp, Mus musculus
gaaaccaggcctatccagatactgg

SEQ ID NO: 405524 - DNA, 25 bp, Mus musculus
gaaaccaggcctttccagatactgg

SEQ ID NO: 405525 - DNA, 25 bp, Mus musculus
gaaaccaggctccatgcatagatta

SEQ ID NO: 405526 - DNA, 25 bp, Mus musculus
gaaaccaggctcgatgcatagatta

SEQ ID NO: 405527 - DNA, 25 bp, Mus musculus
gaaaccaggctgacttgtccattat

SEQ ID NO: 405528 - DNA, 25 bp, Mus musculus
gaaaccaggctgtcttgtccattat

SEQ ID NO: 405529 - DNA, 25 bp, Mus musculus
gaaaccaggcttcgatcaaattcct

SEQ ID NO: 405530 - DNA, 25 bp, Mus musculus
gaaaccaggcttggatcaaattcct

SEQ ID NO: 405531 - DNA, 25 bp, Mus musculus
gaaaccagggttaattcattgattt

SEQ ID NO: 405532 - DNA, 25 bp, Mus musculus
gaaaccagggtttattcattgattt

SEQ ID NO: 405533 - DNA, 25 bp, Mus musculus
gaaaccaggtccctcgatggtccaa

SEQ ID NO: 405534 - DNA, 25 bp, Mus musculus
gaaaccaggtccgtcgatggtccaa

SEQ ID NO: 405535 - DNA, 25 bp, Mus musculus
gaaaccaggtggacaactgctcttt

SEQ ID NO: 405536 - DNA, 25 bp, Mus musculus
gaaaccaggtggtcaactgctcttt

SEQ ID NO: 405537 - DNA, 25 bp, Mus musculus
gaaaccaggtgtcttacttgtgaaa

SEQ ID NO: 405538 - DNA, 25 bp, Mus musculus
gaaaccaggtgtgttacttgtgaaa

SEQ ID NO: 405539 - DNA, 25 bp, Mus musculus
gaaaccaggttgcaagcttataggc

SEQ ID NO: 405540 - DNA, 25 bp, Mus musculus
gaaaccaggttggaagcttataggc

SEQ ID NO: 405541 - DNA, 25 bp, Mus musculus
gaaaccaggtttctttggagcctct

SEQ ID NO: 405542 - DNA, 25 bp, Mus musculus
gaaaccaggtttgtttggagcctct

SEQ ID NO: 405543 - DNA, 25 bp, Mus musculus
gaaaccagtaataagctagcttttt

SEQ ID NO: 405544 - DNA, 25 bp, Mus musculus
gaaaccagtaattagctagcttttt

SEQ ID NO: 405545 - DNA, 25 bp, Mus musculus
gaaaccagtactacagatcggacat

SEQ ID NO: 405546 - DNA, 25 bp, Mus musculus
gaaaccagtacttcagatcggacat

SEQ ID NO: 405547 - DNA, 25 bp, Mus musculus
gaaaccagtagtaaattgttccaag

SEQ ID NO: 405548 - DNA, 25 bp, Mus musculus
gaaaccagtagttaattgttccaag

SEQ ID NO: 405549 - DNA, 25 bp, Mus musculus
gaaaccagtgctcccaacgggacaa

SEQ ID NO: 405550 - DNA, 25 bp, Mus musculus
gaaaccagtgctgccaacgggacaa

SEQ ID NO: 405551 - DNA, 25 bp, Mus musculus
gaaaccagtgtcacctttttcacct

SEQ ID NO: 405552 - DNA, 25 bp, Mus musculus
gaaaccagtgtctcctttttcacct

SEQ ID NO: 405553 - DNA, 25 bp, Mus musculus
gaaaccagtgttaatgaacatattc

SEQ ID NO: 405554 - DNA, 25 bp, Mus musculus
gaaaccagtgttatgagcagctttt

SEQ ID NO: 405555 - DNA, 25 bp, Mus musculus
gaaaccagtgtttatgaacatattc

SEQ ID NO: 405556 - DNA, 25 bp, Mus musculus
gaaaccagtgttttgagcagctttt

SEQ ID NO: 405557 - DNA, 25 bp, Mus musculus
gaaaccagttgcaggcatgctccaa

SEQ ID NO: 405558 - DNA, 25 bp, Mus musculus
gaaaccagttgctggcatgctccaa

SEQ ID NO: 405559 - DNA, 25 bp, Mus musculus
gaaaccataagtccaacctcggaat

SEQ ID NO: 405560 - DNA, 25 bp, Mus musculus
gaaaccataagtgcaacctcggaat

SEQ ID NO: 405561 - DNA, 25 bp, Mus musculus
gaaaccatagcaaagatgtacctag

SEQ ID NO: 405562 - DNA, 25 bp, Mus musculus
gaaaccatagcatagatgtacctag

SEQ ID NO: 405563 - DNA, 25 bp, Mus musculus
gaaaccatagccagctaattgctac

SEQ ID NO: 405564 - DNA, 25 bp, Mus musculus
gaaaccatagcctgctaattgctac

SEQ ID NO: 405565 - DNA, 25 bp, Mus musculus
gaaaccatatccatcagacatgagt

SEQ ID NO: 405566 - DNA, 25 bp, Mus musculus
gaaaccatatccttcagacatgagt

SEQ ID NO: 405567 - DNA, 25 bp, Mus musculus
gaaaccatatgtagatagtattcaa

SEQ ID NO: 405568 - DNA, 25 bp, Mus musculus
gaaaccatatgttgatagtattcaa

SEQ ID NO: 405569 - DNA, 25 bp, Mus musculus
gaaaccatattgcaggctcatgata

SEQ ID NO: 405570 - DNA, 25 bp, Mus musculus
gaaaccatattggaggctcatgata

SEQ ID NO: 405571 - DNA, 25 bp, Mus musculus
gaaaccatcaggcagttcttaattg

SEQ ID NO: 405572 - DNA, 25 bp, Mus musculus
gaaaccatcagggagttcttaattg

SEQ ID NO: 405573 - DNA, 25 bp, Mus musculus
gaaaccatcccactttccaagttag

SEQ ID NO: 405574 - DNA, 25 bp, Mus musculus
gaaaccatcccagtttccaagttag

SEQ ID NO: 405575 - DNA, 25 bp, Mus musculus
gaaaccatcgggagccttttatgta

SEQ ID NO: 405576 - DNA, 25 bp, Mus musculus
gaaaccatcgggtgccttttatgta

SEQ ID NO: 405577 - DNA, 25 bp, Mus musculus
gaaaccatctaaaacagccagcaag

SEQ ID NO: 405578 - DNA, 25 bp, Mus musculus
gaaaccatctaactgttgtccggaa

SEQ ID NO: 405579 - DNA, 25 bp, Mus musculus
gaaaccatctaagtgttgtccggaa

SEQ ID NO: 405580 - DNA, 25 bp, Mus musculus
gaaaccatctaatacagccagcaag

SEQ ID NO: 405581 - DNA, 25 bp, Mus musculus
gaaaccatctcacgcacagggacat

SEQ ID NO: 405582 - DNA, 25 bp, Mus musculus
gaaaccatctcaggcacagggacat

SEQ ID NO: 405583 - DNA, 25 bp, Mus musculus
gaaaccatctgaagatcacacatag

SEQ ID NO: 405584 - DNA, 25 bp, Mus musculus
gaaaccatctgatgatcacacatag

SEQ ID NO: 405585 - DNA, 25 bp, Mus musculus
gaaaccatgaagcagcagccagtca

SEQ ID NO: 405586 - DNA, 25 bp, Mus musculus
gaaaccatgaaggagcagccagtca

SEQ ID NO: 405587 - DNA, 25 bp, Mus musculus
gaaaccatgaataggactcaatctg

SEQ ID NO: 405588 - DNA, 25 bp, Mus musculus
gaaaccatgaattggactcaatctg

SEQ ID NO: 405589 - DNA, 25 bp, Mus musculus
gaaaccatgaccaagacagtttttt

SEQ ID NO: 405590 - DNA, 25 bp, Mus musculus
gaaaccatgacctagacagtttttt

SEQ ID NO: 405591 - DNA, 25 bp, Mus musculus
gaaaccatgaggaccgcagccggtc

SEQ ID NO: 405592 - DNA, 25 bp, Mus musculus
gaaaccatgaggattctttgtatta

SEQ ID NO: 405593 - DNA, 25 bp, Mus musculus
gaaaccatgaggtccgcagccggtc

SEQ ID NO: 405594 - DNA, 25 bp, Mus musculus
gaaaccatgaggtttctttgtatta

SEQ ID NO: 405595 - DNA, 25 bp, Mus musculus
gaaaccatgatcactaccagctagt

SEQ ID NO: 405596 - DNA, 25 bp, Mus musculus
gaaaccatgatctctaccagctagt

SEQ ID NO: 405597 - DNA, 25 bp, Mus musculus
gaaaccatgcaacccttccatttaa

SEQ ID NO: 405598 - DNA, 25 bp, Mus musculus
gaaaccatgcaagccttccatttaa

SEQ ID NO: 405599 - DNA, 25 bp, Mus musculus
gaaaccatgcatctgctccatgata

SEQ ID NO: 405600 - DNA, 25 bp, Mus musculus
gaaaccatgcatgtgctccatgata

SEQ ID NO: 405601 - DNA, 25 bp, Mus musculus
gaaaccatgctgcaattcctaaatt

SEQ ID NO: 405602 - DNA, 25 bp, Mus musculus
gaaaccatgctggaattcctaaatt

SEQ ID NO: 405603 - DNA, 25 bp, Mus musculus
gaaaccatggcgatgcgtgtgctga

SEQ ID NO: 405604 - DNA, 25 bp, Mus musculus
gaaaccatggcgttgcgtgtgctga

SEQ ID NO: 405605 - DNA, 25 bp, Mus musculus
gaaaccatggctagtgatccatcct

SEQ ID NO: 405606 - DNA, 25 bp, Mus musculus
gaaaccatggcttgtgatccatcct

SEQ ID NO: 405607 - DNA, 25 bp, Mus musculus
gaaaccatgggtagtggagcctaat

SEQ ID NO: 405608 - DNA, 25 bp, Mus musculus
gaaaccatgggttgtggagcctaat

SEQ ID NO: 405609 - DNA, 25 bp, Mus musculus
gaaaccatggttccggctttgaagt

SEQ ID NO: 405610 - DNA, 25 bp, Mus musculus
gaaaccatggttcttggtgactaca

SEQ ID NO: 405611 - DNA, 25 bp, Mus musculus
gaaaccatggttgcggctttgaagt

SEQ ID NO: 405612 - DNA, 25 bp, Mus musculus
gaaaccatggttgttggtgactaca

SEQ ID NO: 405613 - DNA, 25 bp, Mus musculus
gaaaccatgtacaggagccctcgtt

SEQ ID NO: 405614 - DNA, 25 bp, Mus musculus
gaaaccatgtactggagccctcgtt

SEQ ID NO: 405615 - DNA, 25 bp, Mus musculus
gaaaccatgtcgaaccagtagcaat

SEQ ID NO: 405616 - DNA, 25 bp, Mus musculus
gaaaccatgtcgtaccagtagcaat

SEQ ID NO: 405617 - DNA, 25 bp, Mus musculus
gaaaccattcagcacgtttgggtga

SEQ ID NO: 405618 - DNA, 25 bp, Mus musculus
gaaaccattcagcataaacaagcac

SEQ ID NO: 405619 - DNA, 25 bp, Mus musculus
gaaaccattcaggacgtttgggtga

SEQ ID NO: 405620 - DNA, 25 bp, Mus musculus
gaaaccattcaggataaacaagcac

SEQ ID NO: 405621 - DNA, 25 bp, Mus musculus
gaaaccattcctatgaaagctatgc

SEQ ID NO: 405622 - DNA, 25 bp, Mus musculus
gaaaccattcctttgaaagctatgc

SEQ ID NO: 405623 - DNA, 25 bp, Mus musculus
gaaaccattctaaattcctaattat

SEQ ID NO: 405624 - DNA, 25 bp, Mus musculus
gaaaccattctatattcctaattat

SEQ ID NO: 405625 - DNA, 25 bp, Mus musculus
gaaaccattctcagttttgtatggg

SEQ ID NO: 405626 - DNA, 25 bp, Mus musculus
gaaaccattctctgttttgtatggg

SEQ ID NO: 405627 - DNA, 25 bp, Mus musculus
gaaaccattctgaattgaaactctt

SEQ ID NO: 405628 - DNA, 25 bp, Mus musculus
gaaaccattctgtattgaaactctt

SEQ ID NO: 405629 - DNA, 25 bp, Mus musculus
gaaaccattgacctgcacatagacc

SEQ ID NO: 405630 - DNA, 25 bp, Mus musculus
gaaaccattgacgtgcacatagacc

SEQ ID NO: 405631 - DNA, 25 bp, Mus musculus
gaaaccattgagctgcggctagtta

SEQ ID NO: 405632 - DNA, 25 bp, Mus musculus
gaaaccattgaggtgcggctagtta

SEQ ID NO: 405633 - DNA, 25 bp, Mus musculus
gaaaccattgcacctgggagcactg

SEQ ID NO: 405634 - DNA, 25 bp, Mus musculus
gaaaccattgcagctgggagcactg

SEQ ID NO: 405635 - DNA, 25 bp, Mus musculus
gaaaccatttctcgtacagctgtgc

SEQ ID NO: 405636 - DNA, 25 bp, Mus musculus
gaaaccatttctggtacagctgtgc

SEQ ID NO: 405637 - DNA, 25 bp, Mus musculus
gaaaccatttggcacagaacactaa

SEQ ID NO: 405638 - DNA, 25 bp, Mus musculus
gaaaccatttgggacagaacactaa

SEQ ID NO: 405639 - DNA, 25 bp, Mus musculus
gaaaccatttgtcttgattgcctta

SEQ ID NO: 405640 - DNA, 25 bp, Mus musculus
gaaaccatttgtgttgattgcctta

SEQ ID NO: 405641 - DNA, 25 bp, Mus musculus
gaaaccattttcacctttcaaagtg

SEQ ID NO: 405642 - DNA, 25 bp, Mus musculus
gaaaccattttctcctttcaaagtg

SEQ ID NO: 405643 - DNA, 25 bp, Mus musculus
gaaaccattttgaataacagcccga

SEQ ID NO: 405644 - DNA, 25 bp, Mus musculus
gaaaccattttgtataacagcccga

SEQ ID NO: 405645 - DNA, 25 bp, Mus musculus
gaaaccatttttcctcaatttgcat

SEQ ID NO: 405646 - DNA, 25 bp, Mus musculus
gaaaccatttttgctcaatttgcat

SEQ ID NO: 405647 - DNA, 25 bp, Mus musculus
gaaacccaaagccagtgaatcaaat

SEQ ID NO: 405648 - DNA, 25 bp, Mus musculus
gaaacccaaagcgagtgaatcaaat

SEQ ID NO: 405649 - DNA, 25 bp, Mus musculus
gaaacccaaccacactctgaggcag

SEQ ID NO: 405650 - DNA, 25 bp, Mus musculus
gaaacccaaccagactctgaggcag

SEQ ID NO: 405651 - DNA, 25 bp, Mus musculus
gaaacccaagatcgcctaacctcat

SEQ ID NO: 405652 - DNA, 25 bp, Mus musculus
gaaacccaagatggcctaacctcat

SEQ ID NO: 405653 - DNA, 25 bp, Mus musculus
gaaacccaagctatccaactgtagg

SEQ ID NO: 405654 - DNA, 25 bp, Mus musculus
gaaacccaagctttccaactgtagg

SEQ ID NO: 405655 - DNA, 25 bp, Mus musculus
gaaacccaaggcagtagtgtgctgt

SEQ ID NO: 405656 - DNA, 25 bp, Mus musculus
gaaacccaaggctgtagtgtgctgt

SEQ ID NO: 405657 - DNA, 25 bp, Mus musculus
gaaacccaaggtcgctcaaacttgc

SEQ ID NO: 405658 - DNA, 25 bp, Mus musculus
gaaacccaaggtggctcaaacttgc

SEQ ID NO: 405659 - DNA, 25 bp, Mus musculus
gaaacccaagtcctggaatgctctc

SEQ ID NO: 405660 - DNA, 25 bp, Mus musculus
gaaacccaagtcgtggaatgctctc

SEQ ID NO: 405661 - DNA, 25 bp, Mus musculus
gaaacccaagtgatcagagcccctt

SEQ ID NO: 405662 - DNA, 25 bp, Mus musculus
gaaacccaagtgttcagagcccctt

SEQ ID NO: 405663 - DNA, 25 bp, Mus musculus
gaaacccaagttcgcacgtagccta

SEQ ID NO: 405664 - DNA, 25 bp, Mus musculus
gaaacccaagttggcacgtagccta

SEQ ID NO: 405665 - DNA, 25 bp, Mus musculus
gaaacccacaacagtatggacagta

SEQ ID NO: 405666 - DNA, 25 bp, Mus musculus
gaaacccacaactgtatggacagta

SEQ ID NO: 405667 - DNA, 25 bp, Mus musculus
gaaacccacatgatctgaataggct

SEQ ID NO: 405668 - DNA, 25 bp, Mus musculus
gaaacccacatgttctgaataggct

SEQ ID NO: 405669 - DNA, 25 bp, Mus musculus
gaaacccaccaacactagatttgca

SEQ ID NO: 405670 - DNA, 25 bp, Mus musculus
gaaacccaccaagactagatttgca

SEQ ID NO: 405671 - DNA, 25 bp, Mus musculus
gaaacccaccagcagcattccagga

SEQ ID NO: 405672 - DNA, 25 bp, Mus musculus
gaaacccaccaggagcattccagga

SEQ ID NO: 405673 - DNA, 25 bp, Mus musculus
gaaacccaccgccaaagtgatagaa

SEQ ID NO: 405674 - DNA, 25 bp, Mus musculus
gaaacccaccgcgaaagtgatagaa

SEQ ID NO: 405675 - DNA, 25 bp, Mus musculus
gaaacccacctaaggcagcgggaga

SEQ ID NO: 405676 - DNA, 25 bp, Mus musculus
gaaacccacctatggcagcgggaga

SEQ ID NO: 405677 - DNA, 25 bp, Mus musculus
gaaacccagaaactggctctattga

SEQ ID NO: 405678 - DNA, 25 bp, Mus musculus
gaaacccagaaagtggctctattga

SEQ ID NO: 405679 - DNA, 25 bp, Mus musculus
gaaacccagaagatccgtatccaca

SEQ ID NO: 405680 - DNA, 25 bp, Mus musculus
gaaacccagaagttccgtatccaca

SEQ ID NO: 405681 - DNA, 25 bp, Mus musculus
gaaacccagacaccttttgtgatgt

SEQ ID NO: 405682 - DNA, 25 bp, Mus musculus
gaaacccagacagcttttgtgatgt

SEQ ID NO: 405683 - DNA, 25 bp, Mus musculus
gaaacccagactcttgtccaagtgg

SEQ ID NO: 405684 - DNA, 25 bp, Mus musculus
gaaacccagactgttgtccaagtgg

SEQ ID NO: 405685 - DNA, 25 bp, Mus musculus
gaaacccagagtatcatccctagta

SEQ ID NO: 405686 - DNA, 25 bp, Mus musculus
gaaacccagagtttcatccctagta

SEQ ID NO: 405687 - DNA, 25 bp, Mus musculus
gaaacccagcaactacactactgtg

SEQ ID NO: 405688 - DNA, 25 bp, Mus musculus
gaaacccagcaagtacactactgtg

SEQ ID NO: 405689 - DNA, 25 bp, Mus musculus
gaaacccagcatctcgattaaccga

SEQ ID NO: 405690 - DNA, 25 bp, Mus musculus
gaaacccagcatgtcgattaaccga

SEQ ID NO: 405691 - DNA, 25 bp, Mus musculus
gaaacccagcccacagagacaaaag

SEQ ID NO: 405692 - DNA, 25 bp, Mus musculus
gaaacccagccctcagagacaaaag

SEQ ID NO: 405693 - DNA, 25 bp, Mus musculus
gaaacccagcgtcttttggatctct

SEQ ID NO: 405694 - DNA, 25 bp, Mus musculus
gaaacccagcgtgttttggatctct

SEQ ID NO: 405695 - DNA, 25 bp, Mus musculus
gaaacccagctgatctgggccaggg

SEQ ID NO: 405696 - DNA, 25 bp, Mus musculus
gaaacccagctgttctgggccaggg

SEQ ID NO: 405697 - DNA, 25 bp, Mus musculus
gaaacccagcttagtccagagaacc

SEQ ID NO: 405698 - DNA, 25 bp, Mus musculus
gaaacccagctttgtccagagaacc

SEQ ID NO: 405699 - DNA, 25 bp, Mus musculus
gaaacccaggacacaccaatgaaat

SEQ ID NO: 405700 - DNA, 25 bp, Mus musculus
gaaacccaggacagtttcctctgac

SEQ ID NO: 405701 - DNA, 25 bp, Mus musculus
gaaacccaggactcaccaatgaaat

SEQ ID NO: 405702 - DNA, 25 bp, Mus musculus
gaaacccaggactgtttcctctgac

SEQ ID NO: 405703 - DNA, 25 bp, Mus musculus
gaaacccaggatactcagaacactg

SEQ ID NO: 405704 - DNA, 25 bp, Mus musculus
gaaacccaggatactcatgtatgtg

SEQ ID NO: 405705 - DNA, 25 bp, Mus musculus
gaaacccaggattctcagaacactg

SEQ ID NO: 405706 - DNA, 25 bp, Mus musculus
gaaacccaggattctcatgtatgtg

SEQ ID NO: 405707 - DNA, 25 bp, Mus musculus
gaaacccagggactgctgctgagaa

SEQ ID NO: 405708 - DNA, 25 bp, Mus musculus
gaaacccagggagtgctgctgagaa

SEQ ID NO: 405709 - DNA, 25 bp, Mus musculus
gaaacccagggcatactaccaaatg

SEQ ID NO: 405710 - DNA, 25 bp, Mus musculus
gaaacccagggcttactaccaaatg

SEQ ID NO: 405711 - DNA, 25 bp, Mus musculus
gaaacccagggtctctcacatgtta

SEQ ID NO: 405712 - DNA, 25 bp, Mus musculus
gaaacccagggtgtctcacatgtta

SEQ ID NO: 405713 - DNA, 25 bp, Mus musculus
gaaacccagtcacgtcattgtggag

SEQ ID NO: 405714 - DNA, 25 bp, Mus musculus
gaaacccagtcaggtcattgtggag

SEQ ID NO: 405715 - DNA, 25 bp, Mus musculus
gaaacccagtgcacattggagctgc

SEQ ID NO: 405716 - DNA, 25 bp, Mus musculus
gaaacccagtgctcattggagctgc

SEQ ID NO: 405717 - DNA, 25 bp, Mus musculus
gaaacccataaacaacacttgactt

SEQ ID NO: 405718 - DNA, 25 bp, Mus musculus
gaaacccataaagaacacttgactt

SEQ ID NO: 405719 - DNA, 25 bp, Mus musculus
gaaacccatacacatgagtgcacat

SEQ ID NO: 405720 - DNA, 25 bp, Mus musculus
gaaacccatacagatgagtgcacat

SEQ ID NO: 405721 - DNA, 25 bp, Mus musculus
gaaacccatactctggtggtcactg

SEQ ID NO: 405722 - DNA, 25 bp, Mus musculus
gaaacccatactgtggtggtcactg

SEQ ID NO: 405723 - DNA, 25 bp, Mus musculus
gaaacccatagaactccgaacaaac

SEQ ID NO: 405724 - DNA, 25 bp, Mus musculus
gaaacccatagacaaggacctccta

SEQ ID NO: 405725 - DNA, 25 bp, Mus musculus
gaaacccatagagaaggacctccta

SEQ ID NO: 405726 - DNA, 25 bp, Mus musculus
gaaacccatagatctccgaacaaac

SEQ ID NO: 405727 - DNA, 25 bp, Mus musculus
gaaacccatagccatataatttttt

SEQ ID NO: 405728 - DNA, 25 bp, Mus musculus
gaaacccatagcgatataatttttt

SEQ ID NO: 405729 - DNA, 25 bp, Mus musculus
gaaacccataggacttcaattcttt

SEQ ID NO: 405730 - DNA, 25 bp, Mus musculus
gaaacccataggtcttcaattcttt

SEQ ID NO: 405731 - DNA, 25 bp, Mus musculus
gaaacccatctcagagctggacaga

SEQ ID NO: 405732 - DNA, 25 bp, Mus musculus
gaaacccatctctgagctggacaga

SEQ ID NO: 405733 - DNA, 25 bp, Mus musculus
gaaacccatggcatctcataggtgg

SEQ ID NO: 405734 - DNA, 25 bp, Mus musculus
gaaacccatggcttctcataggtgg

SEQ ID NO: 405735 - DNA, 25 bp, Mus musculus
gaaacccatgtcaaaatttttagca

SEQ ID NO: 405736 - DNA, 25 bp, Mus musculus
gaaacccatgtcaatcaatcctgct

SEQ ID NO: 405737 - DNA, 25 bp, Mus musculus
gaaacccatgtctaaatttttagca

SEQ ID NO: 405738 - DNA, 25 bp, Mus musculus
gaaacccatgtctatcaatcctgct

SEQ ID NO: 405739 - DNA, 25 bp, Mus musculus
gaaacccattccacattaacaaatt

SEQ ID NO: 405740 - DNA, 25 bp, Mus musculus
gaaacccattccaccatgaatttta

SEQ ID NO: 405741 - DNA, 25 bp, Mus musculus
gaaacccattcctcattaacaaatt

SEQ ID NO: 405742 - DNA, 25 bp, Mus musculus
gaaacccattcctccatgaatttta

SEQ ID NO: 405743 - DNA, 25 bp, Mus musculus
gaaacccattggaactgtctgttaa

SEQ ID NO: 405744 - DNA, 25 bp, Mus musculus
gaaacccattggtactgtctgttaa

SEQ ID NO: 405745 - DNA, 25 bp, Mus musculus
gaaacccattttctgctacaaagat

SEQ ID NO: 405746 - DNA, 25 bp, Mus musculus
gaaacccattttgtgctacaaagat

SEQ ID NO: 405747 - DNA, 25 bp, Mus musculus
gaaaccccaagaactacagctgact

SEQ ID NO: 405748 - DNA, 25 bp, Mus musculus
gaaaccccaagatctacagctgact

SEQ ID NO: 405749 - DNA, 25 bp, Mus musculus
gaaaccccacgtacaagcagcatcg

SEQ ID NO: 405750 - DNA, 25 bp, Mus musculus
gaaaccccacgttcaagcagcatcg

SEQ ID NO: 405751 - DNA, 25 bp, Mus musculus
gaaaccccacttcatgtagactgat

SEQ ID NO: 405752 - DNA, 25 bp, Mus musculus
gaaaccccacttgatgtagactgat

SEQ ID NO: 405753 - DNA, 25 bp, Mus musculus
gaaaccccagagcttaaacatacaa

SEQ ID NO: 405754 - DNA, 25 bp, Mus musculus
gaaaccccagaggttaaacatacaa

SEQ ID NO: 405755 - DNA, 25 bp, Mus musculus
gaaaccccagcgagaccaggctttc

SEQ ID NO: 405756 - DNA, 25 bp, Mus musculus
gaaaccccagcgtgaccaggctttc

SEQ ID NO: 405757 - DNA, 25 bp, Mus musculus
gaaaccccagctcactgaatccaaa

SEQ ID NO: 405758 - DNA, 25 bp, Mus musculus
gaaaccccagctgactgaatccaaa

SEQ ID NO: 405759 - DNA, 25 bp, Mus musculus
gaaaccccaggtaatggccggcact

SEQ ID NO: 405760 - DNA, 25 bp, Mus musculus
gaaaccccaggttatggccggcact

SEQ ID NO: 405761 - DNA, 25 bp, Mus musculus
gaaaccccagttactgatgtgctag

SEQ ID NO: 405762 - DNA, 25 bp, Mus musculus
gaaaccccagtttctgatgtgctag

SEQ ID NO: 405763 - DNA, 25 bp, Mus musculus
gaaaccccatctcaaggtgtgtaag

SEQ ID NO: 405764 - DNA, 25 bp, Mus musculus
gaaaccccatctgaaggtgtgtaag

SEQ ID NO: 405765 - DNA, 25 bp, Mus musculus
gaaacccctgaactatctagctacc

SEQ ID NO: 405766 - DNA, 25 bp, Mus musculus
gaaacccctgaagtatctagctacc

SEQ ID NO: 405767 - DNA, 25 bp, Mus musculus
gaaaccccttgactttgtattgact

SEQ ID NO: 405768 - DNA, 25 bp, Mus musculus
gaaaccccttgagtttgtattgact

SEQ ID NO: 405769 - DNA, 25 bp, Mus musculus
gaaaccccttgcatcattctaactt

SEQ ID NO: 405770 - DNA, 25 bp, Mus musculus
gaaaccccttgcttcattctaactt

SEQ ID NO: 405771 - DNA, 25 bp, Mus musculus
gaaacccgagctactgagtgcatta

SEQ ID NO: 405772 - DNA, 25 bp, Mus musculus
gaaacccgagcttctgagtgcatta

SEQ ID NO: 405773 - DNA, 25 bp, Mus musculus
gaaacccgagttcagtgcttcagct

SEQ ID NO: 405774 - DNA, 25 bp, Mus musculus
gaaacccgagttgagtgcttcagct

SEQ ID NO: 405775 - DNA, 25 bp, Mus musculus
gaaacccgattacatatttggcaaa

SEQ ID NO: 405776 - DNA, 25 bp, Mus musculus
gaaacccgattagatatttggcaaa

SEQ ID NO: 405777 - DNA, 25 bp, Mus musculus
gaaacccgctcaactgtgacctata

SEQ ID NO: 405778 - DNA, 25 bp, Mus musculus
gaaacccgctcatctgtgacctata

SEQ ID NO: 405779 - DNA, 25 bp, Mus musculus
gaaacccgctctaatgtaatgcaag

SEQ ID NO: 405780 - DNA, 25 bp, Mus musculus
gaaacccgctcttatgtaatgcaag

SEQ ID NO: 405781 - DNA, 25 bp, Mus musculus
gaaacccgctgtcatactagcattt

SEQ ID NO: 405782 - DNA, 25 bp, Mus musculus
gaaacccgctgtgatactagcattt

SEQ ID NO: 405783 - DNA, 25 bp, Mus musculus
gaaacccgcttgcttccaggaagct

SEQ ID NO: 405784 - DNA, 25 bp, Mus musculus
gaaacccgcttggttccaggaagct

SEQ ID NO: 405785 - DNA, 25 bp, Mus musculus
gaaacccgtgacagaatggctccaa

SEQ ID NO: 405786 - DNA, 25 bp, Mus musculus
gaaacccgtgactgaatggctccaa

SEQ ID NO: 405787 - DNA, 25 bp, Mus musculus
gaaacccgtgagcagcatttctgtg

SEQ ID NO: 405788 - DNA, 25 bp, Mus musculus
gaaacccgtgaggagcatttctgtg

SEQ ID NO: 405789 - DNA, 25 bp, Mus musculus
gaaacccgtggcagacagcgaaacc

SEQ ID NO: 405790 - DNA, 25 bp, Mus musculus
gaaacccgtggctgacagcgaaacc

SEQ ID NO: 405791 - DNA, 25 bp, Mus musculus
gaaacccgttgcattaagcctatgg

SEQ ID NO: 405792 - DNA, 25 bp, Mus musculus
gaaacccgttgctttaagcctatgg

SEQ ID NO: 405793 - DNA, 25 bp, Mus musculus
gaaaccctaactaatatattcacta

SEQ ID NO: 405794 - DNA, 25 bp, Mus musculus
gaaaccctaacttatatattcacta

SEQ ID NO: 405795 - DNA, 25 bp, Mus musculus
gaaaccctagggaattctagtcagg

SEQ ID NO: 405796 - DNA, 25 bp, Mus musculus
gaaaccctagggtattctagtcagg

SEQ ID NO: 405797 - DNA, 25 bp, Mus musculus
gaaaccctatctagaggaaccaaat

SEQ ID NO: 405798 - DNA, 25 bp, Mus musculus
gaaaccctatcttgaggaaccaaat

SEQ ID NO: 405799 - DNA, 25 bp, Mus musculus
gaaaccctatggagtttgtacattt

SEQ ID NO: 405800 - DNA, 25 bp, Mus musculus
gaaaccctatggcactatcagccat

SEQ ID NO: 405801 - DNA, 25 bp, Mus musculus
gaaaccctatggcagctgggctact

SEQ ID NO: 405802 - DNA, 25 bp, Mus musculus
gaaaccctatgggactatcagccat

SEQ ID NO: 405803 - DNA, 25 bp, Mus musculus
gaaaccctatgggagctgggctact

SEQ ID NO: 405804 - DNA, 25 bp, Mus musculus
gaaaccctatggtgtttgtacattt

SEQ ID NO: 405805 - DNA, 25 bp, Mus musculus
gaaaccctatgtatgcaagccatgt

SEQ ID NO: 405806 - DNA, 25 bp, Mus musculus
gaaaccctatgtttgcaagccatgt

SEQ ID NO: 405807 - DNA, 25 bp, Mus musculus
gaaaccctattgctgtgagaggcta

SEQ ID NO: 405808 - DNA, 25 bp, Mus musculus
gaaaccctattggtgtgagaggcta

SEQ ID NO: 405809 - DNA, 25 bp, Mus musculus
gaaaccctcaacaacaatctttgca

SEQ ID NO: 405810 - DNA, 25 bp, Mus musculus
gaaaccctcaacatcagacacttgg

SEQ ID NO: 405811 - DNA, 25 bp, Mus musculus
gaaaccctcaactacaatctttgca

SEQ ID NO: 405812 - DNA, 25 bp, Mus musculus
gaaaccctcaacttcagacacttgg

SEQ ID NO: 405813 - DNA, 25 bp, Mus musculus
gaaaccctcagtaaattcttttgct

SEQ ID NO: 405814 - DNA, 25 bp, Mus musculus
gaaaccctcagttaattcttttgct

SEQ ID NO: 405815 - DNA, 25 bp, Mus musculus
gaaaccctccaaattgcaggaatca

SEQ ID NO: 405816 - DNA, 25 bp, Mus musculus
gaaaccctccaatttgcaggaatca

SEQ ID NO: 405817 - DNA, 25 bp, Mus musculus
gaaaccctccagaacacttagcagt

SEQ ID NO: 405818 - DNA, 25 bp, Mus musculus
gaaaccctccagtacacttagcagt

SEQ ID NO: 405819 - DNA, 25 bp, Mus musculus
gaaaccctccccatgggacttattg

SEQ ID NO: 405820 - DNA, 25 bp, Mus musculus
gaaaccctccccttgggacttattg

SEQ ID NO: 405821 - DNA, 25 bp, Mus musculus
gaaaccctctctagcgtgtgctgaa

SEQ ID NO: 405822 - DNA, 25 bp, Mus musculus
gaaaccctctcttgcgtgtgctgaa

SEQ ID NO: 405823 - DNA, 25 bp, Mus musculus
gaaaccctctggatggaaatagcgt

SEQ ID NO: 405824 - DNA, 25 bp, Mus musculus
gaaaccctctggttggaaatagcgt

SEQ ID NO: 405825 - DNA, 25 bp, Mus musculus
gaaaccctcttgcaagggctggatt

SEQ ID NO: 405826 - DNA, 25 bp, Mus musculus
gaaaccctcttgctactgttcacag

SEQ ID NO: 405827 - DNA, 25 bp, Mus musculus
gaaaccctcttggaagggctggatt

SEQ ID NO: 405828 - DNA, 25 bp, Mus musculus
gaaaccctcttggtactgttcacag

SEQ ID NO: 405829 - DNA, 25 bp, Mus musculus
gaaaccctgagaaacagcagcccag

SEQ ID NO: 405830 - DNA, 25 bp, Mus musculus
gaaaccctgagatacagcagcccag

SEQ ID NO: 405831 - DNA, 25 bp, Mus musculus
gaaaccctgatgattgactctattc

SEQ ID NO: 405832 - DNA, 25 bp, Mus musculus
gaaaccctgatgtttgactctattc

SEQ ID NO: 405833 - DNA, 25 bp, Mus musculus
gaaaccctgcaaacatagtcagtgt

SEQ ID NO: 405834 - DNA, 25 bp, Mus musculus
gaaaccctgcaatcatagtcagtgt

SEQ ID NO: 405835 - DNA, 25 bp, Mus musculus
gaaaccctgcatacccaacaaggga

SEQ ID NO: 405836 - DNA, 25 bp, Mus musculus
gaaaccctgcattcccaacaaggga

SEQ ID NO: 405837 - DNA, 25 bp, Mus musculus
gaaaccctgccaaacactttcagga

SEQ ID NO: 405838 - DNA, 25 bp, Mus musculus
gaaaccctgccatacactttcagga

SEQ ID NO: 405839 - DNA, 25 bp, Mus musculus
gaaaccctgcctacaagtcttagca

SEQ ID NO: 405840 - DNA, 25 bp, Mus musculus
gaaaccctgccttcaagtcttagca

SEQ ID NO: 405841 - DNA, 25 bp, Mus musculus
gaaaccctgctcataatgtcagctt

SEQ ID NO: 405842 - DNA, 25 bp, Mus musculus
gaaaccctgctcttaatgtcagctt

SEQ ID NO: 405843 - DNA, 25 bp, Mus musculus
gaaaccctgcttagtggaaaactct

SEQ ID NO: 405844 - DNA, 25 bp, Mus musculus
gaaaccctgcttattcaggataact

SEQ ID NO: 405845 - DNA, 25 bp, Mus musculus
gaaaccctgctttgtggaaaactct

SEQ ID NO: 405846 - DNA, 25 bp, Mus musculus
gaaaccctgctttttcaggataact

SEQ ID NO: 405847 - DNA, 25 bp, Mus musculus
gaaaccctggacagttgtgtttttg

SEQ ID NO: 405848 - DNA, 25 bp, Mus musculus
gaaaccctggactgttgtgtttttg

SEQ ID NO: 405849 - DNA, 25 bp, Mus musculus
gaaaccctgggcatgattgaccctt

SEQ ID NO: 405850 - DNA, 25 bp, Mus musculus
gaaaccctgggcttgattgaccctt

SEQ ID NO: 405851 - DNA, 25 bp, Mus musculus
gaaaccctgggtcagatctctagca

SEQ ID NO: 405852 - DNA, 25 bp, Mus musculus
gaaaccctgggtgagatctctagca

SEQ ID NO: 405853 - DNA, 25 bp, Mus musculus
gaaaccctgtctactggctctgttt

SEQ ID NO: 405854 - DNA, 25 bp, Mus musculus
gaaaccctgtcttctggctctgttt

SEQ ID NO: 405855 - DNA, 25 bp, Mus musculus
gaaaccctgtgtatcagtagagtct

SEQ ID NO: 405856 - DNA, 25 bp, Mus musculus
gaaaccctgtgtttcagtagagtct

SEQ ID NO: 405857 - DNA, 25 bp, Mus musculus
gaaaccctgtttccttgccttaaga

SEQ ID NO: 405858 - DNA, 25 bp, Mus musculus
gaaaccctgtttgcttgccttaaga

SEQ ID NO: 405859 - DNA, 25 bp, Mus musculus
gaaacccttaacataactgtttgtg

SEQ ID NO: 405860 - DNA, 25 bp, Mus musculus
gaaacccttaacttaactgtttgtg

SEQ ID NO: 405861 - DNA, 25 bp, Mus musculus
gaaacccttaccatgcaaagtgaat

SEQ ID NO: 405862 - DNA, 25 bp, Mus musculus
gaaacccttaccttgcaaagtgaat

SEQ ID NO: 405863 - DNA, 25 bp, Mus musculus
gaaacccttatcactttattgaaca

SEQ ID NO: 405864 - DNA, 25 bp, Mus musculus
gaaacccttatctctttattgaaca

SEQ ID NO: 405865 - DNA, 25 bp, Mus musculus
gaaacccttgagattccgtggagta

SEQ ID NO: 405866 - DNA, 25 bp, Mus musculus
gaaacccttgagtttccgtggagta

SEQ ID NO: 405867 - DNA, 25 bp, Mus musculus
gaaacccttgcaactgtcttttctc

SEQ ID NO: 405868 - DNA, 25 bp, Mus musculus
gaaacccttgcaactttagatccta

SEQ ID NO: 405869 - DNA, 25 bp, Mus musculus
gaaacccttgcacaaccttgatgct

SEQ ID NO: 405870 - DNA, 25 bp, Mus musculus
gaaacccttgcagaaccttgatgct

SEQ ID NO: 405871 - DNA, 25 bp, Mus musculus
gaaacccttgcatctgtcttttctc

SEQ ID NO: 405872 - DNA, 25 bp, Mus musculus
gaaacccttgcatctttagatccta

SEQ ID NO: 405873 - DNA, 25 bp, Mus musculus
gaaacccttggcaccagtttgtaga

SEQ ID NO: 405874 - DNA, 25 bp, Mus musculus
gaaacccttggctccagtttgtaga

SEQ ID NO: 405875 - DNA, 25 bp, Mus musculus
gaaacccttgtgcatgaagtcaggt

SEQ ID NO: 405876 - DNA, 25 bp, Mus musculus
gaaacccttgtggatgaagtcaggt

SEQ ID NO: 405877 - DNA, 25 bp, Mus musculus
gaaacccttgttctataccagtatg

SEQ ID NO: 405878 - DNA, 25 bp, Mus musculus
gaaacccttgttctcagatcatagt

SEQ ID NO: 405879 - DNA, 25 bp, Mus musculus
gaaacccttgttgtataccagtatg

SEQ ID NO: 405880 - DNA, 25 bp, Mus musculus
gaaacccttgttgtcagatcatagt

SEQ ID NO: 405881 - DNA, 25 bp, Mus musculus
gaaaccctttcaatgggctacactg

SEQ ID NO: 405882 - DNA, 25 bp, Mus musculus
gaaaccctttcactgtggcgagtgt

SEQ ID NO: 405883 - DNA, 25 bp, Mus musculus
gaaaccctttcagtgtggcgagtgt

SEQ ID NO: 405884 - DNA, 25 bp, Mus musculus
gaaaccctttcattgggctacactg

SEQ ID NO: 405885 - DNA, 25 bp, Mus musculus
gaaaccgaagggaatttctgtcatt

SEQ ID NO: 405886 - DNA, 25 bp, Mus musculus
gaaaccgaagggtatttctgtcatt

SEQ ID NO: 405887 - DNA, 25 bp, Mus musculus
gaaaccgaattaaccttgctagaga

SEQ ID NO: 405888 - DNA, 25 bp, Mus musculus
gaaaccgaattatccttgctagaga

SEQ ID NO: 405889 - DNA, 25 bp, Mus musculus
gaaaccgacacccttgatggtctga

SEQ ID NO: 405890 - DNA, 25 bp, Mus musculus
gaaaccgacaccgttgatggtctga

SEQ ID NO: 405891 - DNA, 25 bp, Mus musculus
gaaaccgacccgcttagagctcaag

SEQ ID NO: 405892 - DNA, 25 bp, Mus musculus
gaaaccgacccggttagagctcaag

SEQ ID NO: 405893 - DNA, 25 bp, Mus musculus
gaaaccgagaagagccaactggaac

SEQ ID NO: 405894 - DNA, 25 bp, Mus musculus
gaaaccgagaagtgccaactggaac

SEQ ID NO: 405895 - DNA, 25 bp, Mus musculus
gaaaccgagatgaactttcgtccaa

SEQ ID NO: 405896 - DNA, 25 bp, Mus musculus
gaaaccgagatgtactttcgtccaa

SEQ ID NO: 405897 - DNA, 25 bp, Mus musculus
gaaaccgatataatcacctctaccc

SEQ ID NO: 405898 - DNA, 25 bp, Mus musculus
gaaaccgatatattcacctctaccc

SEQ ID NO: 405899 - DNA, 25 bp, Mus musculus
gaaaccgatctaatcctacactact

SEQ ID NO: 405900 - DNA, 25 bp, Mus musculus
gaaaccgatctattcctacactact

SEQ ID NO: 405901 - DNA, 25 bp, Mus musculus
gaaaccgcaagtccaaaggcacaga

SEQ ID NO: 405902 - DNA, 25 bp, Mus musculus
gaaaccgcaagtgcaaaggcacaga

SEQ ID NO: 405903 - DNA, 25 bp, Mus musculus
gaaaccgcagaaaaatgttgaggta

SEQ ID NO: 405904 - DNA, 25 bp, Mus musculus
gaaaccgcagaataatgttgaggta

SEQ ID NO: 405905 - DNA, 25 bp, Mus musculus
gaaaccgcagcaatacttaagcatc

SEQ ID NO: 405906 - DNA, 25 bp, Mus musculus
gaaaccgcagcattacttaagcatc

SEQ ID NO: 405907 - DNA, 25 bp, Mus musculus
gaaaccgcaggccttgatcctaaaa

SEQ ID NO: 405908 - DNA, 25 bp, Mus musculus
gaaaccgcaggcgttgatcctaaaa

SEQ ID NO: 405909 - DNA, 25 bp, Mus musculus
gaaaccgcaggtctgaacgggtcaa

SEQ ID NO: 405910 - DNA, 25 bp, Mus musculus
gaaaccgcaggtgtgaacgggtcaa

SEQ ID NO: 405911 - DNA, 25 bp, Mus musculus
gaaaccgcatggataaagccagggt

SEQ ID NO: 405912 - DNA, 25 bp, Mus musculus
gaaaccgcatggttaaagccagggt

SEQ ID NO: 405913 - DNA, 25 bp, Mus musculus
gaaaccgccagtacacggaactact

SEQ ID NO: 405914 - DNA, 25 bp, Mus musculus
gaaaccgccagttcacggaactact

SEQ ID NO: 405915 - DNA, 25 bp, Mus musculus
gaaaccgcgactaaggccagttcag

SEQ ID NO: 405916 - DNA, 25 bp, Mus musculus
gaaaccgcgacttaggccagttcag

SEQ ID NO: 405917 - DNA, 25 bp, Mus musculus
gaaaccgctactaagtgctgggact

SEQ ID NO: 405918 - DNA, 25 bp, Mus musculus
gaaaccgctacttagtgctgggact

SEQ ID NO: 405919 - DNA, 25 bp, Mus musculus
gaaaccgctgagattcccatatttg

SEQ ID NO: 405920 - DNA, 25 bp, Mus musculus
gaaaccgctgagtttcccatatttg

SEQ ID NO: 405921 - DNA, 25 bp, Mus musculus
gaaaccgctgctaccagtgaaagaa

SEQ ID NO: 405922 - DNA, 25 bp, Mus musculus
gaaaccgctgcttccagtgaaagaa

SEQ ID NO: 405923 - DNA, 25 bp, Mus musculus
gaaaccgctgttctttgctggagcc

SEQ ID NO: 405924 - DNA, 25 bp, Mus musculus
gaaaccgctgttgtttgctggagcc

SEQ ID NO: 405925 - DNA, 25 bp, Mus musculus
gaaaccggaaatcaggctcccatcc

SEQ ID NO: 405926 - DNA, 25 bp, Mus musculus
gaaaccggaaatgaggctcccatcc

SEQ ID NO: 405927 - DNA, 25 bp, Mus musculus
gaaaccggatcaatgacaaccagaa

SEQ ID NO: 405928 - DNA, 25 bp, Mus musculus
gaaaccggatcattgacaaccagaa

SEQ ID NO: 405929 - DNA, 25 bp, Mus musculus
gaaaccggccagcacagctacgcat

SEQ ID NO: 405930 - DNA, 25 bp, Mus musculus
gaaaccggccaggacagctacgcat

SEQ ID NO: 405931 - DNA, 25 bp, Mus musculus
gaaaccggcctcacagacgaggaga

SEQ ID NO: 405932 - DNA, 25 bp, Mus musculus
gaaaccggcctctcagacgaggaga

SEQ ID NO: 405933 - DNA, 25 bp, Mus musculus
gaaaccggctccagcggctaagtga

SEQ ID NO: 405934 - DNA, 25 bp, Mus musculus
gaaaccggctcctgcggctaagtga

SEQ ID NO: 405935 - DNA, 25 bp, Mus musculus
gaaaccgggactccagagctccgag

SEQ ID NO: 405936 - DNA, 25 bp, Mus musculus
gaaaccgggactgcagagctccgag

SEQ ID NO: 405937 - DNA, 25 bp, Mus musculus
gaaaccgggagcagtttgcagccat

SEQ ID NO: 405938 - DNA, 25 bp, Mus musculus
gaaaccgggagctgtttgcagccat

SEQ ID NO: 405939 - DNA, 25 bp, Mus musculus
gaaaccgggatcaactctggtagag

SEQ ID NO: 405940 - DNA, 25 bp, Mus musculus
gaaaccgggatctactctggtagag

SEQ ID NO: 405941 - DNA, 25 bp, Mus musculus
gaaaccggtgttcgctggaatactt

SEQ ID NO: 405942 - DNA, 25 bp, Mus musculus
gaaaccggtgttggctggaatactt

SEQ ID NO: 405943 - DNA, 25 bp, Mus musculus
gaaaccgtagtcatgtaagtgcaca

SEQ ID NO: 405944 - DNA, 25 bp, Mus musculus
gaaaccgtagtcttgtaagtgcaca

SEQ ID NO: 405945 - DNA, 25 bp, Mus musculus
gaaaccgtatttactttgtaatgtg

SEQ ID NO: 405946 - DNA, 25 bp, Mus musculus
gaaaccgtattttctttgtaatgtg

SEQ ID NO: 405947 - DNA, 25 bp, Mus musculus
gaaaccgtccctaggttgctagcaa

SEQ ID NO: 405948 - DNA, 25 bp, Mus musculus
gaaaccgtcccttggttgctagcaa

SEQ ID NO: 405949 - DNA, 25 bp, Mus musculus
gaaaccgtctggaggcttcctttag

SEQ ID NO: 405950 - DNA, 25 bp, Mus musculus
gaaaccgtctggtggcttcctttag

SEQ ID NO: 405951 - DNA, 25 bp, Mus musculus
gaaaccgtggtaattcgtctgtgaa

SEQ ID NO: 405952 - DNA, 25 bp, Mus musculus
gaaaccgtggtatttcgtctgtgaa

SEQ ID NO: 405953 - DNA, 25 bp, Mus musculus
gaaaccgttagcagttctggctttc

SEQ ID NO: 405954 - DNA, 25 bp, Mus musculus
gaaaccgttagctgttctggctttc

SEQ ID NO: 405955 - DNA, 25 bp, Mus musculus
gaaaccgtttagaacctctgagcgt

SEQ ID NO: 405956 - DNA, 25 bp, Mus musculus
gaaaccgtttagtacctctgagcgt

SEQ ID NO: 405957 - DNA, 25 bp, Mus musculus
gaaacctaaagcagattcctgtcca

SEQ ID NO: 405958 - DNA, 25 bp, Mus musculus
gaaacctaaagccaacagccgtgca

SEQ ID NO: 405959 - DNA, 25 bp, Mus musculus
gaaacctaaagcgaacagccgtgca

SEQ ID NO: 405960 - DNA, 25 bp, Mus musculus
gaaacctaaagctgattcctgtcca

SEQ ID NO: 405961 - DNA, 25 bp, Mus musculus
gaaacctaaattcttctgtgcctag

SEQ ID NO: 405962 - DNA, 25 bp, Mus musculus
gaaacctaaattgttctgtgcctag

SEQ ID NO: 405963 - DNA, 25 bp, Mus musculus
gaaacctaacaacagtaagcggaga

SEQ ID NO: 405964 - DNA, 25 bp, Mus musculus
gaaacctaacaagagtaagcggaga

SEQ ID NO: 405965 - DNA, 25 bp, Mus musculus
gaaacctaaccacttccatagttga

SEQ ID NO: 405966 - DNA, 25 bp, Mus musculus
gaaacctaaccagttccatagttga

SEQ ID NO: 405967 - DNA, 25 bp, Mus musculus
gaaacctaaggtagctgaggacagt

SEQ ID NO: 405968 - DNA, 25 bp, Mus musculus
gaaacctaaggttgctgaggacagt

SEQ ID NO: 405969 - DNA, 25 bp, Mus musculus
gaaacctaagtcagtgctctatccg

SEQ ID NO: 405970 - DNA, 25 bp, Mus musculus
gaaacctaagtctgtgctctatccg

SEQ ID NO: 405971 - DNA, 25 bp, Mus musculus
gaaacctaatggatctgctgggatt

SEQ ID NO: 405972 - DNA, 25 bp, Mus musculus
gaaacctaatggttctgctgggatt

SEQ ID NO: 405973 - DNA, 25 bp, Mus musculus
gaaacctacaccatctgaatctctt

SEQ ID NO: 405974 - DNA, 25 bp, Mus musculus
gaaacctacaccttctgaatctctt

SEQ ID NO: 405975 - DNA, 25 bp, Mus musculus
gaaacctacatcagtagcccacatt

SEQ ID NO: 405976 - DNA, 25 bp, Mus musculus
gaaacctacatctgtagcccacatt

SEQ ID NO: 405977 - DNA, 25 bp, Mus musculus
gaaacctacctactgccgctgtggt

SEQ ID NO: 405978 - DNA, 25 bp, Mus musculus
gaaacctacctagtgccgctgtggt

SEQ ID NO: 405979 - DNA, 25 bp, Mus musculus
gaaacctacctgcattttggcttgg

SEQ ID NO: 405980 - DNA, 25 bp, Mus musculus
gaaacctacctggattttggcttgg

SEQ ID NO: 405981 - DNA, 25 bp, Mus musculus
gaaacctagcataggcaaacaactt

SEQ ID NO: 405982 - DNA, 25 bp, Mus musculus
gaaacctagcattggcaaacaactt

SEQ ID NO: 405983 - DNA, 25 bp, Mus musculus
gaaacctagctcctgattggcatat

SEQ ID NO: 405984 - DNA, 25 bp, Mus musculus
gaaacctagctcgtgattggcatat

SEQ ID NO: 405985 - DNA, 25 bp, Mus musculus
gaaacctaggtgctttttgagactg

SEQ ID NO: 405986 - DNA, 25 bp, Mus musculus
gaaacctaggtggtttttgagactg

SEQ ID NO: 405987 - DNA, 25 bp, Mus musculus
gaaacctatgacatcaccacagatt

SEQ ID NO: 405988 - DNA, 25 bp, Mus musculus
gaaacctatgaccacctatggttga

SEQ ID NO: 405989 - DNA, 25 bp, Mus musculus
gaaacctatgacgacctatggttga

SEQ ID NO: 405990 - DNA, 25 bp, Mus musculus
gaaacctatgacttcaccacagatt

SEQ ID NO: 405991 - DNA, 25 bp, Mus musculus
gaaacctatgcactaaatatgtcct

SEQ ID NO: 405992 - DNA, 25 bp, Mus musculus
gaaacctatgcagtaaatatgtcct

SEQ ID NO: 405993 - DNA, 25 bp, Mus musculus
gaaacctatgccatgctgggaccta

SEQ ID NO: 405994 - DNA, 25 bp, Mus musculus
gaaacctatgccttgctgggaccta

SEQ ID NO: 405995 - DNA, 25 bp, Mus musculus
gaaacctatggaatattatgggcaa

SEQ ID NO: 405996 - DNA, 25 bp, Mus musculus
gaaacctatggattattatgggcaa

SEQ ID NO: 405997 - DNA, 25 bp, Mus musculus
gaaacctatgttaatccactggacc

SEQ ID NO: 405998 - DNA, 25 bp, Mus musculus
gaaacctatgtttatccactggacc

SEQ ID NO: 405999 - DNA, 25 bp, Mus musculus
gaaacctcaaataccctatattggc

SEQ ID NO: 406000 - DNA, 25 bp, Mus musculus
gaaacctcaaattccctatattggc

SEQ ID NO: 406001 - DNA, 25 bp, Mus musculus
gaaacctcaacaaagacaatccttg

SEQ ID NO: 406002 - DNA, 25 bp, Mus musculus
gaaacctcaacacagcatcatgtga

SEQ ID NO: 406003 - DNA, 25 bp, Mus musculus
gaaacctcaacagagcatcatgtga

SEQ ID NO: 406004 - DNA, 25 bp, Mus musculus
gaaacctcaacatagacaatccttg

SEQ ID NO: 406005 - DNA, 25 bp, Mus musculus
gaaacctcaaccctggatctcttgc

SEQ ID NO: 406006 - DNA, 25 bp, Mus musculus
gaaacctcaaccgtggatctcttgc

SEQ ID NO: 406007 - DNA, 25 bp, Mus musculus
gaaacctcaactctattggttagct

SEQ ID NO: 406008 - DNA, 25 bp, Mus musculus
gaaacctcaactgtattggttagct

SEQ ID NO: 406009 - DNA, 25 bp, Mus musculus
gaaacctcaagaacagaggtggcta

SEQ ID NO: 406010 - DNA, 25 bp, Mus musculus
gaaacctcaagatcagaggtggcta

SEQ ID NO: 406011 - DNA, 25 bp, Mus musculus
gaaacctcacagcaaccctctggaa

SEQ ID NO: 406012 - DNA, 25 bp, Mus musculus
gaaacctcacaggaaccctctggaa

SEQ ID NO: 406013 - DNA, 25 bp, Mus musculus
gaaacctcaggaaagccttacttat

SEQ ID NO: 406014 - DNA, 25 bp, Mus musculus
gaaacctcaggactgtgagctccag

SEQ ID NO: 406015 - DNA, 25 bp, Mus musculus
gaaacctcaggagtgtgagctccag

SEQ ID NO: 406016 - DNA, 25 bp, Mus musculus
gaaacctcaggatagccttacttat

SEQ ID NO: 406017 - DNA, 25 bp, Mus musculus
gaaacctcatatccctttcttcatc

SEQ ID NO: 406018 - DNA, 25 bp, Mus musculus
gaaacctcatatgcctttcttcatc

SEQ ID NO: 406019 - DNA, 25 bp, Mus musculus
gaaacctccaacatcaacgactttt

SEQ ID NO: 406020 - DNA, 25 bp, Mus musculus
gaaacctccaacttcaacgactttt

SEQ ID NO: 406021 - DNA, 25 bp, Mus musculus
gaaacctccagacactcatcattag

SEQ ID NO: 406022 - DNA, 25 bp, Mus musculus
gaaacctccagagactcatcattag

SEQ ID NO: 406023 - DNA, 25 bp, Mus musculus
gaaacctccatcccagtgaggaagg

SEQ ID NO: 406024 - DNA, 25 bp, Mus musculus
gaaacctccatcgcagtgaggaagg

SEQ ID NO: 406025 - DNA, 25 bp, Mus musculus
gaaacctccctaagttttcaatgaa

SEQ ID NO: 406026 - DNA, 25 bp, Mus musculus
gaaacctccctatgttttcaatgaa

SEQ ID NO: 406027 - DNA, 25 bp, Mus musculus
gaaacctccgtaccatgggatgttt

SEQ ID NO: 406028 - DNA, 25 bp, Mus musculus
gaaacctccgtagcatgggatgttt

SEQ ID NO: 406029 - DNA, 25 bp, Mus musculus
gaaacctccgtgagtctggtgtaga

SEQ ID NO: 406030 - DNA, 25 bp, Mus musculus
gaaacctccgtgtgtctggtgtaga

SEQ ID NO: 406031 - DNA, 25 bp, Mus musculus
gaaacctcgtggatgtctcaagaag

SEQ ID NO: 406032 - DNA, 25 bp, Mus musculus
gaaacctcgtggttgtctcaagaag

SEQ ID NO: 406033 - DNA, 25 bp, Mus musculus
gaaacctctactatgggaagacatc

SEQ ID NO: 406034 - DNA, 25 bp, Mus musculus
gaaacctctactcgactttgtaaga

SEQ ID NO: 406035 - DNA, 25 bp, Mus musculus
gaaacctctactggactttgtaaga

SEQ ID NO: 406036 - DNA, 25 bp, Mus musculus
gaaacctctactttgggaagacatc

SEQ ID NO: 406037 - DNA, 25 bp, Mus musculus
gaaacctctagaaagtggatccttg

SEQ ID NO: 406038 - DNA, 25 bp, Mus musculus
gaaacctctagatagtggatccttg

SEQ ID NO: 406039 - DNA, 25 bp, Mus musculus
gaaacctctatacgcatcatatgct

SEQ ID NO: 406040 - DNA, 25 bp, Mus musculus
gaaacctctataggcatcatatgct

SEQ ID NO: 406041 - DNA, 25 bp, Mus musculus
gaaacctctccacgaatacagagtg

SEQ ID NO: 406042 - DNA, 25 bp, Mus musculus
gaaacctctccaggaatacagagtg

SEQ ID NO: 406043 - DNA, 25 bp, Mus musculus
gaaacctctgccagcgaaagatgcc

SEQ ID NO: 406044 - DNA, 25 bp, Mus musculus
gaaacctctgcctgcgaaagatgcc

SEQ ID NO: 406045 - DNA, 25 bp, Mus musculus
gaaacctctggtcaaagtcttttca

SEQ ID NO: 406046 - DNA, 25 bp, Mus musculus
gaaacctctggtgaaagtcttttca

SEQ ID NO: 406047 - DNA, 25 bp, Mus musculus
gaaacctctgtcagcactgcctatt

SEQ ID NO: 406048 - DNA, 25 bp, Mus musculus
gaaacctctgtctgcactgcctatt

SEQ ID NO: 406049 - DNA, 25 bp, Mus musculus
gaaacctctgttatatcttagtgca

SEQ ID NO: 406050 - DNA, 25 bp, Mus musculus
gaaacctctgttcatggcctcagat

SEQ ID NO: 406051 - DNA, 25 bp, Mus musculus
gaaacctctgttgatggcctcagat

SEQ ID NO: 406052 - DNA, 25 bp, Mus musculus
gaaacctctgttttatcttagtgca

SEQ ID NO: 406053 - DNA, 25 bp, Mus musculus
gaaacctcttctagggtgaatctga

SEQ ID NO: 406054 - DNA, 25 bp, Mus musculus
gaaacctcttcttgggtgaatctga

SEQ ID NO: 406055 - DNA, 25 bp, Mus musculus
gaaacctgaaggctctcccgatgat

SEQ ID NO: 406056 - DNA, 25 bp, Mus musculus
gaaacctgaagggtctcccgatgat

SEQ ID NO: 406057 - DNA, 25 bp, Mus musculus
gaaacctgaatcacccatatgaaaa

SEQ ID NO: 406058 - DNA, 25 bp, Mus musculus
gaaacctgaatctcccatatgaaaa

SEQ ID NO: 406059 - DNA, 25 bp, Mus musculus
gaaacctgacggctccacggtgacc

SEQ ID NO: 406060 - DNA, 25 bp, Mus musculus
gaaacctgacgggtccacggtgacc

SEQ ID NO: 406061 - DNA, 25 bp, Mus musculus
gaaacctgagaacaaaatacaaact

SEQ ID NO: 406062 - DNA, 25 bp, Mus musculus
gaaacctgagaagaaaatacaaact

SEQ ID NO: 406063 - DNA, 25 bp, Mus musculus
gaaacctgatatattgtacactaat

SEQ ID NO: 406064 - DNA, 25 bp, Mus musculus
gaaacctgatattttgtacactaat

SEQ ID NO: 406065 - DNA, 25 bp, Mus musculus
gaaacctgcaagacaacaagccaag

SEQ ID NO: 406066 - DNA, 25 bp, Mus musculus
gaaacctgcaagtcaacaagccaag

SEQ ID NO: 406067 - DNA, 25 bp, Mus musculus
gaaacctgcaccagatatattgata

SEQ ID NO: 406068 - DNA, 25 bp, Mus musculus
gaaacctgcacctgatatattgata

SEQ ID NO: 406069 - DNA, 25 bp, Mus musculus
gaaacctgcaggaacgccgcagcac

SEQ ID NO: 406070 - DNA, 25 bp, Mus musculus
gaaacctgcaggtacgccgcagcac

SEQ ID NO: 406071 - DNA, 25 bp, Mus musculus
gaaacctgcatgatgttgttttaga

SEQ ID NO: 406072 - DNA, 25 bp, Mus musculus
gaaacctgcatgttgttgttttaga

SEQ ID NO: 406073 - DNA, 25 bp, Mus musculus
gaaacctgcctgagtggattggcct

SEQ ID NO: 406074 - DNA, 25 bp, Mus musculus
gaaacctgcctgtgtggattggcct

SEQ ID NO: 406075 - DNA, 25 bp, Mus musculus
gaaacctgctttatggactgtgtta

SEQ ID NO: 406076 - DNA, 25 bp, Mus musculus
gaaacctgctttttggactgtgtta

SEQ ID NO: 406077 - DNA, 25 bp, Mus musculus
gaaacctggagcctattgggaccct

SEQ ID NO: 406078 - DNA, 25 bp, Mus musculus
gaaacctggagcgtattgggaccct

SEQ ID NO: 406079 - DNA, 25 bp, Mus musculus
gaaacctgggacattgtcatctggc

SEQ ID NO: 406080 - DNA, 25 bp, Mus musculus
gaaacctgggactttgtcatctggc

SEQ ID NO: 406081 - DNA, 25 bp, Mus musculus
gaaacctggtctattaaaatctatg

SEQ ID NO: 406082 - DNA, 25 bp, Mus musculus
gaaacctggtcttttaaaatctatg

SEQ ID NO: 406083 - DNA, 25 bp, Mus musculus
gaaacctggttaattgccatgttgt

SEQ ID NO: 406084 - DNA, 25 bp, Mus musculus
gaaacctggttatttgccatgttgt

SEQ ID NO: 406085 - DNA, 25 bp, Mus musculus
gaaacctgtaagatcctaagcatgt

SEQ ID NO: 406086 - DNA, 25 bp, Mus musculus
gaaacctgtaagttcctaagcatgt

SEQ ID NO: 406087 - DNA, 25 bp, Mus musculus
gaaacctgtacaatttgccctggga

SEQ ID NO: 406088 - DNA, 25 bp, Mus musculus
gaaacctgtacattttgccctggga

SEQ ID NO: 406089 - DNA, 25 bp, Mus musculus
gaaacctgtccaagttgatgccaaa

SEQ ID NO: 406090 - DNA, 25 bp, Mus musculus
gaaacctgtccatgttgatgccaaa

SEQ ID NO: 406091 - DNA, 25 bp, Mus musculus
gaaacctgtctgcaaaattagcttt

SEQ ID NO: 406092 - DNA, 25 bp, Mus musculus
gaaacctgtctggaaaattagcttt

SEQ ID NO: 406093 - DNA, 25 bp, Mus musculus
gaaacctgtgcgagtgtcacacata

SEQ ID NO: 406094 - DNA, 25 bp, Mus musculus
gaaacctgtgcgtgtgtcacacata

SEQ ID NO: 406095 - DNA, 25 bp, Mus musculus
gaaacctgtgctacagaaaccattt

SEQ ID NO: 406096 - DNA, 25 bp, Mus musculus
gaaacctgtgcttcagaaaccattt

SEQ ID NO: 406097 - DNA, 25 bp, Mus musculus
gaaacctgtggcattgcagtggagt

SEQ ID NO: 406098 - DNA, 25 bp, Mus musculus
gaaacctgtggctttgcagtggagt

SEQ ID NO: 406099 - DNA, 25 bp, Mus musculus
gaaacctgtggtcatgaaggcattt

SEQ ID NO: 406100 - DNA, 25 bp, Mus musculus
gaaacctgtggtgatgaaggcattt

SEQ ID NO: 406101 - DNA, 25 bp, Mus musculus
gaaacctgttacaataatgttggat

SEQ ID NO: 406102 - DNA, 25 bp, Mus musculus
gaaacctgttacactgaaggacttc

SEQ ID NO: 406103 - DNA, 25 bp, Mus musculus
gaaacctgttactataatgttggat

SEQ ID NO: 406104 - DNA, 25 bp, Mus musculus
gaaacctgttactctgaaggacttc

SEQ ID NO: 406105 - DNA, 25 bp, Mus musculus
gaaacctgttatctctatgctaatt

SEQ ID NO: 406106 - DNA, 25 bp, Mus musculus
gaaacctgttatgtctatgctaatt

SEQ ID NO: 406107 - DNA, 25 bp, Mus musculus
gaaacctgttttctgagcttacctt

SEQ ID NO: 406108 - DNA, 25 bp, Mus musculus
gaaacctgttttgtgagcttacctt

SEQ ID NO: 406109 - DNA, 25 bp, Mus musculus
gaaaccttaaatcaagctgttctaa

SEQ ID NO: 406110 - DNA, 25 bp, Mus musculus
gaaaccttaaatctggctctcaaat

SEQ ID NO: 406111 - DNA, 25 bp, Mus musculus
gaaaccttaaatgaagctgttctaa

SEQ ID NO: 406112 - DNA, 25 bp, Mus musculus
gaaaccttaaatgtggctctcaaat

SEQ ID NO: 406113 - DNA, 25 bp, Mus musculus
gaaaccttaactcatcagcccagga

SEQ ID NO: 406114 - DNA, 25 bp, Mus musculus
gaaaccttaactgatcagcccagga

SEQ ID NO: 406115 - DNA, 25 bp, Mus musculus
gaaaccttacaaacgctgggcagtg

SEQ ID NO: 406116 - DNA, 25 bp, Mus musculus
gaaaccttacaatcgctgggcagtg

SEQ ID NO: 406117 - DNA, 25 bp, Mus musculus
gaaaccttacacaatctcagatatg

SEQ ID NO: 406118 - DNA, 25 bp, Mus musculus
gaaaccttacactatctcagatatg

SEQ ID NO: 406119 - DNA, 25 bp, Mus musculus
gaaaccttactaccccaaggacata

SEQ ID NO: 406120 - DNA, 25 bp, Mus musculus
gaaaccttactagcccaaggacata

SEQ ID NO: 406121 - DNA, 25 bp, Mus musculus
gaaaccttactcagagaactcccac

SEQ ID NO: 406122 - DNA, 25 bp, Mus musculus
gaaaccttactctgagaactcccac

SEQ ID NO: 406123 - DNA, 25 bp, Mus musculus
gaaaccttagagctcatgtcctcct

SEQ ID NO: 406124 - DNA, 25 bp, Mus musculus
gaaaccttagaggtcatgtcctcct

SEQ ID NO: 406125 - DNA, 25 bp, Mus musculus
gaaaccttaggcaattgcaagactt

SEQ ID NO: 406126 - DNA, 25 bp, Mus musculus
gaaaccttaggctattgcaagactt

SEQ ID NO: 406127 - DNA, 25 bp, Mus musculus
gaaaccttaggtcaatctggctctc

SEQ ID NO: 406128 - DNA, 25 bp, Mus musculus
gaaaccttaggtgaatctggctctc

SEQ ID NO: 406129 - DNA, 25 bp, Mus musculus
gaaaccttagttatgatattggatg

SEQ ID NO: 406130 - DNA, 25 bp, Mus musculus
gaaaccttagttttgatattggatg

SEQ ID NO: 406131 - DNA, 25 bp, Mus musculus
gaaaccttatagaaattgacaccgt

SEQ ID NO: 406132 - DNA, 25 bp, Mus musculus
gaaaccttatagtaattgacaccgt

SEQ ID NO: 406133 - DNA, 25 bp, Mus musculus
gaaaccttatgtagccaaaatcagt

SEQ ID NO: 406134 - DNA, 25 bp, Mus musculus
gaaaccttatgttgccaaaatcagt

SEQ ID NO: 406135 - DNA, 25 bp, Mus musculus
gaaaccttcagaacaattaccccag

SEQ ID NO: 406136 - DNA, 25 bp, Mus musculus
gaaaccttcagatcaattaccccag

SEQ ID NO: 406137 - DNA, 25 bp, Mus musculus
gaaaccttcaggactcattttgagt

SEQ ID NO: 406138 - DNA, 25 bp, Mus musculus
gaaaccttcaggatggcagcaccat

SEQ ID NO: 406139 - DNA, 25 bp, Mus musculus
gaaaccttcaggtctcattttgagt

SEQ ID NO: 406140 - DNA, 25 bp, Mus musculus
gaaaccttcaggttggcagcaccat

SEQ ID NO: 406141 - DNA, 25 bp, Mus musculus
gaaaccttccaccatgtgagttaca

SEQ ID NO: 406142 - DNA, 25 bp, Mus musculus
gaaaccttccacgatgtgagttaca

SEQ ID NO: 406143 - DNA, 25 bp, Mus musculus
gaaaccttcggcatctgagtcaaga

SEQ ID NO: 406144 - DNA, 25 bp, Mus musculus
gaaaccttcggcttctgagtcaaga

SEQ ID NO: 406145 - DNA, 25 bp, Mus musculus
gaaaccttctgaaatcatgtctgta

SEQ ID NO: 406146 - DNA, 25 bp, Mus musculus
gaaaccttctgatatcatgtctgta

SEQ ID NO: 406147 - DNA, 25 bp, Mus musculus
gaaaccttctgtcagattctcgtgt

SEQ ID NO: 406148 - DNA, 25 bp, Mus musculus
gaaaccttctgtgagattctcgtgt

SEQ ID NO: 406149 - DNA, 25 bp, Mus musculus
gaaaccttctttctctaacacatcc

SEQ ID NO: 406150 - DNA, 25 bp, Mus musculus
gaaaccttctttgtctaacacatcc

SEQ ID NO: 406151 - DNA, 25 bp, Mus musculus
gaaaccttgaggcaaacccatgtga

SEQ ID NO: 406152 - DNA, 25 bp, Mus musculus
gaaaccttgagggaaacccatgtga

SEQ ID NO: 406153 - DNA, 25 bp, Mus musculus
gaaaccttgcacaaaagtccttctg

SEQ ID NO: 406154 - DNA, 25 bp, Mus musculus
gaaaccttgcacagcagagcccaga

SEQ ID NO: 406155 - DNA, 25 bp, Mus musculus
gaaaccttgcactaaagtccttctg

SEQ ID NO: 406156 - DNA, 25 bp, Mus musculus
gaaaccttgcactgcagagcccaga

SEQ ID NO: 406157 - DNA, 25 bp, Mus musculus
gaaaccttgcctatggacaattgga

SEQ ID NO: 406158 - DNA, 25 bp, Mus musculus
gaaaccttgcctcccttaatgttga

SEQ ID NO: 406159 - DNA, 25 bp, Mus musculus
gaaaccttgcctgccttaatgttga

SEQ ID NO: 406160 - DNA, 25 bp, Mus musculus
gaaaccttgcctttggacaattgga

SEQ ID NO: 406161 - DNA, 25 bp, Mus musculus
gaaaccttgctcatacagattgaac

SEQ ID NO: 406162 - DNA, 25 bp, Mus musculus
gaaaccttgctcttacagattgaac

SEQ ID NO: 406163 - DNA, 25 bp, Mus musculus
gaaaccttggagacaataacttact

SEQ ID NO: 406164 - DNA, 25 bp, Mus musculus
gaaaccttggagtcaataacttact

SEQ ID NO: 406165 - DNA, 25 bp, Mus musculus
gaaaccttggccactgctactgtct

SEQ ID NO: 406166 - DNA, 25 bp, Mus musculus
gaaaccttggcctctgctactgtct

SEQ ID NO: 406167 - DNA, 25 bp, Mus musculus
gaaaccttgtaactgtctctctctc

SEQ ID NO: 406168 - DNA, 25 bp, Mus musculus
gaaaccttgtaagtgtctctctctc

SEQ ID NO: 406169 - DNA, 25 bp, Mus musculus
gaaaccttgtgactcagacagacca

SEQ ID NO: 406170 - DNA, 25 bp, Mus musculus
gaaaccttgtgagtcagacagacca

SEQ ID NO: 406171 - DNA, 25 bp, Mus musculus
gaaaccttgtttccttatatatttt

SEQ ID NO: 406172 - DNA, 25 bp, Mus musculus
gaaaccttgtttgcttatatatttt

SEQ ID NO: 406173 - DNA, 25 bp, Mus musculus
gaaacctttataacctcagcccaag

SEQ ID NO: 406174 - DNA, 25 bp, Mus musculus
gaaacctttatatcctcagcccaag

SEQ ID NO: 406175 - DNA, 25 bp, Mus musculus
gaaacctttcatcgcctttacttat

SEQ ID NO: 406176 - DNA, 25 bp, Mus musculus
gaaacctttcatctaggcttgtata

SEQ ID NO: 406177 - DNA, 25 bp, Mus musculus
gaaacctttcatggcctttacttat

SEQ ID NO: 406178 - DNA, 25 bp, Mus musculus
gaaacctttcatgtaggcttgtata

SEQ ID NO: 406179 - DNA, 25 bp, Mus musculus
gaaacctttccacacatgaaagtat

SEQ ID NO: 406180 - DNA, 25 bp, Mus musculus
gaaacctttccagacatgaaagtat

SEQ ID NO: 406181 - DNA, 25 bp, Mus musculus
gaaacctttctaaagcctgagcaag

SEQ ID NO: 406182 - DNA, 25 bp, Mus musculus
gaaacctttctatagcctgagcaag

SEQ ID NO: 406183 - DNA, 25 bp, Mus musculus
gaaacctttctgaacaaacttgaat

SEQ ID NO: 406184 - DNA, 25 bp, Mus musculus
gaaacctttctgtacaaacttgaat

SEQ ID NO: 406185 - DNA, 25 bp, Mus musculus
gaaacctttcttaaagctcgatgag

SEQ ID NO: 406186 - DNA, 25 bp, Mus musculus
gaaacctttctttaagctcgatgag

SEQ ID NO: 406187 - DNA, 25 bp, Mus musculus
gaaacctttgaacgaccccagcgag

SEQ ID NO: 406188 - DNA, 25 bp, Mus musculus
gaaacctttgaaggaccccagcgag

SEQ ID NO: 406189 - DNA, 25 bp, Mus musculus
gaaacctttggtcatgcgcctgtgt

SEQ ID NO: 406190 - DNA, 25 bp, Mus musculus
gaaacctttggtgatgcgcctgtgt

SEQ ID NO: 406191 - DNA, 25 bp, Mus musculus
gaaacctttgtaatcatctgcttta

SEQ ID NO: 406192 - DNA, 25 bp, Mus musculus
gaaacctttgtattcatctgcttta

SEQ ID NO: 406193 - DNA, 25 bp, Mus musculus
gaaaccttttatcttgactcaaaca

SEQ ID NO: 406194 - DNA, 25 bp, Mus musculus
gaaaccttttatgttgactcaaaca

SEQ ID NO: 406195 - DNA, 25 bp, Mus musculus
gaaacgaagcaccatcacttaccta

SEQ ID NO: 406196 - DNA, 25 bp, Mus musculus
gaaacgaagcacgatcacttaccta

SEQ ID NO: 406197 - DNA, 25 bp, Mus musculus
gaaacgaatgctaacttctgtgtga

SEQ ID NO: 406198 - DNA, 25 bp, Mus musculus
gaaacgaatgcttacttctgtgtga

SEQ ID NO: 406199 - DNA, 25 bp, Mus musculus
gaaacgacagttcgtgatctcaaaa

SEQ ID NO: 406200 - DNA, 25 bp, Mus musculus
gaaacgacagttggtgatctcaaaa

SEQ ID NO: 406201 - DNA, 25 bp, Mus musculus
gaaacgacgatcattcccgaacaga

SEQ ID NO: 406202 - DNA, 25 bp, Mus musculus
gaaacgacgatctttcccgaacaga

SEQ ID NO: 406203 - DNA, 25 bp, Mus musculus
gaaacgactcagctgacgacctgaa

SEQ ID NO: 406204 - DNA, 25 bp, Mus musculus
gaaacgactcaggtgacgacctgaa

SEQ ID NO: 406205 - DNA, 25 bp, Mus musculus
gaaacgacttgcagcagaagtaaca

SEQ ID NO: 406206 - DNA, 25 bp, Mus musculus
gaaacgacttgctgcagaagtaaca

SEQ ID NO: 406207 - DNA, 25 bp, Mus musculus
gaaacgagacttcgcggcaccatga

SEQ ID NO: 406208 - DNA, 25 bp, Mus musculus
gaaacgagacttggcggcaccatga

SEQ ID NO: 406209 - DNA, 25 bp, Mus musculus
gaaacgagatctcccaccataaaat

SEQ ID NO: 406210 - DNA, 25 bp, Mus musculus
gaaacgagatctgccaccataaaat

SEQ ID NO: 406211 - DNA, 25 bp, Mus musculus
gaaacgagctgccaccattcgactg

SEQ ID NO: 406212 - DNA, 25 bp, Mus musculus
gaaacgagctgcgaccattcgactg

SEQ ID NO: 406213 - DNA, 25 bp, Mus musculus
gaaacgaggagcctcttgggctccc

SEQ ID NO: 406214 - DNA, 25 bp, Mus musculus
gaaacgaggagcgtcttgggctccc

SEQ ID NO: 406215 - DNA, 25 bp, Mus musculus
gaaacgaggctaattcttgggtggt

SEQ ID NO: 406216 - DNA, 25 bp, Mus musculus
gaaacgaggctatttcttgggtggt

SEQ ID NO: 406217 - DNA, 25 bp, Mus musculus
gaaacgagtcttacgattttttgca

SEQ ID NO: 406218 - DNA, 25 bp, Mus musculus
gaaacgagtctttcgattttttgca

SEQ ID NO: 406219 - DNA, 25 bp, Mus musculus
gaaacgagtttcagagtatcagcga

SEQ ID NO: 406220 - DNA, 25 bp, Mus musculus
gaaacgagtttctgagtatcagcga

SEQ ID NO: 406221 - DNA, 25 bp, Mus musculus
gaaacgataacaacttaagctgtgt

SEQ ID NO: 406222 - DNA, 25 bp, Mus musculus
gaaacgataacatcttaagctgtgt

SEQ ID NO: 406223 - DNA, 25 bp, Mus musculus
gaaacgatccagattctgactcggg

SEQ ID NO: 406224 - DNA, 25 bp, Mus musculus
gaaacgatccagtttctgactcggg

SEQ ID NO: 406225 - DNA, 25 bp, Mus musculus
gaaacgatccgcaatagtctctggt

SEQ ID NO: 406226 - DNA, 25 bp, Mus musculus
gaaacgatccgctatagtctctggt

SEQ ID NO: 406227 - DNA, 25 bp, Mus musculus
gaaacgatgtccactttgggctctg

SEQ ID NO: 406228 - DNA, 25 bp, Mus musculus
gaaacgatgtcctctttgggctctg

SEQ ID NO: 406229 - DNA, 25 bp, Mus musculus
gaaacgatgtgtaactcaatctctt

SEQ ID NO: 406230 - DNA, 25 bp, Mus musculus
gaaacgatgtgttactcaatctctt

SEQ ID NO: 406231 - DNA, 25 bp, Mus musculus
gaaacgattgacacagctgcctgca

SEQ ID NO: 406232 - DNA, 25 bp, Mus musculus
gaaacgattgactcagctgcctgca

SEQ ID NO: 406233 - DNA, 25 bp, Mus musculus
gaaacgcaaactcatcctacagcag

SEQ ID NO: 406234 - DNA, 25 bp, Mus musculus
gaaacgcaaactgatcctacagcag

SEQ ID NO: 406235 - DNA, 25 bp, Mus musculus
gaaacgcaaagccttttccacttgc

SEQ ID NO: 406236 - DNA, 25 bp, Mus musculus
gaaacgcaaagcgttttccacttgc

SEQ ID NO: 406237 - DNA, 25 bp, Mus musculus
gaaacgcaacagagaagccacacca

SEQ ID NO: 406238 - DNA, 25 bp, Mus musculus
gaaacgcaacagtgaagccacacca

SEQ ID NO: 406239 - DNA, 25 bp, Mus musculus
gaaacgcaatgcagaggctgttaaa

SEQ ID NO: 406240 - DNA, 25 bp, Mus musculus
gaaacgcaatgctgaggctgttaaa

SEQ ID NO: 406241 - DNA, 25 bp, Mus musculus
gaaacgcacataattttgcagggtt

SEQ ID NO: 406242 - DNA, 25 bp, Mus musculus
gaaacgcacatatttttgcagggtt

SEQ ID NO: 406243 - DNA, 25 bp, Mus musculus
gaaacgcactatcccttggatggct

SEQ ID NO: 406244 - DNA, 25 bp, Mus musculus
gaaacgcactatgccttggatggct

SEQ ID NO: 406245 - DNA, 25 bp, Mus musculus
gaaacgcagcatccaagcctttgga

SEQ ID NO: 406246 - DNA, 25 bp, Mus musculus
gaaacgcagcatgcaagcctttgga

SEQ ID NO: 406247 - DNA, 25 bp, Mus musculus
gaaacgcagcctcatgcggttaatt

SEQ ID NO: 406248 - DNA, 25 bp, Mus musculus
gaaacgcagcctgatgcggttaatt

SEQ ID NO: 406249 - DNA, 25 bp, Mus musculus
gaaacgcagctgaagatctccttaa

SEQ ID NO: 406250 - DNA, 25 bp, Mus musculus
gaaacgcagctgtagatctccttaa

SEQ ID NO: 406251 - DNA, 25 bp, Mus musculus
gaaacgcaggatagcctccttaact

SEQ ID NO: 406252 - DNA, 25 bp, Mus musculus
gaaacgcaggattgcctccttaact

SEQ ID NO: 406253 - DNA, 25 bp, Mus musculus
gaaacgcatagaccctgtcctcatt

SEQ ID NO: 406254 - DNA, 25 bp, Mus musculus
gaaacgcatagagcctgtcctcatt

SEQ ID NO: 406255 - DNA, 25 bp, Mus musculus
gaaacgcatcagaagctgtcctgtt

SEQ ID NO: 406256 - DNA, 25 bp, Mus musculus
gaaacgcatcagtagctgtcctgtt

SEQ ID NO: 406257 - DNA, 25 bp, Mus musculus
gaaacgcatgctcattccctcagag

SEQ ID NO: 406258 - DNA, 25 bp, Mus musculus
gaaacgcatgctgattccctcagag

SEQ ID NO: 406259 - DNA, 25 bp, Mus musculus
gaaacgcatttccaaccaggtgacg

SEQ ID NO: 406260 - DNA, 25 bp, Mus musculus
gaaacgcatttcgaaccaggtgacg

SEQ ID NO: 406261 - DNA, 25 bp, Mus musculus
gaaacgccaaggcacctggatcatg

SEQ ID NO: 406262 - DNA, 25 bp, Mus musculus
gaaacgccaagggacctggatcatg

SEQ ID NO: 406263 - DNA, 25 bp, Mus musculus
gaaacgccacatcctagtctgaaaa

SEQ ID NO: 406264 - DNA, 25 bp, Mus musculus
gaaacgccacatctaggacacgcct

SEQ ID NO: 406265 - DNA, 25 bp, Mus musculus
gaaacgccacatgctagtctgaaaa

SEQ ID NO: 406266 - DNA, 25 bp, Mus musculus
gaaacgccacatgtaggacacgcct

SEQ ID NO: 406267 - DNA, 25 bp, Mus musculus
gaaacgccagtgctaacttatacat

SEQ ID NO: 406268 - DNA, 25 bp, Mus musculus
gaaacgccagtggtaacttatacat

SEQ ID NO: 406269 - DNA, 25 bp, Mus musculus
gaaacgccataactctccaagtaca

SEQ ID NO: 406270 - DNA, 25 bp, Mus musculus
gaaacgccataagtctccaagtaca

SEQ ID NO: 406271 - DNA, 25 bp, Mus musculus
gaaacgcccatgactactatggtga

SEQ ID NO: 406272 - DNA, 25 bp, Mus musculus
gaaacgcccatgtctactatggtga

SEQ ID NO: 406273 - DNA, 25 bp, Mus musculus
gaaacgcccctcatgctacaggaat

SEQ ID NO: 406274 - DNA, 25 bp, Mus musculus
gaaacgcccctcttgctacaggaat

SEQ ID NO: 406275 - DNA, 25 bp, Mus musculus
gaaacgccgtttcaggaagttcctg

SEQ ID NO: 406276 - DNA, 25 bp, Mus musculus
gaaacgccgtttgaggaagttcctg

SEQ ID NO: 406277 - DNA, 25 bp, Mus musculus
gaaacgcctatgattaaggatggtg

SEQ ID NO: 406278 - DNA, 25 bp, Mus musculus
gaaacgcctatgtttaaggatggtg

SEQ ID NO: 406279 - DNA, 25 bp, Mus musculus
gaaacgcctctactagaaagatttg

SEQ ID NO: 406280 - DNA, 25 bp, Mus musculus
gaaacgcctctagtagaaagatttg

SEQ ID NO: 406281 - DNA, 25 bp, Mus musculus
gaaacgctacaaactttactccact

SEQ ID NO: 406282 - DNA, 25 bp, Mus musculus
gaaacgctacaatctttactccact

SEQ ID NO: 406283 - DNA, 25 bp, Mus musculus
gaaacgctactacagcatctgccaa

SEQ ID NO: 406284 - DNA, 25 bp, Mus musculus
gaaacgctactagagcatctgccaa

SEQ ID NO: 406285 - DNA, 25 bp, Mus musculus
gaaacgctcagaaactagtctataa

SEQ ID NO: 406286 - DNA, 25 bp, Mus musculus
gaaacgctcagatactagtctataa

SEQ ID NO: 406287 - DNA, 25 bp, Mus musculus
gaaacgctcctgacaatagttcagt

SEQ ID NO: 406288 - DNA, 25 bp, Mus musculus
gaaacgctcctgtcaatagttcagt

SEQ ID NO: 406289 - DNA, 25 bp, Mus musculus
gaaacgctgcacagaggccactggg

SEQ ID NO: 406290 - DNA, 25 bp, Mus musculus
gaaacgctgcactgaggccactggg

SEQ ID NO: 406291 - DNA, 25 bp, Mus musculus
gaaacgctgtggaaattctgcactc

SEQ ID NO: 406292 - DNA, 25 bp, Mus musculus
gaaacgctgtggtaattctgcactc

SEQ ID NO: 406293 - DNA, 25 bp, Mus musculus
gaaacgctgttcagagtggcttgaa

SEQ ID NO: 406294 - DNA, 25 bp, Mus musculus
gaaacgctgttctgagtggcttgaa

SEQ ID NO: 406295 - DNA, 25 bp, Mus musculus
gaaacgcttaatattctaaaggtct

SEQ ID NO: 406296 - DNA, 25 bp, Mus musculus
gaaacgcttaattttctaaaggtct

SEQ ID NO: 406297 - DNA, 25 bp, Mus musculus
gaaacgcttctacatagaacctaga

SEQ ID NO: 406298 - DNA, 25 bp, Mus musculus
gaaacgcttctagatagaacctaga

SEQ ID NO: 406299 - DNA, 25 bp, Mus musculus
gaaacgctttgacgtctatgaaaca

SEQ ID NO: 406300 - DNA, 25 bp, Mus musculus
gaaacgctttgaggtctatgaaaca

SEQ ID NO: 406301 - DNA, 25 bp, Mus musculus
gaaacgctttgtaaggaggcatctg

SEQ ID NO: 406302 - DNA, 25 bp, Mus musculus
gaaacgctttgttaggaggcatctg

SEQ ID NO: 406303 - DNA, 25 bp, Mus musculus
gaaacggaaacaactagatcatctt

SEQ ID NO: 406304 - DNA, 25 bp, Mus musculus
gaaacggaaacatctagatcatctt

SEQ ID NO: 406305 - DNA, 25 bp, Mus musculus
gaaacggaaactcggagctctccct

SEQ ID NO: 406306 - DNA, 25 bp, Mus musculus
gaaacggaaactgggagctctccct

SEQ ID NO: 406307 - DNA, 25 bp, Mus musculus
gaaacggaacaactcaagtctttag

SEQ ID NO: 406308 - DNA, 25 bp, Mus musculus
gaaacggaacaagtcaagtctttag

SEQ ID NO: 406309 - DNA, 25 bp, Mus musculus
gaaacggaatgtccccaagggtcag

SEQ ID NO: 406310 - DNA, 25 bp, Mus musculus
gaaacggaatgtgcccaagggtcag

SEQ ID NO: 406311 - DNA, 25 bp, Mus musculus
gaaacggacggtcagcttagcttta

SEQ ID NO: 406312 - DNA, 25 bp, Mus musculus
gaaacggacggtgagcttagcttta

SEQ ID NO: 406313 - DNA, 25 bp, Mus musculus
gaaacggagcagcacaccatcacca

SEQ ID NO: 406314 - DNA, 25 bp, Mus musculus
gaaacggagcaggacaccatcacca

SEQ ID NO: 406315 - DNA, 25 bp, Mus musculus
gaaacggagttcaacttaggcaaga

SEQ ID NO: 406316 - DNA, 25 bp, Mus musculus
gaaacggagttctacttaggcaaga

SEQ ID NO: 406317 - DNA, 25 bp, Mus musculus
gaaacggataaacttggcctctcca

SEQ ID NO: 406318 - DNA, 25 bp, Mus musculus
gaaacggataaagttggcctctcca

SEQ ID NO: 406319 - DNA, 25 bp, Mus musculus
gaaacggatacaccagtgaaaactt

SEQ ID NO: 406320 - DNA, 25 bp, Mus musculus
gaaacggatacagcagtgaaaactt

SEQ ID NO: 406321 - DNA, 25 bp, Mus musculus
gaaacggattcgcaacagatccacc

SEQ ID NO: 406322 - DNA, 25 bp, Mus musculus
gaaacggattcggaacagatccacc

SEQ ID NO: 406323 - DNA, 25 bp, Mus musculus
gaaacggattctctagtgctgatag

SEQ ID NO: 406324 - DNA, 25 bp, Mus musculus
gaaacggattctgtagtgctgatag

SEQ ID NO: 406325 - DNA, 25 bp, Mus musculus
gaaacggcaatcaaatatttctggc

SEQ ID NO: 406326 - DNA, 25 bp, Mus musculus
gaaacggcaatctaatatttctggc

SEQ ID NO: 406327 - DNA, 25 bp, Mus musculus
gaaacggcaccaatgatgacttcaa

SEQ ID NO: 406328 - DNA, 25 bp, Mus musculus
gaaacggcaccattgatgacttcaa

SEQ ID NO: 406329 - DNA, 25 bp, Mus musculus
gaaacggcacgaagtgaatacttaa

SEQ ID NO: 406330 - DNA, 25 bp, Mus musculus
gaaacggcacgatgtgaatacttaa

SEQ ID NO: 406331 - DNA, 25 bp, Mus musculus
gaaacggcactgaattatttaccaa

SEQ ID NO: 406332 - DNA, 25 bp, Mus musculus
gaaacggcactgtattatttaccaa

SEQ ID NO: 406333 - DNA, 25 bp, Mus musculus
gaaacggcctatctcttggtttaca

SEQ ID NO: 406334 - DNA, 25 bp, Mus musculus
gaaacggcctatgtcttggtttaca

SEQ ID NO: 406335 - DNA, 25 bp, Mus musculus
gaaacggcctcaacttttcgattat

SEQ ID NO: 406336 - DNA, 25 bp, Mus musculus
gaaacggcctcatcttttcgattat

SEQ ID NO: 406337 - DNA, 25 bp, Mus musculus
gaaacggcgttcattttagatggag

SEQ ID NO: 406338 - DNA, 25 bp, Mus musculus
gaaacggcgttctttttagatggag

SEQ ID NO: 406339 - DNA, 25 bp, Mus musculus
gaaacggctacacttcttagcagga

SEQ ID NO: 406340 - DNA, 25 bp, Mus musculus
gaaacggctacagttcttagcagga

SEQ ID NO: 406341 - DNA, 25 bp, Mus musculus
gaaacggctatgaccgtcattggag

SEQ ID NO: 406342 - DNA, 25 bp, Mus musculus
gaaacggctatgtccgtcattggag

SEQ ID NO: 406343 - DNA, 25 bp, Mus musculus
gaaacggctgccagcgggccatgcc

SEQ ID NO: 406344 - DNA, 25 bp, Mus musculus
gaaacggctgcctgcgggccatgcc

SEQ ID NO: 406345 - DNA, 25 bp, Mus musculus
gaaacggctggtacagagcccaaat

SEQ ID NO: 406346 - DNA, 25 bp, Mus musculus
gaaacggctggttcagagcccaaat

SEQ ID NO: 406347 - DNA, 25 bp, Mus musculus
gaaacgggaaaactgcattttactg

SEQ ID NO: 406348 - DNA, 25 bp, Mus musculus
gaaacgggaaaagtgcattttactg

SEQ ID NO: 406349 - DNA, 25 bp, Mus musculus
gaaacgggaaccagctttgtgatta

SEQ ID NO: 406350 - DNA, 25 bp, Mus musculus
gaaacgggaacctgctttgtgatta

SEQ ID NO: 406351 - DNA, 25 bp, Mus musculus
gaaacgggaagccagtctctccgtg

SEQ ID NO: 406352 - DNA, 25 bp, Mus musculus
gaaacgggaagcgagtctctccgtg

SEQ ID NO: 406353 - DNA, 25 bp, Mus musculus
gaaacgggacataactgtagatgct

SEQ ID NO: 406354 - DNA, 25 bp, Mus musculus
gaaacgggacatatgacacctattc

SEQ ID NO: 406355 - DNA, 25 bp, Mus musculus
gaaacgggacattactgtagatgct

SEQ ID NO: 406356 - DNA, 25 bp, Mus musculus
gaaacgggacatttgacacctattc

SEQ ID NO: 406357 - DNA, 25 bp, Mus musculus
gaaacgggaccgagagcagactctg

SEQ ID NO: 406358 - DNA, 25 bp, Mus musculus
gaaacgggaccgtgagcagactctg

SEQ ID NO: 406359 - DNA, 25 bp, Mus musculus
gaaacgggcaggaaatagcctggca

SEQ ID NO: 406360 - DNA, 25 bp, Mus musculus
gaaacgggcaggtaatagcctggca

SEQ ID NO: 406361 - DNA, 25 bp, Mus musculus
gaaacgggccaacagccaatctggt

SEQ ID NO: 406362 - DNA, 25 bp, Mus musculus
gaaacgggccaagagccaatctggt

SEQ ID NO: 406363 - DNA, 25 bp, Mus musculus
gaaacgggcctaagtcgtgtgataa

SEQ ID NO: 406364 - DNA, 25 bp, Mus musculus
gaaacgggcctatgtcgtgtgataa

SEQ ID NO: 406365 - DNA, 25 bp, Mus musculus
gaaacgggtattatccatctcacac

SEQ ID NO: 406366 - DNA, 25 bp, Mus musculus
gaaacgggtattttccatctcacac

SEQ ID NO: 406367 - DNA, 25 bp, Mus musculus
gaaacggtacctaacgacgcgatca

SEQ ID NO: 406368 - DNA, 25 bp, Mus musculus
gaaacggtacctcattcctggaaat

SEQ ID NO: 406369 - DNA, 25 bp, Mus musculus
gaaacggtacctgattcctggaaat

SEQ ID NO: 406370 - DNA, 25 bp, Mus musculus
gaaacggtaccttacgacgcgatca

SEQ ID NO: 406371 - DNA, 25 bp, Mus musculus
gaaacggtatctcactctagaaaca

SEQ ID NO: 406372 - DNA, 25 bp, Mus musculus
gaaacggtatctgactctagaaaca

SEQ ID NO: 406373 - DNA, 25 bp, Mus musculus
gaaacggtatttaggcctgtgttga

SEQ ID NO: 406374 - DNA, 25 bp, Mus musculus
gaaacggtattttggcctgtgttga

SEQ ID NO: 406375 - DNA, 25 bp, Mus musculus
gaaacggtcaggacttagacactta

SEQ ID NO: 406376 - DNA, 25 bp, Mus musculus
gaaacggtcaggcatgatcccctta

SEQ ID NO: 406377 - DNA, 25 bp, Mus musculus
gaaacggtcagggatgatcccctta

SEQ ID NO: 406378 - DNA, 25 bp, Mus musculus
gaaacggtcaggtcttagacactta

SEQ ID NO: 406379 - DNA, 25 bp, Mus musculus
gaaacggtcttgcaatgacgagcat

SEQ ID NO: 406380 - DNA, 25 bp, Mus musculus
gaaacggtcttggaatgacgagcat

SEQ ID NO: 406381 - DNA, 25 bp, Mus musculus
gaaacggtggaaccattgctctctg

SEQ ID NO: 406382 - DNA, 25 bp, Mus musculus
gaaacggtggaagcattgctctctg

SEQ ID NO: 406383 - DNA, 25 bp, Mus musculus
gaaacgtacaatacacagcggtcat

SEQ ID NO: 406384 - DNA, 25 bp, Mus musculus
gaaacgtacaattcacagcggtcat

SEQ ID NO: 406385 - DNA, 25 bp, Mus musculus
gaaacgtacaccaactagagcttaa

SEQ ID NO: 406386 - DNA, 25 bp, Mus musculus
gaaacgtacacctactagagcttaa

SEQ ID NO: 406387 - DNA, 25 bp, Mus musculus
gaaacgtagcacatcttctcttaag

SEQ ID NO: 406388 - DNA, 25 bp, Mus musculus
gaaacgtagcacttcttctcttaag

SEQ ID NO: 406389 - DNA, 25 bp, Mus musculus
gaaacgtatgtacctttctgtaaat

SEQ ID NO: 406390 - DNA, 25 bp, Mus musculus
gaaacgtatgtagctttctgtaaat

SEQ ID NO: 406391 - DNA, 25 bp, Mus musculus
gaaacgtcacaacgcacggccactt

SEQ ID NO: 406392 - DNA, 25 bp, Mus musculus
gaaacgtcacaaggcacggccactt

SEQ ID NO: 406393 - DNA, 25 bp, Mus musculus
gaaacgtcactcaaacaggcactct

SEQ ID NO: 406394 - DNA, 25 bp, Mus musculus
gaaacgtcactctaacaggcactct

SEQ ID NO: 406395 - DNA, 25 bp, Mus musculus
gaaacgtcagtgcatttctgagatt

SEQ ID NO: 406396 - DNA, 25 bp, Mus musculus
gaaacgtcagtggatttctgagatt

SEQ ID NO: 406397 - DNA, 25 bp, Mus musculus
gaaacgtcatagctgaatcacacat

SEQ ID NO: 406398 - DNA, 25 bp, Mus musculus
gaaacgtcataggtgaatcacacat

SEQ ID NO: 406399 - DNA, 25 bp, Mus musculus
gaaacgtcatcccaccgcgtggaga

SEQ ID NO: 406400 - DNA, 25 bp, Mus musculus
gaaacgtcatccgaccgcgtggaga

SEQ ID NO: 406401 - DNA, 25 bp, Mus musculus
gaaacgtccatgaagacaggcagga

SEQ ID NO: 406402 - DNA, 25 bp, Mus musculus
gaaacgtccatgtagacaggcagga

SEQ ID NO: 406403 - DNA, 25 bp, Mus musculus
gaaacgtccattaacctatcacaag

SEQ ID NO: 406404 - DNA, 25 bp, Mus musculus
gaaacgtccatttacctatcacaag

SEQ ID NO: 406405 - DNA, 25 bp, Mus musculus
gaaacgtcctatacttaaagatagt

SEQ ID NO: 406406 - DNA, 25 bp, Mus musculus
gaaacgtcctattcttaaagatagt

SEQ ID NO: 406407 - DNA, 25 bp, Mus musculus
gaaacgtctacacaaatccttccct

SEQ ID NO: 406408 - DNA, 25 bp, Mus musculus
gaaacgtctacagaaatccttccct

SEQ ID NO: 406409 - DNA, 25 bp, Mus musculus
gaaacgtctattcaggtcctaaggg

SEQ ID NO: 406410 - DNA, 25 bp, Mus musculus
gaaacgtctattgaggtcctaaggg

SEQ ID NO: 406411 - DNA, 25 bp, Mus musculus
gaaacgtctggtccgtgagaacatt

SEQ ID NO: 406412 - DNA, 25 bp, Mus musculus
gaaacgtctggtgcgtgagaacatt

SEQ ID NO: 406413 - DNA, 25 bp, Mus musculus
gaaacgtctgtaatattgtgtcata

SEQ ID NO: 406414 - DNA, 25 bp, Mus musculus
gaaacgtctgtattattgtgtcata

SEQ ID NO: 406415 - DNA, 25 bp, Mus musculus
gaaacgtctgtgcattggagctgta

SEQ ID NO: 406416 - DNA, 25 bp, Mus musculus
gaaacgtctgtggattggagctgta

SEQ ID NO: 406417 - DNA, 25 bp, Mus musculus
gaaacgtgacaacagtaatccaggt

SEQ ID NO: 406418 - DNA, 25 bp, Mus musculus
gaaacgtgacaagagtaatccaggt

SEQ ID NO: 406419 - DNA, 25 bp, Mus musculus
gaaacgtgcagtctgtgttgccttt

SEQ ID NO: 406420 - DNA, 25 bp, Mus musculus
gaaacgtgcagtgtgtgttgccttt

SEQ ID NO: 406421 - DNA, 25 bp, Mus musculus
gaaacgtgctacactccaatgtggt

SEQ ID NO: 406422 - DNA, 25 bp, Mus musculus
gaaacgtgctactctccaatgtggt

SEQ ID NO: 406423 - DNA, 25 bp, Mus musculus
gaaacgtgtcataaagaaaccctag

SEQ ID NO: 406424 - DNA, 25 bp, Mus musculus
gaaacgtgtcattaagaaaccctag

SEQ ID NO: 406425 - DNA, 25 bp, Mus musculus
gaaacgtgtccgagtaatgccagcc

SEQ ID NO: 406426 - DNA, 25 bp, Mus musculus
gaaacgtgtccgtgtaatgccagcc

SEQ ID NO: 406427 - DNA, 25 bp, Mus musculus
gaaacgtgtctccccgtgtatatgt

SEQ ID NO: 406428 - DNA, 25 bp, Mus musculus
gaaacgtgtctcgccgtgtatatgt

SEQ ID NO: 406429 - DNA, 25 bp, Mus musculus
gaaacgtgttaactcttagtgccat

SEQ ID NO: 406430 - DNA, 25 bp, Mus musculus
gaaacgtgttaagtcttagtgccat

SEQ ID NO: 406431 - DNA, 25 bp, Mus musculus
gaaacgtgtttaaggccacctgaca

SEQ ID NO: 406432 - DNA, 25 bp, Mus musculus
gaaacgtgtttatggccacctgaca

SEQ ID NO: 406433 - DNA, 25 bp, Mus musculus
gaaacgttaacaccttgagccacaa

SEQ ID NO: 406434 - DNA, 25 bp, Mus musculus
gaaacgttaacagcttgagccacaa

SEQ ID NO: 406435 - DNA, 25 bp, Mus musculus
gaaacgttccagcatccttgaagtt

SEQ ID NO: 406436 - DNA, 25 bp, Mus musculus
gaaacgttccaggatccttgaagtt

SEQ ID NO: 406437 - DNA, 25 bp, Mus musculus
gaaacgttcccacctaacattcagg

SEQ ID NO: 406438 - DNA, 25 bp, Mus musculus
gaaacgttcccagctaacattcagg

SEQ ID NO: 406439 - DNA, 25 bp, Mus musculus
gaaacgttctctagttttcaatggt

SEQ ID NO: 406440 - DNA, 25 bp, Mus musculus
gaaacgttctcttgttttcaatggt

SEQ ID NO: 406441 - DNA, 25 bp, Mus musculus
gaaacgttgaggcctctatgggaaa

SEQ ID NO: 406442 - DNA, 25 bp, Mus musculus
gaaacgttgagggctctatgggaaa

SEQ ID NO: 406443 - DNA, 25 bp, Mus musculus
gaaacgtttcacacatgttttgtgt

SEQ ID NO: 406444 - DNA, 25 bp, Mus musculus
gaaacgtttcactcatgttttgtgt

SEQ ID NO: 406445 - DNA, 25 bp, Mus musculus
gaaacgtttgctcagaagcggctca

SEQ ID NO: 406446 - DNA, 25 bp, Mus musculus
gaaacgtttgctgagaagcggctca

SEQ ID NO: 406447 - DNA, 25 bp, Mus musculus
gaaacgttttatatgctcctttgaa

SEQ ID NO: 406448 - DNA, 25 bp, Mus musculus
gaaacgttttatttgctcctttgaa

SEQ ID NO: 406449 - DNA, 25 bp, Mus musculus
gaaactaaaactcaagaccttctga

SEQ ID NO: 406450 - DNA, 25 bp, Mus musculus
gaaactaaaactgaagaccttctga

SEQ ID NO: 406451 - DNA, 25 bp, Mus musculus
gaaactaaagccattttgaccgaat

SEQ ID NO: 406452 - DNA, 25 bp, Mus musculus
gaaactaaagccctgcacatgtatg

SEQ ID NO: 406453 - DNA, 25 bp, Mus musculus
gaaactaaagccgtgcacatgtatg

SEQ ID NO: 406454 - DNA, 25 bp, Mus musculus
gaaactaaagcctttttgaccgaat

SEQ ID NO: 406455 - DNA, 25 bp, Mus musculus
gaaactaaagttcctactagccatc

SEQ ID NO: 406456 - DNA, 25 bp, Mus musculus
gaaactaaagttgctactagccatc

SEQ ID NO: 406457 - DNA, 25 bp, Mus musculus
gaaactaaatataatgagcaggaaa

SEQ ID NO: 406458 - DNA, 25 bp, Mus musculus
gaaactaaatattatgagcaggaaa

SEQ ID NO: 406459 - DNA, 25 bp, Mus musculus
gaaactaacctgcagtcacttcctc

SEQ ID NO: 406460 - DNA, 25 bp, Mus musculus
gaaactaacctggagtcacttcctc

SEQ ID NO: 406461 - DNA, 25 bp, Mus musculus
gaaactaactgtaaatgagtcttga

SEQ ID NO: 406462 - DNA, 25 bp, Mus musculus
gaaactaactgtcaatgagtaataa

SEQ ID NO: 406463 - DNA, 25 bp, Mus musculus
gaaactaactgtgaatgagtaataa

SEQ ID NO: 406464 - DNA, 25 bp, Mus musculus
gaaactaactgttaatgagtcttga

SEQ ID NO: 406465 - DNA, 25 bp, Mus musculus
gaaactaagcctcggattgtagctc

SEQ ID NO: 406466 - DNA, 25 bp, Mus musculus
gaaactaagcctgggattgtagctc

SEQ ID NO: 406467 - DNA, 25 bp, Mus musculus
gaaactaaggcgcttggacttcatc

SEQ ID NO: 406468 - DNA, 25 bp, Mus musculus
gaaactaaggcggttggacttcatc

SEQ ID NO: 406469 - DNA, 25 bp, Mus musculus
gaaactaagggtccagaggccaaga

SEQ ID NO: 406470 - DNA, 25 bp, Mus musculus
gaaactaagggtgcagaggccaaga

SEQ ID NO: 406471 - DNA, 25 bp, Mus musculus
gaaactaagtctctcgtatattccg

SEQ ID NO: 406472 - DNA, 25 bp, Mus musculus
gaaactaagtctgtcgtatattccg

SEQ ID NO: 406473 - DNA, 25 bp, Mus musculus
gaaactaagttcaagctcccaggcc

SEQ ID NO: 406474 - DNA, 25 bp, Mus musculus
gaaactaagttctagctcccaggcc

SEQ ID NO: 406475 - DNA, 25 bp, Mus musculus
gaaactaatcatacctctcagcagc

SEQ ID NO: 406476 - DNA, 25 bp, Mus musculus
gaaactaatcattcctctcagcagc

SEQ ID NO: 406477 - DNA, 25 bp, Mus musculus
gaaactaatgttacagcctagtgaa

SEQ ID NO: 406478 - DNA, 25 bp, Mus musculus
gaaactaatgtttcagcctagtgaa

SEQ ID NO: 406479 - DNA, 25 bp, Mus musculus
gaaactaatttgattgacattccat

SEQ ID NO: 406480 - DNA, 25 bp, Mus musculus
gaaactaatttgtttgacattccat

SEQ ID NO: 406481 - DNA, 25 bp, Mus musculus
gaaactacaaagctctgtctgccat

SEQ ID NO: 406482 - DNA, 25 bp, Mus musculus
gaaactacaaaggtctgtctgccat

SEQ ID NO: 406483 - DNA, 25 bp, Mus musculus
gaaactacacggatcagttctggat

SEQ ID NO: 406484 - DNA, 25 bp, Mus musculus
gaaactacacggttcagttctggat

SEQ ID NO: 406485 - DNA, 25 bp, Mus musculus
gaaactacactgagcctgagagaca

SEQ ID NO: 406486 - DNA, 25 bp, Mus musculus
gaaactacactgtgcctgagagaca

SEQ ID NO: 406487 - DNA, 25 bp, Mus musculus
gaaactacagggatcatgactcaca

SEQ ID NO: 406488 - DNA, 25 bp, Mus musculus
gaaactacagggttcatgactcaca

SEQ ID NO: 406489 - DNA, 25 bp, Mus musculus
gaaactacatggcttgtgcccatca

SEQ ID NO: 406490 - DNA, 25 bp, Mus musculus
gaaactacatgggttgtgcccatca

SEQ ID NO: 406491 - DNA, 25 bp, Mus musculus
gaaactacatttctattgggcagtg

SEQ ID NO: 406492 - DNA, 25 bp, Mus musculus
gaaactacatttgtattgggcagtg

SEQ ID NO: 406493 - DNA, 25 bp, Mus musculus
gaaactaccaacatcgggtctgatt

SEQ ID NO: 406494 - DNA, 25 bp, Mus musculus
gaaactaccaacttcgggtctgatt

SEQ ID NO: 406495 - DNA, 25 bp, Mus musculus
gaaactaccagtccatttatacata

SEQ ID NO: 406496 - DNA, 25 bp, Mus musculus
gaaactaccagtctgtgcatcctac

SEQ ID NO: 406497 - DNA, 25 bp, Mus musculus
gaaactaccagtgcatttatacata

SEQ ID NO: 406498 - DNA, 25 bp, Mus musculus
gaaactaccagtgtgtgcatcctac

SEQ ID NO: 406499 - DNA, 25 bp, Mus musculus
gaaactacccaaatcctaactgact

SEQ ID NO: 406500 - DNA, 25 bp, Mus musculus
gaaactacccaattcctaactgact

SEQ ID NO: 406501 - DNA, 25 bp, Mus musculus
gaaactaccctgacccgtggtgagg

SEQ ID NO: 406502 - DNA, 25 bp, Mus musculus
gaaactaccctgacttcagaactaa

SEQ ID NO: 406503 - DNA, 25 bp, Mus musculus
gaaactaccctgtcccgtggtgagg

SEQ ID NO: 406504 - DNA, 25 bp, Mus musculus
gaaactaccctgtcttcagaactaa

SEQ ID NO: 406505 - DNA, 25 bp, Mus musculus
gaaactaccgtgcagatcccaactg

SEQ ID NO: 406506 - DNA, 25 bp, Mus musculus
gaaactaccgtggagatcccaactg

SEQ ID NO: 406507 - DNA, 25 bp, Mus musculus
gaaactactccaccattaccagaag

SEQ ID NO: 406508 - DNA, 25 bp, Mus musculus
gaaactactccagcattaccagaag

SEQ ID NO: 406509 - DNA, 25 bp, Mus musculus
gaaactactcttcaaaaacaggcag

SEQ ID NO: 406510 - DNA, 25 bp, Mus musculus
gaaactactcttgaaaaacaggcag

SEQ ID NO: 406511 - DNA, 25 bp, Mus musculus
gaaactactgagctcccaggaaaat

SEQ ID NO: 406512 - DNA, 25 bp, Mus musculus
gaaactactgaggtcccaggaaaat

SEQ ID NO: 406513 - DNA, 25 bp, Mus musculus
gaaactactggaaacttcatgcaaa

SEQ ID NO: 406514 - DNA, 25 bp, Mus musculus
gaaactactggatacttcatgcaaa

SEQ ID NO: 406515 - DNA, 25 bp, Mus musculus
gaaactactggcaattccttcaatt

SEQ ID NO: 406516 - DNA, 25 bp, Mus musculus
gaaactactggctattccttcaatt

SEQ ID NO: 406517 - DNA, 25 bp, Mus musculus
gaaactactgtcaaggctgtctggt

SEQ ID NO: 406518 - DNA, 25 bp, Mus musculus
gaaactactgtctaggctgtctggt

SEQ ID NO: 406519 - DNA, 25 bp, Mus musculus
gaaactacttccatgtttgaatgtg

SEQ ID NO: 406520 - DNA, 25 bp, Mus musculus
gaaactacttccttgtttgaatgtg

SEQ ID NO: 406521 - DNA, 25 bp, Mus musculus
gaaactactttcaatgtgtacaaat

SEQ ID NO: 406522 - DNA, 25 bp, Mus musculus
gaaactactttctatgtgtacaaat

SEQ ID NO: 406523 - DNA, 25 bp, Mus musculus
gaaactagaacacatcctgggtcag

SEQ ID NO: 406524 - DNA, 25 bp, Mus musculus
gaaactagaacagatcctgggtcag

SEQ ID NO: 406525 - DNA, 25 bp, Mus musculus
gaaactagaaccaccctctggaaag

SEQ ID NO: 406526 - DNA, 25 bp, Mus musculus
gaaactagaacctccctctggaaag

SEQ ID NO: 406527 - DNA, 25 bp, Mus musculus
gaaactagaatcatctcccgttgct

SEQ ID NO: 406528 - DNA, 25 bp, Mus musculus
gaaactagaatcttctcccgttgct

SEQ ID NO: 406529 - DNA, 25 bp, Mus musculus
gaaactagaatgctggattcttttc

SEQ ID NO: 406530 - DNA, 25 bp, Mus musculus
gaaactagaatggtggattcttttc

SEQ ID NO: 406531 - DNA, 25 bp, Mus musculus
gaaactagacacaacagaccaaggg

SEQ ID NO: 406532 - DNA, 25 bp, Mus musculus
gaaactagacactacagaccaaggg

SEQ ID NO: 406533 - DNA, 25 bp, Mus musculus
gaaactagacgtaccattgcttgcc

SEQ ID NO: 406534 - DNA, 25 bp, Mus musculus
gaaactagacgttccattgcttgcc

SEQ ID NO: 406535 - DNA, 25 bp, Mus musculus
gaaactagagcgagatctcagcttt

SEQ ID NO: 406536 - DNA, 25 bp, Mus musculus
gaaactagagcgtgatctcagcttt

SEQ ID NO: 406537 - DNA, 25 bp, Mus musculus
gaaactagatacatgccagtctgtt

SEQ ID NO: 406538 - DNA, 25 bp, Mus musculus
gaaactagatacttgccagtctgtt

SEQ ID NO: 406539 - DNA, 25 bp, Mus musculus
gaaactagatccattactcctgaag

SEQ ID NO: 406540 - DNA, 25 bp, Mus musculus
gaaactagatcctttactcctgaag

SEQ ID NO: 406541 - DNA, 25 bp, Mus musculus
gaaactagcatgacctgatctaccc

SEQ ID NO: 406542 - DNA, 25 bp, Mus musculus
gaaactagcatgtcctgatctaccc

SEQ ID NO: 406543 - DNA, 25 bp, Mus musculus
gaaactagccaacgtccttctcagg

SEQ ID NO: 406544 - DNA, 25 bp, Mus musculus
gaaactagccaaggtccttctcagg

SEQ ID NO: 406545 - DNA, 25 bp, Mus musculus
gaaactagcgatacgggcggcgtct

SEQ ID NO: 406546 - DNA, 25 bp, Mus musculus
gaaactagcgattcgggcggcgtct

SEQ ID NO: 406547 - DNA, 25 bp, Mus musculus
gaaactagctgaacagatgtttcag

SEQ ID NO: 406548 - DNA, 25 bp, Mus musculus
gaaactagctgatcagatgtttcag

SEQ ID NO: 406549 - DNA, 25 bp, Mus musculus
gaaactagctgcctcaagattcttg

SEQ ID NO: 406550 - DNA, 25 bp, Mus musculus
gaaactagctgcgtcaagattcttg

SEQ ID NO: 406551 - DNA, 25 bp, Mus musculus
gaaactagcttacagtcacacgcac

SEQ ID NO: 406552 - DNA, 25 bp, Mus musculus
gaaactagcttagagtcacacgcac

SEQ ID NO: 406553 - DNA, 25 bp, Mus musculus
gaaactaggatgatcccatgtccca

SEQ ID NO: 406554 - DNA, 25 bp, Mus musculus
gaaactaggatgttcccatgtccca

SEQ ID NO: 406555 - DNA, 25 bp, Mus musculus
gaaactaggcacattggtggttcac

SEQ ID NO: 406556 - DNA, 25 bp, Mus musculus
gaaactaggcactttggtggttcac

SEQ ID NO: 406557 - DNA, 25 bp, Mus musculus
gaaactaggccaagtattaatctgt

SEQ ID NO: 406558 - DNA, 25 bp, Mus musculus
gaaactaggccatgtattaatctgt

SEQ ID NO: 406559 - DNA, 25 bp, Mus musculus
gaaactaggctaacactgtcaaaat

SEQ ID NO: 406560 - DNA, 25 bp, Mus musculus
gaaactaggctatcactgtcaaaat

SEQ ID NO: 406561 - DNA, 25 bp, Mus musculus
gaaactaggtttctgtctgacaatg

SEQ ID NO: 406562 - DNA, 25 bp, Mus musculus
gaaactaggtttgtgtctgacaatg

SEQ ID NO: 406563 - DNA, 25 bp, Mus musculus
gaaactagtgatacctgtctagaat

SEQ ID NO: 406564 - DNA, 25 bp, Mus musculus
gaaactagtgattcctgtctagaat

SEQ ID NO: 406565 - DNA, 25 bp, Mus musculus
gaaactagtgtgcttataccctctg

SEQ ID NO: 406566 - DNA, 25 bp, Mus musculus
gaaactagtgtggttataccctctg

SEQ ID NO: 406567 - DNA, 25 bp, Mus musculus
gaaactagttgcaaaacccactatt

SEQ ID NO: 406568 - DNA, 25 bp, Mus musculus
gaaactagttgctaaacccactatt

SEQ ID NO: 406569 - DNA, 25 bp, Mus musculus
gaaactatactactaagccatcaga

SEQ ID NO: 406570 - DNA, 25 bp, Mus musculus
gaaactatactagtaagccatcaga

SEQ ID NO: 406571 - DNA, 25 bp, Mus musculus
gaaactatcagaagttggagcgata

SEQ ID NO: 406572 - DNA, 25 bp, Mus musculus
gaaactatcagatgttggagcgata

SEQ ID NO: 406573 - DNA, 25 bp, Mus musculus
gaaactatccagccaaatacttttt

SEQ ID NO: 406574 - DNA, 25 bp, Mus musculus
gaaactatccaggcaaatacttttt

SEQ ID NO: 406575 - DNA, 25 bp, Mus musculus
gaaactatctggagcccttcaagaa

SEQ ID NO: 406576 - DNA, 25 bp, Mus musculus
gaaactatctggtgcccttcaagaa

SEQ ID NO: 406577 - DNA, 25 bp, Mus musculus
gaaactatctttcagggtattcctg

SEQ ID NO: 406578 - DNA, 25 bp, Mus musculus
gaaactatctttgagggtattcctg

SEQ ID NO: 406579 - DNA, 25 bp, Mus musculus
gaaactatgccacactcctgaagtc

SEQ ID NO: 406580 - DNA, 25 bp, Mus musculus
gaaactatgccagactcctgaagtc

SEQ ID NO: 406581 - DNA, 25 bp, Mus musculus
gaaactatgtacacctttccattcc

SEQ ID NO: 406582 - DNA, 25 bp, Mus musculus
gaaactatgtactcctttccattcc

SEQ ID NO: 406583 - DNA, 25 bp, Mus musculus
gaaactatgtatctcccaacatgcc

SEQ ID NO: 406584 - DNA, 25 bp, Mus musculus
gaaactatgtatgtcccaacatgcc

SEQ ID NO: 406585 - DNA, 25 bp, Mus musculus
gaaactattcatattggcacctcta

SEQ ID NO: 406586 - DNA, 25 bp, Mus musculus
gaaactattcattttggcacctcta

SEQ ID NO: 406587 - DNA, 25 bp, Mus musculus
gaaactattcctagctccagttcta

SEQ ID NO: 406588 - DNA, 25 bp, Mus musculus
gaaactattccttgctccagttcta

SEQ ID NO: 406589 - DNA, 25 bp, Mus musculus
gaaactattctgcatctgcaggcta

SEQ ID NO: 406590 - DNA, 25 bp, Mus musculus
gaaactattctggatctgcaggcta

SEQ ID NO: 406591 - DNA, 25 bp, Mus musculus
gaaactattggtaatcccagaggga

SEQ ID NO: 406592 - DNA, 25 bp, Mus musculus
gaaactattggttatcccagaggga

SEQ ID NO: 406593 - DNA, 25 bp, Mus musculus
gaaactatttagactctcccgagaa

SEQ ID NO: 406594 - DNA, 25 bp, Mus musculus
gaaactatttagcttgaactggtca

SEQ ID NO: 406595 - DNA, 25 bp, Mus musculus
gaaactatttaggttgaactggtca

SEQ ID NO: 406596 - DNA, 25 bp, Mus musculus
gaaactatttagtctctcccgagaa

SEQ ID NO: 406597 - DNA, 25 bp, Mus musculus
gaaactatttccagtactcaagttg

SEQ ID NO: 406598 - DNA, 25 bp, Mus musculus
gaaactatttcctgtactcaagttg

SEQ ID NO: 406599 - DNA, 25 bp, Mus musculus
gaaactatttctcagggaacctatg

SEQ ID NO: 406600 - DNA, 25 bp, Mus musculus
gaaactatttctgagggaacctatg

SEQ ID NO: 406601 - DNA, 25 bp, Mus musculus
gaaactcaaaagaaggtagctaggt

SEQ ID NO: 406602 - DNA, 25 bp, Mus musculus
gaaactcaaaagtaggtagctaggt

SEQ ID NO: 406603 - DNA, 25 bp, Mus musculus
gaaactcaaagacaacttgtgctat

SEQ ID NO: 406604 - DNA, 25 bp, Mus musculus
gaaactcaaagaccgtcaggaagca

SEQ ID NO: 406605 - DNA, 25 bp, Mus musculus
gaaactcaaagagaacttgtgctat

SEQ ID NO: 406606 - DNA, 25 bp, Mus musculus
gaaactcaaagagcgtcaggaagca

SEQ ID NO: 406607 - DNA, 25 bp, Mus musculus
gaaactcaacacatggtgaaaacca

SEQ ID NO: 406608 - DNA, 25 bp, Mus musculus
gaaactcaacacttggtgaaaacca

SEQ ID NO: 406609 - DNA, 25 bp, Mus musculus
gaaactcaacataggtccagcaata

SEQ ID NO: 406610 - DNA, 25 bp, Mus musculus
gaaactcaacattggtccagcaata

SEQ ID NO: 406611 - DNA, 25 bp, Mus musculus
gaaactcaaccacttccattttgac

SEQ ID NO: 406612 - DNA, 25 bp, Mus musculus
gaaactcaaccagttccattttgac

SEQ ID NO: 406613 - DNA, 25 bp, Mus musculus
gaaactcaagccaataatcaggact

SEQ ID NO: 406614 - DNA, 25 bp, Mus musculus
gaaactcaagcctataatcaggact

SEQ ID NO: 406615 - DNA, 25 bp, Mus musculus
gaaactcaagctaatgactccaaca

SEQ ID NO: 406616 - DNA, 25 bp, Mus musculus
gaaactcaagctcactgacttgtgt

SEQ ID NO: 406617 - DNA, 25 bp, Mus musculus
gaaactcaagctgactgacttgtgt

SEQ ID NO: 406618 - DNA, 25 bp, Mus musculus
gaaactcaagcttatgactccaaca

SEQ ID NO: 406619 - DNA, 25 bp, Mus musculus
gaaactcaagttcctgtgttaattt

SEQ ID NO: 406620 - DNA, 25 bp, Mus musculus
gaaactcaagttgctgtgttaattt

SEQ ID NO: 406621 - DNA, 25 bp, Mus musculus
gaaactcaatcacatctcaggacct

SEQ ID NO: 406622 - DNA, 25 bp, Mus musculus
gaaactcaatcagatctcaggacct

SEQ ID NO: 406623 - DNA, 25 bp, Mus musculus
gaaactcaattcacctcagctcaaa

SEQ ID NO: 406624 - DNA, 25 bp, Mus musculus
gaaactcaattcacggattagctat

SEQ ID NO: 406625 - DNA, 25 bp, Mus musculus
gaaactcaattctcctcagctcaaa

SEQ ID NO: 406626 - DNA, 25 bp, Mus musculus
gaaactcaattctcggattagctat

SEQ ID NO: 406627 - DNA, 25 bp, Mus musculus
gaaactcacaaaagctgttcccctt

SEQ ID NO: 406628 - DNA, 25 bp, Mus musculus
gaaactcacaaatgctgttcccctt

SEQ ID NO: 406629 - DNA, 25 bp, Mus musculus
gaaactcacagccaagagccggcag

SEQ ID NO: 406630 - DNA, 25 bp, Mus musculus
gaaactcacagcgaagagccggcag

SEQ ID NO: 406631 - DNA, 25 bp, Mus musculus
gaaactcacagtaatgccctcatag

SEQ ID NO: 406632 - DNA, 25 bp, Mus musculus
gaaactcacagtcttacctgctttt

SEQ ID NO: 406633 - DNA, 25 bp, Mus musculus
gaaactcacagtgttacctgctttt

SEQ ID NO: 406634 - DNA, 25 bp, Mus musculus
gaaactcacagttatgccctcatag

SEQ ID NO: 406635 - DNA, 25 bp, Mus musculus
gaaactcacctgaggttccttaaca

SEQ ID NO: 406636 - DNA, 25 bp, Mus musculus
gaaactcacctgtggttccttaaca

SEQ ID NO: 406637 - DNA, 25 bp, Mus musculus
gaaactcactaaagggtgctcactc

SEQ ID NO: 406638 - DNA, 25 bp, Mus musculus
gaaactcactaatgggtgctcactc

SEQ ID NO: 406639 - DNA, 25 bp, Mus musculus
gaaactcactatctggcatcgttgg

SEQ ID NO: 406640 - DNA, 25 bp, Mus musculus
gaaactcactatgtggcatcgttgg

SEQ ID NO: 406641 - DNA, 25 bp, Mus musculus
gaaactcactgcagttgcacgcata

SEQ ID NO: 406642 - DNA, 25 bp, Mus musculus
gaaactcactgctgttgcacgcata

SEQ ID NO: 406643 - DNA, 25 bp, Mus musculus
gaaactcagaagacagcttttggca

SEQ ID NO: 406644 - DNA, 25 bp, Mus musculus
gaaactcagaagtcagcttttggca

SEQ ID NO: 406645 - DNA, 25 bp, Mus musculus
gaaactcagacaacttaccaacata

SEQ ID NO: 406646 - DNA, 25 bp, Mus musculus
gaaactcagacactaactaaccttg

SEQ ID NO: 406647 - DNA, 25 bp, Mus musculus
gaaactcagacagtaactaaccttg

SEQ ID NO: 406648 - DNA, 25 bp, Mus musculus
gaaactcagacatcttaccaacata

SEQ ID NO: 406649 - DNA, 25 bp, Mus musculus
gaaactcagagaccactcagcgcga

SEQ ID NO: 406650 - DNA, 25 bp, Mus musculus
gaaactcagagagcactcagcgcga

SEQ ID NO: 406651 - DNA, 25 bp, Mus musculus
gaaactcagcagatagtatctattg

SEQ ID NO: 406652 - DNA, 25 bp, Mus musculus
gaaactcagcagttagtatctattg

SEQ ID NO: 406653 - DNA, 25 bp, Mus musculus
gaaactcagcccctggttgctttag

SEQ ID NO: 406654 - DNA, 25 bp, Mus musculus
gaaactcagcccgtggttgctttag

SEQ ID NO: 406655 - DNA, 25 bp, Mus musculus
gaaactcagctgaccaggcttctga

SEQ ID NO: 406656 - DNA, 25 bp, Mus musculus
gaaactcagctgatttttctggcag

SEQ ID NO: 406657 - DNA, 25 bp, Mus musculus
gaaactcagctgtccaggcttctga

SEQ ID NO: 406658 - DNA, 25 bp, Mus musculus
gaaactcagctgttttttctggcag

SEQ ID NO: 406659 - DNA, 25 bp, Mus musculus
gaaactcaggctaccagagcgtcgt

SEQ ID NO: 406660 - DNA, 25 bp, Mus musculus
gaaactcaggcttccagagcgtcgt

SEQ ID NO: 406661 - DNA, 25 bp, Mus musculus
gaaactcagggtatagaatgtgcct

SEQ ID NO: 406662 - DNA, 25 bp, Mus musculus
gaaactcagggtttagaatgtgcct

SEQ ID NO: 406663 - DNA, 25 bp, Mus musculus
gaaactcagtgtaccttctggctca

SEQ ID NO: 406664 - DNA, 25 bp, Mus musculus
gaaactcagtgttccttctggctca

SEQ ID NO: 406665 - DNA, 25 bp, Mus musculus
gaaactcagttacctccaaaagcat

SEQ ID NO: 406666 - DNA, 25 bp, Mus musculus
gaaactcagttagctccaaaagcat

SEQ ID NO: 406667 - DNA, 25 bp, Mus musculus
gaaactcatcctacctacctgtaaa

SEQ ID NO: 406668 - DNA, 25 bp, Mus musculus
gaaactcatcctatcatctggtgtt

SEQ ID NO: 406669 - DNA, 25 bp, Mus musculus
gaaactcatccttcctacctgtaaa

SEQ ID NO: 406670 - DNA, 25 bp, Mus musculus
gaaactcatcctttcatctggtgtt

SEQ ID NO: 406671 - DNA, 25 bp, Mus musculus
gaaactcatcttaccagatccttaa

SEQ ID NO: 406672 - DNA, 25 bp, Mus musculus
gaaactcatctttccagatccttaa

SEQ ID NO: 406673 - DNA, 25 bp, Mus musculus
gaaactcatgtgacaacagacttca

SEQ ID NO: 406674 - DNA, 25 bp, Mus musculus
gaaactcatgtgtcaacagacttca

SEQ ID NO: 406675 - DNA, 25 bp, Mus musculus
gaaactcatttcaactgttaggcag

SEQ ID NO: 406676 - DNA, 25 bp, Mus musculus
gaaactcatttctactgttaggcag

SEQ ID NO: 406677 - DNA, 25 bp, Mus musculus
gaaactccaagacttaacagaccac

SEQ ID NO: 406678 - DNA, 25 bp, Mus musculus
gaaactccaagagttaacagaccac

SEQ ID NO: 406679 - DNA, 25 bp, Mus musculus
gaaactccaattaccgaacaaacag

SEQ ID NO: 406680 - DNA, 25 bp, Mus musculus
gaaactccaatttccgaacaaacag

SEQ ID NO: 406681 - DNA, 25 bp, Mus musculus
gaaactccacaacatcatccaaaaa

SEQ ID NO: 406682 - DNA, 25 bp, Mus musculus
gaaactccacaagatcatccaaaaa

SEQ ID NO: 406683 - DNA, 25 bp, Mus musculus
gaaactccacttctgtagtagtctt

SEQ ID NO: 406684 - DNA, 25 bp, Mus musculus
gaaactccacttgtgtagtagtctt

SEQ ID NO: 406685 - DNA, 25 bp, Mus musculus
gaaactccagaaacctccagtaaga

SEQ ID NO: 406686 - DNA, 25 bp, Mus musculus
gaaactccagaatcctccagtaaga

SEQ ID NO: 406687 - DNA, 25 bp, Mus musculus
gaaactccagatcaatgccccatca

SEQ ID NO: 406688 - DNA, 25 bp, Mus musculus
gaaactccagatcgctccagactga

SEQ ID NO: 406689 - DNA, 25 bp, Mus musculus
gaaactccagatgaatgccccatca

SEQ ID NO: 406690 - DNA, 25 bp, Mus musculus
gaaactccagatggctccagactga

SEQ ID NO: 406691 - DNA, 25 bp, Mus musculus
gaaactccagctacttacgttgtgt

SEQ ID NO: 406692 - DNA, 25 bp, Mus musculus
gaaactccagcttcttacgttgtgt

SEQ ID NO: 406693 - DNA, 25 bp, Mus musculus
gaaactccaggaattggcctccagt

SEQ ID NO: 406694 - DNA, 25 bp, Mus musculus
gaaactccaggatttggcctccagt

SEQ ID NO: 406695 - DNA, 25 bp, Mus musculus
gaaactccagtactggccacagagg

SEQ ID NO: 406696 - DNA, 25 bp, Mus musculus
gaaactccagtagtggccacagagg

SEQ ID NO: 406697 - DNA, 25 bp, Mus musculus
gaaactccatgaccacatagagctg

SEQ ID NO: 406698 - DNA, 25 bp, Mus musculus
gaaactccatgagcacatagagctg

SEQ ID NO: 406699 - DNA, 25 bp, Mus musculus
gaaactccatggagttttgctttgt

SEQ ID NO: 406700 - DNA, 25 bp, Mus musculus
gaaactccatggtgttttgctttgt

SEQ ID NO: 406701 - DNA, 25 bp, Mus musculus
gaaactccattgattcaccaattgt

SEQ ID NO: 406702 - DNA, 25 bp, Mus musculus
gaaactccattgtttcaccaattgt

SEQ ID NO: 406703 - DNA, 25 bp, Mus musculus
gaaactccatttaaatcctcaggcc

SEQ ID NO: 406704 - DNA, 25 bp, Mus musculus
gaaactccattttaatcctcaggcc

SEQ ID NO: 406705 - DNA, 25 bp, Mus musculus
gaaactcccacaacgtggaggtctc

SEQ ID NO: 406706 - DNA, 25 bp, Mus musculus
gaaactcccacatcgtggaggtctc

SEQ ID NO: 406707 - DNA, 25 bp, Mus musculus
gaaactcccctcagtttagatttga

SEQ ID NO: 406708 - DNA, 25 bp, Mus musculus
gaaactcccctctgtttagatttga

SEQ ID NO: 406709 - DNA, 25 bp, Mus musculus
gaaactccccttacaggctttcata

SEQ ID NO: 406710 - DNA, 25 bp, Mus musculus
gaaactcccctttcaggctttcata

SEQ ID NO: 406711 - DNA, 25 bp, Mus musculus
gaaactcccgctctcagctaagaaa

SEQ ID NO: 406712 - DNA, 25 bp, Mus musculus
gaaactcccgctgtcagctaagaaa

SEQ ID NO: 406713 - DNA, 25 bp, Mus musculus
gaaactccctggagtatttgttact

SEQ ID NO: 406714 - DNA, 25 bp, Mus musculus
gaaactccctggtgtatttgttact

SEQ ID NO: 406715 - DNA, 25 bp, Mus musculus
gaaactcccttaatgtcataagtga

SEQ ID NO: 406716 - DNA, 25 bp, Mus musculus
gaaactcccttattgtcataagtga

SEQ ID NO: 406717 - DNA, 25 bp, Mus musculus
gaaactccgacaccttggactgggt

SEQ ID NO: 406718 - DNA, 25 bp, Mus musculus
gaaactccgacagcttggactgggt

SEQ ID NO: 406719 - DNA, 25 bp, Mus musculus
gaaactccgatgctgatggcagaaa

SEQ ID NO: 406720 - DNA, 25 bp, Mus musculus
gaaactccgatggtgatggcagaaa

SEQ ID NO: 406721 - DNA, 25 bp, Mus musculus
gaaactccggccaacagtgacaaat

SEQ ID NO: 406722 - DNA, 25 bp, Mus musculus
gaaactccggcctacagtgacaaat

SEQ ID NO: 406723 - DNA, 25 bp, Mus musculus
gaaactccgttacttgatcttcaag

SEQ ID NO: 406724 - DNA, 25 bp, Mus musculus
gaaactccgttagttgatcttcaag

SEQ ID NO: 406725 - DNA, 25 bp, Mus musculus
gaaactcctaacattgtggttccag

SEQ ID NO: 406726 - DNA, 25 bp, Mus musculus
gaaactcctaactttgtggttccag

SEQ ID NO: 406727 - DNA, 25 bp, Mus musculus
gaaactcctaagactggcaagtggc

SEQ ID NO: 406728 - DNA, 25 bp, Mus musculus
gaaactcctaagtctggcaagtggc

SEQ ID NO: 406729 - DNA, 25 bp, Mus musculus
gaaactcctagtcactgtggctttt

SEQ ID NO: 406730 - DNA, 25 bp, Mus musculus
gaaactcctagtgactgtggctttt

SEQ ID NO: 406731 - DNA, 25 bp, Mus musculus
gaaactcctattactttcagtcttt

SEQ ID NO: 406732 - DNA, 25 bp, Mus musculus
gaaactcctattagtagacaaggca

SEQ ID NO: 406733 - DNA, 25 bp, Mus musculus
gaaactcctatttctttcagtcttt

SEQ ID NO: 406734 - DNA, 25 bp, Mus musculus
gaaactcctatttgtagacaaggca

SEQ ID NO: 406735 - DNA, 25 bp, Mus musculus
gaaactcctcaccaggaagactgac

SEQ ID NO: 406736 - DNA, 25 bp, Mus musculus
gaaactcctcacgaggaagactgac

SEQ ID NO: 406737 - DNA, 25 bp, Mus musculus
gaaactcctcatactgcatgcagtg

SEQ ID NO: 406738 - DNA, 25 bp, Mus musculus
gaaactcctcattctgcatgcagtg

SEQ ID NO: 406739 - DNA, 25 bp, Mus musculus
gaaactcctctgatcatgaagggtg

SEQ ID NO: 406740 - DNA, 25 bp, Mus musculus
gaaactcctctgttcatgaagggtg

SEQ ID NO: 406741 - DNA, 25 bp, Mus musculus
gaaactcctgagaacgctgaacaac

SEQ ID NO: 406742 - DNA, 25 bp, Mus musculus
gaaactcctgagaagtcatcagctg

SEQ ID NO: 406743 - DNA, 25 bp, Mus musculus
gaaactcctgagtacgctgaacaac

SEQ ID NO: 406744 - DNA, 25 bp, Mus musculus
gaaactcctgagtagtcatcagctg

SEQ ID NO: 406745 - DNA, 25 bp, Mus musculus
gaaactcctgtcaataaagagcttg

SEQ ID NO: 406746 - DNA, 25 bp, Mus musculus
gaaactcctgtctataaagagcttg

SEQ ID NO: 406747 - DNA, 25 bp, Mus musculus
gaaactccttagatcaaggccactg

SEQ ID NO: 406748 - DNA, 25 bp, Mus musculus
gaaactccttagttcaaggccactg

SEQ ID NO: 406749 - DNA, 25 bp, Mus musculus
gaaactccttcccatagacaataaa

SEQ ID NO: 406750 - DNA, 25 bp, Mus musculus
gaaactccttccgatagacaataaa

SEQ ID NO: 406751 - DNA, 25 bp, Mus musculus
gaaactccttctcagcaaatctcag

SEQ ID NO: 406752 - DNA, 25 bp, Mus musculus
gaaactccttctgagcaaatctcag

SEQ ID NO: 406753 - DNA, 25 bp, Mus musculus
gaaactcgaactatggaagcccctt

SEQ ID NO: 406754 - DNA, 25 bp, Mus musculus
gaaactcgaactttggaagcccctt

SEQ ID NO: 406755 - DNA, 25 bp, Mus musculus
gaaactcgagtgaaccctgttttgt

SEQ ID NO: 406756 - DNA, 25 bp, Mus musculus
gaaactcgagtgtaccctgttttgt

SEQ ID NO: 406757 - DNA, 25 bp, Mus musculus
gaaactcgatagacctcgcagagcc

SEQ ID NO: 406758 - DNA, 25 bp, Mus musculus
gaaactcgatagtcctcgcagagcc

SEQ ID NO: 406759 - DNA, 25 bp, Mus musculus
gaaactcgatgacacaattcagcat

SEQ ID NO: 406760 - DNA, 25 bp, Mus musculus
gaaactcgatgagacaattcagcat

SEQ ID NO: 406761 - DNA, 25 bp, Mus musculus
gaaactcgatgtcttgtatgaacag

SEQ ID NO: 406762 - DNA, 25 bp, Mus musculus
gaaactcgatgtgttgtatgaacag

SEQ ID NO: 406763 - DNA, 25 bp, Mus musculus
gaaactcgatttagctcaggactct

SEQ ID NO: 406764 - DNA, 25 bp, Mus musculus
gaaactcgattttgctcaggactct

SEQ ID NO: 406765 - DNA, 25 bp, Mus musculus
gaaactcgcctaagatatgtagcaa

SEQ ID NO: 406766 - DNA, 25 bp, Mus musculus
gaaactcgcctatgatatgtagcaa

SEQ ID NO: 406767 - DNA, 25 bp, Mus musculus
gaaactcgggagaccaccagaagag

SEQ ID NO: 406768 - DNA, 25 bp, Mus musculus
gaaactcgggagacttcacacaagt

SEQ ID NO: 406769 - DNA, 25 bp, Mus musculus
gaaactcgggagtccaccagaagag

SEQ ID NO: 406770 - DNA, 25 bp, Mus musculus
gaaactcgggagtcttcacacaagt

SEQ ID NO: 406771 - DNA, 25 bp, Mus musculus
gaaactcggtgaatcctggaatagc

SEQ ID NO: 406772 - DNA, 25 bp, Mus musculus
gaaactcggtgattcctggaatagc

SEQ ID NO: 406773 - DNA, 25 bp, Mus musculus
gaaactcggttcctaagcaggcgta

SEQ ID NO: 406774 - DNA, 25 bp, Mus musculus
gaaactcggttcgtaagcaggcgta

SEQ ID NO: 406775 - DNA, 25 bp, Mus musculus
gaaactcggtttacagagcgaactt

SEQ ID NO: 406776 - DNA, 25 bp, Mus musculus
gaaactcggttttcagagcgaactt

SEQ ID NO: 406777 - DNA, 25 bp, Mus musculus
gaaactcgtaacaggcctgaagcac

SEQ ID NO: 406778 - DNA, 25 bp, Mus musculus
gaaactcgtaactggcctgaagcac

SEQ ID NO: 406779 - DNA, 25 bp, Mus musculus
gaaactctaacaccatggcagctgc

SEQ ID NO: 406780 - DNA, 25 bp, Mus musculus
gaaactctaacagcatggcagctgc

SEQ ID NO: 406781 - DNA, 25 bp, Mus musculus
gaaactctaagtagctgtcaaagcc

SEQ ID NO: 406782 - DNA, 25 bp, Mus musculus
gaaactctaagttgctgtcaaagcc

SEQ ID NO: 406783 - DNA, 25 bp, Mus musculus
gaaactctacttcggcttctggtgg

SEQ ID NO: 406784 - DNA, 25 bp, Mus musculus
gaaactctacttgggcttctggtgg

SEQ ID NO: 406785 - DNA, 25 bp, Mus musculus
gaaactctagacaaagtagttttga

SEQ ID NO: 406786 - DNA, 25 bp, Mus musculus
gaaactctagactaagtagttttga

SEQ ID NO: 406787 - DNA, 25 bp, Mus musculus
gaaactctagttactctaaactctt

SEQ ID NO: 406788 - DNA, 25 bp, Mus musculus
gaaactctagtttctctaaactctt

SEQ ID NO: 406789 - DNA, 25 bp, Mus musculus
gaaactctatacacaatgcaggatt

SEQ ID NO: 406790 - DNA, 25 bp, Mus musculus
gaaactctatactcaatgcaggatt

SEQ ID NO: 406791 - DNA, 25 bp, Mus musculus
gaaactctatttactcccaaagaca

SEQ ID NO: 406792 - DNA, 25 bp, Mus musculus
gaaactctattttctcccaaagaca

SEQ ID NO: 406793 - DNA, 25 bp, Mus musculus
gaaactctcaagagacatccaaggt

SEQ ID NO: 406794 - DNA, 25 bp, Mus musculus
gaaactctcaagtgacatccaaggt

SEQ ID NO: 406795 - DNA, 25 bp, Mus musculus
gaaactctcaggactagaagtgcag

SEQ ID NO: 406796 - DNA, 25 bp, Mus musculus
gaaactctcaggtctagaagtgcag

SEQ ID NO: 406797 - DNA, 25 bp, Mus musculus
gaaactctcgcaatctggttagacc

SEQ ID NO: 406798 - DNA, 25 bp, Mus musculus
gaaactctcgcattctggttagacc

SEQ ID NO: 406799 - DNA, 25 bp, Mus musculus
gaaactctcgccagggtgtgctgtg

SEQ ID NO: 406800 - DNA, 25 bp, Mus musculus
gaaactctcgcctgggtgtgctgtg

SEQ ID NO: 406801 - DNA, 25 bp, Mus musculus
gaaactctcgctcggagctccaggg

SEQ ID NO: 406802 - DNA, 25 bp, Mus musculus
gaaactctcgctgggagctccaggg

SEQ ID NO: 406803 - DNA, 25 bp, Mus musculus
gaaactctctgacttttgtgcatgt

SEQ ID NO: 406804 - DNA, 25 bp, Mus musculus
gaaactctctgagttttgtgcatgt

SEQ ID NO: 406805 - DNA, 25 bp, Mus musculus
gaaactctctggagatgccatctct

SEQ ID NO: 406806 - DNA, 25 bp, Mus musculus
gaaactctctggtgatgccatctct

SEQ ID NO: 406807 - DNA, 25 bp, Mus musculus
gaaactctgatgcacaccggacacc

SEQ ID NO: 406808 - DNA, 25 bp, Mus musculus
gaaactctgatggacaccggacacc

SEQ ID NO: 406809 - DNA, 25 bp, Mus musculus
gaaactctgcaaacggaatacatag

SEQ ID NO: 406810 - DNA, 25 bp, Mus musculus
gaaactctgcaatcggaatacatag

SEQ ID NO: 406811 - DNA, 25 bp, Mus musculus
gaaactctgccactgagcgtagaaa

SEQ ID NO: 406812 - DNA, 25 bp, Mus musculus
gaaactctgccagtgagcgtagaaa

SEQ ID NO: 406813 - DNA, 25 bp, Mus musculus
gaaactctgcctcgtgagtggcttt

SEQ ID NO: 406814 - DNA, 25 bp, Mus musculus
gaaactctgcctggtgagtggcttt

SEQ ID NO: 406815 - DNA, 25 bp, Mus musculus
gaaactctggagacccaaagttgtg

SEQ ID NO: 406816 - DNA, 25 bp, Mus musculus
gaaactctggagtcccaaagttgtg

SEQ ID NO: 406817 - DNA, 25 bp, Mus musculus
gaaactctggctcgatcagctgcta

SEQ ID NO: 406818 - DNA, 25 bp, Mus musculus
gaaactctggctggatcagctgcta

SEQ ID NO: 406819 - DNA, 25 bp, Mus musculus
gaaactctgggtacaccaactgaag

SEQ ID NO: 406820 - DNA, 25 bp, Mus musculus
gaaactctgggttcaccaactgaag

SEQ ID NO: 406821 - DNA, 25 bp, Mus musculus
gaaactctgtctccatatatacaca

SEQ ID NO: 406822 - DNA, 25 bp, Mus musculus
gaaactctgtctgcatatatacaca

SEQ ID NO: 406823 - DNA, 25 bp, Mus musculus
gaaactcttacactttgacactcac

SEQ ID NO: 406824 - DNA, 25 bp, Mus musculus
gaaactcttacagtttgacactcac

SEQ ID NO: 406825 - DNA, 25 bp, Mus musculus
gaaactcttccaacagcagcagtca

SEQ ID NO: 406826 - DNA, 25 bp, Mus musculus
gaaactcttccatcagcagcagtca

SEQ ID NO: 406827 - DNA, 25 bp, Mus musculus
gaaactcttcctaaagcagggcgag

SEQ ID NO: 406828 - DNA, 25 bp, Mus musculus
gaaactcttccttaagcagggcgag

SEQ ID NO: 406829 - DNA, 25 bp, Mus musculus
gaaactcttcgaaatggcgtacaaa

SEQ ID NO: 406830 - DNA, 25 bp, Mus musculus
gaaactcttcgatatggcgtacaaa

SEQ ID NO: 406831 - DNA, 25 bp, Mus musculus
gaaactcttctcagggacacctgtt

SEQ ID NO: 406832 - DNA, 25 bp, Mus musculus
gaaactcttctctgggacacctgtt

SEQ ID NO: 406833 - DNA, 25 bp, Mus musculus
gaaactcttcttacctactttgata

SEQ ID NO: 406834 - DNA, 25 bp, Mus musculus
gaaactcttctttcctactttgata

SEQ ID NO: 406835 - DNA, 25 bp, Mus musculus
gaaactcttgagctgtctacaaatt

SEQ ID NO: 406836 - DNA, 25 bp, Mus musculus
gaaactcttgaggtgtctacaaatt

SEQ ID NO: 406837 - DNA, 25 bp, Mus musculus
gaaactcttgcaccagatccgactt

SEQ ID NO: 406838 - DNA, 25 bp, Mus musculus
gaaactcttgcagcagatccgactt

SEQ ID NO: 406839 - DNA, 25 bp, Mus musculus
gaaactcttgccacacaaggtcttt

SEQ ID NO: 406840 - DNA, 25 bp, Mus musculus
gaaactcttgcctcacaaggtcttt

SEQ ID NO: 406841 - DNA, 25 bp, Mus musculus
gaaactcttgctacaacaaggcata

SEQ ID NO: 406842 - DNA, 25 bp, Mus musculus
gaaactcttgcttcaacaaggcata

SEQ ID NO: 406843 - DNA, 25 bp, Mus musculus
gaaactcttggtattcctcagacct

SEQ ID NO: 406844 - DNA, 25 bp, Mus musculus
gaaactcttggttttcctcagacct

SEQ ID NO: 406845 - DNA, 25 bp, Mus musculus
gaaactctttagacatcaaacagct

SEQ ID NO: 406846 - DNA, 25 bp, Mus musculus
gaaactctttagtcatcaaacagct

SEQ ID NO: 406847 - DNA, 25 bp, Mus musculus
gaaactctttcgatcgaaggacctc

SEQ ID NO: 406848 - DNA, 25 bp, Mus musculus
gaaactctttcgttcgaaggacctc

SEQ ID NO: 406849 - DNA, 25 bp, Mus musculus
gaaactctttctaacagctaacagg

SEQ ID NO: 406850 - DNA, 25 bp, Mus musculus
gaaactctttctccctgtagaatca

SEQ ID NO: 406851 - DNA, 25 bp, Mus musculus
gaaactctttctgcctgtagaatca

SEQ ID NO: 406852 - DNA, 25 bp, Mus musculus
gaaactctttcttacagctaacagg

SEQ ID NO: 406853 - DNA, 25 bp, Mus musculus
gaaactctttgaagtcactttcaga

SEQ ID NO: 406854 - DNA, 25 bp, Mus musculus
gaaactctttgatgtcactttcaga

SEQ ID NO: 406855 - DNA, 25 bp, Mus musculus
gaaactctttgcctatgcattcata

SEQ ID NO: 406856 - DNA, 25 bp, Mus musculus
gaaactctttgcgtatgcattcata

SEQ ID NO: 406857 - DNA, 25 bp, Mus musculus
gaaactgaaacaactctagccaccc

SEQ ID NO: 406858 - DNA, 25 bp, Mus musculus
gaaactgaaacatctctagccaccc

SEQ ID NO: 406859 - DNA, 25 bp, Mus musculus
gaaactgaaacgctgcattcgcaca

SEQ ID NO: 406860 - DNA, 25 bp, Mus musculus
gaaactgaaacggtgcattcgcaca

SEQ ID NO: 406861 - DNA, 25 bp, Mus musculus
gaaactgaaataacactaccagcaa

SEQ ID NO: 406862 - DNA, 25 bp, Mus musculus
gaaactgaaatatcactaccagcaa

SEQ ID NO: 406863 - DNA, 25 bp, Mus musculus
gaaactgaacaaatgctaaggctca

SEQ ID NO: 406864 - DNA, 25 bp, Mus musculus
gaaactgaacaattgctaaggctca

SEQ ID NO: 406865 - DNA, 25 bp, Mus musculus
gaaactgaacatcctcagctggaaa

SEQ ID NO: 406866 - DNA, 25 bp, Mus musculus
gaaactgaacatgctcagctggaaa

SEQ ID NO: 406867 - DNA, 25 bp, Mus musculus
gaaactgaactaccgggtgcccagc

SEQ ID NO: 406868 - DNA, 25 bp, Mus musculus
gaaactgaactagcgggtgcccagc

SEQ ID NO: 406869 - DNA, 25 bp, Mus musculus
gaaactgaagagaaccctcccacag

SEQ ID NO: 406870 - DNA, 25 bp, Mus musculus
gaaactgaagagtaccctcccacag

SEQ ID NO: 406871 - DNA, 25 bp, Mus musculus
gaaactgaagatactctacatgtct

SEQ ID NO: 406872 - DNA, 25 bp, Mus musculus
gaaactgaagattctctacatgtct

SEQ ID NO: 406873 - DNA, 25 bp, Mus musculus
gaaactgaagcaaggagcctcaaaa

SEQ ID NO: 406874 - DNA, 25 bp, Mus musculus
gaaactgaagcatggagcctcaaaa

SEQ ID NO: 406875 - DNA, 25 bp, Mus musculus
gaaactgaagctctctatcctctac

SEQ ID NO: 406876 - DNA, 25 bp, Mus musculus
gaaactgaagctgtctatcctctac

SEQ ID NO: 406877 - DNA, 25 bp, Mus musculus
gaaactgaatagctccagtgaccag

SEQ ID NO: 406878 - DNA, 25 bp, Mus musculus
gaaactgaataggtccagtgaccag

SEQ ID NO: 406879 - DNA, 25 bp, Mus musculus
gaaactgaatgtcgttctctgcaag

SEQ ID NO: 406880 - DNA, 25 bp, Mus musculus
gaaactgaatgtggttctctgcaag

SEQ ID NO: 406881 - DNA, 25 bp, Mus musculus
gaaactgacaagctatccactgctc

SEQ ID NO: 406882 - DNA, 25 bp, Mus musculus
gaaactgacaaggtatccactgctc

SEQ ID NO: 406883 - DNA, 25 bp, Mus musculus
gaaactgacaggcttcctcatcaca

SEQ ID NO: 406884 - DNA, 25 bp, Mus musculus
gaaactgacagggttcctcatcaca

SEQ ID NO: 406885 - DNA, 25 bp, Mus musculus
gaaactgacatgctacctctgtaag

SEQ ID NO: 406886 - DNA, 25 bp, Mus musculus
gaaactgacatggtacctctgtaag

SEQ ID NO: 406887 - DNA, 25 bp, Mus musculus
gaaactgacgctccatgggaaattt

SEQ ID NO: 406888 - DNA, 25 bp, Mus musculus
gaaactgacgctgcatgggaaattt

SEQ ID NO: 406889 - DNA, 25 bp, Mus musculus
gaaactgactcgactctggaggagt

SEQ ID NO: 406890 - DNA, 25 bp, Mus musculus
gaaactgactcgtctctggaggagt

SEQ ID NO: 406891 - DNA, 25 bp, Mus musculus
gaaactgacttcagctacttctcca

SEQ ID NO: 406892 - DNA, 25 bp, Mus musculus
gaaactgacttctgctacttctcca

SEQ ID NO: 406893 - DNA, 25 bp, Mus musculus
gaaactgagaacaagtctttttgag

SEQ ID NO: 406894 - DNA, 25 bp, Mus musculus
gaaactgagaactagtctttttgag

SEQ ID NO: 406895 - DNA, 25 bp, Mus musculus
gaaactgagaagctaatccgggaga

SEQ ID NO: 406896 - DNA, 25 bp, Mus musculus
gaaactgagaagctctctccttcac

SEQ ID NO: 406897 - DNA, 25 bp, Mus musculus
gaaactgagaaggtaatccgggaga

SEQ ID NO: 406898 - DNA, 25 bp, Mus musculus
gaaactgagaaggtctctccttcac

SEQ ID NO: 406899 - DNA, 25 bp, Mus musculus
gaaactgagaccctgctctgcgtgt

SEQ ID NO: 406900 - DNA, 25 bp, Mus musculus
gaaactgagaccgtgctctgcgtgt

SEQ ID NO: 406901 - DNA, 25 bp, Mus musculus
gaaactgagactccttagagttgtt

SEQ ID NO: 406902 - DNA, 25 bp, Mus musculus
gaaactgagactgcttagagttgtt

SEQ ID NO: 406903 - DNA, 25 bp, Mus musculus
gaaactgagcaacctttatttgtat

SEQ ID NO: 406904 - DNA, 25 bp, Mus musculus
gaaactgagcaacttgggccacaga

SEQ ID NO: 406905 - DNA, 25 bp, Mus musculus
gaaactgagcaagctttatttgtat

SEQ ID NO: 406906 - DNA, 25 bp, Mus musculus
gaaactgagcaagttgggccacaga

SEQ ID NO: 406907 - DNA, 25 bp, Mus musculus
gaaactgagcatcgtattccaagct

SEQ ID NO: 406908 - DNA, 25 bp, Mus musculus
gaaactgagcatggtattccaagct

SEQ ID NO: 406909 - DNA, 25 bp, Mus musculus
gaaactgagccaagtccttcagtag

SEQ ID NO: 406910 - DNA, 25 bp, Mus musculus
gaaactgagccatgtccttcagtag

SEQ ID NO: 406911 - DNA, 25 bp, Mus musculus
gaaactgagccgcattttagaaaat

SEQ ID NO: 406912 - DNA, 25 bp, Mus musculus
gaaactgagccggattttagaaaat

SEQ ID NO: 406913 - DNA, 25 bp, Mus musculus
gaaactgaggcacaacccgaatcaa

SEQ ID NO: 406914 - DNA, 25 bp, Mus musculus
gaaactgaggcacttccatgctaaa

SEQ ID NO: 406915 - DNA, 25 bp, Mus musculus
gaaactgaggcagaacccgaatcaa

SEQ ID NO: 406916 - DNA, 25 bp, Mus musculus
gaaactgaggcagttccatgctaaa

SEQ ID NO: 406917 - DNA, 25 bp, Mus musculus
gaaactgaggccctatggagcccca

SEQ ID NO: 406918 - DNA, 25 bp, Mus musculus
gaaactgaggccgtatggagcccca

SEQ ID NO: 406919 - DNA, 25 bp, Mus musculus
gaaactgaggctagttgaagaagaa

SEQ ID NO: 406920 - DNA, 25 bp, Mus musculus
gaaactgaggcttgttgaagaagaa

SEQ ID NO: 406921 - DNA, 25 bp, Mus musculus
gaaactgagggcagatctttttaac

SEQ ID NO: 406922 - DNA, 25 bp, Mus musculus
gaaactgagggccaggctgtcttct

SEQ ID NO: 406923 - DNA, 25 bp, Mus musculus
gaaactgagggcgaggctgtcttct

SEQ ID NO: 406924 - DNA, 25 bp, Mus musculus
gaaactgagggctgatctttttaac

SEQ ID NO: 406925 - DNA, 25 bp, Mus musculus
gaaactgaggttatgtagcttcact

SEQ ID NO: 406926 - DNA, 25 bp, Mus musculus
gaaactgaggttttgtagcttcact

SEQ ID NO: 406927 - DNA, 25 bp, Mus musculus
gaaactgagtcgaggtctacgttat

SEQ ID NO: 406928 - DNA, 25 bp, Mus musculus
gaaactgagtcgtggtctacgttat

SEQ ID NO: 406929 - DNA, 25 bp, Mus musculus
gaaactgatacaattggtcctggag

SEQ ID NO: 406930 - DNA, 25 bp, Mus musculus
gaaactgatacatttggtcctggag

SEQ ID NO: 406931 - DNA, 25 bp, Mus musculus
gaaactgatcaaatcacatgacctc

SEQ ID NO: 406932 - DNA, 25 bp, Mus musculus
gaaactgatcaattcacatgacctc

SEQ ID NO: 406933 - DNA, 25 bp, Mus musculus
gaaactgatcatatgttgattcaac

SEQ ID NO: 406934 - DNA, 25 bp, Mus musculus
gaaactgatcatttgttgattcaac

SEQ ID NO: 406935 - DNA, 25 bp, Mus musculus
gaaactgatccaatttagcaactct

SEQ ID NO: 406936 - DNA, 25 bp, Mus musculus
gaaactgatccattttagcaactct

SEQ ID NO: 406937 - DNA, 25 bp, Mus musculus
gaaactgatcttctgtcacttccaa

SEQ ID NO: 406938 - DNA, 25 bp, Mus musculus
gaaactgatcttgtgtcacttccaa

SEQ ID NO: 406939 - DNA, 25 bp, Mus musculus
gaaactgatgtaactgctccccgaa

SEQ ID NO: 406940 - DNA, 25 bp, Mus musculus
gaaactgatgtatctgctccccgaa

SEQ ID NO: 406941 - DNA, 25 bp, Mus musculus
gaaactgattgaagccgacatctcc

SEQ ID NO: 406942 - DNA, 25 bp, Mus musculus
gaaactgattgatgccgacatctcc

SEQ ID NO: 406943 - DNA, 25 bp, Mus musculus
gaaactgcaattagttgccccatat

SEQ ID NO: 406944 - DNA, 25 bp, Mus musculus
gaaactgcaatttgttgccccatat

SEQ ID NO: 406945 - DNA, 25 bp, Mus musculus
gaaactgcaccaagcgctgtcattt

SEQ ID NO: 406946 - DNA, 25 bp, Mus musculus
gaaactgcaccatgcgctgtcattt

SEQ ID NO: 406947 - DNA, 25 bp, Mus musculus
gaaactgcagcgaagacatgagaag

SEQ ID NO: 406948 - DNA, 25 bp, Mus musculus
gaaactgcagcgtagacatgagaag

SEQ ID NO: 406949 - DNA, 25 bp, Mus musculus
gaaactgcaggaaccgctttctacc

SEQ ID NO: 406950 - DNA, 25 bp, Mus musculus
gaaactgcaggatccgctttctacc

SEQ ID NO: 406951 - DNA, 25 bp, Mus musculus
gaaactgcagttcgcctaagtgttg

SEQ ID NO: 406952 - DNA, 25 bp, Mus musculus
gaaactgcagttcgtgctggcccca

SEQ ID NO: 406953 - DNA, 25 bp, Mus musculus
gaaactgcagttggcctaagtgttg

SEQ ID NO: 406954 - DNA, 25 bp, Mus musculus
gaaactgcagttggtgctggcccca

SEQ ID NO: 406955 - DNA, 25 bp, Mus musculus
gaaactgcatctaagctctcagaaa

SEQ ID NO: 406956 - DNA, 25 bp, Mus musculus
gaaactgcatctcattttataagct

SEQ ID NO: 406957 - DNA, 25 bp, Mus musculus
gaaactgcatctgattttataagct

SEQ ID NO: 406958 - DNA, 25 bp, Mus musculus
gaaactgcatcttagctctcagaaa

SEQ ID NO: 406959 - DNA, 25 bp, Mus musculus
gaaactgcattaatcatcgctgtct

SEQ ID NO: 406960 - DNA, 25 bp, Mus musculus
gaaactgcattattcatcgctgtct

SEQ ID NO: 406961 - DNA, 25 bp, Mus musculus
gaaactgccaaacttcctctgagtg

SEQ ID NO: 406962 - DNA, 25 bp, Mus musculus
gaaactgccaaagttcctctgagtg

SEQ ID NO: 406963 - DNA, 25 bp, Mus musculus
gaaactgccaatcttgtggttaaga

SEQ ID NO: 406964 - DNA, 25 bp, Mus musculus
gaaactgccaatgttgtggttaaga

SEQ ID NO: 406965 - DNA, 25 bp, Mus musculus
gaaactgccagaactctgttgaatg

SEQ ID NO: 406966 - DNA, 25 bp, Mus musculus
gaaactgccagatctctgttgaatg

SEQ ID NO: 406967 - DNA, 25 bp, Mus musculus
gaaactgccagtaatataataatct

SEQ ID NO: 406968 - DNA, 25 bp, Mus musculus
gaaactgccagttatataataatct

SEQ ID NO: 406969 - DNA, 25 bp, Mus musculus
gaaactgccatactccaaagtcact

SEQ ID NO: 406970 - DNA, 25 bp, Mus musculus
gaaactgccatagtccaaagtcact

SEQ ID NO: 406971 - DNA, 25 bp, Mus musculus
gaaactgcccataaattggctccca

SEQ ID NO: 406972 - DNA, 25 bp, Mus musculus
gaaactgcccattaattggctccca

SEQ ID NO: 406973 - DNA, 25 bp, Mus musculus
gaaactgcccctcaggcactcagtg

SEQ ID NO: 406974 - DNA, 25 bp, Mus musculus
gaaactgcccctgaggcactcagtg

SEQ ID NO: 406975 - DNA, 25 bp, Mus musculus
gaaactgcctagctacaggtacacc

SEQ ID NO: 406976 - DNA, 25 bp, Mus musculus
gaaactgcctaggtacaggtacacc

SEQ ID NO: 406977 - DNA, 25 bp, Mus musculus
gaaactgcctatcacttatagcaac

SEQ ID NO: 406978 - DNA, 25 bp, Mus musculus
gaaactgcctatgacttatagcaac

SEQ ID NO: 406979 - DNA, 25 bp, Mus musculus
gaaactgccttacgtcacgtcagct

SEQ ID NO: 406980 - DNA, 25 bp, Mus musculus
gaaactgccttaggtcacgtcagct

SEQ ID NO: 406981 - DNA, 25 bp, Mus musculus
gaaactgcgaataccttaaagctct

SEQ ID NO: 406982 - DNA, 25 bp, Mus musculus
gaaactgcgaattccttaaagctct

SEQ ID NO: 406983 - DNA, 25 bp, Mus musculus
gaaactgcgagaaaccaaagtcctt

SEQ ID NO: 406984 - DNA, 25 bp, Mus musculus
gaaactgcgagataccaaagtcctt

SEQ ID NO: 406985 - DNA, 25 bp, Mus musculus
gaaactgcgtagaacccgttagcca

SEQ ID NO: 406986 - DNA, 25 bp, Mus musculus
gaaactgcgtagtacccgttagcca

SEQ ID NO: 406987 - DNA, 25 bp, Mus musculus
gaaactgcgtccctgacagaaccat

SEQ ID NO: 406988 - DNA, 25 bp, Mus musculus
gaaactgcgtccgtgacagaaccat

SEQ ID NO: 406989 - DNA, 25 bp, Mus musculus
gaaactgctagcatactcaggcatg

SEQ ID NO: 406990 - DNA, 25 bp, Mus musculus
gaaactgctagcttactcaggcatg

SEQ ID NO: 406991 - DNA, 25 bp, Mus musculus
gaaactgctcaccagtgtcatcata

SEQ ID NO: 406992 - DNA, 25 bp, Mus musculus
gaaactgctcacgagtgtcatcata

SEQ ID NO: 406993 - DNA, 25 bp, Mus musculus
gaaactgctcagacaggttttcctc

SEQ ID NO: 406994 - DNA, 25 bp, Mus musculus
gaaactgctcagtcaggttttcctc

SEQ ID NO: 406995 - DNA, 25 bp, Mus musculus
gaaactgctcggagttttcacctac

SEQ ID NO: 406996 - DNA, 25 bp, Mus musculus
gaaactgctcggtgttttcacctac

SEQ ID NO: 406997 - DNA, 25 bp, Mus musculus
gaaactgctctcaactttaaggtca

SEQ ID NO: 406998 - DNA, 25 bp, Mus musculus
gaaactgctctctactttaaggtca

SEQ ID NO: 406999 - DNA, 25 bp, Mus musculus
gaaactgctctgcttgaccaggaga

SEQ ID NO: 407000 - DNA, 25 bp, Mus musculus
gaaactgctctggttgaccaggaga

SEQ ID NO: 407001 - DNA, 25 bp, Mus musculus
gaaactgctcttcggctactgtaga

SEQ ID NO: 407002 - DNA, 25 bp, Mus musculus
gaaactgctcttgggctactgtaga

SEQ ID NO: 407003 - DNA, 25 bp, Mus musculus
gaaactgctgacactacgcttcagg

SEQ ID NO: 407004 - DNA, 25 bp, Mus musculus
gaaactgctgactctacgcttcagg

SEQ ID NO: 407005 - DNA, 25 bp, Mus musculus
gaaactgctgatctcttgagcctgg

SEQ ID NO: 407006 - DNA, 25 bp, Mus musculus
gaaactgctgatgtcttgagcctgg

SEQ ID NO: 407007 - DNA, 25 bp, Mus musculus
gaaactgctgcaatctgagaactat

SEQ ID NO: 407008 - DNA, 25 bp, Mus musculus
gaaactgctgcaatttgatgacttt

SEQ ID NO: 407009 - DNA, 25 bp, Mus musculus
gaaactgctgcattctgagaactat

SEQ ID NO: 407010 - DNA, 25 bp, Mus musculus
gaaactgctgcattttgatgacttt

SEQ ID NO: 407011 - DNA, 25 bp, Mus musculus
gaaactgctgctaaggctactgttg

SEQ ID NO: 407012 - DNA, 25 bp, Mus musculus
gaaactgctgcttaggctactgttg

SEQ ID NO: 407013 - DNA, 25 bp, Mus musculus
gaaactgctggacacgctgaagaag

SEQ ID NO: 407014 - DNA, 25 bp, Mus musculus
gaaactgctggagacgctgaagaag

SEQ ID NO: 407015 - DNA, 25 bp, Mus musculus
gaaactgctggtctacagcttttac

SEQ ID NO: 407016 - DNA, 25 bp, Mus musculus
gaaactgctggtgtacagcttttac

SEQ ID NO: 407017 - DNA, 25 bp, Mus musculus
gaaactgcttgcaatctcctaggtt

SEQ ID NO: 407018 - DNA, 25 bp, Mus musculus
gaaactgcttgctatctcctaggtt

SEQ ID NO: 407019 - DNA, 25 bp, Mus musculus
gaaactgcttgtagttccgggtgcc

SEQ ID NO: 407020 - DNA, 25 bp, Mus musculus
gaaactgcttgttgttccgggtgcc

SEQ ID NO: 407021 - DNA, 25 bp, Mus musculus
gaaactggaactcaccctaaataag

SEQ ID NO: 407022 - DNA, 25 bp, Mus musculus
gaaactggaactgaccctaaataag

SEQ ID NO: 407023 - DNA, 25 bp, Mus musculus
gaaactggaagaaacgctattgaag

SEQ ID NO: 407024 - DNA, 25 bp, Mus musculus
gaaactggaagatacgctattgaag

SEQ ID NO: 407025 - DNA, 25 bp, Mus musculus
gaaactggaagtaagccaaatcagg

SEQ ID NO: 407026 - DNA, 25 bp, Mus musculus
gaaactggaagtctaatgtgtcatt

SEQ ID NO: 407027 - DNA, 25 bp, Mus musculus
gaaactggaagtgtaatgtgtcatt

SEQ ID NO: 407028 - DNA, 25 bp, Mus musculus
gaaactggaagttagccaaatcagg

SEQ ID NO: 407029 - DNA, 25 bp, Mus musculus
gaaactggaattcggtgtgccaccc

SEQ ID NO: 407030 - DNA, 25 bp, Mus musculus
gaaactggaattgggtgtgccaccc

SEQ ID NO: 407031 - DNA, 25 bp, Mus musculus
gaaactggaccacatcgggatgccc

SEQ ID NO: 407032 - DNA, 25 bp, Mus musculus
gaaactggaccagatcgggatgccc

SEQ ID NO: 407033 - DNA, 25 bp, Mus musculus
gaaactggacccctgattagtgtaa

SEQ ID NO: 407034 - DNA, 25 bp, Mus musculus
gaaactggacccgtgattagtgtaa

SEQ ID NO: 407035 - DNA, 25 bp, Mus musculus
gaaactggagaaacacaaagccttt

SEQ ID NO: 407036 - DNA, 25 bp, Mus musculus
gaaactggagaatcacaaagccttt

SEQ ID NO: 407037 - DNA, 25 bp, Mus musculus
gaaactggagcgaaaccatttgaga

SEQ ID NO: 407038 - DNA, 25 bp, Mus musculus
gaaactggagcgtaaccatttgaga

SEQ ID NO: 407039 - DNA, 25 bp, Mus musculus
gaaactggataaaggccctcctggg

SEQ ID NO: 407040 - DNA, 25 bp, Mus musculus
gaaactggataatggccctcctggg

SEQ ID NO: 407041 - DNA, 25 bp, Mus musculus
gaaactggatcaattccctggttaa

SEQ ID NO: 407042 - DNA, 25 bp, Mus musculus
gaaactggatcatttccctggttaa

SEQ ID NO: 407043 - DNA, 25 bp, Mus musculus
gaaactggatctacttttttgaatc

SEQ ID NO: 407044 - DNA, 25 bp, Mus musculus
gaaactggatcttcttttttgaatc

SEQ ID NO: 407045 - DNA, 25 bp, Mus musculus
gaaactggattcatagggttcctgg

SEQ ID NO: 407046 - DNA, 25 bp, Mus musculus
gaaactggattcttagggttcctgg

SEQ ID NO: 407047 - DNA, 25 bp, Mus musculus
gaaactggattgcagagcactctct

SEQ ID NO: 407048 - DNA, 25 bp, Mus musculus
gaaactggattggagagcactctct

SEQ ID NO: 407049 - DNA, 25 bp, Mus musculus
gaaactggcaaaccctactaagtgt

SEQ ID NO: 407050 - DNA, 25 bp, Mus musculus
gaaactggcaaagcctactaagtgt

SEQ ID NO: 407051 - DNA, 25 bp, Mus musculus
gaaactggcagcaaattgttcctat

SEQ ID NO: 407052 - DNA, 25 bp, Mus musculus
gaaactggcagcacaagatatcaga

SEQ ID NO: 407053 - DNA, 25 bp, Mus musculus
gaaactggcagctaattgttcctat

SEQ ID NO: 407054 - DNA, 25 bp, Mus musculus
gaaactggcagctcaagatatcaga

SEQ ID NO: 407055 - DNA, 25 bp, Mus musculus
gaaactggccaacctagccttctgg

SEQ ID NO: 407056 - DNA, 25 bp, Mus musculus
gaaactggccaagctagccttctgg

SEQ ID NO: 407057 - DNA, 25 bp, Mus musculus
gaaactggccatagtcgtacacgat

SEQ ID NO: 407058 - DNA, 25 bp, Mus musculus
gaaactggccattgtcgtacacgat

SEQ ID NO: 407059 - DNA, 25 bp, Mus musculus
gaaactggctatcgctcctccctca

SEQ ID NO: 407060 - DNA, 25 bp, Mus musculus
gaaactggctatggctcctccctca

SEQ ID NO: 407061 - DNA, 25 bp, Mus musculus
gaaactggcttcatggtgtatctgg

SEQ ID NO: 407062 - DNA, 25 bp, Mus musculus
gaaactggcttcttggtgtatctgg

SEQ ID NO: 407063 - DNA, 25 bp, Mus musculus
gaaactgggaaacaccaattttcat

SEQ ID NO: 407064 - DNA, 25 bp, Mus musculus
gaaactgggaaagaccaattttcat

SEQ ID NO: 407065 - DNA, 25 bp, Mus musculus
gaaactgggacacttgcagagctga

SEQ ID NO: 407066 - DNA, 25 bp, Mus musculus
gaaactgggacagttgcagagctga

SEQ ID NO: 407067 - DNA, 25 bp, Mus musculus
gaaactgggagcactataatcaagg

SEQ ID NO: 407068 - DNA, 25 bp, Mus musculus
gaaactgggagctctataatcaagg

SEQ ID NO: 407069 - DNA, 25 bp, Mus musculus
gaaactgggcagaaagcatcacaaa

SEQ ID NO: 407070 - DNA, 25 bp, Mus musculus
gaaactgggcagtaagcatcacaaa

SEQ ID NO: 407071 - DNA, 25 bp, Mus musculus
gaaactgggccaagcttcttttaag

SEQ ID NO: 407072 - DNA, 25 bp, Mus musculus
gaaactgggccatgcttcttttaag

SEQ ID NO: 407073 - DNA, 25 bp, Mus musculus
gaaactgggctcctactaaatattg

SEQ ID NO: 407074 - DNA, 25 bp, Mus musculus
gaaactgggctcgtactaaatattg

SEQ ID NO: 407075 - DNA, 25 bp, Mus musculus
gaaactgggttactgtggccactct

SEQ ID NO: 407076 - DNA, 25 bp, Mus musculus
gaaactgggttagtgtggccactct

SEQ ID NO: 407077 - DNA, 25 bp, Mus musculus
gaaactggtcaaaacttgaatgtca

SEQ ID NO: 407078 - DNA, 25 bp, Mus musculus
gaaactggtcaatacttgaatgtca

SEQ ID NO: 407079 - DNA, 25 bp, Mus musculus
gaaactggtcctctatttggaacat

SEQ ID NO: 407080 - DNA, 25 bp, Mus musculus
gaaactggtcctgtatttggaacat

SEQ ID NO: 407081 - DNA, 25 bp, Mus musculus
gaaactggtcgtcagcaagcagaac

SEQ ID NO: 407082 - DNA, 25 bp, Mus musculus
gaaactggtcgtgagcaagcagaac

SEQ ID NO: 407083 - DNA, 25 bp, Mus musculus
gaaactggtgctccgatcgtcgcga

SEQ ID NO: 407084 - DNA, 25 bp, Mus musculus
gaaactggtgctgcgatcgtcgcga

SEQ ID NO: 407085 - DNA, 25 bp, Mus musculus
gaaactggttcactgtgcagccaag

SEQ ID NO: 407086 - DNA, 25 bp, Mus musculus
gaaactggttcagtgtgcagccaag

SEQ ID NO: 407087 - DNA, 25 bp, Mus musculus
gaaactggtttaaccatcctcagaa

SEQ ID NO: 407088 - DNA, 25 bp, Mus musculus
gaaactggtttatccatcctcagaa

SEQ ID NO: 407089 - DNA, 25 bp, Mus musculus
gaaactggtttcacagcacctacag

SEQ ID NO: 407090 - DNA, 25 bp, Mus musculus
gaaactggtttcactggcacacgtg

SEQ ID NO: 407091 - DNA, 25 bp, Mus musculus
gaaactggtttcattctctaagtga

SEQ ID NO: 407092 - DNA, 25 bp, Mus musculus
gaaactggtttctcagcacctacag

SEQ ID NO: 407093 - DNA, 25 bp, Mus musculus
gaaactggtttctctggcacacgtg

SEQ ID NO: 407094 - DNA, 25 bp, Mus musculus
gaaactggtttctttctctaagtga

SEQ ID NO: 407095 - DNA, 25 bp, Mus musculus
gaaactggttttagcaccaatgtag

SEQ ID NO: 407096 - DNA, 25 bp, Mus musculus
gaaactggttttctgttcatcatat

SEQ ID NO: 407097 - DNA, 25 bp, Mus musculus
gaaactggttttcttttgacagagt

SEQ ID NO: 407098 - DNA, 25 bp, Mus musculus
gaaactggttttgtgttcatcatat

SEQ ID NO: 407099 - DNA, 25 bp, Mus musculus
gaaactggttttgttttgacagagt

SEQ ID NO: 407100 - DNA, 25 bp, Mus musculus
gaaactggtttttgcaccaatgtag

SEQ ID NO: 407101 - DNA, 25 bp, Mus musculus
gaaactgtaactagtcttttccaag

SEQ ID NO: 407102 - DNA, 25 bp, Mus musculus
gaaactgtaactcccacaagtcaaa

SEQ ID NO: 407103 - DNA, 25 bp, Mus musculus
gaaactgtaactgccacaagtcaaa

SEQ ID NO: 407104 - DNA, 25 bp, Mus musculus
gaaactgtaacttgtcttttccaag

SEQ ID NO: 407105 - DNA, 25 bp, Mus musculus
gaaactgtaagaaacctctggagat

SEQ ID NO: 407106 - DNA, 25 bp, Mus musculus
gaaactgtaagatacctctggagat

SEQ ID NO: 407107 - DNA, 25 bp, Mus musculus
gaaactgtacagcacattcttccct

SEQ ID NO: 407108 - DNA, 25 bp, Mus musculus
gaaactgtacaggacattcttccct

SEQ ID NO: 407109 - DNA, 25 bp, Mus musculus
gaaactgtacatctgttaccttgaa

SEQ ID NO: 407110 - DNA, 25 bp, Mus musculus
gaaactgtacatgtgttaccttgaa

SEQ ID NO: 407111 - DNA, 25 bp, Mus musculus
gaaactgtacctacagaagttcaga

SEQ ID NO: 407112 - DNA, 25 bp, Mus musculus
gaaactgtaccttcagaagttcaga

SEQ ID NO: 407113 - DNA, 25 bp, Mus musculus
gaaactgtactaatgtctcacctga

SEQ ID NO: 407114 - DNA, 25 bp, Mus musculus
gaaactgtactattgtctcacctga

SEQ ID NO: 407115 - DNA, 25 bp, Mus musculus
gaaactgtatccactagcaggcact

SEQ ID NO: 407116 - DNA, 25 bp, Mus musculus
gaaactgtatcctctagcaggcact

SEQ ID NO: 407117 - DNA, 25 bp, Mus musculus
gaaactgtatggaagagcttctgtt

SEQ ID NO: 407118 - DNA, 25 bp, Mus musculus
gaaactgtatggtagagcttctgtt

SEQ ID NO: 407119 - DNA, 25 bp, Mus musculus
gaaactgtcacaagagctgctggag

SEQ ID NO: 407120 - DNA, 25 bp, Mus musculus
gaaactgtcacatgagctgctggag

SEQ ID NO: 407121 - DNA, 25 bp, Mus musculus
gaaactgtcaccagaacaactcatt

SEQ ID NO: 407122 - DNA, 25 bp, Mus musculus
gaaactgtcacctgaacaactcatt

SEQ ID NO: 407123 - DNA, 25 bp, Mus musculus
gaaactgtcataatgttacctagct

SEQ ID NO: 407124 - DNA, 25 bp, Mus musculus
gaaactgtcatattgttacctagct

SEQ ID NO: 407125 - DNA, 25 bp, Mus musculus
gaaactgtcatccttgagtgaccag

SEQ ID NO: 407126 - DNA, 25 bp, Mus musculus
gaaactgtcatcgttgagtgaccag

SEQ ID NO: 407127 - DNA, 25 bp, Mus musculus
gaaactgtcccacaagttttctaca

SEQ ID NO: 407128 - DNA, 25 bp, Mus musculus
gaaactgtcccagaagttttctaca

SEQ ID NO: 407129 - DNA, 25 bp, Mus musculus
gaaactgtcctcaaacagaatgaaa

SEQ ID NO: 407130 - DNA, 25 bp, Mus musculus
gaaactgtcctctaacagaatgaaa

SEQ ID NO: 407131 - DNA, 25 bp, Mus musculus
gaaactgtccttaagtcactatgaa

SEQ ID NO: 407132 - DNA, 25 bp, Mus musculus
gaaactgtcctttagtcactatgaa

SEQ ID NO: 407133 - DNA, 25 bp, Mus musculus
gaaactgtcggacggattcaagttc

SEQ ID NO: 407134 - DNA, 25 bp, Mus musculus
gaaactgtcggagggattcaagttc

SEQ ID NO: 407135 - DNA, 25 bp, Mus musculus
gaaactgtctctcttccggcgagga

SEQ ID NO: 407136 - DNA, 25 bp, Mus musculus
gaaactgtctctgttccggcgagga

SEQ ID NO: 407137 - DNA, 25 bp, Mus musculus
gaaactgtctgcatctttcttcaac

SEQ ID NO: 407138 - DNA, 25 bp, Mus musculus
gaaactgtctgcttctttcttcaac

SEQ ID NO: 407139 - DNA, 25 bp, Mus musculus
gaaactgtcttaactgtaataccaa

SEQ ID NO: 407140 - DNA, 25 bp, Mus musculus
gaaactgtcttatctgtaataccaa

SEQ ID NO: 407141 - DNA, 25 bp, Mus musculus
gaaactgtctttaccactggttgat

SEQ ID NO: 407142 - DNA, 25 bp, Mus musculus
gaaactgtctttagacttgggtctt

SEQ ID NO: 407143 - DNA, 25 bp, Mus musculus
gaaactgtcttttccactggttgat

SEQ ID NO: 407144 - DNA, 25 bp, Mus musculus
gaaactgtcttttgacttgggtctt

SEQ ID NO: 407145 - DNA, 25 bp, Mus musculus
gaaactgtgacgacacccagtctaa

SEQ ID NO: 407146 - DNA, 25 bp, Mus musculus
gaaactgtgacgtcacccagtctaa

SEQ ID NO: 407147 - DNA, 25 bp, Mus musculus
gaaactgtgattcaaagatccccat

SEQ ID NO: 407148 - DNA, 25 bp, Mus musculus
gaaactgtgattcccgtggctagta

SEQ ID NO: 407149 - DNA, 25 bp, Mus musculus
gaaactgtgattgaaagatccccat

SEQ ID NO: 407150 - DNA, 25 bp, Mus musculus
gaaactgtgattgccgtggctagta

SEQ ID NO: 407151 - DNA, 25 bp, Mus musculus
gaaactgtgcctacttatattccct

SEQ ID NO: 407152 - DNA, 25 bp, Mus musculus
gaaactgtgccttcttatattccct

SEQ ID NO: 407153 - DNA, 25 bp, Mus musculus
gaaactgtgctcaacttggcttatg

SEQ ID NO: 407154 - DNA, 25 bp, Mus musculus
gaaactgtgctctacttggcttatg

SEQ ID NO: 407155 - DNA, 25 bp, Mus musculus
gaaactgtgcttccatttaatcatg

SEQ ID NO: 407156 - DNA, 25 bp, Mus musculus
gaaactgtgcttgcatttaatcatg

SEQ ID NO: 407157 - DNA, 25 bp, Mus musculus
gaaactgtgtcaaactggtattagg

SEQ ID NO: 407158 - DNA, 25 bp, Mus musculus
gaaactgtgtcatactggtattagg

SEQ ID NO: 407159 - DNA, 25 bp, Mus musculus
gaaactgtgtgactccaggaggaca

SEQ ID NO: 407160 - DNA, 25 bp, Mus musculus
gaaactgtgtgagtccaggaggaca

SEQ ID NO: 407161 - DNA, 25 bp, Mus musculus
gaaactgtgtgccacgcagttcaac

SEQ ID NO: 407162 - DNA, 25 bp, Mus musculus
gaaactgtgtgcgacgcagttcaac

SEQ ID NO: 407163 - DNA, 25 bp, Mus musculus
gaaactgtgtgtataattcccggtt

SEQ ID NO: 407164 - DNA, 25 bp, Mus musculus
gaaactgtgtgtttaattcccggtt

SEQ ID NO: 407165 - DNA, 25 bp, Mus musculus
gaaactgtgttcaagccattgtgtt

SEQ ID NO: 407166 - DNA, 25 bp, Mus musculus
gaaactgtgttctagccattgtgtt

SEQ ID NO: 407167 - DNA, 25 bp, Mus musculus
gaaactgttaacaccactgctatcc

SEQ ID NO: 407168 - DNA, 25 bp, Mus musculus
gaaactgttaactccactgctatcc

SEQ ID NO: 407169 - DNA, 25 bp, Mus musculus
gaaactgttaggacaccaaatcttt

SEQ ID NO: 407170 - DNA, 25 bp, Mus musculus
gaaactgttaggtcaccaaatcttt

SEQ ID NO: 407171 - DNA, 25 bp, Mus musculus
gaaactgttatcagatgcccctcaa

SEQ ID NO: 407172 - DNA, 25 bp, Mus musculus
gaaactgttatctgatgcccctcaa

SEQ ID NO: 407173 - DNA, 25 bp, Mus musculus
gaaactgttatgaagcccttgacca

SEQ ID NO: 407174 - DNA, 25 bp, Mus musculus
gaaactgttatgtagcccttgacca

SEQ ID NO: 407175 - DNA, 25 bp, Mus musculus
gaaactgttattcctgagaatcata

SEQ ID NO: 407176 - DNA, 25 bp, Mus musculus
gaaactgttattgctgagaatcata

SEQ ID NO: 407177 - DNA, 25 bp, Mus musculus
gaaactgttcacatctctggtgtgt

SEQ ID NO: 407178 - DNA, 25 bp, Mus musculus
gaaactgttcaccttactttctcaa

SEQ ID NO: 407179 - DNA, 25 bp, Mus musculus
gaaactgttcacgttactttctcaa

SEQ ID NO: 407180 - DNA, 25 bp, Mus musculus
gaaactgttcacttctctggtgtgt

SEQ ID NO: 407181 - DNA, 25 bp, Mus musculus
gaaactgttccacaaagggatgggt

SEQ ID NO: 407182 - DNA, 25 bp, Mus musculus
gaaactgttccacgcacagtgaggc

SEQ ID NO: 407183 - DNA, 25 bp, Mus musculus
gaaactgttccagaaagggatgggt

SEQ ID NO: 407184 - DNA, 25 bp, Mus musculus
gaaactgttccaggcacagtgaggc

SEQ ID NO: 407185 - DNA, 25 bp, Mus musculus
gaaactgttctcctcaaagctgtgc

SEQ ID NO: 407186 - DNA, 25 bp, Mus musculus
gaaactgttctcgtcaaagctgtgc

SEQ ID NO: 407187 - DNA, 25 bp, Mus musculus
gaaactgttcttaggagcaaatccc

SEQ ID NO: 407188 - DNA, 25 bp, Mus musculus
gaaactgttcttcacagtgctactt

SEQ ID NO: 407189 - DNA, 25 bp, Mus musculus
gaaactgttcttgacagtgctactt

SEQ ID NO: 407190 - DNA, 25 bp, Mus musculus
gaaactgttctttggagcaaatccc

SEQ ID NO: 407191 - DNA, 25 bp, Mus musculus
gaaactgttgcaaatgtaggtaaaa

SEQ ID NO: 407192 - DNA, 25 bp, Mus musculus
gaaactgttgcatatgtaggtaaaa

SEQ ID NO: 407193 - DNA, 25 bp, Mus musculus
gaaactgttgcgagattctcaggaa

SEQ ID NO: 407194 - DNA, 25 bp, Mus musculus
gaaactgttgcgtgattctcaggaa

SEQ ID NO: 407195 - DNA, 25 bp, Mus musculus
gaaactgttggtatttatctattgt

SEQ ID NO: 407196 - DNA, 25 bp, Mus musculus
gaaactgttggtttttatctattgt

SEQ ID NO: 407197 - DNA, 25 bp, Mus musculus
gaaactgttgtacaaggaatgttct

SEQ ID NO: 407198 - DNA, 25 bp, Mus musculus
gaaactgttgtagaaggaatgttct

SEQ ID NO: 407199 - DNA, 25 bp, Mus musculus
gaaactgtttacataagctgtaaca

SEQ ID NO: 407200 - DNA, 25 bp, Mus musculus
gaaactgtttacttaagctgtaaca

SEQ ID NO: 407201 - DNA, 25 bp, Mus musculus
gaaactgtttggcatctaatcaact

SEQ ID NO: 407202 - DNA, 25 bp, Mus musculus
gaaactgtttgggatctaatcaact

SEQ ID NO: 407203 - DNA, 25 bp, Mus musculus
gaaactgtttgtaagcgtcgttctc

SEQ ID NO: 407204 - DNA, 25 bp, Mus musculus
gaaactgtttgttagcgtcgttctc

SEQ ID NO: 407205 - DNA, 25 bp, Mus musculus
gaaactgttttcacacaaacactca

SEQ ID NO: 407206 - DNA, 25 bp, Mus musculus
gaaactgttttctcacaaacactca

SEQ ID NO: 407207 - DNA, 25 bp, Mus musculus
gaaactgttttgacatgaaggactg

SEQ ID NO: 407208 - DNA, 25 bp, Mus musculus
gaaactgttttgtcatgaaggactg

SEQ ID NO: 407209 - DNA, 25 bp, Mus musculus
gaaacttaaaatcatatcccaggag

SEQ ID NO: 407210 - DNA, 25 bp, Mus musculus
gaaacttaaaatgatatcccaggag

SEQ ID NO: 407211 - DNA, 25 bp, Mus musculus
gaaacttaaagcatgttccagcatt

SEQ ID NO: 407212 - DNA, 25 bp, Mus musculus
gaaacttaaagcttgttccagcatt

SEQ ID NO: 407213 - DNA, 25 bp, Mus musculus
gaaacttaaatcagagggcaccaca

SEQ ID NO: 407214 - DNA, 25 bp, Mus musculus
gaaacttaaatctgagggcaccaca

SEQ ID NO: 407215 - DNA, 25 bp, Mus musculus
gaaacttaaatgatcccgaatggca

SEQ ID NO: 407216 - DNA, 25 bp, Mus musculus
gaaacttaaatgttcccgaatggca

SEQ ID NO: 407217 - DNA, 25 bp, Mus musculus
gaaacttaacagagccaggcatgat

SEQ ID NO: 407218 - DNA, 25 bp, Mus musculus
gaaacttaacagtgccaggcatgat

SEQ ID NO: 407219 - DNA, 25 bp, Mus musculus
gaaacttaacttcttcactcctgag

SEQ ID NO: 407220 - DNA, 25 bp, Mus musculus
gaaacttaacttgttcactcctgag

SEQ ID NO: 407221 - DNA, 25 bp, Mus musculus
gaaacttaagttcacccaagggatg

SEQ ID NO: 407222 - DNA, 25 bp, Mus musculus
gaaacttaagttgacccaagggatg

SEQ ID NO: 407223 - DNA, 25 bp, Mus musculus
gaaacttaatctacggctccttggt

SEQ ID NO: 407224 - DNA, 25 bp, Mus musculus
gaaacttaatctctgtgtccacaac

SEQ ID NO: 407225 - DNA, 25 bp, Mus musculus
gaaacttaatctgtgtgtccacaac

SEQ ID NO: 407226 - DNA, 25 bp, Mus musculus
gaaacttaatcttcggctccttggt

SEQ ID NO: 407227 - DNA, 25 bp, Mus musculus
gaaacttaccatattaacctgcaca

SEQ ID NO: 407228 - DNA, 25 bp, Mus musculus
gaaacttaccattttaacctgcaca

SEQ ID NO: 407229 - DNA, 25 bp, Mus musculus
gaaacttacctgcatacggttacag

SEQ ID NO: 407230 - DNA, 25 bp, Mus musculus
gaaacttacctggatacggttacag

SEQ ID NO: 407231 - DNA, 25 bp, Mus musculus
gaaacttactcaacagcttctcagt

SEQ ID NO: 407232 - DNA, 25 bp, Mus musculus
gaaacttactcatcagcttctcagt

SEQ ID NO: 407233 - DNA, 25 bp, Mus musculus
gaaacttactggcaatctgatggct

SEQ ID NO: 407234 - DNA, 25 bp, Mus musculus
gaaacttactgggaatctgatggct

SEQ ID NO: 407235 - DNA, 25 bp, Mus musculus
gaaacttacttaattggcacctacg

SEQ ID NO: 407236 - DNA, 25 bp, Mus musculus
gaaacttacttatttggcacctacg

SEQ ID NO: 407237 - DNA, 25 bp, Mus musculus
gaaacttacttcattatcatgccct

SEQ ID NO: 407238 - DNA, 25 bp, Mus musculus
gaaacttacttctttatcatgccct

SEQ ID NO: 407239 - DNA, 25 bp, Mus musculus
gaaacttagatgcacagtatgacat

SEQ ID NO: 407240 - DNA, 25 bp, Mus musculus
gaaacttagatggacagtatgacat

SEQ ID NO: 407241 - DNA, 25 bp, Mus musculus
gaaacttaggcaataatctcactat

SEQ ID NO: 407242 - DNA, 25 bp, Mus musculus
gaaacttaggcattaatctcactat

SEQ ID NO: 407243 - DNA, 25 bp, Mus musculus
gaaacttagggactgggcctctgct

SEQ ID NO: 407244 - DNA, 25 bp, Mus musculus
gaaacttagggagtgggcctctgct

SEQ ID NO: 407245 - DNA, 25 bp, Mus musculus
gaaacttagggtctgatgttctgcc

SEQ ID NO: 407246 - DNA, 25 bp, Mus musculus
gaaacttagggtgtgatgttctgcc

SEQ ID NO: 407247 - DNA, 25 bp, Mus musculus
gaaacttaggtgactagggtcctga

SEQ ID NO: 407248 - DNA, 25 bp, Mus musculus
gaaacttaggtgtctagggtcctga

SEQ ID NO: 407249 - DNA, 25 bp, Mus musculus
gaaacttagtcgacattgacacttg

SEQ ID NO: 407250 - DNA, 25 bp, Mus musculus
gaaacttagtcgtcattgacacttg

SEQ ID NO: 407251 - DNA, 25 bp, Mus musculus
gaaacttcaagcatcatccaaggga

SEQ ID NO: 407252 - DNA, 25 bp, Mus musculus
gaaacttcaagcttcatccaaggga

SEQ ID NO: 407253 - DNA, 25 bp, Mus musculus
gaaacttcaaggcaagatcaatgat

SEQ ID NO: 407254 - DNA, 25 bp, Mus musculus
gaaacttcaagggaagatcaatgat

SEQ ID NO: 407255 - DNA, 25 bp, Mus musculus
gaaacttcaatgagaccagtccaga

SEQ ID NO: 407256 - DNA, 25 bp, Mus musculus
gaaacttcaatgtgaccagtccaga

SEQ ID NO: 407257 - DNA, 25 bp, Mus musculus
gaaacttcagaaatgccatccagta

SEQ ID NO: 407258 - DNA, 25 bp, Mus musculus
gaaacttcagaattgccatccagta

SEQ ID NO: 407259 - DNA, 25 bp, Mus musculus
gaaacttcagcccaccagttgaaac

SEQ ID NO: 407260 - DNA, 25 bp, Mus musculus
gaaacttcagccgaccagttgaaac

SEQ ID NO: 407261 - DNA, 25 bp, Mus musculus
gaaacttcagctattctcgagtgtc

SEQ ID NO: 407262 - DNA, 25 bp, Mus musculus
gaaacttcagctcaatacactaaag

SEQ ID NO: 407263 - DNA, 25 bp, Mus musculus
gaaacttcagctgaatacactaaag

SEQ ID NO: 407264 - DNA, 25 bp, Mus musculus
gaaacttcagcttttctcgagtgtc

SEQ ID NO: 407265 - DNA, 25 bp, Mus musculus
gaaacttcaggtcatcccacaacta

SEQ ID NO: 407266 - DNA, 25 bp, Mus musculus
gaaacttcaggtcgtagccctggtt

SEQ ID NO: 407267 - DNA, 25 bp, Mus musculus
gaaacttcaggtgatcccacaacta

SEQ ID NO: 407268 - DNA, 25 bp, Mus musculus
gaaacttcaggtggtagccctggtt

SEQ ID NO: 407269 - DNA, 25 bp, Mus musculus
gaaacttcatctctaaacctgggct

SEQ ID NO: 407270 - DNA, 25 bp, Mus musculus
gaaacttcatctgtaaacctgggct

SEQ ID NO: 407271 - DNA, 25 bp, Mus musculus
gaaacttcatgaagcggctacttca

SEQ ID NO: 407272 - DNA, 25 bp, Mus musculus
gaaacttcatgatgcggctacttca

SEQ ID NO: 407273 - DNA, 25 bp, Mus musculus
gaaacttcatgccaaatatacccag

SEQ ID NO: 407274 - DNA, 25 bp, Mus musculus
gaaacttcatgcgaaatatacccag

SEQ ID NO: 407275 - DNA, 25 bp, Mus musculus
gaaacttcattgcaaacctttggag

SEQ ID NO: 407276 - DNA, 25 bp, Mus musculus
gaaacttcattggaaacctttggag

SEQ ID NO: 407277 - DNA, 25 bp, Mus musculus
gaaacttccacactatatgcttggg

SEQ ID NO: 407278 - DNA, 25 bp, Mus musculus
gaaacttccacagtatatgcttggg

SEQ ID NO: 407279 - DNA, 25 bp, Mus musculus
gaaacttcccatcaagcttgtcccg

SEQ ID NO: 407280 - DNA, 25 bp, Mus musculus
gaaacttcccatgaagcttgtcccg

SEQ ID NO: 407281 - DNA, 25 bp, Mus musculus
gaaacttcccgcagtattaaaaatg

SEQ ID NO: 407282 - DNA, 25 bp, Mus musculus
gaaacttcccgctgtattaaaaatg

SEQ ID NO: 407283 - DNA, 25 bp, Mus musculus
gaaacttcccttcctaactgaatat

SEQ ID NO: 407284 - DNA, 25 bp, Mus musculus
gaaacttcccttgctaactgaatat

SEQ ID NO: 407285 - DNA, 25 bp, Mus musculus
gaaacttccgagacctctctgcaaa

SEQ ID NO: 407286 - DNA, 25 bp, Mus musculus
gaaacttccgagtcctctctgcaaa

SEQ ID NO: 407287 - DNA, 25 bp, Mus musculus
gaaacttcctccctcacacaaaaag

SEQ ID NO: 407288 - DNA, 25 bp, Mus musculus
gaaacttcctccgtcacacaaaaag

SEQ ID NO: 407289 - DNA, 25 bp, Mus musculus
gaaacttcctgactttacaggatca

SEQ ID NO: 407290 - DNA, 25 bp, Mus musculus
gaaacttcctgagtttacaggatca

SEQ ID NO: 407291 - DNA, 25 bp, Mus musculus
gaaacttcctggatatgtgccattc

SEQ ID NO: 407292 - DNA, 25 bp, Mus musculus
gaaacttcctggttatgtgccattc

SEQ ID NO: 407293 - DNA, 25 bp, Mus musculus
gaaacttcctgtcgagtcaattcag

SEQ ID NO: 407294 - DNA, 25 bp, Mus musculus
gaaacttcctgtggagtcaattcag

SEQ ID NO: 407295 - DNA, 25 bp, Mus musculus
gaaacttccttcatctttagttata

SEQ ID NO: 407296 - DNA, 25 bp, Mus musculus
gaaacttccttcttctttagttata

SEQ ID NO: 407297 - DNA, 25 bp, Mus musculus
gaaacttccttgacttattactttg

SEQ ID NO: 407298 - DNA, 25 bp, Mus musculus
gaaacttccttgtcttattactttg

SEQ ID NO: 407299 - DNA, 25 bp, Mus musculus
gaaacttcctttccacagaattgtt

SEQ ID NO: 407300 - DNA, 25 bp, Mus musculus
gaaacttcctttgcacagaattgtt

SEQ ID NO: 407301 - DNA, 25 bp, Mus musculus
gaaacttcgagaactagagggttat

SEQ ID NO: 407302 - DNA, 25 bp, Mus musculus
gaaacttcgagatctagagggttat

SEQ ID NO: 407303 - DNA, 25 bp, Mus musculus
gaaacttcgccactacagaaagatt

SEQ ID NO: 407304 - DNA, 25 bp, Mus musculus
gaaacttcgccagtacagaaagatt

SEQ ID NO: 407305 - DNA, 25 bp, Mus musculus
gaaacttcggaaacgcaagccagag

SEQ ID NO: 407306 - DNA, 25 bp, Mus musculus
gaaacttcggaatcgcaagccagag

SEQ ID NO: 407307 - DNA, 25 bp, Mus musculus
gaaacttcgtgtctggtcataattt

SEQ ID NO: 407308 - DNA, 25 bp, Mus musculus
gaaacttcgtgtgtggtcataattt

SEQ ID NO: 407309 - DNA, 25 bp, Mus musculus
gaaacttctactactcagatccagg

SEQ ID NO: 407310 - DNA, 25 bp, Mus musculus
gaaacttctacttctcagatccagg

SEQ ID NO: 407311 - DNA, 25 bp, Mus musculus
gaaacttctagcaaaggtcggttat

SEQ ID NO: 407312 - DNA, 25 bp, Mus musculus
gaaacttctagctaaggtcggttat

SEQ ID NO: 407313 - DNA, 25 bp, Mus musculus
gaaacttctcctattcatggttagg

SEQ ID NO: 407314 - DNA, 25 bp, Mus musculus
gaaacttctccttttcatggttagg

SEQ ID NO: 407315 - DNA, 25 bp, Mus musculus
gaaacttctcttaagcagctgatat

SEQ ID NO: 407316 - DNA, 25 bp, Mus musculus
gaaacttctctttagcagctgatat

SEQ ID NO: 407317 - DNA, 25 bp, Mus musculus
gaaacttctgaaatctattatcttt

SEQ ID NO: 407318 - DNA, 25 bp, Mus musculus
gaaacttctgaattctattatcttt

SEQ ID NO: 407319 - DNA, 25 bp, Mus musculus
gaaacttctgcaacggtatttccca

SEQ ID NO: 407320 - DNA, 25 bp, Mus musculus
gaaacttctgcaagtttgtaagaca

SEQ ID NO: 407321 - DNA, 25 bp, Mus musculus
gaaacttctgcatcggtatttccca

SEQ ID NO: 407322 - DNA, 25 bp, Mus musculus
gaaacttctgcatgtttgtaagaca

SEQ ID NO: 407323 - DNA, 25 bp, Mus musculus
gaaacttctggaacgccatgtaaaa

SEQ ID NO: 407324 - DNA, 25 bp, Mus musculus
gaaacttctggatcgccatgtaaaa

SEQ ID NO: 407325 - DNA, 25 bp, Mus musculus
gaaacttcttttagagggctgtggt

SEQ ID NO: 407326 - DNA, 25 bp, Mus musculus
gaaacttctttttgagggctgtggt

SEQ ID NO: 407327 - DNA, 25 bp, Mus musculus
gaaacttgactaattcgacacacaa

SEQ ID NO: 407328 - DNA, 25 bp, Mus musculus
gaaacttgactatttcgacacacaa

SEQ ID NO: 407329 - DNA, 25 bp, Mus musculus
gaaacttgcagaatcacatcctaaa

SEQ ID NO: 407330 - DNA, 25 bp, Mus musculus
gaaacttgcagattcacatcctaaa

SEQ ID NO: 407331 - DNA, 25 bp, Mus musculus
gaaacttgcatcaaggcttcatcag

SEQ ID NO: 407332 - DNA, 25 bp, Mus musculus
gaaacttgcatctaggcttcatcag

SEQ ID NO: 407333 - DNA, 25 bp, Mus musculus
gaaacttgcccaagtattctcagat

SEQ ID NO: 407334 - DNA, 25 bp, Mus musculus
gaaacttgcccatgtattctcagat

SEQ ID NO: 407335 - DNA, 25 bp, Mus musculus
gaaacttgccccacagagtgggcta

SEQ ID NO: 407336 - DNA, 25 bp, Mus musculus
gaaacttgcccctcagagtgggcta

SEQ ID NO: 407337 - DNA, 25 bp, Mus musculus
gaaacttgcctgagatctgataaat

SEQ ID NO: 407338 - DNA, 25 bp, Mus musculus
gaaacttgcctgtgatctgataaat

SEQ ID NO: 407339 - DNA, 25 bp, Mus musculus
gaaacttgcgagacttcctgttggt

SEQ ID NO: 407340 - DNA, 25 bp, Mus musculus
gaaacttgcgagtcttcctgttggt

SEQ ID NO: 407341 - DNA, 25 bp, Mus musculus
gaaacttgcggaactatgtcctcat

SEQ ID NO: 407342 - DNA, 25 bp, Mus musculus
gaaacttgcggatctatgtcctcat

SEQ ID NO: 407343 - DNA, 25 bp, Mus musculus
gaaacttgctatcaatgtgggccag

SEQ ID NO: 407344 - DNA, 25 bp, Mus musculus
gaaacttgctatgaatgtgggccag

SEQ ID NO: 407345 - DNA, 25 bp, Mus musculus
gaaacttggaatcatcaggtcctaa

SEQ ID NO: 407346 - DNA, 25 bp, Mus musculus
gaaacttggaatgatcaggtcctaa

SEQ ID NO: 407347 - DNA, 25 bp, Mus musculus
gaaacttggacgattggcccagaga

SEQ ID NO: 407348 - DNA, 25 bp, Mus musculus
gaaacttggacgtttggcccagaga

SEQ ID NO: 407349 - DNA, 25 bp, Mus musculus
gaaacttggaggatgccagacacat

SEQ ID NO: 407350 - DNA, 25 bp, Mus musculus
gaaacttggaggttgccagacacat

SEQ ID NO: 407351 - DNA, 25 bp, Mus musculus
gaaacttggagtacgctgttgccca

SEQ ID NO: 407352 - DNA, 25 bp, Mus musculus
gaaacttggagttcgctgttgccca

SEQ ID NO: 407353 - DNA, 25 bp, Mus musculus
gaaacttggatcaatgcactacatt

SEQ ID NO: 407354 - DNA, 25 bp, Mus musculus
gaaacttggatctatgcactacatt

SEQ ID NO: 407355 - DNA, 25 bp, Mus musculus
gaaacttggcaactacggtgacaga

SEQ ID NO: 407356 - DNA, 25 bp, Mus musculus
gaaacttggcaagtacggtgacaga

SEQ ID NO: 407357 - DNA, 25 bp, Mus musculus
gaaacttggccaacaatattctttg

SEQ ID NO: 407358 - DNA, 25 bp, Mus musculus
gaaacttggccatcaatattctttg

SEQ ID NO: 407359 - DNA, 25 bp, Mus musculus
gaaacttggctcaattttatatata

SEQ ID NO: 407360 - DNA, 25 bp, Mus musculus
gaaacttggctctattttatatata

SEQ ID NO: 407361 - DNA, 25 bp, Mus musculus
gaaacttgggcaaaggaggctccac

SEQ ID NO: 407362 - DNA, 25 bp, Mus musculus
gaaacttgggcataggaggctccac

SEQ ID NO: 407363 - DNA, 25 bp, Mus musculus
gaaacttgggtaacaggccatttca

SEQ ID NO: 407364 - DNA, 25 bp, Mus musculus
gaaacttgggtatcaggccatttca

SEQ ID NO: 407365 - DNA, 25 bp, Mus musculus
gaaacttggtgacccagaattacac

SEQ ID NO: 407366 - DNA, 25 bp, Mus musculus
gaaacttggtgagccagaattacac

SEQ ID NO: 407367 - DNA, 25 bp, Mus musculus
gaaacttggtgcagtggctctgagt

SEQ ID NO: 407368 - DNA, 25 bp, Mus musculus
gaaacttggtgctgtggctctgagt

SEQ ID NO: 407369 - DNA, 25 bp, Mus musculus
gaaacttgtcatactcgatgctctg

SEQ ID NO: 407370 - DNA, 25 bp, Mus musculus
gaaacttgtcattctcgatgctctg

SEQ ID NO: 407371 - DNA, 25 bp, Mus musculus
gaaacttgtgcactgggctgcccat

SEQ ID NO: 407372 - DNA, 25 bp, Mus musculus
gaaacttgtgcagtgggctgcccat

SEQ ID NO: 407373 - DNA, 25 bp, Mus musculus
gaaacttgtgttagtggcgaccctt

SEQ ID NO: 407374 - DNA, 25 bp, Mus musculus
gaaacttgtgtttgtggcgaccctt

SEQ ID NO: 407375 - DNA, 25 bp, Mus musculus
gaaacttgttaaaagttaccatatg

SEQ ID NO: 407376 - DNA, 25 bp, Mus musculus
gaaacttgttaatagttaccatatg

SEQ ID NO: 407377 - DNA, 25 bp, Mus musculus
gaaacttgttgcatgtggagactta

SEQ ID NO: 407378 - DNA, 25 bp, Mus musculus
gaaacttgttgcttgtggagactta

SEQ ID NO: 407379 - DNA, 25 bp, Mus musculus
gaaacttgtttgagcatatgctctt

SEQ ID NO: 407380 - DNA, 25 bp, Mus musculus
gaaacttgtttgctatgtctattac

SEQ ID NO: 407381 - DNA, 25 bp, Mus musculus
gaaacttgtttggtatgtctattac

SEQ ID NO: 407382 - DNA, 25 bp, Mus musculus
gaaacttgtttgtgcatatgctctt

SEQ ID NO: 407383 - DNA, 25 bp, Mus musculus
gaaactttacctattgccgagatgc

SEQ ID NO: 407384 - DNA, 25 bp, Mus musculus
gaaactttaccttttgccgagatgc

SEQ ID NO: 407385 - DNA, 25 bp, Mus musculus
gaaactttacgaaggacacagagtc

SEQ ID NO: 407386 - DNA, 25 bp, Mus musculus
gaaactttacgatggacacagagtc

SEQ ID NO: 407387 - DNA, 25 bp, Mus musculus
gaaactttagcgaggtaacacctgt

SEQ ID NO: 407388 - DNA, 25 bp, Mus musculus
gaaactttagcgtggtaacacctgt

SEQ ID NO: 407389 - DNA, 25 bp, Mus musculus
gaaactttcagaatcttcaggactc

SEQ ID NO: 407390 - DNA, 25 bp, Mus musculus
gaaactttcagattcttcaggactc

SEQ ID NO: 407391 - DNA, 25 bp, Mus musculus
gaaactttccctcaggaagccattc

SEQ ID NO: 407392 - DNA, 25 bp, Mus musculus
gaaactttccctgaggaagccattc

SEQ ID NO: 407393 - DNA, 25 bp, Mus musculus
gaaactttccttagacaatgctgca

SEQ ID NO: 407394 - DNA, 25 bp, Mus musculus
gaaactttcctttgacaatgctgca

SEQ ID NO: 407395 - DNA, 25 bp, Mus musculus
gaaactttcgggacaagctgcacag

SEQ ID NO: 407396 - DNA, 25 bp, Mus musculus
gaaactttcgggtcaagctgcacag

SEQ ID NO: 407397 - DNA, 25 bp, Mus musculus
gaaactttctctattcacacctgtc

SEQ ID NO: 407398 - DNA, 25 bp, Mus musculus
gaaactttctcttttcacacctgtc

SEQ ID NO: 407399 - DNA, 25 bp, Mus musculus
gaaactttctggcatgtggataatt

SEQ ID NO: 407400 - DNA, 25 bp, Mus musculus
gaaactttctgggatgtggataatt

SEQ ID NO: 407401 - DNA, 25 bp, Mus musculus
gaaactttgagcatcctgtggagcc

SEQ ID NO: 407402 - DNA, 25 bp, Mus musculus
gaaactttgagcttcctgtggagcc

SEQ ID NO: 407403 - DNA, 25 bp, Mus musculus
gaaactttgctactcatctttaaca

SEQ ID NO: 407404 - DNA, 25 bp, Mus musculus
gaaactttgctagtcatctttaaca

SEQ ID NO: 407405 - DNA, 25 bp, Mus musculus
gaaactttggacctgttcaatctta

SEQ ID NO: 407406 - DNA, 25 bp, Mus musculus
gaaactttggacgtgttcaatctta

SEQ ID NO: 407407 - DNA, 25 bp, Mus musculus
gaaactttgtccagatttggttatt

SEQ ID NO: 407408 - DNA, 25 bp, Mus musculus
gaaactttgtcctgatttggttatt

SEQ ID NO: 407409 - DNA, 25 bp, Mus musculus
gaaactttgtctcgtttatccctat

SEQ ID NO: 407410 - DNA, 25 bp, Mus musculus
gaaactttgtctggtttatccctat

SEQ ID NO: 407411 - DNA, 25 bp, Mus musculus
gaaactttgttactctcagctctgt

SEQ ID NO: 407412 - DNA, 25 bp, Mus musculus
gaaactttgttagtctcagctctgt

SEQ ID NO: 407413 - DNA, 25 bp, Mus musculus
gaaacttttaaaacacaggaccaga

SEQ ID NO: 407414 - DNA, 25 bp, Mus musculus
gaaacttttaaatcacaggaccaga

SEQ ID NO: 407415 - DNA, 25 bp, Mus musculus
gaaacttttagacatcgggccatct

SEQ ID NO: 407416 - DNA, 25 bp, Mus musculus
gaaacttttagagatcgggccatct

SEQ ID NO: 407417 - DNA, 25 bp, Mus musculus
gaaacttttcaaatatatcgaaggt

SEQ ID NO: 407418 - DNA, 25 bp, Mus musculus
gaaacttttcaattatatcgaaggt

SEQ ID NO: 407419 - DNA, 25 bp, Mus musculus
gaaacttttcagaaatgtccaaaga

SEQ ID NO: 407420 - DNA, 25 bp, Mus musculus
gaaacttttcagtaatgtccaaaga

SEQ ID NO: 407421 - DNA, 25 bp, Mus musculus
gaaacttttcggcagaggctgatcc

SEQ ID NO: 407422 - DNA, 25 bp, Mus musculus
gaaacttttcgggagaggctgatcc

SEQ ID NO: 407423 - DNA, 25 bp, Mus musculus
gaaacttttgagaactcccacacat

SEQ ID NO: 407424 - DNA, 25 bp, Mus musculus
gaaacttttgagtactcccacacat

SEQ ID NO: 407425 - DNA, 25 bp, Mus musculus
gaaacttttgcaccattttcagagt

SEQ ID NO: 407426 - DNA, 25 bp, Mus musculus
gaaacttttgcagcattttcagagt

SEQ ID NO: 407427 - DNA, 25 bp, Mus musculus
gaaacttttgtgatgctcttgcttt

SEQ ID NO: 407428 - DNA, 25 bp, Mus musculus
gaaacttttgtgttgctcttgcttt

SEQ ID NO: 407429 - DNA, 25 bp, Mus musculus
gaaactttttgaatgtctccctggt

SEQ ID NO: 407430 - DNA, 25 bp, Mus musculus
gaaactttttgattgtctccctggt

SEQ ID NO: 407431 - DNA, 25 bp, Mus musculus
gaaactttttgtcttgtgctaggag

SEQ ID NO: 407432 - DNA, 25 bp, Mus musculus
gaaactttttgtgttgtgctaggag

SEQ ID NO: 407433 - DNA, 25 bp, Mus musculus
gaaactttttttccatggacacaga

SEQ ID NO: 407434 - DNA, 25 bp, Mus musculus
gaaactttttttgcatggacacaga

SEQ ID NO: 407435 - DNA, 25 bp, Mus musculus
gaaagaaaaatcatggcgcctgccc

SEQ ID NO: 407436 - DNA, 25 bp, Mus musculus
gaaagaaaaatcttggcgcctgccc

SEQ ID NO: 407437 - DNA, 25 bp, Mus musculus
gaaagaaaagccacctaccagctat

SEQ ID NO: 407438 - DNA, 25 bp, Mus musculus
gaaagaaaagcctcctaccagctat

SEQ ID NO: 407439 - DNA, 25 bp, Mus musculus
gaaagaaaagtcaaggctgctggat

SEQ ID NO: 407440 - DNA, 25 bp, Mus musculus
gaaagaaaagtctaggctgctggat

SEQ ID NO: 407441 - DNA, 25 bp, Mus musculus
gaaagaaaagttagccagtacttca

SEQ ID NO: 407442 - DNA, 25 bp, Mus musculus
gaaagaaaagtttgccagtacttca

SEQ ID NO: 407443 - DNA, 25 bp, Mus musculus
gaaagaaaatccaacccagctactg

SEQ ID NO: 407444 - DNA, 25 bp, Mus musculus
gaaagaaaatcctacccagctactg

SEQ ID NO: 407445 - DNA, 25 bp, Mus musculus
gaaagaaacactcctctaggctaag

SEQ ID NO: 407446 - DNA, 25 bp, Mus musculus
gaaagaaacactgctctaggctaag

SEQ ID NO: 407447 - DNA, 25 bp, Mus musculus
gaaagaaaccaacgccctctggaag

SEQ ID NO: 407448 - DNA, 25 bp, Mus musculus
gaaagaaaccaaggccctctggaag

SEQ ID NO: 407449 - DNA, 25 bp, Mus musculus
gaaagaaaccctccgatgtaaactg

SEQ ID NO: 407450 - DNA, 25 bp, Mus musculus
gaaagaaaccctgcgatgtaaactg

SEQ ID NO: 407451 - DNA, 25 bp, Mus musculus
gaaagaaacctgaccaaatgcctga

SEQ ID NO: 407452 - DNA, 25 bp, Mus musculus
gaaagaaacctgtccaaatgcctga

SEQ ID NO: 407453 - DNA, 25 bp, Mus musculus
gaaagaaactctccaatggctccat

SEQ ID NO: 407454 - DNA, 25 bp, Mus musculus
gaaagaaactctgcaatggctccat

SEQ ID NO: 407455 - DNA, 25 bp, Mus musculus
gaaagaaagaatccttccccttgca

SEQ ID NO: 407456 - DNA, 25 bp, Mus musculus
gaaagaaagaatgcttccccttgca

SEQ ID NO: 407457 - DNA, 25 bp, Mus musculus
gaaagaaagagacccctaggctgcc

SEQ ID NO: 407458 - DNA, 25 bp, Mus musculus
gaaagaaagagagccctaggctgcc

SEQ ID NO: 407459 - DNA, 25 bp, Mus musculus
gaaagaaagagcacactatacaagt

SEQ ID NO: 407460 - DNA, 25 bp, Mus musculus
gaaagaaagagctcactatacaagt

SEQ ID NO: 407461 - DNA, 25 bp, Mus musculus
gaaagaaagctcaccatgacctcgg

SEQ ID NO: 407462 - DNA, 25 bp, Mus musculus
gaaagaaagctctccatgacctcgg

SEQ ID NO: 407463 - DNA, 25 bp, Mus musculus
gaaagaaaggacagcccgatgccaa

SEQ ID NO: 407464 - DNA, 25 bp, Mus musculus
gaaagaaaggactgcccgatgccaa

SEQ ID NO: 407465 - DNA, 25 bp, Mus musculus
gaaagaaaggctcgcacttcctcag

SEQ ID NO: 407466 - DNA, 25 bp, Mus musculus
gaaagaaaggctggcacttcctcag

SEQ ID NO: 407467 - DNA, 25 bp, Mus musculus
gaaagaaataagactcaactcgata

SEQ ID NO: 407468 - DNA, 25 bp, Mus musculus
gaaagaaataagtctcaactcgata

SEQ ID NO: 407469 - DNA, 25 bp, Mus musculus
gaaagaaatacaccctcccattgga

SEQ ID NO: 407470 - DNA, 25 bp, Mus musculus
gaaagaaatacagcctcccattgga

SEQ ID NO: 407471 - DNA, 25 bp, Mus musculus
gaaagaaatctcaaccaaggactct

SEQ ID NO: 407472 - DNA, 25 bp, Mus musculus
gaaagaaatctctaccaaggactct

SEQ ID NO: 407473 - DNA, 25 bp, Mus musculus
gaaagaaatgctacctcgtctctaa

SEQ ID NO: 407474 - DNA, 25 bp, Mus musculus
gaaagaaatgctcaacctctggaag

SEQ ID NO: 407475 - DNA, 25 bp, Mus musculus
gaaagaaatgctgaacctctggaag

SEQ ID NO: 407476 - DNA, 25 bp, Mus musculus
gaaagaaatgcttcctcgtctctaa

SEQ ID NO: 407477 - DNA, 25 bp, Mus musculus
gaaagaaattaacccagaaaagcat

SEQ ID NO: 407478 - DNA, 25 bp, Mus musculus
gaaagaaattaagccagaaaagcat

SEQ ID NO: 407479 - DNA, 25 bp, Mus musculus
gaaagaaattggcttgggctcacca

SEQ ID NO: 407480 - DNA, 25 bp, Mus musculus
gaaagaaattgggttgggctcacca

SEQ ID NO: 407481 - DNA, 25 bp, Mus musculus
gaaagaacaaacaccacaatcctag

SEQ ID NO: 407482 - DNA, 25 bp, Mus musculus
gaaagaacaaactccacaatcctag

SEQ ID NO: 407483 - DNA, 25 bp, Mus musculus
gaaagaacaagtaccgccctgatct

SEQ ID NO: 407484 - DNA, 25 bp, Mus musculus
gaaagaacaagttccgccctgatct

SEQ ID NO: 407485 - DNA, 25 bp, Mus musculus
gaaagaacacagattaagcagaact

SEQ ID NO: 407486 - DNA, 25 bp, Mus musculus
gaaagaacacagtttaagcagaact

SEQ ID NO: 407487 - DNA, 25 bp, Mus musculus
gaaagaacagaaccggcttctcact

SEQ ID NO: 407488 - DNA, 25 bp, Mus musculus
gaaagaacagaagcggcttctcact

SEQ ID NO: 407489 - DNA, 25 bp, Mus musculus
gaaagaacagtaactcaccaccttg

SEQ ID NO: 407490 - DNA, 25 bp, Mus musculus
gaaagaacagtatctcaccaccttg

SEQ ID NO: 407491 - DNA, 25 bp, Mus musculus
gaaagaacagtgactgggctctgct

SEQ ID NO: 407492 - DNA, 25 bp, Mus musculus
gaaagaacagtgtctgggctctgct

SEQ ID NO: 407493 - DNA, 25 bp, Mus musculus
gaaagaacatggctaccgtgagaca

SEQ ID NO: 407494 - DNA, 25 bp, Mus musculus
gaaagaacatgggtaccgtgagaca

SEQ ID NO: 407495 - DNA, 25 bp, Mus musculus
gaaagaaccaagcagctccttttcc

SEQ ID NO: 407496 - DNA, 25 bp, Mus musculus
gaaagaaccaaggagctccttttcc

SEQ ID NO: 407497 - DNA, 25 bp, Mus musculus
gaaagaacccaaaggagcatcgtat

SEQ ID NO: 407498 - DNA, 25 bp, Mus musculus
gaaagaacccaatggagcatcgtat

SEQ ID NO: 407499 - DNA, 25 bp, Mus musculus
gaaagaacccagaatcccaagcggc

SEQ ID NO: 407500 - DNA, 25 bp, Mus musculus
gaaagaacccagtatcccaagcggc

SEQ ID NO: 407501 - DNA, 25 bp, Mus musculus
gaaagaacccttagtgtgtggacac

SEQ ID NO: 407502 - DNA, 25 bp, Mus musculus
gaaagaacccttctgcacaatccat

SEQ ID NO: 407503 - DNA, 25 bp, Mus musculus
gaaagaacccttgtgcacaatccat

SEQ ID NO: 407504 - DNA, 25 bp, Mus musculus
gaaagaaccctttgtgtgtggacac

SEQ ID NO: 407505 - DNA, 25 bp, Mus musculus
gaaagaacctaaccaccttctacag

SEQ ID NO: 407506 - DNA, 25 bp, Mus musculus
gaaagaacctaagcaccttctacag

SEQ ID NO: 407507 - DNA, 25 bp, Mus musculus
gaaagaacctagattctttcctcag

SEQ ID NO: 407508 - DNA, 25 bp, Mus musculus
gaaagaacctagtttctttcctcag

SEQ ID NO: 407509 - DNA, 25 bp, Mus musculus
gaaagaacctctaagatcaccccag

SEQ ID NO: 407510 - DNA, 25 bp, Mus musculus
gaaagaacctcttagatcaccccag

SEQ ID NO: 407511 - DNA, 25 bp, Mus musculus
gaaagaaccttactccttgcttagg

SEQ ID NO: 407512 - DNA, 25 bp, Mus musculus
gaaagaaccttagtccttgcttagg

SEQ ID NO: 407513 - DNA, 25 bp, Mus musculus
gaaagaaccttgctcttctgaagta

SEQ ID NO: 407514 - DNA, 25 bp, Mus musculus
gaaagaaccttggtcttctgaagta

SEQ ID NO: 407515 - DNA, 25 bp, Mus musculus
gaaagaacgcctagcagagcccctg

SEQ ID NO: 407516 - DNA, 25 bp, Mus musculus
gaaagaacgccttgcagagcccctg

SEQ ID NO: 407517 - DNA, 25 bp, Mus musculus
gaaagaacgtccactattcaaagat

SEQ ID NO: 407518 - DNA, 25 bp, Mus musculus
gaaagaacgtcctctattcaaagat

SEQ ID NO: 407519 - DNA, 25 bp, Mus musculus
gaaagaactaaaacacctagcgtgg

SEQ ID NO: 407520 - DNA, 25 bp, Mus musculus
gaaagaactaaatcacctagcgtgg

SEQ ID NO: 407521 - DNA, 25 bp, Mus musculus
gaaagaactcctaaccttactctag

SEQ ID NO: 407522 - DNA, 25 bp, Mus musculus
gaaagaactccttaccttactctag

SEQ ID NO: 407523 - DNA, 25 bp, Mus musculus
gaaagaactgacatagcccctcata

SEQ ID NO: 407524 - DNA, 25 bp, Mus musculus
gaaagaactgacttagcccctcata

SEQ ID NO: 407525 - DNA, 25 bp, Mus musculus
gaaagaactgctaagccctagctct

SEQ ID NO: 407526 - DNA, 25 bp, Mus musculus
gaaagaactgctacctgaaattcga

SEQ ID NO: 407527 - DNA, 25 bp, Mus musculus
gaaagaactgcttagccctagctct

SEQ ID NO: 407528 - DNA, 25 bp, Mus musculus
gaaagaactgcttcctgaaattcga

SEQ ID NO: 407529 - DNA, 25 bp, Mus musculus
gaaagaactgtaagcatcctgaaga

SEQ ID NO: 407530 - DNA, 25 bp, Mus musculus
gaaagaactgtatgcatcctgaaga

SEQ ID NO: 407531 - DNA, 25 bp, Mus musculus
gaaagaacttccagtgcttttgtaa

SEQ ID NO: 407532 - DNA, 25 bp, Mus musculus
gaaagaacttcctgtgcttttgtaa

SEQ ID NO: 407533 - DNA, 25 bp, Mus musculus
gaaagaactttaaacatccggtcct

SEQ ID NO: 407534 - DNA, 25 bp, Mus musculus
gaaagaactttaatactgcatttaa

SEQ ID NO: 407535 - DNA, 25 bp, Mus musculus
gaaagaactttatacatccggtcct

SEQ ID NO: 407536 - DNA, 25 bp, Mus musculus
gaaagaactttattactgcatttaa

SEQ ID NO: 407537 - DNA, 25 bp, Mus musculus
gaaagaagaaaactcacctgtgtga

SEQ ID NO: 407538 - DNA, 25 bp, Mus musculus
gaaagaagaaaagtcacctgtgtga

SEQ ID NO: 407539 - DNA, 25 bp, Mus musculus
gaaagaagacctaccagtgccacca

SEQ ID NO: 407540 - DNA, 25 bp, Mus musculus
gaaagaagaccttccagtgccacca

SEQ ID NO: 407541 - DNA, 25 bp, Mus musculus
gaaagaagacttagcagcatttgtt

SEQ ID NO: 407542 - DNA, 25 bp, Mus musculus
gaaagaagactttgcagcatttgtt

SEQ ID NO: 407543 - DNA, 25 bp, Mus musculus
gaaagaagagcccatagtagccaaa

SEQ ID NO: 407544 - DNA, 25 bp, Mus musculus
gaaagaagagccgatagtagccaaa

SEQ ID NO: 407545 - DNA, 25 bp, Mus musculus
gaaagaagatccctgttaacacaga

SEQ ID NO: 407546 - DNA, 25 bp, Mus musculus
gaaagaagatccgtgttaacacaga

SEQ ID NO: 407547 - DNA, 25 bp, Mus musculus
gaaagaagcacacaacagagctaca

SEQ ID NO: 407548 - DNA, 25 bp, Mus musculus
gaaagaagcacagaacagagctaca

SEQ ID NO: 407549 - DNA, 25 bp, Mus musculus
gaaagaagcccaagctaataccttt

SEQ ID NO: 407550 - DNA, 25 bp, Mus musculus
gaaagaagcccatgctaataccttt

SEQ ID NO: 407551 - DNA, 25 bp, Mus musculus
gaaagaagccttagccactagccag

SEQ ID NO: 407552 - DNA, 25 bp, Mus musculus
gaaagaagcctttgccactagccag

SEQ ID NO: 407553 - DNA, 25 bp, Mus musculus
gaaagaagcgcgagccttacactaa

SEQ ID NO: 407554 - DNA, 25 bp, Mus musculus
gaaagaagcgcgtgccttacactaa

SEQ ID NO: 407555 - DNA, 25 bp, Mus musculus
gaaagaagcggcagttcccaggttt

SEQ ID NO: 407556 - DNA, 25 bp, Mus musculus
gaaagaagcggctgttcccaggttt

SEQ ID NO: 407557 - DNA, 25 bp, Mus musculus
gaaagaagctagatattatgcctgt

SEQ ID NO: 407558 - DNA, 25 bp, Mus musculus
gaaagaagctagttattatgcctgt

SEQ ID NO: 407559 - DNA, 25 bp, Mus musculus
gaaagaagctatagtcctctagtag

SEQ ID NO: 407560 - DNA, 25 bp, Mus musculus
gaaagaagctattgtcctctagtag

SEQ ID NO: 407561 - DNA, 25 bp, Mus musculus
gaaagaagctcacctgtcaaggact

SEQ ID NO: 407562 - DNA, 25 bp, Mus musculus
gaaagaagctcagctgtcaaggact

SEQ ID NO: 407563 - DNA, 25 bp, Mus musculus
gaaagaagctgccagcgactgatgt

SEQ ID NO: 407564 - DNA, 25 bp, Mus musculus
gaaagaagctgcgagcgactgatgt

SEQ ID NO: 407565 - DNA, 25 bp, Mus musculus
gaaagaagctggcagccggcagagg

SEQ ID NO: 407566 - DNA, 25 bp, Mus musculus
gaaagaagctgggagccggcagagg

SEQ ID NO: 407567 - DNA, 25 bp, Mus musculus
gaaagaaggaggatcccatcattaa

SEQ ID NO: 407568 - DNA, 25 bp, Mus musculus
gaaagaaggaggttcccatcattaa

SEQ ID NO: 407569 - DNA, 25 bp, Mus musculus
gaaagaagggcccaagccttgcagc

SEQ ID NO: 407570 - DNA, 25 bp, Mus musculus
gaaagaagggccgaagccttgcagc

SEQ ID NO: 407571 - DNA, 25 bp, Mus musculus
gaaagaagtcctacacagttgcctg

SEQ ID NO: 407572 - DNA, 25 bp, Mus musculus
gaaagaagtccttcacagttgcctg

SEQ ID NO: 407573 - DNA, 25 bp, Mus musculus
gaaagaagtctccttagtgtcagat

SEQ ID NO: 407574 - DNA, 25 bp, Mus musculus
gaaagaagtctcgttagtgtcagat

SEQ ID NO: 407575 - DNA, 25 bp, Mus musculus
gaaagaagtgtaatgccccaccagc

SEQ ID NO: 407576 - DNA, 25 bp, Mus musculus
gaaagaagtgtattgccccaccagc

SEQ ID NO: 407577 - DNA, 25 bp, Mus musculus
gaaagaagttgcaaagtgtctccaa

SEQ ID NO: 407578 - DNA, 25 bp, Mus musculus
gaaagaagttgcaccaagtcctctg

SEQ ID NO: 407579 - DNA, 25 bp, Mus musculus
gaaagaagttgctaagtgtctccaa

SEQ ID NO: 407580 - DNA, 25 bp, Mus musculus
gaaagaagttgctccaagtcctctg

SEQ ID NO: 407581 - DNA, 25 bp, Mus musculus
gaaagaatccacatgcatcctgggt

SEQ ID NO: 407582 - DNA, 25 bp, Mus musculus
gaaagaatccacttgcatcctgggt

SEQ ID NO: 407583 - DNA, 25 bp, Mus musculus
gaaagaatcgatagctcagcgctct

SEQ ID NO: 407584 - DNA, 25 bp, Mus musculus
gaaagaatcgattgctcagcgctct

SEQ ID NO: 407585 - DNA, 25 bp, Mus musculus
gaaagaatctcgcaggaccagcagc

SEQ ID NO: 407586 - DNA, 25 bp, Mus musculus
gaaagaatctcggaggaccagcagc

SEQ ID NO: 407587 - DNA, 25 bp, Mus musculus
gaaagaatgcacctttccttccgta

SEQ ID NO: 407588 - DNA, 25 bp, Mus musculus
gaaagaatgcacgtttccttccgta

SEQ ID NO: 407589 - DNA, 25 bp, Mus musculus
gaaagaatgcctatcagtctgcccc

SEQ ID NO: 407590 - DNA, 25 bp, Mus musculus
gaaagaatgcctttcagtctgcccc

SEQ ID NO: 407591 - DNA, 25 bp, Mus musculus
gaaagaatgctaatgttctcccatt

SEQ ID NO: 407592 - DNA, 25 bp, Mus musculus
gaaagaatgctattgttctcccatt

SEQ ID NO: 407593 - DNA, 25 bp, Mus musculus
gaaagaatggacactctctccatct

SEQ ID NO: 407594 - DNA, 25 bp, Mus musculus
gaaagaatggactctctctccatct

SEQ ID NO: 407595 - DNA, 25 bp, Mus musculus
gaaagaatgggtagcccttccctat

SEQ ID NO: 407596 - DNA, 25 bp, Mus musculus
gaaagaatgggttgcccttccctat

SEQ ID NO: 407597 - DNA, 25 bp, Mus musculus
gaaagaatgtatcaaggaacccata

SEQ ID NO: 407598 - DNA, 25 bp, Mus musculus
gaaagaatgtatgaaggaacccata

SEQ ID NO: 407599 - DNA, 25 bp, Mus musculus
gaaagaattcacactgctactctcg

SEQ ID NO: 407600 - DNA, 25 bp, Mus musculus
gaaagaattcactctgctactctcg

SEQ ID NO: 407601 - DNA, 25 bp, Mus musculus
gaaagaatttcaagtgccagagctg

SEQ ID NO: 407602 - DNA, 25 bp, Mus musculus
gaaagaatttcatgtgccagagctg

SEQ ID NO: 407603 - DNA, 25 bp, Mus musculus
gaaagacaaacactcactgcatgtt

SEQ ID NO: 407604 - DNA, 25 bp, Mus musculus
gaaagacaaacagtcactgcatgtt

SEQ ID NO: 407605 - DNA, 25 bp, Mus musculus
gaaagacaaatcagctcattgtgaa

SEQ ID NO: 407606 - DNA, 25 bp, Mus musculus
gaaagacaaatctgctcattgtgaa

SEQ ID NO: 407607 - DNA, 25 bp, Mus musculus
gaaagacaagatcaccaccaggacg

SEQ ID NO: 407608 - DNA, 25 bp, Mus musculus
gaaagacaagatgaccaccaggacg

SEQ ID NO: 407609 - DNA, 25 bp, Mus musculus
gaaagacaatctcattgctgtggaa

SEQ ID NO: 407610 - DNA, 25 bp, Mus musculus
gaaagacaatctgattgctgtggaa

SEQ ID NO: 407611 - DNA, 25 bp, Mus musculus
gaaagacacagtagccattgtgtat

SEQ ID NO: 407612 - DNA, 25 bp, Mus musculus
gaaagacacagttgccattgtgtat

SEQ ID NO: 407613 - DNA, 25 bp, Mus musculus
gaaagacacatcacagctcacaaag

SEQ ID NO: 407614 - DNA, 25 bp, Mus musculus
gaaagacacatctcagctcacaaag

SEQ ID NO: 407615 - DNA, 25 bp, Mus musculus
gaaagacaccatagaagccctggcc

SEQ ID NO: 407616 - DNA, 25 bp, Mus musculus
gaaagacaccattgaagccctggcc

SEQ ID NO: 407617 - DNA, 25 bp, Mus musculus
gaaagacacccacttcttgggtttg

SEQ ID NO: 407618 - DNA, 25 bp, Mus musculus
gaaagacacccagttcttgggtttg

SEQ ID NO: 407619 - DNA, 25 bp, Mus musculus
gaaagacacgttctaggtctgttgt

SEQ ID NO: 407620 - DNA, 25 bp, Mus musculus
gaaagacacgttgtaggtctgttgt

SEQ ID NO: 407621 - DNA, 25 bp, Mus musculus
gaaagacacttgcatttgcctcagt

SEQ ID NO: 407622 - DNA, 25 bp, Mus musculus
gaaagacacttggatttgcctcagt

SEQ ID NO: 407623 - DNA, 25 bp, Mus musculus
gaaagacagacacccgccgcagtgg

SEQ ID NO: 407624 - DNA, 25 bp, Mus musculus
gaaagacagacagccgccgcagtgg

SEQ ID NO: 407625 - DNA, 25 bp, Mus musculus
gaaagacagcaaccactacgttgaa

SEQ ID NO: 407626 - DNA, 25 bp, Mus musculus
gaaagacagcaagcactacgttgaa

SEQ ID NO: 407627 - DNA, 25 bp, Mus musculus
gaaagacagcatcttccctacgaac

SEQ ID NO: 407628 - DNA, 25 bp, Mus musculus
gaaagacagcatgttccctacgaac

SEQ ID NO: 407629 - DNA, 25 bp, Mus musculus
gaaagacagctaacaatcatactgg

SEQ ID NO: 407630 - DNA, 25 bp, Mus musculus
gaaagacagctatcaatcatactgg

SEQ ID NO: 407631 - DNA, 25 bp, Mus musculus
gaaagacagctgactacttgcctct

SEQ ID NO: 407632 - DNA, 25 bp, Mus musculus
gaaagacagctgtctacttgcctct

SEQ ID NO: 407633 - DNA, 25 bp, Mus musculus
gaaagacaggctcgacgctcacact

SEQ ID NO: 407634 - DNA, 25 bp, Mus musculus
gaaagacaggctggacgctcacact

SEQ ID NO: 407635 - DNA, 25 bp, Mus musculus
gaaagacagtccacctgatgtggct

SEQ ID NO: 407636 - DNA, 25 bp, Mus musculus
gaaagacagtcctcctgatgtggct

SEQ ID NO: 407637 - DNA, 25 bp, Mus musculus
gaaagacagtctaacccctgtatct

SEQ ID NO: 407638 - DNA, 25 bp, Mus musculus
gaaagacagtcttacccctgtatct

SEQ ID NO: 407639 - DNA, 25 bp, Mus musculus
gaaagacagtgcactccctcaagtg

SEQ ID NO: 407640 - DNA, 25 bp, Mus musculus
gaaagacagtgctctccctcaagtg

SEQ ID NO: 407641 - DNA, 25 bp, Mus musculus
gaaagacatagcatcttccccaatg

SEQ ID NO: 407642 - DNA, 25 bp, Mus musculus
gaaagacatagcttcttccccaatg

SEQ ID NO: 407643 - DNA, 25 bp, Mus musculus
gaaagacatcccacatttagcacac

SEQ ID NO: 407644 - DNA, 25 bp, Mus musculus
gaaagacatccctcatttagcacac

SEQ ID NO: 407645 - DNA, 25 bp, Mus musculus
gaaagacatcgaccagcacacaaga

SEQ ID NO: 407646 - DNA, 25 bp, Mus musculus
gaaagacatcgacctgtaccatgcc

SEQ ID NO: 407647 - DNA, 25 bp, Mus musculus
gaaagacatcgagcagcacacaaga

SEQ ID NO: 407648 - DNA, 25 bp, Mus musculus
gaaagacatcgagctgtaccatgcc

SEQ ID NO: 407649 - DNA, 25 bp, Mus musculus
gaaagacatctactcttacaggttc

SEQ ID NO: 407650 - DNA, 25 bp, Mus musculus
gaaagacatctagtcttacaggttc

SEQ ID NO: 407651 - DNA, 25 bp, Mus musculus
gaaagacatctcactgtttctcctg

SEQ ID NO: 407652 - DNA, 25 bp, Mus musculus
gaaagacatctcattgtatcgactt

SEQ ID NO: 407653 - DNA, 25 bp, Mus musculus
gaaagacatctctctgtttctcctg

SEQ ID NO: 407654 - DNA, 25 bp, Mus musculus
gaaagacatctctttgtatcgactt

SEQ ID NO: 407655 - DNA, 25 bp, Mus musculus
gaaagacattaccaccactggccag

SEQ ID NO: 407656 - DNA, 25 bp, Mus musculus
gaaagacattacgaccactggccag

SEQ ID NO: 407657 - DNA, 25 bp, Mus musculus
gaaagacattgaaagtatggcttat

SEQ ID NO: 407658 - DNA, 25 bp, Mus musculus
gaaagacattgatagtatggcttat

SEQ ID NO: 407659 - DNA, 25 bp, Mus musculus
gaaagaccaactacatacccacggg

SEQ ID NO: 407660 - DNA, 25 bp, Mus musculus
gaaagaccaacttcatacccacggg

SEQ ID NO: 407661 - DNA, 25 bp, Mus musculus
gaaagaccaaggctggcttccctca

SEQ ID NO: 407662 - DNA, 25 bp, Mus musculus
gaaagaccaagggtggcttccctca

SEQ ID NO: 407663 - DNA, 25 bp, Mus musculus
gaaagaccagcactcacagtctgct

SEQ ID NO: 407664 - DNA, 25 bp, Mus musculus
gaaagaccagcagtcacagtctgct

SEQ ID NO: 407665 - DNA, 25 bp, Mus musculus
gaaagaccagtaaagcagcaataaa

SEQ ID NO: 407666 - DNA, 25 bp, Mus musculus
gaaagaccagtacaagccctgctgt

SEQ ID NO: 407667 - DNA, 25 bp, Mus musculus
gaaagaccagtagaagccctgctgt

SEQ ID NO: 407668 - DNA, 25 bp, Mus musculus
gaaagaccagtatagcagcaataaa

SEQ ID NO: 407669 - DNA, 25 bp, Mus musculus
gaaagaccattcctacaagcacaag

SEQ ID NO: 407670 - DNA, 25 bp, Mus musculus
gaaagaccattcgtacaagcacaag

SEQ ID NO: 407671 - DNA, 25 bp, Mus musculus
gaaagaccatttactcacctaccag

SEQ ID NO: 407672 - DNA, 25 bp, Mus musculus
gaaagaccattttctcacctaccag

SEQ ID NO: 407673 - DNA, 25 bp, Mus musculus
gaaagacccaacacactgataaata

SEQ ID NO: 407674 - DNA, 25 bp, Mus musculus
gaaagacccaactcactgataaata

SEQ ID NO: 407675 - DNA, 25 bp, Mus musculus
gaaagaccccagctgcaaaacctgt

SEQ ID NO: 407676 - DNA, 25 bp, Mus musculus
gaaagaccccaggtgcaaaacctgt

SEQ ID NO: 407677 - DNA, 25 bp, Mus musculus
gaaagaccccatatagtctgacctt

SEQ ID NO: 407678 - DNA, 25 bp, Mus musculus
gaaagaccccatttagtctgacctt

SEQ ID NO: 407679 - DNA, 25 bp, Mus musculus
gaaagaccccgtcgcgattgtgaaa

SEQ ID NO: 407680 - DNA, 25 bp, Mus musculus
gaaagaccccgtggcgattgtgaaa

SEQ ID NO: 407681 - DNA, 25 bp, Mus musculus
gaaagacccgcaactgaagctcagg

SEQ ID NO: 407682 - DNA, 25 bp, Mus musculus
gaaagacccgcatctgaagctcagg

SEQ ID NO: 407683 - DNA, 25 bp, Mus musculus
gaaagaccctcaacattcatgatat

SEQ ID NO: 407684 - DNA, 25 bp, Mus musculus
gaaagaccctcatcattcatgatat

SEQ ID NO: 407685 - DNA, 25 bp, Mus musculus
gaaagacccttgcagcttgtgcata

SEQ ID NO: 407686 - DNA, 25 bp, Mus musculus
gaaagacccttggagcttgtgcata

SEQ ID NO: 407687 - DNA, 25 bp, Mus musculus
gaaagaccctttccacaaatcaagg

SEQ ID NO: 407688 - DNA, 25 bp, Mus musculus
gaaagaccctttctgcaaatcacaa

SEQ ID NO: 407689 - DNA, 25 bp, Mus musculus
gaaagaccctttgcacaaatcaagg

SEQ ID NO: 407690 - DNA, 25 bp, Mus musculus
gaaagaccctttgtgcaaatcacaa

SEQ ID NO: 407691 - DNA, 25 bp, Mus musculus
gaaagaccgcagctcccgatgatcg

SEQ ID NO: 407692 - DNA, 25 bp, Mus musculus
gaaagaccgcaggtcccgatgatcg

SEQ ID NO: 407693 - DNA, 25 bp, Mus musculus
gaaagacctaagaatctggctgtgc

SEQ ID NO: 407694 - DNA, 25 bp, Mus musculus
gaaagacctaagtatctggctgtgc

SEQ ID NO: 407695 - DNA, 25 bp, Mus musculus
gaaagacctataccaggctttagtc

SEQ ID NO: 407696 - DNA, 25 bp, Mus musculus
gaaagacctatagcaggctttagtc

SEQ ID NO: 407697 - DNA, 25 bp, Mus musculus
gaaagacctcaactggccaggtttg

SEQ ID NO: 407698 - DNA, 25 bp, Mus musculus
gaaagacctcaagtggccaggtttg

SEQ ID NO: 407699 - DNA, 25 bp, Mus musculus
gaaagacctcatatctgttcctttt

SEQ ID NO: 407700 - DNA, 25 bp, Mus musculus
gaaagacctcatttctgttcctttt

SEQ ID NO: 407701 - DNA, 25 bp, Mus musculus
gaaagacctcctctagttgtgaatt

SEQ ID NO: 407702 - DNA, 25 bp, Mus musculus
gaaagacctcctgtagttgtgaatt

SEQ ID NO: 407703 - DNA, 25 bp, Mus musculus
gaaagacctgaacaaatctccactg

SEQ ID NO: 407704 - DNA, 25 bp, Mus musculus
gaaagacctgaagaaatctccactg

SEQ ID NO: 407705 - DNA, 25 bp, Mus musculus
gaaagacctgcaaatcgagcgagca

SEQ ID NO: 407706 - DNA, 25 bp, Mus musculus
gaaagacctgcatatcgagcgagca

SEQ ID NO: 407707 - DNA, 25 bp, Mus musculus
gaaagacctggaacgcctgtggaag

SEQ ID NO: 407708 - DNA, 25 bp, Mus musculus
gaaagacctggacctccgcagactt

SEQ ID NO: 407709 - DNA, 25 bp, Mus musculus
gaaagacctggagctccgcagactt

SEQ ID NO: 407710 - DNA, 25 bp, Mus musculus
gaaagacctggatcgcctgtggaag

SEQ ID NO: 407711 - DNA, 25 bp, Mus musculus
gaaagaccttaccagtgccatgatt

SEQ ID NO: 407712 - DNA, 25 bp, Mus musculus
gaaagaccttacgagtgccatgatt

SEQ ID NO: 407713 - DNA, 25 bp, Mus musculus
gaaagacctttaacacccactgtat

SEQ ID NO: 407714 - DNA, 25 bp, Mus musculus
gaaagacctttatcacccactgtat

SEQ ID NO: 407715 - DNA, 25 bp, Mus musculus
gaaagacgaaagagggagaacaaga

SEQ ID NO: 407716 - DNA, 25 bp, Mus musculus
gaaagacgaaagtgggagaacaaga

SEQ ID NO: 407717 - DNA, 25 bp, Mus musculus
gaaagacggcctacaaaactaatgt

SEQ ID NO: 407718 - DNA, 25 bp, Mus musculus
gaaagacggccttcaaaactaatgt

SEQ ID NO: 407719 - DNA, 25 bp, Mus musculus
gaaagacggcgaatcgaagttagaa

SEQ ID NO: 407720 - DNA, 25 bp, Mus musculus
gaaagacggcgattcgaagttagaa

SEQ ID NO: 407721 - DNA, 25 bp, Mus musculus
gaaagacgtcagagcgtgacccttc

SEQ ID NO: 407722 - DNA, 25 bp, Mus musculus
gaaagacgtcagtgcgtgacccttc

SEQ ID NO: 407723 - DNA, 25 bp, Mus musculus
gaaagacgtttgcatccagtttgac

SEQ ID NO: 407724 - DNA, 25 bp, Mus musculus
gaaagacgtttggatccagtttgac

SEQ ID NO: 407725 - DNA, 25 bp, Mus musculus
gaaagactatctctaatgttgtaat

SEQ ID NO: 407726 - DNA, 25 bp, Mus musculus
gaaagactatctgtaatgttgtaat

SEQ ID NO: 407727 - DNA, 25 bp, Mus musculus
gaaagactcaagatgacttctgcag

SEQ ID NO: 407728 - DNA, 25 bp, Mus musculus
gaaagactcaagttgacttctgcag

SEQ ID NO: 407729 - DNA, 25 bp, Mus musculus
gaaagactcagtcacatgtccatgg

SEQ ID NO: 407730 - DNA, 25 bp, Mus musculus
gaaagactcagtgacatgtccatgg

SEQ ID NO: 407731 - DNA, 25 bp, Mus musculus
gaaagactcattccctggcaaatat

SEQ ID NO: 407732 - DNA, 25 bp, Mus musculus
gaaagactcattgcctggcaaatat

SEQ ID NO: 407733 - DNA, 25 bp, Mus musculus
gaaagactccaaactgcctgtggca

SEQ ID NO: 407734 - DNA, 25 bp, Mus musculus
gaaagactccaatctgcctgtggca

SEQ ID NO: 407735 - DNA, 25 bp, Mus musculus
gaaagactccatacccaggaggtgg

SEQ ID NO: 407736 - DNA, 25 bp, Mus musculus
gaaagactccatagacggtggccca

SEQ ID NO: 407737 - DNA, 25 bp, Mus musculus
gaaagactccattcccaggaggtgg

SEQ ID NO: 407738 - DNA, 25 bp, Mus musculus
gaaagactccattgacggtggccca

SEQ ID NO: 407739 - DNA, 25 bp, Mus musculus
gaaagactccgcagcagagccagtg

SEQ ID NO: 407740 - DNA, 25 bp, Mus musculus
gaaagactccgctgcagagccagtg

SEQ ID NO: 407741 - DNA, 25 bp, Mus musculus
gaaagactccggctactgtatggct

SEQ ID NO: 407742 - DNA, 25 bp, Mus musculus
gaaagactccgggtactgtatggct

SEQ ID NO: 407743 - DNA, 25 bp, Mus musculus
gaaagactcctaaacactgtcgcat

SEQ ID NO: 407744 - DNA, 25 bp, Mus musculus
gaaagactcctatacactgtcgcat

SEQ ID NO: 407745 - DNA, 25 bp, Mus musculus
gaaagactccttctaatcatagtat

SEQ ID NO: 407746 - DNA, 25 bp, Mus musculus
gaaagactccttctctgggcctagg

SEQ ID NO: 407747 - DNA, 25 bp, Mus musculus
gaaagactccttgtaatcatagtat

SEQ ID NO: 407748 - DNA, 25 bp, Mus musculus
gaaagactccttgtctgggcctagg

SEQ ID NO: 407749 - DNA, 25 bp, Mus musculus
gaaagactcgtacctgctgctgatg

SEQ ID NO: 407750 - DNA, 25 bp, Mus musculus
gaaagactcgtagctgctgctgatg

SEQ ID NO: 407751 - DNA, 25 bp, Mus musculus
gaaagactctatcgtatgattactg

SEQ ID NO: 407752 - DNA, 25 bp, Mus musculus
gaaagactctatggtatgattactg

SEQ ID NO: 407753 - DNA, 25 bp, Mus musculus
gaaagactctgacgccaggctagtg

SEQ ID NO: 407754 - DNA, 25 bp, Mus musculus
gaaagactctgaggccaggctagtg

SEQ ID NO: 407755 - DNA, 25 bp, Mus musculus
gaaagactcttcaagaccagcatgg

SEQ ID NO: 407756 - DNA, 25 bp, Mus musculus
gaaagactcttctagaccagcatgg

SEQ ID NO: 407757 - DNA, 25 bp, Mus musculus
gaaagactctttcgtctgtggcagt

SEQ ID NO: 407758 - DNA, 25 bp, Mus musculus
gaaagactctttggtctgtggcagt

SEQ ID NO: 407759 - DNA, 25 bp, Mus musculus
gaaagactgcatactcggctttgga

SEQ ID NO: 407760 - DNA, 25 bp, Mus musculus
gaaagactgcattctcggctttgga

SEQ ID NO: 407761 - DNA, 25 bp, Mus musculus
gaaagactgcgtactagagccttat

SEQ ID NO: 407762 - DNA, 25 bp, Mus musculus
gaaagactgcgttctagagccttat

SEQ ID NO: 407763 - DNA, 25 bp, Mus musculus
gaaagactgctcaaattgtaccatt

SEQ ID NO: 407764 - DNA, 25 bp, Mus musculus
gaaagactgctctaattgtaccatt

SEQ ID NO: 407765 - DNA, 25 bp, Mus musculus
gaaagactgctgaccgccagggcca

SEQ ID NO: 407766 - DNA, 25 bp, Mus musculus
gaaagactgctgtccgccagggcca

SEQ ID NO: 407767 - DNA, 25 bp, Mus musculus
gaaagactggaacggacataatttt

SEQ ID NO: 407768 - DNA, 25 bp, Mus musculus
gaaagactggaagggacataatttt

SEQ ID NO: 407769 - DNA, 25 bp, Mus musculus
gaaagactggctcagttgcttcacc

SEQ ID NO: 407770 - DNA, 25 bp, Mus musculus
gaaagactggctgagttgcttcacc

SEQ ID NO: 407771 - DNA, 25 bp, Mus musculus
gaaagactgtcaaactccataagca

SEQ ID NO: 407772 - DNA, 25 bp, Mus musculus
gaaagactgtcatactccataagca

SEQ ID NO: 407773 - DNA, 25 bp, Mus musculus
gaaagactgtctaactgcttactat

SEQ ID NO: 407774 - DNA, 25 bp, Mus musculus
gaaagactgtcttactgcttactat

SEQ ID NO: 407775 - DNA, 25 bp, Mus musculus
gaaagacttaccagagacgccggga

SEQ ID NO: 407776 - DNA, 25 bp, Mus musculus
gaaagacttacctgagacgccggga

SEQ ID NO: 407777 - DNA, 25 bp, Mus musculus
gaaagacttcaaaccaatgtcccat

SEQ ID NO: 407778 - DNA, 25 bp, Mus musculus
gaaagacttcaatccaatgtcccat

SEQ ID NO: 407779 - DNA, 25 bp, Mus musculus
gaaagacttggccttcacaaatggt

SEQ ID NO: 407780 - DNA, 25 bp, Mus musculus
gaaagacttggcgttcacaaatggt

SEQ ID NO: 407781 - DNA, 25 bp, Mus musculus
gaaagacttggtccgagctgtgtcc

SEQ ID NO: 407782 - DNA, 25 bp, Mus musculus
gaaagacttggtcctgccacagaaa

SEQ ID NO: 407783 - DNA, 25 bp, Mus musculus
gaaagacttggtgcgagctgtgtcc

SEQ ID NO: 407784 - DNA, 25 bp, Mus musculus
gaaagacttggtgctgccacagaaa

SEQ ID NO: 407785 - DNA, 25 bp, Mus musculus
gaaagactttaccacatcagggctt

SEQ ID NO: 407786 - DNA, 25 bp, Mus musculus
gaaagactttacgacatcagggctt

SEQ ID NO: 407787 - DNA, 25 bp, Mus musculus
gaaagactttcccaagttgttcaga

SEQ ID NO: 407788 - DNA, 25 bp, Mus musculus
gaaagactttccgaagttgttcaga

SEQ ID NO: 407789 - DNA, 25 bp, Mus musculus
gaaagactttgcagactgctctggg

SEQ ID NO: 407790 - DNA, 25 bp, Mus musculus
gaaagactttgctgactgctctggg

SEQ ID NO: 407791 - DNA, 25 bp, Mus musculus
gaaagactttgtattccgaggtcat

SEQ ID NO: 407792 - DNA, 25 bp, Mus musculus
gaaagactttgttttccgaggtcat

SEQ ID NO: 407793 - DNA, 25 bp, Mus musculus
gaaagagaaaacaccacgtatgaaa

SEQ ID NO: 407794 - DNA, 25 bp, Mus musculus
gaaagagaaaactccacgtatgaaa

SEQ ID NO: 407795 - DNA, 25 bp, Mus musculus
gaaagagaaacaccccttcgacagg

SEQ ID NO: 407796 - DNA, 25 bp, Mus musculus
gaaagagaaacaccttctcctacca

SEQ ID NO: 407797 - DNA, 25 bp, Mus musculus
gaaagagaaacagcccttcgacagg

SEQ ID NO: 407798 - DNA, 25 bp, Mus musculus
gaaagagaaacagcttctcctacca

SEQ ID NO: 407799 - DNA, 25 bp, Mus musculus
gaaagagaacatatggtggcaccat

SEQ ID NO: 407800 - DNA, 25 bp, Mus musculus
gaaagagaacatttggtggcaccat

SEQ ID NO: 407801 - DNA, 25 bp, Mus musculus
gaaagagaaccacatctacagtgct

SEQ ID NO: 407802 - DNA, 25 bp, Mus musculus
gaaagagaaccagatctacagtgct

SEQ ID NO: 407803 - DNA, 25 bp, Mus musculus
gaaagagaacggccctacccacagg

SEQ ID NO: 407804 - DNA, 25 bp, Mus musculus
gaaagagaacgggcctacccacagg

SEQ ID NO: 407805 - DNA, 25 bp, Mus musculus
gaaagagaagccatcattctctctc

SEQ ID NO: 407806 - DNA, 25 bp, Mus musculus
gaaagagaagccttcattctctctc

SEQ ID NO: 407807 - DNA, 25 bp, Mus musculus
gaaagagaagcgagcacaccaccct

SEQ ID NO: 407808 - DNA, 25 bp, Mus musculus
gaaagagaagcgtgcacaccaccct

SEQ ID NO: 407809 - DNA, 25 bp, Mus musculus
gaaagagaaggcaggaccacccaca

SEQ ID NO: 407810 - DNA, 25 bp, Mus musculus
gaaagagaaggctggaccacccaca

SEQ ID NO: 407811 - DNA, 25 bp, Mus musculus
gaaagagaatccaatacccatgata

SEQ ID NO: 407812 - DNA, 25 bp, Mus musculus
gaaagagaatcctatacccatgata

SEQ ID NO: 407813 - DNA, 25 bp, Mus musculus
gaaagagacaatatcttccagagct

SEQ ID NO: 407814 - DNA, 25 bp, Mus musculus
gaaagagacaatttcttccagagct

SEQ ID NO: 407815 - DNA, 25 bp, Mus musculus
gaaagagacacacctggctctctgc

SEQ ID NO: 407816 - DNA, 25 bp, Mus musculus
gaaagagacacagctggctctctgc

SEQ ID NO: 407817 - DNA, 25 bp, Mus musculus
gaaagagaccataacaaatccggaa

SEQ ID NO: 407818 - DNA, 25 bp, Mus musculus
gaaagagaccattacaaatccggaa

SEQ ID NO: 407819 - DNA, 25 bp, Mus musculus
gaaagagaccctccctagggaaggt

SEQ ID NO: 407820 - DNA, 25 bp, Mus musculus
gaaagagaccctgcctagggaaggt

SEQ ID NO: 407821 - DNA, 25 bp, Mus musculus
gaaagagaccgacccatatgttttg

SEQ ID NO: 407822 - DNA, 25 bp, Mus musculus
gaaagagaccgagccatatgttttg

SEQ ID NO: 407823 - DNA, 25 bp, Mus musculus
gaaagagacctactattgacctcag

SEQ ID NO: 407824 - DNA, 25 bp, Mus musculus
gaaagagacctagtattgacctcag

SEQ ID NO: 407825 - DNA, 25 bp, Mus musculus
gaaagagaccttagccatagccacc

SEQ ID NO: 407826 - DNA, 25 bp, Mus musculus
gaaagagaccttcccattataagta

SEQ ID NO: 407827 - DNA, 25 bp, Mus musculus
gaaagagaccttgccattataagta

SEQ ID NO: 407828 - DNA, 25 bp, Mus musculus
gaaagagacctttgccatagccacc

SEQ ID NO: 407829 - DNA, 25 bp, Mus musculus
gaaagagacgtcacccaataggcaa

SEQ ID NO: 407830 - DNA, 25 bp, Mus musculus
gaaagagacgtctcccaataggcaa

SEQ ID NO: 407831 - DNA, 25 bp, Mus musculus
gaaagagacgtgcagcttgaagcca

SEQ ID NO: 407832 - DNA, 25 bp, Mus musculus
gaaagagacgtggagcttgaagcca

SEQ ID NO: 407833 - DNA, 25 bp, Mus musculus
gaaagagactcacgtcctacagaca

SEQ ID NO: 407834 - DNA, 25 bp, Mus musculus
gaaagagactcaggtcctacagaca

SEQ ID NO: 407835 - DNA, 25 bp, Mus musculus
gaaagagagaagctccagccatcat

SEQ ID NO: 407836 - DNA, 25 bp, Mus musculus
gaaagagagaaggtccagccatcat

SEQ ID NO: 407837 - DNA, 25 bp, Mus musculus
gaaagagagaataccccaaatccct

SEQ ID NO: 407838 - DNA, 25 bp, Mus musculus
gaaagagagaattccccaaatccct

SEQ ID NO: 407839 - DNA, 25 bp, Mus musculus
gaaagagagctactgctaccacgat

SEQ ID NO: 407840 - DNA, 25 bp, Mus musculus
gaaagagagctagtgctaccacgat

SEQ ID NO: 407841 - DNA, 25 bp, Mus musculus
gaaagagagcttagcacctgaaaac

SEQ ID NO: 407842 - DNA, 25 bp, Mus musculus
gaaagagagctttgcacctgaaaac

SEQ ID NO: 407843 - DNA, 25 bp, Mus musculus
gaaagagaggccaacagccgacagt

SEQ ID NO: 407844 - DNA, 25 bp, Mus musculus
gaaagagaggcctacagccgacagt

SEQ ID NO: 407845 - DNA, 25 bp, Mus musculus
gaaagagatactcctgggcatggaa

SEQ ID NO: 407846 - DNA, 25 bp, Mus musculus
gaaagagatactgctgggcatggaa

SEQ ID NO: 407847 - DNA, 25 bp, Mus musculus
gaaagagatctaactgtggatgctt

SEQ ID NO: 407848 - DNA, 25 bp, Mus musculus
gaaagagatctatctgtggatgctt

SEQ ID NO: 407849 - DNA, 25 bp, Mus musculus
gaaagagatctgctgatccccagaa

SEQ ID NO: 407850 - DNA, 25 bp, Mus musculus
gaaagagatctggtgatccccagaa

SEQ ID NO: 407851 - DNA, 25 bp, Mus musculus
gaaagagattccacgctggatcaac

SEQ ID NO: 407852 - DNA, 25 bp, Mus musculus
gaaagagattcctcgctggatcaac

SEQ ID NO: 407853 - DNA, 25 bp, Mus musculus
gaaagagattcgataaccaatgtta

SEQ ID NO: 407854 - DNA, 25 bp, Mus musculus
gaaagagattcgttaaccaatgtta

SEQ ID NO: 407855 - DNA, 25 bp, Mus musculus
gaaagagattctaccagttaacata

SEQ ID NO: 407856 - DNA, 25 bp, Mus musculus
gaaagagattcttccagttaacata

SEQ ID NO: 407857 - DNA, 25 bp, Mus musculus
gaaagagcaagaattccgatccatc

SEQ ID NO: 407858 - DNA, 25 bp, Mus musculus
gaaagagcaagatttccgatccatc

SEQ ID NO: 407859 - DNA, 25 bp, Mus musculus
gaaagagcacccagtctctgctttg

SEQ ID NO: 407860 - DNA, 25 bp, Mus musculus
gaaagagcaccctgtctctgctttg

SEQ ID NO: 407861 - DNA, 25 bp, Mus musculus
gaaagagcacttatctctcttcatt

SEQ ID NO: 407862 - DNA, 25 bp, Mus musculus
gaaagagcacttttctctcttcatt

SEQ ID NO: 407863 - DNA, 25 bp, Mus musculus
gaaagagcagacacatagcacccac

SEQ ID NO: 407864 - DNA, 25 bp, Mus musculus
gaaagagcagactcatagcacccac

SEQ ID NO: 407865 - DNA, 25 bp, Mus musculus
gaaagagcagcaagtcctgcgtgat

SEQ ID NO: 407866 - DNA, 25 bp, Mus musculus
gaaagagcagcatgtcctgcgtgat

SEQ ID NO: 407867 - DNA, 25 bp, Mus musculus
gaaagagcagcccactgtctcagac

SEQ ID NO: 407868 - DNA, 25 bp, Mus musculus
gaaagagcagccgactgtctcagac

SEQ ID NO: 407869 - DNA, 25 bp, Mus musculus
gaaagagcagctccgtcattccagg

SEQ ID NO: 407870 - DNA, 25 bp, Mus musculus
gaaagagcagctgcgtcattccagg

SEQ ID NO: 407871 - DNA, 25 bp, Mus musculus
gaaagagccaagacaacccattccg

SEQ ID NO: 407872 - DNA, 25 bp, Mus musculus
gaaagagccaagtcaacccattccg

SEQ ID NO: 407873 - DNA, 25 bp, Mus musculus
gaaagagccacgatcatacgcacag

SEQ ID NO: 407874 - DNA, 25 bp, Mus musculus
gaaagagccacgttcatacgcacag

SEQ ID NO: 407875 - DNA, 25 bp, Mus musculus
gaaagagccactcatctacgagagt

SEQ ID NO: 407876 - DNA, 25 bp, Mus musculus
gaaagagccactgatctacgagagt

SEQ ID NO: 407877 - DNA, 25 bp, Mus musculus
gaaagagccataatgtttaacactg

SEQ ID NO: 407878 - DNA, 25 bp, Mus musculus
gaaagagccatattgtttaacactg

SEQ ID NO: 407879 - DNA, 25 bp, Mus musculus
gaaagagccctcaatcggaccaaat

SEQ ID NO: 407880 - DNA, 25 bp, Mus musculus
gaaagagccctctatcggaccaaat

SEQ ID NO: 407881 - DNA, 25 bp, Mus musculus
gaaagagcccttctcatggtacatg

SEQ ID NO: 407882 - DNA, 25 bp, Mus musculus
gaaagagcccttgtcatggtacatg

SEQ ID NO: 407883 - DNA, 25 bp, Mus musculus
gaaagagcctcactgtgccagagct

SEQ ID NO: 407884 - DNA, 25 bp, Mus musculus
gaaagagcctcagtgtgccagagct

SEQ ID NO: 407885 - DNA, 25 bp, Mus musculus
gaaagagcctgaatgacagcacaag

SEQ ID NO: 407886 - DNA, 25 bp, Mus musculus
gaaagagcctgattgacagcacaag

SEQ ID NO: 407887 - DNA, 25 bp, Mus musculus
gaaagagcctgtagccacagcaccg

SEQ ID NO: 407888 - DNA, 25 bp, Mus musculus
gaaagagcctgttgccacagcaccg

SEQ ID NO: 407889 - DNA, 25 bp, Mus musculus
gaaagagcgattcttcaactactgc

SEQ ID NO: 407890 - DNA, 25 bp, Mus musculus
gaaagagcgattgttcaactactgc

SEQ ID NO: 407891 - DNA, 25 bp, Mus musculus
gaaagagctgcaaccaagtgttggc

SEQ ID NO: 407892 - DNA, 25 bp, Mus musculus
gaaagagctgcaaccagtccccggt

SEQ ID NO: 407893 - DNA, 25 bp, Mus musculus
gaaagagctgcatccaagtgttggc

SEQ ID NO: 407894 - DNA, 25 bp, Mus musculus
gaaagagctgcatccagtccccggt

SEQ ID NO: 407895 - DNA, 25 bp, Mus musculus
gaaagagcttaactgtgacaaccac

SEQ ID NO: 407896 - DNA, 25 bp, Mus musculus
gaaagagcttaagtgtgacaaccac

SEQ ID NO: 407897 - DNA, 25 bp, Mus musculus
gaaagagcttgccacttcgtcacag

SEQ ID NO: 407898 - DNA, 25 bp, Mus musculus
gaaagagcttgcgacttcgtcacag

SEQ ID NO: 407899 - DNA, 25 bp, Mus musculus
gaaagaggactcagtcccattgctt

SEQ ID NO: 407900 - DNA, 25 bp, Mus musculus
gaaagaggactctgtcccattgctt

SEQ ID NO: 407901 - DNA, 25 bp, Mus musculus
gaaagaggccaaacggaaattcagc

SEQ ID NO: 407902 - DNA, 25 bp, Mus musculus
gaaagaggccaatcggaaattcagc

SEQ ID NO: 407903 - DNA, 25 bp, Mus musculus
gaaagaggccatcgcgctgctacag

SEQ ID NO: 407904 - DNA, 25 bp, Mus musculus
gaaagaggccatggcgctgctacag

SEQ ID NO: 407905 - DNA, 25 bp, Mus musculus
gaaagaggcctcctcgggctccacg

SEQ ID NO: 407906 - DNA, 25 bp, Mus musculus
gaaagaggcctcgtcgggctccacg

SEQ ID NO: 407907 - DNA, 25 bp, Mus musculus
gaaagaggctttccagtgcatctgc

SEQ ID NO: 407908 - DNA, 25 bp, Mus musculus
gaaagaggctttgcagtgcatctgc

SEQ ID NO: 407909 - DNA, 25 bp, Mus musculus
gaaagagggatcaccggccccaggt

SEQ ID NO: 407910 - DNA, 25 bp, Mus musculus
gaaagagggatctccggccccaggt

SEQ ID NO: 407911 - DNA, 25 bp, Mus musculus
gaaagagggtgtacatgtaaaacta

SEQ ID NO: 407912 - DNA, 25 bp, Mus musculus
gaaagagggtgttcatgtaaaacta

SEQ ID NO: 407913 - DNA, 25 bp, Mus musculus
gaaagagggttcagtgagcccgcct

SEQ ID NO: 407914 - DNA, 25 bp, Mus musculus
gaaagagggttctgtgagcccgcct

SEQ ID NO: 407915 - DNA, 25 bp, Mus musculus
gaaagaggtcatccttctcgggtct

SEQ ID NO: 407916 - DNA, 25 bp, Mus musculus
gaaagaggtcatgcttctcgggtct

SEQ ID NO: 407917 - DNA, 25 bp, Mus musculus
gaaagaggtcctattttcctgctgc

SEQ ID NO: 407918 - DNA, 25 bp, Mus musculus
gaaagaggtccttttttcctgctgc

SEQ ID NO: 407919 - DNA, 25 bp, Mus musculus
gaaagaggttgacacctactccggg

SEQ ID NO: 407920 - DNA, 25 bp, Mus musculus
gaaagaggttgagacctactccggg

SEQ ID NO: 407921 - DNA, 25 bp, Mus musculus
gaaagagtaattaatgctgtttata

SEQ ID NO: 407922 - DNA, 25 bp, Mus musculus
gaaagagtaatttatgctgtttata

SEQ ID NO: 407923 - DNA, 25 bp, Mus musculus
gaaagagtacctactatgccaccca

SEQ ID NO: 407924 - DNA, 25 bp, Mus musculus
gaaagagtaccttctatgccaccca

SEQ ID NO: 407925 - DNA, 25 bp, Mus musculus
gaaagagtcacccaggttgtgttta

SEQ ID NO: 407926 - DNA, 25 bp, Mus musculus
gaaagagtcaccgaggttgtgttta

SEQ ID NO: 407927 - DNA, 25 bp, Mus musculus
gaaagagtcactcggttgccatctt

SEQ ID NO: 407928 - DNA, 25 bp, Mus musculus
gaaagagtcactgggttgccatctt

SEQ ID NO: 407929 - DNA, 25 bp, Mus musculus
gaaagagtcttcacagagctccgcc

SEQ ID NO: 407930 - DNA, 25 bp, Mus musculus
gaaagagtcttctcagagctccgcc

SEQ ID NO: 407931 - DNA, 25 bp, Mus musculus
gaaagagtgccgatgcgactctcca

SEQ ID NO: 407932 - DNA, 25 bp, Mus musculus
gaaagagtgccgttgcgactctcca

SEQ ID NO: 407933 - DNA, 25 bp, Mus musculus
gaaagagtggccagctggatcctcc

SEQ ID NO: 407934 - DNA, 25 bp, Mus musculus
gaaagagtggcctgctggatcctcc

SEQ ID NO: 407935 - DNA, 25 bp, Mus musculus
gaaagagtgtcactcctggctgtct

SEQ ID NO: 407936 - DNA, 25 bp, Mus musculus
gaaagagtgtcagtcctggctgtct

SEQ ID NO: 407937 - DNA, 25 bp, Mus musculus
gaaagagtgtgtagtcttccagaac

SEQ ID NO: 407938 - DNA, 25 bp, Mus musculus
gaaagagtgtgttgtcttccagaac

SEQ ID NO: 407939 - DNA, 25 bp, Mus musculus
gaaagagttccgaacccgcatggtt

SEQ ID NO: 407940 - DNA, 25 bp, Mus musculus
gaaagagttccgtacccgcatggtt

SEQ ID NO: 407941 - DNA, 25 bp, Mus musculus
gaaagagttcttccatcgctagcca

SEQ ID NO: 407942 - DNA, 25 bp, Mus musculus
gaaagagttcttgcatcgctagcca

SEQ ID NO: 407943 - DNA, 25 bp, Mus musculus
gaaagagttgaccttctatgaaaac

SEQ ID NO: 407944 - DNA, 25 bp, Mus musculus
gaaagagttgacgttctatgaaaac

SEQ ID NO: 407945 - DNA, 25 bp, Mus musculus
gaaagagttgcccaaaatgagtcag

SEQ ID NO: 407946 - DNA, 25 bp, Mus musculus
gaaagagttgccgaaaatgagtcag

SEQ ID NO: 407947 - DNA, 25 bp, Mus musculus
gaaagagttgtcatccaatcaaggc

SEQ ID NO: 407948 - DNA, 25 bp, Mus musculus
gaaagagttgtcttccaatcaaggc

SEQ ID NO: 407949 - DNA, 25 bp, Mus musculus
gaaagagtttaccttggaactcaat

SEQ ID NO: 407950 - DNA, 25 bp, Mus musculus
gaaagagtttacgttggaactcaat

SEQ ID NO: 407951 - DNA, 25 bp, Mus musculus
gaaagagtttccacttttgcgccaa

SEQ ID NO: 407952 - DNA, 25 bp, Mus musculus
gaaagagtttcctcttttgcgccaa

SEQ ID NO: 407953 - DNA, 25 bp, Mus musculus
gaaagagtttttaccactggtccat

SEQ ID NO: 407954 - DNA, 25 bp, Mus musculus
gaaagagttttttccactggtccat

SEQ ID NO: 407955 - DNA, 25 bp, Mus musculus
gaaagataaccgacacacagccttc

SEQ ID NO: 407956 - DNA, 25 bp, Mus musculus
gaaagataaccgtcacacagccttc

SEQ ID NO: 407957 - DNA, 25 bp, Mus musculus
gaaagataaggacgtttgttcccat

SEQ ID NO: 407958 - DNA, 25 bp, Mus musculus
gaaagataaggaggtttgttcccat

SEQ ID NO: 407959 - DNA, 25 bp, Mus musculus
gaaagataattcaacagccacagct

SEQ ID NO: 407960 - DNA, 25 bp, Mus musculus
gaaagataattctacagccacagct

SEQ ID NO: 407961 - DNA, 25 bp, Mus musculus
gaaagatacaacctgggcatgtttg

SEQ ID NO: 407962 - DNA, 25 bp, Mus musculus
gaaagatacaacgtgggcatgtttg

SEQ ID NO: 407963 - DNA, 25 bp, Mus musculus
gaaagatacactagtctgacatatt

SEQ ID NO: 407964 - DNA, 25 bp, Mus musculus
gaaagatacacttgtctgacatatt

SEQ ID NO: 407965 - DNA, 25 bp, Mus musculus
gaaagatacagcaggtggccccacc

SEQ ID NO: 407966 - DNA, 25 bp, Mus musculus
gaaagatacagctggtggccccacc

SEQ ID NO: 407967 - DNA, 25 bp, Mus musculus
gaaagatacaggaccatcaccacag

SEQ ID NO: 407968 - DNA, 25 bp, Mus musculus
gaaagatacaggtccatcaccacag

SEQ ID NO: 407969 - DNA, 25 bp, Mus musculus
gaaagatacctcatacacattttga

SEQ ID NO: 407970 - DNA, 25 bp, Mus musculus
gaaagatacctcttacacattttga

SEQ ID NO: 407971 - DNA, 25 bp, Mus musculus
gaaagatactctagaattgcagact

SEQ ID NO: 407972 - DNA, 25 bp, Mus musculus
gaaagatactcttgaattgcagact

SEQ ID NO: 407973 - DNA, 25 bp, Mus musculus
gaaagatactgacctcactgttcat

SEQ ID NO: 407974 - DNA, 25 bp, Mus musculus
gaaagatactgagctcactgttcat

SEQ ID NO: 407975 - DNA, 25 bp, Mus musculus
gaaagataggtcagcaggtaagaac

SEQ ID NO: 407976 - DNA, 25 bp, Mus musculus
gaaagataggtctgcaggtaagaac

SEQ ID NO: 407977 - DNA, 25 bp, Mus musculus
gaaagatataccaggacaggattct

SEQ ID NO: 407978 - DNA, 25 bp, Mus musculus
gaaagatatacctggacaggattct

SEQ ID NO: 407979 - DNA, 25 bp, Mus musculus
gaaagatattccctctacgactcat

SEQ ID NO: 407980 - DNA, 25 bp, Mus musculus
gaaagatattccgtctacgactcat

SEQ ID NO: 407981 - DNA, 25 bp, Mus musculus
gaaagatatttccaatgggacaaga

SEQ ID NO: 407982 - DNA, 25 bp, Mus musculus
gaaagatatttcgaatgggacaaga

SEQ ID NO: 407983 - DNA, 25 bp, Mus musculus
gaaagatcacctaaaccaaagcccg

SEQ ID NO: 407984 - DNA, 25 bp, Mus musculus
gaaagatcaccttaaccaaagcccg

SEQ ID NO: 407985 - DNA, 25 bp, Mus musculus
gaaagatcagctagttcctcacaga

SEQ ID NO: 407986 - DNA, 25 bp, Mus musculus
gaaagatcagcttgttcctcacaga

SEQ ID NO: 407987 - DNA, 25 bp, Mus musculus
gaaagatcatagatactcggtcaga

SEQ ID NO: 407988 - DNA, 25 bp, Mus musculus
gaaagatcatagttactcggtcaga

SEQ ID NO: 407989 - DNA, 25 bp, Mus musculus
gaaagatccacactaatatcgctgt

SEQ ID NO: 407990 - DNA, 25 bp, Mus musculus
gaaagatccacagtaatatcgctgt

SEQ ID NO: 407991 - DNA, 25 bp, Mus musculus
gaaagatccactaatgcagctggtg

SEQ ID NO: 407992 - DNA, 25 bp, Mus musculus
gaaagatccacttatgcagctggtg

SEQ ID NO: 407993 - DNA, 25 bp, Mus musculus
gaaagatcccaaaaatgtgctgaaa

SEQ ID NO: 407994 - DNA, 25 bp, Mus musculus
gaaagatcccaataatgtgctgaaa

SEQ ID NO: 407995 - DNA, 25 bp, Mus musculus
gaaagatcccatatgaaggctgtga

SEQ ID NO: 407996 - DNA, 25 bp, Mus musculus
gaaagatcccatcccagggtgtcac

SEQ ID NO: 407997 - DNA, 25 bp, Mus musculus
gaaagatcccatgccagggtgtcac

SEQ ID NO: 407998 - DNA, 25 bp, Mus musculus
gaaagatcccatttgaaggctgtga

SEQ ID NO: 407999 - DNA, 25 bp, Mus musculus
gaaagatccctaaggtgccggtgcc

SEQ ID NO: 408000 - DNA, 25 bp, Mus musculus
gaaagatccctatggtgccggtgcc

SEQ ID NO: 408001 - DNA, 25 bp, Mus musculus
gaaagatccctccaagtcaaagtga

SEQ ID NO: 408002 - DNA, 25 bp, Mus musculus
gaaagatccctcgaagtcaaagtga

SEQ ID NO: 408003 - DNA, 25 bp, Mus musculus
gaaagatcccttaaattctgcggtc

SEQ ID NO: 408004 - DNA, 25 bp, Mus musculus
gaaagatcccttagatcgtcgctga

SEQ ID NO: 408005 - DNA, 25 bp, Mus musculus
gaaagatccctttaattctgcggtc

SEQ ID NO: 408006 - DNA, 25 bp, Mus musculus
gaaagatccctttgatcgtcgctga

SEQ ID NO: 408007 - DNA, 25 bp, Mus musculus
gaaagatccgagaactctcacttct

SEQ ID NO: 408008 - DNA, 25 bp, Mus musculus
gaaagatccgagtactctcacttct

SEQ ID NO: 408009 - DNA, 25 bp, Mus musculus
gaaagatccgtcaagctggtgtcat

SEQ ID NO: 408010 - DNA, 25 bp, Mus musculus
gaaagatccgtctagctggtgtcat

SEQ ID NO: 408011 - DNA, 25 bp, Mus musculus
gaaagatcctgtcaacttcctagaa

SEQ ID NO: 408012 - DNA, 25 bp, Mus musculus
gaaagatcctgtgaacttcctagaa

SEQ ID NO: 408013 - DNA, 25 bp, Mus musculus
gaaagatcgacgacctccatgactt

SEQ ID NO: 408014 - DNA, 25 bp, Mus musculus
gaaagatcgacgtcctccatgactt

SEQ ID NO: 408015 - DNA, 25 bp, Mus musculus
gaaagatctgatccacacctgatgt

SEQ ID NO: 408016 - DNA, 25 bp, Mus musculus
gaaagatctgatgcacacctgatgt

SEQ ID NO: 408017 - DNA, 25 bp, Mus musculus
gaaagatctggcaccttgactttag

SEQ ID NO: 408018 - DNA, 25 bp, Mus musculus
gaaagatctggctccttgactttag

SEQ ID NO: 408019 - DNA, 25 bp, Mus musculus
gaaagatctggtattgctccactcc

SEQ ID NO: 408020 - DNA, 25 bp, Mus musculus
gaaagatctggttttgctccactcc

SEQ ID NO: 408021 - DNA, 25 bp, Mus musculus
gaaagatctgtgcataaagctgtat

SEQ ID NO: 408022 - DNA, 25 bp, Mus musculus
gaaagatctgtggataaagctgtat

SEQ ID NO: 408023 - DNA, 25 bp, Mus musculus
gaaagatcttggacccagccctgat

SEQ ID NO: 408024 - DNA, 25 bp, Mus musculus
gaaagatcttggtcccagccctgat

SEQ ID NO: 408025 - DNA, 25 bp, Mus musculus
gaaagatgactacgactatgtgctc

SEQ ID NO: 408026 - DNA, 25 bp, Mus musculus
gaaagatgactaggactatgtgctc

SEQ ID NO: 408027 - DNA, 25 bp, Mus musculus
gaaagatgactcctcctcactctca

SEQ ID NO: 408028 - DNA, 25 bp, Mus musculus
gaaagatgactcgtcctcactctca

SEQ ID NO: 408029 - DNA, 25 bp, Mus musculus
gaaagatgagatcggttcccagcca

SEQ ID NO: 408030 - DNA, 25 bp, Mus musculus
gaaagatgagatgggttcccagcca

SEQ ID NO: 408031 - DNA, 25 bp, Mus musculus
gaaagatgccaacaaccctggtcta

SEQ ID NO: 408032 - DNA, 25 bp, Mus musculus
gaaagatgccaagaaccctggtcta

SEQ ID NO: 408033 - DNA, 25 bp, Mus musculus
gaaagatgccggaaaatccagggac

SEQ ID NO: 408034 - DNA, 25 bp, Mus musculus
gaaagatgccggaaagtcggccaaa

SEQ ID NO: 408035 - DNA, 25 bp, Mus musculus
gaaagatgccggtaaatccagggac

SEQ ID NO: 408036 - DNA, 25 bp, Mus musculus
gaaagatgccggtaagtcggccaaa

SEQ ID NO: 408037 - DNA, 25 bp, Mus musculus
gaaagatgccttcaatacagggact

SEQ ID NO: 408038 - DNA, 25 bp, Mus musculus
gaaagatgccttcccaggatacact

SEQ ID NO: 408039 - DNA, 25 bp, Mus musculus
gaaagatgccttgaatacagggact

SEQ ID NO: 408040 - DNA, 25 bp, Mus musculus
gaaagatgccttgccaggatacact

SEQ ID NO: 408041 - DNA, 25 bp, Mus musculus
gaaagatgctacacacgttgtcgat

SEQ ID NO: 408042 - DNA, 25 bp, Mus musculus
gaaagatgctactcacgttgtcgat

SEQ ID NO: 408043 - DNA, 25 bp, Mus musculus
gaaagatgctatctcacgttttaac

SEQ ID NO: 408044 - DNA, 25 bp, Mus musculus
gaaagatgctatgtcacgttttaac

SEQ ID NO: 408045 - DNA, 25 bp, Mus musculus
gaaagatgcttaatttgggatagag

SEQ ID NO: 408046 - DNA, 25 bp, Mus musculus
gaaagatgcttattttgggatagag

SEQ ID NO: 408047 - DNA, 25 bp, Mus musculus
gaaagatgcttcagatgacttagat

SEQ ID NO: 408048 - DNA, 25 bp, Mus musculus
gaaagatgcttctgatgacttagat

SEQ ID NO: 408049 - DNA, 25 bp, Mus musculus
gaaagatggaatactagctctcttc

SEQ ID NO: 408050 - DNA, 25 bp, Mus musculus
gaaagatggaattctagctctcttc

SEQ ID NO: 408051 - DNA, 25 bp, Mus musculus
gaaagatggagcctcagccgttcct

SEQ ID NO: 408052 - DNA, 25 bp, Mus musculus
gaaagatggagcgtcagccgttcct

SEQ ID NO: 408053 - DNA, 25 bp, Mus musculus
gaaagatggatgaccacggtctggt

SEQ ID NO: 408054 - DNA, 25 bp, Mus musculus
gaaagatggatgtccacggtctggt

SEQ ID NO: 408055 - DNA, 25 bp, Mus musculus
gaaagatggcatcaagttagctcag

SEQ ID NO: 408056 - DNA, 25 bp, Mus musculus
gaaagatggcatgaagttagctcag

SEQ ID NO: 408057 - DNA, 25 bp, Mus musculus
gaaagatggcccacttggtgcgcag

SEQ ID NO: 408058 - DNA, 25 bp, Mus musculus
gaaagatggccctcttggtgcgcag

SEQ ID NO: 408059 - DNA, 25 bp, Mus musculus
gaaagatggcgtaccttctcattga

SEQ ID NO: 408060 - DNA, 25 bp, Mus musculus
gaaagatggcgttccttctcattga

SEQ ID NO: 408061 - DNA, 25 bp, Mus musculus
gaaagatgggctctcaggattcaca

SEQ ID NO: 408062 - DNA, 25 bp, Mus musculus
gaaagatgggctgtcaggattcaca

SEQ ID NO: 408063 - DNA, 25 bp, Mus musculus
gaaagatgtcacctacctctcagga

SEQ ID NO: 408064 - DNA, 25 bp, Mus musculus
gaaagatgtcacgtacctctcagga

SEQ ID NO: 408065 - DNA, 25 bp, Mus musculus
gaaagatgtcgactagtcaccggct

SEQ ID NO: 408066 - DNA, 25 bp, Mus musculus
gaaagatgtcgagtagtcaccggct

SEQ ID NO: 408067 - DNA, 25 bp, Mus musculus
gaaagatgttacatccacgaccact

SEQ ID NO: 408068 - DNA, 25 bp, Mus musculus
gaaagatgttacttccacgaccact

SEQ ID NO: 408069 - DNA, 25 bp, Mus musculus
gaaagatgttctcatcccaaagata

SEQ ID NO: 408070 - DNA, 25 bp, Mus musculus
gaaagatgttctgatcccaaagata

SEQ ID NO: 408071 - DNA, 25 bp, Mus musculus
gaaagatgttgaactgaagctctga

SEQ ID NO: 408072 - DNA, 25 bp, Mus musculus
gaaagatgttgaattttctccctca

SEQ ID NO: 408073 - DNA, 25 bp, Mus musculus
gaaagatgttgatctgaagctctga

SEQ ID NO: 408074 - DNA, 25 bp, Mus musculus
gaaagatgttgatttttctccctca

SEQ ID NO: 408075 - DNA, 25 bp, Mus musculus
gaaagatgtttcaggctgccagcca

SEQ ID NO: 408076 - DNA, 25 bp, Mus musculus
gaaagatgtttctggctgccagcca

SEQ ID NO: 408077 - DNA, 25 bp, Mus musculus
gaaagattaaacatcccactgccct

SEQ ID NO: 408078 - DNA, 25 bp, Mus musculus
gaaagattaaacttcccactgccct

SEQ ID NO: 408079 - DNA, 25 bp, Mus musculus
gaaagattaataccttagctgtgaa

SEQ ID NO: 408080 - DNA, 25 bp, Mus musculus
gaaagattaatagcttagctgtgaa

SEQ ID NO: 408081 - DNA, 25 bp, Mus musculus
gaaagattacttctggttccatagg

SEQ ID NO: 408082 - DNA, 25 bp, Mus musculus
gaaagattacttgtggttccatagg

SEQ ID NO: 408083 - DNA, 25 bp, Mus musculus
gaaagattagtcatagtgggctgaa

SEQ ID NO: 408084 - DNA, 25 bp, Mus musculus
gaaagattagtcttagtgggctgaa

SEQ ID NO: 408085 - DNA, 25 bp, Mus musculus
gaaagattcatacagtccaaagcga

SEQ ID NO: 408086 - DNA, 25 bp, Mus musculus
gaaagattcatagagtccaaagcga

SEQ ID NO: 408087 - DNA, 25 bp, Mus musculus
gaaagattccccaattgatgtaaaa

SEQ ID NO: 408088 - DNA, 25 bp, Mus musculus
gaaagattcccctattgatgtaaaa

SEQ ID NO: 408089 - DNA, 25 bp, Mus musculus
gaaagattgagtctttcccctcaag

SEQ ID NO: 408090 - DNA, 25 bp, Mus musculus
gaaagattgagtgtttcccctcaag

SEQ ID NO: 408091 - DNA, 25 bp, Mus musculus
gaaagattgctcacacattccatta

SEQ ID NO: 408092 - DNA, 25 bp, Mus musculus
gaaagattgctctcacattccatta

SEQ ID NO: 408093 - DNA, 25 bp, Mus musculus
gaaagattgggccatttccttccca

SEQ ID NO: 408094 - DNA, 25 bp, Mus musculus
gaaagattgggcgatttccttccca

SEQ ID NO: 408095 - DNA, 25 bp, Mus musculus
gaaagattgggtagctactccccga

SEQ ID NO: 408096 - DNA, 25 bp, Mus musculus
gaaagattgggttgctactccccga

SEQ ID NO: 408097 - DNA, 25 bp, Mus musculus
gaaagattgtttcgtggctttgtta

SEQ ID NO: 408098 - DNA, 25 bp, Mus musculus
gaaagattgtttggtggctttgtta

SEQ ID NO: 408099 - DNA, 25 bp, Mus musculus
gaaagatttagactacgccacccct

SEQ ID NO: 408100 - DNA, 25 bp, Mus musculus
gaaagatttagagtacgccacccct

SEQ ID NO: 408101 - DNA, 25 bp, Mus musculus
gaaagatttatgctcctgaattgac

SEQ ID NO: 408102 - DNA, 25 bp, Mus musculus
gaaagatttatggtcctgaattgac

SEQ ID NO: 408103 - DNA, 25 bp, Mus musculus
gaaagatttcctctcaggcctggat

SEQ ID NO: 408104 - DNA, 25 bp, Mus musculus
gaaagatttcctgtcaggcctggat

SEQ ID NO: 408105 - DNA, 25 bp, Mus musculus
gaaagatttgccatccttccaagat

SEQ ID NO: 408106 - DNA, 25 bp, Mus musculus
gaaagatttgccttccttccaagat

SEQ ID NO: 408107 - DNA, 25 bp, Mus musculus
gaaagatttgctccctgtatgtgcc

SEQ ID NO: 408108 - DNA, 25 bp, Mus musculus
gaaagatttgctgcctgtatgtgcc

SEQ ID NO: 408109 - DNA, 25 bp, Mus musculus
gaaagatttgtactgggatcatgat

SEQ ID NO: 408110 - DNA, 25 bp, Mus musculus
gaaagatttgtagtgggatcatgat

SEQ ID NO: 408111 - DNA, 25 bp, Mus musculus
gaaagatttgtgaggcgtcccctga

SEQ ID NO: 408112 - DNA, 25 bp, Mus musculus
gaaagatttgtgtggcgtcccctga

SEQ ID NO: 408113 - DNA, 25 bp, Mus musculus
gaaagatttgttaacctggctacct

SEQ ID NO: 408114 - DNA, 25 bp, Mus musculus
gaaagatttgtttacctggctacct

SEQ ID NO: 408115 - DNA, 25 bp, Mus musculus
gaaagattttatccacacccaaaca

SEQ ID NO: 408116 - DNA, 25 bp, Mus musculus
gaaagattttatgcacacccaaaca

SEQ ID NO: 408117 - DNA, 25 bp, Mus musculus
gaaagattttcgctggccccatagt

SEQ ID NO: 408118 - DNA, 25 bp, Mus musculus
gaaagattttcggtggccccatagt

SEQ ID NO: 408119 - DNA, 25 bp, Mus musculus
gaaagattttgcacagtgcctcccg

SEQ ID NO: 408120 - DNA, 25 bp, Mus musculus
gaaagattttgctcagtgcctcccg

SEQ ID NO: 408121 - DNA, 25 bp, Mus musculus
gaaagattttttcagtccctgtgga

SEQ ID NO: 408122 - DNA, 25 bp, Mus musculus
gaaagattttttgagtccctgtgga

SEQ ID NO: 408123 - DNA, 25 bp, Mus musculus
gaaagcaaaatgaggctccccactc

SEQ ID NO: 408124 - DNA, 25 bp, Mus musculus
gaaagcaaaatgtggctccccactc

SEQ ID NO: 408125 - DNA, 25 bp, Mus musculus
gaaagcaaacaaactgactatcccc

SEQ ID NO: 408126 - DNA, 25 bp, Mus musculus
gaaagcaaacaatctgactatcccc

SEQ ID NO: 408127 - DNA, 25 bp, Mus musculus
gaaagcaaaccccaataggtcagaa

SEQ ID NO: 408128 - DNA, 25 bp, Mus musculus
gaaagcaaacccgaataggtcagaa

SEQ ID NO: 408129 - DNA, 25 bp, Mus musculus
gaaagcaaagaccataagcaccatt

SEQ ID NO: 408130 - DNA, 25 bp, Mus musculus
gaaagcaaagacgataagcaccatt

SEQ ID NO: 408131 - DNA, 25 bp, Mus musculus
gaaagcaaagccaaggcctggtccc

SEQ ID NO: 408132 - DNA, 25 bp, Mus musculus
gaaagcaaagccagtacactccacc

SEQ ID NO: 408133 - DNA, 25 bp, Mus musculus
gaaagcaaagcctaggcctggtccc

SEQ ID NO: 408134 - DNA, 25 bp, Mus musculus
gaaagcaaagcctgtacactccacc

SEQ ID NO: 408135 - DNA, 25 bp, Mus musculus
gaaagcaaagctagttcagtatgaa

SEQ ID NO: 408136 - DNA, 25 bp, Mus musculus
gaaagcaaagctcacctgtgaactc

SEQ ID NO: 408137 - DNA, 25 bp, Mus musculus
gaaagcaaagctccgtaccgagcac

SEQ ID NO: 408138 - DNA, 25 bp, Mus musculus
gaaagcaaagctgacctgtgaactc

SEQ ID NO: 408139 - DNA, 25 bp, Mus musculus
gaaagcaaagctgcgtaccgagcac

SEQ ID NO: 408140 - DNA, 25 bp, Mus musculus
gaaagcaaagcttgttcagtatgaa

SEQ ID NO: 408141 - DNA, 25 bp, Mus musculus
gaaagcaaagtgcacctggcagaat

SEQ ID NO: 408142 - DNA, 25 bp, Mus musculus
gaaagcaaagtggacctggcagaat

SEQ ID NO: 408143 - DNA, 25 bp, Mus musculus
gaaagcaaagttcgccagccaggca

SEQ ID NO: 408144 - DNA, 25 bp, Mus musculus
gaaagcaaagttggccagccaggca

SEQ ID NO: 408145 - DNA, 25 bp, Mus musculus
gaaagcaaatgcctctcccaattag

SEQ ID NO: 408146 - DNA, 25 bp, Mus musculus
gaaagcaaatgcgtctcccaattag

SEQ ID NO: 408147 - DNA, 25 bp, Mus musculus
gaaagcaaattaaccattgtcagct

SEQ ID NO: 408148 - DNA, 25 bp, Mus musculus
gaaagcaaattatccattgtcagct

SEQ ID NO: 408149 - DNA, 25 bp, Mus musculus
gaaagcaacacaagggctatgccaa

SEQ ID NO: 408150 - DNA, 25 bp, Mus musculus
gaaagcaacacacccttaacctcat

SEQ ID NO: 408151 - DNA, 25 bp, Mus musculus
gaaagcaacacagccttaacctcat

SEQ ID NO: 408152 - DNA, 25 bp, Mus musculus
gaaagcaacacatgggctatgccaa

SEQ ID NO: 408153 - DNA, 25 bp, Mus musculus
gaaagcaacatgaatatccggaaaa

SEQ ID NO: 408154 - DNA, 25 bp, Mus musculus
gaaagcaacatgtatatccggaaaa

SEQ ID NO: 408155 - DNA, 25 bp, Mus musculus
gaaagcaacctaaaatcttttgaaa

SEQ ID NO: 408156 - DNA, 25 bp, Mus musculus
gaaagcaacctataatcttttgaaa

SEQ ID NO: 408157 - DNA, 25 bp, Mus musculus
gaaagcaacctcactgcacaaagta

SEQ ID NO: 408158 - DNA, 25 bp, Mus musculus
gaaagcaacctcatgtaagccctat

SEQ ID NO: 408159 - DNA, 25 bp, Mus musculus
gaaagcaacctctctgcacaaagta

SEQ ID NO: 408160 - DNA, 25 bp, Mus musculus
gaaagcaacctcttgtaagccctat

SEQ ID NO: 408161 - DNA, 25 bp, Mus musculus
gaaagcaactcaccaggactggcta

SEQ ID NO: 408162 - DNA, 25 bp, Mus musculus
gaaagcaactcagcaggactggcta

SEQ ID NO: 408163 - DNA, 25 bp, Mus musculus
gaaagcaactccagagctacctacg

SEQ ID NO: 408164 - DNA, 25 bp, Mus musculus
gaaagcaactcctgagctacctacg

SEQ ID NO: 408165 - DNA, 25 bp, Mus musculus
gaaagcaagctgagactgcacctat

SEQ ID NO: 408166 - DNA, 25 bp, Mus musculus
gaaagcaagctgtgactgcacctat

SEQ ID NO: 408167 - DNA, 25 bp, Mus musculus
gaaagcaaggatattctcccggagg

SEQ ID NO: 408168 - DNA, 25 bp, Mus musculus
gaaagcaaggattttctcccggagg

SEQ ID NO: 408169 - DNA, 25 bp, Mus musculus
gaaagcaagggtcagccagcaagca

SEQ ID NO: 408170 - DNA, 25 bp, Mus musculus
gaaagcaagggtgagccagcaagca

SEQ ID NO: 408171 - DNA, 25 bp, Mus musculus
gaaagcaagtagcttcccgtggctt

SEQ ID NO: 408172 - DNA, 25 bp, Mus musculus
gaaagcaagtaggttcccgtggctt

SEQ ID NO: 408173 - DNA, 25 bp, Mus musculus
gaaagcaagttgaatttagtccagt

SEQ ID NO: 408174 - DNA, 25 bp, Mus musculus
gaaagcaagttgtatttagtccagt

SEQ ID NO: 408175 - DNA, 25 bp, Mus musculus
gaaagcaatcttcatctatttctct

SEQ ID NO: 408176 - DNA, 25 bp, Mus musculus
gaaagcaatcttgatctatttctct

SEQ ID NO: 408177 - DNA, 25 bp, Mus musculus
gaaagcaatttcaaccctgaccaat

SEQ ID NO: 408178 - DNA, 25 bp, Mus musculus
gaaagcaatttctaccctgaccaat

SEQ ID NO: 408179 - DNA, 25 bp, Mus musculus
gaaagcacaaaaagctacctctata

SEQ ID NO: 408180 - DNA, 25 bp, Mus musculus
gaaagcacaaaatgctacctctata

SEQ ID NO: 408181 - DNA, 25 bp, Mus musculus
gaaagcacagcaactagaataccaa

SEQ ID NO: 408182 - DNA, 25 bp, Mus musculus
gaaagcacagcaatactattaccct

SEQ ID NO: 408183 - DNA, 25 bp, Mus musculus
gaaagcacagcatctagaataccaa

SEQ ID NO: 408184 - DNA, 25 bp, Mus musculus
gaaagcacagcattactattaccct

SEQ ID NO: 408185 - DNA, 25 bp, Mus musculus
gaaagcacaggtctctgggaattta

SEQ ID NO: 408186 - DNA, 25 bp, Mus musculus
gaaagcacaggtgtctgggaattta

SEQ ID NO: 408187 - DNA, 25 bp, Mus musculus
gaaagcacagtcctctcttctggat

SEQ ID NO: 408188 - DNA, 25 bp, Mus musculus
gaaagcacagtcgtctcttctggat

SEQ ID NO: 408189 - DNA, 25 bp, Mus musculus
gaaagcacatagcaccttggttcaa

SEQ ID NO: 408190 - DNA, 25 bp, Mus musculus
gaaagcacataggaccttggttcaa

SEQ ID NO: 408191 - DNA, 25 bp, Mus musculus
gaaagcacatataactgccagcgtg

SEQ ID NO: 408192 - DNA, 25 bp, Mus musculus
gaaagcacatattactgccagcgtg

SEQ ID NO: 408193 - DNA, 25 bp, Mus musculus
gaaagcacatcacggcgggtccatt

SEQ ID NO: 408194 - DNA, 25 bp, Mus musculus
gaaagcacatcagggcgggtccatt

SEQ ID NO: 408195 - DNA, 25 bp, Mus musculus
gaaagcacatctagcttgtccatcc

SEQ ID NO: 408196 - DNA, 25 bp, Mus musculus
gaaagcacatcttgcttgtccatcc

SEQ ID NO: 408197 - DNA, 25 bp, Mus musculus
gaaagcacatttcttcccctagagc

SEQ ID NO: 408198 - DNA, 25 bp, Mus musculus
gaaagcacatttctttctgtcttgg

SEQ ID NO: 408199 - DNA, 25 bp, Mus musculus
gaaagcacatttgttcccctagagc

SEQ ID NO: 408200 - DNA, 25 bp, Mus musculus
gaaagcacatttgtttctgtcttgg

SEQ ID NO: 408201 - DNA, 25 bp, Mus musculus
gaaagcaccagtacgtttaagttct

SEQ ID NO: 408202 - DNA, 25 bp, Mus musculus
gaaagcaccagttcgtttaagttct

SEQ ID NO: 408203 - DNA, 25 bp, Mus musculus
gaaagcaccatgaacttaaacattt

SEQ ID NO: 408204 - DNA, 25 bp, Mus musculus
gaaagcaccatgtacttaaacattt

SEQ ID NO: 408205 - DNA, 25 bp, Mus musculus
gaaagcaccattagcttctacaagg

SEQ ID NO: 408206 - DNA, 25 bp, Mus musculus
gaaagcaccatttgcttctacaagg

SEQ ID NO: 408207 - DNA, 25 bp, Mus musculus
gaaagcacccgccacaaggagacat

SEQ ID NO: 408208 - DNA, 25 bp, Mus musculus
gaaagcacccgcgacaaggagacat

SEQ ID NO: 408209 - DNA, 25 bp, Mus musculus
gaaagcaccgccaggcttgagtgta

SEQ ID NO: 408210 - DNA, 25 bp, Mus musculus
gaaagcaccgcctggcttgagtgta

SEQ ID NO: 408211 - DNA, 25 bp, Mus musculus
gaaagcacctacaggcggagctctg

SEQ ID NO: 408212 - DNA, 25 bp, Mus musculus
gaaagcacctactggcggagctctg

SEQ ID NO: 408213 - DNA, 25 bp, Mus musculus
gaaagcacctataggaagcgttcaa

SEQ ID NO: 408214 - DNA, 25 bp, Mus musculus
gaaagcacctattggaagcgttcaa

SEQ ID NO: 408215 - DNA, 25 bp, Mus musculus
gaaagcacctctcttgtagtgggta

SEQ ID NO: 408216 - DNA, 25 bp, Mus musculus
gaaagcacctctgttgtagtgggta

SEQ ID NO: 408217 - DNA, 25 bp, Mus musculus
gaaagcacctgcaccaaaggcggct

SEQ ID NO: 408218 - DNA, 25 bp, Mus musculus
gaaagcacctgctccaaaggcggct

SEQ ID NO: 408219 - DNA, 25 bp, Mus musculus
gaaagcaccttcattccaagaggtt

SEQ ID NO: 408220 - DNA, 25 bp, Mus musculus
gaaagcaccttctttccaagaggtt

SEQ ID NO: 408221 - DNA, 25 bp, Mus musculus
gaaagcaccttgagaggaacagaaa

SEQ ID NO: 408222 - DNA, 25 bp, Mus musculus
gaaagcaccttgtgaggaacagaaa

SEQ ID NO: 408223 - DNA, 25 bp, Mus musculus
gaaagcacgaaaacaggagatcatc

SEQ ID NO: 408224 - DNA, 25 bp, Mus musculus
gaaagcacgaaatcaggagatcatc

SEQ ID NO: 408225 - DNA, 25 bp, Mus musculus
gaaagcacgaacatcttcagtccct

SEQ ID NO: 408226 - DNA, 25 bp, Mus musculus
gaaagcacgaacttcttcagtccct

SEQ ID NO: 408227 - DNA, 25 bp, Mus musculus
gaaagcacggagaccagtgacgctc

SEQ ID NO: 408228 - DNA, 25 bp, Mus musculus
gaaagcacggagtccagtgacgctc

SEQ ID NO: 408229 - DNA, 25 bp, Mus musculus
gaaagcactatgaagcactggccag

SEQ ID NO: 408230 - DNA, 25 bp, Mus musculus
gaaagcactatgtagcactggccag

SEQ ID NO: 408231 - DNA, 25 bp, Mus musculus
gaaagcactcaacatctacctggat

SEQ ID NO: 408232 - DNA, 25 bp, Mus musculus
gaaagcactcaagatctacctggat

SEQ ID NO: 408233 - DNA, 25 bp, Mus musculus
gaaagcactcaccttgctctagcat

SEQ ID NO: 408234 - DNA, 25 bp, Mus musculus
gaaagcactcacgttgctctagcat

SEQ ID NO: 408235 - DNA, 25 bp, Mus musculus
gaaagcactcagcaaacatcttcac

SEQ ID NO: 408236 - DNA, 25 bp, Mus musculus
gaaagcactcaggaaacatcttcac

SEQ ID NO: 408237 - DNA, 25 bp, Mus musculus
gaaagcactcatccagagcagacaa

SEQ ID NO: 408238 - DNA, 25 bp, Mus musculus
gaaagcactcatgcagagcagacaa

SEQ ID NO: 408239 - DNA, 25 bp, Mus musculus
gaaagcactgatcgaccctggctgg

SEQ ID NO: 408240 - DNA, 25 bp, Mus musculus
gaaagcactgatggaccctggctgg

SEQ ID NO: 408241 - DNA, 25 bp, Mus musculus
gaaagcactgctccaagtaccaagg

SEQ ID NO: 408242 - DNA, 25 bp, Mus musculus
gaaagcactgctcgcgctaagtaac

SEQ ID NO: 408243 - DNA, 25 bp, Mus musculus
gaaagcactgctgcaagtaccaagg

SEQ ID NO: 408244 - DNA, 25 bp, Mus musculus
gaaagcactgctggcgctaagtaac

SEQ ID NO: 408245 - DNA, 25 bp, Mus musculus
gaaagcactggaaggctgttacagt

SEQ ID NO: 408246 - DNA, 25 bp, Mus musculus
gaaagcactggatggctgttacagt

SEQ ID NO: 408247 - DNA, 25 bp, Mus musculus
gaaagcactgtgactgtagttctgt

SEQ ID NO: 408248 - DNA, 25 bp, Mus musculus
gaaagcactgtgtctgtagttctgt

SEQ ID NO: 408249 - DNA, 25 bp, Mus musculus
gaaagcactgttcctgtccagctac

SEQ ID NO: 408250 - DNA, 25 bp, Mus musculus
gaaagcactgttgctgtccagctac

SEQ ID NO: 408251 - DNA, 25 bp, Mus musculus
gaaagcacttaacttcccatccttc

SEQ ID NO: 408252 - DNA, 25 bp, Mus musculus
gaaagcacttaagttcccatccttc

SEQ ID NO: 408253 - DNA, 25 bp, Mus musculus
gaaagcactttgacacttacagtat

SEQ ID NO: 408254 - DNA, 25 bp, Mus musculus
gaaagcactttgcacacatttcctg

SEQ ID NO: 408255 - DNA, 25 bp, Mus musculus
gaaagcactttggacacatttcctg

SEQ ID NO: 408256 - DNA, 25 bp, Mus musculus
gaaagcactttgtcacttacagtat

SEQ ID NO: 408257 - DNA, 25 bp, Mus musculus
gaaagcacttttctgactaagccat

SEQ ID NO: 408258 - DNA, 25 bp, Mus musculus
gaaagcacttttgtgactaagccat

SEQ ID NO: 408259 - DNA, 25 bp, Mus musculus
gaaagcagaccaaccttgcatagag

SEQ ID NO: 408260 - DNA, 25 bp, Mus musculus
gaaagcagaccaatcttagaacaga

SEQ ID NO: 408261 - DNA, 25 bp, Mus musculus
gaaagcagaccatccttgcatagag

SEQ ID NO: 408262 - DNA, 25 bp, Mus musculus
gaaagcagaccattcttagaacaga

SEQ ID NO: 408263 - DNA, 25 bp, Mus musculus
gaaagcagactcatggccaagacac

SEQ ID NO: 408264 - DNA, 25 bp, Mus musculus
gaaagcagactcttggccaagacac

SEQ ID NO: 408265 - DNA, 25 bp, Mus musculus
gaaagcagagccaacagctggagct

SEQ ID NO: 408266 - DNA, 25 bp, Mus musculus
gaaagcagagcctacagctggagct

SEQ ID NO: 408267 - DNA, 25 bp, Mus musculus
gaaagcagagggattcagagatcat

SEQ ID NO: 408268 - DNA, 25 bp, Mus musculus
gaaagcagagggtttcagagatcat

SEQ ID NO: 408269 - DNA, 25 bp, Mus musculus
gaaagcagaggtcccctgtgtgaac

SEQ ID NO: 408270 - DNA, 25 bp, Mus musculus
gaaagcagaggtgccctgtgtgaac

SEQ ID NO: 408271 - DNA, 25 bp, Mus musculus
gaaagcagagttatccagcttactc

SEQ ID NO: 408272 - DNA, 25 bp, Mus musculus
gaaagcagagttttccagcttactc

SEQ ID NO: 408273 - DNA, 25 bp, Mus musculus
gaaagcagatacaatttggtaacta

SEQ ID NO: 408274 - DNA, 25 bp, Mus musculus
gaaagcagatactatttggtaacta

SEQ ID NO: 408275 - DNA, 25 bp, Mus musculus
gaaagcagatgcactccttaaaaat

SEQ ID NO: 408276 - DNA, 25 bp, Mus musculus
gaaagcagatgctctccttaaaaat

SEQ ID NO: 408277 - DNA, 25 bp, Mus musculus
gaaagcagcaagcatggacactcta

SEQ ID NO: 408278 - DNA, 25 bp, Mus musculus
gaaagcagcaaggatggacactcta

SEQ ID NO: 408279 - DNA, 25 bp, Mus musculus
gaaagcagcacacggtttcaacggc

SEQ ID NO: 408280 - DNA, 25 bp, Mus musculus
gaaagcagcacagggtttcaacggc

SEQ ID NO: 408281 - DNA, 25 bp, Mus musculus
gaaagcagcagtagcggctctggcc

SEQ ID NO: 408282 - DNA, 25 bp, Mus musculus
gaaagcagcagttgcggctctggcc

SEQ ID NO: 408283 - DNA, 25 bp, Mus musculus
gaaagcagcatcaccgcttctaggt

SEQ ID NO: 408284 - DNA, 25 bp, Mus musculus
gaaagcagcatcagcagtgggtttg

SEQ ID NO: 408285 - DNA, 25 bp, Mus musculus
gaaagcagcatctccgcttctaggt

SEQ ID NO: 408286 - DNA, 25 bp, Mus musculus
gaaagcagcatctgcagtgggtttg

SEQ ID NO: 408287 - DNA, 25 bp, Mus musculus
gaaagcagccgaaccttgagggaac

SEQ ID NO: 408288 - DNA, 25 bp, Mus musculus
gaaagcagccgatccttgagggaac

SEQ ID NO: 408289 - DNA, 25 bp, Mus musculus
gaaagcagcctcatcagtggcttaa

SEQ ID NO: 408290 - DNA, 25 bp, Mus musculus
gaaagcagcctcttcagtggcttaa

SEQ ID NO: 408291 - DNA, 25 bp, Mus musculus
gaaagcagcgacagacaacccagag

SEQ ID NO: 408292 - DNA, 25 bp, Mus musculus
gaaagcagcgactgacaacccagag

SEQ ID NO: 408293 - DNA, 25 bp, Mus musculus
gaaagcagcgcccagcctctggctg

SEQ ID NO: 408294 - DNA, 25 bp, Mus musculus
gaaagcagcgccgagcctctggctg

SEQ ID NO: 408295 - DNA, 25 bp, Mus musculus
gaaagcagctgtactctttcaacct

SEQ ID NO: 408296 - DNA, 25 bp, Mus musculus
gaaagcagctgttctctttcaacct

SEQ ID NO: 408297 - DNA, 25 bp, Mus musculus
gaaagcagcttcacacatttaatgg

SEQ ID NO: 408298 - DNA, 25 bp, Mus musculus
gaaagcagcttctcacatttaatgg

SEQ ID NO: 408299 - DNA, 25 bp, Mus musculus
gaaagcagctttctaggtctagcaa

SEQ ID NO: 408300 - DNA, 25 bp, Mus musculus
gaaagcagctttgtaggtctagcaa

SEQ ID NO: 408301 - DNA, 25 bp, Mus musculus
gaaagcaggcatatacaacttagaa

SEQ ID NO: 408302 - DNA, 25 bp, Mus musculus
gaaagcaggcatttacaacttagaa

SEQ ID NO: 408303 - DNA, 25 bp, Mus musculus
gaaagcaggcccagaagtggagact

SEQ ID NO: 408304 - DNA, 25 bp, Mus musculus
gaaagcaggccctgaagtggagact

SEQ ID NO: 408305 - DNA, 25 bp, Mus musculus
gaaagcaggcctcctgctaaaggaa

SEQ ID NO: 408306 - DNA, 25 bp, Mus musculus
gaaagcaggcctgctgctaaaggaa

SEQ ID NO: 408307 - DNA, 25 bp, Mus musculus
gaaagcagggacaactggtgattga

SEQ ID NO: 408308 - DNA, 25 bp, Mus musculus
gaaagcagggactactggtgattga

SEQ ID NO: 408309 - DNA, 25 bp, Mus musculus
gaaagcagggcacacattgcgatcc

SEQ ID NO: 408310 - DNA, 25 bp, Mus musculus
gaaagcagggcagacattgcgatcc

SEQ ID NO: 408311 - DNA, 25 bp, Mus musculus
gaaagcagggtgaatctttcccctt

SEQ ID NO: 408312 - DNA, 25 bp, Mus musculus
gaaagcagggtgtatctttcccctt

SEQ ID NO: 408313 - DNA, 25 bp, Mus musculus
gaaagcaggtaaactcgtggatttt

SEQ ID NO: 408314 - DNA, 25 bp, Mus musculus
gaaagcaggtaatctcgtggatttt

SEQ ID NO: 408315 - DNA, 25 bp, Mus musculus
gaaagcaggtttcactcactcaggc

SEQ ID NO: 408316 - DNA, 25 bp, Mus musculus
gaaagcaggtttcgcaggaagaaca

SEQ ID NO: 408317 - DNA, 25 bp, Mus musculus
gaaagcaggtttgactcactcaggc

SEQ ID NO: 408318 - DNA, 25 bp, Mus musculus
gaaagcaggtttggcaggaagaaca

SEQ ID NO: 408319 - DNA, 25 bp, Mus musculus
gaaagcagtaacatccaggaaactt

SEQ ID NO: 408320 - DNA, 25 bp, Mus musculus
gaaagcagtaacttccaggaaactt

SEQ ID NO: 408321 - DNA, 25 bp, Mus musculus
gaaagcagtaatccttcaggccaag

SEQ ID NO: 408322 - DNA, 25 bp, Mus musculus
gaaagcagtaatgcttcaggccaag

SEQ ID NO: 408323 - DNA, 25 bp, Mus musculus
gaaagcagtcagagtagcctcccaa

SEQ ID NO: 408324 - DNA, 25 bp, Mus musculus
gaaagcagtcagtgtagcctcccaa

SEQ ID NO: 408325 - DNA, 25 bp, Mus musculus
gaaagcagtcctagaaagcaatcct

SEQ ID NO: 408326 - DNA, 25 bp, Mus musculus
gaaagcagtccttgaaagcaatcct

SEQ ID NO: 408327 - DNA, 25 bp, Mus musculus
gaaagcagtcgcaagtaaaatccta

SEQ ID NO: 408328 - DNA, 25 bp, Mus musculus
gaaagcagtcgctagtaaaatccta

SEQ ID NO: 408329 - DNA, 25 bp, Mus musculus
gaaagcataaatactacgctgctag

SEQ ID NO: 408330 - DNA, 25 bp, Mus musculus
gaaagcataaattctacgctgctag

SEQ ID NO: 408331 - DNA, 25 bp, Mus musculus
gaaagcatacaacaccgtgatcaag

SEQ ID NO: 408332 - DNA, 25 bp, Mus musculus
gaaagcatacaagaccgtgatcaag

SEQ ID NO: 408333 - DNA, 25 bp, Mus musculus
gaaagcatacccatttgtgttcgta

SEQ ID NO: 408334 - DNA, 25 bp, Mus musculus
gaaagcatacccttttgtgttcgta

SEQ ID NO: 408335 - DNA, 25 bp, Mus musculus
gaaagcatacctatgaatttaagta

SEQ ID NO: 408336 - DNA, 25 bp, Mus musculus
gaaagcatacctttgaatttaagta

SEQ ID NO: 408337 - DNA, 25 bp, Mus musculus
gaaagcatactgatagcctccatgg

SEQ ID NO: 408338 - DNA, 25 bp, Mus musculus
gaaagcatactgttagcctccatgg

SEQ ID NO: 408339 - DNA, 25 bp, Mus musculus
gaaagcatacttcacaataatggat

SEQ ID NO: 408340 - DNA, 25 bp, Mus musculus
gaaagcatacttgacaataatggat

SEQ ID NO: 408341 - DNA, 25 bp, Mus musculus
gaaagcatagtaaaaacaggcattt

SEQ ID NO: 408342 - DNA, 25 bp, Mus musculus
gaaagcatagtataaacaggcattt

SEQ ID NO: 408343 - DNA, 25 bp, Mus musculus
gaaagcatattcacaggcctctact

SEQ ID NO: 408344 - DNA, 25 bp, Mus musculus
gaaagcatattctcaggcctctact

SEQ ID NO: 408345 - DNA, 25 bp, Mus musculus
gaaagcatcatacctcctgaaagaa

SEQ ID NO: 408346 - DNA, 25 bp, Mus musculus
gaaagcatcatagctcctgaaagaa

SEQ ID NO: 408347 - DNA, 25 bp, Mus musculus
gaaagcatcattatgtgtatactaa

SEQ ID NO: 408348 - DNA, 25 bp, Mus musculus
gaaagcatcattttgtgtatactaa

SEQ ID NO: 408349 - DNA, 25 bp, Mus musculus
gaaagcatccacagtcaccaaggcc

SEQ ID NO: 408350 - DNA, 25 bp, Mus musculus
gaaagcatccactgtcaccaaggcc

SEQ ID NO: 408351 - DNA, 25 bp, Mus musculus
gaaagcatccatcgcttagctattg

SEQ ID NO: 408352 - DNA, 25 bp, Mus musculus
gaaagcatccatggcttagctattg

SEQ ID NO: 408353 - DNA, 25 bp, Mus musculus
gaaagcatccctcacattgaagccc

SEQ ID NO: 408354 - DNA, 25 bp, Mus musculus
gaaagcatccctgacattgaagccc

SEQ ID NO: 408355 - DNA, 25 bp, Mus musculus
gaaagcatccgcagcagggaagaga

SEQ ID NO: 408356 - DNA, 25 bp, Mus musculus
gaaagcatccgctgcagggaagaga

SEQ ID NO: 408357 - DNA, 25 bp, Mus musculus
gaaagcatccggaagtttccatact

SEQ ID NO: 408358 - DNA, 25 bp, Mus musculus
gaaagcatccggtagtttccatact

SEQ ID NO: 408359 - DNA, 25 bp, Mus musculus
gaaagcatcctacttctcaacttaa

SEQ ID NO: 408360 - DNA, 25 bp, Mus musculus
gaaagcatcctagttctcaacttaa

SEQ ID NO: 408361 - DNA, 25 bp, Mus musculus
gaaagcatcggtccctagcagcact

SEQ ID NO: 408362 - DNA, 25 bp, Mus musculus
gaaagcatcggtgcctagcagcact

SEQ ID NO: 408363 - DNA, 25 bp, Mus musculus
gaaagcatctaactggcctgccttt

SEQ ID NO: 408364 - DNA, 25 bp, Mus musculus
gaaagcatctaagtggcctgccttt

SEQ ID NO: 408365 - DNA, 25 bp, Mus musculus
gaaagcatgcaaaacgcccaagatg

SEQ ID NO: 408366 - DNA, 25 bp, Mus musculus
gaaagcatgcaatacgcccaagatg

SEQ ID NO: 408367 - DNA, 25 bp, Mus musculus
gaaagcatgctaccatctgggctat

SEQ ID NO: 408368 - DNA, 25 bp, Mus musculus
gaaagcatgctagcatctgggctat

SEQ ID NO: 408369 - DNA, 25 bp, Mus musculus
gaaagcatggaaatgtagcacacaa

SEQ ID NO: 408370 - DNA, 25 bp, Mus musculus
gaaagcatggaattgtagcacacaa

SEQ ID NO: 408371 - DNA, 25 bp, Mus musculus
gaaagcatggtcacaggacccttct

SEQ ID NO: 408372 - DNA, 25 bp, Mus musculus
gaaagcatggtctcaggacccttct

SEQ ID NO: 408373 - DNA, 25 bp, Mus musculus
gaaagcatgtcaacttgtttactgt

SEQ ID NO: 408374 - DNA, 25 bp, Mus musculus
gaaagcatgtcatcttgtttactgt

SEQ ID NO: 408375 - DNA, 25 bp, Mus musculus
gaaagcatgtcccagaaatgttcta

SEQ ID NO: 408376 - DNA, 25 bp, Mus musculus
gaaagcatgtccgagaaatgttcta

SEQ ID NO: 408377 - DNA, 25 bp, Mus musculus
gaaagcatgtgcagtccacaggaaa

SEQ ID NO: 408378 - DNA, 25 bp, Mus musculus
gaaagcatgtgctgtccacaggaaa

SEQ ID NO: 408379 - DNA, 25 bp, Mus musculus
gaaagcattcaaaatgtggccagtt

SEQ ID NO: 408380 - DNA, 25 bp, Mus musculus
gaaagcattcaatatgtggccagtt

SEQ ID NO: 408381 - DNA, 25 bp, Mus musculus
gaaagcattcccaggtagctacttt

SEQ ID NO: 408382 - DNA, 25 bp, Mus musculus
gaaagcattccctggtagctacttt

SEQ ID NO: 408383 - DNA, 25 bp, Mus musculus
gaaagcattctgaaaagacatgatt

SEQ ID NO: 408384 - DNA, 25 bp, Mus musculus
gaaagcattctgattgtagtctgaa

SEQ ID NO: 408385 - DNA, 25 bp, Mus musculus
gaaagcattctgtaaagacatgatt

SEQ ID NO: 408386 - DNA, 25 bp, Mus musculus
gaaagcattctgtttgtagtctgaa

SEQ ID NO: 408387 - DNA, 25 bp, Mus musculus
gaaagcattgacatcttcacttaag

SEQ ID NO: 408388 - DNA, 25 bp, Mus musculus
gaaagcattgacttcttcacttaag

SEQ ID NO: 408389 - DNA, 25 bp, Mus musculus
gaaagcattgctattatcctcataa

SEQ ID NO: 408390 - DNA, 25 bp, Mus musculus
gaaagcattgcttttatcctcataa

SEQ ID NO: 408391 - DNA, 25 bp, Mus musculus
gaaagcattggacatttccccagcc

SEQ ID NO: 408392 - DNA, 25 bp, Mus musculus
gaaagcattggagatttccccagcc

SEQ ID NO: 408393 - DNA, 25 bp, Mus musculus
gaaagcattgtccatactacagtag

SEQ ID NO: 408394 - DNA, 25 bp, Mus musculus
gaaagcattgtcgatactacagtag

SEQ ID NO: 408395 - DNA, 25 bp, Mus musculus
gaaagcatttccctatccatgctat

SEQ ID NO: 408396 - DNA, 25 bp, Mus musculus
gaaagcatttccgtatccatgctat

SEQ ID NO: 408397 - DNA, 25 bp, Mus musculus
gaaagcatttctctctgatcttgcc

SEQ ID NO: 408398 - DNA, 25 bp, Mus musculus
gaaagcatttctgtctgatcttgcc

SEQ ID NO: 408399 - DNA, 25 bp, Mus musculus
gaaagcatttgcacgtggctgtgcc

SEQ ID NO: 408400 - DNA, 25 bp, Mus musculus
gaaagcatttgctcgtggctgtgcc

SEQ ID NO: 408401 - DNA, 25 bp, Mus musculus
gaaagcatttggactagaagagccc

SEQ ID NO: 408402 - DNA, 25 bp, Mus musculus
gaaagcatttggtctagaagagccc

SEQ ID NO: 408403 - DNA, 25 bp, Mus musculus
gaaagccaacaaccgtaagtcggaa

SEQ ID NO: 408404 - DNA, 25 bp, Mus musculus
gaaagccaacaagcgtaagtcggaa

SEQ ID NO: 408405 - DNA, 25 bp, Mus musculus
gaaagccaacacacatgactgcatc

SEQ ID NO: 408406 - DNA, 25 bp, Mus musculus
gaaagccaacactcatgactgcatc

SEQ ID NO: 408407 - DNA, 25 bp, Mus musculus
gaaagccaaccaataagctactaag

SEQ ID NO: 408408 - DNA, 25 bp, Mus musculus
gaaagccaaccaatgaatccctgtt

SEQ ID NO: 408409 - DNA, 25 bp, Mus musculus
gaaagccaaccattaagctactaag

SEQ ID NO: 408410 - DNA, 25 bp, Mus musculus
gaaagccaaccattgaatccctgtt

SEQ ID NO: 408411 - DNA, 25 bp, Mus musculus
gaaagccaacttccacaatcacgga

SEQ ID NO: 408412 - DNA, 25 bp, Mus musculus
gaaagccaacttgcacaatcacgga

SEQ ID NO: 408413 - DNA, 25 bp, Mus musculus
gaaagccaagaactgactctcctca

SEQ ID NO: 408414 - DNA, 25 bp, Mus musculus
gaaagccaagaagtgactctcctca

SEQ ID NO: 408415 - DNA, 25 bp, Mus musculus
gaaagccaagcaaccagaaaataaa

SEQ ID NO: 408416 - DNA, 25 bp, Mus musculus
gaaagccaagcaccctatcattgga

SEQ ID NO: 408417 - DNA, 25 bp, Mus musculus
gaaagccaagcagcctatcattgga

SEQ ID NO: 408418 - DNA, 25 bp, Mus musculus
gaaagccaagcatccagaaaataaa

SEQ ID NO: 408419 - DNA, 25 bp, Mus musculus
gaaagccaagctctaactaagccaa

SEQ ID NO: 408420 - DNA, 25 bp, Mus musculus
gaaagccaagctgtaactaagccaa

SEQ ID NO: 408421 - DNA, 25 bp, Mus musculus
gaaagccaagtcagagtgtcatatc

SEQ ID NO: 408422 - DNA, 25 bp, Mus musculus
gaaagccaagtctgagtgtcatatc

SEQ ID NO: 408423 - DNA, 25 bp, Mus musculus
gaaagccaataccagggtttcccag

SEQ ID NO: 408424 - DNA, 25 bp, Mus musculus
gaaagccaatacgagggtttcccag

SEQ ID NO: 408425 - DNA, 25 bp, Mus musculus
gaaagccacaaaatacttagactga

SEQ ID NO: 408426 - DNA, 25 bp, Mus musculus
gaaagccacaaattacttagactga

SEQ ID NO: 408427 - DNA, 25 bp, Mus musculus
gaaagccacacaccggcaggagaca

SEQ ID NO: 408428 - DNA, 25 bp, Mus musculus
gaaagccacacagcggcaggagaca

SEQ ID NO: 408429 - DNA, 25 bp, Mus musculus
gaaagccacagtcttaagcctccag

SEQ ID NO: 408430 - DNA, 25 bp, Mus musculus
gaaagccacagtgttaagcctccag

SEQ ID NO: 408431 - DNA, 25 bp, Mus musculus
gaaagccacatcagcattctaattt

SEQ ID NO: 408432 - DNA, 25 bp, Mus musculus
gaaagccacatctgcattctaattt

SEQ ID NO: 408433 - DNA, 25 bp, Mus musculus
gaaagccacgctagagattcataat

SEQ ID NO: 408434 - DNA, 25 bp, Mus musculus
gaaagccacgcttgagattcataat

SEQ ID NO: 408435 - DNA, 25 bp, Mus musculus
gaaagccacgtgactatgggtcaga

SEQ ID NO: 408436 - DNA, 25 bp, Mus musculus
gaaagccacgtgtctatgggtcaga

SEQ ID NO: 408437 - DNA, 25 bp, Mus musculus
gaaagccactcactgtacaaactat

SEQ ID NO: 408438 - DNA, 25 bp, Mus musculus
gaaagccactcagtgtacaaactat

SEQ ID NO: 408439 - DNA, 25 bp, Mus musculus
gaaagccactgacagggacgtcctc

SEQ ID NO: 408440 - DNA, 25 bp, Mus musculus
gaaagccactgacagtcctcgtgag

SEQ ID NO: 408441 - DNA, 25 bp, Mus musculus
gaaagccactgagagggacgtcctc

SEQ ID NO: 408442 - DNA, 25 bp, Mus musculus
gaaagccactgagagtcctcgtgag

SEQ ID NO: 408443 - DNA, 25 bp, Mus musculus
gaaagccactggcaaggcaggatta

SEQ ID NO: 408444 - DNA, 25 bp, Mus musculus
gaaagccactgggaaggcaggatta

SEQ ID NO: 408445 - DNA, 25 bp, Mus musculus
gaaagccagaccagcgctggaggac

SEQ ID NO: 408446 - DNA, 25 bp, Mus musculus
gaaagccagacctgcgctggaggac

SEQ ID NO: 408447 - DNA, 25 bp, Mus musculus
gaaagccagactacaaagagacaag

SEQ ID NO: 408448 - DNA, 25 bp, Mus musculus
gaaagccagactagacagtcaacag

SEQ ID NO: 408449 - DNA, 25 bp, Mus musculus
gaaagccagactatttgagatttta

SEQ ID NO: 408450 - DNA, 25 bp, Mus musculus
gaaagccagacttcaaagagacaag

SEQ ID NO: 408451 - DNA, 25 bp, Mus musculus
gaaagccagacttgacagtcaacag

SEQ ID NO: 408452 - DNA, 25 bp, Mus musculus
gaaagccagactttttgagatttta

SEQ ID NO: 408453 - DNA, 25 bp, Mus musculus
gaaagccagaggctttcccctgcga

SEQ ID NO: 408454 - DNA, 25 bp, Mus musculus
gaaagccagagggtttcccctgcga

SEQ ID NO: 408455 - DNA, 25 bp, Mus musculus
gaaagccagatcatccactgtattc

SEQ ID NO: 408456 - DNA, 25 bp, Mus musculus
gaaagccagatcttccactgtattc

SEQ ID NO: 408457 - DNA, 25 bp, Mus musculus
gaaagccagatgaggtagctctgaa

SEQ ID NO: 408458 - DNA, 25 bp, Mus musculus
gaaagccagatgtggtagctctgaa

SEQ ID NO: 408459 - DNA, 25 bp, Mus musculus
gaaagccagcacatctgtgaaatta

SEQ ID NO: 408460 - DNA, 25 bp, Mus musculus
gaaagccagcacttctgtgaaatta

SEQ ID NO: 408461 - DNA, 25 bp, Mus musculus
gaaagccagcccaacgttgtccagg

SEQ ID NO: 408462 - DNA, 25 bp, Mus musculus
gaaagccagccctacgttgtccagg

SEQ ID NO: 408463 - DNA, 25 bp, Mus musculus
gaaagccagctgatccttgtgaaaa

SEQ ID NO: 408464 - DNA, 25 bp, Mus musculus
gaaagccagctgttccttgtgaaaa

SEQ ID NO: 408465 - DNA, 25 bp, Mus musculus
gaaagccaggaaaaagatgtcacaa

SEQ ID NO: 408466 - DNA, 25 bp, Mus musculus
gaaagccaggaataagatgtcacaa

SEQ ID NO: 408467 - DNA, 25 bp, Mus musculus
gaaagccaggacatcgtgaatcaag

SEQ ID NO: 408468 - DNA, 25 bp, Mus musculus
gaaagccaggacttcgtgaatcaag

SEQ ID NO: 408469 - DNA, 25 bp, Mus musculus
gaaagccaggccctagcagagactc

SEQ ID NO: 408470 - DNA, 25 bp, Mus musculus
gaaagccaggccgtagcagagactc

SEQ ID NO: 408471 - DNA, 25 bp, Mus musculus
gaaagccaggcgacttgtggtacac

SEQ ID NO: 408472 - DNA, 25 bp, Mus musculus
gaaagccaggcgtcttgtggtacac

SEQ ID NO: 408473 - DNA, 25 bp, Mus musculus
gaaagccaggctaaggagtcatcag

SEQ ID NO: 408474 - DNA, 25 bp, Mus musculus
gaaagccaggctactgcctgaaggg

SEQ ID NO: 408475 - DNA, 25 bp, Mus musculus
gaaagccaggcttaggagtcatcag

SEQ ID NO: 408476 - DNA, 25 bp, Mus musculus
gaaagccaggcttctgcctgaaggg

SEQ ID NO: 408477 - DNA, 25 bp, Mus musculus
gaaagccaggtaacacaccccagtc

SEQ ID NO: 408478 - DNA, 25 bp, Mus musculus
gaaagccaggtatcacaccccagtc

SEQ ID NO: 408479 - DNA, 25 bp, Mus musculus
gaaagccaggtgctagcaacagaca

SEQ ID NO: 408480 - DNA, 25 bp, Mus musculus
gaaagccaggtggtagcaacagaca

SEQ ID NO: 408481 - DNA, 25 bp, Mus musculus
gaaagccagtgaccctattaaccgt

SEQ ID NO: 408482 - DNA, 25 bp, Mus musculus
gaaagccagtgactgtcgtagacca

SEQ ID NO: 408483 - DNA, 25 bp, Mus musculus
gaaagccagtgagcctattaaccgt

SEQ ID NO: 408484 - DNA, 25 bp, Mus musculus
gaaagccagtgagtgtcgtagacca

SEQ ID NO: 408485 - DNA, 25 bp, Mus musculus
gaaagccataaaccaagcttgaata

SEQ ID NO: 408486 - DNA, 25 bp, Mus musculus
gaaagccataaagcaagcttgaata

SEQ ID NO: 408487 - DNA, 25 bp, Mus musculus
gaaagccataagcagagaactctat

SEQ ID NO: 408488 - DNA, 25 bp, Mus musculus
gaaagccataaggagagaactctat

SEQ ID NO: 408489 - DNA, 25 bp, Mus musculus
gaaagccatagcatagctcccagaa

SEQ ID NO: 408490 - DNA, 25 bp, Mus musculus
gaaagccatagcttagctcccagaa

SEQ ID NO: 408491 - DNA, 25 bp, Mus musculus
gaaagccatcaaagcctgagtgggc

SEQ ID NO: 408492 - DNA, 25 bp, Mus musculus
gaaagccatcaaccatgctgttgtg

SEQ ID NO: 408493 - DNA, 25 bp, Mus musculus
gaaagccatcaacgtccctcagagg

SEQ ID NO: 408494 - DNA, 25 bp, Mus musculus
gaaagccatcaagcatgctgttgtg

SEQ ID NO: 408495 - DNA, 25 bp, Mus musculus
gaaagccatcaaggtccctcagagg

SEQ ID NO: 408496 - DNA, 25 bp, Mus musculus
gaaagccatcaatgcctgagtgggc

SEQ ID NO: 408497 - DNA, 25 bp, Mus musculus
gaaagccatcacctggtcactgttg

SEQ ID NO: 408498 - DNA, 25 bp, Mus musculus
gaaagccatcacgtggtcactgttg

SEQ ID NO: 408499 - DNA, 25 bp, Mus musculus
gaaagccatccaaccaaggtgcctt

SEQ ID NO: 408500 - DNA, 25 bp, Mus musculus
gaaagccatccatccaaggtgcctt

SEQ ID NO: 408501 - DNA, 25 bp, Mus musculus
gaaagccatcccacacatggttaaa

SEQ ID NO: 408502 - DNA, 25 bp, Mus musculus
gaaagccatccctcacatggttaaa

SEQ ID NO: 408503 - DNA, 25 bp, Mus musculus
gaaagccatcctcatgtattcactc

SEQ ID NO: 408504 - DNA, 25 bp, Mus musculus
gaaagccatcctgatgtattcactc

SEQ ID NO: 408505 - DNA, 25 bp, Mus musculus
gaaagccatcgacagtcccaacaaa

SEQ ID NO: 408506 - DNA, 25 bp, Mus musculus
gaaagccatcgagagtcccaacaaa

SEQ ID NO: 408507 - DNA, 25 bp, Mus musculus
gaaagccatcgcagaccacatcaga

SEQ ID NO: 408508 - DNA, 25 bp, Mus musculus
gaaagccatcgctgaccacatcaga

SEQ ID NO: 408509 - DNA, 25 bp, Mus musculus
gaaagccatgagcatttaccacaga

SEQ ID NO: 408510 - DNA, 25 bp, Mus musculus
gaaagccatgaggatttaccacaga

SEQ ID NO: 408511 - DNA, 25 bp, Mus musculus
gaaagccatgatccagcaaagcaat

SEQ ID NO: 408512 - DNA, 25 bp, Mus musculus
gaaagccatgatgcagcaaagcaat

SEQ ID NO: 408513 - DNA, 25 bp, Mus musculus
gaaagccatgccagaattaccaaat

SEQ ID NO: 408514 - DNA, 25 bp, Mus musculus
gaaagccatgccatgtgtgtcccga

SEQ ID NO: 408515 - DNA, 25 bp, Mus musculus
gaaagccatgcctgaattaccaaat

SEQ ID NO: 408516 - DNA, 25 bp, Mus musculus
gaaagccatgccttgtgtgtcccga

SEQ ID NO: 408517 - DNA, 25 bp, Mus musculus
gaaagccatgcgagtccgtgtatat

SEQ ID NO: 408518 - DNA, 25 bp, Mus musculus
gaaagccatgcgtgtccgtgtatat

SEQ ID NO: 408519 - DNA, 25 bp, Mus musculus
gaaagccattctactggctatacaa

SEQ ID NO: 408520 - DNA, 25 bp, Mus musculus
gaaagccattcttctggctatacaa

SEQ ID NO: 408521 - DNA, 25 bp, Mus musculus
gaaagccatttcacttttattgcag

SEQ ID NO: 408522 - DNA, 25 bp, Mus musculus
gaaagccatttcatcctatcaaaaa

SEQ ID NO: 408523 - DNA, 25 bp, Mus musculus
gaaagccatttctcttttattgcag

SEQ ID NO: 408524 - DNA, 25 bp, Mus musculus
gaaagccatttcttcctatcaaaaa

SEQ ID NO: 408525 - DNA, 25 bp, Mus musculus
gaaagccatttgagagtgcttggag

SEQ ID NO: 408526 - DNA, 25 bp, Mus musculus
gaaagccatttgtgagtgcttggag

SEQ ID NO: 408527 - DNA, 25 bp, Mus musculus
gaaagcccaaggaggattaccagca

SEQ ID NO: 408528 - DNA, 25 bp, Mus musculus
gaaagcccaaggtggattaccagca

SEQ ID NO: 408529 - DNA, 25 bp, Mus musculus
gaaagcccacagaactctagccaat

SEQ ID NO: 408530 - DNA, 25 bp, Mus musculus
gaaagcccacagtactctagccaat

SEQ ID NO: 408531 - DNA, 25 bp, Mus musculus
gaaagcccacctctaggttctgttt

SEQ ID NO: 408532 - DNA, 25 bp, Mus musculus
gaaagcccacctgtaggttctgttt

SEQ ID NO: 408533 - DNA, 25 bp, Mus musculus
gaaagcccacgccttcctggagaga

SEQ ID NO: 408534 - DNA, 25 bp, Mus musculus
gaaagcccacgcgttcctggagaga

SEQ ID NO: 408535 - DNA, 25 bp, Mus musculus
gaaagcccacgtactgtcacagctg

SEQ ID NO: 408536 - DNA, 25 bp, Mus musculus
gaaagcccacgttctgtcacagctg

SEQ ID NO: 408537 - DNA, 25 bp, Mus musculus
gaaagcccagctcaagatctacacc

SEQ ID NO: 408538 - DNA, 25 bp, Mus musculus
gaaagcccagctgaagatctacacc

SEQ ID NO: 408539 - DNA, 25 bp, Mus musculus
gaaagccccaagcttctaataactg

SEQ ID NO: 408540 - DNA, 25 bp, Mus musculus
gaaagccccaaggttctaataactg

SEQ ID NO: 408541 - DNA, 25 bp, Mus musculus
gaaagccccagacttgtgttgtgtg

SEQ ID NO: 408542 - DNA, 25 bp, Mus musculus
gaaagccccagagttgtgttgtgtg

SEQ ID NO: 408543 - DNA, 25 bp, Mus musculus
gaaagccccagtaaattccgtatgg

SEQ ID NO: 408544 - DNA, 25 bp, Mus musculus
gaaagccccagttaattccgtatgg

SEQ ID NO: 408545 - DNA, 25 bp, Mus musculus
gaaagccccatcaatctgttgatta

SEQ ID NO: 408546 - DNA, 25 bp, Mus musculus
gaaagccccatctatctgttgatta

SEQ ID NO: 408547 - DNA, 25 bp, Mus musculus
gaaagcccctggcttccctgtgatg

SEQ ID NO: 408548 - DNA, 25 bp, Mus musculus
gaaagcccctgggttccctgtgatg

SEQ ID NO: 408549 - DNA, 25 bp, Mus musculus
gaaagcccgcttacatagtgatctg

SEQ ID NO: 408550 - DNA, 25 bp, Mus musculus
gaaagcccgctttcatagtgatctg

SEQ ID NO: 408551 - DNA, 25 bp, Mus musculus
gaaagccctaagactaaaactgttg

SEQ ID NO: 408552 - DNA, 25 bp, Mus musculus
gaaagccctaagtctaaaactgttg

SEQ ID NO: 408553 - DNA, 25 bp, Mus musculus
gaaagccctattcgtgaaacttctt

SEQ ID NO: 408554 - DNA, 25 bp, Mus musculus
gaaagccctattggtgaaacttctt

SEQ ID NO: 408555 - DNA, 25 bp, Mus musculus
gaaagccctcagaaacaagttgatc

SEQ ID NO: 408556 - DNA, 25 bp, Mus musculus
gaaagccctcagtaacaagttgatc

SEQ ID NO: 408557 - DNA, 25 bp, Mus musculus
gaaagccctccacaaaagaagtccg

SEQ ID NO: 408558 - DNA, 25 bp, Mus musculus
gaaagccctccagaaaagaagtccg

SEQ ID NO: 408559 - DNA, 25 bp, Mus musculus
gaaagccctctgcacgatctagtga

SEQ ID NO: 408560 - DNA, 25 bp, Mus musculus
gaaagccctctggacgatctagtga

SEQ ID NO: 408561 - DNA, 25 bp, Mus musculus
gaaagccctgcaaggcttgctgagt

SEQ ID NO: 408562 - DNA, 25 bp, Mus musculus
gaaagccctgcaagtttataaatct

SEQ ID NO: 408563 - DNA, 25 bp, Mus musculus
gaaagccctgcatggcttgctgagt

SEQ ID NO: 408564 - DNA, 25 bp, Mus musculus
gaaagccctgcatgtttataaatct

SEQ ID NO: 408565 - DNA, 25 bp, Mus musculus
gaaagccctgccataattgtggtgt

SEQ ID NO: 408566 - DNA, 25 bp, Mus musculus
gaaagccctgccttaattgtggtgt

SEQ ID NO: 408567 - DNA, 25 bp, Mus musculus
gaaagccctgctctcatgaaaaata

SEQ ID NO: 408568 - DNA, 25 bp, Mus musculus
gaaagccctgctgtcatgaaaaata

SEQ ID NO: 408569 - DNA, 25 bp, Mus musculus
gaaagccctggcagcggctggttac

SEQ ID NO: 408570 - DNA, 25 bp, Mus musculus
gaaagccctggctgcggctggttac

SEQ ID NO: 408571 - DNA, 25 bp, Mus musculus
gaaagccctggtactgtgaattcac

SEQ ID NO: 408572 - DNA, 25 bp, Mus musculus
gaaagccctggttctgtgaattcac

SEQ ID NO: 408573 - DNA, 25 bp, Mus musculus
gaaagcccttgaaggcctagaggta

SEQ ID NO: 408574 - DNA, 25 bp, Mus musculus
gaaagcccttgaagtttgttgcatg

SEQ ID NO: 408575 - DNA, 25 bp, Mus musculus
gaaagcccttgatggcctagaggta

SEQ ID NO: 408576 - DNA, 25 bp, Mus musculus
gaaagcccttgatgtttgttgcatg

SEQ ID NO: 408577 - DNA, 25 bp, Mus musculus
gaaagccctttacaatgtgaaaagc

SEQ ID NO: 408578 - DNA, 25 bp, Mus musculus
gaaagccctttagaatgtgaaaagc

SEQ ID NO: 408579 - DNA, 25 bp, Mus musculus
gaaagccctttcattttagctacca

SEQ ID NO: 408580 - DNA, 25 bp, Mus musculus
gaaagccctttctttttagctacca

SEQ ID NO: 408581 - DNA, 25 bp, Mus musculus
gaaagccgaagaagcccaactccgc

SEQ ID NO: 408582 - DNA, 25 bp, Mus musculus
gaaagccgaagatgcccaactccgc

SEQ ID NO: 408583 - DNA, 25 bp, Mus musculus
gaaagccgaagccacctatagatgt

SEQ ID NO: 408584 - DNA, 25 bp, Mus musculus
gaaagccgaagcgacctatagatgt

SEQ ID NO: 408585 - DNA, 25 bp, Mus musculus
gaaagccgagccaacttcaatgcta

SEQ ID NO: 408586 - DNA, 25 bp, Mus musculus
gaaagccgagcctacttcaatgcta

SEQ ID NO: 408587 - DNA, 25 bp, Mus musculus
gaaagccgccagagtcatcaaccag

SEQ ID NO: 408588 - DNA, 25 bp, Mus musculus
gaaagccgccagtgtcatcaaccag

SEQ ID NO: 408589 - DNA, 25 bp, Mus musculus
gaaagccgcctacgtgttgttctat

SEQ ID NO: 408590 - DNA, 25 bp, Mus musculus
gaaagccgcctaggtgttgttctat

SEQ ID NO: 408591 - DNA, 25 bp, Mus musculus
gaaagccggcaactgctgctgctgc

SEQ ID NO: 408592 - DNA, 25 bp, Mus musculus
gaaagccggcaagtgctgctgctgc

SEQ ID NO: 408593 - DNA, 25 bp, Mus musculus
gaaagccggccaacagaaaaccctg

SEQ ID NO: 408594 - DNA, 25 bp, Mus musculus
gaaagccggccatcagaaaaccctg

SEQ ID NO: 408595 - DNA, 25 bp, Mus musculus
gaaagccggcctcgaaagtacgttg

SEQ ID NO: 408596 - DNA, 25 bp, Mus musculus
gaaagccggcctggaaagtacgttg

SEQ ID NO: 408597 - DNA, 25 bp, Mus musculus
gaaagccggtacctgctgcgagcaa

SEQ ID NO: 408598 - DNA, 25 bp, Mus musculus
gaaagccggtacgtgctgcgagcaa

SEQ ID NO: 408599 - DNA, 25 bp, Mus musculus
gaaagccgtggtcccttaggagaca

SEQ ID NO: 408600 - DNA, 25 bp, Mus musculus
gaaagccgtggtgccttaggagaca

SEQ ID NO: 408601 - DNA, 25 bp, Mus musculus
gaaagccgtgtgaagtgactactgt

SEQ ID NO: 408602 - DNA, 25 bp, Mus musculus
gaaagccgtgtgtagtgactactgt

SEQ ID NO: 408603 - DNA, 25 bp, Mus musculus
gaaagccgtttaaagctcagttctg

SEQ ID NO: 408604 - DNA, 25 bp, Mus musculus
gaaagccgtttatagctcagttctg

SEQ ID NO: 408605 - DNA, 25 bp, Mus musculus
gaaagcctaaaaacaagctgccata

SEQ ID NO: 408606 - DNA, 25 bp, Mus musculus
gaaagcctaaaatcaagctgccata

SEQ ID NO: 408607 - DNA, 25 bp, Mus musculus
gaaagcctaacaactgaatgcgtgc

SEQ ID NO: 408608 - DNA, 25 bp, Mus musculus
gaaagcctaacatctgaatgcgtgc

SEQ ID NO: 408609 - DNA, 25 bp, Mus musculus
gaaagcctaatgatcctgaggatta

SEQ ID NO: 408610 - DNA, 25 bp, Mus musculus
gaaagcctaatgttcctgaggatta

SEQ ID NO: 408611 - DNA, 25 bp, Mus musculus
gaaagcctacaacacatggcctggg

SEQ ID NO: 408612 - DNA, 25 bp, Mus musculus
gaaagcctacaaccccatgtgctct

SEQ ID NO: 408613 - DNA, 25 bp, Mus musculus
gaaagcctacaactacctagctgcc

SEQ ID NO: 408614 - DNA, 25 bp, Mus musculus
gaaagcctacaagacatggcctggg

SEQ ID NO: 408615 - DNA, 25 bp, Mus musculus
gaaagcctacaagcccatgtgctct

SEQ ID NO: 408616 - DNA, 25 bp, Mus musculus
gaaagcctacaagtacctagctgcc

SEQ ID NO: 408617 - DNA, 25 bp, Mus musculus
gaaagcctacagctgtccacagagt

SEQ ID NO: 408618 - DNA, 25 bp, Mus musculus
gaaagcctacaggtgtccacagagt

SEQ ID NO: 408619 - DNA, 25 bp, Mus musculus
gaaagcctactaataatccagatat

SEQ ID NO: 408620 - DNA, 25 bp, Mus musculus
gaaagcctactattaatccagatat

SEQ ID NO: 408621 - DNA, 25 bp, Mus musculus
gaaagcctagatagcgtctacatac

SEQ ID NO: 408622 - DNA, 25 bp, Mus musculus
gaaagcctagattgcgtctacatac

SEQ ID NO: 408623 - DNA, 25 bp, Mus musculus
gaaagcctaggaataccattgaatg

SEQ ID NO: 408624 - DNA, 25 bp, Mus musculus
gaaagcctaggattaccattgaatg

SEQ ID NO: 408625 - DNA, 25 bp, Mus musculus
gaaagcctatgaccactcatgacac

SEQ ID NO: 408626 - DNA, 25 bp, Mus musculus
gaaagcctatgagcactcatgacac

SEQ ID NO: 408627 - DNA, 25 bp, Mus musculus
gaaagcctattcaaaattgtgtagt

SEQ ID NO: 408628 - DNA, 25 bp, Mus musculus
gaaagcctattcagaggtggtcacc

SEQ ID NO: 408629 - DNA, 25 bp, Mus musculus
gaaagcctattctaaattgtgtagt

SEQ ID NO: 408630 - DNA, 25 bp, Mus musculus
gaaagcctattctgaggtggtcacc

SEQ ID NO: 408631 - DNA, 25 bp, Mus musculus
gaaagcctattgaccactttctacc

SEQ ID NO: 408632 - DNA, 25 bp, Mus musculus
gaaagcctattgtccactttctacc

SEQ ID NO: 408633 - DNA, 25 bp, Mus musculus
gaaagcctcaaaccctgtgttcgct

SEQ ID NO: 408634 - DNA, 25 bp, Mus musculus
gaaagcctcaaagcctgtgttcgct

SEQ ID NO: 408635 - DNA, 25 bp, Mus musculus
gaaagcctcaggaacagtgccaaac

SEQ ID NO: 408636 - DNA, 25 bp, Mus musculus
gaaagcctcaggacttaaattgttt

SEQ ID NO: 408637 - DNA, 25 bp, Mus musculus
gaaagcctcaggtacagtgccaaac

SEQ ID NO: 408638 - DNA, 25 bp, Mus musculus
gaaagcctcaggtcttaaattgttt

SEQ ID NO: 408639 - DNA, 25 bp, Mus musculus
gaaagcctccatagactattgcatg

SEQ ID NO: 408640 - DNA, 25 bp, Mus musculus
gaaagcctccattgactattgcatg

SEQ ID NO: 408641 - DNA, 25 bp, Mus musculus
gaaagcctcgctcgaagatgcctga

SEQ ID NO: 408642 - DNA, 25 bp, Mus musculus
gaaagcctcgctggaagatgcctga

SEQ ID NO: 408643 - DNA, 25 bp, Mus musculus
gaaagcctctgaagtgcgtcatcaa

SEQ ID NO: 408644 - DNA, 25 bp, Mus musculus
gaaagcctctgatgtgcgtcatcaa

SEQ ID NO: 408645 - DNA, 25 bp, Mus musculus
gaaagcctgaacatggcttcctgcc

SEQ ID NO: 408646 - DNA, 25 bp, Mus musculus
gaaagcctgaacttggcttcctgcc

SEQ ID NO: 408647 - DNA, 25 bp, Mus musculus
gaaagcctgaagacgcggtacaagc

SEQ ID NO: 408648 - DNA, 25 bp, Mus musculus
gaaagcctgaagctgcttcaccagg

SEQ ID NO: 408649 - DNA, 25 bp, Mus musculus
gaaagcctgaaggtgcttcaccagg

SEQ ID NO: 408650 - DNA, 25 bp, Mus musculus
gaaagcctgaagtcgcggtacaagc

SEQ ID NO: 408651 - DNA, 25 bp, Mus musculus
gaaagcctgcagacctctgacaagg

SEQ ID NO: 408652 - DNA, 25 bp, Mus musculus
gaaagcctgcagtcctctgacaagg

SEQ ID NO: 408653 - DNA, 25 bp, Mus musculus
gaaagcctgcctagctagaaatggt

SEQ ID NO: 408654 - DNA, 25 bp, Mus musculus
gaaagcctgccttgctagaaatggt

SEQ ID NO: 408655 - DNA, 25 bp, Mus musculus
gaaagcctgctcatactccgatggg

SEQ ID NO: 408656 - DNA, 25 bp, Mus musculus
gaaagcctgctcttactccgatggg

SEQ ID NO: 408657 - DNA, 25 bp, Mus musculus
gaaagcctgctgcaagactcctcca

SEQ ID NO: 408658 - DNA, 25 bp, Mus musculus
gaaagcctgctggaagactcctcca

SEQ ID NO: 408659 - DNA, 25 bp, Mus musculus
gaaagcctgcttattctgtttcctc

SEQ ID NO: 408660 - DNA, 25 bp, Mus musculus
gaaagcctgctttttctgtttcctc

SEQ ID NO: 408661 - DNA, 25 bp, Mus musculus
gaaagcctggagcaagaccctcctg

SEQ ID NO: 408662 - DNA, 25 bp, Mus musculus
gaaagcctggaggaagaccctcctg

SEQ ID NO: 408663 - DNA, 25 bp, Mus musculus
gaaagcctgtacatcgcatgatctc

SEQ ID NO: 408664 - DNA, 25 bp, Mus musculus
gaaagcctgtacttcgcatgatctc

SEQ ID NO: 408665 - DNA, 25 bp, Mus musculus
gaaagcctgtatctcttcgtttgcc

SEQ ID NO: 408666 - DNA, 25 bp, Mus musculus
gaaagcctgtatgtcttcgtttgcc

SEQ ID NO: 408667 - DNA, 25 bp, Mus musculus
gaaagcctgtttctaccaattgatt

SEQ ID NO: 408668 - DNA, 25 bp, Mus musculus
gaaagcctgtttgtaccaattgatt

SEQ ID NO: 408669 - DNA, 25 bp, Mus musculus
gaaagccttataatccgtacttggg

SEQ ID NO: 408670 - DNA, 25 bp, Mus musculus
gaaagccttatattccgtacttggg

SEQ ID NO: 408671 - DNA, 25 bp, Mus musculus
gaaagccttcagaaattctaagcta

SEQ ID NO: 408672 - DNA, 25 bp, Mus musculus
gaaagccttcagacaaagctcatcc

SEQ ID NO: 408673 - DNA, 25 bp, Mus musculus
gaaagccttcagtaattctaagcta

SEQ ID NO: 408674 - DNA, 25 bp, Mus musculus
gaaagccttcagtcaaagctcatcc

SEQ ID NO: 408675 - DNA, 25 bp, Mus musculus
gaaagccttctgacagagttcctct

SEQ ID NO: 408676 - DNA, 25 bp, Mus musculus
gaaagccttctgctgaagtgaactt

SEQ ID NO: 408677 - DNA, 25 bp, Mus musculus
gaaagccttctggtgaagtgaactt

SEQ ID NO: 408678 - DNA, 25 bp, Mus musculus
gaaagccttctgtcagagttcctct

SEQ ID NO: 408679 - DNA, 25 bp, Mus musculus
gaaagccttgccatgtagtcacata

SEQ ID NO: 408680 - DNA, 25 bp, Mus musculus
gaaagccttgccttgtagtcacata

SEQ ID NO: 408681 - DNA, 25 bp, Mus musculus
gaaagccttggaaggagtctcaatt

SEQ ID NO: 408682 - DNA, 25 bp, Mus musculus
gaaagccttggaatgtggtcctgaa

SEQ ID NO: 408683 - DNA, 25 bp, Mus musculus
gaaagccttggacttactggagtac

SEQ ID NO: 408684 - DNA, 25 bp, Mus musculus
gaaagccttggagttactggagtac

SEQ ID NO: 408685 - DNA, 25 bp, Mus musculus
gaaagccttggatggagtctcaatt

SEQ ID NO: 408686 - DNA, 25 bp, Mus musculus
gaaagccttggattgtggtcctgaa

SEQ ID NO: 408687 - DNA, 25 bp, Mus musculus
gaaagccttggcatatctcttcaga

SEQ ID NO: 408688 - DNA, 25 bp, Mus musculus
gaaagccttggcttatctcttcaga

SEQ ID NO: 408689 - DNA, 25 bp, Mus musculus
gaaagccttgtgaccaattcccatt

SEQ ID NO: 408690 - DNA, 25 bp, Mus musculus
gaaagccttgtgctcatgcactcag

SEQ ID NO: 408691 - DNA, 25 bp, Mus musculus
gaaagccttgtggtcatgcactcag

SEQ ID NO: 408692 - DNA, 25 bp, Mus musculus
gaaagccttgtgtccaattcccatt

SEQ ID NO: 408693 - DNA, 25 bp, Mus musculus
gaaagcctttagaagcagcatgtgt

SEQ ID NO: 408694 - DNA, 25 bp, Mus musculus
gaaagcctttagtagcagcatgtgt

SEQ ID NO: 408695 - DNA, 25 bp, Mus musculus
gaaagcctttcaagacaacttttac

SEQ ID NO: 408696 - DNA, 25 bp, Mus musculus
gaaagcctttcactgaactgtggaa

SEQ ID NO: 408697 - DNA, 25 bp, Mus musculus
gaaagcctttcagtgaactgtggaa

SEQ ID NO: 408698 - DNA, 25 bp, Mus musculus
gaaagcctttcatgacaacttttac

SEQ ID NO: 408699 - DNA, 25 bp, Mus musculus
gaaagcctttccatatttttgatga

SEQ ID NO: 408700 - DNA, 25 bp, Mus musculus
gaaagcctttccttatttttgatga

SEQ ID NO: 408701 - DNA, 25 bp, Mus musculus
gaaagcctttgtattaaagatgcac

SEQ ID NO: 408702 - DNA, 25 bp, Mus musculus
gaaagcctttgtcacctggcttaat

SEQ ID NO: 408703 - DNA, 25 bp, Mus musculus
gaaagcctttgtctattgccggttt

SEQ ID NO: 408704 - DNA, 25 bp, Mus musculus
gaaagcctttgtgacctggcttaat

SEQ ID NO: 408705 - DNA, 25 bp, Mus musculus
gaaagcctttgtgtattgccggttt

SEQ ID NO: 408706 - DNA, 25 bp, Mus musculus
gaaagcctttgttttaaagatgcac

SEQ ID NO: 408707 - DNA, 25 bp, Mus musculus
gaaagccttttcagcaaaacctgga

SEQ ID NO: 408708 - DNA, 25 bp, Mus musculus
gaaagccttttctgcaaaacctgga

SEQ ID NO: 408709 - DNA, 25 bp, Mus musculus
gaaagccttttgcttgctcttcata

SEQ ID NO: 408710 - DNA, 25 bp, Mus musculus
gaaagccttttggttgctcttcata

SEQ ID NO: 408711 - DNA, 25 bp, Mus musculus
gaaagcctttttccacagttgaccc

SEQ ID NO: 408712 - DNA, 25 bp, Mus musculus
gaaagcctttttgcacagttgaccc

SEQ ID NO: 408713 - DNA, 25 bp, Mus musculus
gaaagcgaaaacatgaggatccaaa

SEQ ID NO: 408714 - DNA, 25 bp, Mus musculus
gaaagcgaaaacttgaggatccaaa

SEQ ID NO: 408715 - DNA, 25 bp, Mus musculus
gaaagcgaaagacgtccccctggag

SEQ ID NO: 408716 - DNA, 25 bp, Mus musculus
gaaagcgaaagaggtccccctggag

SEQ ID NO: 408717 - DNA, 25 bp, Mus musculus
gaaagcgaactgcttgtttactgat

SEQ ID NO: 408718 - DNA, 25 bp, Mus musculus
gaaagcgaactggttgtttactgat

SEQ ID NO: 408719 - DNA, 25 bp, Mus musculus
gaaagcgaatggatcctctgctcag

SEQ ID NO: 408720 - DNA, 25 bp, Mus musculus
gaaagcgaatggttcctctgctcag

SEQ ID NO: 408721 - DNA, 25 bp, Mus musculus
gaaagcgagcaaccctgagtctgac

SEQ ID NO: 408722 - DNA, 25 bp, Mus musculus
gaaagcgagcaagcctgagtctgac

SEQ ID NO: 408723 - DNA, 25 bp, Mus musculus
gaaagcgagctaagaatgaatgtga

SEQ ID NO: 408724 - DNA, 25 bp, Mus musculus
gaaagcgagctatgaatgaatgtga

SEQ ID NO: 408725 - DNA, 25 bp, Mus musculus
gaaagcgatataacactcccgagat

SEQ ID NO: 408726 - DNA, 25 bp, Mus musculus
gaaagcgatatatcactcccgagat

SEQ ID NO: 408727 - DNA, 25 bp, Mus musculus
gaaagcgcaaccaccgctgatgaaa

SEQ ID NO: 408728 - DNA, 25 bp, Mus musculus
gaaagcgcaacctccgctgatgaaa

SEQ ID NO: 408729 - DNA, 25 bp, Mus musculus
gaaagcgcaagacacccatacagaa

SEQ ID NO: 408730 - DNA, 25 bp, Mus musculus
gaaagcgcaagagacccatacagaa

SEQ ID NO: 408731 - DNA, 25 bp, Mus musculus
gaaagcgcacagacacaaggtcctt

SEQ ID NO: 408732 - DNA, 25 bp, Mus musculus
gaaagcgcacagtcacaaggtcctt

SEQ ID NO: 408733 - DNA, 25 bp, Mus musculus
gaaagcgcagacaggcttgcctatg

SEQ ID NO: 408734 - DNA, 25 bp, Mus musculus
gaaagcgcagactggcttgcctatg

SEQ ID NO: 408735 - DNA, 25 bp, Mus musculus
gaaagcgcatgtccagcgcctgtgt

SEQ ID NO: 408736 - DNA, 25 bp, Mus musculus
gaaagcgcatgtgcagcgcctgtgt

SEQ ID NO: 408737 - DNA, 25 bp, Mus musculus
gaaagcgccactcaacccaaaggag

SEQ ID NO: 408738 - DNA, 25 bp, Mus musculus
gaaagcgccactgaacccaaaggag

SEQ ID NO: 408739 - DNA, 25 bp, Mus musculus
gaaagcgccagcatgatccagaggc

SEQ ID NO: 408740 - DNA, 25 bp, Mus musculus
gaaagcgccagcttgatccagaggc

SEQ ID NO: 408741 - DNA, 25 bp, Mus musculus
gaaagcgccagtcaaaatcagtcct

SEQ ID NO: 408742 - DNA, 25 bp, Mus musculus
gaaagcgccagtgaaaatcagtcct

SEQ ID NO: 408743 - DNA, 25 bp, Mus musculus
gaaagcgcttaaagcatccgggctt

SEQ ID NO: 408744 - DNA, 25 bp, Mus musculus
gaaagcgcttaatgcatccgggctt

SEQ ID NO: 408745 - DNA, 25 bp, Mus musculus
gaaagcgcttgccaatcatcctact

SEQ ID NO: 408746 - DNA, 25 bp, Mus musculus
gaaagcgcttgcgaatcatcctact

SEQ ID NO: 408747 - DNA, 25 bp, Mus musculus
gaaagcgcttgtatattgcagtcat

SEQ ID NO: 408748 - DNA, 25 bp, Mus musculus
gaaagcgcttgtttattgcagtcat

SEQ ID NO: 408749 - DNA, 25 bp, Mus musculus
gaaagcggaaaacgctcctaaggct

SEQ ID NO: 408750 - DNA, 25 bp, Mus musculus
gaaagcggaaaaggctcctaaggct

SEQ ID NO: 408751 - DNA, 25 bp, Mus musculus
gaaagcggaaccatgcgccaggagc

SEQ ID NO: 408752 - DNA, 25 bp, Mus musculus
gaaagcggaaccttgcgccaggagc

SEQ ID NO: 408753 - DNA, 25 bp, Mus musculus
gaaagcggacacctcattacccagg

SEQ ID NO: 408754 - DNA, 25 bp, Mus musculus
gaaagcggacacgtcattacccagg

SEQ ID NO: 408755 - DNA, 25 bp, Mus musculus
gaaagcggattcagcaatggcaact

SEQ ID NO: 408756 - DNA, 25 bp, Mus musculus
gaaagcggattctgcaatggcaact

SEQ ID NO: 408757 - DNA, 25 bp, Mus musculus
gaaagcggcagtcgttctccacagt

SEQ ID NO: 408758 - DNA, 25 bp, Mus musculus
gaaagcggcagtggttctccacagt

SEQ ID NO: 408759 - DNA, 25 bp, Mus musculus
gaaagcggccttagctgagactgac

SEQ ID NO: 408760 - DNA, 25 bp, Mus musculus
gaaagcggcctttgctgagactgac

SEQ ID NO: 408761 - DNA, 25 bp, Mus musculus
gaaagcggcgctacgatcgcaagca

SEQ ID NO: 408762 - DNA, 25 bp, Mus musculus
gaaagcggcgcttcgatcgcaagca

SEQ ID NO: 408763 - DNA, 25 bp, Mus musculus
gaaagcgggcgcctgaacagcatcc

SEQ ID NO: 408764 - DNA, 25 bp, Mus musculus
gaaagcgggcgcgtgaacagcatcc

SEQ ID NO: 408765 - DNA, 25 bp, Mus musculus
gaaagcggtccaaggtcgggtagtg

SEQ ID NO: 408766 - DNA, 25 bp, Mus musculus
gaaagcggtccatggtcgggtagtg

SEQ ID NO: 408767 - DNA, 25 bp, Mus musculus
gaaagcgtacagatttccacccact

SEQ ID NO: 408768 - DNA, 25 bp, Mus musculus
gaaagcgtacagttttccacccact

SEQ ID NO: 408769 - DNA, 25 bp, Mus musculus
gaaagcgtagctaaatggccagagt

SEQ ID NO: 408770 - DNA, 25 bp, Mus musculus
gaaagcgtagctcttctaacttcag

SEQ ID NO: 408771 - DNA, 25 bp, Mus musculus
gaaagcgtagctgttctaacttcag

SEQ ID NO: 408772 - DNA, 25 bp, Mus musculus
gaaagcgtagcttaatggccagagt

SEQ ID NO: 408773 - DNA, 25 bp, Mus musculus
gaaagcgtagtgacatttcctcact

SEQ ID NO: 408774 - DNA, 25 bp, Mus musculus
gaaagcgtagtgtcatttcctcact

SEQ ID NO: 408775 - DNA, 25 bp, Mus musculus
gaaagcgtcagcatgacttggcata

SEQ ID NO: 408776 - DNA, 25 bp, Mus musculus
gaaagcgtcagcttgacttggcata

SEQ ID NO: 408777 - DNA, 25 bp, Mus musculus
gaaagcgtcgccaactcagcagggt

SEQ ID NO: 408778 - DNA, 25 bp, Mus musculus
gaaagcgtcgcctactcagcagggt

SEQ ID NO: 408779 - DNA, 25 bp, Mus musculus
gaaagcgtgactctaaatcccagcc

SEQ ID NO: 408780 - DNA, 25 bp, Mus musculus
gaaagcgtgactgtaaatcccagcc

SEQ ID NO: 408781 - DNA, 25 bp, Mus musculus
gaaagcgtgaggctacacagaataa

SEQ ID NO: 408782 - DNA, 25 bp, Mus musculus
gaaagcgtgagggtacacagaataa

SEQ ID NO: 408783 - DNA, 25 bp, Mus musculus
gaaagcgtggtgataatctgcgtac

SEQ ID NO: 408784 - DNA, 25 bp, Mus musculus
gaaagcgtggtgttaatctgcgtac

SEQ ID NO: 408785 - DNA, 25 bp, Mus musculus
gaaagcgtgtggattggcccaagtc

SEQ ID NO: 408786 - DNA, 25 bp, Mus musculus
gaaagcgtgtggtttggcccaagtc

SEQ ID NO: 408787 - DNA, 25 bp, Mus musculus
gaaagcgttctgataccaacagcaa

SEQ ID NO: 408788 - DNA, 25 bp, Mus musculus
gaaagcgttctgcaaagcctgagac

SEQ ID NO: 408789 - DNA, 25 bp, Mus musculus
gaaagcgttctggaaagcctgagac

SEQ ID NO: 408790 - DNA, 25 bp, Mus musculus
gaaagcgttctgttaccaacagcaa

SEQ ID NO: 408791 - DNA, 25 bp, Mus musculus
gaaagcgttgacacacctggatgtt

SEQ ID NO: 408792 - DNA, 25 bp, Mus musculus
gaaagcgttgactcacctggatgtt

SEQ ID NO: 408793 - DNA, 25 bp, Mus musculus
gaaagcgttgttcggaatctctgaa

SEQ ID NO: 408794 - DNA, 25 bp, Mus musculus
gaaagcgttgttgggaatctctgaa

SEQ ID NO: 408795 - DNA, 25 bp, Mus musculus
gaaagctaaacgagatacctcatga

SEQ ID NO: 408796 - DNA, 25 bp, Mus musculus
gaaagctaaacgtgatacctcatga

SEQ ID NO: 408797 - DNA, 25 bp, Mus musculus
gaaagctaagccagttccggaagaa

SEQ ID NO: 408798 - DNA, 25 bp, Mus musculus
gaaagctaagcctgttccggaagaa

SEQ ID NO: 408799 - DNA, 25 bp, Mus musculus
gaaagctacacccttgtccttaaag

SEQ ID NO: 408800 - DNA, 25 bp, Mus musculus
gaaagctacaccgttgtccttaaag

SEQ ID NO: 408801 - DNA, 25 bp, Mus musculus
gaaagctacagaaaccacccagaat

SEQ ID NO: 408802 - DNA, 25 bp, Mus musculus
gaaagctacagataccacccagaat

SEQ ID NO: 408803 - DNA, 25 bp, Mus musculus
gaaagctacctgactccaataaaca

SEQ ID NO: 408804 - DNA, 25 bp, Mus musculus
gaaagctacctgtctccaataaaca

SEQ ID NO: 408805 - DNA, 25 bp, Mus musculus
gaaagctacgagcttctgcctgcta

SEQ ID NO: 408806 - DNA, 25 bp, Mus musculus
gaaagctacgaggttctgcctgcta

SEQ ID NO: 408807 - DNA, 25 bp, Mus musculus
gaaagctacttcaaagccctgttat

SEQ ID NO: 408808 - DNA, 25 bp, Mus musculus
gaaagctacttctaagccctgttat

SEQ ID NO: 408809 - DNA, 25 bp, Mus musculus
gaaagctagcagctcaatcatccgc

SEQ ID NO: 408810 - DNA, 25 bp, Mus musculus
gaaagctagcaggtcaatcatccgc

SEQ ID NO: 408811 - DNA, 25 bp, Mus musculus
gaaagctagcatagagacctccgag

SEQ ID NO: 408812 - DNA, 25 bp, Mus musculus
gaaagctagcattgagacctccgag

SEQ ID NO: 408813 - DNA, 25 bp, Mus musculus
gaaagctaggccatgaagattgact

SEQ ID NO: 408814 - DNA, 25 bp, Mus musculus
gaaagctaggccatgagcaatgaaa

SEQ ID NO: 408815 - DNA, 25 bp, Mus musculus
gaaagctaggccttgaagattgact

SEQ ID NO: 408816 - DNA, 25 bp, Mus musculus
gaaagctaggccttgagcaatgaaa

SEQ ID NO: 408817 - DNA, 25 bp, Mus musculus
gaaagctaggtacactatctgatta

SEQ ID NO: 408818 - DNA, 25 bp, Mus musculus
gaaagctaggtagactatctgatta

SEQ ID NO: 408819 - DNA, 25 bp, Mus musculus
gaaagctatcttagtgccgggtgtt

SEQ ID NO: 408820 - DNA, 25 bp, Mus musculus
gaaagctatctttgtgccgggtgtt

SEQ ID NO: 408821 - DNA, 25 bp, Mus musculus
gaaagctatgcccaaggtctagaaa

SEQ ID NO: 408822 - DNA, 25 bp, Mus musculus
gaaagctatgccgaaggtctagaaa

SEQ ID NO: 408823 - DNA, 25 bp, Mus musculus
gaaagctatgctaattctctcaaga

SEQ ID NO: 408824 - DNA, 25 bp, Mus musculus
gaaagctatgcttattctctcaaga

SEQ ID NO: 408825 - DNA, 25 bp, Mus musculus
gaaagctattacagcatcaatggta

SEQ ID NO: 408826 - DNA, 25 bp, Mus musculus
gaaagctattactgcatcaatggta

SEQ ID NO: 408827 - DNA, 25 bp, Mus musculus
gaaagctattccagaaaccctgccc

SEQ ID NO: 408828 - DNA, 25 bp, Mus musculus
gaaagctattcctgaaaccctgccc

SEQ ID NO: 408829 - DNA, 25 bp, Mus musculus
gaaagctattgtctaaacactcagg

SEQ ID NO: 408830 - DNA, 25 bp, Mus musculus
gaaagctattgtgtaaacactcagg

SEQ ID NO: 408831 - DNA, 25 bp, Mus musculus
gaaagctcaaacctcagtgtgtact

SEQ ID NO: 408832 - DNA, 25 bp, Mus musculus
gaaagctcaaacgtcagtgtgtact

SEQ ID NO: 408833 - DNA, 25 bp, Mus musculus
gaaagctcaaggactccctgcggca

SEQ ID NO: 408834 - DNA, 25 bp, Mus musculus
gaaagctcaaggtctccctgcggca

SEQ ID NO: 408835 - DNA, 25 bp, Mus musculus
gaaagctcaagtctcctatcagcat

SEQ ID NO: 408836 - DNA, 25 bp, Mus musculus
gaaagctcaagtgtcctatcagcat

SEQ ID NO: 408837 - DNA, 25 bp, Mus musculus
gaaagctcacatactaagtagagaa

SEQ ID NO: 408838 - DNA, 25 bp, Mus musculus
gaaagctcacattctaagtagagaa

SEQ ID NO: 408839 - DNA, 25 bp, Mus musculus
gaaagctcacctaagccacacggaa

SEQ ID NO: 408840 - DNA, 25 bp, Mus musculus
gaaagctcaccttagccacacggaa

SEQ ID NO: 408841 - DNA, 25 bp, Mus musculus
gaaagctcacgtacacatccatttg

SEQ ID NO: 408842 - DNA, 25 bp, Mus musculus
gaaagctcacgttcacatccatttg

SEQ ID NO: 408843 - DNA, 25 bp, Mus musculus
gaaagctcactcaggagaggaccct

SEQ ID NO: 408844 - DNA, 25 bp, Mus musculus
gaaagctcactctggagaggaccct

SEQ ID NO: 408845 - DNA, 25 bp, Mus musculus
gaaagctcagacaagggtgcagaat

SEQ ID NO: 408846 - DNA, 25 bp, Mus musculus
gaaagctcagactagggtgcagaat

SEQ ID NO: 408847 - DNA, 25 bp, Mus musculus
gaaagctcagtaaacattgcgtttg

SEQ ID NO: 408848 - DNA, 25 bp, Mus musculus
gaaagctcagtatacattgcgtttg

SEQ ID NO: 408849 - DNA, 25 bp, Mus musculus
gaaagctcagttctgtcatagtttt

SEQ ID NO: 408850 - DNA, 25 bp, Mus musculus
gaaagctcagttgtgtcatagtttt

SEQ ID NO: 408851 - DNA, 25 bp, Mus musculus
gaaagctcatctaaaccgtgataaa

SEQ ID NO: 408852 - DNA, 25 bp, Mus musculus
gaaagctcatcttaaccgtgataaa

SEQ ID NO: 408853 - DNA, 25 bp, Mus musculus
gaaagctcatgcagctatccgagag

SEQ ID NO: 408854 - DNA, 25 bp, Mus musculus
gaaagctcatgctgctatccgagag

SEQ ID NO: 408855 - DNA, 25 bp, Mus musculus
gaaagctcccaacgaggagttggcc

SEQ ID NO: 408856 - DNA, 25 bp, Mus musculus
gaaagctcccaaggaggagttggcc

SEQ ID NO: 408857 - DNA, 25 bp, Mus musculus
gaaagctcccggaactccaggtaag

SEQ ID NO: 408858 - DNA, 25 bp, Mus musculus
gaaagctcccggtactccaggtaag

SEQ ID NO: 408859 - DNA, 25 bp, Mus musculus
gaaagctccgggactaggctctgta

SEQ ID NO: 408860 - DNA, 25 bp, Mus musculus
gaaagctccgggtctaggctctgta

SEQ ID NO: 408861 - DNA, 25 bp, Mus musculus
gaaagctcctatattgattccacgt

SEQ ID NO: 408862 - DNA, 25 bp, Mus musculus
gaaagctcctattttgattccacgt

SEQ ID NO: 408863 - DNA, 25 bp, Mus musculus
gaaagctccttccagactttaccag

SEQ ID NO: 408864 - DNA, 25 bp, Mus musculus
gaaagctccttcgagactttaccag

SEQ ID NO: 408865 - DNA, 25 bp, Mus musculus
gaaagctcctttccatgacttgtac

SEQ ID NO: 408866 - DNA, 25 bp, Mus musculus
gaaagctcctttgcatgacttgtac

SEQ ID NO: 408867 - DNA, 25 bp, Mus musculus
gaaagctcgattatgatgtcaccag

SEQ ID NO: 408868 - DNA, 25 bp, Mus musculus
gaaagctcgattttgatgtcaccag

SEQ ID NO: 408869 - DNA, 25 bp, Mus musculus
gaaagctcggttaaactccctgcat

SEQ ID NO: 408870 - DNA, 25 bp, Mus musculus
gaaagctcggtttaactccctgcat

SEQ ID NO: 408871 - DNA, 25 bp, Mus musculus
gaaagctctacgactttcgacgcag

SEQ ID NO: 408872 - DNA, 25 bp, Mus musculus
gaaagctctacgtctttcgacgcag

SEQ ID NO: 408873 - DNA, 25 bp, Mus musculus
gaaagctctattacctgtatccaag

SEQ ID NO: 408874 - DNA, 25 bp, Mus musculus
gaaagctctattatttgcctcgggt

SEQ ID NO: 408875 - DNA, 25 bp, Mus musculus
gaaagctctatttcctgtatccaag

SEQ ID NO: 408876 - DNA, 25 bp, Mus musculus
gaaagctctattttttgcctcgggt

SEQ ID NO: 408877 - DNA, 25 bp, Mus musculus
gaaagctctcacactttgtgcagaa

SEQ ID NO: 408878 - DNA, 25 bp, Mus musculus
gaaagctctcaccaaagcactaagt

SEQ ID NO: 408879 - DNA, 25 bp, Mus musculus
gaaagctctcacgaaagcactaagt

SEQ ID NO: 408880 - DNA, 25 bp, Mus musculus
gaaagctctcactctttgtgcagaa

SEQ ID NO: 408881 - DNA, 25 bp, Mus musculus
gaaagctctgagcaagtccagccca

SEQ ID NO: 408882 - DNA, 25 bp, Mus musculus
gaaagctctgaggaagtccagccca

SEQ ID NO: 408883 - DNA, 25 bp, Mus musculus
gaaagctctgcacgctctacgagaa

SEQ ID NO: 408884 - DNA, 25 bp, Mus musculus
gaaagctctgcaggctctacgagaa

SEQ ID NO: 408885 - DNA, 25 bp, Mus musculus
gaaagctctgctatgttttaatttt

SEQ ID NO: 408886 - DNA, 25 bp, Mus musculus
gaaagctctgctttgttttaatttt

SEQ ID NO: 408887 - DNA, 25 bp, Mus musculus
gaaagctctgggataacttctcagt

SEQ ID NO: 408888 - DNA, 25 bp, Mus musculus
gaaagctctgggttaacttctcagt

SEQ ID NO: 408889 - DNA, 25 bp, Mus musculus
gaaagctcttacaatggtccctatc

SEQ ID NO: 408890 - DNA, 25 bp, Mus musculus
gaaagctcttactatggtccctatc

SEQ ID NO: 408891 - DNA, 25 bp, Mus musculus
gaaagctcttcaaatgcaccatcaa

SEQ ID NO: 408892 - DNA, 25 bp, Mus musculus
gaaagctcttcatatgcaccatcaa

SEQ ID NO: 408893 - DNA, 25 bp, Mus musculus
gaaagctcttggagctgccgtatcc

SEQ ID NO: 408894 - DNA, 25 bp, Mus musculus
gaaagctcttggtgctgccgtatcc

SEQ ID NO: 408895 - DNA, 25 bp, Mus musculus
gaaagctctttcaggaatctctcag

SEQ ID NO: 408896 - DNA, 25 bp, Mus musculus
gaaagctctttctggaatctctcag

SEQ ID NO: 408897 - DNA, 25 bp, Mus musculus
gaaagctcttttatgcctggctcat

SEQ ID NO: 408898 - DNA, 25 bp, Mus musculus
gaaagctcttttttgcctggctcat

SEQ ID NO: 408899 - DNA, 25 bp, Mus musculus
gaaagctgaacaccgggcttagcaa

SEQ ID NO: 408900 - DNA, 25 bp, Mus musculus
gaaagctgaacagcgggcttagcaa

SEQ ID NO: 408901 - DNA, 25 bp, Mus musculus
gaaagctgaattcgctgttgctgaa

SEQ ID NO: 408902 - DNA, 25 bp, Mus musculus
gaaagctgaattggctgttgctgaa

SEQ ID NO: 408903 - DNA, 25 bp, Mus musculus
gaaagctgaccgatactgcaagtga

SEQ ID NO: 408904 - DNA, 25 bp, Mus musculus
gaaagctgaccgttactgcaagtga

SEQ ID NO: 408905 - DNA, 25 bp, Mus musculus
gaaagctgacttaaattgccaatca

SEQ ID NO: 408906 - DNA, 25 bp, Mus musculus
gaaagctgactttaattgccaatca

SEQ ID NO: 408907 - DNA, 25 bp, Mus musculus
gaaagctgagacattgtccccaact

SEQ ID NO: 408908 - DNA, 25 bp, Mus musculus
gaaagctgagactttgtccccaact

SEQ ID NO: 408909 - DNA, 25 bp, Mus musculus
gaaagctgaggcatggacgaaccaa

SEQ ID NO: 408910 - DNA, 25 bp, Mus musculus
gaaagctgaggcttggacgaaccaa

SEQ ID NO: 408911 - DNA, 25 bp, Mus musculus
gaaagctgatatcacattaattacc

SEQ ID NO: 408912 - DNA, 25 bp, Mus musculus
gaaagctgatatgacattaattacc

SEQ ID NO: 408913 - DNA, 25 bp, Mus musculus
gaaagctgatccagcctcttgccag

SEQ ID NO: 408914 - DNA, 25 bp, Mus musculus
gaaagctgatcccagcaccttggag

SEQ ID NO: 408915 - DNA, 25 bp, Mus musculus
gaaagctgatccgagcaccttggag

SEQ ID NO: 408916 - DNA, 25 bp, Mus musculus
gaaagctgatcctgcctcttgccag

SEQ ID NO: 408917 - DNA, 25 bp, Mus musculus
gaaagctgcacgcagtggcactcag

SEQ ID NO: 408918 - DNA, 25 bp, Mus musculus
gaaagctgcacggagtggcactcag

SEQ ID NO: 408919 - DNA, 25 bp, Mus musculus
gaaagctgcactagcaggctgacaa

SEQ ID NO: 408920 - DNA, 25 bp, Mus musculus
gaaagctgcacttgcaggctgacaa

SEQ ID NO: 408921 - DNA, 25 bp, Mus musculus
gaaagctgcagaagtcattacaaac

SEQ ID NO: 408922 - DNA, 25 bp, Mus musculus
gaaagctgcagactttgccttgcac

SEQ ID NO: 408923 - DNA, 25 bp, Mus musculus
gaaagctgcagagtttgccttgcac

SEQ ID NO: 408924 - DNA, 25 bp, Mus musculus
gaaagctgcagatgtcattacaaac

SEQ ID NO: 408925 - DNA, 25 bp, Mus musculus
gaaagctgcaggattgttatgcaaa

SEQ ID NO: 408926 - DNA, 25 bp, Mus musculus
gaaagctgcaggtttgttatgcaaa

SEQ ID NO: 408927 - DNA, 25 bp, Mus musculus
gaaagctgcatcacacaactgaaga

SEQ ID NO: 408928 - DNA, 25 bp, Mus musculus
gaaagctgcatctcacaactgaaga

SEQ ID NO: 408929 - DNA, 25 bp, Mus musculus
gaaagctgccagagtcaggcccttc

SEQ ID NO: 408930 - DNA, 25 bp, Mus musculus
gaaagctgccagtgtcaggcccttc

SEQ ID NO: 408931 - DNA, 25 bp, Mus musculus
gaaagctgcgaacttccttaggatt

SEQ ID NO: 408932 - DNA, 25 bp, Mus musculus
gaaagctgcgaagttccttaggatt

SEQ ID NO: 408933 - DNA, 25 bp, Mus musculus
gaaagctgctatccctcaagcttgg

SEQ ID NO: 408934 - DNA, 25 bp, Mus musculus
gaaagctgctatgcctcaagcttgg

SEQ ID NO: 408935 - DNA, 25 bp, Mus musculus
gaaagctgctcaacaatgctcatga

SEQ ID NO: 408936 - DNA, 25 bp, Mus musculus
gaaagctgctcatcaatgctcatga

SEQ ID NO: 408937 - DNA, 25 bp, Mus musculus
gaaagctgcttcaagaaatagacaa

SEQ ID NO: 408938 - DNA, 25 bp, Mus musculus
gaaagctgcttctagaaatagacaa

SEQ ID NO: 408939 - DNA, 25 bp, Mus musculus
gaaagctgctttatagagccatgtg

SEQ ID NO: 408940 - DNA, 25 bp, Mus musculus
gaaagctgctttttagagccatgtg

SEQ ID NO: 408941 - DNA, 25 bp, Mus musculus
gaaagctggactctgtcacagtgaa

SEQ ID NO: 408942 - DNA, 25 bp, Mus musculus
gaaagctggactgtgtcacagtgaa

SEQ ID NO: 408943 - DNA, 25 bp, Mus musculus
gaaagctggatgagtctctgaatca

SEQ ID NO: 408944 - DNA, 25 bp, Mus musculus
gaaagctggatgtgtctctgaatca

SEQ ID NO: 408945 - DNA, 25 bp, Mus musculus
gaaagctggcaaacttaccttttaa

SEQ ID NO: 408946 - DNA, 25 bp, Mus musculus
gaaagctggcaatcttaccttttaa

SEQ ID NO: 408947 - DNA, 25 bp, Mus musculus
gaaagctggcagaactgccgagtta

SEQ ID NO: 408948 - DNA, 25 bp, Mus musculus
gaaagctggcagtactgccgagtta

SEQ ID NO: 408949 - DNA, 25 bp, Mus musculus
gaaagctggcatactcttggagatt

SEQ ID NO: 408950 - DNA, 25 bp, Mus musculus
gaaagctggcattctcttggagatt

SEQ ID NO: 408951 - DNA, 25 bp, Mus musculus
gaaagctggcttagcccatttctta

SEQ ID NO: 408952 - DNA, 25 bp, Mus musculus
gaaagctggctttgcccatttctta

SEQ ID NO: 408953 - DNA, 25 bp, Mus musculus
gaaagctgggtacctgcttcctgtt

SEQ ID NO: 408954 - DNA, 25 bp, Mus musculus
gaaagctgggtagctgcttcctgtt

SEQ ID NO: 408955 - DNA, 25 bp, Mus musculus
gaaagctggttgagcctatgtaata

SEQ ID NO: 408956 - DNA, 25 bp, Mus musculus
gaaagctggttgtgcctatgtaata

SEQ ID NO: 408957 - DNA, 25 bp, Mus musculus
gaaagctgtaggcatattttagcag

SEQ ID NO: 408958 - DNA, 25 bp, Mus musculus
gaaagctgtagggatattttagcag

SEQ ID NO: 408959 - DNA, 25 bp, Mus musculus
gaaagctgtcaaatcccacacaatg

SEQ ID NO: 408960 - DNA, 25 bp, Mus musculus
gaaagctgtcaaccagggaaccact

SEQ ID NO: 408961 - DNA, 25 bp, Mus musculus
gaaagctgtcaagcagggaaccact

SEQ ID NO: 408962 - DNA, 25 bp, Mus musculus
gaaagctgtcaattcccacacaatg

SEQ ID NO: 408963 - DNA, 25 bp, Mus musculus
gaaagctgtcatctctcttcagttg

SEQ ID NO: 408964 - DNA, 25 bp, Mus musculus
gaaagctgtcatgtctcttcagttg

SEQ ID NO: 408965 - DNA, 25 bp, Mus musculus
gaaagctgtctaccccgagttacct

SEQ ID NO: 408966 - DNA, 25 bp, Mus musculus
gaaagctgtctagcccgagttacct

SEQ ID NO: 408967 - DNA, 25 bp, Mus musculus
gaaagctgtgtaagcatttttgttt

SEQ ID NO: 408968 - DNA, 25 bp, Mus musculus
gaaagctgtgtatgcatttttgttt

SEQ ID NO: 408969 - DNA, 25 bp, Mus musculus
gaaagctgtgtcctgccataacgtg

SEQ ID NO: 408970 - DNA, 25 bp, Mus musculus
gaaagctgtgtcgtgccataacgtg

SEQ ID NO: 408971 - DNA, 25 bp, Mus musculus
gaaagctgtgttaaggtgtcacgtg

SEQ ID NO: 408972 - DNA, 25 bp, Mus musculus
gaaagctgtgtttaggtgtcacgtg

SEQ ID NO: 408973 - DNA, 25 bp, Mus musculus
gaaagctgttagagcctgcagagga

SEQ ID NO: 408974 - DNA, 25 bp, Mus musculus
gaaagctgttagtgcctgcagagga

SEQ ID NO: 408975 - DNA, 25 bp, Mus musculus
gaaagctgttctccatcaaaccatc

SEQ ID NO: 408976 - DNA, 25 bp, Mus musculus
gaaagctgttctgcatcaaaccatc

SEQ ID NO: 408977 - DNA, 25 bp, Mus musculus
gaaagctgttgaaccagaatccaga

SEQ ID NO: 408978 - DNA, 25 bp, Mus musculus
gaaagctgttgaagctggatcttaa

SEQ ID NO: 408979 - DNA, 25 bp, Mus musculus
gaaagctgttgatccagaatccaga

SEQ ID NO: 408980 - DNA, 25 bp, Mus musculus
gaaagctgttgatgctggatcttaa

SEQ ID NO: 408981 - DNA, 25 bp, Mus musculus
gaaagctgttgtagtgtgcccaaaa

SEQ ID NO: 408982 - DNA, 25 bp, Mus musculus
gaaagctgttgttgtgtgcccaaaa

SEQ ID NO: 408983 - DNA, 25 bp, Mus musculus
gaaagcttaattcttatcccatatg

SEQ ID NO: 408984 - DNA, 25 bp, Mus musculus
gaaagcttaattgttatcccatatg

SEQ ID NO: 408985 - DNA, 25 bp, Mus musculus
gaaagcttagtacagttgtgattta

SEQ ID NO: 408986 - DNA, 25 bp, Mus musculus
gaaagcttagtagagttgtgattta

SEQ ID NO: 408987 - DNA, 25 bp, Mus musculus
gaaagcttatcaacacaccacgtgt

SEQ ID NO: 408988 - DNA, 25 bp, Mus musculus
gaaagcttatcatcacaccacgtgt

SEQ ID NO: 408989 - DNA, 25 bp, Mus musculus
gaaagcttatctcatgatggccaaa

SEQ ID NO: 408990 - DNA, 25 bp, Mus musculus
gaaagcttatctgatgatggccaaa

SEQ ID NO: 408991 - DNA, 25 bp, Mus musculus
gaaagcttatgcaattatgcctcta

SEQ ID NO: 408992 - DNA, 25 bp, Mus musculus
gaaagcttatgctattatgcctcta

SEQ ID NO: 408993 - DNA, 25 bp, Mus musculus
gaaagcttatttcttctgccctttt

SEQ ID NO: 408994 - DNA, 25 bp, Mus musculus
gaaagcttatttgttctgccctttt

SEQ ID NO: 408995 - DNA, 25 bp, Mus musculus
gaaagcttcagacgctgctgtgaaa

SEQ ID NO: 408996 - DNA, 25 bp, Mus musculus
gaaagcttcagaggctgctgtgaaa

SEQ ID NO: 408997 - DNA, 25 bp, Mus musculus
gaaagcttcaggacgacgtcaggaa

SEQ ID NO: 408998 - DNA, 25 bp, Mus musculus
gaaagcttcaggtcgacgtcaggaa

SEQ ID NO: 408999 - DNA, 25 bp, Mus musculus
gaaagcttccaaagcctgctgtgtg

SEQ ID NO: 409000 - DNA, 25 bp, Mus musculus
gaaagcttccaatgcctgctgtgtg

SEQ ID NO: 409001 - DNA, 25 bp, Mus musculus
gaaagcttccacacatcatcggagg

SEQ ID NO: 409002 - DNA, 25 bp, Mus musculus
gaaagcttccactcatcatcggagg

SEQ ID NO: 409003 - DNA, 25 bp, Mus musculus
gaaagcttccagatgcctgtgctgt

SEQ ID NO: 409004 - DNA, 25 bp, Mus musculus
gaaagcttccagttgcctgtgctgt

SEQ ID NO: 409005 - DNA, 25 bp, Mus musculus
gaaagcttccggctacaaagaacaa

SEQ ID NO: 409006 - DNA, 25 bp, Mus musculus
gaaagcttccgggtacaaagaacaa

SEQ ID NO: 409007 - DNA, 25 bp, Mus musculus
gaaagcttcctgaaggtaggccaga

SEQ ID NO: 409008 - DNA, 25 bp, Mus musculus
gaaagcttcctgctaattcagcact

SEQ ID NO: 409009 - DNA, 25 bp, Mus musculus
gaaagcttcctggtaattcagcact

SEQ ID NO: 409010 - DNA, 25 bp, Mus musculus
gaaagcttcctgtaggtaggccaga

SEQ ID NO: 409011 - DNA, 25 bp, Mus musculus
gaaagcttcgagaactccacagaga

SEQ ID NO: 409012 - DNA, 25 bp, Mus musculus
gaaagcttcgagtactccacagaga

SEQ ID NO: 409013 - DNA, 25 bp, Mus musculus
gaaagcttctacaggcacaatttat

SEQ ID NO: 409014 - DNA, 25 bp, Mus musculus
gaaagcttctactggcacaatttat

SEQ ID NO: 409015 - DNA, 25 bp, Mus musculus
gaaagcttctagaggtgacttcgaa

SEQ ID NO: 409016 - DNA, 25 bp, Mus musculus
gaaagcttctagtggtgacttcgaa

SEQ ID NO: 409017 - DNA, 25 bp, Mus musculus
gaaagcttctataatttatttgcct

SEQ ID NO: 409018 - DNA, 25 bp, Mus musculus
gaaagcttctatcagccctttaaga

SEQ ID NO: 409019 - DNA, 25 bp, Mus musculus
gaaagcttctatgagccctttaaga

SEQ ID NO: 409020 - DNA, 25 bp, Mus musculus
gaaagcttctattatttatttgcct

SEQ ID NO: 409021 - DNA, 25 bp, Mus musculus
gaaagcttctcacctgcacatgtgc

SEQ ID NO: 409022 - DNA, 25 bp, Mus musculus
gaaagcttctcagctgcacatgtgc

SEQ ID NO: 409023 - DNA, 25 bp, Mus musculus
gaaagcttctctaaggatttatctt

SEQ ID NO: 409024 - DNA, 25 bp, Mus musculus
gaaagcttctcttaggatttatctt

SEQ ID NO: 409025 - DNA, 25 bp, Mus musculus
gaaagcttcttcagttggtcatcta

SEQ ID NO: 409026 - DNA, 25 bp, Mus musculus
gaaagcttcttctgttggtcatcta

SEQ ID NO: 409027 - DNA, 25 bp, Mus musculus
gaaagcttgaggacccctagagcat

SEQ ID NO: 409028 - DNA, 25 bp, Mus musculus
gaaagcttgaggtcccctagagcat

SEQ ID NO: 409029 - DNA, 25 bp, Mus musculus
gaaagcttgatgaccctcgatatct

SEQ ID NO: 409030 - DNA, 25 bp, Mus musculus
gaaagcttgatgtccctcgatatct

SEQ ID NO: 409031 - DNA, 25 bp, Mus musculus
gaaagcttgccaactagcctgaggt

SEQ ID NO: 409032 - DNA, 25 bp, Mus musculus
gaaagcttgccactgaccaatcatg

SEQ ID NO: 409033 - DNA, 25 bp, Mus musculus
gaaagcttgccagtgaccaatcatg

SEQ ID NO: 409034 - DNA, 25 bp, Mus musculus
gaaagcttgccatctagcctgaggt

SEQ ID NO: 409035 - DNA, 25 bp, Mus musculus
gaaagcttgctaattcttactgtcc

SEQ ID NO: 409036 - DNA, 25 bp, Mus musculus
gaaagcttgctacatgctctttgct

SEQ ID NO: 409037 - DNA, 25 bp, Mus musculus
gaaagcttgctagatgctctttgct

SEQ ID NO: 409038 - DNA, 25 bp, Mus musculus
gaaagcttgctatttcttactgtcc

SEQ ID NO: 409039 - DNA, 25 bp, Mus musculus
gaaagcttggccagcgacgagctgc

SEQ ID NO: 409040 - DNA, 25 bp, Mus musculus
gaaagcttggcctgcgacgagctgc

SEQ ID NO: 409041 - DNA, 25 bp, Mus musculus
gaaagcttgtcactctaactggcta

SEQ ID NO: 409042 - DNA, 25 bp, Mus musculus
gaaagcttgtcagtctaactggcta

SEQ ID NO: 409043 - DNA, 25 bp, Mus musculus
gaaagcttgtgtcttctgcctggtg

SEQ ID NO: 409044 - DNA, 25 bp, Mus musculus
gaaagcttgtgtgttctgcctggtg

SEQ ID NO: 409045 - DNA, 25 bp, Mus musculus
gaaagcttgttaactcatgtagtgt

SEQ ID NO: 409046 - DNA, 25 bp, Mus musculus
gaaagcttgttatctcatgtagtgt

SEQ ID NO: 409047 - DNA, 25 bp, Mus musculus
gaaagctttacaaattcctctgcaa

SEQ ID NO: 409048 - DNA, 25 bp, Mus musculus
gaaagctttacatattcctctgcaa

SEQ ID NO: 409049 - DNA, 25 bp, Mus musculus
gaaagctttaccacctgcaaaacgt

SEQ ID NO: 409050 - DNA, 25 bp, Mus musculus
gaaagctttacctcctgcaaaacgt

SEQ ID NO: 409051 - DNA, 25 bp, Mus musculus
gaaagctttactcttccactgtgta

SEQ ID NO: 409052 - DNA, 25 bp, Mus musculus
gaaagctttactgttccactgtgta

SEQ ID NO: 409053 - DNA, 25 bp, Mus musculus
gaaagctttagccaaattatgccaa

SEQ ID NO: 409054 - DNA, 25 bp, Mus musculus
gaaagctttagcgaaattatgccaa

SEQ ID NO: 409055 - DNA, 25 bp, Mus musculus
gaaagctttaggagtgtaaccatac

SEQ ID NO: 409056 - DNA, 25 bp, Mus musculus
gaaagctttaggtgtgtaaccatac

SEQ ID NO: 409057 - DNA, 25 bp, Mus musculus
gaaagctttcacaactcagtaagaa

SEQ ID NO: 409058 - DNA, 25 bp, Mus musculus
gaaagctttcactactcagtaagaa

SEQ ID NO: 409059 - DNA, 25 bp, Mus musculus
gaaagctttcgcatggtgatttttt

SEQ ID NO: 409060 - DNA, 25 bp, Mus musculus
gaaagctttcgcttggtgatttttt

SEQ ID NO: 409061 - DNA, 25 bp, Mus musculus
gaaagctttcgtaatcgctgcaggg

SEQ ID NO: 409062 - DNA, 25 bp, Mus musculus
gaaagctttcgttatcgctgcaggg

SEQ ID NO: 409063 - DNA, 25 bp, Mus musculus
gaaagctttctgagactaatcatgt

SEQ ID NO: 409064 - DNA, 25 bp, Mus musculus
gaaagctttctgtgactaatcatgt

SEQ ID NO: 409065 - DNA, 25 bp, Mus musculus
gaaagctttgagattctggcctaac

SEQ ID NO: 409066 - DNA, 25 bp, Mus musculus
gaaagctttgagtttctggcctaac

SEQ ID NO: 409067 - DNA, 25 bp, Mus musculus
gaaagctttgcacaatccacataac

SEQ ID NO: 409068 - DNA, 25 bp, Mus musculus
gaaagctttgcagaatccacataac

SEQ ID NO: 409069 - DNA, 25 bp, Mus musculus
gaaagctttggcaccatgctggaac

SEQ ID NO: 409070 - DNA, 25 bp, Mus musculus
gaaagctttggctccatgctggaac

SEQ ID NO: 409071 - DNA, 25 bp, Mus musculus
gaaagctttggtcaaacattggaga

SEQ ID NO: 409072 - DNA, 25 bp, Mus musculus
gaaagctttggtgaaacattggaga

SEQ ID NO: 409073 - DNA, 25 bp, Mus musculus
gaaagcttttaactgtccacgaaat

SEQ ID NO: 409074 - DNA, 25 bp, Mus musculus
gaaagcttttaagtgtccacgaaat

SEQ ID NO: 409075 - DNA, 25 bp, Mus musculus
gaaagcttttctctttgttcaaatc

SEQ ID NO: 409076 - DNA, 25 bp, Mus musculus
gaaagcttttctgtttgttcaaatc

SEQ ID NO: 409077 - DNA, 25 bp, Mus musculus
gaaagcttttgacaaccgtcaagaa

SEQ ID NO: 409078 - DNA, 25 bp, Mus musculus
gaaagcttttgagaaccgtcaagaa

SEQ ID NO: 409079 - DNA, 25 bp, Mus musculus
gaaagctttttcatttcccaatgag

SEQ ID NO: 409080 - DNA, 25 bp, Mus musculus
gaaagctttttcttttcccaatgag

SEQ ID NO: 409081 - DNA, 25 bp, Mus musculus
gaaaggaaacacatgaagggctaga

SEQ ID NO: 409082 - DNA, 25 bp, Mus musculus
gaaaggaaacacttgaagggctaga

SEQ ID NO: 409083 - DNA, 25 bp, Mus musculus
gaaaggaaacatcaacgtgacgttt

SEQ ID NO: 409084 - DNA, 25 bp, Mus musculus
gaaaggaaacatgaacgtgacgttt

SEQ ID NO: 409085 - DNA, 25 bp, Mus musculus
gaaaggaaacccacggcagacactg

SEQ ID NO: 409086 - DNA, 25 bp, Mus musculus
gaaaggaaaccctcggcagacactg

SEQ ID NO: 409087 - DNA, 25 bp, Mus musculus
gaaaggaaagcgcaagactctcaat

SEQ ID NO: 409088 - DNA, 25 bp, Mus musculus
gaaaggaaagcggaagactctcaat

SEQ ID NO: 409089 - DNA, 25 bp, Mus musculus
gaaaggaaccggactgggcagcaca

SEQ ID NO: 409090 - DNA, 25 bp, Mus musculus
gaaaggaaccggtctgggcagcaca

SEQ ID NO: 409091 - DNA, 25 bp, Mus musculus
gaaaggaacgcaagaacagaatgaa

SEQ ID NO: 409092 - DNA, 25 bp, Mus musculus
gaaaggaacgcaaggcacctgctct

SEQ ID NO: 409093 - DNA, 25 bp, Mus musculus
gaaaggaacgcatgaacagaatgaa

SEQ ID NO: 409094 - DNA, 25 bp, Mus musculus
gaaaggaacgcatggcacctgctct

SEQ ID NO: 409095 - DNA, 25 bp, Mus musculus
gaaaggaactccaggtctgtgccct

SEQ ID NO: 409096 - DNA, 25 bp, Mus musculus
gaaaggaactcctggtctgtgccct

SEQ ID NO: 409097 - DNA, 25 bp, Mus musculus
gaaaggaagacaccttggcccagcg

SEQ ID NO: 409098 - DNA, 25 bp, Mus musculus
gaaaggaagacagcttggcccagcg

SEQ ID NO: 409099 - DNA, 25 bp, Mus musculus
gaaaggaagccgagttcgcccagta

SEQ ID NO: 409100 - DNA, 25 bp, Mus musculus
gaaaggaagccgtgttcgcccagta

SEQ ID NO: 409101 - DNA, 25 bp, Mus musculus
gaaaggaagctcagttcccacgtca

SEQ ID NO: 409102 - DNA, 25 bp, Mus musculus
gaaaggaagctcatcctataagcta

SEQ ID NO: 409103 - DNA, 25 bp, Mus musculus
gaaaggaagctctgttcccacgtca

SEQ ID NO: 409104 - DNA, 25 bp, Mus musculus
gaaaggaagctcttcctataagcta

SEQ ID NO: 409105 - DNA, 25 bp, Mus musculus
gaaaggaaggttccctctcctttag

SEQ ID NO: 409106 - DNA, 25 bp, Mus musculus
gaaaggaaggttgcctctcctttag

SEQ ID NO: 409107 - DNA, 25 bp, Mus musculus
gaaaggaagtacaaccattgggtat

SEQ ID NO: 409108 - DNA, 25 bp, Mus musculus
gaaaggaagtactaccattgggtat

SEQ ID NO: 409109 - DNA, 25 bp, Mus musculus
gaaaggaatataactccaaacagag

SEQ ID NO: 409110 - DNA, 25 bp, Mus musculus
gaaaggaatatatctccaaacagag

SEQ ID NO: 409111 - DNA, 25 bp, Mus musculus
gaaaggaatcacaggacgctgggca

SEQ ID NO: 409112 - DNA, 25 bp, Mus musculus
gaaaggaatcactggacgctgggca

SEQ ID NO: 409113 - DNA, 25 bp, Mus musculus
gaaaggaattcaagttttcgctttt

SEQ ID NO: 409114 - DNA, 25 bp, Mus musculus
gaaaggaattcatgttttcgctttt

SEQ ID NO: 409115 - DNA, 25 bp, Mus musculus
gaaaggacaagtcggcggcaccttt

SEQ ID NO: 409116 - DNA, 25 bp, Mus musculus
gaaaggacaagtgggcggcaccttt

SEQ ID NO: 409117 - DNA, 25 bp, Mus musculus
gaaaggacagaaccactgccctaag

SEQ ID NO: 409118 - DNA, 25 bp, Mus musculus
gaaaggacagaagcactgccctaag

SEQ ID NO: 409119 - DNA, 25 bp, Mus musculus
gaaaggacagtgctttatctttact

SEQ ID NO: 409120 - DNA, 25 bp, Mus musculus
gaaaggacagtggtttatctttact

SEQ ID NO: 409121 - DNA, 25 bp, Mus musculus
gaaaggacatctcgtactcatgaca

SEQ ID NO: 409122 - DNA, 25 bp, Mus musculus
gaaaggacatctggtactcatgaca

SEQ ID NO: 409123 - DNA, 25 bp, Mus musculus
gaaaggaccagtccctgtccacttt

SEQ ID NO: 409124 - DNA, 25 bp, Mus musculus
gaaaggaccagtgcctgtccacttt

SEQ ID NO: 409125 - DNA, 25 bp, Mus musculus
gaaaggacccaacaagatgacgtcc

SEQ ID NO: 409126 - DNA, 25 bp, Mus musculus
gaaaggacccaagaagatgacgtcc

SEQ ID NO: 409127 - DNA, 25 bp, Mus musculus
gaaaggacccagaacccaagatgca

SEQ ID NO: 409128 - DNA, 25 bp, Mus musculus
gaaaggacccagtacccaagatgca

SEQ ID NO: 409129 - DNA, 25 bp, Mus musculus
gaaaggaccttcactcttcctgatg

SEQ ID NO: 409130 - DNA, 25 bp, Mus musculus
gaaaggaccttctctcttcctgatg

SEQ ID NO: 409131 - DNA, 25 bp, Mus musculus
gaaaggaccttgaaccccagagtgc

SEQ ID NO: 409132 - DNA, 25 bp, Mus musculus
gaaaggaccttgtaccccagagtgc

SEQ ID NO: 409133 - DNA, 25 bp, Mus musculus
gaaaggacggacatcctcatctcgt

SEQ ID NO: 409134 - DNA, 25 bp, Mus musculus
gaaaggacggacttcctcatctcgt

SEQ ID NO: 409135 - DNA, 25 bp, Mus musculus
gaaaggactaaaaaggtttaccatg

SEQ ID NO: 409136 - DNA, 25 bp, Mus musculus
gaaaggactaaataggtttaccatg

SEQ ID NO: 409137 - DNA, 25 bp, Mus musculus
gaaaggactactacgtggtccgcga

SEQ ID NO: 409138 - DNA, 25 bp, Mus musculus
gaaaggactacttcgtggtccgcga

SEQ ID NO: 409139 - DNA, 25 bp, Mus musculus
gaaaggactaggacacacccttggc

SEQ ID NO: 409140 - DNA, 25 bp, Mus musculus
gaaaggactaggtcacacccttggc

SEQ ID NO: 409141 - DNA, 25 bp, Mus musculus
gaaaggactcatacttagctttagg

SEQ ID NO: 409142 - DNA, 25 bp, Mus musculus
gaaaggactcattcttagctttagg

SEQ ID NO: 409143 - DNA, 25 bp, Mus musculus
gaaaggactccaacttatgtaaaag

SEQ ID NO: 409144 - DNA, 25 bp, Mus musculus
gaaaggactccatcttatgtaaaag

SEQ ID NO: 409145 - DNA, 25 bp, Mus musculus
gaaaggactcccaccgaatgtttct

SEQ ID NO: 409146 - DNA, 25 bp, Mus musculus
gaaaggactccctccgaatgtttct

SEQ ID NO: 409147 - DNA, 25 bp, Mus musculus
gaaaggactcgcagctctaaagttt

SEQ ID NO: 409148 - DNA, 25 bp, Mus musculus
gaaaggactcgctgctctaaagttt

SEQ ID NO: 409149 - DNA, 25 bp, Mus musculus
gaaaggactcttactccctgagttt

SEQ ID NO: 409150 - DNA, 25 bp, Mus musculus
gaaaggactcttatctgcccaaggg

SEQ ID NO: 409151 - DNA, 25 bp, Mus musculus
gaaaggactctttctccctgagttt

SEQ ID NO: 409152 - DNA, 25 bp, Mus musculus
gaaaggactcttttctgcccaaggg

SEQ ID NO: 409153 - DNA, 25 bp, Mus musculus
gaaaggactgctactcccaaaacag

SEQ ID NO: 409154 - DNA, 25 bp, Mus musculus
gaaaggactgcttctcccaaaacag

SEQ ID NO: 409155 - DNA, 25 bp, Mus musculus
gaaaggactggcagcccaaacttga

SEQ ID NO: 409156 - DNA, 25 bp, Mus musculus
gaaaggactggctgcccaaacttga

SEQ ID NO: 409157 - DNA, 25 bp, Mus musculus
gaaaggactgtcaccatctgattcc

SEQ ID NO: 409158 - DNA, 25 bp, Mus musculus
gaaaggactgtctccatctgattcc

SEQ ID NO: 409159 - DNA, 25 bp, Mus musculus
gaaaggactgttaccgttcaccgat

SEQ ID NO: 409160 - DNA, 25 bp, Mus musculus
gaaaggactgtttccgttcaccgat

SEQ ID NO: 409161 - DNA, 25 bp, Mus musculus
gaaaggacttacactggccacaagc

SEQ ID NO: 409162 - DNA, 25 bp, Mus musculus
gaaaggacttactctggccacaagc

SEQ ID NO: 409163 - DNA, 25 bp, Mus musculus
gaaaggacttggactctgaagacac

SEQ ID NO: 409164 - DNA, 25 bp, Mus musculus
gaaaggacttggtctctgaagacac

SEQ ID NO: 409165 - DNA, 25 bp, Mus musculus
gaaaggactttgagggcctctgtaa

SEQ ID NO: 409166 - DNA, 25 bp, Mus musculus
gaaaggactttgtgggcctctgtaa

SEQ ID NO: 409167 - DNA, 25 bp, Mus musculus
gaaaggagaacccaccagacctgtc

SEQ ID NO: 409168 - DNA, 25 bp, Mus musculus
gaaaggagaaccgaccagacctgtc

SEQ ID NO: 409169 - DNA, 25 bp, Mus musculus
gaaaggagaagcagctactgagcag

SEQ ID NO: 409170 - DNA, 25 bp, Mus musculus
gaaaggagaagctgctactgagcag

SEQ ID NO: 409171 - DNA, 25 bp, Mus musculus
gaaaggagacgtcatttcaacgatt

SEQ ID NO: 409172 - DNA, 25 bp, Mus musculus
gaaaggagacgtgatttcaacgatt

SEQ ID NO: 409173 - DNA, 25 bp, Mus musculus
gaaaggagagacatagcaaaggcat

SEQ ID NO: 409174 - DNA, 25 bp, Mus musculus
gaaaggagagacttagcaaaggcat

SEQ ID NO: 409175 - DNA, 25 bp, Mus musculus
gaaaggagagatagccacgcccaaa

SEQ ID NO: 409176 - DNA, 25 bp, Mus musculus
gaaaggagagatctcttcctcacca

SEQ ID NO: 409177 - DNA, 25 bp, Mus musculus
gaaaggagagatgtcttcctcacca

SEQ ID NO: 409178 - DNA, 25 bp, Mus musculus
gaaaggagagattgccacgcccaaa

SEQ ID NO: 409179 - DNA, 25 bp, Mus musculus
gaaaggagcaaccacccagcagttt

SEQ ID NO: 409180 - DNA, 25 bp, Mus musculus
gaaaggagcaacgacccagcagttt

SEQ ID NO: 409181 - DNA, 25 bp, Mus musculus
gaaaggagccaacacccagctgcct

SEQ ID NO: 409182 - DNA, 25 bp, Mus musculus
gaaaggagccaactggtcttcagtg

SEQ ID NO: 409183 - DNA, 25 bp, Mus musculus
gaaaggagccaagacccagctgcct

SEQ ID NO: 409184 - DNA, 25 bp, Mus musculus
gaaaggagccaagtggtcttcagtg

SEQ ID NO: 409185 - DNA, 25 bp, Mus musculus
gaaaggagcccactgactgactagt

SEQ ID NO: 409186 - DNA, 25 bp, Mus musculus
gaaaggagcccagtgactgactagt

SEQ ID NO: 409187 - DNA, 25 bp, Mus musculus
gaaaggagcctcattcctctggtgc

SEQ ID NO: 409188 - DNA, 25 bp, Mus musculus
gaaaggagcctctttcctctggtgc

SEQ ID NO: 409189 - DNA, 25 bp, Mus musculus
gaaaggagccttaaggtaaagcagg

SEQ ID NO: 409190 - DNA, 25 bp, Mus musculus
gaaaggagcctttaggtaaagcagg

SEQ ID NO: 409191 - DNA, 25 bp, Mus musculus
gaaaggagcgccagggccaactcca

SEQ ID NO: 409192 - DNA, 25 bp, Mus musculus
gaaaggagcgcctgggccaactcca

SEQ ID NO: 409193 - DNA, 25 bp, Mus musculus
gaaaggagctggctaccaccttgac

SEQ ID NO: 409194 - DNA, 25 bp, Mus musculus
gaaaggagctgggtaccaccttgac

SEQ ID NO: 409195 - DNA, 25 bp, Mus musculus
gaaaggagctgtaaatgcaagtttt

SEQ ID NO: 409196 - DNA, 25 bp, Mus musculus
gaaaggagctgttaatgcaagtttt

SEQ ID NO: 409197 - DNA, 25 bp, Mus musculus
gaaaggaggcccagaatcttctgcc

SEQ ID NO: 409198 - DNA, 25 bp, Mus musculus
gaaaggaggccctgaatcttctgcc

SEQ ID NO: 409199 - DNA, 25 bp, Mus musculus
gaaaggagggttacatagcataatt

SEQ ID NO: 409200 - DNA, 25 bp, Mus musculus
gaaaggagggtttcatagcataatt

SEQ ID NO: 409201 - DNA, 25 bp, Mus musculus
gaaaggaggtgaccagccctagcac

SEQ ID NO: 409202 - DNA, 25 bp, Mus musculus
gaaaggaggtgagcagccctagcac

SEQ ID NO: 409203 - DNA, 25 bp, Mus musculus
gaaaggaggtggcttcatctctctc

SEQ ID NO: 409204 - DNA, 25 bp, Mus musculus
gaaaggaggtgggttcatctctctc

SEQ ID NO: 409205 - DNA, 25 bp, Mus musculus
gaaaggagtacacgctcacgtgact

SEQ ID NO: 409206 - DNA, 25 bp, Mus musculus
gaaaggagtacaggctcacgtgact

SEQ ID NO: 409207 - DNA, 25 bp, Mus musculus
gaaaggagtgatcaagaggctgctg

SEQ ID NO: 409208 - DNA, 25 bp, Mus musculus
gaaaggagtgatgaagaggctgctg

SEQ ID NO: 409209 - DNA, 25 bp, Mus musculus
gaaaggagtgtaaactacattacta

SEQ ID NO: 409210 - DNA, 25 bp, Mus musculus
gaaaggagtgtatactacattacta

SEQ ID NO: 409211 - DNA, 25 bp, Mus musculus
gaaaggagtgtgaatatggcgttat

SEQ ID NO: 409212 - DNA, 25 bp, Mus musculus
gaaaggagtgtgtatatggcgttat

SEQ ID NO: 409213 - DNA, 25 bp, Mus musculus
gaaaggagttgacctcgtcctgcaa

SEQ ID NO: 409214 - DNA, 25 bp, Mus musculus
gaaaggagttgacgcccgagatacc

SEQ ID NO: 409215 - DNA, 25 bp, Mus musculus
gaaaggagttgagctcgtcctgcaa

SEQ ID NO: 409216 - DNA, 25 bp, Mus musculus
gaaaggagttgaggcccgagatacc

SEQ ID NO: 409217 - DNA, 25 bp, Mus musculus
gaaaggagtttgatgcacagcaatt

SEQ ID NO: 409218 - DNA, 25 bp, Mus musculus
gaaaggagtttgttgcacagcaatt

SEQ ID NO: 409219 - DNA, 25 bp, Mus musculus
gaaaggagttttccagtgccaaaca

SEQ ID NO: 409220 - DNA, 25 bp, Mus musculus
gaaaggagttttgcagtgccaaaca

SEQ ID NO: 409221 - DNA, 25 bp, Mus musculus
gaaaggatactcacaaaatgtgatg

SEQ ID NO: 409222 - DNA, 25 bp, Mus musculus
gaaaggatactctcaaaatgtgatg

SEQ ID NO: 409223 - DNA, 25 bp, Mus musculus
gaaaggatagctaaccaccctgtca

SEQ ID NO: 409224 - DNA, 25 bp, Mus musculus
gaaaggatagcttaccaccctgtca

SEQ ID NO: 409225 - DNA, 25 bp, Mus musculus
gaaaggatccgcatctacaagctca

SEQ ID NO: 409226 - DNA, 25 bp, Mus musculus
gaaaggatccgcttctacaagctca

SEQ ID NO: 409227 - DNA, 25 bp, Mus musculus
gaaaggatctatctcaggctccctt

SEQ ID NO: 409228 - DNA, 25 bp, Mus musculus
gaaaggatctatgtcaggctccctt

SEQ ID NO: 409229 - DNA, 25 bp, Mus musculus
gaaaggatctttatcgtgtgggcaa

SEQ ID NO: 409230 - DNA, 25 bp, Mus musculus
gaaaggatctttttcgtgtgggcaa

SEQ ID NO: 409231 - DNA, 25 bp, Mus musculus
gaaaggatgcataggagtctagcta

SEQ ID NO: 409232 - DNA, 25 bp, Mus musculus
gaaaggatgcatctctcggtcccca

SEQ ID NO: 409233 - DNA, 25 bp, Mus musculus
gaaaggatgcatgtctcggtcccca

SEQ ID NO: 409234 - DNA, 25 bp, Mus musculus
gaaaggatgcattggagtctagcta

SEQ ID NO: 409235 - DNA, 25 bp, Mus musculus
gaaaggatgcgcctagtcttactgc

SEQ ID NO: 409236 - DNA, 25 bp, Mus musculus
gaaaggatgcgcgtagtcttactgc

SEQ ID NO: 409237 - DNA, 25 bp, Mus musculus
gaaaggatgcgtatcttgccctacc

SEQ ID NO: 409238 - DNA, 25 bp, Mus musculus
gaaaggatgcgtttcttgccctacc

SEQ ID NO: 409239 - DNA, 25 bp, Mus musculus
gaaaggatgctgctctcactgctgt

SEQ ID NO: 409240 - DNA, 25 bp, Mus musculus
gaaaggatgctggtctcactgctgt

SEQ ID NO: 409241 - DNA, 25 bp, Mus musculus
gaaaggatggtcacgctggtgcctc

SEQ ID NO: 409242 - DNA, 25 bp, Mus musculus
gaaaggatggtctcgctggtgcctc

SEQ ID NO: 409243 - DNA, 25 bp, Mus musculus
gaaaggattatcctggcttgttgct

SEQ ID NO: 409244 - DNA, 25 bp, Mus musculus
gaaaggattatcgtggcttgttgct

SEQ ID NO: 409245 - DNA, 25 bp, Mus musculus
gaaaggattggcactctgatcattt

SEQ ID NO: 409246 - DNA, 25 bp, Mus musculus
gaaaggattggctctctgatcattt

SEQ ID NO: 409247 - DNA, 25 bp, Mus musculus
gaaaggatttccatgcaaaccccac

SEQ ID NO: 409248 - DNA, 25 bp, Mus musculus
gaaaggatttccttgcaaaccccac

SEQ ID NO: 409249 - DNA, 25 bp, Mus musculus
gaaaggatttgccacgggacttaag

SEQ ID NO: 409250 - DNA, 25 bp, Mus musculus
gaaaggatttgcgacgggacttaag

SEQ ID NO: 409251 - DNA, 25 bp, Mus musculus
gaaaggcaacacaagctgaagcatg

SEQ ID NO: 409252 - DNA, 25 bp, Mus musculus
gaaaggcaacactagctgaagcatg

SEQ ID NO: 409253 - DNA, 25 bp, Mus musculus
gaaaggcaacctcacaacaccgagg

SEQ ID NO: 409254 - DNA, 25 bp, Mus musculus
gaaaggcaacctgacaacaccgagg

SEQ ID NO: 409255 - DNA, 25 bp, Mus musculus
gaaaggcaactcatatccatcataa

SEQ ID NO: 409256 - DNA, 25 bp, Mus musculus
gaaaggcaactcttatccatcataa

SEQ ID NO: 409257 - DNA, 25 bp, Mus musculus
gaaaggcaagccagggaaacgcaga

SEQ ID NO: 409258 - DNA, 25 bp, Mus musculus
gaaaggcaagcctgggaaacgcaga

SEQ ID NO: 409259 - DNA, 25 bp, Mus musculus
gaaaggcaaggaacacttcgccctt

SEQ ID NO: 409260 - DNA, 25 bp, Mus musculus
gaaaggcaaggatcacttcgccctt

SEQ ID NO: 409261 - DNA, 25 bp, Mus musculus
gaaaggcacacgatgctggtcgcac

SEQ ID NO: 409262 - DNA, 25 bp, Mus musculus
gaaaggcacacgttgctggtcgcac

SEQ ID NO: 409263 - DNA, 25 bp, Mus musculus
gaaaggcacactctcttaatcacca

SEQ ID NO: 409264 - DNA, 25 bp, Mus musculus
gaaaggcacactgtcttaatcacca

SEQ ID NO: 409265 - DNA, 25 bp, Mus musculus
gaaaggcacctgagtctaactctgc

SEQ ID NO: 409266 - DNA, 25 bp, Mus musculus
gaaaggcacctgtgtctaactctgc

SEQ ID NO: 409267 - DNA, 25 bp, Mus musculus
gaaaggcaccttcacggacgacctg

SEQ ID NO: 409268 - DNA, 25 bp, Mus musculus
gaaaggcaccttgacggacgacctg

SEQ ID NO: 409269 - DNA, 25 bp, Mus musculus
gaaaggcactaacaactgtgtttgg

SEQ ID NO: 409270 - DNA, 25 bp, Mus musculus
gaaaggcactaagaactgtgtttgg

SEQ ID NO: 409271 - DNA, 25 bp, Mus musculus
gaaaggcagaaaagccctaacccca

SEQ ID NO: 409272 - DNA, 25 bp, Mus musculus
gaaaggcagaaatgccctaacccca

SEQ ID NO: 409273 - DNA, 25 bp, Mus musculus
gaaaggcagaacacctcttccggat

SEQ ID NO: 409274 - DNA, 25 bp, Mus musculus
gaaaggcagaactcctcttccggat

SEQ ID NO: 409275 - DNA, 25 bp, Mus musculus
gaaaggcagcaccatcagcacaaaa

SEQ ID NO: 409276 - DNA, 25 bp, Mus musculus
gaaaggcagcacgatcagcacaaaa

SEQ ID NO: 409277 - DNA, 25 bp, Mus musculus
gaaaggcagccgcaggatatttttt

SEQ ID NO: 409278 - DNA, 25 bp, Mus musculus
gaaaggcagccggaggatatttttt

SEQ ID NO: 409279 - DNA, 25 bp, Mus musculus
gaaaggcaggagctagcacctctct

SEQ ID NO: 409280 - DNA, 25 bp, Mus musculus
gaaaggcaggaggtagcacctctct

SEQ ID NO: 409281 - DNA, 25 bp, Mus musculus
gaaaggcaggctaatcattgatttt

SEQ ID NO: 409282 - DNA, 25 bp, Mus musculus
gaaaggcaggcttatcattgatttt

SEQ ID NO: 409283 - DNA, 25 bp, Mus musculus
gaaaggcagtgtatattaaaatcac

SEQ ID NO: 409284 - DNA, 25 bp, Mus musculus
gaaaggcagtgtttattaaaatcac

SEQ ID NO: 409285 - DNA, 25 bp, Mus musculus
gaaaggcatatacctggttggtaca

SEQ ID NO: 409286 - DNA, 25 bp, Mus musculus
gaaaggcatatagctggttggtaca

SEQ ID NO: 409287 - DNA, 25 bp, Mus musculus
gaaaggcatcgacgaaccaggagct

SEQ ID NO: 409288 - DNA, 25 bp, Mus musculus
gaaaggcatcgaggaaccaggagct

SEQ ID NO: 409289 - DNA, 25 bp, Mus musculus
gaaaggcatcggacattgtccccag

SEQ ID NO: 409290 - DNA, 25 bp, Mus musculus
gaaaggcatcggtcattgtccccag

SEQ ID NO: 409291 - DNA, 25 bp, Mus musculus
gaaaggcatcgtaccatactgagaa

SEQ ID NO: 409292 - DNA, 25 bp, Mus musculus
gaaaggcatcgttccatactgagaa

SEQ ID NO: 409293 - DNA, 25 bp, Mus musculus
gaaaggcatgccagccagcctttat

SEQ ID NO: 409294 - DNA, 25 bp, Mus musculus
gaaaggcatgcctgccagcctttat

SEQ ID NO: 409295 - DNA, 25 bp, Mus musculus
gaaaggcatggcacacaatgttggt

SEQ ID NO: 409296 - DNA, 25 bp, Mus musculus
gaaaggcatggctcacaatgttggt

SEQ ID NO: 409297 - DNA, 25 bp, Mus musculus
gaaaggcattacatttgtcttcttg

SEQ ID NO: 409298 - DNA, 25 bp, Mus musculus
gaaaggcattacttttgtcttcttg

SEQ ID NO: 409299 - DNA, 25 bp, Mus musculus
gaaaggcattcacccaaagcgccta

SEQ ID NO: 409300 - DNA, 25 bp, Mus musculus
gaaaggcattcagccaaagcgccta

SEQ ID NO: 409301 - DNA, 25 bp, Mus musculus
gaaaggcattccagtgaccgtcaga

SEQ ID NO: 409302 - DNA, 25 bp, Mus musculus
gaaaggcattcctgtgaccgtcaga

SEQ ID NO: 409303 - DNA, 25 bp, Mus musculus
gaaaggcatttactgtggtttatgt

SEQ ID NO: 409304 - DNA, 25 bp, Mus musculus
gaaaggcatttagtgtggtttatgt

SEQ ID NO: 409305 - DNA, 25 bp, Mus musculus
gaaaggcatttcaccttatctcctc

SEQ ID NO: 409306 - DNA, 25 bp, Mus musculus
gaaaggcatttctccttatctcctc

SEQ ID NO: 409307 - DNA, 25 bp, Mus musculus
gaaaggccaaatagttccacaacca

SEQ ID NO: 409308 - DNA, 25 bp, Mus musculus
gaaaggccaaattgttccacaacca

SEQ ID NO: 409309 - DNA, 25 bp, Mus musculus
gaaaggccaactacgaagaaaagct

SEQ ID NO: 409310 - DNA, 25 bp, Mus musculus
gaaaggccaacttcgaagaaaagct

SEQ ID NO: 409311 - DNA, 25 bp, Mus musculus
gaaaggccaagtaatccggtgataa

SEQ ID NO: 409312 - DNA, 25 bp, Mus musculus
gaaaggccaagttatccggtgataa

SEQ ID NO: 409313 - DNA, 25 bp, Mus musculus
gaaaggccaatcagaccattatatt

SEQ ID NO: 409314 - DNA, 25 bp, Mus musculus
gaaaggccaatcagctctataaaat

SEQ ID NO: 409315 - DNA, 25 bp, Mus musculus
gaaaggccaatcctcttaggagcat

SEQ ID NO: 409316 - DNA, 25 bp, Mus musculus
gaaaggccaatcgtcttaggagcat

SEQ ID NO: 409317 - DNA, 25 bp, Mus musculus
gaaaggccaatctgaccattatatt

SEQ ID NO: 409318 - DNA, 25 bp, Mus musculus
gaaaggccaatctgctctataaaat

SEQ ID NO: 409319 - DNA, 25 bp, Mus musculus
gaaaggccaccgcagacaacctgat

SEQ ID NO: 409320 - DNA, 25 bp, Mus musculus
gaaaggccaccggagacaacctgat

SEQ ID NO: 409321 - DNA, 25 bp, Mus musculus
gaaaggccacttccatttaatatct

SEQ ID NO: 409322 - DNA, 25 bp, Mus musculus
gaaaggccacttgcatttaatatct

SEQ ID NO: 409323 - DNA, 25 bp, Mus musculus
gaaaggccagtgcagagttcacagc

SEQ ID NO: 409324 - DNA, 25 bp, Mus musculus
gaaaggccagtggagagttcacagc

SEQ ID NO: 409325 - DNA, 25 bp, Mus musculus
gaaaggccatctagacccagtggga

SEQ ID NO: 409326 - DNA, 25 bp, Mus musculus
gaaaggccatcttgacccagtggga

SEQ ID NO: 409327 - DNA, 25 bp, Mus musculus
gaaaggccatttccttggaactgct

SEQ ID NO: 409328 - DNA, 25 bp, Mus musculus
gaaaggccatttgcttggaactgct

SEQ ID NO: 409329 - DNA, 25 bp, Mus musculus
gaaaggcccactcaaatgatgcttt

SEQ ID NO: 409330 - DNA, 25 bp, Mus musculus
gaaaggcccactgaaatgatgcttt

SEQ ID NO: 409331 - DNA, 25 bp, Mus musculus
gaaaggcccagaatccccatagagt

SEQ ID NO: 409332 - DNA, 25 bp, Mus musculus
gaaaggcccagattccccatagagt

SEQ ID NO: 409333 - DNA, 25 bp, Mus musculus
gaaaggcccatccaagaagccgatg

SEQ ID NO: 409334 - DNA, 25 bp, Mus musculus
gaaaggcccatcgaagaagccgatg

SEQ ID NO: 409335 - DNA, 25 bp, Mus musculus
gaaaggcccattctgtttataactt

SEQ ID NO: 409336 - DNA, 25 bp, Mus musculus
gaaaggcccattgtgtttataactt

SEQ ID NO: 409337 - DNA, 25 bp, Mus musculus
gaaaggccccacaatagtcagaaaa

SEQ ID NO: 409338 - DNA, 25 bp, Mus musculus
gaaaggccccacattagtgttgatt

SEQ ID NO: 409339 - DNA, 25 bp, Mus musculus
gaaaggccccactatagtcagaaaa

SEQ ID NO: 409340 - DNA, 25 bp, Mus musculus
gaaaggccccactttagtgttgatt

SEQ ID NO: 409341 - DNA, 25 bp, Mus musculus
gaaaggcccgggagctctacgacta

SEQ ID NO: 409342 - DNA, 25 bp, Mus musculus
gaaaggcccgggtgctctacgacta

SEQ ID NO: 409343 - DNA, 25 bp, Mus musculus
gaaaggccctatctgttttggacaa

SEQ ID NO: 409344 - DNA, 25 bp, Mus musculus
gaaaggccctatgtgttttggacaa

SEQ ID NO: 409345 - DNA, 25 bp, Mus musculus
gaaaggccgattacttacctattgg

SEQ ID NO: 409346 - DNA, 25 bp, Mus musculus
gaaaggccgatttcttacctattgg

SEQ ID NO: 409347 - DNA, 25 bp, Mus musculus
gaaaggccgctccagctggtctcct

SEQ ID NO: 409348 - DNA, 25 bp, Mus musculus
gaaaggccgctcgagctggtctcct

SEQ ID NO: 409349 - DNA, 25 bp, Mus musculus
gaaaggcctcaaaactaaattgata

SEQ ID NO: 409350 - DNA, 25 bp, Mus musculus
gaaaggcctcaatactaaattgata

SEQ ID NO: 409351 - DNA, 25 bp, Mus musculus
gaaaggcctcttccgccaagggatg

SEQ ID NO: 409352 - DNA, 25 bp, Mus musculus
gaaaggcctcttgcgccaagggatg

SEQ ID NO: 409353 - DNA, 25 bp, Mus musculus
gaaaggcctgaaccggtacaccgag

SEQ ID NO: 409354 - DNA, 25 bp, Mus musculus
gaaaggcctgaagcggtacaccgag

SEQ ID NO: 409355 - DNA, 25 bp, Mus musculus
gaaaggcctggcagccccggtgctt

SEQ ID NO: 409356 - DNA, 25 bp, Mus musculus
gaaaggcctggcatacatccagtct

SEQ ID NO: 409357 - DNA, 25 bp, Mus musculus
gaaaggcctggctgccccggtgctt

SEQ ID NO: 409358 - DNA, 25 bp, Mus musculus
gaaaggcctggcttacatccagtct

SEQ ID NO: 409359 - DNA, 25 bp, Mus musculus
gaaaggccttctaaccatggtgcta

SEQ ID NO: 409360 - DNA, 25 bp, Mus musculus
gaaaggccttcttaccatggtgcta

SEQ ID NO: 409361 - DNA, 25 bp, Mus musculus
gaaaggcctttaatggttgaatctc

SEQ ID NO: 409362 - DNA, 25 bp, Mus musculus
gaaaggcctttacccaatgttcaag

SEQ ID NO: 409363 - DNA, 25 bp, Mus musculus
gaaaggcctttagccaatgttcaag

SEQ ID NO: 409364 - DNA, 25 bp, Mus musculus
gaaaggcctttattggttgaatctc

SEQ ID NO: 409365 - DNA, 25 bp, Mus musculus
gaaaggcgagacaccggttacttct

SEQ ID NO: 409366 - DNA, 25 bp, Mus musculus
gaaaggcgagactccggttacttct

SEQ ID NO: 409367 - DNA, 25 bp, Mus musculus
gaaaggcgccctacgtgaaagttgt

SEQ ID NO: 409368 - DNA, 25 bp, Mus musculus
gaaaggcgcccttcgtgaaagttgt

SEQ ID NO: 409369 - DNA, 25 bp, Mus musculus
gaaaggcgcctgcaagagctgttta

SEQ ID NO: 409370 - DNA, 25 bp, Mus musculus
gaaaggcgcctggaagagctgttta

SEQ ID NO: 409371 - DNA, 25 bp, Mus musculus
gaaaggcgcggaagtcccaggcgcg

SEQ ID NO: 409372 - DNA, 25 bp, Mus musculus
gaaaggcgcggatgtcccaggcgcg

SEQ ID NO: 409373 - DNA, 25 bp, Mus musculus
gaaaggcgctaaagccattgtaaat

SEQ ID NO: 409374 - DNA, 25 bp, Mus musculus
gaaaggcgctaatgccattgtaaat

SEQ ID NO: 409375 - DNA, 25 bp, Mus musculus
gaaaggcgctctaatggaacagata

SEQ ID NO: 409376 - DNA, 25 bp, Mus musculus
gaaaggcgctcttatggaacagata

SEQ ID NO: 409377 - DNA, 25 bp, Mus musculus
gaaaggcggacccaccaggctaaca

SEQ ID NO: 409378 - DNA, 25 bp, Mus musculus
gaaaggcggaccgaccaggctaaca

SEQ ID NO: 409379 - DNA, 25 bp, Mus musculus
gaaaggcggccaaggtttccaaaag

SEQ ID NO: 409380 - DNA, 25 bp, Mus musculus
gaaaggcggccatggtttccaaaag

SEQ ID NO: 409381 - DNA, 25 bp, Mus musculus
gaaaggcgggccactgtccagaagt

SEQ ID NO: 409382 - DNA, 25 bp, Mus musculus
gaaaggcgggcctctgtccagaagt

SEQ ID NO: 409383 - DNA, 25 bp, Mus musculus
gaaaggcggtccaaatccacccact

SEQ ID NO: 409384 - DNA, 25 bp, Mus musculus
gaaaggcggtcctaatccacccact

SEQ ID NO: 409385 - DNA, 25 bp, Mus musculus
gaaaggcggtttcgccaggcttact

SEQ ID NO: 409386 - DNA, 25 bp, Mus musculus
gaaaggcggtttggccaggcttact

SEQ ID NO: 409387 - DNA, 25 bp, Mus musculus
gaaaggcgtgacatccacaagagtt

SEQ ID NO: 409388 - DNA, 25 bp, Mus musculus
gaaaggcgtgacttccacaagagtt

SEQ ID NO: 409389 - DNA, 25 bp, Mus musculus
gaaaggcgtgtcatacacagctaac

SEQ ID NO: 409390 - DNA, 25 bp, Mus musculus
gaaaggcgtgtcttacacagctaac

SEQ ID NO: 409391 - DNA, 25 bp, Mus musculus
gaaaggctaaaccaacctcgtgcta

SEQ ID NO: 409392 - DNA, 25 bp, Mus musculus
gaaaggctaaacgaacctcgtgcta

SEQ ID NO: 409393 - DNA, 25 bp, Mus musculus
gaaaggctaacgaggcattcctacc

SEQ ID NO: 409394 - DNA, 25 bp, Mus musculus
gaaaggctaacgtggcattcctacc

SEQ ID NO: 409395 - DNA, 25 bp, Mus musculus
gaaaggctactcaggcttcatcacc

SEQ ID NO: 409396 - DNA, 25 bp, Mus musculus
gaaaggctactccttggtcagtctt

SEQ ID NO: 409397 - DNA, 25 bp, Mus musculus
gaaaggctactcgttggtcagtctt

SEQ ID NO: 409398 - DNA, 25 bp, Mus musculus
gaaaggctactctggcttcatcacc

SEQ ID NO: 409399 - DNA, 25 bp, Mus musculus
gaaaggctagaaaccctcttggctt

SEQ ID NO: 409400 - DNA, 25 bp, Mus musculus
gaaaggctagaatccctcttggctt

SEQ ID NO: 409401 - DNA, 25 bp, Mus musculus
gaaaggctagatatcctctctgctc

SEQ ID NO: 409402 - DNA, 25 bp, Mus musculus
gaaaggctagatttcctctctgctc

SEQ ID NO: 409403 - DNA, 25 bp, Mus musculus
gaaaggctagcacatgtcagaggaa

SEQ ID NO: 409404 - DNA, 25 bp, Mus musculus
gaaaggctagcagatgtcagaggaa

SEQ ID NO: 409405 - DNA, 25 bp, Mus musculus
gaaaggctagggatggcctccacca

SEQ ID NO: 409406 - DNA, 25 bp, Mus musculus
gaaaggctagggttggcctccacca

SEQ ID NO: 409407 - DNA, 25 bp, Mus musculus
gaaaggctatagacactggcatgca

SEQ ID NO: 409408 - DNA, 25 bp, Mus musculus
gaaaggctatagtcactggcatgca

SEQ ID NO: 409409 - DNA, 25 bp, Mus musculus
gaaaggctattaaacagaaactgat

SEQ ID NO: 409410 - DNA, 25 bp, Mus musculus
gaaaggctattatacagaaactgat

SEQ ID NO: 409411 - DNA, 25 bp, Mus musculus
gaaaggctcagtcctaccctgggac

SEQ ID NO: 409412 - DNA, 25 bp, Mus musculus
gaaaggctcagtgctaccctgggac

SEQ ID NO: 409413 - DNA, 25 bp, Mus musculus
gaaaggctccagctatggcaaccaa

SEQ ID NO: 409414 - DNA, 25 bp, Mus musculus
gaaaggctccaggtatggcaaccaa

SEQ ID NO: 409415 - DNA, 25 bp, Mus musculus
gaaaggctccctactaaatgtctta

SEQ ID NO: 409416 - DNA, 25 bp, Mus musculus
gaaaggctcccttctaaatgtctta

SEQ ID NO: 409417 - DNA, 25 bp, Mus musculus
gaaaggctcctcatatgggtgagaa

SEQ ID NO: 409418 - DNA, 25 bp, Mus musculus
gaaaggctcctcttatgggtgagaa

SEQ ID NO: 409419 - DNA, 25 bp, Mus musculus
gaaaggctcgtcacatgttttggga

SEQ ID NO: 409420 - DNA, 25 bp, Mus musculus
gaaaggctcgtctcatgttttggga

SEQ ID NO: 409421 - DNA, 25 bp, Mus musculus
gaaaggctctctagcactgctgtga

SEQ ID NO: 409422 - DNA, 25 bp, Mus musculus
gaaaggctctcttgcactgctgtga

SEQ ID NO: 409423 - DNA, 25 bp, Mus musculus
gaaaggctctgcaatcacaggtcca

SEQ ID NO: 409424 - DNA, 25 bp, Mus musculus
gaaaggctctgctatcacaggtcca

SEQ ID NO: 409425 - DNA, 25 bp, Mus musculus
gaaaggctctgtcgcataatatgag

SEQ ID NO: 409426 - DNA, 25 bp, Mus musculus
gaaaggctctgtggcataatatgag

SEQ ID NO: 409427 - DNA, 25 bp, Mus musculus
gaaaggctcttcatgaatggctgat

SEQ ID NO: 409428 - DNA, 25 bp, Mus musculus
gaaaggctcttccagtgtgatgctt

SEQ ID NO: 409429 - DNA, 25 bp, Mus musculus
gaaaggctcttccattcatatgtac

SEQ ID NO: 409430 - DNA, 25 bp, Mus musculus
gaaaggctcttcgagtgtgatgctt

SEQ ID NO: 409431 - DNA, 25 bp, Mus musculus
gaaaggctcttcgattcatatgtac

SEQ ID NO: 409432 - DNA, 25 bp, Mus musculus
gaaaggctcttcttgaatggctgat

SEQ ID NO: 409433 - DNA, 25 bp, Mus musculus
gaaaggctctttagacctaacttgt

SEQ ID NO: 409434 - DNA, 25 bp, Mus musculus
gaaaggctcttttgacctaacttgt

SEQ ID NO: 409435 - DNA, 25 bp, Mus musculus
gaaaggctgaatctggatggttcca

SEQ ID NO: 409436 - DNA, 25 bp, Mus musculus
gaaaggctgaatgtggatggttcca

SEQ ID NO: 409437 - DNA, 25 bp, Mus musculus
gaaaggctgaccagggatgtctacc

SEQ ID NO: 409438 - DNA, 25 bp, Mus musculus
gaaaggctgacctgggatgtctacc

SEQ ID NO: 409439 - DNA, 25 bp, Mus musculus
gaaaggctgactacagacattctgt

SEQ ID NO: 409440 - DNA, 25 bp, Mus musculus
gaaaggctgacttcagacattctgt

SEQ ID NO: 409441 - DNA, 25 bp, Mus musculus
gaaaggctgatgattgatgctctac

SEQ ID NO: 409442 - DNA, 25 bp, Mus musculus
gaaaggctgatgtttgatgctctac

SEQ ID NO: 409443 - DNA, 25 bp, Mus musculus
gaaaggctgggcacaaacgcttaaa

SEQ ID NO: 409444 - DNA, 25 bp, Mus musculus
gaaaggctgggctcaaacgcttaaa

SEQ ID NO: 409445 - DNA, 25 bp, Mus musculus
gaaaggctgttcaatttaatcgtgt

SEQ ID NO: 409446 - DNA, 25 bp, Mus musculus
gaaaggctgttctatttaatcgtgt

SEQ ID NO: 409447 - DNA, 25 bp, Mus musculus
gaaaggcttagtagcttgctatgca

SEQ ID NO: 409448 - DNA, 25 bp, Mus musculus
gaaaggcttagttgcttgctatgca

SEQ ID NO: 409449 - DNA, 25 bp, Mus musculus
gaaaggcttccaaaacaagcagtaa

SEQ ID NO: 409450 - DNA, 25 bp, Mus musculus
gaaaggcttccataacaagcagtaa

SEQ ID NO: 409451 - DNA, 25 bp, Mus musculus
gaaaggcttcctactcggctgtgag

SEQ ID NO: 409452 - DNA, 25 bp, Mus musculus
gaaaggcttccttctcggctgtgag

SEQ ID NO: 409453 - DNA, 25 bp, Mus musculus
gaaaggcttgcacatgaccgggccc

SEQ ID NO: 409454 - DNA, 25 bp, Mus musculus
gaaaggcttgcagatgaccgggccc

SEQ ID NO: 409455 - DNA, 25 bp, Mus musculus
gaaaggcttggaacctgagaagaac

SEQ ID NO: 409456 - DNA, 25 bp, Mus musculus
gaaaggcttggatcctgagaagaac

SEQ ID NO: 409457 - DNA, 25 bp, Mus musculus
gaaaggcttggcactgggtcccaga

SEQ ID NO: 409458 - DNA, 25 bp, Mus musculus
gaaaggcttggctctgggtcccaga

SEQ ID NO: 409459 - DNA, 25 bp, Mus musculus
gaaaggctttcgctctcttagtcac

SEQ ID NO: 409460 - DNA, 25 bp, Mus musculus
gaaaggctttcggtctcttagtcac

SEQ ID NO: 409461 - DNA, 25 bp, Mus musculus
gaaaggctttctagacagctatatt

SEQ ID NO: 409462 - DNA, 25 bp, Mus musculus
gaaaggctttcttgacagctatatt

SEQ ID NO: 409463 - DNA, 25 bp, Mus musculus
gaaaggctttggcagaatcttggaa

SEQ ID NO: 409464 - DNA, 25 bp, Mus musculus
gaaaggctttgggagaatcttggaa

SEQ ID NO: 409465 - DNA, 25 bp, Mus musculus
gaaaggctttgtaaataccaatata

SEQ ID NO: 409466 - DNA, 25 bp, Mus musculus
gaaaggctttgttaataccaatata

SEQ ID NO: 409467 - DNA, 25 bp, Mus musculus
gaaaggcttttccacttgctggcta

SEQ ID NO: 409468 - DNA, 25 bp, Mus musculus
gaaaggcttttcgacttgctggcta

SEQ ID NO: 409469 - DNA, 25 bp, Mus musculus
gaaaggcttttgcttcttctatctt

SEQ ID NO: 409470 - DNA, 25 bp, Mus musculus
gaaaggcttttggttcttctatctt

SEQ ID NO: 409471 - DNA, 25 bp, Mus musculus
gaaaggctttttcttgacacatcat

SEQ ID NO: 409472 - DNA, 25 bp, Mus musculus
gaaaggctttttgttgacacatcat

SEQ ID NO: 409473 - DNA, 25 bp, Mus musculus
gaaagggaaactctgtccaattgat

SEQ ID NO: 409474 - DNA, 25 bp, Mus musculus
gaaagggaaactgtgtccaattgat

SEQ ID NO: 409475 - DNA, 25 bp, Mus musculus
gaaagggaacaacagcccgtcacct

SEQ ID NO: 409476 - DNA, 25 bp, Mus musculus
gaaagggaacaagagcccgtcacct

SEQ ID NO: 409477 - DNA, 25 bp, Mus musculus
gaaagggaacctactctggcacaag

SEQ ID NO: 409478 - DNA, 25 bp, Mus musculus
gaaagggaaccttctctggcacaag

SEQ ID NO: 409479 - DNA, 25 bp, Mus musculus
gaaagggaatgtcccagcctagctc

SEQ ID NO: 409480 - DNA, 25 bp, Mus musculus
gaaagggaatgtgccagcctagctc

SEQ ID NO: 409481 - DNA, 25 bp, Mus musculus
gaaagggaattgctagctgacataa

SEQ ID NO: 409482 - DNA, 25 bp, Mus musculus
gaaagggaattggtagctgacataa

SEQ ID NO: 409483 - DNA, 25 bp, Mus musculus
gaaagggacccgacttcacgacacg

SEQ ID NO: 409484 - DNA, 25 bp, Mus musculus
gaaagggacccgtcttcacgacacg

SEQ ID NO: 409485 - DNA, 25 bp, Mus musculus
gaaagggaccctacccagcagacta

SEQ ID NO: 409486 - DNA, 25 bp, Mus musculus
gaaagggaccctcaattgcctccca

SEQ ID NO: 409487 - DNA, 25 bp, Mus musculus
gaaagggaccctgaattgcctccca

SEQ ID NO: 409488 - DNA, 25 bp, Mus musculus
gaaagggacccttcccagcagacta

SEQ ID NO: 409489 - DNA, 25 bp, Mus musculus
gaaagggactagagcttgccaaagg

SEQ ID NO: 409490 - DNA, 25 bp, Mus musculus
gaaagggactagtgcttgccaaagg

SEQ ID NO: 409491 - DNA, 25 bp, Mus musculus
gaaagggacttaccgttaggcatat

SEQ ID NO: 409492 - DNA, 25 bp, Mus musculus
gaaagggacttagcgttaggcatat

SEQ ID NO: 409493 - DNA, 25 bp, Mus musculus
gaaagggagagtatacatgccggtt

SEQ ID NO: 409494 - DNA, 25 bp, Mus musculus
gaaagggagagtttacatgccggtt

SEQ ID NO: 409495 - DNA, 25 bp, Mus musculus
gaaagggagcctagcctgagtgcca

SEQ ID NO: 409496 - DNA, 25 bp, Mus musculus
gaaagggagccttgcctgagtgcca

SEQ ID NO: 409497 - DNA, 25 bp, Mus musculus
gaaagggagctgagctcacactgcc

SEQ ID NO: 409498 - DNA, 25 bp, Mus musculus
gaaagggagctgtgctcacactgcc

SEQ ID NO: 409499 - DNA, 25 bp, Mus musculus
gaaagggaggcaactgaactcacaa

SEQ ID NO: 409500 - DNA, 25 bp, Mus musculus
gaaagggaggcacgaagtacacaca

SEQ ID NO: 409501 - DNA, 25 bp, Mus musculus
gaaagggaggcaggaagtacacaca

SEQ ID NO: 409502 - DNA, 25 bp, Mus musculus
gaaagggaggcatctgaactcacaa

SEQ ID NO: 409503 - DNA, 25 bp, Mus musculus
gaaagggaggttcaccatctcaaga

SEQ ID NO: 409504 - DNA, 25 bp, Mus musculus
gaaagggaggttgaccatctcaaga

SEQ ID NO: 409505 - DNA, 25 bp, Mus musculus
gaaagggatatgaggtttccagagt

SEQ ID NO: 409506 - DNA, 25 bp, Mus musculus
gaaagggatatgtggtttccagagt

SEQ ID NO: 409507 - DNA, 25 bp, Mus musculus
gaaagggatcctcggcatggctccc

SEQ ID NO: 409508 - DNA, 25 bp, Mus musculus
gaaagggatcctcgttagctcctac

SEQ ID NO: 409509 - DNA, 25 bp, Mus musculus
gaaagggatcctgggcatggctccc

SEQ ID NO: 409510 - DNA, 25 bp, Mus musculus
gaaagggatcctggttagctcctac

SEQ ID NO: 409511 - DNA, 25 bp, Mus musculus
gaaagggatgctccgttcagccatt

SEQ ID NO: 409512 - DNA, 25 bp, Mus musculus
gaaagggatgctgcgttcagccatt

SEQ ID NO: 409513 - DNA, 25 bp, Mus musculus
gaaagggatgtgaaccgctgtccgc

SEQ ID NO: 409514 - DNA, 25 bp, Mus musculus
gaaagggatgtgtaccgctgtccgc

SEQ ID NO: 409515 - DNA, 25 bp, Mus musculus
gaaagggattcactgagatctacgt

SEQ ID NO: 409516 - DNA, 25 bp, Mus musculus
gaaagggattcagtgagatctacgt

SEQ ID NO: 409517 - DNA, 25 bp, Mus musculus
gaaagggcaaagagaacatctcaaa

SEQ ID NO: 409518 - DNA, 25 bp, Mus musculus
gaaagggcaaagtgaacatctcaaa

SEQ ID NO: 409519 - DNA, 25 bp, Mus musculus
gaaagggcactgatttatttggtat

SEQ ID NO: 409520 - DNA, 25 bp, Mus musculus
gaaagggcactgttttatttggtat

SEQ ID NO: 409521 - DNA, 25 bp, Mus musculus
gaaagggcagagatgacactagaaa

SEQ ID NO: 409522 - DNA, 25 bp, Mus musculus
gaaagggcagagttgacactagaaa

SEQ ID NO: 409523 - DNA, 25 bp, Mus musculus
gaaagggcagcgatgctcattgaga

SEQ ID NO: 409524 - DNA, 25 bp, Mus musculus
gaaagggcagcgttgctcattgaga

SEQ ID NO: 409525 - DNA, 25 bp, Mus musculus
gaaagggcaggacgtttatgttctt

SEQ ID NO: 409526 - DNA, 25 bp, Mus musculus
gaaagggcaggaggtttatgttctt

SEQ ID NO: 409527 - DNA, 25 bp, Mus musculus
gaaagggcataacgtgttcacattg

SEQ ID NO: 409528 - DNA, 25 bp, Mus musculus
gaaagggcataaggtgttcacattg

SEQ ID NO: 409529 - DNA, 25 bp, Mus musculus
gaaagggcatgcacctttcttccca

SEQ ID NO: 409530 - DNA, 25 bp, Mus musculus
gaaagggcatgctcctttcttccca

SEQ ID NO: 409531 - DNA, 25 bp, Mus musculus
gaaagggccaacagtggcagctaca

SEQ ID NO: 409532 - DNA, 25 bp, Mus musculus
gaaagggccaactgtggcagctaca

SEQ ID NO: 409533 - DNA, 25 bp, Mus musculus
gaaagggccattcctctcttagagt

SEQ ID NO: 409534 - DNA, 25 bp, Mus musculus
gaaagggccattgctctcttagagt

SEQ ID NO: 409535 - DNA, 25 bp, Mus musculus
gaaagggcccaaccaccagttctgt

SEQ ID NO: 409536 - DNA, 25 bp, Mus musculus
gaaagggcccaagcaccagttctgt

SEQ ID NO: 409537 - DNA, 25 bp, Mus musculus
gaaagggcccggaggtcagcttctc

SEQ ID NO: 409538 - DNA, 25 bp, Mus musculus
gaaagggcccggtggtcagcttctc

SEQ ID NO: 409539 - DNA, 25 bp, Mus musculus
gaaagggccggacaagcagcttcca

SEQ ID NO: 409540 - DNA, 25 bp, Mus musculus
gaaagggccggagaagcagcttcca

SEQ ID NO: 409541 - DNA, 25 bp, Mus musculus
gaaagggccggtctctgaatgcata

SEQ ID NO: 409542 - DNA, 25 bp, Mus musculus
gaaagggccggtgtctgaatgcata

SEQ ID NO: 409543 - DNA, 25 bp, Mus musculus
gaaagggcctcacaggacaacccag

SEQ ID NO: 409544 - DNA, 25 bp, Mus musculus
gaaagggcctcagaggacaacccag

SEQ ID NO: 409545 - DNA, 25 bp, Mus musculus
gaaagggctcaactccacactggga

SEQ ID NO: 409546 - DNA, 25 bp, Mus musculus
gaaagggctcaagtccacactggga

SEQ ID NO: 409547 - DNA, 25 bp, Mus musculus
gaaagggctcagagagaaaacttcg

SEQ ID NO: 409548 - DNA, 25 bp, Mus musculus
gaaagggctcagtgagaaaacttcg

SEQ ID NO: 409549 - DNA, 25 bp, Mus musculus
gaaagggctccacccctctgcaaaa

SEQ ID NO: 409550 - DNA, 25 bp, Mus musculus
gaaagggctccagccctctgcaaaa

SEQ ID NO: 409551 - DNA, 25 bp, Mus musculus
gaaagggctgcaacagaccccagct

SEQ ID NO: 409552 - DNA, 25 bp, Mus musculus
gaaagggctgcaattagcacaggaa

SEQ ID NO: 409553 - DNA, 25 bp, Mus musculus
gaaagggctgcatcagaccccagct

SEQ ID NO: 409554 - DNA, 25 bp, Mus musculus
gaaagggctgcatttagcacaggaa

SEQ ID NO: 409555 - DNA, 25 bp, Mus musculus
gaaagggctggaagatttagcttta

SEQ ID NO: 409556 - DNA, 25 bp, Mus musculus
gaaagggctggatgatttagcttta

SEQ ID NO: 409557 - DNA, 25 bp, Mus musculus
gaaagggctggcagcagtctcaacc

SEQ ID NO: 409558 - DNA, 25 bp, Mus musculus
gaaagggctggctgcagtctcaacc

SEQ ID NO: 409559 - DNA, 25 bp, Mus musculus
gaaagggctgtcaagaactccccaa

SEQ ID NO: 409560 - DNA, 25 bp, Mus musculus
gaaagggctgtctagaactccccaa

SEQ ID NO: 409561 - DNA, 25 bp, Mus musculus
gaaagggcttcgcagtcccagattc

SEQ ID NO: 409562 - DNA, 25 bp, Mus musculus
gaaagggcttcggagtcccagattc

SEQ ID NO: 409563 - DNA, 25 bp, Mus musculus
gaaagggcttctctgcgtggtcccc

SEQ ID NO: 409564 - DNA, 25 bp, Mus musculus
gaaagggcttctgtgcgtggtcccc

SEQ ID NO: 409565 - DNA, 25 bp, Mus musculus
gaaagggcttgcagggagtataact

SEQ ID NO: 409566 - DNA, 25 bp, Mus musculus
gaaagggcttgctgggagtataact

SEQ ID NO: 409567 - DNA, 25 bp, Mus musculus
gaaagggctttaccttctcttgact

SEQ ID NO: 409568 - DNA, 25 bp, Mus musculus
gaaagggctttagcttctcttgact

SEQ ID NO: 409569 - DNA, 25 bp, Mus musculus
gaaagggtcacaaagctctgccaat

SEQ ID NO: 409570 - DNA, 25 bp, Mus musculus
gaaagggtcacatagctctgccaat

SEQ ID NO: 409571 - DNA, 25 bp, Mus musculus
gaaagggtccaacgtgcccagtgat

SEQ ID NO: 409572 - DNA, 25 bp, Mus musculus
gaaagggtccaaggtgcccagtgat

SEQ ID NO: 409573 - DNA, 25 bp, Mus musculus
gaaagggtcccacgcccagacttag

SEQ ID NO: 409574 - DNA, 25 bp, Mus musculus
gaaagggtcccaggcccagacttag

SEQ ID NO: 409575 - DNA, 25 bp, Mus musculus
gaaagggtcccgaataccagtacag

SEQ ID NO: 409576 - DNA, 25 bp, Mus musculus
gaaagggtcccgtataccagtacag

SEQ ID NO: 409577 - DNA, 25 bp, Mus musculus
gaaagggtcctacaaacaagcgcct

SEQ ID NO: 409578 - DNA, 25 bp, Mus musculus
gaaagggtcctagaaacaagcgcct

SEQ ID NO: 409579 - DNA, 25 bp, Mus musculus
gaaagggtcctgcatcccaagtcaa

SEQ ID NO: 409580 - DNA, 25 bp, Mus musculus
gaaagggtcctggatcccaagtcaa

SEQ ID NO: 409581 - DNA, 25 bp, Mus musculus
gaaagggtctccacaaagcagcaga

SEQ ID NO: 409582 - DNA, 25 bp, Mus musculus
gaaagggtctcctcaaagcagcaga

SEQ ID NO: 409583 - DNA, 25 bp, Mus musculus
gaaagggtctgtcggatgcacccac

SEQ ID NO: 409584 - DNA, 25 bp, Mus musculus
gaaagggtctgtgggatgcacccac

SEQ ID NO: 409585 - DNA, 25 bp, Mus musculus
gaaagggtcttccaggctctcagag

SEQ ID NO: 409586 - DNA, 25 bp, Mus musculus
gaaagggtcttcgaggctctcagag

SEQ ID NO: 409587 - DNA, 25 bp, Mus musculus
gaaagggtgaagctctaactcatga

SEQ ID NO: 409588 - DNA, 25 bp, Mus musculus
gaaagggtgaaggtctaactcatga

SEQ ID NO: 409589 - DNA, 25 bp, Mus musculus
gaaagggtgcttaacgctcccagca

SEQ ID NO: 409590 - DNA, 25 bp, Mus musculus
gaaagggtgctttacgctcccagca

SEQ ID NO: 409591 - DNA, 25 bp, Mus musculus
gaaagggtgggaactccaacatttt

SEQ ID NO: 409592 - DNA, 25 bp, Mus musculus
gaaagggtgggatctccaacatttt

SEQ ID NO: 409593 - DNA, 25 bp, Mus musculus
gaaagggtgtacatcccaggagaga

SEQ ID NO: 409594 - DNA, 25 bp, Mus musculus
gaaagggtgtacttcccaggagaga

SEQ ID NO: 409595 - DNA, 25 bp, Mus musculus
gaaagggtgtggaccatcggctact

SEQ ID NO: 409596 - DNA, 25 bp, Mus musculus
gaaagggtgtggtccatcggctact

SEQ ID NO: 409597 - DNA, 25 bp, Mus musculus
gaaagggtgtttagactcctagtct

SEQ ID NO: 409598 - DNA, 25 bp, Mus musculus
gaaagggtgttttgactcctagtct

SEQ ID NO: 409599 - DNA, 25 bp, Mus musculus
gaaagggttaggaccaactgcaagt

SEQ ID NO: 409600 - DNA, 25 bp, Mus musculus
gaaagggttaggtccaactgcaagt

SEQ ID NO: 409601 - DNA, 25 bp, Mus musculus
gaaagggttcataagctgccctctt

SEQ ID NO: 409602 - DNA, 25 bp, Mus musculus
gaaagggttcattagctgccctctt

SEQ ID NO: 409603 - DNA, 25 bp, Mus musculus
gaaagggttcttcctgggttttgat

SEQ ID NO: 409604 - DNA, 25 bp, Mus musculus
gaaagggttcttgctgggttttgat

SEQ ID NO: 409605 - DNA, 25 bp, Mus musculus
gaaagggttgccatggtacttgata

SEQ ID NO: 409606 - DNA, 25 bp, Mus musculus
gaaagggttgccttggtacttgata

SEQ ID NO: 409607 - DNA, 25 bp, Mus musculus
gaaaggtaaacaatccaggaggagg

SEQ ID NO: 409608 - DNA, 25 bp, Mus musculus
gaaaggtaaacattccaggaggagg

SEQ ID NO: 409609 - DNA, 25 bp, Mus musculus
gaaaggtaaccaaccatgtggccca

SEQ ID NO: 409610 - DNA, 25 bp, Mus musculus
gaaaggtaaccatccatgtggccca

SEQ ID NO: 409611 - DNA, 25 bp, Mus musculus
gaaaggtacatgaccagtttgtaac

SEQ ID NO: 409612 - DNA, 25 bp, Mus musculus
gaaaggtacatgtccagtttgtaac

SEQ ID NO: 409613 - DNA, 25 bp, Mus musculus
gaaaggtaccaaagtgtgaattagt

SEQ ID NO: 409614 - DNA, 25 bp, Mus musculus
gaaaggtaccaatgtgtgaattagt

SEQ ID NO: 409615 - DNA, 25 bp, Mus musculus
gaaaggtaccacaaaagtgctttat

SEQ ID NO: 409616 - DNA, 25 bp, Mus musculus
gaaaggtaccactaaagtgctttat

SEQ ID NO: 409617 - DNA, 25 bp, Mus musculus
gaaaggtacgctccacttacattgt

SEQ ID NO: 409618 - DNA, 25 bp, Mus musculus
gaaaggtacgctgcacttacattgt

SEQ ID NO: 409619 - DNA, 25 bp, Mus musculus
gaaaggtactaaccaaagccaggca

SEQ ID NO: 409620 - DNA, 25 bp, Mus musculus
gaaaggtactaagcaaagccaggca

SEQ ID NO: 409621 - DNA, 25 bp, Mus musculus
gaaaggtagagccttcatcctccct

SEQ ID NO: 409622 - DNA, 25 bp, Mus musculus
gaaaggtagagcgttcatcctccct

SEQ ID NO: 409623 - DNA, 25 bp, Mus musculus
gaaaggtagttcacagggtccacgt

SEQ ID NO: 409624 - DNA, 25 bp, Mus musculus
gaaaggtagttctcagggtccacgt

SEQ ID NO: 409625 - DNA, 25 bp, Mus musculus
gaaaggtatgacatctgcactgaga

SEQ ID NO: 409626 - DNA, 25 bp, Mus musculus
gaaaggtatgacttctgcactgaga

SEQ ID NO: 409627 - DNA, 25 bp, Mus musculus
gaaaggtattgtcgtgcatgcccat

SEQ ID NO: 409628 - DNA, 25 bp, Mus musculus
gaaaggtattgtggtgcatgcccat

SEQ ID NO: 409629 - DNA, 25 bp, Mus musculus
gaaaggtcaacccagcaaagccatc

SEQ ID NO: 409630 - DNA, 25 bp, Mus musculus
gaaaggtcaaccgagcaaagccatc

SEQ ID NO: 409631 - DNA, 25 bp, Mus musculus
gaaaggtcacatctctgttcagttt

SEQ ID NO: 409632 - DNA, 25 bp, Mus musculus
gaaaggtcacatgtctgttcagttt

SEQ ID NO: 409633 - DNA, 25 bp, Mus musculus
gaaaggtcacccacaagacttacag

SEQ ID NO: 409634 - DNA, 25 bp, Mus musculus
gaaaggtcaccccatagcagagaca

SEQ ID NO: 409635 - DNA, 25 bp, Mus musculus
gaaaggtcacccgatagcagagaca

SEQ ID NO: 409636 - DNA, 25 bp, Mus musculus
gaaaggtcaccctcaagacttacag

SEQ ID NO: 409637 - DNA, 25 bp, Mus musculus
gaaaggtcaggcagaggtagggttt

SEQ ID NO: 409638 - DNA, 25 bp, Mus musculus
gaaaggtcaggctgaggtagggttt

SEQ ID NO: 409639 - DNA, 25 bp, Mus musculus
gaaaggtcaggtcacaacctgaact

SEQ ID NO: 409640 - DNA, 25 bp, Mus musculus
gaaaggtcaggtgacaacctgaact

SEQ ID NO: 409641 - DNA, 25 bp, Mus musculus
gaaaggtcagtgcacctgcttcctt

SEQ ID NO: 409642 - DNA, 25 bp, Mus musculus
gaaaggtcagtggacctgcttcctt

SEQ ID NO: 409643 - DNA, 25 bp, Mus musculus
gaaaggtcagttctagcctcttaga

SEQ ID NO: 409644 - DNA, 25 bp, Mus musculus
gaaaggtcagttgtagcctcttaga

SEQ ID NO: 409645 - DNA, 25 bp, Mus musculus
gaaaggtccacaaatttccatccca

SEQ ID NO: 409646 - DNA, 25 bp, Mus musculus
gaaaggtccacatatttccatccca

SEQ ID NO: 409647 - DNA, 25 bp, Mus musculus
gaaaggtccagaacacagcccagat

SEQ ID NO: 409648 - DNA, 25 bp, Mus musculus
gaaaggtccagatcacagcccagat

SEQ ID NO: 409649 - DNA, 25 bp, Mus musculus
gaaaggtccagcatgggctcaccat

SEQ ID NO: 409650 - DNA, 25 bp, Mus musculus
gaaaggtccagcttgggctcaccat

SEQ ID NO: 409651 - DNA, 25 bp, Mus musculus
gaaaggtccataattttctaatgac

SEQ ID NO: 409652 - DNA, 25 bp, Mus musculus
gaaaggtccatatttttctaatgac

SEQ ID NO: 409653 - DNA, 25 bp, Mus musculus
gaaaggtccattaggcaatttgtac

SEQ ID NO: 409654 - DNA, 25 bp, Mus musculus
gaaaggtccatttggcaatttgtac

SEQ ID NO: 409655 - DNA, 25 bp, Mus musculus
gaaaggtccctgagacagtccaaag

SEQ ID NO: 409656 - DNA, 25 bp, Mus musculus
gaaaggtccctgtgacagtccaaag

SEQ ID NO: 409657 - DNA, 25 bp, Mus musculus
gaaaggtcctgacacccgcgacaag

SEQ ID NO: 409658 - DNA, 25 bp, Mus musculus
gaaaggtcctgagacccgcgacaag

SEQ ID NO: 409659 - DNA, 25 bp, Mus musculus
gaaaggtccttacctgttcattctg

SEQ ID NO: 409660 - DNA, 25 bp, Mus musculus
gaaaggtccttagctgttcattctg

SEQ ID NO: 409661 - DNA, 25 bp, Mus musculus
gaaaggtcctttctcacaccgaaga

SEQ ID NO: 409662 - DNA, 25 bp, Mus musculus
gaaaggtcctttgtcacaccgaaga

SEQ ID NO: 409663 - DNA, 25 bp, Mus musculus
gaaaggtcgaccagtctccatttta

SEQ ID NO: 409664 - DNA, 25 bp, Mus musculus
gaaaggtcgacctgtctccatttta

SEQ ID NO: 409665 - DNA, 25 bp, Mus musculus
gaaaggtctaaacatgtacaacgaa

SEQ ID NO: 409666 - DNA, 25 bp, Mus musculus
gaaaggtctaaagatgtacaacgaa

SEQ ID NO: 409667 - DNA, 25 bp, Mus musculus
gaaaggtctaccctgtgcaccgtca

SEQ ID NO: 409668 - DNA, 25 bp, Mus musculus
gaaaggtctaccgtgtgcaccgtca

SEQ ID NO: 409669 - DNA, 25 bp, Mus musculus
gaaaggtctagaagcatctttgcta

SEQ ID NO: 409670 - DNA, 25 bp, Mus musculus
gaaaggtctagatgcatctttgcta

SEQ ID NO: 409671 - DNA, 25 bp, Mus musculus
gaaaggtctatcacttcatgccttg

SEQ ID NO: 409672 - DNA, 25 bp, Mus musculus
gaaaggtctatctcttcatgccttg

SEQ ID NO: 409673 - DNA, 25 bp, Mus musculus
gaaaggtctcctcaactgcagctgc

SEQ ID NO: 409674 - DNA, 25 bp, Mus musculus
gaaaggtctcctgaactgcagctgc

SEQ ID NO: 409675 - DNA, 25 bp, Mus musculus
gaaaggtctggaacttgtgacctgt

SEQ ID NO: 409676 - DNA, 25 bp, Mus musculus
gaaaggtctggatcttgtgacctgt

SEQ ID NO: 409677 - DNA, 25 bp, Mus musculus
gaaaggtctgtgcagcatctatcta

SEQ ID NO: 409678 - DNA, 25 bp, Mus musculus
gaaaggtctgtggagcatctatcta

SEQ ID NO: 409679 - DNA, 25 bp, Mus musculus
gaaaggtcttgcaaactctggtatt

SEQ ID NO: 409680 - DNA, 25 bp, Mus musculus
gaaaggtcttgccactaggaatttt

SEQ ID NO: 409681 - DNA, 25 bp, Mus musculus
gaaaggtcttgcgactaggaatttt

SEQ ID NO: 409682 - DNA, 25 bp, Mus musculus
gaaaggtcttgctaactctggtatt

SEQ ID NO: 409683 - DNA, 25 bp, Mus musculus
gaaaggtctttccattgcactttgt

SEQ ID NO: 409684 - DNA, 25 bp, Mus musculus
gaaaggtctttcgattgcactttgt

SEQ ID NO: 409685 - DNA, 25 bp, Mus musculus
gaaaggtgacccagacacagaagaa

SEQ ID NO: 409686 - DNA, 25 bp, Mus musculus
gaaaggtgaccctgacacagaagaa

SEQ ID NO: 409687 - DNA, 25 bp, Mus musculus
gaaaggtgagcgatgttaccctcct

SEQ ID NO: 409688 - DNA, 25 bp, Mus musculus
gaaaggtgagcgttgttaccctcct

SEQ ID NO: 409689 - DNA, 25 bp, Mus musculus
gaaaggtgaggtcattcaacaaaat

SEQ ID NO: 409690 - DNA, 25 bp, Mus musculus
gaaaggtgaggtgattcaacaaaat

SEQ ID NO: 409691 - DNA, 25 bp, Mus musculus
gaaaggtgcagaacactccatgaag

SEQ ID NO: 409692 - DNA, 25 bp, Mus musculus
gaaaggtgcagatcactccatgaag

SEQ ID NO: 409693 - DNA, 25 bp, Mus musculus
gaaaggtgccccagatgcaatttta

SEQ ID NO: 409694 - DNA, 25 bp, Mus musculus
gaaaggtgcccctgatgcaatttta

SEQ ID NO: 409695 - DNA, 25 bp, Mus musculus
gaaaggtgctgtcatgactactgaa

SEQ ID NO: 409696 - DNA, 25 bp, Mus musculus
gaaaggtgctgtgatgactactgaa

SEQ ID NO: 409697 - DNA, 25 bp, Mus musculus
gaaaggtggccaacacagctagtta

SEQ ID NO: 409698 - DNA, 25 bp, Mus musculus
gaaaggtggccatcacagctagtta

SEQ ID NO: 409699 - DNA, 25 bp, Mus musculus
gaaaggtggtttaagaagtgactgt

SEQ ID NO: 409700 - DNA, 25 bp, Mus musculus
gaaaggtggtttcaccacactcagc

SEQ ID NO: 409701 - DNA, 25 bp, Mus musculus
gaaaggtggtttgaccacactcagc

SEQ ID NO: 409702 - DNA, 25 bp, Mus musculus
gaaaggtggttttagaagtgactgt

SEQ ID NO: 409703 - DNA, 25 bp, Mus musculus
gaaaggtgtagactccagattagga

SEQ ID NO: 409704 - DNA, 25 bp, Mus musculus
gaaaggtgtagagtccagattagga

SEQ ID NO: 409705 - DNA, 25 bp, Mus musculus
gaaaggtgtatgaggctgccactcc

SEQ ID NO: 409706 - DNA, 25 bp, Mus musculus
gaaaggtgtatgtggctgccactcc

SEQ ID NO: 409707 - DNA, 25 bp, Mus musculus
gaaaggtgtcctaagccactcaggc

SEQ ID NO: 409708 - DNA, 25 bp, Mus musculus
gaaaggtgtccttagccactcaggc

SEQ ID NO: 409709 - DNA, 25 bp, Mus musculus
gaaaggtgtggacccagtttgcctc

SEQ ID NO: 409710 - DNA, 25 bp, Mus musculus
gaaaggtgtggagccagtttgcctc

SEQ ID NO: 409711 - DNA, 25 bp, Mus musculus
gaaaggtgttagacagaggccctaa

SEQ ID NO: 409712 - DNA, 25 bp, Mus musculus
gaaaggtgttagtcagaggccctaa

SEQ ID NO: 409713 - DNA, 25 bp, Mus musculus
gaaaggtgtttccacaatgtatata

SEQ ID NO: 409714 - DNA, 25 bp, Mus musculus
gaaaggtgtttccatgacctgacca

SEQ ID NO: 409715 - DNA, 25 bp, Mus musculus
gaaaggtgtttcgacaatgtatata

SEQ ID NO: 409716 - DNA, 25 bp, Mus musculus
gaaaggtgtttcgatgacctgacca

SEQ ID NO: 409717 - DNA, 25 bp, Mus musculus
gaaaggttaattaaactgtcacata

SEQ ID NO: 409718 - DNA, 25 bp, Mus musculus
gaaaggttaatttaactgtcacata

SEQ ID NO: 409719 - DNA, 25 bp, Mus musculus
gaaaggttaccccagtctcagacag

SEQ ID NO: 409720 - DNA, 25 bp, Mus musculus
gaaaggttacccgagtctcagacag

SEQ ID NO: 409721 - DNA, 25 bp, Mus musculus
gaaaggttcacaccagaggcccggc

SEQ ID NO: 409722 - DNA, 25 bp, Mus musculus
gaaaggttcacagcagaggcccggc

SEQ ID NO: 409723 - DNA, 25 bp, Mus musculus
gaaaggttcagtaggttcacaagat

SEQ ID NO: 409724 - DNA, 25 bp, Mus musculus
gaaaggttcagttggttcacaagat

SEQ ID NO: 409725 - DNA, 25 bp, Mus musculus
gaaaggttcataaagtagtttccct

SEQ ID NO: 409726 - DNA, 25 bp, Mus musculus
gaaaggttcatatagtagtttccct

SEQ ID NO: 409727 - DNA, 25 bp, Mus musculus
gaaaggttccatacagcttctaatg

SEQ ID NO: 409728 - DNA, 25 bp, Mus musculus
gaaaggttccattcagcttctaatg

SEQ ID NO: 409729 - DNA, 25 bp, Mus musculus
gaaaggttctcccagagtaggcaac

SEQ ID NO: 409730 - DNA, 25 bp, Mus musculus
gaaaggttctccgagagtaggcaac

SEQ ID NO: 409731 - DNA, 25 bp, Mus musculus
gaaaggttgcctagattatgtaata

SEQ ID NO: 409732 - DNA, 25 bp, Mus musculus
gaaaggttgccttgattatgtaata

SEQ ID NO: 409733 - DNA, 25 bp, Mus musculus
gaaaggttggctcgctttctcagca

SEQ ID NO: 409734 - DNA, 25 bp, Mus musculus
gaaaggttggctggctttctcagca

SEQ ID NO: 409735 - DNA, 25 bp, Mus musculus
gaaaggtttctacatgtatatcagt

SEQ ID NO: 409736 - DNA, 25 bp, Mus musculus
gaaaggtttctagatgtatatcagt

SEQ ID NO: 409737 - DNA, 25 bp, Mus musculus
gaaaggttttggattatgtgacaga

SEQ ID NO: 409738 - DNA, 25 bp, Mus musculus
gaaaggttttggtttatgtgacaga

SEQ ID NO: 409739 - DNA, 25 bp, Mus musculus
gaaaggttttttcactcagcaacta

SEQ ID NO: 409740 - DNA, 25 bp, Mus musculus
gaaaggttttttgactcagcaacta

SEQ ID NO: 409741 - DNA, 25 bp, Mus musculus
gaaagtaaacaaatccagatcatag

SEQ ID NO: 409742 - DNA, 25 bp, Mus musculus
gaaagtaaacaattccagatcatag

SEQ ID NO: 409743 - DNA, 25 bp, Mus musculus
gaaagtaaatgcctcgctcctttta

SEQ ID NO: 409744 - DNA, 25 bp, Mus musculus
gaaagtaaatgcgtcgctcctttta

SEQ ID NO: 409745 - DNA, 25 bp, Mus musculus
gaaagtaacattaggccaggcatgg

SEQ ID NO: 409746 - DNA, 25 bp, Mus musculus
gaaagtaacatttggccaggcatgg

SEQ ID NO: 409747 - DNA, 25 bp, Mus musculus
gaaagtaacctcctggccaggagac

SEQ ID NO: 409748 - DNA, 25 bp, Mus musculus
gaaagtaacctcgtggccaggagac

SEQ ID NO: 409749 - DNA, 25 bp, Mus musculus
gaaagtaacgctctggtcagtgctt

SEQ ID NO: 409750 - DNA, 25 bp, Mus musculus
gaaagtaacgctgtggtcagtgctt

SEQ ID NO: 409751 - DNA, 25 bp, Mus musculus
gaaagtaagaatcgtgctcatttta

SEQ ID NO: 409752 - DNA, 25 bp, Mus musculus
gaaagtaagaatggtgctcatttta

SEQ ID NO: 409753 - DNA, 25 bp, Mus musculus
gaaagtaagagcaggagtccggcac

SEQ ID NO: 409754 - DNA, 25 bp, Mus musculus
gaaagtaagagctggagtccggcac

SEQ ID NO: 409755 - DNA, 25 bp, Mus musculus
gaaagtaagcacaacataaaagata

SEQ ID NO: 409756 - DNA, 25 bp, Mus musculus
gaaagtaagcactacataaaagata

SEQ ID NO: 409757 - DNA, 25 bp, Mus musculus
gaaagtaatcgcctcttcctacaac

SEQ ID NO: 409758 - DNA, 25 bp, Mus musculus
gaaagtaatcgcgtcttcctacaac

SEQ ID NO: 409759 - DNA, 25 bp, Mus musculus
gaaagtaatctgagctctgtacatt

SEQ ID NO: 409760 - DNA, 25 bp, Mus musculus
gaaagtaatctgtgctctgtacatt

SEQ ID NO: 409761 - DNA, 25 bp, Mus musculus
gaaagtaattatatgctcttattga

SEQ ID NO: 409762 - DNA, 25 bp, Mus musculus
gaaagtaattatttgctcttattga

SEQ ID NO: 409763 - DNA, 25 bp, Mus musculus
gaaagtaatttcaggagaggtggaa

SEQ ID NO: 409764 - DNA, 25 bp, Mus musculus
gaaagtaatttctggagaggtggaa

SEQ ID NO: 409765 - DNA, 25 bp, Mus musculus
gaaagtacaagcatctgtccgtctc

SEQ ID NO: 409766 - DNA, 25 bp, Mus musculus
gaaagtacaagcttctgtccgtctc

SEQ ID NO: 409767 - DNA, 25 bp, Mus musculus
gaaagtacactaaagcgagcagaga

SEQ ID NO: 409768 - DNA, 25 bp, Mus musculus
gaaagtacactatagcgagcagaga

SEQ ID NO: 409769 - DNA, 25 bp, Mus musculus
gaaagtacactcagctgtttgacac

SEQ ID NO: 409770 - DNA, 25 bp, Mus musculus
gaaagtacactctgctgtttgacac

SEQ ID NO: 409771 - DNA, 25 bp, Mus musculus
gaaagtacagaccaatacacttgag

SEQ ID NO: 409772 - DNA, 25 bp, Mus musculus
gaaagtacagacgaatacacttgag

SEQ ID NO: 409773 - DNA, 25 bp, Mus musculus
gaaagtacaggaccatctctgcaac

SEQ ID NO: 409774 - DNA, 25 bp, Mus musculus
gaaagtacaggagcatctctgcaac

SEQ ID NO: 409775 - DNA, 25 bp, Mus musculus
gaaagtaccaccagctactcataaa

SEQ ID NO: 409776 - DNA, 25 bp, Mus musculus
gaaagtaccacctgctactcataaa

SEQ ID NO: 409777 - DNA, 25 bp, Mus musculus
gaaagtaccataatgcattgagctg

SEQ ID NO: 409778 - DNA, 25 bp, Mus musculus
gaaagtaccatattgcattgagctg

SEQ ID NO: 409779 - DNA, 25 bp, Mus musculus
gaaagtacccaaaatcaagttgtat

SEQ ID NO: 409780 - DNA, 25 bp, Mus musculus
gaaagtacccaatatcaagttgtat

SEQ ID NO: 409781 - DNA, 25 bp, Mus musculus
gaaagtacccgccagaggctgcagc

SEQ ID NO: 409782 - DNA, 25 bp, Mus musculus
gaaagtacccgcgagaggctgcagc

SEQ ID NO: 409783 - DNA, 25 bp, Mus musculus
gaaagtaccctgacctactgcaacg

SEQ ID NO: 409784 - DNA, 25 bp, Mus musculus
gaaagtaccctgtcctactgcaacg

SEQ ID NO: 409785 - DNA, 25 bp, Mus musculus
gaaagtacctgtctacccgaagcca

SEQ ID NO: 409786 - DNA, 25 bp, Mus musculus
gaaagtacctgtgtacccgaagcca

SEQ ID NO: 409787 - DNA, 25 bp, Mus musculus
gaaagtaccttacaatgttgtgata

SEQ ID NO: 409788 - DNA, 25 bp, Mus musculus
gaaagtaccttagaatgttgtgata

SEQ ID NO: 409789 - DNA, 25 bp, Mus musculus
gaaagtacctttctgaagttgctag

SEQ ID NO: 409790 - DNA, 25 bp, Mus musculus
gaaagtacctttgtgaagttgctag

SEQ ID NO: 409791 - DNA, 25 bp, Mus musculus
gaaagtactgagagagtgccatgag

SEQ ID NO: 409792 - DNA, 25 bp, Mus musculus
gaaagtactgagtgagtgccatgag

SEQ ID NO: 409793 - DNA, 25 bp, Mus musculus
gaaagtactgctacacccataggat

SEQ ID NO: 409794 - DNA, 25 bp, Mus musculus
gaaagtactgcttcacccataggat

SEQ ID NO: 409795 - DNA, 25 bp, Mus musculus
gaaagtactgggactgttttgagaa

SEQ ID NO: 409796 - DNA, 25 bp, Mus musculus
gaaagtactgggtctgttttgagaa

SEQ ID NO: 409797 - DNA, 25 bp, Mus musculus
gaaagtactgtacattttctcagac

SEQ ID NO: 409798 - DNA, 25 bp, Mus musculus
gaaagtactgtagattttctcagac

SEQ ID NO: 409799 - DNA, 25 bp, Mus musculus
gaaagtactgtcatttggctcccat

SEQ ID NO: 409800 - DNA, 25 bp, Mus musculus
gaaagtactgtcttttggctcccat

SEQ ID NO: 409801 - DNA, 25 bp, Mus musculus
gaaagtacttagcaggtgccttgct

SEQ ID NO: 409802 - DNA, 25 bp, Mus musculus
gaaagtacttaggaggtgccttgct

SEQ ID NO: 409803 - DNA, 25 bp, Mus musculus
gaaagtacttgtaccatggctgagg

SEQ ID NO: 409804 - DNA, 25 bp, Mus musculus
gaaagtacttgtcgatgagggctca

SEQ ID NO: 409805 - DNA, 25 bp, Mus musculus
gaaagtacttgtggatgagggctca

SEQ ID NO: 409806 - DNA, 25 bp, Mus musculus
gaaagtacttgttccatggctgagg

SEQ ID NO: 409807 - DNA, 25 bp, Mus musculus
gaaagtactttgagccaattctata

SEQ ID NO: 409808 - DNA, 25 bp, Mus musculus
gaaagtactttgtgccaattctata

SEQ ID NO: 409809 - DNA, 25 bp, Mus musculus
gaaagtagaaccctgatgctcgcac

SEQ ID NO: 409810 - DNA, 25 bp, Mus musculus
gaaagtagaaccgtgatgctcgcac

SEQ ID NO: 409811 - DNA, 25 bp, Mus musculus
gaaagtagacagattccacttcctt

SEQ ID NO: 409812 - DNA, 25 bp, Mus musculus
gaaagtagacagtttccacttcctt

SEQ ID NO: 409813 - DNA, 25 bp, Mus musculus
gaaagtagagccagccatctgggaa

SEQ ID NO: 409814 - DNA, 25 bp, Mus musculus
gaaagtagagcctgccatctgggaa

SEQ ID NO: 409815 - DNA, 25 bp, Mus musculus
gaaagtagccaacaggtccagaaaa

SEQ ID NO: 409816 - DNA, 25 bp, Mus musculus
gaaagtagccaagaggtccagaaaa

SEQ ID NO: 409817 - DNA, 25 bp, Mus musculus
gaaagtagccagaactcactagcat

SEQ ID NO: 409818 - DNA, 25 bp, Mus musculus
gaaagtagccagtactcactagcat

SEQ ID NO: 409819 - DNA, 25 bp, Mus musculus
gaaagtagccccacatgtgtagagt

SEQ ID NO: 409820 - DNA, 25 bp, Mus musculus
gaaagtagcccctcatgtgtagagt

SEQ ID NO: 409821 - DNA, 25 bp, Mus musculus
gaaagtagccctctatcctttcctc

SEQ ID NO: 409822 - DNA, 25 bp, Mus musculus
gaaagtagccctgtatcctttcctc

SEQ ID NO: 409823 - DNA, 25 bp, Mus musculus
gaaagtagccgaccgactcacagag

SEQ ID NO: 409824 - DNA, 25 bp, Mus musculus
gaaagtagccgagcgactcacagag

SEQ ID NO: 409825 - DNA, 25 bp, Mus musculus
gaaagtagctgtcactgtacaagat

SEQ ID NO: 409826 - DNA, 25 bp, Mus musculus
gaaagtagctgtgactgtacaagat

SEQ ID NO: 409827 - DNA, 25 bp, Mus musculus
gaaagtagcttaacagaacacccac

SEQ ID NO: 409828 - DNA, 25 bp, Mus musculus
gaaagtagcttatcagaacacccac

SEQ ID NO: 409829 - DNA, 25 bp, Mus musculus
gaaagtagcttgctgcctgtgaaac

SEQ ID NO: 409830 - DNA, 25 bp, Mus musculus
gaaagtagcttggtgcctgtgaaac

SEQ ID NO: 409831 - DNA, 25 bp, Mus musculus
gaaagtaggactatctgtgcagctc

SEQ ID NO: 409832 - DNA, 25 bp, Mus musculus
gaaagtaggactttctgtgcagctc

SEQ ID NO: 409833 - DNA, 25 bp, Mus musculus
gaaagtaggatcagcttctccttcc

SEQ ID NO: 409834 - DNA, 25 bp, Mus musculus
gaaagtaggatctgcttctccttcc

SEQ ID NO: 409835 - DNA, 25 bp, Mus musculus
gaaagtaggccccagtccataagga

SEQ ID NO: 409836 - DNA, 25 bp, Mus musculus
gaaagtaggcccgagtccataagga

SEQ ID NO: 409837 - DNA, 25 bp, Mus musculus
gaaagtaggtctctatatcttccac

SEQ ID NO: 409838 - DNA, 25 bp, Mus musculus
gaaagtaggtctgtatatcttccac

SEQ ID NO: 409839 - DNA, 25 bp, Mus musculus
gaaagtagtactacctactcgactg

SEQ ID NO: 409840 - DNA, 25 bp, Mus musculus
gaaagtagtacttcctactcgactg

SEQ ID NO: 409841 - DNA, 25 bp, Mus musculus
gaaagtagtagtacagatgcaagct

SEQ ID NO: 409842 - DNA, 25 bp, Mus musculus
gaaagtagtagttcagatgcaagct

SEQ ID NO: 409843 - DNA, 25 bp, Mus musculus
gaaagtagtccacccaaaccagact

SEQ ID NO: 409844 - DNA, 25 bp, Mus musculus
gaaagtagtccagccaaaccagact

SEQ ID NO: 409845 - DNA, 25 bp, Mus musculus
gaaagtagtctcctgagccaccttg

SEQ ID NO: 409846 - DNA, 25 bp, Mus musculus
gaaagtagtctcgtgagccaccttg

SEQ ID NO: 409847 - DNA, 25 bp, Mus musculus
gaaagtagttggatacccagttcat

SEQ ID NO: 409848 - DNA, 25 bp, Mus musculus
gaaagtagttggttacccagttcat

SEQ ID NO: 409849 - DNA, 25 bp, Mus musculus
gaaagtataccccatatgctggaac

SEQ ID NO: 409850 - DNA, 25 bp, Mus musculus
gaaagtatacccgatatgctggaac

SEQ ID NO: 409851 - DNA, 25 bp, Mus musculus
gaaagtatagtgatcttcacttgaa

SEQ ID NO: 409852 - DNA, 25 bp, Mus musculus
gaaagtatagtgttcttcacttgaa

SEQ ID NO: 409853 - DNA, 25 bp, Mus musculus
gaaagtatatgacacacgggatgat

SEQ ID NO: 409854 - DNA, 25 bp, Mus musculus
gaaagtatatgagacacgggatgat

SEQ ID NO: 409855 - DNA, 25 bp, Mus musculus
gaaagtatgcatacattgatgctaa

SEQ ID NO: 409856 - DNA, 25 bp, Mus musculus
gaaagtatgcattcattgatgctaa

SEQ ID NO: 409857 - DNA, 25 bp, Mus musculus
gaaagtatggttaccccaggtctga

SEQ ID NO: 409858 - DNA, 25 bp, Mus musculus
gaaagtatggtttccccaggtctga

SEQ ID NO: 409859 - DNA, 25 bp, Mus musculus
gaaagtatgtttccacctgggtctt

SEQ ID NO: 409860 - DNA, 25 bp, Mus musculus
gaaagtatgtttgcacctgggtctt

SEQ ID NO: 409861 - DNA, 25 bp, Mus musculus
gaaagtattagactgagttctgtta

SEQ ID NO: 409862 - DNA, 25 bp, Mus musculus
gaaagtattagagtgagttctgtta

SEQ ID NO: 409863 - DNA, 25 bp, Mus musculus
gaaagtattcctacctttcatgcac

SEQ ID NO: 409864 - DNA, 25 bp, Mus musculus
gaaagtattccttcctttcatgcac

SEQ ID NO: 409865 - DNA, 25 bp, Mus musculus
gaaagtatttgtcccactgcacttt

SEQ ID NO: 409866 - DNA, 25 bp, Mus musculus
gaaagtatttgtgccactgcacttt

SEQ ID NO: 409867 - DNA, 25 bp, Mus musculus
gaaagtcaaactatgtgcggttgga

SEQ ID NO: 409868 - DNA, 25 bp, Mus musculus
gaaagtcaaactttgtgcggttgga

SEQ ID NO: 409869 - DNA, 25 bp, Mus musculus
gaaagtcaaaggagatccttctaag

SEQ ID NO: 409870 - DNA, 25 bp, Mus musculus
gaaagtcaaaggcatgtcagtttat

SEQ ID NO: 409871 - DNA, 25 bp, Mus musculus
gaaagtcaaagggatgtcagtttat

SEQ ID NO: 409872 - DNA, 25 bp, Mus musculus
gaaagtcaaaggtgatccttctaag

SEQ ID NO: 409873 - DNA, 25 bp, Mus musculus
gaaagtcaagacacaggctggcagg

SEQ ID NO: 409874 - DNA, 25 bp, Mus musculus
gaaagtcaagactcaggctggcagg

SEQ ID NO: 409875 - DNA, 25 bp, Mus musculus
gaaagtcaagccagcatatcgtggt

SEQ ID NO: 409876 - DNA, 25 bp, Mus musculus
gaaagtcaagcccatctatttccac

SEQ ID NO: 409877 - DNA, 25 bp, Mus musculus
gaaagtcaagccgatctatttccac

SEQ ID NO: 409878 - DNA, 25 bp, Mus musculus
gaaagtcaagcctgcatatcgtggt

SEQ ID NO: 409879 - DNA, 25 bp, Mus musculus
gaaagtcaagttaccacagacgaca

SEQ ID NO: 409880 - DNA, 25 bp, Mus musculus
gaaagtcaagtttccacagacgaca

SEQ ID NO: 409881 - DNA, 25 bp, Mus musculus
gaaagtcaatgacgtgcccatctca

SEQ ID NO: 409882 - DNA, 25 bp, Mus musculus
gaaagtcaatgaggtgcccatctca

SEQ ID NO: 409883 - DNA, 25 bp, Mus musculus
gaaagtcacaacaagacctcgagaa

SEQ ID NO: 409884 - DNA, 25 bp, Mus musculus
gaaagtcacaactagacctcgagaa

SEQ ID NO: 409885 - DNA, 25 bp, Mus musculus
gaaagtcacacaaagttttggtctg

SEQ ID NO: 409886 - DNA, 25 bp, Mus musculus
gaaagtcacacatagttttggtctg

SEQ ID NO: 409887 - DNA, 25 bp, Mus musculus
gaaagtcacacgatggtcacaatcc

SEQ ID NO: 409888 - DNA, 25 bp, Mus musculus
gaaagtcacacgttggtcacaatcc

SEQ ID NO: 409889 - DNA, 25 bp, Mus musculus
gaaagtcacccacgattttccatgg

SEQ ID NO: 409890 - DNA, 25 bp, Mus musculus
gaaagtcacccactgttacccagtg

SEQ ID NO: 409891 - DNA, 25 bp, Mus musculus
gaaagtcacccaggattttccatgg

SEQ ID NO: 409892 - DNA, 25 bp, Mus musculus
gaaagtcacccagtgttacccagtg

SEQ ID NO: 409893 - DNA, 25 bp, Mus musculus
gaaagtcaccctcgccattaccaga

SEQ ID NO: 409894 - DNA, 25 bp, Mus musculus
gaaagtcaccctggccattaccaga

SEQ ID NO: 409895 - DNA, 25 bp, Mus musculus
gaaagtcacctgctcaccactcttt

SEQ ID NO: 409896 - DNA, 25 bp, Mus musculus
gaaagtcacctggtcaccactcttt

SEQ ID NO: 409897 - DNA, 25 bp, Mus musculus
gaaagtcaccttaggattgaacaga

SEQ ID NO: 409898 - DNA, 25 bp, Mus musculus
gaaagtcaccttaggtacaatcaaa

SEQ ID NO: 409899 - DNA, 25 bp, Mus musculus
gaaagtcacctttggattgaacaga

SEQ ID NO: 409900 - DNA, 25 bp, Mus musculus
gaaagtcacctttggtacaatcaaa

SEQ ID NO: 409901 - DNA, 25 bp, Mus musculus
gaaagtcacgtcaccaacttatgtg

SEQ ID NO: 409902 - DNA, 25 bp, Mus musculus
gaaagtcacgtctccaacttatgtg

SEQ ID NO: 409903 - DNA, 25 bp, Mus musculus
gaaagtcactggaaggtgtgtccaa

SEQ ID NO: 409904 - DNA, 25 bp, Mus musculus
gaaagtcactggtaggtgtgtccaa

SEQ ID NO: 409905 - DNA, 25 bp, Mus musculus
gaaagtcacttccatacagctcaac

SEQ ID NO: 409906 - DNA, 25 bp, Mus musculus
gaaagtcacttcgatacagctcaac

SEQ ID NO: 409907 - DNA, 25 bp, Mus musculus
gaaagtcacttgaatcacggctcaa

SEQ ID NO: 409908 - DNA, 25 bp, Mus musculus
gaaagtcacttgtatcacggctcaa

SEQ ID NO: 409909 - DNA, 25 bp, Mus musculus
gaaagtcactttcgccacttttgga

SEQ ID NO: 409910 - DNA, 25 bp, Mus musculus
gaaagtcactttcttccgtgggcct

SEQ ID NO: 409911 - DNA, 25 bp, Mus musculus
gaaagtcactttggccacttttgga

SEQ ID NO: 409912 - DNA, 25 bp, Mus musculus
gaaagtcactttgttccgtgggcct

SEQ ID NO: 409913 - DNA, 25 bp, Mus musculus
gaaagtcagaagcacgcagccttaa

SEQ ID NO: 409914 - DNA, 25 bp, Mus musculus
gaaagtcagaaggacgcagccttaa

SEQ ID NO: 409915 - DNA, 25 bp, Mus musculus
gaaagtcagaccatctgtttgaact

SEQ ID NO: 409916 - DNA, 25 bp, Mus musculus
gaaagtcagaccttctgtttgaact

SEQ ID NO: 409917 - DNA, 25 bp, Mus musculus
gaaagtcagcaaccagagatttgag

SEQ ID NO: 409918 - DNA, 25 bp, Mus musculus
gaaagtcagcaagcagagatttgag

SEQ ID NO: 409919 - DNA, 25 bp, Mus musculus
gaaagtcagcatcagcccagggcca

SEQ ID NO: 409920 - DNA, 25 bp, Mus musculus
gaaagtcagcatgagcccagggcca

SEQ ID NO: 409921 - DNA, 25 bp, Mus musculus
gaaagtcagctccagacacaggaag

SEQ ID NO: 409922 - DNA, 25 bp, Mus musculus
gaaagtcagctcgagacacaggaag

SEQ ID NO: 409923 - DNA, 25 bp, Mus musculus
gaaagtcaggcacccttttctattg

SEQ ID NO: 409924 - DNA, 25 bp, Mus musculus
gaaagtcaggcagccttttctattg

SEQ ID NO: 409925 - DNA, 25 bp, Mus musculus
gaaagtcaggcgacttgtgcctaac

SEQ ID NO: 409926 - DNA, 25 bp, Mus musculus
gaaagtcaggcgtcttgtgcctaac

SEQ ID NO: 409927 - DNA, 25 bp, Mus musculus
gaaagtcagggacccttaggaacat

SEQ ID NO: 409928 - DNA, 25 bp, Mus musculus
gaaagtcagggagccttaggaacat

SEQ ID NO: 409929 - DNA, 25 bp, Mus musculus
gaaagtcagtgaccaactgctgaaa

SEQ ID NO: 409930 - DNA, 25 bp, Mus musculus
gaaagtcagtgagcaactgctgaaa

SEQ ID NO: 409931 - DNA, 25 bp, Mus musculus
gaaagtcagttcaagcttcgaaaac

SEQ ID NO: 409932 - DNA, 25 bp, Mus musculus
gaaagtcagttctagcttcgaaaac

SEQ ID NO: 409933 - DNA, 25 bp, Mus musculus
gaaagtcatcacatatgcatctgga

SEQ ID NO: 409934 - DNA, 25 bp, Mus musculus
gaaagtcatcacttatgcatctgga

SEQ ID NO: 409935 - DNA, 25 bp, Mus musculus
gaaagtcatcgcaaacttggattat

SEQ ID NO: 409936 - DNA, 25 bp, Mus musculus
gaaagtcatcgctaacttggattat

SEQ ID NO: 409937 - DNA, 25 bp, Mus musculus
gaaagtcatgccatcatgtcattgt

SEQ ID NO: 409938 - DNA, 25 bp, Mus musculus
gaaagtcatgccttcatgtcattgt

SEQ ID NO: 409939 - DNA, 25 bp, Mus musculus
gaaagtccaagtccatataccagtg

SEQ ID NO: 409940 - DNA, 25 bp, Mus musculus
gaaagtccaagtgcatataccagtg

SEQ ID NO: 409941 - DNA, 25 bp, Mus musculus
gaaagtccaattccctcacaggaat

SEQ ID NO: 409942 - DNA, 25 bp, Mus musculus
gaaagtccaattgcctcacaggaat

SEQ ID NO: 409943 - DNA, 25 bp, Mus musculus
gaaagtccacagcatccttcatctt

SEQ ID NO: 409944 - DNA, 25 bp, Mus musculus
gaaagtccacaggatccttcatctt

SEQ ID NO: 409945 - DNA, 25 bp, Mus musculus
gaaagtccacgtctgttccccagaa

SEQ ID NO: 409946 - DNA, 25 bp, Mus musculus
gaaagtccacgtgtgttccccagaa

SEQ ID NO: 409947 - DNA, 25 bp, Mus musculus
gaaagtccactcaagcatgtctgca

SEQ ID NO: 409948 - DNA, 25 bp, Mus musculus
gaaagtccactctagcatgtctgca

SEQ ID NO: 409949 - DNA, 25 bp, Mus musculus
gaaagtccacttattgattcacttc

SEQ ID NO: 409950 - DNA, 25 bp, Mus musculus
gaaagtccactttttgattcacttc

SEQ ID NO: 409951 - DNA, 25 bp, Mus musculus
gaaagtccagatcttcggcgagata

SEQ ID NO: 409952 - DNA, 25 bp, Mus musculus
gaaagtccagatgttcggcgagata

SEQ ID NO: 409953 - DNA, 25 bp, Mus musculus
gaaagtccagccacaaaatgatcag

SEQ ID NO: 409954 - DNA, 25 bp, Mus musculus
gaaagtccagcctcaaaatgatcag

SEQ ID NO: 409955 - DNA, 25 bp, Mus musculus
gaaagtcccagactgttactcactg

SEQ ID NO: 409956 - DNA, 25 bp, Mus musculus
gaaagtcccagagtgttactcactg

SEQ ID NO: 409957 - DNA, 25 bp, Mus musculus
gaaagtcccaggcaaggactcaaaa

SEQ ID NO: 409958 - DNA, 25 bp, Mus musculus
gaaagtcccagggaaggactcaaaa

SEQ ID NO: 409959 - DNA, 25 bp, Mus musculus
gaaagtcccatcacgtctctaaatt

SEQ ID NO: 409960 - DNA, 25 bp, Mus musculus
gaaagtcccatctcgtctctaaatt

SEQ ID NO: 409961 - DNA, 25 bp, Mus musculus
gaaagtccccgaatgggtggacaca

SEQ ID NO: 409962 - DNA, 25 bp, Mus musculus
gaaagtccccgattgggtggacaca

SEQ ID NO: 409963 - DNA, 25 bp, Mus musculus
gaaagtcccgagcagggtcatccac

SEQ ID NO: 409964 - DNA, 25 bp, Mus musculus
gaaagtcccgaggagggtcatccac

SEQ ID NO: 409965 - DNA, 25 bp, Mus musculus
gaaagtccctacacactgtaaagtc

SEQ ID NO: 409966 - DNA, 25 bp, Mus musculus
gaaagtccctactcactgtaaagtc

SEQ ID NO: 409967 - DNA, 25 bp, Mus musculus
gaaagtccctgaagtttgtcacctc

SEQ ID NO: 409968 - DNA, 25 bp, Mus musculus
gaaagtccctgatgtttgtcacctc

SEQ ID NO: 409969 - DNA, 25 bp, Mus musculus
gaaagtccctttctgatcaaataaa

SEQ ID NO: 409970 - DNA, 25 bp, Mus musculus
gaaagtccctttgtgatcaaataaa

SEQ ID NO: 409971 - DNA, 25 bp, Mus musculus
gaaagtccgagaccaatcagatgaa

SEQ ID NO: 409972 - DNA, 25 bp, Mus musculus
gaaagtccgagagcaatcagatgaa

SEQ ID NO: 409973 - DNA, 25 bp, Mus musculus
gaaagtccgcctcaagattcgggaa

SEQ ID NO: 409974 - DNA, 25 bp, Mus musculus
gaaagtccgcctgaagattcgggaa

SEQ ID NO: 409975 - DNA, 25 bp, Mus musculus
gaaagtcctacaccactctgcaaat

SEQ ID NO: 409976 - DNA, 25 bp, Mus musculus
gaaagtcctacactgggtttttgat

SEQ ID NO: 409977 - DNA, 25 bp, Mus musculus
gaaagtcctacagcactctgcaaat

SEQ ID NO: 409978 - DNA, 25 bp, Mus musculus
gaaagtcctacagtgggtttttgat

SEQ ID NO: 409979 - DNA, 25 bp, Mus musculus
gaaagtcctagaacgacaacccgat

SEQ ID NO: 409980 - DNA, 25 bp, Mus musculus
gaaagtcctagatcgacaacccgat

SEQ ID NO: 409981 - DNA, 25 bp, Mus musculus
gaaagtcctattaagagtcagataa

SEQ ID NO: 409982 - DNA, 25 bp, Mus musculus
gaaagtcctatttagagtcagataa

SEQ ID NO: 409983 - DNA, 25 bp, Mus musculus
gaaagtcctccaaagatgacacagg

SEQ ID NO: 409984 - DNA, 25 bp, Mus musculus
gaaagtcctccactgcctgaatatt

SEQ ID NO: 409985 - DNA, 25 bp, Mus musculus
gaaagtcctccagtgcctgaatatt

SEQ ID NO: 409986 - DNA, 25 bp, Mus musculus
gaaagtcctccatagatgacacagg

SEQ ID NO: 409987 - DNA, 25 bp, Mus musculus
gaaagtcctgagagacgctggcata

SEQ ID NO: 409988 - DNA, 25 bp, Mus musculus
gaaagtcctgagctctctgcagttg

SEQ ID NO: 409989 - DNA, 25 bp, Mus musculus
gaaagtcctgaggtctctgcagttg

SEQ ID NO: 409990 - DNA, 25 bp, Mus musculus
gaaagtcctgagtgacgctggcata

SEQ ID NO: 409991 - DNA, 25 bp, Mus musculus
gaaagtcctgcaacagtgggattta

SEQ ID NO: 409992 - DNA, 25 bp, Mus musculus
gaaagtcctgcatcagtgggattta

SEQ ID NO: 409993 - DNA, 25 bp, Mus musculus
gaaagtcctgctccaacacttcaca

SEQ ID NO: 409994 - DNA, 25 bp, Mus musculus
gaaagtcctgctgcaacacttcaca

SEQ ID NO: 409995 - DNA, 25 bp, Mus musculus
gaaagtccttatcccagacatgtga

SEQ ID NO: 409996 - DNA, 25 bp, Mus musculus
gaaagtccttatgccagacatgtga

SEQ ID NO: 409997 - DNA, 25 bp, Mus musculus
gaaagtccttttaagccttgcttag

SEQ ID NO: 409998 - DNA, 25 bp, Mus musculus
gaaagtcctttttagccttgcttag

SEQ ID NO: 409999 - DNA, 25 bp, Mus musculus
gaaagtcgccatcttaatcccagtg

SEQ ID NO: 410000 - DNA, 25 bp, Mus musculus
gaaagtcgccatcttcaggcactgg

SEQ ID NO: 410001 - DNA, 25 bp, Mus musculus
gaaagtcgccatgttaatcccagtg

SEQ ID NO: 410002 - DNA, 25 bp, Mus musculus
gaaagtcgccatgttcaggcactgg

SEQ ID NO: 410003 - DNA, 25 bp, Mus musculus
gaaagtcgtcatagaccaccgagga

SEQ ID NO: 410004 - DNA, 25 bp, Mus musculus
gaaagtcgtcattgaccaccgagga

SEQ ID NO: 410005 - DNA, 25 bp, Mus musculus
gaaagtcgtctgacccaagagaaaa

SEQ ID NO: 410006 - DNA, 25 bp, Mus musculus
gaaagtcgtctgtcccaagagaaaa

SEQ ID NO: 410007 - DNA, 25 bp, Mus musculus
gaaagtctaatactaacattatccc

SEQ ID NO: 410008 - DNA, 25 bp, Mus musculus
gaaagtctaatagtaacattatccc

SEQ ID NO: 410009 - DNA, 25 bp, Mus musculus
gaaagtctactaatgtaagagttct

SEQ ID NO: 410010 - DNA, 25 bp, Mus musculus
gaaagtctactattgtaagagttct

SEQ ID NO: 410011 - DNA, 25 bp, Mus musculus
gaaagtctagccatccagctgaaaa

SEQ ID NO: 410012 - DNA, 25 bp, Mus musculus
gaaagtctagccttccagctgaaaa

SEQ ID NO: 410013 - DNA, 25 bp, Mus musculus
gaaagtctataaccaagggaccctt

SEQ ID NO: 410014 - DNA, 25 bp, Mus musculus
gaaagtctataagcaagggaccctt

SEQ ID NO: 410015 - DNA, 25 bp, Mus musculus
gaaagtctatgactactatgagaca

SEQ ID NO: 410016 - DNA, 25 bp, Mus musculus
gaaagtctatgagtactatgagaca

SEQ ID NO: 410017 - DNA, 25 bp, Mus musculus
gaaagtctatgcagaaactcaaaga

SEQ ID NO: 410018 - DNA, 25 bp, Mus musculus
gaaagtctatgctgaaactcaaaga

SEQ ID NO: 410019 - DNA, 25 bp, Mus musculus
gaaagtctcaagaggctcaggtgct

SEQ ID NO: 410020 - DNA, 25 bp, Mus musculus
gaaagtctcaagtggctcaggtgct

SEQ ID NO: 410021 - DNA, 25 bp, Mus musculus
gaaagtctcaatcctcatacggagg

SEQ ID NO: 410022 - DNA, 25 bp, Mus musculus
gaaagtctcaatgctcatacggagg

SEQ ID NO: 410023 - DNA, 25 bp, Mus musculus
gaaagtctcagcactgatatcagat

SEQ ID NO: 410024 - DNA, 25 bp, Mus musculus
gaaagtctcagctctgatatcagat

SEQ ID NO: 410025 - DNA, 25 bp, Mus musculus
gaaagtctcagtcagaacctagtga

SEQ ID NO: 410026 - DNA, 25 bp, Mus musculus
gaaagtctcagtgagaacctagtga

SEQ ID NO: 410027 - DNA, 25 bp, Mus musculus
gaaagtctcatccaagctgtgtctt

SEQ ID NO: 410028 - DNA, 25 bp, Mus musculus
gaaagtctcatcgaagctgtgtctt

SEQ ID NO: 410029 - DNA, 25 bp, Mus musculus
gaaagtctccaaaactcgtgggaag

SEQ ID NO: 410030 - DNA, 25 bp, Mus musculus
gaaagtctccaatactcgtgggaag

SEQ ID NO: 410031 - DNA, 25 bp, Mus musculus
gaaagtctcccacctagggaatggt

SEQ ID NO: 410032 - DNA, 25 bp, Mus musculus
gaaagtctcccagctagggaatggt

SEQ ID NO: 410033 - DNA, 25 bp, Mus musculus
gaaagtctccctagacactatccat

SEQ ID NO: 410034 - DNA, 25 bp, Mus musculus
gaaagtctccctcgaagctgaccca

SEQ ID NO: 410035 - DNA, 25 bp, Mus musculus
gaaagtctccctggaagctgaccca

SEQ ID NO: 410036 - DNA, 25 bp, Mus musculus
gaaagtctcccttgacactatccat

SEQ ID NO: 410037 - DNA, 25 bp, Mus musculus
gaaagtctcctgaaattgccgcttc

SEQ ID NO: 410038 - DNA, 25 bp, Mus musculus
gaaagtctcctgtaattgccgcttc

SEQ ID NO: 410039 - DNA, 25 bp, Mus musculus
gaaagtctctacatggactaccctt

SEQ ID NO: 410040 - DNA, 25 bp, Mus musculus
gaaagtctctacatgtttgtttgtc

SEQ ID NO: 410041 - DNA, 25 bp, Mus musculus
gaaagtctctacttggactaccctt

SEQ ID NO: 410042 - DNA, 25 bp, Mus musculus
gaaagtctctacttgtttgtttgtc

SEQ ID NO: 410043 - DNA, 25 bp, Mus musculus
gaaagtctcttcaatccatgttatt

SEQ ID NO: 410044 - DNA, 25 bp, Mus musculus
gaaagtctcttctatccatgttatt

SEQ ID NO: 410045 - DNA, 25 bp, Mus musculus
gaaagtctgcacagaagctgggcat

SEQ ID NO: 410046 - DNA, 25 bp, Mus musculus
gaaagtctgcactgaagctgggcat

SEQ ID NO: 410047 - DNA, 25 bp, Mus musculus
gaaagtctgcagatcgggacggacc

SEQ ID NO: 410048 - DNA, 25 bp, Mus musculus
gaaagtctgcagttcgggacggacc

SEQ ID NO: 410049 - DNA, 25 bp, Mus musculus
gaaagtctgccccatttccgtgtgc

SEQ ID NO: 410050 - DNA, 25 bp, Mus musculus
gaaagtctgcccgatttccgtgtgc

SEQ ID NO: 410051 - DNA, 25 bp, Mus musculus
gaaagtctggataacacatggctaa

SEQ ID NO: 410052 - DNA, 25 bp, Mus musculus
gaaagtctggattacacatggctaa

SEQ ID NO: 410053 - DNA, 25 bp, Mus musculus
gaaagtctggcaaacaatcgctgag

SEQ ID NO: 410054 - DNA, 25 bp, Mus musculus
gaaagtctggcatacaatcgctgag

SEQ ID NO: 410055 - DNA, 25 bp, Mus musculus
gaaagtctgggtcttgagctcttcc

SEQ ID NO: 410056 - DNA, 25 bp, Mus musculus
gaaagtctgggtgttgagctcttcc

SEQ ID NO: 410057 - DNA, 25 bp, Mus musculus
gaaagtctgtaaccctgcggaaaat

SEQ ID NO: 410058 - DNA, 25 bp, Mus musculus
gaaagtctgtaagcctgcggaaaat

SEQ ID NO: 410059 - DNA, 25 bp, Mus musculus
gaaagtctgtcactatatgcttgga

SEQ ID NO: 410060 - DNA, 25 bp, Mus musculus
gaaagtctgtcagtatatgcttgga

SEQ ID NO: 410061 - DNA, 25 bp, Mus musculus
gaaagtctgtctaagaaccaagtta

SEQ ID NO: 410062 - DNA, 25 bp, Mus musculus
gaaagtctgtcttagaaccaagtta

SEQ ID NO: 410063 - DNA, 25 bp, Mus musculus
gaaagtctgtgcaaactacaacata

SEQ ID NO: 410064 - DNA, 25 bp, Mus musculus
gaaagtctgtgctaactacaacata

SEQ ID NO: 410065 - DNA, 25 bp, Mus musculus
gaaagtctgtgtatcgacactcctg

SEQ ID NO: 410066 - DNA, 25 bp, Mus musculus
gaaagtctgtgtcagtctcaaccta

SEQ ID NO: 410067 - DNA, 25 bp, Mus musculus
gaaagtctgtgtcctcctgagacat

SEQ ID NO: 410068 - DNA, 25 bp, Mus musculus
gaaagtctgtgtgagtctcaaccta

SEQ ID NO: 410069 - DNA, 25 bp, Mus musculus
gaaagtctgtgtgctcctgagacat

SEQ ID NO: 410070 - DNA, 25 bp, Mus musculus
gaaagtctgtgtttcgacactcctg

SEQ ID NO: 410071 - DNA, 25 bp, Mus musculus
gaaagtctgttcaaactggcgctta

SEQ ID NO: 410072 - DNA, 25 bp, Mus musculus
gaaagtctgttctaactggcgctta

SEQ ID NO: 410073 - DNA, 25 bp, Mus musculus
gaaagtcttaaaagctgcctttgat

SEQ ID NO: 410074 - DNA, 25 bp, Mus musculus
gaaagtcttaaatgctgcctttgat

SEQ ID NO: 410075 - DNA, 25 bp, Mus musculus
gaaagtcttacacccactgttaaac

SEQ ID NO: 410076 - DNA, 25 bp, Mus musculus
gaaagtcttacaccttgggcaatag

SEQ ID NO: 410077 - DNA, 25 bp, Mus musculus
gaaagtcttacagccactgttaaac

SEQ ID NO: 410078 - DNA, 25 bp, Mus musculus
gaaagtcttacagcttgggcaatag

SEQ ID NO: 410079 - DNA, 25 bp, Mus musculus
gaaagtcttcaaacacttctcaagt

SEQ ID NO: 410080 - DNA, 25 bp, Mus musculus
gaaagtcttcaatcacttctcaagt

SEQ ID NO: 410081 - DNA, 25 bp, Mus musculus
gaaagtcttcacaatgtcttgcttc

SEQ ID NO: 410082 - DNA, 25 bp, Mus musculus
gaaagtcttcactatgtcttgcttc

SEQ ID NO: 410083 - DNA, 25 bp, Mus musculus
gaaagtcttcttcctgaggactagc

SEQ ID NO: 410084 - DNA, 25 bp, Mus musculus
gaaagtcttcttgctgaggactagc

SEQ ID NO: 410085 - DNA, 25 bp, Mus musculus
gaaagtcttggtaaatgagctaaat

SEQ ID NO: 410086 - DNA, 25 bp, Mus musculus
gaaagtcttggttaatgagctaaat

SEQ ID NO: 410087 - DNA, 25 bp, Mus musculus
gaaagtgaaaacacttccaaatagt

SEQ ID NO: 410088 - DNA, 25 bp, Mus musculus
gaaagtgaaaactcttccaaatagt

SEQ ID NO: 410089 - DNA, 25 bp, Mus musculus
gaaagtgaaaccaacagctgcaaaa

SEQ ID NO: 410090 - DNA, 25 bp, Mus musculus
gaaagtgaaacctacagctgcaaaa

SEQ ID NO: 410091 - DNA, 25 bp, Mus musculus
gaaagtgaaatacagccaacactgg

SEQ ID NO: 410092 - DNA, 25 bp, Mus musculus
gaaagtgaaatagagccaacactgg

SEQ ID NO: 410093 - DNA, 25 bp, Mus musculus
gaaagtgaaattcatgcccagacca

SEQ ID NO: 410094 - DNA, 25 bp, Mus musculus
gaaagtgaaattgatgcccagacca

SEQ ID NO: 410095 - DNA, 25 bp, Mus musculus
gaaagtgaacacacagtttacccaa

SEQ ID NO: 410096 - DNA, 25 bp, Mus musculus
gaaagtgaacactcagtttacccaa

SEQ ID NO: 410097 - DNA, 25 bp, Mus musculus
gaaagtgaacctcgtctttgagaaa

SEQ ID NO: 410098 - DNA, 25 bp, Mus musculus
gaaagtgaacctggtctttgagaaa

SEQ ID NO: 410099 - DNA, 25 bp, Mus musculus
gaaagtgaactgctgtttgcctaat

SEQ ID NO: 410100 - DNA, 25 bp, Mus musculus
gaaagtgaactggtgtttgcctaat

SEQ ID NO: 410101 - DNA, 25 bp, Mus musculus
gaaagtgaacttagctcaacccaga

SEQ ID NO: 410102 - DNA, 25 bp, Mus musculus
gaaagtgaactttgctcaacccaga

SEQ ID NO: 410103 - DNA, 25 bp, Mus musculus
gaaagtgacaacctaaacagaccta

SEQ ID NO: 410104 - DNA, 25 bp, Mus musculus
gaaagtgacaacgtaaacagaccta

SEQ ID NO: 410105 - DNA, 25 bp, Mus musculus
gaaagtgacaccacagagttgtcct

SEQ ID NO: 410106 - DNA, 25 bp, Mus musculus
gaaagtgacacctcagagttgtcct

SEQ ID NO: 410107 - DNA, 25 bp, Mus musculus
gaaagtgacatgaacccaccttgcg

SEQ ID NO: 410108 - DNA, 25 bp, Mus musculus
gaaagtgacatgtacccaccttgcg

SEQ ID NO: 410109 - DNA, 25 bp, Mus musculus
gaaagtgaccagctatatccccatc

SEQ ID NO: 410110 - DNA, 25 bp, Mus musculus
gaaagtgaccaggtatatccccatc

SEQ ID NO: 410111 - DNA, 25 bp, Mus musculus
gaaagtgaccataaccagtcatttt

SEQ ID NO: 410112 - DNA, 25 bp, Mus musculus
gaaagtgaccattaccagtcatttt

SEQ ID NO: 410113 - DNA, 25 bp, Mus musculus
gaaagtgaccccagtgacgatgact

SEQ ID NO: 410114 - DNA, 25 bp, Mus musculus
gaaagtgacccctgtgacgatgact

SEQ ID NO: 410115 - DNA, 25 bp, Mus musculus
gaaagtgacctaacagctcaagagc

SEQ ID NO: 410116 - DNA, 25 bp, Mus musculus
gaaagtgacctaacttgacaggact

SEQ ID NO: 410117 - DNA, 25 bp, Mus musculus
gaaagtgacctatcagctcaagagc

SEQ ID NO: 410118 - DNA, 25 bp, Mus musculus
gaaagtgacctatcttgacaggact

SEQ ID NO: 410119 - DNA, 25 bp, Mus musculus
gaaagtgactgtcatcacgaagcat

SEQ ID NO: 410120 - DNA, 25 bp, Mus musculus
gaaagtgactgtgatcacgaagcat

SEQ ID NO: 410121 - DNA, 25 bp, Mus musculus
gaaagtgacttcataccagggtttt

SEQ ID NO: 410122 - DNA, 25 bp, Mus musculus
gaaagtgacttcttaccagggtttt

SEQ ID NO: 410123 - DNA, 25 bp, Mus musculus
gaaagtgagacaacacctatgttta

SEQ ID NO: 410124 - DNA, 25 bp, Mus musculus
gaaagtgagacatcacctatgttta

SEQ ID NO: 410125 - DNA, 25 bp, Mus musculus
gaaagtgagaccagcgatttagaat

SEQ ID NO: 410126 - DNA, 25 bp, Mus musculus
gaaagtgagacctgcgatttagaat

SEQ ID NO: 410127 - DNA, 25 bp, Mus musculus
gaaagtgagccccagcaaaccctct

SEQ ID NO: 410128 - DNA, 25 bp, Mus musculus
gaaagtgagcccgagcaaaccctct

SEQ ID NO: 410129 - DNA, 25 bp, Mus musculus
gaaagtgagctcaaaccaccatact

SEQ ID NO: 410130 - DNA, 25 bp, Mus musculus
gaaagtgagctctaaccaccatact

SEQ ID NO: 410131 - DNA, 25 bp, Mus musculus
gaaagtgagtatactagcagtacaa

SEQ ID NO: 410132 - DNA, 25 bp, Mus musculus
gaaagtgagtatccggctgcaccgt

SEQ ID NO: 410133 - DNA, 25 bp, Mus musculus
gaaagtgagtatgcggctgcaccgt

SEQ ID NO: 410134 - DNA, 25 bp, Mus musculus
gaaagtgagtattctagcagtacaa

SEQ ID NO: 410135 - DNA, 25 bp, Mus musculus
gaaagtgagtctatggatatggtat

SEQ ID NO: 410136 - DNA, 25 bp, Mus musculus
gaaagtgagtctttggatatggtat

SEQ ID NO: 410137 - DNA, 25 bp, Mus musculus
gaaagtgatctaagtgctacaggag

SEQ ID NO: 410138 - DNA, 25 bp, Mus musculus
gaaagtgatctatgtgctacaggag

SEQ ID NO: 410139 - DNA, 25 bp, Mus musculus
gaaagtgatctcagtccccaaaggc

SEQ ID NO: 410140 - DNA, 25 bp, Mus musculus
gaaagtgatctctgtccccaaaggc

SEQ ID NO: 410141 - DNA, 25 bp, Mus musculus
gaaagtgattaaatgctgagccctg

SEQ ID NO: 410142 - DNA, 25 bp, Mus musculus
gaaagtgattaattgctgagccctg

SEQ ID NO: 410143 - DNA, 25 bp, Mus musculus
gaaagtgattccatttaccagtgat

SEQ ID NO: 410144 - DNA, 25 bp, Mus musculus
gaaagtgattccttttaccagtgat

SEQ ID NO: 410145 - DNA, 25 bp, Mus musculus
gaaagtgattctccctcaaaggctg

SEQ ID NO: 410146 - DNA, 25 bp, Mus musculus
gaaagtgattctgcctcaaaggctg

SEQ ID NO: 410147 - DNA, 25 bp, Mus musculus
gaaagtgattgcagttgccaactct

SEQ ID NO: 410148 - DNA, 25 bp, Mus musculus
gaaagtgattgctgttgccaactct

SEQ ID NO: 410149 - DNA, 25 bp, Mus musculus
gaaagtgcaagtcccgctatatatg

SEQ ID NO: 410150 - DNA, 25 bp, Mus musculus
gaaagtgcaagtcttcagtctccca

SEQ ID NO: 410151 - DNA, 25 bp, Mus musculus
gaaagtgcaagtgccgctatatatg

SEQ ID NO: 410152 - DNA, 25 bp, Mus musculus
gaaagtgcaagtgttcagtctccca

SEQ ID NO: 410153 - DNA, 25 bp, Mus musculus
gaaagtgcacagcatcccagagcta

SEQ ID NO: 410154 - DNA, 25 bp, Mus musculus
gaaagtgcacaggatcccagagcta

SEQ ID NO: 410155 - DNA, 25 bp, Mus musculus
gaaagtgcacttcggctgtggcaac

SEQ ID NO: 410156 - DNA, 25 bp, Mus musculus
gaaagtgcacttgggctgtggcaac

SEQ ID NO: 410157 - DNA, 25 bp, Mus musculus
gaaagtgcagatctgaatccttgct

SEQ ID NO: 410158 - DNA, 25 bp, Mus musculus
gaaagtgcagatgtgaatccttgct

SEQ ID NO: 410159 - DNA, 25 bp, Mus musculus
gaaagtgcagctaggtgtcctccag

SEQ ID NO: 410160 - DNA, 25 bp, Mus musculus
gaaagtgcagcttggtgtcctccag

SEQ ID NO: 410161 - DNA, 25 bp, Mus musculus
gaaagtgcattaatgtcccctgaat

SEQ ID NO: 410162 - DNA, 25 bp, Mus musculus
gaaagtgcattattgtcccctgaat

SEQ ID NO: 410163 - DNA, 25 bp, Mus musculus
gaaagtgccacacgctctgatctca

SEQ ID NO: 410164 - DNA, 25 bp, Mus musculus
gaaagtgccacaggctctgatctca

SEQ ID NO: 410165 - DNA, 25 bp, Mus musculus
gaaagtgccacgaactgtgtctgta

SEQ ID NO: 410166 - DNA, 25 bp, Mus musculus
gaaagtgccacgtactgtgtctgta

SEQ ID NO: 410167 - DNA, 25 bp, Mus musculus
gaaagtgccactagtctatatcttg

SEQ ID NO: 410168 - DNA, 25 bp, Mus musculus
gaaagtgccacttgtctatatcttg

SEQ ID NO: 410169 - DNA, 25 bp, Mus musculus
gaaagtgccagtcccagaactgtat

SEQ ID NO: 410170 - DNA, 25 bp, Mus musculus
gaaagtgccagtgccagaactgtat

SEQ ID NO: 410171 - DNA, 25 bp, Mus musculus
gaaagtgcccaaactgaatgaagta

SEQ ID NO: 410172 - DNA, 25 bp, Mus musculus
gaaagtgcccaatctgaatgaagta

SEQ ID NO: 410173 - DNA, 25 bp, Mus musculus
gaaagtgccctacagttcacctgca

SEQ ID NO: 410174 - DNA, 25 bp, Mus musculus
gaaagtgccctacatccttgaagac

SEQ ID NO: 410175 - DNA, 25 bp, Mus musculus
gaaagtgccctagagttcacctgca

SEQ ID NO: 410176 - DNA, 25 bp, Mus musculus
gaaagtgccctagatccttgaagac

SEQ ID NO: 410177 - DNA, 25 bp, Mus musculus
gaaagtgccctcatagaacatcctt

SEQ ID NO: 410178 - DNA, 25 bp, Mus musculus
gaaagtgccctcttagaacatcctt

SEQ ID NO: 410179 - DNA, 25 bp, Mus musculus
gaaagtgcctaaagctgtctgttat

SEQ ID NO: 410180 - DNA, 25 bp, Mus musculus
gaaagtgcctaatgctgtctgttat

SEQ ID NO: 410181 - DNA, 25 bp, Mus musculus
gaaagtgcctagacaggcaggcagc

SEQ ID NO: 410182 - DNA, 25 bp, Mus musculus
gaaagtgcctagtcaggcaggcagc

SEQ ID NO: 410183 - DNA, 25 bp, Mus musculus
gaaagtgcctgtccatcagcattct

SEQ ID NO: 410184 - DNA, 25 bp, Mus musculus
gaaagtgcctgtgcatcagcattct

SEQ ID NO: 410185 - DNA, 25 bp, Mus musculus
gaaagtgccttgaaaatcgcccgga

SEQ ID NO: 410186 - DNA, 25 bp, Mus musculus
gaaagtgccttgtaaatcgcccgga

SEQ ID NO: 410187 - DNA, 25 bp, Mus musculus
gaaagtgcctttcagttcagtcttg

SEQ ID NO: 410188 - DNA, 25 bp, Mus musculus
gaaagtgcctttccagctcagaacc

SEQ ID NO: 410189 - DNA, 25 bp, Mus musculus
gaaagtgcctttgagttcagtcttg

SEQ ID NO: 410190 - DNA, 25 bp, Mus musculus
gaaagtgcctttgcagctcagaacc

SEQ ID NO: 410191 - DNA, 25 bp, Mus musculus
gaaagtgctaagatttgtacctcaa

SEQ ID NO: 410192 - DNA, 25 bp, Mus musculus
gaaagtgctaagttttgtacctcaa

SEQ ID NO: 410193 - DNA, 25 bp, Mus musculus
gaaagtgctcagaaacaccctcctt

SEQ ID NO: 410194 - DNA, 25 bp, Mus musculus
gaaagtgctcagagtccaggataaa

SEQ ID NO: 410195 - DNA, 25 bp, Mus musculus
gaaagtgctcagataaccagagaga

SEQ ID NO: 410196 - DNA, 25 bp, Mus musculus
gaaagtgctcagtaacaccctcctt

SEQ ID NO: 410197 - DNA, 25 bp, Mus musculus
gaaagtgctcagtgtccaggataaa

SEQ ID NO: 410198 - DNA, 25 bp, Mus musculus
gaaagtgctcagttaaccagagaga

SEQ ID NO: 410199 - DNA, 25 bp, Mus musculus
gaaagtgctcgtaatgtctcgacga

SEQ ID NO: 410200 - DNA, 25 bp, Mus musculus
gaaagtgctcgttatgtctcgacga

SEQ ID NO: 410201 - DNA, 25 bp, Mus musculus
gaaagtgctctcattgttatagaga

SEQ ID NO: 410202 - DNA, 25 bp, Mus musculus
gaaagtgctctctttgttatagaga

SEQ ID NO: 410203 - DNA, 25 bp, Mus musculus
gaaagtgctgacatccttgggcttg

SEQ ID NO: 410204 - DNA, 25 bp, Mus musculus
gaaagtgctgacttccttgggcttg

SEQ ID NO: 410205 - DNA, 25 bp, Mus musculus
gaaagtgctgctacatcttcttcct

SEQ ID NO: 410206 - DNA, 25 bp, Mus musculus
gaaagtgctgcttcatcttcttcct

SEQ ID NO: 410207 - DNA, 25 bp, Mus musculus
gaaagtgctgtactgctatctcagg

SEQ ID NO: 410208 - DNA, 25 bp, Mus musculus
gaaagtgctgtagtgctatctcagg

SEQ ID NO: 410209 - DNA, 25 bp, Mus musculus
gaaagtgcttcacagatacatgcag

SEQ ID NO: 410210 - DNA, 25 bp, Mus musculus
gaaagtgcttcaccgtggccaggca

SEQ ID NO: 410211 - DNA, 25 bp, Mus musculus
gaaagtgcttcagagatacatgcag

SEQ ID NO: 410212 - DNA, 25 bp, Mus musculus
gaaagtgcttcagcgtggccaggca

SEQ ID NO: 410213 - DNA, 25 bp, Mus musculus
gaaagtgcttccctaaagttgctca

SEQ ID NO: 410214 - DNA, 25 bp, Mus musculus
gaaagtgcttccgtaaagttgctca

SEQ ID NO: 410215 - DNA, 25 bp, Mus musculus
gaaagtgcttggctctagtttttgt

SEQ ID NO: 410216 - DNA, 25 bp, Mus musculus
gaaagtgcttgggtctagtttttgt

SEQ ID NO: 410217 - DNA, 25 bp, Mus musculus
gaaagtgcttgtatgctgttatcag

SEQ ID NO: 410218 - DNA, 25 bp, Mus musculus
gaaagtgcttgtttgctgttatcag

SEQ ID NO: 410219 - DNA, 25 bp, Mus musculus
gaaagtggaaatccatcgcctcatc

SEQ ID NO: 410220 - DNA, 25 bp, Mus musculus
gaaagtggaaatgcatcgcctcatc

SEQ ID NO: 410221 - DNA, 25 bp, Mus musculus
gaaagtggaaccatgcctccaaaat

SEQ ID NO: 410222 - DNA, 25 bp, Mus musculus
gaaagtggaaccttgcctccaaaat

SEQ ID NO: 410223 - DNA, 25 bp, Mus musculus
gaaagtggacctcatgatctagcct

SEQ ID NO: 410224 - DNA, 25 bp, Mus musculus
gaaagtggacctgatgatctagcct

SEQ ID NO: 410225 - DNA, 25 bp, Mus musculus
gaaagtggagccctgcaacgaacac

SEQ ID NO: 410226 - DNA, 25 bp, Mus musculus
gaaagtggagccgtgcaacgaacac

SEQ ID NO: 410227 - DNA, 25 bp, Mus musculus
gaaagtggatgcaatcggcttgctt

SEQ ID NO: 410228 - DNA, 25 bp, Mus musculus
gaaagtggatgctatcggcttgctt

SEQ ID NO: 410229 - DNA, 25 bp, Mus musculus
gaaagtggcctccacctgagtccca

SEQ ID NO: 410230 - DNA, 25 bp, Mus musculus
gaaagtggcctcgacctgagtccca

SEQ ID NO: 410231 - DNA, 25 bp, Mus musculus
gaaagtggcttacctccatgccagc

SEQ ID NO: 410232 - DNA, 25 bp, Mus musculus
gaaagtggcttagctccatgccagc

SEQ ID NO: 410233 - DNA, 25 bp, Mus musculus
gaaagtggcttccatagtcaccatc

SEQ ID NO: 410234 - DNA, 25 bp, Mus musculus
gaaagtggcttcgatagtcaccatc

SEQ ID NO: 410235 - DNA, 25 bp, Mus musculus
gaaagtgggagtcccctccctacat

SEQ ID NO: 410236 - DNA, 25 bp, Mus musculus
gaaagtgggagtgccctccctacat

SEQ ID NO: 410237 - DNA, 25 bp, Mus musculus
gaaagtgggctgattcctagtggaa

SEQ ID NO: 410238 - DNA, 25 bp, Mus musculus
gaaagtgggctgtttcctagtggaa

SEQ ID NO: 410239 - DNA, 25 bp, Mus musculus
gaaagtgggtaccattctctcaggc

SEQ ID NO: 410240 - DNA, 25 bp, Mus musculus
gaaagtgggtacgattctctcaggc

SEQ ID NO: 410241 - DNA, 25 bp, Mus musculus
gaaagtggtactcagctaaaaaagt

SEQ ID NO: 410242 - DNA, 25 bp, Mus musculus
gaaagtggtactgagctaaaaaagt

SEQ ID NO: 410243 - DNA, 25 bp, Mus musculus
gaaagtggtagtattgttagcagta

SEQ ID NO: 410244 - DNA, 25 bp, Mus musculus
gaaagtggtagttttgttagcagta

SEQ ID NO: 410245 - DNA, 25 bp, Mus musculus
gaaagtggtatcagtggcccagcgt

SEQ ID NO: 410246 - DNA, 25 bp, Mus musculus
gaaagtggtatctgtggcccagcgt

SEQ ID NO: 410247 - DNA, 25 bp, Mus musculus
gaaagtggtattataatgctgcagg

SEQ ID NO: 410248 - DNA, 25 bp, Mus musculus
gaaagtggtattttaatgctgcagg

SEQ ID NO: 410249 - DNA, 25 bp, Mus musculus
gaaagtggtcccaagaaactcttct

SEQ ID NO: 410250 - DNA, 25 bp, Mus musculus
gaaagtggtccctagaaactcttct

SEQ ID NO: 410251 - DNA, 25 bp, Mus musculus
gaaagtggtcggaccacccacacag

SEQ ID NO: 410252 - DNA, 25 bp, Mus musculus
gaaagtggtcggtccacccacacag

SEQ ID NO: 410253 - DNA, 25 bp, Mus musculus
gaaagtggtgccagcgttagccttc

SEQ ID NO: 410254 - DNA, 25 bp, Mus musculus
gaaagtggtgcctgcgttagccttc

SEQ ID NO: 410255 - DNA, 25 bp, Mus musculus
gaaagtggttatatgtgctttacca

SEQ ID NO: 410256 - DNA, 25 bp, Mus musculus
gaaagtggttatttgtgctttacca

SEQ ID NO: 410257 - DNA, 25 bp, Mus musculus
gaaagtggttttcttctctgagttt

SEQ ID NO: 410258 - DNA, 25 bp, Mus musculus
gaaagtggttttgttctctgagttt

SEQ ID NO: 410259 - DNA, 25 bp, Mus musculus
gaaagtgtacagatcttctcctgca

SEQ ID NO: 410260 - DNA, 25 bp, Mus musculus
gaaagtgtacagttcttctcctgca

SEQ ID NO: 410261 - DNA, 25 bp, Mus musculus
gaaagtgtactcatttgctttataa

SEQ ID NO: 410262 - DNA, 25 bp, Mus musculus
gaaagtgtactcttttgctttataa

SEQ ID NO: 410263 - DNA, 25 bp, Mus musculus
gaaagtgtacttacacccaatgact

SEQ ID NO: 410264 - DNA, 25 bp, Mus musculus
gaaagtgtactttcacccaatgact

SEQ ID NO: 410265 - DNA, 25 bp, Mus musculus
gaaagtgtagcaacacccactgaaa

SEQ ID NO: 410266 - DNA, 25 bp, Mus musculus
gaaagtgtagcatcacccactgaaa

SEQ ID NO: 410267 - DNA, 25 bp, Mus musculus
gaaagtgtatcaacgttccctgttc

SEQ ID NO: 410268 - DNA, 25 bp, Mus musculus
gaaagtgtatcatcgttccctgttc

SEQ ID NO: 410269 - DNA, 25 bp, Mus musculus
gaaagtgtattaagcctcctgagga

SEQ ID NO: 410270 - DNA, 25 bp, Mus musculus
gaaagtgtattatgcctcctgagga

SEQ ID NO: 410271 - DNA, 25 bp, Mus musculus
gaaagtgtcagtatcaacatctaat

SEQ ID NO: 410272 - DNA, 25 bp, Mus musculus
gaaagtgtcagtttcaacatctaat

SEQ ID NO: 410273 - DNA, 25 bp, Mus musculus
gaaagtgtcctcatgttaccaaact

SEQ ID NO: 410274 - DNA, 25 bp, Mus musculus
gaaagtgtcctcttgttaccaaact

SEQ ID NO: 410275 - DNA, 25 bp, Mus musculus
gaaagtgtctacagagctctccaag

SEQ ID NO: 410276 - DNA, 25 bp, Mus musculus
gaaagtgtctactgagctctccaag

SEQ ID NO: 410277 - DNA, 25 bp, Mus musculus
gaaagtgtctccatattacaggcca

SEQ ID NO: 410278 - DNA, 25 bp, Mus musculus
gaaagtgtctccttattacaggcca

SEQ ID NO: 410279 - DNA, 25 bp, Mus musculus
gaaagtgtctgactcgtgaggaaca

SEQ ID NO: 410280 - DNA, 25 bp, Mus musculus
gaaagtgtctgagtcgtgaggaaca

SEQ ID NO: 410281 - DNA, 25 bp, Mus musculus
gaaagtgtctgtaggatttaatcaa

SEQ ID NO: 410282 - DNA, 25 bp, Mus musculus
gaaagtgtctgttggatttaatcaa

SEQ ID NO: 410283 - DNA, 25 bp, Mus musculus
gaaagtgtcttcaggtggaacaatt

SEQ ID NO: 410284 - DNA, 25 bp, Mus musculus
gaaagtgtcttcagtaaaacataat

SEQ ID NO: 410285 - DNA, 25 bp, Mus musculus
gaaagtgtcttctggtggaacaatt

SEQ ID NO: 410286 - DNA, 25 bp, Mus musculus
gaaagtgtcttctgtaaaacataat

SEQ ID NO: 410287 - DNA, 25 bp, Mus musculus
gaaagtgtgcccaccgaaggaataa

SEQ ID NO: 410288 - DNA, 25 bp, Mus musculus
gaaagtgtgccctccgaaggaataa

SEQ ID NO: 410289 - DNA, 25 bp, Mus musculus
gaaagtgtgctactgttggttgaac

SEQ ID NO: 410290 - DNA, 25 bp, Mus musculus
gaaagtgtgctagtgttggttgaac

SEQ ID NO: 410291 - DNA, 25 bp, Mus musculus
gaaagtgtggccagtgttttattca

SEQ ID NO: 410292 - DNA, 25 bp, Mus musculus
gaaagtgtggcctgtgttttattca

SEQ ID NO: 410293 - DNA, 25 bp, Mus musculus
gaaagtgtgggaccttttccctgag

SEQ ID NO: 410294 - DNA, 25 bp, Mus musculus
gaaagtgtgggagcttttccctgag

SEQ ID NO: 410295 - DNA, 25 bp, Mus musculus
gaaagtgtggtccagattaaagttt

SEQ ID NO: 410296 - DNA, 25 bp, Mus musculus
gaaagtgtggtcgagattaaagttt

SEQ ID NO: 410297 - DNA, 25 bp, Mus musculus
gaaagtgtggtgaggcctgcaccca

SEQ ID NO: 410298 - DNA, 25 bp, Mus musculus
gaaagtgtggtgtggcctgcaccca

SEQ ID NO: 410299 - DNA, 25 bp, Mus musculus
gaaagtgtgttactcctacctgcag

SEQ ID NO: 410300 - DNA, 25 bp, Mus musculus
gaaagtgtgttagtcctacctgcag

SEQ ID NO: 410301 - DNA, 25 bp, Mus musculus
gaaagtgtgtttaactgccttgtgt

SEQ ID NO: 410302 - DNA, 25 bp, Mus musculus
gaaagtgtgttttactgccttgtgt

SEQ ID NO: 410303 - DNA, 25 bp, Mus musculus
gaaagtgttagtctactatcccagc

SEQ ID NO: 410304 - DNA, 25 bp, Mus musculus
gaaagtgttagtgtactatcccagc

SEQ ID NO: 410305 - DNA, 25 bp, Mus musculus
gaaagtgttctgaccttcgtttgtc

SEQ ID NO: 410306 - DNA, 25 bp, Mus musculus
gaaagtgttctgtccttcgtttgtc

SEQ ID NO: 410307 - DNA, 25 bp, Mus musculus
gaaagtgttgatacttatgccgtta

SEQ ID NO: 410308 - DNA, 25 bp, Mus musculus
gaaagtgttgatccctctacacact

SEQ ID NO: 410309 - DNA, 25 bp, Mus musculus
gaaagtgttgatgcctctacacact

SEQ ID NO: 410310 - DNA, 25 bp, Mus musculus
gaaagtgttgattcttatgccgtta

SEQ ID NO: 410311 - DNA, 25 bp, Mus musculus
gaaagtgttgggaggctgcccacca

SEQ ID NO: 410312 - DNA, 25 bp, Mus musculus
gaaagtgttgggtggctgcccacca

SEQ ID NO: 410313 - DNA, 25 bp, Mus musculus
gaaagtgttgtaccagcgtgcgccc

SEQ ID NO: 410314 - DNA, 25 bp, Mus musculus
gaaagtgttgtagcagcgtgcgccc

SEQ ID NO: 410315 - DNA, 25 bp, Mus musculus
gaaagtgttgtgatctctcactgta

SEQ ID NO: 410316 - DNA, 25 bp, Mus musculus
gaaagtgttgtgttctctcactgta

SEQ ID NO: 410317 - DNA, 25 bp, Mus musculus
gaaagtgtttatactatgatgagtt

SEQ ID NO: 410318 - DNA, 25 bp, Mus musculus
gaaagtgtttattctatgatgagtt

SEQ ID NO: 410319 - DNA, 25 bp, Mus musculus
gaaagtgttttcaacttggccttga

SEQ ID NO: 410320 - DNA, 25 bp, Mus musculus
gaaagtgttttcagtgaccccagga

SEQ ID NO: 410321 - DNA, 25 bp, Mus musculus
gaaagtgttttctacttggccttga

SEQ ID NO: 410322 - DNA, 25 bp, Mus musculus
gaaagtgttttctgtgaccccagga

SEQ ID NO: 410323 - DNA, 25 bp, Mus musculus
gaaagtgttttgcagtcctccgttt

SEQ ID NO: 410324 - DNA, 25 bp, Mus musculus
gaaagtgttttggagtcctccgttt

SEQ ID NO: 410325 - DNA, 25 bp, Mus musculus
gaaagttaacacagcgcactaaagg

SEQ ID NO: 410326 - DNA, 25 bp, Mus musculus
gaaagttaacactgcgcactaaagg

SEQ ID NO: 410327 - DNA, 25 bp, Mus musculus
gaaagttaacatctatcagcagtca

SEQ ID NO: 410328 - DNA, 25 bp, Mus musculus
gaaagttaacatgtatcagcagtca

SEQ ID NO: 410329 - DNA, 25 bp, Mus musculus
gaaagttacattaacagggtcacat

SEQ ID NO: 410330 - DNA, 25 bp, Mus musculus
gaaagttacatttacagggtcacat

SEQ ID NO: 410331 - DNA, 25 bp, Mus musculus
gaaagttacccaacactctgttaag

SEQ ID NO: 410332 - DNA, 25 bp, Mus musculus
gaaagttacccatcactctgttaag

SEQ ID NO: 410333 - DNA, 25 bp, Mus musculus
gaaagttaccttctagtcgtctcaa

SEQ ID NO: 410334 - DNA, 25 bp, Mus musculus
gaaagttaccttgtagtcgtctcaa

SEQ ID NO: 410335 - DNA, 25 bp, Mus musculus
gaaagttactgtcatgagcaccatt

SEQ ID NO: 410336 - DNA, 25 bp, Mus musculus
gaaagttactgtgatgagcaccatt

SEQ ID NO: 410337 - DNA, 25 bp, Mus musculus
gaaagttagcgacactatgttatgg

SEQ ID NO: 410338 - DNA, 25 bp, Mus musculus
gaaagttagcgagactatgttatgg

SEQ ID NO: 410339 - DNA, 25 bp, Mus musculus
gaaagttagggcatgcacatcagtt

SEQ ID NO: 410340 - DNA, 25 bp, Mus musculus
gaaagttagggcttgcacatcagtt

SEQ ID NO: 410341 - DNA, 25 bp, Mus musculus
gaaagttaggtacatgtgccatctt

SEQ ID NO: 410342 - DNA, 25 bp, Mus musculus
gaaagttaggtagatgtgccatctt

SEQ ID NO: 410343 - DNA, 25 bp, Mus musculus
gaaagttagttcaagaacaccctgt

SEQ ID NO: 410344 - DNA, 25 bp, Mus musculus
gaaagttagttctagaacaccctgt

SEQ ID NO: 410345 - DNA, 25 bp, Mus musculus
gaaagttatataagagctcctccat

SEQ ID NO: 410346 - DNA, 25 bp, Mus musculus
gaaagttatatatgagctcctccat

SEQ ID NO: 410347 - DNA, 25 bp, Mus musculus
gaaagttatctaatactggtctgtt

SEQ ID NO: 410348 - DNA, 25 bp, Mus musculus
gaaagttatctattactggtctgtt

SEQ ID NO: 410349 - DNA, 25 bp, Mus musculus
gaaagttatttgaagctttggacct

SEQ ID NO: 410350 - DNA, 25 bp, Mus musculus
gaaagttatttgatccagacgcctg

SEQ ID NO: 410351 - DNA, 25 bp, Mus musculus
gaaagttatttgtagctttggacct

SEQ ID NO: 410352 - DNA, 25 bp, Mus musculus
gaaagttatttgttccagacgcctg

SEQ ID NO: 410353 - DNA, 25 bp, Mus musculus
gaaagttcacagactagatgtgaca

SEQ ID NO: 410354 - DNA, 25 bp, Mus musculus
gaaagttcacagtctagatgtgaca

SEQ ID NO: 410355 - DNA, 25 bp, Mus musculus
gaaagttcacgacatagaagggctc

SEQ ID NO: 410356 - DNA, 25 bp, Mus musculus
gaaagttcacgagatagaagggctc

SEQ ID NO: 410357 - DNA, 25 bp, Mus musculus
gaaagttcacttcagctgcatttag

SEQ ID NO: 410358 - DNA, 25 bp, Mus musculus
gaaagttcacttgagctgcatttag

SEQ ID NO: 410359 - DNA, 25 bp, Mus musculus
gaaagttcagaaagcgctgtccccg

SEQ ID NO: 410360 - DNA, 25 bp, Mus musculus
gaaagttcagaatgcgctgtccccg

SEQ ID NO: 410361 - DNA, 25 bp, Mus musculus
gaaagttcagacattgcaaacacaa

SEQ ID NO: 410362 - DNA, 25 bp, Mus musculus
gaaagttcagactttgcaaacacaa

SEQ ID NO: 410363 - DNA, 25 bp, Mus musculus
gaaagttcagctagtatttgtgtgt

SEQ ID NO: 410364 - DNA, 25 bp, Mus musculus
gaaagttcagcttgtatttgtgtgt

SEQ ID NO: 410365 - DNA, 25 bp, Mus musculus
gaaagttcagtaactaccccatctg

SEQ ID NO: 410366 - DNA, 25 bp, Mus musculus
gaaagttcagtatctaccccatctg

SEQ ID NO: 410367 - DNA, 25 bp, Mus musculus
gaaagttcagtgaggctctacgtag

SEQ ID NO: 410368 - DNA, 25 bp, Mus musculus
gaaagttcagtgtggctctacgtag

SEQ ID NO: 410369 - DNA, 25 bp, Mus musculus
gaaagttcagttctaccgcatccag

SEQ ID NO: 410370 - DNA, 25 bp, Mus musculus
gaaagttcagttgtaccgcatccag

SEQ ID NO: 410371 - DNA, 25 bp, Mus musculus
gaaagttcatatacttccatctctg

SEQ ID NO: 410372 - DNA, 25 bp, Mus musculus
gaaagttcatattcttccatctctg

SEQ ID NO: 410373 - DNA, 25 bp, Mus musculus
gaaagttccaagctttatagtcctg

SEQ ID NO: 410374 - DNA, 25 bp, Mus musculus
gaaagttccaaggtttatagtcctg

SEQ ID NO: 410375 - DNA, 25 bp, Mus musculus
gaaagttccaccacgcaatagtaga

SEQ ID NO: 410376 - DNA, 25 bp, Mus musculus
gaaagttccacctcgcaatagtaga

SEQ ID NO: 410377 - DNA, 25 bp, Mus musculus
gaaagttccagtagttgcagcagta

SEQ ID NO: 410378 - DNA, 25 bp, Mus musculus
gaaagttccagttgttgcagcagta

SEQ ID NO: 410379 - DNA, 25 bp, Mus musculus
gaaagttccctaaaggattgatttt

SEQ ID NO: 410380 - DNA, 25 bp, Mus musculus
gaaagttccctataggattgatttt

SEQ ID NO: 410381 - DNA, 25 bp, Mus musculus
gaaagttcccttaagttctagagtg

SEQ ID NO: 410382 - DNA, 25 bp, Mus musculus
gaaagttccctttagttctagagtg

SEQ ID NO: 410383 - DNA, 25 bp, Mus musculus
gaaagttcctgccagcagtatgaca

SEQ ID NO: 410384 - DNA, 25 bp, Mus musculus
gaaagttcctgcgagcagtatgaca

SEQ ID NO: 410385 - DNA, 25 bp, Mus musculus
gaaagttccttccagtactacttag

SEQ ID NO: 410386 - DNA, 25 bp, Mus musculus
gaaagttccttccatcaacaacgat

SEQ ID NO: 410387 - DNA, 25 bp, Mus musculus
gaaagttccttcgagtactacttag

SEQ ID NO: 410388 - DNA, 25 bp, Mus musculus
gaaagttccttcgatcaacaacgat

SEQ ID NO: 410389 - DNA, 25 bp, Mus musculus
gaaagttcgtcaactctatcgacac

SEQ ID NO: 410390 - DNA, 25 bp, Mus musculus
gaaagttcgtcatctctatcgacac

SEQ ID NO: 410391 - DNA, 25 bp, Mus musculus
gaaagttcgtgaaccccgggccaat

SEQ ID NO: 410392 - DNA, 25 bp, Mus musculus
gaaagttcgtgatccccgggccaat

SEQ ID NO: 410393 - DNA, 25 bp, Mus musculus
gaaagttctagcatcaggaatgcat

SEQ ID NO: 410394 - DNA, 25 bp, Mus musculus
gaaagttctagcctttagttgtact

SEQ ID NO: 410395 - DNA, 25 bp, Mus musculus
gaaagttctagcgtttagttgtact

SEQ ID NO: 410396 - DNA, 25 bp, Mus musculus
gaaagttctagcttcaggaatgcat

SEQ ID NO: 410397 - DNA, 25 bp, Mus musculus
gaaagttctcagagtccattaattt

SEQ ID NO: 410398 - DNA, 25 bp, Mus musculus
gaaagttctcagtgtccattaattt

SEQ ID NO: 410399 - DNA, 25 bp, Mus musculus
gaaagttctcccatggccacaaagg

SEQ ID NO: 410400 - DNA, 25 bp, Mus musculus
gaaagttctcccttggccacaaagg

SEQ ID NO: 410401 - DNA, 25 bp, Mus musculus
gaaagttctcttcttattcacggag

SEQ ID NO: 410402 - DNA, 25 bp, Mus musculus
gaaagttctcttgttattcacggag

SEQ ID NO: 410403 - DNA, 25 bp, Mus musculus
gaaagttctggactgctgttgtgat

SEQ ID NO: 410404 - DNA, 25 bp, Mus musculus
gaaagttctggagtgctgttgtgat

SEQ ID NO: 410405 - DNA, 25 bp, Mus musculus
gaaagttctggtctctgtttctgtg

SEQ ID NO: 410406 - DNA, 25 bp, Mus musculus
gaaagttctggtgtctgtttctgtg

SEQ ID NO: 410407 - DNA, 25 bp, Mus musculus
gaaagttctgtactgaatgctcgat

SEQ ID NO: 410408 - DNA, 25 bp, Mus musculus
gaaagttctgtagtgaatgctcgat

SEQ ID NO: 410409 - DNA, 25 bp, Mus musculus
gaaagttctgttcggcagcgctgcc

SEQ ID NO: 410410 - DNA, 25 bp, Mus musculus
gaaagttctgttgggcagcgctgcc

SEQ ID NO: 410411 - DNA, 25 bp, Mus musculus
gaaagttcttaccttagaaatgctg

SEQ ID NO: 410412 - DNA, 25 bp, Mus musculus
gaaagttcttacgttagaaatgctg

SEQ ID NO: 410413 - DNA, 25 bp, Mus musculus
gaaagttgagtcactttgtctttag

SEQ ID NO: 410414 - DNA, 25 bp, Mus musculus
gaaagttgagtcagtcgtcagcctg

SEQ ID NO: 410415 - DNA, 25 bp, Mus musculus
gaaagttgagtctctttgtctttag

SEQ ID NO: 410416 - DNA, 25 bp, Mus musculus
gaaagttgagtctgtcgtcagcctg

SEQ ID NO: 410417 - DNA, 25 bp, Mus musculus
gaaagttgcactattatcccctaaa

SEQ ID NO: 410418 - DNA, 25 bp, Mus musculus
gaaagttgcacttttatcccctaaa

SEQ ID NO: 410419 - DNA, 25 bp, Mus musculus
gaaagttgcagccaagtccatgttt

SEQ ID NO: 410420 - DNA, 25 bp, Mus musculus
gaaagttgcagcgaagtccatgttt

SEQ ID NO: 410421 - DNA, 25 bp, Mus musculus
gaaagttgctaacttggagagctaa

SEQ ID NO: 410422 - DNA, 25 bp, Mus musculus
gaaagttgctaagttggagagctaa

SEQ ID NO: 410423 - DNA, 25 bp, Mus musculus
gaaagttgctgtcagtaccaagcct

SEQ ID NO: 410424 - DNA, 25 bp, Mus musculus
gaaagttgctgtgagtaccaagcct

SEQ ID NO: 410425 - DNA, 25 bp, Mus musculus
gaaagttgggtacatgaacccaaga

SEQ ID NO: 410426 - DNA, 25 bp, Mus musculus
gaaagttgggtagatgaacccaaga

SEQ ID NO: 410427 - DNA, 25 bp, Mus musculus
gaaagttgtataatgctggtagatc

SEQ ID NO: 410428 - DNA, 25 bp, Mus musculus
gaaagttgtatattgctggtagatc

SEQ ID NO: 410429 - DNA, 25 bp, Mus musculus
gaaagttgtcgacctaggtggcctc

SEQ ID NO: 410430 - DNA, 25 bp, Mus musculus
gaaagttgtcgagctaggtggcctc

SEQ ID NO: 410431 - DNA, 25 bp, Mus musculus
gaaagttgttgcctggagcacacag

SEQ ID NO: 410432 - DNA, 25 bp, Mus musculus
gaaagttgttgcgtggagcacacag

SEQ ID NO: 410433 - DNA, 25 bp, Mus musculus
gaaagtttaaatactgtctagcata

SEQ ID NO: 410434 - DNA, 25 bp, Mus musculus
gaaagtttaaattctgtctagcata

SEQ ID NO: 410435 - DNA, 25 bp, Mus musculus
gaaagtttacagctcgtggcgcgtc

SEQ ID NO: 410436 - DNA, 25 bp, Mus musculus
gaaagtttacaggtcgtggcgcgtc

SEQ ID NO: 410437 - DNA, 25 bp, Mus musculus
gaaagtttagccactagtctaccac

SEQ ID NO: 410438 - DNA, 25 bp, Mus musculus
gaaagtttagcctctagtctaccac

SEQ ID NO: 410439 - DNA, 25 bp, Mus musculus
gaaagtttagtgatctcagagttct

SEQ ID NO: 410440 - DNA, 25 bp, Mus musculus
gaaagtttagtgttctcagagttct

SEQ ID NO: 410441 - DNA, 25 bp, Mus musculus
gaaagtttcatacaagttctactgt

SEQ ID NO: 410442 - DNA, 25 bp, Mus musculus
gaaagtttcatagaagttctactgt

SEQ ID NO: 410443 - DNA, 25 bp, Mus musculus
gaaagtttcatgagttcgctccttt

SEQ ID NO: 410444 - DNA, 25 bp, Mus musculus
gaaagtttcatgtgttcgctccttt

SEQ ID NO: 410445 - DNA, 25 bp, Mus musculus
gaaagtttccagatctcctgagaca

SEQ ID NO: 410446 - DNA, 25 bp, Mus musculus
gaaagtttccagttctcctgagaca

SEQ ID NO: 410447 - DNA, 25 bp, Mus musculus
gaaagtttcctgattggagtttgtg

SEQ ID NO: 410448 - DNA, 25 bp, Mus musculus
gaaagtttcctgtttggagtttgtg

SEQ ID NO: 410449 - DNA, 25 bp, Mus musculus
gaaagtttccttatttagctgtatt

SEQ ID NO: 410450 - DNA, 25 bp, Mus musculus
gaaagtttccttttttagctgtatt

SEQ ID NO: 410451 - DNA, 25 bp, Mus musculus
gaaagtttcttcaaagcatgtgcta

SEQ ID NO: 410452 - DNA, 25 bp, Mus musculus
gaaagtttcttctaagcatgtgcta

SEQ ID NO: 410453 - DNA, 25 bp, Mus musculus
gaaagtttctttctagccgggtgtg

SEQ ID NO: 410454 - DNA, 25 bp, Mus musculus
gaaagtttctttgtagccgggtgtg

SEQ ID NO: 410455 - DNA, 25 bp, Mus musculus
gaaagtttgcaacgtcagagagctg

SEQ ID NO: 410456 - DNA, 25 bp, Mus musculus
gaaagtttgcaaggtcagagagctg

SEQ ID NO: 410457 - DNA, 25 bp, Mus musculus
gaaagtttgcatcctagttgtacta

SEQ ID NO: 410458 - DNA, 25 bp, Mus musculus
gaaagtttgcatgctagttgtacta

SEQ ID NO: 410459 - DNA, 25 bp, Mus musculus
gaaagtttgccaccatcgctcgtaa

SEQ ID NO: 410460 - DNA, 25 bp, Mus musculus
gaaagtttgccactataagcaccta

SEQ ID NO: 410461 - DNA, 25 bp, Mus musculus
gaaagtttgccagcatcgctcgtaa

SEQ ID NO: 410462 - DNA, 25 bp, Mus musculus
gaaagtttgccagtataagcaccta

SEQ ID NO: 410463 - DNA, 25 bp, Mus musculus
gaaagtttgcctctatttggcctct

SEQ ID NO: 410464 - DNA, 25 bp, Mus musculus
gaaagtttgcctgtatttggcctct

SEQ ID NO: 410465 - DNA, 25 bp, Mus musculus
gaaagtttggctctgtaagcccata

SEQ ID NO: 410466 - DNA, 25 bp, Mus musculus
gaaagtttggctgtgtaagcccata

SEQ ID NO: 410467 - DNA, 25 bp, Mus musculus
gaaagtttgttacctctctgcaatc

SEQ ID NO: 410468 - DNA, 25 bp, Mus musculus
gaaagtttgttagctctctgcaatc

SEQ ID NO: 410469 - DNA, 25 bp, Mus musculus
gaaagtttgtttagactgataccca

SEQ ID NO: 410470 - DNA, 25 bp, Mus musculus
gaaagtttgttttgactgataccca

SEQ ID NO: 410471 - DNA, 25 bp, Mus musculus
gaaagttttaccacggtcactgccg

SEQ ID NO: 410472 - DNA, 25 bp, Mus musculus
gaaagttttacctcggtcactgccg

SEQ ID NO: 410473 - DNA, 25 bp, Mus musculus
gaaagttttagaacctagaccatgg

SEQ ID NO: 410474 - DNA, 25 bp, Mus musculus
gaaagttttagatcctagaccatgg

SEQ ID NO: 410475 - DNA, 25 bp, Mus musculus
gaaagttttcacacaggttcaagac

SEQ ID NO: 410476 - DNA, 25 bp, Mus musculus
gaaagttttcactcaggttcaagac

SEQ ID NO: 410477 - DNA, 25 bp, Mus musculus
gaaagttttctcacaccgtgcactg

SEQ ID NO: 410478 - DNA, 25 bp, Mus musculus
gaaagttttctcaccttgactaagt

SEQ ID NO: 410479 - DNA, 25 bp, Mus musculus
gaaagttttctctcaccgtgcactg

SEQ ID NO: 410480 - DNA, 25 bp, Mus musculus
gaaagttttctctccttgactaagt

SEQ ID NO: 410481 - DNA, 25 bp, Mus musculus
gaaagttttctgaattctacagcaa

SEQ ID NO: 410482 - DNA, 25 bp, Mus musculus
gaaagttttctgtattctacagcaa

SEQ ID NO: 410483 - DNA, 25 bp, Mus musculus
gaaagttttgatccatgtccacata

SEQ ID NO: 410484 - DNA, 25 bp, Mus musculus
gaaagttttgatgcatgtccacata

SEQ ID NO: 410485 - DNA, 25 bp, Mus musculus
gaaagtttttgtcctgtactaatgc

SEQ ID NO: 410486 - DNA, 25 bp, Mus musculus
gaaagtttttgtgctgtactaatgc

SEQ ID NO: 410487 - DNA, 25 bp, Mus musculus
gaaataaaaccaacagcctcaaaac

SEQ ID NO: 410488 - DNA, 25 bp, Mus musculus
gaaataaaaccatcagcctcaaaac

SEQ ID NO: 410489 - DNA, 25 bp, Mus musculus
gaaataaaacccacaatgcccacca

SEQ ID NO: 410490 - DNA, 25 bp, Mus musculus
gaaataaaaccctcaatgcccacca

SEQ ID NO: 410491 - DNA, 25 bp, Mus musculus
gaaataaaagacagaggccggtgat

SEQ ID NO: 410492 - DNA, 25 bp, Mus musculus
gaaataaaagactgaggccggtgat

SEQ ID NO: 410493 - DNA, 25 bp, Mus musculus
gaaataaaagagactgggccctggg

SEQ ID NO: 410494 - DNA, 25 bp, Mus musculus
gaaataaaagagtctgggccctggg

SEQ ID NO: 410495 - DNA, 25 bp, Mus musculus
gaaataaaatatctgccctggatgc

SEQ ID NO: 410496 - DNA, 25 bp, Mus musculus
gaaataaaatatgtgccctggatgc

SEQ ID NO: 410497 - DNA, 25 bp, Mus musculus
gaaataaacctcagccggatcccaa

SEQ ID NO: 410498 - DNA, 25 bp, Mus musculus
gaaataaacctctgccggatcccaa

SEQ ID NO: 410499 - DNA, 25 bp, Mus musculus
gaaataaaccttaggtcctgcccag

SEQ ID NO: 410500 - DNA, 25 bp, Mus musculus
gaaataaaccttcggtacacagcaa

SEQ ID NO: 410501 - DNA, 25 bp, Mus musculus
gaaataaaccttgggtacacagcaa

SEQ ID NO: 410502 - DNA, 25 bp, Mus musculus
gaaataaacctttggtcctgcccag

SEQ ID NO: 410503 - DNA, 25 bp, Mus musculus
gaaataaacttgatctgtccttata

SEQ ID NO: 410504 - DNA, 25 bp, Mus musculus
gaaataaacttgttctgtccttata

SEQ ID NO: 410505 - DNA, 25 bp, Mus musculus
gaaataaagcatcccagaaacaacg

SEQ ID NO: 410506 - DNA, 25 bp, Mus musculus
gaaataaagcatgccagaaacaacg

SEQ ID NO: 410507 - DNA, 25 bp, Mus musculus
gaaataaagctccagggtaagtcct

SEQ ID NO: 410508 - DNA, 25 bp, Mus musculus
gaaataaagctcgagggtaagtcct

SEQ ID NO: 410509 - DNA, 25 bp, Mus musculus
gaaataaatcacacctctgcatcat

SEQ ID NO: 410510 - DNA, 25 bp, Mus musculus
gaaataaatcactcctctgcatcat

SEQ ID NO: 410511 - DNA, 25 bp, Mus musculus
gaaataaatccaacctactgtaaca

SEQ ID NO: 410512 - DNA, 25 bp, Mus musculus
gaaataaatccatcctactgtaaca

SEQ ID NO: 410513 - DNA, 25 bp, Mus musculus
gaaataaatctcatctgattcttgc

SEQ ID NO: 410514 - DNA, 25 bp, Mus musculus
gaaataaatctcttctgattcttgc

SEQ ID NO: 410515 - DNA, 25 bp, Mus musculus
gaaataaatctgaccgcaccatgct

SEQ ID NO: 410516 - DNA, 25 bp, Mus musculus
gaaataaatctgtccgcaccatgct

SEQ ID NO: 410517 - DNA, 25 bp, Mus musculus
gaaataaatttcagtgtgagcttaa

SEQ ID NO: 410518 - DNA, 25 bp, Mus musculus
gaaataaatttctgtgtgagcttaa

SEQ ID NO: 410519 - DNA, 25 bp, Mus musculus
gaaataacaattctacctcccatca

SEQ ID NO: 410520 - DNA, 25 bp, Mus musculus
gaaataacaattgtacctcccatca

SEQ ID NO: 410521 - DNA, 25 bp, Mus musculus
gaaataacaccacatgtccaaacta

SEQ ID NO: 410522 - DNA, 25 bp, Mus musculus
gaaataacaccagatgtccaaacta

SEQ ID NO: 410523 - DNA, 25 bp, Mus musculus
gaaataacacgtctttccattcagc

SEQ ID NO: 410524 - DNA, 25 bp, Mus musculus
gaaataacacgtgtttccattcagc

SEQ ID NO: 410525 - DNA, 25 bp, Mus musculus
gaaataacactactacctccaacgg

SEQ ID NO: 410526 - DNA, 25 bp, Mus musculus
gaaataacactagtacctccaacgg

SEQ ID NO: 410527 - DNA, 25 bp, Mus musculus
gaaataacagacattagttttaact

SEQ ID NO: 410528 - DNA, 25 bp, Mus musculus
gaaataacagactttagttttaact

SEQ ID NO: 410529 - DNA, 25 bp, Mus musculus
gaaataacattcaccctgtacgaaa

SEQ ID NO: 410530 - DNA, 25 bp, Mus musculus
gaaataacattctccctgtacgaaa

SEQ ID NO: 410531 - DNA, 25 bp, Mus musculus
gaaataacccgtactctggaagaca

SEQ ID NO: 410532 - DNA, 25 bp, Mus musculus
gaaataacccgttctctggaagaca

SEQ ID NO: 410533 - DNA, 25 bp, Mus musculus
gaaataacctgtctccctgagagtc

SEQ ID NO: 410534 - DNA, 25 bp, Mus musculus
gaaataacctgtgtccctgagagtc

SEQ ID NO: 410535 - DNA, 25 bp, Mus musculus
gaaataacgcatctacatgtgcata

SEQ ID NO: 410536 - DNA, 25 bp, Mus musculus
gaaataacgcatgtacatgtgcata

SEQ ID NO: 410537 - DNA, 25 bp, Mus musculus
gaaataacgcctcttccacttgtac

SEQ ID NO: 410538 - DNA, 25 bp, Mus musculus
gaaataacgcctgttccacttgtac

SEQ ID NO: 410539 - DNA, 25 bp, Mus musculus
gaaataacgtggcagatgttctgat

SEQ ID NO: 410540 - DNA, 25 bp, Mus musculus
gaaataacgtgggagatgttctgat

SEQ ID NO: 410541 - DNA, 25 bp, Mus musculus
gaaataactccacgtctttaagact

SEQ ID NO: 410542 - DNA, 25 bp, Mus musculus
gaaataactccaggtctttaagact

SEQ ID NO: 410543 - DNA, 25 bp, Mus musculus
gaaataactcccacaatgactttac

SEQ ID NO: 410544 - DNA, 25 bp, Mus musculus
gaaataactccctcaatgactttac

SEQ ID NO: 410545 - DNA, 25 bp, Mus musculus
gaaataactcttcaatcatgcttta

SEQ ID NO: 410546 - DNA, 25 bp, Mus musculus
gaaataactcttgaatcatgcttta

SEQ ID NO: 410547 - DNA, 25 bp, Mus musculus
gaaataactgagatgctctgctttt

SEQ ID NO: 410548 - DNA, 25 bp, Mus musculus
gaaataactgagttgctctgctttt

SEQ ID NO: 410549 - DNA, 25 bp, Mus musculus
gaaataagaataccagccaggtggt

SEQ ID NO: 410550 - DNA, 25 bp, Mus musculus
gaaataagaatagcagccaggtggt

SEQ ID NO: 410551 - DNA, 25 bp, Mus musculus
gaaataagacatctcctgggagtaa

SEQ ID NO: 410552 - DNA, 25 bp, Mus musculus
gaaataagacatgtcctgggagtaa

SEQ ID NO: 410553 - DNA, 25 bp, Mus musculus
gaaataagatatcgaggtgaatgtc

SEQ ID NO: 410554 - DNA, 25 bp, Mus musculus
gaaataagatatggaggtgaatgtc

SEQ ID NO: 410555 - DNA, 25 bp, Mus musculus
gaaataatacccaacagatgagcga

SEQ ID NO: 410556 - DNA, 25 bp, Mus musculus
gaaataataccctacagatgagcga

SEQ ID NO: 410557 - DNA, 25 bp, Mus musculus
gaaataatccccattaatgctagga

SEQ ID NO: 410558 - DNA, 25 bp, Mus musculus
gaaataatcccctttaatgctagga

SEQ ID NO: 410559 - DNA, 25 bp, Mus musculus
gaaataatgactcccagccctggac

SEQ ID NO: 410560 - DNA, 25 bp, Mus musculus
gaaataatgactgccagccctggac

SEQ ID NO: 410561 - DNA, 25 bp, Mus musculus
gaaataatgaggaagattgtccatt

SEQ ID NO: 410562 - DNA, 25 bp, Mus musculus
gaaataatgaggtagattgtccatt

SEQ ID NO: 410563 - DNA, 25 bp, Mus musculus
gaaataatgcagatctttgtataaa

SEQ ID NO: 410564 - DNA, 25 bp, Mus musculus
gaaataatgcagttctttgtataaa

SEQ ID NO: 410565 - DNA, 25 bp, Mus musculus
gaaataatgcttcactgtaatgtat

SEQ ID NO: 410566 - DNA, 25 bp, Mus musculus
gaaataatgcttgactgtaatgtat

SEQ ID NO: 410567 - DNA, 25 bp, Mus musculus
gaaataatgtagattgtcccactgt

SEQ ID NO: 410568 - DNA, 25 bp, Mus musculus
gaaataatgtagtttgtcccactgt

SEQ ID NO: 410569 - DNA, 25 bp, Mus musculus
gaaataatttataccagccccttcg

SEQ ID NO: 410570 - DNA, 25 bp, Mus musculus
gaaataatttattccagccccttcg

SEQ ID NO: 410571 - DNA, 25 bp, Mus musculus
gaaatacaacatactctcatttgga

SEQ ID NO: 410572 - DNA, 25 bp, Mus musculus
gaaatacaacattctctcatttgga

SEQ ID NO: 410573 - DNA, 25 bp, Mus musculus
gaaatacaaccactgctgattaaat

SEQ ID NO: 410574 - DNA, 25 bp, Mus musculus
gaaatacaaccagtgctgattaaat

SEQ ID NO: 410575 - DNA, 25 bp, Mus musculus
gaaatacaactacattagcttctct

SEQ ID NO: 410576 - DNA, 25 bp, Mus musculus
gaaatacaactagattagcttctct

SEQ ID NO: 410577 - DNA, 25 bp, Mus musculus
gaaatacaactcattacatagactg

SEQ ID NO: 410578 - DNA, 25 bp, Mus musculus
gaaatacaactctttacatagactg

SEQ ID NO: 410579 - DNA, 25 bp, Mus musculus
gaaatacaagccataaatccagtga

SEQ ID NO: 410580 - DNA, 25 bp, Mus musculus
gaaatacaagccttaaatccagtga

SEQ ID NO: 410581 - DNA, 25 bp, Mus musculus
gaaatacaaggcagctgatctgaga

SEQ ID NO: 410582 - DNA, 25 bp, Mus musculus
gaaatacaaggctgctgatctgaga

SEQ ID NO: 410583 - DNA, 25 bp, Mus musculus
gaaatacaagtactcccaccaaggg

SEQ ID NO: 410584 - DNA, 25 bp, Mus musculus
gaaatacaagtagtcccaccaaggg

SEQ ID NO: 410585 - DNA, 25 bp, Mus musculus
gaaatacacaatcaatgctcctgtt

SEQ ID NO: 410586 - DNA, 25 bp, Mus musculus
gaaatacacaatgaatgctcctgtt

SEQ ID NO: 410587 - DNA, 25 bp, Mus musculus
gaaatacacatactgagtcaaagct

SEQ ID NO: 410588 - DNA, 25 bp, Mus musculus
gaaatacacatagtgagtcaaagct

SEQ ID NO: 410589 - DNA, 25 bp, Mus musculus
gaaatacacattctttgcttatggt

SEQ ID NO: 410590 - DNA, 25 bp, Mus musculus
gaaatacacattgtttgcttatggt

SEQ ID NO: 410591 - DNA, 25 bp, Mus musculus
gaaatacacctaacctgtgctcaaa

SEQ ID NO: 410592 - DNA, 25 bp, Mus musculus
gaaatacacctatcctgtgctcaaa

SEQ ID NO: 410593 - DNA, 25 bp, Mus musculus
gaaatacacgcaaccttacgatgat

SEQ ID NO: 410594 - DNA, 25 bp, Mus musculus
gaaatacacgcatccttacgatgat

SEQ ID NO: 410595 - DNA, 25 bp, Mus musculus
gaaatacacggtcagtatctccaga

SEQ ID NO: 410596 - DNA, 25 bp, Mus musculus
gaaatacacggtgagtatctccaga

SEQ ID NO: 410597 - DNA, 25 bp, Mus musculus
gaaatacacttacatggcacattca

SEQ ID NO: 410598 - DNA, 25 bp, Mus musculus
gaaatacacttagatggcacattca

SEQ ID NO: 410599 - DNA, 25 bp, Mus musculus
gaaatacagaccacatccatccaga

SEQ ID NO: 410600 - DNA, 25 bp, Mus musculus
gaaatacagacctcatccatccaga

SEQ ID NO: 410601 - DNA, 25 bp, Mus musculus
gaaatacaggttatcttcaagatta

SEQ ID NO: 410602 - DNA, 25 bp, Mus musculus
gaaatacaggttttcttcaagatta

SEQ ID NO: 410603 - DNA, 25 bp, Mus musculus
gaaatacatatcagattgcacacat

SEQ ID NO: 410604 - DNA, 25 bp, Mus musculus
gaaatacatatctgattgcacacat

SEQ ID NO: 410605 - DNA, 25 bp, Mus musculus
gaaatacatattagggcttaggaga

SEQ ID NO: 410606 - DNA, 25 bp, Mus musculus
gaaatacatatttgggcttaggaga

SEQ ID NO: 410607 - DNA, 25 bp, Mus musculus
gaaatacatgccacaaaatagctaa

SEQ ID NO: 410608 - DNA, 25 bp, Mus musculus
gaaatacatgcctcaaaatagctaa

SEQ ID NO: 410609 - DNA, 25 bp, Mus musculus
gaaataccaactacgggctggtgag

SEQ ID NO: 410610 - DNA, 25 bp, Mus musculus
gaaataccaacttcgggctggtgag

SEQ ID NO: 410611 - DNA, 25 bp, Mus musculus
gaaataccacaaaatgaccctgctg

SEQ ID NO: 410612 - DNA, 25 bp, Mus musculus
gaaataccacaatatgaccctgctg

SEQ ID NO: 410613 - DNA, 25 bp, Mus musculus
gaaataccagatccaccaggcagtg

SEQ ID NO: 410614 - DNA, 25 bp, Mus musculus
gaaataccagatgcaccaggcagtg

SEQ ID NO: 410615 - DNA, 25 bp, Mus musculus
gaaataccagcaatactctcacagc

SEQ ID NO: 410616 - DNA, 25 bp, Mus musculus
gaaataccagcattactctcacagc

SEQ ID NO: 410617 - DNA, 25 bp, Mus musculus
gaaataccagctattaaccccgtat

SEQ ID NO: 410618 - DNA, 25 bp, Mus musculus
gaaataccagctattgctcagaaac

SEQ ID NO: 410619 - DNA, 25 bp, Mus musculus
gaaataccagcttttaaccccgtat

SEQ ID NO: 410620 - DNA, 25 bp, Mus musculus
gaaataccagcttttgctcagaaac

SEQ ID NO: 410621 - DNA, 25 bp, Mus musculus
gaaataccatgtattgcctttatag

SEQ ID NO: 410622 - DNA, 25 bp, Mus musculus
gaaataccatgttttgcctttatag

SEQ ID NO: 410623 - DNA, 25 bp, Mus musculus
gaaataccattcattattctcactg

SEQ ID NO: 410624 - DNA, 25 bp, Mus musculus
gaaataccattctttattctcactg

SEQ ID NO: 410625 - DNA, 25 bp, Mus musculus
gaaatacccagcaatctgtagtctt

SEQ ID NO: 410626 - DNA, 25 bp, Mus musculus
gaaatacccagctatctgtagtctt

SEQ ID NO: 410627 - DNA, 25 bp, Mus musculus
gaaatacccattacatctgtgacaa

SEQ ID NO: 410628 - DNA, 25 bp, Mus musculus
gaaatacccatttcatctgtgacaa

SEQ ID NO: 410629 - DNA, 25 bp, Mus musculus
gaaataccccacaacatagatgcca

SEQ ID NO: 410630 - DNA, 25 bp, Mus musculus
gaaataccccactacatagatgcca

SEQ ID NO: 410631 - DNA, 25 bp, Mus musculus
gaaatacccgtcatatacgcacaga

SEQ ID NO: 410632 - DNA, 25 bp, Mus musculus
gaaatacccgtcttatacgcacaga

SEQ ID NO: 410633 - DNA, 25 bp, Mus musculus
gaaataccctaactgtactccaaga

SEQ ID NO: 410634 - DNA, 25 bp, Mus musculus
gaaataccctaagtgtactccaaga

SEQ ID NO: 410635 - DNA, 25 bp, Mus musculus
gaaataccctatagtcttgcttatg

SEQ ID NO: 410636 - DNA, 25 bp, Mus musculus
gaaataccctattgtcttgcttatg

SEQ ID NO: 410637 - DNA, 25 bp, Mus musculus
gaaataccctgtatgccacatttag

SEQ ID NO: 410638 - DNA, 25 bp, Mus musculus
gaaataccctgtttgccacatttag

SEQ ID NO: 410639 - DNA, 25 bp, Mus musculus
gaaatacccttcctagaattctagc

SEQ ID NO: 410640 - DNA, 25 bp, Mus musculus
gaaatacccttcgtagaattctagc

SEQ ID NO: 410641 - DNA, 25 bp, Mus musculus
gaaataccgaatactggaccctgaa

SEQ ID NO: 410642 - DNA, 25 bp, Mus musculus
gaaataccgaattctggaccctgaa

SEQ ID NO: 410643 - DNA, 25 bp, Mus musculus
gaaataccgagcagcagtttcctct

SEQ ID NO: 410644 - DNA, 25 bp, Mus musculus
gaaataccgagctgcagtttcctct

SEQ ID NO: 410645 - DNA, 25 bp, Mus musculus
gaaataccgtcacccaagaactcag

SEQ ID NO: 410646 - DNA, 25 bp, Mus musculus
gaaataccgtcagccaagaactcag

SEQ ID NO: 410647 - DNA, 25 bp, Mus musculus
gaaataccgtctcagggccgaaagt

SEQ ID NO: 410648 - DNA, 25 bp, Mus musculus
gaaataccgtctgagggccgaaagt

SEQ ID NO: 410649 - DNA, 25 bp, Mus musculus
gaaatacctcgacatttgtgcacta

SEQ ID NO: 410650 - DNA, 25 bp, Mus musculus
gaaatacctcgagatttgtgcacta

SEQ ID NO: 410651 - DNA, 25 bp, Mus musculus
gaaatacctggtattgcttcccatc

SEQ ID NO: 410652 - DNA, 25 bp, Mus musculus
gaaatacctggttttgcttcccatc

SEQ ID NO: 410653 - DNA, 25 bp, Mus musculus
gaaataccttaacctgttaactgtt

SEQ ID NO: 410654 - DNA, 25 bp, Mus musculus
gaaataccttaagctgttaactgtt

SEQ ID NO: 410655 - DNA, 25 bp, Mus musculus
gaaatacctttcaggatcacaggga

SEQ ID NO: 410656 - DNA, 25 bp, Mus musculus
gaaatacctttctggatcacaggga

SEQ ID NO: 410657 - DNA, 25 bp, Mus musculus
gaaatacgacccaatctcagataca

SEQ ID NO: 410658 - DNA, 25 bp, Mus musculus
gaaatacgaccctatctcagataca

SEQ ID NO: 410659 - DNA, 25 bp, Mus musculus
gaaatacgagcacccatgacactat

SEQ ID NO: 410660 - DNA, 25 bp, Mus musculus
gaaatacgagcagccatgacactat

SEQ ID NO: 410661 - DNA, 25 bp, Mus musculus
gaaatacgaggcactcatttgggcc

SEQ ID NO: 410662 - DNA, 25 bp, Mus musculus
gaaatacgaggctctcatttgggcc

SEQ ID NO: 410663 - DNA, 25 bp, Mus musculus
gaaatacgccgaagtgatcattcct

SEQ ID NO: 410664 - DNA, 25 bp, Mus musculus
gaaatacgccgatgtgatcattcct

SEQ ID NO: 410665 - DNA, 25 bp, Mus musculus
gaaatacggagaatggaccactgcg

SEQ ID NO: 410666 - DNA, 25 bp, Mus musculus
gaaatacggagattggaccactgcg

SEQ ID NO: 410667 - DNA, 25 bp, Mus musculus
gaaatacggatccaagcctgccaaa

SEQ ID NO: 410668 - DNA, 25 bp, Mus musculus
gaaatacggatcgaagcctgccaaa

SEQ ID NO: 410669 - DNA, 25 bp, Mus musculus
gaaatactaagtcttgcattcagac

SEQ ID NO: 410670 - DNA, 25 bp, Mus musculus
gaaatactaagtgttgcattcagac

SEQ ID NO: 410671 - DNA, 25 bp, Mus musculus
gaaatactacccatggctcagactc

SEQ ID NO: 410672 - DNA, 25 bp, Mus musculus
gaaatactacccttggctcagactc

SEQ ID NO: 410673 - DNA, 25 bp, Mus musculus
gaaatactacttctctatgccagag

SEQ ID NO: 410674 - DNA, 25 bp, Mus musculus
gaaatactacttgtctatgccagag

SEQ ID NO: 410675 - DNA, 25 bp, Mus musculus
gaaatactagcactcctttcaaggg

SEQ ID NO: 410676 - DNA, 25 bp, Mus musculus
gaaatactagcagtcctttcaaggg

SEQ ID NO: 410677 - DNA, 25 bp, Mus musculus
gaaatactagtcctatgactgggaa

SEQ ID NO: 410678 - DNA, 25 bp, Mus musculus
gaaatactagtcgtatgactgggaa

SEQ ID NO: 410679 - DNA, 25 bp, Mus musculus
gaaatactataccttgccagagtga

SEQ ID NO: 410680 - DNA, 25 bp, Mus musculus
gaaatactatacgttgccagagtga

SEQ ID NO: 410681 - DNA, 25 bp, Mus musculus
gaaatactcattaagctccctgaag

SEQ ID NO: 410682 - DNA, 25 bp, Mus musculus
gaaatactcatttagctccctgaag

SEQ ID NO: 410683 - DNA, 25 bp, Mus musculus
gaaatactccacaggccaagtccag

SEQ ID NO: 410684 - DNA, 25 bp, Mus musculus
gaaatactccactggccaagtccag

SEQ ID NO: 410685 - DNA, 25 bp, Mus musculus
gaaatactccttagctgtctttata

SEQ ID NO: 410686 - DNA, 25 bp, Mus musculus
gaaatactcctttgctgtctttata

SEQ ID NO: 410687 - DNA, 25 bp, Mus musculus
gaaatactcggtatactgcacctgc

SEQ ID NO: 410688 - DNA, 25 bp, Mus musculus
gaaatactcggtttactgcacctgc

SEQ ID NO: 410689 - DNA, 25 bp, Mus musculus
gaaatactcgtaataatacccaaga

SEQ ID NO: 410690 - DNA, 25 bp, Mus musculus
gaaatactcgtattaatacccaaga

SEQ ID NO: 410691 - DNA, 25 bp, Mus musculus
gaaatactctctcttgggcctgtaa

SEQ ID NO: 410692 - DNA, 25 bp, Mus musculus
gaaatactctctgttgggcctgtaa

SEQ ID NO: 410693 - DNA, 25 bp, Mus musculus
gaaatactcttgataaattatctga

SEQ ID NO: 410694 - DNA, 25 bp, Mus musculus
gaaatactcttgttaaattatctga

SEQ ID NO: 410695 - DNA, 25 bp, Mus musculus
gaaatactgaacctgcagttccact

SEQ ID NO: 410696 - DNA, 25 bp, Mus musculus
gaaatactgaacgtgcagttccact

SEQ ID NO: 410697 - DNA, 25 bp, Mus musculus
gaaatactggagacactggttggtg

SEQ ID NO: 410698 - DNA, 25 bp, Mus musculus
gaaatactggagtcactggttggtg

SEQ ID NO: 410699 - DNA, 25 bp, Mus musculus
gaaatactgtaactgatcgcagtac

SEQ ID NO: 410700 - DNA, 25 bp, Mus musculus
gaaatactgtaagtgatcgcagtac

SEQ ID NO: 410701 - DNA, 25 bp, Mus musculus
gaaatactgtatccatgccttttgt

SEQ ID NO: 410702 - DNA, 25 bp, Mus musculus
gaaatactgtatgcatgccttttgt

SEQ ID NO: 410703 - DNA, 25 bp, Mus musculus
gaaatactgttcctccactgataaa

SEQ ID NO: 410704 - DNA, 25 bp, Mus musculus
gaaatactgttcgtccactgataaa

SEQ ID NO: 410705 - DNA, 25 bp, Mus musculus
gaaatactgtttccagctaggtgtg

SEQ ID NO: 410706 - DNA, 25 bp, Mus musculus
gaaatactgtttgcagctaggtgtg

SEQ ID NO: 410707 - DNA, 25 bp, Mus musculus
gaaatacttaccaggactcttggaa

SEQ ID NO: 410708 - DNA, 25 bp, Mus musculus
gaaatacttacctggactcttggaa

SEQ ID NO: 410709 - DNA, 25 bp, Mus musculus
gaaatacttactcgaggtcaatctc

SEQ ID NO: 410710 - DNA, 25 bp, Mus musculus
gaaatacttactggaggtcaatctc

SEQ ID NO: 410711 - DNA, 25 bp, Mus musculus
gaaatacttatacgcagatgaaaat

SEQ ID NO: 410712 - DNA, 25 bp, Mus musculus
gaaatacttataggcagatgaaaat

SEQ ID NO: 410713 - DNA, 25 bp, Mus musculus
gaaatacttcttacaatgtaagcta

SEQ ID NO: 410714 - DNA, 25 bp, Mus musculus
gaaatacttctttcaatgtaagcta

SEQ ID NO: 410715 - DNA, 25 bp, Mus musculus
gaaatacttgcccacaggaactttt

SEQ ID NO: 410716 - DNA, 25 bp, Mus musculus
gaaatacttgccgacaggaactttt

SEQ ID NO: 410717 - DNA, 25 bp, Mus musculus
gaaatactttctctccagcagttat

SEQ ID NO: 410718 - DNA, 25 bp, Mus musculus
gaaatactttctgtccagcagttat

SEQ ID NO: 410719 - DNA, 25 bp, Mus musculus
gaaatacttttaaagctgctccagg

SEQ ID NO: 410720 - DNA, 25 bp, Mus musculus
gaaatacttttatagctgctccagg

SEQ ID NO: 410721 - DNA, 25 bp, Mus musculus
gaaatagaagctcggtctgaggcca

SEQ ID NO: 410722 - DNA, 25 bp, Mus musculus
gaaatagaagctgggtctgaggcca

SEQ ID NO: 410723 - DNA, 25 bp, Mus musculus
gaaatagaattgaatggccaccctg

SEQ ID NO: 410724 - DNA, 25 bp, Mus musculus
gaaatagaattgtatggccaccctg

SEQ ID NO: 410725 - DNA, 25 bp, Mus musculus
gaaatagacacgcttttacattttt

SEQ ID NO: 410726 - DNA, 25 bp, Mus musculus
gaaatagacacggttttacattttt

SEQ ID NO: 410727 - DNA, 25 bp, Mus musculus
gaaatagaccctccagttacctaga

SEQ ID NO: 410728 - DNA, 25 bp, Mus musculus
gaaatagaccctgcagttacctaga

SEQ ID NO: 410729 - DNA, 25 bp, Mus musculus
gaaatagagctcacccttttttgtg

SEQ ID NO: 410730 - DNA, 25 bp, Mus musculus
gaaatagagctctcccttttttgtg

SEQ ID NO: 410731 - DNA, 25 bp, Mus musculus
gaaatagaggctatccccagagtgt

SEQ ID NO: 410732 - DNA, 25 bp, Mus musculus
gaaatagaggctttccccagagtgt

SEQ ID NO: 410733 - DNA, 25 bp, Mus musculus
gaaatagatgctcggagctccccgg

SEQ ID NO: 410734 - DNA, 25 bp, Mus musculus
gaaatagatgctgggagctccccgg

SEQ ID NO: 410735 - DNA, 25 bp, Mus musculus
gaaatagatgtaattccttttttgg

SEQ ID NO: 410736 - DNA, 25 bp, Mus musculus
gaaatagatgtatttccttttttgg

SEQ ID NO: 410737 - DNA, 25 bp, Mus musculus
gaaatagattccctaaatgtatctc

SEQ ID NO: 410738 - DNA, 25 bp, Mus musculus
gaaatagattccgtaaatgtatctc

SEQ ID NO: 410739 - DNA, 25 bp, Mus musculus
gaaatagcacacaggatgactccct

SEQ ID NO: 410740 - DNA, 25 bp, Mus musculus
gaaatagcacactggatgactccct

SEQ ID NO: 410741 - DNA, 25 bp, Mus musculus
gaaatagcaccacgcgggtcctaag

SEQ ID NO: 410742 - DNA, 25 bp, Mus musculus
gaaatagcaccaggcgggtcctaag

SEQ ID NO: 410743 - DNA, 25 bp, Mus musculus
gaaatagcatccctctatactttag

SEQ ID NO: 410744 - DNA, 25 bp, Mus musculus
gaaatagcatccgtctatactttag

SEQ ID NO: 410745 - DNA, 25 bp, Mus musculus
gaaatagcattaccacagaaaccat

SEQ ID NO: 410746 - DNA, 25 bp, Mus musculus
gaaatagcattagcacagaaaccat

SEQ ID NO: 410747 - DNA, 25 bp, Mus musculus
gaaatagccataaacaccatcctta

SEQ ID NO: 410748 - DNA, 25 bp, Mus musculus
gaaatagccataacaagattagcaa

SEQ ID NO: 410749 - DNA, 25 bp, Mus musculus
gaaatagccatatacaccatcctta

SEQ ID NO: 410750 - DNA, 25 bp, Mus musculus
gaaatagccatatcaagattagcaa

SEQ ID NO: 410751 - DNA, 25 bp, Mus musculus
gaaatagccatgagtgcctccagtt

SEQ ID NO: 410752 - DNA, 25 bp, Mus musculus
gaaatagccatgtgtgcctccagtt

SEQ ID NO: 410753 - DNA, 25 bp, Mus musculus
gaaatagcctatatgttcatcacta

SEQ ID NO: 410754 - DNA, 25 bp, Mus musculus
gaaatagcctatttgttcatcacta

SEQ ID NO: 410755 - DNA, 25 bp, Mus musculus
gaaatagctgacactaccctcaaag

SEQ ID NO: 410756 - DNA, 25 bp, Mus musculus
gaaatagctgactctaccctcaaag

SEQ ID NO: 410757 - DNA, 25 bp, Mus musculus
gaaatagctgatcaagtagaccaag

SEQ ID NO: 410758 - DNA, 25 bp, Mus musculus
gaaatagctgatgaagtagaccaag

SEQ ID NO: 410759 - DNA, 25 bp, Mus musculus
gaaatagctgctcctctaagtccct

SEQ ID NO: 410760 - DNA, 25 bp, Mus musculus
gaaatagctgctgctctaagtccct

SEQ ID NO: 410761 - DNA, 25 bp, Mus musculus
gaaatagctgtgactttaggaaaat

SEQ ID NO: 410762 - DNA, 25 bp, Mus musculus
gaaatagctgtgtctttaggaaaat

SEQ ID NO: 410763 - DNA, 25 bp, Mus musculus
gaaatagctttgatgtggattgcat

SEQ ID NO: 410764 - DNA, 25 bp, Mus musculus
gaaatagctttgttgtggattgcat

SEQ ID NO: 410765 - DNA, 25 bp, Mus musculus
gaaataggaaaacttcttgctaaag

SEQ ID NO: 410766 - DNA, 25 bp, Mus musculus
gaaataggaaaagttcttgctaaag

SEQ ID NO: 410767 - DNA, 25 bp, Mus musculus
gaaataggatgcacagggcctgaat

SEQ ID NO: 410768 - DNA, 25 bp, Mus musculus
gaaataggatgctcagggcctgaat

SEQ ID NO: 410769 - DNA, 25 bp, Mus musculus
gaaataggctgcagcttctggaatc

SEQ ID NO: 410770 - DNA, 25 bp, Mus musculus
gaaataggctgctgcttctggaatc

SEQ ID NO: 410771 - DNA, 25 bp, Mus musculus
gaaatagggttgagccactgagcaa

SEQ ID NO: 410772 - DNA, 25 bp, Mus musculus
gaaatagggttgtgccactgagcaa

SEQ ID NO: 410773 - DNA, 25 bp, Mus musculus
gaaatagtaactaggagctccaatt

SEQ ID NO: 410774 - DNA, 25 bp, Mus musculus
gaaatagtaacttggagctccaatt

SEQ ID NO: 410775 - DNA, 25 bp, Mus musculus
gaaatagtacttatgaaccgtgata

SEQ ID NO: 410776 - DNA, 25 bp, Mus musculus
gaaatagtacttttgaaccgtgata

SEQ ID NO: 410777 - DNA, 25 bp, Mus musculus
gaaatagtccagcagttcctaataa

SEQ ID NO: 410778 - DNA, 25 bp, Mus musculus
gaaatagtccaggagttcctaataa

SEQ ID NO: 410779 - DNA, 25 bp, Mus musculus
gaaatagtctaacctcattgtccat

SEQ ID NO: 410780 - DNA, 25 bp, Mus musculus
gaaatagtctaagctcattgtccat

SEQ ID NO: 410781 - DNA, 25 bp, Mus musculus
gaaatagtctcgatcctgaaagggt

SEQ ID NO: 410782 - DNA, 25 bp, Mus musculus
gaaatagtctcgttcctgaaagggt

SEQ ID NO: 410783 - DNA, 25 bp, Mus musculus
gaaatagtcttaatttccatattta

SEQ ID NO: 410784 - DNA, 25 bp, Mus musculus
gaaatagtcttattttccatattta

SEQ ID NO: 410785 - DNA, 25 bp, Mus musculus
gaaatagtgcaacctgatccaccca

SEQ ID NO: 410786 - DNA, 25 bp, Mus musculus
gaaatagtgcaagctgatccaccca

SEQ ID NO: 410787 - DNA, 25 bp, Mus musculus
gaaatagtgcagctgacatatgggt

SEQ ID NO: 410788 - DNA, 25 bp, Mus musculus
gaaatagtgcaggtgacatatgggt

SEQ ID NO: 410789 - DNA, 25 bp, Mus musculus
gaaatagtgctgatcctgggacaag

SEQ ID NO: 410790 - DNA, 25 bp, Mus musculus
gaaatagtgctgttcctgggacaag

SEQ ID NO: 410791 - DNA, 25 bp, Mus musculus
gaaatagtgtttctgttctggaaga

SEQ ID NO: 410792 - DNA, 25 bp, Mus musculus
gaaatagtgtttgtgttctggaaga

SEQ ID NO: 410793 - DNA, 25 bp, Mus musculus
gaaatagttagaattctgctcagag

SEQ ID NO: 410794 - DNA, 25 bp, Mus musculus
gaaatagttagatttctgctcagag

SEQ ID NO: 410795 - DNA, 25 bp, Mus musculus
gaaatagttccccatctgccaacca

SEQ ID NO: 410796 - DNA, 25 bp, Mus musculus
gaaatagttcccgatctgccaacca

SEQ ID NO: 410797 - DNA, 25 bp, Mus musculus
gaaatagttcggattctcacttgca

SEQ ID NO: 410798 - DNA, 25 bp, Mus musculus
gaaatagttcggtttctcacttgca

SEQ ID NO: 410799 - DNA, 25 bp, Mus musculus
gaaatagttggcatctggttaaaga

SEQ ID NO: 410800 - DNA, 25 bp, Mus musculus
gaaatagttggcttctggttaaaga

SEQ ID NO: 410801 - DNA, 25 bp, Mus musculus
gaaatagtttccactcaaatgttag

SEQ ID NO: 410802 - DNA, 25 bp, Mus musculus
gaaatagtttcctctcaaatgttag

SEQ ID NO: 410803 - DNA, 25 bp, Mus musculus
gaaatataacttaccccagatggcc

SEQ ID NO: 410804 - DNA, 25 bp, Mus musculus
gaaatataactttccccagatggcc

SEQ ID NO: 410805 - DNA, 25 bp, Mus musculus
gaaatataatcacactggcagatgc

SEQ ID NO: 410806 - DNA, 25 bp, Mus musculus
gaaatataatcagactggcagatgc

SEQ ID NO: 410807 - DNA, 25 bp, Mus musculus
gaaatataatctcagcccggcagtg

SEQ ID NO: 410808 - DNA, 25 bp, Mus musculus
gaaatataatctcgtggccggccgg

SEQ ID NO: 410809 - DNA, 25 bp, Mus musculus
gaaatataatctgagcccggcagtg

SEQ ID NO: 410810 - DNA, 25 bp, Mus musculus
gaaatataatctggtggccggccgg

SEQ ID NO: 410811 - DNA, 25 bp, Mus musculus
gaaatataccttcagcctttagtgc

SEQ ID NO: 410812 - DNA, 25 bp, Mus musculus
gaaatataccttgagcctttagtgc

SEQ ID NO: 410813 - DNA, 25 bp, Mus musculus
gaaatatactccatcactcggcttt

SEQ ID NO: 410814 - DNA, 25 bp, Mus musculus
gaaatatactccttcactcggcttt

SEQ ID NO: 410815 - DNA, 25 bp, Mus musculus
gaaatatacttcagcttttagggct

SEQ ID NO: 410816 - DNA, 25 bp, Mus musculus
gaaatatacttctgcttttagggct

SEQ ID NO: 410817 - DNA, 25 bp, Mus musculus
gaaatatagctgatctttatgcata

SEQ ID NO: 410818 - DNA, 25 bp, Mus musculus
gaaatatagctgttctttatgcata

SEQ ID NO: 410819 - DNA, 25 bp, Mus musculus
gaaatatatttcaaagtgcagcaaa

SEQ ID NO: 410820 - DNA, 25 bp, Mus musculus
gaaatatatttcctgcctctagtga

SEQ ID NO: 410821 - DNA, 25 bp, Mus musculus
gaaatatatttcgtgcctctagtga

SEQ ID NO: 410822 - DNA, 25 bp, Mus musculus
gaaatatatttctaagtgcagcaaa

SEQ ID NO: 410823 - DNA, 25 bp, Mus musculus
gaaatatcacacattcaggtggtaa

SEQ ID NO: 410824 - DNA, 25 bp, Mus musculus
gaaatatcacactttcaggtggtaa

SEQ ID NO: 410825 - DNA, 25 bp, Mus musculus
gaaatatcacagcaggtgggcttaa

SEQ ID NO: 410826 - DNA, 25 bp, Mus musculus
gaaatatcacaggaggtgggcttaa

SEQ ID NO: 410827 - DNA, 25 bp, Mus musculus
gaaatatcactgcattctaaaatta

SEQ ID NO: 410828 - DNA, 25 bp, Mus musculus
gaaatatcactggattctaaaatta

SEQ ID NO: 410829 - DNA, 25 bp, Mus musculus
gaaatatcatccctgaagactgtct

SEQ ID NO: 410830 - DNA, 25 bp, Mus musculus
gaaatatcatccgtgaagactgtct

SEQ ID NO: 410831 - DNA, 25 bp, Mus musculus
gaaatatcatcgacctctccatgga

SEQ ID NO: 410832 - DNA, 25 bp, Mus musculus
gaaatatcatcgtcctctccatgga

SEQ ID NO: 410833 - DNA, 25 bp, Mus musculus
gaaatatccagaccacgctatccga

SEQ ID NO: 410834 - DNA, 25 bp, Mus musculus
gaaatatccagagcacgctatccga

SEQ ID NO: 410835 - DNA, 25 bp, Mus musculus
gaaatatccattatggattgtgtta

SEQ ID NO: 410836 - DNA, 25 bp, Mus musculus
gaaatatccattttggattgtgtta

SEQ ID NO: 410837 - DNA, 25 bp, Mus musculus
gaaatatccttgactagaaacactg

SEQ ID NO: 410838 - DNA, 25 bp, Mus musculus
gaaatatccttgtctagaaacactg

SEQ ID NO: 410839 - DNA, 25 bp, Mus musculus
gaaatatctccactgtttcactatt

SEQ ID NO: 410840 - DNA, 25 bp, Mus musculus
gaaatatctccagtgtttcactatt

SEQ ID NO: 410841 - DNA, 25 bp, Mus musculus
gaaatatctccccagtacccattat

SEQ ID NO: 410842 - DNA, 25 bp, Mus musculus
gaaatatctcccgagtacccattat

SEQ ID NO: 410843 - DNA, 25 bp, Mus musculus
gaaatatctgatcaccattggctaa

SEQ ID NO: 410844 - DNA, 25 bp, Mus musculus
gaaatatctgatgaccattggctaa

SEQ ID NO: 410845 - DNA, 25 bp, Mus musculus
gaaatatctgcaaatcacatttagg

SEQ ID NO: 410846 - DNA, 25 bp, Mus musculus
gaaatatctgcatatcacatttagg

SEQ ID NO: 410847 - DNA, 25 bp, Mus musculus
gaaatatcttctcctctcacaaagg

SEQ ID NO: 410848 - DNA, 25 bp, Mus musculus
gaaatatcttctgctctcacaaagg

SEQ ID NO: 410849 - DNA, 25 bp, Mus musculus
gaaatatcttgcctgcagcgtgaga

SEQ ID NO: 410850 - DNA, 25 bp, Mus musculus
gaaatatcttgcgtgcagcgtgaga

SEQ ID NO: 410851 - DNA, 25 bp, Mus musculus
gaaatatgaaccagagctgggcgtg

SEQ ID NO: 410852 - DNA, 25 bp, Mus musculus
gaaatatgaacctgagctgggcgtg

SEQ ID NO: 410853 - DNA, 25 bp, Mus musculus
gaaatatgcaccaggtagcagatga

SEQ ID NO: 410854 - DNA, 25 bp, Mus musculus
gaaatatgcacctggtagcagatga

SEQ ID NO: 410855 - DNA, 25 bp, Mus musculus
gaaatatgccatattggtactatat

SEQ ID NO: 410856 - DNA, 25 bp, Mus musculus
gaaatatgccattttggtactatat

SEQ ID NO: 410857 - DNA, 25 bp, Mus musculus
gaaatatgctcactgctacttcata

SEQ ID NO: 410858 - DNA, 25 bp, Mus musculus
gaaatatgctcagtgctacttcata

SEQ ID NO: 410859 - DNA, 25 bp, Mus musculus
gaaatatggagacatactactagta

SEQ ID NO: 410860 - DNA, 25 bp, Mus musculus
gaaatatggagagatactactagta

SEQ ID NO: 410861 - DNA, 25 bp, Mus musculus
gaaatatggatacttgtggccacct

SEQ ID NO: 410862 - DNA, 25 bp, Mus musculus
gaaatatggatagttgtggccacct

SEQ ID NO: 410863 - DNA, 25 bp, Mus musculus
gaaatatggttcattccatgtaaaa

SEQ ID NO: 410864 - DNA, 25 bp, Mus musculus
gaaatatggttctttccatgtaaaa

SEQ ID NO: 410865 - DNA, 25 bp, Mus musculus
gaaatatgtcccaaatcagtgcagt

SEQ ID NO: 410866 - DNA, 25 bp, Mus musculus
gaaatatgtccctaatcagtgcagt

SEQ ID NO: 410867 - DNA, 25 bp, Mus musculus
gaaatatgtctacaggccatacctg

SEQ ID NO: 410868 - DNA, 25 bp, Mus musculus
gaaatatgtctagaggccatacctg

SEQ ID NO: 410869 - DNA, 25 bp, Mus musculus
gaaatatgtgatactctgttttgaa

SEQ ID NO: 410870 - DNA, 25 bp, Mus musculus
gaaatatgtgattctctgttttgaa

SEQ ID NO: 410871 - DNA, 25 bp, Mus musculus
gaaatatgtgccacagcttagatgt

SEQ ID NO: 410872 - DNA, 25 bp, Mus musculus
gaaatatgtgcctcagcttagatgt

SEQ ID NO: 410873 - DNA, 25 bp, Mus musculus
gaaatatgttccagatcatacagaa

SEQ ID NO: 410874 - DNA, 25 bp, Mus musculus
gaaatatgttcctgatcatacagaa

SEQ ID NO: 410875 - DNA, 25 bp, Mus musculus
gaaatattacaaactaccacctcaa

SEQ ID NO: 410876 - DNA, 25 bp, Mus musculus
gaaatattacaatctaccacctcaa

SEQ ID NO: 410877 - DNA, 25 bp, Mus musculus
gaaatattacctatattccctgagt

SEQ ID NO: 410878 - DNA, 25 bp, Mus musculus
gaaatattacctccttcccatttag

SEQ ID NO: 410879 - DNA, 25 bp, Mus musculus
gaaatattacctgcttcccatttag

SEQ ID NO: 410880 - DNA, 25 bp, Mus musculus
gaaatattacctttattccctgagt

SEQ ID NO: 410881 - DNA, 25 bp, Mus musculus
gaaatattactcatccatattcctt

SEQ ID NO: 410882 - DNA, 25 bp, Mus musculus
gaaatattactcttccatattcctt

SEQ ID NO: 410883 - DNA, 25 bp, Mus musculus
gaaatattagaactggctgttcatt

SEQ ID NO: 410884 - DNA, 25 bp, Mus musculus
gaaatattagaagtggctgttcatt

SEQ ID NO: 410885 - DNA, 25 bp, Mus musculus
gaaatattaggtacaggtgcataag

SEQ ID NO: 410886 - DNA, 25 bp, Mus musculus
gaaatattaggttcaggtgcataag

SEQ ID NO: 410887 - DNA, 25 bp, Mus musculus
gaaatattcatcattactatacggt

SEQ ID NO: 410888 - DNA, 25 bp, Mus musculus
gaaatattcatctttactatacggt

SEQ ID NO: 410889 - DNA, 25 bp, Mus musculus
gaaatattccatagactgtgtgctg

SEQ ID NO: 410890 - DNA, 25 bp, Mus musculus
gaaatattccattgactgtgtgctg

SEQ ID NO: 410891 - DNA, 25 bp, Mus musculus
gaaatattcccaatcttagccctgt

SEQ ID NO: 410892 - DNA, 25 bp, Mus musculus
gaaatattcccattcttagccctgt

SEQ ID NO: 410893 - DNA, 25 bp, Mus musculus
gaaatattcctcaaaggaccccagc

SEQ ID NO: 410894 - DNA, 25 bp, Mus musculus
gaaatattcctctaaggaccccagc

SEQ ID NO: 410895 - DNA, 25 bp, Mus musculus
gaaatattcgctaggcttttgccag

SEQ ID NO: 410896 - DNA, 25 bp, Mus musculus
gaaatattcgcttggcttttgccag

SEQ ID NO: 410897 - DNA, 25 bp, Mus musculus
gaaatattcggcagccacgaaacaa

SEQ ID NO: 410898 - DNA, 25 bp, Mus musculus
gaaatattcggctgccacgaaacaa

SEQ ID NO: 410899 - DNA, 25 bp, Mus musculus
gaaatattgcatcacagcttcccga

SEQ ID NO: 410900 - DNA, 25 bp, Mus musculus
gaaatattgcatgacagcttcccga

SEQ ID NO: 410901 - DNA, 25 bp, Mus musculus
gaaatattgccaatcctgtcgccat

SEQ ID NO: 410902 - DNA, 25 bp, Mus musculus
gaaatattgccattcctgtcgccat

SEQ ID NO: 410903 - DNA, 25 bp, Mus musculus
gaaatattggttccctacacgactt

SEQ ID NO: 410904 - DNA, 25 bp, Mus musculus
gaaatattggttgcctacacgactt

SEQ ID NO: 410905 - DNA, 25 bp, Mus musculus
gaaatatttactcttcaaggtctgt

SEQ ID NO: 410906 - DNA, 25 bp, Mus musculus
gaaatatttactgttcaaggtctgt

SEQ ID NO: 410907 - DNA, 25 bp, Mus musculus
gaaatatttcctcaatagcgtgtgt

SEQ ID NO: 410908 - DNA, 25 bp, Mus musculus
gaaatatttcctgaatagcgtgtgt

SEQ ID NO: 410909 - DNA, 25 bp, Mus musculus
gaaatatttctgcacttctcacagt

SEQ ID NO: 410910 - DNA, 25 bp, Mus musculus
gaaatatttctggacttctcacagt

SEQ ID NO: 410911 - DNA, 25 bp, Mus musculus
gaaatatttcttacctagtctaagg

SEQ ID NO: 410912 - DNA, 25 bp, Mus musculus
gaaatatttcttctcaggtcctaag

SEQ ID NO: 410913 - DNA, 25 bp, Mus musculus
gaaatatttcttcttcttcattaat

SEQ ID NO: 410914 - DNA, 25 bp, Mus musculus
gaaatatttcttgtcaggtcctaag

SEQ ID NO: 410915 - DNA, 25 bp, Mus musculus
gaaatatttcttgttcttcattaat

SEQ ID NO: 410916 - DNA, 25 bp, Mus musculus
gaaatatttctttcctagtctaagg

SEQ ID NO: 410917 - DNA, 25 bp, Mus musculus
gaaatatttgccattttcagggaca

SEQ ID NO: 410918 - DNA, 25 bp, Mus musculus
gaaatatttgcctttttcagggaca

SEQ ID NO: 410919 - DNA, 25 bp, Mus musculus
gaaatattttggaatcttttgtaca

SEQ ID NO: 410920 - DNA, 25 bp, Mus musculus
gaaatattttggtatcttttgtaca

SEQ ID NO: 410921 - DNA, 25 bp, Mus musculus
gaaatattttgtccttagatgctaa

SEQ ID NO: 410922 - DNA, 25 bp, Mus musculus
gaaatattttgtgcttagatgctaa

SEQ ID NO: 410923 - DNA, 25 bp, Mus musculus
gaaatatttttcaccgctacagttt

SEQ ID NO: 410924 - DNA, 25 bp, Mus musculus
gaaatatttttctccgctacagttt

SEQ ID NO: 410925 - DNA, 25 bp, Mus musculus
gaaatatttttgagccttttacata

SEQ ID NO: 410926 - DNA, 25 bp, Mus musculus
gaaatatttttgatggacctcaatc

SEQ ID NO: 410927 - DNA, 25 bp, Mus musculus
gaaatatttttgtgccttttacata

SEQ ID NO: 410928 - DNA, 25 bp, Mus musculus
gaaatatttttgttggacctcaatc

SEQ ID NO: 410929 - DNA, 25 bp, Mus musculus
gaaatattttttccaaagcatccat

SEQ ID NO: 410930 - DNA, 25 bp, Mus musculus
gaaatattttttgcaaagcatccat

SEQ ID NO: 410931 - DNA, 25 bp, Mus musculus
gaaatcaaaacccaaatgtgaggca

SEQ ID NO: 410932 - DNA, 25 bp, Mus musculus
gaaatcaaaaccgaaatgtgaggca

SEQ ID NO: 410933 - DNA, 25 bp, Mus musculus
gaaatcaaacttcggacctctgcaa

SEQ ID NO: 410934 - DNA, 25 bp, Mus musculus
gaaatcaaacttgggacctctgcaa

SEQ ID NO: 410935 - DNA, 25 bp, Mus musculus
gaaatcaaagccaacgtcgccaaag

SEQ ID NO: 410936 - DNA, 25 bp, Mus musculus
gaaatcaaagcctacgtcgccaaag

SEQ ID NO: 410937 - DNA, 25 bp, Mus musculus
gaaatcaaagtaacctcgccgtgca

SEQ ID NO: 410938 - DNA, 25 bp, Mus musculus
gaaatcaaagtatcctcgccgtgca

SEQ ID NO: 410939 - DNA, 25 bp, Mus musculus
gaaatcaaatccaagtcagcagaca

SEQ ID NO: 410940 - DNA, 25 bp, Mus musculus
gaaatcaaatcctagtcagcagaca

SEQ ID NO: 410941 - DNA, 25 bp, Mus musculus
gaaatcaacagcagacgtcacgaca

SEQ ID NO: 410942 - DNA, 25 bp, Mus musculus
gaaatcaacagctgacgtcacgaca

SEQ ID NO: 410943 - DNA, 25 bp, Mus musculus
gaaatcaacattccctgaatgtctg

SEQ ID NO: 410944 - DNA, 25 bp, Mus musculus
gaaatcaacattgcctgaatgtctg

SEQ ID NO: 410945 - DNA, 25 bp, Mus musculus
gaaatcaacgttctgcgaaaccgga

SEQ ID NO: 410946 - DNA, 25 bp, Mus musculus
gaaatcaacgttgtgcgaaaccgga

SEQ ID NO: 410947 - DNA, 25 bp, Mus musculus
gaaatcaactatagcctcatttgga

SEQ ID NO: 410948 - DNA, 25 bp, Mus musculus
gaaatcaactattgcctcatttgga

SEQ ID NO: 410949 - DNA, 25 bp, Mus musculus
gaaatcaagatgatttagacccaca

SEQ ID NO: 410950 - DNA, 25 bp, Mus musculus
gaaatcaagatgttttagacccaca

SEQ ID NO: 410951 - DNA, 25 bp, Mus musculus
gaaatcaaggctatccacatttgag

SEQ ID NO: 410952 - DNA, 25 bp, Mus musculus
gaaatcaaggctttccacatttgag

SEQ ID NO: 410953 - DNA, 25 bp, Mus musculus
gaaatcaatatcctcctgtcatcac

SEQ ID NO: 410954 - DNA, 25 bp, Mus musculus
gaaatcaatatcgtcctgtcatcac

SEQ ID NO: 410955 - DNA, 25 bp, Mus musculus
gaaatcaatcaactgtctttcttga

SEQ ID NO: 410956 - DNA, 25 bp, Mus musculus
gaaatcaatcaagtgtctttcttga

SEQ ID NO: 410957 - DNA, 25 bp, Mus musculus
gaaatcaatcttcacaccatcttgc

SEQ ID NO: 410958 - DNA, 25 bp, Mus musculus
gaaatcaatcttgacaccatcttgc

SEQ ID NO: 410959 - DNA, 25 bp, Mus musculus
gaaatcaatgaactcttgcacgaaa

SEQ ID NO: 410960 - DNA, 25 bp, Mus musculus
gaaatcaatgaagtcttgcacgaaa

SEQ ID NO: 410961 - DNA, 25 bp, Mus musculus
gaaatcaatggcatcagtgtcgcta

SEQ ID NO: 410962 - DNA, 25 bp, Mus musculus
gaaatcaatggcttcagtgtcgcta

SEQ ID NO: 410963 - DNA, 25 bp, Mus musculus
gaaatcacacacaacaggctaggag

SEQ ID NO: 410964 - DNA, 25 bp, Mus musculus
gaaatcacacactacaggctaggag

SEQ ID NO: 410965 - DNA, 25 bp, Mus musculus
gaaatcacacccagttgtgtcctta

SEQ ID NO: 410966 - DNA, 25 bp, Mus musculus
gaaatcacaccctgttgtgtcctta

SEQ ID NO: 410967 - DNA, 25 bp, Mus musculus
gaaatcacacgtctttagccatgtg

SEQ ID NO: 410968 - DNA, 25 bp, Mus musculus
gaaatcacacgtgtttagccatgtg

SEQ ID NO: 410969 - DNA, 25 bp, Mus musculus
gaaatcacagaccaggaccctcctt

SEQ ID NO: 410970 - DNA, 25 bp, Mus musculus
gaaatcacagacgaggaccctcctt

SEQ ID NO: 410971 - DNA, 25 bp, Mus musculus
gaaatcacagagaccatcaacagca

SEQ ID NO: 410972 - DNA, 25 bp, Mus musculus
gaaatcacagagtccatcaacagca

SEQ ID NO: 410973 - DNA, 25 bp, Mus musculus
gaaatcacatatcagtttgtccctc

SEQ ID NO: 410974 - DNA, 25 bp, Mus musculus
gaaatcacatatgagtttgtccctc

SEQ ID NO: 410975 - DNA, 25 bp, Mus musculus
gaaatcacatccatcattacatcac

SEQ ID NO: 410976 - DNA, 25 bp, Mus musculus
gaaatcacatccttcattacatcac

SEQ ID NO: 410977 - DNA, 25 bp, Mus musculus
gaaatcacatggcatctcctcactg

SEQ ID NO: 410978 - DNA, 25 bp, Mus musculus
gaaatcacatgggatctcctcactg

SEQ ID NO: 410979 - DNA, 25 bp, Mus musculus
gaaatcacatttcctgaccagacca

SEQ ID NO: 410980 - DNA, 25 bp, Mus musculus
gaaatcacatttgctgaccagacca

SEQ ID NO: 410981 - DNA, 25 bp, Mus musculus
gaaatcaccaagacttgttggctat

SEQ ID NO: 410982 - DNA, 25 bp, Mus musculus
gaaatcaccaagctccaaggcgatc

SEQ ID NO: 410983 - DNA, 25 bp, Mus musculus
gaaatcaccaaggtccaaggcgatc

SEQ ID NO: 410984 - DNA, 25 bp, Mus musculus
gaaatcaccaagtcttgttggctat

SEQ ID NO: 410985 - DNA, 25 bp, Mus musculus
gaaatcacccctacatgacaatgag

SEQ ID NO: 410986 - DNA, 25 bp, Mus musculus
gaaatcaccccttcatgacaatgag

SEQ ID NO: 410987 - DNA, 25 bp, Mus musculus
gaaatcaccgataggttacctgccc

SEQ ID NO: 410988 - DNA, 25 bp, Mus musculus
gaaatcaccgattggttacctgccc

SEQ ID NO: 410989 - DNA, 25 bp, Mus musculus
gaaatcaccggaacctacaacagat

SEQ ID NO: 410990 - DNA, 25 bp, Mus musculus
gaaatcaccggatcctacaacagat

SEQ ID NO: 410991 - DNA, 25 bp, Mus musculus
gaaatcaccgggaagcacaggccgt

SEQ ID NO: 410992 - DNA, 25 bp, Mus musculus
gaaatcaccgggtagcacaggccgt

SEQ ID NO: 410993 - DNA, 25 bp, Mus musculus
gaaatcaccttgacatagtccatca

SEQ ID NO: 410994 - DNA, 25 bp, Mus musculus
gaaatcaccttgtcatagtccatca

SEQ ID NO: 410995 - DNA, 25 bp, Mus musculus
gaaatcacgacactcaatgtgaact

SEQ ID NO: 410996 - DNA, 25 bp, Mus musculus
gaaatcacgacagtcaatgtgaact

SEQ ID NO: 410997 - DNA, 25 bp, Mus musculus
gaaatcacggatcaacagctacaga

SEQ ID NO: 410998 - DNA, 25 bp, Mus musculus
gaaatcacggatgaacagctacaga

SEQ ID NO: 410999 - DNA, 25 bp, Mus musculus
gaaatcacgtatatttgtggtaaac

SEQ ID NO: 411000 - DNA, 25 bp, Mus musculus
gaaatcacgtatttttgtggtaaac

SEQ ID NO: 411001 - DNA, 25 bp, Mus musculus
gaaatcacgtctcctgacaaaccag

SEQ ID NO: 411002 - DNA, 25 bp, Mus musculus
gaaatcacgtctgctgacaaaccag

SEQ ID NO: 411003 - DNA, 25 bp, Mus musculus
gaaatcactactctgttgtgctgca

SEQ ID NO: 411004 - DNA, 25 bp, Mus musculus
gaaatcactactgtgttgtgctgca

SEQ ID NO: 411005 - DNA, 25 bp, Mus musculus
gaaatcactccaaacacaagcagaa

SEQ ID NO: 411006 - DNA, 25 bp, Mus musculus
gaaatcactccatacacaagcagaa

SEQ ID NO: 411007 - DNA, 25 bp, Mus musculus
gaaatcactgataggctccttctat

SEQ ID NO: 411008 - DNA, 25 bp, Mus musculus
gaaatcactgattggctccttctat

SEQ ID NO: 411009 - DNA, 25 bp, Mus musculus
gaaatcactgccactctaatgtcac

SEQ ID NO: 411010 - DNA, 25 bp, Mus musculus
gaaatcactgcctctctaatgtcac

SEQ ID NO: 411011 - DNA, 25 bp, Mus musculus
gaaatcactgtcctaattcttactt

SEQ ID NO: 411012 - DNA, 25 bp, Mus musculus
gaaatcactgtcgtaattcttactt

SEQ ID NO: 411013 - DNA, 25 bp, Mus musculus
gaaatcactgttcaaatggtgtcac

SEQ ID NO: 411014 - DNA, 25 bp, Mus musculus
gaaatcactgttgaaatggtgtcac

SEQ ID NO: 411015 - DNA, 25 bp, Mus musculus
gaaatcacttatcctccaaaacgtt

SEQ ID NO: 411016 - DNA, 25 bp, Mus musculus
gaaatcacttatgctccaaaacgtt

SEQ ID NO: 411017 - DNA, 25 bp, Mus musculus
gaaatcacttgtaccatatcaattt

SEQ ID NO: 411018 - DNA, 25 bp, Mus musculus
gaaatcacttgttccatatcaattt

SEQ ID NO: 411019 - DNA, 25 bp, Mus musculus
gaaatcactttcagctttatgatag

SEQ ID NO: 411020 - DNA, 25 bp, Mus musculus
gaaatcactttctgctttatgatag

SEQ ID NO: 411021 - DNA, 25 bp, Mus musculus
gaaatcagaaacctagcgccaaaaa

SEQ ID NO: 411022 - DNA, 25 bp, Mus musculus
gaaatcagaaacgtagcgccaaaaa

SEQ ID NO: 411023 - DNA, 25 bp, Mus musculus
gaaatcagaaatcagggccgacaag

SEQ ID NO: 411024 - DNA, 25 bp, Mus musculus
gaaatcagaaatgagggccgacaag

SEQ ID NO: 411025 - DNA, 25 bp, Mus musculus
gaaatcagaactcctaccatggttt

SEQ ID NO: 411026 - DNA, 25 bp, Mus musculus
gaaatcagaactgctaccatggttt

SEQ ID NO: 411027 - DNA, 25 bp, Mus musculus
gaaatcagaccacccctggagcttt

SEQ ID NO: 411028 - DNA, 25 bp, Mus musculus
gaaatcagaccagccctggagcttt

SEQ ID NO: 411029 - DNA, 25 bp, Mus musculus
gaaatcagacttatctcactgtcct

SEQ ID NO: 411030 - DNA, 25 bp, Mus musculus
gaaatcagacttcactccttaagta

SEQ ID NO: 411031 - DNA, 25 bp, Mus musculus
gaaatcagacttgactccttaagta

SEQ ID NO: 411032 - DNA, 25 bp, Mus musculus
gaaatcagacttttctcactgtcct

SEQ ID NO: 411033 - DNA, 25 bp, Mus musculus
gaaatcagagaactccgcgaaacct

SEQ ID NO: 411034 - DNA, 25 bp, Mus musculus
gaaatcagagaagtccgcgaaacct

SEQ ID NO: 411035 - DNA, 25 bp, Mus musculus
gaaatcagagccacttactagacac

SEQ ID NO: 411036 - DNA, 25 bp, Mus musculus
gaaatcagagcctcttactagacac

SEQ ID NO: 411037 - DNA, 25 bp, Mus musculus
gaaatcagagctacctcggaggtgt

SEQ ID NO: 411038 - DNA, 25 bp, Mus musculus
gaaatcagagctccatctgctggat

SEQ ID NO: 411039 - DNA, 25 bp, Mus musculus
gaaatcagagctgcatctgctggat

SEQ ID NO: 411040 - DNA, 25 bp, Mus musculus
gaaatcagagcttcctcggaggtgt

SEQ ID NO: 411041 - DNA, 25 bp, Mus musculus
gaaatcagagggagccaagcattaa

SEQ ID NO: 411042 - DNA, 25 bp, Mus musculus
gaaatcagagggtgccaagcattaa

SEQ ID NO: 411043 - DNA, 25 bp, Mus musculus
gaaatcagatccctcaggactggag

SEQ ID NO: 411044 - DNA, 25 bp, Mus musculus
gaaatcagatccgtcaggactggag

SEQ ID NO: 411045 - DNA, 25 bp, Mus musculus
gaaatcagatgtacccatgcttagc

SEQ ID NO: 411046 - DNA, 25 bp, Mus musculus
gaaatcagatgttcccatgcttagc

SEQ ID NO: 411047 - DNA, 25 bp, Mus musculus
gaaatcagcaatagatcgtcattct

SEQ ID NO: 411048 - DNA, 25 bp, Mus musculus
gaaatcagcaattgatcgtcattct

SEQ ID NO: 411049 - DNA, 25 bp, Mus musculus
gaaatcagcaccaagccctataatt

SEQ ID NO: 411050 - DNA, 25 bp, Mus musculus
gaaatcagcaccattgcaagcaact

SEQ ID NO: 411051 - DNA, 25 bp, Mus musculus
gaaatcagcacctagccctataatt

SEQ ID NO: 411052 - DNA, 25 bp, Mus musculus
gaaatcagcacctttgcaagcaact

SEQ ID NO: 411053 - DNA, 25 bp, Mus musculus
gaaatcagccagcacgccaagtaca

SEQ ID NO: 411054 - DNA, 25 bp, Mus musculus
gaaatcagccaggacgccaagtaca

SEQ ID NO: 411055 - DNA, 25 bp, Mus musculus
gaaatcagcccgcaagttggccaac

SEQ ID NO: 411056 - DNA, 25 bp, Mus musculus
gaaatcagcccggaagttggccaac

SEQ ID NO: 411057 - DNA, 25 bp, Mus musculus
gaaatcagccttccgaacattcact

SEQ ID NO: 411058 - DNA, 25 bp, Mus musculus
gaaatcagccttgcgaacattcact

SEQ ID NO: 411059 - DNA, 25 bp, Mus musculus
gaaatcagcgatcccggctgggtat

SEQ ID NO: 411060 - DNA, 25 bp, Mus musculus
gaaatcagcgatgccggctgggtat

SEQ ID NO: 411061 - DNA, 25 bp, Mus musculus
gaaatcaggcatacaccatacaatg

SEQ ID NO: 411062 - DNA, 25 bp, Mus musculus
gaaatcaggcattcaccatacaatg

SEQ ID NO: 411063 - DNA, 25 bp, Mus musculus
gaaatcaggctacacacgtacaata

SEQ ID NO: 411064 - DNA, 25 bp, Mus musculus
gaaatcaggctagacacgtacaata

SEQ ID NO: 411065 - DNA, 25 bp, Mus musculus
gaaatcagggctcattgcttttaga

SEQ ID NO: 411066 - DNA, 25 bp, Mus musculus
gaaatcagggctgattgcttttaga

SEQ ID NO: 411067 - DNA, 25 bp, Mus musculus
gaaatcaggtaacatgcgggacttt

SEQ ID NO: 411068 - DNA, 25 bp, Mus musculus
gaaatcaggtaagatgcgggacttt

SEQ ID NO: 411069 - DNA, 25 bp, Mus musculus
gaaatcaggtggctttcctgctgac

SEQ ID NO: 411070 - DNA, 25 bp, Mus musculus
gaaatcaggtgggtttcctgctgac

SEQ ID NO: 411071 - DNA, 25 bp, Mus musculus
gaaatcagtatcaggacttagagca

SEQ ID NO: 411072 - DNA, 25 bp, Mus musculus
gaaatcagtatctggacttagagca

SEQ ID NO: 411073 - DNA, 25 bp, Mus musculus
gaaatcagtcacacacaagcaaaat

SEQ ID NO: 411074 - DNA, 25 bp, Mus musculus
gaaatcagtcactcacaagcaaaat

SEQ ID NO: 411075 - DNA, 25 bp, Mus musculus
gaaatcagtctcactaatgacaact

SEQ ID NO: 411076 - DNA, 25 bp, Mus musculus
gaaatcagtctctctaatgacaact

SEQ ID NO: 411077 - DNA, 25 bp, Mus musculus
gaaatcagtctgacctgggtttatc

SEQ ID NO: 411078 - DNA, 25 bp, Mus musculus
gaaatcagtctgagacctgaaggag

SEQ ID NO: 411079 - DNA, 25 bp, Mus musculus
gaaatcagtctgtcctgggtttatc

SEQ ID NO: 411080 - DNA, 25 bp, Mus musculus
gaaatcagtctgtgacctgaaggag

SEQ ID NO: 411081 - DNA, 25 bp, Mus musculus
gaaatcagtcttatggctttccact

SEQ ID NO: 411082 - DNA, 25 bp, Mus musculus
gaaatcagtcttttggctttccact

SEQ ID NO: 411083 - DNA, 25 bp, Mus musculus
gaaatcagtgataaccgtacaaagt

SEQ ID NO: 411084 - DNA, 25 bp, Mus musculus
gaaatcagtgattaccgtacaaagt

SEQ ID NO: 411085 - DNA, 25 bp, Mus musculus
gaaatcagtgcactacgttctcagc

SEQ ID NO: 411086 - DNA, 25 bp, Mus musculus
gaaatcagtgcagtacgttctcagc

SEQ ID NO: 411087 - DNA, 25 bp, Mus musculus
gaaatcagtggaaagaggctagcac

SEQ ID NO: 411088 - DNA, 25 bp, Mus musculus
gaaatcagtggatagaggctagcac

SEQ ID NO: 411089 - DNA, 25 bp, Mus musculus
gaaatcagtgttagcttgtgcccag

SEQ ID NO: 411090 - DNA, 25 bp, Mus musculus
gaaatcagtgtttgcttgtgcccag

SEQ ID NO: 411091 - DNA, 25 bp, Mus musculus
gaaatcatagaaaccagagcctcct

SEQ ID NO: 411092 - DNA, 25 bp, Mus musculus
gaaatcatagaatccagagcctcct

SEQ ID NO: 411093 - DNA, 25 bp, Mus musculus
gaaatcatagcaacccatggttttg

SEQ ID NO: 411094 - DNA, 25 bp, Mus musculus
gaaatcatagcatcccatggttttg

SEQ ID NO: 411095 - DNA, 25 bp, Mus musculus
gaaatcataggacttagtgggaaaa

SEQ ID NO: 411096 - DNA, 25 bp, Mus musculus
gaaatcataggagttagtgggaaaa

SEQ ID NO: 411097 - DNA, 25 bp, Mus musculus
gaaatcatatatattattgcctctg

SEQ ID NO: 411098 - DNA, 25 bp, Mus musculus
gaaatcatatattttattgcctctg

SEQ ID NO: 411099 - DNA, 25 bp, Mus musculus
gaaatcatatttcttcatcctcccc

SEQ ID NO: 411100 - DNA, 25 bp, Mus musculus
gaaatcatatttgttcatcctcccc

SEQ ID NO: 411101 - DNA, 25 bp, Mus musculus
gaaatcatcactatcctggacaagt

SEQ ID NO: 411102 - DNA, 25 bp, Mus musculus
gaaatcatcactttcctggacaagt

SEQ ID NO: 411103 - DNA, 25 bp, Mus musculus
gaaatcatcagaatagctgcgtttt

SEQ ID NO: 411104 - DNA, 25 bp, Mus musculus
gaaatcatcagattagctgcgtttt

SEQ ID NO: 411105 - DNA, 25 bp, Mus musculus
gaaatcatcagtcgccatcgtgcag

SEQ ID NO: 411106 - DNA, 25 bp, Mus musculus
gaaatcatcagtggccatcgtgcag

SEQ ID NO: 411107 - DNA, 25 bp, Mus musculus
gaaatcatcccgaaagagcccagaa

SEQ ID NO: 411108 - DNA, 25 bp, Mus musculus
gaaatcatcccgtaagagcccagaa

SEQ ID NO: 411109 - DNA, 25 bp, Mus musculus
gaaatcatcctccaacagtaaaaaa

SEQ ID NO: 411110 - DNA, 25 bp, Mus musculus
gaaatcatcctcgaacagtaaaaaa

SEQ ID NO: 411111 - DNA, 25 bp, Mus musculus
gaaatcatcgacagcttttccatgc

SEQ ID NO: 411112 - DNA, 25 bp, Mus musculus
gaaatcatcgactgcttttccatgc

SEQ ID NO: 411113 - DNA, 25 bp, Mus musculus
gaaatcatctctacaatttcggatg

SEQ ID NO: 411114 - DNA, 25 bp, Mus musculus
gaaatcatctcttcaatttcggatg

SEQ ID NO: 411115 - DNA, 25 bp, Mus musculus
gaaatcatgcacaagtctcctcagt

SEQ ID NO: 411116 - DNA, 25 bp, Mus musculus
gaaatcatgcactagtctcctcagt

SEQ ID NO: 411117 - DNA, 25 bp, Mus musculus
gaaatcatgccacgtaacagacctg

SEQ ID NO: 411118 - DNA, 25 bp, Mus musculus
gaaatcatgccaggtaacagacctg

SEQ ID NO: 411119 - DNA, 25 bp, Mus musculus
gaaatcatgcctattcaacgacaag

SEQ ID NO: 411120 - DNA, 25 bp, Mus musculus
gaaatcatgcctcagcacactgtct

SEQ ID NO: 411121 - DNA, 25 bp, Mus musculus
gaaatcatgcctgagcacactgtct

SEQ ID NO: 411122 - DNA, 25 bp, Mus musculus
gaaatcatgccttttcaacgacaag

SEQ ID NO: 411123 - DNA, 25 bp, Mus musculus
gaaatcatgggacgccctgatcgtg

SEQ ID NO: 411124 - DNA, 25 bp, Mus musculus
gaaatcatgggaggccctgatcgtg

SEQ ID NO: 411125 - DNA, 25 bp, Mus musculus
gaaatcatggtaaatcctcaggaga

SEQ ID NO: 411126 - DNA, 25 bp, Mus musculus
gaaatcatggtatatcctcaggaga

SEQ ID NO: 411127 - DNA, 25 bp, Mus musculus
gaaatcatgtcaacagcattctgtg

SEQ ID NO: 411128 - DNA, 25 bp, Mus musculus
gaaatcatgtcatcagcattctgtg

SEQ ID NO: 411129 - DNA, 25 bp, Mus musculus
gaaatcattaagagcccttctctgc

SEQ ID NO: 411130 - DNA, 25 bp, Mus musculus
gaaatcattaagtgcccttctctgc

SEQ ID NO: 411131 - DNA, 25 bp, Mus musculus
gaaatcattcatccagtcttctctg

SEQ ID NO: 411132 - DNA, 25 bp, Mus musculus
gaaatcattcatgcagtcttctctg

SEQ ID NO: 411133 - DNA, 25 bp, Mus musculus
gaaatcattccaaagcgcctcatat

SEQ ID NO: 411134 - DNA, 25 bp, Mus musculus
gaaatcattccatagcgcctcatat

SEQ ID NO: 411135 - DNA, 25 bp, Mus musculus
gaaatcattgcacaacacattccaa

SEQ ID NO: 411136 - DNA, 25 bp, Mus musculus
gaaatcattgcagaacacattccaa

SEQ ID NO: 411137 - DNA, 25 bp, Mus musculus
gaaatcattgccatgttaatctctt

SEQ ID NO: 411138 - DNA, 25 bp, Mus musculus
gaaatcattgccttgttaatctctt

SEQ ID NO: 411139 - DNA, 25 bp, Mus musculus
gaaatcattgtcagggtcctactca

SEQ ID NO: 411140 - DNA, 25 bp, Mus musculus
gaaatcattgtctgggtcctactca

SEQ ID NO: 411141 - DNA, 25 bp, Mus musculus
gaaatcattgttccaggtttagact

SEQ ID NO: 411142 - DNA, 25 bp, Mus musculus
gaaatcattgttgcaggtttagact

SEQ ID NO: 411143 - DNA, 25 bp, Mus musculus
gaaatcattttcaggcaaccaccat

SEQ ID NO: 411144 - DNA, 25 bp, Mus musculus
gaaatcattttctggcaaccaccat

SEQ ID NO: 411145 - DNA, 25 bp, Mus musculus
gaaatcatttttactgaatgactta

SEQ ID NO: 411146 - DNA, 25 bp, Mus musculus
gaaatcattttttctgaatgactta

SEQ ID NO: 411147 - DNA, 25 bp, Mus musculus
gaaatccaaaacatgttcacactaa

SEQ ID NO: 411148 - DNA, 25 bp, Mus musculus
gaaatccaaaacttgttcacactaa

SEQ ID NO: 411149 - DNA, 25 bp, Mus musculus
gaaatccaaagacccttcgccatgt

SEQ ID NO: 411150 - DNA, 25 bp, Mus musculus
gaaatccaaagagccttcgccatgt

SEQ ID NO: 411151 - DNA, 25 bp, Mus musculus
gaaatccaaccactgagccaggtgt

SEQ ID NO: 411152 - DNA, 25 bp, Mus musculus
gaaatccaaccagtgagccaggtgt

SEQ ID NO: 411153 - DNA, 25 bp, Mus musculus
gaaatccaactgaggttgtcacttg

SEQ ID NO: 411154 - DNA, 25 bp, Mus musculus
gaaatccaactgtggttgtcacttg

SEQ ID NO: 411155 - DNA, 25 bp, Mus musculus
gaaatccaacttaacctgacttaga

SEQ ID NO: 411156 - DNA, 25 bp, Mus musculus
gaaatccaactttacctgacttaga

SEQ ID NO: 411157 - DNA, 25 bp, Mus musculus
gaaatccaatcgaattaggtttaat

SEQ ID NO: 411158 - DNA, 25 bp, Mus musculus
gaaatccaatcgtattaggtttaat

SEQ ID NO: 411159 - DNA, 25 bp, Mus musculus
gaaatccacagcactcaaagctttg

SEQ ID NO: 411160 - DNA, 25 bp, Mus musculus
gaaatccacagctctcaaagctttg

SEQ ID NO: 411161 - DNA, 25 bp, Mus musculus
gaaatccacaggctgggaactatct

SEQ ID NO: 411162 - DNA, 25 bp, Mus musculus
gaaatccacagggtgggaactatct

SEQ ID NO: 411163 - DNA, 25 bp, Mus musculus
gaaatccaccacagtatcctgaaaa

SEQ ID NO: 411164 - DNA, 25 bp, Mus musculus
gaaatccaccactgtatcctgaaaa

SEQ ID NO: 411165 - DNA, 25 bp, Mus musculus
gaaatccactggatcatcgtgcagt

SEQ ID NO: 411166 - DNA, 25 bp, Mus musculus
gaaatccactggttcatcgtgcagt

SEQ ID NO: 411167 - DNA, 25 bp, Mus musculus
gaaatccagaacaccccaacagggt

SEQ ID NO: 411168 - DNA, 25 bp, Mus musculus
gaaatccagaactccccaacagggt

SEQ ID NO: 411169 - DNA, 25 bp, Mus musculus
gaaatccagagcactcagtcataag

SEQ ID NO: 411170 - DNA, 25 bp, Mus musculus
gaaatccagagctctcagtcataag

SEQ ID NO: 411171 - DNA, 25 bp, Mus musculus
gaaatccagattacacaggccaatt

SEQ ID NO: 411172 - DNA, 25 bp, Mus musculus
gaaatccagatttcacaggccaatt

SEQ ID NO: 411173 - DNA, 25 bp, Mus musculus
gaaatccagcaactgacttctcagt

SEQ ID NO: 411174 - DNA, 25 bp, Mus musculus
gaaatccagcaagtgacttctcagt

SEQ ID NO: 411175 - DNA, 25 bp, Mus musculus
gaaatccagcccaatagaagcaatt

SEQ ID NO: 411176 - DNA, 25 bp, Mus musculus
gaaatccagccctatagaagcaatt

SEQ ID NO: 411177 - DNA, 25 bp, Mus musculus
gaaatccagcctcatgcaaaacctg

SEQ ID NO: 411178 - DNA, 25 bp, Mus musculus
gaaatccagcctgatgcaaaacctg

SEQ ID NO: 411179 - DNA, 25 bp, Mus musculus
gaaatccagctgactgcactgaatg

SEQ ID NO: 411180 - DNA, 25 bp, Mus musculus
gaaatccagctgtctgcactgaatg

SEQ ID NO: 411181 - DNA, 25 bp, Mus musculus
gaaatccaggacacgggctcctttt

SEQ ID NO: 411182 - DNA, 25 bp, Mus musculus
gaaatccaggaccaccgcattttct

SEQ ID NO: 411183 - DNA, 25 bp, Mus musculus
gaaatccaggacgaccgcattttct

SEQ ID NO: 411184 - DNA, 25 bp, Mus musculus
gaaatccaggactcgggctcctttt

SEQ ID NO: 411185 - DNA, 25 bp, Mus musculus
gaaatccaggagaatctgattacag

SEQ ID NO: 411186 - DNA, 25 bp, Mus musculus
gaaatccaggagcaatcccacagca

SEQ ID NO: 411187 - DNA, 25 bp, Mus musculus
gaaatccaggaggaatcccacagca

SEQ ID NO: 411188 - DNA, 25 bp, Mus musculus
gaaatccaggagtatctgattacag

SEQ ID NO: 411189 - DNA, 25 bp, Mus musculus
gaaatccaggatacccagggacctt

SEQ ID NO: 411190 - DNA, 25 bp, Mus musculus
gaaatccaggattcccagggacctt

SEQ ID NO: 411191 - DNA, 25 bp, Mus musculus
gaaatccagtacctgtctgacctcg

SEQ ID NO: 411192 - DNA, 25 bp, Mus musculus
gaaatccagtacgtgtctgacctcg

SEQ ID NO: 411193 - DNA, 25 bp, Mus musculus
gaaatccagtatagtttgccattaa

SEQ ID NO: 411194 - DNA, 25 bp, Mus musculus
gaaatccagtatatagacacggaac

SEQ ID NO: 411195 - DNA, 25 bp, Mus musculus
gaaatccagtatcggtctctactcc

SEQ ID NO: 411196 - DNA, 25 bp, Mus musculus
gaaatccagtatgggtctctactcc

SEQ ID NO: 411197 - DNA, 25 bp, Mus musculus
gaaatccagtattgtttgccattaa

SEQ ID NO: 411198 - DNA, 25 bp, Mus musculus
gaaatccagtatttagacacggaac

SEQ ID NO: 411199 - DNA, 25 bp, Mus musculus
gaaatccagtccaatttatacatac

SEQ ID NO: 411200 - DNA, 25 bp, Mus musculus
gaaatccagtcctatttatacatac

SEQ ID NO: 411201 - DNA, 25 bp, Mus musculus
gaaatccagtctcacacattactta

SEQ ID NO: 411202 - DNA, 25 bp, Mus musculus
gaaatccagtctgacacattactta

SEQ ID NO: 411203 - DNA, 25 bp, Mus musculus
gaaatccagtgtcggtcatccagaa

SEQ ID NO: 411204 - DNA, 25 bp, Mus musculus
gaaatccagtgtgggtcatccagaa

SEQ ID NO: 411205 - DNA, 25 bp, Mus musculus
gaaatccatattccccttttaaaag

SEQ ID NO: 411206 - DNA, 25 bp, Mus musculus
gaaatccatattctacgctattttg

SEQ ID NO: 411207 - DNA, 25 bp, Mus musculus
gaaatccatattcttcactttactt

SEQ ID NO: 411208 - DNA, 25 bp, Mus musculus
gaaatccatattgcccttttaaaag

SEQ ID NO: 411209 - DNA, 25 bp, Mus musculus
gaaatccatattgtacgctattttg

SEQ ID NO: 411210 - DNA, 25 bp, Mus musculus
gaaatccatattgttcactttactt

SEQ ID NO: 411211 - DNA, 25 bp, Mus musculus
gaaatccatgttacgtgagccagaa

SEQ ID NO: 411212 - DNA, 25 bp, Mus musculus
gaaatccatgtttcgtgagccagaa

SEQ ID NO: 411213 - DNA, 25 bp, Mus musculus
gaaatccattccaacttttcgtcct

SEQ ID NO: 411214 - DNA, 25 bp, Mus musculus
gaaatccattcctacttttcgtcct

SEQ ID NO: 411215 - DNA, 25 bp, Mus musculus
gaaatccatttccacggcgctattg

SEQ ID NO: 411216 - DNA, 25 bp, Mus musculus
gaaatccatttcgacggcgctattg

SEQ ID NO: 411217 - DNA, 25 bp, Mus musculus
gaaatcccaaccaaagatgtcccta

SEQ ID NO: 411218 - DNA, 25 bp, Mus musculus
gaaatcccaacctaagatgtcccta

SEQ ID NO: 411219 - DNA, 25 bp, Mus musculus
gaaatcccaagcatgttttctggct

SEQ ID NO: 411220 - DNA, 25 bp, Mus musculus
gaaatcccaagcttgttttctggct

SEQ ID NO: 411221 - DNA, 25 bp, Mus musculus
gaaatcccacaacctatgcttagag

SEQ ID NO: 411222 - DNA, 25 bp, Mus musculus
gaaatcccacaagctatgcttagag

SEQ ID NO: 411223 - DNA, 25 bp, Mus musculus
gaaatcccacacctatcagacaaag

SEQ ID NO: 411224 - DNA, 25 bp, Mus musculus
gaaatcccacacgtatcagacaaag

SEQ ID NO: 411225 - DNA, 25 bp, Mus musculus
gaaatcccacgaaggatcttaccaa

SEQ ID NO: 411226 - DNA, 25 bp, Mus musculus
gaaatcccacgatggatcttaccaa

SEQ ID NO: 411227 - DNA, 25 bp, Mus musculus
gaaatcccagaacatcagagcccag

SEQ ID NO: 411228 - DNA, 25 bp, Mus musculus
gaaatcccagaacgctacatccctg

SEQ ID NO: 411229 - DNA, 25 bp, Mus musculus
gaaatcccagaagatcagagcccag

SEQ ID NO: 411230 - DNA, 25 bp, Mus musculus
gaaatcccagaaggctacatccctg

SEQ ID NO: 411231 - DNA, 25 bp, Mus musculus
gaaatcccaggaacaagtcgaacac

SEQ ID NO: 411232 - DNA, 25 bp, Mus musculus
gaaatcccaggactgtattgctgag

SEQ ID NO: 411233 - DNA, 25 bp, Mus musculus
gaaatcccaggagtgtattgctgag

SEQ ID NO: 411234 - DNA, 25 bp, Mus musculus
gaaatcccaggatcaagtcgaacac

SEQ ID NO: 411235 - DNA, 25 bp, Mus musculus
gaaatcccatcaaccgtggtggcat

SEQ ID NO: 411236 - DNA, 25 bp, Mus musculus
gaaatcccatcatccgtggtggcat

SEQ ID NO: 411237 - DNA, 25 bp, Mus musculus
gaaatcccatcccaatagaattctg

SEQ ID NO: 411238 - DNA, 25 bp, Mus musculus
gaaatcccatccgaatagaattctg

SEQ ID NO: 411239 - DNA, 25 bp, Mus musculus
gaaatcccatggaaacacataccag

SEQ ID NO: 411240 - DNA, 25 bp, Mus musculus
gaaatcccatggtaacacataccag

SEQ ID NO: 411241 - DNA, 25 bp, Mus musculus
gaaatcccgcaaacgctacgactag

SEQ ID NO: 411242 - DNA, 25 bp, Mus musculus
gaaatcccgcaatcgctacgactag

SEQ ID NO: 411243 - DNA, 25 bp, Mus musculus
gaaatcccggagaggctgagaagtc

SEQ ID NO: 411244 - DNA, 25 bp, Mus musculus
gaaatcccggagattagtgcccaga

SEQ ID NO: 411245 - DNA, 25 bp, Mus musculus
gaaatcccggagtggctgagaagtc

SEQ ID NO: 411246 - DNA, 25 bp, Mus musculus
gaaatcccggagtttagtgcccaga

SEQ ID NO: 411247 - DNA, 25 bp, Mus musculus
gaaatcccgggaactgatggtcctc

SEQ ID NO: 411248 - DNA, 25 bp, Mus musculus
gaaatcccgggatctgatggtcctc

SEQ ID NO: 411249 - DNA, 25 bp, Mus musculus
gaaatcccgtttaacatattgtcaa

SEQ ID NO: 411250 - DNA, 25 bp, Mus musculus
gaaatcccgttttacatattgtcaa

SEQ ID NO: 411251 - DNA, 25 bp, Mus musculus
gaaatccctattatgtgtgctccgc

SEQ ID NO: 411252 - DNA, 25 bp, Mus musculus
gaaatccctattttgtgtgctccgc

SEQ ID NO: 411253 - DNA, 25 bp, Mus musculus
gaaatccctccaaagacctattctt

SEQ ID NO: 411254 - DNA, 25 bp, Mus musculus
gaaatccctccatagacctattctt

SEQ ID NO: 411255 - DNA, 25 bp, Mus musculus
gaaatccctgacaaagtactgtcct

SEQ ID NO: 411256 - DNA, 25 bp, Mus musculus
gaaatccctgactaagtactgtcct

SEQ ID NO: 411257 - DNA, 25 bp, Mus musculus
gaaatccctgagctctcttttattt

SEQ ID NO: 411258 - DNA, 25 bp, Mus musculus
gaaatccctgaggtctcttttattt

SEQ ID NO: 411259 - DNA, 25 bp, Mus musculus
gaaatccctggtctcataaaacaca

SEQ ID NO: 411260 - DNA, 25 bp, Mus musculus
gaaatccctggtgtcataaaacaca

SEQ ID NO: 411261 - DNA, 25 bp, Mus musculus
gaaatcccttctaattcttaccagg

SEQ ID NO: 411262 - DNA, 25 bp, Mus musculus
gaaatcccttcttattcttaccagg

SEQ ID NO: 411263 - DNA, 25 bp, Mus musculus
gaaatcccttgtctatgctttttga

SEQ ID NO: 411264 - DNA, 25 bp, Mus musculus
gaaatcccttgtgtatgctttttga

SEQ ID NO: 411265 - DNA, 25 bp, Mus musculus
gaaatcccttttctggagacagttt

SEQ ID NO: 411266 - DNA, 25 bp, Mus musculus
gaaatcccttttgtggagacagttt

SEQ ID NO: 411267 - DNA, 25 bp, Mus musculus
gaaatccgatttacgacgcgattgt

SEQ ID NO: 411268 - DNA, 25 bp, Mus musculus
gaaatccgattttcgacgcgattgt

SEQ ID NO: 411269 - DNA, 25 bp, Mus musculus
gaaatccggcaacttgaattggtgg

SEQ ID NO: 411270 - DNA, 25 bp, Mus musculus
gaaatccggcaagttgaattggtgg

SEQ ID NO: 411271 - DNA, 25 bp, Mus musculus
gaaatccgtgtgaatatttaagacc

SEQ ID NO: 411272 - DNA, 25 bp, Mus musculus
gaaatccgtgtgtatatttaagacc

SEQ ID NO: 411273 - DNA, 25 bp, Mus musculus
gaaatccgtgttacagcctatagct

SEQ ID NO: 411274 - DNA, 25 bp, Mus musculus
gaaatccgtgtttcagcctatagct

SEQ ID NO: 411275 - DNA, 25 bp, Mus musculus
gaaatccgttggcagcctgcgataa

SEQ ID NO: 411276 - DNA, 25 bp, Mus musculus
gaaatccgttgggagcctgcgataa

SEQ ID NO: 411277 - DNA, 25 bp, Mus musculus
gaaatcctaacacaagccaatctgg

SEQ ID NO: 411278 - DNA, 25 bp, Mus musculus
gaaatcctaacagaagccaatctgg

SEQ ID NO: 411279 - DNA, 25 bp, Mus musculus
gaaatcctacaacccttacagagtg

SEQ ID NO: 411280 - DNA, 25 bp, Mus musculus
gaaatcctacaagccttacagagtg

SEQ ID NO: 411281 - DNA, 25 bp, Mus musculus
gaaatcctacagaggtctcctatca

SEQ ID NO: 411282 - DNA, 25 bp, Mus musculus
gaaatcctacagtggtctcctatca

SEQ ID NO: 411283 - DNA, 25 bp, Mus musculus
gaaatcctaggcaacttcagcttca

SEQ ID NO: 411284 - DNA, 25 bp, Mus musculus
gaaatcctaggctacttcagcttca

SEQ ID NO: 411285 - DNA, 25 bp, Mus musculus
gaaatcctatagctgtacaggttat

SEQ ID NO: 411286 - DNA, 25 bp, Mus musculus
gaaatcctataggtgtacaggttat

SEQ ID NO: 411287 - DNA, 25 bp, Mus musculus
gaaatcctatttctcactttctctt

SEQ ID NO: 411288 - DNA, 25 bp, Mus musculus
gaaatcctatttgtcactttctctt

SEQ ID NO: 411289 - DNA, 25 bp, Mus musculus
gaaatcctcatgaatttgcttttat

SEQ ID NO: 411290 - DNA, 25 bp, Mus musculus
gaaatcctcatgtatttgcttttat

SEQ ID NO: 411291 - DNA, 25 bp, Mus musculus
gaaatcctcccaatgggcacagaat

SEQ ID NO: 411292 - DNA, 25 bp, Mus musculus
gaaatcctcccattgggcacagaat

SEQ ID NO: 411293 - DNA, 25 bp, Mus musculus
gaaatcctcctgaaacagacctcaa

SEQ ID NO: 411294 - DNA, 25 bp, Mus musculus
gaaatcctcctgtaacagacctcaa

SEQ ID NO: 411295 - DNA, 25 bp, Mus musculus
gaaatcctctcccaaatgtgatgat

SEQ ID NO: 411296 - DNA, 25 bp, Mus musculus
gaaatcctctccgaaatgtgatgat

SEQ ID NO: 411297 - DNA, 25 bp, Mus musculus
gaaatcctctttcctgctaacacga

SEQ ID NO: 411298 - DNA, 25 bp, Mus musculus
gaaatcctctttcgagacagctcga

SEQ ID NO: 411299 - DNA, 25 bp, Mus musculus
gaaatcctctttgctgctaacacga

SEQ ID NO: 411300 - DNA, 25 bp, Mus musculus
gaaatcctctttggagacagctcga

SEQ ID NO: 411301 - DNA, 25 bp, Mus musculus
gaaatcctgaagaccttggctgaat

SEQ ID NO: 411302 - DNA, 25 bp, Mus musculus
gaaatcctgaagtccttggctgaat

SEQ ID NO: 411303 - DNA, 25 bp, Mus musculus
gaaatcctgatgatttcctggccag

SEQ ID NO: 411304 - DNA, 25 bp, Mus musculus
gaaatcctgatgttttcctggccag

SEQ ID NO: 411305 - DNA, 25 bp, Mus musculus
gaaatcctgattaatccagtacttt

SEQ ID NO: 411306 - DNA, 25 bp, Mus musculus
gaaatcctgattattgcctcttggt

SEQ ID NO: 411307 - DNA, 25 bp, Mus musculus
gaaatcctgatttatccagtacttt

SEQ ID NO: 411308 - DNA, 25 bp, Mus musculus
gaaatcctgatttttgcctcttggt

SEQ ID NO: 411309 - DNA, 25 bp, Mus musculus
gaaatcctgccaccagaagattaaa

SEQ ID NO: 411310 - DNA, 25 bp, Mus musculus
gaaatcctgccagcagaagattaaa

SEQ ID NO: 411311 - DNA, 25 bp, Mus musculus
gaaatcctggaccacttttccaaag

SEQ ID NO: 411312 - DNA, 25 bp, Mus musculus
gaaatcctggacgacttttccaaag

SEQ ID NO: 411313 - DNA, 25 bp, Mus musculus
gaaatcctggcaaatctggcatacg

SEQ ID NO: 411314 - DNA, 25 bp, Mus musculus
gaaatcctggcatatctggcatacg

SEQ ID NO: 411315 - DNA, 25 bp, Mus musculus
gaaatcctgggtatggctaagaata

SEQ ID NO: 411316 - DNA, 25 bp, Mus musculus
gaaatcctgggtttggctaagaata

SEQ ID NO: 411317 - DNA, 25 bp, Mus musculus
gaaatcctgtcccaaaataagcatt

SEQ ID NO: 411318 - DNA, 25 bp, Mus musculus
gaaatcctgtccgaaaataagcatt

SEQ ID NO: 411319 - DNA, 25 bp, Mus musculus
gaaatcctgttcaccttgaccagag

SEQ ID NO: 411320 - DNA, 25 bp, Mus musculus
gaaatcctgttctccttgaccagag

SEQ ID NO: 411321 - DNA, 25 bp, Mus musculus
gaaatccttgagaatctcttccgag

SEQ ID NO: 411322 - DNA, 25 bp, Mus musculus
gaaatccttgagtatctcttccgag

SEQ ID NO: 411323 - DNA, 25 bp, Mus musculus
gaaatccttgcccatgtggtggccc

SEQ ID NO: 411324 - DNA, 25 bp, Mus musculus
gaaatccttgccgatgtggtggccc

SEQ ID NO: 411325 - DNA, 25 bp, Mus musculus
gaaatccttgtacaactgggtggga

SEQ ID NO: 411326 - DNA, 25 bp, Mus musculus
gaaatccttgtagaactgggtggga

SEQ ID NO: 411327 - DNA, 25 bp, Mus musculus
gaaatccttgttcctaagctacaga

SEQ ID NO: 411328 - DNA, 25 bp, Mus musculus
gaaatccttgttgctaagctacaga

SEQ ID NO: 411329 - DNA, 25 bp, Mus musculus
gaaatcctttgacggtggtgctgct

SEQ ID NO: 411330 - DNA, 25 bp, Mus musculus
gaaatcctttgagggtggtgctgct

SEQ ID NO: 411331 - DNA, 25 bp, Mus musculus
gaaatcctttgtcctgaagacttgc

SEQ ID NO: 411332 - DNA, 25 bp, Mus musculus
gaaatcctttgtcttgctgatacag

SEQ ID NO: 411333 - DNA, 25 bp, Mus musculus
gaaatcctttgtgctgaagacttgc

SEQ ID NO: 411334 - DNA, 25 bp, Mus musculus
gaaatcctttgtgttgctgatacag

SEQ ID NO: 411335 - DNA, 25 bp, Mus musculus
gaaatccttttcaggtatacttaat

SEQ ID NO: 411336 - DNA, 25 bp, Mus musculus
gaaatccttttctggtatacttaat

SEQ ID NO: 411337 - DNA, 25 bp, Mus musculus
gaaatcctttttcacagtattgctg

SEQ ID NO: 411338 - DNA, 25 bp, Mus musculus
gaaatcctttttgacagtattgctg

SEQ ID NO: 411339 - DNA, 25 bp, Mus musculus
gaaatcgaaactcccctagtgcttc

SEQ ID NO: 411340 - DNA, 25 bp, Mus musculus
gaaatcgaaactgccctagtgcttc

SEQ ID NO: 411341 - DNA, 25 bp, Mus musculus
gaaatcgaagaaaacctcccatgct

SEQ ID NO: 411342 - DNA, 25 bp, Mus musculus
gaaatcgaagaatacctcccatgct

SEQ ID NO: 411343 - DNA, 25 bp, Mus musculus
gaaatcgaagtcaggctctcgtcct

SEQ ID NO: 411344 - DNA, 25 bp, Mus musculus
gaaatcgaagtctggctctcgtcct

SEQ ID NO: 411345 - DNA, 25 bp, Mus musculus
gaaatcgacaatcaagttccagatg

SEQ ID NO: 411346 - DNA, 25 bp, Mus musculus
gaaatcgacaatgaagttccagatg

SEQ ID NO: 411347 - DNA, 25 bp, Mus musculus
gaaatcgacagcaatggtatttttt

SEQ ID NO: 411348 - DNA, 25 bp, Mus musculus
gaaatcgacagctatggtatttttt

SEQ ID NO: 411349 - DNA, 25 bp, Mus musculus
gaaatcgaccccaaggcagaggcag

SEQ ID NO: 411350 - DNA, 25 bp, Mus musculus
gaaatcgacccctaggcagaggcag

SEQ ID NO: 411351 - DNA, 25 bp, Mus musculus
gaaatcgagcgcaacttcagtgaag

SEQ ID NO: 411352 - DNA, 25 bp, Mus musculus
gaaatcgagcgctacttcagtgaag

SEQ ID NO: 411353 - DNA, 25 bp, Mus musculus
gaaatcgaggatcctgcccagtttg

SEQ ID NO: 411354 - DNA, 25 bp, Mus musculus
gaaatcgaggatgctgcccagtttg

SEQ ID NO: 411355 - DNA, 25 bp, Mus musculus
gaaatcgagtccagtatacacccca

SEQ ID NO: 411356 - DNA, 25 bp, Mus musculus
gaaatcgagtcctgtatacacccca

SEQ ID NO: 411357 - DNA, 25 bp, Mus musculus
gaaatcgattctatggtctctacgg

SEQ ID NO: 411358 - DNA, 25 bp, Mus musculus
gaaatcgattctttggtctctacgg

SEQ ID NO: 411359 - DNA, 25 bp, Mus musculus
gaaatcgccacacctcagaaatcgc

SEQ ID NO: 411360 - DNA, 25 bp, Mus musculus
gaaatcgccacagctcagaaatcgc

SEQ ID NO: 411361 - DNA, 25 bp, Mus musculus
gaaatcgcctgccacgggaatgtga

SEQ ID NO: 411362 - DNA, 25 bp, Mus musculus
gaaatcgcctgcgacgggaatgtga

SEQ ID NO: 411363 - DNA, 25 bp, Mus musculus
gaaatcgcgactcagaatgtctaga

SEQ ID NO: 411364 - DNA, 25 bp, Mus musculus
gaaatcgcgactgagaatgtctaga

SEQ ID NO: 411365 - DNA, 25 bp, Mus musculus
gaaatcgcgcagagtgaagtcttcc

SEQ ID NO: 411366 - DNA, 25 bp, Mus musculus
gaaatcgcgcagtgtgaagtcttcc

SEQ ID NO: 411367 - DNA, 25 bp, Mus musculus
gaaatcgctgacctgtatgaccaca

SEQ ID NO: 411368 - DNA, 25 bp, Mus musculus
gaaatcgctgacgtgtatgaccaca

SEQ ID NO: 411369 - DNA, 25 bp, Mus musculus
gaaatcgctgtgatagggaaactgt

SEQ ID NO: 411370 - DNA, 25 bp, Mus musculus
gaaatcgctgtgttagggaaactgt

SEQ ID NO: 411371 - DNA, 25 bp, Mus musculus
gaaatcgcttatcacatcactgccc

SEQ ID NO: 411372 - DNA, 25 bp, Mus musculus
gaaatcgcttatgacatcactgccc

SEQ ID NO: 411373 - DNA, 25 bp, Mus musculus
gaaatcgctttcatgagttgagctg

SEQ ID NO: 411374 - DNA, 25 bp, Mus musculus
gaaatcgctttcttgagttgagctg

SEQ ID NO: 411375 - DNA, 25 bp, Mus musculus
gaaatcggacgcaggcatcagctca

SEQ ID NO: 411376 - DNA, 25 bp, Mus musculus
gaaatcggacgctggcatcagctca

SEQ ID NO: 411377 - DNA, 25 bp, Mus musculus
gaaatcggatttcagcacaggtaaa

SEQ ID NO: 411378 - DNA, 25 bp, Mus musculus
gaaatcggatttgagcacaggtaaa

SEQ ID NO: 411379 - DNA, 25 bp, Mus musculus
gaaatcggcagcaccgacgagatca

SEQ ID NO: 411380 - DNA, 25 bp, Mus musculus
gaaatcggcagctccgacgagatca

SEQ ID NO: 411381 - DNA, 25 bp, Mus musculus
gaaatcggcgctcaccaaacaccag

SEQ ID NO: 411382 - DNA, 25 bp, Mus musculus
gaaatcggcgctgaccaaacaccag

SEQ ID NO: 411383 - DNA, 25 bp, Mus musculus
gaaatcgggtacagttgtctttgac

SEQ ID NO: 411384 - DNA, 25 bp, Mus musculus
gaaatcgggtactgttgtctttgac

SEQ ID NO: 411385 - DNA, 25 bp, Mus musculus
gaaatcgggtgcacagcatccatct

SEQ ID NO: 411386 - DNA, 25 bp, Mus musculus
gaaatcgggtgctcagcatccatct

SEQ ID NO: 411387 - DNA, 25 bp, Mus musculus
gaaatcggtcttacaagtgctttaa

SEQ ID NO: 411388 - DNA, 25 bp, Mus musculus
gaaatcggtcttagggtgccacact

SEQ ID NO: 411389 - DNA, 25 bp, Mus musculus
gaaatcggtctttcaagtgctttaa

SEQ ID NO: 411390 - DNA, 25 bp, Mus musculus
gaaatcggtctttgggtgccacact

SEQ ID NO: 411391 - DNA, 25 bp, Mus musculus
gaaatcgtattgattccctttgagg

SEQ ID NO: 411392 - DNA, 25 bp, Mus musculus
gaaatcgtattgtttccctttgagg

SEQ ID NO: 411393 - DNA, 25 bp, Mus musculus
gaaatcgtgataccaggtaactcca

SEQ ID NO: 411394 - DNA, 25 bp, Mus musculus
gaaatcgtgatagcaggtaactcca

SEQ ID NO: 411395 - DNA, 25 bp, Mus musculus
gaaatcgtgcataaccgtgctgaag

SEQ ID NO: 411396 - DNA, 25 bp, Mus musculus
gaaatcgtgcattaccgtgctgaag

SEQ ID NO: 411397 - DNA, 25 bp, Mus musculus
gaaatcgtgcctcatactaacgctg

SEQ ID NO: 411398 - DNA, 25 bp, Mus musculus
gaaatcgtgcctgatactaacgctg

SEQ ID NO: 411399 - DNA, 25 bp, Mus musculus
gaaatcgtgcgtcacatcaaagaga

SEQ ID NO: 411400 - DNA, 25 bp, Mus musculus
gaaatcgtgcgtgacatcaaagaga

SEQ ID NO: 411401 - DNA, 25 bp, Mus musculus
gaaatcgtggacactttaggtgaag

SEQ ID NO: 411402 - DNA, 25 bp, Mus musculus
gaaatcgtggactctttaggtgaag

SEQ ID NO: 411403 - DNA, 25 bp, Mus musculus
gaaatcgtgtgactacttgcatgga

SEQ ID NO: 411404 - DNA, 25 bp, Mus musculus
gaaatcgtgtgagtacttgcatgga

SEQ ID NO: 411405 - DNA, 25 bp, Mus musculus
gaaatcgttaaaccactcattttct

SEQ ID NO: 411406 - DNA, 25 bp, Mus musculus
gaaatcgttaaagcactcattttct

SEQ ID NO: 411407 - DNA, 25 bp, Mus musculus
gaaatcgttttcctcaccttgaaga

SEQ ID NO: 411408 - DNA, 25 bp, Mus musculus
gaaatcgttttcgtcaccttgaaga

SEQ ID NO: 411409 - DNA, 25 bp, Mus musculus
gaaatctaaccaattcttggtcacg

SEQ ID NO: 411410 - DNA, 25 bp, Mus musculus
gaaatctaaccatttcttggtcacg

SEQ ID NO: 411411 - DNA, 25 bp, Mus musculus
gaaatctaccaacgagcttcgagac

SEQ ID NO: 411412 - DNA, 25 bp, Mus musculus
gaaatctaccaaggagcttcgagac

SEQ ID NO: 411413 - DNA, 25 bp, Mus musculus
gaaatctaccatctgtcagatgatt

SEQ ID NO: 411414 - DNA, 25 bp, Mus musculus
gaaatctaccatgtgtcagatgatt

SEQ ID NO: 411415 - DNA, 25 bp, Mus musculus
gaaatctaccctctgaatttaaaat

SEQ ID NO: 411416 - DNA, 25 bp, Mus musculus
gaaatctaccctgtgaatttaaaat

SEQ ID NO: 411417 - DNA, 25 bp, Mus musculus
gaaatctactacaactgctgttact

SEQ ID NO: 411418 - DNA, 25 bp, Mus musculus
gaaatctactactactgctgttact

SEQ ID NO: 411419 - DNA, 25 bp, Mus musculus
gaaatctagtttctgcctattagca

SEQ ID NO: 411420 - DNA, 25 bp, Mus musculus
gaaatctagtttgtgcctattagca

SEQ ID NO: 411421 - DNA, 25 bp, Mus musculus
gaaatctataaacccatgagagcat

SEQ ID NO: 411422 - DNA, 25 bp, Mus musculus
gaaatctataaagccatgagagcat

SEQ ID NO: 411423 - DNA, 25 bp, Mus musculus
gaaatctatcccaatgtcatccagg

SEQ ID NO: 411424 - DNA, 25 bp, Mus musculus
gaaatctatccctatgtcatccagg

SEQ ID NO: 411425 - DNA, 25 bp, Mus musculus
gaaatctatgatcctcggaacccag

SEQ ID NO: 411426 - DNA, 25 bp, Mus musculus
gaaatctatgatgctcggaacccag

SEQ ID NO: 411427 - DNA, 25 bp, Mus musculus
gaaatctatgtactactgtttttga

SEQ ID NO: 411428 - DNA, 25 bp, Mus musculus
gaaatctatgtagtactgtttttga

SEQ ID NO: 411429 - DNA, 25 bp, Mus musculus
gaaatctatgtgattgtaacccttt

SEQ ID NO: 411430 - DNA, 25 bp, Mus musculus
gaaatctatgtgtttgtaacccttt

SEQ ID NO: 411431 - DNA, 25 bp, Mus musculus
gaaatctattgcagggactgtctga

SEQ ID NO: 411432 - DNA, 25 bp, Mus musculus
gaaatctattgctgggactgtctga

SEQ ID NO: 411433 - DNA, 25 bp, Mus musculus
gaaatctatttcattgacaggcaaa

SEQ ID NO: 411434 - DNA, 25 bp, Mus musculus
gaaatctatttctttgacaggcaaa

SEQ ID NO: 411435 - DNA, 25 bp, Mus musculus
gaaatctcaaccaaggactctataa

SEQ ID NO: 411436 - DNA, 25 bp, Mus musculus
gaaatctcaacctaggactctataa

SEQ ID NO: 411437 - DNA, 25 bp, Mus musculus
gaaatctcagataatggacctacac

SEQ ID NO: 411438 - DNA, 25 bp, Mus musculus
gaaatctcagatatggagtcttcgt

SEQ ID NO: 411439 - DNA, 25 bp, Mus musculus
gaaatctcagattatggacctacac

SEQ ID NO: 411440 - DNA, 25 bp, Mus musculus
gaaatctcagatttggagtcttcgt

SEQ ID NO: 411441 - DNA, 25 bp, Mus musculus
gaaatctcagctatggtagatccta

SEQ ID NO: 411442 - DNA, 25 bp, Mus musculus
gaaatctcagctttggtagatccta

SEQ ID NO: 411443 - DNA, 25 bp, Mus musculus
gaaatctcaggaacaaatctataga

SEQ ID NO: 411444 - DNA, 25 bp, Mus musculus
gaaatctcaggatcaaatctataga

SEQ ID NO: 411445 - DNA, 25 bp, Mus musculus
gaaatctcatcaaagaagctgtcac

SEQ ID NO: 411446 - DNA, 25 bp, Mus musculus
gaaatctcatcatagaagctgtcac

SEQ ID NO: 411447 - DNA, 25 bp, Mus musculus
gaaatctccaagagaaattccattc

SEQ ID NO: 411448 - DNA, 25 bp, Mus musculus
gaaatctccaagatcctagtggttt

SEQ ID NO: 411449 - DNA, 25 bp, Mus musculus
gaaatctccaagtgaaattccattc

SEQ ID NO: 411450 - DNA, 25 bp, Mus musculus
gaaatctccaagttcctagtggttt

SEQ ID NO: 411451 - DNA, 25 bp, Mus musculus
gaaatctccaatactgaactgcatg

SEQ ID NO: 411452 - DNA, 25 bp, Mus musculus
gaaatctccaatcactgttttgact

SEQ ID NO: 411453 - DNA, 25 bp, Mus musculus
gaaatctccaatgactgttttgact

SEQ ID NO: 411454 - DNA, 25 bp, Mus musculus
gaaatctccaattctgaactgcatg

SEQ ID NO: 411455 - DNA, 25 bp, Mus musculus
gaaatctccataatcctaattcttc

SEQ ID NO: 411456 - DNA, 25 bp, Mus musculus
gaaatctccatattcctaattcttc

SEQ ID NO: 411457 - DNA, 25 bp, Mus musculus
gaaatctccatccaaggctttgcgg

SEQ ID NO: 411458 - DNA, 25 bp, Mus musculus
gaaatctccatcgaaggctttgcgg

SEQ ID NO: 411459 - DNA, 25 bp, Mus musculus
gaaatctccgggagctagatccgat

SEQ ID NO: 411460 - DNA, 25 bp, Mus musculus
gaaatctccgggtgctagatccgat

SEQ ID NO: 411461 - DNA, 25 bp, Mus musculus
gaaatctcgaaaattaaagactctt

SEQ ID NO: 411462 - DNA, 25 bp, Mus musculus
gaaatctcgaaatttaaagactctt

SEQ ID NO: 411463 - DNA, 25 bp, Mus musculus
gaaatctcgggaaccagtggcggca

SEQ ID NO: 411464 - DNA, 25 bp, Mus musculus
gaaatctcgggaacggctgtctgct

SEQ ID NO: 411465 - DNA, 25 bp, Mus musculus
gaaatctcgggatccagtggcggca

SEQ ID NO: 411466 - DNA, 25 bp, Mus musculus
gaaatctcgggatcggctgtctgct

SEQ ID NO: 411467 - DNA, 25 bp, Mus musculus
gaaatctctcctagatgcttaccat

SEQ ID NO: 411468 - DNA, 25 bp, Mus musculus
gaaatctctccttgatgcttaccat

SEQ ID NO: 411469 - DNA, 25 bp, Mus musculus
gaaatctctcgtacttatgtgagtt

SEQ ID NO: 411470 - DNA, 25 bp, Mus musculus
gaaatctctcgttcttatgtgagtt

SEQ ID NO: 411471 - DNA, 25 bp, Mus musculus
gaaatctctcttatttgttctcttc

SEQ ID NO: 411472 - DNA, 25 bp, Mus musculus
gaaatctctcttttttgttctcttc

SEQ ID NO: 411473 - DNA, 25 bp, Mus musculus
gaaatctctgacatacaggcatgga

SEQ ID NO: 411474 - DNA, 25 bp, Mus musculus
gaaatctctgacttacaggcatgga

SEQ ID NO: 411475 - DNA, 25 bp, Mus musculus
gaaatctctgctactgctgtgttga

SEQ ID NO: 411476 - DNA, 25 bp, Mus musculus
gaaatctctgcttctgctgtgttga

SEQ ID NO: 411477 - DNA, 25 bp, Mus musculus
gaaatctctttcaccggcagggttt

SEQ ID NO: 411478 - DNA, 25 bp, Mus musculus
gaaatctctttctccggcagggttt

SEQ ID NO: 411479 - DNA, 25 bp, Mus musculus
gaaatctgaatgctactgccttcca

SEQ ID NO: 411480 - DNA, 25 bp, Mus musculus
gaaatctgaatggtactgccttcca

SEQ ID NO: 411481 - DNA, 25 bp, Mus musculus
gaaatctgactcatccattgaacaa

SEQ ID NO: 411482 - DNA, 25 bp, Mus musculus
gaaatctgactcttccattgaacaa

SEQ ID NO: 411483 - DNA, 25 bp, Mus musculus
gaaatctgaggtccttgctgtcaag

SEQ ID NO: 411484 - DNA, 25 bp, Mus musculus
gaaatctgaggtgcttgctgtcaag

SEQ ID NO: 411485 - DNA, 25 bp, Mus musculus
gaaatctgatccaagtacacctaag

SEQ ID NO: 411486 - DNA, 25 bp, Mus musculus
gaaatctgatcctagtacacctaag

SEQ ID NO: 411487 - DNA, 25 bp, Mus musculus
gaaatctgatctatgccgaacacca

SEQ ID NO: 411488 - DNA, 25 bp, Mus musculus
gaaatctgatctttgccgaacacca

SEQ ID NO: 411489 - DNA, 25 bp, Mus musculus
gaaatctgattccacttctaataac

SEQ ID NO: 411490 - DNA, 25 bp, Mus musculus
gaaatctgattcgacttctaataac

SEQ ID NO: 411491 - DNA, 25 bp, Mus musculus
gaaatctgccaaagacttgcctcct

SEQ ID NO: 411492 - DNA, 25 bp, Mus musculus
gaaatctgccaatgacttgcctcct

SEQ ID NO: 411493 - DNA, 25 bp, Mus musculus
gaaatctgccatctttttaaggaca

SEQ ID NO: 411494 - DNA, 25 bp, Mus musculus
gaaatctgccatgtttttaaggaca

SEQ ID NO: 411495 - DNA, 25 bp, Mus musculus
gaaatctgcctgaactgtatattgg

SEQ ID NO: 411496 - DNA, 25 bp, Mus musculus
gaaatctgcctgtactgtatattgg

SEQ ID NO: 411497 - DNA, 25 bp, Mus musculus
gaaatctgccttcatcataattgtg

SEQ ID NO: 411498 - DNA, 25 bp, Mus musculus
gaaatctgccttgatcataattgtg

SEQ ID NO: 411499 - DNA, 25 bp, Mus musculus
gaaatctgcggacagtacctgtgta

SEQ ID NO: 411500 - DNA, 25 bp, Mus musculus
gaaatctgcggagagtacctgtgta

SEQ ID NO: 411501 - DNA, 25 bp, Mus musculus
gaaatctgctgcacagagaacacct

SEQ ID NO: 411502 - DNA, 25 bp, Mus musculus
gaaatctgctgctcagagaacacct

SEQ ID NO: 411503 - DNA, 25 bp, Mus musculus
gaaatctgctgtcgactacaacaca

SEQ ID NO: 411504 - DNA, 25 bp, Mus musculus
gaaatctgctgtggactacaacaca

SEQ ID NO: 411505 - DNA, 25 bp, Mus musculus
gaaatctgcttcagccaaggctaag

SEQ ID NO: 411506 - DNA, 25 bp, Mus musculus
gaaatctgcttctgccaaggctaag

SEQ ID NO: 411507 - DNA, 25 bp, Mus musculus
gaaatctggcacaaatcatcttttt

SEQ ID NO: 411508 - DNA, 25 bp, Mus musculus
gaaatctggcactaatcatcttttt

SEQ ID NO: 411509 - DNA, 25 bp, Mus musculus
gaaatctggcttaacatgactcata

SEQ ID NO: 411510 - DNA, 25 bp, Mus musculus
gaaatctggcttagtttccacaagt

SEQ ID NO: 411511 - DNA, 25 bp, Mus musculus
gaaatctggctttacatgactcata

SEQ ID NO: 411512 - DNA, 25 bp, Mus musculus
gaaatctggctttgtttccacaagt

SEQ ID NO: 411513 - DNA, 25 bp, Mus musculus
gaaatctgggccatcatttttagtc

SEQ ID NO: 411514 - DNA, 25 bp, Mus musculus
gaaatctgggccttcatttttagtc

SEQ ID NO: 411515 - DNA, 25 bp, Mus musculus
gaaatctgggtacacttgacccctg

SEQ ID NO: 411516 - DNA, 25 bp, Mus musculus
gaaatctgggtagacttgacccctg

SEQ ID NO: 411517 - DNA, 25 bp, Mus musculus
gaaatctggtcaaaccaactgccct

SEQ ID NO: 411518 - DNA, 25 bp, Mus musculus
gaaatctggtcataccaactgccct

SEQ ID NO: 411519 - DNA, 25 bp, Mus musculus
gaaatctggtccacttatgagagtc

SEQ ID NO: 411520 - DNA, 25 bp, Mus musculus
gaaatctggtcctcttatgagagtc

SEQ ID NO: 411521 - DNA, 25 bp, Mus musculus
gaaatctggtgtacctcatattccc

SEQ ID NO: 411522 - DNA, 25 bp, Mus musculus
gaaatctggtgttcctcatattccc

SEQ ID NO: 411523 - DNA, 25 bp, Mus musculus
gaaatctgtctcctcttcaatgtca

SEQ ID NO: 411524 - DNA, 25 bp, Mus musculus
gaaatctgtctcgtcttcaatgtca

SEQ ID NO: 411525 - DNA, 25 bp, Mus musculus
gaaatctgtgaaattacccctgtcc

SEQ ID NO: 411526 - DNA, 25 bp, Mus musculus
gaaatctgtgaatttacccctgtcc

SEQ ID NO: 411527 - DNA, 25 bp, Mus musculus
gaaatctgtgctaccaagtgcctat

SEQ ID NO: 411528 - DNA, 25 bp, Mus musculus
gaaatctgtgcttccaagtgcctat

SEQ ID NO: 411529 - DNA, 25 bp, Mus musculus
gaaatctgtggtatgataaactgct

SEQ ID NO: 411530 - DNA, 25 bp, Mus musculus
gaaatctgtggtttgataaactgct

SEQ ID NO: 411531 - DNA, 25 bp, Mus musculus
gaaatctgttatagaagctcttaaa

SEQ ID NO: 411532 - DNA, 25 bp, Mus musculus
gaaatctgttattgaagctcttaaa

SEQ ID NO: 411533 - DNA, 25 bp, Mus musculus
gaaatctgttcaacccgaatactct

SEQ ID NO: 411534 - DNA, 25 bp, Mus musculus
gaaatctgttcatcccgaatactct

SEQ ID NO: 411535 - DNA, 25 bp, Mus musculus
gaaatctgtttcatgcatcctggaa

SEQ ID NO: 411536 - DNA, 25 bp, Mus musculus
gaaatctgtttcctgatgcaagtat

SEQ ID NO: 411537 - DNA, 25 bp, Mus musculus
gaaatctgtttcgtgatgcaagtat

SEQ ID NO: 411538 - DNA, 25 bp, Mus musculus
gaaatctgtttcttgcatcctggaa

SEQ ID NO: 411539 - DNA, 25 bp, Mus musculus
gaaatcttacaacgctcatcaccag

SEQ ID NO: 411540 - DNA, 25 bp, Mus musculus
gaaatcttacaaggctcatcaccag

SEQ ID NO: 411541 - DNA, 25 bp, Mus musculus
gaaatcttacacaatggtatcagaa

SEQ ID NO: 411542 - DNA, 25 bp, Mus musculus
gaaatcttacactatggtatcagaa

SEQ ID NO: 411543 - DNA, 25 bp, Mus musculus
gaaatcttactcaatagacagcaag

SEQ ID NO: 411544 - DNA, 25 bp, Mus musculus
gaaatcttactctatagacagcaag

SEQ ID NO: 411545 - DNA, 25 bp, Mus musculus
gaaatcttaggtcttcattcttgga

SEQ ID NO: 411546 - DNA, 25 bp, Mus musculus
gaaatcttaggtgttcattcttgga

SEQ ID NO: 411547 - DNA, 25 bp, Mus musculus
gaaatcttcaagagcagtctcccag

SEQ ID NO: 411548 - DNA, 25 bp, Mus musculus
gaaatcttcaagtgcagtctcccag

SEQ ID NO: 411549 - DNA, 25 bp, Mus musculus
gaaatcttcacaacgtactgtggat

SEQ ID NO: 411550 - DNA, 25 bp, Mus musculus
gaaatcttcacatcgtactgtggat

SEQ ID NO: 411551 - DNA, 25 bp, Mus musculus
gaaatcttcacgacttgttctgttt

SEQ ID NO: 411552 - DNA, 25 bp, Mus musculus
gaaatcttcacgtcttgttctgttt

SEQ ID NO: 411553 - DNA, 25 bp, Mus musculus
gaaatcttcaggacatcaatacagt

SEQ ID NO: 411554 - DNA, 25 bp, Mus musculus
gaaatcttcaggtcatcaatacagt

SEQ ID NO: 411555 - DNA, 25 bp, Mus musculus
gaaatcttcctgacaaattctggtt

SEQ ID NO: 411556 - DNA, 25 bp, Mus musculus
gaaatcttcctgtcaaattctggtt

SEQ ID NO: 411557 - DNA, 25 bp, Mus musculus
gaaatcttcgtccaagctgtttctt

SEQ ID NO: 411558 - DNA, 25 bp, Mus musculus
gaaatcttcgtcgaagctgtttctt

SEQ ID NO: 411559 - DNA, 25 bp, Mus musculus
gaaatcttctacacgtatgcttttg

SEQ ID NO: 411560 - DNA, 25 bp, Mus musculus
gaaatcttctactcgtatgcttttg

SEQ ID NO: 411561 - DNA, 25 bp, Mus musculus
gaaatcttctgtcattcatcctgga

SEQ ID NO: 411562 - DNA, 25 bp, Mus musculus
gaaatcttctgtgattcatcctgga

SEQ ID NO: 411563 - DNA, 25 bp, Mus musculus
gaaatcttgaaaactccaccaccaa

SEQ ID NO: 411564 - DNA, 25 bp, Mus musculus
gaaatcttgaaatctccaccaccaa

SEQ ID NO: 411565 - DNA, 25 bp, Mus musculus
gaaatcttgagaaccatgcttggcc

SEQ ID NO: 411566 - DNA, 25 bp, Mus musculus
gaaatcttgagaactctacagacaa

SEQ ID NO: 411567 - DNA, 25 bp, Mus musculus
gaaatcttgagatccatgcttggcc

SEQ ID NO: 411568 - DNA, 25 bp, Mus musculus
gaaatcttgagatctctacagacaa

SEQ ID NO: 411569 - DNA, 25 bp, Mus musculus
gaaatcttgcctcaggaacagaacc

SEQ ID NO: 411570 - DNA, 25 bp, Mus musculus
gaaatcttgcctgaggaacagaacc

SEQ ID NO: 411571 - DNA, 25 bp, Mus musculus
gaaatcttggccctactgaaagctc

SEQ ID NO: 411572 - DNA, 25 bp, Mus musculus
gaaatcttggccgtactgaaagctc

SEQ ID NO: 411573 - DNA, 25 bp, Mus musculus
gaaatcttggctatcttatttttgt

SEQ ID NO: 411574 - DNA, 25 bp, Mus musculus
gaaatcttggctttcttatttttgt

SEQ ID NO: 411575 - DNA, 25 bp, Mus musculus
gaaatcttgggcaaccgtgttattc

SEQ ID NO: 411576 - DNA, 25 bp, Mus musculus
gaaatcttgggctaccgtgttattc

SEQ ID NO: 411577 - DNA, 25 bp, Mus musculus
gaaatcttgtttccaagctaggtgt

SEQ ID NO: 411578 - DNA, 25 bp, Mus musculus
gaaatcttgtttgcaagctaggtgt

SEQ ID NO: 411579 - DNA, 25 bp, Mus musculus
gaaatctttaagacggtgttggtct

SEQ ID NO: 411580 - DNA, 25 bp, Mus musculus
gaaatctttaagtcggtgttggtct

SEQ ID NO: 411581 - DNA, 25 bp, Mus musculus
gaaatctttacaagcaccttcagga

SEQ ID NO: 411582 - DNA, 25 bp, Mus musculus
gaaatctttacatgcaccttcagga

SEQ ID NO: 411583 - DNA, 25 bp, Mus musculus
gaaatctttaggctcttgttcttaa

SEQ ID NO: 411584 - DNA, 25 bp, Mus musculus
gaaatctttagggtcttgttcttaa

SEQ ID NO: 411585 - DNA, 25 bp, Mus musculus
gaaatctttcctaagctggttggca

SEQ ID NO: 411586 - DNA, 25 bp, Mus musculus
gaaatctttccttagctggttggca

SEQ ID NO: 411587 - DNA, 25 bp, Mus musculus
gaaatctttctcatcttgctctatt

SEQ ID NO: 411588 - DNA, 25 bp, Mus musculus
gaaatctttctcttcttgctctatt

SEQ ID NO: 411589 - DNA, 25 bp, Mus musculus
gaaatctttcttactattgcaatac

SEQ ID NO: 411590 - DNA, 25 bp, Mus musculus
gaaatctttctttctattgcaatac

SEQ ID NO: 411591 - DNA, 25 bp, Mus musculus
gaaatctttgaaccagacaccgaca

SEQ ID NO: 411592 - DNA, 25 bp, Mus musculus
gaaatctttgaagcagacaccgaca

SEQ ID NO: 411593 - DNA, 25 bp, Mus musculus
gaaatctttgcaaatcttaaacctg

SEQ ID NO: 411594 - DNA, 25 bp, Mus musculus
gaaatctttgcatatcttaaacctg

SEQ ID NO: 411595 - DNA, 25 bp, Mus musculus
gaaatctttgctctatgtttttggc

SEQ ID NO: 411596 - DNA, 25 bp, Mus musculus
gaaatctttgctcttcaccagatgt

SEQ ID NO: 411597 - DNA, 25 bp, Mus musculus
gaaatctttgctgtatgtttttggc

SEQ ID NO: 411598 - DNA, 25 bp, Mus musculus
gaaatctttgctgttcaccagatgt

SEQ ID NO: 411599 - DNA, 25 bp, Mus musculus
gaaatctttggtattggctggaaat

SEQ ID NO: 411600 - DNA, 25 bp, Mus musculus
gaaatctttggttttggctggaaat

SEQ ID NO: 411601 - DNA, 25 bp, Mus musculus
gaaatcttttagatccctgggtcag

SEQ ID NO: 411602 - DNA, 25 bp, Mus musculus
gaaatcttttagttccctgggtcag

SEQ ID NO: 411603 - DNA, 25 bp, Mus musculus
gaaatcttttctcttgggcattcac

SEQ ID NO: 411604 - DNA, 25 bp, Mus musculus
gaaatcttttctgttgggcattcac

SEQ ID NO: 411605 - DNA, 25 bp, Mus musculus
gaaatctttttaacacagagcctag

SEQ ID NO: 411606 - DNA, 25 bp, Mus musculus
gaaatctttttatcacagagcctag

SEQ ID NO: 411607 - DNA, 25 bp, Mus musculus
gaaatctttttcagacctcagtggg

SEQ ID NO: 411608 - DNA, 25 bp, Mus musculus
gaaatctttttctgacctcagtggg

SEQ ID NO: 411609 - DNA, 25 bp, Mus musculus
gaaatgaaacctacagacactcgag

SEQ ID NO: 411610 - DNA, 25 bp, Mus musculus
gaaatgaaaccttcagacactcgag

SEQ ID NO: 411611 - DNA, 25 bp, Mus musculus
gaaatgaacagcatgtttgacgaag

SEQ ID NO: 411612 - DNA, 25 bp, Mus musculus
gaaatgaacagcttgtttgacgaag

SEQ ID NO: 411613 - DNA, 25 bp, Mus musculus
gaaatgaacatgcacgtcgcaggaa

SEQ ID NO: 411614 - DNA, 25 bp, Mus musculus
gaaatgaacatggacgtcgcaggaa

SEQ ID NO: 411615 - DNA, 25 bp, Mus musculus
gaaatgaacccactatgttttggcc

SEQ ID NO: 411616 - DNA, 25 bp, Mus musculus
gaaatgaacccagtatgttttggcc

SEQ ID NO: 411617 - DNA, 25 bp, Mus musculus
gaaatgaaccctacgtgcaggtgtg

SEQ ID NO: 411618 - DNA, 25 bp, Mus musculus
gaaatgaacccttcgtgcaggtgtg

SEQ ID NO: 411619 - DNA, 25 bp, Mus musculus
gaaatgaacctacgtgtccacactg

SEQ ID NO: 411620 - DNA, 25 bp, Mus musculus
gaaatgaacctaggtgtccacactg

SEQ ID NO: 411621 - DNA, 25 bp, Mus musculus
gaaatgaagacacaagatgaggagt

SEQ ID NO: 411622 - DNA, 25 bp, Mus musculus
gaaatgaagacagaagatgaggagt

SEQ ID NO: 411623 - DNA, 25 bp, Mus musculus
gaaatgaagattagcgtgtctataa

SEQ ID NO: 411624 - DNA, 25 bp, Mus musculus
gaaatgaagatttgcgtgtctataa

SEQ ID NO: 411625 - DNA, 25 bp, Mus musculus
gaaatgaagccaaagtacccacact

SEQ ID NO: 411626 - DNA, 25 bp, Mus musculus
gaaatgaagccatagtacccacact

SEQ ID NO: 411627 - DNA, 25 bp, Mus musculus
gaaatgaagcctctcagatccctcc

SEQ ID NO: 411628 - DNA, 25 bp, Mus musculus
gaaatgaagcctgtcagatccctcc

SEQ ID NO: 411629 - DNA, 25 bp, Mus musculus
gaaatgaaggtcctacactctccct

SEQ ID NO: 411630 - DNA, 25 bp, Mus musculus
gaaatgaaggtcgtacactctccct

SEQ ID NO: 411631 - DNA, 25 bp, Mus musculus
gaaatgaagtcaccttgcctttaga

SEQ ID NO: 411632 - DNA, 25 bp, Mus musculus
gaaatgaagtcagcttgcctttaga

SEQ ID NO: 411633 - DNA, 25 bp, Mus musculus
gaaatgaagtgtagccttgtatact

SEQ ID NO: 411634 - DNA, 25 bp, Mus musculus
gaaatgaagtgttgccttgtatact

SEQ ID NO: 411635 - DNA, 25 bp, Mus musculus
gaaatgaataggacaatggctccct

SEQ ID NO: 411636 - DNA, 25 bp, Mus musculus
gaaatgaataggtcaatggctccct

SEQ ID NO: 411637 - DNA, 25 bp, Mus musculus
gaaatgaatcagatgctgagtgcta

SEQ ID NO: 411638 - DNA, 25 bp, Mus musculus
gaaatgaatcagttgctgagtgcta

SEQ ID NO: 411639 - DNA, 25 bp, Mus musculus
gaaatgaatgtaactacgtcccaaa

SEQ ID NO: 411640 - DNA, 25 bp, Mus musculus
gaaatgaatgtatctacgtcccaaa

SEQ ID NO: 411641 - DNA, 25 bp, Mus musculus
gaaatgaattccacggtccaagagg

SEQ ID NO: 411642 - DNA, 25 bp, Mus musculus
gaaatgaattcctcggtccaagagg

SEQ ID NO: 411643 - DNA, 25 bp, Mus musculus
gaaatgaattctatgttcccacact

SEQ ID NO: 411644 - DNA, 25 bp, Mus musculus
gaaatgaattctttgttcccacact

SEQ ID NO: 411645 - DNA, 25 bp, Mus musculus
gaaatgacatacatgactggtctct

SEQ ID NO: 411646 - DNA, 25 bp, Mus musculus
gaaatgacatacttgactggtctct

SEQ ID NO: 411647 - DNA, 25 bp, Mus musculus
gaaatgaccatccagacgacgcaag

SEQ ID NO: 411648 - DNA, 25 bp, Mus musculus
gaaatgaccatcgagacgacgcaag

SEQ ID NO: 411649 - DNA, 25 bp, Mus musculus
gaaatgaccattatccagggacctt

SEQ ID NO: 411650 - DNA, 25 bp, Mus musculus
gaaatgaccattcaaacctatagtg

SEQ ID NO: 411651 - DNA, 25 bp, Mus musculus
gaaatgaccattgaaacctatagtg

SEQ ID NO: 411652 - DNA, 25 bp, Mus musculus
gaaatgaccattttccagggacctt

SEQ ID NO: 411653 - DNA, 25 bp, Mus musculus
gaaatgaccgacaaggactggccca

SEQ ID NO: 411654 - DNA, 25 bp, Mus musculus
gaaatgaccgactaggactggccca

SEQ ID NO: 411655 - DNA, 25 bp, Mus musculus
gaaatgaccggcatccgtgctgcta

SEQ ID NO: 411656 - DNA, 25 bp, Mus musculus
gaaatgaccggcttccgtgctgcta

SEQ ID NO: 411657 - DNA, 25 bp, Mus musculus
gaaatgactatacccaccgtggacg

SEQ ID NO: 411658 - DNA, 25 bp, Mus musculus
gaaatgactatagccaccgtggacg

SEQ ID NO: 411659 - DNA, 25 bp, Mus musculus
gaaatgactcatcttcagacacaac

SEQ ID NO: 411660 - DNA, 25 bp, Mus musculus
gaaatgactcatgttcagacacaac

SEQ ID NO: 411661 - DNA, 25 bp, Mus musculus
gaaatgactccgagtgcttgggttt

SEQ ID NO: 411662 - DNA, 25 bp, Mus musculus
gaaatgactccgtgtgcttgggttt

SEQ ID NO: 411663 - DNA, 25 bp, Mus musculus
gaaatgactcctcttataaagtcag

SEQ ID NO: 411664 - DNA, 25 bp, Mus musculus
gaaatgactcctgttataaagtcag

SEQ ID NO: 411665 - DNA, 25 bp, Mus musculus
gaaatgactgcgattggtgaacaaa

SEQ ID NO: 411666 - DNA, 25 bp, Mus musculus
gaaatgactgcgtttggtgaacaaa

SEQ ID NO: 411667 - DNA, 25 bp, Mus musculus
gaaatgactgctcgtttgctgtact

SEQ ID NO: 411668 - DNA, 25 bp, Mus musculus
gaaatgactgctggtttgctgtact

SEQ ID NO: 411669 - DNA, 25 bp, Mus musculus
gaaatgactgtcacacattctgtgt

SEQ ID NO: 411670 - DNA, 25 bp, Mus musculus
gaaatgactgtctcacattctgtgt

SEQ ID NO: 411671 - DNA, 25 bp, Mus musculus
gaaatgagaaccacagaccccagaa

SEQ ID NO: 411672 - DNA, 25 bp, Mus musculus
gaaatgagaacctcagaccccagaa

SEQ ID NO: 411673 - DNA, 25 bp, Mus musculus
gaaatgagagtacatccaggtgaaa

SEQ ID NO: 411674 - DNA, 25 bp, Mus musculus
gaaatgagagtagatccaggtgaaa

SEQ ID NO: 411675 - DNA, 25 bp, Mus musculus
gaaatgagccatccgatattcctag

SEQ ID NO: 411676 - DNA, 25 bp, Mus musculus
gaaatgagccatgcgatattcctag

SEQ ID NO: 411677 - DNA, 25 bp, Mus musculus
gaaatgagccggcatacagccctgt

SEQ ID NO: 411678 - DNA, 25 bp, Mus musculus
gaaatgagccgggatacagccctgt

SEQ ID NO: 411679 - DNA, 25 bp, Mus musculus
gaaatgagcggtattggctaccaaa

SEQ ID NO: 411680 - DNA, 25 bp, Mus musculus
gaaatgagcggttttggctaccaaa

SEQ ID NO: 411681 - DNA, 25 bp, Mus musculus
gaaatgagctaacatgtgtccctaa

SEQ ID NO: 411682 - DNA, 25 bp, Mus musculus
gaaatgagctaagatgtgtccctaa

SEQ ID NO: 411683 - DNA, 25 bp, Mus musculus
gaaatgagctcactgtggcagatgt

SEQ ID NO: 411684 - DNA, 25 bp, Mus musculus
gaaatgagctcagtgtggcagatgt

SEQ ID NO: 411685 - DNA, 25 bp, Mus musculus
gaaatgagcttcaagctttgacctt

SEQ ID NO: 411686 - DNA, 25 bp, Mus musculus
gaaatgagcttctagctttgacctt

SEQ ID NO: 411687 - DNA, 25 bp, Mus musculus
gaaatgaggtgcacagaccggtgct

SEQ ID NO: 411688 - DNA, 25 bp, Mus musculus
gaaatgaggtgctcagaccggtgct

SEQ ID NO: 411689 - DNA, 25 bp, Mus musculus
gaaatgagtcaaaggttaactaact

SEQ ID NO: 411690 - DNA, 25 bp, Mus musculus
gaaatgagtcaatggttaactaact

SEQ ID NO: 411691 - DNA, 25 bp, Mus musculus
gaaatgagtgctatattttctttct

SEQ ID NO: 411692 - DNA, 25 bp, Mus musculus
gaaatgagtgctttattttctttct

SEQ ID NO: 411693 - DNA, 25 bp, Mus musculus
gaaatgagtggtcgccacagtctgt

SEQ ID NO: 411694 - DNA, 25 bp, Mus musculus
gaaatgagtggtggccacagtctgt

SEQ ID NO: 411695 - DNA, 25 bp, Mus musculus
gaaatgagtgtcatctactctgtcc

SEQ ID NO: 411696 - DNA, 25 bp, Mus musculus
gaaatgagtgtcttctactctgtcc

SEQ ID NO: 411697 - DNA, 25 bp, Mus musculus
gaaatgagttgtcagcctgcagtgc

SEQ ID NO: 411698 - DNA, 25 bp, Mus musculus
gaaatgagttgtgagcctgcagtgc

SEQ ID NO: 411699 - DNA, 25 bp, Mus musculus
gaaatgatacgaattagtcctcctt

SEQ ID NO: 411700 - DNA, 25 bp, Mus musculus
gaaatgatacgatttagtcctcctt

SEQ ID NO: 411701 - DNA, 25 bp, Mus musculus
gaaatgatatggagcctttgaacta

SEQ ID NO: 411702 - DNA, 25 bp, Mus musculus
gaaatgatatggtgcctttgaacta

SEQ ID NO: 411703 - DNA, 25 bp, Mus musculus
gaaatgatcaacaccagggcctact

SEQ ID NO: 411704 - DNA, 25 bp, Mus musculus
gaaatgatcaacattagcatccatc

SEQ ID NO: 411705 - DNA, 25 bp, Mus musculus
gaaatgatcaactccagggcctact

SEQ ID NO: 411706 - DNA, 25 bp, Mus musculus
gaaatgatcaactttagcatccatc

SEQ ID NO: 411707 - DNA, 25 bp, Mus musculus
gaaatgatctgcaccagccaaactt

SEQ ID NO: 411708 - DNA, 25 bp, Mus musculus
gaaatgatctgctccagccaaactt

SEQ ID NO: 411709 - DNA, 25 bp, Mus musculus
gaaatgatgattccgctttgttctc

SEQ ID NO: 411710 - DNA, 25 bp, Mus musculus
gaaatgatgattgcgctttgttctc

SEQ ID NO: 411711 - DNA, 25 bp, Mus musculus
gaaatgatgcagcttgctccttcct

SEQ ID NO: 411712 - DNA, 25 bp, Mus musculus
gaaatgatgcaggttgctccttcct

SEQ ID NO: 411713 - DNA, 25 bp, Mus musculus
gaaatgatgcgtattaacagggcta

SEQ ID NO: 411714 - DNA, 25 bp, Mus musculus
gaaatgatgcgttttaacagggcta

SEQ ID NO: 411715 - DNA, 25 bp, Mus musculus
gaaatgatgtacatgcggcactcat

SEQ ID NO: 411716 - DNA, 25 bp, Mus musculus
gaaatgatgtacttgcggcactcat

SEQ ID NO: 411717 - DNA, 25 bp, Mus musculus
gaaatgatgtgtatactccagatag

SEQ ID NO: 411718 - DNA, 25 bp, Mus musculus
gaaatgatgtgtttactccagatag

SEQ ID NO: 411719 - DNA, 25 bp, Mus musculus
gaaatgattaatactggaacccttc

SEQ ID NO: 411720 - DNA, 25 bp, Mus musculus
gaaatgattaattctggaacccttc

SEQ ID NO: 411721 - DNA, 25 bp, Mus musculus
gaaatgattactacaggctgcagat

SEQ ID NO: 411722 - DNA, 25 bp, Mus musculus
gaaatgattacttcaggctgcagat

SEQ ID NO: 411723 - DNA, 25 bp, Mus musculus
gaaatgattcccaccgtcttaaata

SEQ ID NO: 411724 - DNA, 25 bp, Mus musculus
gaaatgattccctccgtcttaaata

SEQ ID NO: 411725 - DNA, 25 bp, Mus musculus
gaaatgattgatcccagttaccctt

SEQ ID NO: 411726 - DNA, 25 bp, Mus musculus
gaaatgattgatgccagttaccctt

SEQ ID NO: 411727 - DNA, 25 bp, Mus musculus
gaaatgattgttcatcagtcttgat

SEQ ID NO: 411728 - DNA, 25 bp, Mus musculus
gaaatgattgttgatcagtcttgat

SEQ ID NO: 411729 - DNA, 25 bp, Mus musculus
gaaatgattttcatctctacttgtg

SEQ ID NO: 411730 - DNA, 25 bp, Mus musculus
gaaatgattttcttctctacttgtg

SEQ ID NO: 411731 - DNA, 25 bp, Mus musculus
gaaatgcaacgacatcatccatcat

SEQ ID NO: 411732 - DNA, 25 bp, Mus musculus
gaaatgcaacgagatcatccatcat

SEQ ID NO: 411733 - DNA, 25 bp, Mus musculus
gaaatgcaacgtcacctcaagtaca

SEQ ID NO: 411734 - DNA, 25 bp, Mus musculus
gaaatgcaacgtgacctcaagtaca

SEQ ID NO: 411735 - DNA, 25 bp, Mus musculus
gaaatgcaacttagtatcacttaag

SEQ ID NO: 411736 - DNA, 25 bp, Mus musculus
gaaatgcaactttgtatcacttaag

SEQ ID NO: 411737 - DNA, 25 bp, Mus musculus
gaaatgcaagcccaaggcacctgag

SEQ ID NO: 411738 - DNA, 25 bp, Mus musculus
gaaatgcaagccgaaggcacctgag

SEQ ID NO: 411739 - DNA, 25 bp, Mus musculus
gaaatgcaataaacttccaagttat

SEQ ID NO: 411740 - DNA, 25 bp, Mus musculus
gaaatgcaataatcttccaagttat

SEQ ID NO: 411741 - DNA, 25 bp, Mus musculus
gaaatgcaatccatctgtcatggaa

SEQ ID NO: 411742 - DNA, 25 bp, Mus musculus
gaaatgcaatccttctgtcatggaa

SEQ ID NO: 411743 - DNA, 25 bp, Mus musculus
gaaatgcaatgcagccgaagccttt

SEQ ID NO: 411744 - DNA, 25 bp, Mus musculus
gaaatgcaatgctgccgaagccttt

SEQ ID NO: 411745 - DNA, 25 bp, Mus musculus
gaaatgcacaaacttccaagacatg

SEQ ID NO: 411746 - DNA, 25 bp, Mus musculus
gaaatgcacaaagttccaagacatg

SEQ ID NO: 411747 - DNA, 25 bp, Mus musculus
gaaatgcacaccaaaaatactcaca

SEQ ID NO: 411748 - DNA, 25 bp, Mus musculus
gaaatgcacacctaaaatactcaca

SEQ ID NO: 411749 - DNA, 25 bp, Mus musculus
gaaatgcacactataacctgtcaag

SEQ ID NO: 411750 - DNA, 25 bp, Mus musculus
gaaatgcacactttaacctgtcaag

SEQ ID NO: 411751 - DNA, 25 bp, Mus musculus
gaaatgcacatacccaagtcttgac

SEQ ID NO: 411752 - DNA, 25 bp, Mus musculus
gaaatgcacatacccggtcctcaag

SEQ ID NO: 411753 - DNA, 25 bp, Mus musculus
gaaatgcacatagccaagtcttgac

SEQ ID NO: 411754 - DNA, 25 bp, Mus musculus
gaaatgcacatagccggtcctcaag

SEQ ID NO: 411755 - DNA, 25 bp, Mus musculus
gaaatgcacattattatctgtctct

SEQ ID NO: 411756 - DNA, 25 bp, Mus musculus
gaaatgcacattcactacagtaaat

SEQ ID NO: 411757 - DNA, 25 bp, Mus musculus
gaaatgcacattgactacagtaaat

SEQ ID NO: 411758 - DNA, 25 bp, Mus musculus
gaaatgcacatttttatctgtctct

SEQ ID NO: 411759 - DNA, 25 bp, Mus musculus
gaaatgcacgcaccttttgtgccat

SEQ ID NO: 411760 - DNA, 25 bp, Mus musculus
gaaatgcacgcagcttttgtgccat

SEQ ID NO: 411761 - DNA, 25 bp, Mus musculus
gaaatgcactctatatcatcctaag

SEQ ID NO: 411762 - DNA, 25 bp, Mus musculus
gaaatgcactctttatcatcctaag

SEQ ID NO: 411763 - DNA, 25 bp, Mus musculus
gaaatgcactgtactgttagcgtct

SEQ ID NO: 411764 - DNA, 25 bp, Mus musculus
gaaatgcactgttctgttagcgtct

SEQ ID NO: 411765 - DNA, 25 bp, Mus musculus
gaaatgcacttaatccaaagatact

SEQ ID NO: 411766 - DNA, 25 bp, Mus musculus
gaaatgcacttaatcttattacagg

SEQ ID NO: 411767 - DNA, 25 bp, Mus musculus
gaaatgcacttattccaaagatact

SEQ ID NO: 411768 - DNA, 25 bp, Mus musculus
gaaatgcacttattcttattacagg

SEQ ID NO: 411769 - DNA, 25 bp, Mus musculus
gaaatgcagcccattctggtttgtc

SEQ ID NO: 411770 - DNA, 25 bp, Mus musculus
gaaatgcagccctttctggtttgtc

SEQ ID NO: 411771 - DNA, 25 bp, Mus musculus
gaaatgcagcctaatgctagctata

SEQ ID NO: 411772 - DNA, 25 bp, Mus musculus
gaaatgcagccttatgctagctata

SEQ ID NO: 411773 - DNA, 25 bp, Mus musculus
gaaatgcagcgtcaacatctcgaac

SEQ ID NO: 411774 - DNA, 25 bp, Mus musculus
gaaatgcagcgtgaacatctcgaac

SEQ ID NO: 411775 - DNA, 25 bp, Mus musculus
gaaatgcaggccagctagatctctt

SEQ ID NO: 411776 - DNA, 25 bp, Mus musculus
gaaatgcaggcctgctagatctctt

SEQ ID NO: 411777 - DNA, 25 bp, Mus musculus
gaaatgcaggttactcagcaactcc

SEQ ID NO: 411778 - DNA, 25 bp, Mus musculus
gaaatgcaggtttctcagcaactcc

SEQ ID NO: 411779 - DNA, 25 bp, Mus musculus
gaaatgcagtgcaaatttataaaat

SEQ ID NO: 411780 - DNA, 25 bp, Mus musculus
gaaatgcagtgctaatttataaaat

SEQ ID NO: 411781 - DNA, 25 bp, Mus musculus
gaaatgcagttcagctcttgcccta

SEQ ID NO: 411782 - DNA, 25 bp, Mus musculus
gaaatgcagttctgctcttgcccta

SEQ ID NO: 411783 - DNA, 25 bp, Mus musculus
gaaatgcatactatgtgcctgaatg

SEQ ID NO: 411784 - DNA, 25 bp, Mus musculus
gaaatgcatactttgtgcctgaatg

SEQ ID NO: 411785 - DNA, 25 bp, Mus musculus
gaaatgcatcgccatgtgcatggac

SEQ ID NO: 411786 - DNA, 25 bp, Mus musculus
gaaatgcatcgcctcatcagggacc

SEQ ID NO: 411787 - DNA, 25 bp, Mus musculus
gaaatgcatcgcgatgtgcatggac

SEQ ID NO: 411788 - DNA, 25 bp, Mus musculus
gaaatgcatcgcgtcatcagggacc

SEQ ID NO: 411789 - DNA, 25 bp, Mus musculus
gaaatgcatcttctggtgcaccgtc

SEQ ID NO: 411790 - DNA, 25 bp, Mus musculus
gaaatgcatcttgtggtgcaccgtc

SEQ ID NO: 411791 - DNA, 25 bp, Mus musculus
gaaatgcattatcatttagcacatc

SEQ ID NO: 411792 - DNA, 25 bp, Mus musculus
gaaatgcattatgatttagcacatc

SEQ ID NO: 411793 - DNA, 25 bp, Mus musculus
gaaatgcattcaatctgcatccttt

SEQ ID NO: 411794 - DNA, 25 bp, Mus musculus
gaaatgcattcacaccctcaggtgt

SEQ ID NO: 411795 - DNA, 25 bp, Mus musculus
gaaatgcattcagaccctcaggtgt

SEQ ID NO: 411796 - DNA, 25 bp, Mus musculus
gaaatgcattcattctgcatccttt

SEQ ID NO: 411797 - DNA, 25 bp, Mus musculus
gaaatgcattccatatcaaaacaca

SEQ ID NO: 411798 - DNA, 25 bp, Mus musculus
gaaatgcattccttatcaaaacaca

SEQ ID NO: 411799 - DNA, 25 bp, Mus musculus
gaaatgcattctcccaaccgggtgg

SEQ ID NO: 411800 - DNA, 25 bp, Mus musculus
gaaatgcattctgccaaccgggtgg

SEQ ID NO: 411801 - DNA, 25 bp, Mus musculus
gaaatgcattgaaattctcatcgaa

SEQ ID NO: 411802 - DNA, 25 bp, Mus musculus
gaaatgcattgatattctcatcgaa

SEQ ID NO: 411803 - DNA, 25 bp, Mus musculus
gaaatgcattgcatacacatgaagt

SEQ ID NO: 411804 - DNA, 25 bp, Mus musculus
gaaatgcattgcttacacatgaagt

SEQ ID NO: 411805 - DNA, 25 bp, Mus musculus
gaaatgcattgtcatcatcccgaac

SEQ ID NO: 411806 - DNA, 25 bp, Mus musculus
gaaatgcattgtgatcatcccgaac

SEQ ID NO: 411807 - DNA, 25 bp, Mus musculus
gaaatgcattttcacagaaatcaag

SEQ ID NO: 411808 - DNA, 25 bp, Mus musculus
gaaatgcattttgacagaaatcaag

SEQ ID NO: 411809 - DNA, 25 bp, Mus musculus
gaaatgccaagcagctgcacgactt

SEQ ID NO: 411810 - DNA, 25 bp, Mus musculus
gaaatgccaagctgctgcacgactt

SEQ ID NO: 411811 - DNA, 25 bp, Mus musculus
gaaatgccaagtccccaagaaaacc

SEQ ID NO: 411812 - DNA, 25 bp, Mus musculus
gaaatgccaagtgcccaagaaaacc

SEQ ID NO: 411813 - DNA, 25 bp, Mus musculus
gaaatgccacataggttaagtgcca

SEQ ID NO: 411814 - DNA, 25 bp, Mus musculus
gaaatgccacattggttaagtgcca

SEQ ID NO: 411815 - DNA, 25 bp, Mus musculus
gaaatgccaccgaactgaagccgga

SEQ ID NO: 411816 - DNA, 25 bp, Mus musculus
gaaatgccaccgtactgaagccgga

SEQ ID NO: 411817 - DNA, 25 bp, Mus musculus
gaaatgccacttaatttctgctggc

SEQ ID NO: 411818 - DNA, 25 bp, Mus musculus
gaaatgccactttatttctgctggc

SEQ ID NO: 411819 - DNA, 25 bp, Mus musculus
gaaatgccagcccatgccagggaag

SEQ ID NO: 411820 - DNA, 25 bp, Mus musculus
gaaatgccagccgatgccagggaag

SEQ ID NO: 411821 - DNA, 25 bp, Mus musculus
gaaatgccagctcaaaaatcagtct

SEQ ID NO: 411822 - DNA, 25 bp, Mus musculus
gaaatgccagctgaaaaatcagtct

SEQ ID NO: 411823 - DNA, 25 bp, Mus musculus
gaaatgccagttcatcaggaagcca

SEQ ID NO: 411824 - DNA, 25 bp, Mus musculus
gaaatgccagttgatcaggaagcca

SEQ ID NO: 411825 - DNA, 25 bp, Mus musculus
gaaatgccatatacttgccttcatg

SEQ ID NO: 411826 - DNA, 25 bp, Mus musculus
gaaatgccatattcttgccttcatg

SEQ ID NO: 411827 - DNA, 25 bp, Mus musculus
gaaatgccatccagacacagtggga

SEQ ID NO: 411828 - DNA, 25 bp, Mus musculus
gaaatgccatcctgacacagtggga

SEQ ID NO: 411829 - DNA, 25 bp, Mus musculus
gaaatgccatgaaattccacatagg

SEQ ID NO: 411830 - DNA, 25 bp, Mus musculus
gaaatgccatgatattccacatagg

SEQ ID NO: 411831 - DNA, 25 bp, Mus musculus
gaaatgccattgagatgtacttaat

SEQ ID NO: 411832 - DNA, 25 bp, Mus musculus
gaaatgccattgtgatgtacttaat

SEQ ID NO: 411833 - DNA, 25 bp, Mus musculus
gaaatgcccaatcctttgtgaagag

SEQ ID NO: 411834 - DNA, 25 bp, Mus musculus
gaaatgcccaatgctttgtgaagag

SEQ ID NO: 411835 - DNA, 25 bp, Mus musculus
gaaatgcccactccagataccacag

SEQ ID NO: 411836 - DNA, 25 bp, Mus musculus
gaaatgcccactgcagataccacag

SEQ ID NO: 411837 - DNA, 25 bp, Mus musculus
gaaatgcccataacattgctaccca

SEQ ID NO: 411838 - DNA, 25 bp, Mus musculus
gaaatgcccataagcttcaggccca

SEQ ID NO: 411839 - DNA, 25 bp, Mus musculus
gaaatgcccatatcattgctaccca

SEQ ID NO: 411840 - DNA, 25 bp, Mus musculus
gaaatgcccatatgcttcaggccca

SEQ ID NO: 411841 - DNA, 25 bp, Mus musculus
gaaatgcccatcacgggatctattt

SEQ ID NO: 411842 - DNA, 25 bp, Mus musculus
gaaatgcccatctcgggatctattt

SEQ ID NO: 411843 - DNA, 25 bp, Mus musculus
gaaatgcccctaaggtcatgactct

SEQ ID NO: 411844 - DNA, 25 bp, Mus musculus
gaaatgcccctatggtcatgactct

SEQ ID NO: 411845 - DNA, 25 bp, Mus musculus
gaaatgcccctgattatatctgtag

SEQ ID NO: 411846 - DNA, 25 bp, Mus musculus
gaaatgcccctgtttatatctgtag

SEQ ID NO: 411847 - DNA, 25 bp, Mus musculus
gaaatgccctatattaggtgcactt

SEQ ID NO: 411848 - DNA, 25 bp, Mus musculus
gaaatgccctattttaggtgcactt

SEQ ID NO: 411849 - DNA, 25 bp, Mus musculus
gaaatgccctgactgtaccaatgta

SEQ ID NO: 411850 - DNA, 25 bp, Mus musculus
gaaatgccctgagtgtaccaatgta

SEQ ID NO: 411851 - DNA, 25 bp, Mus musculus
gaaatgccctgtatggtcatacaag

SEQ ID NO: 411852 - DNA, 25 bp, Mus musculus
gaaatgccctgtttggtcatacaag

SEQ ID NO: 411853 - DNA, 25 bp, Mus musculus
gaaatgcccttcacccataagtgaa

SEQ ID NO: 411854 - DNA, 25 bp, Mus musculus
gaaatgcccttcaggtttgcagctg

SEQ ID NO: 411855 - DNA, 25 bp, Mus musculus
gaaatgcccttctcccataagtgaa

SEQ ID NO: 411856 - DNA, 25 bp, Mus musculus
gaaatgcccttctggtttgcagctg

SEQ ID NO: 411857 - DNA, 25 bp, Mus musculus
gaaatgccgcccaaaatatgaaatt

SEQ ID NO: 411858 - DNA, 25 bp, Mus musculus
gaaatgccgccctaaatatgaaatt

SEQ ID NO: 411859 - DNA, 25 bp, Mus musculus
gaaatgccgtctctcatcgaataaa

SEQ ID NO: 411860 - DNA, 25 bp, Mus musculus
gaaatgccgtctgtcatcgaataaa

SEQ ID NO: 411861 - DNA, 25 bp, Mus musculus
gaaatgcctcagcaagcacgtcaga

SEQ ID NO: 411862 - DNA, 25 bp, Mus musculus
gaaatgcctcaggaagcacgtcaga

SEQ ID NO: 411863 - DNA, 25 bp, Mus musculus
gaaatgcctcccaaaggttgggcaa

SEQ ID NO: 411864 - DNA, 25 bp, Mus musculus
gaaatgcctccctaaggttgggcaa

SEQ ID NO: 411865 - DNA, 25 bp, Mus musculus
gaaatgcctctgaaaccatgagccc

SEQ ID NO: 411866 - DNA, 25 bp, Mus musculus
gaaatgcctctgagagctgtcacaa

SEQ ID NO: 411867 - DNA, 25 bp, Mus musculus
gaaatgcctctgtaaccatgagccc

SEQ ID NO: 411868 - DNA, 25 bp, Mus musculus
gaaatgcctctgtgagctgtcacaa

SEQ ID NO: 411869 - DNA, 25 bp, Mus musculus
gaaatgcctgagataatgtgacctt

SEQ ID NO: 411870 - DNA, 25 bp, Mus musculus
gaaatgcctgagttaatgtgacctt

SEQ ID NO: 411871 - DNA, 25 bp, Mus musculus
gaaatgcctgatccctggggatgaa

SEQ ID NO: 411872 - DNA, 25 bp, Mus musculus
gaaatgcctgatctgtttctttccc

SEQ ID NO: 411873 - DNA, 25 bp, Mus musculus
gaaatgcctgatgcctggggatgaa

SEQ ID NO: 411874 - DNA, 25 bp, Mus musculus
gaaatgcctgatgtgtttctttccc

SEQ ID NO: 411875 - DNA, 25 bp, Mus musculus
gaaatgcctgccattcgcaatgcaa

SEQ ID NO: 411876 - DNA, 25 bp, Mus musculus
gaaatgcctgccctgtatgaacaaa

SEQ ID NO: 411877 - DNA, 25 bp, Mus musculus
gaaatgcctgccgtgtatgaacaaa

SEQ ID NO: 411878 - DNA, 25 bp, Mus musculus
gaaatgcctgcctttcgcaatgcaa

SEQ ID NO: 411879 - DNA, 25 bp, Mus musculus
gaaatgcctggcctggagagctctc

SEQ ID NO: 411880 - DNA, 25 bp, Mus musculus
gaaatgcctggcgtggagagctctc

SEQ ID NO: 411881 - DNA, 25 bp, Mus musculus
gaaatgcctgtgagagctgagctca

SEQ ID NO: 411882 - DNA, 25 bp, Mus musculus
gaaatgcctgtgtgagctgagctca

SEQ ID NO: 411883 - DNA, 25 bp, Mus musculus
gaaatgcctttcaaggaatccacag

SEQ ID NO: 411884 - DNA, 25 bp, Mus musculus
gaaatgcctttctaggaatccacag

SEQ ID NO: 411885 - DNA, 25 bp, Mus musculus
gaaatgcggattattaatctgtatg

SEQ ID NO: 411886 - DNA, 25 bp, Mus musculus
gaaatgcggatttttaatctgtatg

SEQ ID NO: 411887 - DNA, 25 bp, Mus musculus
gaaatgcgtcacaaaggccaaggca

SEQ ID NO: 411888 - DNA, 25 bp, Mus musculus
gaaatgcgtcactaaggccaaggca

SEQ ID NO: 411889 - DNA, 25 bp, Mus musculus
gaaatgcgtcatctagtgcaaggaa

SEQ ID NO: 411890 - DNA, 25 bp, Mus musculus
gaaatgcgtcatgtagtgcaaggaa

SEQ ID NO: 411891 - DNA, 25 bp, Mus musculus
gaaatgcgtctactgcttaaactgt

SEQ ID NO: 411892 - DNA, 25 bp, Mus musculus
gaaatgcgtctagtgcttaaactgt

SEQ ID NO: 411893 - DNA, 25 bp, Mus musculus
gaaatgctaaatcagttgtatcaca

SEQ ID NO: 411894 - DNA, 25 bp, Mus musculus
gaaatgctaaatgagttgtatcaca

SEQ ID NO: 411895 - DNA, 25 bp, Mus musculus
gaaatgctaccgcagcaatgcctac

SEQ ID NO: 411896 - DNA, 25 bp, Mus musculus
gaaatgctaccggagcaatgcctac

SEQ ID NO: 411897 - DNA, 25 bp, Mus musculus
gaaatgctacgactttgatgagtgt

SEQ ID NO: 411898 - DNA, 25 bp, Mus musculus
gaaatgctacgagtttgatgagtgt

SEQ ID NO: 411899 - DNA, 25 bp, Mus musculus
gaaatgctacttagtctccatgact

SEQ ID NO: 411900 - DNA, 25 bp, Mus musculus
gaaatgctactttgtctccatgact

SEQ ID NO: 411901 - DNA, 25 bp, Mus musculus
gaaatgctagcactcctcaaagagg

SEQ ID NO: 411902 - DNA, 25 bp, Mus musculus
gaaatgctagcagtcctcaaagagg

SEQ ID NO: 411903 - DNA, 25 bp, Mus musculus
gaaatgctatatcaaagtctgctac

SEQ ID NO: 411904 - DNA, 25 bp, Mus musculus
gaaatgctatatgaaagtctgctac

SEQ ID NO: 411905 - DNA, 25 bp, Mus musculus
gaaatgctatgaaggctcctcagcc

SEQ ID NO: 411906 - DNA, 25 bp, Mus musculus
gaaatgctatgatggctcctcagcc

SEQ ID NO: 411907 - DNA, 25 bp, Mus musculus
gaaatgctccacagcactaattgct

SEQ ID NO: 411908 - DNA, 25 bp, Mus musculus
gaaatgctccactgcactaattgct

SEQ ID NO: 411909 - DNA, 25 bp, Mus musculus
gaaatgctctcaaacaatcggccac

SEQ ID NO: 411910 - DNA, 25 bp, Mus musculus
gaaatgctctcatacaatcggccac

SEQ ID NO: 411911 - DNA, 25 bp, Mus musculus
gaaatgctgaaaatctatatcaagt

SEQ ID NO: 411912 - DNA, 25 bp, Mus musculus
gaaatgctgaaattctatatcaagt

SEQ ID NO: 411913 - DNA, 25 bp, Mus musculus
gaaatgctgactacaagtggaagtt

SEQ ID NO: 411914 - DNA, 25 bp, Mus musculus
gaaatgctgacttcaagtggaagtt

SEQ ID NO: 411915 - DNA, 25 bp, Mus musculus
gaaatgctgcctaaacgtaactggt

SEQ ID NO: 411916 - DNA, 25 bp, Mus musculus
gaaatgctgccttaacgtaactggt

SEQ ID NO: 411917 - DNA, 25 bp, Mus musculus
gaaatgctgcttcccatagctggag

SEQ ID NO: 411918 - DNA, 25 bp, Mus musculus
gaaatgctgcttgccatagctggag

SEQ ID NO: 411919 - DNA, 25 bp, Mus musculus
gaaatgctgggtcatttctccccta

SEQ ID NO: 411920 - DNA, 25 bp, Mus musculus
gaaatgctgggtgatttctccccta

SEQ ID NO: 411921 - DNA, 25 bp, Mus musculus
gaaatgctgtacagctcactagtta

SEQ ID NO: 411922 - DNA, 25 bp, Mus musculus
gaaatgctgtactgctcactagtta

SEQ ID NO: 411923 - DNA, 25 bp, Mus musculus
gaaatgctgtctcatccagtttcga

SEQ ID NO: 411924 - DNA, 25 bp, Mus musculus
gaaatgctgtctcggtggagctccc

SEQ ID NO: 411925 - DNA, 25 bp, Mus musculus
gaaatgctgtctgatccagtttcga

SEQ ID NO: 411926 - DNA, 25 bp, Mus musculus
gaaatgctgtctgggtggagctccc

SEQ ID NO: 411927 - DNA, 25 bp, Mus musculus
gaaatgctgtgcacctgcggtgatc

SEQ ID NO: 411928 - DNA, 25 bp, Mus musculus
gaaatgctgtgctcctgcggtgatc

SEQ ID NO: 411929 - DNA, 25 bp, Mus musculus
gaaatgctgtggattccttcaaagt

SEQ ID NO: 411930 - DNA, 25 bp, Mus musculus
gaaatgctgtggtttccttcaaagt

SEQ ID NO: 411931 - DNA, 25 bp, Mus musculus
gaaatgctgtttacctcgataggat

SEQ ID NO: 411932 - DNA, 25 bp, Mus musculus
gaaatgctgttttcctcgataggat

SEQ ID NO: 411933 - DNA, 25 bp, Mus musculus
gaaatgcttaaactagaccgtcaac

SEQ ID NO: 411934 - DNA, 25 bp, Mus musculus
gaaatgcttaaagtagaccgtcaac

SEQ ID NO: 411935 - DNA, 25 bp, Mus musculus
gaaatgcttagtcttcagcctcatt

SEQ ID NO: 411936 - DNA, 25 bp, Mus musculus
gaaatgcttagtgttcagcctcatt

SEQ ID NO: 411937 - DNA, 25 bp, Mus musculus
gaaatgcttatgaagctggcccgtg

SEQ ID NO: 411938 - DNA, 25 bp, Mus musculus
gaaatgcttatgtagctggcccgtg

SEQ ID NO: 411939 - DNA, 25 bp, Mus musculus
gaaatgcttcaaaatatccagtatt

SEQ ID NO: 411940 - DNA, 25 bp, Mus musculus
gaaatgcttcaatatatccagtatt

SEQ ID NO: 411941 - DNA, 25 bp, Mus musculus
gaaatgcttcccattaaagcccatg

SEQ ID NO: 411942 - DNA, 25 bp, Mus musculus
gaaatgcttccccatgttaatgagg

SEQ ID NO: 411943 - DNA, 25 bp, Mus musculus
gaaatgcttcccgatgttaatgagg

SEQ ID NO: 411944 - DNA, 25 bp, Mus musculus
gaaatgcttccctttaaagcccatg

SEQ ID NO: 411945 - DNA, 25 bp, Mus musculus
gaaatgcttgccctgaaatcagatc

SEQ ID NO: 411946 - DNA, 25 bp, Mus musculus
gaaatgcttgccgtgaaatcagatc

SEQ ID NO: 411947 - DNA, 25 bp, Mus musculus
gaaatgcttgcgactgagcgagaag

SEQ ID NO: 411948 - DNA, 25 bp, Mus musculus
gaaatgcttgcgtctgagcgagaag

SEQ ID NO: 411949 - DNA, 25 bp, Mus musculus
gaaatgcttgtgaacctgcctgggc

SEQ ID NO: 411950 - DNA, 25 bp, Mus musculus
gaaatgcttgtgtacctgcctgggc

SEQ ID NO: 411951 - DNA, 25 bp, Mus musculus
gaaatgcttgttaaggctgctgaaa

SEQ ID NO: 411952 - DNA, 25 bp, Mus musculus
gaaatgcttgtttaggctgctgaaa

SEQ ID NO: 411953 - DNA, 25 bp, Mus musculus
gaaatgctttgcatactgtaccaga

SEQ ID NO: 411954 - DNA, 25 bp, Mus musculus
gaaatgctttgccatgctaatgctt

SEQ ID NO: 411955 - DNA, 25 bp, Mus musculus
gaaatgctttgcgatgctaatgctt

SEQ ID NO: 411956 - DNA, 25 bp, Mus musculus
gaaatgctttgcttactgtaccaga

SEQ ID NO: 411957 - DNA, 25 bp, Mus musculus
gaaatgcttttacagcaccggccag

SEQ ID NO: 411958 - DNA, 25 bp, Mus musculus
gaaatgcttttagagcaccggccag

SEQ ID NO: 411959 - DNA, 25 bp, Mus musculus
gaaatgctttttcgcagtgcatcaa

SEQ ID NO: 411960 - DNA, 25 bp, Mus musculus
gaaatgctttttggcagtgcatcaa

SEQ ID NO: 411961 - DNA, 25 bp, Mus musculus
gaaatggaaatgaggtgcacagacc

SEQ ID NO: 411962 - DNA, 25 bp, Mus musculus
gaaatggaaatgtggtgcacagacc

SEQ ID NO: 411963 - DNA, 25 bp, Mus musculus
gaaatggaaccaccatcatccaggg

SEQ ID NO: 411964 - DNA, 25 bp, Mus musculus
gaaatggaaccagcatcatccaggg

SEQ ID NO: 411965 - DNA, 25 bp, Mus musculus
gaaatggaatctactcctgctttgt

SEQ ID NO: 411966 - DNA, 25 bp, Mus musculus
gaaatggaatcttctcctgctttgt

SEQ ID NO: 411967 - DNA, 25 bp, Mus musculus
gaaatggacacaactaagcttgctg

SEQ ID NO: 411968 - DNA, 25 bp, Mus musculus
gaaatggacacatctaagcttgctg

SEQ ID NO: 411969 - DNA, 25 bp, Mus musculus
gaaatggacaccagcccagatcata

SEQ ID NO: 411970 - DNA, 25 bp, Mus musculus
gaaatggacacctgcccagatcata

SEQ ID NO: 411971 - DNA, 25 bp, Mus musculus
gaaatggacacgaatactttgaatc

SEQ ID NO: 411972 - DNA, 25 bp, Mus musculus
gaaatggacacgtatactttgaatc

SEQ ID NO: 411973 - DNA, 25 bp, Mus musculus
gaaatggaccaaagccctcacaagg

SEQ ID NO: 411974 - DNA, 25 bp, Mus musculus
gaaatggaccaatgccctcacaagg

SEQ ID NO: 411975 - DNA, 25 bp, Mus musculus
gaaatggaccatcgatcatgcaaat

SEQ ID NO: 411976 - DNA, 25 bp, Mus musculus
gaaatggaccatggatcatgcaaat

SEQ ID NO: 411977 - DNA, 25 bp, Mus musculus
gaaatggaccccatgactgaggagg

SEQ ID NO: 411978 - DNA, 25 bp, Mus musculus
gaaatggaccccttgactgaggagg

SEQ ID NO: 411979 - DNA, 25 bp, Mus musculus
gaaatggaccctacaaatactaaag

SEQ ID NO: 411980 - DNA, 25 bp, Mus musculus
gaaatggacccttcaaatactaaag

SEQ ID NO: 411981 - DNA, 25 bp, Mus musculus
gaaatggacctgctaccaataccaa

SEQ ID NO: 411982 - DNA, 25 bp, Mus musculus
gaaatggacctggtaccaataccaa

SEQ ID NO: 411983 - DNA, 25 bp, Mus musculus
gaaatggacttcagtcatccggcat

SEQ ID NO: 411984 - DNA, 25 bp, Mus musculus
gaaatggacttctgtcatccggcat

SEQ ID NO: 411985 - DNA, 25 bp, Mus musculus
gaaatggacttgacccagtgtcccc

SEQ ID NO: 411986 - DNA, 25 bp, Mus musculus
gaaatggacttgtcccagtgtcccc

SEQ ID NO: 411987 - DNA, 25 bp, Mus musculus
gaaatggagacacatactcgctcat

SEQ ID NO: 411988 - DNA, 25 bp, Mus musculus
gaaatggagacagatactcgctcat

SEQ ID NO: 411989 - DNA, 25 bp, Mus musculus
gaaatggagagacccacctgccctg

SEQ ID NO: 411990 - DNA, 25 bp, Mus musculus
gaaatggagagagccacctgccctg

SEQ ID NO: 411991 - DNA, 25 bp, Mus musculus
gaaatggagagtcggtttattttct

SEQ ID NO: 411992 - DNA, 25 bp, Mus musculus
gaaatggagagtgggtttattttct

SEQ ID NO: 411993 - DNA, 25 bp, Mus musculus
gaaatggagatgacctatgaaccct

SEQ ID NO: 411994 - DNA, 25 bp, Mus musculus
gaaatggagatgtcctatgaaccct

SEQ ID NO: 411995 - DNA, 25 bp, Mus musculus
gaaatggagcccactgtctgtgtct

SEQ ID NO: 411996 - DNA, 25 bp, Mus musculus
gaaatggagccctctgtctgtgtct

SEQ ID NO: 411997 - DNA, 25 bp, Mus musculus
gaaatggagcctagatacttttgta

SEQ ID NO: 411998 - DNA, 25 bp, Mus musculus
gaaatggagccttgatacttttgta

SEQ ID NO: 411999 - DNA, 25 bp, Mus musculus
gaaatggagctcagatcccagtgcc

SEQ ID NO: 412000 - DNA, 25 bp, Mus musculus
gaaatggagctctgatcccagtgcc

SEQ ID NO: 412001 - DNA, 25 bp, Mus musculus
gaaatggaggcccttgcttttctcc

SEQ ID NO: 412002 - DNA, 25 bp, Mus musculus
gaaatggaggccgttgcttttctcc

SEQ ID NO: 412003 - DNA, 25 bp, Mus musculus
gaaatggagtacataggcttgctat

SEQ ID NO: 412004 - DNA, 25 bp, Mus musculus
gaaatggagtacttaggcttgctat

SEQ ID NO: 412005 - DNA, 25 bp, Mus musculus
gaaatggatacaccctcatgttctc

SEQ ID NO: 412006 - DNA, 25 bp, Mus musculus
gaaatggatacagcctcatgttctc

SEQ ID NO: 412007 - DNA, 25 bp, Mus musculus
gaaatggatccacggcttgccaggc

SEQ ID NO: 412008 - DNA, 25 bp, Mus musculus
gaaatggatccagggcttgccaggc

SEQ ID NO: 412009 - DNA, 25 bp, Mus musculus
gaaatggatctccaatgtgcctaga

SEQ ID NO: 412010 - DNA, 25 bp, Mus musculus
gaaatggatctcgaatgtgcctaga

SEQ ID NO: 412011 - DNA, 25 bp, Mus musculus
gaaatggatgagagattcaaagagt

SEQ ID NO: 412012 - DNA, 25 bp, Mus musculus
gaaatggatgagtgattcaaagagt

SEQ ID NO: 412013 - DNA, 25 bp, Mus musculus
gaaatggatgtcactgacctcggct

SEQ ID NO: 412014 - DNA, 25 bp, Mus musculus
gaaatggatgtctctgacctcggct

SEQ ID NO: 412015 - DNA, 25 bp, Mus musculus
gaaatggattccctggctgagccag

SEQ ID NO: 412016 - DNA, 25 bp, Mus musculus
gaaatggattccgtggctgagccag

SEQ ID NO: 412017 - DNA, 25 bp, Mus musculus
gaaatggattgtccttctcacgcta

SEQ ID NO: 412018 - DNA, 25 bp, Mus musculus
gaaatggattgtgcttctcacgcta

SEQ ID NO: 412019 - DNA, 25 bp, Mus musculus
gaaatggcacggaccagttctgatg

SEQ ID NO: 412020 - DNA, 25 bp, Mus musculus
gaaatggcacggtccagttctgatg

SEQ ID NO: 412021 - DNA, 25 bp, Mus musculus
gaaatggcactgctctccaaaaaga

SEQ ID NO: 412022 - DNA, 25 bp, Mus musculus
gaaatggcactggtctccaaaaaga

SEQ ID NO: 412023 - DNA, 25 bp, Mus musculus
gaaatggcagctagcacatggatta

SEQ ID NO: 412024 - DNA, 25 bp, Mus musculus
gaaatggcagctcatctgcatctga

SEQ ID NO: 412025 - DNA, 25 bp, Mus musculus
gaaatggcagctgatctgcatctga

SEQ ID NO: 412026 - DNA, 25 bp, Mus musculus
gaaatggcagcttgcacatggatta

SEQ ID NO: 412027 - DNA, 25 bp, Mus musculus
gaaatggcaggcactcatggtaacc

SEQ ID NO: 412028 - DNA, 25 bp, Mus musculus
gaaatggcaggctctcatggtaacc

SEQ ID NO: 412029 - DNA, 25 bp, Mus musculus
gaaatggcagtcatgctttcttctg

SEQ ID NO: 412030 - DNA, 25 bp, Mus musculus
gaaatggcagtcttgctttcttctg

SEQ ID NO: 412031 - DNA, 25 bp, Mus musculus
gaaatggccactccttgatgtccaa

SEQ ID NO: 412032 - DNA, 25 bp, Mus musculus
gaaatggccactgcttgatgtccaa

SEQ ID NO: 412033 - DNA, 25 bp, Mus musculus
gaaatggcccagagacagctcttga

SEQ ID NO: 412034 - DNA, 25 bp, Mus musculus
gaaatggcccagtgacagctcttga

SEQ ID NO: 412035 - DNA, 25 bp, Mus musculus
gaaatggcccatcgattaagaaaga

SEQ ID NO: 412036 - DNA, 25 bp, Mus musculus
gaaatggcccatggattaagaaaga

SEQ ID NO: 412037 - DNA, 25 bp, Mus musculus
gaaatggcccccagaaaggactctt

SEQ ID NO: 412038 - DNA, 25 bp, Mus musculus
gaaatggccccctgaaaggactctt

SEQ ID NO: 412039 - DNA, 25 bp, Mus musculus
gaaatggcccgacagacttgtctca

SEQ ID NO: 412040 - DNA, 25 bp, Mus musculus
gaaatggcccgagagacttgtctca

SEQ ID NO: 412041 - DNA, 25 bp, Mus musculus
gaaatggccctgaccaaaggagcat

SEQ ID NO: 412042 - DNA, 25 bp, Mus musculus
gaaatggccctgtccaaaggagcat

SEQ ID NO: 412043 - DNA, 25 bp, Mus musculus
gaaatggccgtcatcgggctgaagt

SEQ ID NO: 412044 - DNA, 25 bp, Mus musculus
gaaatggccgtcttcgggctgaagt

SEQ ID NO: 412045 - DNA, 25 bp, Mus musculus
gaaatggccttcacatccgctgaga

SEQ ID NO: 412046 - DNA, 25 bp, Mus musculus
gaaatggccttctcatccgctgaga

SEQ ID NO: 412047 - DNA, 25 bp, Mus musculus
gaaatggccttgaaaacacagccag

SEQ ID NO: 412048 - DNA, 25 bp, Mus musculus
gaaatggccttgtaaacacagccag

SEQ ID NO: 412049 - DNA, 25 bp, Mus musculus
gaaatggctaataatgttccaatta

SEQ ID NO: 412050 - DNA, 25 bp, Mus musculus
gaaatggctaattatgttccaatta

SEQ ID NO: 412051 - DNA, 25 bp, Mus musculus
gaaatggctatactgcctcagactt

SEQ ID NO: 412052 - DNA, 25 bp, Mus musculus
gaaatggctatagtgcctcagactt

SEQ ID NO: 412053 - DNA, 25 bp, Mus musculus
gaaatggctcacctatgtgcctatg

SEQ ID NO: 412054 - DNA, 25 bp, Mus musculus
gaaatggctcacgtatgtgcctatg

SEQ ID NO: 412055 - DNA, 25 bp, Mus musculus
gaaatggctcagacttaagctcagt

SEQ ID NO: 412056 - DNA, 25 bp, Mus musculus
gaaatggctcagtcttaagctcagt

SEQ ID NO: 412057 - DNA, 25 bp, Mus musculus
gaaatggctctcagtatccaacttc

SEQ ID NO: 412058 - DNA, 25 bp, Mus musculus
gaaatggctctctgtatccaacttc

SEQ ID NO: 412059 - DNA, 25 bp, Mus musculus
gaaatggctgacctcgaaatagtgt

SEQ ID NO: 412060 - DNA, 25 bp, Mus musculus
gaaatggctgacgtcgaaatagtgt

SEQ ID NO: 412061 - DNA, 25 bp, Mus musculus
gaaatggctgtccagggaccacaaa

SEQ ID NO: 412062 - DNA, 25 bp, Mus musculus
gaaatggctgtcgagggaccacaaa

SEQ ID NO: 412063 - DNA, 25 bp, Mus musculus
gaaatggcttctcaggatttctttc

SEQ ID NO: 412064 - DNA, 25 bp, Mus musculus
gaaatggcttctgaggatttctttc

SEQ ID NO: 412065 - DNA, 25 bp, Mus musculus
gaaatggcttttctggaattacagc

SEQ ID NO: 412066 - DNA, 25 bp, Mus musculus
gaaatggcttttgtggaattacagc

SEQ ID NO: 412067 - DNA, 25 bp, Mus musculus
gaaatgggaacactggctgcctctc

SEQ ID NO: 412068 - DNA, 25 bp, Mus musculus
gaaatgggaacagtggctgcctctc

SEQ ID NO: 412069 - DNA, 25 bp, Mus musculus
gaaatgggaactcctttaacctaga

SEQ ID NO: 412070 - DNA, 25 bp, Mus musculus
gaaatgggaactgctttaacctaga

SEQ ID NO: 412071 - DNA, 25 bp, Mus musculus
gaaatgggacctactgtcattgtga

SEQ ID NO: 412072 - DNA, 25 bp, Mus musculus
gaaatgggaccttctgtcattgtga

SEQ ID NO: 412073 - DNA, 25 bp, Mus musculus
gaaatgggagagaccatccccacag

SEQ ID NO: 412074 - DNA, 25 bp, Mus musculus
gaaatgggagagtccatccccacag

SEQ ID NO: 412075 - DNA, 25 bp, Mus musculus
gaaatgggagccatgacttccgtgc

SEQ ID NO: 412076 - DNA, 25 bp, Mus musculus
gaaatgggagccttgacttccgtgc

SEQ ID NO: 412077 - DNA, 25 bp, Mus musculus
gaaatgggagtgctgtcctgctcaa

SEQ ID NO: 412078 - DNA, 25 bp, Mus musculus
gaaatgggagtggtgtcctgctcaa

SEQ ID NO: 412079 - DNA, 25 bp, Mus musculus
gaaatgggatcaaccctgccatgta

SEQ ID NO: 412080 - DNA, 25 bp, Mus musculus
gaaatgggatcatccctgccatgta

SEQ ID NO: 412081 - DNA, 25 bp, Mus musculus
gaaatgggatcgcaggtcttcctgt

SEQ ID NO: 412082 - DNA, 25 bp, Mus musculus
gaaatgggatcggaggtcttcctgt

SEQ ID NO: 412083 - DNA, 25 bp, Mus musculus
gaaatgggatgcatacgttagtaaa

SEQ ID NO: 412084 - DNA, 25 bp, Mus musculus
gaaatgggatgcttacgttagtaaa

SEQ ID NO: 412085 - DNA, 25 bp, Mus musculus
gaaatgggcggacctccagcatgaa

SEQ ID NO: 412086 - DNA, 25 bp, Mus musculus
gaaatgggcggagctccagcatgaa

SEQ ID NO: 412087 - DNA, 25 bp, Mus musculus
gaaatgggctcaagtatttcagcca

SEQ ID NO: 412088 - DNA, 25 bp, Mus musculus
gaaatgggctcacatcatacctaag

SEQ ID NO: 412089 - DNA, 25 bp, Mus musculus
gaaatgggctcagatcatacctaag

SEQ ID NO: 412090 - DNA, 25 bp, Mus musculus
gaaatgggctcatgtatttcagcca

SEQ ID NO: 412091 - DNA, 25 bp, Mus musculus
gaaatgggctttcgctacactacgc

SEQ ID NO: 412092 - DNA, 25 bp, Mus musculus
gaaatgggctttggctacactacgc

SEQ ID NO: 412093 - DNA, 25 bp, Mus musculus
gaaatgggtattattatccccaagg

SEQ ID NO: 412094 - DNA, 25 bp, Mus musculus
gaaatgggtatttttatccccaagg

SEQ ID NO: 412095 - DNA, 25 bp, Mus musculus
gaaatgggtcacactgtcacacggc

SEQ ID NO: 412096 - DNA, 25 bp, Mus musculus
gaaatgggtcactctgtcacacggc

SEQ ID NO: 412097 - DNA, 25 bp, Mus musculus
gaaatgggtcataaagatagctcag

SEQ ID NO: 412098 - DNA, 25 bp, Mus musculus
gaaatgggtcatactgccaagcata

SEQ ID NO: 412099 - DNA, 25 bp, Mus musculus
gaaatgggtcatacttacgaagtat

SEQ ID NO: 412100 - DNA, 25 bp, Mus musculus
gaaatgggtcattaagatagctcag

SEQ ID NO: 412101 - DNA, 25 bp, Mus musculus
gaaatgggtcattctgccaagcata

SEQ ID NO: 412102 - DNA, 25 bp, Mus musculus
gaaatgggtcattcttacgaagtat

SEQ ID NO: 412103 - DNA, 25 bp, Mus musculus
gaaatgggtccactttttaggcgtg

SEQ ID NO: 412104 - DNA, 25 bp, Mus musculus
gaaatgggtccagtttttaggcgtg

SEQ ID NO: 412105 - DNA, 25 bp, Mus musculus
gaaatgggtgtgcttacctccacat

SEQ ID NO: 412106 - DNA, 25 bp, Mus musculus
gaaatgggtgtggttacctccacat

SEQ ID NO: 412107 - DNA, 25 bp, Mus musculus
gaaatgggttggagtctctaatgtt

SEQ ID NO: 412108 - DNA, 25 bp, Mus musculus
gaaatgggttggtgtctctaatgtt

SEQ ID NO: 412109 - DNA, 25 bp, Mus musculus
gaaatggtactgaagtctccttttc

SEQ ID NO: 412110 - DNA, 25 bp, Mus musculus
gaaatggtactgtagtctccttttc

SEQ ID NO: 412111 - DNA, 25 bp, Mus musculus
gaaatggtaggcagcttcacacctc

SEQ ID NO: 412112 - DNA, 25 bp, Mus musculus
gaaatggtaggctgcttcacacctc

SEQ ID NO: 412113 - DNA, 25 bp, Mus musculus
gaaatggtattgaccccgaacagct

SEQ ID NO: 412114 - DNA, 25 bp, Mus musculus
gaaatggtattgtccccgaacagct

SEQ ID NO: 412115 - DNA, 25 bp, Mus musculus
gaaatggtcacacaaacctttaatc

SEQ ID NO: 412116 - DNA, 25 bp, Mus musculus
gaaatggtcacagaaacctttaatc

SEQ ID NO: 412117 - DNA, 25 bp, Mus musculus
gaaatggtcactatgaactcagatg

SEQ ID NO: 412118 - DNA, 25 bp, Mus musculus
gaaatggtcactttgaactcagatg

SEQ ID NO: 412119 - DNA, 25 bp, Mus musculus
gaaatggtctagagtctgcccaacc

SEQ ID NO: 412120 - DNA, 25 bp, Mus musculus
gaaatggtctagtgtctgcccaacc

SEQ ID NO: 412121 - DNA, 25 bp, Mus musculus
gaaatggtctcaagtggaacaaatt

SEQ ID NO: 412122 - DNA, 25 bp, Mus musculus
gaaatggtctcatgtggaacaaatt

SEQ ID NO: 412123 - DNA, 25 bp, Mus musculus
gaaatggtgaatatttgcccgtaag

SEQ ID NO: 412124 - DNA, 25 bp, Mus musculus
gaaatggtgaatttttgcccgtaag

SEQ ID NO: 412125 - DNA, 25 bp, Mus musculus
gaaatggtgagcatattcagtagta

SEQ ID NO: 412126 - DNA, 25 bp, Mus musculus
gaaatggtgagcttattcagtagta

SEQ ID NO: 412127 - DNA, 25 bp, Mus musculus
gaaatggtggatcctactcaacccc

SEQ ID NO: 412128 - DNA, 25 bp, Mus musculus
gaaatggtggatgctactcaacccc

SEQ ID NO: 412129 - DNA, 25 bp, Mus musculus
gaaatggtggcccttgtgacagaca

SEQ ID NO: 412130 - DNA, 25 bp, Mus musculus
gaaatggtggccgttgtgacagaca

SEQ ID NO: 412131 - DNA, 25 bp, Mus musculus
gaaatggtgggcacagtcgttcctc

SEQ ID NO: 412132 - DNA, 25 bp, Mus musculus
gaaatggtgggctcagtcgttcctc

SEQ ID NO: 412133 - DNA, 25 bp, Mus musculus
gaaatggtggttcctcttgaaaatc

SEQ ID NO: 412134 - DNA, 25 bp, Mus musculus
gaaatggtggttgctcttgaaaatc

SEQ ID NO: 412135 - DNA, 25 bp, Mus musculus
gaaatggtgtgcatatttaatgacc

SEQ ID NO: 412136 - DNA, 25 bp, Mus musculus
gaaatggtgtgcttatttaatgacc

SEQ ID NO: 412137 - DNA, 25 bp, Mus musculus
gaaatggttcaaactgcagccctgg

SEQ ID NO: 412138 - DNA, 25 bp, Mus musculus
gaaatggttcaatctgcagccctgg

SEQ ID NO: 412139 - DNA, 25 bp, Mus musculus
gaaatggtttcaagcttctgtggaa

SEQ ID NO: 412140 - DNA, 25 bp, Mus musculus
gaaatggtttcatgcttctgtggaa

SEQ ID NO: 412141 - DNA, 25 bp, Mus musculus
gaaatggtttgaagcaagatacacc

SEQ ID NO: 412142 - DNA, 25 bp, Mus musculus
gaaatggtttgatgcaagatacacc

SEQ ID NO: 412143 - DNA, 25 bp, Mus musculus
gaaatggtttttccacattacttgt

SEQ ID NO: 412144 - DNA, 25 bp, Mus musculus
gaaatggtttttgcacattacttgt

SEQ ID NO: 412145 - DNA, 25 bp, Mus musculus
gaaatgtaagaacggagctcctcct

SEQ ID NO: 412146 - DNA, 25 bp, Mus musculus
gaaatgtaagaagggagctcctcct

SEQ ID NO: 412147 - DNA, 25 bp, Mus musculus
gaaatgtaagttattacccaactag

SEQ ID NO: 412148 - DNA, 25 bp, Mus musculus
gaaatgtaagtttttacccaactag

SEQ ID NO: 412149 - DNA, 25 bp, Mus musculus
gaaatgtaccacagtcctgatgtgt

SEQ ID NO: 412150 - DNA, 25 bp, Mus musculus
gaaatgtaccactgtcctgatgtgt

SEQ ID NO: 412151 - DNA, 25 bp, Mus musculus
gaaatgtacccacatgaacaatgat

SEQ ID NO: 412152 - DNA, 25 bp, Mus musculus
gaaatgtacccagatgaacaatgat

SEQ ID NO: 412153 - DNA, 25 bp, Mus musculus
gaaatgtacggacgactcagctcag

SEQ ID NO: 412154 - DNA, 25 bp, Mus musculus
gaaatgtacggaggactcagctcag

SEQ ID NO: 412155 - DNA, 25 bp, Mus musculus
gaaatgtagatgacctctctgtatg

SEQ ID NO: 412156 - DNA, 25 bp, Mus musculus
gaaatgtagatgtcctctctgtatg

SEQ ID NO: 412157 - DNA, 25 bp, Mus musculus
gaaatgtaggtcatgatctgtgtaa

SEQ ID NO: 412158 - DNA, 25 bp, Mus musculus
gaaatgtaggtcttgatctgtgtaa

SEQ ID NO: 412159 - DNA, 25 bp, Mus musculus
gaaatgtagtcacgctttcaagtct

SEQ ID NO: 412160 - DNA, 25 bp, Mus musculus
gaaatgtagtcaggctttcaagtct

SEQ ID NO: 412161 - DNA, 25 bp, Mus musculus
gaaatgtagttcatttctggccctt

SEQ ID NO: 412162 - DNA, 25 bp, Mus musculus
gaaatgtagttcttttctggccctt

SEQ ID NO: 412163 - DNA, 25 bp, Mus musculus
gaaatgtagtttatcctcttccagc

SEQ ID NO: 412164 - DNA, 25 bp, Mus musculus
gaaatgtagtttttcctcttccagc

SEQ ID NO: 412165 - DNA, 25 bp, Mus musculus
gaaatgtataccagctcaaatataa

SEQ ID NO: 412166 - DNA, 25 bp, Mus musculus
gaaatgtatacctgctcaaatataa

SEQ ID NO: 412167 - DNA, 25 bp, Mus musculus
gaaatgtataggcttccagtttaac

SEQ ID NO: 412168 - DNA, 25 bp, Mus musculus
gaaatgtatagggttccagtttaac

SEQ ID NO: 412169 - DNA, 25 bp, Mus musculus
gaaatgtatctaataagcacttgtt

SEQ ID NO: 412170 - DNA, 25 bp, Mus musculus
gaaatgtatctattaagcacttgtt

SEQ ID NO: 412171 - DNA, 25 bp, Mus musculus
gaaatgtatcttatgactgaattat

SEQ ID NO: 412172 - DNA, 25 bp, Mus musculus
gaaatgtatcttttgactgaattat

SEQ ID NO: 412173 - DNA, 25 bp, Mus musculus
gaaatgtatggacacaacttttatg

SEQ ID NO: 412174 - DNA, 25 bp, Mus musculus
gaaatgtatggagacaacttttatg

SEQ ID NO: 412175 - DNA, 25 bp, Mus musculus
gaaatgtatgtaacaagtgctgcac

SEQ ID NO: 412176 - DNA, 25 bp, Mus musculus
gaaatgtatgtatcaagtgctgcac

SEQ ID NO: 412177 - DNA, 25 bp, Mus musculus
gaaatgtatgtcacgggccgaggca

SEQ ID NO: 412178 - DNA, 25 bp, Mus musculus
gaaatgtatgtctcgggccgaggca

SEQ ID NO: 412179 - DNA, 25 bp, Mus musculus
gaaatgtatgttcgtttttacttgg

SEQ ID NO: 412180 - DNA, 25 bp, Mus musculus
gaaatgtatgttggtttttacttgg

SEQ ID NO: 412181 - DNA, 25 bp, Mus musculus
gaaatgtattaaaaatccactctta

SEQ ID NO: 412182 - DNA, 25 bp, Mus musculus
gaaatgtattaataatccactctta

SEQ ID NO: 412183 - DNA, 25 bp, Mus musculus
gaaatgtattgtctccccatatctt

SEQ ID NO: 412184 - DNA, 25 bp, Mus musculus
gaaatgtattgtgtccccatatctt

SEQ ID NO: 412185 - DNA, 25 bp, Mus musculus
gaaatgtatttcaagtctgggaaag

SEQ ID NO: 412186 - DNA, 25 bp, Mus musculus
gaaatgtatttccaaaagtcccaag

SEQ ID NO: 412187 - DNA, 25 bp, Mus musculus
gaaatgtatttcgaaaagtcccaag

SEQ ID NO: 412188 - DNA, 25 bp, Mus musculus
gaaatgtatttctagtctgggaaag

SEQ ID NO: 412189 - DNA, 25 bp, Mus musculus
gaaatgtcaagcatctgaggcagat

SEQ ID NO: 412190 - DNA, 25 bp, Mus musculus
gaaatgtcaagcttctgaggcagat

SEQ ID NO: 412191 - DNA, 25 bp, Mus musculus
gaaatgtcaatgcttatttggaaac

SEQ ID NO: 412192 - DNA, 25 bp, Mus musculus
gaaatgtcaatggttatttggaaac

SEQ ID NO: 412193 - DNA, 25 bp, Mus musculus
gaaatgtcacacatagacttgctat

SEQ ID NO: 412194 - DNA, 25 bp, Mus musculus
gaaatgtcacacttagacttgctat

SEQ ID NO: 412195 - DNA, 25 bp, Mus musculus
gaaatgtcaccactggctgcaaaca

SEQ ID NO: 412196 - DNA, 25 bp, Mus musculus
gaaatgtcaccagtggctgcaaaca

SEQ ID NO: 412197 - DNA, 25 bp, Mus musculus
gaaatgtcactcaccaagtaagctt

SEQ ID NO: 412198 - DNA, 25 bp, Mus musculus
gaaatgtcactctccaagtaagctt

SEQ ID NO: 412199 - DNA, 25 bp, Mus musculus
gaaatgtcagcgagatctgatcgat

SEQ ID NO: 412200 - DNA, 25 bp, Mus musculus
gaaatgtcagcgtgatctgatcgat

SEQ ID NO: 412201 - DNA, 25 bp, Mus musculus
gaaatgtcagggatcctccttctac

SEQ ID NO: 412202 - DNA, 25 bp, Mus musculus
gaaatgtcagggatttctgttacat

SEQ ID NO: 412203 - DNA, 25 bp, Mus musculus
gaaatgtcagggttcctccttctac

SEQ ID NO: 412204 - DNA, 25 bp, Mus musculus
gaaatgtcagggttttctgttacat

SEQ ID NO: 412205 - DNA, 25 bp, Mus musculus
gaaatgtcatcaactgtcacttcca

SEQ ID NO: 412206 - DNA, 25 bp, Mus musculus
gaaatgtcatcatctgtcacttcca

SEQ ID NO: 412207 - DNA, 25 bp, Mus musculus
gaaatgtcatccaattactgcttaa

SEQ ID NO: 412208 - DNA, 25 bp, Mus musculus
gaaatgtcatcctattactgcttaa

SEQ ID NO: 412209 - DNA, 25 bp, Mus musculus
gaaatgtcatctagggtcacctctg

SEQ ID NO: 412210 - DNA, 25 bp, Mus musculus
gaaatgtcatcttgggtcacctctg

SEQ ID NO: 412211 - DNA, 25 bp, Mus musculus
gaaatgtcattccagcttgattgtt

SEQ ID NO: 412212 - DNA, 25 bp, Mus musculus
gaaatgtcattcgagcttgattgtt

SEQ ID NO: 412213 - DNA, 25 bp, Mus musculus
gaaatgtcattgagcgactccagga

SEQ ID NO: 412214 - DNA, 25 bp, Mus musculus
gaaatgtcattgtgcgactccagga

SEQ ID NO: 412215 - DNA, 25 bp, Mus musculus
gaaatgtcatttctccttttaattg

SEQ ID NO: 412216 - DNA, 25 bp, Mus musculus
gaaatgtcatttgtccttttaattg

SEQ ID NO: 412217 - DNA, 25 bp, Mus musculus
gaaatgtccaggatgctacaagatt

SEQ ID NO: 412218 - DNA, 25 bp, Mus musculus
gaaatgtccaggttgctacaagatt

SEQ ID NO: 412219 - DNA, 25 bp, Mus musculus
gaaatgtccatgcatcacacaatga

SEQ ID NO: 412220 - DNA, 25 bp, Mus musculus
gaaatgtccatggatcacacaatga

SEQ ID NO: 412221 - DNA, 25 bp, Mus musculus
gaaatgtcccagagtctgactctcc

SEQ ID NO: 412222 - DNA, 25 bp, Mus musculus
gaaatgtcccagcaaacccctgtga

SEQ ID NO: 412223 - DNA, 25 bp, Mus musculus
gaaatgtcccaggaaacccctgtga

SEQ ID NO: 412224 - DNA, 25 bp, Mus musculus
gaaatgtcccagtgtctgactctcc

SEQ ID NO: 412225 - DNA, 25 bp, Mus musculus
gaaatgtccccaatgctatttttta

SEQ ID NO: 412226 - DNA, 25 bp, Mus musculus
gaaatgtccccattgctatttttta

SEQ ID NO: 412227 - DNA, 25 bp, Mus musculus
gaaatgtcccctagctgtgctactg

SEQ ID NO: 412228 - DNA, 25 bp, Mus musculus
gaaatgtccccttgctgtgctactg

SEQ ID NO: 412229 - DNA, 25 bp, Mus musculus
gaaatgtcctggatacctcggacaa

SEQ ID NO: 412230 - DNA, 25 bp, Mus musculus
gaaatgtcctggatcttcatggtaa

SEQ ID NO: 412231 - DNA, 25 bp, Mus musculus
gaaatgtcctggttacctcggacaa

SEQ ID NO: 412232 - DNA, 25 bp, Mus musculus
gaaatgtcctggttcttcatggtaa

SEQ ID NO: 412233 - DNA, 25 bp, Mus musculus
gaaatgtccttcaaccaatatctga

SEQ ID NO: 412234 - DNA, 25 bp, Mus musculus
gaaatgtccttctaccaatatctga

SEQ ID NO: 412235 - DNA, 25 bp, Mus musculus
gaaatgtcctttatcattgtgtggg

SEQ ID NO: 412236 - DNA, 25 bp, Mus musculus
gaaatgtcctttcaccttagtcgaa

SEQ ID NO: 412237 - DNA, 25 bp, Mus musculus
gaaatgtcctttgaccttagtcgaa

SEQ ID NO: 412238 - DNA, 25 bp, Mus musculus
gaaatgtcctttttcattgtgtggg

SEQ ID NO: 412239 - DNA, 25 bp, Mus musculus
gaaatgtcgaacaacttgactcttt

SEQ ID NO: 412240 - DNA, 25 bp, Mus musculus
gaaatgtcgaactacttgactcttt

SEQ ID NO: 412241 - DNA, 25 bp, Mus musculus
gaaatgtcgagaaagtgagcttcct

SEQ ID NO: 412242 - DNA, 25 bp, Mus musculus
gaaatgtcgagatagtgagcttcct

SEQ ID NO: 412243 - DNA, 25 bp, Mus musculus
gaaatgtcgatacagccatgtgcat

SEQ ID NO: 412244 - DNA, 25 bp, Mus musculus
gaaatgtcgatagagccatgtgcat

SEQ ID NO: 412245 - DNA, 25 bp, Mus musculus
gaaatgtcggcacctgctctacaca

SEQ ID NO: 412246 - DNA, 25 bp, Mus musculus
gaaatgtcggcagctgctctacaca

SEQ ID NO: 412247 - DNA, 25 bp, Mus musculus
gaaatgtcgttccttccagtttgtt

SEQ ID NO: 412248 - DNA, 25 bp, Mus musculus
gaaatgtcgttcgttccagtttgtt

SEQ ID NO: 412249 - DNA, 25 bp, Mus musculus
gaaatgtctactaatgcatgctaaa

SEQ ID NO: 412250 - DNA, 25 bp, Mus musculus
gaaatgtctacttatgcatgctaaa

SEQ ID NO: 412251 - DNA, 25 bp, Mus musculus
gaaatgtctctcaattggaattatg

SEQ ID NO: 412252 - DNA, 25 bp, Mus musculus
gaaatgtctctctattggaattatg

SEQ ID NO: 412253 - DNA, 25 bp, Mus musculus
gaaatgtctctgactaaaagcataa

SEQ ID NO: 412254 - DNA, 25 bp, Mus musculus
gaaatgtctctgtctaaaagcataa

SEQ ID NO: 412255 - DNA, 25 bp, Mus musculus
gaaatgtctcttattgacctcagag

SEQ ID NO: 412256 - DNA, 25 bp, Mus musculus
gaaatgtctctttttgacctcagag

SEQ ID NO: 412257 - DNA, 25 bp, Mus musculus
gaaatgtctggcactttaatggcaa

SEQ ID NO: 412258 - DNA, 25 bp, Mus musculus
gaaatgtctggctctttaatggcaa

SEQ ID NO: 412259 - DNA, 25 bp, Mus musculus
gaaatgtctgtacccatctctacca

SEQ ID NO: 412260 - DNA, 25 bp, Mus musculus
gaaatgtctgtacgaggctcaaaac

SEQ ID NO: 412261 - DNA, 25 bp, Mus musculus
gaaatgtctgtagccatctctacca

SEQ ID NO: 412262 - DNA, 25 bp, Mus musculus
gaaatgtctgtaggaggctcaaaac

SEQ ID NO: 412263 - DNA, 25 bp, Mus musculus
gaaatgtcttcgagaaatgtagctg

SEQ ID NO: 412264 - DNA, 25 bp, Mus musculus
gaaatgtcttcgtgaaatgtagctg

SEQ ID NO: 412265 - DNA, 25 bp, Mus musculus
gaaatgtgacccacggcacggcaag

SEQ ID NO: 412266 - DNA, 25 bp, Mus musculus
gaaatgtgaccctcggcacggcaag

SEQ ID NO: 412267 - DNA, 25 bp, Mus musculus
gaaatgtgacttccctgatcatctt

SEQ ID NO: 412268 - DNA, 25 bp, Mus musculus
gaaatgtgacttgcctgatcatctt

SEQ ID NO: 412269 - DNA, 25 bp, Mus musculus
gaaatgtgagcaagcgcactcgctt

SEQ ID NO: 412270 - DNA, 25 bp, Mus musculus
gaaatgtgagcatgcgcactcgctt

SEQ ID NO: 412271 - DNA, 25 bp, Mus musculus
gaaatgtgagctaaggtaaaccctt

SEQ ID NO: 412272 - DNA, 25 bp, Mus musculus
gaaatgtgagcttaggtaaaccctt

SEQ ID NO: 412273 - DNA, 25 bp, Mus musculus
gaaatgtgatgaactccaatctttt

SEQ ID NO: 412274 - DNA, 25 bp, Mus musculus
gaaatgtgatgacctttagggaata

SEQ ID NO: 412275 - DNA, 25 bp, Mus musculus
gaaatgtgatgagctttagggaata

SEQ ID NO: 412276 - DNA, 25 bp, Mus musculus
gaaatgtgatgatctccaatctttt

SEQ ID NO: 412277 - DNA, 25 bp, Mus musculus
gaaatgtgatgcctaacgtgcttta

SEQ ID NO: 412278 - DNA, 25 bp, Mus musculus
gaaatgtgatgcgtaacgtgcttta

SEQ ID NO: 412279 - DNA, 25 bp, Mus musculus
gaaatgtgcagtaacaagttcctca

SEQ ID NO: 412280 - DNA, 25 bp, Mus musculus
gaaatgtgcagtagccttttccctc

SEQ ID NO: 412281 - DNA, 25 bp, Mus musculus
gaaatgtgcagttacaagttcctca

SEQ ID NO: 412282 - DNA, 25 bp, Mus musculus
gaaatgtgcagttgccttttccctc

SEQ ID NO: 412283 - DNA, 25 bp, Mus musculus
gaaatgtgccgtcgtgtgcagcatc

SEQ ID NO: 412284 - DNA, 25 bp, Mus musculus
gaaatgtgccgtggtgtgcagcatc

SEQ ID NO: 412285 - DNA, 25 bp, Mus musculus
gaaatgtgctacattggcctatgga

SEQ ID NO: 412286 - DNA, 25 bp, Mus musculus
gaaatgtgctactttggcctatgga

SEQ ID NO: 412287 - DNA, 25 bp, Mus musculus
gaaatgtgctctaaagccagctgta

SEQ ID NO: 412288 - DNA, 25 bp, Mus musculus
gaaatgtgctcttaagccagctgta

SEQ ID NO: 412289 - DNA, 25 bp, Mus musculus
gaaatgtgctgtaataggcacctaa

SEQ ID NO: 412290 - DNA, 25 bp, Mus musculus
gaaatgtgctgttataggcacctaa

SEQ ID NO: 412291 - DNA, 25 bp, Mus musculus
gaaatgtgcttacagtgtctcacgt

SEQ ID NO: 412292 - DNA, 25 bp, Mus musculus
gaaatgtgcttagagtgtctcacgt

SEQ ID NO: 412293 - DNA, 25 bp, Mus musculus
gaaatgtgcttgcttccttcattgc

SEQ ID NO: 412294 - DNA, 25 bp, Mus musculus
gaaatgtgcttggttccttcattgc

SEQ ID NO: 412295 - DNA, 25 bp, Mus musculus
gaaatgtggatcaggatgccgcccc

SEQ ID NO: 412296 - DNA, 25 bp, Mus musculus
gaaatgtggatctggatgccgcccc

SEQ ID NO: 412297 - DNA, 25 bp, Mus musculus
gaaatgtggcaaccatcagcctcac

SEQ ID NO: 412298 - DNA, 25 bp, Mus musculus
gaaatgtggcaagcatcagcctcac

SEQ ID NO: 412299 - DNA, 25 bp, Mus musculus
gaaatgtggcataccaaacctggag

SEQ ID NO: 412300 - DNA, 25 bp, Mus musculus
gaaatgtggcattccaaacctggag

SEQ ID NO: 412301 - DNA, 25 bp, Mus musculus
gaaatgtggccccaggaccagccat

SEQ ID NO: 412302 - DNA, 25 bp, Mus musculus
gaaatgtggcccgaggaccagccat

SEQ ID NO: 412303 - DNA, 25 bp, Mus musculus
gaaatgtggctcagttttgtgcttg

SEQ ID NO: 412304 - DNA, 25 bp, Mus musculus
gaaatgtggctctgttttgtgcttg

SEQ ID NO: 412305 - DNA, 25 bp, Mus musculus
gaaatgtgggaacttttagctggac

SEQ ID NO: 412306 - DNA, 25 bp, Mus musculus
gaaatgtgggaagttttagctggac

SEQ ID NO: 412307 - DNA, 25 bp, Mus musculus
gaaatgtgggaccttactccagact

SEQ ID NO: 412308 - DNA, 25 bp, Mus musculus
gaaatgtgggacgttactccagact

SEQ ID NO: 412309 - DNA, 25 bp, Mus musculus
gaaatgtgggccctttcctcaatca

SEQ ID NO: 412310 - DNA, 25 bp, Mus musculus
gaaatgtgggccgtttcctcaatca

SEQ ID NO: 412311 - DNA, 25 bp, Mus musculus
gaaatgtgggttcttcgagctgaaa

SEQ ID NO: 412312 - DNA, 25 bp, Mus musculus
gaaatgtgggttgttcgagctgaaa

SEQ ID NO: 412313 - DNA, 25 bp, Mus musculus
gaaatgtggtatacctgctttgtcc

SEQ ID NO: 412314 - DNA, 25 bp, Mus musculus
gaaatgtggtattcctgctttgtcc

SEQ ID NO: 412315 - DNA, 25 bp, Mus musculus
gaaatgtggtgaagctttgcttata

SEQ ID NO: 412316 - DNA, 25 bp, Mus musculus
gaaatgtggtgatgctttgcttata

SEQ ID NO: 412317 - DNA, 25 bp, Mus musculus
gaaatgtggtgtaatcctcagctcc

SEQ ID NO: 412318 - DNA, 25 bp, Mus musculus
gaaatgtggtgttatcctcagctcc

SEQ ID NO: 412319 - DNA, 25 bp, Mus musculus
gaaatgtggttcctcatcaggataa

SEQ ID NO: 412320 - DNA, 25 bp, Mus musculus
gaaatgtggttcgtcatcaggataa

SEQ ID NO: 412321 - DNA, 25 bp, Mus musculus
gaaatgtgtacccagaagacatgat

SEQ ID NO: 412322 - DNA, 25 bp, Mus musculus
gaaatgtgtaccgagaagacatgat

SEQ ID NO: 412323 - DNA, 25 bp, Mus musculus
gaaatgtgtcacagttgaacttgta

SEQ ID NO: 412324 - DNA, 25 bp, Mus musculus
gaaatgtgtcaccttaaccagatgt

SEQ ID NO: 412325 - DNA, 25 bp, Mus musculus
gaaatgtgtcacgttaaccagatgt

SEQ ID NO: 412326 - DNA, 25 bp, Mus musculus
gaaatgtgtcactgttgaacttgta

SEQ ID NO: 412327 - DNA, 25 bp, Mus musculus
gaaatgtgtctcagctatggtacta

SEQ ID NO: 412328 - DNA, 25 bp, Mus musculus
gaaatgtgtctcagtgccaatgtca

SEQ ID NO: 412329 - DNA, 25 bp, Mus musculus
gaaatgtgtctctgctatggtacta

SEQ ID NO: 412330 - DNA, 25 bp, Mus musculus
gaaatgtgtctctgtgccaatgtca

SEQ ID NO: 412331 - DNA, 25 bp, Mus musculus
gaaatgtgtgacaatgtcttcagca

SEQ ID NO: 412332 - DNA, 25 bp, Mus musculus
gaaatgtgtgactatgtcttcagca

SEQ ID NO: 412333 - DNA, 25 bp, Mus musculus
gaaatgtgttccaagtttacgaggg

SEQ ID NO: 412334 - DNA, 25 bp, Mus musculus
gaaatgtgttccatcacgaggcagg

SEQ ID NO: 412335 - DNA, 25 bp, Mus musculus
gaaatgtgttcctagtttacgaggg

SEQ ID NO: 412336 - DNA, 25 bp, Mus musculus
gaaatgtgttccttcacgaggcagg

SEQ ID NO: 412337 - DNA, 25 bp, Mus musculus
gaaatgtgtttactcaactttacca

SEQ ID NO: 412338 - DNA, 25 bp, Mus musculus
gaaatgtgtttagtcaactttacca

SEQ ID NO: 412339 - DNA, 25 bp, Mus musculus
gaaatgttaactcgagcaccgctcc

SEQ ID NO: 412340 - DNA, 25 bp, Mus musculus
gaaatgttaactggagcaccgctcc

SEQ ID NO: 412341 - DNA, 25 bp, Mus musculus
gaaatgttacaacttgtgcttctgt

SEQ ID NO: 412342 - DNA, 25 bp, Mus musculus
gaaatgttacaagttgtgcttctgt

SEQ ID NO: 412343 - DNA, 25 bp, Mus musculus
gaaatgttacataagccttatctga

SEQ ID NO: 412344 - DNA, 25 bp, Mus musculus
gaaatgttacattagccttatctga

SEQ ID NO: 412345 - DNA, 25 bp, Mus musculus
gaaatgttaccgagccatactaaat

SEQ ID NO: 412346 - DNA, 25 bp, Mus musculus
gaaatgttaccgtgccatactaaat

SEQ ID NO: 412347 - DNA, 25 bp, Mus musculus
gaaatgttactgatgaaaggcccta

SEQ ID NO: 412348 - DNA, 25 bp, Mus musculus
gaaatgttactgttgaaaggcccta

SEQ ID NO: 412349 - DNA, 25 bp, Mus musculus
gaaatgttagtccatcctcagctag

SEQ ID NO: 412350 - DNA, 25 bp, Mus musculus
gaaatgttagtcgatcctcagctag

SEQ ID NO: 412351 - DNA, 25 bp, Mus musculus
gaaatgttagtgagcccagtcttgc

SEQ ID NO: 412352 - DNA, 25 bp, Mus musculus
gaaatgttagtgtgcccagtcttgc

SEQ ID NO: 412353 - DNA, 25 bp, Mus musculus
gaaatgttcaaaagtttattgtcat

SEQ ID NO: 412354 - DNA, 25 bp, Mus musculus
gaaatgttcaaatgtttattgtcat

SEQ ID NO: 412355 - DNA, 25 bp, Mus musculus
gaaatgttcatcacaccaattattc

SEQ ID NO: 412356 - DNA, 25 bp, Mus musculus
gaaatgttcatctcaccaattattc

SEQ ID NO: 412357 - DNA, 25 bp, Mus musculus
gaaatgttccacattctgtataaag

SEQ ID NO: 412358 - DNA, 25 bp, Mus musculus
gaaatgttccactttctgtataaag

SEQ ID NO: 412359 - DNA, 25 bp, Mus musculus
gaaatgttccctctgaagttccata

SEQ ID NO: 412360 - DNA, 25 bp, Mus musculus
gaaatgttccctgtgaagttccata

SEQ ID NO: 412361 - DNA, 25 bp, Mus musculus
gaaatgttcctgatttcctagtcag

SEQ ID NO: 412362 - DNA, 25 bp, Mus musculus
gaaatgttcctgttttcctagtcag

SEQ ID NO: 412363 - DNA, 25 bp, Mus musculus
gaaatgttcgacactgtatgattat

SEQ ID NO: 412364 - DNA, 25 bp, Mus musculus
gaaatgttcgactctgtatgattat

SEQ ID NO: 412365 - DNA, 25 bp, Mus musculus
gaaatgttctctagagcaggccctg

SEQ ID NO: 412366 - DNA, 25 bp, Mus musculus
gaaatgttctctatggtcaagtgac

SEQ ID NO: 412367 - DNA, 25 bp, Mus musculus
gaaatgttctctcctacgaatgagc

SEQ ID NO: 412368 - DNA, 25 bp, Mus musculus
gaaatgttctctgctacgaatgagc

SEQ ID NO: 412369 - DNA, 25 bp, Mus musculus
gaaatgttctcttgagcaggccctg

SEQ ID NO: 412370 - DNA, 25 bp, Mus musculus
gaaatgttctctttggtcaagtgac

SEQ ID NO: 412371 - DNA, 25 bp, Mus musculus
gaaatgttctgaaaggaccttgacc

SEQ ID NO: 412372 - DNA, 25 bp, Mus musculus
gaaatgttctgataggaccttgacc

SEQ ID NO: 412373 - DNA, 25 bp, Mus musculus
gaaatgttcttaatccctgagtttt

SEQ ID NO: 412374 - DNA, 25 bp, Mus musculus
gaaatgttcttattccctgagtttt

SEQ ID NO: 412375 - DNA, 25 bp, Mus musculus
gaaatgttcttccagttgtcatcct

SEQ ID NO: 412376 - DNA, 25 bp, Mus musculus
gaaatgttcttcgagttgtcatcct

SEQ ID NO: 412377 - DNA, 25 bp, Mus musculus
gaaatgttctttctcactgtgaagc

SEQ ID NO: 412378 - DNA, 25 bp, Mus musculus
gaaatgttctttgtcactgtgaagc

SEQ ID NO: 412379 - DNA, 25 bp, Mus musculus
gaaatgttgaaccactggtctgcac

SEQ ID NO: 412380 - DNA, 25 bp, Mus musculus
gaaatgttgaacgactggtctgcac

SEQ ID NO: 412381 - DNA, 25 bp, Mus musculus
gaaatgttgcacatcaacttaacat

SEQ ID NO: 412382 - DNA, 25 bp, Mus musculus
gaaatgttgcacttcaacttaacat

SEQ ID NO: 412383 - DNA, 25 bp, Mus musculus
gaaatgttgccaagtgccataccaa

SEQ ID NO: 412384 - DNA, 25 bp, Mus musculus
gaaatgttgccatgtgccataccaa

SEQ ID NO: 412385 - DNA, 25 bp, Mus musculus
gaaatgttgcctaccaagcagagac

SEQ ID NO: 412386 - DNA, 25 bp, Mus musculus
gaaatgttgccttccaagcagagac

SEQ ID NO: 412387 - DNA, 25 bp, Mus musculus
gaaatgttgctacttgtactccaag

SEQ ID NO: 412388 - DNA, 25 bp, Mus musculus
gaaatgttgctagttgtactccaag

SEQ ID NO: 412389 - DNA, 25 bp, Mus musculus
gaaatgttgctgctaggcttaccac

SEQ ID NO: 412390 - DNA, 25 bp, Mus musculus
gaaatgttgctggtaggcttaccac

SEQ ID NO: 412391 - DNA, 25 bp, Mus musculus
gaaatgttgcttctacactcactgg

SEQ ID NO: 412392 - DNA, 25 bp, Mus musculus
gaaatgttgcttgtacactcactgg

SEQ ID NO: 412393 - DNA, 25 bp, Mus musculus
gaaatgttggctctcgacgcaccga

SEQ ID NO: 412394 - DNA, 25 bp, Mus musculus
gaaatgttggctgtcgacgcaccga

SEQ ID NO: 412395 - DNA, 25 bp, Mus musculus
gaaatgttgggacgctcttcccact

SEQ ID NO: 412396 - DNA, 25 bp, Mus musculus
gaaatgttgggaggctcttcccact

SEQ ID NO: 412397 - DNA, 25 bp, Mus musculus
gaaatgttggtaatatgtgactcag

SEQ ID NO: 412398 - DNA, 25 bp, Mus musculus
gaaatgttggtaatgctactgggcc

SEQ ID NO: 412399 - DNA, 25 bp, Mus musculus
gaaatgttggtattatgtgactcag

SEQ ID NO: 412400 - DNA, 25 bp, Mus musculus
gaaatgttggtattgctactgggcc

SEQ ID NO: 412401 - DNA, 25 bp, Mus musculus
gaaatgttgtatagactctctgagt

SEQ ID NO: 412402 - DNA, 25 bp, Mus musculus
gaaatgttgtattgactctctgagt

SEQ ID NO: 412403 - DNA, 25 bp, Mus musculus
gaaatgtttacaagttgcacccagc

SEQ ID NO: 412404 - DNA, 25 bp, Mus musculus
gaaatgtttacatgttgcacccagc

SEQ ID NO: 412405 - DNA, 25 bp, Mus musculus
gaaatgtttactactctctttccac

SEQ ID NO: 412406 - DNA, 25 bp, Mus musculus
gaaatgtttacttctctctttccac

SEQ ID NO: 412407 - DNA, 25 bp, Mus musculus
gaaatgtttatcaaaggcctgacag

SEQ ID NO: 412408 - DNA, 25 bp, Mus musculus
gaaatgtttatctaaggcctgacag

SEQ ID NO: 412409 - DNA, 25 bp, Mus musculus
gaaatgtttcagagccttggaatat

SEQ ID NO: 412410 - DNA, 25 bp, Mus musculus
gaaatgtttcagtgccttggaatat

SEQ ID NO: 412411 - DNA, 25 bp, Mus musculus
gaaatgtttcccaaataaggtgcaa

SEQ ID NO: 412412 - DNA, 25 bp, Mus musculus
gaaatgtttccctaataaggtgcaa

SEQ ID NO: 412413 - DNA, 25 bp, Mus musculus
gaaatgtttcctactgctaaagttt

SEQ ID NO: 412414 - DNA, 25 bp, Mus musculus
gaaatgtttccttctgctaaagttt

SEQ ID NO: 412415 - DNA, 25 bp, Mus musculus
gaaatgtttgcacactctactagtt

SEQ ID NO: 412416 - DNA, 25 bp, Mus musculus
gaaatgtttgcagactctactagtt

SEQ ID NO: 412417 - DNA, 25 bp, Mus musculus
gaaatgtttgccagacacgcgaaaa

SEQ ID NO: 412418 - DNA, 25 bp, Mus musculus
gaaatgtttgcctgacacgcgaaaa

SEQ ID NO: 412419 - DNA, 25 bp, Mus musculus
gaaatgtttgctagaaactccctca

SEQ ID NO: 412420 - DNA, 25 bp, Mus musculus
gaaatgtttgcttgaaactccctca

SEQ ID NO: 412421 - DNA, 25 bp, Mus musculus
gaaatgtttggaaatgccactgtaa

SEQ ID NO: 412422 - DNA, 25 bp, Mus musculus
gaaatgtttggatatgccactgtaa

SEQ ID NO: 412423 - DNA, 25 bp, Mus musculus
gaaatgtttgtcagtttgcacactg

SEQ ID NO: 412424 - DNA, 25 bp, Mus musculus
gaaatgtttgtctgtttgcacactg

SEQ ID NO: 412425 - DNA, 25 bp, Mus musculus
gaaatgtttgttaggatctcctcta

SEQ ID NO: 412426 - DNA, 25 bp, Mus musculus
gaaatgtttgtttggatctcctcta

SEQ ID NO: 412427 - DNA, 25 bp, Mus musculus
gaaatgttttacctttgtcagtttg

SEQ ID NO: 412428 - DNA, 25 bp, Mus musculus
gaaatgttttacgtttgtcagtttg

SEQ ID NO: 412429 - DNA, 25 bp, Mus musculus
gaaatgttttctacccttcatagca

SEQ ID NO: 412430 - DNA, 25 bp, Mus musculus
gaaatgttttcttcccttcatagca

SEQ ID NO: 412431 - DNA, 25 bp, Mus musculus
gaaatgttttgcctacttcaactgg

SEQ ID NO: 412432 - DNA, 25 bp, Mus musculus
gaaatgttttgcgtacttcaactgg

SEQ ID NO: 412433 - DNA, 25 bp, Mus musculus
gaaatgtttttaacacccaactctg

SEQ ID NO: 412434 - DNA, 25 bp, Mus musculus
gaaatgtttttatcacccaactctg

SEQ ID NO: 412435 - DNA, 25 bp, Mus musculus
gaaattaaaaaccttctgcacagga

SEQ ID NO: 412436 - DNA, 25 bp, Mus musculus
gaaattaaaaacgttctgcacagga

SEQ ID NO: 412437 - DNA, 25 bp, Mus musculus
gaaattaaacctaagactagaccat

SEQ ID NO: 412438 - DNA, 25 bp, Mus musculus
gaaattaaacctccaagtgaaacat

SEQ ID NO: 412439 - DNA, 25 bp, Mus musculus
gaaattaaacctgcaagtgaaacat

SEQ ID NO: 412440 - DNA, 25 bp, Mus musculus
gaaattaaaccttagactagaccat

SEQ ID NO: 412441 - DNA, 25 bp, Mus musculus
gaaattaaactgatccctgcagaag

SEQ ID NO: 412442 - DNA, 25 bp, Mus musculus
gaaattaaactgttccctgcagaag

SEQ ID NO: 412443 - DNA, 25 bp, Mus musculus
gaaattaaagacatccctagaaaat

SEQ ID NO: 412444 - DNA, 25 bp, Mus musculus
gaaattaaagacttccctagaaaat

SEQ ID NO: 412445 - DNA, 25 bp, Mus musculus
gaaattaaagccctctcttatcctt

SEQ ID NO: 412446 - DNA, 25 bp, Mus musculus
gaaattaaagccgtctcttatcctt

SEQ ID NO: 412447 - DNA, 25 bp, Mus musculus
gaaattaaagctatgtgaccacccc

SEQ ID NO: 412448 - DNA, 25 bp, Mus musculus
gaaattaaagctttgtgaccacccc

SEQ ID NO: 412449 - DNA, 25 bp, Mus musculus
gaaattaacctaaactttgcagtgt

SEQ ID NO: 412450 - DNA, 25 bp, Mus musculus
gaaattaacctatactttgcagtgt

SEQ ID NO: 412451 - DNA, 25 bp, Mus musculus
gaaattaagctgcactcatgtattg

SEQ ID NO: 412452 - DNA, 25 bp, Mus musculus
gaaattaagctgctttctcccttgg

SEQ ID NO: 412453 - DNA, 25 bp, Mus musculus
gaaattaagctggactcatgtattg

SEQ ID NO: 412454 - DNA, 25 bp, Mus musculus
gaaattaagctggtttctcccttgg

SEQ ID NO: 412455 - DNA, 25 bp, Mus musculus
gaaattaagtatacacatcgtgccg

SEQ ID NO: 412456 - DNA, 25 bp, Mus musculus
gaaattaagtattcacatcgtgccg

SEQ ID NO: 412457 - DNA, 25 bp, Mus musculus
gaaattaagtcgatcgtccctgttc

SEQ ID NO: 412458 - DNA, 25 bp, Mus musculus
gaaattaagtcgttcgtccctgttc

SEQ ID NO: 412459 - DNA, 25 bp, Mus musculus
gaaattaatgatacggcacccggtt

SEQ ID NO: 412460 - DNA, 25 bp, Mus musculus
gaaattaatgattcggcacccggtt

SEQ ID NO: 412461 - DNA, 25 bp, Mus musculus
gaaattaatgcccacatgttgaact

SEQ ID NO: 412462 - DNA, 25 bp, Mus musculus
gaaattaatgccgacatgttgaact

SEQ ID NO: 412463 - DNA, 25 bp, Mus musculus
gaaattaatgtaccagcccacacac

SEQ ID NO: 412464 - DNA, 25 bp, Mus musculus
gaaattaatgtagcagcccacacac

SEQ ID NO: 412465 - DNA, 25 bp, Mus musculus
gaaattaatgtgctgctatgggtat

SEQ ID NO: 412466 - DNA, 25 bp, Mus musculus
gaaattaatgtggtgctatgggtat

SEQ ID NO: 412467 - DNA, 25 bp, Mus musculus
gaaattacaaacaccctgcaagcta

SEQ ID NO: 412468 - DNA, 25 bp, Mus musculus
gaaattacaaactccctgcaagcta

SEQ ID NO: 412469 - DNA, 25 bp, Mus musculus
gaaattacaaatccatccacaaaat

SEQ ID NO: 412470 - DNA, 25 bp, Mus musculus
gaaattacaaatgcatccacaaaat

SEQ ID NO: 412471 - DNA, 25 bp, Mus musculus
gaaattacaagccagggttccttct

SEQ ID NO: 412472 - DNA, 25 bp, Mus musculus
gaaattacaagcgagggttccttct

SEQ ID NO: 412473 - DNA, 25 bp, Mus musculus
gaaattacagcaaggttccttcacc

SEQ ID NO: 412474 - DNA, 25 bp, Mus musculus
gaaattacagcatggttccttcacc

SEQ ID NO: 412475 - DNA, 25 bp, Mus musculus
gaaattacaggacctgctattttat

SEQ ID NO: 412476 - DNA, 25 bp, Mus musculus
gaaattacaggagctgctattttat

SEQ ID NO: 412477 - DNA, 25 bp, Mus musculus
gaaattacagtgatgggagccgacc

SEQ ID NO: 412478 - DNA, 25 bp, Mus musculus
gaaattacagtgttgggagccgacc

SEQ ID NO: 412479 - DNA, 25 bp, Mus musculus
gaaattaccaaaaccctaagacaat

SEQ ID NO: 412480 - DNA, 25 bp, Mus musculus
gaaattaccaaatccctaagacaat

SEQ ID NO: 412481 - DNA, 25 bp, Mus musculus
gaaattacccaaattaggctacagt

SEQ ID NO: 412482 - DNA, 25 bp, Mus musculus
gaaattacccaatttaggctacagt

SEQ ID NO: 412483 - DNA, 25 bp, Mus musculus
gaaattacccagcaacataactctt

SEQ ID NO: 412484 - DNA, 25 bp, Mus musculus
gaaattacccaggaacataactctt

SEQ ID NO: 412485 - DNA, 25 bp, Mus musculus
gaaattacccggagtcgtggcccag

SEQ ID NO: 412486 - DNA, 25 bp, Mus musculus
gaaattacccggtgtcgtggcccag

SEQ ID NO: 412487 - DNA, 25 bp, Mus musculus
gaaattacctgaaacaagcagctgt

SEQ ID NO: 412488 - DNA, 25 bp, Mus musculus
gaaattacctgatacaagcagctgt

SEQ ID NO: 412489 - DNA, 25 bp, Mus musculus
gaaattaccttcatcagtgtactag

SEQ ID NO: 412490 - DNA, 25 bp, Mus musculus
gaaattaccttcttcagtgtactag

SEQ ID NO: 412491 - DNA, 25 bp, Mus musculus
gaaattactaaaatgtcctgtctta

SEQ ID NO: 412492 - DNA, 25 bp, Mus musculus
gaaattactaaattgtcctgtctta

SEQ ID NO: 412493 - DNA, 25 bp, Mus musculus
gaaattactcgtcaacaggcggcag

SEQ ID NO: 412494 - DNA, 25 bp, Mus musculus
gaaattactcgtgaacaggcggcag

SEQ ID NO: 412495 - DNA, 25 bp, Mus musculus
gaaattactgctattactatctgta

SEQ ID NO: 412496 - DNA, 25 bp, Mus musculus
gaaattactgcttttactatctgta

SEQ ID NO: 412497 - DNA, 25 bp, Mus musculus
gaaattacttttcatccacattgtt

SEQ ID NO: 412498 - DNA, 25 bp, Mus musculus
gaaattacttttgatccacattgtt

SEQ ID NO: 412499 - DNA, 25 bp, Mus musculus
gaaattagaacccttcttcacagga

SEQ ID NO: 412500 - DNA, 25 bp, Mus musculus
gaaattagaaccgttcttcacagga

SEQ ID NO: 412501 - DNA, 25 bp, Mus musculus
gaaattagactgagccccttgactt

SEQ ID NO: 412502 - DNA, 25 bp, Mus musculus
gaaattagactgtgccccttgactt

SEQ ID NO: 412503 - DNA, 25 bp, Mus musculus
gaaattagcaaaccatgaacacgaa

SEQ ID NO: 412504 - DNA, 25 bp, Mus musculus
gaaattagcaaagcatgaacacgaa

SEQ ID NO: 412505 - DNA, 25 bp, Mus musculus
gaaattagcaccatccttggatccc

SEQ ID NO: 412506 - DNA, 25 bp, Mus musculus
gaaattagcaccttccttggatccc

SEQ ID NO: 412507 - DNA, 25 bp, Mus musculus
gaaattagcctgaggatctttaaaa

SEQ ID NO: 412508 - DNA, 25 bp, Mus musculus
gaaattagcctgtggatctttaaaa

SEQ ID NO: 412509 - DNA, 25 bp, Mus musculus
gaaattagcttacacccttttcagt

SEQ ID NO: 412510 - DNA, 25 bp, Mus musculus
gaaattagcttagacccttttcagt

SEQ ID NO: 412511 - DNA, 25 bp, Mus musculus
gaaattagcttcaccactttggtat

SEQ ID NO: 412512 - DNA, 25 bp, Mus musculus
gaaattagcttctccactttggtat

SEQ ID NO: 412513 - DNA, 25 bp, Mus musculus
gaaattagggacagcctctcagcca

SEQ ID NO: 412514 - DNA, 25 bp, Mus musculus
gaaattagggactgcctctcagcca

SEQ ID NO: 412515 - DNA, 25 bp, Mus musculus
gaaattaggtccatgtctccaaaga

SEQ ID NO: 412516 - DNA, 25 bp, Mus musculus
gaaattaggtccttgtctccaaaga

SEQ ID NO: 412517 - DNA, 25 bp, Mus musculus
gaaattaggtgaatgtactggagaa

SEQ ID NO: 412518 - DNA, 25 bp, Mus musculus
gaaattaggtgattgtactggagaa

SEQ ID NO: 412519 - DNA, 25 bp, Mus musculus
gaaattaggtttagatggcagcagc

SEQ ID NO: 412520 - DNA, 25 bp, Mus musculus
gaaattaggttttgatggcagcagc

SEQ ID NO: 412521 - DNA, 25 bp, Mus musculus
gaaattagtatcatagagggcccaa

SEQ ID NO: 412522 - DNA, 25 bp, Mus musculus
gaaattagtatcttagagggcccaa

SEQ ID NO: 412523 - DNA, 25 bp, Mus musculus
gaaattagtgccagttttcttgcaa

SEQ ID NO: 412524 - DNA, 25 bp, Mus musculus
gaaattagtgcctgttttcttgcaa

SEQ ID NO: 412525 - DNA, 25 bp, Mus musculus
gaaattagttccacttaaagtgcaa

SEQ ID NO: 412526 - DNA, 25 bp, Mus musculus
gaaattagttcctcttaaagtgcaa

SEQ ID NO: 412527 - DNA, 25 bp, Mus musculus
gaaattagttctcgagggtgctccc

SEQ ID NO: 412528 - DNA, 25 bp, Mus musculus
gaaattagttctggagggtgctccc

SEQ ID NO: 412529 - DNA, 25 bp, Mus musculus
gaaattatacatagaggctgcctct

SEQ ID NO: 412530 - DNA, 25 bp, Mus musculus
gaaattatacattgaggctgcctct

SEQ ID NO: 412531 - DNA, 25 bp, Mus musculus
gaaattatagaacaggctggcatga

SEQ ID NO: 412532 - DNA, 25 bp, Mus musculus
gaaattatagaagaggctggcatga

SEQ ID NO: 412533 - DNA, 25 bp, Mus musculus
gaaattatagtgcacagcaacaatc

SEQ ID NO: 412534 - DNA, 25 bp, Mus musculus
gaaattatagtggacagcaacaatc

SEQ ID NO: 412535 - DNA, 25 bp, Mus musculus
gaaattatatctctagggccagtga

SEQ ID NO: 412536 - DNA, 25 bp, Mus musculus
gaaattatatctgtagggccagtga

SEQ ID NO: 412537 - DNA, 25 bp, Mus musculus
gaaattatcactcaacatagctata

SEQ ID NO: 412538 - DNA, 25 bp, Mus musculus
gaaattatcactgaacatagctata

SEQ ID NO: 412539 - DNA, 25 bp, Mus musculus
gaaattatccacatcctcaagacaa

SEQ ID NO: 412540 - DNA, 25 bp, Mus musculus
gaaattatccacttcctcaagacaa

SEQ ID NO: 412541 - DNA, 25 bp, Mus musculus
gaaattatccgacacgtggacctca

SEQ ID NO: 412542 - DNA, 25 bp, Mus musculus
gaaattatccgagacgtggacctca

SEQ ID NO: 412543 - DNA, 25 bp, Mus musculus
gaaattatcctaatggctcttgtat

SEQ ID NO: 412544 - DNA, 25 bp, Mus musculus
gaaattatcctattggctcttgtat

SEQ ID NO: 412545 - DNA, 25 bp, Mus musculus
gaaattatctcgacataattctttt

SEQ ID NO: 412546 - DNA, 25 bp, Mus musculus
gaaattatctcgtcataattctttt

SEQ ID NO: 412547 - DNA, 25 bp, Mus musculus
gaaattatctgccttcgttttacct

SEQ ID NO: 412548 - DNA, 25 bp, Mus musculus
gaaattatctgcgttcgttttacct

SEQ ID NO: 412549 - DNA, 25 bp, Mus musculus
gaaattattagcagcaatgtatgaa

SEQ ID NO: 412550 - DNA, 25 bp, Mus musculus
gaaattattagctgcaatgtatgaa

SEQ ID NO: 412551 - DNA, 25 bp, Mus musculus
gaaattattcatctcccatggcagc

SEQ ID NO: 412552 - DNA, 25 bp, Mus musculus
gaaattattcatgtcccatggcagc

SEQ ID NO: 412553 - DNA, 25 bp, Mus musculus
gaaattattctaaccagtccaagag

SEQ ID NO: 412554 - DNA, 25 bp, Mus musculus
gaaattattctatccagtccaagag

SEQ ID NO: 412555 - DNA, 25 bp, Mus musculus
gaaattattggaaaacctctacaaa

SEQ ID NO: 412556 - DNA, 25 bp, Mus musculus
gaaattattggataacctctacaaa

SEQ ID NO: 412557 - DNA, 25 bp, Mus musculus
gaaattattggcctgggttgtgatt

SEQ ID NO: 412558 - DNA, 25 bp, Mus musculus
gaaattattggcgtgggttgtgatt

SEQ ID NO: 412559 - DNA, 25 bp, Mus musculus
gaaattatttctatctgccatctca

SEQ ID NO: 412560 - DNA, 25 bp, Mus musculus
gaaattatttctttctgccatctca

SEQ ID NO: 412561 - DNA, 25 bp, Mus musculus
gaaattcaaactccagtgttcataa

SEQ ID NO: 412562 - DNA, 25 bp, Mus musculus
gaaattcaaactgcagtgttcataa

SEQ ID NO: 412563 - DNA, 25 bp, Mus musculus
gaaattcaaaggcatcctcagcgac

SEQ ID NO: 412564 - DNA, 25 bp, Mus musculus
gaaattcaaagggatcctcagcgac

SEQ ID NO: 412565 - DNA, 25 bp, Mus musculus
gaaattcaacaaaccaagctgccaa

SEQ ID NO: 412566 - DNA, 25 bp, Mus musculus
gaaattcaacaatccaagctgccaa

SEQ ID NO: 412567 - DNA, 25 bp, Mus musculus
gaaattcaaggtcatgctctactac

SEQ ID NO: 412568 - DNA, 25 bp, Mus musculus
gaaattcaaggtgatgctctactac

SEQ ID NO: 412569 - DNA, 25 bp, Mus musculus
gaaattcaagtccttttatgccata

SEQ ID NO: 412570 - DNA, 25 bp, Mus musculus
gaaattcaagtcgttttatgccata

SEQ ID NO: 412571 - DNA, 25 bp, Mus musculus
gaaattcaagtgaacctgccataac

SEQ ID NO: 412572 - DNA, 25 bp, Mus musculus
gaaattcaagtgtacctgccataac

SEQ ID NO: 412573 - DNA, 25 bp, Mus musculus
gaaattcaataaaggcagtgatgtg

SEQ ID NO: 412574 - DNA, 25 bp, Mus musculus
gaaattcaataatggcagtgatgtg

SEQ ID NO: 412575 - DNA, 25 bp, Mus musculus
gaaattcaatgtagtccatcttagt

SEQ ID NO: 412576 - DNA, 25 bp, Mus musculus
gaaattcaatgttgtccatcttagt

SEQ ID NO: 412577 - DNA, 25 bp, Mus musculus
gaaattcacacgacctctattcaag

SEQ ID NO: 412578 - DNA, 25 bp, Mus musculus
gaaattcacacgtcctctattcaag

SEQ ID NO: 412579 - DNA, 25 bp, Mus musculus
gaaattcaccaacactagtttgtgg

SEQ ID NO: 412580 - DNA, 25 bp, Mus musculus
gaaattcaccaagactagtttgtgg

SEQ ID NO: 412581 - DNA, 25 bp, Mus musculus
gaaattcaccctaactgggcttgac

SEQ ID NO: 412582 - DNA, 25 bp, Mus musculus
gaaattcaccctcacatgggctgtt

SEQ ID NO: 412583 - DNA, 25 bp, Mus musculus
gaaattcaccctgacatgggctgtt

SEQ ID NO: 412584 - DNA, 25 bp, Mus musculus
gaaattcacccttactgggcttgac

SEQ ID NO: 412585 - DNA, 25 bp, Mus musculus
gaaattcacctgatccttcagatat

SEQ ID NO: 412586 - DNA, 25 bp, Mus musculus
gaaattcacctgttccttcagatat

SEQ ID NO: 412587 - DNA, 25 bp, Mus musculus
gaaattcacgcaagcatccgagtaa

SEQ ID NO: 412588 - DNA, 25 bp, Mus musculus
gaaattcacgcatgcatccgagtaa

SEQ ID NO: 412589 - DNA, 25 bp, Mus musculus
gaaattcagactctccaagcaattg

SEQ ID NO: 412590 - DNA, 25 bp, Mus musculus
gaaattcagactgtccaagcaattg

SEQ ID NO: 412591 - DNA, 25 bp, Mus musculus
gaaattcagagccaaccagagaact

SEQ ID NO: 412592 - DNA, 25 bp, Mus musculus
gaaattcagagcgaaccagagaact

SEQ ID NO: 412593 - DNA, 25 bp, Mus musculus
gaaattcagcaacaaatacctcctt

SEQ ID NO: 412594 - DNA, 25 bp, Mus musculus
gaaattcagcaagaaatacctcctt

SEQ ID NO: 412595 - DNA, 25 bp, Mus musculus
gaaattcagctaatctcttctcctt

SEQ ID NO: 412596 - DNA, 25 bp, Mus musculus
gaaattcagctattctcttctcctt

SEQ ID NO: 412597 - DNA, 25 bp, Mus musculus
gaaattcaggcgagttctgcccagg

SEQ ID NO: 412598 - DNA, 25 bp, Mus musculus
gaaattcaggcgcacatgctcacag

SEQ ID NO: 412599 - DNA, 25 bp, Mus musculus
gaaattcaggcggacatgctcacag

SEQ ID NO: 412600 - DNA, 25 bp, Mus musculus
gaaattcaggcgtgttctgcccagg

SEQ ID NO: 412601 - DNA, 25 bp, Mus musculus
gaaattcagggcctcctaagcaggg

SEQ ID NO: 412602 - DNA, 25 bp, Mus musculus
gaaattcagggcgtcctaagcaggg

SEQ ID NO: 412603 - DNA, 25 bp, Mus musculus
gaaattcagtcactcatatcaacat

SEQ ID NO: 412604 - DNA, 25 bp, Mus musculus
gaaattcagtcagtcatatcaacat

SEQ ID NO: 412605 - DNA, 25 bp, Mus musculus
gaaattcagtgcattggtctgtaat

SEQ ID NO: 412606 - DNA, 25 bp, Mus musculus
gaaattcagtgccttgaaccacaga

SEQ ID NO: 412607 - DNA, 25 bp, Mus musculus
gaaattcagtgcgttgaaccacaga

SEQ ID NO: 412608 - DNA, 25 bp, Mus musculus
gaaattcagtgctttggtctgtaat

SEQ ID NO: 412609 - DNA, 25 bp, Mus musculus
gaaattcatcgcctgggttccagaa

SEQ ID NO: 412610 - DNA, 25 bp, Mus musculus
gaaattcatcgcgtgggttccagaa

SEQ ID NO: 412611 - DNA, 25 bp, Mus musculus
gaaattcatggaacttttgcatcga

SEQ ID NO: 412612 - DNA, 25 bp, Mus musculus
gaaattcatggaagcctaggtgggc

SEQ ID NO: 412613 - DNA, 25 bp, Mus musculus
gaaattcatggatcttttgcatcga

SEQ ID NO: 412614 - DNA, 25 bp, Mus musculus
gaaattcatggatgcctaggtgggc

SEQ ID NO: 412615 - DNA, 25 bp, Mus musculus
gaaattcattatagaccctcttgag

SEQ ID NO: 412616 - DNA, 25 bp, Mus musculus
gaaattcattattgaccctcttgag

SEQ ID NO: 412617 - DNA, 25 bp, Mus musculus
gaaattcattttcctttctgcctac

SEQ ID NO: 412618 - DNA, 25 bp, Mus musculus
gaaattcattttgctttctgcctac

SEQ ID NO: 412619 - DNA, 25 bp, Mus musculus
gaaattccaaccatcacagggtagc

SEQ ID NO: 412620 - DNA, 25 bp, Mus musculus
gaaattccaaccttcacagggtagc

SEQ ID NO: 412621 - DNA, 25 bp, Mus musculus
gaaattccaatgaacgtgcagctta

SEQ ID NO: 412622 - DNA, 25 bp, Mus musculus
gaaattccaatgtacgtgcagctta

SEQ ID NO: 412623 - DNA, 25 bp, Mus musculus
gaaattccacaaactgtgcctgttg

SEQ ID NO: 412624 - DNA, 25 bp, Mus musculus
gaaattccacaatctgtgcctgttg

SEQ ID NO: 412625 - DNA, 25 bp, Mus musculus
gaaattccacatctgttttgaaaag

SEQ ID NO: 412626 - DNA, 25 bp, Mus musculus
gaaattccacatgtgttttgaaaag

SEQ ID NO: 412627 - DNA, 25 bp, Mus musculus
gaaattccactgagactcttggcat

SEQ ID NO: 412628 - DNA, 25 bp, Mus musculus
gaaattccactgcatgctgaagaag

SEQ ID NO: 412629 - DNA, 25 bp, Mus musculus
gaaattccactggatgctgaagaag

SEQ ID NO: 412630 - DNA, 25 bp, Mus musculus
gaaattccactgtgactcttggcat

SEQ ID NO: 412631 - DNA, 25 bp, Mus musculus
gaaattccagccactgtcaacgcaa

SEQ ID NO: 412632 - DNA, 25 bp, Mus musculus
gaaattccagcctctgtcaacgcaa

SEQ ID NO: 412633 - DNA, 25 bp, Mus musculus
gaaattccaggaatgaaacatacaa

SEQ ID NO: 412634 - DNA, 25 bp, Mus musculus
gaaattccaggattgaaacatacaa

SEQ ID NO: 412635 - DNA, 25 bp, Mus musculus
gaaattccaggcacagacattacat

SEQ ID NO: 412636 - DNA, 25 bp, Mus musculus
gaaattccaggcattaaagtcagtg

SEQ ID NO: 412637 - DNA, 25 bp, Mus musculus
gaaattccaggcctgtgttggtgaa

SEQ ID NO: 412638 - DNA, 25 bp, Mus musculus
gaaattccaggcgtgtgttggtgaa

SEQ ID NO: 412639 - DNA, 25 bp, Mus musculus
gaaattccaggctcagacattacat

SEQ ID NO: 412640 - DNA, 25 bp, Mus musculus
gaaattccaggctttaaagtcagtg

SEQ ID NO: 412641 - DNA, 25 bp, Mus musculus
gaaattccagttattcatgcattga

SEQ ID NO: 412642 - DNA, 25 bp, Mus musculus
gaaattccagtttttcatgcattga

SEQ ID NO: 412643 - DNA, 25 bp, Mus musculus
gaaattccatggcaaccagcactta

SEQ ID NO: 412644 - DNA, 25 bp, Mus musculus
gaaattccatgggaaccagcactta

SEQ ID NO: 412645 - DNA, 25 bp, Mus musculus
gaaattcccatgctagtattcttct

SEQ ID NO: 412646 - DNA, 25 bp, Mus musculus
gaaattcccatggtagtattcttct

SEQ ID NO: 412647 - DNA, 25 bp, Mus musculus
gaaattcccattccctctgcagtca

SEQ ID NO: 412648 - DNA, 25 bp, Mus musculus
gaaattcccattgcctctgcagtca

SEQ ID NO: 412649 - DNA, 25 bp, Mus musculus
gaaattccccgaaggaggcttcatt

SEQ ID NO: 412650 - DNA, 25 bp, Mus musculus
gaaattccccgatggaggcttcatt

SEQ ID NO: 412651 - DNA, 25 bp, Mus musculus
gaaattcccctacctgaagtaactg

SEQ ID NO: 412652 - DNA, 25 bp, Mus musculus
gaaattcccctagctgaagtaactg

SEQ ID NO: 412653 - DNA, 25 bp, Mus musculus
gaaattccctagactgatacctcag

SEQ ID NO: 412654 - DNA, 25 bp, Mus musculus
gaaattccctagtctgatacctcag

SEQ ID NO: 412655 - DNA, 25 bp, Mus musculus
gaaattccctgaaatcgtttcacta

SEQ ID NO: 412656 - DNA, 25 bp, Mus musculus
gaaattccctgatatcgtttcacta

SEQ ID NO: 412657 - DNA, 25 bp, Mus musculus
gaaattccctgcagttttggcttgc

SEQ ID NO: 412658 - DNA, 25 bp, Mus musculus
gaaattccctgctgttttggcttgc

SEQ ID NO: 412659 - DNA, 25 bp, Mus musculus
gaaattccgaagcacattcctgaaa

SEQ ID NO: 412660 - DNA, 25 bp, Mus musculus
gaaattccgaaggacattcctgaaa

SEQ ID NO: 412661 - DNA, 25 bp, Mus musculus
gaaattccgagaatcacagccaatg

SEQ ID NO: 412662 - DNA, 25 bp, Mus musculus
gaaattccgagattcacagccaatg

SEQ ID NO: 412663 - DNA, 25 bp, Mus musculus
gaaattccgggcagccttcctgaaa

SEQ ID NO: 412664 - DNA, 25 bp, Mus musculus
gaaattccgggctgccttcctgaaa

SEQ ID NO: 412665 - DNA, 25 bp, Mus musculus
gaaattccgtagcattcagttcttt

SEQ ID NO: 412666 - DNA, 25 bp, Mus musculus
gaaattccgtaggattcagttcttt

SEQ ID NO: 412667 - DNA, 25 bp, Mus musculus
gaaattccgtgacagcttgttccaa

SEQ ID NO: 412668 - DNA, 25 bp, Mus musculus
gaaattccgtgagagcttgttccaa

SEQ ID NO: 412669 - DNA, 25 bp, Mus musculus
gaaattcctaagatcaatgaaagag

SEQ ID NO: 412670 - DNA, 25 bp, Mus musculus
gaaattcctaagttcaatgaaagag

SEQ ID NO: 412671 - DNA, 25 bp, Mus musculus
gaaattcctacaattaagctctgat

SEQ ID NO: 412672 - DNA, 25 bp, Mus musculus
gaaattcctacaccttagactactg

SEQ ID NO: 412673 - DNA, 25 bp, Mus musculus
gaaattcctacagcttagactactg

SEQ ID NO: 412674 - DNA, 25 bp, Mus musculus
gaaattcctacatttaagctctgat

SEQ ID NO: 412675 - DNA, 25 bp, Mus musculus
gaaattcctatcacatatcccacta

SEQ ID NO: 412676 - DNA, 25 bp, Mus musculus
gaaattcctatctcatatcccacta

SEQ ID NO: 412677 - DNA, 25 bp, Mus musculus
gaaattcctcaaagtgtcggcgtcg

SEQ ID NO: 412678 - DNA, 25 bp, Mus musculus
gaaattcctcaatgtgtcggcgtcg

SEQ ID NO: 412679 - DNA, 25 bp, Mus musculus
gaaattcctgagaatccactgtgct

SEQ ID NO: 412680 - DNA, 25 bp, Mus musculus
gaaattcctgagtatccactgtgct

SEQ ID NO: 412681 - DNA, 25 bp, Mus musculus
gaaattcctgctcacaggccagtgc

SEQ ID NO: 412682 - DNA, 25 bp, Mus musculus
gaaattcctgctgacaggccagtgc

SEQ ID NO: 412683 - DNA, 25 bp, Mus musculus
gaaattcctgtgatataccatgtgt

SEQ ID NO: 412684 - DNA, 25 bp, Mus musculus
gaaattcctgtgcactgagctgatt

SEQ ID NO: 412685 - DNA, 25 bp, Mus musculus
gaaattcctgtggactgagctgatt

SEQ ID NO: 412686 - DNA, 25 bp, Mus musculus
gaaattcctgtgttataccatgtgt

SEQ ID NO: 412687 - DNA, 25 bp, Mus musculus
gaaattcctttcacctttgatcatt

SEQ ID NO: 412688 - DNA, 25 bp, Mus musculus
gaaattcctttctcctttgatcatt

SEQ ID NO: 412689 - DNA, 25 bp, Mus musculus
gaaattcgcctaaaacactacggaa

SEQ ID NO: 412690 - DNA, 25 bp, Mus musculus
gaaattcgcctataacactacggaa

SEQ ID NO: 412691 - DNA, 25 bp, Mus musculus
gaaattcggcacaatcactgtaatc

SEQ ID NO: 412692 - DNA, 25 bp, Mus musculus
gaaattcggcactatcactgtaatc

SEQ ID NO: 412693 - DNA, 25 bp, Mus musculus
gaaattcggtaccatccatatgaga

SEQ ID NO: 412694 - DNA, 25 bp, Mus musculus
gaaattcggtacgatccatatgaga

SEQ ID NO: 412695 - DNA, 25 bp, Mus musculus
gaaattctatacatgctattctttt

SEQ ID NO: 412696 - DNA, 25 bp, Mus musculus
gaaattctatacttgctattctttt

SEQ ID NO: 412697 - DNA, 25 bp, Mus musculus
gaaattctattcatcctgtgatctt

SEQ ID NO: 412698 - DNA, 25 bp, Mus musculus
gaaattctattcttcctgtgatctt

SEQ ID NO: 412699 - DNA, 25 bp, Mus musculus
gaaattctcaatctgtcttgccact

SEQ ID NO: 412700 - DNA, 25 bp, Mus musculus
gaaattctcaatgtgtcttgccact

SEQ ID NO: 412701 - DNA, 25 bp, Mus musculus
gaaattctccaaaggttcgggactg

SEQ ID NO: 412702 - DNA, 25 bp, Mus musculus
gaaattctccaatggttcgggactg

SEQ ID NO: 412703 - DNA, 25 bp, Mus musculus
gaaattctccatcttggacttggtg

SEQ ID NO: 412704 - DNA, 25 bp, Mus musculus
gaaattctccatgttggacttggtg

SEQ ID NO: 412705 - DNA, 25 bp, Mus musculus
gaaattctcctaccatgccaagtgt

SEQ ID NO: 412706 - DNA, 25 bp, Mus musculus
gaaattctcctagcatgccaagtgt

SEQ ID NO: 412707 - DNA, 25 bp, Mus musculus
gaaattctcgttaccaacataacat

SEQ ID NO: 412708 - DNA, 25 bp, Mus musculus
gaaattctcgtttccaacataacat

SEQ ID NO: 412709 - DNA, 25 bp, Mus musculus
gaaattctctaaagaccctaggata

SEQ ID NO: 412710 - DNA, 25 bp, Mus musculus
gaaattctctaatgaccctaggata

SEQ ID NO: 412711 - DNA, 25 bp, Mus musculus
gaaattctctcacccagtaaataca

SEQ ID NO: 412712 - DNA, 25 bp, Mus musculus
gaaattctctcagccagtaaataca

SEQ ID NO: 412713 - DNA, 25 bp, Mus musculus
gaaattctctgactagaccctgttt

SEQ ID NO: 412714 - DNA, 25 bp, Mus musculus
gaaattctctgagtagaccctgttt

SEQ ID NO: 412715 - DNA, 25 bp, Mus musculus
gaaattctctttacctattgcagtt

SEQ ID NO: 412716 - DNA, 25 bp, Mus musculus
gaaattctctttcatgagcttttga

SEQ ID NO: 412717 - DNA, 25 bp, Mus musculus
gaaattctctttgatgagcttttga

SEQ ID NO: 412718 - DNA, 25 bp, Mus musculus
gaaattctcttttcctattgcagtt

SEQ ID NO: 412719 - DNA, 25 bp, Mus musculus
gaaattctgaagacctgatcatcac

SEQ ID NO: 412720 - DNA, 25 bp, Mus musculus
gaaattctgaagtcctgatcatcac

SEQ ID NO: 412721 - DNA, 25 bp, Mus musculus
gaaattctgagtcatgtgcagctga

SEQ ID NO: 412722 - DNA, 25 bp, Mus musculus
gaaattctgagtctaggctagttag

SEQ ID NO: 412723 - DNA, 25 bp, Mus musculus
gaaattctgagtgatgtgcagctga

SEQ ID NO: 412724 - DNA, 25 bp, Mus musculus
gaaattctgagtgtaggctagttag

SEQ ID NO: 412725 - DNA, 25 bp, Mus musculus
gaaattctgatactgtcctctgctg

SEQ ID NO: 412726 - DNA, 25 bp, Mus musculus
gaaattctgatagtgtcctctgctg

SEQ ID NO: 412727 - DNA, 25 bp, Mus musculus
gaaattctgattccgactcacttct

SEQ ID NO: 412728 - DNA, 25 bp, Mus musculus
gaaattctgattcttgttaatccaa

SEQ ID NO: 412729 - DNA, 25 bp, Mus musculus
gaaattctgattgcgactcacttct

SEQ ID NO: 412730 - DNA, 25 bp, Mus musculus
gaaattctgattgttgttaatccaa

SEQ ID NO: 412731 - DNA, 25 bp, Mus musculus
gaaattctgcaaccacgcttcccaa

SEQ ID NO: 412732 - DNA, 25 bp, Mus musculus
gaaattctgcaagcacgcttcccaa

SEQ ID NO: 412733 - DNA, 25 bp, Mus musculus
gaaattctgcacactagtcagtata

SEQ ID NO: 412734 - DNA, 25 bp, Mus musculus
gaaattctgcacactttcaactggc

SEQ ID NO: 412735 - DNA, 25 bp, Mus musculus
gaaattctgcactctagtcagtata

SEQ ID NO: 412736 - DNA, 25 bp, Mus musculus
gaaattctgcactctttcaactggc

SEQ ID NO: 412737 - DNA, 25 bp, Mus musculus
gaaattctgctgatatgtatcaccc

SEQ ID NO: 412738 - DNA, 25 bp, Mus musculus
gaaattctgctgttatgtatcaccc

SEQ ID NO: 412739 - DNA, 25 bp, Mus musculus
gaaattctggccatgagaccccagt

SEQ ID NO: 412740 - DNA, 25 bp, Mus musculus
gaaattctggccttgagaccccagt

SEQ ID NO: 412741 - DNA, 25 bp, Mus musculus
gaaattctgtaccatctgaaagtag

SEQ ID NO: 412742 - DNA, 25 bp, Mus musculus
gaaattctgtacgatctgaaagtag

SEQ ID NO: 412743 - DNA, 25 bp, Mus musculus
gaaattctgtcaaactgtacaactc

SEQ ID NO: 412744 - DNA, 25 bp, Mus musculus
gaaattctgtcatactgtacaactc

SEQ ID NO: 412745 - DNA, 25 bp, Mus musculus
gaaattctgtgacgtttcagagcat

SEQ ID NO: 412746 - DNA, 25 bp, Mus musculus
gaaattctgtgaggtttcagagcat

SEQ ID NO: 412747 - DNA, 25 bp, Mus musculus
gaaattctgtgcaagcctattccat

SEQ ID NO: 412748 - DNA, 25 bp, Mus musculus
gaaattctgtgctagcctattccat

SEQ ID NO: 412749 - DNA, 25 bp, Mus musculus
gaaattctgtgtccatttgctgtct

SEQ ID NO: 412750 - DNA, 25 bp, Mus musculus
gaaattctgtgtgcatttgctgtct

SEQ ID NO: 412751 - DNA, 25 bp, Mus musculus
gaaattctgttaatgctgcttacaa

SEQ ID NO: 412752 - DNA, 25 bp, Mus musculus
gaaattctgttattgctgcttacaa

SEQ ID NO: 412753 - DNA, 25 bp, Mus musculus
gaaattctgttgaatgggcaccatt

SEQ ID NO: 412754 - DNA, 25 bp, Mus musculus
gaaattctgttgctcatagttgaag

SEQ ID NO: 412755 - DNA, 25 bp, Mus musculus
gaaattctgttggtcatagttgaag

SEQ ID NO: 412756 - DNA, 25 bp, Mus musculus
gaaattctgttgtatgggcaccatt

SEQ ID NO: 412757 - DNA, 25 bp, Mus musculus
gaaattctgtttcatctttggtctt

SEQ ID NO: 412758 - DNA, 25 bp, Mus musculus
gaaattctgtttgatctttggtctt

SEQ ID NO: 412759 - DNA, 25 bp, Mus musculus
gaaattcttagtagcctgagttcaa

SEQ ID NO: 412760 - DNA, 25 bp, Mus musculus
gaaattcttagttgcctgagttcaa

SEQ ID NO: 412761 - DNA, 25 bp, Mus musculus
gaaattcttgaactgcctctgtgtg

SEQ ID NO: 412762 - DNA, 25 bp, Mus musculus
gaaattcttgaagtgcctctgtgtg

SEQ ID NO: 412763 - DNA, 25 bp, Mus musculus
gaaattctttagcacttaattatgc

SEQ ID NO: 412764 - DNA, 25 bp, Mus musculus
gaaattctttaggacttaattatgc

SEQ ID NO: 412765 - DNA, 25 bp, Mus musculus
gaaattctttctcaggtgccgatgt

SEQ ID NO: 412766 - DNA, 25 bp, Mus musculus
gaaattctttctgaggtgccgatgt

SEQ ID NO: 412767 - DNA, 25 bp, Mus musculus
gaaattctttggcaactggagtagg

SEQ ID NO: 412768 - DNA, 25 bp, Mus musculus
gaaattctttgggaactggagtagg

SEQ ID NO: 412769 - DNA, 25 bp, Mus musculus
gaaattctttgtccacagcctgagg

SEQ ID NO: 412770 - DNA, 25 bp, Mus musculus
gaaattctttgtgcacagcctgagg

SEQ ID NO: 412771 - DNA, 25 bp, Mus musculus
gaaattctttttcttgggtgtacag

SEQ ID NO: 412772 - DNA, 25 bp, Mus musculus
gaaattctttttgttgggtgtacag

SEQ ID NO: 412773 - DNA, 25 bp, Mus musculus
gaaattgaatttctccagcatcatg

SEQ ID NO: 412774 - DNA, 25 bp, Mus musculus
gaaattgaatttgtccagcatcatg

SEQ ID NO: 412775 - DNA, 25 bp, Mus musculus
gaaattgacagtattccattttctc

SEQ ID NO: 412776 - DNA, 25 bp, Mus musculus
gaaattgacagttttccattttctc

SEQ ID NO: 412777 - DNA, 25 bp, Mus musculus
gaaattgacattcatgatcttcttg

SEQ ID NO: 412778 - DNA, 25 bp, Mus musculus
gaaattgacattgatgatcttcttg

SEQ ID NO: 412779 - DNA, 25 bp, Mus musculus
gaaattgacctcacagctcagtatt

SEQ ID NO: 412780 - DNA, 25 bp, Mus musculus
gaaattgacctctcagctcagtatt

SEQ ID NO: 412781 - DNA, 25 bp, Mus musculus
gaaattgactgtacccaggtcacct

SEQ ID NO: 412782 - DNA, 25 bp, Mus musculus
gaaattgactgttcccaggtcacct

SEQ ID NO: 412783 - DNA, 25 bp, Mus musculus
gaaattgatcatatctgccagtagc

SEQ ID NO: 412784 - DNA, 25 bp, Mus musculus
gaaattgatcatttctgccagtagc

SEQ ID NO: 412785 - DNA, 25 bp, Mus musculus
gaaattgatccaacctcgaaccaaa

SEQ ID NO: 412786 - DNA, 25 bp, Mus musculus
gaaattgatccatcctcgaaccaaa

SEQ ID NO: 412787 - DNA, 25 bp, Mus musculus
gaaattgatgccagaggagtaccaa

SEQ ID NO: 412788 - DNA, 25 bp, Mus musculus
gaaattgatgcctgaggagtaccaa

SEQ ID NO: 412789 - DNA, 25 bp, Mus musculus
gaaattgatgttccaacagacatga

SEQ ID NO: 412790 - DNA, 25 bp, Mus musculus
gaaattgatgttgcaacagacatga

SEQ ID NO: 412791 - DNA, 25 bp, Mus musculus
gaaattgcagccctacgatcagagc

SEQ ID NO: 412792 - DNA, 25 bp, Mus musculus
gaaattgcagccgtacgatcagagc

SEQ ID NO: 412793 - DNA, 25 bp, Mus musculus
gaaattgcaggtatcaacgcctcga

SEQ ID NO: 412794 - DNA, 25 bp, Mus musculus
gaaattgcaggtttcaacgcctcga

SEQ ID NO: 412795 - DNA, 25 bp, Mus musculus
gaaattgcagtcacttcatattcac

SEQ ID NO: 412796 - DNA, 25 bp, Mus musculus
gaaattgcagtctcttcatattcac

SEQ ID NO: 412797 - DNA, 25 bp, Mus musculus
gaaattgcatctcctgtggtcgcac

SEQ ID NO: 412798 - DNA, 25 bp, Mus musculus
gaaattgcatctgctgtggtcgcac

SEQ ID NO: 412799 - DNA, 25 bp, Mus musculus
gaaattgcatgcacgttaacccttc

SEQ ID NO: 412800 - DNA, 25 bp, Mus musculus
gaaattgcatgctcgttaacccttc

SEQ ID NO: 412801 - DNA, 25 bp, Mus musculus
gaaattgcatgtctcaagaagtcaa

SEQ ID NO: 412802 - DNA, 25 bp, Mus musculus
gaaattgcatgtgtcaagaagtcaa

SEQ ID NO: 412803 - DNA, 25 bp, Mus musculus
gaaattgccaaaatcccaagacctt

SEQ ID NO: 412804 - DNA, 25 bp, Mus musculus
gaaattgccaaattcccaagacctt

SEQ ID NO: 412805 - DNA, 25 bp, Mus musculus
gaaattgccacaacagatgctctgg

SEQ ID NO: 412806 - DNA, 25 bp, Mus musculus
gaaattgccacacatttgtcacatg

SEQ ID NO: 412807 - DNA, 25 bp, Mus musculus
gaaattgccacagatttgtcacatg

SEQ ID NO: 412808 - DNA, 25 bp, Mus musculus
gaaattgccacatcagatgctctgg

SEQ ID NO: 412809 - DNA, 25 bp, Mus musculus
gaaattgccaggaacctcacctgct

SEQ ID NO: 412810 - DNA, 25 bp, Mus musculus
gaaattgccaggtacctcacctgct

SEQ ID NO: 412811 - DNA, 25 bp, Mus musculus
gaaattgccagtaagctccaactga

SEQ ID NO: 412812 - DNA, 25 bp, Mus musculus
gaaattgccagttagctccaactga

SEQ ID NO: 412813 - DNA, 25 bp, Mus musculus
gaaattgccataagcattcctgctt

SEQ ID NO: 412814 - DNA, 25 bp, Mus musculus
gaaattgccatatgcattcctgctt

SEQ ID NO: 412815 - DNA, 25 bp, Mus musculus
gaaattgcccgcctggaccccaaga

SEQ ID NO: 412816 - DNA, 25 bp, Mus musculus
gaaattgcccgcgtggaccccaaga

SEQ ID NO: 412817 - DNA, 25 bp, Mus musculus
gaaattgcctcaaaacgggtgcctt

SEQ ID NO: 412818 - DNA, 25 bp, Mus musculus
gaaattgcctcataacgggtgcctt

SEQ ID NO: 412819 - DNA, 25 bp, Mus musculus
gaaattgccttaaagacagaagctt

SEQ ID NO: 412820 - DNA, 25 bp, Mus musculus
gaaattgccttatagacagaagctt

SEQ ID NO: 412821 - DNA, 25 bp, Mus musculus
gaaattgccttcactgatgtgatgt

SEQ ID NO: 412822 - DNA, 25 bp, Mus musculus
gaaattgccttctctgatgtgatgt

SEQ ID NO: 412823 - DNA, 25 bp, Mus musculus
gaaattgccttgattagatcagtga

SEQ ID NO: 412824 - DNA, 25 bp, Mus musculus
gaaattgccttgtttagatcagtga

SEQ ID NO: 412825 - DNA, 25 bp, Mus musculus
gaaattgcctttacgttttgcgcag

SEQ ID NO: 412826 - DNA, 25 bp, Mus musculus
gaaattgccttttcgttttgcgcag

SEQ ID NO: 412827 - DNA, 25 bp, Mus musculus
gaaattgcgttgagtcttctcattc

SEQ ID NO: 412828 - DNA, 25 bp, Mus musculus
gaaattgcgttgtgtcttctcattc

SEQ ID NO: 412829 - DNA, 25 bp, Mus musculus
gaaattgctagaacgctgagtctgc

SEQ ID NO: 412830 - DNA, 25 bp, Mus musculus
gaaattgctagatcgctgagtctgc

SEQ ID NO: 412831 - DNA, 25 bp, Mus musculus
gaaattgctcgaagctgtttttgaa

SEQ ID NO: 412832 - DNA, 25 bp, Mus musculus
gaaattgctcgatgctgtttttgaa

SEQ ID NO: 412833 - DNA, 25 bp, Mus musculus
gaaattgctgtaaccatctccatat

SEQ ID NO: 412834 - DNA, 25 bp, Mus musculus
gaaattgctgtatccatctccatat

SEQ ID NO: 412835 - DNA, 25 bp, Mus musculus
gaaattgcttttaccagctaaagta

SEQ ID NO: 412836 - DNA, 25 bp, Mus musculus
gaaattgctttttccagctaaagta

SEQ ID NO: 412837 - DNA, 25 bp, Mus musculus
gaaattggaagacttggtaccacca

SEQ ID NO: 412838 - DNA, 25 bp, Mus musculus
gaaattggaagagttggtaccacca

SEQ ID NO: 412839 - DNA, 25 bp, Mus musculus
gaaattggacggatcacttcacttt

SEQ ID NO: 412840 - DNA, 25 bp, Mus musculus
gaaattggacggttcacttcacttt

SEQ ID NO: 412841 - DNA, 25 bp, Mus musculus
gaaattggagctaccacttgtaagt

SEQ ID NO: 412842 - DNA, 25 bp, Mus musculus
gaaattggagcttccacttgtaagt

SEQ ID NO: 412843 - DNA, 25 bp, Mus musculus
gaaattggataaacaagcctcaaca

SEQ ID NO: 412844 - DNA, 25 bp, Mus musculus
gaaattggataatcaagcctcaaca

SEQ ID NO: 412845 - DNA, 25 bp, Mus musculus
gaaattggcaatatcaaaatgccca

SEQ ID NO: 412846 - DNA, 25 bp, Mus musculus
gaaattggcaatttcaaaatgccca

SEQ ID NO: 412847 - DNA, 25 bp, Mus musculus
gaaattggcagcattggtcctgtaa

SEQ ID NO: 412848 - DNA, 25 bp, Mus musculus
gaaattggcagctttggtcctgtaa

SEQ ID NO: 412849 - DNA, 25 bp, Mus musculus
gaaattggcctactacagctgcaga

SEQ ID NO: 412850 - DNA, 25 bp, Mus musculus
gaaattggcctagtacagctgcaga

SEQ ID NO: 412851 - DNA, 25 bp, Mus musculus
gaaattggcttgcttctctttagag

SEQ ID NO: 412852 - DNA, 25 bp, Mus musculus
gaaattggcttggttctctttagag

SEQ ID NO: 412853 - DNA, 25 bp, Mus musculus
gaaattgggatcaggtcctgatgct

SEQ ID NO: 412854 - DNA, 25 bp, Mus musculus
gaaattgggatctggtcctgatgct

SEQ ID NO: 412855 - DNA, 25 bp, Mus musculus
gaaattgggcgtcatggtacatacc

SEQ ID NO: 412856 - DNA, 25 bp, Mus musculus
gaaattgggcgtgatggtacatacc

SEQ ID NO: 412857 - DNA, 25 bp, Mus musculus
gaaattgggctcaaatcatgttcct

SEQ ID NO: 412858 - DNA, 25 bp, Mus musculus
gaaattgggctctaatcatgttcct

SEQ ID NO: 412859 - DNA, 25 bp, Mus musculus
gaaattggtaccatgcacacatcat

SEQ ID NO: 412860 - DNA, 25 bp, Mus musculus
gaaattggtaccttgcacacatcat

SEQ ID NO: 412861 - DNA, 25 bp, Mus musculus
gaaattggtcccacccggagtggag

SEQ ID NO: 412862 - DNA, 25 bp, Mus musculus
gaaattggtccctcccggagtggag

SEQ ID NO: 412863 - DNA, 25 bp, Mus musculus
gaaattggtggacactttgccatca

SEQ ID NO: 412864 - DNA, 25 bp, Mus musculus
gaaattggtggagactttgccatca

SEQ ID NO: 412865 - DNA, 25 bp, Mus musculus
gaaattggtgttcatctggagtctc

SEQ ID NO: 412866 - DNA, 25 bp, Mus musculus
gaaattggtgttgatctggagtctc

SEQ ID NO: 412867 - DNA, 25 bp, Mus musculus
gaaattggtttcacatgcatagacc

SEQ ID NO: 412868 - DNA, 25 bp, Mus musculus
gaaattggtttctcatgcatagacc

SEQ ID NO: 412869 - DNA, 25 bp, Mus musculus
gaaattggtttgatacgatgatgct

SEQ ID NO: 412870 - DNA, 25 bp, Mus musculus
gaaattggtttgttacgatgatgct

SEQ ID NO: 412871 - DNA, 25 bp, Mus musculus
gaaattgtaagcacagctcagcagt

SEQ ID NO: 412872 - DNA, 25 bp, Mus musculus
gaaattgtaagctcagctcagcagt

SEQ ID NO: 412873 - DNA, 25 bp, Mus musculus
gaaattgtacttactgaggtccatg

SEQ ID NO: 412874 - DNA, 25 bp, Mus musculus
gaaattgtactttctgaggtccatg

SEQ ID NO: 412875 - DNA, 25 bp, Mus musculus
gaaattgtagtcacctgtgctttaa

SEQ ID NO: 412876 - DNA, 25 bp, Mus musculus
gaaattgtagtctcctgtgctttaa

SEQ ID NO: 412877 - DNA, 25 bp, Mus musculus
gaaattgtatacatctcctctgcag

SEQ ID NO: 412878 - DNA, 25 bp, Mus musculus
gaaattgtatacttctcctctgcag

SEQ ID NO: 412879 - DNA, 25 bp, Mus musculus
gaaattgtatatatgcccctccaaa

SEQ ID NO: 412880 - DNA, 25 bp, Mus musculus
gaaattgtatatttgcccctccaaa

SEQ ID NO: 412881 - DNA, 25 bp, Mus musculus
gaaattgtatctcggcacggcacgg

SEQ ID NO: 412882 - DNA, 25 bp, Mus musculus
gaaattgtatctgggcacggcacgg

SEQ ID NO: 412883 - DNA, 25 bp, Mus musculus
gaaattgtatgcatttcttgactct

SEQ ID NO: 412884 - DNA, 25 bp, Mus musculus
gaaattgtatgcttttcttgactct

SEQ ID NO: 412885 - DNA, 25 bp, Mus musculus
gaaattgtcaccattgcagaggcgg

SEQ ID NO: 412886 - DNA, 25 bp, Mus musculus
gaaattgtcacctttgcagaggcgg

SEQ ID NO: 412887 - DNA, 25 bp, Mus musculus
gaaattgtccccacttttgattaat

SEQ ID NO: 412888 - DNA, 25 bp, Mus musculus
gaaattgtcccctcttttgattaat

SEQ ID NO: 412889 - DNA, 25 bp, Mus musculus
gaaattgtccttaggactcctagac

SEQ ID NO: 412890 - DNA, 25 bp, Mus musculus
gaaattgtcctttggactcctagac

SEQ ID NO: 412891 - DNA, 25 bp, Mus musculus
gaaattgtctcacctcaacgatggg

SEQ ID NO: 412892 - DNA, 25 bp, Mus musculus
gaaattgtctcagctcaacgatggg

SEQ ID NO: 412893 - DNA, 25 bp, Mus musculus
gaaattgtctggcatgaacctctat

SEQ ID NO: 412894 - DNA, 25 bp, Mus musculus
gaaattgtctgggatgaacctctat

SEQ ID NO: 412895 - DNA, 25 bp, Mus musculus
gaaattgtcttccttcctaagaatg

SEQ ID NO: 412896 - DNA, 25 bp, Mus musculus
gaaattgtcttcgttcctaagaatg

SEQ ID NO: 412897 - DNA, 25 bp, Mus musculus
gaaattgtcttgaccacattgaggg

SEQ ID NO: 412898 - DNA, 25 bp, Mus musculus
gaaattgtcttgtccacattgaggg

SEQ ID NO: 412899 - DNA, 25 bp, Mus musculus
gaaattgtgactatgccacctggtt

SEQ ID NO: 412900 - DNA, 25 bp, Mus musculus
gaaattgtgactttgccacctggtt

SEQ ID NO: 412901 - DNA, 25 bp, Mus musculus
gaaattgtgattctccagctctgag

SEQ ID NO: 412902 - DNA, 25 bp, Mus musculus
gaaattgtgattgtccagctctgag

SEQ ID NO: 412903 - DNA, 25 bp, Mus musculus
gaaattgtgcacagtgccttgccca

SEQ ID NO: 412904 - DNA, 25 bp, Mus musculus
gaaattgtgcactgtgccttgccca

SEQ ID NO: 412905 - DNA, 25 bp, Mus musculus
gaaattgtgccaaaagttgctaaaa

SEQ ID NO: 412906 - DNA, 25 bp, Mus musculus
gaaattgtgccacattcagaattgg

SEQ ID NO: 412907 - DNA, 25 bp, Mus musculus
gaaattgtgccagattcagaattgg

SEQ ID NO: 412908 - DNA, 25 bp, Mus musculus
gaaattgtgccataagttgctaaaa

SEQ ID NO: 412909 - DNA, 25 bp, Mus musculus
gaaattgtgcggctcagcaaggaat

SEQ ID NO: 412910 - DNA, 25 bp, Mus musculus
gaaattgtgcgggtcagcaaggaat

SEQ ID NO: 412911 - DNA, 25 bp, Mus musculus
gaaattgtggacagaaacagtggaa

SEQ ID NO: 412912 - DNA, 25 bp, Mus musculus
gaaattgtggactgaaacagtggaa

SEQ ID NO: 412913 - DNA, 25 bp, Mus musculus
gaaattgtgtctatgccaggcatga

SEQ ID NO: 412914 - DNA, 25 bp, Mus musculus
gaaattgtgtctttgccaggcatga

SEQ ID NO: 412915 - DNA, 25 bp, Mus musculus
gaaattgtgttaaagccaggcgtgg

SEQ ID NO: 412916 - DNA, 25 bp, Mus musculus
gaaattgtgttatagccaggcgtgg

SEQ ID NO: 412917 - DNA, 25 bp, Mus musculus
gaaattgttaatagactggcacaca

SEQ ID NO: 412918 - DNA, 25 bp, Mus musculus
gaaattgttaattgactggcacaca

SEQ ID NO: 412919 - DNA, 25 bp, Mus musculus
gaaattgttaccaaggtcagagcac

SEQ ID NO: 412920 - DNA, 25 bp, Mus musculus
gaaattgttacctaggtcagagcac

SEQ ID NO: 412921 - DNA, 25 bp, Mus musculus
gaaattgttactacggagcatgaca

SEQ ID NO: 412922 - DNA, 25 bp, Mus musculus
gaaattgttacttcggagcatgaca

SEQ ID NO: 412923 - DNA, 25 bp, Mus musculus
gaaattgttatcactggaaagctgg

SEQ ID NO: 412924 - DNA, 25 bp, Mus musculus
gaaattgttatctctggaaagctgg

SEQ ID NO: 412925 - DNA, 25 bp, Mus musculus
gaaattgttattagatctttgttca

SEQ ID NO: 412926 - DNA, 25 bp, Mus musculus
gaaattgttatttgatctttgttca

SEQ ID NO: 412927 - DNA, 25 bp, Mus musculus
gaaattgttcagattgagcttccaa

SEQ ID NO: 412928 - DNA, 25 bp, Mus musculus
gaaattgttcagtttgagcttccaa

SEQ ID NO: 412929 - DNA, 25 bp, Mus musculus
gaaattgttcctcgtctatcagctc

SEQ ID NO: 412930 - DNA, 25 bp, Mus musculus
gaaattgttcctggtctatcagctc

SEQ ID NO: 412931 - DNA, 25 bp, Mus musculus
gaaattgtttgtagtaatcctctat

SEQ ID NO: 412932 - DNA, 25 bp, Mus musculus
gaaattgtttgttgtaatcctctat

SEQ ID NO: 412933 - DNA, 25 bp, Mus musculus
gaaattgttttaaggacagctgtca

SEQ ID NO: 412934 - DNA, 25 bp, Mus musculus
gaaattgttttatggacagctgtca

SEQ ID NO: 412935 - DNA, 25 bp, Mus musculus
gaaatttaaagcaggttcttgttgg

SEQ ID NO: 412936 - DNA, 25 bp, Mus musculus
gaaatttaaagctggttcttgttgg

SEQ ID NO: 412937 - DNA, 25 bp, Mus musculus
gaaatttaagacacgccgggcagtg

SEQ ID NO: 412938 - DNA, 25 bp, Mus musculus
gaaatttaagactcgccgggcagtg

SEQ ID NO: 412939 - DNA, 25 bp, Mus musculus
gaaatttaaggcacagactcaactg

SEQ ID NO: 412940 - DNA, 25 bp, Mus musculus
gaaatttaaggctcagactcaactg

SEQ ID NO: 412941 - DNA, 25 bp, Mus musculus
gaaatttacagacctatcactttag

SEQ ID NO: 412942 - DNA, 25 bp, Mus musculus
gaaatttacagagctatcactttag

SEQ ID NO: 412943 - DNA, 25 bp, Mus musculus
gaaatttacatacttggcagcttaa

SEQ ID NO: 412944 - DNA, 25 bp, Mus musculus
gaaatttacatagttggcagcttaa

SEQ ID NO: 412945 - DNA, 25 bp, Mus musculus
gaaatttaccctaatgtacttaatg

SEQ ID NO: 412946 - DNA, 25 bp, Mus musculus
gaaatttacccttatgtacttaatg

SEQ ID NO: 412947 - DNA, 25 bp, Mus musculus
gaaatttacctgcaagagaagctgg

SEQ ID NO: 412948 - DNA, 25 bp, Mus musculus
gaaatttacctggaagagaagctgg

SEQ ID NO: 412949 - DNA, 25 bp, Mus musculus
gaaatttactccattctcagttatt

SEQ ID NO: 412950 - DNA, 25 bp, Mus musculus
gaaatttactcctttctcagttatt

SEQ ID NO: 412951 - DNA, 25 bp, Mus musculus
gaaatttagacaaagcagtgccatt

SEQ ID NO: 412952 - DNA, 25 bp, Mus musculus
gaaatttagacaccactgaatggat

SEQ ID NO: 412953 - DNA, 25 bp, Mus musculus
gaaatttagacagcactgaatggat

SEQ ID NO: 412954 - DNA, 25 bp, Mus musculus
gaaatttagacatagcagtgccatt

SEQ ID NO: 412955 - DNA, 25 bp, Mus musculus
gaaatttaggtgcaatgtcccctgg

SEQ ID NO: 412956 - DNA, 25 bp, Mus musculus
gaaatttaggtggaatgtcccctgg

SEQ ID NO: 412957 - DNA, 25 bp, Mus musculus
gaaatttagtccatgcttgtagaca

SEQ ID NO: 412958 - DNA, 25 bp, Mus musculus
gaaatttagtccttgcttgtagaca

SEQ ID NO: 412959 - DNA, 25 bp, Mus musculus
gaaatttatcccaacagctaggctg

SEQ ID NO: 412960 - DNA, 25 bp, Mus musculus
gaaatttatccctacagctaggctg

SEQ ID NO: 412961 - DNA, 25 bp, Mus musculus
gaaatttattgcacacagttgtggt

SEQ ID NO: 412962 - DNA, 25 bp, Mus musculus
gaaatttattgctcacagttgtggt

SEQ ID NO: 412963 - DNA, 25 bp, Mus musculus
gaaatttcaaaactgcttagcgcaa

SEQ ID NO: 412964 - DNA, 25 bp, Mus musculus
gaaatttcaaaagtgcttagcgcaa

SEQ ID NO: 412965 - DNA, 25 bp, Mus musculus
gaaatttcaactattgaattgccaa

SEQ ID NO: 412966 - DNA, 25 bp, Mus musculus
gaaatttcaacttttgaattgccaa

SEQ ID NO: 412967 - DNA, 25 bp, Mus musculus
gaaatttcaagacctaggcctgttt

SEQ ID NO: 412968 - DNA, 25 bp, Mus musculus
gaaatttcaagagctaggcctgttt

SEQ ID NO: 412969 - DNA, 25 bp, Mus musculus
gaaatttcaattagtctttctattt

SEQ ID NO: 412970 - DNA, 25 bp, Mus musculus
gaaatttcaatttgtctttctattt

SEQ ID NO: 412971 - DNA, 25 bp, Mus musculus
gaaatttcacttagtacgattcttt

SEQ ID NO: 412972 - DNA, 25 bp, Mus musculus
gaaatttcactttgtacgattcttt

SEQ ID NO: 412973 - DNA, 25 bp, Mus musculus
gaaatttcagagacccaaatctcta

SEQ ID NO: 412974 - DNA, 25 bp, Mus musculus
gaaatttcagagtcccaaatctcta

SEQ ID NO: 412975 - DNA, 25 bp, Mus musculus
gaaatttcagttctccacaagctct

SEQ ID NO: 412976 - DNA, 25 bp, Mus musculus
gaaatttcagttgtccacaagctct

SEQ ID NO: 412977 - DNA, 25 bp, Mus musculus
gaaatttcataacgtatatctgtaa

SEQ ID NO: 412978 - DNA, 25 bp, Mus musculus
gaaatttcataaggtatatctgtaa

SEQ ID NO: 412979 - DNA, 25 bp, Mus musculus
gaaatttcatctactcctcatttgt

SEQ ID NO: 412980 - DNA, 25 bp, Mus musculus
gaaatttcatctcccatcaacatat

SEQ ID NO: 412981 - DNA, 25 bp, Mus musculus
gaaatttcatctgccatcaacatat

SEQ ID NO: 412982 - DNA, 25 bp, Mus musculus
gaaatttcatcttctcctcatttgt

SEQ ID NO: 412983 - DNA, 25 bp, Mus musculus
gaaatttcatgtctcattcaatgct

SEQ ID NO: 412984 - DNA, 25 bp, Mus musculus
gaaatttcatgtgtcattcaatgct

SEQ ID NO: 412985 - DNA, 25 bp, Mus musculus
gaaatttccaaacatctcctactct

SEQ ID NO: 412986 - DNA, 25 bp, Mus musculus
gaaatttccaaacttgggctggtga

SEQ ID NO: 412987 - DNA, 25 bp, Mus musculus
gaaatttccaaagatctcctactct

SEQ ID NO: 412988 - DNA, 25 bp, Mus musculus
gaaatttccaaagttgggctggtga

SEQ ID NO: 412989 - DNA, 25 bp, Mus musculus
gaaatttccaacctgtccctaatct

SEQ ID NO: 412990 - DNA, 25 bp, Mus musculus
gaaatttccaacgtgtccctaatct

SEQ ID NO: 412991 - DNA, 25 bp, Mus musculus
gaaatttccaccatttatgctcaaa

SEQ ID NO: 412992 - DNA, 25 bp, Mus musculus
gaaatttccaccttttatgctcaaa

SEQ ID NO: 412993 - DNA, 25 bp, Mus musculus
gaaatttccactcaaaactgcaagc

SEQ ID NO: 412994 - DNA, 25 bp, Mus musculus
gaaatttccactgaaaactgcaagc

SEQ ID NO: 412995 - DNA, 25 bp, Mus musculus
gaaatttccatcagtgattgcttgt

SEQ ID NO: 412996 - DNA, 25 bp, Mus musculus
gaaatttccatcatcctcaagtcac

SEQ ID NO: 412997 - DNA, 25 bp, Mus musculus
gaaatttccatctgtgattgcttgt

SEQ ID NO: 412998 - DNA, 25 bp, Mus musculus
gaaatttccatcttcctcaagtcac

SEQ ID NO: 412999 - DNA, 25 bp, Mus musculus
gaaatttccctgaaatgaccgaggt

SEQ ID NO: 413000 - DNA, 25 bp, Mus musculus
gaaatttccctgctattaacacctg

SEQ ID NO: 413001 - DNA, 25 bp, Mus musculus
gaaatttccctggtattaacacctg

SEQ ID NO: 413002 - DNA, 25 bp, Mus musculus
gaaatttccctgtaatgaccgaggt

SEQ ID NO: 413003 - DNA, 25 bp, Mus musculus
gaaatttccttcaggccatgtgtat

SEQ ID NO: 413004 - DNA, 25 bp, Mus musculus
gaaatttccttctggccatgtgtat

SEQ ID NO: 413005 - DNA, 25 bp, Mus musculus
gaaatttcctttccttctttcgagg

SEQ ID NO: 413006 - DNA, 25 bp, Mus musculus
gaaatttcctttgcttctttcgagg

SEQ ID NO: 413007 - DNA, 25 bp, Mus musculus
gaaatttctaggctagtcagagcta

SEQ ID NO: 413008 - DNA, 25 bp, Mus musculus
gaaatttctagggtagtcagagcta

SEQ ID NO: 413009 - DNA, 25 bp, Mus musculus
gaaatttctattccttcctagagtt

SEQ ID NO: 413010 - DNA, 25 bp, Mus musculus
gaaatttctattgcttcctagagtt

SEQ ID NO: 413011 - DNA, 25 bp, Mus musculus
gaaatttctgaacatgataccacca

SEQ ID NO: 413012 - DNA, 25 bp, Mus musculus
gaaatttctgaagatgataccacca

SEQ ID NO: 413013 - DNA, 25 bp, Mus musculus
gaaatttctgatccacaaatgcatg

SEQ ID NO: 413014 - DNA, 25 bp, Mus musculus
gaaatttctgatgcacaaatgcatg

SEQ ID NO: 413015 - DNA, 25 bp, Mus musculus
gaaatttctggtatggaccaccaca

SEQ ID NO: 413016 - DNA, 25 bp, Mus musculus
gaaatttctggtttggaccaccaca

SEQ ID NO: 413017 - DNA, 25 bp, Mus musculus
gaaatttcttagactgtatacacac

SEQ ID NO: 413018 - DNA, 25 bp, Mus musculus
gaaatttcttagtctgtatacacac

SEQ ID NO: 413019 - DNA, 25 bp, Mus musculus
gaaatttcttccacctacattttat

SEQ ID NO: 413020 - DNA, 25 bp, Mus musculus
gaaatttcttcctcctacattttat

SEQ ID NO: 413021 - DNA, 25 bp, Mus musculus
gaaatttcttgacttttgtgcacag

SEQ ID NO: 413022 - DNA, 25 bp, Mus musculus
gaaatttcttgagttttgtgcacag

SEQ ID NO: 413023 - DNA, 25 bp, Mus musculus
gaaatttctttgaatctccaacaac

SEQ ID NO: 413024 - DNA, 25 bp, Mus musculus
gaaatttctttgtatctccaacaac

SEQ ID NO: 413025 - DNA, 25 bp, Mus musculus
gaaatttcttttactatgactggcc

SEQ ID NO: 413026 - DNA, 25 bp, Mus musculus
gaaatttctttttctatgactggcc

SEQ ID NO: 413027 - DNA, 25 bp, Mus musculus
gaaatttgaactaggctcatcgtcc

SEQ ID NO: 413028 - DNA, 25 bp, Mus musculus
gaaatttgaacttggctcatcgtcc

SEQ ID NO: 413029 - DNA, 25 bp, Mus musculus
gaaatttgacagacctcaggctaat

SEQ ID NO: 413030 - DNA, 25 bp, Mus musculus
gaaatttgacagtcctcaggctaat

SEQ ID NO: 413031 - DNA, 25 bp, Mus musculus
gaaatttgacctctttttacctcag

SEQ ID NO: 413032 - DNA, 25 bp, Mus musculus
gaaatttgacctgtttttacctcag

SEQ ID NO: 413033 - DNA, 25 bp, Mus musculus
gaaatttgagtcaaaagcatgcccc

SEQ ID NO: 413034 - DNA, 25 bp, Mus musculus
gaaatttgagtctaaagcatgcccc

SEQ ID NO: 413035 - DNA, 25 bp, Mus musculus
gaaatttgagtgaccatctggtcat

SEQ ID NO: 413036 - DNA, 25 bp, Mus musculus
gaaatttgagtgtccatctggtcat

SEQ ID NO: 413037 - DNA, 25 bp, Mus musculus
gaaatttgagttcggccgacctttg

SEQ ID NO: 413038 - DNA, 25 bp, Mus musculus
gaaatttgagttgggccgacctttg

SEQ ID NO: 413039 - DNA, 25 bp, Mus musculus
gaaatttgcatgatgagccttatta

SEQ ID NO: 413040 - DNA, 25 bp, Mus musculus
gaaatttgcatgttgagccttatta

SEQ ID NO: 413041 - DNA, 25 bp, Mus musculus
gaaatttgccagcatctacctgctt

SEQ ID NO: 413042 - DNA, 25 bp, Mus musculus
gaaatttgccaggatctacctgctt

SEQ ID NO: 413043 - DNA, 25 bp, Mus musculus
gaaatttgccatagtaaaaatacct

SEQ ID NO: 413044 - DNA, 25 bp, Mus musculus
gaaatttgccattgtaaaaatacct

SEQ ID NO: 413045 - DNA, 25 bp, Mus musculus
gaaatttgcctaattccaggcttaa

SEQ ID NO: 413046 - DNA, 25 bp, Mus musculus
gaaatttgcctatttccaggcttaa

SEQ ID NO: 413047 - DNA, 25 bp, Mus musculus
gaaatttgccttcaccgtttctcat

SEQ ID NO: 413048 - DNA, 25 bp, Mus musculus
gaaatttgccttgaccgtttctcat

SEQ ID NO: 413049 - DNA, 25 bp, Mus musculus
gaaatttgctgcagacatgtcgagt

SEQ ID NO: 413050 - DNA, 25 bp, Mus musculus
gaaatttgctgccatacgtgtggca

SEQ ID NO: 413051 - DNA, 25 bp, Mus musculus
gaaatttgctgcgatacgtgtggca

SEQ ID NO: 413052 - DNA, 25 bp, Mus musculus
gaaatttgctgctgacatgtcgagt

SEQ ID NO: 413053 - DNA, 25 bp, Mus musculus
gaaatttgctggaggtggaccctaa

SEQ ID NO: 413054 - DNA, 25 bp, Mus musculus
gaaatttgctggtggtggaccctaa

SEQ ID NO: 413055 - DNA, 25 bp, Mus musculus
gaaatttggaaaatgccttgcagat

SEQ ID NO: 413056 - DNA, 25 bp, Mus musculus
gaaatttggaaattgccttgcagat

SEQ ID NO: 413057 - DNA, 25 bp, Mus musculus
gaaatttggaacactatgagaagac

SEQ ID NO: 413058 - DNA, 25 bp, Mus musculus
gaaatttggaactctatgagaagac

SEQ ID NO: 413059 - DNA, 25 bp, Mus musculus
gaaatttggactacctccaaaatat

SEQ ID NO: 413060 - DNA, 25 bp, Mus musculus
gaaatttggacttcctccaaaatat

SEQ ID NO: 413061 - DNA, 25 bp, Mus musculus
gaaatttggagcaccttccagtgaa

SEQ ID NO: 413062 - DNA, 25 bp, Mus musculus
gaaatttggagctccttccagtgaa

SEQ ID NO: 413063 - DNA, 25 bp, Mus musculus
gaaatttggctaacaagtcactcag

SEQ ID NO: 413064 - DNA, 25 bp, Mus musculus
gaaatttggctatcaagtcactcag

SEQ ID NO: 413065 - DNA, 25 bp, Mus musculus
gaaatttggcttcttgtgtgacaca

SEQ ID NO: 413066 - DNA, 25 bp, Mus musculus
gaaatttggcttgttgtgtgacaca

SEQ ID NO: 413067 - DNA, 25 bp, Mus musculus
gaaatttggtaccatcacggcccat

SEQ ID NO: 413068 - DNA, 25 bp, Mus musculus
gaaatttggtacgatcacggcccat

SEQ ID NO: 413069 - DNA, 25 bp, Mus musculus
gaaatttgtttcaggcttgccacga

SEQ ID NO: 413070 - DNA, 25 bp, Mus musculus
gaaatttgtttctggcttgccacga

SEQ ID NO: 413071 - DNA, 25 bp, Mus musculus
gaaattttaaccacaatgtcctgta

SEQ ID NO: 413072 - DNA, 25 bp, Mus musculus
gaaattttaacctcaatgtcctgta

SEQ ID NO: 413073 - DNA, 25 bp, Mus musculus
gaaattttagctacacactgcctcc

SEQ ID NO: 413074 - DNA, 25 bp, Mus musculus
gaaattttagcttcacactgcctcc

SEQ ID NO: 413075 - DNA, 25 bp, Mus musculus
gaaattttaggaagcttaagacttt

SEQ ID NO: 413076 - DNA, 25 bp, Mus musculus
gaaattttaggatgcttaagacttt

SEQ ID NO: 413077 - DNA, 25 bp, Mus musculus
gaaattttatctcagtctcaagtca

SEQ ID NO: 413078 - DNA, 25 bp, Mus musculus
gaaattttatctgagtctcaagtca

SEQ ID NO: 413079 - DNA, 25 bp, Mus musculus
gaaattttattcacagtgttcctat

SEQ ID NO: 413080 - DNA, 25 bp, Mus musculus
gaaattttattctcagtgttcctat

SEQ ID NO: 413081 - DNA, 25 bp, Mus musculus
gaaattttcatccaagatcttccaa

SEQ ID NO: 413082 - DNA, 25 bp, Mus musculus
gaaattttcatcgaagatcttccaa

SEQ ID NO: 413083 - DNA, 25 bp, Mus musculus
gaaattttcctacttgtgcctctca

SEQ ID NO: 413084 - DNA, 25 bp, Mus musculus
gaaattttcctagttgtgcctctca

SEQ ID NO: 413085 - DNA, 25 bp, Mus musculus
gaaattttccttagccattcagaag

SEQ ID NO: 413086 - DNA, 25 bp, Mus musculus
gaaattttcctttgccattcagaag

SEQ ID NO: 413087 - DNA, 25 bp, Mus musculus
gaaattttctctagcaggcttcagt

SEQ ID NO: 413088 - DNA, 25 bp, Mus musculus
gaaattttctctattccagtcaatt

SEQ ID NO: 413089 - DNA, 25 bp, Mus musculus
gaaattttctcttgcaggcttcagt

SEQ ID NO: 413090 - DNA, 25 bp, Mus musculus
gaaattttctcttttccagtcaatt

SEQ ID NO: 413091 - DNA, 25 bp, Mus musculus
gaaattttcttcagaactgcttaat

SEQ ID NO: 413092 - DNA, 25 bp, Mus musculus
gaaattttcttcagtggtatggcat

SEQ ID NO: 413093 - DNA, 25 bp, Mus musculus
gaaattttcttctgaactgcttaat

SEQ ID NO: 413094 - DNA, 25 bp, Mus musculus
gaaattttcttctgtggtatggcat

SEQ ID NO: 413095 - DNA, 25 bp, Mus musculus
gaaattttgaacagatcgccaagaa

SEQ ID NO: 413096 - DNA, 25 bp, Mus musculus
gaaattttgaactgatcgccaagaa

SEQ ID NO: 413097 - DNA, 25 bp, Mus musculus
gaaattttgggacttgcagctacgc

SEQ ID NO: 413098 - DNA, 25 bp, Mus musculus
gaaattttgggagttgcagctacgc

SEQ ID NO: 413099 - DNA, 25 bp, Mus musculus
gaaattttgggtactccagtggaca

SEQ ID NO: 413100 - DNA, 25 bp, Mus musculus
gaaattttgggttctccagtggaca

SEQ ID NO: 413101 - DNA, 25 bp, Mus musculus
gaaattttgtagaattagcccttgc

SEQ ID NO: 413102 - DNA, 25 bp, Mus musculus
gaaattttgtagtattagcccttgc

SEQ ID NO: 413103 - DNA, 25 bp, Mus musculus
gaaattttgtccatgtgtgctggca

SEQ ID NO: 413104 - DNA, 25 bp, Mus musculus
gaaattttgtccttgtgtgctggca

SEQ ID NO: 413105 - DNA, 25 bp, Mus musculus
gaaattttgtctatccatgtaagaa

SEQ ID NO: 413106 - DNA, 25 bp, Mus musculus
gaaattttgtctttccatgtaagaa

SEQ ID NO: 413107 - DNA, 25 bp, Mus musculus
gaaattttgtggactgagtttatag

SEQ ID NO: 413108 - DNA, 25 bp, Mus musculus
gaaattttgtggtctgagtttatag

SEQ ID NO: 413109 - DNA, 25 bp, Mus musculus
gaaatttttaagatgggccaggcat

SEQ ID NO: 413110 - DNA, 25 bp, Mus musculus
gaaatttttaagttgggccaggcat

SEQ ID NO: 413111 - DNA, 25 bp, Mus musculus
gaaatttttacacatctccttgaaa

SEQ ID NO: 413112 - DNA, 25 bp, Mus musculus
gaaatttttacagatctccttgaaa

SEQ ID NO: 413113 - DNA, 25 bp, Mus musculus
gaaatttttcagcacaggaaaaggt

SEQ ID NO: 413114 - DNA, 25 bp, Mus musculus
gaaatttttcaggacaggaaaaggt

SEQ ID NO: 413115 - DNA, 25 bp, Mus musculus
gaaatttttctgagcatgcctacga

SEQ ID NO: 413116 - DNA, 25 bp, Mus musculus
gaaatttttctgtgcatgcctacga

SEQ ID NO: 413117 - DNA, 25 bp, Mus musculus
gaaatttttcttctgaggaaattca

SEQ ID NO: 413118 - DNA, 25 bp, Mus musculus
gaaatttttcttgtgaggaaattca

SEQ ID NO: 413119 - DNA, 25 bp, Mus musculus
gaaatttttgagacccattcattag

SEQ ID NO: 413120 - DNA, 25 bp, Mus musculus
gaaatttttgagtcccattcattag

SEQ ID NO: 413121 - DNA, 25 bp, Mus musculus
gaaatttttgggacatataactcag

SEQ ID NO: 413122 - DNA, 25 bp, Mus musculus
gaaatttttgggtcatataactcag

SEQ ID NO: 413123 - DNA, 25 bp, Mus musculus
gaacaaaaatctcagtacgtctatc

SEQ ID NO: 413124 - DNA, 25 bp, Mus musculus
gaacaaaaatctgagtacgtctatc

SEQ ID NO: 413125 - DNA, 25 bp, Mus musculus
gaacaaaacattcttccgcgggctt

SEQ ID NO: 413126 - DNA, 25 bp, Mus musculus
gaacaaaacattgttccgcgggctt

SEQ ID NO: 413127 - DNA, 25 bp, Mus musculus
gaacaaaaccctccttgttcattgg

SEQ ID NO: 413128 - DNA, 25 bp, Mus musculus
gaacaaaaccctgcttgttcattgg

SEQ ID NO: 413129 - DNA, 25 bp, Mus musculus
gaacaaaagattagttgctgtgtaa

SEQ ID NO: 413130 - DNA, 25 bp, Mus musculus
gaacaaaagatttgttgctgtgtaa

SEQ ID NO: 413131 - DNA, 25 bp, Mus musculus
gaacaaaaggtgctccagttcccac

SEQ ID NO: 413132 - DNA, 25 bp, Mus musculus
gaacaaaaggtggtccagttcccac

SEQ ID NO: 413133 - DNA, 25 bp, Mus musculus
gaacaaaagtccatcgcaagtgctt

SEQ ID NO: 413134 - DNA, 25 bp, Mus musculus
gaacaaaagtccttcgcaagtgctt

SEQ ID NO: 413135 - DNA, 25 bp, Mus musculus
gaacaaaatacacccttggacgcct

SEQ ID NO: 413136 - DNA, 25 bp, Mus musculus
gaacaaaatacagccttggacgcct

SEQ ID NO: 413137 - DNA, 25 bp, Mus musculus
gaacaaaatacgagttgtgtctcaa

SEQ ID NO: 413138 - DNA, 25 bp, Mus musculus
gaacaaaatacgtgttgtgtctcaa

SEQ ID NO: 413139 - DNA, 25 bp, Mus musculus
gaacaaaatatcatccgtacagcta

SEQ ID NO: 413140 - DNA, 25 bp, Mus musculus
gaacaaaatatcttccgtacagcta

SEQ ID NO: 413141 - DNA, 25 bp, Mus musculus
gaacaaaattctcatagctagccga

SEQ ID NO: 413142 - DNA, 25 bp, Mus musculus
gaacaaaattctgatagctagccga

SEQ ID NO: 413143 - DNA, 25 bp, Mus musculus
gaacaaacacagactagcgttgcaa

SEQ ID NO: 413144 - DNA, 25 bp, Mus musculus
gaacaaacacagtctagcgttgcaa

SEQ ID NO: 413145 - DNA, 25 bp, Mus musculus
gaacaaacagggactggccacttct

SEQ ID NO: 413146 - DNA, 25 bp, Mus musculus
gaacaaacagggtctggccacttct

SEQ ID NO: 413147 - DNA, 25 bp, Mus musculus
gaacaaacagttccttgcttgtgat

SEQ ID NO: 413148 - DNA, 25 bp, Mus musculus
gaacaaacagttgcttgcttgtgat

SEQ ID NO: 413149 - DNA, 25 bp, Mus musculus
gaacaaacattaacttcgctgaagt

SEQ ID NO: 413150 - DNA, 25 bp, Mus musculus
gaacaaacattaatatccatgccat

SEQ ID NO: 413151 - DNA, 25 bp, Mus musculus
gaacaaacattatcttcgctgaagt

SEQ ID NO: 413152 - DNA, 25 bp, Mus musculus
gaacaaacattattatccatgccat

SEQ ID NO: 413153 - DNA, 25 bp, Mus musculus
gaacaaaccagcaactcagctactc

SEQ ID NO: 413154 - DNA, 25 bp, Mus musculus
gaacaaaccagctactcagctactc

SEQ ID NO: 413155 - DNA, 25 bp, Mus musculus
gaacaaaccggaagctgggcttaga

SEQ ID NO: 413156 - DNA, 25 bp, Mus musculus
gaacaaaccggatgctgggcttaga

SEQ ID NO: 413157 - DNA, 25 bp, Mus musculus
gaacaaaccgggagcttccagcaat

SEQ ID NO: 413158 - DNA, 25 bp, Mus musculus
gaacaaaccgggtgcttccagcaat

SEQ ID NO: 413159 - DNA, 25 bp, Mus musculus
gaacaaacgcatatcctttcttgtt

SEQ ID NO: 413160 - DNA, 25 bp, Mus musculus
gaacaaacgcatttcctttcttgtt

SEQ ID NO: 413161 - DNA, 25 bp, Mus musculus
gaacaaacgcctcgatctcctggag

SEQ ID NO: 413162 - DNA, 25 bp, Mus musculus
gaacaaacgcctggatctcctggag

SEQ ID NO: 413163 - DNA, 25 bp, Mus musculus
gaacaaactaagacctagagatatt

SEQ ID NO: 413164 - DNA, 25 bp, Mus musculus
gaacaaactaagtcctagagatatt

SEQ ID NO: 413165 - DNA, 25 bp, Mus musculus
gaacaaactagtacactaagcctag

SEQ ID NO: 413166 - DNA, 25 bp, Mus musculus
gaacaaactagttcactaagcctag

SEQ ID NO: 413167 - DNA, 25 bp, Mus musculus
gaacaaactccaaggtcgtctgatg

SEQ ID NO: 413168 - DNA, 25 bp, Mus musculus
gaacaaactccatggtcgtctgatg

SEQ ID NO: 413169 - DNA, 25 bp, Mus musculus
gaacaaactcttccaagttgcccta

SEQ ID NO: 413170 - DNA, 25 bp, Mus musculus
gaacaaactcttgcaagttgcccta

SEQ ID NO: 413171 - DNA, 25 bp, Mus musculus
gaacaaactgctatcgaaatctatt

SEQ ID NO: 413172 - DNA, 25 bp, Mus musculus
gaacaaactgctttcgaaatctatt

SEQ ID NO: 413173 - DNA, 25 bp, Mus musculus
gaacaaactgtgatctttgccccag

SEQ ID NO: 413174 - DNA, 25 bp, Mus musculus
gaacaaactgtgttctttgccccag

SEQ ID NO: 413175 - DNA, 25 bp, Mus musculus
gaacaaagagccagctaccacgagg

SEQ ID NO: 413176 - DNA, 25 bp, Mus musculus
gaacaaagagcctgctaccacgagg

SEQ ID NO: 413177 - DNA, 25 bp, Mus musculus
gaacaaagattcctgggctaataca

SEQ ID NO: 413178 - DNA, 25 bp, Mus musculus
gaacaaagattcgtgggctaataca

SEQ ID NO: 413179 - DNA, 25 bp, Mus musculus
gaacaaagcccacagattctgaagt

SEQ ID NO: 413180 - DNA, 25 bp, Mus musculus
gaacaaagcccagagattctgaagt

SEQ ID NO: 413181 - DNA, 25 bp, Mus musculus
gaacaaagcgtccagcttgtcggct

SEQ ID NO: 413182 - DNA, 25 bp, Mus musculus
gaacaaagcgtcgagcttgtcggct

SEQ ID NO: 413183 - DNA, 25 bp, Mus musculus
gaacaaaggcctacatgggaagctt

SEQ ID NO: 413184 - DNA, 25 bp, Mus musculus
gaacaaaggccttcatgggaagctt

SEQ ID NO: 413185 - DNA, 25 bp, Mus musculus
gaacaaagggtgaattcctcacatt

SEQ ID NO: 413186 - DNA, 25 bp, Mus musculus
gaacaaagggtgtattcctcacatt

SEQ ID NO: 413187 - DNA, 25 bp, Mus musculus
gaacaaagtattctttcctccagca

SEQ ID NO: 413188 - DNA, 25 bp, Mus musculus
gaacaaagtattgtttcctccagca

SEQ ID NO: 413189 - DNA, 25 bp, Mus musculus
gaacaaagtccccggcgttggctcg

SEQ ID NO: 413190 - DNA, 25 bp, Mus musculus
gaacaaagtcccgggcgttggctcg

SEQ ID NO: 413191 - DNA, 25 bp, Mus musculus
gaacaaagtctgcagagaacaggga

SEQ ID NO: 413192 - DNA, 25 bp, Mus musculus
gaacaaagtctggagagaacaggga

SEQ ID NO: 413193 - DNA, 25 bp, Mus musculus
gaacaaagtgccagtgtacctaaga

SEQ ID NO: 413194 - DNA, 25 bp, Mus musculus
gaacaaagtgcctgtgtacctaaga

SEQ ID NO: 413195 - DNA, 25 bp, Mus musculus
gaacaaagtgtgctctgtacatcta

SEQ ID NO: 413196 - DNA, 25 bp, Mus musculus
gaacaaagtgtggtctgtacatcta

SEQ ID NO: 413197 - DNA, 25 bp, Mus musculus
gaacaaagttgacccttgtgaccca

SEQ ID NO: 413198 - DNA, 25 bp, Mus musculus
gaacaaagttgagccttgtgaccca

SEQ ID NO: 413199 - DNA, 25 bp, Mus musculus
gaacaaatacttccgggctgctttt

SEQ ID NO: 413200 - DNA, 25 bp, Mus musculus
gaacaaatacttgcgggctgctttt

SEQ ID NO: 413201 - DNA, 25 bp, Mus musculus
gaacaaatagctaaagggccccagg

SEQ ID NO: 413202 - DNA, 25 bp, Mus musculus
gaacaaatagcttaagggccccagg

SEQ ID NO: 413203 - DNA, 25 bp, Mus musculus
gaacaaatatatagtttctggcact

SEQ ID NO: 413204 - DNA, 25 bp, Mus musculus
gaacaaatatattgtttctggcact

SEQ ID NO: 413205 - DNA, 25 bp, Mus musculus
gaacaaatatcgatctcaaatggaa

SEQ ID NO: 413206 - DNA, 25 bp, Mus musculus
gaacaaatatcgttctcaaatggaa

SEQ ID NO: 413207 - DNA, 25 bp, Mus musculus
gaacaaatcacgaaggtttatggca

SEQ ID NO: 413208 - DNA, 25 bp, Mus musculus
gaacaaatcacgtaggtttatggca

SEQ ID NO: 413209 - DNA, 25 bp, Mus musculus
gaacaaatcatcctatcacaggctg

SEQ ID NO: 413210 - DNA, 25 bp, Mus musculus
gaacaaatcatcgtatcacaggctg

SEQ ID NO: 413211 - DNA, 25 bp, Mus musculus
gaacaaatgaaaattccctaactca

SEQ ID NO: 413212 - DNA, 25 bp, Mus musculus
gaacaaatgaaatttccctaactca

SEQ ID NO: 413213 - DNA, 25 bp, Mus musculus
gaacaaatgacaaccaagttttccc

SEQ ID NO: 413214 - DNA, 25 bp, Mus musculus
gaacaaatgacactccttaggcaga

SEQ ID NO: 413215 - DNA, 25 bp, Mus musculus
gaacaaatgacagtccttaggcaga

SEQ ID NO: 413216 - DNA, 25 bp, Mus musculus
gaacaaatgacatccaagttttccc

SEQ ID NO: 413217 - DNA, 25 bp, Mus musculus
gaacaaatgagacgccaacgagaag

SEQ ID NO: 413218 - DNA, 25 bp, Mus musculus
gaacaaatgagaggccaacgagaag

SEQ ID NO: 413219 - DNA, 25 bp, Mus musculus
gaacaaatgccaagctggtgccatt

SEQ ID NO: 413220 - DNA, 25 bp, Mus musculus
gaacaaatgccatgctggtgccatt

SEQ ID NO: 413221 - DNA, 25 bp, Mus musculus
gaacaaatgctaccgaggccgctct

SEQ ID NO: 413222 - DNA, 25 bp, Mus musculus
gaacaaatgctagcgaggccgctct

SEQ ID NO: 413223 - DNA, 25 bp, Mus musculus
gaacaaatgctcatgcgggaactac

SEQ ID NO: 413224 - DNA, 25 bp, Mus musculus
gaacaaatgctcttgcgggaactac

SEQ ID NO: 413225 - DNA, 25 bp, Mus musculus
gaacaaatggttattccagaagctt

SEQ ID NO: 413226 - DNA, 25 bp, Mus musculus
gaacaaatggtttttccagaagctt

SEQ ID NO: 413227 - DNA, 25 bp, Mus musculus
gaacaaattcccacctagaagaaag

SEQ ID NO: 413228 - DNA, 25 bp, Mus musculus
gaacaaattccctcctagaagaaag

SEQ ID NO: 413229 - DNA, 25 bp, Mus musculus
gaacaaattgaaaatccacagtcct

SEQ ID NO: 413230 - DNA, 25 bp, Mus musculus
gaacaaattgaatatccacagtcct

SEQ ID NO: 413231 - DNA, 25 bp, Mus musculus
gaacaaattgtacatcgggaacctc

SEQ ID NO: 413232 - DNA, 25 bp, Mus musculus
gaacaaattgtagatcgggaacctc

SEQ ID NO: 413233 - DNA, 25 bp, Mus musculus
gaacaaatttgtcagtgctaagtaa

SEQ ID NO: 413234 - DNA, 25 bp, Mus musculus
gaacaaatttgtgagtgctaagtaa

SEQ ID NO: 413235 - DNA, 25 bp, Mus musculus
gaacaaattttcctttgagtatcaa

SEQ ID NO: 413236 - DNA, 25 bp, Mus musculus
gaacaaattttcgtttgagtatcaa

SEQ ID NO: 413237 - DNA, 25 bp, Mus musculus
gaacaacaacaccacactaagtctt

SEQ ID NO: 413238 - DNA, 25 bp, Mus musculus
gaacaacaacacgacactaagtctt

SEQ ID NO: 413239 - DNA, 25 bp, Mus musculus
gaacaacaactgaaggtcccctaag

SEQ ID NO: 413240 - DNA, 25 bp, Mus musculus
gaacaacaactgtaggtcccctaag

SEQ ID NO: 413241 - DNA, 25 bp, Mus musculus
gaacaacaaggactgcttcttctgc

SEQ ID NO: 413242 - DNA, 25 bp, Mus musculus
gaacaacaaggagtgcttcttctgc

SEQ ID NO: 413243 - DNA, 25 bp, Mus musculus
gaacaacaatacagtacaatgcaga

SEQ ID NO: 413244 - DNA, 25 bp, Mus musculus
gaacaacaatactgtacaatgcaga

SEQ ID NO: 413245 - DNA, 25 bp, Mus musculus
gaacaacaatgtcagccagcgtccc

SEQ ID NO: 413246 - DNA, 25 bp, Mus musculus
gaacaacaatgtgagccagcgtccc

SEQ ID NO: 413247 - DNA, 25 bp, Mus musculus
gaacaacacaccaggccaagaactg

SEQ ID NO: 413248 - DNA, 25 bp, Mus musculus
gaacaacacacctggccaagaactg

SEQ ID NO: 413249 - DNA, 25 bp, Mus musculus
gaacaacaccccagtatggctgagg

SEQ ID NO: 413250 - DNA, 25 bp, Mus musculus
gaacaacacccctgtatggctgagg

SEQ ID NO: 413251 - DNA, 25 bp, Mus musculus
gaacaacacctgaacttgctgtcta

SEQ ID NO: 413252 - DNA, 25 bp, Mus musculus
gaacaacacctgtacttgctgtcta

SEQ ID NO: 413253 - DNA, 25 bp, Mus musculus
gaacaacagactccttgaagtcgct

SEQ ID NO: 413254 - DNA, 25 bp, Mus musculus
gaacaacagactgcttgaagtcgct

SEQ ID NO: 413255 - DNA, 25 bp, Mus musculus
gaacaacagatgatgtacgcaggaa

SEQ ID NO: 413256 - DNA, 25 bp, Mus musculus
gaacaacagatgttgtacgcaggaa

SEQ ID NO: 413257 - DNA, 25 bp, Mus musculus
gaacaacagcaaagcttttttccaa

SEQ ID NO: 413258 - DNA, 25 bp, Mus musculus
gaacaacagcaatgcttttttccaa

SEQ ID NO: 413259 - DNA, 25 bp, Mus musculus
gaacaacagcgaacatctgacccat

SEQ ID NO: 413260 - DNA, 25 bp, Mus musculus
gaacaacagcgatcatctgacccat

SEQ ID NO: 413261 - DNA, 25 bp, Mus musculus
gaacaacaggccatattccgctgct

SEQ ID NO: 413262 - DNA, 25 bp, Mus musculus
gaacaacaggccttattccgctgct

SEQ ID NO: 413263 - DNA, 25 bp, Mus musculus
gaacaacagggtctattgagggaca

SEQ ID NO: 413264 - DNA, 25 bp, Mus musculus
gaacaacagggtgtattgagggaca

SEQ ID NO: 413265 - DNA, 25 bp, Mus musculus
gaacaacagtgtacatgggctttta

SEQ ID NO: 413266 - DNA, 25 bp, Mus musculus
gaacaacagtgttcatgggctttta

SEQ ID NO: 413267 - DNA, 25 bp, Mus musculus
gaacaacatcaaaaagttgctgtga

SEQ ID NO: 413268 - DNA, 25 bp, Mus musculus
gaacaacatcaaaaatacggagtat

SEQ ID NO: 413269 - DNA, 25 bp, Mus musculus
gaacaacatcaataagttgctgtga

SEQ ID NO: 413270 - DNA, 25 bp, Mus musculus
gaacaacatcaataatacggagtat

SEQ ID NO: 413271 - DNA, 25 bp, Mus musculus
gaacaacatcacagggtgtccacac

SEQ ID NO: 413272 - DNA, 25 bp, Mus musculus
gaacaacatcacattgggccaagca

SEQ ID NO: 413273 - DNA, 25 bp, Mus musculus
gaacaacatcactgggtgtccacac

SEQ ID NO: 413274 - DNA, 25 bp, Mus musculus
gaacaacatcactttgggccaagca

SEQ ID NO: 413275 - DNA, 25 bp, Mus musculus
gaacaacatgcaactttagtccgtt

SEQ ID NO: 413276 - DNA, 25 bp, Mus musculus
gaacaacatgcatctttagtccgtt

SEQ ID NO: 413277 - DNA, 25 bp, Mus musculus
gaacaacattagacactgccacact

SEQ ID NO: 413278 - DNA, 25 bp, Mus musculus
gaacaacattagtcactgccacact

SEQ ID NO: 413279 - DNA, 25 bp, Mus musculus
gaacaacccaccagaagaagcacct

SEQ ID NO: 413280 - DNA, 25 bp, Mus musculus
gaacaacccacctgaagaagcacct

SEQ ID NO: 413281 - DNA, 25 bp, Mus musculus
gaacaacccactcttaggattgcat

SEQ ID NO: 413282 - DNA, 25 bp, Mus musculus
gaacaacccactgttaggattgcat

SEQ ID NO: 413283 - DNA, 25 bp, Mus musculus
gaacaaccctttctgacttaggaga

SEQ ID NO: 413284 - DNA, 25 bp, Mus musculus
gaacaaccctttgtgacttaggaga

SEQ ID NO: 413285 - DNA, 25 bp, Mus musculus
gaacaaccgactacgattcttcctt

SEQ ID NO: 413286 - DNA, 25 bp, Mus musculus
gaacaaccgacttcgattcttcctt

SEQ ID NO: 413287 - DNA, 25 bp, Mus musculus
gaacaaccgcctaaaaacaaccatg

SEQ ID NO: 413288 - DNA, 25 bp, Mus musculus
gaacaaccgccttaaaacaaccatg

SEQ ID NO: 413289 - DNA, 25 bp, Mus musculus
gaacaaccgcgcctgagtaagcaac

SEQ ID NO: 413290 - DNA, 25 bp, Mus musculus
gaacaaccgcgcgtgagtaagcaac

SEQ ID NO: 413291 - DNA, 25 bp, Mus musculus
gaacaaccgtttctcttaactgatg

SEQ ID NO: 413292 - DNA, 25 bp, Mus musculus
gaacaaccgtttgtcttaactgatg

SEQ ID NO: 413293 - DNA, 25 bp, Mus musculus
gaacaacctaacattcttctattag

SEQ ID NO: 413294 - DNA, 25 bp, Mus musculus
gaacaacctaactttcttctattag

SEQ ID NO: 413295 - DNA, 25 bp, Mus musculus
gaacaacctgcacagtcagttttct

SEQ ID NO: 413296 - DNA, 25 bp, Mus musculus
gaacaacctgcagagtcagttttct

SEQ ID NO: 413297 - DNA, 25 bp, Mus musculus
gaacaacctggtctatatcctggtc

SEQ ID NO: 413298 - DNA, 25 bp, Mus musculus
gaacaacctggtgtatatcctggtc

SEQ ID NO: 413299 - DNA, 25 bp, Mus musculus
gaacaacgactaactccagtgtggg

SEQ ID NO: 413300 - DNA, 25 bp, Mus musculus
gaacaacgactatctccagtgtggg

SEQ ID NO: 413301 - DNA, 25 bp, Mus musculus
gaacaacgatataaactcgtccgtg

SEQ ID NO: 413302 - DNA, 25 bp, Mus musculus
gaacaacgatattaactcgtccgtg

SEQ ID NO: 413303 - DNA, 25 bp, Mus musculus
gaacaacgcaggaggccagcagcat

SEQ ID NO: 413304 - DNA, 25 bp, Mus musculus
gaacaacgcaggtggccagcagcat

SEQ ID NO: 413305 - DNA, 25 bp, Mus musculus
gaacaacgggctatatggaccattt

SEQ ID NO: 413306 - DNA, 25 bp, Mus musculus
gaacaacgggctttatggaccattt

SEQ ID NO: 413307 - DNA, 25 bp, Mus musculus
gaacaacggtgaaatttggtttgag

SEQ ID NO: 413308 - DNA, 25 bp, Mus musculus
gaacaacggtgatatttggtttgag

SEQ ID NO: 413309 - DNA, 25 bp, Mus musculus
gaacaacggtgtcaccctgaaggaa

SEQ ID NO: 413310 - DNA, 25 bp, Mus musculus
gaacaacggtgtgaccctgaaggaa

SEQ ID NO: 413311 - DNA, 25 bp, Mus musculus
gaacaacgtaacaccagacatgatg

SEQ ID NO: 413312 - DNA, 25 bp, Mus musculus
gaacaacgtaactccagacatgatg

SEQ ID NO: 413313 - DNA, 25 bp, Mus musculus
gaacaacgtcaacgtcatccgtgac

SEQ ID NO: 413314 - DNA, 25 bp, Mus musculus
gaacaacgtcaaggtcatccgtgac

SEQ ID NO: 413315 - DNA, 25 bp, Mus musculus
gaacaactaaggctaaggatacaaa

SEQ ID NO: 413316 - DNA, 25 bp, Mus musculus
gaacaactaagggtaaggatacaaa

SEQ ID NO: 413317 - DNA, 25 bp, Mus musculus
gaacaactacgcacttgcaaaggtt

SEQ ID NO: 413318 - DNA, 25 bp, Mus musculus
gaacaactacgctcttgcaaaggtt

SEQ ID NO: 413319 - DNA, 25 bp, Mus musculus
gaacaactcaagaatccacgtctcc

SEQ ID NO: 413320 - DNA, 25 bp, Mus musculus
gaacaactcaagtatccacgtctcc

SEQ ID NO: 413321 - DNA, 25 bp, Mus musculus
gaacaactcacaaaccagtgtcaaa

SEQ ID NO: 413322 - DNA, 25 bp, Mus musculus
gaacaactcacataccagtgtcaaa

SEQ ID NO: 413323 - DNA, 25 bp, Mus musculus
gaacaactcataaaactggtctcag

SEQ ID NO: 413324 - DNA, 25 bp, Mus musculus
gaacaactcatataactggtctcag

SEQ ID NO: 413325 - DNA, 25 bp, Mus musculus
gaacaactccagataagtcccactt

SEQ ID NO: 413326 - DNA, 25 bp, Mus musculus
gaacaactccagttaagtcccactt

SEQ ID NO: 413327 - DNA, 25 bp, Mus musculus
gaacaactccccatagttttagcaa

SEQ ID NO: 413328 - DNA, 25 bp, Mus musculus
gaacaactccccttagttttagcaa

SEQ ID NO: 413329 - DNA, 25 bp, Mus musculus
gaacaactccttaggtgtgggctgc

SEQ ID NO: 413330 - DNA, 25 bp, Mus musculus
gaacaactcctttggtgtgggctgc

SEQ ID NO: 413331 - DNA, 25 bp, Mus musculus
gaacaactgacaatcacacttccca

SEQ ID NO: 413332 - DNA, 25 bp, Mus musculus
gaacaactgacattcacacttccca

SEQ ID NO: 413333 - DNA, 25 bp, Mus musculus
gaacaactgcatcctgtggagatca

SEQ ID NO: 413334 - DNA, 25 bp, Mus musculus
gaacaactgcatgctgtggagatca

SEQ ID NO: 413335 - DNA, 25 bp, Mus musculus
gaacaactgcccaaggaagtggcct

SEQ ID NO: 413336 - DNA, 25 bp, Mus musculus
gaacaactgccctaggaagtggcct

SEQ ID NO: 413337 - DNA, 25 bp, Mus musculus
gaacaactgctccaatagctacctg

SEQ ID NO: 413338 - DNA, 25 bp, Mus musculus
gaacaactgctcgaatagctacctg

SEQ ID NO: 413339 - DNA, 25 bp, Mus musculus
gaacaactggatacctggcgtctat

SEQ ID NO: 413340 - DNA, 25 bp, Mus musculus
gaacaactggattcctggcgtctat

SEQ ID NO: 413341 - DNA, 25 bp, Mus musculus
gaacaactggccctgctttattgaa

SEQ ID NO: 413342 - DNA, 25 bp, Mus musculus
gaacaactggccgtgctttattgaa

SEQ ID NO: 413343 - DNA, 25 bp, Mus musculus
gaacaactggtgctaatccatggct

SEQ ID NO: 413344 - DNA, 25 bp, Mus musculus
gaacaactggtggtaatccatggct

SEQ ID NO: 413345 - DNA, 25 bp, Mus musculus
gaacaactgtatccatgcttctcct

SEQ ID NO: 413346 - DNA, 25 bp, Mus musculus
gaacaactgtatgcatgcttctcct

SEQ ID NO: 413347 - DNA, 25 bp, Mus musculus
gaacaactgtttagacattaaatgt

SEQ ID NO: 413348 - DNA, 25 bp, Mus musculus
gaacaactgttttgacattaaatgt

SEQ ID NO: 413349 - DNA, 25 bp, Mus musculus
gaacaacttaaaactgcctcaggtt

SEQ ID NO: 413350 - DNA, 25 bp, Mus musculus
gaacaacttaaatctgcctcaggtt

SEQ ID NO: 413351 - DNA, 25 bp, Mus musculus
gaacaacttaagatctgaagacact

SEQ ID NO: 413352 - DNA, 25 bp, Mus musculus
gaacaacttaagttctgaagacact

SEQ ID NO: 413353 - DNA, 25 bp, Mus musculus
gaacaacttaatccctgatgacaga

SEQ ID NO: 413354 - DNA, 25 bp, Mus musculus
gaacaacttaatgcctgatgacaga

SEQ ID NO: 413355 - DNA, 25 bp, Mus musculus
gaacaacttcgacggcagagtgagt

SEQ ID NO: 413356 - DNA, 25 bp, Mus musculus
gaacaacttcgagggcagagtgagt

SEQ ID NO: 413357 - DNA, 25 bp, Mus musculus
gaacaacttgacatcatcatccatg

SEQ ID NO: 413358 - DNA, 25 bp, Mus musculus
gaacaacttgacttcatcatccatg

SEQ ID NO: 413359 - DNA, 25 bp, Mus musculus
gaacaacttgagattttcagcttaa

SEQ ID NO: 413360 - DNA, 25 bp, Mus musculus
gaacaacttgagtttttcagcttaa

SEQ ID NO: 413361 - DNA, 25 bp, Mus musculus
gaacaactttgcagagcggcagaaa

SEQ ID NO: 413362 - DNA, 25 bp, Mus musculus
gaacaactttgctgagcggcagaaa

SEQ ID NO: 413363 - DNA, 25 bp, Mus musculus
gaacaactttgtaactccatagtta

SEQ ID NO: 413364 - DNA, 25 bp, Mus musculus
gaacaactttgtcgcgagcaccact

SEQ ID NO: 413365 - DNA, 25 bp, Mus musculus
gaacaactttgtggcgagcaccact

SEQ ID NO: 413366 - DNA, 25 bp, Mus musculus
gaacaactttgttactccatagtta

SEQ ID NO: 413367 - DNA, 25 bp, Mus musculus
gaacaacttttaactttgaccttat

SEQ ID NO: 413368 - DNA, 25 bp, Mus musculus
gaacaacttttatctttgaccttat

SEQ ID NO: 413369 - DNA, 25 bp, Mus musculus
gaacaacttttcagtagcaccttct

SEQ ID NO: 413370 - DNA, 25 bp, Mus musculus
gaacaacttttcatcagactgcatt

SEQ ID NO: 413371 - DNA, 25 bp, Mus musculus
gaacaacttttctgtagcaccttct

SEQ ID NO: 413372 - DNA, 25 bp, Mus musculus
gaacaacttttcttcagactgcatt

SEQ ID NO: 413373 - DNA, 25 bp, Mus musculus
gaacaagaaaaaatggcgtctctga

SEQ ID NO: 413374 - DNA, 25 bp, Mus musculus
gaacaagaaaaattggcgtctctga

SEQ ID NO: 413375 - DNA, 25 bp, Mus musculus
gaacaagaagagaatggaagaccca

SEQ ID NO: 413376 - DNA, 25 bp, Mus musculus
gaacaagaagagtatggaagaccca

SEQ ID NO: 413377 - DNA, 25 bp, Mus musculus
gaacaagacaacctcaatgatgcag

SEQ ID NO: 413378 - DNA, 25 bp, Mus musculus
gaacaagacaacgtcaatgatgcag

SEQ ID NO: 413379 - DNA, 25 bp, Mus musculus
gaacaagacaatatggctctgccta

SEQ ID NO: 413380 - DNA, 25 bp, Mus musculus
gaacaagacaatttggctctgccta

SEQ ID NO: 413381 - DNA, 25 bp, Mus musculus
gaacaagacagaacgctggatcctt

SEQ ID NO: 413382 - DNA, 25 bp, Mus musculus
gaacaagacagatcgctggatcctt

SEQ ID NO: 413383 - DNA, 25 bp, Mus musculus
gaacaagacattctcttaaccacta

SEQ ID NO: 413384 - DNA, 25 bp, Mus musculus
gaacaagacattgtcttaaccacta

SEQ ID NO: 413385 - DNA, 25 bp, Mus musculus
gaacaagaccacatggttctctgtg

SEQ ID NO: 413386 - DNA, 25 bp, Mus musculus
gaacaagaccacttggttctctgtg

SEQ ID NO: 413387 - DNA, 25 bp, Mus musculus
gaacaagacctgaacacactgatgg

SEQ ID NO: 413388 - DNA, 25 bp, Mus musculus
gaacaagacctgtacacactgatgg

SEQ ID NO: 413389 - DNA, 25 bp, Mus musculus
gaacaagacgctaacccgtagacaa

SEQ ID NO: 413390 - DNA, 25 bp, Mus musculus
gaacaagacgcttacccgtagacaa

SEQ ID NO: 413391 - DNA, 25 bp, Mus musculus
gaacaagacggcaagctctctgggc

SEQ ID NO: 413392 - DNA, 25 bp, Mus musculus
gaacaagacggctagctctctgggc

SEQ ID NO: 413393 - DNA, 25 bp, Mus musculus
gaacaagacgtcctcaaaagcctcg

SEQ ID NO: 413394 - DNA, 25 bp, Mus musculus
gaacaagacgtcgtcaaaagcctcg

SEQ ID NO: 413395 - DNA, 25 bp, Mus musculus
gaacaagactatcaaagggaccgtg

SEQ ID NO: 413396 - DNA, 25 bp, Mus musculus
gaacaagactatgaaagggaccgtg

SEQ ID NO: 413397 - DNA, 25 bp, Mus musculus
gaacaagagacccttcaacagcctg

SEQ ID NO: 413398 - DNA, 25 bp, Mus musculus
gaacaagagaccgttcaacagcctg

SEQ ID NO: 413399 - DNA, 25 bp, Mus musculus
gaacaagatcatatcctttgaggaa

SEQ ID NO: 413400 - DNA, 25 bp, Mus musculus
gaacaagatcatttcctttgaggaa

SEQ ID NO: 413401 - DNA, 25 bp, Mus musculus
gaacaagatgagaagagtattttac

SEQ ID NO: 413402 - DNA, 25 bp, Mus musculus
gaacaagatgagtagagtattttac

SEQ ID NO: 413403 - DNA, 25 bp, Mus musculus
gaacaagatgatacctagattttta

SEQ ID NO: 413404 - DNA, 25 bp, Mus musculus
gaacaagatgattcctagattttta

SEQ ID NO: 413405 - DNA, 25 bp, Mus musculus
gaacaagatgctctcattactgaaa

SEQ ID NO: 413406 - DNA, 25 bp, Mus musculus
gaacaagatgctgtcattactgaaa

SEQ ID NO: 413407 - DNA, 25 bp, Mus musculus
gaacaagatgtaaggctctgagaaa

SEQ ID NO: 413408 - DNA, 25 bp, Mus musculus
gaacaagatgtatggctctgagaaa

SEQ ID NO: 413409 - DNA, 25 bp, Mus musculus
gaacaagattcaacactcaatggga

SEQ ID NO: 413410 - DNA, 25 bp, Mus musculus
gaacaagattcatcactcaatggga

SEQ ID NO: 413411 - DNA, 25 bp, Mus musculus
gaacaagattggcaagccccacact

SEQ ID NO: 413412 - DNA, 25 bp, Mus musculus
gaacaagattgggaagccccacact

SEQ ID NO: 413413 - DNA, 25 bp, Mus musculus
gaacaagcacatatttcctgccagt

SEQ ID NO: 413414 - DNA, 25 bp, Mus musculus
gaacaagcacatttttcctgccagt

SEQ ID NO: 413415 - DNA, 25 bp, Mus musculus
gaacaagcacgccttcccaggaggc

SEQ ID NO: 413416 - DNA, 25 bp, Mus musculus
gaacaagcacgcgttcccaggaggc

SEQ ID NO: 413417 - DNA, 25 bp, Mus musculus
gaacaagcacttaggaagcatcccc

SEQ ID NO: 413418 - DNA, 25 bp, Mus musculus
gaacaagcactttggaagcatcccc

SEQ ID NO: 413419 - DNA, 25 bp, Mus musculus
gaacaagcaggcacacctaggcctt

SEQ ID NO: 413420 - DNA, 25 bp, Mus musculus
gaacaagcaggctcacctaggcctt

SEQ ID NO: 413421 - DNA, 25 bp, Mus musculus
gaacaagcatacattccacaatgat

SEQ ID NO: 413422 - DNA, 25 bp, Mus musculus
gaacaagcatactttccacaatgat

SEQ ID NO: 413423 - DNA, 25 bp, Mus musculus
gaacaagcatatctcctattatgga

SEQ ID NO: 413424 - DNA, 25 bp, Mus musculus
gaacaagcatatgtcctattatgga

SEQ ID NO: 413425 - DNA, 25 bp, Mus musculus
gaacaagcatccatgactgtctact

SEQ ID NO: 413426 - DNA, 25 bp, Mus musculus
gaacaagcatccttgactgtctact

SEQ ID NO: 413427 - DNA, 25 bp, Mus musculus
gaacaagccacaaaggtgattgcta

SEQ ID NO: 413428 - DNA, 25 bp, Mus musculus
gaacaagccacataggtgattgcta

SEQ ID NO: 413429 - DNA, 25 bp, Mus musculus
gaacaagccacgaggagcaacccat

SEQ ID NO: 413430 - DNA, 25 bp, Mus musculus
gaacaagccacgcttgctgacatgc

SEQ ID NO: 413431 - DNA, 25 bp, Mus musculus
gaacaagccacggttgctgacatgc

SEQ ID NO: 413432 - DNA, 25 bp, Mus musculus
gaacaagccacgtggagcaacccat

SEQ ID NO: 413433 - DNA, 25 bp, Mus musculus
gaacaagccagtagactttagccta

SEQ ID NO: 413434 - DNA, 25 bp, Mus musculus
gaacaagccagttgactttagccta

SEQ ID NO: 413435 - DNA, 25 bp, Mus musculus
gaacaagccatccagtgtctcaatg

SEQ ID NO: 413436 - DNA, 25 bp, Mus musculus
gaacaagccatcgagtgtctcaatg

SEQ ID NO: 413437 - DNA, 25 bp, Mus musculus
gaacaagccgacagggtttgctctg

SEQ ID NO: 413438 - DNA, 25 bp, Mus musculus
gaacaagccgactgggtttgctctg

SEQ ID NO: 413439 - DNA, 25 bp, Mus musculus
gaacaagcctgacaagtaccagctg

SEQ ID NO: 413440 - DNA, 25 bp, Mus musculus
gaacaagcctgagaagtaccagctg

SEQ ID NO: 413441 - DNA, 25 bp, Mus musculus
gaacaagcctgcagcacattttctg

SEQ ID NO: 413442 - DNA, 25 bp, Mus musculus
gaacaagcctgctgcacattttctg

SEQ ID NO: 413443 - DNA, 25 bp, Mus musculus
gaacaagccttgctttacattagaa

SEQ ID NO: 413444 - DNA, 25 bp, Mus musculus
gaacaagccttggtttacattagaa

SEQ ID NO: 413445 - DNA, 25 bp, Mus musculus
gaacaagcgagtcctcacagatacc

SEQ ID NO: 413446 - DNA, 25 bp, Mus musculus
gaacaagcgagtgctcacagatacc

SEQ ID NO: 413447 - DNA, 25 bp, Mus musculus
gaacaagcgcgcaacttttatatga

SEQ ID NO: 413448 - DNA, 25 bp, Mus musculus
gaacaagcgcgctacttttatatga

SEQ ID NO: 413449 - DNA, 25 bp, Mus musculus
gaacaagcggccctccaaggagatg

SEQ ID NO: 413450 - DNA, 25 bp, Mus musculus
gaacaagcggccctgcaggaaattc

SEQ ID NO: 413451 - DNA, 25 bp, Mus musculus
gaacaagcggccgtccaaggagatg

SEQ ID NO: 413452 - DNA, 25 bp, Mus musculus
gaacaagcggccgtgcaggaaattc

SEQ ID NO: 413453 - DNA, 25 bp, Mus musculus
gaacaagctcaactatggccagact

SEQ ID NO: 413454 - DNA, 25 bp, Mus musculus
gaacaagctcaagtatggccagact

SEQ ID NO: 413455 - DNA, 25 bp, Mus musculus
gaacaagctctaattttctaaaaat

SEQ ID NO: 413456 - DNA, 25 bp, Mus musculus
gaacaagctctatttttctaaaaat

SEQ ID NO: 413457 - DNA, 25 bp, Mus musculus
gaacaagctgacagtgctcccgtgt

SEQ ID NO: 413458 - DNA, 25 bp, Mus musculus
gaacaagctgactgtgctcccgtgt

SEQ ID NO: 413459 - DNA, 25 bp, Mus musculus
gaacaagctggtcttttggttttct

SEQ ID NO: 413460 - DNA, 25 bp, Mus musculus
gaacaagctggtgttttggttttct

SEQ ID NO: 413461 - DNA, 25 bp, Mus musculus
gaacaagctgtgaaccagaccattt

SEQ ID NO: 413462 - DNA, 25 bp, Mus musculus
gaacaagctgtgtaccagaccattt

SEQ ID NO: 413463 - DNA, 25 bp, Mus musculus
gaacaagctgttaaatatttaccga

SEQ ID NO: 413464 - DNA, 25 bp, Mus musculus
gaacaagctgtttaatatttaccga

SEQ ID NO: 413465 - DNA, 25 bp, Mus musculus
gaacaagcttttagtaggatctgaa

SEQ ID NO: 413466 - DNA, 25 bp, Mus musculus
gaacaagctttttgtaggatctgaa

SEQ ID NO: 413467 - DNA, 25 bp, Mus musculus
gaacaaggaacactcttacctggaa

SEQ ID NO: 413468 - DNA, 25 bp, Mus musculus
gaacaaggaacagtcttacctggaa

SEQ ID NO: 413469 - DNA, 25 bp, Mus musculus
gaacaaggacatagccccaagatgg

SEQ ID NO: 413470 - DNA, 25 bp, Mus musculus
gaacaaggacattgccccaagatgg

SEQ ID NO: 413471 - DNA, 25 bp, Mus musculus
gaacaaggactcaaacaggcctgtc

SEQ ID NO: 413472 - DNA, 25 bp, Mus musculus
gaacaaggactctaacaggcctgtc

SEQ ID NO: 413473 - DNA, 25 bp, Mus musculus
gaacaaggagtaacaccctgcccct

SEQ ID NO: 413474 - DNA, 25 bp, Mus musculus
gaacaaggagtatcaccctgcccct

SEQ ID NO: 413475 - DNA, 25 bp, Mus musculus
gaacaaggcaacatttctaggtaag

SEQ ID NO: 413476 - DNA, 25 bp, Mus musculus
gaacaaggcaacttttctaggtaag

SEQ ID NO: 413477 - DNA, 25 bp, Mus musculus
gaacaaggcagcatccaggcaaatg

SEQ ID NO: 413478 - DNA, 25 bp, Mus musculus
gaacaaggcagcttccaggcaaatg

SEQ ID NO: 413479 - DNA, 25 bp, Mus musculus
gaacaaggcataaccctggtgctta

SEQ ID NO: 413480 - DNA, 25 bp, Mus musculus
gaacaaggcatatccctggtgctta

SEQ ID NO: 413481 - DNA, 25 bp, Mus musculus
gaacaaggcatcaccatgggctgct

SEQ ID NO: 413482 - DNA, 25 bp, Mus musculus
gaacaaggcatcatagacaagctga

SEQ ID NO: 413483 - DNA, 25 bp, Mus musculus
gaacaaggcatctccatgggctgct

SEQ ID NO: 413484 - DNA, 25 bp, Mus musculus
gaacaaggcatcttagacaagctga

SEQ ID NO: 413485 - DNA, 25 bp, Mus musculus
gaacaaggccaacacagcagctact

SEQ ID NO: 413486 - DNA, 25 bp, Mus musculus
gaacaaggccaagacagcagctact

SEQ ID NO: 413487 - DNA, 25 bp, Mus musculus
gaacaaggcctacgagtgtagctca

SEQ ID NO: 413488 - DNA, 25 bp, Mus musculus
gaacaaggcctaggagtgtagctca

SEQ ID NO: 413489 - DNA, 25 bp, Mus musculus
gaacaaggcggacttccaaggcatc

SEQ ID NO: 413490 - DNA, 25 bp, Mus musculus
gaacaaggcggagttccaaggcatc

SEQ ID NO: 413491 - DNA, 25 bp, Mus musculus
gaacaaggcgtccaacgacgtccct

SEQ ID NO: 413492 - DNA, 25 bp, Mus musculus
gaacaaggcgtcgaacgacgtccct

SEQ ID NO: 413493 - DNA, 25 bp, Mus musculus
gaacaaggctgtaggttcctctcca

SEQ ID NO: 413494 - DNA, 25 bp, Mus musculus
gaacaaggctgttggttcctctcca

SEQ ID NO: 413495 - DNA, 25 bp, Mus musculus
gaacaagggcagattttccacggga

SEQ ID NO: 413496 - DNA, 25 bp, Mus musculus
gaacaagggcagtttttccacggga

SEQ ID NO: 413497 - DNA, 25 bp, Mus musculus
gaacaagggctccttcgccccaggg

SEQ ID NO: 413498 - DNA, 25 bp, Mus musculus
gaacaagggctcgttcgccccaggg

SEQ ID NO: 413499 - DNA, 25 bp, Mus musculus
gaacaaggggcacccattcccaagt

SEQ ID NO: 413500 - DNA, 25 bp, Mus musculus
gaacaaggggcagccattcccaagt

SEQ ID NO: 413501 - DNA, 25 bp, Mus musculus
gaacaagggtctcagcctgcagcac

SEQ ID NO: 413502 - DNA, 25 bp, Mus musculus
gaacaagggtctgagcctgcagcac

SEQ ID NO: 413503 - DNA, 25 bp, Mus musculus
gaacaaggtgtcaaagatgttgctg

SEQ ID NO: 413504 - DNA, 25 bp, Mus musculus
gaacaaggtgtcaggactcagtcac

SEQ ID NO: 413505 - DNA, 25 bp, Mus musculus
gaacaaggtgtctaagatgttgctg

SEQ ID NO: 413506 - DNA, 25 bp, Mus musculus
gaacaaggtgtctggactcagtcac

SEQ ID NO: 413507 - DNA, 25 bp, Mus musculus
gaacaagtaatcacggcaacagcaa

SEQ ID NO: 413508 - DNA, 25 bp, Mus musculus
gaacaagtaatctcggcaacagcaa

SEQ ID NO: 413509 - DNA, 25 bp, Mus musculus
gaacaagtatttcctttcctcgtgc

SEQ ID NO: 413510 - DNA, 25 bp, Mus musculus
gaacaagtatttgctttcctcgtgc

SEQ ID NO: 413511 - DNA, 25 bp, Mus musculus
gaacaagtcatgaatcccgagttat

SEQ ID NO: 413512 - DNA, 25 bp, Mus musculus
gaacaagtcatgtatcccgagttat

SEQ ID NO: 413513 - DNA, 25 bp, Mus musculus
gaacaagtccacaatggtcccaggc

SEQ ID NO: 413514 - DNA, 25 bp, Mus musculus
gaacaagtccactatggtcccaggc

SEQ ID NO: 413515 - DNA, 25 bp, Mus musculus
gaacaagtccatcaagaccaattct

SEQ ID NO: 413516 - DNA, 25 bp, Mus musculus
gaacaagtccatcttcagcaaccag

SEQ ID NO: 413517 - DNA, 25 bp, Mus musculus
gaacaagtccatgaagaccaattct

SEQ ID NO: 413518 - DNA, 25 bp, Mus musculus
gaacaagtccatgttcagcaaccag

SEQ ID NO: 413519 - DNA, 25 bp, Mus musculus
gaacaagtcctcattgtctacttta

SEQ ID NO: 413520 - DNA, 25 bp, Mus musculus
gaacaagtcctctttgtctacttta

SEQ ID NO: 413521 - DNA, 25 bp, Mus musculus
gaacaagtcgccctgtctatgacat

SEQ ID NO: 413522 - DNA, 25 bp, Mus musculus
gaacaagtcgccgtgtctatgacat

SEQ ID NO: 413523 - DNA, 25 bp, Mus musculus
gaacaagtctaacgctaggcaatcc

SEQ ID NO: 413524 - DNA, 25 bp, Mus musculus
gaacaagtctaaggctaggcaatcc

SEQ ID NO: 413525 - DNA, 25 bp, Mus musculus
gaacaagtgacccaagacccatgtg

SEQ ID NO: 413526 - DNA, 25 bp, Mus musculus
gaacaagtgaccgaagacccatgtg

SEQ ID NO: 413527 - DNA, 25 bp, Mus musculus
gaacaagtgaggatcctgcactttg

SEQ ID NO: 413528 - DNA, 25 bp, Mus musculus
gaacaagtgaggttcctgcactttg

SEQ ID NO: 413529 - DNA, 25 bp, Mus musculus
gaacaagtgatgaccatcttcatga

SEQ ID NO: 413530 - DNA, 25 bp, Mus musculus
gaacaagtgatgtccatcttcatga

SEQ ID NO: 413531 - DNA, 25 bp, Mus musculus
gaacaagtgcgcatttcagagctta

SEQ ID NO: 413532 - DNA, 25 bp, Mus musculus
gaacaagtgcgcttttcagagctta

SEQ ID NO: 413533 - DNA, 25 bp, Mus musculus
gaacaagtgctcaaagctcctgtga

SEQ ID NO: 413534 - DNA, 25 bp, Mus musculus
gaacaagtgctctaagctcctgtga

SEQ ID NO: 413535 - DNA, 25 bp, Mus musculus
gaacaagtggtaccctccttcaaaa

SEQ ID NO: 413536 - DNA, 25 bp, Mus musculus
gaacaagtggtagcctccttcaaaa

SEQ ID NO: 413537 - DNA, 25 bp, Mus musculus
gaacaagtgtccacacggtatggta

SEQ ID NO: 413538 - DNA, 25 bp, Mus musculus
gaacaagtgtcctcacggtatggta

SEQ ID NO: 413539 - DNA, 25 bp, Mus musculus
gaacaagtgtgacagagcctatcca

SEQ ID NO: 413540 - DNA, 25 bp, Mus musculus
gaacaagtgtgagagagcctatcca

SEQ ID NO: 413541 - DNA, 25 bp, Mus musculus
gaacaagtgtttaggatcaatagcc

SEQ ID NO: 413542 - DNA, 25 bp, Mus musculus
gaacaagtgttttggatcaatagcc

SEQ ID NO: 413543 - DNA, 25 bp, Mus musculus
gaacaagttagtccgtgtgaccaag

SEQ ID NO: 413544 - DNA, 25 bp, Mus musculus
gaacaagttagtgcgtgtgaccaag

SEQ ID NO: 413545 - DNA, 25 bp, Mus musculus
gaacaagttcatcttaactttatta

SEQ ID NO: 413546 - DNA, 25 bp, Mus musculus
gaacaagttcatgttaactttatta

SEQ ID NO: 413547 - DNA, 25 bp, Mus musculus
gaacaagttcccaggttcagaacag

SEQ ID NO: 413548 - DNA, 25 bp, Mus musculus
gaacaagttcccattatttatgatg

SEQ ID NO: 413549 - DNA, 25 bp, Mus musculus
gaacaagttccctggttcagaacag

SEQ ID NO: 413550 - DNA, 25 bp, Mus musculus
gaacaagttccctttatttatgatg

SEQ ID NO: 413551 - DNA, 25 bp, Mus musculus
gaacaagttccgcaagtcactctct

SEQ ID NO: 413552 - DNA, 25 bp, Mus musculus
gaacaagttccggaagtcactctct

SEQ ID NO: 413553 - DNA, 25 bp, Mus musculus
gaacaagttcctcacatactaccct

SEQ ID NO: 413554 - DNA, 25 bp, Mus musculus
gaacaagttcctgacatactaccct

SEQ ID NO: 413555 - DNA, 25 bp, Mus musculus
gaacaagttctactcttgccaaaga

SEQ ID NO: 413556 - DNA, 25 bp, Mus musculus
gaacaagttctagtcttgccaaaga

SEQ ID NO: 413557 - DNA, 25 bp, Mus musculus
gaacaataagccacgcacggttttg

SEQ ID NO: 413558 - DNA, 25 bp, Mus musculus
gaacaataagcctcgcacggttttg

SEQ ID NO: 413559 - DNA, 25 bp, Mus musculus
gaacaatacatccactaccatttcg

SEQ ID NO: 413560 - DNA, 25 bp, Mus musculus
gaacaatacatccagctgagctgct

SEQ ID NO: 413561 - DNA, 25 bp, Mus musculus
gaacaatacatcgactaccatttcg

SEQ ID NO: 413562 - DNA, 25 bp, Mus musculus
gaacaatacatcgagctgagctgct

SEQ ID NO: 413563 - DNA, 25 bp, Mus musculus
gaacaatacccaacggtgtcatcct

SEQ ID NO: 413564 - DNA, 25 bp, Mus musculus
gaacaatacccatcggtgtcatcct

SEQ ID NO: 413565 - DNA, 25 bp, Mus musculus
gaacaataccctagagagaagtcat

SEQ ID NO: 413566 - DNA, 25 bp, Mus musculus
gaacaatacccttgagagaagtcat

SEQ ID NO: 413567 - DNA, 25 bp, Mus musculus
gaacaatagagccatctaggtcaaa

SEQ ID NO: 413568 - DNA, 25 bp, Mus musculus
gaacaatagagcgatctaggtcaaa

SEQ ID NO: 413569 - DNA, 25 bp, Mus musculus
gaacaatagttcatccccgtagcaa

SEQ ID NO: 413570 - DNA, 25 bp, Mus musculus
gaacaatagttcttccccgtagcaa

SEQ ID NO: 413571 - DNA, 25 bp, Mus musculus
gaacaatatgctcccaatagagttt

SEQ ID NO: 413572 - DNA, 25 bp, Mus musculus
gaacaatatgctgccaatagagttt

SEQ ID NO: 413573 - DNA, 25 bp, Mus musculus
gaacaatatttcaatttctggtcag

SEQ ID NO: 413574 - DNA, 25 bp, Mus musculus
gaacaatatttctatttctggtcag

SEQ ID NO: 413575 - DNA, 25 bp, Mus musculus
gaacaatcacggagtttcccacttg

SEQ ID NO: 413576 - DNA, 25 bp, Mus musculus
gaacaatcacggtgtttcccacttg

SEQ ID NO: 413577 - DNA, 25 bp, Mus musculus
gaacaatcactgaaaccacgctcat

SEQ ID NO: 413578 - DNA, 25 bp, Mus musculus
gaacaatcactgtaaccacgctcat

SEQ ID NO: 413579 - DNA, 25 bp, Mus musculus
gaacaatcagggaacagaatttctt

SEQ ID NO: 413580 - DNA, 25 bp, Mus musculus
gaacaatcagggtacagaatttctt

SEQ ID NO: 413581 - DNA, 25 bp, Mus musculus
gaacaatccactaacatgtaccaac

SEQ ID NO: 413582 - DNA, 25 bp, Mus musculus
gaacaatccacttacatgtaccaac

SEQ ID NO: 413583 - DNA, 25 bp, Mus musculus
gaacaatccagaattctaacccagg

SEQ ID NO: 413584 - DNA, 25 bp, Mus musculus
gaacaatccagatttctaacccagg

SEQ ID NO: 413585 - DNA, 25 bp, Mus musculus
gaacaatccatccttaaaacccagc

SEQ ID NO: 413586 - DNA, 25 bp, Mus musculus
gaacaatccatcgttaaaacccagc

SEQ ID NO: 413587 - DNA, 25 bp, Mus musculus
gaacaatccattcagcagaaaccct

SEQ ID NO: 413588 - DNA, 25 bp, Mus musculus
gaacaatccattgagcagaaaccct

SEQ ID NO: 413589 - DNA, 25 bp, Mus musculus
gaacaatccccacgctctctaaata

SEQ ID NO: 413590 - DNA, 25 bp, Mus musculus
gaacaatccccaggctctctaaata

SEQ ID NO: 413591 - DNA, 25 bp, Mus musculus
gaacaatccgtgcaaattgcttctc

SEQ ID NO: 413592 - DNA, 25 bp, Mus musculus
gaacaatccgtggaaattgcttctc

SEQ ID NO: 413593 - DNA, 25 bp, Mus musculus
gaacaatcctatagactctgggaac

SEQ ID NO: 413594 - DNA, 25 bp, Mus musculus
gaacaatcctattgactctgggaac

SEQ ID NO: 413595 - DNA, 25 bp, Mus musculus
gaacaatcctgaacaatagaactat

SEQ ID NO: 413596 - DNA, 25 bp, Mus musculus
gaacaatcctgatcaatagaactat

SEQ ID NO: 413597 - DNA, 25 bp, Mus musculus
gaacaatctagacaatccctcacag

SEQ ID NO: 413598 - DNA, 25 bp, Mus musculus
gaacaatctagagaatccctcacag

SEQ ID NO: 413599 - DNA, 25 bp, Mus musculus
gaacaatctctgcttggttggccaa

SEQ ID NO: 413600 - DNA, 25 bp, Mus musculus
gaacaatctctggttggttggccaa

SEQ ID NO: 413601 - DNA, 25 bp, Mus musculus
gaacaatctcttagggccgtttgaa

SEQ ID NO: 413602 - DNA, 25 bp, Mus musculus
gaacaatctcttcaggtcatgctct

SEQ ID NO: 413603 - DNA, 25 bp, Mus musculus
gaacaatctcttgaggtcatgctct

SEQ ID NO: 413604 - DNA, 25 bp, Mus musculus
gaacaatctctttgggccgtttgaa

SEQ ID NO: 413605 - DNA, 25 bp, Mus musculus
gaacaatctgtgcttcagcttagaa

SEQ ID NO: 413606 - DNA, 25 bp, Mus musculus
gaacaatctgtggttcagcttagaa

SEQ ID NO: 413607 - DNA, 25 bp, Mus musculus
gaacaatgatcacctgttcagacag

SEQ ID NO: 413608 - DNA, 25 bp, Mus musculus
gaacaatgatcagctgttcagacag

SEQ ID NO: 413609 - DNA, 25 bp, Mus musculus
gaacaatgcatgcagttggctcata

SEQ ID NO: 413610 - DNA, 25 bp, Mus musculus
gaacaatgcatgcttagttttcagg

SEQ ID NO: 413611 - DNA, 25 bp, Mus musculus
gaacaatgcatggagttggctcata

SEQ ID NO: 413612 - DNA, 25 bp, Mus musculus
gaacaatgcatggttagttttcagg

SEQ ID NO: 413613 - DNA, 25 bp, Mus musculus
gaacaatgcttaagaaaccaagctt

SEQ ID NO: 413614 - DNA, 25 bp, Mus musculus
gaacaatgcttatgaaaccaagctt

SEQ ID NO: 413615 - DNA, 25 bp, Mus musculus
gaacaatggcaacccagctaatact

SEQ ID NO: 413616 - DNA, 25 bp, Mus musculus
gaacaatggcaagccagctaatact

SEQ ID NO: 413617 - DNA, 25 bp, Mus musculus
gaacaatggcagaatcagtagactt

SEQ ID NO: 413618 - DNA, 25 bp, Mus musculus
gaacaatggcagtatcagtagactt

SEQ ID NO: 413619 - DNA, 25 bp, Mus musculus
gaacaatggctcacacatttagcta

SEQ ID NO: 413620 - DNA, 25 bp, Mus musculus
gaacaatggctctcacatttagcta

SEQ ID NO: 413621 - DNA, 25 bp, Mus musculus
gaacaatggtggactctacttctcc

SEQ ID NO: 413622 - DNA, 25 bp, Mus musculus
gaacaatggtggtctctacttctcc

SEQ ID NO: 413623 - DNA, 25 bp, Mus musculus
gaacaatggtgtacagcacgtaaat

SEQ ID NO: 413624 - DNA, 25 bp, Mus musculus
gaacaatggtgttcagcacgtaaat

SEQ ID NO: 413625 - DNA, 25 bp, Mus musculus
gaacaatgtacgatatcccttagag

SEQ ID NO: 413626 - DNA, 25 bp, Mus musculus
gaacaatgtacgttatcccttagag

SEQ ID NO: 413627 - DNA, 25 bp, Mus musculus
gaacaatgtataactgggctaagga

SEQ ID NO: 413628 - DNA, 25 bp, Mus musculus
gaacaatgtatatctgggctaagga

SEQ ID NO: 413629 - DNA, 25 bp, Mus musculus
gaacaatgtcctatttccagagcat

SEQ ID NO: 413630 - DNA, 25 bp, Mus musculus
gaacaatgtcctttttccagagcat

SEQ ID NO: 413631 - DNA, 25 bp, Mus musculus
gaacaatgtctccacagataataat

SEQ ID NO: 413632 - DNA, 25 bp, Mus musculus
gaacaatgtctcgacagataataat

SEQ ID NO: 413633 - DNA, 25 bp, Mus musculus
gaacaatgtgaaagatacctccaat

SEQ ID NO: 413634 - DNA, 25 bp, Mus musculus
gaacaatgtgaacttgctttcttat

SEQ ID NO: 413635 - DNA, 25 bp, Mus musculus
gaacaatgtgaagttgctttcttat

SEQ ID NO: 413636 - DNA, 25 bp, Mus musculus
gaacaatgtgaatgatacctccaat

SEQ ID NO: 413637 - DNA, 25 bp, Mus musculus
gaacaatgtggcaactcctgtgatt

SEQ ID NO: 413638 - DNA, 25 bp, Mus musculus
gaacaatgtggctactcctgtgatt

SEQ ID NO: 413639 - DNA, 25 bp, Mus musculus
gaacaatgttagattacaccagaaa

SEQ ID NO: 413640 - DNA, 25 bp, Mus musculus
gaacaatgttagtttacaccagaaa

SEQ ID NO: 413641 - DNA, 25 bp, Mus musculus
gaacaatgttctcactgtgtttaca

SEQ ID NO: 413642 - DNA, 25 bp, Mus musculus
gaacaatgttctgactgtgtttaca

SEQ ID NO: 413643 - DNA, 25 bp, Mus musculus
gaacaatgttgtacccttcgtcaga

SEQ ID NO: 413644 - DNA, 25 bp, Mus musculus
gaacaatgttgttcccttcgtcaga

SEQ ID NO: 413645 - DNA, 25 bp, Mus musculus
gaacaatgtttacctttcctaagaa

SEQ ID NO: 413646 - DNA, 25 bp, Mus musculus
gaacaatgtttagctttcctaagaa

SEQ ID NO: 413647 - DNA, 25 bp, Mus musculus
gaacaattaccacccctactaaagg

SEQ ID NO: 413648 - DNA, 25 bp, Mus musculus
gaacaattaccagccctactaaagg

SEQ ID NO: 413649 - DNA, 25 bp, Mus musculus
gaacaattactgagccatggcgtgt

SEQ ID NO: 413650 - DNA, 25 bp, Mus musculus
gaacaattactgtgccatggcgtgt

SEQ ID NO: 413651 - DNA, 25 bp, Mus musculus
gaacaattatcaaaaggagcaccag

SEQ ID NO: 413652 - DNA, 25 bp, Mus musculus
gaacaattatcataaggagcaccag

SEQ ID NO: 413653 - DNA, 25 bp, Mus musculus
gaacaattatccaatgcaccatgac

SEQ ID NO: 413654 - DNA, 25 bp, Mus musculus
gaacaattatcctatgcaccatgac

SEQ ID NO: 413655 - DNA, 25 bp, Mus musculus
gaacaattccagatggtaaagattc

SEQ ID NO: 413656 - DNA, 25 bp, Mus musculus
gaacaattccagttggtaaagattc

SEQ ID NO: 413657 - DNA, 25 bp, Mus musculus
gaacaattccataatctcctgcagg

SEQ ID NO: 413658 - DNA, 25 bp, Mus musculus
gaacaattccattatctcctgcagg

SEQ ID NO: 413659 - DNA, 25 bp, Mus musculus
gaacaattcctaagtgcattctaaa

SEQ ID NO: 413660 - DNA, 25 bp, Mus musculus
gaacaattcctatgtgcattctaaa

SEQ ID NO: 413661 - DNA, 25 bp, Mus musculus
gaacaattcgtcatggaggtaggca

SEQ ID NO: 413662 - DNA, 25 bp, Mus musculus
gaacaattcgtcttggaggtaggca

SEQ ID NO: 413663 - DNA, 25 bp, Mus musculus
gaacaattcgttccaagcttctcag

SEQ ID NO: 413664 - DNA, 25 bp, Mus musculus
gaacaattcgttgcaagcttctcag

SEQ ID NO: 413665 - DNA, 25 bp, Mus musculus
gaacaattctggaacataactgatg

SEQ ID NO: 413666 - DNA, 25 bp, Mus musculus
gaacaattctggtacataactgatg

SEQ ID NO: 413667 - DNA, 25 bp, Mus musculus
gaacaattgccacttgccggcggcc

SEQ ID NO: 413668 - DNA, 25 bp, Mus musculus
gaacaattgccagttgccggcggcc

SEQ ID NO: 413669 - DNA, 25 bp, Mus musculus
gaacaattgctgactactcgcagtg

SEQ ID NO: 413670 - DNA, 25 bp, Mus musculus
gaacaattgctgtctactcgcagtg

SEQ ID NO: 413671 - DNA, 25 bp, Mus musculus
gaacaattggctactttgcatgctt

SEQ ID NO: 413672 - DNA, 25 bp, Mus musculus
gaacaattggcttctttgcatgctt

SEQ ID NO: 413673 - DNA, 25 bp, Mus musculus
gaacaattgtataacttgctgttag

SEQ ID NO: 413674 - DNA, 25 bp, Mus musculus
gaacaattgtattacttgctgttag

SEQ ID NO: 413675 - DNA, 25 bp, Mus musculus
gaacaattgtctacgtcttttcaag

SEQ ID NO: 413676 - DNA, 25 bp, Mus musculus
gaacaattgtcttcgtcttttcaag

SEQ ID NO: 413677 - DNA, 25 bp, Mus musculus
gaacaatttaatatgccttcctttc

SEQ ID NO: 413678 - DNA, 25 bp, Mus musculus
gaacaatttaatttgccttcctttc

SEQ ID NO: 413679 - DNA, 25 bp, Mus musculus
gaacaatttccaagtgtgcagagct

SEQ ID NO: 413680 - DNA, 25 bp, Mus musculus
gaacaatttccatgtgtgcagagct

SEQ ID NO: 413681 - DNA, 25 bp, Mus musculus
gaacaattttacattgcgttgcatt

SEQ ID NO: 413682 - DNA, 25 bp, Mus musculus
gaacaattttactttgcgttgcatt

SEQ ID NO: 413683 - DNA, 25 bp, Mus musculus
gaacacaaaaggattctggcgtttg

SEQ ID NO: 413684 - DNA, 25 bp, Mus musculus
gaacacaaaaggtttctggcgtttg

SEQ ID NO: 413685 - DNA, 25 bp, Mus musculus
gaacacaaaatgacttctcccttta

SEQ ID NO: 413686 - DNA, 25 bp, Mus musculus
gaacacaaaatgtcttctcccttta

SEQ ID NO: 413687 - DNA, 25 bp, Mus musculus
gaacacaaacctaggaaccaccagc

SEQ ID NO: 413688 - DNA, 25 bp, Mus musculus
gaacacaaaccttggaaccaccagc

SEQ ID NO: 413689 - DNA, 25 bp, Mus musculus
gaacacaaagtgcttatacaaatat

SEQ ID NO: 413690 - DNA, 25 bp, Mus musculus
gaacacaaagtggttatacaaatat

SEQ ID NO: 413691 - DNA, 25 bp, Mus musculus
gaacacaaatctactaccaggcgca

SEQ ID NO: 413692 - DNA, 25 bp, Mus musculus
gaacacaaatcttctaccaggcgca

SEQ ID NO: 413693 - DNA, 25 bp, Mus musculus
gaacacaaatgtagcccactggaca

SEQ ID NO: 413694 - DNA, 25 bp, Mus musculus
gaacacaaatgttgcccactggaca

SEQ ID NO: 413695 - DNA, 25 bp, Mus musculus
gaacacaaatttccttcaagtctga

SEQ ID NO: 413696 - DNA, 25 bp, Mus musculus
gaacacaaatttgcttcaagtctga

SEQ ID NO: 413697 - DNA, 25 bp, Mus musculus
gaacacaacactagagcagatgcat

SEQ ID NO: 413698 - DNA, 25 bp, Mus musculus
gaacacaacacttgagcagatgcat

SEQ ID NO: 413699 - DNA, 25 bp, Mus musculus
gaacacaaccatagcctgctttgta

SEQ ID NO: 413700 - DNA, 25 bp, Mus musculus
gaacacaaccattgcctgctttgta

SEQ ID NO: 413701 - DNA, 25 bp, Mus musculus
gaacacaacggcaatgacaatctat

SEQ ID NO: 413702 - DNA, 25 bp, Mus musculus
gaacacaacggctatgacaatctat

SEQ ID NO: 413703 - DNA, 25 bp, Mus musculus
gaacacaagcctcgtggttttactt

SEQ ID NO: 413704 - DNA, 25 bp, Mus musculus
gaacacaagcctggtggttttactt

SEQ ID NO: 413705 - DNA, 25 bp, Mus musculus
gaacacaagcggaccatgcatcgtt

SEQ ID NO: 413706 - DNA, 25 bp, Mus musculus
gaacacaagcggtccatgcatcgtt

SEQ ID NO: 413707 - DNA, 25 bp, Mus musculus
gaacacaaggccaagtgaggtttaa

SEQ ID NO: 413708 - DNA, 25 bp, Mus musculus
gaacacaaggcctagtgaggtttaa

SEQ ID NO: 413709 - DNA, 25 bp, Mus musculus
gaacacaaggcgaatgaggcgtctt

SEQ ID NO: 413710 - DNA, 25 bp, Mus musculus
gaacacaaggcgtatgaggcgtctt

SEQ ID NO: 413711 - DNA, 25 bp, Mus musculus
gaacacaagggacaatagcagccat

SEQ ID NO: 413712 - DNA, 25 bp, Mus musculus
gaacacaagggagaatagcagccat

SEQ ID NO: 413713 - DNA, 25 bp, Mus musculus
gaacacaagggtccatacacatatg

SEQ ID NO: 413714 - DNA, 25 bp, Mus musculus
gaacacaagggtgcatacacatatg

SEQ ID NO: 413715 - DNA, 25 bp, Mus musculus
gaacacaagtcaacaccctgaatgc

SEQ ID NO: 413716 - DNA, 25 bp, Mus musculus
gaacacaagtcactctggaatccct

SEQ ID NO: 413717 - DNA, 25 bp, Mus musculus
gaacacaagtcagtctggaatccct

SEQ ID NO: 413718 - DNA, 25 bp, Mus musculus
gaacacaagtcatcaccctgaatgc

SEQ ID NO: 413719 - DNA, 25 bp, Mus musculus
gaacacaatgtgcaatttacccatg

SEQ ID NO: 413720 - DNA, 25 bp, Mus musculus
gaacacaatgtggaatttacccatg

SEQ ID NO: 413721 - DNA, 25 bp, Mus musculus
gaacacaattgtctccttaaggtta

SEQ ID NO: 413722 - DNA, 25 bp, Mus musculus
gaacacaattgtgtccttaaggtta

SEQ ID NO: 413723 - DNA, 25 bp, Mus musculus
gaacacacaaggacaggcaagctta

SEQ ID NO: 413724 - DNA, 25 bp, Mus musculus
gaacacacaaggtcaggcaagctta

SEQ ID NO: 413725 - DNA, 25 bp, Mus musculus
gaacacacacatattttctaagaaa

SEQ ID NO: 413726 - DNA, 25 bp, Mus musculus
gaacacacacattttttctaagaaa

SEQ ID NO: 413727 - DNA, 25 bp, Mus musculus
gaacacacacccattagttccagaa

SEQ ID NO: 413728 - DNA, 25 bp, Mus musculus
gaacacacaccctttagttccagaa

SEQ ID NO: 413729 - DNA, 25 bp, Mus musculus
gaacacacactcactgtttcttata

SEQ ID NO: 413730 - DNA, 25 bp, Mus musculus
gaacacacactctctgtttcttata

SEQ ID NO: 413731 - DNA, 25 bp, Mus musculus
gaacacacagctacatccataatag

SEQ ID NO: 413732 - DNA, 25 bp, Mus musculus
gaacacacagcttcatccataatag

SEQ ID NO: 413733 - DNA, 25 bp, Mus musculus
gaacacacagttctaaaatgatttt

SEQ ID NO: 413734 - DNA, 25 bp, Mus musculus
gaacacacagttgtaaaatgatttt

SEQ ID NO: 413735 - DNA, 25 bp, Mus musculus
gaacacacatctctaaccaggactt

SEQ ID NO: 413736 - DNA, 25 bp, Mus musculus
gaacacacatctgtaaccaggactt

SEQ ID NO: 413737 - DNA, 25 bp, Mus musculus
gaacacacattacccagtagcataa

SEQ ID NO: 413738 - DNA, 25 bp, Mus musculus
gaacacacattagccagtagcataa

SEQ ID NO: 413739 - DNA, 25 bp, Mus musculus
gaacacacattgctctgtcttgtct

SEQ ID NO: 413740 - DNA, 25 bp, Mus musculus
gaacacacattggtctgtcttgtct

SEQ ID NO: 413741 - DNA, 25 bp, Mus musculus
gaacacaccaagattctaagacaca

SEQ ID NO: 413742 - DNA, 25 bp, Mus musculus
gaacacaccaagtttctaagacaca

SEQ ID NO: 413743 - DNA, 25 bp, Mus musculus
gaacacaccttcaaaattgctttaa

SEQ ID NO: 413744 - DNA, 25 bp, Mus musculus
gaacacaccttctaaattgctttaa

SEQ ID NO: 413745 - DNA, 25 bp, Mus musculus
gaacacacgagaatgctcaagcaga

SEQ ID NO: 413746 - DNA, 25 bp, Mus musculus
gaacacacgagattgctcaagcaga

SEQ ID NO: 413747 - DNA, 25 bp, Mus musculus
gaacacacgctgctggtgactgtgt

SEQ ID NO: 413748 - DNA, 25 bp, Mus musculus
gaacacacgctggtggtgactgtgt

SEQ ID NO: 413749 - DNA, 25 bp, Mus musculus
gaacacacggacaaccattttgcat

SEQ ID NO: 413750 - DNA, 25 bp, Mus musculus
gaacacacggactaccattttgcat

SEQ ID NO: 413751 - DNA, 25 bp, Mus musculus
gaacacacggcaagtagacccagag

SEQ ID NO: 413752 - DNA, 25 bp, Mus musculus
gaacacacggcatgtagacccagag

SEQ ID NO: 413753 - DNA, 25 bp, Mus musculus
gaacacacgggccttctcatgggtg

SEQ ID NO: 413754 - DNA, 25 bp, Mus musculus
gaacacacgggcgttctcatgggtg

SEQ ID NO: 413755 - DNA, 25 bp, Mus musculus
gaacacactaggaatttctttccaa

SEQ ID NO: 413756 - DNA, 25 bp, Mus musculus
gaacacactaggtatttctttccaa

SEQ ID NO: 413757 - DNA, 25 bp, Mus musculus
gaacacactgatatctttcttcgat

SEQ ID NO: 413758 - DNA, 25 bp, Mus musculus
gaacacactgatttctttcttcgat

SEQ ID NO: 413759 - DNA, 25 bp, Mus musculus
gaacacactgcaatgacctggatga

SEQ ID NO: 413760 - DNA, 25 bp, Mus musculus
gaacacactgcattgacctggatga

SEQ ID NO: 413761 - DNA, 25 bp, Mus musculus
gaacacactgtcatgtttctcagct

SEQ ID NO: 413762 - DNA, 25 bp, Mus musculus
gaacacactgtcttgtttctcagct

SEQ ID NO: 413763 - DNA, 25 bp, Mus musculus
gaacacacttacatgcttgtttctc

SEQ ID NO: 413764 - DNA, 25 bp, Mus musculus
gaacacacttacttgcttgtttctc

SEQ ID NO: 413765 - DNA, 25 bp, Mus musculus
gaacacacttcaagttagctgctcc

SEQ ID NO: 413766 - DNA, 25 bp, Mus musculus
gaacacacttcatgttagctgctcc

SEQ ID NO: 413767 - DNA, 25 bp, Mus musculus
gaacacagaatgatttgctattgac

SEQ ID NO: 413768 - DNA, 25 bp, Mus musculus
gaacacagaatgttttgctattgac

SEQ ID NO: 413769 - DNA, 25 bp, Mus musculus
gaacacagacctctgctgtaaataa

SEQ ID NO: 413770 - DNA, 25 bp, Mus musculus
gaacacagacctgtgctgtaaataa

SEQ ID NO: 413771 - DNA, 25 bp, Mus musculus
gaacacagacttaggttgccccaga

SEQ ID NO: 413772 - DNA, 25 bp, Mus musculus
gaacacagactttggttgccccaga

SEQ ID NO: 413773 - DNA, 25 bp, Mus musculus
gaacacagagacaattttatcagct

SEQ ID NO: 413774 - DNA, 25 bp, Mus musculus
gaacacagagactattttatcagct

SEQ ID NO: 413775 - DNA, 25 bp, Mus musculus
gaacacagagcaaccgagtcacata

SEQ ID NO: 413776 - DNA, 25 bp, Mus musculus
gaacacagagcatccgagtcacata

SEQ ID NO: 413777 - DNA, 25 bp, Mus musculus
gaacacagaggtatatgcagtcttt

SEQ ID NO: 413778 - DNA, 25 bp, Mus musculus
gaacacagaggtttatgcagtcttt

SEQ ID NO: 413779 - DNA, 25 bp, Mus musculus
gaacacagagttcgacctcaggtca

SEQ ID NO: 413780 - DNA, 25 bp, Mus musculus
gaacacagagttggacctcaggtca

SEQ ID NO: 413781 - DNA, 25 bp, Mus musculus
gaacacagatacacattaatacata

SEQ ID NO: 413782 - DNA, 25 bp, Mus musculus
gaacacagatactcattaatacata

SEQ ID NO: 413783 - DNA, 25 bp, Mus musculus
gaacacagattaattcctttggtga

SEQ ID NO: 413784 - DNA, 25 bp, Mus musculus
gaacacagattatttcctttggtga

SEQ ID NO: 413785 - DNA, 25 bp, Mus musculus
gaacacagattcagattgccctaat

SEQ ID NO: 413786 - DNA, 25 bp, Mus musculus
gaacacagattctgattgccctaat

SEQ ID NO: 413787 - DNA, 25 bp, Mus musculus
gaacacagcagaatcccacaaattg

SEQ ID NO: 413788 - DNA, 25 bp, Mus musculus
gaacacagcagattcccacaaattg

SEQ ID NO: 413789 - DNA, 25 bp, Mus musculus
gaacacagcagccatggtgtgctct

SEQ ID NO: 413790 - DNA, 25 bp, Mus musculus
gaacacagcagcgatggtgtgctct

SEQ ID NO: 413791 - DNA, 25 bp, Mus musculus
gaacacagccaacctggtcctggaa

SEQ ID NO: 413792 - DNA, 25 bp, Mus musculus
gaacacagccaagctggtcctggaa

SEQ ID NO: 413793 - DNA, 25 bp, Mus musculus
gaacacagctgacttaagctctgcc

SEQ ID NO: 413794 - DNA, 25 bp, Mus musculus
gaacacagctgagttaagctctgcc

SEQ ID NO: 413795 - DNA, 25 bp, Mus musculus
gaacacagctttccttgaggaatca

SEQ ID NO: 413796 - DNA, 25 bp, Mus musculus
gaacacagctttgcttgaggaatca

SEQ ID NO: 413797 - DNA, 25 bp, Mus musculus
gaacacaggactctggcagtctgcg

SEQ ID NO: 413798 - DNA, 25 bp, Mus musculus
gaacacaggactcttgctcaacagc

SEQ ID NO: 413799 - DNA, 25 bp, Mus musculus
gaacacaggactgtggcagtctgcg

SEQ ID NO: 413800 - DNA, 25 bp, Mus musculus
gaacacaggactgttgctcaacagc

SEQ ID NO: 413801 - DNA, 25 bp, Mus musculus
gaacacaggcttaatcaagtccatg

SEQ ID NO: 413802 - DNA, 25 bp, Mus musculus
gaacacaggcttcttttcgtaggat

SEQ ID NO: 413803 - DNA, 25 bp, Mus musculus
gaacacaggcttgttttcgtaggat

SEQ ID NO: 413804 - DNA, 25 bp, Mus musculus
gaacacaggctttatcaagtccatg

SEQ ID NO: 413805 - DNA, 25 bp, Mus musculus
gaacacagggcccagagcaaagcta

SEQ ID NO: 413806 - DNA, 25 bp, Mus musculus
gaacacagggccgagagcaaagcta

SEQ ID NO: 413807 - DNA, 25 bp, Mus musculus
gaacacaggtttagcacttatttgg

SEQ ID NO: 413808 - DNA, 25 bp, Mus musculus
gaacacaggttttgcacttatttgg

SEQ ID NO: 413809 - DNA, 25 bp, Mus musculus
gaacacagtcagctgacaactttaa

SEQ ID NO: 413810 - DNA, 25 bp, Mus musculus
gaacacagtcaggtgacaactttaa

SEQ ID NO: 413811 - DNA, 25 bp, Mus musculus
gaacacagtctgcaattgcattcct

SEQ ID NO: 413812 - DNA, 25 bp, Mus musculus
gaacacagtctggaattgcattcct

SEQ ID NO: 413813 - DNA, 25 bp, Mus musculus
gaacacagtgcacaccatcatgcta

SEQ ID NO: 413814 - DNA, 25 bp, Mus musculus
gaacacagtgcagaccatcatgcta

SEQ ID NO: 413815 - DNA, 25 bp, Mus musculus
gaacacagtgccactctacgtatct

SEQ ID NO: 413816 - DNA, 25 bp, Mus musculus
gaacacagtgcctctctacgtatct

SEQ ID NO: 413817 - DNA, 25 bp, Mus musculus
gaacacagtgcgatccatattgtga

SEQ ID NO: 413818 - DNA, 25 bp, Mus musculus
gaacacagtgcgttccatattgtga

SEQ ID NO: 413819 - DNA, 25 bp, Mus musculus
gaacacagtgtgatgatatgcaagt

SEQ ID NO: 413820 - DNA, 25 bp, Mus musculus
gaacacagtgtgttgatatgcaagt

SEQ ID NO: 413821 - DNA, 25 bp, Mus musculus
gaacacagtgttctttttactgagt

SEQ ID NO: 413822 - DNA, 25 bp, Mus musculus
gaacacagtgttgtttttactgagt

SEQ ID NO: 413823 - DNA, 25 bp, Mus musculus
gaacacagttccatcagtgtgctga

SEQ ID NO: 413824 - DNA, 25 bp, Mus musculus
gaacacagttccttcagtgtgctga

SEQ ID NO: 413825 - DNA, 25 bp, Mus musculus
gaacacagttcgatccttcatgaaa

SEQ ID NO: 413826 - DNA, 25 bp, Mus musculus
gaacacagttcgctgagtccaggaa

SEQ ID NO: 413827 - DNA, 25 bp, Mus musculus
gaacacagttcggtgagtccaggaa

SEQ ID NO: 413828 - DNA, 25 bp, Mus musculus
gaacacagttcgttccttcatgaaa

SEQ ID NO: 413829 - DNA, 25 bp, Mus musculus
gaacacataaggaactgtagcccag

SEQ ID NO: 413830 - DNA, 25 bp, Mus musculus
gaacacataaggtactgtagcccag

SEQ ID NO: 413831 - DNA, 25 bp, Mus musculus
gaacacataatcatgatctgtcaac

SEQ ID NO: 413832 - DNA, 25 bp, Mus musculus
gaacacataatcttgatctgtcaac

SEQ ID NO: 413833 - DNA, 25 bp, Mus musculus
gaacacataatgctttcaccctttt

SEQ ID NO: 413834 - DNA, 25 bp, Mus musculus
gaacacataatggtttcaccctttt

SEQ ID NO: 413835 - DNA, 25 bp, Mus musculus
gaacacatacacaaggtctgcaagg

SEQ ID NO: 413836 - DNA, 25 bp, Mus musculus
gaacacatacactaggtctgcaagg

SEQ ID NO: 413837 - DNA, 25 bp, Mus musculus
gaacacatactgctcgaattgagct

SEQ ID NO: 413838 - DNA, 25 bp, Mus musculus
gaacacatactggtcgaattgagct

SEQ ID NO: 413839 - DNA, 25 bp, Mus musculus
gaacacatagatagctttctagcat

SEQ ID NO: 413840 - DNA, 25 bp, Mus musculus
gaacacatagattgctttctagcat

SEQ ID NO: 413841 - DNA, 25 bp, Mus musculus
gaacacatatttcacaactgcaggt

SEQ ID NO: 413842 - DNA, 25 bp, Mus musculus
gaacacatatttgacaactgcaggt

SEQ ID NO: 413843 - DNA, 25 bp, Mus musculus
gaacacatcactcgagctttttatt

SEQ ID NO: 413844 - DNA, 25 bp, Mus musculus
gaacacatcactggagctttttatt

SEQ ID NO: 413845 - DNA, 25 bp, Mus musculus
gaacacatctgcattgaacacatct

SEQ ID NO: 413846 - DNA, 25 bp, Mus musculus
gaacacatctgctttgaacacatct

SEQ ID NO: 413847 - DNA, 25 bp, Mus musculus
gaacacatctgtatgctacaacttg

SEQ ID NO: 413848 - DNA, 25 bp, Mus musculus
gaacacatctgtttgctacaacttg

SEQ ID NO: 413849 - DNA, 25 bp, Mus musculus
gaacacatgagaatcctgcctcggt

SEQ ID NO: 413850 - DNA, 25 bp, Mus musculus
gaacacatgagattcctgcctcggt

SEQ ID NO: 413851 - DNA, 25 bp, Mus musculus
gaacacatgcaaacctgcagaagag

SEQ ID NO: 413852 - DNA, 25 bp, Mus musculus
gaacacatgcaatcctgcagaagag

SEQ ID NO: 413853 - DNA, 25 bp, Mus musculus
gaacacatgctccatggcaggttca

SEQ ID NO: 413854 - DNA, 25 bp, Mus musculus
gaacacatgctcgatggcaggttca

SEQ ID NO: 413855 - DNA, 25 bp, Mus musculus
gaacacatgcttcggtttttacctt

SEQ ID NO: 413856 - DNA, 25 bp, Mus musculus
gaacacatgcttgggtttttacctt

SEQ ID NO: 413857 - DNA, 25 bp, Mus musculus
gaacacatggttagcatttcgctat

SEQ ID NO: 413858 - DNA, 25 bp, Mus musculus
gaacacatggtttgcatttcgctat

SEQ ID NO: 413859 - DNA, 25 bp, Mus musculus
gaacacatgtagctaggtttagagt

SEQ ID NO: 413860 - DNA, 25 bp, Mus musculus
gaacacatgtaggtaggtttagagt

SEQ ID NO: 413861 - DNA, 25 bp, Mus musculus
gaacacattagaatgtctctgcctt

SEQ ID NO: 413862 - DNA, 25 bp, Mus musculus
gaacacattagattgtctctgcctt

SEQ ID NO: 413863 - DNA, 25 bp, Mus musculus
gaacacattcaacgtacggcaggat

SEQ ID NO: 413864 - DNA, 25 bp, Mus musculus
gaacacattcaaggtacggcaggat

SEQ ID NO: 413865 - DNA, 25 bp, Mus musculus
gaacacattcagacatcagcctgtc

SEQ ID NO: 413866 - DNA, 25 bp, Mus musculus
gaacacattcagcttaccatgtcat

SEQ ID NO: 413867 - DNA, 25 bp, Mus musculus
gaacacattcaggttaccatgtcat

SEQ ID NO: 413868 - DNA, 25 bp, Mus musculus
gaacacattcagtcatcagcctgtc

SEQ ID NO: 413869 - DNA, 25 bp, Mus musculus
gaacacattcttaggtaactgtccc

SEQ ID NO: 413870 - DNA, 25 bp, Mus musculus
gaacacattctttggtaactgtccc

SEQ ID NO: 413871 - DNA, 25 bp, Mus musculus
gaacacattgggaatgcccgccgca

SEQ ID NO: 413872 - DNA, 25 bp, Mus musculus
gaacacattgggtatgcccgccgca

SEQ ID NO: 413873 - DNA, 25 bp, Mus musculus
gaacacatttacagagtccaggaac

SEQ ID NO: 413874 - DNA, 25 bp, Mus musculus
gaacacatttactgagtccaggaac

SEQ ID NO: 413875 - DNA, 25 bp, Mus musculus
gaacacatttataccgtcaactagg

SEQ ID NO: 413876 - DNA, 25 bp, Mus musculus
gaacacatttattccgtcaactagg

SEQ ID NO: 413877 - DNA, 25 bp, Mus musculus
gaacacatttcaagggtagcattgt

SEQ ID NO: 413878 - DNA, 25 bp, Mus musculus
gaacacatttcatgggtagcattgt

SEQ ID NO: 413879 - DNA, 25 bp, Mus musculus
gaacacatttctatcacaacatcaa

SEQ ID NO: 413880 - DNA, 25 bp, Mus musculus
gaacacatttctattaccacgtcaa

SEQ ID NO: 413881 - DNA, 25 bp, Mus musculus
gaacacatttctccggatacctttg

SEQ ID NO: 413882 - DNA, 25 bp, Mus musculus
gaacacatttctgcggatacctttg

SEQ ID NO: 413883 - DNA, 25 bp, Mus musculus
gaacacatttctttcacaacatcaa

SEQ ID NO: 413884 - DNA, 25 bp, Mus musculus
gaacacatttcttttaccacgtcaa

SEQ ID NO: 413885 - DNA, 25 bp, Mus musculus
gaacacatttgtcaggatcagatga

SEQ ID NO: 413886 - DNA, 25 bp, Mus musculus
gaacacatttgtgaggatcagatga

SEQ ID NO: 413887 - DNA, 25 bp, Mus musculus
gaacaccaagcacaacataatctat

SEQ ID NO: 413888 - DNA, 25 bp, Mus musculus
gaacaccaagcagaacataatctat

SEQ ID NO: 413889 - DNA, 25 bp, Mus musculus
gaacaccaagggagcccgttcctgg

SEQ ID NO: 413890 - DNA, 25 bp, Mus musculus
gaacaccaagggtgcccgttcctgg

SEQ ID NO: 413891 - DNA, 25 bp, Mus musculus
gaacaccacaagagaccagcatttt

SEQ ID NO: 413892 - DNA, 25 bp, Mus musculus
gaacaccacaagtgaccagcatttt

SEQ ID NO: 413893 - DNA, 25 bp, Mus musculus
gaacaccaccttaaggaatgcttga

SEQ ID NO: 413894 - DNA, 25 bp, Mus musculus
gaacaccacctttaggaatgcttga

SEQ ID NO: 413895 - DNA, 25 bp, Mus musculus
gaacaccactcaccaaccgtgtgtg

SEQ ID NO: 413896 - DNA, 25 bp, Mus musculus
gaacaccactcagcaaccgtgtgtg

SEQ ID NO: 413897 - DNA, 25 bp, Mus musculus
gaacaccactggatgctgtgtggct

SEQ ID NO: 413898 - DNA, 25 bp, Mus musculus
gaacaccactggttgctgtgtggct

SEQ ID NO: 413899 - DNA, 25 bp, Mus musculus
gaacaccagaatcgaaataaccagg

SEQ ID NO: 413900 - DNA, 25 bp, Mus musculus
gaacaccagaatggaaataaccagg

SEQ ID NO: 413901 - DNA, 25 bp, Mus musculus
gaacaccagattctttccgggtcag

SEQ ID NO: 413902 - DNA, 25 bp, Mus musculus
gaacaccagattgtttccgggtcag

SEQ ID NO: 413903 - DNA, 25 bp, Mus musculus
gaacaccagcagaatttttagtaat

SEQ ID NO: 413904 - DNA, 25 bp, Mus musculus
gaacaccagcagagcttggcagcat

SEQ ID NO: 413905 - DNA, 25 bp, Mus musculus
gaacaccagcagtatttttagtaat

SEQ ID NO: 413906 - DNA, 25 bp, Mus musculus
gaacaccagcagtgcttggcagcat

SEQ ID NO: 413907 - DNA, 25 bp, Mus musculus
gaacaccagcatactgaatgacaga

SEQ ID NO: 413908 - DNA, 25 bp, Mus musculus
gaacaccagcattctgaatgacaga

SEQ ID NO: 413909 - DNA, 25 bp, Mus musculus
gaacaccagctcactgcagcagttc

SEQ ID NO: 413910 - DNA, 25 bp, Mus musculus
gaacaccagctctctgcagcagttc

SEQ ID NO: 413911 - DNA, 25 bp, Mus musculus
gaacaccaggacatgctagcaccgg

SEQ ID NO: 413912 - DNA, 25 bp, Mus musculus
gaacaccaggacttgctagcaccgg

SEQ ID NO: 413913 - DNA, 25 bp, Mus musculus
gaacaccaggatcgccgcagggata

SEQ ID NO: 413914 - DNA, 25 bp, Mus musculus
gaacaccaggatggccgcagggata

SEQ ID NO: 413915 - DNA, 25 bp, Mus musculus
gaacaccaggctcaggacatcctca

SEQ ID NO: 413916 - DNA, 25 bp, Mus musculus
gaacaccaggctgaggacatcctca

SEQ ID NO: 413917 - DNA, 25 bp, Mus musculus
gaacaccaggttcccatttccacat

SEQ ID NO: 413918 - DNA, 25 bp, Mus musculus
gaacaccaggttgccatttccacat

SEQ ID NO: 413919 - DNA, 25 bp, Mus musculus
gaacaccagtgcacctcattaggca

SEQ ID NO: 413920 - DNA, 25 bp, Mus musculus
gaacaccagtgctcctcattaggca

SEQ ID NO: 413921 - DNA, 25 bp, Mus musculus
gaacaccagtgtccagcttgttgaa

SEQ ID NO: 413922 - DNA, 25 bp, Mus musculus
gaacaccagtgtgcagcttgttgaa

SEQ ID NO: 413923 - DNA, 25 bp, Mus musculus
gaacaccagttgactcgatggaaac

SEQ ID NO: 413924 - DNA, 25 bp, Mus musculus
gaacaccagttgtctcgatggaaac

SEQ ID NO: 413925 - DNA, 25 bp, Mus musculus
gaacaccatcggagcgaggcatgac

SEQ ID NO: 413926 - DNA, 25 bp, Mus musculus
gaacaccatcggtgcgaggcatgac

SEQ ID NO: 413927 - DNA, 25 bp, Mus musculus
gaacaccatctcctactgtgcattt

SEQ ID NO: 413928 - DNA, 25 bp, Mus musculus
gaacaccatctcctgtagagtttca

SEQ ID NO: 413929 - DNA, 25 bp, Mus musculus
gaacaccatctcgtactgtgcattt

SEQ ID NO: 413930 - DNA, 25 bp, Mus musculus
gaacaccatctcgtgtagagtttca

SEQ ID NO: 413931 - DNA, 25 bp, Mus musculus
gaacaccatgctagacatctccaaa

SEQ ID NO: 413932 - DNA, 25 bp, Mus musculus
gaacaccatgcttgacatctccaaa

SEQ ID NO: 413933 - DNA, 25 bp, Mus musculus
gaacaccatgtccttaaccaaagtc

SEQ ID NO: 413934 - DNA, 25 bp, Mus musculus
gaacaccatgtcgttaaccaaagtc

SEQ ID NO: 413935 - DNA, 25 bp, Mus musculus
gaacaccatgttctacgacttagga

SEQ ID NO: 413936 - DNA, 25 bp, Mus musculus
gaacaccatgttgtacgacttagga

SEQ ID NO: 413937 - DNA, 25 bp, Mus musculus
gaacaccattctcgatatccttgga

SEQ ID NO: 413938 - DNA, 25 bp, Mus musculus
gaacaccattctggatatccttgga

SEQ ID NO: 413939 - DNA, 25 bp, Mus musculus
gaacaccattttcttgcagtggctg

SEQ ID NO: 413940 - DNA, 25 bp, Mus musculus
gaacaccattttgttgcagtggctg

SEQ ID NO: 413941 - DNA, 25 bp, Mus musculus
gaacacccactgattgagcgtgtgc

SEQ ID NO: 413942 - DNA, 25 bp, Mus musculus
gaacacccactgtttgagcgtgtgc

SEQ ID NO: 413943 - DNA, 25 bp, Mus musculus
gaacacccaggaaatcttgcctctg

SEQ ID NO: 413944 - DNA, 25 bp, Mus musculus
gaacacccaggatatcttgcctctg

SEQ ID NO: 413945 - DNA, 25 bp, Mus musculus
gaacacccatgccattgacaaatac

SEQ ID NO: 413946 - DNA, 25 bp, Mus musculus
gaacacccatgcgattgacaaatac

SEQ ID NO: 413947 - DNA, 25 bp, Mus musculus
gaacaccccaacatgagcttggaga

SEQ ID NO: 413948 - DNA, 25 bp, Mus musculus
gaacaccccaacttgagcttggaga

SEQ ID NO: 413949 - DNA, 25 bp, Mus musculus
gaacaccccagactctatgtaccgg

SEQ ID NO: 413950 - DNA, 25 bp, Mus musculus
gaacaccccagagtctatgtaccgg

SEQ ID NO: 413951 - DNA, 25 bp, Mus musculus
gaacaccccattcatcacacatggg

SEQ ID NO: 413952 - DNA, 25 bp, Mus musculus
gaacaccccattgatcacacatggg

SEQ ID NO: 413953 - DNA, 25 bp, Mus musculus
gaacacccctgtcataataccgact

SEQ ID NO: 413954 - DNA, 25 bp, Mus musculus
gaacacccctgtgataataccgact

SEQ ID NO: 413955 - DNA, 25 bp, Mus musculus
gaacacccgtgaatctatagtattg

SEQ ID NO: 413956 - DNA, 25 bp, Mus musculus
gaacacccgtgattctatagtattg

SEQ ID NO: 413957 - DNA, 25 bp, Mus musculus
gaacacccgtggaatgtagtcctct

SEQ ID NO: 413958 - DNA, 25 bp, Mus musculus
gaacacccgtggtatgtagtcctct

SEQ ID NO: 413959 - DNA, 25 bp, Mus musculus
gaacaccctcttcgaactttatctt

SEQ ID NO: 413960 - DNA, 25 bp, Mus musculus
gaacaccctcttggaactttatctt

SEQ ID NO: 413961 - DNA, 25 bp, Mus musculus
gaacaccctgacctgcactgatgga

SEQ ID NO: 413962 - DNA, 25 bp, Mus musculus
gaacaccctgacgtgcactgatgga

SEQ ID NO: 413963 - DNA, 25 bp, Mus musculus
gaacaccctggaccgtatgaaagat

SEQ ID NO: 413964 - DNA, 25 bp, Mus musculus
gaacaccctggagcgtatgaaagat

SEQ ID NO: 413965 - DNA, 25 bp, Mus musculus
gaacaccctgtacatgtcaaacttt

SEQ ID NO: 413966 - DNA, 25 bp, Mus musculus
gaacaccctgtagatgtcaaacttt

SEQ ID NO: 413967 - DNA, 25 bp, Mus musculus
gaacaccctgtcaacttaaaacctg

SEQ ID NO: 413968 - DNA, 25 bp, Mus musculus
gaacaccctgtctacttaaaacctg

SEQ ID NO: 413969 - DNA, 25 bp, Mus musculus
gaacaccctgttctacgtgaaggag

SEQ ID NO: 413970 - DNA, 25 bp, Mus musculus
gaacaccctgttgtacgtgaaggag

SEQ ID NO: 413971 - DNA, 25 bp, Mus musculus
gaacaccgaactctttctgagctag

SEQ ID NO: 413972 - DNA, 25 bp, Mus musculus
gaacaccgaactgtttctgagctag

SEQ ID NO: 413973 - DNA, 25 bp, Mus musculus
gaacaccgaatccacccagtagtgt

SEQ ID NO: 413974 - DNA, 25 bp, Mus musculus
gaacaccgaatcgacccagtagtgt

SEQ ID NO: 413975 - DNA, 25 bp, Mus musculus
gaacaccgacatcttcagtttactt

SEQ ID NO: 413976 - DNA, 25 bp, Mus musculus
gaacaccgacatgttcagtttactt

SEQ ID NO: 413977 - DNA, 25 bp, Mus musculus
gaacaccgattccactcaactaagg

SEQ ID NO: 413978 - DNA, 25 bp, Mus musculus
gaacaccgattcgactcaactaagg

SEQ ID NO: 413979 - DNA, 25 bp, Mus musculus
gaacaccgggtgaggcagatcacat

SEQ ID NO: 413980 - DNA, 25 bp, Mus musculus
gaacaccgggtgtggcagatcacat

SEQ ID NO: 413981 - DNA, 25 bp, Mus musculus
gaacaccgtaggaatattcttccgt

SEQ ID NO: 413982 - DNA, 25 bp, Mus musculus
gaacaccgtaggtatattcttccgt

SEQ ID NO: 413983 - DNA, 25 bp, Mus musculus
gaacaccgtgcacagaatacctgaa

SEQ ID NO: 413984 - DNA, 25 bp, Mus musculus
gaacaccgtgcagagaatacctgaa

SEQ ID NO: 413985 - DNA, 25 bp, Mus musculus
gaacaccgtggacacgtcaatttgt

SEQ ID NO: 413986 - DNA, 25 bp, Mus musculus
gaacaccgtggactcacctgagtcg

SEQ ID NO: 413987 - DNA, 25 bp, Mus musculus
gaacaccgtggagacgtcaatttgt

SEQ ID NO: 413988 - DNA, 25 bp, Mus musculus
gaacaccgtggagtcacctgagtcg

SEQ ID NO: 413989 - DNA, 25 bp, Mus musculus
gaacacctacataaaagacgacaca

SEQ ID NO: 413990 - DNA, 25 bp, Mus musculus
gaacacctacattaaagacgacaca

SEQ ID NO: 413991 - DNA, 25 bp, Mus musculus
gaacacctatgaatgtatgtttatt

SEQ ID NO: 413992 - DNA, 25 bp, Mus musculus
gaacacctatgattgtatgtttatt

SEQ ID NO: 413993 - DNA, 25 bp, Mus musculus
gaacacctcaccaaccttgagttca

SEQ ID NO: 413994 - DNA, 25 bp, Mus musculus
gaacacctcacctaccttgagttca

SEQ ID NO: 413995 - DNA, 25 bp, Mus musculus
gaacacctcagtctatttccattgt

SEQ ID NO: 413996 - DNA, 25 bp, Mus musculus
gaacacctcagtgtatttccattgt

SEQ ID NO: 413997 - DNA, 25 bp, Mus musculus
gaacacctctgtatgtggcttgtaa

SEQ ID NO: 413998 - DNA, 25 bp, Mus musculus
gaacacctctgtttgtggcttgtaa

SEQ ID NO: 413999 - DNA, 25 bp, Mus musculus
gaacacctgaccacacttttgagtt

SEQ ID NO: 414000 - DNA, 25 bp, Mus musculus
gaacacctgacctcacttttgagtt

SEQ ID NO: 414001 - DNA, 25 bp, Mus musculus
gaacacctgagaaagagtgtgtgaa

SEQ ID NO: 414002 - DNA, 25 bp, Mus musculus
gaacacctgagatagagtgtgtgaa

SEQ ID NO: 414003 - DNA, 25 bp, Mus musculus
gaacacctgagtcatggaagtcctt

SEQ ID NO: 414004 - DNA, 25 bp, Mus musculus
gaacacctgagtgatggaagtcctt

SEQ ID NO: 414005 - DNA, 25 bp, Mus musculus
gaacacctgcagactagcagtgtta

SEQ ID NO: 414006 - DNA, 25 bp, Mus musculus
gaacacctgcagtctagcagtgtta

SEQ ID NO: 414007 - DNA, 25 bp, Mus musculus
gaacacctgcttaacgattattgta

SEQ ID NO: 414008 - DNA, 25 bp, Mus musculus
gaacacctgctttacgattattgta

SEQ ID NO: 414009 - DNA, 25 bp, Mus musculus
gaacacctggaaccaaaaccatagt

SEQ ID NO: 414010 - DNA, 25 bp, Mus musculus
gaacacctggaagcaaaaccatagt

SEQ ID NO: 414011 - DNA, 25 bp, Mus musculus
gaacacctgggcaataactacagat

SEQ ID NO: 414012 - DNA, 25 bp, Mus musculus
gaacacctgggctataactacagat

SEQ ID NO: 414013 - DNA, 25 bp, Mus musculus
gaacacctgtatacttaaaggctta

SEQ ID NO: 414014 - DNA, 25 bp, Mus musculus
gaacacctgtattcttaaaggctta

SEQ ID NO: 414015 - DNA, 25 bp, Mus musculus
gaacaccttacccagcaacttgctg

SEQ ID NO: 414016 - DNA, 25 bp, Mus musculus
gaacaccttaccgagcaacttgctg

SEQ ID NO: 414017 - DNA, 25 bp, Mus musculus
gaacaccttcatactggtagagcac

SEQ ID NO: 414018 - DNA, 25 bp, Mus musculus
gaacaccttcattctggtagagcac

SEQ ID NO: 414019 - DNA, 25 bp, Mus musculus
gaacaccttccgcaactgctgagag

SEQ ID NO: 414020 - DNA, 25 bp, Mus musculus
gaacaccttccggaactgctgagag

SEQ ID NO: 414021 - DNA, 25 bp, Mus musculus
gaacaccttcggaagagctacacag

SEQ ID NO: 414022 - DNA, 25 bp, Mus musculus
gaacaccttcggtagagctacacag

SEQ ID NO: 414023 - DNA, 25 bp, Mus musculus
gaacaccttcttcatccagtttaaa

SEQ ID NO: 414024 - DNA, 25 bp, Mus musculus
gaacaccttcttcgtttttgcatta

SEQ ID NO: 414025 - DNA, 25 bp, Mus musculus
gaacaccttcttgatccagtttaaa

SEQ ID NO: 414026 - DNA, 25 bp, Mus musculus
gaacaccttcttggtttttgcatta

SEQ ID NO: 414027 - DNA, 25 bp, Mus musculus
gaacacctttcacagtgtgcctttc

SEQ ID NO: 414028 - DNA, 25 bp, Mus musculus
gaacacctttcagagtgtgcctttc

SEQ ID NO: 414029 - DNA, 25 bp, Mus musculus
gaacacctttctaacaggaagtagt

SEQ ID NO: 414030 - DNA, 25 bp, Mus musculus
gaacacctttcttacaggaagtagt

SEQ ID NO: 414031 - DNA, 25 bp, Mus musculus
gaacacctttggcaatgacttctga

SEQ ID NO: 414032 - DNA, 25 bp, Mus musculus
gaacacctttgggaatgacttctga

SEQ ID NO: 414033 - DNA, 25 bp, Mus musculus
gaacacgaacaaattcataccggag

SEQ ID NO: 414034 - DNA, 25 bp, Mus musculus
gaacacgaacaatttcataccggag

SEQ ID NO: 414035 - DNA, 25 bp, Mus musculus
gaacacgaacccatgcgtgcactta

SEQ ID NO: 414036 - DNA, 25 bp, Mus musculus
gaacacgaacccttgcgtgcactta

SEQ ID NO: 414037 - DNA, 25 bp, Mus musculus
gaacacgaagcaacctgtccccaag

SEQ ID NO: 414038 - DNA, 25 bp, Mus musculus
gaacacgaagcatcctgtccccaag

SEQ ID NO: 414039 - DNA, 25 bp, Mus musculus
gaacacgactctcatcaatcaaatg

SEQ ID NO: 414040 - DNA, 25 bp, Mus musculus
gaacacgactctgatcaatcaaatg

SEQ ID NO: 414041 - DNA, 25 bp, Mus musculus
gaacacgagacaacacagacattat

SEQ ID NO: 414042 - DNA, 25 bp, Mus musculus
gaacacgagacatcacagacattat

SEQ ID NO: 414043 - DNA, 25 bp, Mus musculus
gaacacgagcaaagcatgtaccaac

SEQ ID NO: 414044 - DNA, 25 bp, Mus musculus
gaacacgagcaatgcatgtaccaac

SEQ ID NO: 414045 - DNA, 25 bp, Mus musculus
gaacacgagctgcttcctacgaact

SEQ ID NO: 414046 - DNA, 25 bp, Mus musculus
gaacacgagctggttcctacgaact

SEQ ID NO: 414047 - DNA, 25 bp, Mus musculus
gaacacgagtaacaggtgcccacca

SEQ ID NO: 414048 - DNA, 25 bp, Mus musculus
gaacacgagtaagaggtgcccacca

SEQ ID NO: 414049 - DNA, 25 bp, Mus musculus
gaacacgagtttccgacgggaccag

SEQ ID NO: 414050 - DNA, 25 bp, Mus musculus
gaacacgagtttgcgacgggaccag

SEQ ID NO: 414051 - DNA, 25 bp, Mus musculus
gaacacgcagggactctacattagg

SEQ ID NO: 414052 - DNA, 25 bp, Mus musculus
gaacacgcagggtctctacattagg

SEQ ID NO: 414053 - DNA, 25 bp, Mus musculus
gaacacgcagtaaatcctagggtag

SEQ ID NO: 414054 - DNA, 25 bp, Mus musculus
gaacacgcagtatatcctagggtag

SEQ ID NO: 414055 - DNA, 25 bp, Mus musculus
gaacacgcattgctttgtgctgtct

SEQ ID NO: 414056 - DNA, 25 bp, Mus musculus
gaacacgcattggtttgtgctgtct

SEQ ID NO: 414057 - DNA, 25 bp, Mus musculus
gaacacgcccatagtggtttaacca

SEQ ID NO: 414058 - DNA, 25 bp, Mus musculus
gaacacgcccattgtggtttaacca

SEQ ID NO: 414059 - DNA, 25 bp, Mus musculus
gaacacgcgcagagcttcacggagt

SEQ ID NO: 414060 - DNA, 25 bp, Mus musculus
gaacacgcgcagtgcttcacggagt

SEQ ID NO: 414061 - DNA, 25 bp, Mus musculus
gaacacgctgggagacactatggtt

SEQ ID NO: 414062 - DNA, 25 bp, Mus musculus
gaacacgctgggtgacactatggtt

SEQ ID NO: 414063 - DNA, 25 bp, Mus musculus
gaacacggaaagaagccatttaaca

SEQ ID NO: 414064 - DNA, 25 bp, Mus musculus
gaacacggaaagtagccatttaaca

SEQ ID NO: 414065 - DNA, 25 bp, Mus musculus
gaacacggaaggagaacttgatctg

SEQ ID NO: 414066 - DNA, 25 bp, Mus musculus
gaacacggaaggtgaacttgatctg

SEQ ID NO: 414067 - DNA, 25 bp, Mus musculus
gaacacggacatagctgactggtaa

SEQ ID NO: 414068 - DNA, 25 bp, Mus musculus
gaacacggacattgctgactggtaa

SEQ ID NO: 414069 - DNA, 25 bp, Mus musculus
gaacacggagaccttcagggagact

SEQ ID NO: 414070 - DNA, 25 bp, Mus musculus
gaacacggagacgttcagggagact

SEQ ID NO: 414071 - DNA, 25 bp, Mus musculus
gaacacggaggaagacgatctggaa

SEQ ID NO: 414072 - DNA, 25 bp, Mus musculus
gaacacggaggatgacgatctggaa

SEQ ID NO: 414073 - DNA, 25 bp, Mus musculus
gaacacggatccagctcacaagaga

SEQ ID NO: 414074 - DNA, 25 bp, Mus musculus
gaacacggatcctgctcacaagaga

SEQ ID NO: 414075 - DNA, 25 bp, Mus musculus
gaacacggatgacccaatgggaatc

SEQ ID NO: 414076 - DNA, 25 bp, Mus musculus
gaacacggatgagccaatgggaatc

SEQ ID NO: 414077 - DNA, 25 bp, Mus musculus
gaacacggatttcagccaggctgct

SEQ ID NO: 414078 - DNA, 25 bp, Mus musculus
gaacacggatttgagccaggctgct

SEQ ID NO: 414079 - DNA, 25 bp, Mus musculus
gaacacggccttcggacctagcagc

SEQ ID NO: 414080 - DNA, 25 bp, Mus musculus
gaacacggccttgggacctagcagc

SEQ ID NO: 414081 - DNA, 25 bp, Mus musculus
gaacacggctgtcgcccctcagttg

SEQ ID NO: 414082 - DNA, 25 bp, Mus musculus
gaacacggctgtggcccctcagttg

SEQ ID NO: 414083 - DNA, 25 bp, Mus musculus
gaacacgggagtctgatcttggccc

SEQ ID NO: 414084 - DNA, 25 bp, Mus musculus
gaacacgggagtgtgatcttggccc

SEQ ID NO: 414085 - DNA, 25 bp, Mus musculus
gaacacgggcagaatgtgcacaaga

SEQ ID NO: 414086 - DNA, 25 bp, Mus musculus
gaacacgggcagtatgtgcacaaga

SEQ ID NO: 414087 - DNA, 25 bp, Mus musculus
gaacacgggcttactttcacataag

SEQ ID NO: 414088 - DNA, 25 bp, Mus musculus
gaacacgggctttctttcacataag

SEQ ID NO: 414089 - DNA, 25 bp, Mus musculus
gaacacgggttaccagaacttctat

SEQ ID NO: 414090 - DNA, 25 bp, Mus musculus
gaacacgggttagcagaacttctat

SEQ ID NO: 414091 - DNA, 25 bp, Mus musculus
gaacacgggttcactatcaccagag

SEQ ID NO: 414092 - DNA, 25 bp, Mus musculus
gaacacgggttctctatcaccagag

SEQ ID NO: 414093 - DNA, 25 bp, Mus musculus
gaacacggttcaacctggtgaactt

SEQ ID NO: 414094 - DNA, 25 bp, Mus musculus
gaacacggttcatcctggtgaactt

SEQ ID NO: 414095 - DNA, 25 bp, Mus musculus
gaacacgtaaatctccctggatcat

SEQ ID NO: 414096 - DNA, 25 bp, Mus musculus
gaacacgtaaatgtccctggatcat

SEQ ID NO: 414097 - DNA, 25 bp, Mus musculus
gaacacgtctgaatccagggcacac

SEQ ID NO: 414098 - DNA, 25 bp, Mus musculus
gaacacgtctgattccagggcacac

SEQ ID NO: 414099 - DNA, 25 bp, Mus musculus
gaacacgtgaacagtggcggacatg

SEQ ID NO: 414100 - DNA, 25 bp, Mus musculus
gaacacgtgaactgtggcggacatg

SEQ ID NO: 414101 - DNA, 25 bp, Mus musculus
gaacacgtggtacccgctgcaatgc

SEQ ID NO: 414102 - DNA, 25 bp, Mus musculus
gaacacgtggtagccgctgcaatgc

SEQ ID NO: 414103 - DNA, 25 bp, Mus musculus
gaacacgtggtccaccatcgttttg

SEQ ID NO: 414104 - DNA, 25 bp, Mus musculus
gaacacgtggtcgaccatcgttttg

SEQ ID NO: 414105 - DNA, 25 bp, Mus musculus
gaacacgtgtctaaccagcagatcc

SEQ ID NO: 414106 - DNA, 25 bp, Mus musculus
gaacacgtgtcttaccagcagatcc

SEQ ID NO: 414107 - DNA, 25 bp, Mus musculus
gaacacgtgtgtcgcggatcctcca

SEQ ID NO: 414108 - DNA, 25 bp, Mus musculus
gaacacgtgtgtggcggatcctcca

SEQ ID NO: 414109 - DNA, 25 bp, Mus musculus
gaacacgtgttgatgaacagcacat

SEQ ID NO: 414110 - DNA, 25 bp, Mus musculus
gaacacgtgttgttgaacagcacat

SEQ ID NO: 414111 - DNA, 25 bp, Mus musculus
gaacactaaagacccttccattctt

SEQ ID NO: 414112 - DNA, 25 bp, Mus musculus
gaacactaaagagccttccattctt

SEQ ID NO: 414113 - DNA, 25 bp, Mus musculus
gaacactaaatcaacaccatgccct

SEQ ID NO: 414114 - DNA, 25 bp, Mus musculus
gaacactaaatctacaccatgccct

SEQ ID NO: 414115 - DNA, 25 bp, Mus musculus
gaacactaacatatcccatctagag

SEQ ID NO: 414116 - DNA, 25 bp, Mus musculus
gaacactaacatttcccatctagag

SEQ ID NO: 414117 - DNA, 25 bp, Mus musculus
gaacactaacccaatggttccatgc

SEQ ID NO: 414118 - DNA, 25 bp, Mus musculus
gaacactaaccctatggttccatgc

SEQ ID NO: 414119 - DNA, 25 bp, Mus musculus
gaacactaacctcaccatgggcggg

SEQ ID NO: 414120 - DNA, 25 bp, Mus musculus
gaacactaacctgaccatgggcggg

SEQ ID NO: 414121 - DNA, 25 bp, Mus musculus
gaacactaagacaggaatttctggt

SEQ ID NO: 414122 - DNA, 25 bp, Mus musculus
gaacactaagactggaatttctggt

SEQ ID NO: 414123 - DNA, 25 bp, Mus musculus
gaacactaagtacttgctgtcccct

SEQ ID NO: 414124 - DNA, 25 bp, Mus musculus
gaacactaagtagttgctgtcccct

SEQ ID NO: 414125 - DNA, 25 bp, Mus musculus
gaacactaatgactgcagctactaa

SEQ ID NO: 414126 - DNA, 25 bp, Mus musculus
gaacactaatgagtgcagctactaa

SEQ ID NO: 414127 - DNA, 25 bp, Mus musculus
gaacactaattgagatggacagtta

SEQ ID NO: 414128 - DNA, 25 bp, Mus musculus
gaacactaattgtgatggacagtta

SEQ ID NO: 414129 - DNA, 25 bp, Mus musculus
gaacactacatcctttctgtttgtt

SEQ ID NO: 414130 - DNA, 25 bp, Mus musculus
gaacactacatcgtttctgtttgtt

SEQ ID NO: 414131 - DNA, 25 bp, Mus musculus
gaacactacctgcaatagacgcctc

SEQ ID NO: 414132 - DNA, 25 bp, Mus musculus
gaacactacctggaatagacgcctc

SEQ ID NO: 414133 - DNA, 25 bp, Mus musculus
gaacactacgctcgcctgttttatc

SEQ ID NO: 414134 - DNA, 25 bp, Mus musculus
gaacactacgctggcctgttttatc

SEQ ID NO: 414135 - DNA, 25 bp, Mus musculus
gaacactacgttcacctgaaggacc

SEQ ID NO: 414136 - DNA, 25 bp, Mus musculus
gaacactacgttgacctgaaggacc

SEQ ID NO: 414137 - DNA, 25 bp, Mus musculus
gaacactactaactcctgcggtcta

SEQ ID NO: 414138 - DNA, 25 bp, Mus musculus
gaacactactaagtcctgcggtcta

SEQ ID NO: 414139 - DNA, 25 bp, Mus musculus
gaacactactacaatgccatctctg

SEQ ID NO: 414140 - DNA, 25 bp, Mus musculus
gaacactactactatgccatctctg

SEQ ID NO: 414141 - DNA, 25 bp, Mus musculus
gaacactacttaccaaacacttgcc

SEQ ID NO: 414142 - DNA, 25 bp, Mus musculus
gaacactacttagcaaacacttgcc

SEQ ID NO: 414143 - DNA, 25 bp, Mus musculus
gaacactaggtaaccacatgtagaa

SEQ ID NO: 414144 - DNA, 25 bp, Mus musculus
gaacactaggtatccacatgtagaa

SEQ ID NO: 414145 - DNA, 25 bp, Mus musculus
gaacactatacaatgctttaggtgc

SEQ ID NO: 414146 - DNA, 25 bp, Mus musculus
gaacactatacattgctttaggtgc

SEQ ID NO: 414147 - DNA, 25 bp, Mus musculus
gaacactataggctggaactactcc

SEQ ID NO: 414148 - DNA, 25 bp, Mus musculus
gaacactatagggtggaactactcc

SEQ ID NO: 414149 - DNA, 25 bp, Mus musculus
gaacactatctgaattctagacaca

SEQ ID NO: 414150 - DNA, 25 bp, Mus musculus
gaacactatctgacttactattttt

SEQ ID NO: 414151 - DNA, 25 bp, Mus musculus
gaacactatctgtattctagacaca

SEQ ID NO: 414152 - DNA, 25 bp, Mus musculus
gaacactatctgtcttactattttt

SEQ ID NO: 414153 - DNA, 25 bp, Mus musculus
gaacactattctactctggattcaa

SEQ ID NO: 414154 - DNA, 25 bp, Mus musculus
gaacactattcttctctggattcaa

SEQ ID NO: 414155 - DNA, 25 bp, Mus musculus
gaacactcacggcaacagttacagc

SEQ ID NO: 414156 - DNA, 25 bp, Mus musculus
gaacactcacgggaacagttacagc

SEQ ID NO: 414157 - DNA, 25 bp, Mus musculus
gaacactccagcctttttggcagaa

SEQ ID NO: 414158 - DNA, 25 bp, Mus musculus
gaacactccagcgtttttggcagaa

SEQ ID NO: 414159 - DNA, 25 bp, Mus musculus
gaacactccataccccatttttgga

SEQ ID NO: 414160 - DNA, 25 bp, Mus musculus
gaacactccatagcccatttttgga

SEQ ID NO: 414161 - DNA, 25 bp, Mus musculus
gaacactcccgaaacttggccaatg

SEQ ID NO: 414162 - DNA, 25 bp, Mus musculus
gaacactcccgatacttggccaatg

SEQ ID NO: 414163 - DNA, 25 bp, Mus musculus
gaacactccgtcagaaatgctggtt

SEQ ID NO: 414164 - DNA, 25 bp, Mus musculus
gaacactccgtctgaaatgctggtt

SEQ ID NO: 414165 - DNA, 25 bp, Mus musculus
gaacactcctgaataagacggttga

SEQ ID NO: 414166 - DNA, 25 bp, Mus musculus
gaacactcctgattaagacggttga

SEQ ID NO: 414167 - DNA, 25 bp, Mus musculus
gaacactcctgcaggacattttgtg

SEQ ID NO: 414168 - DNA, 25 bp, Mus musculus
gaacactcctgctggacattttgtg

SEQ ID NO: 414169 - DNA, 25 bp, Mus musculus
gaacactcgtgcctgttgaaacgta

SEQ ID NO: 414170 - DNA, 25 bp, Mus musculus
gaacactcgtgcgtgttgaaacgta

SEQ ID NO: 414171 - DNA, 25 bp, Mus musculus
gaacactctgagacttgcgacaatg

SEQ ID NO: 414172 - DNA, 25 bp, Mus musculus
gaacactctgagcaactgaactatc

SEQ ID NO: 414173 - DNA, 25 bp, Mus musculus
gaacactctgaggaactgaactatc

SEQ ID NO: 414174 - DNA, 25 bp, Mus musculus
gaacactctgagtcttgcgacaatg

SEQ ID NO: 414175 - DNA, 25 bp, Mus musculus
gaacactctgatacacttcatctgc

SEQ ID NO: 414176 - DNA, 25 bp, Mus musculus
gaacactctgattcacttcatctgc

SEQ ID NO: 414177 - DNA, 25 bp, Mus musculus
gaacactctgcactgctctggaaac

SEQ ID NO: 414178 - DNA, 25 bp, Mus musculus
gaacactctgcagtgctctggaaac

SEQ ID NO: 414179 - DNA, 25 bp, Mus musculus
gaacactctgtgagcgattttgaaa

SEQ ID NO: 414180 - DNA, 25 bp, Mus musculus
gaacactctgtgtgcgattttgaaa

SEQ ID NO: 414181 - DNA, 25 bp, Mus musculus
gaacactcttgtagttccctttgtg

SEQ ID NO: 414182 - DNA, 25 bp, Mus musculus
gaacactcttgttgttccctttgtg

SEQ ID NO: 414183 - DNA, 25 bp, Mus musculus
gaacactctttcacatggagctgtg

SEQ ID NO: 414184 - DNA, 25 bp, Mus musculus
gaacactctttctcatggagctgtg

SEQ ID NO: 414185 - DNA, 25 bp, Mus musculus
gaacactgaaataaaggtctatttt

SEQ ID NO: 414186 - DNA, 25 bp, Mus musculus
gaacactgaaatcctttgctttaag

SEQ ID NO: 414187 - DNA, 25 bp, Mus musculus
gaacactgaaatgctttgctttaag

SEQ ID NO: 414188 - DNA, 25 bp, Mus musculus
gaacactgaaattaaggtctatttt

SEQ ID NO: 414189 - DNA, 25 bp, Mus musculus
gaacactgaagaccctgtgtctttt

SEQ ID NO: 414190 - DNA, 25 bp, Mus musculus
gaacactgaagagcctgtgtctttt

SEQ ID NO: 414191 - DNA, 25 bp, Mus musculus
gaacactgaagtcacgagctcaatt

SEQ ID NO: 414192 - DNA, 25 bp, Mus musculus
gaacactgaagtgacgagctcaatt

SEQ ID NO: 414193 - DNA, 25 bp, Mus musculus
gaacactgaataatcccttgtttaa

SEQ ID NO: 414194 - DNA, 25 bp, Mus musculus
gaacactgaatattcccttgtttaa

SEQ ID NO: 414195 - DNA, 25 bp, Mus musculus
gaacactgaccaatcactgtgcaga

SEQ ID NO: 414196 - DNA, 25 bp, Mus musculus
gaacactgaccattcactgtgcaga

SEQ ID NO: 414197 - DNA, 25 bp, Mus musculus
gaacactgacttcactggagggcaa

SEQ ID NO: 414198 - DNA, 25 bp, Mus musculus
gaacactgacttgactggagggcaa

SEQ ID NO: 414199 - DNA, 25 bp, Mus musculus
gaacactgagcaatgtgcacttgaa

SEQ ID NO: 414200 - DNA, 25 bp, Mus musculus
gaacactgagcattgtgcacttgaa

SEQ ID NO: 414201 - DNA, 25 bp, Mus musculus
gaacactgagttatcaagatgcctt

SEQ ID NO: 414202 - DNA, 25 bp, Mus musculus
gaacactgagttttcaagatgcctt

SEQ ID NO: 414203 - DNA, 25 bp, Mus musculus
gaacactgatgaaaccaacactgct

SEQ ID NO: 414204 - DNA, 25 bp, Mus musculus
gaacactgatgataccaacactgct

SEQ ID NO: 414205 - DNA, 25 bp, Mus musculus
gaacactgattcatttcatctgatg

SEQ ID NO: 414206 - DNA, 25 bp, Mus musculus
gaacactgattcttttcatctgatg

SEQ ID NO: 414207 - DNA, 25 bp, Mus musculus
gaacactgcagcagtgctcattatc

SEQ ID NO: 414208 - DNA, 25 bp, Mus musculus
gaacactgcagctgtgctcattatc

SEQ ID NO: 414209 - DNA, 25 bp, Mus musculus
gaacactgcctacttacatgtgttg

SEQ ID NO: 414210 - DNA, 25 bp, Mus musculus
gaacactgcctagttacatgtgttg

SEQ ID NO: 414211 - DNA, 25 bp, Mus musculus
gaacactgctttcaacgaactccgt

SEQ ID NO: 414212 - DNA, 25 bp, Mus musculus
gaacactgctttcggatgggtacca

SEQ ID NO: 414213 - DNA, 25 bp, Mus musculus
gaacactgctttgaacgaactccgt

SEQ ID NO: 414214 - DNA, 25 bp, Mus musculus
gaacactgctttgggatgggtacca

SEQ ID NO: 414215 - DNA, 25 bp, Mus musculus
gaacactggataagagactagggat

SEQ ID NO: 414216 - DNA, 25 bp, Mus musculus
gaacactggatatgagactagggat

SEQ ID NO: 414217 - DNA, 25 bp, Mus musculus
gaacactggattaatccttcttggg

SEQ ID NO: 414218 - DNA, 25 bp, Mus musculus
gaacactggatttatccttcttggg

SEQ ID NO: 414219 - DNA, 25 bp, Mus musculus
gaacactggctactcaggatataca

SEQ ID NO: 414220 - DNA, 25 bp, Mus musculus
gaacactggctagtcaggatataca

SEQ ID NO: 414221 - DNA, 25 bp, Mus musculus
gaacactggctgatattcagtagat

SEQ ID NO: 414222 - DNA, 25 bp, Mus musculus
gaacactggctgttattcagtagat

SEQ ID NO: 414223 - DNA, 25 bp, Mus musculus
gaacactgggatatggctgacaaac

SEQ ID NO: 414224 - DNA, 25 bp, Mus musculus
gaacactgggatttggctgacaaac

SEQ ID NO: 414225 - DNA, 25 bp, Mus musculus
gaacactgggtacacccacagtttc

SEQ ID NO: 414226 - DNA, 25 bp, Mus musculus
gaacactgggtacattttatctctt

SEQ ID NO: 414227 - DNA, 25 bp, Mus musculus
gaacactgggtagacccacagtttc

SEQ ID NO: 414228 - DNA, 25 bp, Mus musculus
gaacactgggtagattttatctctt

SEQ ID NO: 414229 - DNA, 25 bp, Mus musculus
gaacactggtaacgttgctgcccgt

SEQ ID NO: 414230 - DNA, 25 bp, Mus musculus
gaacactggtaaggttgctgcccgt

SEQ ID NO: 414231 - DNA, 25 bp, Mus musculus
gaacactggtcacagccgtggccac

SEQ ID NO: 414232 - DNA, 25 bp, Mus musculus
gaacactggtcagagccgtggccac

SEQ ID NO: 414233 - DNA, 25 bp, Mus musculus
gaacactggttaatcacatgatcta

SEQ ID NO: 414234 - DNA, 25 bp, Mus musculus
gaacactggttattcacatgatcta

SEQ ID NO: 414235 - DNA, 25 bp, Mus musculus
gaacactggttccatcgttcattgt

SEQ ID NO: 414236 - DNA, 25 bp, Mus musculus
gaacactggttcgatcgttcattgt

SEQ ID NO: 414237 - DNA, 25 bp, Mus musculus
gaacactgtaatctcccttgcagct

SEQ ID NO: 414238 - DNA, 25 bp, Mus musculus
gaacactgtaatgtcccttgcagct

SEQ ID NO: 414239 - DNA, 25 bp, Mus musculus
gaacactgtactcaatgataccttg

SEQ ID NO: 414240 - DNA, 25 bp, Mus musculus
gaacactgtactgaatgataccttg

SEQ ID NO: 414241 - DNA, 25 bp, Mus musculus
gaacactgtatgagcatctttcaaa

SEQ ID NO: 414242 - DNA, 25 bp, Mus musculus
gaacactgtatgtgcatctttcaaa

SEQ ID NO: 414243 - DNA, 25 bp, Mus musculus
gaacactgtcttaaatgctacggaa

SEQ ID NO: 414244 - DNA, 25 bp, Mus musculus
gaacactgtctttaatgctacggaa

SEQ ID NO: 414245 - DNA, 25 bp, Mus musculus
gaacactgtgagcacctaagtgtga

SEQ ID NO: 414246 - DNA, 25 bp, Mus musculus
gaacactgtgaggacctaagtgtga

SEQ ID NO: 414247 - DNA, 25 bp, Mus musculus
gaacactgtgctatggctacacaca

SEQ ID NO: 414248 - DNA, 25 bp, Mus musculus
gaacactgtgctttggctacacaca

SEQ ID NO: 414249 - DNA, 25 bp, Mus musculus
gaacactgtggtatctgttgacacc

SEQ ID NO: 414250 - DNA, 25 bp, Mus musculus
gaacactgtggtttctgttgacacc

SEQ ID NO: 414251 - DNA, 25 bp, Mus musculus
gaacactgttaccagacacaaaact

SEQ ID NO: 414252 - DNA, 25 bp, Mus musculus
gaacactgttacgagacacaaaact

SEQ ID NO: 414253 - DNA, 25 bp, Mus musculus
gaacactgttctccaatagccatag

SEQ ID NO: 414254 - DNA, 25 bp, Mus musculus
gaacactgttctgcaatagccatag

SEQ ID NO: 414255 - DNA, 25 bp, Mus musculus
gaacactgtttcagtggagctcaag

SEQ ID NO: 414256 - DNA, 25 bp, Mus musculus
gaacactgtttctgtggagctcaag

SEQ ID NO: 414257 - DNA, 25 bp, Mus musculus
gaacactgttttcatccaaatgcgg

SEQ ID NO: 414258 - DNA, 25 bp, Mus musculus
gaacactgttttccggacatggtct

SEQ ID NO: 414259 - DNA, 25 bp, Mus musculus
gaacactgttttgatccaaatgcgg

SEQ ID NO: 414260 - DNA, 25 bp, Mus musculus
gaacactgttttgcggacatggtct

SEQ ID NO: 414261 - DNA, 25 bp, Mus musculus
gaacacttaatgaccagatacccaa

SEQ ID NO: 414262 - DNA, 25 bp, Mus musculus
gaacacttaatgtccagatacccaa

SEQ ID NO: 414263 - DNA, 25 bp, Mus musculus
gaacacttaattagcaccgactcgt

SEQ ID NO: 414264 - DNA, 25 bp, Mus musculus
gaacacttaatttgcaccgactcgt

SEQ ID NO: 414265 - DNA, 25 bp, Mus musculus
gaacacttacctagttttaagctcg

SEQ ID NO: 414266 - DNA, 25 bp, Mus musculus
gaacacttaccttgttttaagctcg

SEQ ID NO: 414267 - DNA, 25 bp, Mus musculus
gaacacttagctatcaatcagtcat

SEQ ID NO: 414268 - DNA, 25 bp, Mus musculus
gaacacttagctttcaatcagtcat

SEQ ID NO: 414269 - DNA, 25 bp, Mus musculus
gaacacttagtcatcttttatgaag

SEQ ID NO: 414270 - DNA, 25 bp, Mus musculus
gaacacttagtcttcttttatgaag

SEQ ID NO: 414271 - DNA, 25 bp, Mus musculus
gaacacttagttctctcgtagagga

SEQ ID NO: 414272 - DNA, 25 bp, Mus musculus
gaacacttagttgtctcgtagagga

SEQ ID NO: 414273 - DNA, 25 bp, Mus musculus
gaacacttatctacatttgcacgga

SEQ ID NO: 414274 - DNA, 25 bp, Mus musculus
gaacacttatcttcatttgcacgga

SEQ ID NO: 414275 - DNA, 25 bp, Mus musculus
gaacacttcaagacatggaatgcta

SEQ ID NO: 414276 - DNA, 25 bp, Mus musculus
gaacacttcaagtcatggaatgcta

SEQ ID NO: 414277 - DNA, 25 bp, Mus musculus
gaacacttcagaagcaccgtgtctg

SEQ ID NO: 414278 - DNA, 25 bp, Mus musculus
gaacacttcagatgcaccgtgtctg

SEQ ID NO: 414279 - DNA, 25 bp, Mus musculus
gaacacttccttcgttggacggaga

SEQ ID NO: 414280 - DNA, 25 bp, Mus musculus
gaacacttccttggttggacggaga

SEQ ID NO: 414281 - DNA, 25 bp, Mus musculus
gaacacttctctcagtctatggtcc

SEQ ID NO: 414282 - DNA, 25 bp, Mus musculus
gaacacttctctgagtctatggtcc

SEQ ID NO: 414283 - DNA, 25 bp, Mus musculus
gaacacttctgaccaggatcaacca

SEQ ID NO: 414284 - DNA, 25 bp, Mus musculus
gaacacttctgagcaggatcaacca

SEQ ID NO: 414285 - DNA, 25 bp, Mus musculus
gaacacttctggctccaagacaatc

SEQ ID NO: 414286 - DNA, 25 bp, Mus musculus
gaacacttctgggtccaagacaatc

SEQ ID NO: 414287 - DNA, 25 bp, Mus musculus
gaacacttgaaaagcccgtcgaggg

SEQ ID NO: 414288 - DNA, 25 bp, Mus musculus
gaacacttgaaatgcccgtcgaggg

SEQ ID NO: 414289 - DNA, 25 bp, Mus musculus
gaacacttgaagacaccgggagctg

SEQ ID NO: 414290 - DNA, 25 bp, Mus musculus
gaacacttgaagtcaccgggagctg

SEQ ID NO: 414291 - DNA, 25 bp, Mus musculus
gaacacttgaccctgtagacggagt

SEQ ID NO: 414292 - DNA, 25 bp, Mus musculus
gaacacttgaccgtgtagacggagt

SEQ ID NO: 414293 - DNA, 25 bp, Mus musculus
gaacacttgattcaacctcaagacc

SEQ ID NO: 414294 - DNA, 25 bp, Mus musculus
gaacacttgattgaacctcaagacc

SEQ ID NO: 414295 - DNA, 25 bp, Mus musculus
gaacacttgcagatgctaagggact

SEQ ID NO: 414296 - DNA, 25 bp, Mus musculus
gaacacttgcagttgctaagggact

SEQ ID NO: 414297 - DNA, 25 bp, Mus musculus
gaacacttggcaaggtggcgcatac

SEQ ID NO: 414298 - DNA, 25 bp, Mus musculus
gaacacttggcatggtggcgcatac

SEQ ID NO: 414299 - DNA, 25 bp, Mus musculus
gaacacttggccagccgggagtcag

SEQ ID NO: 414300 - DNA, 25 bp, Mus musculus
gaacacttggcctgccgggagtcag

SEQ ID NO: 414301 - DNA, 25 bp, Mus musculus
gaacacttgtacataggactctttt

SEQ ID NO: 414302 - DNA, 25 bp, Mus musculus
gaacacttgtacttaggactctttt

SEQ ID NO: 414303 - DNA, 25 bp, Mus musculus
gaacacttgtctcaggctgactcca

SEQ ID NO: 414304 - DNA, 25 bp, Mus musculus
gaacacttgtctgaggctgactcca

SEQ ID NO: 414305 - DNA, 25 bp, Mus musculus
gaacactttaagaattacctgtcta

SEQ ID NO: 414306 - DNA, 25 bp, Mus musculus
gaacactttaagtattacctgtcta

SEQ ID NO: 414307 - DNA, 25 bp, Mus musculus
gaacactttaccagttgggccgcct

SEQ ID NO: 414308 - DNA, 25 bp, Mus musculus
gaacactttacctgttgggccgcct

SEQ ID NO: 414309 - DNA, 25 bp, Mus musculus
gaacactttcacacagcattaatca

SEQ ID NO: 414310 - DNA, 25 bp, Mus musculus
gaacactttcactcagcattaatca

SEQ ID NO: 414311 - DNA, 25 bp, Mus musculus
gaacactttcttatcattgggatta

SEQ ID NO: 414312 - DNA, 25 bp, Mus musculus
gaacactttcttttcattgggatta

SEQ ID NO: 414313 - DNA, 25 bp, Mus musculus
gaacactttgatcaacagccgcttt

SEQ ID NO: 414314 - DNA, 25 bp, Mus musculus
gaacactttgatgaacagccgcttt

SEQ ID NO: 414315 - DNA, 25 bp, Mus musculus
gaacactttgctagagatccgtgcc

SEQ ID NO: 414316 - DNA, 25 bp, Mus musculus
gaacactttgctatgatgaatttga

SEQ ID NO: 414317 - DNA, 25 bp, Mus musculus
gaacactttgcttgagatccgtgcc

SEQ ID NO: 414318 - DNA, 25 bp, Mus musculus
gaacactttgctttgatgaatttga

SEQ ID NO: 414319 - DNA, 25 bp, Mus musculus
gaacactttgtaaatttgctcacat

SEQ ID NO: 414320 - DNA, 25 bp, Mus musculus
gaacactttgtatatttgctcacat

SEQ ID NO: 414321 - DNA, 25 bp, Mus musculus
gaacactttttcaagtccgttatgt

SEQ ID NO: 414322 - DNA, 25 bp, Mus musculus
gaacactttttcatcgttgagcttt

SEQ ID NO: 414323 - DNA, 25 bp, Mus musculus
gaacactttttctagtccgttatgt

SEQ ID NO: 414324 - DNA, 25 bp, Mus musculus
gaacactttttcttcgttgagcttt

SEQ ID NO: 414325 - DNA, 25 bp, Mus musculus
gaacagaaacccactgactattttt

SEQ ID NO: 414326 - DNA, 25 bp, Mus musculus
gaacagaaaccctctgactattttt

SEQ ID NO: 414327 - DNA, 25 bp, Mus musculus
gaacagaaactcctgcttcaccgaa

SEQ ID NO: 414328 - DNA, 25 bp, Mus musculus
gaacagaaactcgtgcttcaccgaa

SEQ ID NO: 414329 - DNA, 25 bp, Mus musculus
gaacagaaactgcacgcatcggatt

SEQ ID NO: 414330 - DNA, 25 bp, Mus musculus
gaacagaaactggacgcatcggatt

SEQ ID NO: 414331 - DNA, 25 bp, Mus musculus
gaacagaaagggacatcactacatt

SEQ ID NO: 414332 - DNA, 25 bp, Mus musculus
gaacagaaagggtcatcactacatt

SEQ ID NO: 414333 - DNA, 25 bp, Mus musculus
gaacagaaagtcagctcccagtgga

SEQ ID NO: 414334 - DNA, 25 bp, Mus musculus
gaacagaaagtctgctcccagtgga

SEQ ID NO: 414335 - DNA, 25 bp, Mus musculus
gaacagaacatccttttgaggcaat

SEQ ID NO: 414336 - DNA, 25 bp, Mus musculus
gaacagaacatcgttttgaggcaat

SEQ ID NO: 414337 - DNA, 25 bp, Mus musculus
gaacagaaccctagttggtctgctt

SEQ ID NO: 414338 - DNA, 25 bp, Mus musculus
gaacagaaccctatgtggcttccca

SEQ ID NO: 414339 - DNA, 25 bp, Mus musculus
gaacagaacccttgttggtctgctt

SEQ ID NO: 414340 - DNA, 25 bp, Mus musculus
gaacagaaccctttgtggcttccca

SEQ ID NO: 414341 - DNA, 25 bp, Mus musculus
gaacagaactgaagcccgatttctt

SEQ ID NO: 414342 - DNA, 25 bp, Mus musculus
gaacagaactgatgcccgatttctt

SEQ ID NO: 414343 - DNA, 25 bp, Mus musculus
gaacagaactgcactctgagagcct

SEQ ID NO: 414344 - DNA, 25 bp, Mus musculus
gaacagaactgcatcaaattgattt

SEQ ID NO: 414345 - DNA, 25 bp, Mus musculus
gaacagaactgctctctgagagcct

SEQ ID NO: 414346 - DNA, 25 bp, Mus musculus
gaacagaactgcttcaaattgattt

SEQ ID NO: 414347 - DNA, 25 bp, Mus musculus
gaacagaagcaaaacccaggaccaa

SEQ ID NO: 414348 - DNA, 25 bp, Mus musculus
gaacagaagcaatacccaggaccaa

SEQ ID NO: 414349 - DNA, 25 bp, Mus musculus
gaacagaagcgcattgccaggctcg

SEQ ID NO: 414350 - DNA, 25 bp, Mus musculus
gaacagaagcgctttgccaggctcg

SEQ ID NO: 414351 - DNA, 25 bp, Mus musculus
gaacagaagggactcgtattacatc

SEQ ID NO: 414352 - DNA, 25 bp, Mus musculus
gaacagaagggagtcgtattacatc

SEQ ID NO: 414353 - DNA, 25 bp, Mus musculus
gaacagaagtatatctttaagccag

SEQ ID NO: 414354 - DNA, 25 bp, Mus musculus
gaacagaagtatttctttaagccag

SEQ ID NO: 414355 - DNA, 25 bp, Mus musculus
gaacagaatcccaacccaaattgta

SEQ ID NO: 414356 - DNA, 25 bp, Mus musculus
gaacagaatccctacccaaattgta

SEQ ID NO: 414357 - DNA, 25 bp, Mus musculus
gaacagaatctacacacaatgacaa

SEQ ID NO: 414358 - DNA, 25 bp, Mus musculus
gaacagaatctagacacaatgacaa

SEQ ID NO: 414359 - DNA, 25 bp, Mus musculus
gaacagaatcttacacctcgtactt

SEQ ID NO: 414360 - DNA, 25 bp, Mus musculus
gaacagaatctttcacctcgtactt

SEQ ID NO: 414361 - DNA, 25 bp, Mus musculus
gaacagaatttaaaggttcacagaa

SEQ ID NO: 414362 - DNA, 25 bp, Mus musculus
gaacagaatttataggttcacagaa

SEQ ID NO: 414363 - DNA, 25 bp, Mus musculus
gaacagacactgctgcagactccaa

SEQ ID NO: 414364 - DNA, 25 bp, Mus musculus
gaacagacactggtgcagactccaa

SEQ ID NO: 414365 - DNA, 25 bp, Mus musculus
gaacagacagcaatcctaggtctct

SEQ ID NO: 414366 - DNA, 25 bp, Mus musculus
gaacagacagcattcctaggtctct

SEQ ID NO: 414367 - DNA, 25 bp, Mus musculus
gaacagaccaaaatccctgtcctgg

SEQ ID NO: 414368 - DNA, 25 bp, Mus musculus
gaacagaccaaattccctgtcctgg

SEQ ID NO: 414369 - DNA, 25 bp, Mus musculus
gaacagaccagactgaggcccattc

SEQ ID NO: 414370 - DNA, 25 bp, Mus musculus
gaacagaccagagtgaggcccattc

SEQ ID NO: 414371 - DNA, 25 bp, Mus musculus
gaacagaccatcatagcctttttgc

SEQ ID NO: 414372 - DNA, 25 bp, Mus musculus
gaacagaccatcttagcctttttgc

SEQ ID NO: 414373 - DNA, 25 bp, Mus musculus
gaacagacccgcatctggacctatg

SEQ ID NO: 414374 - DNA, 25 bp, Mus musculus
gaacagacccgcttctggacctatg

SEQ ID NO: 414375 - DNA, 25 bp, Mus musculus
gaacagacctagagaacattccacg

SEQ ID NO: 414376 - DNA, 25 bp, Mus musculus
gaacagacctagtgaacattccacg

SEQ ID NO: 414377 - DNA, 25 bp, Mus musculus
gaacagacgaaacaggagcagaagc

SEQ ID NO: 414378 - DNA, 25 bp, Mus musculus
gaacagacgaaagaggagcagaagc

SEQ ID NO: 414379 - DNA, 25 bp, Mus musculus
gaacagactaagcatcatgtgatct

SEQ ID NO: 414380 - DNA, 25 bp, Mus musculus
gaacagactaaggatcatgtgatct

SEQ ID NO: 414381 - DNA, 25 bp, Mus musculus
gaacagactagtctcatcaacaata

SEQ ID NO: 414382 - DNA, 25 bp, Mus musculus
gaacagactagtgtcatcaacaata

SEQ ID NO: 414383 - DNA, 25 bp, Mus musculus
gaacagactcaaccagtgcttgcaa

SEQ ID NO: 414384 - DNA, 25 bp, Mus musculus
gaacagactcaagcagtgcttgcaa

SEQ ID NO: 414385 - DNA, 25 bp, Mus musculus
gaacagactcagccgatgtgcttta

SEQ ID NO: 414386 - DNA, 25 bp, Mus musculus
gaacagactcaggcgatgtgcttta

SEQ ID NO: 414387 - DNA, 25 bp, Mus musculus
gaacagactccacgacagtgcaatg

SEQ ID NO: 414388 - DNA, 25 bp, Mus musculus
gaacagactccaggacagtgcaatg

SEQ ID NO: 414389 - DNA, 25 bp, Mus musculus
gaacagactctaccccagagcctgg

SEQ ID NO: 414390 - DNA, 25 bp, Mus musculus
gaacagactctagcccagagcctgg

SEQ ID NO: 414391 - DNA, 25 bp, Mus musculus
gaacagactgcacacaccggagaaa

SEQ ID NO: 414392 - DNA, 25 bp, Mus musculus
gaacagactgcagacaccggagaaa

SEQ ID NO: 414393 - DNA, 25 bp, Mus musculus
gaacagactggaagtgtcaggccaa

SEQ ID NO: 414394 - DNA, 25 bp, Mus musculus
gaacagactggatgtgtcaggccaa

SEQ ID NO: 414395 - DNA, 25 bp, Mus musculus
gaacagactgtgaacccgccaagag

SEQ ID NO: 414396 - DNA, 25 bp, Mus musculus
gaacagactgtgtacccgccaagag

SEQ ID NO: 414397 - DNA, 25 bp, Mus musculus
gaacagacttctatcagcgatcaaa

SEQ ID NO: 414398 - DNA, 25 bp, Mus musculus
gaacagacttctttcagcgatcaaa

SEQ ID NO: 414399 - DNA, 25 bp, Mus musculus
gaacagacttgcatagcttccttga

SEQ ID NO: 414400 - DNA, 25 bp, Mus musculus
gaacagacttgcttagcttccttga

SEQ ID NO: 414401 - DNA, 25 bp, Mus musculus
gaacagagaaacacagctgccccat

SEQ ID NO: 414402 - DNA, 25 bp, Mus musculus
gaacagagaaacataagccagcata

SEQ ID NO: 414403 - DNA, 25 bp, Mus musculus
gaacagagaaactcagctgccccat

SEQ ID NO: 414404 - DNA, 25 bp, Mus musculus
gaacagagaaacttaagccagcata

SEQ ID NO: 414405 - DNA, 25 bp, Mus musculus
gaacagagaagaagctctctcccct

SEQ ID NO: 414406 - DNA, 25 bp, Mus musculus
gaacagagaagatgctctctcccct

SEQ ID NO: 414407 - DNA, 25 bp, Mus musculus
gaacagagacagaacagaccccaag

SEQ ID NO: 414408 - DNA, 25 bp, Mus musculus
gaacagagacagtacagaccccaag

SEQ ID NO: 414409 - DNA, 25 bp, Mus musculus
gaacagagatggctctccctttcca

SEQ ID NO: 414410 - DNA, 25 bp, Mus musculus
gaacagagatgggtctccctttcca

SEQ ID NO: 414411 - DNA, 25 bp, Mus musculus
gaacagagcacacggccagacagcc

SEQ ID NO: 414412 - DNA, 25 bp, Mus musculus
gaacagagcacagggccagacagcc

SEQ ID NO: 414413 - DNA, 25 bp, Mus musculus
gaacagagccaaagctgtacggcaa

SEQ ID NO: 414414 - DNA, 25 bp, Mus musculus
gaacagagccaatgctgtacggcaa

SEQ ID NO: 414415 - DNA, 25 bp, Mus musculus
gaacagagccacaccggtattatat

SEQ ID NO: 414416 - DNA, 25 bp, Mus musculus
gaacagagccactccggtattatat

SEQ ID NO: 414417 - DNA, 25 bp, Mus musculus
gaacagagccttctgcattaaaatc

SEQ ID NO: 414418 - DNA, 25 bp, Mus musculus
gaacagagccttgtgcattaaaatc

SEQ ID NO: 414419 - DNA, 25 bp, Mus musculus
gaacagaggcttcttcctggcagtc

SEQ ID NO: 414420 - DNA, 25 bp, Mus musculus
gaacagaggcttgttcctggcagtc

SEQ ID NO: 414421 - DNA, 25 bp, Mus musculus
gaacagagggcccagtagcctcccg

SEQ ID NO: 414422 - DNA, 25 bp, Mus musculus
gaacagagggccgagtagcctcccg

SEQ ID NO: 414423 - DNA, 25 bp, Mus musculus
gaacagaggtttcatatccccagtc

SEQ ID NO: 414424 - DNA, 25 bp, Mus musculus
gaacagaggtttgatatccccagtc

SEQ ID NO: 414425 - DNA, 25 bp, Mus musculus
gaacagagtccacttactcgctctt

SEQ ID NO: 414426 - DNA, 25 bp, Mus musculus
gaacagagtccagttactcgctctt

SEQ ID NO: 414427 - DNA, 25 bp, Mus musculus
gaacagagtcccaagctggcaggat

SEQ ID NO: 414428 - DNA, 25 bp, Mus musculus
gaacagagtccctagctggcaggat

SEQ ID NO: 414429 - DNA, 25 bp, Mus musculus
gaacagagtttcaatgtctaaggaa

SEQ ID NO: 414430 - DNA, 25 bp, Mus musculus
gaacagagtttctatgtctaaggaa

SEQ ID NO: 414431 - DNA, 25 bp, Mus musculus
gaacagataaacacttgctgcctcc

SEQ ID NO: 414432 - DNA, 25 bp, Mus musculus
gaacagataaactcttgctgcctcc

SEQ ID NO: 414433 - DNA, 25 bp, Mus musculus
gaacagataagtagcttttctcaga

SEQ ID NO: 414434 - DNA, 25 bp, Mus musculus
gaacagataagttgcttttctcaga

SEQ ID NO: 414435 - DNA, 25 bp, Mus musculus
gaacagataatacggccatgacatt

SEQ ID NO: 414436 - DNA, 25 bp, Mus musculus
gaacagataatagggccatgacatt

SEQ ID NO: 414437 - DNA, 25 bp, Mus musculus
gaacagatagttatgtgccgaatca

SEQ ID NO: 414438 - DNA, 25 bp, Mus musculus
gaacagatagttttgtgccgaatca

SEQ ID NO: 414439 - DNA, 25 bp, Mus musculus
gaacagatccaaaacctgctctttg

SEQ ID NO: 414440 - DNA, 25 bp, Mus musculus
gaacagatccaaacattcctaggct

SEQ ID NO: 414441 - DNA, 25 bp, Mus musculus
gaacagatccaatacctgctctttg

SEQ ID NO: 414442 - DNA, 25 bp, Mus musculus
gaacagatccaatcattcctaggct

SEQ ID NO: 414443 - DNA, 25 bp, Mus musculus
gaacagatccggatatgcatcatgt

SEQ ID NO: 414444 - DNA, 25 bp, Mus musculus
gaacagatccggttatgcatcatgt

SEQ ID NO: 414445 - DNA, 25 bp, Mus musculus
gaacagatctagctccaatgtggat

SEQ ID NO: 414446 - DNA, 25 bp, Mus musculus
gaacagatctaggtccaatgtggat

SEQ ID NO: 414447 - DNA, 25 bp, Mus musculus
gaacagatgtgcaatgcccagaaca

SEQ ID NO: 414448 - DNA, 25 bp, Mus musculus
gaacagatgtgcaccagtgactttg

SEQ ID NO: 414449 - DNA, 25 bp, Mus musculus
gaacagatgtgctatgcccagaaca

SEQ ID NO: 414450 - DNA, 25 bp, Mus musculus
gaacagatgtgctccagtgactttg

SEQ ID NO: 414451 - DNA, 25 bp, Mus musculus
gaacagattaagaagagatgagcca

SEQ ID NO: 414452 - DNA, 25 bp, Mus musculus
gaacagattaagtagagatgagcca

SEQ ID NO: 414453 - DNA, 25 bp, Mus musculus
gaacagattcaacagtagagcttac

SEQ ID NO: 414454 - DNA, 25 bp, Mus musculus
gaacagattcaagagtagagcttac

SEQ ID NO: 414455 - DNA, 25 bp, Mus musculus
gaacagattcttcgactgtcctctt

SEQ ID NO: 414456 - DNA, 25 bp, Mus musculus
gaacagattcttggactgtcctctt

SEQ ID NO: 414457 - DNA, 25 bp, Mus musculus
gaacagattgccaagagacgtaggc

SEQ ID NO: 414458 - DNA, 25 bp, Mus musculus
gaacagattgccctgtttggaacct

SEQ ID NO: 414459 - DNA, 25 bp, Mus musculus
gaacagattgccgtgtttggaacct

SEQ ID NO: 414460 - DNA, 25 bp, Mus musculus
gaacagattgcctagagacgtaggc

SEQ ID NO: 414461 - DNA, 25 bp, Mus musculus
gaacagatttatcacctccaggaac

SEQ ID NO: 414462 - DNA, 25 bp, Mus musculus
gaacagatttatgacctccaggaac

SEQ ID NO: 414463 - DNA, 25 bp, Mus musculus
gaacagatttctagatgaaggcagt

SEQ ID NO: 414464 - DNA, 25 bp, Mus musculus
gaacagatttcttgatgaaggcagt

SEQ ID NO: 414465 - DNA, 25 bp, Mus musculus
gaacagattttaaaaactccacaac

SEQ ID NO: 414466 - DNA, 25 bp, Mus musculus
gaacagattttataaactccacaac

SEQ ID NO: 414467 - DNA, 25 bp, Mus musculus
gaacagcaaaacaagcctatgtcta

SEQ ID NO: 414468 - DNA, 25 bp, Mus musculus
gaacagcaaaactagcctatgtcta

SEQ ID NO: 414469 - DNA, 25 bp, Mus musculus
gaacagcaaacacttgatcctccac

SEQ ID NO: 414470 - DNA, 25 bp, Mus musculus
gaacagcaaacagttgatcctccac

SEQ ID NO: 414471 - DNA, 25 bp, Mus musculus
gaacagcaaaggcacacgtccccat

SEQ ID NO: 414472 - DNA, 25 bp, Mus musculus
gaacagcaaagggacacgtccccat

SEQ ID NO: 414473 - DNA, 25 bp, Mus musculus
gaacagcaacctatcctaagtgata

SEQ ID NO: 414474 - DNA, 25 bp, Mus musculus
gaacagcaacctttcctaagtgata

SEQ ID NO: 414475 - DNA, 25 bp, Mus musculus
gaacagcaacgtaacctgtgcaagg

SEQ ID NO: 414476 - DNA, 25 bp, Mus musculus
gaacagcaacgttacctgtgcaagg

SEQ ID NO: 414477 - DNA, 25 bp, Mus musculus
gaacagcaactcaacccagaaacat

SEQ ID NO: 414478 - DNA, 25 bp, Mus musculus
gaacagcaactctacccagaaacat

SEQ ID NO: 414479 - DNA, 25 bp, Mus musculus
gaacagcaagaaccctcatcaggat

SEQ ID NO: 414480 - DNA, 25 bp, Mus musculus
gaacagcaagaagcctcatcaggat

SEQ ID NO: 414481 - DNA, 25 bp, Mus musculus
gaacagcaagagaatgccggccacc

SEQ ID NO: 414482 - DNA, 25 bp, Mus musculus
gaacagcaagagtatgccggccacc

SEQ ID NO: 414483 - DNA, 25 bp, Mus musculus
gaacagcaagcacttactcgtctct

SEQ ID NO: 414484 - DNA, 25 bp, Mus musculus
gaacagcaagcagttactcgtctct

SEQ ID NO: 414485 - DNA, 25 bp, Mus musculus
gaacagcaaggtctggcccatttcc

SEQ ID NO: 414486 - DNA, 25 bp, Mus musculus
gaacagcaaggtgtggcccatttcc

SEQ ID NO: 414487 - DNA, 25 bp, Mus musculus
gaacagcaagtgatacccaacccag

SEQ ID NO: 414488 - DNA, 25 bp, Mus musculus
gaacagcaagtgttacccaacccag

SEQ ID NO: 414489 - DNA, 25 bp, Mus musculus
gaacagcacagaatccagcactggt

SEQ ID NO: 414490 - DNA, 25 bp, Mus musculus
gaacagcacagattccagcactggt

SEQ ID NO: 414491 - DNA, 25 bp, Mus musculus
gaacagcacagccagattctttgac

SEQ ID NO: 414492 - DNA, 25 bp, Mus musculus
gaacagcacagcgagattctttgac

SEQ ID NO: 414493 - DNA, 25 bp, Mus musculus
gaacagcacatgcaatctctcacgg

SEQ ID NO: 414494 - DNA, 25 bp, Mus musculus
gaacagcacatggaatctctcacgg

SEQ ID NO: 414495 - DNA, 25 bp, Mus musculus
gaacagcaccagaagcagatcaact

SEQ ID NO: 414496 - DNA, 25 bp, Mus musculus
gaacagcaccagtagcagatcaact

SEQ ID NO: 414497 - DNA, 25 bp, Mus musculus
gaacagcacctgcaggaccgtggac

SEQ ID NO: 414498 - DNA, 25 bp, Mus musculus
gaacagcacctggaggaccgtggac

SEQ ID NO: 414499 - DNA, 25 bp, Mus musculus
gaacagcacggcagtggccctggct

SEQ ID NO: 414500 - DNA, 25 bp, Mus musculus
gaacagcacggctgtggccctggct

SEQ ID NO: 414501 - DNA, 25 bp, Mus musculus
gaacagcacggtcaatatcgcctca

SEQ ID NO: 414502 - DNA, 25 bp, Mus musculus
gaacagcacggtgaatatcgcctca

SEQ ID NO: 414503 - DNA, 25 bp, Mus musculus
gaacagcactatctttgatgagctg

SEQ ID NO: 414504 - DNA, 25 bp, Mus musculus
gaacagcactatgtttgatgagctg

SEQ ID NO: 414505 - DNA, 25 bp, Mus musculus
gaacagcactgcactctctgaggga

SEQ ID NO: 414506 - DNA, 25 bp, Mus musculus
gaacagcactgctctctctgaggga

SEQ ID NO: 414507 - DNA, 25 bp, Mus musculus
gaacagcactgtattagagacccat

SEQ ID NO: 414508 - DNA, 25 bp, Mus musculus
gaacagcactgttttagagacccat

SEQ ID NO: 414509 - DNA, 25 bp, Mus musculus
gaacagcagatgaggtcagcagtca

SEQ ID NO: 414510 - DNA, 25 bp, Mus musculus
gaacagcagatgtggtcagcagtca

SEQ ID NO: 414511 - DNA, 25 bp, Mus musculus
gaacagcagcaaccctatcatcgtc

SEQ ID NO: 414512 - DNA, 25 bp, Mus musculus
gaacagcagcaagcctatcatcgtc

SEQ ID NO: 414513 - DNA, 25 bp, Mus musculus
gaacagcagcagaagtcacatttag

SEQ ID NO: 414514 - DNA, 25 bp, Mus musculus
gaacagcagcagaatgtgtacagga

SEQ ID NO: 414515 - DNA, 25 bp, Mus musculus
gaacagcagcagtagtcacatttag

SEQ ID NO: 414516 - DNA, 25 bp, Mus musculus
gaacagcagcagtatgtgtacagga

SEQ ID NO: 414517 - DNA, 25 bp, Mus musculus
gaacagcagcataagacagggataa

SEQ ID NO: 414518 - DNA, 25 bp, Mus musculus
gaacagcagcattagacagggataa

SEQ ID NO: 414519 - DNA, 25 bp, Mus musculus
gaacagcagccaacggccaggagca

SEQ ID NO: 414520 - DNA, 25 bp, Mus musculus
gaacagcagccaccctattaactgt

SEQ ID NO: 414521 - DNA, 25 bp, Mus musculus
gaacagcagccagcctattaactgt

SEQ ID NO: 414522 - DNA, 25 bp, Mus musculus
gaacagcagccatcggccaggagca

SEQ ID NO: 414523 - DNA, 25 bp, Mus musculus
gaacagcagcgccaagcccaggagc

SEQ ID NO: 414524 - DNA, 25 bp, Mus musculus
gaacagcagcgcgaagcccaggagc

SEQ ID NO: 414525 - DNA, 25 bp, Mus musculus
gaacagcagcggctgtttcagctgt

SEQ ID NO: 414526 - DNA, 25 bp, Mus musculus
gaacagcagcgggtgtttcagctgt

SEQ ID NO: 414527 - DNA, 25 bp, Mus musculus
gaacagcaggaaccagtaccaccag

SEQ ID NO: 414528 - DNA, 25 bp, Mus musculus
gaacagcaggaagcagtaccaccag

SEQ ID NO: 414529 - DNA, 25 bp, Mus musculus
gaacagcaggatcgcagggactcaa

SEQ ID NO: 414530 - DNA, 25 bp, Mus musculus
gaacagcaggatggcagggactcaa

SEQ ID NO: 414531 - DNA, 25 bp, Mus musculus
gaacagcagtatacacagccttttt

SEQ ID NO: 414532 - DNA, 25 bp, Mus musculus
gaacagcagtattcacagccttttt

SEQ ID NO: 414533 - DNA, 25 bp, Mus musculus
gaacagcatcatccttcttagcatc

SEQ ID NO: 414534 - DNA, 25 bp, Mus musculus
gaacagcatcatgcttcttagcatc

SEQ ID NO: 414535 - DNA, 25 bp, Mus musculus
gaacagcatccgctacgagaatatg

SEQ ID NO: 414536 - DNA, 25 bp, Mus musculus
gaacagcatccggtacgagaatatg

SEQ ID NO: 414537 - DNA, 25 bp, Mus musculus
gaacagcatcttacaggcttgagga

SEQ ID NO: 414538 - DNA, 25 bp, Mus musculus
gaacagcatcttcagatttccctat

SEQ ID NO: 414539 - DNA, 25 bp, Mus musculus
gaacagcatcttgagatttccctat

SEQ ID NO: 414540 - DNA, 25 bp, Mus musculus
gaacagcatctttcaggcttgagga

SEQ ID NO: 414541 - DNA, 25 bp, Mus musculus
gaacagcatggtcttttgcttcagt

SEQ ID NO: 414542 - DNA, 25 bp, Mus musculus
gaacagcatggtgttttgcttcagt

SEQ ID NO: 414543 - DNA, 25 bp, Mus musculus
gaacagcattgcctacctggatgag

SEQ ID NO: 414544 - DNA, 25 bp, Mus musculus
gaacagcattgcgtacctggatgag

SEQ ID NO: 414545 - DNA, 25 bp, Mus musculus
gaacagcattttaaggctcatgtaa

SEQ ID NO: 414546 - DNA, 25 bp, Mus musculus
gaacagcattttccttcactaaacc

SEQ ID NO: 414547 - DNA, 25 bp, Mus musculus
gaacagcattttgcttcactaaacc

SEQ ID NO: 414548 - DNA, 25 bp, Mus musculus
gaacagcatttttaggctcatgtaa

SEQ ID NO: 414549 - DNA, 25 bp, Mus musculus
gaacagccaagaaacaagaatttac

SEQ ID NO: 414550 - DNA, 25 bp, Mus musculus
gaacagccaagatacaagaatttac

SEQ ID NO: 414551 - DNA, 25 bp, Mus musculus
gaacagccacggatgcttagagctt

SEQ ID NO: 414552 - DNA, 25 bp, Mus musculus
gaacagccacggttgcttagagctt

SEQ ID NO: 414553 - DNA, 25 bp, Mus musculus
gaacagccagaaaatgctcaatata

SEQ ID NO: 414554 - DNA, 25 bp, Mus musculus
gaacagccagaatatgctcaatata

SEQ ID NO: 414555 - DNA, 25 bp, Mus musculus
gaacagccagagatgattcaacagt

SEQ ID NO: 414556 - DNA, 25 bp, Mus musculus
gaacagccagagttgattcaacagt

SEQ ID NO: 414557 - DNA, 25 bp, Mus musculus
gaacagccagcaagtcatcaaatag

SEQ ID NO: 414558 - DNA, 25 bp, Mus musculus
gaacagccagcatgtcatcaaatag

SEQ ID NO: 414559 - DNA, 25 bp, Mus musculus
gaacagccagggaatggaccagagt

SEQ ID NO: 414560 - DNA, 25 bp, Mus musculus
gaacagccagggtatggaccagagt

SEQ ID NO: 414561 - DNA, 25 bp, Mus musculus
gaacagccaggtctactgtgccaag

SEQ ID NO: 414562 - DNA, 25 bp, Mus musculus
gaacagccaggtgtactgtgccaag

SEQ ID NO: 414563 - DNA, 25 bp, Mus musculus
gaacagccagtcctacgaggagatg

SEQ ID NO: 414564 - DNA, 25 bp, Mus musculus
gaacagccagtcgtacgaggagatg

SEQ ID NO: 414565 - DNA, 25 bp, Mus musculus
gaacagccagtgaaaatgctagttg

SEQ ID NO: 414566 - DNA, 25 bp, Mus musculus
gaacagccagtgtaaatgctagttg

SEQ ID NO: 414567 - DNA, 25 bp, Mus musculus
gaacagccatgccttccaaaagcta

SEQ ID NO: 414568 - DNA, 25 bp, Mus musculus
gaacagccatgcgttccaaaagcta

SEQ ID NO: 414569 - DNA, 25 bp, Mus musculus
gaacagcccactctactgagcatgg

SEQ ID NO: 414570 - DNA, 25 bp, Mus musculus
gaacagcccactgtactgagcatgg

SEQ ID NO: 414571 - DNA, 25 bp, Mus musculus
gaacagcccatcaaccagcagaatg

SEQ ID NO: 414572 - DNA, 25 bp, Mus musculus
gaacagcccatctaccagcagaatg

SEQ ID NO: 414573 - DNA, 25 bp, Mus musculus
gaacagcccatgaggacagcagtca

SEQ ID NO: 414574 - DNA, 25 bp, Mus musculus
gaacagcccatgtggacagcagtca

SEQ ID NO: 414575 - DNA, 25 bp, Mus musculus
gaacagcccattccagatacagttt

SEQ ID NO: 414576 - DNA, 25 bp, Mus musculus
gaacagcccattgcagatacagttt

SEQ ID NO: 414577 - DNA, 25 bp, Mus musculus
gaacagcccttaatcaatgtgcaaa

SEQ ID NO: 414578 - DNA, 25 bp, Mus musculus
gaacagcccttattcaatgtgcaaa

SEQ ID NO: 414579 - DNA, 25 bp, Mus musculus
gaacagcccttccagagcagtcaga

SEQ ID NO: 414580 - DNA, 25 bp, Mus musculus
gaacagcccttcgagagcagtcaga

SEQ ID NO: 414581 - DNA, 25 bp, Mus musculus
gaacagccgtttacaggtccagcat

SEQ ID NO: 414582 - DNA, 25 bp, Mus musculus
gaacagccgttttcaggtccagcat

SEQ ID NO: 414583 - DNA, 25 bp, Mus musculus
gaacagcctatgattaattcttggg

SEQ ID NO: 414584 - DNA, 25 bp, Mus musculus
gaacagcctatgtttaattcttggg

SEQ ID NO: 414585 - DNA, 25 bp, Mus musculus
gaacagcctcctaacattatggcaa

SEQ ID NO: 414586 - DNA, 25 bp, Mus musculus
gaacagcctccttacattatggcaa

SEQ ID NO: 414587 - DNA, 25 bp, Mus musculus
gaacagcctcttccacatggaggat

SEQ ID NO: 414588 - DNA, 25 bp, Mus musculus
gaacagcctcttgcacatggaggat

SEQ ID NO: 414589 - DNA, 25 bp, Mus musculus
gaacagcctgagaagtcactttgga

SEQ ID NO: 414590 - DNA, 25 bp, Mus musculus
gaacagcctgagtagtcactttgga

SEQ ID NO: 414591 - DNA, 25 bp, Mus musculus
gaacagcctgccctggcgcaccctg

SEQ ID NO: 414592 - DNA, 25 bp, Mus musculus
gaacagcctgccgtggcgcaccctg

SEQ ID NO: 414593 - DNA, 25 bp, Mus musculus
gaacagcctggaagtctcgaagatg

SEQ ID NO: 414594 - DNA, 25 bp, Mus musculus
gaacagcctggatgtctcgaagatg

SEQ ID NO: 414595 - DNA, 25 bp, Mus musculus
gaacagcctggcactagtatgtaag

SEQ ID NO: 414596 - DNA, 25 bp, Mus musculus
gaacagcctggctctagtatgtaag

SEQ ID NO: 414597 - DNA, 25 bp, Mus musculus
gaacagcctgggacaccacgccaag

SEQ ID NO: 414598 - DNA, 25 bp, Mus musculus
gaacagcctgggtcaccacgccaag

SEQ ID NO: 414599 - DNA, 25 bp, Mus musculus
gaacagcctgtcaatgggactttat

SEQ ID NO: 414600 - DNA, 25 bp, Mus musculus
gaacagcctgtctatgggactttat

SEQ ID NO: 414601 - DNA, 25 bp, Mus musculus
gaacagccttaaacattccagtttg

SEQ ID NO: 414602 - DNA, 25 bp, Mus musculus
gaacagccttaatcattccagtttg

SEQ ID NO: 414603 - DNA, 25 bp, Mus musculus
gaacagccttttccatctgaggcga

SEQ ID NO: 414604 - DNA, 25 bp, Mus musculus
gaacagccttttgcatctgaggcga

SEQ ID NO: 414605 - DNA, 25 bp, Mus musculus
gaacagcgaaaaacggtcacctatg

SEQ ID NO: 414606 - DNA, 25 bp, Mus musculus
gaacagcgaaaatcggtcacctatg

SEQ ID NO: 414607 - DNA, 25 bp, Mus musculus
gaacagcgaattcggtcctggacca

SEQ ID NO: 414608 - DNA, 25 bp, Mus musculus
gaacagcgaattgggtcctggacca

SEQ ID NO: 414609 - DNA, 25 bp, Mus musculus
gaacagcgacagagttttcatatac

SEQ ID NO: 414610 - DNA, 25 bp, Mus musculus
gaacagcgacagtgttttcatatac

SEQ ID NO: 414611 - DNA, 25 bp, Mus musculus
gaacagcgactgctacatgaagcag

SEQ ID NO: 414612 - DNA, 25 bp, Mus musculus
gaacagcgactggtacatgaagcag

SEQ ID NO: 414613 - DNA, 25 bp, Mus musculus
gaacagcgagccagtgaaacaccca

SEQ ID NO: 414614 - DNA, 25 bp, Mus musculus
gaacagcgagcctgtgaaacaccca

SEQ ID NO: 414615 - DNA, 25 bp, Mus musculus
gaacagcgggacaatgtcttctacc

SEQ ID NO: 414616 - DNA, 25 bp, Mus musculus
gaacagcgggactatgtcttctacc

SEQ ID NO: 414617 - DNA, 25 bp, Mus musculus
gaacagcgtaggatcgctcgtaacc

SEQ ID NO: 414618 - DNA, 25 bp, Mus musculus
gaacagcgtaggttcgctcgtaacc

SEQ ID NO: 414619 - DNA, 25 bp, Mus musculus
gaacagcgtatgaaccacacagtga

SEQ ID NO: 414620 - DNA, 25 bp, Mus musculus
gaacagcgtatgtaccacacagtga

SEQ ID NO: 414621 - DNA, 25 bp, Mus musculus
gaacagcgttttcattcgaacctcg

SEQ ID NO: 414622 - DNA, 25 bp, Mus musculus
gaacagcgttttgattcgaacctcg

SEQ ID NO: 414623 - DNA, 25 bp, Mus musculus
gaacagctaagcagcggcttcttct

SEQ ID NO: 414624 - DNA, 25 bp, Mus musculus
gaacagctaagctgcggcttcttct

SEQ ID NO: 414625 - DNA, 25 bp, Mus musculus
gaacagctaataattttctggcagc

SEQ ID NO: 414626 - DNA, 25 bp, Mus musculus
gaacagctaatatttttctggcagc

SEQ ID NO: 414627 - DNA, 25 bp, Mus musculus
gaacagctacgacatagaccaggga

SEQ ID NO: 414628 - DNA, 25 bp, Mus musculus
gaacagctacgagatagaccaggga

SEQ ID NO: 414629 - DNA, 25 bp, Mus musculus
gaacagctagaacacagccatgtgg

SEQ ID NO: 414630 - DNA, 25 bp, Mus musculus
gaacagctagaagacagccatgtgg

SEQ ID NO: 414631 - DNA, 25 bp, Mus musculus
gaacagctaggaacaccatccgcag

SEQ ID NO: 414632 - DNA, 25 bp, Mus musculus
gaacagctaggatcaccatccgcag

SEQ ID NO: 414633 - DNA, 25 bp, Mus musculus
gaacagctaggcataccgatgtatt

SEQ ID NO: 414634 - DNA, 25 bp, Mus musculus
gaacagctaggcttaccgatgtatt

SEQ ID NO: 414635 - DNA, 25 bp, Mus musculus
gaacagctatatatagatatccctg

SEQ ID NO: 414636 - DNA, 25 bp, Mus musculus
gaacagctatatttagatatccctg

SEQ ID NO: 414637 - DNA, 25 bp, Mus musculus
gaacagctcaggaggttagttacca

SEQ ID NO: 414638 - DNA, 25 bp, Mus musculus
gaacagctcaggtggttagttacca

SEQ ID NO: 414639 - DNA, 25 bp, Mus musculus
gaacagctcagtcgcaaggaacctt

SEQ ID NO: 414640 - DNA, 25 bp, Mus musculus
gaacagctcagtggcaaggaacctt

SEQ ID NO: 414641 - DNA, 25 bp, Mus musculus
gaacagctccaactgactttgccat

SEQ ID NO: 414642 - DNA, 25 bp, Mus musculus
gaacagctccaagtgactttgccat

SEQ ID NO: 414643 - DNA, 25 bp, Mus musculus
gaacagctccatctctctggatgag

SEQ ID NO: 414644 - DNA, 25 bp, Mus musculus
gaacagctccatgtctctggatgag

SEQ ID NO: 414645 - DNA, 25 bp, Mus musculus
gaacagctcgggattgagttttttg

SEQ ID NO: 414646 - DNA, 25 bp, Mus musculus
gaacagctcgggtttgagttttttg

SEQ ID NO: 414647 - DNA, 25 bp, Mus musculus
gaacagctctcgctgttgactgcat

SEQ ID NO: 414648 - DNA, 25 bp, Mus musculus
gaacagctctcggtgttgactgcat

SEQ ID NO: 414649 - DNA, 25 bp, Mus musculus
gaacagctctctatgtaaatcagta

SEQ ID NO: 414650 - DNA, 25 bp, Mus musculus
gaacagctctctttgtaaatcagta

SEQ ID NO: 414651 - DNA, 25 bp, Mus musculus
gaacagctctgacatcctggagtga

SEQ ID NO: 414652 - DNA, 25 bp, Mus musculus
gaacagctctgacatgatgcctgcc

SEQ ID NO: 414653 - DNA, 25 bp, Mus musculus
gaacagctctgagatcctggagtga

SEQ ID NO: 414654 - DNA, 25 bp, Mus musculus
gaacagctctgagatgatgcctgcc

SEQ ID NO: 414655 - DNA, 25 bp, Mus musculus
gaacagctctgcatagtggtttgga

SEQ ID NO: 414656 - DNA, 25 bp, Mus musculus
gaacagctctgcttagtggtttgga

SEQ ID NO: 414657 - DNA, 25 bp, Mus musculus
gaacagctctggacattccaaggac

SEQ ID NO: 414658 - DNA, 25 bp, Mus musculus
gaacagctctggatgttttcatgct

SEQ ID NO: 414659 - DNA, 25 bp, Mus musculus
gaacagctctggtcattccaaggac

SEQ ID NO: 414660 - DNA, 25 bp, Mus musculus
gaacagctctggttgttttcatgct

SEQ ID NO: 414661 - DNA, 25 bp, Mus musculus
gaacagctctgtatgtttacattgt

SEQ ID NO: 414662 - DNA, 25 bp, Mus musculus
gaacagctctgtttgtttacattgt

SEQ ID NO: 414663 - DNA, 25 bp, Mus musculus
gaacagctgaaaagcatttctctgt

SEQ ID NO: 414664 - DNA, 25 bp, Mus musculus
gaacagctgaaatgcatttctctgt

SEQ ID NO: 414665 - DNA, 25 bp, Mus musculus
gaacagctgacacctgcgggagttt

SEQ ID NO: 414666 - DNA, 25 bp, Mus musculus
gaacagctgacagctgcgggagttt

SEQ ID NO: 414667 - DNA, 25 bp, Mus musculus
gaacagctgatgaaggcaccaagtc

SEQ ID NO: 414668 - DNA, 25 bp, Mus musculus
gaacagctgatgtaggcaccaagtc

SEQ ID NO: 414669 - DNA, 25 bp, Mus musculus
gaacagctgattagccatgtaattt

SEQ ID NO: 414670 - DNA, 25 bp, Mus musculus
gaacagctgatttgccatgtaattt

SEQ ID NO: 414671 - DNA, 25 bp, Mus musculus
gaacagctgcacataacatggccat

SEQ ID NO: 414672 - DNA, 25 bp, Mus musculus
gaacagctgcacttaacatggccat

SEQ ID NO: 414673 - DNA, 25 bp, Mus musculus
gaacagctgcctaaagttcctgctg

SEQ ID NO: 414674 - DNA, 25 bp, Mus musculus
gaacagctgccttaagttcctgctg

SEQ ID NO: 414675 - DNA, 25 bp, Mus musculus
gaacagctggatccaatgagtttgc

SEQ ID NO: 414676 - DNA, 25 bp, Mus musculus
gaacagctggatgcaatgagtttgc

SEQ ID NO: 414677 - DNA, 25 bp, Mus musculus
gaacagctgtcaaccaggccaggag

SEQ ID NO: 414678 - DNA, 25 bp, Mus musculus
gaacagctgtcaagcagctcgggaa

SEQ ID NO: 414679 - DNA, 25 bp, Mus musculus
gaacagctgtcatccaggccaggag

SEQ ID NO: 414680 - DNA, 25 bp, Mus musculus
gaacagctgtcatgcagctcgggaa

SEQ ID NO: 414681 - DNA, 25 bp, Mus musculus
gaacagctgtgcactggtcttgatt

SEQ ID NO: 414682 - DNA, 25 bp, Mus musculus
gaacagctgtgctctggtcttgatt

SEQ ID NO: 414683 - DNA, 25 bp, Mus musculus
gaacagctgtgtcactttgctttta

SEQ ID NO: 414684 - DNA, 25 bp, Mus musculus
gaacagctgtgtgactttgctttta

SEQ ID NO: 414685 - DNA, 25 bp, Mus musculus
gaacagctgttgacttttcaggtag

SEQ ID NO: 414686 - DNA, 25 bp, Mus musculus
gaacagctgttgtcttttcaggtag

SEQ ID NO: 414687 - DNA, 25 bp, Mus musculus
gaacagctgtttcccacagctgggt

SEQ ID NO: 414688 - DNA, 25 bp, Mus musculus
gaacagctgtttgccacagctgggt

SEQ ID NO: 414689 - DNA, 25 bp, Mus musculus
gaacagcttagcacacttcctggat

SEQ ID NO: 414690 - DNA, 25 bp, Mus musculus
gaacagcttagctcacttcctggat

SEQ ID NO: 414691 - DNA, 25 bp, Mus musculus
gaacagcttccgaccatgggatgat

SEQ ID NO: 414692 - DNA, 25 bp, Mus musculus
gaacagcttccgtccatgggatgat

SEQ ID NO: 414693 - DNA, 25 bp, Mus musculus
gaacagcttcgaaactctggtgcat

SEQ ID NO: 414694 - DNA, 25 bp, Mus musculus
gaacagcttcgatactctggtgcat

SEQ ID NO: 414695 - DNA, 25 bp, Mus musculus
gaacagcttcgtcgtttaatgccta

SEQ ID NO: 414696 - DNA, 25 bp, Mus musculus
gaacagcttcgtggtttaatgccta

SEQ ID NO: 414697 - DNA, 25 bp, Mus musculus
gaacagcttgagagtggcccaggtc

SEQ ID NO: 414698 - DNA, 25 bp, Mus musculus
gaacagcttgagtgtggcccaggtc

SEQ ID NO: 414699 - DNA, 25 bp, Mus musculus
gaacagcttgttcagaacttgcatt

SEQ ID NO: 414700 - DNA, 25 bp, Mus musculus
gaacagcttgttgagaacttgcatt

SEQ ID NO: 414701 - DNA, 25 bp, Mus musculus
gaacaggaaactactgccaactgct

SEQ ID NO: 414702 - DNA, 25 bp, Mus musculus
gaacaggaaacttctgccaactgct

SEQ ID NO: 414703 - DNA, 25 bp, Mus musculus
gaacaggaacatcaattttacaagt

SEQ ID NO: 414704 - DNA, 25 bp, Mus musculus
gaacaggaacatgaattttacaagt

SEQ ID NO: 414705 - DNA, 25 bp, Mus musculus
gaacaggaaccaccccctttgtgag

SEQ ID NO: 414706 - DNA, 25 bp, Mus musculus
gaacaggaaccagcccctttgtgag

SEQ ID NO: 414707 - DNA, 25 bp, Mus musculus
gaacaggaacccagctgagggctcc

SEQ ID NO: 414708 - DNA, 25 bp, Mus musculus
gaacaggaaccctgctgagggctcc

SEQ ID NO: 414709 - DNA, 25 bp, Mus musculus
gaacaggaactaacgctgccagcac

SEQ ID NO: 414710 - DNA, 25 bp, Mus musculus
gaacaggaactatcgctgccagcac

SEQ ID NO: 414711 - DNA, 25 bp, Mus musculus
gaacaggaactgaagacacaattat

SEQ ID NO: 414712 - DNA, 25 bp, Mus musculus
gaacaggaactgtagacacaattat

SEQ ID NO: 414713 - DNA, 25 bp, Mus musculus
gaacaggacactatgtggaccagca

SEQ ID NO: 414714 - DNA, 25 bp, Mus musculus
gaacaggacactttgtggaccagca

SEQ ID NO: 414715 - DNA, 25 bp, Mus musculus
gaacaggacagacatgatctcccct

SEQ ID NO: 414716 - DNA, 25 bp, Mus musculus
gaacaggacagagatgatctcccct

SEQ ID NO: 414717 - DNA, 25 bp, Mus musculus
gaacaggaccctcgaaacctgaact

SEQ ID NO: 414718 - DNA, 25 bp, Mus musculus
gaacaggaccctggaaacctgaact

SEQ ID NO: 414719 - DNA, 25 bp, Mus musculus
gaacaggacctacttttgcctgttt

SEQ ID NO: 414720 - DNA, 25 bp, Mus musculus
gaacaggacctagttttgcctgttt

SEQ ID NO: 414721 - DNA, 25 bp, Mus musculus
gaacaggacctgaaccacgaggccg

SEQ ID NO: 414722 - DNA, 25 bp, Mus musculus
gaacaggacctgtaccacgaggccg

SEQ ID NO: 414723 - DNA, 25 bp, Mus musculus
gaacaggactaccaggaagccttag

SEQ ID NO: 414724 - DNA, 25 bp, Mus musculus
gaacaggactacgaggaagccttag

SEQ ID NO: 414725 - DNA, 25 bp, Mus musculus
gaacaggagagcatcattcagcaat

SEQ ID NO: 414726 - DNA, 25 bp, Mus musculus
gaacaggagagcttcattcagcaat

SEQ ID NO: 414727 - DNA, 25 bp, Mus musculus
gaacaggaggtcatccgattccaaa

SEQ ID NO: 414728 - DNA, 25 bp, Mus musculus
gaacaggaggtcttccgattccaaa

SEQ ID NO: 414729 - DNA, 25 bp, Mus musculus
gaacaggagttactggctgagcctc

SEQ ID NO: 414730 - DNA, 25 bp, Mus musculus
gaacaggagttagtggctgagcctc

SEQ ID NO: 414731 - DNA, 25 bp, Mus musculus
gaacaggatatcaacctcaaggttt

SEQ ID NO: 414732 - DNA, 25 bp, Mus musculus
gaacaggatatctacctcaaggttt

SEQ ID NO: 414733 - DNA, 25 bp, Mus musculus
gaacaggatcaacttttcacctcca

SEQ ID NO: 414734 - DNA, 25 bp, Mus musculus
gaacaggatcaagttttcacctcca

SEQ ID NO: 414735 - DNA, 25 bp, Mus musculus
gaacaggatgtccacatgcacgacc

SEQ ID NO: 414736 - DNA, 25 bp, Mus musculus
gaacaggatgtcgacatgcacgacc

SEQ ID NO: 414737 - DNA, 25 bp, Mus musculus
gaacaggcaacaactctagagcaat

SEQ ID NO: 414738 - DNA, 25 bp, Mus musculus
gaacaggcaacatctctagagcaat

SEQ ID NO: 414739 - DNA, 25 bp, Mus musculus
gaacaggcacttcgcagagacactt

SEQ ID NO: 414740 - DNA, 25 bp, Mus musculus
gaacaggcacttggcagagacactt

SEQ ID NO: 414741 - DNA, 25 bp, Mus musculus
gaacaggcagatcttttggtcctaa

SEQ ID NO: 414742 - DNA, 25 bp, Mus musculus
gaacaggcagatgttttggtcctaa

SEQ ID NO: 414743 - DNA, 25 bp, Mus musculus
gaacaggcagctatgtcccttatga

SEQ ID NO: 414744 - DNA, 25 bp, Mus musculus
gaacaggcagctttgtcccttatga

SEQ ID NO: 414745 - DNA, 25 bp, Mus musculus
gaacaggcatttagtgacaacccac

SEQ ID NO: 414746 - DNA, 25 bp, Mus musculus
gaacaggcattttgtgacaacccac

SEQ ID NO: 414747 - DNA, 25 bp, Mus musculus
gaacaggccaccctaagactaaagt

SEQ ID NO: 414748 - DNA, 25 bp, Mus musculus
gaacaggccaccgtaagactaaagt

SEQ ID NO: 414749 - DNA, 25 bp, Mus musculus
gaacaggccatcattttaagtgaga

SEQ ID NO: 414750 - DNA, 25 bp, Mus musculus
gaacaggccatctttttaagtgaga

SEQ ID NO: 414751 - DNA, 25 bp, Mus musculus
gaacaggccctacagaactggagat

SEQ ID NO: 414752 - DNA, 25 bp, Mus musculus
gaacaggccctagagaactggagat

SEQ ID NO: 414753 - DNA, 25 bp, Mus musculus
gaacaggccgagaacgctcaggaca

SEQ ID NO: 414754 - DNA, 25 bp, Mus musculus
gaacaggccgagtacgctcaggaca

SEQ ID NO: 414755 - DNA, 25 bp, Mus musculus
gaacaggcctgaaattccatcactc

SEQ ID NO: 414756 - DNA, 25 bp, Mus musculus
gaacaggcctgatattccatcactc

SEQ ID NO: 414757 - DNA, 25 bp, Mus musculus
gaacaggcggccctgggactactcc

SEQ ID NO: 414758 - DNA, 25 bp, Mus musculus
gaacaggcggccgtgggactactcc

SEQ ID NO: 414759 - DNA, 25 bp, Mus musculus
gaacaggcggtcactatgccaacca

SEQ ID NO: 414760 - DNA, 25 bp, Mus musculus
gaacaggcggtctctatgccaacca

SEQ ID NO: 414761 - DNA, 25 bp, Mus musculus
gaacaggcgtggctatttctagtgt

SEQ ID NO: 414762 - DNA, 25 bp, Mus musculus
gaacaggcgtgggtatttctagtgt

SEQ ID NO: 414763 - DNA, 25 bp, Mus musculus
gaacaggctactctgctatgagccc

SEQ ID NO: 414764 - DNA, 25 bp, Mus musculus
gaacaggctactgtgctatgagccc

SEQ ID NO: 414765 - DNA, 25 bp, Mus musculus
gaacaggctccaagttaccaagctg

SEQ ID NO: 414766 - DNA, 25 bp, Mus musculus
gaacaggctccatgttaccaagctg

SEQ ID NO: 414767 - DNA, 25 bp, Mus musculus
gaacaggctccgactgggatgcagt

SEQ ID NO: 414768 - DNA, 25 bp, Mus musculus
gaacaggctccgtctgggatgcagt

SEQ ID NO: 414769 - DNA, 25 bp, Mus musculus
gaacaggctcgcagtgttcactggg

SEQ ID NO: 414770 - DNA, 25 bp, Mus musculus
gaacaggctcgctgtgttcactggg

SEQ ID NO: 414771 - DNA, 25 bp, Mus musculus
gaacaggctgagctatcagtcctac

SEQ ID NO: 414772 - DNA, 25 bp, Mus musculus
gaacaggctgaggtatcagtcctac

SEQ ID NO: 414773 - DNA, 25 bp, Mus musculus
gaacaggctgcacatctttttaatg

SEQ ID NO: 414774 - DNA, 25 bp, Mus musculus
gaacaggctgcagatctttttaatg

SEQ ID NO: 414775 - DNA, 25 bp, Mus musculus
gaacaggctgctaagaacttggtgt

SEQ ID NO: 414776 - DNA, 25 bp, Mus musculus
gaacaggctgcttagaacttggtgt

SEQ ID NO: 414777 - DNA, 25 bp, Mus musculus
gaacaggctggcaccataccgcaga

SEQ ID NO: 414778 - DNA, 25 bp, Mus musculus
gaacaggctggctccataccgcaga

SEQ ID NO: 414779 - DNA, 25 bp, Mus musculus
gaacaggctgttagttcatggtccc

SEQ ID NO: 414780 - DNA, 25 bp, Mus musculus
gaacaggctgtttgttcatggtccc

SEQ ID NO: 414781 - DNA, 25 bp, Mus musculus
gaacaggcttctaaagtatccaaga

SEQ ID NO: 414782 - DNA, 25 bp, Mus musculus
gaacaggcttctaactgggctctta

SEQ ID NO: 414783 - DNA, 25 bp, Mus musculus
gaacaggcttcttaagtatccaaga

SEQ ID NO: 414784 - DNA, 25 bp, Mus musculus
gaacaggcttcttactgggctctta

SEQ ID NO: 414785 - DNA, 25 bp, Mus musculus
gaacaggctttgaaaacatacccag

SEQ ID NO: 414786 - DNA, 25 bp, Mus musculus
gaacaggctttgtaaacatacccag

SEQ ID NO: 414787 - DNA, 25 bp, Mus musculus
gaacagggaaagagccagccgtcta

SEQ ID NO: 414788 - DNA, 25 bp, Mus musculus
gaacagggaaagtgccagccgtcta

SEQ ID NO: 414789 - DNA, 25 bp, Mus musculus
gaacagggaactccgtcagtgcaac

SEQ ID NO: 414790 - DNA, 25 bp, Mus musculus
gaacagggaactgcgtcagtgcaac

SEQ ID NO: 414791 - DNA, 25 bp, Mus musculus
gaacagggaagacaccaccacaact

SEQ ID NO: 414792 - DNA, 25 bp, Mus musculus
gaacagggaagagaccaccacaact

SEQ ID NO: 414793 - DNA, 25 bp, Mus musculus
gaacagggaagcatcctactcggga

SEQ ID NO: 414794 - DNA, 25 bp, Mus musculus
gaacagggaagcttcctactcggga

SEQ ID NO: 414795 - DNA, 25 bp, Mus musculus
gaacagggaatcatctcaactatgg

SEQ ID NO: 414796 - DNA, 25 bp, Mus musculus
gaacagggaatcttctcaactatgg

SEQ ID NO: 414797 - DNA, 25 bp, Mus musculus
gaacagggaatgactcatccatttt

SEQ ID NO: 414798 - DNA, 25 bp, Mus musculus
gaacagggaatgtctcatccatttt

SEQ ID NO: 414799 - DNA, 25 bp, Mus musculus
gaacagggacccatggctgaggcac

SEQ ID NO: 414800 - DNA, 25 bp, Mus musculus
gaacagggacccttggctgaggcac

SEQ ID NO: 414801 - DNA, 25 bp, Mus musculus
gaacagggacctccatgcctccaag

SEQ ID NO: 414802 - DNA, 25 bp, Mus musculus
gaacagggacctgcatgcctccaag

SEQ ID NO: 414803 - DNA, 25 bp, Mus musculus
gaacagggacgtacgttgccctgga

SEQ ID NO: 414804 - DNA, 25 bp, Mus musculus
gaacagggacgttcgttgccctgga

SEQ ID NO: 414805 - DNA, 25 bp, Mus musculus
gaacagggccctagaagatgtttgt

SEQ ID NO: 414806 - DNA, 25 bp, Mus musculus
gaacagggcccttgaagatgtttgt

SEQ ID NO: 414807 - DNA, 25 bp, Mus musculus
gaacagggcctaaatcttatacttt

SEQ ID NO: 414808 - DNA, 25 bp, Mus musculus
gaacagggcctatatcttatacttt

SEQ ID NO: 414809 - DNA, 25 bp, Mus musculus
gaacagggctccatttagataggta

SEQ ID NO: 414810 - DNA, 25 bp, Mus musculus
gaacagggctccttttagataggta

SEQ ID NO: 414811 - DNA, 25 bp, Mus musculus
gaacagggctgcattgaagagttat

SEQ ID NO: 414812 - DNA, 25 bp, Mus musculus
gaacagggctgctttgaagagttat

SEQ ID NO: 414813 - DNA, 25 bp, Mus musculus
gaacagggcttgagggcacgctctt

SEQ ID NO: 414814 - DNA, 25 bp, Mus musculus
gaacagggcttgcaggttatagctt

SEQ ID NO: 414815 - DNA, 25 bp, Mus musculus
gaacagggcttggaggttatagctt

SEQ ID NO: 414816 - DNA, 25 bp, Mus musculus
gaacagggcttgtgggcacgctctt

SEQ ID NO: 414817 - DNA, 25 bp, Mus musculus
gaacaggggtacatggctagcacca

SEQ ID NO: 414818 - DNA, 25 bp, Mus musculus
gaacaggggtacttggctagcacca

SEQ ID NO: 414819 - DNA, 25 bp, Mus musculus
gaacagggtaagagcacaacaaaga

SEQ ID NO: 414820 - DNA, 25 bp, Mus musculus
gaacagggtaagtgcacaacaaaga

SEQ ID NO: 414821 - DNA, 25 bp, Mus musculus
gaacagggtcacattgactctaagt

SEQ ID NO: 414822 - DNA, 25 bp, Mus musculus
gaacagggtcactttgactctaagt

SEQ ID NO: 414823 - DNA, 25 bp, Mus musculus
gaacagggtccacaacatggctctt

SEQ ID NO: 414824 - DNA, 25 bp, Mus musculus
gaacagggtccagaacatggctctt

SEQ ID NO: 414825 - DNA, 25 bp, Mus musculus
gaacagggtctcacatctatgcagg

SEQ ID NO: 414826 - DNA, 25 bp, Mus musculus
gaacagggtctctcatctatgcagg

SEQ ID NO: 414827 - DNA, 25 bp, Mus musculus
gaacagggtctgaccagaagctgtg

SEQ ID NO: 414828 - DNA, 25 bp, Mus musculus
gaacagggtctgtccagaagctgtg

SEQ ID NO: 414829 - DNA, 25 bp, Mus musculus
gaacagggtgctattccacgactag

SEQ ID NO: 414830 - DNA, 25 bp, Mus musculus
gaacagggtgcttttccacgactag

SEQ ID NO: 414831 - DNA, 25 bp, Mus musculus
gaacagggtgtactctcattactag

SEQ ID NO: 414832 - DNA, 25 bp, Mus musculus
gaacagggtgtagtctcattactag

SEQ ID NO: 414833 - DNA, 25 bp, Mus musculus
gaacagggttcacacagcagggcta

SEQ ID NO: 414834 - DNA, 25 bp, Mus musculus
gaacagggttcagacagcagggcta

SEQ ID NO: 414835 - DNA, 25 bp, Mus musculus
gaacaggtaacaatcagtcccatgt

SEQ ID NO: 414836 - DNA, 25 bp, Mus musculus
gaacaggtaacattcagtcccatgt

SEQ ID NO: 414837 - DNA, 25 bp, Mus musculus
gaacaggtactccataagggcctca

SEQ ID NO: 414838 - DNA, 25 bp, Mus musculus
gaacaggtactcgataagggcctca

SEQ ID NO: 414839 - DNA, 25 bp, Mus musculus
gaacaggtaggacctatcctgccat

SEQ ID NO: 414840 - DNA, 25 bp, Mus musculus
gaacaggtaggagctatcctgccat

SEQ ID NO: 414841 - DNA, 25 bp, Mus musculus
gaacaggtatgtccttttccaaaag

SEQ ID NO: 414842 - DNA, 25 bp, Mus musculus
gaacaggtatgtgcttttccaaaag

SEQ ID NO: 414843 - DNA, 25 bp, Mus musculus
gaacaggtcattaagtggtcctaga

SEQ ID NO: 414844 - DNA, 25 bp, Mus musculus
gaacaggtcatttagtggtcctaga

SEQ ID NO: 414845 - DNA, 25 bp, Mus musculus
gaacaggtccagacactgaggcaaa

SEQ ID NO: 414846 - DNA, 25 bp, Mus musculus
gaacaggtccagtcactgaggcaaa

SEQ ID NO: 414847 - DNA, 25 bp, Mus musculus
gaacaggtcctacgtttcatatatg

SEQ ID NO: 414848 - DNA, 25 bp, Mus musculus
gaacaggtcctaggtttcatatatg

SEQ ID NO: 414849 - DNA, 25 bp, Mus musculus
gaacaggtcctgaggcctcccttga

SEQ ID NO: 414850 - DNA, 25 bp, Mus musculus
gaacaggtcctgtggcctcccttga

SEQ ID NO: 414851 - DNA, 25 bp, Mus musculus
gaacaggtcttaattgttccctaag

SEQ ID NO: 414852 - DNA, 25 bp, Mus musculus
gaacaggtcttatttgttccctaag

SEQ ID NO: 414853 - DNA, 25 bp, Mus musculus
gaacaggtgatgcactacactctgt

SEQ ID NO: 414854 - DNA, 25 bp, Mus musculus
gaacaggtgatggactacactctgt

SEQ ID NO: 414855 - DNA, 25 bp, Mus musculus
gaacaggtgcatactcccagaagca

SEQ ID NO: 414856 - DNA, 25 bp, Mus musculus
gaacaggtgcattctcccagaagca

SEQ ID NO: 414857 - DNA, 25 bp, Mus musculus
gaacaggtgctgagaagacatttgg

SEQ ID NO: 414858 - DNA, 25 bp, Mus musculus
gaacaggtgctgtgaagacatttgg

SEQ ID NO: 414859 - DNA, 25 bp, Mus musculus
gaacaggtggaacccatctgtccct

SEQ ID NO: 414860 - DNA, 25 bp, Mus musculus
gaacaggtggaagccatctgtccct

SEQ ID NO: 414861 - DNA, 25 bp, Mus musculus
gaacaggtggccatttagggctctc

SEQ ID NO: 414862 - DNA, 25 bp, Mus musculus
gaacaggtggccttttagggctctc

SEQ ID NO: 414863 - DNA, 25 bp, Mus musculus
gaacaggttaataccattgtatgac

SEQ ID NO: 414864 - DNA, 25 bp, Mus musculus
gaacaggttaattccattgtatgac

SEQ ID NO: 414865 - DNA, 25 bp, Mus musculus
gaacaggttactaacatacacacat

SEQ ID NO: 414866 - DNA, 25 bp, Mus musculus
gaacaggttacttacatacacacat

SEQ ID NO: 414867 - DNA, 25 bp, Mus musculus
gaacaggttctccatactagcaaag

SEQ ID NO: 414868 - DNA, 25 bp, Mus musculus
gaacaggttctcgatactagcaaag

SEQ ID NO: 414869 - DNA, 25 bp, Mus musculus
gaacaggttctgaaactccccaggc

SEQ ID NO: 414870 - DNA, 25 bp, Mus musculus
gaacaggttctgtaactccccaggc

SEQ ID NO: 414871 - DNA, 25 bp, Mus musculus
gaacaggttgaactccgcctgcatt

SEQ ID NO: 414872 - DNA, 25 bp, Mus musculus
gaacaggttgaagtccgcctgcatt

SEQ ID NO: 414873 - DNA, 25 bp, Mus musculus
gaacaggttgataactcctcacaca

SEQ ID NO: 414874 - DNA, 25 bp, Mus musculus
gaacaggttgattactcctcacaca

SEQ ID NO: 414875 - DNA, 25 bp, Mus musculus
gaacaggttgtaagattccattcaa

SEQ ID NO: 414876 - DNA, 25 bp, Mus musculus
gaacaggttgtatgattccattcaa

SEQ ID NO: 414877 - DNA, 25 bp, Mus musculus
gaacagtaacctctttctgcgatgc

SEQ ID NO: 414878 - DNA, 25 bp, Mus musculus
gaacagtaacctgtttctgcgatgc

SEQ ID NO: 414879 - DNA, 25 bp, Mus musculus
gaacagtacaccagtgccaacattc

SEQ ID NO: 414880 - DNA, 25 bp, Mus musculus
gaacagtacacctgtgccaacattc

SEQ ID NO: 414881 - DNA, 25 bp, Mus musculus
gaacagtacattcatggctccaaaa

SEQ ID NO: 414882 - DNA, 25 bp, Mus musculus
gaacagtacattgatggctccaaaa

SEQ ID NO: 414883 - DNA, 25 bp, Mus musculus
gaacagtactttccaggcaacccga

SEQ ID NO: 414884 - DNA, 25 bp, Mus musculus
gaacagtactttgcaggcaacccga

SEQ ID NO: 414885 - DNA, 25 bp, Mus musculus
gaacagtagctcacttacactggat

SEQ ID NO: 414886 - DNA, 25 bp, Mus musculus
gaacagtagctctcttacactggat

SEQ ID NO: 414887 - DNA, 25 bp, Mus musculus
gaacagtaggaaccagacacctgcc

SEQ ID NO: 414888 - DNA, 25 bp, Mus musculus
gaacagtaggaagcagacacctgcc

SEQ ID NO: 414889 - DNA, 25 bp, Mus musculus
gaacagtaggccactgggtgctgta

SEQ ID NO: 414890 - DNA, 25 bp, Mus musculus
gaacagtaggcctctgggtgctgta

SEQ ID NO: 414891 - DNA, 25 bp, Mus musculus
gaacagtaggtgcttcacctgtact

SEQ ID NO: 414892 - DNA, 25 bp, Mus musculus
gaacagtaggtggttcacctgtact

SEQ ID NO: 414893 - DNA, 25 bp, Mus musculus
gaacagtataatctaccggctggag

SEQ ID NO: 414894 - DNA, 25 bp, Mus musculus
gaacagtataatgtaccggctggag

SEQ ID NO: 414895 - DNA, 25 bp, Mus musculus
gaacagtatacccacgttgcacatg

SEQ ID NO: 414896 - DNA, 25 bp, Mus musculus
gaacagtataccgacgttgcacatg

SEQ ID NO: 414897 - DNA, 25 bp, Mus musculus
gaacagtatgccaagatgatcttca

SEQ ID NO: 414898 - DNA, 25 bp, Mus musculus
gaacagtatgcctagatgatcttca

SEQ ID NO: 414899 - DNA, 25 bp, Mus musculus
gaacagtatgctcacgctgttgcac

SEQ ID NO: 414900 - DNA, 25 bp, Mus musculus
gaacagtatgctgacgctgttgcac

SEQ ID NO: 414901 - DNA, 25 bp, Mus musculus
gaacagtattctattcagccacacc

SEQ ID NO: 414902 - DNA, 25 bp, Mus musculus
gaacagtattctcctagttaccccg

SEQ ID NO: 414903 - DNA, 25 bp, Mus musculus
gaacagtattctgctagttaccccg

SEQ ID NO: 414904 - DNA, 25 bp, Mus musculus
gaacagtattcttttcagccacacc

SEQ ID NO: 414905 - DNA, 25 bp, Mus musculus
gaacagtatttgatgtttcagagat

SEQ ID NO: 414906 - DNA, 25 bp, Mus musculus
gaacagtatttgttgtttcagagat

SEQ ID NO: 414907 - DNA, 25 bp, Mus musculus
gaacagtattttcagttgactcagg

SEQ ID NO: 414908 - DNA, 25 bp, Mus musculus
gaacagtattttgagttgactcagg

SEQ ID NO: 414909 - DNA, 25 bp, Mus musculus
gaacagtcaagacgagtaaggcctg

SEQ ID NO: 414910 - DNA, 25 bp, Mus musculus
gaacagtcaagaggagtaaggcctg

SEQ ID NO: 414911 - DNA, 25 bp, Mus musculus
gaacagtcaaggaaagacacccaat

SEQ ID NO: 414912 - DNA, 25 bp, Mus musculus
gaacagtcaaggtaagacacccaat

SEQ ID NO: 414913 - DNA, 25 bp, Mus musculus
gaacagtcaatacctcctggatgtg

SEQ ID NO: 414914 - DNA, 25 bp, Mus musculus
gaacagtcaatagctcctggatgtg

SEQ ID NO: 414915 - DNA, 25 bp, Mus musculus
gaacagtcacacatcacatcatggc

SEQ ID NO: 414916 - DNA, 25 bp, Mus musculus
gaacagtcacacatttgtgccgcca

SEQ ID NO: 414917 - DNA, 25 bp, Mus musculus
gaacagtcacacttcacatcatggc

SEQ ID NO: 414918 - DNA, 25 bp, Mus musculus
gaacagtcacacttttgtgccgcca

SEQ ID NO: 414919 - DNA, 25 bp, Mus musculus
gaacagtcacccagaggcctggctt

SEQ ID NO: 414920 - DNA, 25 bp, Mus musculus
gaacagtcaccctgaggcctggctt

SEQ ID NO: 414921 - DNA, 25 bp, Mus musculus
gaacagtcacttccagaaggaggga

SEQ ID NO: 414922 - DNA, 25 bp, Mus musculus
gaacagtcacttgcagaaggaggga

SEQ ID NO: 414923 - DNA, 25 bp, Mus musculus
gaacagtcatatctaccttggcaat

SEQ ID NO: 414924 - DNA, 25 bp, Mus musculus
gaacagtcatatgtaccttggcaat

SEQ ID NO: 414925 - DNA, 25 bp, Mus musculus
gaacagtcattgctgatgaccgctg

SEQ ID NO: 414926 - DNA, 25 bp, Mus musculus
gaacagtcattggtgatgaccgctg

SEQ ID NO: 414927 - DNA, 25 bp, Mus musculus
gaacagtccaagcatagattcggaa

SEQ ID NO: 414928 - DNA, 25 bp, Mus musculus
gaacagtccaaggatagattcggaa

SEQ ID NO: 414929 - DNA, 25 bp, Mus musculus
gaacagtcccagcagcaatgacctt

SEQ ID NO: 414930 - DNA, 25 bp, Mus musculus
gaacagtcccaggagcaatgacctt

SEQ ID NO: 414931 - DNA, 25 bp, Mus musculus
gaacagtcctggaggccagtggtcc

SEQ ID NO: 414932 - DNA, 25 bp, Mus musculus
gaacagtcctggtggccagtggtcc

SEQ ID NO: 414933 - DNA, 25 bp, Mus musculus
gaacagtcgccgctcagctgtttgc

SEQ ID NO: 414934 - DNA, 25 bp, Mus musculus
gaacagtcgccggtcagctgtttgc

SEQ ID NO: 414935 - DNA, 25 bp, Mus musculus
gaacagtctcaacatccaagtggga

SEQ ID NO: 414936 - DNA, 25 bp, Mus musculus
gaacagtctcaagatccaagtggga

SEQ ID NO: 414937 - DNA, 25 bp, Mus musculus
gaacagtctcatctacatggtgcga

SEQ ID NO: 414938 - DNA, 25 bp, Mus musculus
gaacagtctcatgtacatggtgcga

SEQ ID NO: 414939 - DNA, 25 bp, Mus musculus
gaacagtctcctaactctttagtga

SEQ ID NO: 414940 - DNA, 25 bp, Mus musculus
gaacagtctccttactctttagtga

SEQ ID NO: 414941 - DNA, 25 bp, Mus musculus
gaacagtctctccaaaatgcttcta

SEQ ID NO: 414942 - DNA, 25 bp, Mus musculus
gaacagtctctcgaaaatgcttcta

SEQ ID NO: 414943 - DNA, 25 bp, Mus musculus
gaacagtctgatccgagagccgaaa

SEQ ID NO: 414944 - DNA, 25 bp, Mus musculus
gaacagtctgatgcgagagccgaaa

SEQ ID NO: 414945 - DNA, 25 bp, Mus musculus
gaacagtctttcaggtttcttttca

SEQ ID NO: 414946 - DNA, 25 bp, Mus musculus
gaacagtctttctggtttcttttca

SEQ ID NO: 414947 - DNA, 25 bp, Mus musculus
gaacagtgacacactcgaagtacag

SEQ ID NO: 414948 - DNA, 25 bp, Mus musculus
gaacagtgacactctcgaagtacag

SEQ ID NO: 414949 - DNA, 25 bp, Mus musculus
gaacagtgacagcttcttgtaagta

SEQ ID NO: 414950 - DNA, 25 bp, Mus musculus
gaacagtgacaggttcttgtaagta

SEQ ID NO: 414951 - DNA, 25 bp, Mus musculus
gaacagtgaggcctgatgcagcaaa

SEQ ID NO: 414952 - DNA, 25 bp, Mus musculus
gaacagtgaggcgtgatgcagcaaa

SEQ ID NO: 414953 - DNA, 25 bp, Mus musculus
gaacagtgatacaccagtgaccttc

SEQ ID NO: 414954 - DNA, 25 bp, Mus musculus
gaacagtgatactccagtgaccttc

SEQ ID NO: 414955 - DNA, 25 bp, Mus musculus
gaacagtgatttaaaggcccttgga

SEQ ID NO: 414956 - DNA, 25 bp, Mus musculus
gaacagtgattttaaggcccttgga

SEQ ID NO: 414957 - DNA, 25 bp, Mus musculus
gaacagtgcagactcctgggagcca

SEQ ID NO: 414958 - DNA, 25 bp, Mus musculus
gaacagtgcagagtcctgggagcca

SEQ ID NO: 414959 - DNA, 25 bp, Mus musculus
gaacagtgcagtctctctatgaaga

SEQ ID NO: 414960 - DNA, 25 bp, Mus musculus
gaacagtgcagtgtctctatgaaga

SEQ ID NO: 414961 - DNA, 25 bp, Mus musculus
gaacagtgccatagtctgaatctct

SEQ ID NO: 414962 - DNA, 25 bp, Mus musculus
gaacagtgccattgtctgaatctct

SEQ ID NO: 414963 - DNA, 25 bp, Mus musculus
gaacagtgcctgagttggattatta

SEQ ID NO: 414964 - DNA, 25 bp, Mus musculus
gaacagtgcctgtgttggattatta

SEQ ID NO: 414965 - DNA, 25 bp, Mus musculus
gaacagtgcggaccattctttccct

SEQ ID NO: 414966 - DNA, 25 bp, Mus musculus
gaacagtgcggagcattctttccct

SEQ ID NO: 414967 - DNA, 25 bp, Mus musculus
gaacagtgcgtgacatctcaagcct

SEQ ID NO: 414968 - DNA, 25 bp, Mus musculus
gaacagtgcgtgtcatctcaagcct

SEQ ID NO: 414969 - DNA, 25 bp, Mus musculus
gaacagtgctgaacccacgtgctgg

SEQ ID NO: 414970 - DNA, 25 bp, Mus musculus
gaacagtgctgatcccacgtgctgg

SEQ ID NO: 414971 - DNA, 25 bp, Mus musculus
gaacagtgctgcagtggagagagac

SEQ ID NO: 414972 - DNA, 25 bp, Mus musculus
gaacagtgctgctgtggagagagac

SEQ ID NO: 414973 - DNA, 25 bp, Mus musculus
gaacagtgcttcagaggtccccaga

SEQ ID NO: 414974 - DNA, 25 bp, Mus musculus
gaacagtgcttctgaggtccccaga

SEQ ID NO: 414975 - DNA, 25 bp, Mus musculus
gaacagtggcaccagtctgcttcat

SEQ ID NO: 414976 - DNA, 25 bp, Mus musculus
gaacagtggcacgagtctgcttcat

SEQ ID NO: 414977 - DNA, 25 bp, Mus musculus
gaacagtggcagatgacccagaaat

SEQ ID NO: 414978 - DNA, 25 bp, Mus musculus
gaacagtggcagttgacccagaaat

SEQ ID NO: 414979 - DNA, 25 bp, Mus musculus
gaacagtggcgccaacagcagcgta

SEQ ID NO: 414980 - DNA, 25 bp, Mus musculus
gaacagtggcgcgaacagcagcgta

SEQ ID NO: 414981 - DNA, 25 bp, Mus musculus
gaacagtgtcttcaatgtatcaagc

SEQ ID NO: 414982 - DNA, 25 bp, Mus musculus
gaacagtgtcttgaatgtatcaagc

SEQ ID NO: 414983 - DNA, 25 bp, Mus musculus
gaacagtgtgacatagcaaattatt

SEQ ID NO: 414984 - DNA, 25 bp, Mus musculus
gaacagtgtgacttagcaaattatt

SEQ ID NO: 414985 - DNA, 25 bp, Mus musculus
gaacagtgtgccaaggtggccagcc

SEQ ID NO: 414986 - DNA, 25 bp, Mus musculus
gaacagtgtgcctaggtggccagcc

SEQ ID NO: 414987 - DNA, 25 bp, Mus musculus
gaacagtgtggtcacgtgtccatgt

SEQ ID NO: 414988 - DNA, 25 bp, Mus musculus
gaacagtgtggtgacgtgtccatgt

SEQ ID NO: 414989 - DNA, 25 bp, Mus musculus
gaacagtgttaaatccaaccatgat

SEQ ID NO: 414990 - DNA, 25 bp, Mus musculus
gaacagtgttaattccaaccatgat

SEQ ID NO: 414991 - DNA, 25 bp, Mus musculus
gaacagtgttgcaaatttcccagga

SEQ ID NO: 414992 - DNA, 25 bp, Mus musculus
gaacagtgttgcaataggcatcgtg

SEQ ID NO: 414993 - DNA, 25 bp, Mus musculus
gaacagtgttgcacacctagaatat

SEQ ID NO: 414994 - DNA, 25 bp, Mus musculus
gaacagtgttgctaatttcccagga

SEQ ID NO: 414995 - DNA, 25 bp, Mus musculus
gaacagtgttgctataggcatcgtg

SEQ ID NO: 414996 - DNA, 25 bp, Mus musculus
gaacagtgttgctcacctagaatat

SEQ ID NO: 414997 - DNA, 25 bp, Mus musculus
gaacagtgtttcatatgacccattt

SEQ ID NO: 414998 - DNA, 25 bp, Mus musculus
gaacagtgtttccttgttaagattt

SEQ ID NO: 414999 - DNA, 25 bp, Mus musculus
gaacagtgtttcgttgttaagattt

SEQ ID NO: 415000 - DNA, 25 bp, Mus musculus
gaacagtgtttcttatgacccattt

SEQ ID NO: 415001 - DNA, 25 bp, Mus musculus
gaacagttaaacactctaaccattg

SEQ ID NO: 415002 - DNA, 25 bp, Mus musculus
gaacagttaaactctctaaccattg

SEQ ID NO: 415003 - DNA, 25 bp, Mus musculus
gaacagttaactccactgagtgctg

SEQ ID NO: 415004 - DNA, 25 bp, Mus musculus
gaacagttaactgcactgagtgctg

SEQ ID NO: 415005 - DNA, 25 bp, Mus musculus
gaacagttaattacactgaggaact

SEQ ID NO: 415006 - DNA, 25 bp, Mus musculus
gaacagttaatttcactgaggaact

SEQ ID NO: 415007 - DNA, 25 bp, Mus musculus
gaacagttagagattctacttgaaa

SEQ ID NO: 415008 - DNA, 25 bp, Mus musculus
gaacagttagagtttctacttgaaa

SEQ ID NO: 415009 - DNA, 25 bp, Mus musculus
gaacagttatgacttgcccacatgc

SEQ ID NO: 415010 - DNA, 25 bp, Mus musculus
gaacagttatgagttgcccacatgc

SEQ ID NO: 415011 - DNA, 25 bp, Mus musculus
gaacagttatttcctgacccatggc

SEQ ID NO: 415012 - DNA, 25 bp, Mus musculus
gaacagttatttgctgacccatggc

SEQ ID NO: 415013 - DNA, 25 bp, Mus musculus
gaacagttcaccaaatttgcagcat

SEQ ID NO: 415014 - DNA, 25 bp, Mus musculus
gaacagttcacctaatttgcagcat

SEQ ID NO: 415015 - DNA, 25 bp, Mus musculus
gaacagttcagacagcagctgggtc

SEQ ID NO: 415016 - DNA, 25 bp, Mus musculus
gaacagttcagagagcagctgggtc

SEQ ID NO: 415017 - DNA, 25 bp, Mus musculus
gaacagttcagccattcgaataaat

SEQ ID NO: 415018 - DNA, 25 bp, Mus musculus
gaacagttcagcgattcgaataaat

SEQ ID NO: 415019 - DNA, 25 bp, Mus musculus
gaacagttcccacttgtccataagg

SEQ ID NO: 415020 - DNA, 25 bp, Mus musculus
gaacagttcccagttgtccataagg

SEQ ID NO: 415021 - DNA, 25 bp, Mus musculus
gaacagttccggaattccagacaac

SEQ ID NO: 415022 - DNA, 25 bp, Mus musculus
gaacagttccggtattccagacaac

SEQ ID NO: 415023 - DNA, 25 bp, Mus musculus
gaacagttcctacggcacaggctga

SEQ ID NO: 415024 - DNA, 25 bp, Mus musculus
gaacagttcctagggcacaggctga

SEQ ID NO: 415025 - DNA, 25 bp, Mus musculus
gaacagttcgacactgtgagcagct

SEQ ID NO: 415026 - DNA, 25 bp, Mus musculus
gaacagttcgactctgtgagcagct

SEQ ID NO: 415027 - DNA, 25 bp, Mus musculus
gaacagttctccatatctttctgat

SEQ ID NO: 415028 - DNA, 25 bp, Mus musculus
gaacagttctccttatctttctgat

SEQ ID NO: 415029 - DNA, 25 bp, Mus musculus
gaacagttgatgacactaaagtttt

SEQ ID NO: 415030 - DNA, 25 bp, Mus musculus
gaacagttgatgtcactaaagtttt

SEQ ID NO: 415031 - DNA, 25 bp, Mus musculus
gaacagttggacactgctatccgtt

SEQ ID NO: 415032 - DNA, 25 bp, Mus musculus
gaacagttggactctgctatccgtt

SEQ ID NO: 415033 - DNA, 25 bp, Mus musculus
gaacagttggcaacagccttgacca

SEQ ID NO: 415034 - DNA, 25 bp, Mus musculus
gaacagttggcatcagccttgacca

SEQ ID NO: 415035 - DNA, 25 bp, Mus musculus
gaacagttggttcccagctagtgct

SEQ ID NO: 415036 - DNA, 25 bp, Mus musculus
gaacagttggttgccagctagtgct

SEQ ID NO: 415037 - DNA, 25 bp, Mus musculus
gaacagttgttccaagatagcttag

SEQ ID NO: 415038 - DNA, 25 bp, Mus musculus
gaacagttgttcgaagatagcttag

SEQ ID NO: 415039 - DNA, 25 bp, Mus musculus
gaacagtttactaccatgaatcttt

SEQ ID NO: 415040 - DNA, 25 bp, Mus musculus
gaacagtttacttccatgaatcttt

SEQ ID NO: 415041 - DNA, 25 bp, Mus musculus
gaacagtttcctattgttcctcact

SEQ ID NO: 415042 - DNA, 25 bp, Mus musculus
gaacagtttccttttgttcctcact

SEQ ID NO: 415043 - DNA, 25 bp, Mus musculus
gaacagtttgggatattctgacaaa

SEQ ID NO: 415044 - DNA, 25 bp, Mus musculus
gaacagtttgggttattctgacaaa

SEQ ID NO: 415045 - DNA, 25 bp, Mus musculus
gaacagtttgttacactggtcagga

SEQ ID NO: 415046 - DNA, 25 bp, Mus musculus
gaacagtttgttccttgcgagggaa

SEQ ID NO: 415047 - DNA, 25 bp, Mus musculus
gaacagtttgttgcttgcgagggaa

SEQ ID NO: 415048 - DNA, 25 bp, Mus musculus
gaacagtttgtttcactggtcagga

SEQ ID NO: 415049 - DNA, 25 bp, Mus musculus
gaacagttttacacttgtggctcct

SEQ ID NO: 415050 - DNA, 25 bp, Mus musculus
gaacagttttacctgttacatggtt

SEQ ID NO: 415051 - DNA, 25 bp, Mus musculus
gaacagttttacgtgttacatggtt

SEQ ID NO: 415052 - DNA, 25 bp, Mus musculus
gaacagttttactcttgtggctcct

SEQ ID NO: 415053 - DNA, 25 bp, Mus musculus
gaacagttttcactaatccagacat

SEQ ID NO: 415054 - DNA, 25 bp, Mus musculus
gaacagttttcagtaatccagacat

SEQ ID NO: 415055 - DNA, 25 bp, Mus musculus
gaacataaacctcctgcattggaca

SEQ ID NO: 415056 - DNA, 25 bp, Mus musculus
gaacataaacctgctgcattggaca

SEQ ID NO: 415057 - DNA, 25 bp, Mus musculus
gaacataaagtcctaagtccaggca

SEQ ID NO: 415058 - DNA, 25 bp, Mus musculus
gaacataaagtcgtaagtccaggca

SEQ ID NO: 415059 - DNA, 25 bp, Mus musculus
gaacataaccttcgagtggcgtgtg

SEQ ID NO: 415060 - DNA, 25 bp, Mus musculus
gaacataaccttggagtggcgtgtg

SEQ ID NO: 415061 - DNA, 25 bp, Mus musculus
gaacataagaaaatctccctggaaa

SEQ ID NO: 415062 - DNA, 25 bp, Mus musculus
gaacataagaaattctccctggaaa

SEQ ID NO: 415063 - DNA, 25 bp, Mus musculus
gaacataagagtcaccgaggagagt

SEQ ID NO: 415064 - DNA, 25 bp, Mus musculus
gaacataagagtgaccgaggagagt

SEQ ID NO: 415065 - DNA, 25 bp, Mus musculus
gaacataagtaaccttgggaacaag

SEQ ID NO: 415066 - DNA, 25 bp, Mus musculus
gaacataagtaagcttgggaacaag

SEQ ID NO: 415067 - DNA, 25 bp, Mus musculus
gaacataagtctacgagaggcccta

SEQ ID NO: 415068 - DNA, 25 bp, Mus musculus
gaacataagtcttcgagaggcccta

SEQ ID NO: 415069 - DNA, 25 bp, Mus musculus
gaacataattccctttgaccagatg

SEQ ID NO: 415070 - DNA, 25 bp, Mus musculus
gaacataattccgtttgaccagatg

SEQ ID NO: 415071 - DNA, 25 bp, Mus musculus
gaacatacaactaccccaagtaccg

SEQ ID NO: 415072 - DNA, 25 bp, Mus musculus
gaacatacaacttccccaagtaccg

SEQ ID NO: 415073 - DNA, 25 bp, Mus musculus
gaacatacatttacctccacaagtt

SEQ ID NO: 415074 - DNA, 25 bp, Mus musculus
gaacatacattttcctccacaagtt

SEQ ID NO: 415075 - DNA, 25 bp, Mus musculus
gaacataccactcccgaaagccttt

SEQ ID NO: 415076 - DNA, 25 bp, Mus musculus
gaacataccactgccgaaagccttt

SEQ ID NO: 415077 - DNA, 25 bp, Mus musculus
gaacataccagacaatcccctgaag

SEQ ID NO: 415078 - DNA, 25 bp, Mus musculus
gaacataccagagaatcccctgaag

SEQ ID NO: 415079 - DNA, 25 bp, Mus musculus
gaacataccatgacactacaacctg

SEQ ID NO: 415080 - DNA, 25 bp, Mus musculus
gaacataccatgtcactacaacctg

SEQ ID NO: 415081 - DNA, 25 bp, Mus musculus
gaacataccgctattcctgggaaat

SEQ ID NO: 415082 - DNA, 25 bp, Mus musculus
gaacataccgcttttcctgggaaat

SEQ ID NO: 415083 - DNA, 25 bp, Mus musculus
gaacatacctcaacaagtgtcacta

SEQ ID NO: 415084 - DNA, 25 bp, Mus musculus
gaacatacctcatcaagtgtcacta

SEQ ID NO: 415085 - DNA, 25 bp, Mus musculus
gaacatactggaacacttggcgcga

SEQ ID NO: 415086 - DNA, 25 bp, Mus musculus
gaacatactggatcacttggcgcga

SEQ ID NO: 415087 - DNA, 25 bp, Mus musculus
gaacatacttaaaactccagctgcc

SEQ ID NO: 415088 - DNA, 25 bp, Mus musculus
gaacatacttaatactccagctgcc

SEQ ID NO: 415089 - DNA, 25 bp, Mus musculus
gaacatagaattccttggccctcaa

SEQ ID NO: 415090 - DNA, 25 bp, Mus musculus
gaacatagaattgcttggccctcaa

SEQ ID NO: 415091 - DNA, 25 bp, Mus musculus
gaacatagagacctctctctctcct

SEQ ID NO: 415092 - DNA, 25 bp, Mus musculus
gaacatagagacgtctctctctcct

SEQ ID NO: 415093 - DNA, 25 bp, Mus musculus
gaacatagatgtcagtgtgaccttt

SEQ ID NO: 415094 - DNA, 25 bp, Mus musculus
gaacatagatgtgagtgtgaccttt

SEQ ID NO: 415095 - DNA, 25 bp, Mus musculus
gaacatagcaaacactcccaggtca

SEQ ID NO: 415096 - DNA, 25 bp, Mus musculus
gaacatagcaaagactcccaggtca

SEQ ID NO: 415097 - DNA, 25 bp, Mus musculus
gaacatagccaacagacagacggta

SEQ ID NO: 415098 - DNA, 25 bp, Mus musculus
gaacatagccaagagacagacggta

SEQ ID NO: 415099 - DNA, 25 bp, Mus musculus
gaacatagccttctcggagcttgat

SEQ ID NO: 415100 - DNA, 25 bp, Mus musculus
gaacatagccttgtcggagcttgat

SEQ ID NO: 415101 - DNA, 25 bp, Mus musculus
gaacatagcgttattcatattcatt

SEQ ID NO: 415102 - DNA, 25 bp, Mus musculus
gaacatagcgtttttcatattcatt

SEQ ID NO: 415103 - DNA, 25 bp, Mus musculus
gaacatagctctactgaccatcagt

SEQ ID NO: 415104 - DNA, 25 bp, Mus musculus
gaacatagctcttctgaccatcagt

SEQ ID NO: 415105 - DNA, 25 bp, Mus musculus
gaacatagctgcagaacagcccgga

SEQ ID NO: 415106 - DNA, 25 bp, Mus musculus
gaacatagctgcataccactatagc

SEQ ID NO: 415107 - DNA, 25 bp, Mus musculus
gaacatagctgctgaacagcccgga

SEQ ID NO: 415108 - DNA, 25 bp, Mus musculus
gaacatagctgcttaccactatagc

SEQ ID NO: 415109 - DNA, 25 bp, Mus musculus
gaacataggctacgctgtgagttat

SEQ ID NO: 415110 - DNA, 25 bp, Mus musculus
gaacataggctaggctgtgagttat

SEQ ID NO: 415111 - DNA, 25 bp, Mus musculus
gaacatagggtgctcatcagtatag

SEQ ID NO: 415112 - DNA, 25 bp, Mus musculus
gaacatagggtggtcatcagtatag

SEQ ID NO: 415113 - DNA, 25 bp, Mus musculus
gaacatataaatacagtccccatga

SEQ ID NO: 415114 - DNA, 25 bp, Mus musculus
gaacatataaattcagtccccatga

SEQ ID NO: 415115 - DNA, 25 bp, Mus musculus
gaacatatacaacagtccaaggaca

SEQ ID NO: 415116 - DNA, 25 bp, Mus musculus
gaacatatacaagagtccaaggaca

SEQ ID NO: 415117 - DNA, 25 bp, Mus musculus
gaacatatacctatccttgtaacag

SEQ ID NO: 415118 - DNA, 25 bp, Mus musculus
gaacatatacctttccttgtaacag

SEQ ID NO: 415119 - DNA, 25 bp, Mus musculus
gaacatatatgacctctgaacagga

SEQ ID NO: 415120 - DNA, 25 bp, Mus musculus
gaacatatatgagctctgaacagga

SEQ ID NO: 415121 - DNA, 25 bp, Mus musculus
gaacatatccagatttcagtggaag

SEQ ID NO: 415122 - DNA, 25 bp, Mus musculus
gaacatatccagttttcagtggaag

SEQ ID NO: 415123 - DNA, 25 bp, Mus musculus
gaacatatcctgcaacttcttcttt

SEQ ID NO: 415124 - DNA, 25 bp, Mus musculus
gaacatatcctggaacttcttcttt

SEQ ID NO: 415125 - DNA, 25 bp, Mus musculus
gaacatatctcaagtatgacattat

SEQ ID NO: 415126 - DNA, 25 bp, Mus musculus
gaacatatctcatgtatgacattat

SEQ ID NO: 415127 - DNA, 25 bp, Mus musculus
gaacatatctgccttttgtgctgta

SEQ ID NO: 415128 - DNA, 25 bp, Mus musculus
gaacatatctgcgttttgtgctgta

SEQ ID NO: 415129 - DNA, 25 bp, Mus musculus
gaacatatgaacactggccagctag

SEQ ID NO: 415130 - DNA, 25 bp, Mus musculus
gaacatatgaactctggccagctag

SEQ ID NO: 415131 - DNA, 25 bp, Mus musculus
gaacatatgtccatcgccagcagca

SEQ ID NO: 415132 - DNA, 25 bp, Mus musculus
gaacatatgtccttcgccagcagca

SEQ ID NO: 415133 - DNA, 25 bp, Mus musculus
gaacatatgtgtactgtctggaaaa

SEQ ID NO: 415134 - DNA, 25 bp, Mus musculus
gaacatatgtgttctgtctggaaaa

SEQ ID NO: 415135 - DNA, 25 bp, Mus musculus
gaacatattcaaacaagccactgtg

SEQ ID NO: 415136 - DNA, 25 bp, Mus musculus
gaacatattcaatcaagccactgtg

SEQ ID NO: 415137 - DNA, 25 bp, Mus musculus
gaacatattcctagtaaagtatttt

SEQ ID NO: 415138 - DNA, 25 bp, Mus musculus
gaacatattccttgtaaagtatttt

SEQ ID NO: 415139 - DNA, 25 bp, Mus musculus
gaacatattgtgatttttaccttag

SEQ ID NO: 415140 - DNA, 25 bp, Mus musculus
gaacatattgtgttttttaccttag

SEQ ID NO: 415141 - DNA, 25 bp, Mus musculus
gaacatattgttcagctcgtcttag

SEQ ID NO: 415142 - DNA, 25 bp, Mus musculus
gaacatattgttgagctcgtcttag

SEQ ID NO: 415143 - DNA, 25 bp, Mus musculus
gaacatcaacaccagtgtattgctg

SEQ ID NO: 415144 - DNA, 25 bp, Mus musculus
gaacatcaacacgagtgtattgctg

SEQ ID NO: 415145 - DNA, 25 bp, Mus musculus
gaacatcaactcagcaaatggtgga

SEQ ID NO: 415146 - DNA, 25 bp, Mus musculus
gaacatcaactctgcaaatggtgga

SEQ ID NO: 415147 - DNA, 25 bp, Mus musculus
gaacatcaagatatctttttgtgga

SEQ ID NO: 415148 - DNA, 25 bp, Mus musculus
gaacatcaagatttctttttgtgga

SEQ ID NO: 415149 - DNA, 25 bp, Mus musculus
gaacatcaagcacataccgggccca

SEQ ID NO: 415150 - DNA, 25 bp, Mus musculus
gaacatcaagcagataccgggccca

SEQ ID NO: 415151 - DNA, 25 bp, Mus musculus
gaacatcaagctcccaatcgattgt

SEQ ID NO: 415152 - DNA, 25 bp, Mus musculus
gaacatcaagctgccaatcgattgt

SEQ ID NO: 415153 - DNA, 25 bp, Mus musculus
gaacatcaattcactatcccaaaca

SEQ ID NO: 415154 - DNA, 25 bp, Mus musculus
gaacatcaattctctatcccaaaca

SEQ ID NO: 415155 - DNA, 25 bp, Mus musculus
gaacatcacagtatgagatcacaca

SEQ ID NO: 415156 - DNA, 25 bp, Mus musculus
gaacatcacagtttgagatcacaca

SEQ ID NO: 415157 - DNA, 25 bp, Mus musculus
gaacatcacatcagcttgggtgttt

SEQ ID NO: 415158 - DNA, 25 bp, Mus musculus
gaacatcacatctgcttgggtgttt

SEQ ID NO: 415159 - DNA, 25 bp, Mus musculus
gaacatcaccatagaaattcagggc

SEQ ID NO: 415160 - DNA, 25 bp, Mus musculus
gaacatcaccattgaaattcagggc

SEQ ID NO: 415161 - DNA, 25 bp, Mus musculus
gaacatcacggacctcagggtgcag

SEQ ID NO: 415162 - DNA, 25 bp, Mus musculus
gaacatcacggagctcagggtgcag

SEQ ID NO: 415163 - DNA, 25 bp, Mus musculus
gaacatcacgtacgcacagggctga

SEQ ID NO: 415164 - DNA, 25 bp, Mus musculus
gaacatcacgtaggcacagggctga

SEQ ID NO: 415165 - DNA, 25 bp, Mus musculus
gaacatcactgcaaaatctcctagg

SEQ ID NO: 415166 - DNA, 25 bp, Mus musculus
gaacatcactgctaaatctcctagg

SEQ ID NO: 415167 - DNA, 25 bp, Mus musculus
gaacatcagagccacaagtttcaca

SEQ ID NO: 415168 - DNA, 25 bp, Mus musculus
gaacatcagagcgacaagtttcaca

SEQ ID NO: 415169 - DNA, 25 bp, Mus musculus
gaacatcagataagttagtttcatc

SEQ ID NO: 415170 - DNA, 25 bp, Mus musculus
gaacatcagatatgttagtttcatc

SEQ ID NO: 415171 - DNA, 25 bp, Mus musculus
gaacatcagcggactcactgttagt

SEQ ID NO: 415172 - DNA, 25 bp, Mus musculus
gaacatcagcggtctcactgttagt

SEQ ID NO: 415173 - DNA, 25 bp, Mus musculus
gaacatcaggacaagtgggaagcag

SEQ ID NO: 415174 - DNA, 25 bp, Mus musculus
gaacatcaggactagtgggaagcag

SEQ ID NO: 415175 - DNA, 25 bp, Mus musculus
gaacatcagggcagtgcaagcttaa

SEQ ID NO: 415176 - DNA, 25 bp, Mus musculus
gaacatcagggctgtgcaagcttaa

SEQ ID NO: 415177 - DNA, 25 bp, Mus musculus
gaacatcagtctctcaagtgaggag

SEQ ID NO: 415178 - DNA, 25 bp, Mus musculus
gaacatcagtctgtcaagtgaggag

SEQ ID NO: 415179 - DNA, 25 bp, Mus musculus
gaacatcagttcacatcaagctata

SEQ ID NO: 415180 - DNA, 25 bp, Mus musculus
gaacatcagttctcatcaagctata

SEQ ID NO: 415181 - DNA, 25 bp, Mus musculus
gaacatcataaaacggagtcatact

SEQ ID NO: 415182 - DNA, 25 bp, Mus musculus
gaacatcataaaccatgcacggtgg

SEQ ID NO: 415183 - DNA, 25 bp, Mus musculus
gaacatcataaagcatgcacggtgg

SEQ ID NO: 415184 - DNA, 25 bp, Mus musculus
gaacatcataaatcggagtcatact

SEQ ID NO: 415185 - DNA, 25 bp, Mus musculus
gaacatcatgtgagtctgactagag

SEQ ID NO: 415186 - DNA, 25 bp, Mus musculus
gaacatcatgtgtgtctgactagag

SEQ ID NO: 415187 - DNA, 25 bp, Mus musculus
gaacatcattggctgacgaggtctg

SEQ ID NO: 415188 - DNA, 25 bp, Mus musculus
gaacatcattgggtgacgaggtctg

SEQ ID NO: 415189 - DNA, 25 bp, Mus musculus
gaacatccaaatccggcttgcagat

SEQ ID NO: 415190 - DNA, 25 bp, Mus musculus
gaacatccaaatgcggcttgcagat

SEQ ID NO: 415191 - DNA, 25 bp, Mus musculus
gaacatccaacaatcagagctcctc

SEQ ID NO: 415192 - DNA, 25 bp, Mus musculus
gaacatccaacattcagagctcctc

SEQ ID NO: 415193 - DNA, 25 bp, Mus musculus
gaacatccaagcagagtttcccatg

SEQ ID NO: 415194 - DNA, 25 bp, Mus musculus
gaacatccaagcctgttttctttag

SEQ ID NO: 415195 - DNA, 25 bp, Mus musculus
gaacatccaagcctttctggcagcg

SEQ ID NO: 415196 - DNA, 25 bp, Mus musculus
gaacatccaagcgtgttttctttag

SEQ ID NO: 415197 - DNA, 25 bp, Mus musculus
gaacatccaagcgtttctggcagcg

SEQ ID NO: 415198 - DNA, 25 bp, Mus musculus
gaacatccaagctgagtttcccatg

SEQ ID NO: 415199 - DNA, 25 bp, Mus musculus
gaacatccaaggcactgacctactt

SEQ ID NO: 415200 - DNA, 25 bp, Mus musculus
gaacatccaagggactgacctactt

SEQ ID NO: 415201 - DNA, 25 bp, Mus musculus
gaacatccacatactggtggcacac

SEQ ID NO: 415202 - DNA, 25 bp, Mus musculus
gaacatccacattctggtggcacac

SEQ ID NO: 415203 - DNA, 25 bp, Mus musculus
gaacatccacgcactgaatggtgct

SEQ ID NO: 415204 - DNA, 25 bp, Mus musculus
gaacatccacgctctgaatggtgct

SEQ ID NO: 415205 - DNA, 25 bp, Mus musculus
gaacatccagttctgtttcacaagt

SEQ ID NO: 415206 - DNA, 25 bp, Mus musculus
gaacatccagttgtgtttcacaagt

SEQ ID NO: 415207 - DNA, 25 bp, Mus musculus
gaacatccatccaatcaatccatta

SEQ ID NO: 415208 - DNA, 25 bp, Mus musculus
gaacatccatcctatcaatccatta

SEQ ID NO: 415209 - DNA, 25 bp, Mus musculus
gaacatccctacagagatcaagtgt

SEQ ID NO: 415210 - DNA, 25 bp, Mus musculus
gaacatccctactgagatcaagtgt

SEQ ID NO: 415211 - DNA, 25 bp, Mus musculus
gaacatcccttgcaaagctttcttt

SEQ ID NO: 415212 - DNA, 25 bp, Mus musculus
gaacatcccttggaaagctttcttt

SEQ ID NO: 415213 - DNA, 25 bp, Mus musculus
gaacatcctagaagctcttgtctcc

SEQ ID NO: 415214 - DNA, 25 bp, Mus musculus
gaacatcctagatgctcttgtctcc

SEQ ID NO: 415215 - DNA, 25 bp, Mus musculus
gaacatcctatcatccagaactgtg

SEQ ID NO: 415216 - DNA, 25 bp, Mus musculus
gaacatcctatcttccagaactgtg

SEQ ID NO: 415217 - DNA, 25 bp, Mus musculus
gaacatcctcgtatcccagggagag

SEQ ID NO: 415218 - DNA, 25 bp, Mus musculus
gaacatcctcgtttcccagggagag

SEQ ID NO: 415219 - DNA, 25 bp, Mus musculus
gaacatcctctgaggtctacccggc

SEQ ID NO: 415220 - DNA, 25 bp, Mus musculus
gaacatcctctgtggtctacccggc

SEQ ID NO: 415221 - DNA, 25 bp, Mus musculus
gaacatcctcttcaacatcgacaag

SEQ ID NO: 415222 - DNA, 25 bp, Mus musculus
gaacatcctcttgaacatcgacaag

SEQ ID NO: 415223 - DNA, 25 bp, Mus musculus
gaacatcctggaatcattcgtgaag

SEQ ID NO: 415224 - DNA, 25 bp, Mus musculus
gaacatcctggattcattcgtgaag

SEQ ID NO: 415225 - DNA, 25 bp, Mus musculus
gaacatcctggtagaggcaagccgt

SEQ ID NO: 415226 - DNA, 25 bp, Mus musculus
gaacatcctggttgaggcaagccgt

SEQ ID NO: 415227 - DNA, 25 bp, Mus musculus
gaacatcctgtgagcttatgaacct

SEQ ID NO: 415228 - DNA, 25 bp, Mus musculus
gaacatcctgtgtgcttatgaacct

SEQ ID NO: 415229 - DNA, 25 bp, Mus musculus
gaacatcctgttcagcgtgggaaaa

SEQ ID NO: 415230 - DNA, 25 bp, Mus musculus
gaacatcctgttgagcgtgggaaaa

SEQ ID NO: 415231 - DNA, 25 bp, Mus musculus
gaacatccttatcacttggcaaatc

SEQ ID NO: 415232 - DNA, 25 bp, Mus musculus
gaacatccttatgacttggcaaatc

SEQ ID NO: 415233 - DNA, 25 bp, Mus musculus
gaacatccttccatcgcagagtcag

SEQ ID NO: 415234 - DNA, 25 bp, Mus musculus
gaacatccttccttcgcagagtcag

SEQ ID NO: 415235 - DNA, 25 bp, Mus musculus
gaacatccttctagtatattcacat

SEQ ID NO: 415236 - DNA, 25 bp, Mus musculus
gaacatccttcttgtatattcacat

SEQ ID NO: 415237 - DNA, 25 bp, Mus musculus
gaacatcgcacgattcctgttctct

SEQ ID NO: 415238 - DNA, 25 bp, Mus musculus
gaacatcgcacgtttcctgttctct

SEQ ID NO: 415239 - DNA, 25 bp, Mus musculus
gaacatcgcagaccttgtgacatct

SEQ ID NO: 415240 - DNA, 25 bp, Mus musculus
gaacatcgcagagcttgtgacatct

SEQ ID NO: 415241 - DNA, 25 bp, Mus musculus
gaacatcgcattctaaccttagaga

SEQ ID NO: 415242 - DNA, 25 bp, Mus musculus
gaacatcgcattgtaaccttagaga

SEQ ID NO: 415243 - DNA, 25 bp, Mus musculus
gaacatcgcttcctaaagagacgtt

SEQ ID NO: 415244 - DNA, 25 bp, Mus musculus
gaacatcgcttcgtaaagagacgtt

SEQ ID NO: 415245 - DNA, 25 bp, Mus musculus
gaacatcggaacagggctcttcaag

SEQ ID NO: 415246 - DNA, 25 bp, Mus musculus
gaacatcggaaccaagaggctgttt

SEQ ID NO: 415247 - DNA, 25 bp, Mus musculus
gaacatcggaacgaagaggctgttt

SEQ ID NO: 415248 - DNA, 25 bp, Mus musculus
gaacatcggaactgggctcttcaag

SEQ ID NO: 415249 - DNA, 25 bp, Mus musculus
gaacatcggagtactcacactggag

SEQ ID NO: 415250 - DNA, 25 bp, Mus musculus
gaacatcggagttctcacactggag

SEQ ID NO: 415251 - DNA, 25 bp, Mus musculus
gaacatcggcgaacgttttttcaga

SEQ ID NO: 415252 - DNA, 25 bp, Mus musculus
gaacatcggcgatcgttttttcaga

SEQ ID NO: 415253 - DNA, 25 bp, Mus musculus
gaacatcgttgtaggttctcaccca

SEQ ID NO: 415254 - DNA, 25 bp, Mus musculus
gaacatcgttgttggttctcaccca

SEQ ID NO: 415255 - DNA, 25 bp, Mus musculus
gaacatctaagcattctgtccaaga

SEQ ID NO: 415256 - DNA, 25 bp, Mus musculus
gaacatctaagctttctgtccaaga

SEQ ID NO: 415257 - DNA, 25 bp, Mus musculus
gaacatctaagtctctcttatttta

SEQ ID NO: 415258 - DNA, 25 bp, Mus musculus
gaacatctaagtgtctcttatttta

SEQ ID NO: 415259 - DNA, 25 bp, Mus musculus
gaacatctaataactcatgcatgca

SEQ ID NO: 415260 - DNA, 25 bp, Mus musculus
gaacatctaatatctcatgcatgca

SEQ ID NO: 415261 - DNA, 25 bp, Mus musculus
gaacatctaggcagaaactcataca

SEQ ID NO: 415262 - DNA, 25 bp, Mus musculus
gaacatctaggctgaaactcataca

SEQ ID NO: 415263 - DNA, 25 bp, Mus musculus
gaacatctatggagtcacggtgcca

SEQ ID NO: 415264 - DNA, 25 bp, Mus musculus
gaacatctatggtgtcacggtgcca

SEQ ID NO: 415265 - DNA, 25 bp, Mus musculus
gaacatctatttactccgtgaacat

SEQ ID NO: 415266 - DNA, 25 bp, Mus musculus
gaacatctattttctccgtgaacat

SEQ ID NO: 415267 - DNA, 25 bp, Mus musculus
gaacatctcaaaacactatcatagt

SEQ ID NO: 415268 - DNA, 25 bp, Mus musculus
gaacatctcaaatcactatcatagt

SEQ ID NO: 415269 - DNA, 25 bp, Mus musculus
gaacatctcagaacgtttcattaat

SEQ ID NO: 415270 - DNA, 25 bp, Mus musculus
gaacatctcagatcgtttcattaat

SEQ ID NO: 415271 - DNA, 25 bp, Mus musculus
gaacatctcataaagtatccctcag

SEQ ID NO: 415272 - DNA, 25 bp, Mus musculus
gaacatctcatatagtatccctcag

SEQ ID NO: 415273 - DNA, 25 bp, Mus musculus
gaacatctccaccttgtttagatag

SEQ ID NO: 415274 - DNA, 25 bp, Mus musculus
gaacatctccacgttgtttagatag

SEQ ID NO: 415275 - DNA, 25 bp, Mus musculus
gaacatctcccaccgaaatcatgac

SEQ ID NO: 415276 - DNA, 25 bp, Mus musculus
gaacatctcccagcgaaatcatgac

SEQ ID NO: 415277 - DNA, 25 bp, Mus musculus
gaacatctcccgcatcatggactgt

SEQ ID NO: 415278 - DNA, 25 bp, Mus musculus
gaacatctcccggatcatggactgt

SEQ ID NO: 415279 - DNA, 25 bp, Mus musculus
gaacatctcctgctttatgacctag

SEQ ID NO: 415280 - DNA, 25 bp, Mus musculus
gaacatctcctggtttatgacctag

SEQ ID NO: 415281 - DNA, 25 bp, Mus musculus
gaacatctctcaagcttcagcagaa

SEQ ID NO: 415282 - DNA, 25 bp, Mus musculus
gaacatctctcatgcttcagcagaa

SEQ ID NO: 415283 - DNA, 25 bp, Mus musculus
gaacatctctttctgtggataccat

SEQ ID NO: 415284 - DNA, 25 bp, Mus musculus
gaacatctctttgtgtggataccat

SEQ ID NO: 415285 - DNA, 25 bp, Mus musculus
gaacatctgaacatggtttcccaaa

SEQ ID NO: 415286 - DNA, 25 bp, Mus musculus
gaacatctgaacttggtttcccaaa

SEQ ID NO: 415287 - DNA, 25 bp, Mus musculus
gaacatctgactcggatctcaagac

SEQ ID NO: 415288 - DNA, 25 bp, Mus musculus
gaacatctgactgggatctcaagac

SEQ ID NO: 415289 - DNA, 25 bp, Mus musculus
gaacatctgagaagtgaaggtcagg

SEQ ID NO: 415290 - DNA, 25 bp, Mus musculus
gaacatctgagatgtgaaggtcagg

SEQ ID NO: 415291 - DNA, 25 bp, Mus musculus
gaacatctgctcatgcagaggacct

SEQ ID NO: 415292 - DNA, 25 bp, Mus musculus
gaacatctgctcttgcagaggacct

SEQ ID NO: 415293 - DNA, 25 bp, Mus musculus
gaacatctggaaaatacttttacta

SEQ ID NO: 415294 - DNA, 25 bp, Mus musculus
gaacatctggaatatacttttacta

SEQ ID NO: 415295 - DNA, 25 bp, Mus musculus
gaacatctggagaaccctgcgcttg

SEQ ID NO: 415296 - DNA, 25 bp, Mus musculus
gaacatctggagaacgttgcggtgt

SEQ ID NO: 415297 - DNA, 25 bp, Mus musculus
gaacatctggagtaccctgcgcttg

SEQ ID NO: 415298 - DNA, 25 bp, Mus musculus
gaacatctggagtacgttgcggtgt

SEQ ID NO: 415299 - DNA, 25 bp, Mus musculus
gaacatctgtctaactcagcagcca

SEQ ID NO: 415300 - DNA, 25 bp, Mus musculus
gaacatctgtctctggcaatgagaa

SEQ ID NO: 415301 - DNA, 25 bp, Mus musculus
gaacatctgtctgtggcaatgagaa

SEQ ID NO: 415302 - DNA, 25 bp, Mus musculus
gaacatctgtcttactcagcagcca

SEQ ID NO: 415303 - DNA, 25 bp, Mus musculus
gaacatctgtgaatatactcataat

SEQ ID NO: 415304 - DNA, 25 bp, Mus musculus
gaacatctgtgaatgagccaactca

SEQ ID NO: 415305 - DNA, 25 bp, Mus musculus
gaacatctgtgattatactcataat

SEQ ID NO: 415306 - DNA, 25 bp, Mus musculus
gaacatctgtgattgagccaactca

SEQ ID NO: 415307 - DNA, 25 bp, Mus musculus
gaacatctgttacaattgcctgtga

SEQ ID NO: 415308 - DNA, 25 bp, Mus musculus
gaacatctgttagaattgcctgtga

SEQ ID NO: 415309 - DNA, 25 bp, Mus musculus
gaacatctgttgcttgcattcctta

SEQ ID NO: 415310 - DNA, 25 bp, Mus musculus
gaacatctgttggttgcattcctta

SEQ ID NO: 415311 - DNA, 25 bp, Mus musculus
gaacatcttctacctggtgtgcgca

SEQ ID NO: 415312 - DNA, 25 bp, Mus musculus
gaacatcttctagctggtgtgcgca

SEQ ID NO: 415313 - DNA, 25 bp, Mus musculus
gaacatcttgctctgttggctgtga

SEQ ID NO: 415314 - DNA, 25 bp, Mus musculus
gaacatcttgctgtgttggctgtga

SEQ ID NO: 415315 - DNA, 25 bp, Mus musculus
gaacatcttgtaaacatatctgcca

SEQ ID NO: 415316 - DNA, 25 bp, Mus musculus
gaacatcttgtatacatatctgcca

SEQ ID NO: 415317 - DNA, 25 bp, Mus musculus
gaacatcttgtcagcctagtcagca

SEQ ID NO: 415318 - DNA, 25 bp, Mus musculus
gaacatcttgtctgcctagtcagca

SEQ ID NO: 415319 - DNA, 25 bp, Mus musculus
gaacatctttccacatcaataaata

SEQ ID NO: 415320 - DNA, 25 bp, Mus musculus
gaacatctttcctcatcaataaata

SEQ ID NO: 415321 - DNA, 25 bp, Mus musculus
gaacatcttttcatggatttgacat

SEQ ID NO: 415322 - DNA, 25 bp, Mus musculus
gaacatcttttcttggatttgacat

SEQ ID NO: 415323 - DNA, 25 bp, Mus musculus
gaacatctttttcaaatgccagact

SEQ ID NO: 415324 - DNA, 25 bp, Mus musculus
gaacatctttttcctcattcctgag

SEQ ID NO: 415325 - DNA, 25 bp, Mus musculus
gaacatctttttgaaatgccagact

SEQ ID NO: 415326 - DNA, 25 bp, Mus musculus
gaacatctttttgctcattcctgag

SEQ ID NO: 415327 - DNA, 25 bp, Mus musculus
gaacatgaaacacgcgctcagccct

SEQ ID NO: 415328 - DNA, 25 bp, Mus musculus
gaacatgaaacaggcgctcagccct

SEQ ID NO: 415329 - DNA, 25 bp, Mus musculus
gaacatgaacgtatctgtactcatt

SEQ ID NO: 415330 - DNA, 25 bp, Mus musculus
gaacatgaacgtttctgtactcatt

SEQ ID NO: 415331 - DNA, 25 bp, Mus musculus
gaacatgaacttctcttggagaaat

SEQ ID NO: 415332 - DNA, 25 bp, Mus musculus
gaacatgaacttgtcttggagaaat

SEQ ID NO: 415333 - DNA, 25 bp, Mus musculus
gaacatgacaccattcacagcacaa

SEQ ID NO: 415334 - DNA, 25 bp, Mus musculus
gaacatgacacctttcacagcacaa

SEQ ID NO: 415335 - DNA, 25 bp, Mus musculus
gaacatgacggcactcttaatgatg

SEQ ID NO: 415336 - DNA, 25 bp, Mus musculus
gaacatgacggctctcttaatgatg

SEQ ID NO: 415337 - DNA, 25 bp, Mus musculus
gaacatgacgttcatcatttgggca

SEQ ID NO: 415338 - DNA, 25 bp, Mus musculus
gaacatgacgttgatcatttgggca

SEQ ID NO: 415339 - DNA, 25 bp, Mus musculus
gaacatgactccctattattaccct

SEQ ID NO: 415340 - DNA, 25 bp, Mus musculus
gaacatgactccgtattattaccct

SEQ ID NO: 415341 - DNA, 25 bp, Mus musculus
gaacatgagacacgccggcgcagta

SEQ ID NO: 415342 - DNA, 25 bp, Mus musculus
gaacatgagacaggccggcgcagta

SEQ ID NO: 415343 - DNA, 25 bp, Mus musculus
gaacatgagcgcctcctgtcctgca

SEQ ID NO: 415344 - DNA, 25 bp, Mus musculus
gaacatgagcgcgtcctgtcctgca

SEQ ID NO: 415345 - DNA, 25 bp, Mus musculus
gaacatgagtgcattccctcaggaa

SEQ ID NO: 415346 - DNA, 25 bp, Mus musculus
gaacatgagtgctttccctcaggaa

SEQ ID NO: 415347 - DNA, 25 bp, Mus musculus
gaacatgatcatagttttacagtag

SEQ ID NO: 415348 - DNA, 25 bp, Mus musculus
gaacatgatcattgttttacagtag

SEQ ID NO: 415349 - DNA, 25 bp, Mus musculus
gaacatgatcctcagtgctacttgc

SEQ ID NO: 415350 - DNA, 25 bp, Mus musculus
gaacatgatcctgagtgctacttgc

SEQ ID NO: 415351 - DNA, 25 bp, Mus musculus
gaacatgatctcaattctcagataa

SEQ ID NO: 415352 - DNA, 25 bp, Mus musculus
gaacatgatctctattctcagataa

SEQ ID NO: 415353 - DNA, 25 bp, Mus musculus
gaacatgatctgaaccaccaattat

SEQ ID NO: 415354 - DNA, 25 bp, Mus musculus
gaacatgatctgtaccaccaattat

SEQ ID NO: 415355 - DNA, 25 bp, Mus musculus
gaacatgatgcaccatggtggctgt

SEQ ID NO: 415356 - DNA, 25 bp, Mus musculus
gaacatgatgcagcatggtggctgt

SEQ ID NO: 415357 - DNA, 25 bp, Mus musculus
gaacatgattatccctattccttga

SEQ ID NO: 415358 - DNA, 25 bp, Mus musculus
gaacatgattatgcctattccttga

SEQ ID NO: 415359 - DNA, 25 bp, Mus musculus
gaacatgattctaaagcgagctgcc

SEQ ID NO: 415360 - DNA, 25 bp, Mus musculus
gaacatgattcttaagcgagctgcc

SEQ ID NO: 415361 - DNA, 25 bp, Mus musculus
gaacatgcaaaaagtccggcctggg

SEQ ID NO: 415362 - DNA, 25 bp, Mus musculus
gaacatgcaaaatgtccggcctggg

SEQ ID NO: 415363 - DNA, 25 bp, Mus musculus
gaacatgcagccacgtattaccagg

SEQ ID NO: 415364 - DNA, 25 bp, Mus musculus
gaacatgcagcctcgtattaccagg

SEQ ID NO: 415365 - DNA, 25 bp, Mus musculus
gaacatgcagctaacagctggatct

SEQ ID NO: 415366 - DNA, 25 bp, Mus musculus
gaacatgcagctagcaaatacagaa

SEQ ID NO: 415367 - DNA, 25 bp, Mus musculus
gaacatgcagcttacagctggatct

SEQ ID NO: 415368 - DNA, 25 bp, Mus musculus
gaacatgcagcttgcaaatacagaa

SEQ ID NO: 415369 - DNA, 25 bp, Mus musculus
gaacatgcatagcaagagaagctct

SEQ ID NO: 415370 - DNA, 25 bp, Mus musculus
gaacatgcataggaagagaagctct

SEQ ID NO: 415371 - DNA, 25 bp, Mus musculus
gaacatgcattgacaatcttttgac

SEQ ID NO: 415372 - DNA, 25 bp, Mus musculus
gaacatgcattgtcaatcttttgac

SEQ ID NO: 415373 - DNA, 25 bp, Mus musculus
gaacatgcatttctcagaatttatc

SEQ ID NO: 415374 - DNA, 25 bp, Mus musculus
gaacatgcatttgtcagaatttatc

SEQ ID NO: 415375 - DNA, 25 bp, Mus musculus
gaacatgccaagatggcctcaggtt

SEQ ID NO: 415376 - DNA, 25 bp, Mus musculus
gaacatgccaagttggcctcaggtt

SEQ ID NO: 415377 - DNA, 25 bp, Mus musculus
gaacatgccacaaagaggagcagga

SEQ ID NO: 415378 - DNA, 25 bp, Mus musculus
gaacatgccacatagaggagcagga

SEQ ID NO: 415379 - DNA, 25 bp, Mus musculus
gaacatgccagcagacactgtgttt

SEQ ID NO: 415380 - DNA, 25 bp, Mus musculus
gaacatgccagctgacactgtgttt

SEQ ID NO: 415381 - DNA, 25 bp, Mus musculus
gaacatgccaggattctgtgaagga

SEQ ID NO: 415382 - DNA, 25 bp, Mus musculus
gaacatgccaggtttctgtgaagga

SEQ ID NO: 415383 - DNA, 25 bp, Mus musculus
gaacatgccatcaggtgccaaatga

SEQ ID NO: 415384 - DNA, 25 bp, Mus musculus
gaacatgccatctggtgccaaatga

SEQ ID NO: 415385 - DNA, 25 bp, Mus musculus
gaacatgccatgagaccattctcca

SEQ ID NO: 415386 - DNA, 25 bp, Mus musculus
gaacatgccatgtgaccattctcca

SEQ ID NO: 415387 - DNA, 25 bp, Mus musculus
gaacatgccgccactgggtgggaca

SEQ ID NO: 415388 - DNA, 25 bp, Mus musculus
gaacatgccgcctctgggtgggaca

SEQ ID NO: 415389 - DNA, 25 bp, Mus musculus
gaacatgccgtacgatgcttatcca

SEQ ID NO: 415390 - DNA, 25 bp, Mus musculus
gaacatgccgtaggatgcttatcca

SEQ ID NO: 415391 - DNA, 25 bp, Mus musculus
gaacatgcctacaatgcacacacag

SEQ ID NO: 415392 - DNA, 25 bp, Mus musculus
gaacatgcctactatgcacacacag

SEQ ID NO: 415393 - DNA, 25 bp, Mus musculus
gaacatgcgggtctccaacacgggc

SEQ ID NO: 415394 - DNA, 25 bp, Mus musculus
gaacatgcgggtgtccaacacgggc

SEQ ID NO: 415395 - DNA, 25 bp, Mus musculus
gaacatgcgtgtcatctttaattga

SEQ ID NO: 415396 - DNA, 25 bp, Mus musculus
gaacatgcgtgtgatctttaattga

SEQ ID NO: 415397 - DNA, 25 bp, Mus musculus
gaacatgctaccacaaagtgctgtg

SEQ ID NO: 415398 - DNA, 25 bp, Mus musculus
gaacatgctacctcaaagtgctgtg

SEQ ID NO: 415399 - DNA, 25 bp, Mus musculus
gaacatgctagtattaggtcttttt

SEQ ID NO: 415400 - DNA, 25 bp, Mus musculus
gaacatgctagttttaggtcttttt

SEQ ID NO: 415401 - DNA, 25 bp, Mus musculus
gaacatgctcaccaccagaaggacc

SEQ ID NO: 415402 - DNA, 25 bp, Mus musculus
gaacatgctcacgaccagaaggacc

SEQ ID NO: 415403 - DNA, 25 bp, Mus musculus
gaacatgctcagagactatgcagtg

SEQ ID NO: 415404 - DNA, 25 bp, Mus musculus
gaacatgctcagtgactatgcagtg

SEQ ID NO: 415405 - DNA, 25 bp, Mus musculus
gaacatgctcatctcttcttagtag

SEQ ID NO: 415406 - DNA, 25 bp, Mus musculus
gaacatgctcatgtcttcttagtag

SEQ ID NO: 415407 - DNA, 25 bp, Mus musculus
gaacatgctgacagtatcttacgga

SEQ ID NO: 415408 - DNA, 25 bp, Mus musculus
gaacatgctgactgtatcttacgga

SEQ ID NO: 415409 - DNA, 25 bp, Mus musculus
gaacatgctgatccaaaccattggt

SEQ ID NO: 415410 - DNA, 25 bp, Mus musculus
gaacatgctgatgcaaaccattggt

SEQ ID NO: 415411 - DNA, 25 bp, Mus musculus
gaacatgctgcaaagttactaggct

SEQ ID NO: 415412 - DNA, 25 bp, Mus musculus
gaacatgctgcatagttactaggct

SEQ ID NO: 415413 - DNA, 25 bp, Mus musculus
gaacatgctggaaatgggctatcaa

SEQ ID NO: 415414 - DNA, 25 bp, Mus musculus
gaacatgctggatatgggctatcaa

SEQ ID NO: 415415 - DNA, 25 bp, Mus musculus
gaacatgctggtcacaaggattcct

SEQ ID NO: 415416 - DNA, 25 bp, Mus musculus
gaacatgctggtgacaaggattcct

SEQ ID NO: 415417 - DNA, 25 bp, Mus musculus
gaacatgctgtcctcaagatgaaag

SEQ ID NO: 415418 - DNA, 25 bp, Mus musculus
gaacatgctgtcgtcaagatgaaag

SEQ ID NO: 415419 - DNA, 25 bp, Mus musculus
gaacatgcttaacgtcaaactgtcc

SEQ ID NO: 415420 - DNA, 25 bp, Mus musculus
gaacatgcttaaggtcaaactgtcc

SEQ ID NO: 415421 - DNA, 25 bp, Mus musculus
gaacatgctttacatctctactgtg

SEQ ID NO: 415422 - DNA, 25 bp, Mus musculus
gaacatgctttagatctctactgtg

SEQ ID NO: 415423 - DNA, 25 bp, Mus musculus
gaacatggacttctgtaacagtttc

SEQ ID NO: 415424 - DNA, 25 bp, Mus musculus
gaacatggacttgtgtaacagtttc

SEQ ID NO: 415425 - DNA, 25 bp, Mus musculus
gaacatggatgtatcgtagtctacc

SEQ ID NO: 415426 - DNA, 25 bp, Mus musculus
gaacatggatgtttcgtagtctacc

SEQ ID NO: 415427 - DNA, 25 bp, Mus musculus
gaacatggatttcattattcgcatt

SEQ ID NO: 415428 - DNA, 25 bp, Mus musculus
gaacatggatttgattattcgcatt

SEQ ID NO: 415429 - DNA, 25 bp, Mus musculus
gaacatggcattcctccttagagat

SEQ ID NO: 415430 - DNA, 25 bp, Mus musculus
gaacatggcattgctccttagagat

SEQ ID NO: 415431 - DNA, 25 bp, Mus musculus
gaacatggccacacttttcagtatt

SEQ ID NO: 415432 - DNA, 25 bp, Mus musculus
gaacatggccaccattgaaacaagg

SEQ ID NO: 415433 - DNA, 25 bp, Mus musculus
gaacatggccacgattgaaacaagg

SEQ ID NO: 415434 - DNA, 25 bp, Mus musculus
gaacatggccactcttttcagtatt

SEQ ID NO: 415435 - DNA, 25 bp, Mus musculus
gaacatggcggtaccaaaggcccat

SEQ ID NO: 415436 - DNA, 25 bp, Mus musculus
gaacatggcggttccaaaggcccat

SEQ ID NO: 415437 - DNA, 25 bp, Mus musculus
gaacatggcgtcaccttaatacctg

SEQ ID NO: 415438 - DNA, 25 bp, Mus musculus
gaacatggcgtctccttaatacctg

SEQ ID NO: 415439 - DNA, 25 bp, Mus musculus
gaacatggcgttaaaactctgataa

SEQ ID NO: 415440 - DNA, 25 bp, Mus musculus
gaacatggcgtttaaactctgataa

SEQ ID NO: 415441 - DNA, 25 bp, Mus musculus
gaacatggctacatctctcggtgct

SEQ ID NO: 415442 - DNA, 25 bp, Mus musculus
gaacatggctaccaaacttacctgc

SEQ ID NO: 415443 - DNA, 25 bp, Mus musculus
gaacatggctacgaaacttacctgc

SEQ ID NO: 415444 - DNA, 25 bp, Mus musculus
gaacatggctacttctctcggtgct

SEQ ID NO: 415445 - DNA, 25 bp, Mus musculus
gaacatggctatccggagtcactgc

SEQ ID NO: 415446 - DNA, 25 bp, Mus musculus
gaacatggctatgcggagtcactgc

SEQ ID NO: 415447 - DNA, 25 bp, Mus musculus
gaacatggctccattccaaatgact

SEQ ID NO: 415448 - DNA, 25 bp, Mus musculus
gaacatggctcctttccaaatgact

SEQ ID NO: 415449 - DNA, 25 bp, Mus musculus
gaacatggctctatatgccgacgtt

SEQ ID NO: 415450 - DNA, 25 bp, Mus musculus
gaacatggctctttatgccgacgtt

SEQ ID NO: 415451 - DNA, 25 bp, Mus musculus
gaacatggcttacagtgtcccgagg

SEQ ID NO: 415452 - DNA, 25 bp, Mus musculus
gaacatggcttagagtgtcccgagg

SEQ ID NO: 415453 - DNA, 25 bp, Mus musculus
gaacatggcttgcttcagaaagaaa

SEQ ID NO: 415454 - DNA, 25 bp, Mus musculus
gaacatggcttggttcagaaagaaa

SEQ ID NO: 415455 - DNA, 25 bp, Mus musculus
gaacatgggcaactttcttcagaaa

SEQ ID NO: 415456 - DNA, 25 bp, Mus musculus
gaacatgggcaagtttcttcagaaa

SEQ ID NO: 415457 - DNA, 25 bp, Mus musculus
gaacatgggctaaatacatacctgc

SEQ ID NO: 415458 - DNA, 25 bp, Mus musculus
gaacatgggctatatacatacctgc

SEQ ID NO: 415459 - DNA, 25 bp, Mus musculus
gaacatgggtttagttgccaacacc

SEQ ID NO: 415460 - DNA, 25 bp, Mus musculus
gaacatgggttttgttgccaacacc

SEQ ID NO: 415461 - DNA, 25 bp, Mus musculus
gaacatggtattcaatattctatcc

SEQ ID NO: 415462 - DNA, 25 bp, Mus musculus
gaacatggtattgaatattctatcc

SEQ ID NO: 415463 - DNA, 25 bp, Mus musculus
gaacatggtgaccattttcccagga

SEQ ID NO: 415464 - DNA, 25 bp, Mus musculus
gaacatggtgacgattttcccagga

SEQ ID NO: 415465 - DNA, 25 bp, Mus musculus
gaacatggttaaatcctttagactt

SEQ ID NO: 415466 - DNA, 25 bp, Mus musculus
gaacatggttaattcctttagactt

SEQ ID NO: 415467 - DNA, 25 bp, Mus musculus
gaacatggttcacacttctgtctac

SEQ ID NO: 415468 - DNA, 25 bp, Mus musculus
gaacatggttcagacttctgtctac

SEQ ID NO: 415469 - DNA, 25 bp, Mus musculus
gaacatgtaaaaccttactgtactg

SEQ ID NO: 415470 - DNA, 25 bp, Mus musculus
gaacatgtaaaagcttactgtactg

SEQ ID NO: 415471 - DNA, 25 bp, Mus musculus
gaacatgtaagcccgcataccctga

SEQ ID NO: 415472 - DNA, 25 bp, Mus musculus
gaacatgtaagcgcgcataccctga

SEQ ID NO: 415473 - DNA, 25 bp, Mus musculus
gaacatgtaatcacaacccctgaga

SEQ ID NO: 415474 - DNA, 25 bp, Mus musculus
gaacatgtaatctcaacccctgaga

SEQ ID NO: 415475 - DNA, 25 bp, Mus musculus
gaacatgtacccaagtcctatgaat

SEQ ID NO: 415476 - DNA, 25 bp, Mus musculus
gaacatgtaccctagtcctatgaat

SEQ ID NO: 415477 - DNA, 25 bp, Mus musculus
gaacatgtagaaaccagattccctg

SEQ ID NO: 415478 - DNA, 25 bp, Mus musculus
gaacatgtagaatccagattccctg

SEQ ID NO: 415479 - DNA, 25 bp, Mus musculus
gaacatgtagcccaaaccagacttt

SEQ ID NO: 415480 - DNA, 25 bp, Mus musculus
gaacatgtagccgaaaccagacttt

SEQ ID NO: 415481 - DNA, 25 bp, Mus musculus
gaacatgtagctctcctaggtcaca

SEQ ID NO: 415482 - DNA, 25 bp, Mus musculus
gaacatgtagctgtcctaggtcaca

SEQ ID NO: 415483 - DNA, 25 bp, Mus musculus
gaacatgtagtgatcccgggtgtcc

SEQ ID NO: 415484 - DNA, 25 bp, Mus musculus
gaacatgtagtgttcccgggtgtcc

SEQ ID NO: 415485 - DNA, 25 bp, Mus musculus
gaacatgtatctactgcttttgcca

SEQ ID NO: 415486 - DNA, 25 bp, Mus musculus
gaacatgtatcttctgcttttgcca

SEQ ID NO: 415487 - DNA, 25 bp, Mus musculus
gaacatgtattcagcaaagcctgaa

SEQ ID NO: 415488 - DNA, 25 bp, Mus musculus
gaacatgtattctgcaaagcctgaa

SEQ ID NO: 415489 - DNA, 25 bp, Mus musculus
gaacatgtcaccactcagagagggc

SEQ ID NO: 415490 - DNA, 25 bp, Mus musculus
gaacatgtcacctctcagagagggc

SEQ ID NO: 415491 - DNA, 25 bp, Mus musculus
gaacatgtccatcgtccgagatgcc

SEQ ID NO: 415492 - DNA, 25 bp, Mus musculus
gaacatgtccatggtccgagatgcc

SEQ ID NO: 415493 - DNA, 25 bp, Mus musculus
gaacatgtcctacgaaactcaccat

SEQ ID NO: 415494 - DNA, 25 bp, Mus musculus
gaacatgtcctaggaaactcaccat

SEQ ID NO: 415495 - DNA, 25 bp, Mus musculus
gaacatgtctagatgcatattttaa

SEQ ID NO: 415496 - DNA, 25 bp, Mus musculus
gaacatgtctagttgcatattttaa

SEQ ID NO: 415497 - DNA, 25 bp, Mus musculus
gaacatgtctcacttgattctccct

SEQ ID NO: 415498 - DNA, 25 bp, Mus musculus
gaacatgtctcagttgattctccct

SEQ ID NO: 415499 - DNA, 25 bp, Mus musculus
gaacatgtctccacttggagatcct

SEQ ID NO: 415500 - DNA, 25 bp, Mus musculus
gaacatgtctcctcttggagatcct

SEQ ID NO: 415501 - DNA, 25 bp, Mus musculus
gaacatgtcttgacaagtgaatcta

SEQ ID NO: 415502 - DNA, 25 bp, Mus musculus
gaacatgtcttgtcaagtgaatcta

SEQ ID NO: 415503 - DNA, 25 bp, Mus musculus
gaacatgtctttctcatcaaactcc

SEQ ID NO: 415504 - DNA, 25 bp, Mus musculus
gaacatgtctttgtcatcaaactcc

SEQ ID NO: 415505 - DNA, 25 bp, Mus musculus
gaacatgtgactcaggacctacgga

SEQ ID NO: 415506 - DNA, 25 bp, Mus musculus
gaacatgtgactgaggacctacgga

SEQ ID NO: 415507 - DNA, 25 bp, Mus musculus
gaacatgtgcccatctatgaacctc

SEQ ID NO: 415508 - DNA, 25 bp, Mus musculus
gaacatgtgcccttctatgaacctc

SEQ ID NO: 415509 - DNA, 25 bp, Mus musculus
gaacatgtgcctattctgaattatg

SEQ ID NO: 415510 - DNA, 25 bp, Mus musculus
gaacatgtgccttttctgaattatg

SEQ ID NO: 415511 - DNA, 25 bp, Mus musculus
gaacatgtggtcataacagcctttt

SEQ ID NO: 415512 - DNA, 25 bp, Mus musculus
gaacatgtggtcttaacagcctttt

SEQ ID NO: 415513 - DNA, 25 bp, Mus musculus
gaacatgtggttaagtctagctcca

SEQ ID NO: 415514 - DNA, 25 bp, Mus musculus
gaacatgtggttatcttgctcaccc

SEQ ID NO: 415515 - DNA, 25 bp, Mus musculus
gaacatgtggtttagtctagctcca

SEQ ID NO: 415516 - DNA, 25 bp, Mus musculus
gaacatgtggttttcttgctcaccc

SEQ ID NO: 415517 - DNA, 25 bp, Mus musculus
gaacatgtgtgaaaaataacttcca

SEQ ID NO: 415518 - DNA, 25 bp, Mus musculus
gaacatgtgtgataaataacttcca

SEQ ID NO: 415519 - DNA, 25 bp, Mus musculus
gaacatgtgttcaggactctggcct

SEQ ID NO: 415520 - DNA, 25 bp, Mus musculus
gaacatgtgttctggactctggcct

SEQ ID NO: 415521 - DNA, 25 bp, Mus musculus
gaacatgttactaccattatctttg

SEQ ID NO: 415522 - DNA, 25 bp, Mus musculus
gaacatgttacttccattatctttg

SEQ ID NO: 415523 - DNA, 25 bp, Mus musculus
gaacatgttcatcggtcctgggctt

SEQ ID NO: 415524 - DNA, 25 bp, Mus musculus
gaacatgttcatgggtcctgggctt

SEQ ID NO: 415525 - DNA, 25 bp, Mus musculus
gaacatgttccgctaaccaagcttg

SEQ ID NO: 415526 - DNA, 25 bp, Mus musculus
gaacatgttccggtaaccaagcttg

SEQ ID NO: 415527 - DNA, 25 bp, Mus musculus
gaacatgttctaacagcctaaatga

SEQ ID NO: 415528 - DNA, 25 bp, Mus musculus
gaacatgttctatcagcctaaatga

SEQ ID NO: 415529 - DNA, 25 bp, Mus musculus
gaacatgttctgaagagccagggct

SEQ ID NO: 415530 - DNA, 25 bp, Mus musculus
gaacatgttctgaagccctatcctg

SEQ ID NO: 415531 - DNA, 25 bp, Mus musculus
gaacatgttctgtagagccagggct

SEQ ID NO: 415532 - DNA, 25 bp, Mus musculus
gaacatgttctgtagccctatcctg

SEQ ID NO: 415533 - DNA, 25 bp, Mus musculus
gaacatgttcttaggttccacatat

SEQ ID NO: 415534 - DNA, 25 bp, Mus musculus
gaacatgttctttggttccacatat

SEQ ID NO: 415535 - DNA, 25 bp, Mus musculus
gaacatgttgctaaccgcaccattc

SEQ ID NO: 415536 - DNA, 25 bp, Mus musculus
gaacatgttgcttaccgcaccattc

SEQ ID NO: 415537 - DNA, 25 bp, Mus musculus
gaacatgttggcagcggtacgagct

SEQ ID NO: 415538 - DNA, 25 bp, Mus musculus
gaacatgttggctgcggtacgagct

SEQ ID NO: 415539 - DNA, 25 bp, Mus musculus
gaacatgttttacgactctactcag

SEQ ID NO: 415540 - DNA, 25 bp, Mus musculus
gaacatgttttaggactctactcag

SEQ ID NO: 415541 - DNA, 25 bp, Mus musculus
gaacatgtttttctgaccatcatga

SEQ ID NO: 415542 - DNA, 25 bp, Mus musculus
gaacatgtttttgtgaccatcatga

SEQ ID NO: 415543 - DNA, 25 bp, Mus musculus
gaacattaatagagtctaccctaga

SEQ ID NO: 415544 - DNA, 25 bp, Mus musculus
gaacattaatagtgtctaccctaga

SEQ ID NO: 415545 - DNA, 25 bp, Mus musculus
gaacattaatccaccagatgcaagg

SEQ ID NO: 415546 - DNA, 25 bp, Mus musculus
gaacattaatcctccagatgcaagg

SEQ ID NO: 415547 - DNA, 25 bp, Mus musculus
gaacattacattatcaaagctagct

SEQ ID NO: 415548 - DNA, 25 bp, Mus musculus
gaacattacattttcaaagctagct

SEQ ID NO: 415549 - DNA, 25 bp, Mus musculus
gaacattacccactagcagtcctgt

SEQ ID NO: 415550 - DNA, 25 bp, Mus musculus
gaacattacccagtagcagtcctgt

SEQ ID NO: 415551 - DNA, 25 bp, Mus musculus
gaacattactctccggtaaatctaa

SEQ ID NO: 415552 - DNA, 25 bp, Mus musculus
gaacattactctgcggtaaatctaa

SEQ ID NO: 415553 - DNA, 25 bp, Mus musculus
gaacattagagtcccaagtcaaagt

SEQ ID NO: 415554 - DNA, 25 bp, Mus musculus
gaacattagagtgccaagtcaaagt

SEQ ID NO: 415555 - DNA, 25 bp, Mus musculus
gaacattagctgaccttctgtgtta

SEQ ID NO: 415556 - DNA, 25 bp, Mus musculus
gaacattagctgtccttctgtgtta

SEQ ID NO: 415557 - DNA, 25 bp, Mus musculus
gaacattagggaacccacactggga

SEQ ID NO: 415558 - DNA, 25 bp, Mus musculus
gaacattagggatcccacactggga

SEQ ID NO: 415559 - DNA, 25 bp, Mus musculus
gaacattagttacacccatctcact

SEQ ID NO: 415560 - DNA, 25 bp, Mus musculus
gaacattagttacctcgtcatataa

SEQ ID NO: 415561 - DNA, 25 bp, Mus musculus
gaacattagttagacccatctcact

SEQ ID NO: 415562 - DNA, 25 bp, Mus musculus
gaacattagttagctcgtcatataa

SEQ ID NO: 415563 - DNA, 25 bp, Mus musculus
gaacattatctgatgtgctgtatcc

SEQ ID NO: 415564 - DNA, 25 bp, Mus musculus
gaacattatctgttgtgctgtatcc

SEQ ID NO: 415565 - DNA, 25 bp, Mus musculus
gaacattatgcaacattggagggat

SEQ ID NO: 415566 - DNA, 25 bp, Mus musculus
gaacattatgcacagatgcacacaa

SEQ ID NO: 415567 - DNA, 25 bp, Mus musculus
gaacattatgcagagatgcacacaa

SEQ ID NO: 415568 - DNA, 25 bp, Mus musculus
gaacattatgcatcattggagggat

SEQ ID NO: 415569 - DNA, 25 bp, Mus musculus
gaacattatggcattctgcctggca

SEQ ID NO: 415570 - DNA, 25 bp, Mus musculus
gaacattatggctttctgcctggca

SEQ ID NO: 415571 - DNA, 25 bp, Mus musculus
gaacattcaagtccttctcagtcat

SEQ ID NO: 415572 - DNA, 25 bp, Mus musculus
gaacattcaagtgcttctcagtcat

SEQ ID NO: 415573 - DNA, 25 bp, Mus musculus
gaacattcacaaaactgtagtatat

SEQ ID NO: 415574 - DNA, 25 bp, Mus musculus
gaacattcacaatactgtagtatat

SEQ ID NO: 415575 - DNA, 25 bp, Mus musculus
gaacattcacacagacgtgctgaag

SEQ ID NO: 415576 - DNA, 25 bp, Mus musculus
gaacattcacactgacgtgctgaag

SEQ ID NO: 415577 - DNA, 25 bp, Mus musculus
gaacattcagctactgtctcttgta

SEQ ID NO: 415578 - DNA, 25 bp, Mus musculus
gaacattcagcttctgtctcttgta

SEQ ID NO: 415579 - DNA, 25 bp, Mus musculus
gaacattcatagcaccaaggactct

SEQ ID NO: 415580 - DNA, 25 bp, Mus musculus
gaacattcataggaccaaggactct

SEQ ID NO: 415581 - DNA, 25 bp, Mus musculus
gaacattcatatagctctggctaca

SEQ ID NO: 415582 - DNA, 25 bp, Mus musculus
gaacattcatattgctctggctaca

SEQ ID NO: 415583 - DNA, 25 bp, Mus musculus
gaacattcatcacggaactttcctc

SEQ ID NO: 415584 - DNA, 25 bp, Mus musculus
gaacattcatcagggaactttcctc

SEQ ID NO: 415585 - DNA, 25 bp, Mus musculus
gaacattccactccagtcatgtctg

SEQ ID NO: 415586 - DNA, 25 bp, Mus musculus
gaacattccactgcagtcatgtctg

SEQ ID NO: 415587 - DNA, 25 bp, Mus musculus
gaacattccagaagttgcacctgtt

SEQ ID NO: 415588 - DNA, 25 bp, Mus musculus
gaacattccagaatcgcatcaacgt

SEQ ID NO: 415589 - DNA, 25 bp, Mus musculus
gaacattccagacaacaaatgctat

SEQ ID NO: 415590 - DNA, 25 bp, Mus musculus
gaacattccagagaacaaatgctat

SEQ ID NO: 415591 - DNA, 25 bp, Mus musculus
gaacattccagatgttgcacctgtt

SEQ ID NO: 415592 - DNA, 25 bp, Mus musculus
gaacattccagattcgcatcaacgt

SEQ ID NO: 415593 - DNA, 25 bp, Mus musculus
gaacattcccatcaccctaagatgt

SEQ ID NO: 415594 - DNA, 25 bp, Mus musculus
gaacattcccatgaccctaagatgt

SEQ ID NO: 415595 - DNA, 25 bp, Mus musculus
gaacattccccaatagatagagcaa

SEQ ID NO: 415596 - DNA, 25 bp, Mus musculus
gaacattccccattagatagagcaa

SEQ ID NO: 415597 - DNA, 25 bp, Mus musculus
gaacattccgcaacttgggactccg

SEQ ID NO: 415598 - DNA, 25 bp, Mus musculus
gaacattccgcatcttgggactccg

SEQ ID NO: 415599 - DNA, 25 bp, Mus musculus
gaacattcctaactctcaagggcta

SEQ ID NO: 415600 - DNA, 25 bp, Mus musculus
gaacattcctaagtctcaagggcta

SEQ ID NO: 415601 - DNA, 25 bp, Mus musculus
gaacattcctcactcttagggtcac

SEQ ID NO: 415602 - DNA, 25 bp, Mus musculus
gaacattcctcagtcttagggtcac

SEQ ID NO: 415603 - DNA, 25 bp, Mus musculus
gaacattccttccataaccagcaat

SEQ ID NO: 415604 - DNA, 25 bp, Mus musculus
gaacattccttcgataaccagcaat

SEQ ID NO: 415605 - DNA, 25 bp, Mus musculus
gaacattctaaacgaggcggtgaga

SEQ ID NO: 415606 - DNA, 25 bp, Mus musculus
gaacattctaaaggaggcggtgaga

SEQ ID NO: 415607 - DNA, 25 bp, Mus musculus
gaacattctacaacatattacctgt

SEQ ID NO: 415608 - DNA, 25 bp, Mus musculus
gaacattctacatcatattacctgt

SEQ ID NO: 415609 - DNA, 25 bp, Mus musculus
gaacattctataactctagtttcag

SEQ ID NO: 415610 - DNA, 25 bp, Mus musculus
gaacattctatatctctagtttcag

SEQ ID NO: 415611 - DNA, 25 bp, Mus musculus
gaacattctatgctagagtaaactt

SEQ ID NO: 415612 - DNA, 25 bp, Mus musculus
gaacattctatggtagagtaaactt

SEQ ID NO: 415613 - DNA, 25 bp, Mus musculus
gaacattctccaacgtgatcctaga

SEQ ID NO: 415614 - DNA, 25 bp, Mus musculus
gaacattctccatcgtgatcctaga

SEQ ID NO: 415615 - DNA, 25 bp, Mus musculus
gaacattctcgcactcaaaagaagc

SEQ ID NO: 415616 - DNA, 25 bp, Mus musculus
gaacattctcgctctcaaaagaagc

SEQ ID NO: 415617 - DNA, 25 bp, Mus musculus
gaacattctcttaaatccctttaag

SEQ ID NO: 415618 - DNA, 25 bp, Mus musculus
gaacattctcttaccatcactgaga

SEQ ID NO: 415619 - DNA, 25 bp, Mus musculus
gaacattctctttaatccctttaag

SEQ ID NO: 415620 - DNA, 25 bp, Mus musculus
gaacattctctttccatcactgaga

SEQ ID NO: 415621 - DNA, 25 bp, Mus musculus
gaacattctggcatagatgattctc

SEQ ID NO: 415622 - DNA, 25 bp, Mus musculus
gaacattctggcttagatgattctc

SEQ ID NO: 415623 - DNA, 25 bp, Mus musculus
gaacattcttcaactatactcctga

SEQ ID NO: 415624 - DNA, 25 bp, Mus musculus
gaacattcttcatctatactcctga

SEQ ID NO: 415625 - DNA, 25 bp, Mus musculus
gaacattcttttcaggtttcactgt

SEQ ID NO: 415626 - DNA, 25 bp, Mus musculus
gaacattcttttctaacttggcatt

SEQ ID NO: 415627 - DNA, 25 bp, Mus musculus
gaacattcttttgaggtttcactgt

SEQ ID NO: 415628 - DNA, 25 bp, Mus musculus
gaacattcttttgtaacttggcatt

SEQ ID NO: 415629 - DNA, 25 bp, Mus musculus
gaacattgacagcacaaggcctggt

SEQ ID NO: 415630 - DNA, 25 bp, Mus musculus
gaacattgacaggacaaggcctggt

SEQ ID NO: 415631 - DNA, 25 bp, Mus musculus
gaacattgacatagctgtgctcact

SEQ ID NO: 415632 - DNA, 25 bp, Mus musculus
gaacattgacattgctgtgctcact

SEQ ID NO: 415633 - DNA, 25 bp, Mus musculus
gaacattgaccaacttagcgatgac

SEQ ID NO: 415634 - DNA, 25 bp, Mus musculus
gaacattgaccatcttagcgatgac

SEQ ID NO: 415635 - DNA, 25 bp, Mus musculus
gaacattgacgaaggcacctcggac

SEQ ID NO: 415636 - DNA, 25 bp, Mus musculus
gaacattgacgatggcacctcggac

SEQ ID NO: 415637 - DNA, 25 bp, Mus musculus
gaacattgacttctggatcagctgt

SEQ ID NO: 415638 - DNA, 25 bp, Mus musculus
gaacattgacttgtggatcagctgt

SEQ ID NO: 415639 - DNA, 25 bp, Mus musculus
gaacattgagcacctcttcaccaaa

SEQ ID NO: 415640 - DNA, 25 bp, Mus musculus
gaacattgagcagctcttcaccaaa

SEQ ID NO: 415641 - DNA, 25 bp, Mus musculus
gaacattgcaacaaagaccttctgg

SEQ ID NO: 415642 - DNA, 25 bp, Mus musculus
gaacattgcaactaagaccttctgg

SEQ ID NO: 415643 - DNA, 25 bp, Mus musculus
gaacattgcatgctaggcagctaat

SEQ ID NO: 415644 - DNA, 25 bp, Mus musculus
gaacattgcatggtaggcagctaat

SEQ ID NO: 415645 - DNA, 25 bp, Mus musculus
gaacattgccacacccatgatgggc

SEQ ID NO: 415646 - DNA, 25 bp, Mus musculus
gaacattgccactcccatgatgggc

SEQ ID NO: 415647 - DNA, 25 bp, Mus musculus
gaacattgccccacagggacttcag

SEQ ID NO: 415648 - DNA, 25 bp, Mus musculus
gaacattgcccctcagggacttcag

SEQ ID NO: 415649 - DNA, 25 bp, Mus musculus
gaacattgctctctttcccagagta

SEQ ID NO: 415650 - DNA, 25 bp, Mus musculus
gaacattgctctgtttcccagagta

SEQ ID NO: 415651 - DNA, 25 bp, Mus musculus
gaacattgctgcatggccaagacag

SEQ ID NO: 415652 - DNA, 25 bp, Mus musculus
gaacattgctgcttggccaagacag

SEQ ID NO: 415653 - DNA, 25 bp, Mus musculus
gaacattggcgccattggtctagag

SEQ ID NO: 415654 - DNA, 25 bp, Mus musculus
gaacattggcgcgattggtctagag

SEQ ID NO: 415655 - DNA, 25 bp, Mus musculus
gaacattgggacagtactctcctat

SEQ ID NO: 415656 - DNA, 25 bp, Mus musculus
gaacattgggactgtactctcctat

SEQ ID NO: 415657 - DNA, 25 bp, Mus musculus
gaacattgggccatctatgtggaag

SEQ ID NO: 415658 - DNA, 25 bp, Mus musculus
gaacattgggccttctatgtggaag

SEQ ID NO: 415659 - DNA, 25 bp, Mus musculus
gaacattggtatagtctctgtgttt

SEQ ID NO: 415660 - DNA, 25 bp, Mus musculus
gaacattggtattgtctctgtgttt

SEQ ID NO: 415661 - DNA, 25 bp, Mus musculus
gaacattgtaatccctcgggacatt

SEQ ID NO: 415662 - DNA, 25 bp, Mus musculus
gaacattgtaatctggtctgtgctt

SEQ ID NO: 415663 - DNA, 25 bp, Mus musculus
gaacattgtaatgcctcgggacatt

SEQ ID NO: 415664 - DNA, 25 bp, Mus musculus
gaacattgtaatgtggtctgtgctt

SEQ ID NO: 415665 - DNA, 25 bp, Mus musculus
gaacattgtaccaggctttgggccc

SEQ ID NO: 415666 - DNA, 25 bp, Mus musculus
gaacattgtacctggctttgggccc

SEQ ID NO: 415667 - DNA, 25 bp, Mus musculus
gaacattgtcctaagaacctggagc

SEQ ID NO: 415668 - DNA, 25 bp, Mus musculus
gaacattgtccttagaacctggagc

SEQ ID NO: 415669 - DNA, 25 bp, Mus musculus
gaacattgtctacctgtatctttgt

SEQ ID NO: 415670 - DNA, 25 bp, Mus musculus
gaacattgtctagctgtatctttgt

SEQ ID NO: 415671 - DNA, 25 bp, Mus musculus
gaacattgtggacctttccttatct

SEQ ID NO: 415672 - DNA, 25 bp, Mus musculus
gaacattgtggagctttccttatct

SEQ ID NO: 415673 - DNA, 25 bp, Mus musculus
gaacattgttcaagtgcgcacagca

SEQ ID NO: 415674 - DNA, 25 bp, Mus musculus
gaacattgttcatgtgcgcacagca

SEQ ID NO: 415675 - DNA, 25 bp, Mus musculus
gaacattgttccaatcttcaaaagg

SEQ ID NO: 415676 - DNA, 25 bp, Mus musculus
gaacattgttcctatcttcaaaagg

SEQ ID NO: 415677 - DNA, 25 bp, Mus musculus
gaacattgttgtccccaaagagctg

SEQ ID NO: 415678 - DNA, 25 bp, Mus musculus
gaacattgttgtgcccaaagagctg

SEQ ID NO: 415679 - DNA, 25 bp, Mus musculus
gaacattgttttctttccactaggt

SEQ ID NO: 415680 - DNA, 25 bp, Mus musculus
gaacattgttttgtttccactaggt

SEQ ID NO: 415681 - DNA, 25 bp, Mus musculus
gaacatttaaaaccaactacctgaa

SEQ ID NO: 415682 - DNA, 25 bp, Mus musculus
gaacatttaaaagcaactacctgaa

SEQ ID NO: 415683 - DNA, 25 bp, Mus musculus
gaacatttaatgaaaacgtccactg

SEQ ID NO: 415684 - DNA, 25 bp, Mus musculus
gaacatttaatgtaaacgtccactg

SEQ ID NO: 415685 - DNA, 25 bp, Mus musculus
gaacatttaccaacttttgattccc

SEQ ID NO: 415686 - DNA, 25 bp, Mus musculus
gaacatttaccatcttttgattccc

SEQ ID NO: 415687 - DNA, 25 bp, Mus musculus
gaacatttactgaggtcatggatcc

SEQ ID NO: 415688 - DNA, 25 bp, Mus musculus
gaacatttactgtggtcatggatcc

SEQ ID NO: 415689 - DNA, 25 bp, Mus musculus
gaacatttagtccacattgtcttgt

SEQ ID NO: 415690 - DNA, 25 bp, Mus musculus
gaacatttagtcgacattgtcttgt

SEQ ID NO: 415691 - DNA, 25 bp, Mus musculus
gaacatttatctaagcccacatttg

SEQ ID NO: 415692 - DNA, 25 bp, Mus musculus
gaacatttatcttagcccacatttg

SEQ ID NO: 415693 - DNA, 25 bp, Mus musculus
gaacatttcaagacaggtactgagc

SEQ ID NO: 415694 - DNA, 25 bp, Mus musculus
gaacatttcaagtcaggtactgagc

SEQ ID NO: 415695 - DNA, 25 bp, Mus musculus
gaacatttcataacattaacctcta

SEQ ID NO: 415696 - DNA, 25 bp, Mus musculus
gaacatttcatactgggtcaatcaa

SEQ ID NO: 415697 - DNA, 25 bp, Mus musculus
gaacatttcatagtgggtcaatcaa

SEQ ID NO: 415698 - DNA, 25 bp, Mus musculus
gaacatttcatatcattaacctcta

SEQ ID NO: 415699 - DNA, 25 bp, Mus musculus
gaacatttccctcacaatttctatc

SEQ ID NO: 415700 - DNA, 25 bp, Mus musculus
gaacatttccctgacaatttctatc

SEQ ID NO: 415701 - DNA, 25 bp, Mus musculus
gaacatttctatagacttcgggtgg

SEQ ID NO: 415702 - DNA, 25 bp, Mus musculus
gaacatttctatctcatttattgta

SEQ ID NO: 415703 - DNA, 25 bp, Mus musculus
gaacatttctatgtcatttattgta

SEQ ID NO: 415704 - DNA, 25 bp, Mus musculus
gaacatttctattgacttcgggtgg

SEQ ID NO: 415705 - DNA, 25 bp, Mus musculus
gaacatttctccattgcagatctcg

SEQ ID NO: 415706 - DNA, 25 bp, Mus musculus
gaacatttctcctttgcagatctcg

SEQ ID NO: 415707 - DNA, 25 bp, Mus musculus
gaacatttctctagtccagtttata

SEQ ID NO: 415708 - DNA, 25 bp, Mus musculus
gaacatttctcttgtccagtttata

SEQ ID NO: 415709 - DNA, 25 bp, Mus musculus
gaacatttctgtataccattctgat

SEQ ID NO: 415710 - DNA, 25 bp, Mus musculus
gaacatttctgtttaccattctgat

SEQ ID NO: 415711 - DNA, 25 bp, Mus musculus
gaacatttgcaaaggtgcccagaga

SEQ ID NO: 415712 - DNA, 25 bp, Mus musculus
gaacatttgcaatggtgcccagaga

SEQ ID NO: 415713 - DNA, 25 bp, Mus musculus
gaacatttgcaccaacttagagctg

SEQ ID NO: 415714 - DNA, 25 bp, Mus musculus
gaacatttgcacgaacttagagctg

SEQ ID NO: 415715 - DNA, 25 bp, Mus musculus
gaacatttgcatacttttagaggac

SEQ ID NO: 415716 - DNA, 25 bp, Mus musculus
gaacatttgcattcttttagaggac

SEQ ID NO: 415717 - DNA, 25 bp, Mus musculus
gaacatttgctcaccaacccagaga

SEQ ID NO: 415718 - DNA, 25 bp, Mus musculus
gaacatttgctctccaacccagaga

SEQ ID NO: 415719 - DNA, 25 bp, Mus musculus
gaacatttgcttacaggcacttgtg

SEQ ID NO: 415720 - DNA, 25 bp, Mus musculus
gaacatttgctttcaggcacttgtg

SEQ ID NO: 415721 - DNA, 25 bp, Mus musculus
gaacatttggctattcctggtatct

SEQ ID NO: 415722 - DNA, 25 bp, Mus musculus
gaacatttggcttttcctggtatct

SEQ ID NO: 415723 - DNA, 25 bp, Mus musculus
gaacatttgtctagtaaggtaccgt

SEQ ID NO: 415724 - DNA, 25 bp, Mus musculus
gaacatttgtcttgtaaggtaccgt

SEQ ID NO: 415725 - DNA, 25 bp, Mus musculus
gaacatttgtgaccttcttgctgtt

SEQ ID NO: 415726 - DNA, 25 bp, Mus musculus
gaacatttgtgagcttcttgctgtt

SEQ ID NO: 415727 - DNA, 25 bp, Mus musculus
gaacatttgtgcaggactcttactt

SEQ ID NO: 415728 - DNA, 25 bp, Mus musculus
gaacatttgtgcctcaagtgccaag

SEQ ID NO: 415729 - DNA, 25 bp, Mus musculus
gaacatttgtgcgtcaagtgccaag

SEQ ID NO: 415730 - DNA, 25 bp, Mus musculus
gaacatttgtgctggactcttactt

SEQ ID NO: 415731 - DNA, 25 bp, Mus musculus
gaacattttagacctgccattgatg

SEQ ID NO: 415732 - DNA, 25 bp, Mus musculus
gaacattttagagctgccattgatg

SEQ ID NO: 415733 - DNA, 25 bp, Mus musculus
gaacattttaggcaacccctgtgat

SEQ ID NO: 415734 - DNA, 25 bp, Mus musculus
gaacattttagggaacccctgtgat

SEQ ID NO: 415735 - DNA, 25 bp, Mus musculus
gaacattttataagatagcctagtc

SEQ ID NO: 415736 - DNA, 25 bp, Mus musculus
gaacattttatatgatagcctagtc

SEQ ID NO: 415737 - DNA, 25 bp, Mus musculus
gaacattttatcacatgcggcttgg

SEQ ID NO: 415738 - DNA, 25 bp, Mus musculus
gaacattttatctcatgcggcttgg

SEQ ID NO: 415739 - DNA, 25 bp, Mus musculus
gaacattttcatcatcaaaacctgt

SEQ ID NO: 415740 - DNA, 25 bp, Mus musculus
gaacattttcatgatcaaaacctgt

SEQ ID NO: 415741 - DNA, 25 bp, Mus musculus
gaacattttcccacaagagaggaga

SEQ ID NO: 415742 - DNA, 25 bp, Mus musculus
gaacattttcccattatgccaagat

SEQ ID NO: 415743 - DNA, 25 bp, Mus musculus
gaacattttccctcaagagaggaga

SEQ ID NO: 415744 - DNA, 25 bp, Mus musculus
gaacattttccctttatgccaagat

SEQ ID NO: 415745 - DNA, 25 bp, Mus musculus
gaacattttcgaactcctcttctgg

SEQ ID NO: 415746 - DNA, 25 bp, Mus musculus
gaacattttcgatctcctcttctgg

SEQ ID NO: 415747 - DNA, 25 bp, Mus musculus
gaacattttcgtcgagagctcttta

SEQ ID NO: 415748 - DNA, 25 bp, Mus musculus
gaacattttcgtggagagctcttta

SEQ ID NO: 415749 - DNA, 25 bp, Mus musculus
gaacattttctaactaccttgtgtg

SEQ ID NO: 415750 - DNA, 25 bp, Mus musculus
gaacattttctatctaccttgtgtg

SEQ ID NO: 415751 - DNA, 25 bp, Mus musculus
gaacattttgataagctgtgtgcat

SEQ ID NO: 415752 - DNA, 25 bp, Mus musculus
gaacattttgattagctgtgtgcat

SEQ ID NO: 415753 - DNA, 25 bp, Mus musculus
gaacattttgcacagtttggccatg

SEQ ID NO: 415754 - DNA, 25 bp, Mus musculus
gaacattttgcagagtttggccatg

SEQ ID NO: 415755 - DNA, 25 bp, Mus musculus
gaacattttgtaccacttctgtgat

SEQ ID NO: 415756 - DNA, 25 bp, Mus musculus
gaacattttgtagcacttctgtgat

SEQ ID NO: 415757 - DNA, 25 bp, Mus musculus
gaacattttgtcaccaaattggtga

SEQ ID NO: 415758 - DNA, 25 bp, Mus musculus
gaacattttgtctccaaattggtga

SEQ ID NO: 415759 - DNA, 25 bp, Mus musculus
gaacattttgttacactggtgtttg

SEQ ID NO: 415760 - DNA, 25 bp, Mus musculus
gaacattttgtttcactggtgtttg

SEQ ID NO: 415761 - DNA, 25 bp, Mus musculus
gaacatttttctacgtgtccatact

SEQ ID NO: 415762 - DNA, 25 bp, Mus musculus
gaacatttttcttcgtgtccatact

SEQ ID NO: 415763 - DNA, 25 bp, Mus musculus
gaacatttttgtacacccatctgaa

SEQ ID NO: 415764 - DNA, 25 bp, Mus musculus
gaacatttttgttcacccatctgaa

SEQ ID NO: 415765 - DNA, 25 bp, Mus musculus
gaaccaaaaactcccaatgcagaga

SEQ ID NO: 415766 - DNA, 25 bp, Mus musculus
gaaccaaaaactgccaatgcagaga

SEQ ID NO: 415767 - DNA, 25 bp, Mus musculus
gaaccaaaatcccttaagtcctctg

SEQ ID NO: 415768 - DNA, 25 bp, Mus musculus
gaaccaaaatccgttaagtcctctg

SEQ ID NO: 415769 - DNA, 25 bp, Mus musculus
gaaccaaacaccattatttacagag

SEQ ID NO: 415770 - DNA, 25 bp, Mus musculus
gaaccaaacacctttatttacagag

SEQ ID NO: 415771 - DNA, 25 bp, Mus musculus
gaaccaaacactaaggccgtcatct

SEQ ID NO: 415772 - DNA, 25 bp, Mus musculus
gaaccaaacacttaggccgtcatct

SEQ ID NO: 415773 - DNA, 25 bp, Mus musculus
gaaccaaaccaactgtgtgactgtc

SEQ ID NO: 415774 - DNA, 25 bp, Mus musculus
gaaccaaaccaagtgtgtgactgtc

SEQ ID NO: 415775 - DNA, 25 bp, Mus musculus
gaaccaaacctcaccgaaagaacat

SEQ ID NO: 415776 - DNA, 25 bp, Mus musculus
gaaccaaacctctccgaaagaacat

SEQ ID NO: 415777 - DNA, 25 bp, Mus musculus
gaaccaaacgggaagcacagcagct

SEQ ID NO: 415778 - DNA, 25 bp, Mus musculus
gaaccaaacgggtagcacagcagct

SEQ ID NO: 415779 - DNA, 25 bp, Mus musculus
gaaccaaactgcatgtctcagcgac

SEQ ID NO: 415780 - DNA, 25 bp, Mus musculus
gaaccaaactgcttgtctcagcgac

SEQ ID NO: 415781 - DNA, 25 bp, Mus musculus
gaaccaaactttagtggaacaggca

SEQ ID NO: 415782 - DNA, 25 bp, Mus musculus
gaaccaaacttttgtggaacaggca

SEQ ID NO: 415783 - DNA, 25 bp, Mus musculus
gaaccaaagactcggtcatccccaa

SEQ ID NO: 415784 - DNA, 25 bp, Mus musculus
gaaccaaagactgggtcatccccaa

SEQ ID NO: 415785 - DNA, 25 bp, Mus musculus
gaaccaaagcacaggacagctctgt

SEQ ID NO: 415786 - DNA, 25 bp, Mus musculus
gaaccaaagcactggacagctctgt

SEQ ID NO: 415787 - DNA, 25 bp, Mus musculus
gaaccaaaggataagcctcgcgcta

SEQ ID NO: 415788 - DNA, 25 bp, Mus musculus
gaaccaaaggattagcctcgcgcta

SEQ ID NO: 415789 - DNA, 25 bp, Mus musculus
gaaccaaagttgatttcagctaata

SEQ ID NO: 415790 - DNA, 25 bp, Mus musculus
gaaccaaagttgttttcagctaata

SEQ ID NO: 415791 - DNA, 25 bp, Mus musculus
gaaccaaatcgtatacattccaatt

SEQ ID NO: 415792 - DNA, 25 bp, Mus musculus
gaaccaaatcgtttacattccaatt

SEQ ID NO: 415793 - DNA, 25 bp, Mus musculus
gaaccaaatctacatgcaaccctgt

SEQ ID NO: 415794 - DNA, 25 bp, Mus musculus
gaaccaaatctagatgcaaccctgt

SEQ ID NO: 415795 - DNA, 25 bp, Mus musculus
gaaccaaattagaggctccctctga

SEQ ID NO: 415796 - DNA, 25 bp, Mus musculus
gaaccaaattagtggctccctctga

SEQ ID NO: 415797 - DNA, 25 bp, Mus musculus
gaaccaaattccatgggcccgtgat

SEQ ID NO: 415798 - DNA, 25 bp, Mus musculus
gaaccaaattccttgggcccgtgat

SEQ ID NO: 415799 - DNA, 25 bp, Mus musculus
gaaccaaattgccaagtactcagtt

SEQ ID NO: 415800 - DNA, 25 bp, Mus musculus
gaaccaaattgcgaagtactcagtt

SEQ ID NO: 415801 - DNA, 25 bp, Mus musculus
gaaccaaatttacattgtaaggaag

SEQ ID NO: 415802 - DNA, 25 bp, Mus musculus
gaaccaaatttaccaccaagtggca

SEQ ID NO: 415803 - DNA, 25 bp, Mus musculus
gaaccaaatttagattgtaaggaag

SEQ ID NO: 415804 - DNA, 25 bp, Mus musculus
gaaccaaatttagcaccaagtggca

SEQ ID NO: 415805 - DNA, 25 bp, Mus musculus
gaaccaaatttcagtggaggcccct

SEQ ID NO: 415806 - DNA, 25 bp, Mus musculus
gaaccaaatttctgtggaggcccct

SEQ ID NO: 415807 - DNA, 25 bp, Mus musculus
gaaccaacaccaatctgggtgccaa

SEQ ID NO: 415808 - DNA, 25 bp, Mus musculus
gaaccaacaccattctgggtgccaa

SEQ ID NO: 415809 - DNA, 25 bp, Mus musculus
gaaccaacatctcctcctcaagtgg

SEQ ID NO: 415810 - DNA, 25 bp, Mus musculus
gaaccaacatctgctcctcaagtgg

SEQ ID NO: 415811 - DNA, 25 bp, Mus musculus
gaaccaacattaaactcctctatga

SEQ ID NO: 415812 - DNA, 25 bp, Mus musculus
gaaccaacattatactcctctatga

SEQ ID NO: 415813 - DNA, 25 bp, Mus musculus
gaaccaaccggaagcaatcatgccc

SEQ ID NO: 415814 - DNA, 25 bp, Mus musculus
gaaccaaccggatgcaatcatgccc

SEQ ID NO: 415815 - DNA, 25 bp, Mus musculus
gaaccaaccgtgacatcagcacagt

SEQ ID NO: 415816 - DNA, 25 bp, Mus musculus
gaaccaaccgtgtcatcagcacagt

SEQ ID NO: 415817 - DNA, 25 bp, Mus musculus
gaaccaacgagactactggctttca

SEQ ID NO: 415818 - DNA, 25 bp, Mus musculus
gaaccaacgagagtactggctttca

SEQ ID NO: 415819 - DNA, 25 bp, Mus musculus
gaaccaacgttgctaggagaacacc

SEQ ID NO: 415820 - DNA, 25 bp, Mus musculus
gaaccaacgttggtaggagaacacc

SEQ ID NO: 415821 - DNA, 25 bp, Mus musculus
gaaccaactagcattctttcagtta

SEQ ID NO: 415822 - DNA, 25 bp, Mus musculus
gaaccaactagctttctttcagtta

SEQ ID NO: 415823 - DNA, 25 bp, Mus musculus
gaaccaactcccacacatcattatg

SEQ ID NO: 415824 - DNA, 25 bp, Mus musculus
gaaccaactccccaaccttgtagag

SEQ ID NO: 415825 - DNA, 25 bp, Mus musculus
gaaccaactcccgaaccttgtagag

SEQ ID NO: 415826 - DNA, 25 bp, Mus musculus
gaaccaactccctcacatcattatg

SEQ ID NO: 415827 - DNA, 25 bp, Mus musculus
gaaccaactgccattgtcaaaccta

SEQ ID NO: 415828 - DNA, 25 bp, Mus musculus
gaaccaactgcctttgtcaaaccta

SEQ ID NO: 415829 - DNA, 25 bp, Mus musculus
gaaccaactgcgctaaaactcaatg

SEQ ID NO: 415830 - DNA, 25 bp, Mus musculus
gaaccaactgcggtaaaactcaatg

SEQ ID NO: 415831 - DNA, 25 bp, Mus musculus
gaaccaactttcaggtcttactcat

SEQ ID NO: 415832 - DNA, 25 bp, Mus musculus
gaaccaactttctggtcttactcat

SEQ ID NO: 415833 - DNA, 25 bp, Mus musculus
gaaccaagaacacatcacccatatc

SEQ ID NO: 415834 - DNA, 25 bp, Mus musculus
gaaccaagaacagatcacccatatc

SEQ ID NO: 415835 - DNA, 25 bp, Mus musculus
gaaccaagacctacaaagcagcctg

SEQ ID NO: 415836 - DNA, 25 bp, Mus musculus
gaaccaagaccttcaaagcagcctg

SEQ ID NO: 415837 - DNA, 25 bp, Mus musculus
gaaccaagagttaggatccttagaa

SEQ ID NO: 415838 - DNA, 25 bp, Mus musculus
gaaccaagagtttggatccttagaa

SEQ ID NO: 415839 - DNA, 25 bp, Mus musculus
gaaccaagcattccatgtcatggct

SEQ ID NO: 415840 - DNA, 25 bp, Mus musculus
gaaccaagcattgcatgtcatggct

SEQ ID NO: 415841 - DNA, 25 bp, Mus musculus
gaaccaagccagaagcacagctcta

SEQ ID NO: 415842 - DNA, 25 bp, Mus musculus
gaaccaagccagtagcacagctcta

SEQ ID NO: 415843 - DNA, 25 bp, Mus musculus
gaaccaagcccaataaaatcaggaa

SEQ ID NO: 415844 - DNA, 25 bp, Mus musculus
gaaccaagcccattaaaatcaggaa

SEQ ID NO: 415845 - DNA, 25 bp, Mus musculus
gaaccaagcctgaaagcactgctga

SEQ ID NO: 415846 - DNA, 25 bp, Mus musculus
gaaccaagcctgtaagcactgctga

SEQ ID NO: 415847 - DNA, 25 bp, Mus musculus
gaaccaagcgaacagaccccaatgt

SEQ ID NO: 415848 - DNA, 25 bp, Mus musculus
gaaccaagcgaacattccctgctca

SEQ ID NO: 415849 - DNA, 25 bp, Mus musculus
gaaccaagcgaagagaccccaatgt

SEQ ID NO: 415850 - DNA, 25 bp, Mus musculus
gaaccaagcgaagattccctgctca

SEQ ID NO: 415851 - DNA, 25 bp, Mus musculus
gaaccaaggaccagattcttcttct

SEQ ID NO: 415852 - DNA, 25 bp, Mus musculus
gaaccaaggacctgattcttcttct

SEQ ID NO: 415853 - DNA, 25 bp, Mus musculus
gaaccaaggactccgaggtgactct

SEQ ID NO: 415854 - DNA, 25 bp, Mus musculus
gaaccaaggactgcgaggtgactct

SEQ ID NO: 415855 - DNA, 25 bp, Mus musculus
gaaccaaggagaagtgtcgaaccaa

SEQ ID NO: 415856 - DNA, 25 bp, Mus musculus
gaaccaaggagaatcagactcctga

SEQ ID NO: 415857 - DNA, 25 bp, Mus musculus
gaaccaaggagatgtgtcgaaccaa

SEQ ID NO: 415858 - DNA, 25 bp, Mus musculus
gaaccaaggagattcagactcctga

SEQ ID NO: 415859 - DNA, 25 bp, Mus musculus
gaaccaaggcccatgagtgactcac

SEQ ID NO: 415860 - DNA, 25 bp, Mus musculus
gaaccaaggcccttgagtgactcac

SEQ ID NO: 415861 - DNA, 25 bp, Mus musculus
gaaccaaggcttatacattccaggc

SEQ ID NO: 415862 - DNA, 25 bp, Mus musculus
gaaccaaggcttttacattccaggc

SEQ ID NO: 415863 - DNA, 25 bp, Mus musculus
gaaccaaggtccagtgatccctgag

SEQ ID NO: 415864 - DNA, 25 bp, Mus musculus
gaaccaaggtcctgtgatccctgag

SEQ ID NO: 415865 - DNA, 25 bp, Mus musculus
gaaccaagtgatctggaggcctttt

SEQ ID NO: 415866 - DNA, 25 bp, Mus musculus
gaaccaagtgatgtggaggcctttt

SEQ ID NO: 415867 - DNA, 25 bp, Mus musculus
gaaccaagtttcatgatagatccag

SEQ ID NO: 415868 - DNA, 25 bp, Mus musculus
gaaccaagtttcttgatagatccag

SEQ ID NO: 415869 - DNA, 25 bp, Mus musculus
gaaccaatattacctgcagttgaat

SEQ ID NO: 415870 - DNA, 25 bp, Mus musculus
gaaccaatattagctgcagttgaat

SEQ ID NO: 415871 - DNA, 25 bp, Mus musculus
gaaccaatattccagattccaaggg

SEQ ID NO: 415872 - DNA, 25 bp, Mus musculus
gaaccaatattcgagattccaaggg

SEQ ID NO: 415873 - DNA, 25 bp, Mus musculus
gaaccaatcaaaactgcgatcagag

SEQ ID NO: 415874 - DNA, 25 bp, Mus musculus
gaaccaatcaaatctgcgatcagag

SEQ ID NO: 415875 - DNA, 25 bp, Mus musculus
gaaccaatcattaagcagtatcaac

SEQ ID NO: 415876 - DNA, 25 bp, Mus musculus
gaaccaatcatttagcagtatcaac

SEQ ID NO: 415877 - DNA, 25 bp, Mus musculus
gaaccaatccatcgatctttgggaa

SEQ ID NO: 415878 - DNA, 25 bp, Mus musculus
gaaccaatccatggatctttgggaa

SEQ ID NO: 415879 - DNA, 25 bp, Mus musculus
gaaccaatctctaacaggtatgcga

SEQ ID NO: 415880 - DNA, 25 bp, Mus musculus
gaaccaatctcttacaggtatgcga

SEQ ID NO: 415881 - DNA, 25 bp, Mus musculus
gaaccaatgaggcaacagaggctga

SEQ ID NO: 415882 - DNA, 25 bp, Mus musculus
gaaccaatgagggaacagaggctga

SEQ ID NO: 415883 - DNA, 25 bp, Mus musculus
gaaccaatgcgacggtgccatcaga

SEQ ID NO: 415884 - DNA, 25 bp, Mus musculus
gaaccaatgcgagggtgccatcaga

SEQ ID NO: 415885 - DNA, 25 bp, Mus musculus
gaaccaatgcgcaattctcattcta

SEQ ID NO: 415886 - DNA, 25 bp, Mus musculus
gaaccaatgcgctattctcattcta

SEQ ID NO: 415887 - DNA, 25 bp, Mus musculus
gaaccaatgtgcatcaggtcctgtg

SEQ ID NO: 415888 - DNA, 25 bp, Mus musculus
gaaccaatgtgcttcaggtcctgtg

SEQ ID NO: 415889 - DNA, 25 bp, Mus musculus
gaaccaatgtggaagtccaggtgat

SEQ ID NO: 415890 - DNA, 25 bp, Mus musculus
gaaccaatgtggctgaacctagggt

SEQ ID NO: 415891 - DNA, 25 bp, Mus musculus
gaaccaatgtgggtgaacctagggt

SEQ ID NO: 415892 - DNA, 25 bp, Mus musculus
gaaccaatgtggtagtccaggtgat

SEQ ID NO: 415893 - DNA, 25 bp, Mus musculus
gaaccaatgtttatccctgatgggt

SEQ ID NO: 415894 - DNA, 25 bp, Mus musculus
gaaccaatgtttttccctgatgggt

SEQ ID NO: 415895 - DNA, 25 bp, Mus musculus
gaaccaattaacaacctctgtccta

SEQ ID NO: 415896 - DNA, 25 bp, Mus musculus
gaaccaattaactacctctgtccta

SEQ ID NO: 415897 - DNA, 25 bp, Mus musculus
gaaccaattaagcaggcctctgaag

SEQ ID NO: 415898 - DNA, 25 bp, Mus musculus
gaaccaattaaggaggcctctgaag

SEQ ID NO: 415899 - DNA, 25 bp, Mus musculus
gaaccaattatgctgatctgcttca

SEQ ID NO: 415900 - DNA, 25 bp, Mus musculus
gaaccaattatggtgatctgcttca

SEQ ID NO: 415901 - DNA, 25 bp, Mus musculus
gaaccaattcgccatgttcttctac

SEQ ID NO: 415902 - DNA, 25 bp, Mus musculus
gaaccaattcgcgatgttcttctac

SEQ ID NO: 415903 - DNA, 25 bp, Mus musculus
gaaccaattcggatcctagacctaa

SEQ ID NO: 415904 - DNA, 25 bp, Mus musculus
gaaccaattcggttcctagacctaa

SEQ ID NO: 415905 - DNA, 25 bp, Mus musculus
gaaccaattctcaaccctagaggag

SEQ ID NO: 415906 - DNA, 25 bp, Mus musculus
gaaccaattctctaccctagaggag

SEQ ID NO: 415907 - DNA, 25 bp, Mus musculus
gaaccaattggtcagctcctggcca

SEQ ID NO: 415908 - DNA, 25 bp, Mus musculus
gaaccaattggtgagctcctggcca

SEQ ID NO: 415909 - DNA, 25 bp, Mus musculus
gaaccaattgtcactgacgtcatca

SEQ ID NO: 415910 - DNA, 25 bp, Mus musculus
gaaccaattgtctctgacgtcatca

SEQ ID NO: 415911 - DNA, 25 bp, Mus musculus
gaaccaattgtgatgcctttgcatt

SEQ ID NO: 415912 - DNA, 25 bp, Mus musculus
gaaccaattgtgttgcctttgcatt

SEQ ID NO: 415913 - DNA, 25 bp, Mus musculus
gaaccacaaaatcttgcctatctag

SEQ ID NO: 415914 - DNA, 25 bp, Mus musculus
gaaccacaaaatgttgcctatctag

SEQ ID NO: 415915 - DNA, 25 bp, Mus musculus
gaaccacaaagtcaatctttatcct

SEQ ID NO: 415916 - DNA, 25 bp, Mus musculus
gaaccacaaagtgaatctttatcct

SEQ ID NO: 415917 - DNA, 25 bp, Mus musculus
gaaccacaaccaaagtataagaaaa

SEQ ID NO: 415918 - DNA, 25 bp, Mus musculus
gaaccacaaccatagtataagaaaa

SEQ ID NO: 415919 - DNA, 25 bp, Mus musculus
gaaccacaacgtccagggcttccat

SEQ ID NO: 415920 - DNA, 25 bp, Mus musculus
gaaccacaacgtgcagggcttccat

SEQ ID NO: 415921 - DNA, 25 bp, Mus musculus
gaaccacaagatcatgtctcaacag

SEQ ID NO: 415922 - DNA, 25 bp, Mus musculus
gaaccacaagatgatgtctcaacag

SEQ ID NO: 415923 - DNA, 25 bp, Mus musculus
gaaccacaatgtcacaactccagaa

SEQ ID NO: 415924 - DNA, 25 bp, Mus musculus
gaaccacaatgtgacaactccagaa

SEQ ID NO: 415925 - DNA, 25 bp, Mus musculus
gaaccacaatttaggtacctaagag

SEQ ID NO: 415926 - DNA, 25 bp, Mus musculus
gaaccacaatttctggcttggattt

SEQ ID NO: 415927 - DNA, 25 bp, Mus musculus
gaaccacaatttgtggcttggattt

SEQ ID NO: 415928 - DNA, 25 bp, Mus musculus
gaaccacaattttggtacctaagag

SEQ ID NO: 415929 - DNA, 25 bp, Mus musculus
gaaccacacatgatgaggtttttgt

SEQ ID NO: 415930 - DNA, 25 bp, Mus musculus
gaaccacacatgttgaggtttttgt

SEQ ID NO: 415931 - DNA, 25 bp, Mus musculus
gaaccacacccacggagggtctagc

SEQ ID NO: 415932 - DNA, 25 bp, Mus musculus
gaaccacacccagggagggtctagc

SEQ ID NO: 415933 - DNA, 25 bp, Mus musculus
gaaccacacgtgacaaacctaaatc

SEQ ID NO: 415934 - DNA, 25 bp, Mus musculus
gaaccacacgtgtcaaacctaaatc

SEQ ID NO: 415935 - DNA, 25 bp, Mus musculus
gaaccacactgcagaaattccctag

SEQ ID NO: 415936 - DNA, 25 bp, Mus musculus
gaaccacactgctgaaattccctag

SEQ ID NO: 415937 - DNA, 25 bp, Mus musculus
gaaccacacttgagagcatacgtac

SEQ ID NO: 415938 - DNA, 25 bp, Mus musculus
gaaccacacttgtgagcatacgtac

SEQ ID NO: 415939 - DNA, 25 bp, Mus musculus
gaaccacagacacaattccacatgt

SEQ ID NO: 415940 - DNA, 25 bp, Mus musculus
gaaccacagacagaattccacatgt

SEQ ID NO: 415941 - DNA, 25 bp, Mus musculus
gaaccacagagcattgggcccgcaa

SEQ ID NO: 415942 - DNA, 25 bp, Mus musculus
gaaccacagagctttgggcccgcaa

SEQ ID NO: 415943 - DNA, 25 bp, Mus musculus
gaaccacagggaaagcaactctaat

SEQ ID NO: 415944 - DNA, 25 bp, Mus musculus
gaaccacagggatagcaactctaat

SEQ ID NO: 415945 - DNA, 25 bp, Mus musculus
gaaccacaggttcctagactctatc

SEQ ID NO: 415946 - DNA, 25 bp, Mus musculus
gaaccacaggttgctagactctatc

SEQ ID NO: 415947 - DNA, 25 bp, Mus musculus
gaaccacagttgaggaggctaagac

SEQ ID NO: 415948 - DNA, 25 bp, Mus musculus
gaaccacagttgtggaggctaagac

SEQ ID NO: 415949 - DNA, 25 bp, Mus musculus
gaaccacagtttaagcagccttcac

SEQ ID NO: 415950 - DNA, 25 bp, Mus musculus
gaaccacagtttcctgtaggcactg

SEQ ID NO: 415951 - DNA, 25 bp, Mus musculus
gaaccacagtttgctgtaggcactg

SEQ ID NO: 415952 - DNA, 25 bp, Mus musculus
gaaccacagttttagcagccttcac

SEQ ID NO: 415953 - DNA, 25 bp, Mus musculus
gaaccacatggcatggtcaaatgaa

SEQ ID NO: 415954 - DNA, 25 bp, Mus musculus
gaaccacatggcttggtcaaatgaa

SEQ ID NO: 415955 - DNA, 25 bp, Mus musculus
gaaccacatgtactggtccccgaag

SEQ ID NO: 415956 - DNA, 25 bp, Mus musculus
gaaccacatgtagtggtccccgaag

SEQ ID NO: 415957 - DNA, 25 bp, Mus musculus
gaaccaccacaaactttcttcgtga

SEQ ID NO: 415958 - DNA, 25 bp, Mus musculus
gaaccaccacaaagtcaggaactga

SEQ ID NO: 415959 - DNA, 25 bp, Mus musculus
gaaccaccacaatctttcttcgtga

SEQ ID NO: 415960 - DNA, 25 bp, Mus musculus
gaaccaccacaatgtcaggaactga

SEQ ID NO: 415961 - DNA, 25 bp, Mus musculus
gaaccaccagcaagtttcattctgt

SEQ ID NO: 415962 - DNA, 25 bp, Mus musculus
gaaccaccagcactgtatggcgcta

SEQ ID NO: 415963 - DNA, 25 bp, Mus musculus
gaaccaccagcagtgtatggcgcta

SEQ ID NO: 415964 - DNA, 25 bp, Mus musculus
gaaccaccagcatgtttcattctgt

SEQ ID NO: 415965 - DNA, 25 bp, Mus musculus
gaaccaccatagatccaccaaatag

SEQ ID NO: 415966 - DNA, 25 bp, Mus musculus
gaaccaccatagttccaccaaatag

SEQ ID NO: 415967 - DNA, 25 bp, Mus musculus
gaaccaccattgagggcgtttaaga

SEQ ID NO: 415968 - DNA, 25 bp, Mus musculus
gaaccaccattgtgggcgtttaaga

SEQ ID NO: 415969 - DNA, 25 bp, Mus musculus
gaaccacccaaacgacctggctttg

SEQ ID NO: 415970 - DNA, 25 bp, Mus musculus
gaaccacccaaaggacctggctttg

SEQ ID NO: 415971 - DNA, 25 bp, Mus musculus
gaaccacccaggaagagtctcagat

SEQ ID NO: 415972 - DNA, 25 bp, Mus musculus
gaaccacccaggtagagtctcagat

SEQ ID NO: 415973 - DNA, 25 bp, Mus musculus
gaaccacccatgaattcagatacag

SEQ ID NO: 415974 - DNA, 25 bp, Mus musculus
gaaccacccatgtattcagatacag

SEQ ID NO: 415975 - DNA, 25 bp, Mus musculus
gaaccaccgatgcaaatgaaaagag

SEQ ID NO: 415976 - DNA, 25 bp, Mus musculus
gaaccaccgatggaaatgaaaagag

SEQ ID NO: 415977 - DNA, 25 bp, Mus musculus
gaaccaccgcctcgaaagccaggaa

SEQ ID NO: 415978 - DNA, 25 bp, Mus musculus
gaaccaccgcctggaaagccaggaa

SEQ ID NO: 415979 - DNA, 25 bp, Mus musculus
gaaccaccggatcagtggctttcta

SEQ ID NO: 415980 - DNA, 25 bp, Mus musculus
gaaccaccggatgagtggctttcta

SEQ ID NO: 415981 - DNA, 25 bp, Mus musculus
gaaccaccgtgaaccagacaataga

SEQ ID NO: 415982 - DNA, 25 bp, Mus musculus
gaaccaccgtgatccagacaataga

SEQ ID NO: 415983 - DNA, 25 bp, Mus musculus
gaaccacctaacagcttgggcatct

SEQ ID NO: 415984 - DNA, 25 bp, Mus musculus
gaaccacctaactgcttgggcatct

SEQ ID NO: 415985 - DNA, 25 bp, Mus musculus
gaaccacctagtatatgtgctcaga

SEQ ID NO: 415986 - DNA, 25 bp, Mus musculus
gaaccacctagtttatgtgctcaga

SEQ ID NO: 415987 - DNA, 25 bp, Mus musculus
gaaccacctatgcagatgacggaaa

SEQ ID NO: 415988 - DNA, 25 bp, Mus musculus
gaaccacctatggagatgacggaaa

SEQ ID NO: 415989 - DNA, 25 bp, Mus musculus
gaaccacctgatcacacagctggat

SEQ ID NO: 415990 - DNA, 25 bp, Mus musculus
gaaccacctgatgacacagctggat

SEQ ID NO: 415991 - DNA, 25 bp, Mus musculus
gaaccacctgcaaatgttatctaca

SEQ ID NO: 415992 - DNA, 25 bp, Mus musculus
gaaccacctgcacgagtcactgaag

SEQ ID NO: 415993 - DNA, 25 bp, Mus musculus
gaaccacctgcaggagtcactgaag

SEQ ID NO: 415994 - DNA, 25 bp, Mus musculus
gaaccacctgcatatgttatctaca

SEQ ID NO: 415995 - DNA, 25 bp, Mus musculus
gaaccacctgctagaatccatgccg

SEQ ID NO: 415996 - DNA, 25 bp, Mus musculus
gaaccacctgcttgaatccatgccg

SEQ ID NO: 415997 - DNA, 25 bp, Mus musculus
gaaccacctgtgatatcccataata

SEQ ID NO: 415998 - DNA, 25 bp, Mus musculus
gaaccacctgtgttatcccataata

SEQ ID NO: 415999 - DNA, 25 bp, Mus musculus
gaaccaccttctccacttaaagaat

SEQ ID NO: 416000 - DNA, 25 bp, Mus musculus
gaaccaccttctgcacttaaagaat

SEQ ID NO: 416001 - DNA, 25 bp, Mus musculus
gaaccaccttgaaaaggccacggaa

SEQ ID NO: 416002 - DNA, 25 bp, Mus musculus
gaaccaccttgataaggccacggaa

SEQ ID NO: 416003 - DNA, 25 bp, Mus musculus
gaaccacgacatctggctgaagttt

SEQ ID NO: 416004 - DNA, 25 bp, Mus musculus
gaaccacgacatgtggctgaagttt

SEQ ID NO: 416005 - DNA, 25 bp, Mus musculus
gaaccacgcctgactggaagatgcc

SEQ ID NO: 416006 - DNA, 25 bp, Mus musculus
gaaccacgcctgtctggaagatgcc

SEQ ID NO: 416007 - DNA, 25 bp, Mus musculus
gaaccacgggcacactctgagagaa

SEQ ID NO: 416008 - DNA, 25 bp, Mus musculus
gaaccacgggcagactctgagagaa

SEQ ID NO: 416009 - DNA, 25 bp, Mus musculus
gaaccacggtatactggcagaccca

SEQ ID NO: 416010 - DNA, 25 bp, Mus musculus
gaaccacggtattctggcagaccca

SEQ ID NO: 416011 - DNA, 25 bp, Mus musculus
gaaccacgtgccaggaaattcagtt

SEQ ID NO: 416012 - DNA, 25 bp, Mus musculus
gaaccacgtgcctggaaattcagtt

SEQ ID NO: 416013 - DNA, 25 bp, Mus musculus
gaaccacgtgtacactcttctggaa

SEQ ID NO: 416014 - DNA, 25 bp, Mus musculus
gaaccacgtgtagactcttctggaa

SEQ ID NO: 416015 - DNA, 25 bp, Mus musculus
gaaccacgttgtacttttcactgag

SEQ ID NO: 416016 - DNA, 25 bp, Mus musculus
gaaccacgttgttcttttcactgag

SEQ ID NO: 416017 - DNA, 25 bp, Mus musculus
gaaccactaaaaccatcggatacag

SEQ ID NO: 416018 - DNA, 25 bp, Mus musculus
gaaccactaaaagcatcggatacag

SEQ ID NO: 416019 - DNA, 25 bp, Mus musculus
gaaccactaggcaaatgtatcactt

SEQ ID NO: 416020 - DNA, 25 bp, Mus musculus
gaaccactaggctaatgtatcactt

SEQ ID NO: 416021 - DNA, 25 bp, Mus musculus
gaaccactagtgaggctgcttcgca

SEQ ID NO: 416022 - DNA, 25 bp, Mus musculus
gaaccactagtgtggctgcttcgca

SEQ ID NO: 416023 - DNA, 25 bp, Mus musculus
gaaccactatggaacaacttaaatt

SEQ ID NO: 416024 - DNA, 25 bp, Mus musculus
gaaccactatggtacaacttaaatt

SEQ ID NO: 416025 - DNA, 25 bp, Mus musculus
gaaccactattaagtgagtactaga

SEQ ID NO: 416026 - DNA, 25 bp, Mus musculus
gaaccactattatgtgagtactaga

SEQ ID NO: 416027 - DNA, 25 bp, Mus musculus
gaaccactattcaaatacttgggca

SEQ ID NO: 416028 - DNA, 25 bp, Mus musculus
gaaccactattctaatacttgggca

SEQ ID NO: 416029 - DNA, 25 bp, Mus musculus
gaaccactatttatggacaaccagt

SEQ ID NO: 416030 - DNA, 25 bp, Mus musculus
gaaccactatttttggacaaccagt

SEQ ID NO: 416031 - DNA, 25 bp, Mus musculus
gaaccactcatgaaccacaatgctg

SEQ ID NO: 416032 - DNA, 25 bp, Mus musculus
gaaccactcatgtaccacaatgctg

SEQ ID NO: 416033 - DNA, 25 bp, Mus musculus
gaaccactcattcctctaatataca

SEQ ID NO: 416034 - DNA, 25 bp, Mus musculus
gaaccactcattgctctaatataca

SEQ ID NO: 416035 - DNA, 25 bp, Mus musculus
gaaccactccaccatgctatgtttg

SEQ ID NO: 416036 - DNA, 25 bp, Mus musculus
gaaccactccacgatgctatgtttg

SEQ ID NO: 416037 - DNA, 25 bp, Mus musculus
gaaccactccataaagtcggtgaaa

SEQ ID NO: 416038 - DNA, 25 bp, Mus musculus
gaaccactccattaagtcggtgaaa

SEQ ID NO: 416039 - DNA, 25 bp, Mus musculus
gaaccactcgtacctttaatgagaa

SEQ ID NO: 416040 - DNA, 25 bp, Mus musculus
gaaccactcgtagctttaatgagaa

SEQ ID NO: 416041 - DNA, 25 bp, Mus musculus
gaaccactctttagtaactgattgt

SEQ ID NO: 416042 - DNA, 25 bp, Mus musculus
gaaccactcttttgtaactgattgt

SEQ ID NO: 416043 - DNA, 25 bp, Mus musculus
gaaccactgatacaactgtgcccaa

SEQ ID NO: 416044 - DNA, 25 bp, Mus musculus
gaaccactgatagaactgtgcccaa

SEQ ID NO: 416045 - DNA, 25 bp, Mus musculus
gaaccactgctaaaagcaggccttg

SEQ ID NO: 416046 - DNA, 25 bp, Mus musculus
gaaccactgctataagcaggccttg

SEQ ID NO: 416047 - DNA, 25 bp, Mus musculus
gaaccactggagacttgtagcattc

SEQ ID NO: 416048 - DNA, 25 bp, Mus musculus
gaaccactggagtcttgtagcattc

SEQ ID NO: 416049 - DNA, 25 bp, Mus musculus
gaaccactggctaagacccatgcaa

SEQ ID NO: 416050 - DNA, 25 bp, Mus musculus
gaaccactggctaccatagcacagg

SEQ ID NO: 416051 - DNA, 25 bp, Mus musculus
gaaccactggcttagacccatgcaa

SEQ ID NO: 416052 - DNA, 25 bp, Mus musculus
gaaccactggcttccatagcacagg

SEQ ID NO: 416053 - DNA, 25 bp, Mus musculus
gaaccactgggaaaaacgagccatg

SEQ ID NO: 416054 - DNA, 25 bp, Mus musculus
gaaccactgggacgctactatccat

SEQ ID NO: 416055 - DNA, 25 bp, Mus musculus
gaaccactgggaggctactatccat

SEQ ID NO: 416056 - DNA, 25 bp, Mus musculus
gaaccactgggataaacgagccatg

SEQ ID NO: 416057 - DNA, 25 bp, Mus musculus
gaaccactgggcaaattacatcggg

SEQ ID NO: 416058 - DNA, 25 bp, Mus musculus
gaaccactgggcaatagaatcataa

SEQ ID NO: 416059 - DNA, 25 bp, Mus musculus
gaaccactgggctaattacatcggg

SEQ ID NO: 416060 - DNA, 25 bp, Mus musculus
gaaccactgggctatagaatcataa

SEQ ID NO: 416061 - DNA, 25 bp, Mus musculus
gaaccactggtaatagctgaatctg

SEQ ID NO: 416062 - DNA, 25 bp, Mus musculus
gaaccactggtattagctgaatctg

SEQ ID NO: 416063 - DNA, 25 bp, Mus musculus
gaaccactgtaaatatatgcctatg

SEQ ID NO: 416064 - DNA, 25 bp, Mus musculus
gaaccactgtaattatatgcctatg

SEQ ID NO: 416065 - DNA, 25 bp, Mus musculus
gaaccactgtgacacacataagtgt

SEQ ID NO: 416066 - DNA, 25 bp, Mus musculus
gaaccactgtgagacacataagtgt

SEQ ID NO: 416067 - DNA, 25 bp, Mus musculus
gaaccactgtggacacgtgacaatt

SEQ ID NO: 416068 - DNA, 25 bp, Mus musculus
gaaccactgtggtcacgtgacaatt

SEQ ID NO: 416069 - DNA, 25 bp, Mus musculus
gaaccactgtttcagtcagtaggaa

SEQ ID NO: 416070 - DNA, 25 bp, Mus musculus
gaaccactgtttgagtcagtaggaa

SEQ ID NO: 416071 - DNA, 25 bp, Mus musculus
gaaccacttaaacaatgcctaggga

SEQ ID NO: 416072 - DNA, 25 bp, Mus musculus
gaaccacttaaagaatgcctaggga

SEQ ID NO: 416073 - DNA, 25 bp, Mus musculus
gaaccacttaagctgcgtccaagac

SEQ ID NO: 416074 - DNA, 25 bp, Mus musculus
gaaccacttaaggtgcgtccaagac

SEQ ID NO: 416075 - DNA, 25 bp, Mus musculus
gaaccacttactccctttgtgaatc

SEQ ID NO: 416076 - DNA, 25 bp, Mus musculus
gaaccacttactgcctttgtgaatc

SEQ ID NO: 416077 - DNA, 25 bp, Mus musculus
gaaccacttcaactgtatatagaca

SEQ ID NO: 416078 - DNA, 25 bp, Mus musculus
gaaccacttcaagtgtatatagaca

SEQ ID NO: 416079 - DNA, 25 bp, Mus musculus
gaaccacttctaactacagcccttg

SEQ ID NO: 416080 - DNA, 25 bp, Mus musculus
gaaccacttctatctacagcccttg

SEQ ID NO: 416081 - DNA, 25 bp, Mus musculus
gaaccacttctgcacaggccgggat

SEQ ID NO: 416082 - DNA, 25 bp, Mus musculus
gaaccacttctggacaggccgggat

SEQ ID NO: 416083 - DNA, 25 bp, Mus musculus
gaaccactttccaatgaggaccccg

SEQ ID NO: 416084 - DNA, 25 bp, Mus musculus
gaaccactttcctatgaggaccccg

SEQ ID NO: 416085 - DNA, 25 bp, Mus musculus
gaaccactttctaggtttgcaccac

SEQ ID NO: 416086 - DNA, 25 bp, Mus musculus
gaaccactttcttggtttgcaccac

SEQ ID NO: 416087 - DNA, 25 bp, Mus musculus
gaaccactttggacgggagtacaga

SEQ ID NO: 416088 - DNA, 25 bp, Mus musculus
gaaccactttggcaaagcctcctct

SEQ ID NO: 416089 - DNA, 25 bp, Mus musculus
gaaccactttgggaaagcctcctct

SEQ ID NO: 416090 - DNA, 25 bp, Mus musculus
gaaccactttggtcgggagtacaga

SEQ ID NO: 416091 - DNA, 25 bp, Mus musculus
gaaccactttgtataactctacctg

SEQ ID NO: 416092 - DNA, 25 bp, Mus musculus
gaaccactttgtttaactctacctg

SEQ ID NO: 416093 - DNA, 25 bp, Mus musculus
gaaccagaaaagctaagtgactaaa

SEQ ID NO: 416094 - DNA, 25 bp, Mus musculus
gaaccagaaaaggtaagtgactaaa

SEQ ID NO: 416095 - DNA, 25 bp, Mus musculus
gaaccagaaccgacgctttcaggaa

SEQ ID NO: 416096 - DNA, 25 bp, Mus musculus
gaaccagaaccgtcgctttcaggaa

SEQ ID NO: 416097 - DNA, 25 bp, Mus musculus
gaaccagaagacagacaaggaaatt

SEQ ID NO: 416098 - DNA, 25 bp, Mus musculus
gaaccagaagactgacaaggaaatt

SEQ ID NO: 416099 - DNA, 25 bp, Mus musculus
gaaccagaatcaacggccatgcttg

SEQ ID NO: 416100 - DNA, 25 bp, Mus musculus
gaaccagaatcatcggccatgcttg

SEQ ID NO: 416101 - DNA, 25 bp, Mus musculus
gaaccagaatgcacttgtcagcctc

SEQ ID NO: 416102 - DNA, 25 bp, Mus musculus
gaaccagaatgctcttgtcagcctc

SEQ ID NO: 416103 - DNA, 25 bp, Mus musculus
gaaccagaatggataccacctctcc

SEQ ID NO: 416104 - DNA, 25 bp, Mus musculus
gaaccagaatggcaacaacgcctcg

SEQ ID NO: 416105 - DNA, 25 bp, Mus musculus
gaaccagaatgggaacaacgcctcg

SEQ ID NO: 416106 - DNA, 25 bp, Mus musculus
gaaccagaatggttaccacctctcc

SEQ ID NO: 416107 - DNA, 25 bp, Mus musculus
gaaccagacaataccaggcttccaa

SEQ ID NO: 416108 - DNA, 25 bp, Mus musculus
gaaccagacaattccaggcttccaa

SEQ ID NO: 416109 - DNA, 25 bp, Mus musculus
gaaccagacacaccagggatcttcg

SEQ ID NO: 416110 - DNA, 25 bp, Mus musculus
gaaccagacacagcagggatcttcg

SEQ ID NO: 416111 - DNA, 25 bp, Mus musculus
gaaccagaccttatgacagatgtgt

SEQ ID NO: 416112 - DNA, 25 bp, Mus musculus
gaaccagaccttttgacagatgtgt

SEQ ID NO: 416113 - DNA, 25 bp, Mus musculus
gaaccagacgcgaaactgctaccag

SEQ ID NO: 416114 - DNA, 25 bp, Mus musculus
gaaccagacgcgtaactgctaccag

SEQ ID NO: 416115 - DNA, 25 bp, Mus musculus
gaaccagactgtaatatctccagga

SEQ ID NO: 416116 - DNA, 25 bp, Mus musculus
gaaccagactgttatatctccagga

SEQ ID NO: 416117 - DNA, 25 bp, Mus musculus
gaaccagagaaaagctccgagactg

SEQ ID NO: 416118 - DNA, 25 bp, Mus musculus
gaaccagagaaatgctccgagactg

SEQ ID NO: 416119 - DNA, 25 bp, Mus musculus
gaaccagagcagattctcaggtatg

SEQ ID NO: 416120 - DNA, 25 bp, Mus musculus
gaaccagagcagtttctcaggtatg

SEQ ID NO: 416121 - DNA, 25 bp, Mus musculus
gaaccagagcccacgagcggacgat

SEQ ID NO: 416122 - DNA, 25 bp, Mus musculus
gaaccagagcccctgtgtgcttttc

SEQ ID NO: 416123 - DNA, 25 bp, Mus musculus
gaaccagagcccgtgtgtgcttttc

SEQ ID NO: 416124 - DNA, 25 bp, Mus musculus
gaaccagagccctcgagcggacgat

SEQ ID NO: 416125 - DNA, 25 bp, Mus musculus
gaaccagagctcatttattgggcat

SEQ ID NO: 416126 - DNA, 25 bp, Mus musculus
gaaccagagctcttttattgggcat

SEQ ID NO: 416127 - DNA, 25 bp, Mus musculus
gaaccagaggctcttgttgctgcag

SEQ ID NO: 416128 - DNA, 25 bp, Mus musculus
gaaccagaggctgttgttgctgcag

SEQ ID NO: 416129 - DNA, 25 bp, Mus musculus
gaaccagaggtaaagattcctcaga

SEQ ID NO: 416130 - DNA, 25 bp, Mus musculus
gaaccagaggtatagattcctcaga

SEQ ID NO: 416131 - DNA, 25 bp, Mus musculus
gaaccagagtagaggaaccagcatt

SEQ ID NO: 416132 - DNA, 25 bp, Mus musculus
gaaccagagtagtggaaccagcatt

SEQ ID NO: 416133 - DNA, 25 bp, Mus musculus
gaaccagatatgctactgctgccgg

SEQ ID NO: 416134 - DNA, 25 bp, Mus musculus
gaaccagatatggtactgctgccgg

SEQ ID NO: 416135 - DNA, 25 bp, Mus musculus
gaaccagatcatcgacttccgcatg

SEQ ID NO: 416136 - DNA, 25 bp, Mus musculus
gaaccagatcatggacttccgcatg

SEQ ID NO: 416137 - DNA, 25 bp, Mus musculus
gaaccagatccaagaccagctgctg

SEQ ID NO: 416138 - DNA, 25 bp, Mus musculus
gaaccagatccatgaccagctgctg

SEQ ID NO: 416139 - DNA, 25 bp, Mus musculus
gaaccagatgttcgcttgcaatatt

SEQ ID NO: 416140 - DNA, 25 bp, Mus musculus
gaaccagatgttggcttgcaatatt

SEQ ID NO: 416141 - DNA, 25 bp, Mus musculus
gaaccagattctagccatgcacttt

SEQ ID NO: 416142 - DNA, 25 bp, Mus musculus
gaaccagattctcattgctttgtat

SEQ ID NO: 416143 - DNA, 25 bp, Mus musculus
gaaccagattctgattgctttgtat

SEQ ID NO: 416144 - DNA, 25 bp, Mus musculus
gaaccagattcttgccatgcacttt

SEQ ID NO: 416145 - DNA, 25 bp, Mus musculus
gaaccagcaacacgatctggccaag

SEQ ID NO: 416146 - DNA, 25 bp, Mus musculus
gaaccagcaacaggatctggccaag

SEQ ID NO: 416147 - DNA, 25 bp, Mus musculus
gaaccagcaaccagtaactgccctt

SEQ ID NO: 416148 - DNA, 25 bp, Mus musculus
gaaccagcaacctgtaactgccctt

SEQ ID NO: 416149 - DNA, 25 bp, Mus musculus
gaaccagcacagattcttgggcagt

SEQ ID NO: 416150 - DNA, 25 bp, Mus musculus
gaaccagcacagtttcttgggcagt

SEQ ID NO: 416151 - DNA, 25 bp, Mus musculus
gaaccagcacgaaatagaccagctt

SEQ ID NO: 416152 - DNA, 25 bp, Mus musculus
gaaccagcacgatatagaccagctt

SEQ ID NO: 416153 - DNA, 25 bp, Mus musculus
gaaccagcagatagagagctccaga

SEQ ID NO: 416154 - DNA, 25 bp, Mus musculus
gaaccagcagatattcttacgggac

SEQ ID NO: 416155 - DNA, 25 bp, Mus musculus
gaaccagcagattgagagctccaga

SEQ ID NO: 416156 - DNA, 25 bp, Mus musculus
gaaccagcagattttcttacgggac

SEQ ID NO: 416157 - DNA, 25 bp, Mus musculus
gaaccagcatagaaagtgtcacttt

SEQ ID NO: 416158 - DNA, 25 bp, Mus musculus
gaaccagcatagtaagtgtcacttt

SEQ ID NO: 416159 - DNA, 25 bp, Mus musculus
gaaccagccacacgaatcggactat

SEQ ID NO: 416160 - DNA, 25 bp, Mus musculus
gaaccagccacaggaatcggactat

SEQ ID NO: 416161 - DNA, 25 bp, Mus musculus
gaaccagcccgaacatgttggctta

SEQ ID NO: 416162 - DNA, 25 bp, Mus musculus
gaaccagcccgatcatgttggctta

SEQ ID NO: 416163 - DNA, 25 bp, Mus musculus
gaaccagccggtcctgggaactcag

SEQ ID NO: 416164 - DNA, 25 bp, Mus musculus
gaaccagccggtgctgggaactcag

SEQ ID NO: 416165 - DNA, 25 bp, Mus musculus
gaaccagcctcgactcagctttgct

SEQ ID NO: 416166 - DNA, 25 bp, Mus musculus
gaaccagcctcgtctcagctttgct

SEQ ID NO: 416167 - DNA, 25 bp, Mus musculus
gaaccagcctggaccactgggaact

SEQ ID NO: 416168 - DNA, 25 bp, Mus musculus
gaaccagcctggtccactgggaact

SEQ ID NO: 416169 - DNA, 25 bp, Mus musculus
gaaccagccttactaccaagagtgc

SEQ ID NO: 416170 - DNA, 25 bp, Mus musculus
gaaccagccttagtaccaagagtgc

SEQ ID NO: 416171 - DNA, 25 bp, Mus musculus
gaaccagcgtcgaatagacagtgct

SEQ ID NO: 416172 - DNA, 25 bp, Mus musculus
gaaccagcgtcgtatagacagtgct

SEQ ID NO: 416173 - DNA, 25 bp, Mus musculus
gaaccagcgtgccaagttagagtcc

SEQ ID NO: 416174 - DNA, 25 bp, Mus musculus
gaaccagcgtgcgaagttagagtcc

SEQ ID NO: 416175 - DNA, 25 bp, Mus musculus
gaaccagctaacacccaagatacga

SEQ ID NO: 416176 - DNA, 25 bp, Mus musculus
gaaccagctaactcccaagatacga

SEQ ID NO: 416177 - DNA, 25 bp, Mus musculus
gaaccagctcaacatttgatgcatg

SEQ ID NO: 416178 - DNA, 25 bp, Mus musculus
gaaccagctcaagatttgatgcatg

SEQ ID NO: 416179 - DNA, 25 bp, Mus musculus
gaaccagctcagaagggactacacc

SEQ ID NO: 416180 - DNA, 25 bp, Mus musculus
gaaccagctcagtagggactacacc

SEQ ID NO: 416181 - DNA, 25 bp, Mus musculus
gaaccagctccgactcagtcctgtg

SEQ ID NO: 416182 - DNA, 25 bp, Mus musculus
gaaccagctccgtctcagtcctgtg

SEQ ID NO: 416183 - DNA, 25 bp, Mus musculus
gaaccagctgcgatgtctccaatct

SEQ ID NO: 416184 - DNA, 25 bp, Mus musculus
gaaccagctgcgttgtctccaatct

SEQ ID NO: 416185 - DNA, 25 bp, Mus musculus
gaaccagctgctatcaggaatgtgt

SEQ ID NO: 416186 - DNA, 25 bp, Mus musculus
gaaccagctgctttcaggaatgtgt

SEQ ID NO: 416187 - DNA, 25 bp, Mus musculus
gaaccagctgggacgtgcataccgg

SEQ ID NO: 416188 - DNA, 25 bp, Mus musculus
gaaccagctgggtcgtgcataccgg

SEQ ID NO: 416189 - DNA, 25 bp, Mus musculus
gaaccaggaaccagactgtctttca

SEQ ID NO: 416190 - DNA, 25 bp, Mus musculus
gaaccaggaacctgactgtctttca

SEQ ID NO: 416191 - DNA, 25 bp, Mus musculus
gaaccaggaagtcaaacgagacaaa

SEQ ID NO: 416192 - DNA, 25 bp, Mus musculus
gaaccaggaagtgaaacgagacaaa

SEQ ID NO: 416193 - DNA, 25 bp, Mus musculus
gaaccaggaatcacaactgcggaaa

SEQ ID NO: 416194 - DNA, 25 bp, Mus musculus
gaaccaggaatctcaactgcggaaa

SEQ ID NO: 416195 - DNA, 25 bp, Mus musculus
gaaccaggacaaatcttctcttttt

SEQ ID NO: 416196 - DNA, 25 bp, Mus musculus
gaaccaggacaattcttctcttttt

SEQ ID NO: 416197 - DNA, 25 bp, Mus musculus
gaaccaggacctagaatagactcca

SEQ ID NO: 416198 - DNA, 25 bp, Mus musculus
gaaccaggaccttgaatagactcca

SEQ ID NO: 416199 - DNA, 25 bp, Mus musculus
gaaccaggactacggtcttgctgtc

SEQ ID NO: 416200 - DNA, 25 bp, Mus musculus
gaaccaggactagggtcttgctgtc

SEQ ID NO: 416201 - DNA, 25 bp, Mus musculus
gaaccaggactccaggaacacttcc

SEQ ID NO: 416202 - DNA, 25 bp, Mus musculus
gaaccaggactcgaggaacacttcc

SEQ ID NO: 416203 - DNA, 25 bp, Mus musculus
gaaccaggactgatgctcagggact

SEQ ID NO: 416204 - DNA, 25 bp, Mus musculus
gaaccaggactgttgctcagggact

SEQ ID NO: 416205 - DNA, 25 bp, Mus musculus
gaaccaggacttagggtcgcccgtg

SEQ ID NO: 416206 - DNA, 25 bp, Mus musculus
gaaccaggacttagtgcactgctct

SEQ ID NO: 416207 - DNA, 25 bp, Mus musculus
gaaccaggactttgggtcgcccgtg

SEQ ID NO: 416208 - DNA, 25 bp, Mus musculus
gaaccaggactttgtgcactgctct

SEQ ID NO: 416209 - DNA, 25 bp, Mus musculus
gaaccaggagctatactcagagggc

SEQ ID NO: 416210 - DNA, 25 bp, Mus musculus
gaaccaggagctttactcagagggc

SEQ ID NO: 416211 - DNA, 25 bp, Mus musculus
gaaccaggaggaagtgtatccttat

SEQ ID NO: 416212 - DNA, 25 bp, Mus musculus
gaaccaggaggatgtgtatccttat

SEQ ID NO: 416213 - DNA, 25 bp, Mus musculus
gaaccaggaggcaagtgaactcaag

SEQ ID NO: 416214 - DNA, 25 bp, Mus musculus
gaaccaggaggctagtgaactcaag

SEQ ID NO: 416215 - DNA, 25 bp, Mus musculus
gaaccaggatccagtttagtatcaa

SEQ ID NO: 416216 - DNA, 25 bp, Mus musculus
gaaccaggatcctgtttagtatcaa

SEQ ID NO: 416217 - DNA, 25 bp, Mus musculus
gaaccaggatgcatcatcatagggt

SEQ ID NO: 416218 - DNA, 25 bp, Mus musculus
gaaccaggatgcttcatcatagggt

SEQ ID NO: 416219 - DNA, 25 bp, Mus musculus
gaaccaggcaatcaccacagggcaa

SEQ ID NO: 416220 - DNA, 25 bp, Mus musculus
gaaccaggcaatgaccacagggcaa

SEQ ID NO: 416221 - DNA, 25 bp, Mus musculus
gaaccaggcattaaattccaacgct

SEQ ID NO: 416222 - DNA, 25 bp, Mus musculus
gaaccaggcatttaattccaacgct

SEQ ID NO: 416223 - DNA, 25 bp, Mus musculus
gaaccaggcccgcaagtacatgaat

SEQ ID NO: 416224 - DNA, 25 bp, Mus musculus
gaaccaggcccggaagtacatgaat

SEQ ID NO: 416225 - DNA, 25 bp, Mus musculus
gaaccaggcctgctgaagggcaaaa

SEQ ID NO: 416226 - DNA, 25 bp, Mus musculus
gaaccaggcctggtgaagggcaaaa

SEQ ID NO: 416227 - DNA, 25 bp, Mus musculus
gaaccaggcgctatggaccgtgaga

SEQ ID NO: 416228 - DNA, 25 bp, Mus musculus
gaaccaggcgctttggaccgtgaga

SEQ ID NO: 416229 - DNA, 25 bp, Mus musculus
gaaccaggctatcttgtaagacctt

SEQ ID NO: 416230 - DNA, 25 bp, Mus musculus
gaaccaggctatgttgtaagacctt

SEQ ID NO: 416231 - DNA, 25 bp, Mus musculus
gaaccaggctgtaacaggtacccat

SEQ ID NO: 416232 - DNA, 25 bp, Mus musculus
gaaccaggctgttacaggtacccat

SEQ ID NO: 416233 - DNA, 25 bp, Mus musculus
gaaccaggtaatctaactaaactca

SEQ ID NO: 416234 - DNA, 25 bp, Mus musculus
gaaccaggtaatgtaactaaactca

SEQ ID NO: 416235 - DNA, 25 bp, Mus musculus
gaaccaggtactataagtttgtcat

SEQ ID NO: 416236 - DNA, 25 bp, Mus musculus
gaaccaggtactttaagtttgtcat

SEQ ID NO: 416237 - DNA, 25 bp, Mus musculus
gaaccaggtatgagttttgccaata

SEQ ID NO: 416238 - DNA, 25 bp, Mus musculus
gaaccaggtatgtgttttgccaata

SEQ ID NO: 416239 - DNA, 25 bp, Mus musculus
gaaccaggtcttcatggctgcgtga

SEQ ID NO: 416240 - DNA, 25 bp, Mus musculus
gaaccaggtcttgatggctgcgtga

SEQ ID NO: 416241 - DNA, 25 bp, Mus musculus
gaaccaggtgatctctagataagag

SEQ ID NO: 416242 - DNA, 25 bp, Mus musculus
gaaccaggtgatgtctagataagag

SEQ ID NO: 416243 - DNA, 25 bp, Mus musculus
gaaccaggttcccttggtagatgca

SEQ ID NO: 416244 - DNA, 25 bp, Mus musculus
gaaccaggttccgttggtagatgca

SEQ ID NO: 416245 - DNA, 25 bp, Mus musculus
gaaccagtaaccctgacgctagcag

SEQ ID NO: 416246 - DNA, 25 bp, Mus musculus
gaaccagtaaccgtgacgctagcag

SEQ ID NO: 416247 - DNA, 25 bp, Mus musculus
gaaccagtaagtagcattcgaaacg

SEQ ID NO: 416248 - DNA, 25 bp, Mus musculus
gaaccagtaagttgcattcgaaacg

SEQ ID NO: 416249 - DNA, 25 bp, Mus musculus
gaaccagtaggtcatcgggcttcct

SEQ ID NO: 416250 - DNA, 25 bp, Mus musculus
gaaccagtaggtgatcgggcttcct

SEQ ID NO: 416251 - DNA, 25 bp, Mus musculus
gaaccagtattgctctgtggacatc

SEQ ID NO: 416252 - DNA, 25 bp, Mus musculus
gaaccagtattggtctgtggacatc

SEQ ID NO: 416253 - DNA, 25 bp, Mus musculus
gaaccagtcagcaggaggaacatct

SEQ ID NO: 416254 - DNA, 25 bp, Mus musculus
gaaccagtcagctggaggaacatct

SEQ ID NO: 416255 - DNA, 25 bp, Mus musculus
gaaccagtcagtatcttcttgagga

SEQ ID NO: 416256 - DNA, 25 bp, Mus musculus
gaaccagtcagtttcttcttgagga

SEQ ID NO: 416257 - DNA, 25 bp, Mus musculus
gaaccagtcctcatgaaaggtctca

SEQ ID NO: 416258 - DNA, 25 bp, Mus musculus
gaaccagtcctcttgaaaggtctca

SEQ ID NO: 416259 - DNA, 25 bp, Mus musculus
gaaccagtctcaaggtgttctttgg

SEQ ID NO: 416260 - DNA, 25 bp, Mus musculus
gaaccagtctcatggtgttctttgg

SEQ ID NO: 416261 - DNA, 25 bp, Mus musculus
gaaccagtctgcatcgttgttgtga

SEQ ID NO: 416262 - DNA, 25 bp, Mus musculus
gaaccagtctgcttcgttgttgtga

SEQ ID NO: 416263 - DNA, 25 bp, Mus musculus
gaaccagtgagacctggcgccatta

SEQ ID NO: 416264 - DNA, 25 bp, Mus musculus
gaaccagtgagagctggcgccatta

SEQ ID NO: 416265 - DNA, 25 bp, Mus musculus
gaaccagtgagtcctgactggacat

SEQ ID NO: 416266 - DNA, 25 bp, Mus musculus
gaaccagtgagtgctgactggacat

SEQ ID NO: 416267 - DNA, 25 bp, Mus musculus
gaaccagtgcgccacatgtgatttt

SEQ ID NO: 416268 - DNA, 25 bp, Mus musculus
gaaccagtgcgcgacatgtgatttt

SEQ ID NO: 416269 - DNA, 25 bp, Mus musculus
gaaccagtggtcagtatccaggcct

SEQ ID NO: 416270 - DNA, 25 bp, Mus musculus
gaaccagtggtctgtatccaggcct

SEQ ID NO: 416271 - DNA, 25 bp, Mus musculus
gaaccagtggtgatgcaggtatttg

SEQ ID NO: 416272 - DNA, 25 bp, Mus musculus
gaaccagtggtgcataggaaagcaa

SEQ ID NO: 416273 - DNA, 25 bp, Mus musculus
gaaccagtggtggataggaaagcaa

SEQ ID NO: 416274 - DNA, 25 bp, Mus musculus
gaaccagtggtgttgcaggtatttg

SEQ ID NO: 416275 - DNA, 25 bp, Mus musculus
gaaccagtgtgtatcatgggcctga

SEQ ID NO: 416276 - DNA, 25 bp, Mus musculus
gaaccagtgtgtttcatgggcctga

SEQ ID NO: 416277 - DNA, 25 bp, Mus musculus
gaaccagttagccttgacaaacaca

SEQ ID NO: 416278 - DNA, 25 bp, Mus musculus
gaaccagttagcgttgacaaacaca

SEQ ID NO: 416279 - DNA, 25 bp, Mus musculus
gaaccagttcaaaacagatatcagg

SEQ ID NO: 416280 - DNA, 25 bp, Mus musculus
gaaccagttcaatacagatatcagg

SEQ ID NO: 416281 - DNA, 25 bp, Mus musculus
gaaccagttcgaccactatagcaag

SEQ ID NO: 416282 - DNA, 25 bp, Mus musculus
gaaccagttcgagcactatagcaag

SEQ ID NO: 416283 - DNA, 25 bp, Mus musculus
gaaccagttgagaatcccttagcta

SEQ ID NO: 416284 - DNA, 25 bp, Mus musculus
gaaccagttgagtatcccttagcta

SEQ ID NO: 416285 - DNA, 25 bp, Mus musculus
gaaccagttgtccaacatggtccat

SEQ ID NO: 416286 - DNA, 25 bp, Mus musculus
gaaccagttgtcgaacatggtccat

SEQ ID NO: 416287 - DNA, 25 bp, Mus musculus
gaaccagttttgaggagcattgtga

SEQ ID NO: 416288 - DNA, 25 bp, Mus musculus
gaaccagttttgtggagcattgtga

SEQ ID NO: 416289 - DNA, 25 bp, Mus musculus
gaaccataaaatctccacacccatg

SEQ ID NO: 416290 - DNA, 25 bp, Mus musculus
gaaccataaaatgtccacacccatg

SEQ ID NO: 416291 - DNA, 25 bp, Mus musculus
gaaccataacatatactccacacaa

SEQ ID NO: 416292 - DNA, 25 bp, Mus musculus
gaaccataacatttactccacacaa

SEQ ID NO: 416293 - DNA, 25 bp, Mus musculus
gaaccataagatatacctgtaggca

SEQ ID NO: 416294 - DNA, 25 bp, Mus musculus
gaaccataagatttacctgtaggca

SEQ ID NO: 416295 - DNA, 25 bp, Mus musculus
gaaccataagcacgtaagcacatta

SEQ ID NO: 416296 - DNA, 25 bp, Mus musculus
gaaccataagcaggtaagcacatta

SEQ ID NO: 416297 - DNA, 25 bp, Mus musculus
gaaccataagctcttccatgcataa

SEQ ID NO: 416298 - DNA, 25 bp, Mus musculus
gaaccataagctgttccatgcataa

SEQ ID NO: 416299 - DNA, 25 bp, Mus musculus
gaaccatacaatatttttccaccat

SEQ ID NO: 416300 - DNA, 25 bp, Mus musculus
gaaccatacaatttttttccaccat

SEQ ID NO: 416301 - DNA, 25 bp, Mus musculus
gaaccatacagaccaccagccttag

SEQ ID NO: 416302 - DNA, 25 bp, Mus musculus
gaaccatacagacccacatgcgact

SEQ ID NO: 416303 - DNA, 25 bp, Mus musculus
gaaccatacagagcaccagccttag

SEQ ID NO: 416304 - DNA, 25 bp, Mus musculus
gaaccatacagagccacatgcgact

SEQ ID NO: 416305 - DNA, 25 bp, Mus musculus
gaaccatacccaaagctatcatgac

SEQ ID NO: 416306 - DNA, 25 bp, Mus musculus
gaaccatacccatagctatcatgac

SEQ ID NO: 416307 - DNA, 25 bp, Mus musculus
gaaccatagaaaaacggcattccag

SEQ ID NO: 416308 - DNA, 25 bp, Mus musculus
gaaccatagaaatacggcattccag

SEQ ID NO: 416309 - DNA, 25 bp, Mus musculus
gaaccatagcacataaccatacacc

SEQ ID NO: 416310 - DNA, 25 bp, Mus musculus
gaaccatagcacttaaccatacacc

SEQ ID NO: 416311 - DNA, 25 bp, Mus musculus
gaaccataggtgcttggtaccgaga

SEQ ID NO: 416312 - DNA, 25 bp, Mus musculus
gaaccataggtggttggtaccgaga

SEQ ID NO: 416313 - DNA, 25 bp, Mus musculus
gaaccatatcagactgggctctcag

SEQ ID NO: 416314 - DNA, 25 bp, Mus musculus
gaaccatatcagtctgggctctcag

SEQ ID NO: 416315 - DNA, 25 bp, Mus musculus
gaaccatatggcacttttttatttt

SEQ ID NO: 416316 - DNA, 25 bp, Mus musculus
gaaccatatggctcttttttatttt

SEQ ID NO: 416317 - DNA, 25 bp, Mus musculus
gaaccatcaatgaccagtgcatcac

SEQ ID NO: 416318 - DNA, 25 bp, Mus musculus
gaaccatcaatgtccagtgcatcac

SEQ ID NO: 416319 - DNA, 25 bp, Mus musculus
gaaccatcacacatctaccattatg

SEQ ID NO: 416320 - DNA, 25 bp, Mus musculus
gaaccatcacacttctaccattatg

SEQ ID NO: 416321 - DNA, 25 bp, Mus musculus
gaaccatcaccaagagaagctcctg

SEQ ID NO: 416322 - DNA, 25 bp, Mus musculus
gaaccatcaccatgagaagctcctg

SEQ ID NO: 416323 - DNA, 25 bp, Mus musculus
gaaccatcacctcttagtgctctta

SEQ ID NO: 416324 - DNA, 25 bp, Mus musculus
gaaccatcacctcttggccaacaag

SEQ ID NO: 416325 - DNA, 25 bp, Mus musculus
gaaccatcacctgttagtgctctta

SEQ ID NO: 416326 - DNA, 25 bp, Mus musculus
gaaccatcacctgttggccaacaag

SEQ ID NO: 416327 - DNA, 25 bp, Mus musculus
gaaccatcactacgaccagacaagt

SEQ ID NO: 416328 - DNA, 25 bp, Mus musculus
gaaccatcactaggaccagacaagt

SEQ ID NO: 416329 - DNA, 25 bp, Mus musculus
gaaccatcagatctcaaaggactat

SEQ ID NO: 416330 - DNA, 25 bp, Mus musculus
gaaccatcagatgtcaaaggactat

SEQ ID NO: 416331 - DNA, 25 bp, Mus musculus
gaaccatcagggatgcagagacgga

SEQ ID NO: 416332 - DNA, 25 bp, Mus musculus
gaaccatcagggttgcagagacgga

SEQ ID NO: 416333 - DNA, 25 bp, Mus musculus
gaaccatcatccattaaggctctcc

SEQ ID NO: 416334 - DNA, 25 bp, Mus musculus
gaaccatcatcctttaaggctctcc

SEQ ID NO: 416335 - DNA, 25 bp, Mus musculus
gaaccatcattgacaccagcataat

SEQ ID NO: 416336 - DNA, 25 bp, Mus musculus
gaaccatcattgtcaccagcataat

SEQ ID NO: 416337 - DNA, 25 bp, Mus musculus
gaaccatccagcagaccagagataa

SEQ ID NO: 416338 - DNA, 25 bp, Mus musculus
gaaccatccagctgaccagagataa

SEQ ID NO: 416339 - DNA, 25 bp, Mus musculus
gaaccatccagtctgtgtacacatc

SEQ ID NO: 416340 - DNA, 25 bp, Mus musculus
gaaccatccagtgtgtgtacacatc

SEQ ID NO: 416341 - DNA, 25 bp, Mus musculus
gaaccatccatacaggccttgggca

SEQ ID NO: 416342 - DNA, 25 bp, Mus musculus
gaaccatccatacctcgatttctaa

SEQ ID NO: 416343 - DNA, 25 bp, Mus musculus
gaaccatccatagaggccttgggca

SEQ ID NO: 416344 - DNA, 25 bp, Mus musculus
gaaccatccatagctcgatttctaa

SEQ ID NO: 416345 - DNA, 25 bp, Mus musculus
gaaccatccatcaagatcatggcag

SEQ ID NO: 416346 - DNA, 25 bp, Mus musculus
gaaccatccatctagatcatggcag

SEQ ID NO: 416347 - DNA, 25 bp, Mus musculus
gaaccatcccttcggtaaacctgag

SEQ ID NO: 416348 - DNA, 25 bp, Mus musculus
gaaccatcccttgggtaaacctgag

SEQ ID NO: 416349 - DNA, 25 bp, Mus musculus
gaaccatctagaatgtgagtcactc

SEQ ID NO: 416350 - DNA, 25 bp, Mus musculus
gaaccatctagattgtgagtcactc

SEQ ID NO: 416351 - DNA, 25 bp, Mus musculus
gaaccatctctaattgttcccctaa

SEQ ID NO: 416352 - DNA, 25 bp, Mus musculus
gaaccatctctatttgttcccctaa

SEQ ID NO: 416353 - DNA, 25 bp, Mus musculus
gaaccatctgcccatctatggaata

SEQ ID NO: 416354 - DNA, 25 bp, Mus musculus
gaaccatctgccgatctatggaata

SEQ ID NO: 416355 - DNA, 25 bp, Mus musculus
gaaccatctgtgactgttaagctta

SEQ ID NO: 416356 - DNA, 25 bp, Mus musculus
gaaccatctgtgattattctgctta

SEQ ID NO: 416357 - DNA, 25 bp, Mus musculus
gaaccatctgtgtctgttaagctta

SEQ ID NO: 416358 - DNA, 25 bp, Mus musculus
gaaccatctgtgtttattctgctta

SEQ ID NO: 416359 - DNA, 25 bp, Mus musculus
gaaccatcttggaactgatgtccca

SEQ ID NO: 416360 - DNA, 25 bp, Mus musculus
gaaccatcttggtactgatgtccca

SEQ ID NO: 416361 - DNA, 25 bp, Mus musculus
gaaccatgaattagtacactgtgcc

SEQ ID NO: 416362 - DNA, 25 bp, Mus musculus
gaaccatgaatttgtacactgtgcc

SEQ ID NO: 416363 - DNA, 25 bp, Mus musculus
gaaccatgatcaatgcctgctgaat

SEQ ID NO: 416364 - DNA, 25 bp, Mus musculus
gaaccatgatcattgcctgctgaat

SEQ ID NO: 416365 - DNA, 25 bp, Mus musculus
gaaccatgcatccaagtgcaggctg

SEQ ID NO: 416366 - DNA, 25 bp, Mus musculus
gaaccatgcatcgaagtgcaggctg

SEQ ID NO: 416367 - DNA, 25 bp, Mus musculus
gaaccatgcctcaagtaggtgcaat

SEQ ID NO: 416368 - DNA, 25 bp, Mus musculus
gaaccatgcctctagtaggtgcaat

SEQ ID NO: 416369 - DNA, 25 bp, Mus musculus
gaaccatgccttattccaggaggaa

SEQ ID NO: 416370 - DNA, 25 bp, Mus musculus
gaaccatgcctttttccaggaggaa

SEQ ID NO: 416371 - DNA, 25 bp, Mus musculus
gaaccatgctggagctcatcaatca

SEQ ID NO: 416372 - DNA, 25 bp, Mus musculus
gaaccatgctggtgctcatcaatca

SEQ ID NO: 416373 - DNA, 25 bp, Mus musculus
gaaccatggaggacggctgcttact

SEQ ID NO: 416374 - DNA, 25 bp, Mus musculus
gaaccatggaggcatcctgcgtact

SEQ ID NO: 416375 - DNA, 25 bp, Mus musculus
gaaccatggagggatcctgcgtact

SEQ ID NO: 416376 - DNA, 25 bp, Mus musculus
gaaccatggaggtcggctgcttact

SEQ ID NO: 416377 - DNA, 25 bp, Mus musculus
gaaccatggagtaatgctgtttatt

SEQ ID NO: 416378 - DNA, 25 bp, Mus musculus
gaaccatggagtctttcgtttcctg

SEQ ID NO: 416379 - DNA, 25 bp, Mus musculus
gaaccatggagtgtttcgtttcctg

SEQ ID NO: 416380 - DNA, 25 bp, Mus musculus
gaaccatggagttatgctgtttatt

SEQ ID NO: 416381 - DNA, 25 bp, Mus musculus
gaaccatggattagggtgtggacta

SEQ ID NO: 416382 - DNA, 25 bp, Mus musculus
gaaccatggatttgggtgtggacta

SEQ ID NO: 416383 - DNA, 25 bp, Mus musculus
gaaccatggccaaaaaagtcttaaa

SEQ ID NO: 416384 - DNA, 25 bp, Mus musculus
gaaccatggccataaaagtcttaaa

SEQ ID NO: 416385 - DNA, 25 bp, Mus musculus
gaaccatggcttagagatattagac

SEQ ID NO: 416386 - DNA, 25 bp, Mus musculus
gaaccatggctttgagatattagac

SEQ ID NO: 416387 - DNA, 25 bp, Mus musculus
gaaccatgggtgaattggacctcaa

SEQ ID NO: 416388 - DNA, 25 bp, Mus musculus
gaaccatgggtgtattggacctcaa

SEQ ID NO: 416389 - DNA, 25 bp, Mus musculus
gaaccatggtgcacttcagaaggcc

SEQ ID NO: 416390 - DNA, 25 bp, Mus musculus
gaaccatggtgctcttcagaaggcc

SEQ ID NO: 416391 - DNA, 25 bp, Mus musculus
gaaccatgtaagagtgacggccctg

SEQ ID NO: 416392 - DNA, 25 bp, Mus musculus
gaaccatgtaagtgtgacggccctg

SEQ ID NO: 416393 - DNA, 25 bp, Mus musculus
gaaccatgtactcatactgcatctt

SEQ ID NO: 416394 - DNA, 25 bp, Mus musculus
gaaccatgtactgatactgcatctt

SEQ ID NO: 416395 - DNA, 25 bp, Mus musculus
gaaccatgtagtagggccgttgaat

SEQ ID NO: 416396 - DNA, 25 bp, Mus musculus
gaaccatgtagttgggccgttgaat

SEQ ID NO: 416397 - DNA, 25 bp, Mus musculus
gaaccatgtcagatgtaccaggtga

SEQ ID NO: 416398 - DNA, 25 bp, Mus musculus
gaaccatgtcagttgtaccaggtga

SEQ ID NO: 416399 - DNA, 25 bp, Mus musculus
gaaccatgtcgacgacactgccttt

SEQ ID NO: 416400 - DNA, 25 bp, Mus musculus
gaaccatgtcgaggacactgccttt

SEQ ID NO: 416401 - DNA, 25 bp, Mus musculus
gaaccatgtggaaatattaccttaa

SEQ ID NO: 416402 - DNA, 25 bp, Mus musculus
gaaccatgtggatatattaccttaa

SEQ ID NO: 416403 - DNA, 25 bp, Mus musculus
gaaccatgtggtcgtgtcttactgc

SEQ ID NO: 416404 - DNA, 25 bp, Mus musculus
gaaccatgtggtggtgtcttactgc

SEQ ID NO: 416405 - DNA, 25 bp, Mus musculus
gaaccatgttagacaacactttgca

SEQ ID NO: 416406 - DNA, 25 bp, Mus musculus
gaaccatgttagtcaacactttgca

SEQ ID NO: 416407 - DNA, 25 bp, Mus musculus
gaaccatgttgcctgtattaatcat

SEQ ID NO: 416408 - DNA, 25 bp, Mus musculus
gaaccatgttgcgtgtattaatcat

SEQ ID NO: 416409 - DNA, 25 bp, Mus musculus
gaaccatgtttcctacgacattaaa

SEQ ID NO: 416410 - DNA, 25 bp, Mus musculus
gaaccatgtttcgtacgacattaaa

SEQ ID NO: 416411 - DNA, 25 bp, Mus musculus
gaaccattaaacaatttcttcccat

SEQ ID NO: 416412 - DNA, 25 bp, Mus musculus
gaaccattaaactatttcttcccat

SEQ ID NO: 416413 - DNA, 25 bp, Mus musculus
gaaccattacaccagcatgtgcttg

SEQ ID NO: 416414 - DNA, 25 bp, Mus musculus
gaaccattacacgagcatgtgcttg

SEQ ID NO: 416415 - DNA, 25 bp, Mus musculus
gaaccattatgtattctcctctgta

SEQ ID NO: 416416 - DNA, 25 bp, Mus musculus
gaaccattatgttttctcctctgta

SEQ ID NO: 416417 - DNA, 25 bp, Mus musculus
gaaccattattacggctcattttta

SEQ ID NO: 416418 - DNA, 25 bp, Mus musculus
gaaccattattagggctcattttta

SEQ ID NO: 416419 - DNA, 25 bp, Mus musculus
gaaccattcatcattgggtggtgaa

SEQ ID NO: 416420 - DNA, 25 bp, Mus musculus
gaaccattcatctttgggtggtgaa

SEQ ID NO: 416421 - DNA, 25 bp, Mus musculus
gaaccattcccgatgtgaaagcagg

SEQ ID NO: 416422 - DNA, 25 bp, Mus musculus
gaaccattcccgttgtgaaagcagg

SEQ ID NO: 416423 - DNA, 25 bp, Mus musculus
gaaccattccggcactggtaccctg

SEQ ID NO: 416424 - DNA, 25 bp, Mus musculus
gaaccattccgggactggtaccctg

SEQ ID NO: 416425 - DNA, 25 bp, Mus musculus
gaaccattcgggagcatgccgactg

SEQ ID NO: 416426 - DNA, 25 bp, Mus musculus
gaaccattcgggtgcatgccgactg

SEQ ID NO: 416427 - DNA, 25 bp, Mus musculus
gaaccattctgtcctacagttgcta

SEQ ID NO: 416428 - DNA, 25 bp, Mus musculus
gaaccattctgtgctacagttgcta

SEQ ID NO: 416429 - DNA, 25 bp, Mus musculus
gaaccattgaagctacagaatctga

SEQ ID NO: 416430 - DNA, 25 bp, Mus musculus
gaaccattgaaggtacagaatctga

SEQ ID NO: 416431 - DNA, 25 bp, Mus musculus
gaaccattgagtagtgcatgacaga

SEQ ID NO: 416432 - DNA, 25 bp, Mus musculus
gaaccattgagttgtgcatgacaga

SEQ ID NO: 416433 - DNA, 25 bp, Mus musculus
gaaccattgataactttcatgttta

SEQ ID NO: 416434 - DNA, 25 bp, Mus musculus
gaaccattgatatctttcatgttta

SEQ ID NO: 416435 - DNA, 25 bp, Mus musculus
gaaccattgctaagtctggcacgaa

SEQ ID NO: 416436 - DNA, 25 bp, Mus musculus
gaaccattgctatgtctggcacgaa

SEQ ID NO: 416437 - DNA, 25 bp, Mus musculus
gaaccattgtaccagctttgtacag

SEQ ID NO: 416438 - DNA, 25 bp, Mus musculus
gaaccattgtacgagctttgtacag

SEQ ID NO: 416439 - DNA, 25 bp, Mus musculus
gaaccattgtcaaacacccggttta

SEQ ID NO: 416440 - DNA, 25 bp, Mus musculus
gaaccattgtcatacacccggttta

SEQ ID NO: 416441 - DNA, 25 bp, Mus musculus
gaaccattgtctagaggaactgaag

SEQ ID NO: 416442 - DNA, 25 bp, Mus musculus
gaaccattgtcttgaggaactgaag

SEQ ID NO: 416443 - DNA, 25 bp, Mus musculus
gaaccattgtgcataacaaaactgg

SEQ ID NO: 416444 - DNA, 25 bp, Mus musculus
gaaccattgtgcttaacaaaactgg

SEQ ID NO: 416445 - DNA, 25 bp, Mus musculus
gaaccattgttacgctttgtaaagc

SEQ ID NO: 416446 - DNA, 25 bp, Mus musculus
gaaccattgttaggctttgtaaagc

SEQ ID NO: 416447 - DNA, 25 bp, Mus musculus
gaaccatttcacaagccatcatctt

SEQ ID NO: 416448 - DNA, 25 bp, Mus musculus
gaaccatttcactagccatcatctt

SEQ ID NO: 416449 - DNA, 25 bp, Mus musculus
gaaccatttcttaagctcaacagca

SEQ ID NO: 416450 - DNA, 25 bp, Mus musculus
gaaccatttctttagctcaacagca

SEQ ID NO: 416451 - DNA, 25 bp, Mus musculus
gaaccatttggcatcaaggattaag

SEQ ID NO: 416452 - DNA, 25 bp, Mus musculus
gaaccatttggcttcaaggattaag

SEQ ID NO: 416453 - DNA, 25 bp, Mus musculus
gaaccatttgttataaactcattag

SEQ ID NO: 416454 - DNA, 25 bp, Mus musculus
gaaccatttgttttaaactcattag

SEQ ID NO: 416455 - DNA, 25 bp, Mus musculus
gaaccattttccagaccttgactgg

SEQ ID NO: 416456 - DNA, 25 bp, Mus musculus
gaaccattttcctgaccttgactgg

SEQ ID NO: 416457 - DNA, 25 bp, Mus musculus
gaaccatttttccaaatttcagtga

SEQ ID NO: 416458 - DNA, 25 bp, Mus musculus
gaaccatttttcgaaatttcagtga

SEQ ID NO: 416459 - DNA, 25 bp, Mus musculus
gaacccaaagctattgaacctgcca

SEQ ID NO: 416460 - DNA, 25 bp, Mus musculus
gaacccaaagcttttgaacctgcca

SEQ ID NO: 416461 - DNA, 25 bp, Mus musculus
gaacccaaatctcgctggctgactt

SEQ ID NO: 416462 - DNA, 25 bp, Mus musculus
gaacccaaatctggctggctgactt

SEQ ID NO: 416463 - DNA, 25 bp, Mus musculus
gaacccaaatttagatcctgcaccc

SEQ ID NO: 416464 - DNA, 25 bp, Mus musculus
gaacccaaattttgatcctgcaccc

SEQ ID NO: 416465 - DNA, 25 bp, Mus musculus
gaacccaacaagcttctatgtgatt

SEQ ID NO: 416466 - DNA, 25 bp, Mus musculus
gaacccaacaaggttctatgtgatt

SEQ ID NO: 416467 - DNA, 25 bp, Mus musculus
gaacccaacactccctaacatatat

SEQ ID NO: 416468 - DNA, 25 bp, Mus musculus
gaacccaacactgcctaacatatat

SEQ ID NO: 416469 - DNA, 25 bp, Mus musculus
gaacccaacagtcaaaacgtagata

SEQ ID NO: 416470 - DNA, 25 bp, Mus musculus
gaacccaacagtgaaaacgtagata

SEQ ID NO: 416471 - DNA, 25 bp, Mus musculus
gaacccaacatcaagctgttaggaa

SEQ ID NO: 416472 - DNA, 25 bp, Mus musculus
gaacccaacatctagctgttaggaa

SEQ ID NO: 416473 - DNA, 25 bp, Mus musculus
gaacccaacatgctgttacacaagt

SEQ ID NO: 416474 - DNA, 25 bp, Mus musculus
gaacccaacatggtgttacacaagt

SEQ ID NO: 416475 - DNA, 25 bp, Mus musculus
gaacccaactaaaactcttcatctt

SEQ ID NO: 416476 - DNA, 25 bp, Mus musculus
gaacccaactaatactcttcatctt

SEQ ID NO: 416477 - DNA, 25 bp, Mus musculus
gaacccaactagcagcagggcgctg

SEQ ID NO: 416478 - DNA, 25 bp, Mus musculus
gaacccaactaggagcagggcgctg

SEQ ID NO: 416479 - DNA, 25 bp, Mus musculus
gaacccaactccagggcttgctttt

SEQ ID NO: 416480 - DNA, 25 bp, Mus musculus
gaacccaactcctgggcttgctttt

SEQ ID NO: 416481 - DNA, 25 bp, Mus musculus
gaacccaacttgattaggtgtcaca

SEQ ID NO: 416482 - DNA, 25 bp, Mus musculus
gaacccaacttgtttaggtgtcaca

SEQ ID NO: 416483 - DNA, 25 bp, Mus musculus
gaacccaagaaaccgcagaataatg

SEQ ID NO: 416484 - DNA, 25 bp, Mus musculus
gaacccaagaaagcgcagaataatg

SEQ ID NO: 416485 - DNA, 25 bp, Mus musculus
gaacccaagagaatccttcacatgc

SEQ ID NO: 416486 - DNA, 25 bp, Mus musculus
gaacccaagagattccttcacatgc

SEQ ID NO: 416487 - DNA, 25 bp, Mus musculus
gaacccaagatcatgtgctcaatag

SEQ ID NO: 416488 - DNA, 25 bp, Mus musculus
gaacccaagatcttgtgctcaatag

SEQ ID NO: 416489 - DNA, 25 bp, Mus musculus
gaacccaagcaaagcaggctcctgg

SEQ ID NO: 416490 - DNA, 25 bp, Mus musculus
gaacccaagcaatgcaggctcctgg

SEQ ID NO: 416491 - DNA, 25 bp, Mus musculus
gaacccaagcgtcgcgagtttctta

SEQ ID NO: 416492 - DNA, 25 bp, Mus musculus
gaacccaagcgtggcgagtttctta

SEQ ID NO: 416493 - DNA, 25 bp, Mus musculus
gaacccaagctgactctggattcga

SEQ ID NO: 416494 - DNA, 25 bp, Mus musculus
gaacccaagctgtctctggattcga

SEQ ID NO: 416495 - DNA, 25 bp, Mus musculus
gaacccaaggagcaatcagaaacga

SEQ ID NO: 416496 - DNA, 25 bp, Mus musculus
gaacccaaggaggaatcagaaacga

SEQ ID NO: 416497 - DNA, 25 bp, Mus musculus
gaacccaagtcaatttgatattatg

SEQ ID NO: 416498 - DNA, 25 bp, Mus musculus
gaacccaagtcattttgatattatg

SEQ ID NO: 416499 - DNA, 25 bp, Mus musculus
gaacccaatagcactacctttcaag

SEQ ID NO: 416500 - DNA, 25 bp, Mus musculus
gaacccaatagctctacctttcaag

SEQ ID NO: 416501 - DNA, 25 bp, Mus musculus
gaacccaatcagagatggcattatt

SEQ ID NO: 416502 - DNA, 25 bp, Mus musculus
gaacccaatcagtgatggcattatt

SEQ ID NO: 416503 - DNA, 25 bp, Mus musculus
gaacccaatcccatgagtttaagat

SEQ ID NO: 416504 - DNA, 25 bp, Mus musculus
gaacccaatcccttgagtttaagat

SEQ ID NO: 416505 - DNA, 25 bp, Mus musculus
gaacccaatcttccagaagagcggt

SEQ ID NO: 416506 - DNA, 25 bp, Mus musculus
gaacccaatcttgcagaagagcggt

SEQ ID NO: 416507 - DNA, 25 bp, Mus musculus
gaacccaatgacaatttcacaaatg

SEQ ID NO: 416508 - DNA, 25 bp, Mus musculus
gaacccaatgactatttcacaaatg

SEQ ID NO: 416509 - DNA, 25 bp, Mus musculus
gaacccacaagtcatagcttctcag

SEQ ID NO: 416510 - DNA, 25 bp, Mus musculus
gaacccacaagtgatagcttctcag

SEQ ID NO: 416511 - DNA, 25 bp, Mus musculus
gaacccacagcccatggtcatgtga

SEQ ID NO: 416512 - DNA, 25 bp, Mus musculus
gaacccacagccgatggtcatgtga

SEQ ID NO: 416513 - DNA, 25 bp, Mus musculus
gaacccacataaagctgaacacgat

SEQ ID NO: 416514 - DNA, 25 bp, Mus musculus
gaacccacataatgctgaacacgat

SEQ ID NO: 416515 - DNA, 25 bp, Mus musculus
gaacccacatggcaagtcttagtag

SEQ ID NO: 416516 - DNA, 25 bp, Mus musculus
gaacccacatgggaagtcttagtag

SEQ ID NO: 416517 - DNA, 25 bp, Mus musculus
gaacccaccagtcaggattactgat

SEQ ID NO: 416518 - DNA, 25 bp, Mus musculus
gaacccaccagtgaggattactgat

SEQ ID NO: 416519 - DNA, 25 bp, Mus musculus
gaacccaccatgcatcttggactaa

SEQ ID NO: 416520 - DNA, 25 bp, Mus musculus
gaacccaccatggatcttggactaa

SEQ ID NO: 416521 - DNA, 25 bp, Mus musculus
gaacccaccgtgagcctgatgggag

SEQ ID NO: 416522 - DNA, 25 bp, Mus musculus
gaacccaccgtgtgcctgatgggag

SEQ ID NO: 416523 - DNA, 25 bp, Mus musculus
gaacccacctcccttgttgaattcg

SEQ ID NO: 416524 - DNA, 25 bp, Mus musculus
gaacccacctccgttgttgaattcg

SEQ ID NO: 416525 - DNA, 25 bp, Mus musculus
gaacccacgacacataaaagcactt

SEQ ID NO: 416526 - DNA, 25 bp, Mus musculus
gaacccacgacagataaaagcactt

SEQ ID NO: 416527 - DNA, 25 bp, Mus musculus
gaacccacgataaactgcttgcagg

SEQ ID NO: 416528 - DNA, 25 bp, Mus musculus
gaacccacgatatactgcttgcagg

SEQ ID NO: 416529 - DNA, 25 bp, Mus musculus
gaacccactcctcagagttgttctc

SEQ ID NO: 416530 - DNA, 25 bp, Mus musculus
gaacccactcctgagagttgttctc

SEQ ID NO: 416531 - DNA, 25 bp, Mus musculus
gaacccactggtcttttgcttttga

SEQ ID NO: 416532 - DNA, 25 bp, Mus musculus
gaacccactggtgttttgcttttga

SEQ ID NO: 416533 - DNA, 25 bp, Mus musculus
gaacccactttaaaagccagtacag

SEQ ID NO: 416534 - DNA, 25 bp, Mus musculus
gaacccactttataagccagtacag

SEQ ID NO: 416535 - DNA, 25 bp, Mus musculus
gaacccagaattctgattgcagcat

SEQ ID NO: 416536 - DNA, 25 bp, Mus musculus
gaacccagaattgtgattgcagcat

SEQ ID NO: 416537 - DNA, 25 bp, Mus musculus
gaacccagactcatccagaaggagt

SEQ ID NO: 416538 - DNA, 25 bp, Mus musculus
gaacccagactcttccagaaggagt

SEQ ID NO: 416539 - DNA, 25 bp, Mus musculus
gaacccagacttaacctcaggttag

SEQ ID NO: 416540 - DNA, 25 bp, Mus musculus
gaacccagactttacctcaggttag

SEQ ID NO: 416541 - DNA, 25 bp, Mus musculus
gaacccagagacacaatggctgctc

SEQ ID NO: 416542 - DNA, 25 bp, Mus musculus
gaacccagagactcaatggctgctc

SEQ ID NO: 416543 - DNA, 25 bp, Mus musculus
gaacccagagcaaaacacttcaact

SEQ ID NO: 416544 - DNA, 25 bp, Mus musculus
gaacccagagcactattccaagcgc

SEQ ID NO: 416545 - DNA, 25 bp, Mus musculus
gaacccagagcagtattccaagcgc

SEQ ID NO: 416546 - DNA, 25 bp, Mus musculus
gaacccagagcataacacttcaact

SEQ ID NO: 416547 - DNA, 25 bp, Mus musculus
gaacccagagcgcaataccaacatg

SEQ ID NO: 416548 - DNA, 25 bp, Mus musculus
gaacccagagcggaataccaacatg

SEQ ID NO: 416549 - DNA, 25 bp, Mus musculus
gaacccagagctaacttataggact

SEQ ID NO: 416550 - DNA, 25 bp, Mus musculus
gaacccagagcttacttataggact

SEQ ID NO: 416551 - DNA, 25 bp, Mus musculus
gaacccagagggaacttctagacac

SEQ ID NO: 416552 - DNA, 25 bp, Mus musculus
gaacccagagggtacttctagacac

SEQ ID NO: 416553 - DNA, 25 bp, Mus musculus
gaacccagaggtctcacatcagctg

SEQ ID NO: 416554 - DNA, 25 bp, Mus musculus
gaacccagaggtgtcacatcagctg

SEQ ID NO: 416555 - DNA, 25 bp, Mus musculus
gaacccagatgaagtcttcagggaa

SEQ ID NO: 416556 - DNA, 25 bp, Mus musculus
gaacccagatgatgtcttcagggaa

SEQ ID NO: 416557 - DNA, 25 bp, Mus musculus
gaacccagatgccaccttctgaaag

SEQ ID NO: 416558 - DNA, 25 bp, Mus musculus
gaacccagatgcgaccttctgaaag

SEQ ID NO: 416559 - DNA, 25 bp, Mus musculus
gaacccagattcattatatcgtact

SEQ ID NO: 416560 - DNA, 25 bp, Mus musculus
gaacccagattctttatatcgtact

SEQ ID NO: 416561 - DNA, 25 bp, Mus musculus
gaacccagcaacacagctgttgtga

SEQ ID NO: 416562 - DNA, 25 bp, Mus musculus
gaacccagcaactcagctgttgtga

SEQ ID NO: 416563 - DNA, 25 bp, Mus musculus
gaacccagcagccatactgtgagga

SEQ ID NO: 416564 - DNA, 25 bp, Mus musculus
gaacccagcagcgatactgtgagga

SEQ ID NO: 416565 - DNA, 25 bp, Mus musculus
gaacccagcccaattctaagaactc

SEQ ID NO: 416566 - DNA, 25 bp, Mus musculus
gaacccagcccatttctaagaactc

SEQ ID NO: 416567 - DNA, 25 bp, Mus musculus
gaacccagccgactgcaagcagcag

SEQ ID NO: 416568 - DNA, 25 bp, Mus musculus
gaacccagccgagtgcaagcagcag

SEQ ID NO: 416569 - DNA, 25 bp, Mus musculus
gaacccagctctcaactgtgttcat

SEQ ID NO: 416570 - DNA, 25 bp, Mus musculus
gaacccagctctgaactgtgttcat

SEQ ID NO: 416571 - DNA, 25 bp, Mus musculus
gaacccagctgcattgaagaccaat

SEQ ID NO: 416572 - DNA, 25 bp, Mus musculus
gaacccagctgctttgaagaccaat

SEQ ID NO: 416573 - DNA, 25 bp, Mus musculus
gaacccagcttgaggacaggactct

SEQ ID NO: 416574 - DNA, 25 bp, Mus musculus
gaacccagcttgtggacaggactct

SEQ ID NO: 416575 - DNA, 25 bp, Mus musculus
gaacccaggaagagagtttgatact

SEQ ID NO: 416576 - DNA, 25 bp, Mus musculus
gaacccaggaagtgagtttgatact

SEQ ID NO: 416577 - DNA, 25 bp, Mus musculus
gaacccaggaccacacatgtgttat

SEQ ID NO: 416578 - DNA, 25 bp, Mus musculus
gaacccaggacctcacatgtgttat

SEQ ID NO: 416579 - DNA, 25 bp, Mus musculus
gaacccaggcatcatgctagaccta

SEQ ID NO: 416580 - DNA, 25 bp, Mus musculus
gaacccaggcatgatgctagaccta

SEQ ID NO: 416581 - DNA, 25 bp, Mus musculus
gaacccagggagaggccagtttgaa

SEQ ID NO: 416582 - DNA, 25 bp, Mus musculus
gaacccagggagagttcactgccag

SEQ ID NO: 416583 - DNA, 25 bp, Mus musculus
gaacccagggagtggccagtttgaa

SEQ ID NO: 416584 - DNA, 25 bp, Mus musculus
gaacccagggagtgttcactgccag

SEQ ID NO: 416585 - DNA, 25 bp, Mus musculus
gaacccagggccactcatgtacaga

SEQ ID NO: 416586 - DNA, 25 bp, Mus musculus
gaacccagggcctctcatgtacaga

SEQ ID NO: 416587 - DNA, 25 bp, Mus musculus
gaacccaggtcccttgagaaagcag

SEQ ID NO: 416588 - DNA, 25 bp, Mus musculus
gaacccaggtccgttgagaaagcag

SEQ ID NO: 416589 - DNA, 25 bp, Mus musculus
gaacccaggtctcaatggaacccag

SEQ ID NO: 416590 - DNA, 25 bp, Mus musculus
gaacccaggtctgaatggaacccag

SEQ ID NO: 416591 - DNA, 25 bp, Mus musculus
gaacccaggtgaaggtgctgtccac

SEQ ID NO: 416592 - DNA, 25 bp, Mus musculus
gaacccaggtgatggtgctgtccac

SEQ ID NO: 416593 - DNA, 25 bp, Mus musculus
gaacccagtcgactgtgcaagtctt

SEQ ID NO: 416594 - DNA, 25 bp, Mus musculus
gaacccagtcgagtgtgcaagtctt

SEQ ID NO: 416595 - DNA, 25 bp, Mus musculus
gaacccagtgccaacacaggacaat

SEQ ID NO: 416596 - DNA, 25 bp, Mus musculus
gaacccagtgcctacacaggacaat

SEQ ID NO: 416597 - DNA, 25 bp, Mus musculus
gaacccagtgtcaagtgctgtgcga

SEQ ID NO: 416598 - DNA, 25 bp, Mus musculus
gaacccagtgtctagtgctgtgcga

SEQ ID NO: 416599 - DNA, 25 bp, Mus musculus
gaacccagtgttcccaaatagtatt

SEQ ID NO: 416600 - DNA, 25 bp, Mus musculus
gaacccagtgttgccaaatagtatt

SEQ ID NO: 416601 - DNA, 25 bp, Mus musculus
gaacccagttcaaggatgctctgct

SEQ ID NO: 416602 - DNA, 25 bp, Mus musculus
gaacccagttcatggatgctctgct

SEQ ID NO: 416603 - DNA, 25 bp, Mus musculus
gaacccagttggcacttccagaata

SEQ ID NO: 416604 - DNA, 25 bp, Mus musculus
gaacccagttgggacttccagaata

SEQ ID NO: 416605 - DNA, 25 bp, Mus musculus
gaacccataaagctaatacgtccca

SEQ ID NO: 416606 - DNA, 25 bp, Mus musculus
gaacccataaagcttttcacctatg

SEQ ID NO: 416607 - DNA, 25 bp, Mus musculus
gaacccataaaggtaatacgtccca

SEQ ID NO: 416608 - DNA, 25 bp, Mus musculus
gaacccataaaggttttcacctatg

SEQ ID NO: 416609 - DNA, 25 bp, Mus musculus
gaacccataagcagtctagactcat

SEQ ID NO: 416610 - DNA, 25 bp, Mus musculus
gaacccataagctgtctagactcat

SEQ ID NO: 416611 - DNA, 25 bp, Mus musculus
gaacccatacacagttgctttgctt

SEQ ID NO: 416612 - DNA, 25 bp, Mus musculus
gaacccatacactgttgctttgctt

SEQ ID NO: 416613 - DNA, 25 bp, Mus musculus
gaacccatactgcataacttactat

SEQ ID NO: 416614 - DNA, 25 bp, Mus musculus
gaacccatactggataacttactat

SEQ ID NO: 416615 - DNA, 25 bp, Mus musculus
gaacccatagttccatgtcttattc

SEQ ID NO: 416616 - DNA, 25 bp, Mus musculus
gaacccatagttgcatgtcttattc

SEQ ID NO: 416617 - DNA, 25 bp, Mus musculus
gaacccatcatcatctcttgaaagt

SEQ ID NO: 416618 - DNA, 25 bp, Mus musculus
gaacccatcatcttctcttgaaagt

SEQ ID NO: 416619 - DNA, 25 bp, Mus musculus
gaacccatcatgaggtgtacttttt

SEQ ID NO: 416620 - DNA, 25 bp, Mus musculus
gaacccatcatgctcatactataga

SEQ ID NO: 416621 - DNA, 25 bp, Mus musculus
gaacccatcatggtcatactataga

SEQ ID NO: 416622 - DNA, 25 bp, Mus musculus
gaacccatcatgtggtgtacttttt

SEQ ID NO: 416623 - DNA, 25 bp, Mus musculus
gaacccatctctcatcatgtccagt

SEQ ID NO: 416624 - DNA, 25 bp, Mus musculus
gaacccatctctgatcatgtccagt

SEQ ID NO: 416625 - DNA, 25 bp, Mus musculus
gaacccatcttcaagcttttcagcg

SEQ ID NO: 416626 - DNA, 25 bp, Mus musculus
gaacccatcttctagcttttcagcg

SEQ ID NO: 416627 - DNA, 25 bp, Mus musculus
gaacccatgagaccttcttgtatgt

SEQ ID NO: 416628 - DNA, 25 bp, Mus musculus
gaacccatgagagcttcttgtatgt

SEQ ID NO: 416629 - DNA, 25 bp, Mus musculus
gaacccatgccccatgtgaattcag

SEQ ID NO: 416630 - DNA, 25 bp, Mus musculus
gaacccatgcccgatgtgaattcag

SEQ ID NO: 416631 - DNA, 25 bp, Mus musculus
gaacccatggctacgcagatgctag

SEQ ID NO: 416632 - DNA, 25 bp, Mus musculus
gaacccatggctatagacactgtta

SEQ ID NO: 416633 - DNA, 25 bp, Mus musculus
gaacccatggcttcgcagatgctag

SEQ ID NO: 416634 - DNA, 25 bp, Mus musculus
gaacccatggctttagacactgtta

SEQ ID NO: 416635 - DNA, 25 bp, Mus musculus
gaacccatgggaatttttagctcat

SEQ ID NO: 416636 - DNA, 25 bp, Mus musculus
gaacccatgggacactttaaactct

SEQ ID NO: 416637 - DNA, 25 bp, Mus musculus
gaacccatgggagactttaaactct

SEQ ID NO: 416638 - DNA, 25 bp, Mus musculus
gaacccatgggattttttagctcat

SEQ ID NO: 416639 - DNA, 25 bp, Mus musculus
gaacccatggtgcagtggtacattt

SEQ ID NO: 416640 - DNA, 25 bp, Mus musculus
gaacccatggtggagtggtacattt

SEQ ID NO: 416641 - DNA, 25 bp, Mus musculus
gaacccatggttctaagtcatgtcc

SEQ ID NO: 416642 - DNA, 25 bp, Mus musculus
gaacccatggttgtaagtcatgtcc

SEQ ID NO: 416643 - DNA, 25 bp, Mus musculus
gaacccatgtatcactgttgtgaga

SEQ ID NO: 416644 - DNA, 25 bp, Mus musculus
gaacccatgtatgactgttgtgaga

SEQ ID NO: 416645 - DNA, 25 bp, Mus musculus
gaacccatgtccagagaaagcgcaa

SEQ ID NO: 416646 - DNA, 25 bp, Mus musculus
gaacccatgtcctgagaaagcgcaa

SEQ ID NO: 416647 - DNA, 25 bp, Mus musculus
gaacccatgtggatctgaagatgac

SEQ ID NO: 416648 - DNA, 25 bp, Mus musculus
gaacccatgtggttctgaagatgac

SEQ ID NO: 416649 - DNA, 25 bp, Mus musculus
gaacccattaataaagccactgacc

SEQ ID NO: 416650 - DNA, 25 bp, Mus musculus
gaacccattaattaagccactgacc

SEQ ID NO: 416651 - DNA, 25 bp, Mus musculus
gaacccattccacacacatgatact

SEQ ID NO: 416652 - DNA, 25 bp, Mus musculus
gaacccattccacttaacatctcag

SEQ ID NO: 416653 - DNA, 25 bp, Mus musculus
gaacccattccagacacatgatact

SEQ ID NO: 416654 - DNA, 25 bp, Mus musculus
gaacccattccagttaacatctcag

SEQ ID NO: 416655 - DNA, 25 bp, Mus musculus
gaacccattgtaagcggggcagctg

SEQ ID NO: 416656 - DNA, 25 bp, Mus musculus
gaacccattgtaatgctttatctct

SEQ ID NO: 416657 - DNA, 25 bp, Mus musculus
gaacccattgtatgcggggcagctg

SEQ ID NO: 416658 - DNA, 25 bp, Mus musculus
gaacccattgtattgctttatctct

SEQ ID NO: 416659 - DNA, 25 bp, Mus musculus
gaacccatttggcttacaactgtct

SEQ ID NO: 416660 - DNA, 25 bp, Mus musculus
gaacccatttgggttacaactgtct

SEQ ID NO: 416661 - DNA, 25 bp, Mus musculus
gaaccccaagaacctgacgctgctg

SEQ ID NO: 416662 - DNA, 25 bp, Mus musculus
gaaccccaagaagctgacgctgctg

SEQ ID NO: 416663 - DNA, 25 bp, Mus musculus
gaaccccaagcacgtcgagtatttg

SEQ ID NO: 416664 - DNA, 25 bp, Mus musculus
gaaccccaagcaggtcgagtatttg

SEQ ID NO: 416665 - DNA, 25 bp, Mus musculus
gaaccccaagctattgaactgcact

SEQ ID NO: 416666 - DNA, 25 bp, Mus musculus
gaaccccaagctcgtgattcactgg

SEQ ID NO: 416667 - DNA, 25 bp, Mus musculus
gaaccccaagctggtgattcactgg

SEQ ID NO: 416668 - DNA, 25 bp, Mus musculus
gaaccccaagcttttgaactgcact

SEQ ID NO: 416669 - DNA, 25 bp, Mus musculus
gaaccccaaggtcttcctgtttcag

SEQ ID NO: 416670 - DNA, 25 bp, Mus musculus
gaaccccaaggtgttcctgtttcag

SEQ ID NO: 416671 - DNA, 25 bp, Mus musculus
gaaccccacacacgtctctgttgaa

SEQ ID NO: 416672 - DNA, 25 bp, Mus musculus
gaaccccacacaggtctctgttgaa

SEQ ID NO: 416673 - DNA, 25 bp, Mus musculus
gaaccccacaccagaggagctgcag

SEQ ID NO: 416674 - DNA, 25 bp, Mus musculus
gaaccccacacctgaggagctgcag

SEQ ID NO: 416675 - DNA, 25 bp, Mus musculus
gaaccccacagtaagtacactttat

SEQ ID NO: 416676 - DNA, 25 bp, Mus musculus
gaaccccacagttagtacactttat

SEQ ID NO: 416677 - DNA, 25 bp, Mus musculus
gaaccccacctgaagtgtccaagaa

SEQ ID NO: 416678 - DNA, 25 bp, Mus musculus
gaaccccacctgtagtgtccaagaa

SEQ ID NO: 416679 - DNA, 25 bp, Mus musculus
gaaccccaccttaaaggtgctgaag

SEQ ID NO: 416680 - DNA, 25 bp, Mus musculus
gaaccccacctttaaggtgctgaag

SEQ ID NO: 416681 - DNA, 25 bp, Mus musculus
gaaccccactaaactccacaaagtg

SEQ ID NO: 416682 - DNA, 25 bp, Mus musculus
gaaccccactaatctccacaaagtg

SEQ ID NO: 416683 - DNA, 25 bp, Mus musculus
gaaccccactctcatctggacagag

SEQ ID NO: 416684 - DNA, 25 bp, Mus musculus
gaaccccactctgatctggacagag

SEQ ID NO: 416685 - DNA, 25 bp, Mus musculus
gaaccccacttccaatttgcaaagg

SEQ ID NO: 416686 - DNA, 25 bp, Mus musculus
gaaccccacttcgaatttgcaaagg

SEQ ID NO: 416687 - DNA, 25 bp, Mus musculus
gaaccccagagtctatcagggactg

SEQ ID NO: 416688 - DNA, 25 bp, Mus musculus
gaaccccagagtgtatcagggactg

SEQ ID NO: 416689 - DNA, 25 bp, Mus musculus
gaaccccagatcaatgtcgaggaaa

SEQ ID NO: 416690 - DNA, 25 bp, Mus musculus
gaaccccagatctatgtcgaggaaa

SEQ ID NO: 416691 - DNA, 25 bp, Mus musculus
gaaccccaggataggctttagcgca

SEQ ID NO: 416692 - DNA, 25 bp, Mus musculus
gaaccccaggatctggtctacagga

SEQ ID NO: 416693 - DNA, 25 bp, Mus musculus
gaaccccaggatgtggtctacagga

SEQ ID NO: 416694 - DNA, 25 bp, Mus musculus
gaaccccaggattggctttagcgca

SEQ ID NO: 416695 - DNA, 25 bp, Mus musculus
gaaccccaggcaaactgcttgtttt

SEQ ID NO: 416696 - DNA, 25 bp, Mus musculus
gaaccccaggcatactgcttgtttt

SEQ ID NO: 416697 - DNA, 25 bp, Mus musculus
gaaccccagggcaggtgactcagcc

SEQ ID NO: 416698 - DNA, 25 bp, Mus musculus
gaaccccagggctggtgactcagcc

SEQ ID NO: 416699 - DNA, 25 bp, Mus musculus
gaaccccagggtaaactcagacaca

SEQ ID NO: 416700 - DNA, 25 bp, Mus musculus
gaaccccagggttaactcagacaca

SEQ ID NO: 416701 - DNA, 25 bp, Mus musculus
gaaccccagtatactgtgactccag

SEQ ID NO: 416702 - DNA, 25 bp, Mus musculus
gaaccccagtattctgtgactccag

SEQ ID NO: 416703 - DNA, 25 bp, Mus musculus
gaaccccatacccaattgtcgttat

SEQ ID NO: 416704 - DNA, 25 bp, Mus musculus
gaaccccataccgaattgtcgttat

SEQ ID NO: 416705 - DNA, 25 bp, Mus musculus
gaaccccataggcagaggtcttatg

SEQ ID NO: 416706 - DNA, 25 bp, Mus musculus
gaaccccatagggagaggtcttatg

SEQ ID NO: 416707 - DNA, 25 bp, Mus musculus
gaaccccatcacactacaattgttt

SEQ ID NO: 416708 - DNA, 25 bp, Mus musculus
gaaccccatcactctacaattgttt

SEQ ID NO: 416709 - DNA, 25 bp, Mus musculus
gaaccccatctcaaatgcctttaaa

SEQ ID NO: 416710 - DNA, 25 bp, Mus musculus
gaaccccatctctaatgcctttaaa

SEQ ID NO: 416711 - DNA, 25 bp, Mus musculus
gaaccccatgacaaaggactcacac

SEQ ID NO: 416712 - DNA, 25 bp, Mus musculus
gaaccccatgactaaggactcacac

SEQ ID NO: 416713 - DNA, 25 bp, Mus musculus
gaaccccatgataacagaagcagcc

SEQ ID NO: 416714 - DNA, 25 bp, Mus musculus
gaaccccatgattacagaagcagcc

SEQ ID NO: 416715 - DNA, 25 bp, Mus musculus
gaaccccatgctatgtgcccgatat

SEQ ID NO: 416716 - DNA, 25 bp, Mus musculus
gaaccccatgctttgtgcccgatat

SEQ ID NO: 416717 - DNA, 25 bp, Mus musculus
gaaccccatggtagttttctgatcg

SEQ ID NO: 416718 - DNA, 25 bp, Mus musculus
gaaccccatggtcatgcttgataat

SEQ ID NO: 416719 - DNA, 25 bp, Mus musculus
gaaccccatggtgatgcttgataat

SEQ ID NO: 416720 - DNA, 25 bp, Mus musculus
gaaccccatggttgttttctgatcg

SEQ ID NO: 416721 - DNA, 25 bp, Mus musculus
gaaccccatgtcactgagccataat

SEQ ID NO: 416722 - DNA, 25 bp, Mus musculus
gaaccccatgtctctgagccataat

SEQ ID NO: 416723 - DNA, 25 bp, Mus musculus
gaaccccattatacctagtagtctc

SEQ ID NO: 416724 - DNA, 25 bp, Mus musculus
gaaccccattattcctagtagtctc

SEQ ID NO: 416725 - DNA, 25 bp, Mus musculus
gaaccccatttgctgtgggcagcac

SEQ ID NO: 416726 - DNA, 25 bp, Mus musculus
gaaccccatttggtgtgggcagcac

SEQ ID NO: 416727 - DNA, 25 bp, Mus musculus
gaacccccaagaagaccttgcagag

SEQ ID NO: 416728 - DNA, 25 bp, Mus musculus
gaacccccaagatgaccttgcagag

SEQ ID NO: 416729 - DNA, 25 bp, Mus musculus
gaaccccctggccaaataaagcatg

SEQ ID NO: 416730 - DNA, 25 bp, Mus musculus
gaaccccctggcgaaataaagcatg

SEQ ID NO: 416731 - DNA, 25 bp, Mus musculus
gaaccccgaagaccctgttgaagtg

SEQ ID NO: 416732 - DNA, 25 bp, Mus musculus
gaaccccgaagagcctgttgaagtg

SEQ ID NO: 416733 - DNA, 25 bp, Mus musculus
gaaccccgaataactgagtcttgcg

SEQ ID NO: 416734 - DNA, 25 bp, Mus musculus
gaaccccgaatatctgagtcttgcg

SEQ ID NO: 416735 - DNA, 25 bp, Mus musculus
gaaccccgagatcgatttaacattg

SEQ ID NO: 416736 - DNA, 25 bp, Mus musculus
gaaccccgagatggatttaacattg

SEQ ID NO: 416737 - DNA, 25 bp, Mus musculus
gaaccccgccaaagaccgaggtcat

SEQ ID NO: 416738 - DNA, 25 bp, Mus musculus
gaaccccgccaatgaccgaggtcat

SEQ ID NO: 416739 - DNA, 25 bp, Mus musculus
gaaccccgctatctggtgtccatgg

SEQ ID NO: 416740 - DNA, 25 bp, Mus musculus
gaaccccgctatgtggtgtccatgg

SEQ ID NO: 416741 - DNA, 25 bp, Mus musculus
gaaccccgctttctcaatcaacaga

SEQ ID NO: 416742 - DNA, 25 bp, Mus musculus
gaaccccgctttgtcaatcaacaga

SEQ ID NO: 416743 - DNA, 25 bp, Mus musculus
gaaccccggcagcagtaggtactgt

SEQ ID NO: 416744 - DNA, 25 bp, Mus musculus
gaaccccggcaggagtaggtactgt

SEQ ID NO: 416745 - DNA, 25 bp, Mus musculus
gaaccccggttcataggcacagcag

SEQ ID NO: 416746 - DNA, 25 bp, Mus musculus
gaaccccggttcttaggcacagcag

SEQ ID NO: 416747 - DNA, 25 bp, Mus musculus
gaaccccgtaacaaagggctcacag

SEQ ID NO: 416748 - DNA, 25 bp, Mus musculus
gaaccccgtaactaagggctcacag

SEQ ID NO: 416749 - DNA, 25 bp, Mus musculus
gaaccccgtgatcaagtgttcaccg

SEQ ID NO: 416750 - DNA, 25 bp, Mus musculus
gaaccccgtgatgaagtgttcaccg

SEQ ID NO: 416751 - DNA, 25 bp, Mus musculus
gaacccctacttactctgggagtgg

SEQ ID NO: 416752 - DNA, 25 bp, Mus musculus
gaacccctactttctctgggagtgg

SEQ ID NO: 416753 - DNA, 25 bp, Mus musculus
gaacccctagccacttagaatatga

SEQ ID NO: 416754 - DNA, 25 bp, Mus musculus
gaacccctagcctcttagaatatga

SEQ ID NO: 416755 - DNA, 25 bp, Mus musculus
gaacccctagctagggctggagttt

SEQ ID NO: 416756 - DNA, 25 bp, Mus musculus
gaacccctagcttgggctggagttt

SEQ ID NO: 416757 - DNA, 25 bp, Mus musculus
gaacccctatgccaccaatgtgtgc

SEQ ID NO: 416758 - DNA, 25 bp, Mus musculus
gaacccctatgcgaccaatgtgtgc

SEQ ID NO: 416759 - DNA, 25 bp, Mus musculus
gaacccctctaacgacatgtatgca

SEQ ID NO: 416760 - DNA, 25 bp, Mus musculus
gaacccctctaaggacatgtatgca

SEQ ID NO: 416761 - DNA, 25 bp, Mus musculus
gaacccctctggattcgtggaactg

SEQ ID NO: 416762 - DNA, 25 bp, Mus musculus
gaacccctctggcaagtggaagcag

SEQ ID NO: 416763 - DNA, 25 bp, Mus musculus
gaacccctctgggaagtggaagcag

SEQ ID NO: 416764 - DNA, 25 bp, Mus musculus
gaacccctctggtttcgtggaactg

SEQ ID NO: 416765 - DNA, 25 bp, Mus musculus
gaacccctgagaaagtttgctctta

SEQ ID NO: 416766 - DNA, 25 bp, Mus musculus
gaacccctgagatagtttgctctta

SEQ ID NO: 416767 - DNA, 25 bp, Mus musculus
gaacccctggaactgcagatacagg

SEQ ID NO: 416768 - DNA, 25 bp, Mus musculus
gaacccctggaagtgcagatacagg

SEQ ID NO: 416769 - DNA, 25 bp, Mus musculus
gaacccctggctcatttggaactag

SEQ ID NO: 416770 - DNA, 25 bp, Mus musculus
gaacccctggctgatttggaactag

SEQ ID NO: 416771 - DNA, 25 bp, Mus musculus
gaacccctggttcgctcagaactat

SEQ ID NO: 416772 - DNA, 25 bp, Mus musculus
gaacccctggttggctcagaactat

SEQ ID NO: 416773 - DNA, 25 bp, Mus musculus
gaacccctgttgcaagtacatgaaa

SEQ ID NO: 416774 - DNA, 25 bp, Mus musculus
gaacccctgttggaagtacatgaaa

SEQ ID NO: 416775 - DNA, 25 bp, Mus musculus
gaacccctgtttatagcatactgtg

SEQ ID NO: 416776 - DNA, 25 bp, Mus musculus
gaacccctgtttttagcatactgtg

SEQ ID NO: 416777 - DNA, 25 bp, Mus musculus
gaaccccttcaacccatcaactgag

SEQ ID NO: 416778 - DNA, 25 bp, Mus musculus
gaaccccttcaagccatcaactgag

SEQ ID NO: 416779 - DNA, 25 bp, Mus musculus
gaaccccttcttaacgagcaatatg

SEQ ID NO: 416780 - DNA, 25 bp, Mus musculus
gaaccccttcttcagactccagagt

SEQ ID NO: 416781 - DNA, 25 bp, Mus musculus
gaaccccttcttgagactccagagt

SEQ ID NO: 416782 - DNA, 25 bp, Mus musculus
gaaccccttctttacgagcaatatg

SEQ ID NO: 416783 - DNA, 25 bp, Mus musculus
gaacccctttccaagatgaggctgg

SEQ ID NO: 416784 - DNA, 25 bp, Mus musculus
gaacccctttcctagatgaggctgg

SEQ ID NO: 416785 - DNA, 25 bp, Mus musculus
gaacccctttggctggatctctctg

SEQ ID NO: 416786 - DNA, 25 bp, Mus musculus
gaacccctttgggtggatctctctg

SEQ ID NO: 416787 - DNA, 25 bp, Mus musculus
gaaccccttttacggatcaatatgt

SEQ ID NO: 416788 - DNA, 25 bp, Mus musculus
gaaccccttttagggatcaatatgt

SEQ ID NO: 416789 - DNA, 25 bp, Mus musculus
gaacccgaatgcactggtcagctga

SEQ ID NO: 416790 - DNA, 25 bp, Mus musculus
gaacccgaatgctctggtcagctga

SEQ ID NO: 416791 - DNA, 25 bp, Mus musculus
gaacccgacctcagagcagattgaa

SEQ ID NO: 416792 - DNA, 25 bp, Mus musculus
gaacccgacctctgagcagattgaa

SEQ ID NO: 416793 - DNA, 25 bp, Mus musculus
gaacccgagcaaatcctaagtagat

SEQ ID NO: 416794 - DNA, 25 bp, Mus musculus
gaacccgagcaattcctaagtagat

SEQ ID NO: 416795 - DNA, 25 bp, Mus musculus
gaacccgaggccagtgatcagatgt

SEQ ID NO: 416796 - DNA, 25 bp, Mus musculus
gaacccgaggcctgtgatcagatgt

SEQ ID NO: 416797 - DNA, 25 bp, Mus musculus
gaacccgagtttatcagaccaacag

SEQ ID NO: 416798 - DNA, 25 bp, Mus musculus
gaacccgagtttttcagaccaacag

SEQ ID NO: 416799 - DNA, 25 bp, Mus musculus
gaacccgatcaaagaaattttgagt

SEQ ID NO: 416800 - DNA, 25 bp, Mus musculus
gaacccgatcaatgaaattttgagt

SEQ ID NO: 416801 - DNA, 25 bp, Mus musculus
gaacccgcaagaacagagcatctgt

SEQ ID NO: 416802 - DNA, 25 bp, Mus musculus
gaacccgcaagatcagagcatctgt

SEQ ID NO: 416803 - DNA, 25 bp, Mus musculus
gaacccgcaggtaatcttggtctca

SEQ ID NO: 416804 - DNA, 25 bp, Mus musculus
gaacccgcaggttatcttggtctca

SEQ ID NO: 416805 - DNA, 25 bp, Mus musculus
gaacccgcatcaactgttctgattc

SEQ ID NO: 416806 - DNA, 25 bp, Mus musculus
gaacccgcatcatctgttctgattc

SEQ ID NO: 416807 - DNA, 25 bp, Mus musculus
gaacccgccatcagcttggaatatg

SEQ ID NO: 416808 - DNA, 25 bp, Mus musculus
gaacccgccatctgcttggaatatg

SEQ ID NO: 416809 - DNA, 25 bp, Mus musculus
gaacccgctcgaactacagccatgt

SEQ ID NO: 416810 - DNA, 25 bp, Mus musculus
gaacccgctcgatctacagccatgt

SEQ ID NO: 416811 - DNA, 25 bp, Mus musculus
gaacccggaaccaaggagattcaga

SEQ ID NO: 416812 - DNA, 25 bp, Mus musculus
gaacccggaacctaggagattcaga

SEQ ID NO: 416813 - DNA, 25 bp, Mus musculus
gaacccggacctacgcaagggcgag

SEQ ID NO: 416814 - DNA, 25 bp, Mus musculus
gaacccggaccttcgcaagggcgag

SEQ ID NO: 416815 - DNA, 25 bp, Mus musculus
gaacccggagaaacatttgtatgtc

SEQ ID NO: 416816 - DNA, 25 bp, Mus musculus
gaacccggagaatcatttgtatgtc

SEQ ID NO: 416817 - DNA, 25 bp, Mus musculus
gaacccggattccaagagctgctgt

SEQ ID NO: 416818 - DNA, 25 bp, Mus musculus
gaacccggattcgaagagctgctgt

SEQ ID NO: 416819 - DNA, 25 bp, Mus musculus
gaacccggccaacgctgggctttga

SEQ ID NO: 416820 - DNA, 25 bp, Mus musculus
gaacccggccaaggctgggctttga

SEQ ID NO: 416821 - DNA, 25 bp, Mus musculus
gaacccggctctcggaaaggacaat

SEQ ID NO: 416822 - DNA, 25 bp, Mus musculus
gaacccggctctgggaaaggacaat

SEQ ID NO: 416823 - DNA, 25 bp, Mus musculus
gaacccggtcagaagttcccacagg

SEQ ID NO: 416824 - DNA, 25 bp, Mus musculus
gaacccggtcagtagttcccacagg

SEQ ID NO: 416825 - DNA, 25 bp, Mus musculus
gaacccggtgaaatgacacaggcaa

SEQ ID NO: 416826 - DNA, 25 bp, Mus musculus
gaacccggtgaattgacacaggcaa

SEQ ID NO: 416827 - DNA, 25 bp, Mus musculus
gaacccggtggactacactgttcaa

SEQ ID NO: 416828 - DNA, 25 bp, Mus musculus
gaacccggtggagtacactgttcaa

SEQ ID NO: 416829 - DNA, 25 bp, Mus musculus
gaacccggttacagtgattagagct

SEQ ID NO: 416830 - DNA, 25 bp, Mus musculus
gaacccggttactgtgattagagct

SEQ ID NO: 416831 - DNA, 25 bp, Mus musculus
gaacccgtcactcctgtctgtaaat

SEQ ID NO: 416832 - DNA, 25 bp, Mus musculus
gaacccgtcactgctgtctgtaaat

SEQ ID NO: 416833 - DNA, 25 bp, Mus musculus
gaacccgtccatacagaaagcttca

SEQ ID NO: 416834 - DNA, 25 bp, Mus musculus
gaacccgtccattcagaaagcttca

SEQ ID NO: 416835 - DNA, 25 bp, Mus musculus
gaacccgtgcatctcagcagactgt

SEQ ID NO: 416836 - DNA, 25 bp, Mus musculus
gaacccgtgcatgtcagcagactgt

SEQ ID NO: 416837 - DNA, 25 bp, Mus musculus
gaacccgttgcaattcaatcttcta

SEQ ID NO: 416838 - DNA, 25 bp, Mus musculus
gaacccgttgcatttcaatcttcta

SEQ ID NO: 416839 - DNA, 25 bp, Mus musculus
gaaccctaacataacactaaccagc

SEQ ID NO: 416840 - DNA, 25 bp, Mus musculus
gaaccctaacattacactaaccagc

SEQ ID NO: 416841 - DNA, 25 bp, Mus musculus
gaaccctacataaggacctgcatcc

SEQ ID NO: 416842 - DNA, 25 bp, Mus musculus
gaaccctacatatggacctgcatcc

SEQ ID NO: 416843 - DNA, 25 bp, Mus musculus
gaaccctaccgcagaggccgtgtaa

SEQ ID NO: 416844 - DNA, 25 bp, Mus musculus
gaaccctaccgctgaggccgtgtaa

SEQ ID NO: 416845 - DNA, 25 bp, Mus musculus
gaaccctacgctacatcaagctgtt

SEQ ID NO: 416846 - DNA, 25 bp, Mus musculus
gaaccctacgcttcatcaagctgtt

SEQ ID NO: 416847 - DNA, 25 bp, Mus musculus
gaaccctagaaccatgcaggccctg

SEQ ID NO: 416848 - DNA, 25 bp, Mus musculus
gaaccctagaacgatgcaggccctg

SEQ ID NO: 416849 - DNA, 25 bp, Mus musculus
gaaccctagactatgcttattccct

SEQ ID NO: 416850 - DNA, 25 bp, Mus musculus
gaaccctagactttgcttattccct

SEQ ID NO: 416851 - DNA, 25 bp, Mus musculus
gaaccctagtgcagtgataactcct

SEQ ID NO: 416852 - DNA, 25 bp, Mus musculus
gaaccctagtgctgtgataactcct

SEQ ID NO: 416853 - DNA, 25 bp, Mus musculus
gaaccctagttcactcataatcagt

SEQ ID NO: 416854 - DNA, 25 bp, Mus musculus
gaaccctagttctctcataatcagt

SEQ ID NO: 416855 - DNA, 25 bp, Mus musculus
gaaccctattttaggaagcactgaa

SEQ ID NO: 416856 - DNA, 25 bp, Mus musculus
gaaccctatttttggaagcactgaa

SEQ ID NO: 416857 - DNA, 25 bp, Mus musculus
gaaccctcaaagctgcacaaatgat

SEQ ID NO: 416858 - DNA, 25 bp, Mus musculus
gaaccctcaaaggtgcacaaatgat

SEQ ID NO: 416859 - DNA, 25 bp, Mus musculus
gaaccctcacagcttctgccaagtg

SEQ ID NO: 416860 - DNA, 25 bp, Mus musculus
gaaccctcacaggttctgccaagtg

SEQ ID NO: 416861 - DNA, 25 bp, Mus musculus
gaaccctcactcaagtggagtctgg

SEQ ID NO: 416862 - DNA, 25 bp, Mus musculus
gaaccctcactctagtggagtctgg

SEQ ID NO: 416863 - DNA, 25 bp, Mus musculus
gaaccctcagatcctgcactggtgg

SEQ ID NO: 416864 - DNA, 25 bp, Mus musculus
gaaccctcagatgctgcactggtgg

SEQ ID NO: 416865 - DNA, 25 bp, Mus musculus
gaaccctcagtaaagtggctgcagt

SEQ ID NO: 416866 - DNA, 25 bp, Mus musculus
gaaccctcagtatagtggctgcagt

SEQ ID NO: 416867 - DNA, 25 bp, Mus musculus
gaaccctccacgacaaggtacatga

SEQ ID NO: 416868 - DNA, 25 bp, Mus musculus
gaaccctccacgtcaaggtacatga

SEQ ID NO: 416869 - DNA, 25 bp, Mus musculus
gaaccctccagtcatgtacagtcaa

SEQ ID NO: 416870 - DNA, 25 bp, Mus musculus
gaaccctccagtgatgtacagtcaa

SEQ ID NO: 416871 - DNA, 25 bp, Mus musculus
gaaccctcggtgctatgcaaccctg

SEQ ID NO: 416872 - DNA, 25 bp, Mus musculus
gaaccctcggtggtatgcaaccctg

SEQ ID NO: 416873 - DNA, 25 bp, Mus musculus
gaaccctctcaacagctagatctgg

SEQ ID NO: 416874 - DNA, 25 bp, Mus musculus
gaaccctctcaagagctagatctgg

SEQ ID NO: 416875 - DNA, 25 bp, Mus musculus
gaaccctctccacgttttgcaaatt

SEQ ID NO: 416876 - DNA, 25 bp, Mus musculus
gaaccctctccaggttttgcaaatt

SEQ ID NO: 416877 - DNA, 25 bp, Mus musculus
gaaccctctgttccttgcagcgata

SEQ ID NO: 416878 - DNA, 25 bp, Mus musculus
gaaccctctgttgcttgcagcgata

SEQ ID NO: 416879 - DNA, 25 bp, Mus musculus
gaaccctcttctcgagacttctctt

SEQ ID NO: 416880 - DNA, 25 bp, Mus musculus
gaaccctcttctggagacttctctt

SEQ ID NO: 416881 - DNA, 25 bp, Mus musculus
gaaccctgaaggaagtcgcctacat

SEQ ID NO: 416882 - DNA, 25 bp, Mus musculus
gaaccctgaaggtagtcgcctacat

SEQ ID NO: 416883 - DNA, 25 bp, Mus musculus
gaaccctgacaaccttagacttaca

SEQ ID NO: 416884 - DNA, 25 bp, Mus musculus
gaaccctgacaagcttagacttaca

SEQ ID NO: 416885 - DNA, 25 bp, Mus musculus
gaaccctgacagcttttaagaattg

SEQ ID NO: 416886 - DNA, 25 bp, Mus musculus
gaaccctgacaggttttaagaattg

SEQ ID NO: 416887 - DNA, 25 bp, Mus musculus
gaaccctgacatcactaaggctgga

SEQ ID NO: 416888 - DNA, 25 bp, Mus musculus
gaaccctgacatgactaaggctgga

SEQ ID NO: 416889 - DNA, 25 bp, Mus musculus
gaaccctgatataccaagaccttat

SEQ ID NO: 416890 - DNA, 25 bp, Mus musculus
gaaccctgatattccaagaccttat

SEQ ID NO: 416891 - DNA, 25 bp, Mus musculus
gaaccctgatgcctgctaagactag

SEQ ID NO: 416892 - DNA, 25 bp, Mus musculus
gaaccctgatgcgtgctaagactag

SEQ ID NO: 416893 - DNA, 25 bp, Mus musculus
gaaccctgatgtcgtggcataccgc

SEQ ID NO: 416894 - DNA, 25 bp, Mus musculus
gaaccctgatgtggtggcataccgc

SEQ ID NO: 416895 - DNA, 25 bp, Mus musculus
gaaccctgcaagatggtaaacctga

SEQ ID NO: 416896 - DNA, 25 bp, Mus musculus
gaaccctgcaagttggtaaacctga

SEQ ID NO: 416897 - DNA, 25 bp, Mus musculus
gaaccctgcactcaattatcatctg

SEQ ID NO: 416898 - DNA, 25 bp, Mus musculus
gaaccctgcactgaattatcatctg

SEQ ID NO: 416899 - DNA, 25 bp, Mus musculus
gaaccctgcattacacccagtggta

SEQ ID NO: 416900 - DNA, 25 bp, Mus musculus
gaaccctgcatttcacccagtggta

SEQ ID NO: 416901 - DNA, 25 bp, Mus musculus
gaaccctgctaaaggattttcacga

SEQ ID NO: 416902 - DNA, 25 bp, Mus musculus
gaaccctgctaatggattttcacga

SEQ ID NO: 416903 - DNA, 25 bp, Mus musculus
gaaccctgctgacacggttatcaaa

SEQ ID NO: 416904 - DNA, 25 bp, Mus musculus
gaaccctgctgagacggttatcaaa

SEQ ID NO: 416905 - DNA, 25 bp, Mus musculus
gaaccctggaggatgttttccttcg

SEQ ID NO: 416906 - DNA, 25 bp, Mus musculus
gaaccctggaggttgttttccttcg

SEQ ID NO: 416907 - DNA, 25 bp, Mus musculus
gaaccctggctaagcaaatcatgag

SEQ ID NO: 416908 - DNA, 25 bp, Mus musculus
gaaccctggctatgcaaatcatgag

SEQ ID NO: 416909 - DNA, 25 bp, Mus musculus
gaaccctggtacatggttatgctag

SEQ ID NO: 416910 - DNA, 25 bp, Mus musculus
gaaccctggtacttggttatgctag

SEQ ID NO: 416911 - DNA, 25 bp, Mus musculus
gaaccctggtagagtaatcctgatt

SEQ ID NO: 416912 - DNA, 25 bp, Mus musculus
gaaccctggtagtgtaatcctgatt

SEQ ID NO: 416913 - DNA, 25 bp, Mus musculus
gaaccctggttcatacgcatagaca

SEQ ID NO: 416914 - DNA, 25 bp, Mus musculus
gaaccctggttcttacgcatagaca

SEQ ID NO: 416915 - DNA, 25 bp, Mus musculus
gaaccctggtttagtcagacttgtg

SEQ ID NO: 416916 - DNA, 25 bp, Mus musculus
gaaccctggttttgtcagacttgtg

SEQ ID NO: 416917 - DNA, 25 bp, Mus musculus
gaaccctgtaaaatgacttcttcat

SEQ ID NO: 416918 - DNA, 25 bp, Mus musculus
gaaccctgtaaattgacttcttcat

SEQ ID NO: 416919 - DNA, 25 bp, Mus musculus
gaaccctgtagaattaactcctgtc

SEQ ID NO: 416920 - DNA, 25 bp, Mus musculus
gaaccctgtagatttaactcctgtc

SEQ ID NO: 416921 - DNA, 25 bp, Mus musculus
gaaccctgtcatctatagcattaag

SEQ ID NO: 416922 - DNA, 25 bp, Mus musculus
gaaccctgtcatctcagtgtgatta

SEQ ID NO: 416923 - DNA, 25 bp, Mus musculus
gaaccctgtcatgtatagcattaag

SEQ ID NO: 416924 - DNA, 25 bp, Mus musculus
gaaccctgtcatgtcagtgtgatta

SEQ ID NO: 416925 - DNA, 25 bp, Mus musculus
gaaccctgtgctcgatgcgtggtac

SEQ ID NO: 416926 - DNA, 25 bp, Mus musculus
gaaccctgtgctggatgcgtggtac

SEQ ID NO: 416927 - DNA, 25 bp, Mus musculus
gaaccctgtggtcattaacaaggtc

SEQ ID NO: 416928 - DNA, 25 bp, Mus musculus
gaaccctgtggtgattaacaaggtc

SEQ ID NO: 416929 - DNA, 25 bp, Mus musculus
gaaccctgtgtcaggatgattgtca

SEQ ID NO: 416930 - DNA, 25 bp, Mus musculus
gaaccctgtgtctggatgattgtca

SEQ ID NO: 416931 - DNA, 25 bp, Mus musculus
gaaccctgttttaacattgacaata

SEQ ID NO: 416932 - DNA, 25 bp, Mus musculus
gaaccctgtttttacattgacaata

SEQ ID NO: 416933 - DNA, 25 bp, Mus musculus
gaacccttaatacatacagtactta

SEQ ID NO: 416934 - DNA, 25 bp, Mus musculus
gaacccttaatagatacagtactta

SEQ ID NO: 416935 - DNA, 25 bp, Mus musculus
gaacccttaccgagactctgggaag

SEQ ID NO: 416936 - DNA, 25 bp, Mus musculus
gaacccttaccgtgactctgggaag

SEQ ID NO: 416937 - DNA, 25 bp, Mus musculus
gaacccttagaaagactggcgtggc

SEQ ID NO: 416938 - DNA, 25 bp, Mus musculus
gaacccttagaatgactggcgtggc

SEQ ID NO: 416939 - DNA, 25 bp, Mus musculus
gaacccttatacctgtttgaagaag

SEQ ID NO: 416940 - DNA, 25 bp, Mus musculus
gaacccttatacgtgtttgaagaag

SEQ ID NO: 416941 - DNA, 25 bp, Mus musculus
gaacccttccagctagattgtttta

SEQ ID NO: 416942 - DNA, 25 bp, Mus musculus
gaacccttccaggtagattgtttta

SEQ ID NO: 416943 - DNA, 25 bp, Mus musculus
gaacccttccggcacaagcgagttg

SEQ ID NO: 416944 - DNA, 25 bp, Mus musculus
gaacccttccgggacaagcgagttg

SEQ ID NO: 416945 - DNA, 25 bp, Mus musculus
gaacccttcctcaaagtgcctcgat

SEQ ID NO: 416946 - DNA, 25 bp, Mus musculus
gaacccttcctctaagtgcctcgat

SEQ ID NO: 416947 - DNA, 25 bp, Mus musculus
gaacccttctgactagttaggccaa

SEQ ID NO: 416948 - DNA, 25 bp, Mus musculus
gaacccttctgagtagttaggccaa

SEQ ID NO: 416949 - DNA, 25 bp, Mus musculus
gaacccttgatcctatacatccatt

SEQ ID NO: 416950 - DNA, 25 bp, Mus musculus
gaacccttgatcgtatacatccatt

SEQ ID NO: 416951 - DNA, 25 bp, Mus musculus
gaacccttgcctattctggtggaag

SEQ ID NO: 416952 - DNA, 25 bp, Mus musculus
gaacccttgccttttctggtggaag

SEQ ID NO: 416953 - DNA, 25 bp, Mus musculus
gaacccttgcgacatttcaacacaa

SEQ ID NO: 416954 - DNA, 25 bp, Mus musculus
gaacccttgcgagatttcaacacaa

SEQ ID NO: 416955 - DNA, 25 bp, Mus musculus
gaacccttgctgagattttgtttga

SEQ ID NO: 416956 - DNA, 25 bp, Mus musculus
gaacccttgctgtgattttgtttga

SEQ ID NO: 416957 - DNA, 25 bp, Mus musculus
gaacccttgggaaagcactgtatct

SEQ ID NO: 416958 - DNA, 25 bp, Mus musculus
gaacccttgggatagcactgtatct

SEQ ID NO: 416959 - DNA, 25 bp, Mus musculus
gaacccttggttatatgagatttgg

SEQ ID NO: 416960 - DNA, 25 bp, Mus musculus
gaacccttggttttatgagatttgg

SEQ ID NO: 416961 - DNA, 25 bp, Mus musculus
gaacccttgtatcgagacttaccta

SEQ ID NO: 416962 - DNA, 25 bp, Mus musculus
gaacccttgtatggagacttaccta

SEQ ID NO: 416963 - DNA, 25 bp, Mus musculus
gaacccttgtctcttgtggtattgt

SEQ ID NO: 416964 - DNA, 25 bp, Mus musculus
gaacccttgtctgttgtggtattgt

SEQ ID NO: 416965 - DNA, 25 bp, Mus musculus
gaacccttgtggacctcactagtga

SEQ ID NO: 416966 - DNA, 25 bp, Mus musculus
gaacccttgtggtcctcactagtga

SEQ ID NO: 416967 - DNA, 25 bp, Mus musculus
gaacccttgtgtctgactttcagtc

SEQ ID NO: 416968 - DNA, 25 bp, Mus musculus
gaacccttgtgtgtgactttcagtc

SEQ ID NO: 416969 - DNA, 25 bp, Mus musculus
gaaccctttagcaaggaacaaaatg

SEQ ID NO: 416970 - DNA, 25 bp, Mus musculus
gaaccctttagctaggaacaaaatg

SEQ ID NO: 416971 - DNA, 25 bp, Mus musculus
gaaccctttataccataatttcaga

SEQ ID NO: 416972 - DNA, 25 bp, Mus musculus
gaaccctttatagcataatttcaga

SEQ ID NO: 416973 - DNA, 25 bp, Mus musculus
gaaccctttattagtatagtgtcct

SEQ ID NO: 416974 - DNA, 25 bp, Mus musculus
gaaccctttatttgtatagtgtcct

SEQ ID NO: 416975 - DNA, 25 bp, Mus musculus
gaaccctttgagaactatcggacca

SEQ ID NO: 416976 - DNA, 25 bp, Mus musculus
gaaccctttgagtactatcggacca

SEQ ID NO: 416977 - DNA, 25 bp, Mus musculus
gaaccctttgatcattcagtcctgg

SEQ ID NO: 416978 - DNA, 25 bp, Mus musculus
gaaccctttgatgattcagtcctgg

SEQ ID NO: 416979 - DNA, 25 bp, Mus musculus
gaaccctttggaagtgtgtagcacc

SEQ ID NO: 416980 - DNA, 25 bp, Mus musculus
gaaccctttggatgtgtgtagcacc

SEQ ID NO: 416981 - DNA, 25 bp, Mus musculus
gaaccctttgttaatgccagaatgt

SEQ ID NO: 416982 - DNA, 25 bp, Mus musculus
gaaccctttgtttatgccagaatgt

SEQ ID NO: 416983 - DNA, 25 bp, Mus musculus
gaacccttttggaatcatgatttgt

SEQ ID NO: 416984 - DNA, 25 bp, Mus musculus
gaacccttttggtatcatgatttgt

SEQ ID NO: 416985 - DNA, 25 bp, Mus musculus
gaaccgaacaaccaggactttatca

SEQ ID NO: 416986 - DNA, 25 bp, Mus musculus
gaaccgaacaacgaggactttatca

SEQ ID NO: 416987 - DNA, 25 bp, Mus musculus
gaaccgaacccaagatatgacttgt

SEQ ID NO: 416988 - DNA, 25 bp, Mus musculus
gaaccgaacccaagtaatactaact

SEQ ID NO: 416989 - DNA, 25 bp, Mus musculus
gaaccgaacccatgatatgacttgt

SEQ ID NO: 416990 - DNA, 25 bp, Mus musculus
gaaccgaacccatgtaatactaact

SEQ ID NO: 416991 - DNA, 25 bp, Mus musculus
gaaccgaagcagcaagggtcagcta

SEQ ID NO: 416992 - DNA, 25 bp, Mus musculus
gaaccgaagcaggaagggtcagcta

SEQ ID NO: 416993 - DNA, 25 bp, Mus musculus
gaaccgaagggaatggccctccaag

SEQ ID NO: 416994 - DNA, 25 bp, Mus musculus
gaaccgaagggattggccctccaag

SEQ ID NO: 416995 - DNA, 25 bp, Mus musculus
gaaccgaagtagcttggcttcctct

SEQ ID NO: 416996 - DNA, 25 bp, Mus musculus
gaaccgaagtaggttggcttcctct

SEQ ID NO: 416997 - DNA, 25 bp, Mus musculus
gaaccgaagtctctgaggcatctca

SEQ ID NO: 416998 - DNA, 25 bp, Mus musculus
gaaccgaagtctgtgaggcatctca

SEQ ID NO: 416999 - DNA, 25 bp, Mus musculus
gaaccgaatctaactcacagctgac

SEQ ID NO: 417000 - DNA, 25 bp, Mus musculus
gaaccgaatctatctcacagctgac

SEQ ID NO: 417001 - DNA, 25 bp, Mus musculus
gaaccgaatgtcactccagtaaaca

SEQ ID NO: 417002 - DNA, 25 bp, Mus musculus
gaaccgaatgtctctccagtaaaca

SEQ ID NO: 417003 - DNA, 25 bp, Mus musculus
gaaccgagaagacactgcatgacac

SEQ ID NO: 417004 - DNA, 25 bp, Mus musculus
gaaccgagaagagactgcatgacac

SEQ ID NO: 417005 - DNA, 25 bp, Mus musculus
gaaccgagcattctcctggagtgca

SEQ ID NO: 417006 - DNA, 25 bp, Mus musculus
gaaccgagcattgtcctggagtgca

SEQ ID NO: 417007 - DNA, 25 bp, Mus musculus
gaaccgaggcttaggatctaagtta

SEQ ID NO: 417008 - DNA, 25 bp, Mus musculus
gaaccgaggctttggatctaagtta

SEQ ID NO: 417009 - DNA, 25 bp, Mus musculus
gaaccgagtggcagagttccacaca

SEQ ID NO: 417010 - DNA, 25 bp, Mus musculus
gaaccgagtggctgagttccacaca

SEQ ID NO: 417011 - DNA, 25 bp, Mus musculus
gaaccgagttgcagcccaggaggta

SEQ ID NO: 417012 - DNA, 25 bp, Mus musculus
gaaccgagttgctgcccaggaggta

SEQ ID NO: 417013 - DNA, 25 bp, Mus musculus
gaaccgataactccaagggtaccaa

SEQ ID NO: 417014 - DNA, 25 bp, Mus musculus
gaaccgataactgcaagggtaccaa

SEQ ID NO: 417015 - DNA, 25 bp, Mus musculus
gaaccgatactactctgtatgcatg

SEQ ID NO: 417016 - DNA, 25 bp, Mus musculus
gaaccgatactagtctgtatgcatg

SEQ ID NO: 417017 - DNA, 25 bp, Mus musculus
gaaccgatgaaactgaagcccgata

SEQ ID NO: 417018 - DNA, 25 bp, Mus musculus
gaaccgatgaaagtgaagcccgata

SEQ ID NO: 417019 - DNA, 25 bp, Mus musculus
gaaccgatttccaagttgaccagga

SEQ ID NO: 417020 - DNA, 25 bp, Mus musculus
gaaccgatttcctagttgaccagga

SEQ ID NO: 417021 - DNA, 25 bp, Mus musculus
gaaccgcagaggaacaacccagatg

SEQ ID NO: 417022 - DNA, 25 bp, Mus musculus
gaaccgcagaggtacaacccagatg

SEQ ID NO: 417023 - DNA, 25 bp, Mus musculus
gaaccgcagggcacttgaacaccaa

SEQ ID NO: 417024 - DNA, 25 bp, Mus musculus
gaaccgcagggctcttgaacaccaa

SEQ ID NO: 417025 - DNA, 25 bp, Mus musculus
gaaccgcatattcttctctttagac

SEQ ID NO: 417026 - DNA, 25 bp, Mus musculus
gaaccgcatattgttctctttagac

SEQ ID NO: 417027 - DNA, 25 bp, Mus musculus
gaaccgcatgtaagactgtagtcct

SEQ ID NO: 417028 - DNA, 25 bp, Mus musculus
gaaccgcatgtatgactgtagtcct

SEQ ID NO: 417029 - DNA, 25 bp, Mus musculus
gaaccgccgggcaaagtggcgacac

SEQ ID NO: 417030 - DNA, 25 bp, Mus musculus
gaaccgccgggctaagtggcgacac

SEQ ID NO: 417031 - DNA, 25 bp, Mus musculus
gaaccgcgagatagcacagatcact

SEQ ID NO: 417032 - DNA, 25 bp, Mus musculus
gaaccgcgagattgcacagatcact

SEQ ID NO: 417033 - DNA, 25 bp, Mus musculus
gaaccgcgtactacatcagtatgcc

SEQ ID NO: 417034 - DNA, 25 bp, Mus musculus
gaaccgcgtacttcatcagtatgcc

SEQ ID NO: 417035 - DNA, 25 bp, Mus musculus
gaaccgctcagacagagggtcctta

SEQ ID NO: 417036 - DNA, 25 bp, Mus musculus
gaaccgctcagagagagggtcctta

SEQ ID NO: 417037 - DNA, 25 bp, Mus musculus
gaaccgctcatgaggtacaaccaat

SEQ ID NO: 417038 - DNA, 25 bp, Mus musculus
gaaccgctcatgtggtacaaccaat

SEQ ID NO: 417039 - DNA, 25 bp, Mus musculus
gaaccgctctgaactctggagtgaa

SEQ ID NO: 417040 - DNA, 25 bp, Mus musculus
gaaccgctctgatctctggagtgaa

SEQ ID NO: 417041 - DNA, 25 bp, Mus musculus
gaaccgctgcacaatgggattgcac

SEQ ID NO: 417042 - DNA, 25 bp, Mus musculus
gaaccgctgcactatgggattgcac

SEQ ID NO: 417043 - DNA, 25 bp, Mus musculus
gaaccgctgccaatggcgatgtgat

SEQ ID NO: 417044 - DNA, 25 bp, Mus musculus
gaaccgctgccattggcgatgtgat

SEQ ID NO: 417045 - DNA, 25 bp, Mus musculus
gaaccgctggcgaggaagatcttta

SEQ ID NO: 417046 - DNA, 25 bp, Mus musculus
gaaccgctggcgtggaagatcttta

SEQ ID NO: 417047 - DNA, 25 bp, Mus musculus
gaaccgctgtagagccacgagtgga

SEQ ID NO: 417048 - DNA, 25 bp, Mus musculus
gaaccgctgtagtgccacgagtgga

SEQ ID NO: 417049 - DNA, 25 bp, Mus musculus
gaaccgctgtgcattcagctttaga

SEQ ID NO: 417050 - DNA, 25 bp, Mus musculus
gaaccgctgtgctttcagctttaga

SEQ ID NO: 417051 - DNA, 25 bp, Mus musculus
gaaccgctttgtaaagatgcttctt

SEQ ID NO: 417052 - DNA, 25 bp, Mus musculus
gaaccgctttgttaagatgcttctt

SEQ ID NO: 417053 - DNA, 25 bp, Mus musculus
gaaccggaaccgaccatggctttgg

SEQ ID NO: 417054 - DNA, 25 bp, Mus musculus
gaaccggaaccgtccatggctttgg

SEQ ID NO: 417055 - DNA, 25 bp, Mus musculus
gaaccggaactactcctgtacaggt

SEQ ID NO: 417056 - DNA, 25 bp, Mus musculus
gaaccggaactagtcctgtacaggt

SEQ ID NO: 417057 - DNA, 25 bp, Mus musculus
gaaccggaatttatctcaccagctt

SEQ ID NO: 417058 - DNA, 25 bp, Mus musculus
gaaccggaatttttctcaccagctt

SEQ ID NO: 417059 - DNA, 25 bp, Mus musculus
gaaccggacctcagcgcaatttaga

SEQ ID NO: 417060 - DNA, 25 bp, Mus musculus
gaaccggacctctgcgcaatttaga

SEQ ID NO: 417061 - DNA, 25 bp, Mus musculus
gaaccggactcacatgcacaacgct

SEQ ID NO: 417062 - DNA, 25 bp, Mus musculus
gaaccggactcagatgcacaacgct

SEQ ID NO: 417063 - DNA, 25 bp, Mus musculus
gaaccggagaaacccgtggcagaca

SEQ ID NO: 417064 - DNA, 25 bp, Mus musculus
gaaccggagaaagccgtggcagaca

SEQ ID NO: 417065 - DNA, 25 bp, Mus musculus
gaaccggaggacagcagaggacatc

SEQ ID NO: 417066 - DNA, 25 bp, Mus musculus
gaaccggaggactgcagaggacatc

SEQ ID NO: 417067 - DNA, 25 bp, Mus musculus
gaaccggcacttaagaggtggtgat

SEQ ID NO: 417068 - DNA, 25 bp, Mus musculus
gaaccggcactttagaggtggtgat

SEQ ID NO: 417069 - DNA, 25 bp, Mus musculus
gaaccggcagacaagatgagcgata

SEQ ID NO: 417070 - DNA, 25 bp, Mus musculus
gaaccggcagactagatgagcgata

SEQ ID NO: 417071 - DNA, 25 bp, Mus musculus
gaaccggcagcccaagtatgaggac

SEQ ID NO: 417072 - DNA, 25 bp, Mus musculus
gaaccggcagccgaagtatgaggac

SEQ ID NO: 417073 - DNA, 25 bp, Mus musculus
gaaccggcagctaacacagcactga

SEQ ID NO: 417074 - DNA, 25 bp, Mus musculus
gaaccggcagcttacacagcactga

SEQ ID NO: 417075 - DNA, 25 bp, Mus musculus
gaaccggccaagcaacagaatctct

SEQ ID NO: 417076 - DNA, 25 bp, Mus musculus
gaaccggccaaggaacagaatctct

SEQ ID NO: 417077 - DNA, 25 bp, Mus musculus
gaaccggcgaatccaaccgtggcaa

SEQ ID NO: 417078 - DNA, 25 bp, Mus musculus
gaaccggcgaatgcaaccgtggcaa

SEQ ID NO: 417079 - DNA, 25 bp, Mus musculus
gaaccgggacttattcacaagcatg

SEQ ID NO: 417080 - DNA, 25 bp, Mus musculus
gaaccgggactttttcacaagcatg

SEQ ID NO: 417081 - DNA, 25 bp, Mus musculus
gaaccgggagcacagatgtccatgt

SEQ ID NO: 417082 - DNA, 25 bp, Mus musculus
gaaccgggagcagagatgtccatgt

SEQ ID NO: 417083 - DNA, 25 bp, Mus musculus
gaaccgggagtacaatcacctgtgt

SEQ ID NO: 417084 - DNA, 25 bp, Mus musculus
gaaccgggagtagaatcacctgtgt

SEQ ID NO: 417085 - DNA, 25 bp, Mus musculus
gaaccgggccgtactctcgtgggag

SEQ ID NO: 417086 - DNA, 25 bp, Mus musculus
gaaccgggccgttctctcgtgggag

SEQ ID NO: 417087 - DNA, 25 bp, Mus musculus
gaaccgggtcataatctatcaagaa

SEQ ID NO: 417088 - DNA, 25 bp, Mus musculus
gaaccgggtcattatctatcaagaa

SEQ ID NO: 417089 - DNA, 25 bp, Mus musculus
gaaccgggtttgatttctcacacct

SEQ ID NO: 417090 - DNA, 25 bp, Mus musculus
gaaccgggtttgttttctcacacct

SEQ ID NO: 417091 - DNA, 25 bp, Mus musculus
gaaccggtgagcaaatggtctccga

SEQ ID NO: 417092 - DNA, 25 bp, Mus musculus
gaaccggtgagctaatggtctccga

SEQ ID NO: 417093 - DNA, 25 bp, Mus musculus
gaaccggtgcaaattagccttcagg

SEQ ID NO: 417094 - DNA, 25 bp, Mus musculus
gaaccggtgcaatttagccttcagg

SEQ ID NO: 417095 - DNA, 25 bp, Mus musculus
gaaccggtgtctcaaaacccaggtg

SEQ ID NO: 417096 - DNA, 25 bp, Mus musculus
gaaccggtgtctgaaaacccaggtg

SEQ ID NO: 417097 - DNA, 25 bp, Mus musculus
gaaccggttctcagcctgtttcatt

SEQ ID NO: 417098 - DNA, 25 bp, Mus musculus
gaaccggttctctgcctgtttcatt

SEQ ID NO: 417099 - DNA, 25 bp, Mus musculus
gaaccgtagtacattagagagattg

SEQ ID NO: 417100 - DNA, 25 bp, Mus musculus
gaaccgtagtactttagagagattg

SEQ ID NO: 417101 - DNA, 25 bp, Mus musculus
gaaccgtagtatctgtaggcactta

SEQ ID NO: 417102 - DNA, 25 bp, Mus musculus
gaaccgtagtatgtgtaggcactta

SEQ ID NO: 417103 - DNA, 25 bp, Mus musculus
gaaccgtattttatatctcagagga

SEQ ID NO: 417104 - DNA, 25 bp, Mus musculus
gaaccgtattttttatctcagagga

SEQ ID NO: 417105 - DNA, 25 bp, Mus musculus
gaaccgtcccatcaatggcaatggc

SEQ ID NO: 417106 - DNA, 25 bp, Mus musculus
gaaccgtcccatgaatggcaatggc

SEQ ID NO: 417107 - DNA, 25 bp, Mus musculus
gaaccgtcctgaatgtagcactgaa

SEQ ID NO: 417108 - DNA, 25 bp, Mus musculus
gaaccgtcctgattgtagcactgaa

SEQ ID NO: 417109 - DNA, 25 bp, Mus musculus
gaaccgtctatgcttcaaggtccca

SEQ ID NO: 417110 - DNA, 25 bp, Mus musculus
gaaccgtctatggttcaaggtccca

SEQ ID NO: 417111 - DNA, 25 bp, Mus musculus
gaaccgtctcacagggaggtgctgc

SEQ ID NO: 417112 - DNA, 25 bp, Mus musculus
gaaccgtctcactgggaggtgctgc

SEQ ID NO: 417113 - DNA, 25 bp, Mus musculus
gaaccgtcttgaagaggtctctcct

SEQ ID NO: 417114 - DNA, 25 bp, Mus musculus
gaaccgtcttgatgaggtctctcct

SEQ ID NO: 417115 - DNA, 25 bp, Mus musculus
gaaccgtgacagcagtgcggcctca

SEQ ID NO: 417116 - DNA, 25 bp, Mus musculus
gaaccgtgacaggagtgcggcctca

SEQ ID NO: 417117 - DNA, 25 bp, Mus musculus
gaaccgtgataaagtaacacctctg

SEQ ID NO: 417118 - DNA, 25 bp, Mus musculus
gaaccgtgataatgtaacacctctg

SEQ ID NO: 417119 - DNA, 25 bp, Mus musculus
gaaccgtgatgacagtgccattgat

SEQ ID NO: 417120 - DNA, 25 bp, Mus musculus
gaaccgtgatgagagtgccattgat

SEQ ID NO: 417121 - DNA, 25 bp, Mus musculus
gaaccgtgccatatgggatcataca

SEQ ID NO: 417122 - DNA, 25 bp, Mus musculus
gaaccgtgccatttgggatcataca

SEQ ID NO: 417123 - DNA, 25 bp, Mus musculus
gaaccgtggtacaattaggctggga

SEQ ID NO: 417124 - DNA, 25 bp, Mus musculus
gaaccgtggtactattaggctggga

SEQ ID NO: 417125 - DNA, 25 bp, Mus musculus
gaaccgtggtccctaaattctgcgt

SEQ ID NO: 417126 - DNA, 25 bp, Mus musculus
gaaccgtggtccgtaaattctgcgt

SEQ ID NO: 417127 - DNA, 25 bp, Mus musculus
gaaccgtggtctattttagccatca

SEQ ID NO: 417128 - DNA, 25 bp, Mus musculus
gaaccgtggtcttttttagccatca

SEQ ID NO: 417129 - DNA, 25 bp, Mus musculus
gaaccgtgtcacacggaagctgcaa

SEQ ID NO: 417130 - DNA, 25 bp, Mus musculus
gaaccgtgtcactcggaagctgcaa

SEQ ID NO: 417131 - DNA, 25 bp, Mus musculus
gaaccgtgtgtgaggacactgccaa

SEQ ID NO: 417132 - DNA, 25 bp, Mus musculus
gaaccgtgtgtgtggacactgccaa

SEQ ID NO: 417133 - DNA, 25 bp, Mus musculus
gaaccgttacttcactatggacttc

SEQ ID NO: 417134 - DNA, 25 bp, Mus musculus
gaaccgttacttgactatggacttc

SEQ ID NO: 417135 - DNA, 25 bp, Mus musculus
gaaccgttaggtcaatgctaggcat

SEQ ID NO: 417136 - DNA, 25 bp, Mus musculus
gaaccgttaggtgaatgctaggcat

SEQ ID NO: 417137 - DNA, 25 bp, Mus musculus
gaaccgttctcaaaagcatacatta

SEQ ID NO: 417138 - DNA, 25 bp, Mus musculus
gaaccgttctcataagcatacatta

SEQ ID NO: 417139 - DNA, 25 bp, Mus musculus
gaaccgttcttacaggcgacacact

SEQ ID NO: 417140 - DNA, 25 bp, Mus musculus
gaaccgttcttagaggcgacacact

SEQ ID NO: 417141 - DNA, 25 bp, Mus musculus
gaaccgttgcgccaccagcttccga

SEQ ID NO: 417142 - DNA, 25 bp, Mus musculus
gaaccgttgcgcgaccagcttccga

SEQ ID NO: 417143 - DNA, 25 bp, Mus musculus
gaaccgttgcttctggatttagtag

SEQ ID NO: 417144 - DNA, 25 bp, Mus musculus
gaaccgttgcttgtggatttagtag

SEQ ID NO: 417145 - DNA, 25 bp, Mus musculus
gaacctaaacaaactcatccagcac

SEQ ID NO: 417146 - DNA, 25 bp, Mus musculus
gaacctaaacaatctcatccagcac

SEQ ID NO: 417147 - DNA, 25 bp, Mus musculus
gaacctaaaggcagaccaacttact

SEQ ID NO: 417148 - DNA, 25 bp, Mus musculus
gaacctaaaggctgaccaacttact

SEQ ID NO: 417149 - DNA, 25 bp, Mus musculus
gaacctaaattcattcatctgtgta

SEQ ID NO: 417150 - DNA, 25 bp, Mus musculus
gaacctaaattctttcatctgtgta

SEQ ID NO: 417151 - DNA, 25 bp, Mus musculus
gaacctaacatactatagccttcag

SEQ ID NO: 417152 - DNA, 25 bp, Mus musculus
gaacctaacatagtatagccttcag

SEQ ID NO: 417153 - DNA, 25 bp, Mus musculus
gaacctaacgatccacatggacgcc

SEQ ID NO: 417154 - DNA, 25 bp, Mus musculus
gaacctaacgatgcacatggacgcc

SEQ ID NO: 417155 - DNA, 25 bp, Mus musculus
gaacctaactgtatctttgaggcga

SEQ ID NO: 417156 - DNA, 25 bp, Mus musculus
gaacctaactgtttctttgaggcga

SEQ ID NO: 417157 - DNA, 25 bp, Mus musculus
gaacctaagccaagggtaactcgtg

SEQ ID NO: 417158 - DNA, 25 bp, Mus musculus
gaacctaagccatgggtaactcgtg

SEQ ID NO: 417159 - DNA, 25 bp, Mus musculus
gaacctaaggagaccagcactgctg

SEQ ID NO: 417160 - DNA, 25 bp, Mus musculus
gaacctaaggagtccagcactgctg

SEQ ID NO: 417161 - DNA, 25 bp, Mus musculus
gaacctaatcccaatagtccagcaa

SEQ ID NO: 417162 - DNA, 25 bp, Mus musculus
gaacctaatccctatagtccagcaa

SEQ ID NO: 417163 - DNA, 25 bp, Mus musculus
gaacctaatcgaaatgtctgaactg

SEQ ID NO: 417164 - DNA, 25 bp, Mus musculus
gaacctaatcgatatgtctgaactg

SEQ ID NO: 417165 - DNA, 25 bp, Mus musculus
gaacctaatgcaagatacctccaaa

SEQ ID NO: 417166 - DNA, 25 bp, Mus musculus
gaacctaatgcatgatacctccaaa

SEQ ID NO: 417167 - DNA, 25 bp, Mus musculus
gaacctaattacagtagatacaatg

SEQ ID NO: 417168 - DNA, 25 bp, Mus musculus
gaacctaattactgtagatacaatg

SEQ ID NO: 417169 - DNA, 25 bp, Mus musculus
gaacctaattagcaaagccacaatg

SEQ ID NO: 417170 - DNA, 25 bp, Mus musculus
gaacctaattaggaaagccacaatg

SEQ ID NO: 417171 - DNA, 25 bp, Mus musculus
gaacctaatttcaccctatgattaa

SEQ ID NO: 417172 - DNA, 25 bp, Mus musculus
gaacctaatttcacttaagtcagct

SEQ ID NO: 417173 - DNA, 25 bp, Mus musculus
gaacctaatttctccctatgattaa

SEQ ID NO: 417174 - DNA, 25 bp, Mus musculus
gaacctaatttctcttaagtcagct

SEQ ID NO: 417175 - DNA, 25 bp, Mus musculus
gaacctacaaacctccatggacagt

SEQ ID NO: 417176 - DNA, 25 bp, Mus musculus
gaacctacaaacgtccatggacagt

SEQ ID NO: 417177 - DNA, 25 bp, Mus musculus
gaacctacaaggaatacagtgctga

SEQ ID NO: 417178 - DNA, 25 bp, Mus musculus
gaacctacaaggtatacagtgctga

SEQ ID NO: 417179 - DNA, 25 bp, Mus musculus
gaacctacacctaagtagctgtgag

SEQ ID NO: 417180 - DNA, 25 bp, Mus musculus
gaacctacacctcttctgtaactgt

SEQ ID NO: 417181 - DNA, 25 bp, Mus musculus
gaacctacacctgttctgtaactgt

SEQ ID NO: 417182 - DNA, 25 bp, Mus musculus
gaacctacaccttagtagctgtgag

SEQ ID NO: 417183 - DNA, 25 bp, Mus musculus
gaacctacatctaatagttacattt

SEQ ID NO: 417184 - DNA, 25 bp, Mus musculus
gaacctacatcttatagttacattt

SEQ ID NO: 417185 - DNA, 25 bp, Mus musculus
gaacctaccaccatgaacatgatca

SEQ ID NO: 417186 - DNA, 25 bp, Mus musculus
gaacctaccaccttgaacatgatca

SEQ ID NO: 417187 - DNA, 25 bp, Mus musculus
gaacctaccataccatactaaacca

SEQ ID NO: 417188 - DNA, 25 bp, Mus musculus
gaacctaccatagcatactaaacca

SEQ ID NO: 417189 - DNA, 25 bp, Mus musculus
gaacctacccttacaaaacatatgc

SEQ ID NO: 417190 - DNA, 25 bp, Mus musculus
gaacctacccttactaggagtggct

SEQ ID NO: 417191 - DNA, 25 bp, Mus musculus
gaacctaccctttcaaaacatatgc

SEQ ID NO: 417192 - DNA, 25 bp, Mus musculus
gaacctaccctttctaggagtggct

SEQ ID NO: 417193 - DNA, 25 bp, Mus musculus
gaacctacctggatccactttcagt

SEQ ID NO: 417194 - DNA, 25 bp, Mus musculus
gaacctacctggttccactttcagt

SEQ ID NO: 417195 - DNA, 25 bp, Mus musculus
gaacctacgtgcacatttgttttta

SEQ ID NO: 417196 - DNA, 25 bp, Mus musculus
gaacctacgtgctcatttgttttta

SEQ ID NO: 417197 - DNA, 25 bp, Mus musculus
gaacctactattacccgaggaacat

SEQ ID NO: 417198 - DNA, 25 bp, Mus musculus
gaacctactatttcccgaggaacat

SEQ ID NO: 417199 - DNA, 25 bp, Mus musculus
gaacctactcccaaagttattctct

SEQ ID NO: 417200 - DNA, 25 bp, Mus musculus
gaacctactccctaagttattctct

SEQ ID NO: 417201 - DNA, 25 bp, Mus musculus
gaacctagaaatcatattcccagtg

SEQ ID NO: 417202 - DNA, 25 bp, Mus musculus
gaacctagaaatgatattcccagtg

SEQ ID NO: 417203 - DNA, 25 bp, Mus musculus
gaacctagaactaactgaggcttaa

SEQ ID NO: 417204 - DNA, 25 bp, Mus musculus
gaacctagaacttactgaggcttaa

SEQ ID NO: 417205 - DNA, 25 bp, Mus musculus
gaacctagaagtcatctggagtctt

SEQ ID NO: 417206 - DNA, 25 bp, Mus musculus
gaacctagaagtgatctggagtctt

SEQ ID NO: 417207 - DNA, 25 bp, Mus musculus
gaacctagagccagtagtgtattta

SEQ ID NO: 417208 - DNA, 25 bp, Mus musculus
gaacctagagccatggtttattact

SEQ ID NO: 417209 - DNA, 25 bp, Mus musculus
gaacctagagcctgtagtgtattta

SEQ ID NO: 417210 - DNA, 25 bp, Mus musculus
gaacctagagccttggtttattact

SEQ ID NO: 417211 - DNA, 25 bp, Mus musculus
gaacctagagttatgtgcttgccaa

SEQ ID NO: 417212 - DNA, 25 bp, Mus musculus
gaacctagagttttgtgcttgccaa

SEQ ID NO: 417213 - DNA, 25 bp, Mus musculus
gaacctagattaaatactcggatgt

SEQ ID NO: 417214 - DNA, 25 bp, Mus musculus
gaacctagattatatactcggatgt

SEQ ID NO: 417215 - DNA, 25 bp, Mus musculus
gaacctagattcattgaacaaacga

SEQ ID NO: 417216 - DNA, 25 bp, Mus musculus
gaacctagattctttgaacaaacga

SEQ ID NO: 417217 - DNA, 25 bp, Mus musculus
gaacctagcagtcgaaatggtccct

SEQ ID NO: 417218 - DNA, 25 bp, Mus musculus
gaacctagcagtggaaatggtccct

SEQ ID NO: 417219 - DNA, 25 bp, Mus musculus
gaacctagggctctagtttctaagg

SEQ ID NO: 417220 - DNA, 25 bp, Mus musculus
gaacctagggctgtagtttctaagg

SEQ ID NO: 417221 - DNA, 25 bp, Mus musculus
gaacctaggtacaaagtcttcaaca

SEQ ID NO: 417222 - DNA, 25 bp, Mus musculus
gaacctaggtactaagtcttcaaca

SEQ ID NO: 417223 - DNA, 25 bp, Mus musculus
gaacctaggtttaagccacacagag

SEQ ID NO: 417224 - DNA, 25 bp, Mus musculus
gaacctaggttttagccacacagag

SEQ ID NO: 417225 - DNA, 25 bp, Mus musculus
gaacctagtgtaattgcttaccgat

SEQ ID NO: 417226 - DNA, 25 bp, Mus musculus
gaacctagtgtatttgcttaccgat

SEQ ID NO: 417227 - DNA, 25 bp, Mus musculus
gaacctagttacactgggcaactaa

SEQ ID NO: 417228 - DNA, 25 bp, Mus musculus
gaacctagttactctgggcaactaa

SEQ ID NO: 417229 - DNA, 25 bp, Mus musculus
gaacctatagggagcgtcagaccag

SEQ ID NO: 417230 - DNA, 25 bp, Mus musculus
gaacctatagggtgcgtcagaccag

SEQ ID NO: 417231 - DNA, 25 bp, Mus musculus
gaacctatcaaacgtggctgtcagt

SEQ ID NO: 417232 - DNA, 25 bp, Mus musculus
gaacctatcaaaggtggctgtcagt

SEQ ID NO: 417233 - DNA, 25 bp, Mus musculus
gaacctatcttgcagagccccatgt

SEQ ID NO: 417234 - DNA, 25 bp, Mus musculus
gaacctatcttggagagccccatgt

SEQ ID NO: 417235 - DNA, 25 bp, Mus musculus
gaacctatgcggcaattttgccaaa

SEQ ID NO: 417236 - DNA, 25 bp, Mus musculus
gaacctatgcgggaattttgccaaa

SEQ ID NO: 417237 - DNA, 25 bp, Mus musculus
gaacctatgtaaagtagagatgcct

SEQ ID NO: 417238 - DNA, 25 bp, Mus musculus
gaacctatgtaatgtagagatgcct

SEQ ID NO: 417239 - DNA, 25 bp, Mus musculus
gaacctatgtttctgtttggcccct

SEQ ID NO: 417240 - DNA, 25 bp, Mus musculus
gaacctatgtttgtgtttggcccct

SEQ ID NO: 417241 - DNA, 25 bp, Mus musculus
gaacctattaaactcttgtgtcgga

SEQ ID NO: 417242 - DNA, 25 bp, Mus musculus
gaacctattaaagtcttgtgtcgga

SEQ ID NO: 417243 - DNA, 25 bp, Mus musculus
gaacctattatcactgcaacaatct

SEQ ID NO: 417244 - DNA, 25 bp, Mus musculus
gaacctattatctctgcaacaatct

SEQ ID NO: 417245 - DNA, 25 bp, Mus musculus
gaacctattatgactgacactacct

SEQ ID NO: 417246 - DNA, 25 bp, Mus musculus
gaacctattatgtctgacactacct

SEQ ID NO: 417247 - DNA, 25 bp, Mus musculus
gaacctattcttcagtttgtcgatg

SEQ ID NO: 417248 - DNA, 25 bp, Mus musculus
gaacctattcttgagtttgtcgatg

SEQ ID NO: 417249 - DNA, 25 bp, Mus musculus
gaacctcaaacgcagcaaacagacc

SEQ ID NO: 417250 - DNA, 25 bp, Mus musculus
gaacctcaaacggagcaaacagacc

SEQ ID NO: 417251 - DNA, 25 bp, Mus musculus
gaacctcaaagtcctatagtcctaa

SEQ ID NO: 417252 - DNA, 25 bp, Mus musculus
gaacctcaaagtgctatagtcctaa

SEQ ID NO: 417253 - DNA, 25 bp, Mus musculus
gaacctcaaatccaaggctctttct

SEQ ID NO: 417254 - DNA, 25 bp, Mus musculus
gaacctcaaatcgaaggctctttct

SEQ ID NO: 417255 - DNA, 25 bp, Mus musculus
gaacctcaagttagtctcctattag

SEQ ID NO: 417256 - DNA, 25 bp, Mus musculus
gaacctcaagtttgtctcctattag

SEQ ID NO: 417257 - DNA, 25 bp, Mus musculus
gaacctcaataaccccgcggacgag

SEQ ID NO: 417258 - DNA, 25 bp, Mus musculus
gaacctcaataagcccgcggacgag

SEQ ID NO: 417259 - DNA, 25 bp, Mus musculus
gaacctcaatccactcttgttagaa

SEQ ID NO: 417260 - DNA, 25 bp, Mus musculus
gaacctcaatcctctcttgttagaa

SEQ ID NO: 417261 - DNA, 25 bp, Mus musculus
gaacctcacagccagagttaatgca

SEQ ID NO: 417262 - DNA, 25 bp, Mus musculus
gaacctcacagcgagagttaatgca

SEQ ID NO: 417263 - DNA, 25 bp, Mus musculus
gaacctcacatacttctgacttgga

SEQ ID NO: 417264 - DNA, 25 bp, Mus musculus
gaacctcacatagttctgacttgga

SEQ ID NO: 417265 - DNA, 25 bp, Mus musculus
gaacctcaccaactactacgagatg

SEQ ID NO: 417266 - DNA, 25 bp, Mus musculus
gaacctcaccaagtactacgagatg

SEQ ID NO: 417267 - DNA, 25 bp, Mus musculus
gaacctcacctgctcatgaggttga

SEQ ID NO: 417268 - DNA, 25 bp, Mus musculus
gaacctcacctgctgaccaatggag

SEQ ID NO: 417269 - DNA, 25 bp, Mus musculus
gaacctcacctggtcatgaggttga

SEQ ID NO: 417270 - DNA, 25 bp, Mus musculus
gaacctcacctggtgaccaatggag

SEQ ID NO: 417271 - DNA, 25 bp, Mus musculus
gaacctcacgggaagtgacccagat

SEQ ID NO: 417272 - DNA, 25 bp, Mus musculus
gaacctcacgggtagtgacccagat

SEQ ID NO: 417273 - DNA, 25 bp, Mus musculus
gaacctcactgaaggagaattaaga

SEQ ID NO: 417274 - DNA, 25 bp, Mus musculus
gaacctcactgatggagaattaaga

SEQ ID NO: 417275 - DNA, 25 bp, Mus musculus
gaacctcagaacagtgatcctccaa

SEQ ID NO: 417276 - DNA, 25 bp, Mus musculus
gaacctcagaacctggtttctctgt

SEQ ID NO: 417277 - DNA, 25 bp, Mus musculus
gaacctcagaacgtggtttctctgt

SEQ ID NO: 417278 - DNA, 25 bp, Mus musculus
gaacctcagaactgtgatcctccaa

SEQ ID NO: 417279 - DNA, 25 bp, Mus musculus
gaacctcagaagctatccaggtgct

SEQ ID NO: 417280 - DNA, 25 bp, Mus musculus
gaacctcagaaggtatccaggtgct

SEQ ID NO: 417281 - DNA, 25 bp, Mus musculus
gaacctcagagaaggtgttttccat

SEQ ID NO: 417282 - DNA, 25 bp, Mus musculus
gaacctcagagatggtgttttccat

SEQ ID NO: 417283 - DNA, 25 bp, Mus musculus
gaacctcagcgaactgatcgacctg

SEQ ID NO: 417284 - DNA, 25 bp, Mus musculus
gaacctcagcgaccagcaggtcaaa

SEQ ID NO: 417285 - DNA, 25 bp, Mus musculus
gaacctcagcgagcagcaggtcaaa

SEQ ID NO: 417286 - DNA, 25 bp, Mus musculus
gaacctcagcgatctgatcgacctg

SEQ ID NO: 417287 - DNA, 25 bp, Mus musculus
gaacctcagctccagttactcaatg

SEQ ID NO: 417288 - DNA, 25 bp, Mus musculus
gaacctcagctccttaggcaggaag

SEQ ID NO: 417289 - DNA, 25 bp, Mus musculus
gaacctcagctcgagttactcaatg

SEQ ID NO: 417290 - DNA, 25 bp, Mus musculus
gaacctcagctcgttaggcaggaag

SEQ ID NO: 417291 - DNA, 25 bp, Mus musculus
gaacctcaggccatgtgacttgaag

SEQ ID NO: 417292 - DNA, 25 bp, Mus musculus
gaacctcaggccttgtgacttgaag

SEQ ID NO: 417293 - DNA, 25 bp, Mus musculus
gaacctcaggctacaacatggtctg

SEQ ID NO: 417294 - DNA, 25 bp, Mus musculus
gaacctcaggcttcaacatggtctg

SEQ ID NO: 417295 - DNA, 25 bp, Mus musculus
gaacctcagttgaatttatttccac

SEQ ID NO: 417296 - DNA, 25 bp, Mus musculus
gaacctcagttgtatttatttccac

SEQ ID NO: 417297 - DNA, 25 bp, Mus musculus
gaacctcatagacttcacccaggaa

SEQ ID NO: 417298 - DNA, 25 bp, Mus musculus
gaacctcatagagttcacccaggaa

SEQ ID NO: 417299 - DNA, 25 bp, Mus musculus
gaacctcatcagactttctatttaa

SEQ ID NO: 417300 - DNA, 25 bp, Mus musculus
gaacctcatcagtctttctatttaa

SEQ ID NO: 417301 - DNA, 25 bp, Mus musculus
gaacctcatgcccaaagagtcccgg

SEQ ID NO: 417302 - DNA, 25 bp, Mus musculus
gaacctcatgccgaaagagtcccgg

SEQ ID NO: 417303 - DNA, 25 bp, Mus musculus
gaacctcatggtatgcggtgactta

SEQ ID NO: 417304 - DNA, 25 bp, Mus musculus
gaacctcatggtttgcggtgactta

SEQ ID NO: 417305 - DNA, 25 bp, Mus musculus
gaacctcatgtaacctgtctgtaaa

SEQ ID NO: 417306 - DNA, 25 bp, Mus musculus
gaacctcatgtatcctgtctgtaaa

SEQ ID NO: 417307 - DNA, 25 bp, Mus musculus
gaacctcatgttacacagcagtaga

SEQ ID NO: 417308 - DNA, 25 bp, Mus musculus
gaacctcatgtttcacagcagtaga

SEQ ID NO: 417309 - DNA, 25 bp, Mus musculus
gaacctcattacagcttcatttttg

SEQ ID NO: 417310 - DNA, 25 bp, Mus musculus
gaacctcattactgcttcatttttg

SEQ ID NO: 417311 - DNA, 25 bp, Mus musculus
gaacctcattcgcagatttcagggc

SEQ ID NO: 417312 - DNA, 25 bp, Mus musculus
gaacctcattcggagatttcagggc

SEQ ID NO: 417313 - DNA, 25 bp, Mus musculus
gaacctccaaacaaaataccgcagg

SEQ ID NO: 417314 - DNA, 25 bp, Mus musculus
gaacctccaaacctggtcataatga

SEQ ID NO: 417315 - DNA, 25 bp, Mus musculus
gaacctccaaacgtggtcataatga

SEQ ID NO: 417316 - DNA, 25 bp, Mus musculus
gaacctccaaactaaataccgcagg

SEQ ID NO: 417317 - DNA, 25 bp, Mus musculus
gaacctccacagactgtttgggttt

SEQ ID NO: 417318 - DNA, 25 bp, Mus musculus
gaacctccacagtctgtttgggttt

SEQ ID NO: 417319 - DNA, 25 bp, Mus musculus
gaacctccacataagaggctttgtt

SEQ ID NO: 417320 - DNA, 25 bp, Mus musculus
gaacctccacattagaggctttgtt

SEQ ID NO: 417321 - DNA, 25 bp, Mus musculus
gaacctccatagcagagggctccaa

SEQ ID NO: 417322 - DNA, 25 bp, Mus musculus
gaacctccataggagagggctccaa

SEQ ID NO: 417323 - DNA, 25 bp, Mus musculus
gaacctccatcgcagagcaagagta

SEQ ID NO: 417324 - DNA, 25 bp, Mus musculus
gaacctccatcggagagcaagagta

SEQ ID NO: 417325 - DNA, 25 bp, Mus musculus
gaacctccatgccccagtgctttta

SEQ ID NO: 417326 - DNA, 25 bp, Mus musculus
gaacctccatgcgccagtgctttta

SEQ ID NO: 417327 - DNA, 25 bp, Mus musculus
gaacctccatgtcggtcaagggaag

SEQ ID NO: 417328 - DNA, 25 bp, Mus musculus
gaacctccatgtgggtcaagggaag

SEQ ID NO: 417329 - DNA, 25 bp, Mus musculus
gaacctccccggatgaggcagatgg

SEQ ID NO: 417330 - DNA, 25 bp, Mus musculus
gaacctccccggttgaggcagatgg

SEQ ID NO: 417331 - DNA, 25 bp, Mus musculus
gaacctccctgacgtcccaggagga

SEQ ID NO: 417332 - DNA, 25 bp, Mus musculus
gaacctccctgaggtcccaggagga

SEQ ID NO: 417333 - DNA, 25 bp, Mus musculus
gaacctccctgtaaatcaggtgcag

SEQ ID NO: 417334 - DNA, 25 bp, Mus musculus
gaacctccctgttaatcaggtgcag

SEQ ID NO: 417335 - DNA, 25 bp, Mus musculus
gaacctccgccactaaacatggctt

SEQ ID NO: 417336 - DNA, 25 bp, Mus musculus
gaacctccgccagtaaacatggctt

SEQ ID NO: 417337 - DNA, 25 bp, Mus musculus
gaacctccgggaaatcagccaactg

SEQ ID NO: 417338 - DNA, 25 bp, Mus musculus
gaacctccgggatatcagccaactg

SEQ ID NO: 417339 - DNA, 25 bp, Mus musculus
gaacctcctcagagttgcatgtaga

SEQ ID NO: 417340 - DNA, 25 bp, Mus musculus
gaacctcctcagtgttgcatgtaga

SEQ ID NO: 417341 - DNA, 25 bp, Mus musculus
gaacctcctgatactttggctataa

SEQ ID NO: 417342 - DNA, 25 bp, Mus musculus
gaacctcctgattctttggctataa

SEQ ID NO: 417343 - DNA, 25 bp, Mus musculus
gaacctcctgcgctgaaacctgggt

SEQ ID NO: 417344 - DNA, 25 bp, Mus musculus
gaacctcctgcggtgaaacctgggt

SEQ ID NO: 417345 - DNA, 25 bp, Mus musculus
gaacctcctgttatgatatcgaatg

SEQ ID NO: 417346 - DNA, 25 bp, Mus musculus
gaacctcctgttttgatatcgaatg

SEQ ID NO: 417347 - DNA, 25 bp, Mus musculus
gaacctcgaagaatagtactgactc

SEQ ID NO: 417348 - DNA, 25 bp, Mus musculus
gaacctcgaagattagtactgactc

SEQ ID NO: 417349 - DNA, 25 bp, Mus musculus
gaacctcgcatgaatccatttgtca

SEQ ID NO: 417350 - DNA, 25 bp, Mus musculus
gaacctcgcatgtatccatttgtca

SEQ ID NO: 417351 - DNA, 25 bp, Mus musculus
gaacctcggagaccagcggaaattt

SEQ ID NO: 417352 - DNA, 25 bp, Mus musculus
gaacctcggagagcagcggaaattt

SEQ ID NO: 417353 - DNA, 25 bp, Mus musculus
gaacctcggcgaactgactgtgtag

SEQ ID NO: 417354 - DNA, 25 bp, Mus musculus
gaacctcggcgatctgactgtgtag

SEQ ID NO: 417355 - DNA, 25 bp, Mus musculus
gaacctcggttccttgaagaagttg

SEQ ID NO: 417356 - DNA, 25 bp, Mus musculus
gaacctcggttcgttgaagaagttg

SEQ ID NO: 417357 - DNA, 25 bp, Mus musculus
gaacctcgtgaaaattaagcatgcc

SEQ ID NO: 417358 - DNA, 25 bp, Mus musculus
gaacctcgtgaatattaagcatgcc

SEQ ID NO: 417359 - DNA, 25 bp, Mus musculus
gaacctcgtgtgatgattccattct

SEQ ID NO: 417360 - DNA, 25 bp, Mus musculus
gaacctcgtgtgttgattccattct

SEQ ID NO: 417361 - DNA, 25 bp, Mus musculus
gaacctctaaaacgcaccaacaggg

SEQ ID NO: 417362 - DNA, 25 bp, Mus musculus
gaacctctaaaaggcaccaacaggg

SEQ ID NO: 417363 - DNA, 25 bp, Mus musculus
gaacctctcacacatgaatcagcag

SEQ ID NO: 417364 - DNA, 25 bp, Mus musculus
gaacctctcacagatgaatcagcag

SEQ ID NO: 417365 - DNA, 25 bp, Mus musculus
gaacctctcatacatgtggaccctt

SEQ ID NO: 417366 - DNA, 25 bp, Mus musculus
gaacctctcatagatgtggaccctt

SEQ ID NO: 417367 - DNA, 25 bp, Mus musculus
gaacctctccttcggaggatctgtt

SEQ ID NO: 417368 - DNA, 25 bp, Mus musculus
gaacctctccttgggaggatctgtt

SEQ ID NO: 417369 - DNA, 25 bp, Mus musculus
gaacctctctatatcatcagatcac

SEQ ID NO: 417370 - DNA, 25 bp, Mus musculus
gaacctctctatttcatcagatcac

SEQ ID NO: 417371 - DNA, 25 bp, Mus musculus
gaacctctctgacgaggtcgacctg

SEQ ID NO: 417372 - DNA, 25 bp, Mus musculus
gaacctctctgaggaggtcgacctg

SEQ ID NO: 417373 - DNA, 25 bp, Mus musculus
gaacctctcttcataaactgggatt

SEQ ID NO: 417374 - DNA, 25 bp, Mus musculus
gaacctctcttcttaaactgggatt

SEQ ID NO: 417375 - DNA, 25 bp, Mus musculus
gaacctctgcatacctcagagggag

SEQ ID NO: 417376 - DNA, 25 bp, Mus musculus
gaacctctgcattcctcagagggag

SEQ ID NO: 417377 - DNA, 25 bp, Mus musculus
gaacctctgctccatgatggaggct

SEQ ID NO: 417378 - DNA, 25 bp, Mus musculus
gaacctctgctcgatgatggaggct

SEQ ID NO: 417379 - DNA, 25 bp, Mus musculus
gaacctctggacatgcctgtgaaga

SEQ ID NO: 417380 - DNA, 25 bp, Mus musculus
gaacctctggacttgcctgtgaaga

SEQ ID NO: 417381 - DNA, 25 bp, Mus musculus
gaacctctggtgactaattctacat

SEQ ID NO: 417382 - DNA, 25 bp, Mus musculus
gaacctctggtgtctaattctacat

SEQ ID NO: 417383 - DNA, 25 bp, Mus musculus
gaacctctggttcttgattcagcct

SEQ ID NO: 417384 - DNA, 25 bp, Mus musculus
gaacctctggttgttgattcagcct

SEQ ID NO: 417385 - DNA, 25 bp, Mus musculus
gaacctctgtaaatagctcactcgc

SEQ ID NO: 417386 - DNA, 25 bp, Mus musculus
gaacctctgtaattagctcactcgc

SEQ ID NO: 417387 - DNA, 25 bp, Mus musculus
gaacctctgtgacccttgtaagcaa

SEQ ID NO: 417388 - DNA, 25 bp, Mus musculus
gaacctctgtgagccttgtaagcaa

SEQ ID NO: 417389 - DNA, 25 bp, Mus musculus
gaacctctgttacactcatgcagta

SEQ ID NO: 417390 - DNA, 25 bp, Mus musculus
gaacctctgttagactcatgcagta

SEQ ID NO: 417391 - DNA, 25 bp, Mus musculus
gaacctcttctacaactcagtccat

SEQ ID NO: 417392 - DNA, 25 bp, Mus musculus
gaacctcttctagaactcagtccat

SEQ ID NO: 417393 - DNA, 25 bp, Mus musculus
gaacctcttggaagtttcagtttag

SEQ ID NO: 417394 - DNA, 25 bp, Mus musculus
gaacctcttggatgtttcagtttag

SEQ ID NO: 417395 - DNA, 25 bp, Mus musculus
gaacctctttccagactgtaaaaca

SEQ ID NO: 417396 - DNA, 25 bp, Mus musculus
gaacctctttcctgactgtaaaaca

SEQ ID NO: 417397 - DNA, 25 bp, Mus musculus
gaacctctttctaggtgacaaatcg

SEQ ID NO: 417398 - DNA, 25 bp, Mus musculus
gaacctctttcttggtgacaaatcg

SEQ ID NO: 417399 - DNA, 25 bp, Mus musculus
gaacctctttgacatcatcacagca

SEQ ID NO: 417400 - DNA, 25 bp, Mus musculus
gaacctctttgagatcatcacagca

SEQ ID NO: 417401 - DNA, 25 bp, Mus musculus
gaacctgaaacactgggagcccaga

SEQ ID NO: 417402 - DNA, 25 bp, Mus musculus
gaacctgaaacagtgggagcccaga

SEQ ID NO: 417403 - DNA, 25 bp, Mus musculus
gaacctgaaactcatgatgaacctg

SEQ ID NO: 417404 - DNA, 25 bp, Mus musculus
gaacctgaaactgatgatgaacctg

SEQ ID NO: 417405 - DNA, 25 bp, Mus musculus
gaacctgaacagactccaagacgat

SEQ ID NO: 417406 - DNA, 25 bp, Mus musculus
gaacctgaacagatgccaccattag

SEQ ID NO: 417407 - DNA, 25 bp, Mus musculus
gaacctgaacagtctccaagacgat

SEQ ID NO: 417408 - DNA, 25 bp, Mus musculus
gaacctgaacagttgccaccattag

SEQ ID NO: 417409 - DNA, 25 bp, Mus musculus
gaacctgaacctactatttctattt

SEQ ID NO: 417410 - DNA, 25 bp, Mus musculus
gaacctgaaccttctatttctattt

SEQ ID NO: 417411 - DNA, 25 bp, Mus musculus
gaacctgaacgaacgcatcctgagg

SEQ ID NO: 417412 - DNA, 25 bp, Mus musculus
gaacctgaacgatcgcatcctgagg

SEQ ID NO: 417413 - DNA, 25 bp, Mus musculus
gaacctgaactcagaagtacgcctg

SEQ ID NO: 417414 - DNA, 25 bp, Mus musculus
gaacctgaactctgaagtacgcctg

SEQ ID NO: 417415 - DNA, 25 bp, Mus musculus
gaacctgaagcaccagccaggaggt

SEQ ID NO: 417416 - DNA, 25 bp, Mus musculus
gaacctgaagcagcagccaggaggt

SEQ ID NO: 417417 - DNA, 25 bp, Mus musculus
gaacctgaagtgactgagtgctgct

SEQ ID NO: 417418 - DNA, 25 bp, Mus musculus
gaacctgaagtgtctgagtgctgct

SEQ ID NO: 417419 - DNA, 25 bp, Mus musculus
gaacctgaatccacaagttaactgt

SEQ ID NO: 417420 - DNA, 25 bp, Mus musculus
gaacctgaatcctcaagttaactgt

SEQ ID NO: 417421 - DNA, 25 bp, Mus musculus
gaacctgacaatataactcttaaag

SEQ ID NO: 417422 - DNA, 25 bp, Mus musculus
gaacctgacaatcattacgactttt

SEQ ID NO: 417423 - DNA, 25 bp, Mus musculus
gaacctgacaatgattacgactttt

SEQ ID NO: 417424 - DNA, 25 bp, Mus musculus
gaacctgacaatttaactcttaaag

SEQ ID NO: 417425 - DNA, 25 bp, Mus musculus
gaacctgacatacaaaccctgctgt

SEQ ID NO: 417426 - DNA, 25 bp, Mus musculus
gaacctgacatagaaaccctgctgt

SEQ ID NO: 417427 - DNA, 25 bp, Mus musculus
gaacctgaccatatggactgtataa

SEQ ID NO: 417428 - DNA, 25 bp, Mus musculus
gaacctgaccatttggactgtataa

SEQ ID NO: 417429 - DNA, 25 bp, Mus musculus
gaacctgacctcatttatggctaat

SEQ ID NO: 417430 - DNA, 25 bp, Mus musculus
gaacctgacctcttttatggctaat

SEQ ID NO: 417431 - DNA, 25 bp, Mus musculus
gaacctgacctgctcaagtgatggg

SEQ ID NO: 417432 - DNA, 25 bp, Mus musculus
gaacctgacctggtcaagtgatggg

SEQ ID NO: 417433 - DNA, 25 bp, Mus musculus
gaacctgacgacattgagctgcttt

SEQ ID NO: 417434 - DNA, 25 bp, Mus musculus
gaacctgacgactttgagctgcttt

SEQ ID NO: 417435 - DNA, 25 bp, Mus musculus
gaacctgacggcaacgctggtgtta

SEQ ID NO: 417436 - DNA, 25 bp, Mus musculus
gaacctgacggctacgctggtgtta

SEQ ID NO: 417437 - DNA, 25 bp, Mus musculus
gaacctgactacatactgccttgct

SEQ ID NO: 417438 - DNA, 25 bp, Mus musculus
gaacctgactacttactgccttgct

SEQ ID NO: 417439 - DNA, 25 bp, Mus musculus
gaacctgactcactagcatctaaac

SEQ ID NO: 417440 - DNA, 25 bp, Mus musculus
gaacctgactcagtagcatctaaac

SEQ ID NO: 417441 - DNA, 25 bp, Mus musculus
gaacctgactggcagttattcagca

SEQ ID NO: 417442 - DNA, 25 bp, Mus musculus
gaacctgactgggagttattcagca

SEQ ID NO: 417443 - DNA, 25 bp, Mus musculus
gaacctgactttcgtcggccagaac

SEQ ID NO: 417444 - DNA, 25 bp, Mus musculus
gaacctgactttggtcggccagaac

SEQ ID NO: 417445 - DNA, 25 bp, Mus musculus
gaacctgagatcatattcccgaatc

SEQ ID NO: 417446 - DNA, 25 bp, Mus musculus
gaacctgagatcttattcccgaatc

SEQ ID NO: 417447 - DNA, 25 bp, Mus musculus
gaacctgaggttacttccattgttg

SEQ ID NO: 417448 - DNA, 25 bp, Mus musculus
gaacctgaggttcctgataccaagc

SEQ ID NO: 417449 - DNA, 25 bp, Mus musculus
gaacctgaggttgctgataccaagc

SEQ ID NO: 417450 - DNA, 25 bp, Mus musculus
gaacctgaggtttcttccattgttg

SEQ ID NO: 417451 - DNA, 25 bp, Mus musculus
gaacctgagtagatttataccactg

SEQ ID NO: 417452 - DNA, 25 bp, Mus musculus
gaacctgagtagttttataccactg

SEQ ID NO: 417453 - DNA, 25 bp, Mus musculus
gaacctgagtatatggcacatgatg

SEQ ID NO: 417454 - DNA, 25 bp, Mus musculus
gaacctgagtatttggcacatgatg

SEQ ID NO: 417455 - DNA, 25 bp, Mus musculus
gaacctgagtggctgggacccctct

SEQ ID NO: 417456 - DNA, 25 bp, Mus musculus
gaacctgagtgggtgggacccctct

SEQ ID NO: 417457 - DNA, 25 bp, Mus musculus
gaacctgagttacggtcctagcaca

SEQ ID NO: 417458 - DNA, 25 bp, Mus musculus
gaacctgagttagggtcctagcaca

SEQ ID NO: 417459 - DNA, 25 bp, Mus musculus
gaacctgataccacgacaagaacat

SEQ ID NO: 417460 - DNA, 25 bp, Mus musculus
gaacctgatacctcgacaagaacat

SEQ ID NO: 417461 - DNA, 25 bp, Mus musculus
gaacctgatactatcctcaagtgtt

SEQ ID NO: 417462 - DNA, 25 bp, Mus musculus
gaacctgatactttcctcaagtgtt

SEQ ID NO: 417463 - DNA, 25 bp, Mus musculus
gaacctgatatactagccagtacaa

SEQ ID NO: 417464 - DNA, 25 bp, Mus musculus
gaacctgatatagtagccagtacaa

SEQ ID NO: 417465 - DNA, 25 bp, Mus musculus
gaacctgatcacataagtttgtgga

SEQ ID NO: 417466 - DNA, 25 bp, Mus musculus
gaacctgatcacttaagtttgtgga

SEQ ID NO: 417467 - DNA, 25 bp, Mus musculus
gaacctgatcctcagtttggtgcag

SEQ ID NO: 417468 - DNA, 25 bp, Mus musculus
gaacctgatcctgagtttggtgcag

SEQ ID NO: 417469 - DNA, 25 bp, Mus musculus
gaacctgatctgagacccagaacta

SEQ ID NO: 417470 - DNA, 25 bp, Mus musculus
gaacctgatctgtgacccagaacta

SEQ ID NO: 417471 - DNA, 25 bp, Mus musculus
gaacctgatgatcgaaacttaaccc

SEQ ID NO: 417472 - DNA, 25 bp, Mus musculus
gaacctgatgatggaaacttaaccc

SEQ ID NO: 417473 - DNA, 25 bp, Mus musculus
gaacctgatgtgagaccccaccaca

SEQ ID NO: 417474 - DNA, 25 bp, Mus musculus
gaacctgatgtgtgaccccaccaca

SEQ ID NO: 417475 - DNA, 25 bp, Mus musculus
gaacctgattcactgaccggacact

SEQ ID NO: 417476 - DNA, 25 bp, Mus musculus
gaacctgattcagtgaccggacact

SEQ ID NO: 417477 - DNA, 25 bp, Mus musculus
gaacctgattccattgtgtgcacat

SEQ ID NO: 417478 - DNA, 25 bp, Mus musculus
gaacctgattcctttgtgtgcacat

SEQ ID NO: 417479 - DNA, 25 bp, Mus musculus
gaacctgattttctacactgtccac

SEQ ID NO: 417480 - DNA, 25 bp, Mus musculus
gaacctgattttgtacactgtccac

SEQ ID NO: 417481 - DNA, 25 bp, Mus musculus
gaacctgcaatgaccagtgacctat

SEQ ID NO: 417482 - DNA, 25 bp, Mus musculus
gaacctgcaatgcaaatgtgctatt

SEQ ID NO: 417483 - DNA, 25 bp, Mus musculus
gaacctgcaatggaaatgtgctatt

SEQ ID NO: 417484 - DNA, 25 bp, Mus musculus
gaacctgcaatgtccagtgacctat

SEQ ID NO: 417485 - DNA, 25 bp, Mus musculus
gaacctgcaattagcttattctgat

SEQ ID NO: 417486 - DNA, 25 bp, Mus musculus
gaacctgcaatttgcttattctgat

SEQ ID NO: 417487 - DNA, 25 bp, Mus musculus
gaacctgcacaactgaccatgagaa

SEQ ID NO: 417488 - DNA, 25 bp, Mus musculus
gaacctgcacaagtgaccatgagaa

SEQ ID NO: 417489 - DNA, 25 bp, Mus musculus
gaacctgcagccatagttattgact

SEQ ID NO: 417490 - DNA, 25 bp, Mus musculus
gaacctgcagccttagttattgact

SEQ ID NO: 417491 - DNA, 25 bp, Mus musculus
gaacctgcagctaacttgaattgta

SEQ ID NO: 417492 - DNA, 25 bp, Mus musculus
gaacctgcagcttacttgaattgta

SEQ ID NO: 417493 - DNA, 25 bp, Mus musculus
gaacctgcaggaagataaagtcatg

SEQ ID NO: 417494 - DNA, 25 bp, Mus musculus
gaacctgcaggaccctagccaaggg

SEQ ID NO: 417495 - DNA, 25 bp, Mus musculus
gaacctgcaggagcctagccaaggg

SEQ ID NO: 417496 - DNA, 25 bp, Mus musculus
gaacctgcaggatgataaagtcatg

SEQ ID NO: 417497 - DNA, 25 bp, Mus musculus
gaacctgccaaacagattacccttt

SEQ ID NO: 417498 - DNA, 25 bp, Mus musculus
gaacctgccaaagagattacccttt

SEQ ID NO: 417499 - DNA, 25 bp, Mus musculus
gaacctgccagaagcgtttgtgtga

SEQ ID NO: 417500 - DNA, 25 bp, Mus musculus
gaacctgccagatgcgtttgtgtga

SEQ ID NO: 417501 - DNA, 25 bp, Mus musculus
gaacctgcgagtacaagagctgaaa

SEQ ID NO: 417502 - DNA, 25 bp, Mus musculus
gaacctgcgagttcaagagctgaaa

SEQ ID NO: 417503 - DNA, 25 bp, Mus musculus
gaacctgctacaaaataaacctaac

SEQ ID NO: 417504 - DNA, 25 bp, Mus musculus
gaacctgctacataataaacctaac

SEQ ID NO: 417505 - DNA, 25 bp, Mus musculus
gaacctgctagaaatgatacaaacc

SEQ ID NO: 417506 - DNA, 25 bp, Mus musculus
gaacctgctagatatgatacaaacc

SEQ ID NO: 417507 - DNA, 25 bp, Mus musculus
gaacctgctaggagtgttcctgact

SEQ ID NO: 417508 - DNA, 25 bp, Mus musculus
gaacctgctaggtgtgttcctgact

SEQ ID NO: 417509 - DNA, 25 bp, Mus musculus
gaacctgctcctaggttagcttttt

SEQ ID NO: 417510 - DNA, 25 bp, Mus musculus
gaacctgctccttggttagcttttt

SEQ ID NO: 417511 - DNA, 25 bp, Mus musculus
gaacctgctgagatgtgctactaaa

SEQ ID NO: 417512 - DNA, 25 bp, Mus musculus
gaacctgctgagttgtgctactaaa

SEQ ID NO: 417513 - DNA, 25 bp, Mus musculus
gaacctgctgatacagtttattatt

SEQ ID NO: 417514 - DNA, 25 bp, Mus musculus
gaacctgctgattcagtttattatt

SEQ ID NO: 417515 - DNA, 25 bp, Mus musculus
gaacctgctgccatgcataattttt

SEQ ID NO: 417516 - DNA, 25 bp, Mus musculus
gaacctgctgccttgcataattttt

SEQ ID NO: 417517 - DNA, 25 bp, Mus musculus
gaacctgctgctaaggtgactgtag

SEQ ID NO: 417518 - DNA, 25 bp, Mus musculus
gaacctgctgcttaggtgactgtag

SEQ ID NO: 417519 - DNA, 25 bp, Mus musculus
gaacctgcttaaatacaaatccagt

SEQ ID NO: 417520 - DNA, 25 bp, Mus musculus
gaacctgcttaattacaaatccagt

SEQ ID NO: 417521 - DNA, 25 bp, Mus musculus
gaacctgctttacagctaggtactg

SEQ ID NO: 417522 - DNA, 25 bp, Mus musculus
gaacctgctttagagctaggtactg

SEQ ID NO: 417523 - DNA, 25 bp, Mus musculus
gaacctggaactaatgacatttcat

SEQ ID NO: 417524 - DNA, 25 bp, Mus musculus
gaacctggaacttatgacatttcat

SEQ ID NO: 417525 - DNA, 25 bp, Mus musculus
gaacctggaagcacccgtgatgacg

SEQ ID NO: 417526 - DNA, 25 bp, Mus musculus
gaacctggaagctcccgtgatgacg

SEQ ID NO: 417527 - DNA, 25 bp, Mus musculus
gaacctggaatcacccgaagaactt

SEQ ID NO: 417528 - DNA, 25 bp, Mus musculus
gaacctggaatctcccgaagaactt

SEQ ID NO: 417529 - DNA, 25 bp, Mus musculus
gaacctggacaaccattgtctcaag

SEQ ID NO: 417530 - DNA, 25 bp, Mus musculus
gaacctggacaagcattgtctcaag

SEQ ID NO: 417531 - DNA, 25 bp, Mus musculus
gaacctggacatatggactagcaca

SEQ ID NO: 417532 - DNA, 25 bp, Mus musculus
gaacctggacatttggactagcaca

SEQ ID NO: 417533 - DNA, 25 bp, Mus musculus
gaacctggaccgcagggagcgcgtg

SEQ ID NO: 417534 - DNA, 25 bp, Mus musculus
gaacctggaccggagggagcgcgtg

SEQ ID NO: 417535 - DNA, 25 bp, Mus musculus
gaacctggacctctgtaaagaactt

SEQ ID NO: 417536 - DNA, 25 bp, Mus musculus
gaacctggacctgtgtaaagaactt

SEQ ID NO: 417537 - DNA, 25 bp, Mus musculus
gaacctggacgtagagctggagaca

SEQ ID NO: 417538 - DNA, 25 bp, Mus musculus
gaacctggacgttgagctggagaca

SEQ ID NO: 417539 - DNA, 25 bp, Mus musculus
gaacctggactcatgcaccagagag

SEQ ID NO: 417540 - DNA, 25 bp, Mus musculus
gaacctggactcttgcaccagagag

SEQ ID NO: 417541 - DNA, 25 bp, Mus musculus
gaacctggactgacacctaggaaca

SEQ ID NO: 417542 - DNA, 25 bp, Mus musculus
gaacctggactgtcacctaggaaca

SEQ ID NO: 417543 - DNA, 25 bp, Mus musculus
gaacctggagcaacactgtatgtgt

SEQ ID NO: 417544 - DNA, 25 bp, Mus musculus
gaacctggagcaccgagtggctaca

SEQ ID NO: 417545 - DNA, 25 bp, Mus musculus
gaacctggagcagcgagtggctaca

SEQ ID NO: 417546 - DNA, 25 bp, Mus musculus
gaacctggagcatcactgtatgtgt

SEQ ID NO: 417547 - DNA, 25 bp, Mus musculus
gaacctggagctaacctggcagcca

SEQ ID NO: 417548 - DNA, 25 bp, Mus musculus
gaacctggagctccatacgaacgcc

SEQ ID NO: 417549 - DNA, 25 bp, Mus musculus
gaacctggagctctgctagcaagca

SEQ ID NO: 417550 - DNA, 25 bp, Mus musculus
gaacctggagctgcatacgaacgcc

SEQ ID NO: 417551 - DNA, 25 bp, Mus musculus
gaacctggagctgtgctagcaagca

SEQ ID NO: 417552 - DNA, 25 bp, Mus musculus
gaacctggagcttacctggcagcca

SEQ ID NO: 417553 - DNA, 25 bp, Mus musculus
gaacctggagggacacgtgcgtttt

SEQ ID NO: 417554 - DNA, 25 bp, Mus musculus
gaacctggagggtcacgtgcgtttt

SEQ ID NO: 417555 - DNA, 25 bp, Mus musculus
gaacctggcagaagcattgctgacc

SEQ ID NO: 417556 - DNA, 25 bp, Mus musculus
gaacctggcagacatggagatccaa

SEQ ID NO: 417557 - DNA, 25 bp, Mus musculus
gaacctggcagagatggagatccaa

SEQ ID NO: 417558 - DNA, 25 bp, Mus musculus
gaacctggcagatgcattgctgacc

SEQ ID NO: 417559 - DNA, 25 bp, Mus musculus
gaacctggcagtccacatactagaa

SEQ ID NO: 417560 - DNA, 25 bp, Mus musculus
gaacctggcagtgcacatactagaa

SEQ ID NO: 417561 - DNA, 25 bp, Mus musculus
gaacctggcattatctagaagaagt

SEQ ID NO: 417562 - DNA, 25 bp, Mus musculus
gaacctggcattttctagaagaagt

SEQ ID NO: 417563 - DNA, 25 bp, Mus musculus
gaacctggccttcttgtggatgaat

SEQ ID NO: 417564 - DNA, 25 bp, Mus musculus
gaacctggccttgttgtggatgaat

SEQ ID NO: 417565 - DNA, 25 bp, Mus musculus
gaacctggctagacaaggacatact

SEQ ID NO: 417566 - DNA, 25 bp, Mus musculus
gaacctggctagacttttcagttaa

SEQ ID NO: 417567 - DNA, 25 bp, Mus musculus
gaacctggctagtcaaggacatact

SEQ ID NO: 417568 - DNA, 25 bp, Mus musculus
gaacctggctagtcttttcagttaa

SEQ ID NO: 417569 - DNA, 25 bp, Mus musculus
gaacctggctcgcaggaatctcaat

SEQ ID NO: 417570 - DNA, 25 bp, Mus musculus
gaacctggctcggaggaatctcaat

SEQ ID NO: 417571 - DNA, 25 bp, Mus musculus
gaacctggctgccacgcagcacgag

SEQ ID NO: 417572 - DNA, 25 bp, Mus musculus
gaacctggctgcgacgcagcacgag

SEQ ID NO: 417573 - DNA, 25 bp, Mus musculus
gaacctggctggagcattgcctata

SEQ ID NO: 417574 - DNA, 25 bp, Mus musculus
gaacctggctggtgcattgcctata

SEQ ID NO: 417575 - DNA, 25 bp, Mus musculus
gaacctgggataaacgactctgcta

SEQ ID NO: 417576 - DNA, 25 bp, Mus musculus
gaacctgggatatacgactctgcta

SEQ ID NO: 417577 - DNA, 25 bp, Mus musculus
gaacctgggatgagcgttttgtaat

SEQ ID NO: 417578 - DNA, 25 bp, Mus musculus
gaacctgggatgtgcgttttgtaat

SEQ ID NO: 417579 - DNA, 25 bp, Mus musculus
gaacctgggcataggcaagatcact

SEQ ID NO: 417580 - DNA, 25 bp, Mus musculus
gaacctgggcattggcaagatcact

SEQ ID NO: 417581 - DNA, 25 bp, Mus musculus
gaacctgggctcatattggaagttg

SEQ ID NO: 417582 - DNA, 25 bp, Mus musculus
gaacctgggctcttattggaagttg

SEQ ID NO: 417583 - DNA, 25 bp, Mus musculus
gaacctgggtcactgccctgtgaga

SEQ ID NO: 417584 - DNA, 25 bp, Mus musculus
gaacctgggtcagtgccctgtgaga

SEQ ID NO: 417585 - DNA, 25 bp, Mus musculus
gaacctgggttcaggtcaatgttgt

SEQ ID NO: 417586 - DNA, 25 bp, Mus musculus
gaacctgggttcagttatgagcacc

SEQ ID NO: 417587 - DNA, 25 bp, Mus musculus
gaacctgggttctggtcaatgttgt

SEQ ID NO: 417588 - DNA, 25 bp, Mus musculus
gaacctgggttctgttatgagcacc

SEQ ID NO: 417589 - DNA, 25 bp, Mus musculus
gaacctggtagcatttgtgtcgcaa

SEQ ID NO: 417590 - DNA, 25 bp, Mus musculus
gaacctggtagcttttgtgtcgcaa

SEQ ID NO: 417591 - DNA, 25 bp, Mus musculus
gaacctggtagtctttcatcaactt

SEQ ID NO: 417592 - DNA, 25 bp, Mus musculus
gaacctggtagtgtttcatcaactt

SEQ ID NO: 417593 - DNA, 25 bp, Mus musculus
gaacctggtatccagaggtgcccag

SEQ ID NO: 417594 - DNA, 25 bp, Mus musculus
gaacctggtatcgagaggtgcccag

SEQ ID NO: 417595 - DNA, 25 bp, Mus musculus
gaacctggtcctcaaaatgacatat

SEQ ID NO: 417596 - DNA, 25 bp, Mus musculus
gaacctggtcctgaaaatgacatat

SEQ ID NO: 417597 - DNA, 25 bp, Mus musculus
gaacctggtgaactgggaatccctg

SEQ ID NO: 417598 - DNA, 25 bp, Mus musculus
gaacctggtgaagtgggaatccctg

SEQ ID NO: 417599 - DNA, 25 bp, Mus musculus
gaacctggtgatattcctgatcatc

SEQ ID NO: 417600 - DNA, 25 bp, Mus musculus
gaacctggtgattttcctgatcatc

SEQ ID NO: 417601 - DNA, 25 bp, Mus musculus
gaacctggttccacaaacggattct

SEQ ID NO: 417602 - DNA, 25 bp, Mus musculus
gaacctggttcctcaaacggattct

SEQ ID NO: 417603 - DNA, 25 bp, Mus musculus
gaacctggttctcagaaagagcagt

SEQ ID NO: 417604 - DNA, 25 bp, Mus musculus
gaacctggttctgagaaagagcagt

SEQ ID NO: 417605 - DNA, 25 bp, Mus musculus
gaacctgtaaggcttcatggataaa

SEQ ID NO: 417606 - DNA, 25 bp, Mus musculus
gaacctgtaagggttcatggataaa

SEQ ID NO: 417607 - DNA, 25 bp, Mus musculus
gaacctgtacatctgtttaagttta

SEQ ID NO: 417608 - DNA, 25 bp, Mus musculus
gaacctgtacatgtgtttaagttta

SEQ ID NO: 417609 - DNA, 25 bp, Mus musculus
gaacctgtactaagtgactgtcgtt

SEQ ID NO: 417610 - DNA, 25 bp, Mus musculus
gaacctgtactatgtgactgtcgtt

SEQ ID NO: 417611 - DNA, 25 bp, Mus musculus
gaacctgtagcccagatgcctctga

SEQ ID NO: 417612 - DNA, 25 bp, Mus musculus
gaacctgtagccgagatgcctctga

SEQ ID NO: 417613 - DNA, 25 bp, Mus musculus
gaacctgtaggcagttctcagccat

SEQ ID NO: 417614 - DNA, 25 bp, Mus musculus
gaacctgtaggctgttctcagccat

SEQ ID NO: 417615 - DNA, 25 bp, Mus musculus
gaacctgtaggtagtctgggtgctt

SEQ ID NO: 417616 - DNA, 25 bp, Mus musculus
gaacctgtaggttgtctgggtgctt

SEQ ID NO: 417617 - DNA, 25 bp, Mus musculus
gaacctgtatctatggtgcttggca

SEQ ID NO: 417618 - DNA, 25 bp, Mus musculus
gaacctgtatctttggtgcttggca

SEQ ID NO: 417619 - DNA, 25 bp, Mus musculus
gaacctgtattcacacaatccacat

SEQ ID NO: 417620 - DNA, 25 bp, Mus musculus
gaacctgtattctcacaatccacat

SEQ ID NO: 417621 - DNA, 25 bp, Mus musculus
gaacctgtcactcatcaattaggaa

SEQ ID NO: 417622 - DNA, 25 bp, Mus musculus
gaacctgtcactgatcaattaggaa

SEQ ID NO: 417623 - DNA, 25 bp, Mus musculus
gaacctgtcagactgcgcacatttc

SEQ ID NO: 417624 - DNA, 25 bp, Mus musculus
gaacctgtcagagtgcgcacatttc

SEQ ID NO: 417625 - DNA, 25 bp, Mus musculus
gaacctgtcagcactgagtgctcaa

SEQ ID NO: 417626 - DNA, 25 bp, Mus musculus
gaacctgtcagctctgagtgctcaa

SEQ ID NO: 417627 - DNA, 25 bp, Mus musculus
gaacctgtcatcatcacatttctgt

SEQ ID NO: 417628 - DNA, 25 bp, Mus musculus
gaacctgtcatcttcacatttctgt

SEQ ID NO: 417629 - DNA, 25 bp, Mus musculus
gaacctgtccctaaattagatagct

SEQ ID NO: 417630 - DNA, 25 bp, Mus musculus
gaacctgtcccttaattagatagct

SEQ ID NO: 417631 - DNA, 25 bp, Mus musculus
gaacctgtcctaatacaactgtggc

SEQ ID NO: 417632 - DNA, 25 bp, Mus musculus
gaacctgtcctattacaactgtggc

SEQ ID NO: 417633 - DNA, 25 bp, Mus musculus
gaacctgtctagcagctggcatgat

SEQ ID NO: 417634 - DNA, 25 bp, Mus musculus
gaacctgtctaggagctggcatgat

SEQ ID NO: 417635 - DNA, 25 bp, Mus musculus
gaacctgtctgaaatagtgctgcca

SEQ ID NO: 417636 - DNA, 25 bp, Mus musculus
gaacctgtctgatatagtgctgcca

SEQ ID NO: 417637 - DNA, 25 bp, Mus musculus
gaacctgtctggagacctgctgcaa

SEQ ID NO: 417638 - DNA, 25 bp, Mus musculus
gaacctgtctggctaactacatcat

SEQ ID NO: 417639 - DNA, 25 bp, Mus musculus
gaacctgtctgggtaactacatcat

SEQ ID NO: 417640 - DNA, 25 bp, Mus musculus
gaacctgtctggtgacctgctgcaa

SEQ ID NO: 417641 - DNA, 25 bp, Mus musculus
gaacctgtgaatccctctgctgatg

SEQ ID NO: 417642 - DNA, 25 bp, Mus musculus
gaacctgtgaatgcctctgctgatg

SEQ ID NO: 417643 - DNA, 25 bp, Mus musculus
gaacctgtgatgatcattagccaga

SEQ ID NO: 417644 - DNA, 25 bp, Mus musculus
gaacctgtgatgttcattagccaga

SEQ ID NO: 417645 - DNA, 25 bp, Mus musculus
gaacctgtgcagagcttgagggcca

SEQ ID NO: 417646 - DNA, 25 bp, Mus musculus
gaacctgtgcagtgcttgagggcca

SEQ ID NO: 417647 - DNA, 25 bp, Mus musculus
gaacctgtgccgcaagtactatctt

SEQ ID NO: 417648 - DNA, 25 bp, Mus musculus
gaacctgtgccggaagtactatctt

SEQ ID NO: 417649 - DNA, 25 bp, Mus musculus
gaacctgtggaacagggtttataca

SEQ ID NO: 417650 - DNA, 25 bp, Mus musculus
gaacctgtggaagagggtttataca

SEQ ID NO: 417651 - DNA, 25 bp, Mus musculus
gaacctgtggatagtttcaattgca

SEQ ID NO: 417652 - DNA, 25 bp, Mus musculus
gaacctgtggattgtttcaattgca

SEQ ID NO: 417653 - DNA, 25 bp, Mus musculus
gaacctgtggccatctgtagcagaa

SEQ ID NO: 417654 - DNA, 25 bp, Mus musculus
gaacctgtggccttctgtagcagaa

SEQ ID NO: 417655 - DNA, 25 bp, Mus musculus
gaacctgtgggcacagcaaccacca

SEQ ID NO: 417656 - DNA, 25 bp, Mus musculus
gaacctgtgggctcagcaaccacca

SEQ ID NO: 417657 - DNA, 25 bp, Mus musculus
gaacctgtggttacgtctttcttgc

SEQ ID NO: 417658 - DNA, 25 bp, Mus musculus
gaacctgtggtttcgtctttcttgc

SEQ ID NO: 417659 - DNA, 25 bp, Mus musculus
gaacctgtgtaaatggtggcacttt

SEQ ID NO: 417660 - DNA, 25 bp, Mus musculus
gaacctgtgtaattggtggcacttt

SEQ ID NO: 417661 - DNA, 25 bp, Mus musculus
gaacctgtgtgacgcaattctgcag

SEQ ID NO: 417662 - DNA, 25 bp, Mus musculus
gaacctgtgtgaggcaattctgcag

SEQ ID NO: 417663 - DNA, 25 bp, Mus musculus
gaacctgtgttaaagggtctcacta

SEQ ID NO: 417664 - DNA, 25 bp, Mus musculus
gaacctgtgttatagggtctcacta

SEQ ID NO: 417665 - DNA, 25 bp, Mus musculus
gaacctgttcacctctttcatgctg

SEQ ID NO: 417666 - DNA, 25 bp, Mus musculus
gaacctgttcacgtctttcatgctg

SEQ ID NO: 417667 - DNA, 25 bp, Mus musculus
gaacctgttctgatcttggagcagt

SEQ ID NO: 417668 - DNA, 25 bp, Mus musculus
gaacctgttctgttcttggagcagt

SEQ ID NO: 417669 - DNA, 25 bp, Mus musculus
gaacctgttcttcatttgtgcttaa

SEQ ID NO: 417670 - DNA, 25 bp, Mus musculus
gaacctgttcttccacaagacaagt

SEQ ID NO: 417671 - DNA, 25 bp, Mus musculus
gaacctgttcttgatttgtgcttaa

SEQ ID NO: 417672 - DNA, 25 bp, Mus musculus
gaacctgttcttgcacaagacaagt

SEQ ID NO: 417673 - DNA, 25 bp, Mus musculus
gaacctgttgctaagtccttagaga

SEQ ID NO: 417674 - DNA, 25 bp, Mus musculus
gaacctgttgcttagtccttagaga

SEQ ID NO: 417675 - DNA, 25 bp, Mus musculus
gaacctgttgtgagatgtcctttga

SEQ ID NO: 417676 - DNA, 25 bp, Mus musculus
gaacctgttgtgtgatgtcctttga

SEQ ID NO: 417677 - DNA, 25 bp, Mus musculus
gaacctgttgttacaactgtcctgg

SEQ ID NO: 417678 - DNA, 25 bp, Mus musculus
gaacctgttgtttcaactgtcctgg

SEQ ID NO: 417679 - DNA, 25 bp, Mus musculus
gaacctgtttgtcaggcaggactga

SEQ ID NO: 417680 - DNA, 25 bp, Mus musculus
gaacctgtttgtgaggcaggactga

SEQ ID NO: 417681 - DNA, 25 bp, Mus musculus
gaacctgttttcactgaggaatcca

SEQ ID NO: 417682 - DNA, 25 bp, Mus musculus
gaacctgttttcagtagtgtaaccg

SEQ ID NO: 417683 - DNA, 25 bp, Mus musculus
gaacctgttttctctgaggaatcca

SEQ ID NO: 417684 - DNA, 25 bp, Mus musculus
gaacctgttttctgtagtgtaaccg

SEQ ID NO: 417685 - DNA, 25 bp, Mus musculus
gaacctgttttgctgtgtccaccct

SEQ ID NO: 417686 - DNA, 25 bp, Mus musculus
gaacctgttttggtgtgtccaccct

SEQ ID NO: 417687 - DNA, 25 bp, Mus musculus
gaacctgtttttcctacatagataa

SEQ ID NO: 417688 - DNA, 25 bp, Mus musculus
gaacctgtttttgctacatagataa

SEQ ID NO: 417689 - DNA, 25 bp, Mus musculus
gaaccttaaagacaaactagagcag

SEQ ID NO: 417690 - DNA, 25 bp, Mus musculus
gaaccttaaagagaaactagagcag

SEQ ID NO: 417691 - DNA, 25 bp, Mus musculus
gaaccttaactaccttgttgtgttt

SEQ ID NO: 417692 - DNA, 25 bp, Mus musculus
gaaccttaactagcttgttgtgttt

SEQ ID NO: 417693 - DNA, 25 bp, Mus musculus
gaaccttaataaactgtcactgagt

SEQ ID NO: 417694 - DNA, 25 bp, Mus musculus
gaaccttaataatctgtcactgagt

SEQ ID NO: 417695 - DNA, 25 bp, Mus musculus
gaaccttaatggacagtgtacccat

SEQ ID NO: 417696 - DNA, 25 bp, Mus musculus
gaaccttaatggtcagtgtacccat

SEQ ID NO: 417697 - DNA, 25 bp, Mus musculus
gaaccttacaataagctgctctgaa

SEQ ID NO: 417698 - DNA, 25 bp, Mus musculus
gaaccttacaatatcttgacatatg

SEQ ID NO: 417699 - DNA, 25 bp, Mus musculus
gaaccttacaattagctgctctgaa

SEQ ID NO: 417700 - DNA, 25 bp, Mus musculus
gaaccttacaatttcttgacatatg

SEQ ID NO: 417701 - DNA, 25 bp, Mus musculus
gaaccttacagacacccaggtcaaa

SEQ ID NO: 417702 - DNA, 25 bp, Mus musculus
gaaccttacagagacccaggtcaaa

SEQ ID NO: 417703 - DNA, 25 bp, Mus musculus
gaaccttacgtgataactggacatt

SEQ ID NO: 417704 - DNA, 25 bp, Mus musculus
gaaccttacgtgttaactggacatt

SEQ ID NO: 417705 - DNA, 25 bp, Mus musculus
gaaccttagacacagttcctcacga

SEQ ID NO: 417706 - DNA, 25 bp, Mus musculus
gaaccttagacagagttcctcacga

SEQ ID NO: 417707 - DNA, 25 bp, Mus musculus
gaaccttagagacgtcagaagctgt

SEQ ID NO: 417708 - DNA, 25 bp, Mus musculus
gaaccttagagaggtcagaagctgt

SEQ ID NO: 417709 - DNA, 25 bp, Mus musculus
gaaccttagaggaaggccatcacct

SEQ ID NO: 417710 - DNA, 25 bp, Mus musculus
gaaccttagaggtaggccatcacct

SEQ ID NO: 417711 - DNA, 25 bp, Mus musculus
gaaccttagatgatacttctcgtct

SEQ ID NO: 417712 - DNA, 25 bp, Mus musculus
gaaccttagatgttacttctcgtct

SEQ ID NO: 417713 - DNA, 25 bp, Mus musculus
gaaccttagggcatggatttctggg

SEQ ID NO: 417714 - DNA, 25 bp, Mus musculus
gaaccttagggcttggatttctggg

SEQ ID NO: 417715 - DNA, 25 bp, Mus musculus
gaaccttatttcatcctatgaactt

SEQ ID NO: 417716 - DNA, 25 bp, Mus musculus
gaaccttatttcttcctatgaactt

SEQ ID NO: 417717 - DNA, 25 bp, Mus musculus
gaaccttcacagagaccagggcgaa

SEQ ID NO: 417718 - DNA, 25 bp, Mus musculus
gaaccttcacagtgaccagggcgaa

SEQ ID NO: 417719 - DNA, 25 bp, Mus musculus
gaaccttcagcaccagtcacacatt

SEQ ID NO: 417720 - DNA, 25 bp, Mus musculus
gaaccttcagcagcagtcacacatt

SEQ ID NO: 417721 - DNA, 25 bp, Mus musculus
gaaccttcattcagagggtagcaaa

SEQ ID NO: 417722 - DNA, 25 bp, Mus musculus
gaaccttcattctgagggtagcaaa

SEQ ID NO: 417723 - DNA, 25 bp, Mus musculus
gaaccttcattgagattgacatcct

SEQ ID NO: 417724 - DNA, 25 bp, Mus musculus
gaaccttcattgtgattgacatcct

SEQ ID NO: 417725 - DNA, 25 bp, Mus musculus
gaaccttccagacattcggcaagac

SEQ ID NO: 417726 - DNA, 25 bp, Mus musculus
gaaccttccagagattcggcaagac

SEQ ID NO: 417727 - DNA, 25 bp, Mus musculus
gaaccttccagtcctttgtgtattg

SEQ ID NO: 417728 - DNA, 25 bp, Mus musculus
gaaccttccagtgctttgtgtattg

SEQ ID NO: 417729 - DNA, 25 bp, Mus musculus
gaaccttccataaggtgcttgtgtg

SEQ ID NO: 417730 - DNA, 25 bp, Mus musculus
gaaccttccatatggtgcttgtgtg

SEQ ID NO: 417731 - DNA, 25 bp, Mus musculus
gaaccttcccaaagcaggactacat

SEQ ID NO: 417732 - DNA, 25 bp, Mus musculus
gaaccttcccaatgcaggactacat

SEQ ID NO: 417733 - DNA, 25 bp, Mus musculus
gaaccttccctactcaggtcagcaa

SEQ ID NO: 417734 - DNA, 25 bp, Mus musculus
gaaccttccctagtcaggtcagcaa

SEQ ID NO: 417735 - DNA, 25 bp, Mus musculus
gaaccttccgctcgatctgtgagat

SEQ ID NO: 417736 - DNA, 25 bp, Mus musculus
gaaccttccgctggatctgtgagat

SEQ ID NO: 417737 - DNA, 25 bp, Mus musculus
gaaccttcctcactgtttatttatg

SEQ ID NO: 417738 - DNA, 25 bp, Mus musculus
gaaccttcctcagtgtttatttatg

SEQ ID NO: 417739 - DNA, 25 bp, Mus musculus
gaaccttcctgaccagtgtaactca

SEQ ID NO: 417740 - DNA, 25 bp, Mus musculus
gaaccttcctgagcagtgtaactca

SEQ ID NO: 417741 - DNA, 25 bp, Mus musculus
gaaccttccttcagatttgcctgcc

SEQ ID NO: 417742 - DNA, 25 bp, Mus musculus
gaaccttccttctgatttgcctgcc

SEQ ID NO: 417743 - DNA, 25 bp, Mus musculus
gaaccttcgagaacagtcctgtgag

SEQ ID NO: 417744 - DNA, 25 bp, Mus musculus
gaaccttcgagatcagtcctgtgag

SEQ ID NO: 417745 - DNA, 25 bp, Mus musculus
gaaccttcggaaaacctctgaggag

SEQ ID NO: 417746 - DNA, 25 bp, Mus musculus
gaaccttcggaatacctctgaggag

SEQ ID NO: 417747 - DNA, 25 bp, Mus musculus
gaaccttctaagaatccaatgtgga

SEQ ID NO: 417748 - DNA, 25 bp, Mus musculus
gaaccttctaagtatccaatgtgga

SEQ ID NO: 417749 - DNA, 25 bp, Mus musculus
gaaccttctactccttggatcttca

SEQ ID NO: 417750 - DNA, 25 bp, Mus musculus
gaaccttctactgcttggatcttca

SEQ ID NO: 417751 - DNA, 25 bp, Mus musculus
gaaccttctctgaaaatgccctaat

SEQ ID NO: 417752 - DNA, 25 bp, Mus musculus
gaaccttctctgtaaatgccctaat

SEQ ID NO: 417753 - DNA, 25 bp, Mus musculus
gaaccttctgaacagcctaatcggc

SEQ ID NO: 417754 - DNA, 25 bp, Mus musculus
gaaccttctgaagagcctaatcggc

SEQ ID NO: 417755 - DNA, 25 bp, Mus musculus
gaaccttctgacacagctttgttgt

SEQ ID NO: 417756 - DNA, 25 bp, Mus musculus
gaaccttctgactcagctttgttgt

SEQ ID NO: 417757 - DNA, 25 bp, Mus musculus
gaaccttctgtacttggaatcaaaa

SEQ ID NO: 417758 - DNA, 25 bp, Mus musculus
gaaccttctgtagttggaatcaaaa

SEQ ID NO: 417759 - DNA, 25 bp, Mus musculus
gaaccttcttctactgtgaatactg

SEQ ID NO: 417760 - DNA, 25 bp, Mus musculus
gaaccttcttcttctgtgaatactg

SEQ ID NO: 417761 - DNA, 25 bp, Mus musculus
gaaccttcttgaaatgacgcattgt

SEQ ID NO: 417762 - DNA, 25 bp, Mus musculus
gaaccttcttgatatgacgcattgt

SEQ ID NO: 417763 - DNA, 25 bp, Mus musculus
gaaccttgaaatctgggaccttact

SEQ ID NO: 417764 - DNA, 25 bp, Mus musculus
gaaccttgaaatgtgggaccttact

SEQ ID NO: 417765 - DNA, 25 bp, Mus musculus
gaaccttgaagacgcttgggcctta

SEQ ID NO: 417766 - DNA, 25 bp, Mus musculus
gaaccttgaagaggcttgggcctta

SEQ ID NO: 417767 - DNA, 25 bp, Mus musculus
gaaccttgaatgagagacggtgcat

SEQ ID NO: 417768 - DNA, 25 bp, Mus musculus
gaaccttgaatgtgagacggtgcat

SEQ ID NO: 417769 - DNA, 25 bp, Mus musculus
gaaccttgacccctaaaatacagcg

SEQ ID NO: 417770 - DNA, 25 bp, Mus musculus
gaaccttgacccgtaaaatacagcg

SEQ ID NO: 417771 - DNA, 25 bp, Mus musculus
gaaccttgactcaaatctatgatgg

SEQ ID NO: 417772 - DNA, 25 bp, Mus musculus
gaaccttgactctaatctatgatgg

SEQ ID NO: 417773 - DNA, 25 bp, Mus musculus
gaaccttgagagatgtcttcttttg

SEQ ID NO: 417774 - DNA, 25 bp, Mus musculus
gaaccttgagagttgtcttcttttg

SEQ ID NO: 417775 - DNA, 25 bp, Mus musculus
gaaccttgatatatactgtcttatt

SEQ ID NO: 417776 - DNA, 25 bp, Mus musculus
gaaccttgatatttactgtcttatt

SEQ ID NO: 417777 - DNA, 25 bp, Mus musculus
gaaccttgatgcagtcttgatcacc

SEQ ID NO: 417778 - DNA, 25 bp, Mus musculus
gaaccttgatgctgtcttgatcacc

SEQ ID NO: 417779 - DNA, 25 bp, Mus musculus
gaaccttgcaggagcagagcctagt

SEQ ID NO: 417780 - DNA, 25 bp, Mus musculus
gaaccttgcaggtgcagagcctagt

SEQ ID NO: 417781 - DNA, 25 bp, Mus musculus
gaaccttgctagaagaataaacagt

SEQ ID NO: 417782 - DNA, 25 bp, Mus musculus
gaaccttgctagtagaataaacagt

SEQ ID NO: 417783 - DNA, 25 bp, Mus musculus
gaaccttggaccattaggcatgcca

SEQ ID NO: 417784 - DNA, 25 bp, Mus musculus
gaaccttggacctttaggcatgcca

SEQ ID NO: 417785 - DNA, 25 bp, Mus musculus
gaaccttggaggaagcccagatcct

SEQ ID NO: 417786 - DNA, 25 bp, Mus musculus
gaaccttggaggtagcccagatcct

SEQ ID NO: 417787 - DNA, 25 bp, Mus musculus
gaaccttggagtcctgagtctgagt

SEQ ID NO: 417788 - DNA, 25 bp, Mus musculus
gaaccttggagtgctgagtctgagt

SEQ ID NO: 417789 - DNA, 25 bp, Mus musculus
gaaccttggctcagcttcatgccca

SEQ ID NO: 417790 - DNA, 25 bp, Mus musculus
gaaccttggctctgcttcatgccca

SEQ ID NO: 417791 - DNA, 25 bp, Mus musculus
gaaccttggctgcaatggcatgctt

SEQ ID NO: 417792 - DNA, 25 bp, Mus musculus
gaaccttggctggaatggcatgctt

SEQ ID NO: 417793 - DNA, 25 bp, Mus musculus
gaaccttgggtcatttgctctgtgt

SEQ ID NO: 417794 - DNA, 25 bp, Mus musculus
gaaccttgggtcttttgctctgtgt

SEQ ID NO: 417795 - DNA, 25 bp, Mus musculus
gaaccttgggttctagactggaaag

SEQ ID NO: 417796 - DNA, 25 bp, Mus musculus
gaaccttgggttgtagactggaaag

SEQ ID NO: 417797 - DNA, 25 bp, Mus musculus
gaaccttggtccactcgacgaacag

SEQ ID NO: 417798 - DNA, 25 bp, Mus musculus
gaaccttggtccactgaaagtgtag

SEQ ID NO: 417799 - DNA, 25 bp, Mus musculus
gaaccttggtcctctcgacgaacag

SEQ ID NO: 417800 - DNA, 25 bp, Mus musculus
gaaccttggtcctctgaaagtgtag

SEQ ID NO: 417801 - DNA, 25 bp, Mus musculus
gaaccttggtggagggcgaccatct

SEQ ID NO: 417802 - DNA, 25 bp, Mus musculus
gaaccttggtggtgggcgaccatct

SEQ ID NO: 417803 - DNA, 25 bp, Mus musculus
gaaccttggtgtaaagtgagcccca

SEQ ID NO: 417804 - DNA, 25 bp, Mus musculus
gaaccttggtgtatatggccaatgt

SEQ ID NO: 417805 - DNA, 25 bp, Mus musculus
gaaccttggtgttaagtgagcccca

SEQ ID NO: 417806 - DNA, 25 bp, Mus musculus
gaaccttggtgtttatggccaatgt

SEQ ID NO: 417807 - DNA, 25 bp, Mus musculus
gaaccttgtagacttctttgctggg

SEQ ID NO: 417808 - DNA, 25 bp, Mus musculus
gaaccttgtagagttctttgctggg

SEQ ID NO: 417809 - DNA, 25 bp, Mus musculus
gaaccttgtatactacacagaatgt

SEQ ID NO: 417810 - DNA, 25 bp, Mus musculus
gaaccttgtatagtacacagaatgt

SEQ ID NO: 417811 - DNA, 25 bp, Mus musculus
gaaccttgtgcccatgtgtatgtct

SEQ ID NO: 417812 - DNA, 25 bp, Mus musculus
gaaccttgtgccgatgtgtatgtct

SEQ ID NO: 417813 - DNA, 25 bp, Mus musculus
gaaccttgtggcaggcaactaagaa

SEQ ID NO: 417814 - DNA, 25 bp, Mus musculus
gaaccttgtggctggcaactaagaa

SEQ ID NO: 417815 - DNA, 25 bp, Mus musculus
gaaccttgttataatcctctgccag

SEQ ID NO: 417816 - DNA, 25 bp, Mus musculus
gaaccttgttattatcctctgccag

SEQ ID NO: 417817 - DNA, 25 bp, Mus musculus
gaaccttgtttcaaactatcattta

SEQ ID NO: 417818 - DNA, 25 bp, Mus musculus
gaaccttgtttctaactatcattta

SEQ ID NO: 417819 - DNA, 25 bp, Mus musculus
gaacctttaagtctgcattcagttt

SEQ ID NO: 417820 - DNA, 25 bp, Mus musculus
gaacctttaagtgtgcattcagttt

SEQ ID NO: 417821 - DNA, 25 bp, Mus musculus
gaacctttacacatgttattctctt

SEQ ID NO: 417822 - DNA, 25 bp, Mus musculus
gaacctttacacttgttattctctt

SEQ ID NO: 417823 - DNA, 25 bp, Mus musculus
gaacctttacagaagcgactcagat

SEQ ID NO: 417824 - DNA, 25 bp, Mus musculus
gaacctttacagtagcgactcagat

SEQ ID NO: 417825 - DNA, 25 bp, Mus musculus
gaacctttacatagtcctcataagt

SEQ ID NO: 417826 - DNA, 25 bp, Mus musculus
gaacctttacattgtcctcataagt

SEQ ID NO: 417827 - DNA, 25 bp, Mus musculus
gaacctttacgtatctgtgtctcca

SEQ ID NO: 417828 - DNA, 25 bp, Mus musculus
gaacctttacgtttctgtgtctcca

SEQ ID NO: 417829 - DNA, 25 bp, Mus musculus
gaacctttactccaggacacgaatg

SEQ ID NO: 417830 - DNA, 25 bp, Mus musculus
gaacctttactcgaggacacgaatg

SEQ ID NO: 417831 - DNA, 25 bp, Mus musculus
gaacctttacttctacacatctcaa

SEQ ID NO: 417832 - DNA, 25 bp, Mus musculus
gaacctttacttgtacacatctcaa

SEQ ID NO: 417833 - DNA, 25 bp, Mus musculus
gaacctttagggatcatggagtaca

SEQ ID NO: 417834 - DNA, 25 bp, Mus musculus
gaacctttagggttcatggagtaca

SEQ ID NO: 417835 - DNA, 25 bp, Mus musculus
gaacctttagtcatcagccatgtat

SEQ ID NO: 417836 - DNA, 25 bp, Mus musculus
gaacctttagtcttcagccatgtat

SEQ ID NO: 417837 - DNA, 25 bp, Mus musculus
gaacctttataacctgacctgactg

SEQ ID NO: 417838 - DNA, 25 bp, Mus musculus
gaacctttataagctgacctgactg

SEQ ID NO: 417839 - DNA, 25 bp, Mus musculus
gaacctttatcaacagacactgcgt

SEQ ID NO: 417840 - DNA, 25 bp, Mus musculus
gaacctttatcatcagacactgcgt

SEQ ID NO: 417841 - DNA, 25 bp, Mus musculus
gaacctttcagaccccatgccattg

SEQ ID NO: 417842 - DNA, 25 bp, Mus musculus
gaacctttcagagcccatgccattg

SEQ ID NO: 417843 - DNA, 25 bp, Mus musculus
gaacctttcattctgaagtttgagg

SEQ ID NO: 417844 - DNA, 25 bp, Mus musculus
gaacctttcattgtgaagtttgagg

SEQ ID NO: 417845 - DNA, 25 bp, Mus musculus
gaacctttcctgagggttggacgtg

SEQ ID NO: 417846 - DNA, 25 bp, Mus musculus
gaacctttcctgtgggttggacgtg

SEQ ID NO: 417847 - DNA, 25 bp, Mus musculus
gaacctttctataatcccctaactg

SEQ ID NO: 417848 - DNA, 25 bp, Mus musculus
gaacctttctattatcccctaactg

SEQ ID NO: 417849 - DNA, 25 bp, Mus musculus
gaacctttctgaaccagctttcatt

SEQ ID NO: 417850 - DNA, 25 bp, Mus musculus
gaacctttctgatccagctttcatt

SEQ ID NO: 417851 - DNA, 25 bp, Mus musculus
gaacctttctttcctgtggcattaa

SEQ ID NO: 417852 - DNA, 25 bp, Mus musculus
gaacctttctttgctgtggcattaa

SEQ ID NO: 417853 - DNA, 25 bp, Mus musculus
gaacctttgacactacatgtttttt

SEQ ID NO: 417854 - DNA, 25 bp, Mus musculus
gaacctttgacagtacatgtttttt

SEQ ID NO: 417855 - DNA, 25 bp, Mus musculus
gaacctttgacccattttgtggcct

SEQ ID NO: 417856 - DNA, 25 bp, Mus musculus
gaacctttgaccgattttgtggcct

SEQ ID NO: 417857 - DNA, 25 bp, Mus musculus
gaacctttgagccagaatgaacctt

SEQ ID NO: 417858 - DNA, 25 bp, Mus musculus
gaacctttgagcgagaatgaacctt

SEQ ID NO: 417859 - DNA, 25 bp, Mus musculus
gaacctttgatacccatttcagata

SEQ ID NO: 417860 - DNA, 25 bp, Mus musculus
gaacctttgatagccatttcagata

SEQ ID NO: 417861 - DNA, 25 bp, Mus musculus
gaacctttgcagatattctaatatg

SEQ ID NO: 417862 - DNA, 25 bp, Mus musculus
gaacctttgcagttattctaatatg

SEQ ID NO: 417863 - DNA, 25 bp, Mus musculus
gaacctttggacagtaacacggaca

SEQ ID NO: 417864 - DNA, 25 bp, Mus musculus
gaacctttggactgtaacacggaca

SEQ ID NO: 417865 - DNA, 25 bp, Mus musculus
gaacctttggatacaggcctgtctt

SEQ ID NO: 417866 - DNA, 25 bp, Mus musculus
gaacctttggattcaggcctgtctt

SEQ ID NO: 417867 - DNA, 25 bp, Mus musculus
gaacctttgggcaattgtccttctt

SEQ ID NO: 417868 - DNA, 25 bp, Mus musculus
gaacctttgggctattgtccttctt

SEQ ID NO: 417869 - DNA, 25 bp, Mus musculus
gaacctttgtccatttgttgtggca

SEQ ID NO: 417870 - DNA, 25 bp, Mus musculus
gaacctttgtccttttgttgtggca

SEQ ID NO: 417871 - DNA, 25 bp, Mus musculus
gaacctttgtggacatggacacctt

SEQ ID NO: 417872 - DNA, 25 bp, Mus musculus
gaacctttgtggtcatggacacctt

SEQ ID NO: 417873 - DNA, 25 bp, Mus musculus
gaacctttgtttagctagtgaatga

SEQ ID NO: 417874 - DNA, 25 bp, Mus musculus
gaacctttgttttgctagtgaatga

SEQ ID NO: 417875 - DNA, 25 bp, Mus musculus
gaaccttttactaactgatacacta

SEQ ID NO: 417876 - DNA, 25 bp, Mus musculus
gaaccttttacttactgatacacta

SEQ ID NO: 417877 - DNA, 25 bp, Mus musculus
gaaccttttatcaaatgctgcttgg

SEQ ID NO: 417878 - DNA, 25 bp, Mus musculus
gaaccttttatctaatgctgcttgg

SEQ ID NO: 417879 - DNA, 25 bp, Mus musculus
gaaccttttcacaagggcttctgaa

SEQ ID NO: 417880 - DNA, 25 bp, Mus musculus
gaaccttttcactagggcttctgaa

SEQ ID NO: 417881 - DNA, 25 bp, Mus musculus
gaaccttttggtctcaatgcaagtt

SEQ ID NO: 417882 - DNA, 25 bp, Mus musculus
gaaccttttggtgtcaatgcaagtt

SEQ ID NO: 417883 - DNA, 25 bp, Mus musculus
gaaccttttgtcctcagaacagatg

SEQ ID NO: 417884 - DNA, 25 bp, Mus musculus
gaaccttttgtcgtcagaacagatg

SEQ ID NO: 417885 - DNA, 25 bp, Mus musculus
gaacctttttgacggcaggtccttg

SEQ ID NO: 417886 - DNA, 25 bp, Mus musculus
gaacctttttgagggcaggtccttg

SEQ ID NO: 417887 - DNA, 25 bp, Mus musculus
gaacgaaaaagcacgcacaccttac

SEQ ID NO: 417888 - DNA, 25 bp, Mus musculus
gaacgaaaaagctcgcacaccttac

SEQ ID NO: 417889 - DNA, 25 bp, Mus musculus
gaacgaaacggaagcctccgacatc

SEQ ID NO: 417890 - DNA, 25 bp, Mus musculus
gaacgaaacggatgcctccgacatc

SEQ ID NO: 417891 - DNA, 25 bp, Mus musculus
gaacgaaagatgctcactggatctg

SEQ ID NO: 417892 - DNA, 25 bp, Mus musculus
gaacgaaagatggtcactggatctg

SEQ ID NO: 417893 - DNA, 25 bp, Mus musculus
gaacgaaagtgtcctgcaagtcctg

SEQ ID NO: 417894 - DNA, 25 bp, Mus musculus
gaacgaaagtgtgctgcaagtcctg

SEQ ID NO: 417895 - DNA, 25 bp, Mus musculus
gaacgaacaagacgctttccgcagt

SEQ ID NO: 417896 - DNA, 25 bp, Mus musculus
gaacgaacaagaggctttccgcagt

SEQ ID NO: 417897 - DNA, 25 bp, Mus musculus
gaacgaacactaacaggctgatgat

SEQ ID NO: 417898 - DNA, 25 bp, Mus musculus
gaacgaacactacattcccctattg

SEQ ID NO: 417899 - DNA, 25 bp, Mus musculus
gaacgaacactagattcccctattg

SEQ ID NO: 417900 - DNA, 25 bp, Mus musculus
gaacgaacactatcaggctgatgat

SEQ ID NO: 417901 - DNA, 25 bp, Mus musculus
gaacgaacatgcagtgcacatctct

SEQ ID NO: 417902 - DNA, 25 bp, Mus musculus
gaacgaacatgctgtgcacatctct

SEQ ID NO: 417903 - DNA, 25 bp, Mus musculus
gaacgaacatggacattgccccaga

SEQ ID NO: 417904 - DNA, 25 bp, Mus musculus
gaacgaacatggtcattgccccaga

SEQ ID NO: 417905 - DNA, 25 bp, Mus musculus
gaacgaacattcagctcgcttcaag

SEQ ID NO: 417906 - DNA, 25 bp, Mus musculus
gaacgaacattctgctcgcttcaag

SEQ ID NO: 417907 - DNA, 25 bp, Mus musculus
gaacgaactaccctttatgccaatc

SEQ ID NO: 417908 - DNA, 25 bp, Mus musculus
gaacgaactaccgtttatgccaatc

SEQ ID NO: 417909 - DNA, 25 bp, Mus musculus
gaacgaactgctcaagcgctctcgg

SEQ ID NO: 417910 - DNA, 25 bp, Mus musculus
gaacgaactgctgaagcgctctcgg

SEQ ID NO: 417911 - DNA, 25 bp, Mus musculus
gaacgaacttgtcacacctcagtgt

SEQ ID NO: 417912 - DNA, 25 bp, Mus musculus
gaacgaacttgtgacacctcagtgt

SEQ ID NO: 417913 - DNA, 25 bp, Mus musculus
gaacgaagacctcaacacgtgaact

SEQ ID NO: 417914 - DNA, 25 bp, Mus musculus
gaacgaagacctgaacacgtgaact

SEQ ID NO: 417915 - DNA, 25 bp, Mus musculus
gaacgaagccgacatgctgttctct

SEQ ID NO: 417916 - DNA, 25 bp, Mus musculus
gaacgaagccgagatgctgttctct

SEQ ID NO: 417917 - DNA, 25 bp, Mus musculus
gaacgaagtctacaagtcaatgggt

SEQ ID NO: 417918 - DNA, 25 bp, Mus musculus
gaacgaagtctagaagtcaatgggt

SEQ ID NO: 417919 - DNA, 25 bp, Mus musculus
gaacgaagttctatatacccatgta

SEQ ID NO: 417920 - DNA, 25 bp, Mus musculus
gaacgaagttctttatacccatgta

SEQ ID NO: 417921 - DNA, 25 bp, Mus musculus
gaacgaatccatccgaacagtctct

SEQ ID NO: 417922 - DNA, 25 bp, Mus musculus
gaacgaatccatgcgaacagtctct

SEQ ID NO: 417923 - DNA, 25 bp, Mus musculus
gaacgaatctcactagtcactttga

SEQ ID NO: 417924 - DNA, 25 bp, Mus musculus
gaacgaatctcagtagtcactttga

SEQ ID NO: 417925 - DNA, 25 bp, Mus musculus
gaacgaattgatcacccatgagcag

SEQ ID NO: 417926 - DNA, 25 bp, Mus musculus
gaacgaattgatgacccatgagcag

SEQ ID NO: 417927 - DNA, 25 bp, Mus musculus
gaacgacacagtctacttcactcta

SEQ ID NO: 417928 - DNA, 25 bp, Mus musculus
gaacgacacagtgtacttcactcta

SEQ ID NO: 417929 - DNA, 25 bp, Mus musculus
gaacgacaccatacagattgatttg

SEQ ID NO: 417930 - DNA, 25 bp, Mus musculus
gaacgacaccattcagattgatttg

SEQ ID NO: 417931 - DNA, 25 bp, Mus musculus
gaacgacagaagaacatggcatttt

SEQ ID NO: 417932 - DNA, 25 bp, Mus musculus
gaacgacagaagtacatggcatttt

SEQ ID NO: 417933 - DNA, 25 bp, Mus musculus
gaacgacagcgtatggtttcctgcg

SEQ ID NO: 417934 - DNA, 25 bp, Mus musculus
gaacgacagcgtttggtttcctgcg

SEQ ID NO: 417935 - DNA, 25 bp, Mus musculus
gaacgacagtcaaactgggtgagaa

SEQ ID NO: 417936 - DNA, 25 bp, Mus musculus
gaacgacagtcatactgggtgagaa

SEQ ID NO: 417937 - DNA, 25 bp, Mus musculus
gaacgacatcgccatcatcaagttg

SEQ ID NO: 417938 - DNA, 25 bp, Mus musculus
gaacgacatcgcgatcatcaagttg

SEQ ID NO: 417939 - DNA, 25 bp, Mus musculus
gaacgacatcttagtgtttctgtta

SEQ ID NO: 417940 - DNA, 25 bp, Mus musculus
gaacgacatctttgtgtttctgtta

SEQ ID NO: 417941 - DNA, 25 bp, Mus musculus
gaacgacatgttctgtacaagctca

SEQ ID NO: 417942 - DNA, 25 bp, Mus musculus
gaacgacatgttgtgtacaagctca

SEQ ID NO: 417943 - DNA, 25 bp, Mus musculus
gaacgaccacgaaaccaagactaga

SEQ ID NO: 417944 - DNA, 25 bp, Mus musculus
gaacgaccacgataccaagactaga

SEQ ID NO: 417945 - DNA, 25 bp, Mus musculus
gaacgaccagttcaactgggtgtcc

SEQ ID NO: 417946 - DNA, 25 bp, Mus musculus
gaacgaccagttgaactgggtgtcc

SEQ ID NO: 417947 - DNA, 25 bp, Mus musculus
gaacgaccatcacacatcggaggag

SEQ ID NO: 417948 - DNA, 25 bp, Mus musculus
gaacgaccatcagacatcggaggag

SEQ ID NO: 417949 - DNA, 25 bp, Mus musculus
gaacgaccggacaaatctgaagaga

SEQ ID NO: 417950 - DNA, 25 bp, Mus musculus
gaacgaccggactaatctgaagaga

SEQ ID NO: 417951 - DNA, 25 bp, Mus musculus
gaacgacctgacatttcttaggatc

SEQ ID NO: 417952 - DNA, 25 bp, Mus musculus
gaacgacctgacttttcttaggatc

SEQ ID NO: 417953 - DNA, 25 bp, Mus musculus
gaacgaccttctatatgacattctc

SEQ ID NO: 417954 - DNA, 25 bp, Mus musculus
gaacgaccttctttatgacattctc

SEQ ID NO: 417955 - DNA, 25 bp, Mus musculus
gaacgacggaaaccgcgacctgatc

SEQ ID NO: 417956 - DNA, 25 bp, Mus musculus
gaacgacggaaagcgcgacctgatc

SEQ ID NO: 417957 - DNA, 25 bp, Mus musculus
gaacgacgggtcattcatttccaag

SEQ ID NO: 417958 - DNA, 25 bp, Mus musculus
gaacgacgggtctttcatttccaag

SEQ ID NO: 417959 - DNA, 25 bp, Mus musculus
gaacgactacagcattaacaggctt

SEQ ID NO: 417960 - DNA, 25 bp, Mus musculus
gaacgactacaggattaacaggctt

SEQ ID NO: 417961 - DNA, 25 bp, Mus musculus
gaacgactcccacctttaggagaag

SEQ ID NO: 417962 - DNA, 25 bp, Mus musculus
gaacgactcccagctttaggagaag

SEQ ID NO: 417963 - DNA, 25 bp, Mus musculus
gaacgactgcaaatgacttaattta

SEQ ID NO: 417964 - DNA, 25 bp, Mus musculus
gaacgactgcaattgacttaattta

SEQ ID NO: 417965 - DNA, 25 bp, Mus musculus
gaacgactgtccaattatcgccggg

SEQ ID NO: 417966 - DNA, 25 bp, Mus musculus
gaacgactgtcctattatcgccggg

SEQ ID NO: 417967 - DNA, 25 bp, Mus musculus
gaacgactgtctacataacccgaga

SEQ ID NO: 417968 - DNA, 25 bp, Mus musculus
gaacgactgtcttcataacccgaga

SEQ ID NO: 417969 - DNA, 25 bp, Mus musculus
gaacgacttccgacattgactctga

SEQ ID NO: 417970 - DNA, 25 bp, Mus musculus
gaacgacttccgtcattgactctga

SEQ ID NO: 417971 - DNA, 25 bp, Mus musculus
gaacgactttatcggccagagtact

SEQ ID NO: 417972 - DNA, 25 bp, Mus musculus
gaacgactttatgggccagagtact

SEQ ID NO: 417973 - DNA, 25 bp, Mus musculus
gaacgagaaaagcaaggttctggct

SEQ ID NO: 417974 - DNA, 25 bp, Mus musculus
gaacgagaaaaggaaggttctggct

SEQ ID NO: 417975 - DNA, 25 bp, Mus musculus
gaacgagaaccacgtgtccagtgat

SEQ ID NO: 417976 - DNA, 25 bp, Mus musculus
gaacgagaaccaggtgtccagtgat

SEQ ID NO: 417977 - DNA, 25 bp, Mus musculus
gaacgagaagctccatcagcgcgtg

SEQ ID NO: 417978 - DNA, 25 bp, Mus musculus
gaacgagaagctgcatcagcgcgtg

SEQ ID NO: 417979 - DNA, 25 bp, Mus musculus
gaacgagactctcgcatgctaacta

SEQ ID NO: 417980 - DNA, 25 bp, Mus musculus
gaacgagactctggcatgctaacta

SEQ ID NO: 417981 - DNA, 25 bp, Mus musculus
gaacgagagcgcaactacgacaaag

SEQ ID NO: 417982 - DNA, 25 bp, Mus musculus
gaacgagagcgctactacgacaaag

SEQ ID NO: 417983 - DNA, 25 bp, Mus musculus
gaacgagatcctcttcactgagaac

SEQ ID NO: 417984 - DNA, 25 bp, Mus musculus
gaacgagatcctgttcactgagaac

SEQ ID NO: 417985 - DNA, 25 bp, Mus musculus
gaacgagatgccatcaggagcagga

SEQ ID NO: 417986 - DNA, 25 bp, Mus musculus
gaacgagatgccttcaggagcagga

SEQ ID NO: 417987 - DNA, 25 bp, Mus musculus
gaacgagatggtacagcacaaacta

SEQ ID NO: 417988 - DNA, 25 bp, Mus musculus
gaacgagatggttcagcacaaacta

SEQ ID NO: 417989 - DNA, 25 bp, Mus musculus
gaacgagattaaagacgctagcaat

SEQ ID NO: 417990 - DNA, 25 bp, Mus musculus
gaacgagattaatgacgctagcaat

SEQ ID NO: 417991 - DNA, 25 bp, Mus musculus
gaacgagcacaaattaatctaaagc

SEQ ID NO: 417992 - DNA, 25 bp, Mus musculus
gaacgagcacaatttaatctaaagc

SEQ ID NO: 417993 - DNA, 25 bp, Mus musculus
gaacgagccaccagtgacctgagga

SEQ ID NO: 417994 - DNA, 25 bp, Mus musculus
gaacgagccacctgtgacctgagga

SEQ ID NO: 417995 - DNA, 25 bp, Mus musculus
gaacgagccagcaagtgtccatcaa

SEQ ID NO: 417996 - DNA, 25 bp, Mus musculus
gaacgagccagctagtgtccatcaa

SEQ ID NO: 417997 - DNA, 25 bp, Mus musculus
gaacgagccaggcacctcaacagct

SEQ ID NO: 417998 - DNA, 25 bp, Mus musculus
gaacgagccagggacctcaacagct

SEQ ID NO: 417999 - DNA, 25 bp, Mus musculus
gaacgagccctaaggagtggtctct

SEQ ID NO: 418000 - DNA, 25 bp, Mus musculus
gaacgagccctatggagtggtctct

SEQ ID NO: 418001 - DNA, 25 bp, Mus musculus
gaacgagcctaaaagcatggcgagt

SEQ ID NO: 418002 - DNA, 25 bp, Mus musculus
gaacgagcctaatagcatggcgagt

SEQ ID NO: 418003 - DNA, 25 bp, Mus musculus
gaacgagctgaaacagtcccagctt

SEQ ID NO: 418004 - DNA, 25 bp, Mus musculus
gaacgagctgaaccgcagctttttt

SEQ ID NO: 418005 - DNA, 25 bp, Mus musculus
gaacgagctgaagcgcagctttttt

SEQ ID NO: 418006 - DNA, 25 bp, Mus musculus
gaacgagctgaatcagtcccagctt

SEQ ID NO: 418007 - DNA, 25 bp, Mus musculus
gaacgaggactcaggactttgaacc

SEQ ID NO: 418008 - DNA, 25 bp, Mus musculus
gaacgaggactctggactttgaacc

SEQ ID NO: 418009 - DNA, 25 bp, Mus musculus
gaacgaggccatccaggcggcccat

SEQ ID NO: 418010 - DNA, 25 bp, Mus musculus
gaacgaggccatcgcaagcattaca

SEQ ID NO: 418011 - DNA, 25 bp, Mus musculus
gaacgaggccatgcaggcggcccat

SEQ ID NO: 418012 - DNA, 25 bp, Mus musculus
gaacgaggccatggcaagcattaca

SEQ ID NO: 418013 - DNA, 25 bp, Mus musculus
gaacgaggctctccaggtccaaaag

SEQ ID NO: 418014 - DNA, 25 bp, Mus musculus
gaacgaggctctgcaggtccaaaag

SEQ ID NO: 418015 - DNA, 25 bp, Mus musculus
gaacgaggtacgaatacccagcttt

SEQ ID NO: 418016 - DNA, 25 bp, Mus musculus
gaacgaggtacgtatacccagcttt

SEQ ID NO: 418017 - DNA, 25 bp, Mus musculus
gaacgaggtttgaaagtcccagcct

SEQ ID NO: 418018 - DNA, 25 bp, Mus musculus
gaacgaggtttgtaagtcccagcct

SEQ ID NO: 418019 - DNA, 25 bp, Mus musculus
gaacgagtgactccaactgaagcct

SEQ ID NO: 418020 - DNA, 25 bp, Mus musculus
gaacgagtgactgcaactgaagcct

SEQ ID NO: 418021 - DNA, 25 bp, Mus musculus
gaacgagtgagtcttcactcttttg

SEQ ID NO: 418022 - DNA, 25 bp, Mus musculus
gaacgagtgagtgttcactcttttg

SEQ ID NO: 418023 - DNA, 25 bp, Mus musculus
gaacgagtgcgaccagactgttgca

SEQ ID NO: 418024 - DNA, 25 bp, Mus musculus
gaacgagtgcgagcagactgttgca

SEQ ID NO: 418025 - DNA, 25 bp, Mus musculus
gaacgagtgcttagccgaagagctc

SEQ ID NO: 418026 - DNA, 25 bp, Mus musculus
gaacgagtgcttctttgaacttgaa

SEQ ID NO: 418027 - DNA, 25 bp, Mus musculus
gaacgagtgcttgtttgaacttgaa

SEQ ID NO: 418028 - DNA, 25 bp, Mus musculus
gaacgagtgctttgccgaagagctc

SEQ ID NO: 418029 - DNA, 25 bp, Mus musculus
gaacgagtggatcagatgcatcgca

SEQ ID NO: 418030 - DNA, 25 bp, Mus musculus
gaacgagtggatccttcatctggcg

SEQ ID NO: 418031 - DNA, 25 bp, Mus musculus
gaacgagtggatgagatgcatcgca

SEQ ID NO: 418032 - DNA, 25 bp, Mus musculus
gaacgagtggatgcttcatctggcg

SEQ ID NO: 418033 - DNA, 25 bp, Mus musculus
gaacgagttcgtacgtgacaccagc

SEQ ID NO: 418034 - DNA, 25 bp, Mus musculus
gaacgagttcgttcgtgacaccagc

SEQ ID NO: 418035 - DNA, 25 bp, Mus musculus
gaacgatagaccagttctgtcaaaa

SEQ ID NO: 418036 - DNA, 25 bp, Mus musculus
gaacgatagacctgttctgtcaaaa

SEQ ID NO: 418037 - DNA, 25 bp, Mus musculus
gaacgatctgataaaataaccattt

SEQ ID NO: 418038 - DNA, 25 bp, Mus musculus
gaacgatctgattaaataaccattt

SEQ ID NO: 418039 - DNA, 25 bp, Mus musculus
gaacgatctgctcgtgtgtggacac

SEQ ID NO: 418040 - DNA, 25 bp, Mus musculus
gaacgatctgctggtgtgtggacac

SEQ ID NO: 418041 - DNA, 25 bp, Mus musculus
gaacgatgacccatccaaaatggtt

SEQ ID NO: 418042 - DNA, 25 bp, Mus musculus
gaacgatgacccttccaaaatggtt

SEQ ID NO: 418043 - DNA, 25 bp, Mus musculus
gaacgatgactgctacttctaagat

SEQ ID NO: 418044 - DNA, 25 bp, Mus musculus
gaacgatgactggtacttctaagat

SEQ ID NO: 418045 - DNA, 25 bp, Mus musculus
gaacgatgcgttatcacggcttgta

SEQ ID NO: 418046 - DNA, 25 bp, Mus musculus
gaacgatgcgttttcacggcttgta

SEQ ID NO: 418047 - DNA, 25 bp, Mus musculus
gaacgatggcatctcccagcggtga

SEQ ID NO: 418048 - DNA, 25 bp, Mus musculus
gaacgatggcatgtcccagcggtga

SEQ ID NO: 418049 - DNA, 25 bp, Mus musculus
gaacgatgtcatcgccagcatgtca

SEQ ID NO: 418050 - DNA, 25 bp, Mus musculus
gaacgatgtcatggccagcatgtca

SEQ ID NO: 418051 - DNA, 25 bp, Mus musculus
gaacgattacctcccaaggacatcc

SEQ ID NO: 418052 - DNA, 25 bp, Mus musculus
gaacgattacctgccaaggacatcc

SEQ ID NO: 418053 - DNA, 25 bp, Mus musculus
gaacgattacttctttagcctatct

SEQ ID NO: 418054 - DNA, 25 bp, Mus musculus
gaacgattacttgtttagcctatct

SEQ ID NO: 418055 - DNA, 25 bp, Mus musculus
gaacgattcgttaaatgcagaccat

SEQ ID NO: 418056 - DNA, 25 bp, Mus musculus
gaacgattcgtttaatgcagaccat

SEQ ID NO: 418057 - DNA, 25 bp, Mus musculus
gaacgattggacaaatccatgccat

SEQ ID NO: 418058 - DNA, 25 bp, Mus musculus
gaacgattggactaatccatgccat

SEQ ID NO: 418059 - DNA, 25 bp, Mus musculus
gaacgattgggtagtcaccctcaaa

SEQ ID NO: 418060 - DNA, 25 bp, Mus musculus
gaacgattgggttgtcaccctcaaa

SEQ ID NO: 418061 - DNA, 25 bp, Mus musculus
gaacgatttcttagctggattctga

SEQ ID NO: 418062 - DNA, 25 bp, Mus musculus
gaacgatttctttgctggattctga

SEQ ID NO: 418063 - DNA, 25 bp, Mus musculus
gaacgatttggaaccctgctggaga

SEQ ID NO: 418064 - DNA, 25 bp, Mus musculus
gaacgatttggatccctgctggaga

SEQ ID NO: 418065 - DNA, 25 bp, Mus musculus
gaacgatttggcactgtccaggaat

SEQ ID NO: 418066 - DNA, 25 bp, Mus musculus
gaacgatttggctctgtccaggaat

SEQ ID NO: 418067 - DNA, 25 bp, Mus musculus
gaacgcaaacagaagccggccggcc

SEQ ID NO: 418068 - DNA, 25 bp, Mus musculus
gaacgcaaacagtagccggccggcc

SEQ ID NO: 418069 - DNA, 25 bp, Mus musculus
gaacgcaaagctcaactcaacagtg

SEQ ID NO: 418070 - DNA, 25 bp, Mus musculus
gaacgcaaagctcgctgcaagaact

SEQ ID NO: 418071 - DNA, 25 bp, Mus musculus
gaacgcaaagctgaactcaacagtg

SEQ ID NO: 418072 - DNA, 25 bp, Mus musculus
gaacgcaaagctggctgcaagaact

SEQ ID NO: 418073 - DNA, 25 bp, Mus musculus
gaacgcaaaggcaaagacggatatt

SEQ ID NO: 418074 - DNA, 25 bp, Mus musculus
gaacgcaaaggctaagacggatatt

SEQ ID NO: 418075 - DNA, 25 bp, Mus musculus
gaacgcaaatgaattattatccaga

SEQ ID NO: 418076 - DNA, 25 bp, Mus musculus
gaacgcaaatgatttattatccaga

SEQ ID NO: 418077 - DNA, 25 bp, Mus musculus
gaacgcaacattactccagctggga

SEQ ID NO: 418078 - DNA, 25 bp, Mus musculus
gaacgcaacatttctccagctggga

SEQ ID NO: 418079 - DNA, 25 bp, Mus musculus
gaacgcaactctcgcgcggaggctc

SEQ ID NO: 418080 - DNA, 25 bp, Mus musculus
gaacgcaactctggcgcggaggctc

SEQ ID NO: 418081 - DNA, 25 bp, Mus musculus
gaacgcaactgacactggaatcttg

SEQ ID NO: 418082 - DNA, 25 bp, Mus musculus
gaacgcaactgagactggaatcttg

SEQ ID NO: 418083 - DNA, 25 bp, Mus musculus
gaacgcaagcttctgcactgtggat

SEQ ID NO: 418084 - DNA, 25 bp, Mus musculus
gaacgcaagcttgtgcactgtggat

SEQ ID NO: 418085 - DNA, 25 bp, Mus musculus
gaacgcaatactaatctacacccaa

SEQ ID NO: 418086 - DNA, 25 bp, Mus musculus
gaacgcaatacttatctacacccaa

SEQ ID NO: 418087 - DNA, 25 bp, Mus musculus
gaacgcaattccagataatagccaa

SEQ ID NO: 418088 - DNA, 25 bp, Mus musculus
gaacgcaattcctgataatagccaa

SEQ ID NO: 418089 - DNA, 25 bp, Mus musculus
gaacgcacactcatgctgattccta

SEQ ID NO: 418090 - DNA, 25 bp, Mus musculus
gaacgcacactcttgctgattccta

SEQ ID NO: 418091 - DNA, 25 bp, Mus musculus
gaacgcacagggacttgactctcgt

SEQ ID NO: 418092 - DNA, 25 bp, Mus musculus
gaacgcacagggtcttgactctcgt

SEQ ID NO: 418093 - DNA, 25 bp, Mus musculus
gaacgcactgggattcttagagaac

SEQ ID NO: 418094 - DNA, 25 bp, Mus musculus
gaacgcactgggtttcttagagaac

SEQ ID NO: 418095 - DNA, 25 bp, Mus musculus
gaacgcagacggctacattgatgct

SEQ ID NO: 418096 - DNA, 25 bp, Mus musculus
gaacgcagacgggtacattgatgct

SEQ ID NO: 418097 - DNA, 25 bp, Mus musculus
gaacgcagatacaacgaggaggagc

SEQ ID NO: 418098 - DNA, 25 bp, Mus musculus
gaacgcagatactacgaggaggagc

SEQ ID NO: 418099 - DNA, 25 bp, Mus musculus
gaacgcagcatgaatctcatttcca

SEQ ID NO: 418100 - DNA, 25 bp, Mus musculus
gaacgcagcatgtatctcatttcca

SEQ ID NO: 418101 - DNA, 25 bp, Mus musculus
gaacgcagcgagcaacttcactggg

SEQ ID NO: 418102 - DNA, 25 bp, Mus musculus
gaacgcagcgaggaacttcactggg

SEQ ID NO: 418103 - DNA, 25 bp, Mus musculus
gaacgcagctgaaggcttgcaaact

SEQ ID NO: 418104 - DNA, 25 bp, Mus musculus
gaacgcagctgatggcttgcaaact

SEQ ID NO: 418105 - DNA, 25 bp, Mus musculus
gaacgcaggaggctactttaaataa

SEQ ID NO: 418106 - DNA, 25 bp, Mus musculus
gaacgcaggagggtactttaaataa

SEQ ID NO: 418107 - DNA, 25 bp, Mus musculus
gaacgcaggcagactgtgcaatcac

SEQ ID NO: 418108 - DNA, 25 bp, Mus musculus
gaacgcaggcagtctgtgcaatcac

SEQ ID NO: 418109 - DNA, 25 bp, Mus musculus
gaacgcaggcggatctccggccata

SEQ ID NO: 418110 - DNA, 25 bp, Mus musculus
gaacgcaggcggttctccggccata

SEQ ID NO: 418111 - DNA, 25 bp, Mus musculus
gaacgcagggagcaagtcattcaag

SEQ ID NO: 418112 - DNA, 25 bp, Mus musculus
gaacgcagggaggaagtcattcaag

SEQ ID NO: 418113 - DNA, 25 bp, Mus musculus
gaacgcagtcctcaaaagtatgtct

SEQ ID NO: 418114 - DNA, 25 bp, Mus musculus
gaacgcagtcctgaaaagtatgtct

SEQ ID NO: 418115 - DNA, 25 bp, Mus musculus
gaacgcagtgacagatgccctggtc

SEQ ID NO: 418116 - DNA, 25 bp, Mus musculus
gaacgcagtgactgatgccctggtc

SEQ ID NO: 418117 - DNA, 25 bp, Mus musculus
gaacgcataggcaaaacacccatat

SEQ ID NO: 418118 - DNA, 25 bp, Mus musculus
gaacgcataggctaaacacccatat

SEQ ID NO: 418119 - DNA, 25 bp, Mus musculus
gaacgcatcaacaccttcgtgaggt

SEQ ID NO: 418120 - DNA, 25 bp, Mus musculus
gaacgcatcaactccttcgtgaggt

SEQ ID NO: 418121 - DNA, 25 bp, Mus musculus
gaacgcatccacattcatggaaaca

SEQ ID NO: 418122 - DNA, 25 bp, Mus musculus
gaacgcatccactttcatggaaaca

SEQ ID NO: 418123 - DNA, 25 bp, Mus musculus
gaacgcatctccctgtctgcagcat

SEQ ID NO: 418124 - DNA, 25 bp, Mus musculus
gaacgcatctccgtgtctgcagcat

SEQ ID NO: 418125 - DNA, 25 bp, Mus musculus
gaacgcatgaagcaaatggtgagct

SEQ ID NO: 418126 - DNA, 25 bp, Mus musculus
gaacgcatgaaggaaatggtgagct

SEQ ID NO: 418127 - DNA, 25 bp, Mus musculus
gaacgcattgtgagatcagttgact

SEQ ID NO: 418128 - DNA, 25 bp, Mus musculus
gaacgcattgtgtgatcagttgact

SEQ ID NO: 418129 - DNA, 25 bp, Mus musculus
gaacgcattgttaatccctatgaaa

SEQ ID NO: 418130 - DNA, 25 bp, Mus musculus
gaacgcattgtttatccctatgaaa

SEQ ID NO: 418131 - DNA, 25 bp, Mus musculus
gaacgccaacgactccaggtcgtgt

SEQ ID NO: 418132 - DNA, 25 bp, Mus musculus
gaacgccaacgagtccaggtcgtgt

SEQ ID NO: 418133 - DNA, 25 bp, Mus musculus
gaacgccaagctaacacctcaagta

SEQ ID NO: 418134 - DNA, 25 bp, Mus musculus
gaacgccaagcttacacctcaagta

SEQ ID NO: 418135 - DNA, 25 bp, Mus musculus
gaacgccatgttcgtttctctacaa

SEQ ID NO: 418136 - DNA, 25 bp, Mus musculus
gaacgccatgttggtttctctacaa

SEQ ID NO: 418137 - DNA, 25 bp, Mus musculus
gaacgcccatctaaaaatcgacgcc

SEQ ID NO: 418138 - DNA, 25 bp, Mus musculus
gaacgcccatcttaaaatcgacgcc

SEQ ID NO: 418139 - DNA, 25 bp, Mus musculus
gaacgcccggcacgctgaggctaac

SEQ ID NO: 418140 - DNA, 25 bp, Mus musculus
gaacgcccggcaggctgaggctaac

SEQ ID NO: 418141 - DNA, 25 bp, Mus musculus
gaacgccctaggaaagtgtttctca

SEQ ID NO: 418142 - DNA, 25 bp, Mus musculus
gaacgccctaggtaagtgtttctca

SEQ ID NO: 418143 - DNA, 25 bp, Mus musculus
gaacgcccttatcaagcagtaccag

SEQ ID NO: 418144 - DNA, 25 bp, Mus musculus
gaacgcccttatgaagcagtaccag

SEQ ID NO: 418145 - DNA, 25 bp, Mus musculus
gaacgcccttctcataactacaaca

SEQ ID NO: 418146 - DNA, 25 bp, Mus musculus
gaacgcccttctgataactacaaca

SEQ ID NO: 418147 - DNA, 25 bp, Mus musculus
gaacgccgaaggaccattgttttct

SEQ ID NO: 418148 - DNA, 25 bp, Mus musculus
gaacgccgaaggtccattgttttct

SEQ ID NO: 418149 - DNA, 25 bp, Mus musculus
gaacgccgcatgacagtgctgctat

SEQ ID NO: 418150 - DNA, 25 bp, Mus musculus
gaacgccgcatgtcagtgctgctat

SEQ ID NO: 418151 - DNA, 25 bp, Mus musculus
gaacgcctacggagcttctgaagga

SEQ ID NO: 418152 - DNA, 25 bp, Mus musculus
gaacgcctacggtgcttctgaagga

SEQ ID NO: 418153 - DNA, 25 bp, Mus musculus
gaacgcctcaggaacaggtactatg

SEQ ID NO: 418154 - DNA, 25 bp, Mus musculus
gaacgcctcaggtacaggtactatg

SEQ ID NO: 418155 - DNA, 25 bp, Mus musculus
gaacgcctcatgagtcagggctatt

SEQ ID NO: 418156 - DNA, 25 bp, Mus musculus
gaacgcctcatgtgtcagggctatt

SEQ ID NO: 418157 - DNA, 25 bp, Mus musculus
gaacgcctcctgcagaacggtttaa

SEQ ID NO: 418158 - DNA, 25 bp, Mus musculus
gaacgcctcctggagaacggtttaa

SEQ ID NO: 418159 - DNA, 25 bp, Mus musculus
gaacgcctctgacatgtacagacct

SEQ ID NO: 418160 - DNA, 25 bp, Mus musculus
gaacgcctctgagatgtacagacct

SEQ ID NO: 418161 - DNA, 25 bp, Mus musculus
gaacgcctggctctcatttcagttg

SEQ ID NO: 418162 - DNA, 25 bp, Mus musculus
gaacgcctggctgtcatttcagttg

SEQ ID NO: 418163 - DNA, 25 bp, Mus musculus
gaacgccttaataatgattgtctaa

SEQ ID NO: 418164 - DNA, 25 bp, Mus musculus
gaacgccttaattatgattgtctaa

SEQ ID NO: 418165 - DNA, 25 bp, Mus musculus
gaacgccttcataaaaagcccaagt

SEQ ID NO: 418166 - DNA, 25 bp, Mus musculus
gaacgccttcattaaaagcccaagt

SEQ ID NO: 418167 - DNA, 25 bp, Mus musculus
gaacgcctttccaattagccataaa

SEQ ID NO: 418168 - DNA, 25 bp, Mus musculus
gaacgcctttcctattagccataaa

SEQ ID NO: 418169 - DNA, 25 bp, Mus musculus
gaacgcgacttgagaaggagctccg

SEQ ID NO: 418170 - DNA, 25 bp, Mus musculus
gaacgcgacttgtgaaggagctccg

SEQ ID NO: 418171 - DNA, 25 bp, Mus musculus
gaacgcgagaacagattccttgcaa

SEQ ID NO: 418172 - DNA, 25 bp, Mus musculus
gaacgcgagaactgattccttgcaa

SEQ ID NO: 418173 - DNA, 25 bp, Mus musculus
gaacgcgatttaaggcctgttactt

SEQ ID NO: 418174 - DNA, 25 bp, Mus musculus
gaacgcgatttatggcctgttactt

SEQ ID NO: 418175 - DNA, 25 bp, Mus musculus
gaacgcgccctgacaactttgtagt

SEQ ID NO: 418176 - DNA, 25 bp, Mus musculus
gaacgcgccctgtcaactttgtagt

SEQ ID NO: 418177 - DNA, 25 bp, Mus musculus
gaacgcgccttccaacttgagcttc

SEQ ID NO: 418178 - DNA, 25 bp, Mus musculus
gaacgcgccttcgaacttgagcttc

SEQ ID NO: 418179 - DNA, 25 bp, Mus musculus
gaacgcgcgcctagtgcttccgctt

SEQ ID NO: 418180 - DNA, 25 bp, Mus musculus
gaacgcgcgccttgtgcttccgctt

SEQ ID NO: 418181 - DNA, 25 bp, Mus musculus
gaacgcgcgcgtcttgtgtgaacct

SEQ ID NO: 418182 - DNA, 25 bp, Mus musculus
gaacgcgcgcgtgttgtgtgaacct

SEQ ID NO: 418183 - DNA, 25 bp, Mus musculus
gaacgcgctagaagcctttttgcat

SEQ ID NO: 418184 - DNA, 25 bp, Mus musculus
gaacgcgctagatgcctttttgcat

SEQ ID NO: 418185 - DNA, 25 bp, Mus musculus
gaacgcggcgcacacaccaaggata

SEQ ID NO: 418186 - DNA, 25 bp, Mus musculus
gaacgcggcgcagacaccaaggata

SEQ ID NO: 418187 - DNA, 25 bp, Mus musculus
gaacgcgtcggtacagtagcgttaa

SEQ ID NO: 418188 - DNA, 25 bp, Mus musculus
gaacgcgtcggttcagtagcgttaa

SEQ ID NO: 418189 - DNA, 25 bp, Mus musculus
gaacgcgtttttcggacctgcagaa

SEQ ID NO: 418190 - DNA, 25 bp, Mus musculus
gaacgcgtttttgggacctgcagaa

SEQ ID NO: 418191 - DNA, 25 bp, Mus musculus
gaacgctacagacccgtaagcctcg

SEQ ID NO: 418192 - DNA, 25 bp, Mus musculus
gaacgctacagagccgtaagcctcg

SEQ ID NO: 418193 - DNA, 25 bp, Mus musculus
gaacgctacatgaagatgcatttgg

SEQ ID NO: 418194 - DNA, 25 bp, Mus musculus
gaacgctacatgtagatgcatttgg

SEQ ID NO: 418195 - DNA, 25 bp, Mus musculus
gaacgctactacaacgtgtaaacca

SEQ ID NO: 418196 - DNA, 25 bp, Mus musculus
gaacgctactactacgtgtaaacca

SEQ ID NO: 418197 - DNA, 25 bp, Mus musculus
gaacgctagcacagagcttgccata

SEQ ID NO: 418198 - DNA, 25 bp, Mus musculus
gaacgctagcactgagcttgccata

SEQ ID NO: 418199 - DNA, 25 bp, Mus musculus
gaacgctagtgcaaatatcacagat

SEQ ID NO: 418200 - DNA, 25 bp, Mus musculus
gaacgctagtgctaatatcacagat

SEQ ID NO: 418201 - DNA, 25 bp, Mus musculus
gaacgctatatgcaacctgtcaccc

SEQ ID NO: 418202 - DNA, 25 bp, Mus musculus
gaacgctatatggaacctgtcaccc

SEQ ID NO: 418203 - DNA, 25 bp, Mus musculus
gaacgctatcaaccagaactggagt

SEQ ID NO: 418204 - DNA, 25 bp, Mus musculus
gaacgctatcaagcagaactggagt

SEQ ID NO: 418205 - DNA, 25 bp, Mus musculus
gaacgctcaagtccatcaggcttca

SEQ ID NO: 418206 - DNA, 25 bp, Mus musculus
gaacgctcaagtgcatcaggcttca

SEQ ID NO: 418207 - DNA, 25 bp, Mus musculus
gaacgctcactcacagggacctggg

SEQ ID NO: 418208 - DNA, 25 bp, Mus musculus
gaacgctcactctcagggacctggg

SEQ ID NO: 418209 - DNA, 25 bp, Mus musculus
gaacgctccttgagtcattgtcaac

SEQ ID NO: 418210 - DNA, 25 bp, Mus musculus
gaacgctccttgtgtcattgtcaac

SEQ ID NO: 418211 - DNA, 25 bp, Mus musculus
gaacgctcgatcaagctgagctgca

SEQ ID NO: 418212 - DNA, 25 bp, Mus musculus
gaacgctcgatctagctgagctgca

SEQ ID NO: 418213 - DNA, 25 bp, Mus musculus
gaacgctctcagaccagagtgcttt

SEQ ID NO: 418214 - DNA, 25 bp, Mus musculus
gaacgctctcagtccagagtgcttt

SEQ ID NO: 418215 - DNA, 25 bp, Mus musculus
gaacgctctcatcaaatgcagtgct

SEQ ID NO: 418216 - DNA, 25 bp, Mus musculus
gaacgctctcatgaaatgcagtgct

SEQ ID NO: 418217 - DNA, 25 bp, Mus musculus
gaacgctctgaaacatcttgtgaat

SEQ ID NO: 418218 - DNA, 25 bp, Mus musculus
gaacgctctgaatcatcttgtgaat

SEQ ID NO: 418219 - DNA, 25 bp, Mus musculus
gaacgctctttgatgatcattgtct

SEQ ID NO: 418220 - DNA, 25 bp, Mus musculus
gaacgctctttgttgatcattgtct

SEQ ID NO: 418221 - DNA, 25 bp, Mus musculus
gaacgctgagaacacttcgggcagc

SEQ ID NO: 418222 - DNA, 25 bp, Mus musculus
gaacgctgagaagacttcgggcagc

SEQ ID NO: 418223 - DNA, 25 bp, Mus musculus
gaacgctgagtacgtatatctgcat

SEQ ID NO: 418224 - DNA, 25 bp, Mus musculus
gaacgctgagtaggtatatctgcat

SEQ ID NO: 418225 - DNA, 25 bp, Mus musculus
gaacgctgcagactttactgatgta

SEQ ID NO: 418226 - DNA, 25 bp, Mus musculus
gaacgctgcagagtttactgatgta

SEQ ID NO: 418227 - DNA, 25 bp, Mus musculus
gaacgctgcataaagaacttcccaa

SEQ ID NO: 418228 - DNA, 25 bp, Mus musculus
gaacgctgcatatagaacttcccaa

SEQ ID NO: 418229 - DNA, 25 bp, Mus musculus
gaacgctgctgcattgcagtgtgaa

SEQ ID NO: 418230 - DNA, 25 bp, Mus musculus
gaacgctgctgctttgcagtgtgaa

SEQ ID NO: 418231 - DNA, 25 bp, Mus musculus
gaacgctggctgaaaagcctttgcc

SEQ ID NO: 418232 - DNA, 25 bp, Mus musculus
gaacgctggctgtaaagcctttgcc

SEQ ID NO: 418233 - DNA, 25 bp, Mus musculus
gaacgctgggaactctacgacatca

SEQ ID NO: 418234 - DNA, 25 bp, Mus musculus
gaacgctgggaagtctacgacatca

SEQ ID NO: 418235 - DNA, 25 bp, Mus musculus
gaacgctggttaaagacactcacat

SEQ ID NO: 418236 - DNA, 25 bp, Mus musculus
gaacgctggttatagacactcacat

SEQ ID NO: 418237 - DNA, 25 bp, Mus musculus
gaacgcttacagaacattgctgcca

SEQ ID NO: 418238 - DNA, 25 bp, Mus musculus
gaacgcttacagtacattgctgcca

SEQ ID NO: 418239 - DNA, 25 bp, Mus musculus
gaacgcttattccagtttactttga

SEQ ID NO: 418240 - DNA, 25 bp, Mus musculus
gaacgcttattcgagtttactttga

SEQ ID NO: 418241 - DNA, 25 bp, Mus musculus
gaacgcttccatattgctgtttggc

SEQ ID NO: 418242 - DNA, 25 bp, Mus musculus
gaacgcttccattttgctgtttggc

SEQ ID NO: 418243 - DNA, 25 bp, Mus musculus
gaacgcttggagctgacctgtagac

SEQ ID NO: 418244 - DNA, 25 bp, Mus musculus
gaacgcttggaggtgacctgtagac

SEQ ID NO: 418245 - DNA, 25 bp, Mus musculus
gaacgcttttgactggttgatgact

SEQ ID NO: 418246 - DNA, 25 bp, Mus musculus
gaacgcttttgagtggttgatgact

SEQ ID NO: 418247 - DNA, 25 bp, Mus musculus
gaacggaacccaaggcctggtctgt

SEQ ID NO: 418248 - DNA, 25 bp, Mus musculus
gaacggaacccatggcctggtctgt

SEQ ID NO: 418249 - DNA, 25 bp, Mus musculus
gaacggaaggccacagcgctcatga

SEQ ID NO: 418250 - DNA, 25 bp, Mus musculus
gaacggaaggcctcagcgctcatga

SEQ ID NO: 418251 - DNA, 25 bp, Mus musculus
gaacggaagtacctatgccctgagt

SEQ ID NO: 418252 - DNA, 25 bp, Mus musculus
gaacggaagtacgtatgccctgagt

SEQ ID NO: 418253 - DNA, 25 bp, Mus musculus
gaacggaatactcagggacgccctg

SEQ ID NO: 418254 - DNA, 25 bp, Mus musculus
gaacggaatactgagggacgccctg

SEQ ID NO: 418255 - DNA, 25 bp, Mus musculus
gaacggaataggactctgtatttct

SEQ ID NO: 418256 - DNA, 25 bp, Mus musculus
gaacggaataggtctctgtatttct

SEQ ID NO: 418257 - DNA, 25 bp, Mus musculus
gaacggaatcacctcaagtcctgta

SEQ ID NO: 418258 - DNA, 25 bp, Mus musculus
gaacggaatcacgtcaagtcctgta

SEQ ID NO: 418259 - DNA, 25 bp, Mus musculus
gaacggaattcacttacttgccact

SEQ ID NO: 418260 - DNA, 25 bp, Mus musculus
gaacggaattcagttacttgccact

SEQ ID NO: 418261 - DNA, 25 bp, Mus musculus
gaacggacagaacttggtcaccaca

SEQ ID NO: 418262 - DNA, 25 bp, Mus musculus
gaacggacagaagttggtcaccaca

SEQ ID NO: 418263 - DNA, 25 bp, Mus musculus
gaacggacagagaatctcacttgaa

SEQ ID NO: 418264 - DNA, 25 bp, Mus musculus
gaacggacagagtatctcacttgaa

SEQ ID NO: 418265 - DNA, 25 bp, Mus musculus
gaacggacatcaatgttttaagaca

SEQ ID NO: 418266 - DNA, 25 bp, Mus musculus
gaacggacatcattgttttaagaca

SEQ ID NO: 418267 - DNA, 25 bp, Mus musculus
gaacggacccttaaaacacaggctg

SEQ ID NO: 418268 - DNA, 25 bp, Mus musculus
gaacggaccctttaaacacaggctg

SEQ ID NO: 418269 - DNA, 25 bp, Mus musculus
gaacggaccggaattccgctgcatc

SEQ ID NO: 418270 - DNA, 25 bp, Mus musculus
gaacggaccggatttccgctgcatc

SEQ ID NO: 418271 - DNA, 25 bp, Mus musculus
gaacggactacacggttcaagctcc

SEQ ID NO: 418272 - DNA, 25 bp, Mus musculus
gaacggactacagggttcaagctcc

SEQ ID NO: 418273 - DNA, 25 bp, Mus musculus
gaacggacttctcagagcccgggtt

SEQ ID NO: 418274 - DNA, 25 bp, Mus musculus
gaacggacttctgagagcccgggtt

SEQ ID NO: 418275 - DNA, 25 bp, Mus musculus
gaacggagactgcttccctgtccaa

SEQ ID NO: 418276 - DNA, 25 bp, Mus musculus
gaacggagactggttccctgtccaa

SEQ ID NO: 418277 - DNA, 25 bp, Mus musculus
gaacggagatgccatgctcgtctgc

SEQ ID NO: 418278 - DNA, 25 bp, Mus musculus
gaacggagatgcgatgctcgtctgc

SEQ ID NO: 418279 - DNA, 25 bp, Mus musculus
gaacggagcatgagcataccgcatg

SEQ ID NO: 418280 - DNA, 25 bp, Mus musculus
gaacggagcatgtgcataccgcatg

SEQ ID NO: 418281 - DNA, 25 bp, Mus musculus
gaacggagcctcaagagcatcccat

SEQ ID NO: 418282 - DNA, 25 bp, Mus musculus
gaacggagcctctagagcatcccat

SEQ ID NO: 418283 - DNA, 25 bp, Mus musculus
gaacggagctgtcctatactctgcc

SEQ ID NO: 418284 - DNA, 25 bp, Mus musculus
gaacggagctgtgctatactctgcc

SEQ ID NO: 418285 - DNA, 25 bp, Mus musculus
gaacggaggataatagcacctgcct

SEQ ID NO: 418286 - DNA, 25 bp, Mus musculus
gaacggaggatattagcacctgcct

SEQ ID NO: 418287 - DNA, 25 bp, Mus musculus
gaacggataatcctctttatgcttg

SEQ ID NO: 418288 - DNA, 25 bp, Mus musculus
gaacggataatcgtctttatgcttg

SEQ ID NO: 418289 - DNA, 25 bp, Mus musculus
gaacggatatgaacacttacagcaa

SEQ ID NO: 418290 - DNA, 25 bp, Mus musculus
gaacggatatgatcacttacagcaa

SEQ ID NO: 418291 - DNA, 25 bp, Mus musculus
gaacggatcacaaaattatctgcag

SEQ ID NO: 418292 - DNA, 25 bp, Mus musculus
gaacggatcacataattatctgcag

SEQ ID NO: 418293 - DNA, 25 bp, Mus musculus
gaacggatgctgcaggaccttctga

SEQ ID NO: 418294 - DNA, 25 bp, Mus musculus
gaacggatgctggaggaccttctga

SEQ ID NO: 418295 - DNA, 25 bp, Mus musculus
gaacggatttccactgatgattgag

SEQ ID NO: 418296 - DNA, 25 bp, Mus musculus
gaacggatttcctctgatgattgag

SEQ ID NO: 418297 - DNA, 25 bp, Mus musculus
gaacggatttctccaagcgtcttct

SEQ ID NO: 418298 - DNA, 25 bp, Mus musculus
gaacggatttctgcaagcgtcttct

SEQ ID NO: 418299 - DNA, 25 bp, Mus musculus
gaacggcaacttatcctggtacaga

SEQ ID NO: 418300 - DNA, 25 bp, Mus musculus
gaacggcaacttttcctggtacaga

SEQ ID NO: 418301 - DNA, 25 bp, Mus musculus
gaacggcaccagcatctaatagcgg

SEQ ID NO: 418302 - DNA, 25 bp, Mus musculus
gaacggcaccaggatctaatagcgg

SEQ ID NO: 418303 - DNA, 25 bp, Mus musculus
gaacggcacccacctgatgatacgc

SEQ ID NO: 418304 - DNA, 25 bp, Mus musculus
gaacggcacccagctgatgatacgc

SEQ ID NO: 418305 - DNA, 25 bp, Mus musculus
gaacggcagattcggaacaccaaag

SEQ ID NO: 418306 - DNA, 25 bp, Mus musculus
gaacggcagattgggaacaccaaag

SEQ ID NO: 418307 - DNA, 25 bp, Mus musculus
gaacggcagtaacggctcaggacta

SEQ ID NO: 418308 - DNA, 25 bp, Mus musculus
gaacggcagtaagggctcaggacta

SEQ ID NO: 418309 - DNA, 25 bp, Mus musculus
gaacggcatcctcctgggatatgag

SEQ ID NO: 418310 - DNA, 25 bp, Mus musculus
gaacggcatcctgctgggatatgag

SEQ ID NO: 418311 - DNA, 25 bp, Mus musculus
gaacggcatgaaaccttaacaagtt

SEQ ID NO: 418312 - DNA, 25 bp, Mus musculus
gaacggcatgaacagtcttcagcca

SEQ ID NO: 418313 - DNA, 25 bp, Mus musculus
gaacggcatgaagagtcttcagcca

SEQ ID NO: 418314 - DNA, 25 bp, Mus musculus
gaacggcatgaatccttaacaagtt

SEQ ID NO: 418315 - DNA, 25 bp, Mus musculus
gaacggcccacaaagaggcaggccc

SEQ ID NO: 418316 - DNA, 25 bp, Mus musculus
gaacggcccacatagaggcaggccc

SEQ ID NO: 418317 - DNA, 25 bp, Mus musculus
gaacggccccatccagcgcgggaaa

SEQ ID NO: 418318 - DNA, 25 bp, Mus musculus
gaacggccccatgcagcgcgggaaa

SEQ ID NO: 418319 - DNA, 25 bp, Mus musculus
gaacggcctcagaagtcttgggtta

SEQ ID NO: 418320 - DNA, 25 bp, Mus musculus
gaacggcctcagtagtcttgggtta

SEQ ID NO: 418321 - DNA, 25 bp, Mus musculus
gaacggccttcgaaaagtgtcctgt

SEQ ID NO: 418322 - DNA, 25 bp, Mus musculus
gaacggccttcgtaaagtgtcctgt

SEQ ID NO: 418323 - DNA, 25 bp, Mus musculus
gaacggcctttaatcttttagcgat

SEQ ID NO: 418324 - DNA, 25 bp, Mus musculus
gaacggcctttattcttttagcgat

SEQ ID NO: 418325 - DNA, 25 bp, Mus musculus
gaacggcgcactcatgaaacccagt

SEQ ID NO: 418326 - DNA, 25 bp, Mus musculus
gaacggcgcactgatgaaacccagt

SEQ ID NO: 418327 - DNA, 25 bp, Mus musculus
gaacggcgtgcaatatcaacatcat

SEQ ID NO: 418328 - DNA, 25 bp, Mus musculus
gaacggcgtgcattatcaacatcat

SEQ ID NO: 418329 - DNA, 25 bp, Mus musculus
gaacggcgtgtcacataaagtcgat

SEQ ID NO: 418330 - DNA, 25 bp, Mus musculus
gaacggcgtgtctcataaagtcgat

SEQ ID NO: 418331 - DNA, 25 bp, Mus musculus
gaacggctaaagctcacgtgtctac

SEQ ID NO: 418332 - DNA, 25 bp, Mus musculus
gaacggctaaaggtcacgtgtctac

SEQ ID NO: 418333 - DNA, 25 bp, Mus musculus
gaacggctcatcatgaggttgctga

SEQ ID NO: 418334 - DNA, 25 bp, Mus musculus
gaacggctcatcttgaggttgctga

SEQ ID NO: 418335 - DNA, 25 bp, Mus musculus
gaacggctggacctgtcagtagtca

SEQ ID NO: 418336 - DNA, 25 bp, Mus musculus
gaacggctggacgtgtcagtagtca

SEQ ID NO: 418337 - DNA, 25 bp, Mus musculus
gaacggctgggtagaggactattga

SEQ ID NO: 418338 - DNA, 25 bp, Mus musculus
gaacggctgggttgaggactattga

SEQ ID NO: 418339 - DNA, 25 bp, Mus musculus
gaacggctgttcaaactgcagtcta

SEQ ID NO: 418340 - DNA, 25 bp, Mus musculus
gaacggctgttctaactgcagtcta

SEQ ID NO: 418341 - DNA, 25 bp, Mus musculus
gaacggcttccccaagaagttgcta

SEQ ID NO: 418342 - DNA, 25 bp, Mus musculus
gaacggcttcccgaagaagttgcta

SEQ ID NO: 418343 - DNA, 25 bp, Mus musculus
gaacggcttcctatgtatctttaat

SEQ ID NO: 418344 - DNA, 25 bp, Mus musculus
gaacggcttcctttgtatctttaat

SEQ ID NO: 418345 - DNA, 25 bp, Mus musculus
gaacggcttcttcgctatgatgcga

SEQ ID NO: 418346 - DNA, 25 bp, Mus musculus
gaacggcttcttggctatgatgcga

SEQ ID NO: 418347 - DNA, 25 bp, Mus musculus
gaacggcttgccagaccaatgtttt

SEQ ID NO: 418348 - DNA, 25 bp, Mus musculus
gaacggcttgcctgaccaatgtttt

SEQ ID NO: 418349 - DNA, 25 bp, Mus musculus
gaacggcttggaattgctctcaaaa

SEQ ID NO: 418350 - DNA, 25 bp, Mus musculus
gaacggcttggatttgctctcaaaa

SEQ ID NO: 418351 - DNA, 25 bp, Mus musculus
gaacggctttagactttgagccagg

SEQ ID NO: 418352 - DNA, 25 bp, Mus musculus
gaacggctttagtctttgagccagg

SEQ ID NO: 418353 - DNA, 25 bp, Mus musculus
gaacgggaaactcctcctctaaggc

SEQ ID NO: 418354 - DNA, 25 bp, Mus musculus
gaacgggaaactgctcctctaaggc

SEQ ID NO: 418355 - DNA, 25 bp, Mus musculus
gaacgggaagcaacactatttctgt

SEQ ID NO: 418356 - DNA, 25 bp, Mus musculus
gaacgggaagcatcactatttctgt

SEQ ID NO: 418357 - DNA, 25 bp, Mus musculus
gaacgggaagctcactggcatggcc

SEQ ID NO: 418358 - DNA, 25 bp, Mus musculus
gaacgggaagctgactggcatggcc

SEQ ID NO: 418359 - DNA, 25 bp, Mus musculus
gaacgggacagtcagccattcagat

SEQ ID NO: 418360 - DNA, 25 bp, Mus musculus
gaacgggacagtgagccattcagat

SEQ ID NO: 418361 - DNA, 25 bp, Mus musculus
gaacgggacatcaatatgacctcca

SEQ ID NO: 418362 - DNA, 25 bp, Mus musculus
gaacgggacatctatatgacctcca

SEQ ID NO: 418363 - DNA, 25 bp, Mus musculus
gaacgggagggcatcactgtctatt

SEQ ID NO: 418364 - DNA, 25 bp, Mus musculus
gaacgggagggcttcactgtctatt

SEQ ID NO: 418365 - DNA, 25 bp, Mus musculus
gaacgggattttccaacagaaactg

SEQ ID NO: 418366 - DNA, 25 bp, Mus musculus
gaacgggattttgcaacagaaactg

SEQ ID NO: 418367 - DNA, 25 bp, Mus musculus
gaacgggcaggaatgtcccttgctg

SEQ ID NO: 418368 - DNA, 25 bp, Mus musculus
gaacgggcaggacacaacactaact

SEQ ID NO: 418369 - DNA, 25 bp, Mus musculus
gaacgggcaggagacaacactaact

SEQ ID NO: 418370 - DNA, 25 bp, Mus musculus
gaacgggcaggattgtcccttgctg

SEQ ID NO: 418371 - DNA, 25 bp, Mus musculus
gaacgggctgacactacaaccacat

SEQ ID NO: 418372 - DNA, 25 bp, Mus musculus
gaacgggctgactctacaaccacat

SEQ ID NO: 418373 - DNA, 25 bp, Mus musculus
gaacgggctgtcctaactggcaaga

SEQ ID NO: 418374 - DNA, 25 bp, Mus musculus
gaacgggctgtcgtaactggcaaga

SEQ ID NO: 418375 - DNA, 25 bp, Mus musculus
gaacgggggccacgaatgtgcaatg

SEQ ID NO: 418376 - DNA, 25 bp, Mus musculus
gaacgggggccaggaatgtgcaatg

SEQ ID NO: 418377 - DNA, 25 bp, Mus musculus
gaacgggtaggacttgaccctcttg

SEQ ID NO: 418378 - DNA, 25 bp, Mus musculus
gaacgggtaggagttgaccctcttg

SEQ ID NO: 418379 - DNA, 25 bp, Mus musculus
gaacgggtatttctagtttctcatt

SEQ ID NO: 418380 - DNA, 25 bp, Mus musculus
gaacgggtatttgtagtttctcatt

SEQ ID NO: 418381 - DNA, 25 bp, Mus musculus
gaacgggtgcagagtgatctatttt

SEQ ID NO: 418382 - DNA, 25 bp, Mus musculus
gaacgggtgcagtgtgatctatttt

SEQ ID NO: 418383 - DNA, 25 bp, Mus musculus
gaacgggttccacccatgagctatg

SEQ ID NO: 418384 - DNA, 25 bp, Mus musculus
gaacgggttccagccatgagctatg

SEQ ID NO: 418385 - DNA, 25 bp, Mus musculus
gaacgggtttcaccagacaacccca

SEQ ID NO: 418386 - DNA, 25 bp, Mus musculus
gaacgggtttcagcagacaacccca

SEQ ID NO: 418387 - DNA, 25 bp, Mus musculus
gaacggtaccaaaaggtggcatcca

SEQ ID NO: 418388 - DNA, 25 bp, Mus musculus
gaacggtaccaataggtggcatcca

SEQ ID NO: 418389 - DNA, 25 bp, Mus musculus
gaacggtaccccatgttcacagtgg

SEQ ID NO: 418390 - DNA, 25 bp, Mus musculus
gaacggtaccccttgttcacagtgg

SEQ ID NO: 418391 - DNA, 25 bp, Mus musculus
gaacggtacttgagttagttagctt

SEQ ID NO: 418392 - DNA, 25 bp, Mus musculus
gaacggtacttgtgttagttagctt

SEQ ID NO: 418393 - DNA, 16 bp, Mus musculus
gaacggtagcatcttg

SEQ ID NO: 418394 - DNA, 25 bp, Mus musculus
gaacggtagtgtcgctttcctatat

SEQ ID NO: 418395 - DNA, 25 bp, Mus musculus
gaacggtagtgtggctttcctatat

SEQ ID NO: 418396 - DNA, 25 bp, Mus musculus
gaacggtcaaagctcactccatggt

SEQ ID NO: 418397 - DNA, 25 bp, Mus musculus
gaacggtcaaaggtcactccatggt

SEQ ID NO: 418398 - DNA, 25 bp, Mus musculus
gaacggtcacccagtaaagtgctca

SEQ ID NO: 418399 - DNA, 25 bp, Mus musculus
gaacggtcaccctgtaaagtgctca

SEQ ID NO: 418400 - DNA, 25 bp, Mus musculus
gaacggtcacttaagtaatggtctg

SEQ ID NO: 418401 - DNA, 25 bp, Mus musculus
gaacggtcactttagtaatggtctg

SEQ ID NO: 418402 - DNA, 25 bp, Mus musculus
gaacggtcagtaagctgtccacgga

SEQ ID NO: 418403 - DNA, 25 bp, Mus musculus
gaacggtcagtatgctgtccacgga

SEQ ID NO: 418404 - DNA, 25 bp, Mus musculus
gaacggtccatcctaaggacttgtt

SEQ ID NO: 418405 - DNA, 25 bp, Mus musculus
gaacggtccatcgtaaggacttgtt

SEQ ID NO: 418406 - DNA, 25 bp, Mus musculus
gaacggtccctcacaggagcatagg

SEQ ID NO: 418407 - DNA, 25 bp, Mus musculus
gaacggtccctctcaggagcatagg

SEQ ID NO: 418408 - DNA, 25 bp, Mus musculus
gaacggtccgacaaaagccaccagt

SEQ ID NO: 418409 - DNA, 25 bp, Mus musculus
gaacggtccgactaaagccaccagt

SEQ ID NO: 418410 - DNA, 25 bp, Mus musculus
gaacggtcggtgcttcttatatcag

SEQ ID NO: 418411 - DNA, 25 bp, Mus musculus
gaacggtcggtggttcttatatcag

SEQ ID NO: 418412 - DNA, 25 bp, Mus musculus
gaacggtgcgtaaggctcagacata

SEQ ID NO: 418413 - DNA, 25 bp, Mus musculus
gaacggtgcgtatggctcagacata

SEQ ID NO: 418414 - DNA, 25 bp, Mus musculus
gaacggtgtcatccgcactattttt

SEQ ID NO: 418415 - DNA, 25 bp, Mus musculus
gaacggtgtcatgcgcactattttt

SEQ ID NO: 418416 - DNA, 25 bp, Mus musculus
gaacggtgtttcctcttatctgtcc

SEQ ID NO: 418417 - DNA, 25 bp, Mus musculus
gaacggtgtttcgtcttatctgtcc

SEQ ID NO: 418418 - DNA, 25 bp, Mus musculus
gaacggttccttctgacagaactga

SEQ ID NO: 418419 - DNA, 25 bp, Mus musculus
gaacggttccttgtgacagaactga

SEQ ID NO: 418420 - DNA, 25 bp, Mus musculus
gaacggttggttaccgtctgcttca

SEQ ID NO: 418421 - DNA, 25 bp, Mus musculus
gaacggttggtttccgtctgcttca

SEQ ID NO: 418422 - DNA, 25 bp, Mus musculus
gaacggttgtcgcacttgctagatt

SEQ ID NO: 418423 - DNA, 25 bp, Mus musculus
gaacggttgtcggacttgctagatt

SEQ ID NO: 418424 - DNA, 25 bp, Mus musculus
gaacggtttgatcttgcaactcact

SEQ ID NO: 418425 - DNA, 25 bp, Mus musculus
gaacggtttgatgttgcaactcact

SEQ ID NO: 418426 - DNA, 25 bp, Mus musculus
gaacgtaacatgatcaacattttga

SEQ ID NO: 418427 - DNA, 25 bp, Mus musculus
gaacgtaacatgttcaacattttga

SEQ ID NO: 418428 - DNA, 25 bp, Mus musculus
gaacgtaagacacccagccttgagg

SEQ ID NO: 418429 - DNA, 25 bp, Mus musculus
gaacgtaagacagccagccttgagg

SEQ ID NO: 418430 - DNA, 25 bp, Mus musculus
gaacgtaattaaccagcccctggga

SEQ ID NO: 418431 - DNA, 25 bp, Mus musculus
gaacgtaattaagcagcccctggga

SEQ ID NO: 418432 - DNA, 25 bp, Mus musculus
gaacgtaattacagctctacagcgt

SEQ ID NO: 418433 - DNA, 25 bp, Mus musculus
gaacgtaattactgctctacagcgt

SEQ ID NO: 418434 - DNA, 25 bp, Mus musculus
gaacgtaattcaatgcctgctacat

SEQ ID NO: 418435 - DNA, 25 bp, Mus musculus
gaacgtaattcattgcctgctacat

SEQ ID NO: 418436 - DNA, 25 bp, Mus musculus
gaacgtacaaccactgcactgtaaa

SEQ ID NO: 418437 - DNA, 25 bp, Mus musculus
gaacgtacaacctctgcactgtaaa

SEQ ID NO: 418438 - DNA, 25 bp, Mus musculus
gaacgtacacaacatgcgcaagcta

SEQ ID NO: 418439 - DNA, 25 bp, Mus musculus
gaacgtacacaagatgcgcaagcta

SEQ ID NO: 418440 - DNA, 25 bp, Mus musculus
gaacgtacgtcacttgaggcctcac

SEQ ID NO: 418441 - DNA, 25 bp, Mus musculus
gaacgtacgtcagttgaggcctcac

SEQ ID NO: 418442 - DNA, 25 bp, Mus musculus
gaacgtactgtcagttttttgcttt

SEQ ID NO: 418443 - DNA, 25 bp, Mus musculus
gaacgtactgtctgttttttgcttt

SEQ ID NO: 418444 - DNA, 25 bp, Mus musculus
gaacgtagaagtatcgggtcagact

SEQ ID NO: 418445 - DNA, 25 bp, Mus musculus
gaacgtagaagtttcgggtcagact

SEQ ID NO: 418446 - DNA, 25 bp, Mus musculus
gaacgtagagatctcactccttcaa

SEQ ID NO: 418447 - DNA, 25 bp, Mus musculus
gaacgtagagatgtcactccttcaa

SEQ ID NO: 418448 - DNA, 25 bp, Mus musculus
gaacgtagagccaggtccatatgca

SEQ ID NO: 418449 - DNA, 25 bp, Mus musculus
gaacgtagagcctggtccatatgca

SEQ ID NO: 418450 - DNA, 25 bp, Mus musculus
gaacgtagtagtcggcagttaactg

SEQ ID NO: 418451 - DNA, 25 bp, Mus musculus
gaacgtagtagtgggcagttaactg

SEQ ID NO: 418452 - DNA, 25 bp, Mus musculus
gaacgtagtgtacagaagctgccct

SEQ ID NO: 418453 - DNA, 25 bp, Mus musculus
gaacgtagtgtagagaagctgccct

SEQ ID NO: 418454 - DNA, 25 bp, Mus musculus
gaacgtatctctcagttttcaagat

SEQ ID NO: 418455 - DNA, 25 bp, Mus musculus
gaacgtatctctgagttttcaagat

SEQ ID NO: 418456 - DNA, 25 bp, Mus musculus
gaacgtattggcataccttatacaa

SEQ ID NO: 418457 - DNA, 25 bp, Mus musculus
gaacgtattggcttaccttatacaa

SEQ ID NO: 418458 - DNA, 25 bp, Mus musculus
gaacgtcaaacactgtatgtcctag

SEQ ID NO: 418459 - DNA, 25 bp, Mus musculus
gaacgtcaaacagtgtatgtcctag

SEQ ID NO: 418460 - DNA, 25 bp, Mus musculus
gaacgtcaagtcaaggatccaaagg

SEQ ID NO: 418461 - DNA, 25 bp, Mus musculus
gaacgtcaagtctaggatccaaagg

SEQ ID NO: 418462 - DNA, 25 bp, Mus musculus
gaacgtcaatatacctaccagcggg

SEQ ID NO: 418463 - DNA, 25 bp, Mus musculus
gaacgtcaatattcctaccagcggg

SEQ ID NO: 418464 - DNA, 25 bp, Mus musculus
gaacgtcacagaccccagatcttaa

SEQ ID NO: 418465 - DNA, 25 bp, Mus musculus
gaacgtcacagagcccagatcttaa

SEQ ID NO: 418466 - DNA, 25 bp, Mus musculus
gaacgtcactcaatatcttcttagt

SEQ ID NO: 418467 - DNA, 25 bp, Mus musculus
gaacgtcactcattatcttcttagt

SEQ ID NO: 418468 - DNA, 25 bp, Mus musculus
gaacgtcagcttatcgatcacagat

SEQ ID NO: 418469 - DNA, 25 bp, Mus musculus
gaacgtcagcttttcgatcacagat

SEQ ID NO: 418470 - DNA, 25 bp, Mus musculus
gaacgtcatagtcatctcctgctta

SEQ ID NO: 418471 - DNA, 25 bp, Mus musculus
gaacgtcatagtgatctcctgctta

SEQ ID NO: 418472 - DNA, 25 bp, Mus musculus
gaacgtcatgatccagacaaataca

SEQ ID NO: 418473 - DNA, 25 bp, Mus musculus
gaacgtcatgatgcagacaaataca

SEQ ID NO: 418474 - DNA, 25 bp, Mus musculus
gaacgtccaccaaggcagcgcctgg

SEQ ID NO: 418475 - DNA, 25 bp, Mus musculus
gaacgtccaccatggcagcgcctgg

SEQ ID NO: 418476 - DNA, 25 bp, Mus musculus
gaacgtccatcgaagttacccaaag

SEQ ID NO: 418477 - DNA, 25 bp, Mus musculus
gaacgtccatcgtagttacccaaag

SEQ ID NO: 418478 - DNA, 25 bp, Mus musculus
gaacgtcccctgacctatggttgga

SEQ ID NO: 418479 - DNA, 25 bp, Mus musculus
gaacgtcccctgtcctatggttgga

SEQ ID NO: 418480 - DNA, 25 bp, Mus musculus
gaacgtcccggaaatgtactcttcg

SEQ ID NO: 418481 - DNA, 25 bp, Mus musculus
gaacgtcccggatatgtactcttcg

SEQ ID NO: 418482 - DNA, 25 bp, Mus musculus
gaacgtccgagacaagctgcaagca

SEQ ID NO: 418483 - DNA, 25 bp, Mus musculus
gaacgtccgagagaagctgcaagca

SEQ ID NO: 418484 - DNA, 25 bp, Mus musculus
gaacgtccgattagtgtccgaagcc

SEQ ID NO: 418485 - DNA, 25 bp, Mus musculus
gaacgtccgatttgtgtccgaagcc

SEQ ID NO: 418486 - DNA, 25 bp, Mus musculus
gaacgtccgcagagtgaccagggca

SEQ ID NO: 418487 - DNA, 25 bp, Mus musculus
gaacgtccgcagtgtgaccagggca

SEQ ID NO: 418488 - DNA, 25 bp, Mus musculus
gaacgtctaggaactgaagccccac

SEQ ID NO: 418489 - DNA, 25 bp, Mus musculus
gaacgtctaggatctgaagccccac

SEQ ID NO: 418490 - DNA, 25 bp, Mus musculus
gaacgtctattgacagagtactggc

SEQ ID NO: 418491 - DNA, 25 bp, Mus musculus
gaacgtctattgtcagagtactggc

SEQ ID NO: 418492 - DNA, 25 bp, Mus musculus
gaacgtctctacctcctttgaagag

SEQ ID NO: 418493 - DNA, 25 bp, Mus musculus
gaacgtctctacgtcctttgaagag

SEQ ID NO: 418494 - DNA, 25 bp, Mus musculus
gaacgtctctagacttgagcctagt

SEQ ID NO: 418495 - DNA, 25 bp, Mus musculus
gaacgtctctagtcttgagcctagt

SEQ ID NO: 418496 - DNA, 25 bp, Mus musculus
gaacgtctcttaaactctcaatggt

SEQ ID NO: 418497 - DNA, 25 bp, Mus musculus
gaacgtctcttatactctcaatggt

SEQ ID NO: 418498 - DNA, 25 bp, Mus musculus
gaacgtctgagacttgccaaggcaa

SEQ ID NO: 418499 - DNA, 25 bp, Mus musculus
gaacgtctgagagttgccaaggcaa

SEQ ID NO: 418500 - DNA, 25 bp, Mus musculus
gaacgtcttaatcccagaggtcact

SEQ ID NO: 418501 - DNA, 25 bp, Mus musculus
gaacgtcttaatgccagaggtcact

SEQ ID NO: 418502 - DNA, 25 bp, Mus musculus
gaacgtcttcagaaccgttgagtta

SEQ ID NO: 418503 - DNA, 25 bp, Mus musculus
gaacgtcttcagtaccgttgagtta

SEQ ID NO: 418504 - DNA, 25 bp, Mus musculus
gaacgtcttcatcagtcacacacag

SEQ ID NO: 418505 - DNA, 25 bp, Mus musculus
gaacgtcttcatgagtcacacacag

SEQ ID NO: 418506 - DNA, 25 bp, Mus musculus
gaacgtctttaaccgaatgccaatt

SEQ ID NO: 418507 - DNA, 25 bp, Mus musculus
gaacgtctttaagcgaatgccaatt

SEQ ID NO: 418508 - DNA, 25 bp, Mus musculus
gaacgtgaaatcattgtctgaccaa

SEQ ID NO: 418509 - DNA, 25 bp, Mus musculus
gaacgtgaaatctttgtctgaccaa

SEQ ID NO: 418510 - DNA, 25 bp, Mus musculus
gaacgtgaacctccaatttggaaga

SEQ ID NO: 418511 - DNA, 25 bp, Mus musculus
gaacgtgaacctgcaatttggaaga

SEQ ID NO: 418512 - DNA, 25 bp, Mus musculus
gaacgtgaatccatgcagttgagat

SEQ ID NO: 418513 - DNA, 25 bp, Mus musculus
gaacgtgaatccttgcagttgagat

SEQ ID NO: 418514 - DNA, 25 bp, Mus musculus
gaacgtgaatgaactcttcctggca

SEQ ID NO: 418515 - DNA, 25 bp, Mus musculus
gaacgtgaatgatctcttcctggca

SEQ ID NO: 418516 - DNA, 25 bp, Mus musculus
gaacgtgaccgtatctgtgtgaata

SEQ ID NO: 418517 - DNA, 25 bp, Mus musculus
gaacgtgaccgtttctgtgtgaata

SEQ ID NO: 418518 - DNA, 25 bp, Mus musculus
gaacgtgacctacaagcacagggag

SEQ ID NO: 418519 - DNA, 25 bp, Mus musculus
gaacgtgacctagaagcacagggag

SEQ ID NO: 418520 - DNA, 25 bp, Mus musculus
gaacgtgagaggagccggctaccac

SEQ ID NO: 418521 - DNA, 25 bp, Mus musculus
gaacgtgagaggtgccggctaccac

SEQ ID NO: 418522 - DNA, 25 bp, Mus musculus
gaacgtgagtgaaatcttccggtat

SEQ ID NO: 418523 - DNA, 25 bp, Mus musculus
gaacgtgagtgatatcttccggtat

SEQ ID NO: 418524 - DNA, 25 bp, Mus musculus
gaacgtgattagacatcaccgggaa

SEQ ID NO: 418525 - DNA, 25 bp, Mus musculus
gaacgtgattagtcatcaccgggaa

SEQ ID NO: 418526 - DNA, 25 bp, Mus musculus
gaacgtgattccagactaagctaag

SEQ ID NO: 418527 - DNA, 25 bp, Mus musculus
gaacgtgattcctgactaagctaag

SEQ ID NO: 418528 - DNA, 25 bp, Mus musculus
gaacgtgattgtactgcaaactcag

SEQ ID NO: 418529 - DNA, 25 bp, Mus musculus
gaacgtgattgttctgcaaactcag

SEQ ID NO: 418530 - DNA, 25 bp, Mus musculus
gaacgtgcaacaagctttgtcattt

SEQ ID NO: 418531 - DNA, 25 bp, Mus musculus
gaacgtgcaacatgctttgtcattt

SEQ ID NO: 418532 - DNA, 25 bp, Mus musculus
gaacgtgcacataaaacccgagcgc

SEQ ID NO: 418533 - DNA, 25 bp, Mus musculus
gaacgtgcacattaaacccgagcgc

SEQ ID NO: 418534 - DNA, 25 bp, Mus musculus
gaacgtgcagagctgaatcagtcag

SEQ ID NO: 418535 - DNA, 25 bp, Mus musculus
gaacgtgcagaggtgaatcagtcag

SEQ ID NO: 418536 - DNA, 25 bp, Mus musculus
gaacgtgcattccaataggcttaag

SEQ ID NO: 418537 - DNA, 25 bp, Mus musculus
gaacgtgcattcgaataggcttaag

SEQ ID NO: 418538 - DNA, 25 bp, Mus musculus
gaacgtgccatcatgctgttggaag

SEQ ID NO: 418539 - DNA, 25 bp, Mus musculus
gaacgtgccatcattcaaaaacaag

SEQ ID NO: 418540 - DNA, 25 bp, Mus musculus
gaacgtgccatcttgctgttggaag

SEQ ID NO: 418541 - DNA, 25 bp, Mus musculus
gaacgtgccatctttcaaaaacaag

SEQ ID NO: 418542 - DNA, 25 bp, Mus musculus
gaacgtgcccatcaccttaagggaa

SEQ ID NO: 418543 - DNA, 25 bp, Mus musculus
gaacgtgcccatgaccttaagggaa

SEQ ID NO: 418544 - DNA, 25 bp, Mus musculus
gaacgtgccccaagagacatctgta

SEQ ID NO: 418545 - DNA, 25 bp, Mus musculus
gaacgtgccccatgagacatctgta

SEQ ID NO: 418546 - DNA, 25 bp, Mus musculus
gaacgtgccgcgctctaagcgactc

SEQ ID NO: 418547 - DNA, 25 bp, Mus musculus
gaacgtgccgcggtctaagcgactc

SEQ ID NO: 418548 - DNA, 25 bp, Mus musculus
gaacgtgcctcaaacattggaacct

SEQ ID NO: 418549 - DNA, 25 bp, Mus musculus
gaacgtgcctcatacattggaacct

SEQ ID NO: 418550 - DNA, 25 bp, Mus musculus
gaacgtgcctgcacaattaattgct

SEQ ID NO: 418551 - DNA, 25 bp, Mus musculus
gaacgtgcctgctcaattaattgct

SEQ ID NO: 418552 - DNA, 25 bp, Mus musculus
gaacgtgccttccagcgagctgcag

SEQ ID NO: 418553 - DNA, 25 bp, Mus musculus
gaacgtgccttcgagcgagctgcag

SEQ ID NO: 418554 - DNA, 25 bp, Mus musculus
gaacgtgcgcatccaaagccactgt

SEQ ID NO: 418555 - DNA, 25 bp, Mus musculus
gaacgtgcgcatgcaaagccactgt

SEQ ID NO: 418556 - DNA, 25 bp, Mus musculus
gaacgtgcggcgaataacctcagtc

SEQ ID NO: 418557 - DNA, 25 bp, Mus musculus
gaacgtgcggcgtataacctcagtc

SEQ ID NO: 418558 - DNA, 25 bp, Mus musculus
gaacgtgctgatagaagtgaacccc

SEQ ID NO: 418559 - DNA, 25 bp, Mus musculus
gaacgtgctgattgaagtgaacccc

SEQ ID NO: 418560 - DNA, 25 bp, Mus musculus
gaacgtgctgttatccacatttcac

SEQ ID NO: 418561 - DNA, 25 bp, Mus musculus
gaacgtgctgttttccacatttcac

SEQ ID NO: 418562 - DNA, 25 bp, Mus musculus
gaacgtgcttctatgtaatgaccga

SEQ ID NO: 418563 - DNA, 25 bp, Mus musculus
gaacgtgcttctttgtaatgaccga

SEQ ID NO: 418564 - DNA, 25 bp, Mus musculus
gaacgtgcttttctacttctacttg

SEQ ID NO: 418565 - DNA, 25 bp, Mus musculus
gaacgtgcttttgtacttctacttg

SEQ ID NO: 418566 - DNA, 25 bp, Mus musculus
gaacgtggaagaccttaagcgtaaa

SEQ ID NO: 418567 - DNA, 25 bp, Mus musculus
gaacgtggaagagcttaagcgtaaa

SEQ ID NO: 418568 - DNA, 25 bp, Mus musculus
gaacgtggacagaatagctgcccca

SEQ ID NO: 418569 - DNA, 25 bp, Mus musculus
gaacgtggacagagctgaccggaaa

SEQ ID NO: 418570 - DNA, 25 bp, Mus musculus
gaacgtggacagtatagctgcccca

SEQ ID NO: 418571 - DNA, 25 bp, Mus musculus
gaacgtggacagtgctgaccggaaa

SEQ ID NO: 418572 - DNA, 25 bp, Mus musculus
gaacgtggacataagttttactaca

SEQ ID NO: 418573 - DNA, 25 bp, Mus musculus
gaacgtggacatcattcgagccaag

SEQ ID NO: 418574 - DNA, 25 bp, Mus musculus
gaacgtggacatgattcgagccaag

SEQ ID NO: 418575 - DNA, 25 bp, Mus musculus
gaacgtggacattagttttactaca

SEQ ID NO: 418576 - DNA, 25 bp, Mus musculus
gaacgtggaccaccaggctttctgt

SEQ ID NO: 418577 - DNA, 25 bp, Mus musculus
gaacgtggaccagcaggctttctgt

SEQ ID NO: 418578 - DNA, 25 bp, Mus musculus
gaacgtggacgcagaatgtctcgct

SEQ ID NO: 418579 - DNA, 25 bp, Mus musculus
gaacgtggacgctgaatgtctcgct

SEQ ID NO: 418580 - DNA, 25 bp, Mus musculus
gaacgtggcccaagttttcttggaa

SEQ ID NO: 418581 - DNA, 25 bp, Mus musculus
gaacgtggcccatgttttcttggaa

SEQ ID NO: 418582 - DNA, 25 bp, Mus musculus
gaacgtggctggaaccaacctacta

SEQ ID NO: 418583 - DNA, 25 bp, Mus musculus
gaacgtggctggtaccaacctacta

SEQ ID NO: 418584 - DNA, 25 bp, Mus musculus
gaacgtgggatcacatcaggatatc

SEQ ID NO: 418585 - DNA, 25 bp, Mus musculus
gaacgtgggatctcatcaggatatc

SEQ ID NO: 418586 - DNA, 25 bp, Mus musculus
gaacgtgggcgtctagctgcttctc

SEQ ID NO: 418587 - DNA, 25 bp, Mus musculus
gaacgtgggcgtgtagctgcttctc

SEQ ID NO: 418588 - DNA, 25 bp, Mus musculus
gaacgtgggcttctttcacttccag

SEQ ID NO: 418589 - DNA, 25 bp, Mus musculus
gaacgtgggcttgtttcacttccag

SEQ ID NO: 418590 - DNA, 25 bp, Mus musculus
gaacgtggtgctaagcttgcaagga

SEQ ID NO: 418591 - DNA, 25 bp, Mus musculus
gaacgtggtgcttagcttgcaagga

SEQ ID NO: 418592 - DNA, 25 bp, Mus musculus
gaacgtggttaacgagacggcatcc

SEQ ID NO: 418593 - DNA, 25 bp, Mus musculus
gaacgtggttaaggagacggcatcc

SEQ ID NO: 418594 - DNA, 25 bp, Mus musculus
gaacgtggttcaattacaggtttca

SEQ ID NO: 418595 - DNA, 25 bp, Mus musculus
gaacgtggttcatttacaggtttca

SEQ ID NO: 418596 - DNA, 25 bp, Mus musculus
gaacgtggttgaccgggtatcttca

SEQ ID NO: 418597 - DNA, 25 bp, Mus musculus
gaacgtggttgagcgggtatcttca

SEQ ID NO: 418598 - DNA, 25 bp, Mus musculus
gaacgtgtataaattcacctgacaa

SEQ ID NO: 418599 - DNA, 25 bp, Mus musculus
gaacgtgtataatttcacctgacaa

SEQ ID NO: 418600 - DNA, 25 bp, Mus musculus
gaacgtgtatccacaagtgtcattt

SEQ ID NO: 418601 - DNA, 25 bp, Mus musculus
gaacgtgtatcctcaagtgtcattt

SEQ ID NO: 418602 - DNA, 25 bp, Mus musculus
gaacgtgtcaggaagagctttctaa

SEQ ID NO: 418603 - DNA, 25 bp, Mus musculus
gaacgtgtcaggtagagctttctaa

SEQ ID NO: 418604 - DNA, 25 bp, Mus musculus
gaacgtgtccagactttataactgt

SEQ ID NO: 418605 - DNA, 25 bp, Mus musculus
gaacgtgtccagtctttataactgt

SEQ ID NO: 418606 - DNA, 25 bp, Mus musculus
gaacgtgtctctccttgtaatatca

SEQ ID NO: 418607 - DNA, 25 bp, Mus musculus
gaacgtgtctctctgtgagcatgtg

SEQ ID NO: 418608 - DNA, 25 bp, Mus musculus
gaacgtgtctctgcttgtaatatca

SEQ ID NO: 418609 - DNA, 25 bp, Mus musculus
gaacgtgtctctgtgtgagcatgtg

SEQ ID NO: 418610 - DNA, 25 bp, Mus musculus
gaacgtgtctttctgtggacttgct

SEQ ID NO: 418611 - DNA, 25 bp, Mus musculus
gaacgtgtctttgtgtggacttgct

SEQ ID NO: 418612 - DNA, 25 bp, Mus musculus
gaacgtgtgatccatgccgtgcgct

SEQ ID NO: 418613 - DNA, 25 bp, Mus musculus
gaacgtgtgatcgatgccgtgcgct

SEQ ID NO: 418614 - DNA, 25 bp, Mus musculus
gaacgtgtgcagactgatgcctttg

SEQ ID NO: 418615 - DNA, 25 bp, Mus musculus
gaacgtgtgcagtctgatgcctttg

SEQ ID NO: 418616 - DNA, 25 bp, Mus musculus
gaacgtgttcaaaatggtgtagcat

SEQ ID NO: 418617 - DNA, 25 bp, Mus musculus
gaacgtgttcaatatggtgtagcat

SEQ ID NO: 418618 - DNA, 25 bp, Mus musculus
gaacgtgttcgactctctacaagat

SEQ ID NO: 418619 - DNA, 25 bp, Mus musculus
gaacgtgttcgagtctctacaagat

SEQ ID NO: 418620 - DNA, 25 bp, Mus musculus
gaacgtgttgctactataagggaat

SEQ ID NO: 418621 - DNA, 25 bp, Mus musculus
gaacgtgttgcttctataagggaat

SEQ ID NO: 418622 - DNA, 25 bp, Mus musculus
gaacgttaccggcagcagctggaac

SEQ ID NO: 418623 - DNA, 25 bp, Mus musculus
gaacgttaccgggagcagctggaac

SEQ ID NO: 418624 - DNA, 25 bp, Mus musculus
gaacgttactttaggccagacaact

SEQ ID NO: 418625 - DNA, 25 bp, Mus musculus
gaacgttacttttggccagacaact

SEQ ID NO: 418626 - DNA, 25 bp, Mus musculus
gaacgttatgttaagtgaggtcacc

SEQ ID NO: 418627 - DNA, 25 bp, Mus musculus
gaacgttatgtttagtgaggtcacc

SEQ ID NO: 418628 - DNA, 25 bp, Mus musculus
gaacgttcacgtatccttacagtgt

SEQ ID NO: 418629 - DNA, 25 bp, Mus musculus
gaacgttcacgtttccttacagtgt

SEQ ID NO: 418630 - DNA, 25 bp, Mus musculus
gaacgttcagaacctgttccagacc

SEQ ID NO: 418631 - DNA, 25 bp, Mus musculus
gaacgttcagaagctgttccagacc

SEQ ID NO: 418632 - DNA, 25 bp, Mus musculus
gaacgttcagagatctccgagcatt

SEQ ID NO: 418633 - DNA, 25 bp, Mus musculus
gaacgttcagagttctccgagcatt

SEQ ID NO: 418634 - DNA, 25 bp, Mus musculus
gaacgttccaggatactcttggtag

SEQ ID NO: 418635 - DNA, 25 bp, Mus musculus
gaacgttccaggttactcttggtag

SEQ ID NO: 418636 - DNA, 25 bp, Mus musculus
gaacgttccattcctaacagcctga

SEQ ID NO: 418637 - DNA, 25 bp, Mus musculus
gaacgttccattgctaacagcctga

SEQ ID NO: 418638 - DNA, 25 bp, Mus musculus
gaacgttcccagactccgccgggag

SEQ ID NO: 418639 - DNA, 25 bp, Mus musculus
gaacgttcccagtctccgccgggag

SEQ ID NO: 418640 - DNA, 25 bp, Mus musculus
gaacgttcctcacatatggctgcta

SEQ ID NO: 418641 - DNA, 25 bp, Mus musculus
gaacgttcctcagatatggctgcta

SEQ ID NO: 418642 - DNA, 25 bp, Mus musculus
gaacgttcctctcataaaaagtggg

SEQ ID NO: 418643 - DNA, 25 bp, Mus musculus
gaacgttcctctgataaaaagtggg

SEQ ID NO: 418644 - DNA, 25 bp, Mus musculus
gaacgttcgtggagttgaccagccc

SEQ ID NO: 418645 - DNA, 25 bp, Mus musculus
gaacgttcgtggtgttgaccagccc

SEQ ID NO: 418646 - DNA, 25 bp, Mus musculus
gaacgttctagtccaaatccattgt

SEQ ID NO: 418647 - DNA, 25 bp, Mus musculus
gaacgttctagtgcaaatccattgt

SEQ ID NO: 418648 - DNA, 25 bp, Mus musculus
gaacgttctggacaggatcctctgg

SEQ ID NO: 418649 - DNA, 25 bp, Mus musculus
gaacgttctggagaggatcctctgg

SEQ ID NO: 418650 - DNA, 25 bp, Mus musculus
gaacgttcttatcttggcgtgtctt

SEQ ID NO: 418651 - DNA, 25 bp, Mus musculus
gaacgttcttatgttggcgtgtctt

SEQ ID NO: 418652 - DNA, 25 bp, Mus musculus
gaacgttgaattccagctctattgt

SEQ ID NO: 418653 - DNA, 25 bp, Mus musculus
gaacgttgaattgcagctctattgt

SEQ ID NO: 418654 - DNA, 25 bp, Mus musculus
gaacgttgatggaagcttcgactat

SEQ ID NO: 418655 - DNA, 25 bp, Mus musculus
gaacgttgatggtagcttcgactat

SEQ ID NO: 418656 - DNA, 25 bp, Mus musculus
gaacgttggctactcttctagagga

SEQ ID NO: 418657 - DNA, 25 bp, Mus musculus
gaacgttggctagtcttctagagga

SEQ ID NO: 418658 - DNA, 25 bp, Mus musculus
gaacgttggtataagcttgcatctc

SEQ ID NO: 418659 - DNA, 25 bp, Mus musculus
gaacgttggtattagcttgcatctc

SEQ ID NO: 418660 - DNA, 25 bp, Mus musculus
gaacgttgtcaaatgtttacatttt

SEQ ID NO: 418661 - DNA, 25 bp, Mus musculus
gaacgttgtcaattgtttacatttt

SEQ ID NO: 418662 - DNA, 25 bp, Mus musculus
gaacgtttaaacagctcctctgaag

SEQ ID NO: 418663 - DNA, 25 bp, Mus musculus
gaacgtttaaactgctcctctgaag

SEQ ID NO: 418664 - DNA, 25 bp, Mus musculus
gaacgtttatgtattccttgagtcg

SEQ ID NO: 418665 - DNA, 25 bp, Mus musculus
gaacgtttatgttttccttgagtcg

SEQ ID NO: 418666 - DNA, 25 bp, Mus musculus
gaacgtttcagacttgctagagcat

SEQ ID NO: 418667 - DNA, 25 bp, Mus musculus
gaacgtttcagagttgctagagcat

SEQ ID NO: 418668 - DNA, 25 bp, Mus musculus
gaacgtttccgtaacatggacaaga

SEQ ID NO: 418669 - DNA, 25 bp, Mus musculus
gaacgtttccgttacatggacaaga

SEQ ID NO: 418670 - DNA, 25 bp, Mus musculus
gaacgtttccttctcgttattcgca

SEQ ID NO: 418671 - DNA, 25 bp, Mus musculus
gaacgtttccttgtcgttattcgca

SEQ ID NO: 418672 - DNA, 25 bp, Mus musculus
gaacgtttgattacgcaactacttt

SEQ ID NO: 418673 - DNA, 25 bp, Mus musculus
gaacgtttgatttcgcaactacttt

SEQ ID NO: 418674 - DNA, 25 bp, Mus musculus
gaacgtttgtggatccaaggcctgg

SEQ ID NO: 418675 - DNA, 25 bp, Mus musculus
gaacgtttgtggttccaaggcctgg

SEQ ID NO: 418676 - DNA, 25 bp, Mus musculus
gaacgttttcagagctgggaataca

SEQ ID NO: 418677 - DNA, 25 bp, Mus musculus
gaacgttttcagtgctgggaataca

SEQ ID NO: 418678 - DNA, 25 bp, Mus musculus
gaacgttttgcaaatttgctcttta

SEQ ID NO: 418679 - DNA, 25 bp, Mus musculus
gaacgttttgcatatttgctcttta

SEQ ID NO: 418680 - DNA, 25 bp, Mus musculus
gaacgtttttccatacagattagag

SEQ ID NO: 418681 - DNA, 25 bp, Mus musculus
gaacgtttttccttacagattagag

SEQ ID NO: 418682 - DNA, 25 bp, Mus musculus
gaacgtttttctaagctggtgcagg

SEQ ID NO: 418683 - DNA, 25 bp, Mus musculus
gaacgtttttcttagctggtgcagg

SEQ ID NO: 418684 - DNA, 25 bp, Mus musculus
gaactaaaaatactgcaagcccttc

SEQ ID NO: 418685 - DNA, 25 bp, Mus musculus
gaactaaaaatagtgcaagcccttc

SEQ ID NO: 418686 - DNA, 25 bp, Mus musculus
gaactaaaaatgacacctccagcat

SEQ ID NO: 418687 - DNA, 25 bp, Mus musculus
gaactaaaaatgtcacctccagcat

SEQ ID NO: 418688 - DNA, 25 bp, Mus musculus
gaactaaaactacaactgccatact

SEQ ID NO: 418689 - DNA, 25 bp, Mus musculus
gaactaaaactagaactgccatact

SEQ ID NO: 418690 - DNA, 25 bp, Mus musculus
gaactaaaagctacctagaccaggt

SEQ ID NO: 418691 - DNA, 25 bp, Mus musculus
gaactaaaagcttcctagaccaggt

SEQ ID NO: 418692 - DNA, 25 bp, Mus musculus
gaactaaacccacaacaagtgctct

SEQ ID NO: 418693 - DNA, 25 bp, Mus musculus
gaactaaacccaccaggtaaccgag

SEQ ID NO: 418694 - DNA, 25 bp, Mus musculus
gaactaaacccagaacaagtgctct

SEQ ID NO: 418695 - DNA, 25 bp, Mus musculus
gaactaaacccagcaggtaaccgag

SEQ ID NO: 418696 - DNA, 25 bp, Mus musculus
gaactaaagagcaacgggatccaag

SEQ ID NO: 418697 - DNA, 25 bp, Mus musculus
gaactaaagagctacgggatccaag

SEQ ID NO: 418698 - DNA, 25 bp, Mus musculus
gaactaaatcagagctaactagcat

SEQ ID NO: 418699 - DNA, 25 bp, Mus musculus
gaactaaatcagtgctaactagcat

SEQ ID NO: 418700 - DNA, 25 bp, Mus musculus
gaactaaatctacgtcgtctgcaag

SEQ ID NO: 418701 - DNA, 25 bp, Mus musculus
gaactaaatctaggtcgtctgcaag

SEQ ID NO: 418702 - DNA, 25 bp, Mus musculus
gaactaaatctcacctatctaactc

SEQ ID NO: 418703 - DNA, 25 bp, Mus musculus
gaactaaatctctcctatctaactc

SEQ ID NO: 418704 - DNA, 25 bp, Mus musculus
gaactaaatctgcagctttcatccc

SEQ ID NO: 418705 - DNA, 25 bp, Mus musculus
gaactaaatctggagctttcatccc

SEQ ID NO: 418706 - DNA, 25 bp, Mus musculus
gaactaaatgctcattatacctgta

SEQ ID NO: 418707 - DNA, 25 bp, Mus musculus
gaactaaatgctgattatacctgta

SEQ ID NO: 418708 - DNA, 25 bp, Mus musculus
gaactaaattacaagtcccattggg

SEQ ID NO: 418709 - DNA, 25 bp, Mus musculus
gaactaaattactagtcccattggg

SEQ ID NO: 418710 - DNA, 25 bp, Mus musculus
gaactaaatttgctgttactcaaag

SEQ ID NO: 418711 - DNA, 25 bp, Mus musculus
gaactaaatttggtgttactcaaag

SEQ ID NO: 418712 - DNA, 25 bp, Mus musculus
gaactaacacataccttttctctgt

SEQ ID NO: 418713 - DNA, 25 bp, Mus musculus
gaactaacacattccttttctctgt

SEQ ID NO: 418714 - DNA, 25 bp, Mus musculus
gaactaacagatcaaaccgtgacac

SEQ ID NO: 418715 - DNA, 25 bp, Mus musculus
gaactaacagatgaaaccgtgacac

SEQ ID NO: 418716 - DNA, 25 bp, Mus musculus
gaactaacatccacactctgaaaca

SEQ ID NO: 418717 - DNA, 25 bp, Mus musculus
gaactaacatcctcactctgaaaca

SEQ ID NO: 418718 - DNA, 25 bp, Mus musculus
gaactaacctgccactcgtataaat

SEQ ID NO: 418719 - DNA, 25 bp, Mus musculus
gaactaacctgcgactcgtataaat

SEQ ID NO: 418720 - DNA, 25 bp, Mus musculus
gaactaacgtttcacagcattctct

SEQ ID NO: 418721 - DNA, 25 bp, Mus musculus
gaactaacgtttgacagcattctct

SEQ ID NO: 418722 - DNA, 25 bp, Mus musculus
gaactaactaatctttccaggattc

SEQ ID NO: 418723 - DNA, 25 bp, Mus musculus
gaactaactaatgtttccaggattc

SEQ ID NO: 418724 - DNA, 25 bp, Mus musculus
gaactaactagtagctttataagct

SEQ ID NO: 418725 - DNA, 25 bp, Mus musculus
gaactaactagttgctttataagct

SEQ ID NO: 418726 - DNA, 25 bp, Mus musculus
gaactaactcacattataaaccaag

SEQ ID NO: 418727 - DNA, 25 bp, Mus musculus
gaactaactcactttataaaccaag

SEQ ID NO: 418728 - DNA, 25 bp, Mus musculus
gaactaactcctccaagtggtctct

SEQ ID NO: 418729 - DNA, 25 bp, Mus musculus
gaactaactcctgcaagtggtctct

SEQ ID NO: 418730 - DNA, 25 bp, Mus musculus
gaactaactctgaaggcaggtcaac

SEQ ID NO: 418731 - DNA, 25 bp, Mus musculus
gaactaactctgtaggcaggtcaac

SEQ ID NO: 418732 - DNA, 25 bp, Mus musculus
gaactaactgtacctctggatttca

SEQ ID NO: 418733 - DNA, 25 bp, Mus musculus
gaactaactgtagctctggatttca

SEQ ID NO: 418734 - DNA, 25 bp, Mus musculus
gaactaactgtcctcacatttttaa

SEQ ID NO: 418735 - DNA, 25 bp, Mus musculus
gaactaactgtcgtcacatttttaa

SEQ ID NO: 418736 - DNA, 25 bp, Mus musculus
gaactaactgttaatactggtccat

SEQ ID NO: 418737 - DNA, 25 bp, Mus musculus
gaactaactgttcttggcttttcca

SEQ ID NO: 418738 - DNA, 25 bp, Mus musculus
gaactaactgttgttggcttttcca

SEQ ID NO: 418739 - DNA, 25 bp, Mus musculus
gaactaactgtttatactggtccat

SEQ ID NO: 418740 - DNA, 25 bp, Mus musculus
gaactaacttggattgtcagctata

SEQ ID NO: 418741 - DNA, 25 bp, Mus musculus
gaactaacttggtttgtcagctata

SEQ ID NO: 418742 - DNA, 25 bp, Mus musculus
gaactaactttacaaaggtgcctga

SEQ ID NO: 418743 - DNA, 25 bp, Mus musculus
gaactaactttagaaaggtgcctga

SEQ ID NO: 418744 - DNA, 25 bp, Mus musculus
gaactaagaaaaagctctggactca

SEQ ID NO: 418745 - DNA, 25 bp, Mus musculus
gaactaagaaaatgctctggactca

SEQ ID NO: 418746 - DNA, 25 bp, Mus musculus
gaactaagaccacctgtcactcatt

SEQ ID NO: 418747 - DNA, 25 bp, Mus musculus
gaactaagaccagctgtcactcatt

SEQ ID NO: 418748 - DNA, 25 bp, Mus musculus
gaactaagcaagactctcactgttg

SEQ ID NO: 418749 - DNA, 25 bp, Mus musculus
gaactaagcaagtctctcactgttg

SEQ ID NO: 418750 - DNA, 25 bp, Mus musculus
gaactaagccaaccgtgtacttgac

SEQ ID NO: 418751 - DNA, 25 bp, Mus musculus
gaactaagccaagcgtgtacttgac

SEQ ID NO: 418752 - DNA, 25 bp, Mus musculus
gaactaaggatccactcaggcaagt

SEQ ID NO: 418753 - DNA, 25 bp, Mus musculus
gaactaaggatcgactcaggcaagt

SEQ ID NO: 418754 - DNA, 25 bp, Mus musculus
gaactaagggcaaatcttctttcac

SEQ ID NO: 418755 - DNA, 25 bp, Mus musculus
gaactaagggcatatcttctttcac

SEQ ID NO: 418756 - DNA, 25 bp, Mus musculus
gaactaagtgccattcaccactaag

SEQ ID NO: 418757 - DNA, 25 bp, Mus musculus
gaactaagtgcctttcaccactaag

SEQ ID NO: 418758 - DNA, 25 bp, Mus musculus
gaactaagtgtcagtgtccggcgtc

SEQ ID NO: 418759 - DNA, 25 bp, Mus musculus
gaactaagtgtctgtgtccggcgtc

SEQ ID NO: 418760 - DNA, 25 bp, Mus musculus
gaactaagtgtgaacctatttttgg

SEQ ID NO: 418761 - DNA, 25 bp, Mus musculus
gaactaagtgtgtacctatttttgg

SEQ ID NO: 418762 - DNA, 25 bp, Mus musculus
gaactaagttcaaccaacagtgtct

SEQ ID NO: 418763 - DNA, 25 bp, Mus musculus
gaactaagttcatccaacagtgtct

SEQ ID NO: 418764 - DNA, 25 bp, Mus musculus
gaactaatacatattctccattgaa

SEQ ID NO: 418765 - DNA, 25 bp, Mus musculus
gaactaatacattttctccattgaa

SEQ ID NO: 418766 - DNA, 25 bp, Mus musculus
gaactaatactcagactctggatat

SEQ ID NO: 418767 - DNA, 25 bp, Mus musculus
gaactaatactctgactctggatat

SEQ ID NO: 418768 - DNA, 25 bp, Mus musculus
gaactaatcacaccccggtggtaga

SEQ ID NO: 418769 - DNA, 25 bp, Mus musculus
gaactaatcacagcccggtggtaga

SEQ ID NO: 418770 - DNA, 25 bp, Mus musculus
gaactaatccagacctacacatatg

SEQ ID NO: 418771 - DNA, 25 bp, Mus musculus
gaactaatccagtcctacacatatg

SEQ ID NO: 418772 - DNA, 25 bp, Mus musculus
gaactaatgaccattctgggcgtag

SEQ ID NO: 418773 - DNA, 25 bp, Mus musculus
gaactaatgacctttctgggcgtag

SEQ ID NO: 418774 - DNA, 25 bp, Mus musculus
gaactaatgcccaaacatccaagca

SEQ ID NO: 418775 - DNA, 25 bp, Mus musculus
gaactaatgccctaacatccaagca

SEQ ID NO: 418776 - DNA, 25 bp, Mus musculus
gaactaatgctgatgcttgtgagga

SEQ ID NO: 418777 - DNA, 25 bp, Mus musculus
gaactaatgctgttgcttgtgagga

SEQ ID NO: 418778 - DNA, 25 bp, Mus musculus
gaactaatgtacagcaccagaattg

SEQ ID NO: 418779 - DNA, 25 bp, Mus musculus
gaactaatgtactgcaccagaattg

SEQ ID NO: 418780 - DNA, 25 bp, Mus musculus
gaactaattcatctttgcatcatat

SEQ ID NO: 418781 - DNA, 25 bp, Mus musculus
gaactaattcatgtttgcatcatat

SEQ ID NO: 418782 - DNA, 25 bp, Mus musculus
gaactaatttccatggacacttcct

SEQ ID NO: 418783 - DNA, 25 bp, Mus musculus
gaactaatttccttggacacttcct

SEQ ID NO: 418784 - DNA, 25 bp, Mus musculus
gaactaatttctctaaggtgtcctc

SEQ ID NO: 418785 - DNA, 25 bp, Mus musculus
gaactaatttctgtaaggtgtcctc

SEQ ID NO: 418786 - DNA, 25 bp, Mus musculus
gaactacaaatgcttgcttgtttaa

SEQ ID NO: 418787 - DNA, 25 bp, Mus musculus
gaactacaaatggttgcttgtttaa

SEQ ID NO: 418788 - DNA, 25 bp, Mus musculus
gaactacaacaacttcatctcagct

SEQ ID NO: 418789 - DNA, 25 bp, Mus musculus
gaactacaacaagttcatctcagct

SEQ ID NO: 418790 - DNA, 25 bp, Mus musculus
gaactacaactaaagatgcatacaa

SEQ ID NO: 418791 - DNA, 25 bp, Mus musculus
gaactacaactatagatgcatacaa

SEQ ID NO: 418792 - DNA, 25 bp, Mus musculus
gaactacaagtacgagttgccatat

SEQ ID NO: 418793 - DNA, 25 bp, Mus musculus
gaactacaagtaggagttgccatat

SEQ ID NO: 418794 - DNA, 25 bp, Mus musculus
gaactacacagccaggacggtgata

SEQ ID NO: 418795 - DNA, 25 bp, Mus musculus
gaactacacagcgaggacggtgata

SEQ ID NO: 418796 - DNA, 25 bp, Mus musculus
gaactacacctgaagctccattcct

SEQ ID NO: 418797 - DNA, 25 bp, Mus musculus
gaactacacctgtagctccattcct

SEQ ID NO: 418798 - DNA, 25 bp, Mus musculus
gaactacactgtacattattctgat

SEQ ID NO: 418799 - DNA, 25 bp, Mus musculus
gaactacactgttcattattctgat

SEQ ID NO: 418800 - DNA, 25 bp, Mus musculus
gaactacagatgcacaacagtacca

SEQ ID NO: 418801 - DNA, 25 bp, Mus musculus
gaactacagatggacaacagtacca

SEQ ID NO: 418802 - DNA, 25 bp, Mus musculus
gaactacagcatcaagcgcacggtt

SEQ ID NO: 418803 - DNA, 25 bp, Mus musculus
gaactacagcatcctgaccttggag

SEQ ID NO: 418804 - DNA, 25 bp, Mus musculus
gaactacagcatgaagcgcacggtt

SEQ ID NO: 418805 - DNA, 25 bp, Mus musculus
gaactacagcatgctgaccttggag

SEQ ID NO: 418806 - DNA, 25 bp, Mus musculus
gaactacagccaaatctggaccaga

SEQ ID NO: 418807 - DNA, 25 bp, Mus musculus
gaactacagccatatctggaccaga

SEQ ID NO: 418808 - DNA, 25 bp, Mus musculus
gaactacagctcagatttccaagtg

SEQ ID NO: 418809 - DNA, 25 bp, Mus musculus
gaactacagctctgatttccaagtg

SEQ ID NO: 418810 - DNA, 25 bp, Mus musculus
gaactacaggcccaagattcagtcc

SEQ ID NO: 418811 - DNA, 25 bp, Mus musculus
gaactacaggccgaagattcagtcc

SEQ ID NO: 418812 - DNA, 25 bp, Mus musculus
gaactacagtcccacacaatggtac

SEQ ID NO: 418813 - DNA, 25 bp, Mus musculus
gaactacagtcccacacgatggtac

SEQ ID NO: 418814 - DNA, 25 bp, Mus musculus
gaactacagtccgacacaatggtac

SEQ ID NO: 418815 - DNA, 25 bp, Mus musculus
gaactacagtccgacacgatggtac

SEQ ID NO: 418816 - DNA, 25 bp, Mus musculus
gaactacagtgtaattaagcttcca

SEQ ID NO: 418817 - DNA, 25 bp, Mus musculus
gaactacagtgttattaagcttcca

SEQ ID NO: 418818 - DNA, 25 bp, Mus musculus
gaactacataaaccgctactgtccc

SEQ ID NO: 418819 - DNA, 25 bp, Mus musculus
gaactacataaacggatcctctcta

SEQ ID NO: 418820 - DNA, 25 bp, Mus musculus
gaactacataaagcgctactgtccc

SEQ ID NO: 418821 - DNA, 25 bp, Mus musculus
gaactacataaagggatcctctcta

SEQ ID NO: 418822 - DNA, 25 bp, Mus musculus
gaactacatatccaactctaccacg

SEQ ID NO: 418823 - DNA, 25 bp, Mus musculus
gaactacatatcgaactctaccacg

SEQ ID NO: 418824 - DNA, 25 bp, Mus musculus
gaactacatcaaactccaagccaag

SEQ ID NO: 418825 - DNA, 25 bp, Mus musculus
gaactacatcaatctccaagccaag

SEQ ID NO: 418826 - DNA, 25 bp, Mus musculus
gaactacatcatctccttactgata

SEQ ID NO: 418827 - DNA, 25 bp, Mus musculus
gaactacatcatgtccttactgata

SEQ ID NO: 418828 - DNA, 25 bp, Mus musculus
gaactacatgaaagacagccttcgc

SEQ ID NO: 418829 - DNA, 25 bp, Mus musculus
gaactacatgaatgacagccttcgc

SEQ ID NO: 418830 - DNA, 25 bp, Mus musculus
gaactacatgcactactcttctgag

SEQ ID NO: 418831 - DNA, 25 bp, Mus musculus
gaactacatgcagtactcttctgag

SEQ ID NO: 418832 - DNA, 25 bp, Mus musculus
gaactacattgcaacataaccacgt

SEQ ID NO: 418833 - DNA, 25 bp, Mus musculus
gaactacattgcagctgtggacctc

SEQ ID NO: 418834 - DNA, 25 bp, Mus musculus
gaactacattgctacataaccacgt

SEQ ID NO: 418835 - DNA, 25 bp, Mus musculus
gaactacattgctgctgtggacctc

SEQ ID NO: 418836 - DNA, 25 bp, Mus musculus
gaactacattggacaagcactttat

SEQ ID NO: 418837 - DNA, 25 bp, Mus musculus
gaactacattggcttggtatatcaa

SEQ ID NO: 418838 - DNA, 25 bp, Mus musculus
gaactacattgggttggtatatcaa

SEQ ID NO: 418839 - DNA, 25 bp, Mus musculus
gaactacattggtcaagcactttat

SEQ ID NO: 418840 - DNA, 25 bp, Mus musculus
gaactaccaggccttgctttaaatt

SEQ ID NO: 418841 - DNA, 25 bp, Mus musculus
gaactaccaggcgttgctttaaatt

SEQ ID NO: 418842 - DNA, 25 bp, Mus musculus
gaactaccagggatcctaatggaca

SEQ ID NO: 418843 - DNA, 25 bp, Mus musculus
gaactaccagggttcctaatggaca

SEQ ID NO: 418844 - DNA, 25 bp, Mus musculus
gaactaccagtgagcaagaccacga

SEQ ID NO: 418845 - DNA, 25 bp, Mus musculus
gaactaccagtgtgcaagaccacga

SEQ ID NO: 418846 - DNA, 25 bp, Mus musculus
gaactaccattaaagattaccgaag

SEQ ID NO: 418847 - DNA, 25 bp, Mus musculus
gaactaccattatagattaccgaag

SEQ ID NO: 418848 - DNA, 25 bp, Mus musculus
gaactaccccagagctggtcagaga

SEQ ID NO: 418849 - DNA, 25 bp, Mus musculus
gaactaccccagtgctggtcagaga

SEQ ID NO: 418850 - DNA, 25 bp, Mus musculus
gaactaccgcttcgttcttccttgt

SEQ ID NO: 418851 - DNA, 25 bp, Mus musculus
gaactaccgcttggttcttccttgt

SEQ ID NO: 418852 - DNA, 25 bp, Mus musculus
gaactacctcaacacactttgcagt

SEQ ID NO: 418853 - DNA, 25 bp, Mus musculus
gaactacctcaagacactttgcagt

SEQ ID NO: 418854 - DNA, 25 bp, Mus musculus
gaactacctctgaagtgttgtcctg

SEQ ID NO: 418855 - DNA, 25 bp, Mus musculus
gaactacctctgtagtgttgtcctg

SEQ ID NO: 418856 - DNA, 25 bp, Mus musculus
gaactacctcttcacagcaacgaat

SEQ ID NO: 418857 - DNA, 25 bp, Mus musculus
gaactacctcttgacagcaacgaat

SEQ ID NO: 418858 - DNA, 25 bp, Mus musculus
gaactacctgataagtcggccagag

SEQ ID NO: 418859 - DNA, 25 bp, Mus musculus
gaactacctgattagtcggccagag

SEQ ID NO: 418860 - DNA, 25 bp, Mus musculus
gaactaccttatacagatggcgcgg

SEQ ID NO: 418861 - DNA, 25 bp, Mus musculus
gaactaccttattcagatggcgcgg

SEQ ID NO: 418862 - DNA, 25 bp, Mus musculus
gaactacctttcagaacccgcggag

SEQ ID NO: 418863 - DNA, 25 bp, Mus musculus
gaactacctttctgaacccgcggag

SEQ ID NO: 418864 - DNA, 25 bp, Mus musculus
gaactacgagtactatgcaagccat

SEQ ID NO: 418865 - DNA, 25 bp, Mus musculus
gaactacgagtagtatgcaagccat

SEQ ID NO: 418866 - DNA, 25 bp, Mus musculus
gaactacgtctcaatgtcaaaggca

SEQ ID NO: 418867 - DNA, 25 bp, Mus musculus
gaactacgtctctatgtcaaaggca

SEQ ID NO: 418868 - DNA, 25 bp, Mus musculus
gaactacgtgacacccattgaagac

SEQ ID NO: 418869 - DNA, 25 bp, Mus musculus
gaactacgtgactcccattgaagac

SEQ ID NO: 418870 - DNA, 25 bp, Mus musculus
gaactacgtggcctgatctttctgc

SEQ ID NO: 418871 - DNA, 25 bp, Mus musculus
gaactacgtggcgtgatctttctgc

SEQ ID NO: 418872 - DNA, 25 bp, Mus musculus
gaactactacttagttttatcaaag

SEQ ID NO: 418873 - DNA, 25 bp, Mus musculus
gaactactactttgttttatcaaag

SEQ ID NO: 418874 - DNA, 25 bp, Mus musculus
gaactactagcaacacatagactgg

SEQ ID NO: 418875 - DNA, 25 bp, Mus musculus
gaactactagcatcacatagactgg

SEQ ID NO: 418876 - DNA, 25 bp, Mus musculus
gaactactatagcagtacacactgg

SEQ ID NO: 418877 - DNA, 25 bp, Mus musculus
gaactactataggagtacacactgg

SEQ ID NO: 418878 - DNA, 25 bp, Mus musculus
gaactactattaccttgattgcgaa

SEQ ID NO: 418879 - DNA, 25 bp, Mus musculus
gaactactattagcttgattgcgaa

SEQ ID NO: 418880 - DNA, 25 bp, Mus musculus
gaactactattcaaaaggctcagca

SEQ ID NO: 418881 - DNA, 25 bp, Mus musculus
gaactactattctaaaggctcagca

SEQ ID NO: 418882 - DNA, 25 bp, Mus musculus
gaactactcactcctgacacttggc

SEQ ID NO: 418883 - DNA, 25 bp, Mus musculus
gaactactcactgctgacacttggc

SEQ ID NO: 418884 - DNA, 25 bp, Mus musculus
gaactactgatcactgggagactga

SEQ ID NO: 418885 - DNA, 25 bp, Mus musculus
gaactactgatctctgggagactga

SEQ ID NO: 418886 - DNA, 25 bp, Mus musculus
gaactactgcatacctatgggcgtg

SEQ ID NO: 418887 - DNA, 25 bp, Mus musculus
gaactactgcattcctatgggcgtg

SEQ ID NO: 418888 - DNA, 25 bp, Mus musculus
gaactactggcacgcacagacactt

SEQ ID NO: 418889 - DNA, 25 bp, Mus musculus
gaactactggcaggcacagacactt

SEQ ID NO: 418890 - DNA, 25 bp, Mus musculus
gaactactggcccatgaaagacttt

SEQ ID NO: 418891 - DNA, 25 bp, Mus musculus
gaactactggccgatgaaagacttt

SEQ ID NO: 418892 - DNA, 25 bp, Mus musculus
gaactactgggaactgggcctgact

SEQ ID NO: 418893 - DNA, 25 bp, Mus musculus
gaactactgggatctgggcctgact

SEQ ID NO: 418894 - DNA, 25 bp, Mus musculus
gaactactgggtaggctatcacctg

SEQ ID NO: 418895 - DNA, 25 bp, Mus musculus
gaactactgggtcaaaactcaaatg

SEQ ID NO: 418896 - DNA, 25 bp, Mus musculus
gaactactgggtgaaaactcaaatg

SEQ ID NO: 418897 - DNA, 25 bp, Mus musculus
gaactactgggttggctatcacctg

SEQ ID NO: 418898 - DNA, 25 bp, Mus musculus
gaactactggtaaactctcaaagcc

SEQ ID NO: 418899 - DNA, 25 bp, Mus musculus
gaactactggtatactctcaaagcc

SEQ ID NO: 418900 - DNA, 25 bp, Mus musculus
gaactactgttgatgtgttcccctt

SEQ ID NO: 418901 - DNA, 25 bp, Mus musculus
gaactactgttgttgtgttcccctt

SEQ ID NO: 418902 - DNA, 25 bp, Mus musculus
gaactacttcaaaagccaattggga

SEQ ID NO: 418903 - DNA, 25 bp, Mus musculus
gaactacttcaatagccaattggga

SEQ ID NO: 418904 - DNA, 25 bp, Mus musculus
gaactacttcacatggacacggaga

SEQ ID NO: 418905 - DNA, 25 bp, Mus musculus
gaactacttcacttggacacggaga

SEQ ID NO: 418906 - DNA, 25 bp, Mus musculus
gaactacttccaactttctgagtaa

SEQ ID NO: 418907 - DNA, 25 bp, Mus musculus
gaactacttccatctttctgagtaa

SEQ ID NO: 418908 - DNA, 25 bp, Mus musculus
gaactacttgctccctggcctaaga

SEQ ID NO: 418909 - DNA, 25 bp, Mus musculus
gaactacttgctgcctggcctaaga

SEQ ID NO: 418910 - DNA, 25 bp, Mus musculus
gaactacttgtcactactgaagcca

SEQ ID NO: 418911 - DNA, 25 bp, Mus musculus
gaactacttgtctctactgaagcca

SEQ ID NO: 418912 - DNA, 25 bp, Mus musculus
gaactactttggaagctccaaacgg

SEQ ID NO: 418913 - DNA, 25 bp, Mus musculus
gaactactttggcttatggtgccct

SEQ ID NO: 418914 - DNA, 25 bp, Mus musculus
gaactactttgggttatggtgccct

SEQ ID NO: 418915 - DNA, 25 bp, Mus musculus
gaactactttggtagctccaaacgg

SEQ ID NO: 418916 - DNA, 25 bp, Mus musculus
gaactacttttaaccgagtcaccca

SEQ ID NO: 418917 - DNA, 25 bp, Mus musculus
gaactacttttatccgagtcaccca

SEQ ID NO: 418918 - DNA, 25 bp, Mus musculus
gaactagaaactcgataccttgaga

SEQ ID NO: 418919 - DNA, 25 bp, Mus musculus
gaactagaaactggataccttgaga

SEQ ID NO: 418920 - DNA, 25 bp, Mus musculus
gaactagacaacatgctgttaaaga

SEQ ID NO: 418921 - DNA, 25 bp, Mus musculus
gaactagacaacttgctgttaaaga

SEQ ID NO: 418922 - DNA, 25 bp, Mus musculus
gaactagactaaagcaccgggcggt

SEQ ID NO: 418923 - DNA, 25 bp, Mus musculus
gaactagactaatgcaccgggcggt

SEQ ID NO: 418924 - DNA, 25 bp, Mus musculus
gaactagacttcaggattattataa

SEQ ID NO: 418925 - DNA, 25 bp, Mus musculus
gaactagacttcatggtgctccttg

SEQ ID NO: 418926 - DNA, 25 bp, Mus musculus
gaactagacttctggattattataa

SEQ ID NO: 418927 - DNA, 25 bp, Mus musculus
gaactagacttcttggtgctccttg

SEQ ID NO: 418928 - DNA, 25 bp, Mus musculus
gaactagagagtcatcttatttgct

SEQ ID NO: 418929 - DNA, 25 bp, Mus musculus
gaactagagagtgatcttatttgct

SEQ ID NO: 418930 - DNA, 25 bp, Mus musculus
gaactagaggccagctttggccggc

SEQ ID NO: 418931 - DNA, 25 bp, Mus musculus
gaactagaggcctgctttggccggc

SEQ ID NO: 418932 - DNA, 25 bp, Mus musculus
gaactagattctaagctggcagcag

SEQ ID NO: 418933 - DNA, 25 bp, Mus musculus
gaactagattcttagctggcagcag

SEQ ID NO: 418934 - DNA, 25 bp, Mus musculus
gaactagcacatagggcgacagcct

SEQ ID NO: 418935 - DNA, 25 bp, Mus musculus
gaactagcacattgggcgacagcct

SEQ ID NO: 418936 - DNA, 25 bp, Mus musculus
gaactagccagaaggaatgccctca

SEQ ID NO: 418937 - DNA, 25 bp, Mus musculus
gaactagccagatggaatgccctca

SEQ ID NO: 418938 - DNA, 25 bp, Mus musculus
gaactagctacgcaggcatcaacag

SEQ ID NO: 418939 - DNA, 25 bp, Mus musculus
gaactagctacggaggcatcaacag

SEQ ID NO: 418940 - DNA, 25 bp, Mus musculus
gaactagctaggaccaggtggctgt

SEQ ID NO: 418941 - DNA, 25 bp, Mus musculus
gaactagctaggtccaggtggctgt

SEQ ID NO: 418942 - DNA, 25 bp, Mus musculus
gaactagctgccatatgggtactaa

SEQ ID NO: 418943 - DNA, 25 bp, Mus musculus
gaactagctgccttatgggtactaa

SEQ ID NO: 418944 - DNA, 25 bp, Mus musculus
gaactagctgctctatatgtccttg

SEQ ID NO: 418945 - DNA, 25 bp, Mus musculus
gaactagctgctgtatatgtccttg

SEQ ID NO: 418946 - DNA, 25 bp, Mus musculus
gaactagcttggatgagtccttagg

SEQ ID NO: 418947 - DNA, 25 bp, Mus musculus
gaactagcttggttgagtccttagg

SEQ ID NO: 418948 - DNA, 25 bp, Mus musculus
gaactagctttgctgtataattatc

SEQ ID NO: 418949 - DNA, 25 bp, Mus musculus
gaactagctttggtgtataattatc

SEQ ID NO: 418950 - DNA, 25 bp, Mus musculus
gaactaggaaagcatcctagctggc

SEQ ID NO: 418951 - DNA, 25 bp, Mus musculus
gaactaggaaaggatcctagctggc

SEQ ID NO: 418952 - DNA, 25 bp, Mus musculus
gaactaggccaactggttaaactgt

SEQ ID NO: 418953 - DNA, 25 bp, Mus musculus
gaactaggccaagtggttaaactgt

SEQ ID NO: 418954 - DNA, 25 bp, Mus musculus
gaactaggctgcattgaccgtaaaa

SEQ ID NO: 418955 - DNA, 25 bp, Mus musculus
gaactaggctgctttgaccgtaaaa

SEQ ID NO: 418956 - DNA, 25 bp, Mus musculus
gaactaggtattagcaccagctcat

SEQ ID NO: 418957 - DNA, 25 bp, Mus musculus
gaactaggtatttgcaccagctcat

SEQ ID NO: 418958 - DNA, 25 bp, Mus musculus
gaactaggtcatacttcatattatg

SEQ ID NO: 418959 - DNA, 25 bp, Mus musculus
gaactaggtcattcttcatattatg

SEQ ID NO: 418960 - DNA, 25 bp, Mus musculus
gaactaggtccacggtatccagggc

SEQ ID NO: 418961 - DNA, 25 bp, Mus musculus
gaactaggtccagggtatccagggc

SEQ ID NO: 418962 - DNA, 25 bp, Mus musculus
gaactaggtcttagcaccagagagc

SEQ ID NO: 418963 - DNA, 25 bp, Mus musculus
gaactaggtctttgcaccagagagc

SEQ ID NO: 418964 - DNA, 25 bp, Mus musculus
gaactaggttgaattcttctgcaca

SEQ ID NO: 418965 - DNA, 25 bp, Mus musculus
gaactaggttgatttcttctgcaca

SEQ ID NO: 418966 - DNA, 25 bp, Mus musculus
gaactagtactgaattttgcacctc

SEQ ID NO: 418967 - DNA, 25 bp, Mus musculus
gaactagtactgtattttgcacctc

SEQ ID NO: 418968 - DNA, 25 bp, Mus musculus
gaactagtaggtacaattaattagc

SEQ ID NO: 418969 - DNA, 25 bp, Mus musculus
gaactagtaggttcaattaattagc

SEQ ID NO: 418970 - DNA, 25 bp, Mus musculus
gaactagtagtgagctcatcagaat

SEQ ID NO: 418971 - DNA, 25 bp, Mus musculus
gaactagtagtgtgctcatcagaat

SEQ ID NO: 418972 - DNA, 25 bp, Mus musculus
gaactagtcaaaacagtgagctcca

SEQ ID NO: 418973 - DNA, 25 bp, Mus musculus
gaactagtcaaatcagtgagctcca

SEQ ID NO: 418974 - DNA, 25 bp, Mus musculus
gaactagtcattcgtggcacacgcc

SEQ ID NO: 418975 - DNA, 25 bp, Mus musculus
gaactagtcattggtggcacacgcc

SEQ ID NO: 418976 - DNA, 25 bp, Mus musculus
gaactagttgacacccatttctagg

SEQ ID NO: 418977 - DNA, 25 bp, Mus musculus
gaactagttgactcccatttctagg

SEQ ID NO: 418978 - DNA, 25 bp, Mus musculus
gaactagttgccaatgtactgtcct

SEQ ID NO: 418979 - DNA, 25 bp, Mus musculus
gaactagttgcctatgtactgtcct

SEQ ID NO: 418980 - DNA, 25 bp, Mus musculus
gaactagtttcccttatgggacaat

SEQ ID NO: 418981 - DNA, 25 bp, Mus musculus
gaactagtttccgttatgggacaat

SEQ ID NO: 418982 - DNA, 25 bp, Mus musculus
gaactagttttcatgactcccaatc

SEQ ID NO: 418983 - DNA, 25 bp, Mus musculus
gaactagttttcttgactcccaatc

SEQ ID NO: 418984 - DNA, 25 bp, Mus musculus
gaactataacttatgcttgatgatc

SEQ ID NO: 418985 - DNA, 25 bp, Mus musculus
gaactataacttttgcttgatgatc

SEQ ID NO: 418986 - DNA, 25 bp, Mus musculus
gaactataatttccccatgaagaaa

SEQ ID NO: 418987 - DNA, 25 bp, Mus musculus
gaactataatttgcccatgaagaaa

SEQ ID NO: 418988 - DNA, 25 bp, Mus musculus
gaactatacagaccaaccatgtctt

SEQ ID NO: 418989 - DNA, 25 bp, Mus musculus
gaactatacagagcaaccatgtctt

SEQ ID NO: 418990 - DNA, 25 bp, Mus musculus
gaactatacccgataatcgcatcta

SEQ ID NO: 418991 - DNA, 25 bp, Mus musculus
gaactatacccgttaatcgcatcta

SEQ ID NO: 418992 - DNA, 25 bp, Mus musculus
gaactatactctccatattggtgga

SEQ ID NO: 418993 - DNA, 25 bp, Mus musculus
gaactatactctgcatattggtgga

SEQ ID NO: 418994 - DNA, 25 bp, Mus musculus
gaactatagatcaccctattcctgc

SEQ ID NO: 418995 - DNA, 25 bp, Mus musculus
gaactatagatctccctattcctgc

SEQ ID NO: 418996 - DNA, 25 bp, Mus musculus
gaactatagtggctatggcggctat

SEQ ID NO: 418997 - DNA, 25 bp, Mus musculus
gaactatagtgggtatggcggctat

SEQ ID NO: 418998 - DNA, 25 bp, Mus musculus
gaactatagtttatactggtatcac

SEQ ID NO: 418999 - DNA, 25 bp, Mus musculus
gaactatagtttttactggtatcac

SEQ ID NO: 419000 - DNA, 25 bp, Mus musculus
gaactatatccacgtgacaccgcag

SEQ ID NO: 419001 - DNA, 25 bp, Mus musculus
gaactatatccaggtgacaccgcag

SEQ ID NO: 419002 - DNA, 25 bp, Mus musculus
gaactatatcccaagtcctgaggaa

SEQ ID NO: 419003 - DNA, 25 bp, Mus musculus
gaactatatccctagtcctgaggaa

SEQ ID NO: 419004 - DNA, 25 bp, Mus musculus
gaactatatggactcttcatttcat

SEQ ID NO: 419005 - DNA, 25 bp, Mus musculus
gaactatatggagtcttcatttcat

SEQ ID NO: 419006 - DNA, 25 bp, Mus musculus
gaactatattataggctgtgtgtgt

SEQ ID NO: 419007 - DNA, 25 bp, Mus musculus
gaactatattattggctgtgtgtgt

SEQ ID NO: 419008 - DNA, 25 bp, Mus musculus
gaactatcactgcatatatgaacca

SEQ ID NO: 419009 - DNA, 25 bp, Mus musculus
gaactatcactggatatatgaacca

SEQ ID NO: 419010 - DNA, 25 bp, Mus musculus
gaactatcattcacaattctaaagg

SEQ ID NO: 419011 - DNA, 25 bp, Mus musculus
gaactatcattctcaattctaaagg

SEQ ID NO: 419012 - DNA, 25 bp, Mus musculus
gaactatccataagacaatctgtct

SEQ ID NO: 419013 - DNA, 25 bp, Mus musculus
gaactatccatatgacaatctgtct

SEQ ID NO: 419014 - DNA, 25 bp, Mus musculus
gaactatcgatgacgtggaccttga

SEQ ID NO: 419015 - DNA, 25 bp, Mus musculus
gaactatcgatgtcgtggaccttga

SEQ ID NO: 419016 - DNA, 25 bp, Mus musculus
gaactatcggtgacagtcattgtga

SEQ ID NO: 419017 - DNA, 25 bp, Mus musculus
gaactatcggtgtcagtcattgtga

SEQ ID NO: 419018 - DNA, 25 bp, Mus musculus
gaactatcgtctaacaagagtctgg

SEQ ID NO: 419019 - DNA, 25 bp, Mus musculus
gaactatcgtcttacaagagtctgg

SEQ ID NO: 419020 - DNA, 25 bp, Mus musculus
gaactatctacaagattttctcaag

SEQ ID NO: 419021 - DNA, 25 bp, Mus musculus
gaactatctacatgattttctcaag

SEQ ID NO: 419022 - DNA, 25 bp, Mus musculus
gaactatctagaatagccttcccat

SEQ ID NO: 419023 - DNA, 25 bp, Mus musculus
gaactatctagattagccttcccat

SEQ ID NO: 419024 - DNA, 25 bp, Mus musculus
gaactatctgacatcttcagacttg

SEQ ID NO: 419025 - DNA, 25 bp, Mus musculus
gaactatctgacttcttcagacttg

SEQ ID NO: 419026 - DNA, 25 bp, Mus musculus
gaactatctttacttggtagattct

SEQ ID NO: 419027 - DNA, 25 bp, Mus musculus
gaactatctttagttggtagattct

SEQ ID NO: 419028 - DNA, 25 bp, Mus musculus
gaactatgaaggctcttggcattcc

SEQ ID NO: 419029 - DNA, 25 bp, Mus musculus
gaactatgaagggtcttggcattcc

SEQ ID NO: 419030 - DNA, 25 bp, Mus musculus
gaactatgacctcactggtagctac

SEQ ID NO: 419031 - DNA, 25 bp, Mus musculus
gaactatgacctgactggtagctac

SEQ ID NO: 419032 - DNA, 25 bp, Mus musculus
gaactatgactcagaacctgtgccc

SEQ ID NO: 419033 - DNA, 25 bp, Mus musculus
gaactatgactctgaacctgtgccc

SEQ ID NO: 419034 - DNA, 25 bp, Mus musculus
gaactatgcaatctttaagcctcaa

SEQ ID NO: 419035 - DNA, 25 bp, Mus musculus
gaactatgcaatgtttaagcctcaa

SEQ ID NO: 419036 - DNA, 25 bp, Mus musculus
gaactatgccatctagatgccctgt

SEQ ID NO: 419037 - DNA, 25 bp, Mus musculus
gaactatgccatgtagatgccctgt

SEQ ID NO: 419038 - DNA, 25 bp, Mus musculus
gaactatgctgccaatctgcagagc

SEQ ID NO: 419039 - DNA, 25 bp, Mus musculus
gaactatgctgcgaatctgcagagc

SEQ ID NO: 419040 - DNA, 25 bp, Mus musculus
gaactatggctccttcggacatctt

SEQ ID NO: 419041 - DNA, 25 bp, Mus musculus
gaactatggctcgttcggacatctt

SEQ ID NO: 419042 - DNA, 25 bp, Mus musculus
gaactatgggtccacatcagggtaa

SEQ ID NO: 419043 - DNA, 25 bp, Mus musculus
gaactatgggtcgacatcagggtaa

SEQ ID NO: 419044 - DNA, 25 bp, Mus musculus
gaactatgtagtaagagcttgtctc

SEQ ID NO: 419045 - DNA, 25 bp, Mus musculus
gaactatgtagttagagcttgtctc

SEQ ID NO: 419046 - DNA, 25 bp, Mus musculus
gaactatgtataaggtggccgtttc

SEQ ID NO: 419047 - DNA, 25 bp, Mus musculus
gaactatgtatatggtggccgtttc

SEQ ID NO: 419048 - DNA, 25 bp, Mus musculus
gaactatgtatgcagtgaggtcatt

SEQ ID NO: 419049 - DNA, 25 bp, Mus musculus
gaactatgtatggagtgaggtcatt

SEQ ID NO: 419050 - DNA, 25 bp, Mus musculus
gaactatgtttgagaattttccgta

SEQ ID NO: 419051 - DNA, 25 bp, Mus musculus
gaactatgtttgtgaattttccgta

SEQ ID NO: 419052 - DNA, 25 bp, Mus musculus
gaactattacctatttagctgcaca

SEQ ID NO: 419053 - DNA, 25 bp, Mus musculus
gaactattacctttttagctgcaca

SEQ ID NO: 419054 - DNA, 25 bp, Mus musculus
gaactattagctaggcctgagtaaa

SEQ ID NO: 419055 - DNA, 25 bp, Mus musculus
gaactattagcttggcctgagtaaa

SEQ ID NO: 419056 - DNA, 25 bp, Mus musculus
gaactattatttctgttaggcctga

SEQ ID NO: 419057 - DNA, 25 bp, Mus musculus
gaactattatttgtgttaggcctga

SEQ ID NO: 419058 - DNA, 25 bp, Mus musculus
gaactattcactcgctgaactggat

SEQ ID NO: 419059 - DNA, 25 bp, Mus musculus
gaactattcactggctgaactggat

SEQ ID NO: 419060 - DNA, 25 bp, Mus musculus
gaactattccttagcagtgcctaga

SEQ ID NO: 419061 - DNA, 25 bp, Mus musculus
gaactattcctttgcagtgcctaga

SEQ ID NO: 419062 - DNA, 25 bp, Mus musculus
gaactattcgtgatgctgagctaaa

SEQ ID NO: 419063 - DNA, 25 bp, Mus musculus
gaactattcgtgttgctgagctaaa

SEQ ID NO: 419064 - DNA, 25 bp, Mus musculus
gaactattctgtacctactggcttt

SEQ ID NO: 419065 - DNA, 25 bp, Mus musculus
gaactattctgtatgtttccataaa

SEQ ID NO: 419066 - DNA, 25 bp, Mus musculus
gaactattctgttcctactggcttt

SEQ ID NO: 419067 - DNA, 25 bp, Mus musculus
gaactattctgtttgtttccataaa

SEQ ID NO: 419068 - DNA, 25 bp, Mus musculus
gaactattgagactcgtccaccatt

SEQ ID NO: 419069 - DNA, 25 bp, Mus musculus
gaactattgagagtcgtccaccatt

SEQ ID NO: 419070 - DNA, 25 bp, Mus musculus
gaactattgctgaaccccccatatc

SEQ ID NO: 419071 - DNA, 25 bp, Mus musculus
gaactattgctgtaccccccatatc

SEQ ID NO: 419072 - DNA, 25 bp, Mus musculus
gaactattgtctatgtcacagccta

SEQ ID NO: 419073 - DNA, 25 bp, Mus musculus
gaactattgtctttgtcacagccta

SEQ ID NO: 419074 - DNA, 25 bp, Mus musculus
gaactattgtgtctgggtgtgcctt

SEQ ID NO: 419075 - DNA, 25 bp, Mus musculus
gaactattgtgtgtgggtgtgcctt

SEQ ID NO: 419076 - DNA, 25 bp, Mus musculus
gaactatttattcctattcacagaa

SEQ ID NO: 419077 - DNA, 25 bp, Mus musculus
gaactatttattgctattcacagaa

SEQ ID NO: 419078 - DNA, 25 bp, Mus musculus
gaactatttgaaccacctgacatga

SEQ ID NO: 419079 - DNA, 25 bp, Mus musculus
gaactatttgaagcacctgacatga

SEQ ID NO: 419080 - DNA, 25 bp, Mus musculus
gaactattttggcttcaacctcaca

SEQ ID NO: 419081 - DNA, 25 bp, Mus musculus
gaactattttgggttcaacctcaca

SEQ ID NO: 419082 - DNA, 25 bp, Mus musculus
gaactcaaaacaaacctcgggacgt

SEQ ID NO: 419083 - DNA, 25 bp, Mus musculus
gaactcaaaacatacctcgggacgt

SEQ ID NO: 419084 - DNA, 25 bp, Mus musculus
gaactcaaaactcttccacattctt

SEQ ID NO: 419085 - DNA, 25 bp, Mus musculus
gaactcaaaactgttccacattctt

SEQ ID NO: 419086 - DNA, 25 bp, Mus musculus
gaactcaaacctcggactgtagaga

SEQ ID NO: 419087 - DNA, 25 bp, Mus musculus
gaactcaaacctgggactgtagaga

SEQ ID NO: 419088 - DNA, 25 bp, Mus musculus
gaactcaaactgctccttagaatca

SEQ ID NO: 419089 - DNA, 25 bp, Mus musculus
gaactcaaactggtccttagaatca

SEQ ID NO: 419090 - DNA, 25 bp, Mus musculus
gaactcaaaggacgctgtgtgattt

SEQ ID NO: 419091 - DNA, 25 bp, Mus musculus
gaactcaaaggaggctgtgtgattt

SEQ ID NO: 419092 - DNA, 25 bp, Mus musculus
gaactcaaatatcatttcaagaggg

SEQ ID NO: 419093 - DNA, 25 bp, Mus musculus
gaactcaaatatgatttcaagaggg

SEQ ID NO: 419094 - DNA, 25 bp, Mus musculus
gaactcaaatccacatgcttgtaca

SEQ ID NO: 419095 - DNA, 25 bp, Mus musculus
gaactcaaatcctcatgcttgtaca

SEQ ID NO: 419096 - DNA, 25 bp, Mus musculus
gaactcaaattcatcctgcgcgaat

SEQ ID NO: 419097 - DNA, 25 bp, Mus musculus
gaactcaaattcttcctgcgcgaat

SEQ ID NO: 419098 - DNA, 25 bp, Mus musculus
gaactcaacctaaatacagctgtgc

SEQ ID NO: 419099 - DNA, 25 bp, Mus musculus
gaactcaacctatatacagctgtgc

SEQ ID NO: 419100 - DNA, 25 bp, Mus musculus
gaactcaacgaaatccactcaggcc

SEQ ID NO: 419101 - DNA, 25 bp, Mus musculus
gaactcaacgaattccactcaggcc

SEQ ID NO: 419102 - DNA, 25 bp, Mus musculus
gaactcaactcaaggtggctaggga

SEQ ID NO: 419103 - DNA, 25 bp, Mus musculus
gaactcaactcatggtggctaggga

SEQ ID NO: 419104 - DNA, 25 bp, Mus musculus
gaactcaactccatttctgagggtg

SEQ ID NO: 419105 - DNA, 25 bp, Mus musculus
gaactcaactccttttctgagggtg

SEQ ID NO: 419106 - DNA, 25 bp, Mus musculus
gaactcaagatcaccttgtcctagt

SEQ ID NO: 419107 - DNA, 25 bp, Mus musculus
gaactcaagatctccttgtcctagt

SEQ ID NO: 419108 - DNA, 25 bp, Mus musculus
gaactcaagcctacatcagaagagt

SEQ ID NO: 419109 - DNA, 25 bp, Mus musculus
gaactcaagccttcatcagaagagt

SEQ ID NO: 419110 - DNA, 25 bp, Mus musculus
gaactcaagtcacctctcaacaaga

SEQ ID NO: 419111 - DNA, 25 bp, Mus musculus
gaactcaagtcagctctcaacaaga

SEQ ID NO: 419112 - DNA, 25 bp, Mus musculus
gaactcaagttaactgccaggtaga

SEQ ID NO: 419113 - DNA, 25 bp, Mus musculus
gaactcaagttatctgccaggtaga

SEQ ID NO: 419114 - DNA, 25 bp, Mus musculus
gaactcaagtttcccgttatcttcc

SEQ ID NO: 419115 - DNA, 25 bp, Mus musculus
gaactcaagtttgccgttatcttcc

SEQ ID NO: 419116 - DNA, 25 bp, Mus musculus
gaactcaatcataagcagtgatcat

SEQ ID NO: 419117 - DNA, 25 bp, Mus musculus
gaactcaatcattagcagtgatcat

SEQ ID NO: 419118 - DNA, 25 bp, Mus musculus
gaactcaatccaccatttgtagcag

SEQ ID NO: 419119 - DNA, 25 bp, Mus musculus
gaactcaatccagcatttgtagcag

SEQ ID NO: 419120 - DNA, 25 bp, Mus musculus
gaactcaatggaaggcgtgcccaat

SEQ ID NO: 419121 - DNA, 25 bp, Mus musculus
gaactcaatggatggcgtgcccaat

SEQ ID NO: 419122 - DNA, 25 bp, Mus musculus
gaactcaatgttatcctgggctcat

SEQ ID NO: 419123 - DNA, 25 bp, Mus musculus
gaactcaatgttttcctgggctcat

SEQ ID NO: 419124 - DNA, 25 bp, Mus musculus
gaactcaattctagcactacatggt

SEQ ID NO: 419125 - DNA, 25 bp, Mus musculus
gaactcaattctagttttgccccta

SEQ ID NO: 419126 - DNA, 25 bp, Mus musculus
gaactcaattcttgcactacatggt

SEQ ID NO: 419127 - DNA, 25 bp, Mus musculus
gaactcaattcttgttttgccccta

SEQ ID NO: 419128 - DNA, 25 bp, Mus musculus
gaactcacaaatccacagactcaca

SEQ ID NO: 419129 - DNA, 25 bp, Mus musculus
gaactcacaaatgcacagactcaca

SEQ ID NO: 419130 - DNA, 25 bp, Mus musculus
gaactcacaacactgcttatttcta

SEQ ID NO: 419131 - DNA, 25 bp, Mus musculus
gaactcacaacagtgcttatttcta

SEQ ID NO: 419132 - DNA, 25 bp, Mus musculus
gaactcacaaccagatccaaatacc

SEQ ID NO: 419133 - DNA, 25 bp, Mus musculus
gaactcacaacctgatccaaatacc

SEQ ID NO: 419134 - DNA, 25 bp, Mus musculus
gaactcacagaaaatacttcccgtg

SEQ ID NO: 419135 - DNA, 25 bp, Mus musculus
gaactcacagaatatacttcccgtg

SEQ ID NO: 419136 - DNA, 25 bp, Mus musculus
gaactcacagagcaacttcacaact

SEQ ID NO: 419137 - DNA, 25 bp, Mus musculus
gaactcacagaggaacttcacaact

SEQ ID NO: 419138 - DNA, 25 bp, Mus musculus
gaactcacagtaactatgacttttt

SEQ ID NO: 419139 - DNA, 25 bp, Mus musculus
gaactcacagtacgaacgcggcctt

SEQ ID NO: 419140 - DNA, 25 bp, Mus musculus
gaactcacagtaggaacgcggcctt

SEQ ID NO: 419141 - DNA, 25 bp, Mus musculus
gaactcacagtatctatgacttttt

SEQ ID NO: 419142 - DNA, 25 bp, Mus musculus
gaactcacagtcctcctgagagcct

SEQ ID NO: 419143 - DNA, 25 bp, Mus musculus
gaactcacagtcgtcctgagagcct

SEQ ID NO: 419144 - DNA, 25 bp, Mus musculus
gaactcacagtgattgctttcatat

SEQ ID NO: 419145 - DNA, 25 bp, Mus musculus
gaactcacagtgtttgctttcatat

SEQ ID NO: 419146 - DNA, 25 bp, Mus musculus
gaactcacatgcaagttgtatgcac

SEQ ID NO: 419147 - DNA, 25 bp, Mus musculus
gaactcacatgctagttgtatgcac

SEQ ID NO: 419148 - DNA, 25 bp, Mus musculus
gaactcacattaattaccacacaca

SEQ ID NO: 419149 - DNA, 25 bp, Mus musculus
gaactcacattatttaccacacaca

SEQ ID NO: 419150 - DNA, 25 bp, Mus musculus
gaactcacattcacagccagggtat

SEQ ID NO: 419151 - DNA, 25 bp, Mus musculus
gaactcacattctcagccagggtat

SEQ ID NO: 419152 - DNA, 25 bp, Mus musculus
gaactcaccaagactcacctggttt

SEQ ID NO: 419153 - DNA, 25 bp, Mus musculus
gaactcaccaagtctcacctggttt

SEQ ID NO: 419154 - DNA, 25 bp, Mus musculus
gaactcaccctgaggcataggctgg

SEQ ID NO: 419155 - DNA, 25 bp, Mus musculus
gaactcaccctgtggcataggctgg

SEQ ID NO: 419156 - DNA, 25 bp, Mus musculus
gaactcaccgttacagtggtagggt

SEQ ID NO: 419157 - DNA, 25 bp, Mus musculus
gaactcaccgtttcagtggtagggt

SEQ ID NO: 419158 - DNA, 25 bp, Mus musculus
gaactcacgggtattctacacaagg

SEQ ID NO: 419159 - DNA, 25 bp, Mus musculus
gaactcacgggttttctacacaagg

SEQ ID NO: 419160 - DNA, 25 bp, Mus musculus
gaactcacgtgcagtgggattcgct

SEQ ID NO: 419161 - DNA, 25 bp, Mus musculus
gaactcacgtgctgtgggattcgct

SEQ ID NO: 419162 - DNA, 25 bp, Mus musculus
gaactcactactacagagcagccaa

SEQ ID NO: 419163 - DNA, 25 bp, Mus musculus
gaactcactacttcagagcagccaa

SEQ ID NO: 419164 - DNA, 25 bp, Mus musculus
gaactcactatacatgtggccatgg

SEQ ID NO: 419165 - DNA, 25 bp, Mus musculus
gaactcactatagatgtggccatgg

SEQ ID NO: 419166 - DNA, 25 bp, Mus musculus
gaactcactatcaaccagggcattg

SEQ ID NO: 419167 - DNA, 25 bp, Mus musculus
gaactcactatctaccagggcattg

SEQ ID NO: 419168 - DNA, 25 bp, Mus musculus
gaactcactcaacctgtaagactaa

SEQ ID NO: 419169 - DNA, 25 bp, Mus musculus
gaactcactcaagctgtaagactaa

SEQ ID NO: 419170 - DNA, 25 bp, Mus musculus
gaactcactccacagcttcctgaaa

SEQ ID NO: 419171 - DNA, 25 bp, Mus musculus
gaactcactccagagcttcctgaaa

SEQ ID NO: 419172 - DNA, 25 bp, Mus musculus
gaactcactctaactagatcacgct

SEQ ID NO: 419173 - DNA, 25 bp, Mus musculus
gaactcactctatctagatcacgct

SEQ ID NO: 419174 - DNA, 25 bp, Mus musculus
gaactcactctcctagtgtttttaa

SEQ ID NO: 419175 - DNA, 25 bp, Mus musculus
gaactcactctcgtagtgtttttaa

SEQ ID NO: 419176 - DNA, 25 bp, Mus musculus
gaactcactggtattttcgaagtct

SEQ ID NO: 419177 - DNA, 25 bp, Mus musculus
gaactcactggttttttcgaagtct

SEQ ID NO: 419178 - DNA, 25 bp, Mus musculus
gaactcactgtgaactagaggatga

SEQ ID NO: 419179 - DNA, 25 bp, Mus musculus
gaactcactgtgcatagacacgtct

SEQ ID NO: 419180 - DNA, 25 bp, Mus musculus
gaactcactgtggatagacacgtct

SEQ ID NO: 419181 - DNA, 25 bp, Mus musculus
gaactcactgtgtactagaggatga

SEQ ID NO: 419182 - DNA, 25 bp, Mus musculus
gaactcacttaaagctcaatataat

SEQ ID NO: 419183 - DNA, 25 bp, Mus musculus
gaactcacttaatgctcaatataat

SEQ ID NO: 419184 - DNA, 25 bp, Mus musculus
gaactcacttgaagggaccctgcag

SEQ ID NO: 419185 - DNA, 25 bp, Mus musculus
gaactcacttgatgggaccctgcag

SEQ ID NO: 419186 - DNA, 25 bp, Mus musculus
gaactcacttggcactacaactacg

SEQ ID NO: 419187 - DNA, 25 bp, Mus musculus
gaactcacttgggactacaactacg

SEQ ID NO: 419188 - DNA, 25 bp, Mus musculus
gaactcacttgtcgcagaggctgtt

SEQ ID NO: 419189 - DNA, 25 bp, Mus musculus
gaactcacttgtggcagaggctgtt

SEQ ID NO: 419190 - DNA, 25 bp, Mus musculus
gaactcactttgacccaatgggcat

SEQ ID NO: 419191 - DNA, 25 bp, Mus musculus
gaactcactttgtcccaatgggcat

SEQ ID NO: 419192 - DNA, 25 bp, Mus musculus
gaactcagaattactctggccagga

SEQ ID NO: 419193 - DNA, 25 bp, Mus musculus
gaactcagaatttctctggccagga

SEQ ID NO: 419194 - DNA, 25 bp, Mus musculus
gaactcagacatacctatactcttc

SEQ ID NO: 419195 - DNA, 25 bp, Mus musculus
gaactcagacattcctatactcttc

SEQ ID NO: 419196 - DNA, 25 bp, Mus musculus
gaactcagacccatatatatcccaa

SEQ ID NO: 419197 - DNA, 25 bp, Mus musculus
gaactcagacccttatatatcccaa

SEQ ID NO: 419198 - DNA, 25 bp, Mus musculus
gaactcagagaacgccttgtggaga

SEQ ID NO: 419199 - DNA, 25 bp, Mus musculus
gaactcagagaaggccttgtggaga

SEQ ID NO: 419200 - DNA, 25 bp, Mus musculus
gaactcagagacaaagctgccctcc

SEQ ID NO: 419201 - DNA, 25 bp, Mus musculus
gaactcagagactaagctgccctcc

SEQ ID NO: 419202 - DNA, 25 bp, Mus musculus
gaactcagagccagcaatattttat

SEQ ID NO: 419203 - DNA, 25 bp, Mus musculus
gaactcagagcctgcaatattttat

SEQ ID NO: 419204 - DNA, 25 bp, Mus musculus
gaactcagaggacagactgcccact

SEQ ID NO: 419205 - DNA, 25 bp, Mus musculus
gaactcagaggagagactgcccact

SEQ ID NO: 419206 - DNA, 25 bp, Mus musculus
gaactcagatctcctccttctctga

SEQ ID NO: 419207 - DNA, 25 bp, Mus musculus
gaactcagatctgctccttctctga

SEQ ID NO: 419208 - DNA, 25 bp, Mus musculus
gaactcagatgaacaaacttgacag

SEQ ID NO: 419209 - DNA, 25 bp, Mus musculus
gaactcagatgatcaaacttgacag

SEQ ID NO: 419210 - DNA, 25 bp, Mus musculus
gaactcagatgtagaactatacccg

SEQ ID NO: 419211 - DNA, 25 bp, Mus musculus
gaactcagatgtagatcccgacctc

SEQ ID NO: 419212 - DNA, 25 bp, Mus musculus
gaactcagatgttgaactatacccg

SEQ ID NO: 419213 - DNA, 25 bp, Mus musculus
gaactcagatgttgatcccgacctc

SEQ ID NO: 419214 - DNA, 25 bp, Mus musculus
gaactcagattgaagcttgtacctt

SEQ ID NO: 419215 - DNA, 25 bp, Mus musculus
gaactcagattgtagcttgtacctt

SEQ ID NO: 419216 - DNA, 25 bp, Mus musculus
gaactcagcaccctctgttaggatg

SEQ ID NO: 419217 - DNA, 25 bp, Mus musculus
gaactcagcaccgtctgttaggatg

SEQ ID NO: 419218 - DNA, 25 bp, Mus musculus
gaactcagcagccacaggccaacag

SEQ ID NO: 419219 - DNA, 25 bp, Mus musculus
gaactcagcagcgacaggccaacag

SEQ ID NO: 419220 - DNA, 25 bp, Mus musculus
gaactcagccagagtgtcactgtct

SEQ ID NO: 419221 - DNA, 25 bp, Mus musculus
gaactcagccagtgtgtcactgtct

SEQ ID NO: 419222 - DNA, 25 bp, Mus musculus
gaactcagccatccagatgtggaca

SEQ ID NO: 419223 - DNA, 25 bp, Mus musculus
gaactcagccatccctgtgtgagaa

SEQ ID NO: 419224 - DNA, 25 bp, Mus musculus
gaactcagccatgcagatgtggaca

SEQ ID NO: 419225 - DNA, 25 bp, Mus musculus
gaactcagccatgcctgtgtgagaa

SEQ ID NO: 419226 - DNA, 25 bp, Mus musculus
gaactcagcccaattgaatgtattg

SEQ ID NO: 419227 - DNA, 25 bp, Mus musculus
gaactcagcccatttgaatgtattg

SEQ ID NO: 419228 - DNA, 25 bp, Mus musculus
gaactcagccccatcagaggaggtg

SEQ ID NO: 419229 - DNA, 25 bp, Mus musculus
gaactcagccccttcagaggaggtg

SEQ ID NO: 419230 - DNA, 25 bp, Mus musculus
gaactcagcctgcagttgtccaaat

SEQ ID NO: 419231 - DNA, 25 bp, Mus musculus
gaactcagcctggagttgtccaaat

SEQ ID NO: 419232 - DNA, 25 bp, Mus musculus
gaactcagcgagaaccgggaccagc

SEQ ID NO: 419233 - DNA, 25 bp, Mus musculus
gaactcagcgagacccagcgcagga

SEQ ID NO: 419234 - DNA, 25 bp, Mus musculus
gaactcagcgagtaccgggaccagc

SEQ ID NO: 419235 - DNA, 25 bp, Mus musculus
gaactcagcgagtcccagcgcagga

SEQ ID NO: 419236 - DNA, 25 bp, Mus musculus
gaactcagctgaattcctgtctttc

SEQ ID NO: 419237 - DNA, 25 bp, Mus musculus
gaactcagctgatttcctgtctttc

SEQ ID NO: 419238 - DNA, 25 bp, Mus musculus
gaactcagctgcctgtgtctaatca

SEQ ID NO: 419239 - DNA, 25 bp, Mus musculus
gaactcagctgcgtgtgtctaatca

SEQ ID NO: 419240 - DNA, 25 bp, Mus musculus
gaactcaggagaatccatgaatcca

SEQ ID NO: 419241 - DNA, 25 bp, Mus musculus
gaactcaggagattccatgaatcca

SEQ ID NO: 419242 - DNA, 25 bp, Mus musculus
gaactcaggagtagatcaggctggt

SEQ ID NO: 419243 - DNA, 25 bp, Mus musculus
gaactcaggagttgatcaggctggt

SEQ ID NO: 419244 - DNA, 25 bp, Mus musculus
gaactcaggctacctttcttgtgtt

SEQ ID NO: 419245 - DNA, 25 bp, Mus musculus
gaactcaggctagctttcttgtgtt

SEQ ID NO: 419246 - DNA, 25 bp, Mus musculus
gaactcagggcaataaactcttaaa

SEQ ID NO: 419247 - DNA, 25 bp, Mus musculus
gaactcagggcattaaactcttaaa

SEQ ID NO: 419248 - DNA, 25 bp, Mus musculus
gaactcaggtcaacgaacttgcaca

SEQ ID NO: 419249 - DNA, 25 bp, Mus musculus
gaactcaggtcacacatctgtatca

SEQ ID NO: 419250 - DNA, 25 bp, Mus musculus
gaactcaggtcagacatctgtatca

SEQ ID NO: 419251 - DNA, 25 bp, Mus musculus
gaactcaggtcatcgaacttgcaca

SEQ ID NO: 419252 - DNA, 25 bp, Mus musculus
gaactcaggtctacctaaagtgcag

SEQ ID NO: 419253 - DNA, 25 bp, Mus musculus
gaactcaggtcttcctaaagtgcag

SEQ ID NO: 419254 - DNA, 25 bp, Mus musculus
gaactcagtactccatcatctttaa

SEQ ID NO: 419255 - DNA, 25 bp, Mus musculus
gaactcagtactgcatcatctttaa

SEQ ID NO: 419256 - DNA, 25 bp, Mus musculus
gaactcagtagccacttgtaatatt

SEQ ID NO: 419257 - DNA, 25 bp, Mus musculus
gaactcagtagcgacttgtaatatt

SEQ ID NO: 419258 - DNA, 25 bp, Mus musculus
gaactcagtcgcaaccaaacaaaat

SEQ ID NO: 419259 - DNA, 25 bp, Mus musculus
gaactcagtcgctaccaaacaaaat

SEQ ID NO: 419260 - DNA, 25 bp, Mus musculus
gaactcagtgagctgttcttctccc

SEQ ID NO: 419261 - DNA, 25 bp, Mus musculus
gaactcagtgaggtgttcttctccc

SEQ ID NO: 419262 - DNA, 25 bp, Mus musculus
gaactcagtgctaccatgggaggta

SEQ ID NO: 419263 - DNA, 25 bp, Mus musculus
gaactcagtgcttccatgggaggta

SEQ ID NO: 419264 - DNA, 25 bp, Mus musculus
gaactcagtgttactacagtgtaag

SEQ ID NO: 419265 - DNA, 25 bp, Mus musculus
gaactcagtgttctagacggcccag

SEQ ID NO: 419266 - DNA, 25 bp, Mus musculus
gaactcagtgttgtagacggcccag

SEQ ID NO: 419267 - DNA, 25 bp, Mus musculus
gaactcagtgtttctacagtgtaag

SEQ ID NO: 419268 - DNA, 25 bp, Mus musculus
gaactcagttccaaaagctatatat

SEQ ID NO: 419269 - DNA, 25 bp, Mus musculus
gaactcagttcctaaagctatatat

SEQ ID NO: 419270 - DNA, 25 bp, Mus musculus
gaactcatacttaaatttaggcact

SEQ ID NO: 419271 - DNA, 25 bp, Mus musculus
gaactcatactttaatttaggcact

SEQ ID NO: 419272 - DNA, 25 bp, Mus musculus
gaactcatagaactgttgggaccat

SEQ ID NO: 419273 - DNA, 25 bp, Mus musculus
gaactcatagaagtgttgggaccat

SEQ ID NO: 419274 - DNA, 25 bp, Mus musculus
gaactcatagtactgaaaaacccta

SEQ ID NO: 419275 - DNA, 25 bp, Mus musculus
gaactcatagtagtgaaaaacccta

SEQ ID NO: 419276 - DNA, 25 bp, Mus musculus
gaactcatattcaacgcctgaactt

SEQ ID NO: 419277 - DNA, 25 bp, Mus musculus
gaactcatattctacgcctgaactt

SEQ ID NO: 419278 - DNA, 25 bp, Mus musculus
gaactcatccagctcacatatgcaa

SEQ ID NO: 419279 - DNA, 25 bp, Mus musculus
gaactcatccaggtcacatatgcaa

SEQ ID NO: 419280 - DNA, 25 bp, Mus musculus
gaactcatccgacgactgggcatga

SEQ ID NO: 419281 - DNA, 25 bp, Mus musculus
gaactcatccgaggactgggcatga

SEQ ID NO: 419282 - DNA, 25 bp, Mus musculus
gaactcatcgaactgatccatctga

SEQ ID NO: 419283 - DNA, 25 bp, Mus musculus
gaactcatcgaagtgatccatctga

SEQ ID NO: 419284 - DNA, 25 bp, Mus musculus
gaactcatcgtaacagctttggaca

SEQ ID NO: 419285 - DNA, 25 bp, Mus musculus
gaactcatcgtatcagctttggaca

SEQ ID NO: 419286 - DNA, 25 bp, Mus musculus
gaactcatctgaatactaatccgtg

SEQ ID NO: 419287 - DNA, 25 bp, Mus musculus
gaactcatctgattactaatccgtg

SEQ ID NO: 419288 - DNA, 25 bp, Mus musculus
gaactcatctggacctaatttgtgc

SEQ ID NO: 419289 - DNA, 25 bp, Mus musculus
gaactcatctggtcctaatttgtgc

SEQ ID NO: 419290 - DNA, 25 bp, Mus musculus
gaactcatcttcattaaggcttttt

SEQ ID NO: 419291 - DNA, 25 bp, Mus musculus
gaactcatcttctttaaggcttttt

SEQ ID NO: 419292 - DNA, 25 bp, Mus musculus
gaactcatcttgaaatccagactag

SEQ ID NO: 419293 - DNA, 25 bp, Mus musculus
gaactcatcttgtaatccagactag

SEQ ID NO: 419294 - DNA, 25 bp, Mus musculus
gaactcatctttcctggaggagccc

SEQ ID NO: 419295 - DNA, 25 bp, Mus musculus
gaactcatctttgctggaggagccc

SEQ ID NO: 419296 - DNA, 25 bp, Mus musculus
gaactcatgaacaaaggctccacct

SEQ ID NO: 419297 - DNA, 25 bp, Mus musculus
gaactcatgaactaaggctccacct

SEQ ID NO: 419298 - DNA, 25 bp, Mus musculus
gaactcatgactaaaagcactttct

SEQ ID NO: 419299 - DNA, 25 bp, Mus musculus
gaactcatgacttaaagcactttct

SEQ ID NO: 419300 - DNA, 25 bp, Mus musculus
gaactcatgaggaactgtgcagctt

SEQ ID NO: 419301 - DNA, 25 bp, Mus musculus
gaactcatgaggcttccagtcgttt

SEQ ID NO: 419302 - DNA, 25 bp, Mus musculus
gaactcatgagggttccagtcgttt

SEQ ID NO: 419303 - DNA, 25 bp, Mus musculus
gaactcatgaggtactgtgcagctt

SEQ ID NO: 419304 - DNA, 25 bp, Mus musculus
gaactcatgagtaggtctccagttt

SEQ ID NO: 419305 - DNA, 25 bp, Mus musculus
gaactcatgagtccacacatccaca

SEQ ID NO: 419306 - DNA, 25 bp, Mus musculus
gaactcatgagtgcacacatccaca

SEQ ID NO: 419307 - DNA, 25 bp, Mus musculus
gaactcatgagttggtctccagttt

SEQ ID NO: 419308 - DNA, 25 bp, Mus musculus
gaactcatgcgcattattttcttgc

SEQ ID NO: 419309 - DNA, 25 bp, Mus musculus
gaactcatgcgctttattttcttgc

SEQ ID NO: 419310 - DNA, 25 bp, Mus musculus
gaactcatgctcagcttgacctcgg

SEQ ID NO: 419311 - DNA, 25 bp, Mus musculus
gaactcatgctctgcttgacctcgg

SEQ ID NO: 419312 - DNA, 25 bp, Mus musculus
gaactcatggatcccagcgagctgg

SEQ ID NO: 419313 - DNA, 25 bp, Mus musculus
gaactcatggatgccagcgagctgg

SEQ ID NO: 419314 - DNA, 25 bp, Mus musculus
gaactcatgggcaatgtggtcaaac

SEQ ID NO: 419315 - DNA, 25 bp, Mus musculus
gaactcatgggcactttgctggaac

SEQ ID NO: 419316 - DNA, 25 bp, Mus musculus
gaactcatgggctatgtggtcaaac

SEQ ID NO: 419317 - DNA, 25 bp, Mus musculus
gaactcatgggctctttgctggaac

SEQ ID NO: 419318 - DNA, 25 bp, Mus musculus
gaactcatggtgaccggcatgcaca

SEQ ID NO: 419319 - DNA, 25 bp, Mus musculus
gaactcatggtgtccggcatgcaca

SEQ ID NO: 419320 - DNA, 25 bp, Mus musculus
gaactcatgtgtccacatactcaca

SEQ ID NO: 419321 - DNA, 25 bp, Mus musculus
gaactcatgtgtgcacatactcaca

SEQ ID NO: 419322 - DNA, 25 bp, Mus musculus
gaactcatgttaatcagaccaatat

SEQ ID NO: 419323 - DNA, 25 bp, Mus musculus
gaactcatgttattcagaccaatat

SEQ ID NO: 419324 - DNA, 25 bp, Mus musculus
gaactcattctccacagagagctgg

SEQ ID NO: 419325 - DNA, 25 bp, Mus musculus
gaactcattctcgacagagagctgg

SEQ ID NO: 419326 - DNA, 25 bp, Mus musculus
gaactcattctgaagcttgggttgg

SEQ ID NO: 419327 - DNA, 25 bp, Mus musculus
gaactcattctgtagcttgggttgg

SEQ ID NO: 419328 - DNA, 25 bp, Mus musculus
gaactcattgataatgcattacatg

SEQ ID NO: 419329 - DNA, 25 bp, Mus musculus
gaactcattgattatgcattacatg

SEQ ID NO: 419330 - DNA, 25 bp, Mus musculus
gaactcattgctaagacctgggtgg

SEQ ID NO: 419331 - DNA, 25 bp, Mus musculus
gaactcattgcttagacctgggtgg

SEQ ID NO: 419332 - DNA, 25 bp, Mus musculus
gaactcattggtatcacaagtcatt

SEQ ID NO: 419333 - DNA, 25 bp, Mus musculus
gaactcattggtttcacaagtcatt

SEQ ID NO: 419334 - DNA, 25 bp, Mus musculus
gaactcattgttcctgtatagaagt

SEQ ID NO: 419335 - DNA, 25 bp, Mus musculus
gaactcattgttgctgtatagaagt

SEQ ID NO: 419336 - DNA, 25 bp, Mus musculus
gaactcatttgccttgtttgaaaca

SEQ ID NO: 419337 - DNA, 25 bp, Mus musculus
gaactcatttgcgttgtttgaaaca

SEQ ID NO: 419338 - DNA, 25 bp, Mus musculus
gaactcatttttcacattcaggggt

SEQ ID NO: 419339 - DNA, 25 bp, Mus musculus
gaactcatttttgacattcaggggt

SEQ ID NO: 419340 - DNA, 25 bp, Mus musculus
gaactccaaaaactgtctcaacagc

SEQ ID NO: 419341 - DNA, 25 bp, Mus musculus
gaactccaaaaagtgtctcaacagc

SEQ ID NO: 419342 - DNA, 25 bp, Mus musculus
gaactccaaagaacgcgaagacgct

SEQ ID NO: 419343 - DNA, 25 bp, Mus musculus
gaactccaaagaacgtgtgtacatc

SEQ ID NO: 419344 - DNA, 25 bp, Mus musculus
gaactccaaagatcgcgaagacgct

SEQ ID NO: 419345 - DNA, 25 bp, Mus musculus
gaactccaaagatcgtgtgtacatc

SEQ ID NO: 419346 - DNA, 25 bp, Mus musculus
gaactccaacaacaaccaacgtgct

SEQ ID NO: 419347 - DNA, 25 bp, Mus musculus
gaactccaacaagaaccaacgtgct

SEQ ID NO: 419348 - DNA, 25 bp, Mus musculus
gaactccaacgtaaccgtcatttca

SEQ ID NO: 419349 - DNA, 25 bp, Mus musculus
gaactccaacgttaccgtcatttca

SEQ ID NO: 419350 - DNA, 25 bp, Mus musculus
gaactccaagagatggtgccaggtc

SEQ ID NO: 419351 - DNA, 25 bp, Mus musculus
gaactccaagagttggtgccaggtc

SEQ ID NO: 419352 - DNA, 25 bp, Mus musculus
gaactccaagctcttcctgaacgag

SEQ ID NO: 419353 - DNA, 25 bp, Mus musculus
gaactccaagctgttcctgaacgag

SEQ ID NO: 419354 - DNA, 25 bp, Mus musculus
gaactccaatctattccagaaaagc

SEQ ID NO: 419355 - DNA, 25 bp, Mus musculus
gaactccaatcttttccagaaaagc

SEQ ID NO: 419356 - DNA, 25 bp, Mus musculus
gaactccacaagaacgtgcacaggc

SEQ ID NO: 419357 - DNA, 25 bp, Mus musculus
gaactccacaagtacgtgcacaggc

SEQ ID NO: 419358 - DNA, 25 bp, Mus musculus
gaactccacagaaggtagcgctcac

SEQ ID NO: 419359 - DNA, 25 bp, Mus musculus
gaactccacagatggtagcgctcac

SEQ ID NO: 419360 - DNA, 25 bp, Mus musculus
gaactccacagccttaccaggaact

SEQ ID NO: 419361 - DNA, 25 bp, Mus musculus
gaactccacagcgttaccaggaact

SEQ ID NO: 419362 - DNA, 25 bp, Mus musculus
gaactccaccagaggcaattgcact

SEQ ID NO: 419363 - DNA, 25 bp, Mus musculus
gaactccaccagtggcaattgcact

SEQ ID NO: 419364 - DNA, 25 bp, Mus musculus
gaactccaccccagtgagtgttgat

SEQ ID NO: 419365 - DNA, 25 bp, Mus musculus
gaactccacccctgtgagtgttgat

SEQ ID NO: 419366 - DNA, 25 bp, Mus musculus
gaactccacggcagtaacaggcggc

SEQ ID NO: 419367 - DNA, 25 bp, Mus musculus
gaactccacggctgtaacaggcggc

SEQ ID NO: 419368 - DNA, 25 bp, Mus musculus
gaactccactatcatgatcaggcct

SEQ ID NO: 419369 - DNA, 25 bp, Mus musculus
gaactccactatgatgatcaggcct

SEQ ID NO: 419370 - DNA, 25 bp, Mus musculus
gaactccactcaagctagatgtcca

SEQ ID NO: 419371 - DNA, 25 bp, Mus musculus
gaactccactcatgctagatgtcca

SEQ ID NO: 419372 - DNA, 25 bp, Mus musculus
gaactccagaaaatgcgattccact

SEQ ID NO: 419373 - DNA, 25 bp, Mus musculus
gaactccagaaattgcgattccact

SEQ ID NO: 419374 - DNA, 25 bp, Mus musculus
gaactccagaagacactgtttcttg

SEQ ID NO: 419375 - DNA, 25 bp, Mus musculus
gaactccagaagtcactgtttcttg

SEQ ID NO: 419376 - DNA, 25 bp, Mus musculus
gaactccagcatcgcggatctcaga

SEQ ID NO: 419377 - DNA, 25 bp, Mus musculus
gaactccagcatggcggatctcaga

SEQ ID NO: 419378 - DNA, 25 bp, Mus musculus
gaactccaggaaacagtccactacc

SEQ ID NO: 419379 - DNA, 25 bp, Mus musculus
gaactccaggaatcagtccactacc

SEQ ID NO: 419380 - DNA, 25 bp, Mus musculus
gaactccaggagattaaatctgaac

SEQ ID NO: 419381 - DNA, 25 bp, Mus musculus
gaactccaggagtttaaatctgaac

SEQ ID NO: 419382 - DNA, 25 bp, Mus musculus
gaactccaggtaacttctttataag

SEQ ID NO: 419383 - DNA, 25 bp, Mus musculus
gaactccaggtatcttctttataag

SEQ ID NO: 419384 - DNA, 25 bp, Mus musculus
gaactccagtcaaggtagtagccta

SEQ ID NO: 419385 - DNA, 25 bp, Mus musculus
gaactccagtcatggtagtagccta

SEQ ID NO: 419386 - DNA, 25 bp, Mus musculus
gaactccatagacggccagggcaga

SEQ ID NO: 419387 - DNA, 25 bp, Mus musculus
gaactccatagagggccagggcaga

SEQ ID NO: 419388 - DNA, 25 bp, Mus musculus
gaactccatccacggctattgattg

SEQ ID NO: 419389 - DNA, 25 bp, Mus musculus
gaactccatccagggctattgattg

SEQ ID NO: 419390 - DNA, 25 bp, Mus musculus
gaactccatgaactaccttcttgac

SEQ ID NO: 419391 - DNA, 25 bp, Mus musculus
gaactccatgaagtaccttcttgac

SEQ ID NO: 419392 - DNA, 25 bp, Mus musculus
gaactccatgctcagagtcatctac

SEQ ID NO: 419393 - DNA, 25 bp, Mus musculus
gaactccatgctgagagtcatctac

SEQ ID NO: 419394 - DNA, 25 bp, Mus musculus
gaactccatggtacctgcagttgta

SEQ ID NO: 419395 - DNA, 25 bp, Mus musculus
gaactccatggttcctgcagttgta

SEQ ID NO: 419396 - DNA, 25 bp, Mus musculus
gaactccattgtcaagggctggcaa

SEQ ID NO: 419397 - DNA, 25 bp, Mus musculus
gaactccattgtcatagtacacctg

SEQ ID NO: 419398 - DNA, 25 bp, Mus musculus
gaactccattgtgaagggctggcaa

SEQ ID NO: 419399 - DNA, 25 bp, Mus musculus
gaactccattgtgatagtacacctg

SEQ ID NO: 419400 - DNA, 25 bp, Mus musculus
gaactcccaaggaggctactccaga

SEQ ID NO: 419401 - DNA, 25 bp, Mus musculus
gaactcccaaggtggctactccaga

SEQ ID NO: 419402 - DNA, 25 bp, Mus musculus
gaactcccacacataccaaataaat

SEQ ID NO: 419403 - DNA, 25 bp, Mus musculus
gaactcccacacttaccaaataaat

SEQ ID NO: 419404 - DNA, 25 bp, Mus musculus
gaactcccacagcaaagccctatat

SEQ ID NO: 419405 - DNA, 25 bp, Mus musculus
gaactcccacaggaaagccctatat

SEQ ID NO: 419406 - DNA, 25 bp, Mus musculus
gaactcccagaaagccacctgagaa

SEQ ID NO: 419407 - DNA, 25 bp, Mus musculus
gaactcccagaatgccacctgagaa

SEQ ID NO: 419408 - DNA, 25 bp, Mus musculus
gaactcccagagacggtgcttaagt

SEQ ID NO: 419409 - DNA, 25 bp, Mus musculus
gaactcccagagtcggtgcttaagt

SEQ ID NO: 419410 - DNA, 25 bp, Mus musculus
gaactcccaggaagacagaacatga

SEQ ID NO: 419411 - DNA, 25 bp, Mus musculus
gaactcccaggacgacttacaggac

SEQ ID NO: 419412 - DNA, 25 bp, Mus musculus
gaactcccaggaggacttacaggac

SEQ ID NO: 419413 - DNA, 25 bp, Mus musculus
gaactcccaggatgacagaacatga

SEQ ID NO: 419414 - DNA, 25 bp, Mus musculus
gaactcccagtgactataccaaact

SEQ ID NO: 419415 - DNA, 25 bp, Mus musculus
gaactcccagtgtctataccaaact

SEQ ID NO: 419416 - DNA, 25 bp, Mus musculus
gaactcccgcatatttcaaccgtat

SEQ ID NO: 419417 - DNA, 25 bp, Mus musculus
gaactcccgcatttttcaaccgtat

SEQ ID NO: 419418 - DNA, 25 bp, Mus musculus
gaactcccggagaacaagtgctaga

SEQ ID NO: 419419 - DNA, 25 bp, Mus musculus
gaactcccggagtacaagtgctaga

SEQ ID NO: 419420 - DNA, 25 bp, Mus musculus
gaactccctccaacagaggaagcta

SEQ ID NO: 419421 - DNA, 25 bp, Mus musculus
gaactccctccatcagaggaagcta

SEQ ID NO: 419422 - DNA, 25 bp, Mus musculus
gaactccctctcaaggtgaggatgc

SEQ ID NO: 419423 - DNA, 25 bp, Mus musculus
gaactccctctctaggtgaggatgc

SEQ ID NO: 419424 - DNA, 25 bp, Mus musculus
gaactcccttagactcaacttatag

SEQ ID NO: 419425 - DNA, 25 bp, Mus musculus
gaactcccttagtctcaacttatag

SEQ ID NO: 419426 - DNA, 25 bp, Mus musculus
gaactcccttcactgaatttcttct

SEQ ID NO: 419427 - DNA, 25 bp, Mus musculus
gaactcccttcagtgaatttcttct

SEQ ID NO: 419428 - DNA, 25 bp, Mus musculus
gaactcccttctagcacagtataat

SEQ ID NO: 419429 - DNA, 25 bp, Mus musculus
gaactcccttctcgttaagcagtct

SEQ ID NO: 419430 - DNA, 25 bp, Mus musculus
gaactcccttctggttaagcagtct

SEQ ID NO: 419431 - DNA, 25 bp, Mus musculus
gaactcccttcttgcacagtataat

SEQ ID NO: 419432 - DNA, 25 bp, Mus musculus
gaactccctttaccggtgcacctgg

SEQ ID NO: 419433 - DNA, 25 bp, Mus musculus
gaactccctttagcggtgcacctgg

SEQ ID NO: 419434 - DNA, 25 bp, Mus musculus
gaactccgacctacttggttggtgg

SEQ ID NO: 419435 - DNA, 25 bp, Mus musculus
gaactccgaccttcttggttggtgg

SEQ ID NO: 419436 - DNA, 25 bp, Mus musculus
gaactccgagttacacacagaagca

SEQ ID NO: 419437 - DNA, 25 bp, Mus musculus
gaactccgagtttcacacagaagca

SEQ ID NO: 419438 - DNA, 25 bp, Mus musculus
gaactccgctttatcaaaggcagca

SEQ ID NO: 419439 - DNA, 25 bp, Mus musculus
gaactccgctttttcaaaggcagca

SEQ ID NO: 419440 - DNA, 25 bp, Mus musculus
gaactccggataagcaatcaaccca

SEQ ID NO: 419441 - DNA, 25 bp, Mus musculus
gaactccggatatgcaatcaaccca

SEQ ID NO: 419442 - DNA, 25 bp, Mus musculus
gaactccgggagaggaagatcctta

SEQ ID NO: 419443 - DNA, 25 bp, Mus musculus
gaactccgggagtggaagatcctta

SEQ ID NO: 419444 - DNA, 25 bp, Mus musculus
gaactccgggataaaggcttctttg

SEQ ID NO: 419445 - DNA, 25 bp, Mus musculus
gaactccgggattaaggcttctttg

SEQ ID NO: 419446 - DNA, 25 bp, Mus musculus
gaactccgggcaatccttgtcataa

SEQ ID NO: 419447 - DNA, 25 bp, Mus musculus
gaactccgggcattccttgtcataa

SEQ ID NO: 419448 - DNA, 25 bp, Mus musculus
gaactccgtgaactcgagaggcaga

SEQ ID NO: 419449 - DNA, 25 bp, Mus musculus
gaactccgtgaagtcgagaggcaga

SEQ ID NO: 419450 - DNA, 25 bp, Mus musculus
gaactcctaggtcaactcatttata

SEQ ID NO: 419451 - DNA, 25 bp, Mus musculus
gaactcctaggtgaactcatttata

SEQ ID NO: 419452 - DNA, 25 bp, Mus musculus
gaactcctcaatcaagctaatgttt

SEQ ID NO: 419453 - DNA, 25 bp, Mus musculus
gaactcctcaatgaagctaatgttt

SEQ ID NO: 419454 - DNA, 25 bp, Mus musculus
gaactcctccaaaaatatgggttgt

SEQ ID NO: 419455 - DNA, 25 bp, Mus musculus
gaactcctccaataatatgggttgt

SEQ ID NO: 419456 - DNA, 25 bp, Mus musculus
gaactcctcctcagttgagttttca

SEQ ID NO: 419457 - DNA, 25 bp, Mus musculus
gaactcctcctctgttgagttttca

SEQ ID NO: 419458 - DNA, 25 bp, Mus musculus
gaactcctcctgatttatttaccat

SEQ ID NO: 419459 - DNA, 25 bp, Mus musculus
gaactcctcctgttttatttaccat

SEQ ID NO: 419460 - DNA, 25 bp, Mus musculus
gaactcctcgttagaagatgtagat

SEQ ID NO: 419461 - DNA, 25 bp, Mus musculus
gaactcctcgtttgaagatgtagat

SEQ ID NO: 419462 - DNA, 25 bp, Mus musculus
gaactcctctagagataccttaaga

SEQ ID NO: 419463 - DNA, 25 bp, Mus musculus
gaactcctctagtgataccttaaga

SEQ ID NO: 419464 - DNA, 25 bp, Mus musculus
gaactcctcttcaggggcagatcct

SEQ ID NO: 419465 - DNA, 25 bp, Mus musculus
gaactcctcttctggggcagatcct

SEQ ID NO: 419466 - DNA, 25 bp, Mus musculus
gaactcctgagtcttttgtattagc

SEQ ID NO: 419467 - DNA, 25 bp, Mus musculus
gaactcctgagtgttttgtattagc

SEQ ID NO: 419468 - DNA, 25 bp, Mus musculus
gaactcctgatgctaacgtgtctgg

SEQ ID NO: 419469 - DNA, 25 bp, Mus musculus
gaactcctgatggtaacgtgtctgg

SEQ ID NO: 419470 - DNA, 25 bp, Mus musculus
gaactcctgcataccatgtgcaaaa

SEQ ID NO: 419471 - DNA, 25 bp, Mus musculus
gaactcctgcattccatgtgcaaaa

SEQ ID NO: 419472 - DNA, 25 bp, Mus musculus
gaactcctggatactggcattaatg

SEQ ID NO: 419473 - DNA, 25 bp, Mus musculus
gaactcctggattctggcattaatg

SEQ ID NO: 419474 - DNA, 25 bp, Mus musculus
gaactcctgggaaaagactcatgcc

SEQ ID NO: 419475 - DNA, 25 bp, Mus musculus
gaactcctgggataagactcatgcc

SEQ ID NO: 419476 - DNA, 25 bp, Mus musculus
gaactcctgggcatagacctgaaca

SEQ ID NO: 419477 - DNA, 25 bp, Mus musculus
gaactcctgggcttagacctgaaca

SEQ ID NO: 419478 - DNA, 25 bp, Mus musculus
gaactcctggttagcagtgttcaga

SEQ ID NO: 419479 - DNA, 25 bp, Mus musculus
gaactcctggttatccttaactatg

SEQ ID NO: 419480 - DNA, 25 bp, Mus musculus
gaactcctggttcaagattttgcag

SEQ ID NO: 419481 - DNA, 25 bp, Mus musculus
gaactcctggttccatttgaagaag

SEQ ID NO: 419482 - DNA, 25 bp, Mus musculus
gaactcctggttgaagattttgcag

SEQ ID NO: 419483 - DNA, 25 bp, Mus musculus
gaactcctggttgcatttgaagaag

SEQ ID NO: 419484 - DNA, 25 bp, Mus musculus
gaactcctggtttgcagtgttcaga

SEQ ID NO: 419485 - DNA, 25 bp, Mus musculus
gaactcctggttttccttaactatg

SEQ ID NO: 419486 - DNA, 25 bp, Mus musculus
gaactcctgtcacaaacggctgtgt

SEQ ID NO: 419487 - DNA, 25 bp, Mus musculus
gaactcctgtcagaaacggctgtgt

SEQ ID NO: 419488 - DNA, 25 bp, Mus musculus
gaactccttagtaacagccacatga

SEQ ID NO: 419489 - DNA, 25 bp, Mus musculus
gaactccttagtaaccaacttcttg

SEQ ID NO: 419490 - DNA, 25 bp, Mus musculus
gaactccttagttacagccacatga

SEQ ID NO: 419491 - DNA, 25 bp, Mus musculus
gaactccttagttaccaacttcttg

SEQ ID NO: 419492 - DNA, 25 bp, Mus musculus
gaactccttggacatccattcttaa

SEQ ID NO: 419493 - DNA, 25 bp, Mus musculus
gaactccttggagatccattcttaa

SEQ ID NO: 419494 - DNA, 25 bp, Mus musculus
gaactccttgtaagagccatggaag

SEQ ID NO: 419495 - DNA, 25 bp, Mus musculus
gaactccttgtatgagccatggaag

SEQ ID NO: 419496 - DNA, 25 bp, Mus musculus
gaactccttgttagactgttgcatg

SEQ ID NO: 419497 - DNA, 25 bp, Mus musculus
gaactccttgtttgactgttgcatg

SEQ ID NO: 419498 - DNA, 25 bp, Mus musculus
gaactcctttctcggcgtagaatac

SEQ ID NO: 419499 - DNA, 25 bp, Mus musculus
gaactcctttctgggcgtagaatac

SEQ ID NO: 419500 - DNA, 25 bp, Mus musculus
gaactcctttgacagacccttgaag

SEQ ID NO: 419501 - DNA, 25 bp, Mus musculus
gaactcctttgagagacccttgaag

SEQ ID NO: 419502 - DNA, 25 bp, Mus musculus
gaactccttttcatcaagcattggt

SEQ ID NO: 419503 - DNA, 25 bp, Mus musculus
gaactccttttcttcaagcattggt

SEQ ID NO: 419504 - DNA, 25 bp, Mus musculus
gaactcgaacggcaatacgctacga

SEQ ID NO: 419505 - DNA, 25 bp, Mus musculus
gaactcgaacgggaatacgctacga

SEQ ID NO: 419506 - DNA, 25 bp, Mus musculus
gaactcgaatcccaaactgttgctg

SEQ ID NO: 419507 - DNA, 25 bp, Mus musculus
gaactcgaatccgaaactgttgctg

SEQ ID NO: 419508 - DNA, 25 bp, Mus musculus
gaactcgactttctgtataactgta

SEQ ID NO: 419509 - DNA, 25 bp, Mus musculus
gaactcgactttgtgtataactgta

SEQ ID NO: 419510 - DNA, 25 bp, Mus musculus
gaactcgaggttcgttgtttactat

SEQ ID NO: 419511 - DNA, 25 bp, Mus musculus
gaactcgaggttggttgtttactat

SEQ ID NO: 419512 - DNA, 25 bp, Mus musculus
gaactcgatgaactactatgatgac

SEQ ID NO: 419513 - DNA, 25 bp, Mus musculus
gaactcgatgaagtactatgatgac

SEQ ID NO: 419514 - DNA, 25 bp, Mus musculus
gaactcgattcacccagttagcttg

SEQ ID NO: 419515 - DNA, 25 bp, Mus musculus
gaactcgattcagccagttagcttg

SEQ ID NO: 419516 - DNA, 25 bp, Mus musculus
gaactcgcacatcaagatacctgtc

SEQ ID NO: 419517 - DNA, 25 bp, Mus musculus
gaactcgcacatgaagatacctgtc

SEQ ID NO: 419518 - DNA, 25 bp, Mus musculus
gaactcgccatgaagtttggctacg

SEQ ID NO: 419519 - DNA, 25 bp, Mus musculus
gaactcgccatgtagtttggctacg

SEQ ID NO: 419520 - DNA, 25 bp, Mus musculus
gaactcgccgagcttccaaggcaga

SEQ ID NO: 419521 - DNA, 25 bp, Mus musculus
gaactcgccgaggttccaaggcaga

SEQ ID NO: 419522 - DNA, 25 bp, Mus musculus
gaactcgcgaggctctaagttggta

SEQ ID NO: 419523 - DNA, 25 bp, Mus musculus
gaactcgcgagggtctaagttggta

SEQ ID NO: 419524 - DNA, 25 bp, Mus musculus
gaactcgctatgcagcaggatgaga

SEQ ID NO: 419525 - DNA, 25 bp, Mus musculus
gaactcgctatggagcaggatgaga

SEQ ID NO: 419526 - DNA, 25 bp, Mus musculus
gaactcgctcacaagaagccaccag

SEQ ID NO: 419527 - DNA, 25 bp, Mus musculus
gaactcgctcactagaagccaccag

SEQ ID NO: 419528 - DNA, 25 bp, Mus musculus
gaactcgcttctctttaaagtcacg

SEQ ID NO: 419529 - DNA, 25 bp, Mus musculus
gaactcgcttctgtttaaagtcacg

SEQ ID NO: 419530 - DNA, 25 bp, Mus musculus
gaactcggaaccattgtaactcatc

SEQ ID NO: 419531 - DNA, 25 bp, Mus musculus
gaactcggaacctttgtaactcatc

SEQ ID NO: 419532 - DNA, 25 bp, Mus musculus
gaactcggaagacggccttggccca

SEQ ID NO: 419533 - DNA, 25 bp, Mus musculus
gaactcggaagagggccttggccca

SEQ ID NO: 419534 - DNA, 25 bp, Mus musculus
gaactcggacatcctgacccgcggg

SEQ ID NO: 419535 - DNA, 25 bp, Mus musculus
gaactcggacatgctgacccgcggg

SEQ ID NO: 419536 - DNA, 25 bp, Mus musculus
gaactcggagaaacttagggctctt

SEQ ID NO: 419537 - DNA, 25 bp, Mus musculus
gaactcggagaatcttagggctctt

SEQ ID NO: 419538 - DNA, 25 bp, Mus musculus
gaactcggagttagcctgatcaaca

SEQ ID NO: 419539 - DNA, 25 bp, Mus musculus
gaactcggagtttgcctgatcaaca

SEQ ID NO: 419540 - DNA, 25 bp, Mus musculus
gaactcggatatactcggtgctacc

SEQ ID NO: 419541 - DNA, 25 bp, Mus musculus
gaactcggatattctcggtgctacc

SEQ ID NO: 419542 - DNA, 25 bp, Mus musculus
gaactcggatccacttgaaaagcag

SEQ ID NO: 419543 - DNA, 25 bp, Mus musculus
gaactcggatcctcttgaaaagcag

SEQ ID NO: 419544 - DNA, 25 bp, Mus musculus
gaactcggatgtatatcttcagatg

SEQ ID NO: 419545 - DNA, 25 bp, Mus musculus
gaactcggatgtttatcttcagatg

SEQ ID NO: 419546 - DNA, 25 bp, Mus musculus
gaactcggcagtacaggaacataga

SEQ ID NO: 419547 - DNA, 25 bp, Mus musculus
gaactcggcagttcaggaacataga

SEQ ID NO: 419548 - DNA, 25 bp, Mus musculus
gaactcggccaaaagcaggtgattc

SEQ ID NO: 419549 - DNA, 25 bp, Mus musculus
gaactcggccaatagcaggtgattc

SEQ ID NO: 419550 - DNA, 25 bp, Mus musculus
gaactcggccgcaggcacgctgatg

SEQ ID NO: 419551 - DNA, 25 bp, Mus musculus
gaactcggccgctggcacgctgatg

SEQ ID NO: 419552 - DNA, 25 bp, Mus musculus
gaactcggcgacatcgggtgacaaa

SEQ ID NO: 419553 - DNA, 25 bp, Mus musculus
gaactcggcgacttcgggtgacaaa

SEQ ID NO: 419554 - DNA, 25 bp, Mus musculus
gaactcggctaaacagcagagatct

SEQ ID NO: 419555 - DNA, 25 bp, Mus musculus
gaactcggctaatcagcagagatct

SEQ ID NO: 419556 - DNA, 25 bp, Mus musculus
gaactcggctttatacttcaagcag

SEQ ID NO: 419557 - DNA, 25 bp, Mus musculus
gaactcggctttatctagccttggt

SEQ ID NO: 419558 - DNA, 25 bp, Mus musculus
gaactcggctttttacttcaagcag

SEQ ID NO: 419559 - DNA, 25 bp, Mus musculus
gaactcggctttttctagccttggt

SEQ ID NO: 419560 - DNA, 25 bp, Mus musculus
gaactcgggaagctgatgtgtacct

SEQ ID NO: 419561 - DNA, 25 bp, Mus musculus
gaactcgggaaggtgatgtgtacct

SEQ ID NO: 419562 - DNA, 25 bp, Mus musculus
gaactcgggaccaaccagatactga

SEQ ID NO: 419563 - DNA, 25 bp, Mus musculus
gaactcgggacctaccagatactga

SEQ ID NO: 419564 - DNA, 25 bp, Mus musculus
gaactcgggatcagattcaccagaa

SEQ ID NO: 419565 - DNA, 25 bp, Mus musculus
gaactcgggatctgattcaccagaa

SEQ ID NO: 419566 - DNA, 25 bp, Mus musculus
gaactcgggtccacgtgattaaata

SEQ ID NO: 419567 - DNA, 25 bp, Mus musculus
gaactcgggtcctcgtgattaaata

SEQ ID NO: 419568 - DNA, 25 bp, Mus musculus
gaactcggtggaatgggagcccgcg

SEQ ID NO: 419569 - DNA, 25 bp, Mus musculus
gaactcggtggattgggagcccgcg

SEQ ID NO: 419570 - DNA, 25 bp, Mus musculus
gaactcgtaattcatggttgacctt

SEQ ID NO: 419571 - DNA, 25 bp, Mus musculus
gaactcgtaattgatggttgacctt

SEQ ID NO: 419572 - DNA, 25 bp, Mus musculus
gaactcgtactactgttacaaggta

SEQ ID NO: 419573 - DNA, 25 bp, Mus musculus
gaactcgtactagtgttacaaggta

SEQ ID NO: 419574 - DNA, 25 bp, Mus musculus
gaactcgtcctgatggtgtcttgtt

SEQ ID NO: 419575 - DNA, 25 bp, Mus musculus
gaactcgtcctgttggtgtcttgtt

SEQ ID NO: 419576 - DNA, 25 bp, Mus musculus
gaactcgtcgtacggtctttccagg

SEQ ID NO: 419577 - DNA, 25 bp, Mus musculus
gaactcgtcgtagggtctttccagg

SEQ ID NO: 419578 - DNA, 25 bp, Mus musculus
gaactcgtctggatgaccggatcat

SEQ ID NO: 419579 - DNA, 25 bp, Mus musculus
gaactcgtctggttgaccggatcat

SEQ ID NO: 419580 - DNA, 25 bp, Mus musculus
gaactcgttcgtacgtttggagact

SEQ ID NO: 419581 - DNA, 25 bp, Mus musculus
gaactcgttcgttcgtttggagact

SEQ ID NO: 419582 - DNA, 25 bp, Mus musculus
gaactcgttcttacgtgttttgtat

SEQ ID NO: 419583 - DNA, 25 bp, Mus musculus
gaactcgttctttcgtgttttgtat

SEQ ID NO: 419584 - DNA, 25 bp, Mus musculus
gaactcgttgcaattcacacacaca

SEQ ID NO: 419585 - DNA, 25 bp, Mus musculus
gaactcgttgcatttcacacacaca

SEQ ID NO: 419586 - DNA, 25 bp, Mus musculus
gaactcgtttggactaagcatgctg

SEQ ID NO: 419587 - DNA, 25 bp, Mus musculus
gaactcgtttggtctaagcatgctg

SEQ ID NO: 419588 - DNA, 25 bp, Mus musculus
gaactcgttttaccaagaacttcaa

SEQ ID NO: 419589 - DNA, 25 bp, Mus musculus
gaactcgttttagcaagaacttcaa

SEQ ID NO: 419590 - DNA, 25 bp, Mus musculus
gaactctaaacaaacatccaggata

SEQ ID NO: 419591 - DNA, 25 bp, Mus musculus
gaactctaaacatacatccaggata

SEQ ID NO: 419592 - DNA, 25 bp, Mus musculus
gaactctaaaccattctgtatttga

SEQ ID NO: 419593 - DNA, 25 bp, Mus musculus
gaactctaaacctttctgtatttga

SEQ ID NO: 419594 - DNA, 25 bp, Mus musculus
gaactctaacaaaagcctctctggt

SEQ ID NO: 419595 - DNA, 25 bp, Mus musculus
gaactctaacaatagcctctctggt

SEQ ID NO: 419596 - DNA, 25 bp, Mus musculus
gaactctaacggagcaactttgaga

SEQ ID NO: 419597 - DNA, 25 bp, Mus musculus
gaactctaacggtgcaactttgaga

SEQ ID NO: 419598 - DNA, 25 bp, Mus musculus
gaactctaacttcgaaactgcactg

SEQ ID NO: 419599 - DNA, 25 bp, Mus musculus
gaactctaacttggaaactgcactg

SEQ ID NO: 419600 - DNA, 25 bp, Mus musculus
gaactctacaacaagctgctgtgcc

SEQ ID NO: 419601 - DNA, 25 bp, Mus musculus
gaactctacaactagctgctgtgcc

SEQ ID NO: 419602 - DNA, 25 bp, Mus musculus
gaactctacagaccatggcgggact

SEQ ID NO: 419603 - DNA, 25 bp, Mus musculus
gaactctacagagcatggcgggact

SEQ ID NO: 419604 - DNA, 25 bp, Mus musculus
gaactctacatgctcttggctgtgg

SEQ ID NO: 419605 - DNA, 25 bp, Mus musculus
gaactctacatggtcttggctgtgg

SEQ ID NO: 419606 - DNA, 25 bp, Mus musculus
gaactctaccctcgtaggaaagcac

SEQ ID NO: 419607 - DNA, 25 bp, Mus musculus
gaactctaccctggtaggaaagcac

SEQ ID NO: 419608 - DNA, 25 bp, Mus musculus
gaactctaccggcagtcaaagaaaa

SEQ ID NO: 419609 - DNA, 25 bp, Mus musculus
gaactctaccgggagtcaaagaaaa

SEQ ID NO: 419610 - DNA, 25 bp, Mus musculus
gaactctactcaaatgatacctact

SEQ ID NO: 419611 - DNA, 25 bp, Mus musculus
gaactctactcatatgatacctact

SEQ ID NO: 419612 - DNA, 25 bp, Mus musculus
gaactctactctcaataacatctat

SEQ ID NO: 419613 - DNA, 25 bp, Mus musculus
gaactctactctgaataacatctat

SEQ ID NO: 419614 - DNA, 25 bp, Mus musculus
gaactctagaacctcctgagtcagt

SEQ ID NO: 419615 - DNA, 25 bp, Mus musculus
gaactctagaacgtcctgagtcagt

SEQ ID NO: 419616 - DNA, 25 bp, Mus musculus
gaactctagagtcggaagccagctt

SEQ ID NO: 419617 - DNA, 25 bp, Mus musculus
gaactctagagtgggaagccagctt

SEQ ID NO: 419618 - DNA, 25 bp, Mus musculus
gaactctagcaaagtcaggctcctg

SEQ ID NO: 419619 - DNA, 25 bp, Mus musculus
gaactctagcaatgtcaggctcctg

SEQ ID NO: 419620 - DNA, 25 bp, Mus musculus
gaactctagcagcaatgcattggca

SEQ ID NO: 419621 - DNA, 25 bp, Mus musculus
gaactctagcaggaatgcattggca

SEQ ID NO: 419622 - DNA, 25 bp, Mus musculus
gaactctagcccactgaaattgtaa

SEQ ID NO: 419623 - DNA, 25 bp, Mus musculus
gaactctagccctctgaaattgtaa

SEQ ID NO: 419624 - DNA, 25 bp, Mus musculus
gaactctagctacagccaatcttaa

SEQ ID NO: 419625 - DNA, 25 bp, Mus musculus
gaactctagctagagccaatcttaa

SEQ ID NO: 419626 - DNA, 25 bp, Mus musculus
gaactctaggtaagacccattgcaa

SEQ ID NO: 419627 - DNA, 25 bp, Mus musculus
gaactctaggtatgacccattgcaa

SEQ ID NO: 419628 - DNA, 25 bp, Mus musculus
gaactctagtctctgactctcaata

SEQ ID NO: 419629 - DNA, 25 bp, Mus musculus
gaactctagtctgtgactctcaata

SEQ ID NO: 419630 - DNA, 25 bp, Mus musculus
gaactctatcggacttatgtcagaa

SEQ ID NO: 419631 - DNA, 25 bp, Mus musculus
gaactctatcggtcttatgtcagaa

SEQ ID NO: 419632 - DNA, 25 bp, Mus musculus
gaactctatctgactttctttgtct

SEQ ID NO: 419633 - DNA, 25 bp, Mus musculus
gaactctatctgtctttctttgtct

SEQ ID NO: 419634 - DNA, 25 bp, Mus musculus
gaactctatgtaaccagggtttggt

SEQ ID NO: 419635 - DNA, 25 bp, Mus musculus
gaactctatgtatccagggtttggt

SEQ ID NO: 419636 - DNA, 25 bp, Mus musculus
gaactctattctcaagtctcactgg

SEQ ID NO: 419637 - DNA, 25 bp, Mus musculus
gaactctattctgaagtctcactgg

SEQ ID NO: 419638 - DNA, 25 bp, Mus musculus
gaactctattttattgaacttccag

SEQ ID NO: 419639 - DNA, 25 bp, Mus musculus
gaactctatttttttgaacttccag

SEQ ID NO: 419640 - DNA, 25 bp, Mus musculus
gaactctcaagacccatttggtcat

SEQ ID NO: 419641 - DNA, 25 bp, Mus musculus
gaactctcaagactccatgcagtgt

SEQ ID NO: 419642 - DNA, 25 bp, Mus musculus
gaactctcaagagccatttggtcat

SEQ ID NO: 419643 - DNA, 25 bp, Mus musculus
gaactctcaagagtccatgcagtgt

SEQ ID NO: 419644 - DNA, 25 bp, Mus musculus
gaactctcacttcttccagagcgag

SEQ ID NO: 419645 - DNA, 25 bp, Mus musculus
gaactctcacttgttccagagcgag

SEQ ID NO: 419646 - DNA, 25 bp, Mus musculus
gaactctcagatagagccctgtctc

SEQ ID NO: 419647 - DNA, 25 bp, Mus musculus
gaactctcagattgagccctgtctc

SEQ ID NO: 419648 - DNA, 25 bp, Mus musculus
gaactctcagcacgcagaactcagg

SEQ ID NO: 419649 - DNA, 25 bp, Mus musculus
gaactctcagcaggcagaactcagg

SEQ ID NO: 419650 - DNA, 25 bp, Mus musculus
gaactctcaggaaacgtgcgtgcgt

SEQ ID NO: 419651 - DNA, 25 bp, Mus musculus
gaactctcaggatacgtgcgtgcgt

SEQ ID NO: 419652 - DNA, 25 bp, Mus musculus
gaactctcatctctaattgggtaca

SEQ ID NO: 419653 - DNA, 25 bp, Mus musculus
gaactctcatctgtaattgggtaca

SEQ ID NO: 419654 - DNA, 25 bp, Mus musculus
gaactctccagtctattaacccctt

SEQ ID NO: 419655 - DNA, 25 bp, Mus musculus
gaactctccagtgtattaacccctt

SEQ ID NO: 419656 - DNA, 25 bp, Mus musculus
gaactctccatcctttgtggattct

SEQ ID NO: 419657 - DNA, 25 bp, Mus musculus
gaactctccatcgtttgtggattct

SEQ ID NO: 419658 - DNA, 25 bp, Mus musculus
gaactctcccttcatggacagttca

SEQ ID NO: 419659 - DNA, 25 bp, Mus musculus
gaactctcccttgatggacagttca

SEQ ID NO: 419660 - DNA, 25 bp, Mus musculus
gaactctcctagctgcatgaaatta

SEQ ID NO: 419661 - DNA, 25 bp, Mus musculus
gaactctcctaggtgcatgaaatta

SEQ ID NO: 419662 - DNA, 25 bp, Mus musculus
gaactctcctatagacagtatgctt

SEQ ID NO: 419663 - DNA, 25 bp, Mus musculus
gaactctcctattgacagtatgctt

SEQ ID NO: 419664 - DNA, 25 bp, Mus musculus
gaactctcctcaaaggtgagatcta

SEQ ID NO: 419665 - DNA, 25 bp, Mus musculus
gaactctcctcataggtgagatcta

SEQ ID NO: 419666 - DNA, 25 bp, Mus musculus
gaactctccttccaacttaacgata

SEQ ID NO: 419667 - DNA, 25 bp, Mus musculus
gaactctccttcgaacttaacgata

SEQ ID NO: 419668 - DNA, 25 bp, Mus musculus
gaactctcgcatagctacattctga

SEQ ID NO: 419669 - DNA, 25 bp, Mus musculus
gaactctcgcattgctacattctga

SEQ ID NO: 419670 - DNA, 25 bp, Mus musculus
gaactctcggccagcatttaaagaa

SEQ ID NO: 419671 - DNA, 25 bp, Mus musculus
gaactctcggcctgcatttaaagaa

SEQ ID NO: 419672 - DNA, 25 bp, Mus musculus
gaactctcgtccatggagaagccca

SEQ ID NO: 419673 - DNA, 25 bp, Mus musculus
gaactctcgtccttggagaagccca

SEQ ID NO: 419674 - DNA, 25 bp, Mus musculus
gaactctctacaacgtttgatcctt

SEQ ID NO: 419675 - DNA, 25 bp, Mus musculus
gaactctctacatcgtttgatcctt

SEQ ID NO: 419676 - DNA, 25 bp, Mus musculus
gaactctctaggacagtataagcta

SEQ ID NO: 419677 - DNA, 25 bp, Mus musculus
gaactctctaggtcagtataagcta

SEQ ID NO: 419678 - DNA, 25 bp, Mus musculus
gaactctctctaattgccaggctgg

SEQ ID NO: 419679 - DNA, 25 bp, Mus musculus
gaactctctctatttgccaggctgg

SEQ ID NO: 419680 - DNA, 25 bp, Mus musculus
gaactctctgacaatgtccagtgta

SEQ ID NO: 419681 - DNA, 25 bp, Mus musculus
gaactctctgactatgtccagtgta

SEQ ID NO: 419682 - DNA, 25 bp, Mus musculus
gaactctctgttcttgtccatttca

SEQ ID NO: 419683 - DNA, 25 bp, Mus musculus
gaactctctgttgttgtccatttca

SEQ ID NO: 419684 - DNA, 25 bp, Mus musculus
gaactctcttcacaggctgtgctca

SEQ ID NO: 419685 - DNA, 25 bp, Mus musculus
gaactctcttcagaggctgtgctca

SEQ ID NO: 419686 - DNA, 25 bp, Mus musculus
gaactctctttcatatctgctggaa

SEQ ID NO: 419687 - DNA, 25 bp, Mus musculus
gaactctctttcttatctgctggaa

SEQ ID NO: 419688 - DNA, 25 bp, Mus musculus
gaactctgaattctttgtgcacata

SEQ ID NO: 419689 - DNA, 25 bp, Mus musculus
gaactctgaattgtttgtgcacata

SEQ ID NO: 419690 - DNA, 25 bp, Mus musculus
gaactctgacaaaagcggctggacc

SEQ ID NO: 419691 - DNA, 25 bp, Mus musculus
gaactctgacaatagcggctggacc

SEQ ID NO: 419692 - DNA, 25 bp, Mus musculus
gaactctgacagaaggctttcccac

SEQ ID NO: 419693 - DNA, 25 bp, Mus musculus
gaactctgacagtaggctttcccac

SEQ ID NO: 419694 - DNA, 25 bp, Mus musculus
gaactctgaccgattcacatagcaa

SEQ ID NO: 419695 - DNA, 25 bp, Mus musculus
gaactctgaccgtttcacatagcaa

SEQ ID NO: 419696 - DNA, 25 bp, Mus musculus
gaactctgacctaattgggttttca

SEQ ID NO: 419697 - DNA, 25 bp, Mus musculus
gaactctgacctccagaattgtgag

SEQ ID NO: 419698 - DNA, 25 bp, Mus musculus
gaactctgacctgcagaattgtgag

SEQ ID NO: 419699 - DNA, 25 bp, Mus musculus
gaactctgaccttattgggttttca

SEQ ID NO: 419700 - DNA, 25 bp, Mus musculus
gaactctgagccaaaagcgaagaac

SEQ ID NO: 419701 - DNA, 25 bp, Mus musculus
gaactctgagcctaaagcgaagaac

SEQ ID NO: 419702 - DNA, 25 bp, Mus musculus
gaactctgaggcacagtcatactga

SEQ ID NO: 419703 - DNA, 25 bp, Mus musculus
gaactctgaggctcagtcatactga

SEQ ID NO: 419704 - DNA, 25 bp, Mus musculus
gaactctgagtgaggtggctacaca

SEQ ID NO: 419705 - DNA, 25 bp, Mus musculus
gaactctgagtgtggtggctacaca

SEQ ID NO: 419706 - DNA, 25 bp, Mus musculus
gaactctgatacagcagtactcgga

SEQ ID NO: 419707 - DNA, 25 bp, Mus musculus
gaactctgatacagcagtactctga

SEQ ID NO: 419708 - DNA, 25 bp, Mus musculus
gaactctgatactgcagtactcgga

SEQ ID NO: 419709 - DNA, 25 bp, Mus musculus
gaactctgatactgcagtactctga

SEQ ID NO: 419710 - DNA, 25 bp, Mus musculus
gaactctgattacagtgctccccag

SEQ ID NO: 419711 - DNA, 25 bp, Mus musculus
gaactctgattagagtgctccccag

SEQ ID NO: 419712 - DNA, 25 bp, Mus musculus
gaactctgattcagtggcaaggccc

SEQ ID NO: 419713 - DNA, 25 bp, Mus musculus
gaactctgattctgtggcaaggccc

SEQ ID NO: 419714 - DNA, 25 bp, Mus musculus
gaactctgcactagggtgccttggg

SEQ ID NO: 419715 - DNA, 25 bp, Mus musculus
gaactctgcacttgggtgccttggg

SEQ ID NO: 419716 - DNA, 25 bp, Mus musculus
gaactctgcaggattgcagctctgg

SEQ ID NO: 419717 - DNA, 25 bp, Mus musculus
gaactctgcaggtttgcagctctgg

SEQ ID NO: 419718 - DNA, 25 bp, Mus musculus
gaactctgccataaaggagcctggg

SEQ ID NO: 419719 - DNA, 25 bp, Mus musculus
gaactctgccattaaggagcctggg

SEQ ID NO: 419720 - DNA, 25 bp, Mus musculus
gaactctgcgcaaaacgagcctgaa

SEQ ID NO: 419721 - DNA, 25 bp, Mus musculus
gaactctgcgcataacgagcctgaa

SEQ ID NO: 419722 - DNA, 25 bp, Mus musculus
gaactctgctagatttggctatcga

SEQ ID NO: 419723 - DNA, 25 bp, Mus musculus
gaactctgctagttttggctatcga

SEQ ID NO: 419724 - DNA, 25 bp, Mus musculus
gaactctgctgaagtgttgctgaaa

SEQ ID NO: 419725 - DNA, 25 bp, Mus musculus
gaactctgctgatgtgttgctgaaa

SEQ ID NO: 419726 - DNA, 25 bp, Mus musculus
gaactctgcttaatcgcctgttaag

SEQ ID NO: 419727 - DNA, 25 bp, Mus musculus
gaactctgcttattcgcctgttaag

SEQ ID NO: 419728 - DNA, 25 bp, Mus musculus
gaactctggacaattctacttggga

SEQ ID NO: 419729 - DNA, 25 bp, Mus musculus
gaactctggacatttctacttggga

SEQ ID NO: 419730 - DNA, 25 bp, Mus musculus
gaactctggaggacttatctcatcc

SEQ ID NO: 419731 - DNA, 25 bp, Mus musculus
gaactctggaggtcttatctcatcc

SEQ ID NO: 419732 - DNA, 25 bp, Mus musculus
gaactctggccacaatctaagcctg

SEQ ID NO: 419733 - DNA, 25 bp, Mus musculus
gaactctggccagaatctaagcctg

SEQ ID NO: 419734 - DNA, 25 bp, Mus musculus
gaactctgggatatcgaagctagtg

SEQ ID NO: 419735 - DNA, 25 bp, Mus musculus
gaactctgggatttcgaagctagtg

SEQ ID NO: 419736 - DNA, 25 bp, Mus musculus
gaactctgggctacgtgctgggcat

SEQ ID NO: 419737 - DNA, 25 bp, Mus musculus
gaactctgggctctgcatatgctaa

SEQ ID NO: 419738 - DNA, 25 bp, Mus musculus
gaactctgggctgtgcatatgctaa

SEQ ID NO: 419739 - DNA, 25 bp, Mus musculus
gaactctgggcttcgtgctgggcat

SEQ ID NO: 419740 - DNA, 25 bp, Mus musculus
gaactctggtaaagcttagtcttgt

SEQ ID NO: 419741 - DNA, 25 bp, Mus musculus
gaactctggtaatgcttagtcttgt

SEQ ID NO: 419742 - DNA, 25 bp, Mus musculus
gaactctgtactattcctacagctt

SEQ ID NO: 419743 - DNA, 25 bp, Mus musculus
gaactctgtacttttcctacagctt

SEQ ID NO: 419744 - DNA, 25 bp, Mus musculus
gaactctgtccccttgatttagaat

SEQ ID NO: 419745 - DNA, 25 bp, Mus musculus
gaactctgtcccgttgatttagaat

SEQ ID NO: 419746 - DNA, 25 bp, Mus musculus
gaactctgtctcacagaacttgctt

SEQ ID NO: 419747 - DNA, 25 bp, Mus musculus
gaactctgtctctcagaacttgctt

SEQ ID NO: 419748 - DNA, 25 bp, Mus musculus
gaactctgtgatcgttatggcaaca

SEQ ID NO: 419749 - DNA, 25 bp, Mus musculus
gaactctgtgatggttatggcaaca

SEQ ID NO: 419750 - DNA, 25 bp, Mus musculus
gaactctgtgctaaacctttgtggc

SEQ ID NO: 419751 - DNA, 25 bp, Mus musculus
gaactctgtgcttaacctttgtggc

SEQ ID NO: 419752 - DNA, 25 bp, Mus musculus
gaactctgtgtaacatgatcctcat

SEQ ID NO: 419753 - DNA, 25 bp, Mus musculus
gaactctgtgtatcatgatcctcat

SEQ ID NO: 419754 - DNA, 25 bp, Mus musculus
gaactctgtgtgcatactttggaaa

SEQ ID NO: 419755 - DNA, 25 bp, Mus musculus
gaactctgtgtggatactttggaaa

SEQ ID NO: 419756 - DNA, 25 bp, Mus musculus
gaactctgttcacagccaatctgaa

SEQ ID NO: 419757 - DNA, 25 bp, Mus musculus
gaactctgttcacaggtatcctacc

SEQ ID NO: 419758 - DNA, 25 bp, Mus musculus
gaactctgttcagagccaatctgaa

SEQ ID NO: 419759 - DNA, 25 bp, Mus musculus
gaactctgttcagaggtatcctacc

SEQ ID NO: 419760 - DNA, 25 bp, Mus musculus
gaactctgttccattgtaagagcaa

SEQ ID NO: 419761 - DNA, 25 bp, Mus musculus
gaactctgttcctttgtaagagcaa

SEQ ID NO: 419762 - DNA, 25 bp, Mus musculus
gaactctgttctcttttgtcctgca

SEQ ID NO: 419763 - DNA, 25 bp, Mus musculus
gaactctgttctgttttgtcctgca

SEQ ID NO: 419764 - DNA, 25 bp, Mus musculus
gaactcttaagtcttattgatgaga

SEQ ID NO: 419765 - DNA, 25 bp, Mus musculus
gaactcttaagtgttattgatgaga

SEQ ID NO: 419766 - DNA, 25 bp, Mus musculus
gaactcttacacacatcgccaaggt

SEQ ID NO: 419767 - DNA, 25 bp, Mus musculus
gaactcttacactcatcgccaaggt

SEQ ID NO: 419768 - DNA, 25 bp, Mus musculus
gaactcttacatagtctgaaactat

SEQ ID NO: 419769 - DNA, 25 bp, Mus musculus
gaactcttacattgtctgaaactat

SEQ ID NO: 419770 - DNA, 25 bp, Mus musculus
gaactcttacgtacattccaaagac

SEQ ID NO: 419771 - DNA, 25 bp, Mus musculus
gaactcttacgttcattccaaagac

SEQ ID NO: 419772 - DNA, 25 bp, Mus musculus
gaactcttactacttccaaccttca

SEQ ID NO: 419773 - DNA, 25 bp, Mus musculus
gaactcttactagttccaaccttca

SEQ ID NO: 419774 - DNA, 25 bp, Mus musculus
gaactcttagatagatcccgaggac

SEQ ID NO: 419775 - DNA, 25 bp, Mus musculus
gaactcttagattgatcccgaggac

SEQ ID NO: 419776 - DNA, 25 bp, Mus musculus
gaactcttagtacccaggaaatgga

SEQ ID NO: 419777 - DNA, 25 bp, Mus musculus
gaactcttagtagccaggaaatgga

SEQ ID NO: 419778 - DNA, 25 bp, Mus musculus
gaactcttatttagtaagtgctgct

SEQ ID NO: 419779 - DNA, 25 bp, Mus musculus
gaactcttattttgtaagtgctgct

SEQ ID NO: 419780 - DNA, 25 bp, Mus musculus
gaactcttcacacgaggtgctgtta

SEQ ID NO: 419781 - DNA, 25 bp, Mus musculus
gaactcttcacaggaggtgctgtta

SEQ ID NO: 419782 - DNA, 25 bp, Mus musculus
gaactcttcagcaactagtgttaaa

SEQ ID NO: 419783 - DNA, 25 bp, Mus musculus
gaactcttcagctactagtgttaaa

SEQ ID NO: 419784 - DNA, 25 bp, Mus musculus
gaactcttccaacagcccaagagag

SEQ ID NO: 419785 - DNA, 25 bp, Mus musculus
gaactcttccaagagcccaagagag

SEQ ID NO: 419786 - DNA, 25 bp, Mus musculus
gaactcttccagctgttgaagatga

SEQ ID NO: 419787 - DNA, 25 bp, Mus musculus
gaactcttccaggtgttgaagatga

SEQ ID NO: 419788 - DNA, 25 bp, Mus musculus
gaactcttctcaagttatgtccaga

SEQ ID NO: 419789 - DNA, 25 bp, Mus musculus
gaactcttctcatgttatgtccaga

SEQ ID NO: 419790 - DNA, 25 bp, Mus musculus
gaactcttgagaatattctagctgc

SEQ ID NO: 419791 - DNA, 25 bp, Mus musculus
gaactcttgagattattctagctgc

SEQ ID NO: 419792 - DNA, 25 bp, Mus musculus
gaactcttgagcaagtcccttgagg

SEQ ID NO: 419793 - DNA, 25 bp, Mus musculus
gaactcttgagctagtcccttgagg

SEQ ID NO: 419794 - DNA, 25 bp, Mus musculus
gaactcttgataattttgtcatgcc

SEQ ID NO: 419795 - DNA, 25 bp, Mus musculus
gaactcttgatatttttgtcatgcc

SEQ ID NO: 419796 - DNA, 25 bp, Mus musculus
gaactcttgccgagatgtgatccta

SEQ ID NO: 419797 - DNA, 25 bp, Mus musculus
gaactcttgccgtgatgtgatccta

SEQ ID NO: 419798 - DNA, 25 bp, Mus musculus
gaactcttgcctatggatgtctcat

SEQ ID NO: 419799 - DNA, 25 bp, Mus musculus
gaactcttgcctattttgccattat

SEQ ID NO: 419800 - DNA, 25 bp, Mus musculus
gaactcttgcctttggatgtctcat

SEQ ID NO: 419801 - DNA, 25 bp, Mus musculus
gaactcttgccttttttgccattat

SEQ ID NO: 419802 - DNA, 25 bp, Mus musculus
gaactcttgggccaatcagcctaaa

SEQ ID NO: 419803 - DNA, 25 bp, Mus musculus
gaactcttgggcgaatcagcctaaa

SEQ ID NO: 419804 - DNA, 25 bp, Mus musculus
gaactcttgtagaggaagcagcttc

SEQ ID NO: 419805 - DNA, 25 bp, Mus musculus
gaactcttgtagtggaagcagcttc

SEQ ID NO: 419806 - DNA, 25 bp, Mus musculus
gaactcttgttcaacctaacgtata

SEQ ID NO: 419807 - DNA, 25 bp, Mus musculus
gaactcttgttctacctaacgtata

SEQ ID NO: 419808 - DNA, 25 bp, Mus musculus
gaactcttgtttctgcacagtccag

SEQ ID NO: 419809 - DNA, 25 bp, Mus musculus
gaactcttgtttgtgcacagtccag

SEQ ID NO: 419810 - DNA, 25 bp, Mus musculus
gaactctttagaacattccagaagc

SEQ ID NO: 419811 - DNA, 25 bp, Mus musculus
gaactctttagaaccacattggcta

SEQ ID NO: 419812 - DNA, 25 bp, Mus musculus
gaactctttagatcattccagaagc

SEQ ID NO: 419813 - DNA, 25 bp, Mus musculus
gaactctttagatccacattggcta

SEQ ID NO: 419814 - DNA, 25 bp, Mus musculus
gaactctttataaggtggctcattg

SEQ ID NO: 419815 - DNA, 25 bp, Mus musculus
gaactctttatatggtggctcattg

SEQ ID NO: 419816 - DNA, 25 bp, Mus musculus
gaactctttcctacacgtttcataa

SEQ ID NO: 419817 - DNA, 25 bp, Mus musculus
gaactctttccttcacgtttcataa

SEQ ID NO: 419818 - DNA, 25 bp, Mus musculus
gaactctttcttagcaggcacatta

SEQ ID NO: 419819 - DNA, 25 bp, Mus musculus
gaactctttctttgcaggcacatta

SEQ ID NO: 419820 - DNA, 25 bp, Mus musculus
gaactctttgagatatggtctgagg

SEQ ID NO: 419821 - DNA, 25 bp, Mus musculus
gaactctttgagttatggtctgagg

SEQ ID NO: 419822 - DNA, 25 bp, Mus musculus
gaactcttttggcataaatatttgt

SEQ ID NO: 419823 - DNA, 25 bp, Mus musculus
gaactcttttgggataaatatttgt

SEQ ID NO: 419824 - DNA, 25 bp, Mus musculus
gaactctttttcaccagtaactatt

SEQ ID NO: 419825 - DNA, 25 bp, Mus musculus
gaactctttttctccagtaactatt

SEQ ID NO: 419826 - DNA, 25 bp, Mus musculus
gaactgaaacttctgtcctccagcc

SEQ ID NO: 419827 - DNA, 25 bp, Mus musculus
gaactgaaacttgtgtcctccagcc

SEQ ID NO: 419828 - DNA, 25 bp, Mus musculus
gaactgaaagcgacctggtttggtt

SEQ ID NO: 419829 - DNA, 25 bp, Mus musculus
gaactgaaagcgtcctggtttggtt

SEQ ID NO: 419830 - DNA, 25 bp, Mus musculus
gaactgaaaggccttcttctgtctc

SEQ ID NO: 419831 - DNA, 25 bp, Mus musculus
gaactgaaaggcgttcttctgtctc

SEQ ID NO: 419832 - DNA, 25 bp, Mus musculus
gaactgaaattccatgacttccaat

SEQ ID NO: 419833 - DNA, 25 bp, Mus musculus
gaactgaaattcgatgacttccaat

SEQ ID NO: 419834 - DNA, 25 bp, Mus musculus
gaactgaacacacgttctctgaaat

SEQ ID NO: 419835 - DNA, 25 bp, Mus musculus
gaactgaacacaggttctctgaaat

SEQ ID NO: 419836 - DNA, 25 bp, Mus musculus
gaactgaacacgcttggcctagacg

SEQ ID NO: 419837 - DNA, 25 bp, Mus musculus
gaactgaacacggttggcctagacg

SEQ ID NO: 419838 - DNA, 25 bp, Mus musculus
gaactgaacattatgtctcacagac

SEQ ID NO: 419839 - DNA, 25 bp, Mus musculus
gaactgaacattttgtctcacagac

SEQ ID NO: 419840 - DNA, 25 bp, Mus musculus
gaactgaacctaagtcctggaagag

SEQ ID NO: 419841 - DNA, 25 bp, Mus musculus
gaactgaacctatgtcctggaagag

SEQ ID NO: 419842 - DNA, 25 bp, Mus musculus
gaactgaacctgcaccttgagataa

SEQ ID NO: 419843 - DNA, 25 bp, Mus musculus
gaactgaacctggaccttgagataa

SEQ ID NO: 419844 - DNA, 25 bp, Mus musculus
gaactgaacgtcacggtggtcacct

SEQ ID NO: 419845 - DNA, 25 bp, Mus musculus
gaactgaacgtcagcgggctcagca

SEQ ID NO: 419846 - DNA, 25 bp, Mus musculus
gaactgaacgtctcggtggtcacct

SEQ ID NO: 419847 - DNA, 25 bp, Mus musculus
gaactgaacgtctgcgggctcagca

SEQ ID NO: 419848 - DNA, 25 bp, Mus musculus
gaactgaactcacccttctagaaaa

SEQ ID NO: 419849 - DNA, 25 bp, Mus musculus
gaactgaactcagccttctagaaaa

SEQ ID NO: 419850 - DNA, 25 bp, Mus musculus
gaactgaactgcagttattctgaca

SEQ ID NO: 419851 - DNA, 25 bp, Mus musculus
gaactgaactgctgttattctgaca

SEQ ID NO: 419852 - DNA, 25 bp, Mus musculus
gaactgaactgtaaggacttctgca

SEQ ID NO: 419853 - DNA, 25 bp, Mus musculus
gaactgaactgttaggacttctgca

SEQ ID NO: 419854 - DNA, 25 bp, Mus musculus
gaactgaacttcacattgttgcctt

SEQ ID NO: 419855 - DNA, 25 bp, Mus musculus
gaactgaacttctcattgttgcctt

SEQ ID NO: 419856 - DNA, 25 bp, Mus musculus
gaactgaagagacttccttctcaca

SEQ ID NO: 419857 - DNA, 25 bp, Mus musculus
gaactgaagagagttccttctcaca

SEQ ID NO: 419858 - DNA, 25 bp, Mus musculus
gaactgaagccacgcgagtgaccct

SEQ ID NO: 419859 - DNA, 25 bp, Mus musculus
gaactgaagccaggcgagtgaccct

SEQ ID NO: 419860 - DNA, 25 bp, Mus musculus
gaactgaaggaacgtttcacccgct

SEQ ID NO: 419861 - DNA, 25 bp, Mus musculus
gaactgaaggaaggtttcacccgct

SEQ ID NO: 419862 - DNA, 25 bp, Mus musculus
gaactgaaggcaatcgcatgtgtaa

SEQ ID NO: 419863 - DNA, 25 bp, Mus musculus
gaactgaaggcattcgcatgtgtaa

SEQ ID NO: 419864 - DNA, 25 bp, Mus musculus
gaactgaaggttctcctgaccagga

SEQ ID NO: 419865 - DNA, 25 bp, Mus musculus
gaactgaaggttgtcctgaccagga

SEQ ID NO: 419866 - DNA, 25 bp, Mus musculus
gaactgaagtctcaggccttggcct

SEQ ID NO: 419867 - DNA, 25 bp, Mus musculus
gaactgaagtctgaggccttggcct

SEQ ID NO: 419868 - DNA, 25 bp, Mus musculus
gaactgaagtgactcccggtttcct

SEQ ID NO: 419869 - DNA, 25 bp, Mus musculus
gaactgaagtgagtcccggtttcct

SEQ ID NO: 419870 - DNA, 25 bp, Mus musculus
gaactgaatcacatcaaccagccac

SEQ ID NO: 419871 - DNA, 25 bp, Mus musculus
gaactgaatcacttcaaccagccac

SEQ ID NO: 419872 - DNA, 25 bp, Mus musculus
gaactgaatcgcctccaagcagaaa

SEQ ID NO: 419873 - DNA, 25 bp, Mus musculus
gaactgaatcgcgtccaagcagaaa

SEQ ID NO: 419874 - DNA, 25 bp, Mus musculus
gaactgaatcttccttgtcttagta

SEQ ID NO: 419875 - DNA, 25 bp, Mus musculus
gaactgaatcttgcttgtcttagta

SEQ ID NO: 419876 - DNA, 25 bp, Mus musculus
gaactgaatgatccttatatccctt

SEQ ID NO: 419877 - DNA, 25 bp, Mus musculus
gaactgaatgatgcttatatccctt

SEQ ID NO: 419878 - DNA, 25 bp, Mus musculus
gaactgaattctagtaccagtccat

SEQ ID NO: 419879 - DNA, 25 bp, Mus musculus
gaactgaattctcctgggttgtggt

SEQ ID NO: 419880 - DNA, 25 bp, Mus musculus
gaactgaattctgctgggttgtggt

SEQ ID NO: 419881 - DNA, 25 bp, Mus musculus
gaactgaattcttgtaccagtccat

SEQ ID NO: 419882 - DNA, 25 bp, Mus musculus
gaactgacaactaagatccgtggga

SEQ ID NO: 419883 - DNA, 25 bp, Mus musculus
gaactgacaacttagatccgtggga

SEQ ID NO: 419884 - DNA, 25 bp, Mus musculus
gaactgacagtaatacatgattaaa

SEQ ID NO: 419885 - DNA, 25 bp, Mus musculus
gaactgacagtattacatgattaaa

SEQ ID NO: 419886 - DNA, 25 bp, Mus musculus
gaactgacagtcaaacttctcggac

SEQ ID NO: 419887 - DNA, 25 bp, Mus musculus
gaactgacagtctaacttctcggac

SEQ ID NO: 419888 - DNA, 25 bp, Mus musculus
gaactgacataaccctgatcagttt

SEQ ID NO: 419889 - DNA, 25 bp, Mus musculus
gaactgacataagcctgatcagttt

SEQ ID NO: 419890 - DNA, 25 bp, Mus musculus
gaactgaccattctcatcagtgcac

SEQ ID NO: 419891 - DNA, 25 bp, Mus musculus
gaactgaccattgtcatcagtgcac

SEQ ID NO: 419892 - DNA, 25 bp, Mus musculus
gaactgaccctgaatccaatgataa

SEQ ID NO: 419893 - DNA, 25 bp, Mus musculus
gaactgaccctgagaaatcctcctc

SEQ ID NO: 419894 - DNA, 25 bp, Mus musculus
gaactgaccctgtatccaatgataa

SEQ ID NO: 419895 - DNA, 25 bp, Mus musculus
gaactgaccctgtgaaatcctcctc

SEQ ID NO: 419896 - DNA, 25 bp, Mus musculus
gaactgacctccatagctgaaatat

SEQ ID NO: 419897 - DNA, 25 bp, Mus musculus
gaactgacctccttagctgaaatat

SEQ ID NO: 419898 - DNA, 25 bp, Mus musculus
gaactgacgaatcccaggaagaggt

SEQ ID NO: 419899 - DNA, 25 bp, Mus musculus
gaactgacgaatgccaggaagaggt

SEQ ID NO: 419900 - DNA, 25 bp, Mus musculus
gaactgacgatgatgctgccgctgc

SEQ ID NO: 419901 - DNA, 25 bp, Mus musculus
gaactgacgatgttgctgccgctgc

SEQ ID NO: 419902 - DNA, 25 bp, Mus musculus
gaactgacggacaagctgctcatct

SEQ ID NO: 419903 - DNA, 25 bp, Mus musculus
gaactgacggactagctgctcatct

SEQ ID NO: 419904 - DNA, 25 bp, Mus musculus
gaactgactcatagctcggaatgtc

SEQ ID NO: 419905 - DNA, 25 bp, Mus musculus
gaactgactcattgctcggaatgtc

SEQ ID NO: 419906 - DNA, 25 bp, Mus musculus
gaactgactccacagtatgctgtca

SEQ ID NO: 419907 - DNA, 25 bp, Mus musculus
gaactgactccagagtatgctgtca

SEQ ID NO: 419908 - DNA, 25 bp, Mus musculus
gaactgactctgatcacttggatgt

SEQ ID NO: 419909 - DNA, 25 bp, Mus musculus
gaactgactctgttcacttggatgt

SEQ ID NO: 419910 - DNA, 25 bp, Mus musculus
gaactgactgacatatagcccttca

SEQ ID NO: 419911 - DNA, 25 bp, Mus musculus
gaactgactgacttatagcccttca

SEQ ID NO: 419912 - DNA, 25 bp, Mus musculus
gaactgactgatatttacatcttat

SEQ ID NO: 419913 - DNA, 25 bp, Mus musculus
gaactgactgatttttacatcttat

SEQ ID NO: 419914 - DNA, 25 bp, Mus musculus
gaactgactggtaagtgattgtcta

SEQ ID NO: 419915 - DNA, 25 bp, Mus musculus
gaactgactggttagtgattgtcta

SEQ ID NO: 419916 - DNA, 25 bp, Mus musculus
gaactgactgttaaaatggccgtat

SEQ ID NO: 419917 - DNA, 25 bp, Mus musculus
gaactgactgttatggtagctagat

SEQ ID NO: 419918 - DNA, 25 bp, Mus musculus
gaactgactgtttaaatggccgtat

SEQ ID NO: 419919 - DNA, 25 bp, Mus musculus
gaactgactgttttggtagctagat

SEQ ID NO: 419920 - DNA, 25 bp, Mus musculus
gaactgacttctcagaaccttgatg

SEQ ID NO: 419921 - DNA, 25 bp, Mus musculus
gaactgacttctgagaaccttgatg

SEQ ID NO: 419922 - DNA, 25 bp, Mus musculus
gaactgacttgcaacccacctgcag

SEQ ID NO: 419923 - DNA, 25 bp, Mus musculus
gaactgacttgctacccacctgcag

SEQ ID NO: 419924 - DNA, 25 bp, Mus musculus
gaactgagaaaacgccttcccacat

SEQ ID NO: 419925 - DNA, 25 bp, Mus musculus
gaactgagaaaaggccttcccacat

SEQ ID NO: 419926 - DNA, 25 bp, Mus musculus
gaactgagaagaagcgctcctctct

SEQ ID NO: 419927 - DNA, 25 bp, Mus musculus
gaactgagaagatgcgctcctctct

SEQ ID NO: 419928 - DNA, 25 bp, Mus musculus
gaactgagacaaatcactctggctg

SEQ ID NO: 419929 - DNA, 25 bp, Mus musculus
gaactgagacaattcactctggctg

SEQ ID NO: 419930 - DNA, 25 bp, Mus musculus
gaactgagactacattagccctaag

SEQ ID NO: 419931 - DNA, 25 bp, Mus musculus
gaactgagactagattagccctaag

SEQ ID NO: 419932 - DNA, 25 bp, Mus musculus
gaactgagactcatcattctgttta

SEQ ID NO: 419933 - DNA, 25 bp, Mus musculus
gaactgagactcttcattctgttta

SEQ ID NO: 419934 - DNA, 25 bp, Mus musculus
gaactgagagatagtgtggtgccca

SEQ ID NO: 419935 - DNA, 25 bp, Mus musculus
gaactgagagattgtgtggtgccca

SEQ ID NO: 419936 - DNA, 25 bp, Mus musculus
gaactgagagtaatcgtcacccaga

SEQ ID NO: 419937 - DNA, 25 bp, Mus musculus
gaactgagagtattcgtcacccaga

SEQ ID NO: 419938 - DNA, 25 bp, Mus musculus
gaactgagatatcccgccatctgga

SEQ ID NO: 419939 - DNA, 25 bp, Mus musculus
gaactgagatatgccgccatctgga

SEQ ID NO: 419940 - DNA, 25 bp, Mus musculus
gaactgagccacacaagtcttgcta

SEQ ID NO: 419941 - DNA, 25 bp, Mus musculus
gaactgagccactcaagtcttgcta

SEQ ID NO: 419942 - DNA, 25 bp, Mus musculus
gaactgagccatcctcttaagggca

SEQ ID NO: 419943 - DNA, 25 bp, Mus musculus
gaactgagccatgctcttaagggca

SEQ ID NO: 419944 - DNA, 25 bp, Mus musculus
gaactgagcccacagcccgggtccc

SEQ ID NO: 419945 - DNA, 25 bp, Mus musculus
gaactgagcccagagcccgggtccc

SEQ ID NO: 419946 - DNA, 25 bp, Mus musculus
gaactgagcctgatagccaccagga

SEQ ID NO: 419947 - DNA, 25 bp, Mus musculus
gaactgagcctgttagccaccagga

SEQ ID NO: 419948 - DNA, 25 bp, Mus musculus
gaactgagggtgcttttccctccaa

SEQ ID NO: 419949 - DNA, 25 bp, Mus musculus
gaactgagggtggttttccctccaa

SEQ ID NO: 419950 - DNA, 25 bp, Mus musculus
gaactgaggttcaacttttacttca

SEQ ID NO: 419951 - DNA, 25 bp, Mus musculus
gaactgaggttctacttttacttca

SEQ ID NO: 419952 - DNA, 25 bp, Mus musculus
gaactgagtattctgccaacagcag

SEQ ID NO: 419953 - DNA, 25 bp, Mus musculus
gaactgagtattgtgccaacagcag

SEQ ID NO: 419954 - DNA, 25 bp, Mus musculus
gaactgagtcagacaccaaaggcct

SEQ ID NO: 419955 - DNA, 25 bp, Mus musculus
gaactgagtcagtcaccaaaggcct

SEQ ID NO: 419956 - DNA, 25 bp, Mus musculus
gaactgagtcggcttttgctacaaa

SEQ ID NO: 419957 - DNA, 25 bp, Mus musculus
gaactgagtcgggttttgctacaaa

SEQ ID NO: 419958 - DNA, 25 bp, Mus musculus
gaactgagtctaaaacgagagttat

SEQ ID NO: 419959 - DNA, 25 bp, Mus musculus
gaactgagtctacaccgagcgtcgt

SEQ ID NO: 419960 - DNA, 25 bp, Mus musculus
gaactgagtctagaccgagcgtcgt

SEQ ID NO: 419961 - DNA, 25 bp, Mus musculus
gaactgagtctataacgagagttat

SEQ ID NO: 419962 - DNA, 25 bp, Mus musculus
gaactgagtcttctctcaggagctc

SEQ ID NO: 419963 - DNA, 25 bp, Mus musculus
gaactgagtcttgtctcaggagctc

SEQ ID NO: 419964 - DNA, 25 bp, Mus musculus
gaactgagtgtaaattgcctgaaat

SEQ ID NO: 419965 - DNA, 25 bp, Mus musculus
gaactgagtgtatattgcctgaaat

SEQ ID NO: 419966 - DNA, 25 bp, Mus musculus
gaactgagttcacacactttgctct

SEQ ID NO: 419967 - DNA, 25 bp, Mus musculus
gaactgagttcagacactttgctct

SEQ ID NO: 419968 - DNA, 25 bp, Mus musculus
gaactgagttgaaacattgaaaatt

SEQ ID NO: 419969 - DNA, 25 bp, Mus musculus
gaactgagttgatacattgaaaatt

SEQ ID NO: 419970 - DNA, 25 bp, Mus musculus
gaactgataaagaagcaagtcctaa

SEQ ID NO: 419971 - DNA, 25 bp, Mus musculus
gaactgataaagtagcaagtcctaa

SEQ ID NO: 419972 - DNA, 25 bp, Mus musculus
gaactgatatagagacctccaccct

SEQ ID NO: 419973 - DNA, 25 bp, Mus musculus
gaactgatatagtgacctccaccct

SEQ ID NO: 419974 - DNA, 25 bp, Mus musculus
gaactgatatgtcacttcttggcca

SEQ ID NO: 419975 - DNA, 25 bp, Mus musculus
gaactgatatgtcttccagtgagac

SEQ ID NO: 419976 - DNA, 25 bp, Mus musculus
gaactgatatgtgacttcttggcca

SEQ ID NO: 419977 - DNA, 25 bp, Mus musculus
gaactgatatgtgttccagtgagac

SEQ ID NO: 419978 - DNA, 25 bp, Mus musculus
gaactgatatttaaaaccatggctc

SEQ ID NO: 419979 - DNA, 25 bp, Mus musculus
gaactgatattttaaaccatggctc

SEQ ID NO: 419980 - DNA, 25 bp, Mus musculus
gaactgatcataatctggcaggtga

SEQ ID NO: 419981 - DNA, 25 bp, Mus musculus
gaactgatcatattctggcaggtga

SEQ ID NO: 419982 - DNA, 25 bp, Mus musculus
gaactgatccaaaaagctggtctct

SEQ ID NO: 419983 - DNA, 25 bp, Mus musculus
gaactgatccaataagctggtctct

SEQ ID NO: 419984 - DNA, 25 bp, Mus musculus
gaactgatccgaagctcattccaag

SEQ ID NO: 419985 - DNA, 25 bp, Mus musculus
gaactgatccgatgctcattccaag

SEQ ID NO: 419986 - DNA, 25 bp, Mus musculus
gaactgatccggcaggtcaccatca

SEQ ID NO: 419987 - DNA, 25 bp, Mus musculus
gaactgatccgggaggtcaccatca

SEQ ID NO: 419988 - DNA, 25 bp, Mus musculus
gaactgatcgggaaggtcttacttt

SEQ ID NO: 419989 - DNA, 25 bp, Mus musculus
gaactgatcgggtaggtcttacttt

SEQ ID NO: 419990 - DNA, 25 bp, Mus musculus
gaactgatgacgaatttccagccgt

SEQ ID NO: 419991 - DNA, 25 bp, Mus musculus
gaactgatgacgtatttccagccgt

SEQ ID NO: 419992 - DNA, 25 bp, Mus musculus
gaactgatgcctcactcatgctaaa

SEQ ID NO: 419993 - DNA, 25 bp, Mus musculus
gaactgatgcctgactcatgctaaa

SEQ ID NO: 419994 - DNA, 25 bp, Mus musculus
gaactgatggctctactgtaaataa

SEQ ID NO: 419995 - DNA, 25 bp, Mus musculus
gaactgatggctgtactgtaaataa

SEQ ID NO: 419996 - DNA, 25 bp, Mus musculus
gaactgatgtttctgcactgtcgag

SEQ ID NO: 419997 - DNA, 25 bp, Mus musculus
gaactgatgtttgtgcactgtcgag

SEQ ID NO: 419998 - DNA, 25 bp, Mus musculus
gaactgattctgaggatgcatcggc

SEQ ID NO: 419999 - DNA, 25 bp, Mus musculus
gaactgattctgtggatgcatcggc

SEQ ID NO: 420000 - DNA, 25 bp, Mus musculus
gaactgattcttctattgattggga

SEQ ID NO: 420001 - DNA, 25 bp, Mus musculus
gaactgattcttgtattgattggga

SEQ ID NO: 420002 - DNA, 25 bp, Mus musculus
gaactgattgtaagctgctttcata

SEQ ID NO: 420003 - DNA, 25 bp, Mus musculus
gaactgattgtatgctgctttcata

SEQ ID NO: 420004 - DNA, 25 bp, Mus musculus
gaactgatttcaatttgctcaaggg

SEQ ID NO: 420005 - DNA, 25 bp, Mus musculus
gaactgatttcattttgctcaaggg

SEQ ID NO: 420006 - DNA, 25 bp, Mus musculus
gaactgatttccaagcattcttccc

SEQ ID NO: 420007 - DNA, 25 bp, Mus musculus
gaactgatttccctaacaggtcaaa

SEQ ID NO: 420008 - DNA, 25 bp, Mus musculus
gaactgatttccgtaacaggtcaaa

SEQ ID NO: 420009 - DNA, 25 bp, Mus musculus
gaactgatttcctagcattcttccc

SEQ ID NO: 420010 - DNA, 25 bp, Mus musculus
gaactgatttgtcacagagtcccaa

SEQ ID NO: 420011 - DNA, 25 bp, Mus musculus
gaactgatttgtgacagagtcccaa

SEQ ID NO: 420012 - DNA, 25 bp, Mus musculus
gaactgcaacatagacacaaattac

SEQ ID NO: 420013 - DNA, 25 bp, Mus musculus
gaactgcaacattgacacaaattac

SEQ ID NO: 420014 - DNA, 25 bp, Mus musculus
gaactgcaaggaatccaagctccta

SEQ ID NO: 420015 - DNA, 25 bp, Mus musculus
gaactgcaaggattccaagctccta

SEQ ID NO: 420016 - DNA, 25 bp, Mus musculus
gaactgcaatccctttcttaaagtg

SEQ ID NO: 420017 - DNA, 25 bp, Mus musculus
gaactgcaatccgtttcttaaagtg

SEQ ID NO: 420018 - DNA, 25 bp, Mus musculus
gaactgcacaatagggatcacattt

SEQ ID NO: 420019 - DNA, 25 bp, Mus musculus
gaactgcacaatcatctcctgtgtt

SEQ ID NO: 420020 - DNA, 25 bp, Mus musculus
gaactgcacaatgatctcctgtgtt

SEQ ID NO: 420021 - DNA, 25 bp, Mus musculus
gaactgcacaattgggatcacattt

SEQ ID NO: 420022 - DNA, 25 bp, Mus musculus
gaactgcacgtgctggcacaagttc

SEQ ID NO: 420023 - DNA, 25 bp, Mus musculus
gaactgcacgtggtggcacaagttc

SEQ ID NO: 420024 - DNA, 25 bp, Mus musculus
gaactgcagagtccctagcaggcta

SEQ ID NO: 420025 - DNA, 25 bp, Mus musculus
gaactgcagagtgcctagcaggcta

SEQ ID NO: 420026 - DNA, 25 bp, Mus musculus
gaactgcagatccacttgttctcaa

SEQ ID NO: 420027 - DNA, 25 bp, Mus musculus
gaactgcagatcgacttgttctcaa

SEQ ID NO: 420028 - DNA, 25 bp, Mus musculus
gaactgcagcaaatagtcactgcta

SEQ ID NO: 420029 - DNA, 25 bp, Mus musculus
gaactgcagcaactgaggcctgtgc

SEQ ID NO: 420030 - DNA, 25 bp, Mus musculus
gaactgcagcaagtgaggcctgtgc

SEQ ID NO: 420031 - DNA, 25 bp, Mus musculus
gaactgcagcaattagtcactgcta

SEQ ID NO: 420032 - DNA, 25 bp, Mus musculus
gaactgcagcataataccacggcat

SEQ ID NO: 420033 - DNA, 25 bp, Mus musculus
gaactgcagcattataccacggcat

SEQ ID NO: 420034 - DNA, 25 bp, Mus musculus
gaactgcagcccaagtgagcttgaa

SEQ ID NO: 420035 - DNA, 25 bp, Mus musculus
gaactgcagccccaggagtagtaca

SEQ ID NO: 420036 - DNA, 25 bp, Mus musculus
gaactgcagcccgaggagtagtaca

SEQ ID NO: 420037 - DNA, 25 bp, Mus musculus
gaactgcagccctagtgagcttgaa

SEQ ID NO: 420038 - DNA, 25 bp, Mus musculus
gaactgcagcgtccgaggaaatccc

SEQ ID NO: 420039 - DNA, 25 bp, Mus musculus
gaactgcagcgtgcgaggaaatccc

SEQ ID NO: 420040 - DNA, 25 bp, Mus musculus
gaactgcagctacgcacctgtgaac

SEQ ID NO: 420041 - DNA, 25 bp, Mus musculus
gaactgcagctaggcacctgtgaac

SEQ ID NO: 420042 - DNA, 25 bp, Mus musculus
gaactgcaggacatgatcaatgaag

SEQ ID NO: 420043 - DNA, 25 bp, Mus musculus
gaactgcaggacttgatcaatgaag

SEQ ID NO: 420044 - DNA, 25 bp, Mus musculus
gaactgcaggctacaaaggtcaatg

SEQ ID NO: 420045 - DNA, 25 bp, Mus musculus
gaactgcaggcttcaaaggtcaatg

SEQ ID NO: 420046 - DNA, 25 bp, Mus musculus
gaactgcaggttcaactgtctggct

SEQ ID NO: 420047 - DNA, 25 bp, Mus musculus
gaactgcaggttgaactgtctggct

SEQ ID NO: 420048 - DNA, 25 bp, Mus musculus
gaactgcagtgtactgtctggagtt

SEQ ID NO: 420049 - DNA, 25 bp, Mus musculus
gaactgcagtgttctgtctggagtt

SEQ ID NO: 420050 - DNA, 25 bp, Mus musculus
gaactgcatacaagttttgtactgt

SEQ ID NO: 420051 - DNA, 25 bp, Mus musculus
gaactgcatacatgttttgtactgt

SEQ ID NO: 420052 - DNA, 25 bp, Mus musculus
gaactgcataggatgctcctactgt

SEQ ID NO: 420053 - DNA, 25 bp, Mus musculus
gaactgcataggttgctcctactgt

SEQ ID NO: 420054 - DNA, 25 bp, Mus musculus
gaactgcatcaaatccaagaaactg

SEQ ID NO: 420055 - DNA, 25 bp, Mus musculus
gaactgcatcaattccaagaaactg

SEQ ID NO: 420056 - DNA, 25 bp, Mus musculus
gaactgcatgaccttctttgaagtc

SEQ ID NO: 420057 - DNA, 25 bp, Mus musculus
gaactgcatgacgttctttgaagtc

SEQ ID NO: 420058 - DNA, 25 bp, Mus musculus
gaactgcatgcaacatatgtcccaa

SEQ ID NO: 420059 - DNA, 25 bp, Mus musculus
gaactgcatgcatcatatgtcccaa

SEQ ID NO: 420060 - DNA, 25 bp, Mus musculus
gaactgcatgttagagaggttttac

SEQ ID NO: 420061 - DNA, 25 bp, Mus musculus
gaactgcatgttcgaaaatgctact

SEQ ID NO: 420062 - DNA, 25 bp, Mus musculus
gaactgcatgttggaaaatgctact

SEQ ID NO: 420063 - DNA, 25 bp, Mus musculus
gaactgcatgtttgagaggttttac

SEQ ID NO: 420064 - DNA, 25 bp, Mus musculus
gaactgcattgcactgacggcacca

SEQ ID NO: 420065 - DNA, 25 bp, Mus musculus
gaactgcattgctctgacggcacca

SEQ ID NO: 420066 - DNA, 25 bp, Mus musculus
gaactgccaaagacggtttctggaa

SEQ ID NO: 420067 - DNA, 25 bp, Mus musculus
gaactgccaaagtcggtttctggaa

SEQ ID NO: 420068 - DNA, 25 bp, Mus musculus
gaactgccaaatacattgtccttct

SEQ ID NO: 420069 - DNA, 25 bp, Mus musculus
gaactgccaaattcattgtccttct

SEQ ID NO: 420070 - DNA, 25 bp, Mus musculus
gaactgccaaccctgggatggacca

SEQ ID NO: 420071 - DNA, 25 bp, Mus musculus
gaactgccaaccgtgggatggacca

SEQ ID NO: 420072 - DNA, 25 bp, Mus musculus
gaactgccacatctcacgcaaaagg

SEQ ID NO: 420073 - DNA, 25 bp, Mus musculus
gaactgccacatgtcacgcaaaagg

SEQ ID NO: 420074 - DNA, 25 bp, Mus musculus
gaactgccacttcgtagtcaggcct

SEQ ID NO: 420075 - DNA, 25 bp, Mus musculus
gaactgccacttggtagtcaggcct

SEQ ID NO: 420076 - DNA, 25 bp, Mus musculus
gaactgccagagacaatggacccta

SEQ ID NO: 420077 - DNA, 25 bp, Mus musculus
gaactgccagagtcaatggacccta

SEQ ID NO: 420078 - DNA, 25 bp, Mus musculus
gaactgccagtaaagaaaggattct

SEQ ID NO: 420079 - DNA, 25 bp, Mus musculus
gaactgccagtatagaaaggattct

SEQ ID NO: 420080 - DNA, 25 bp, Mus musculus
gaactgccatcacagagaccttgga

SEQ ID NO: 420081 - DNA, 25 bp, Mus musculus
gaactgccatcagagagaccttgga

SEQ ID NO: 420082 - DNA, 25 bp, Mus musculus
gaactgcccagaatggagacggaat

SEQ ID NO: 420083 - DNA, 25 bp, Mus musculus
gaactgcccagattggagacggaat

SEQ ID NO: 420084 - DNA, 25 bp, Mus musculus
gaactgcccatacgtttttcaggaa

SEQ ID NO: 420085 - DNA, 25 bp, Mus musculus
gaactgcccataggtttttcaggaa

SEQ ID NO: 420086 - DNA, 25 bp, Mus musculus
gaactgcccatgacagtgcattgat

SEQ ID NO: 420087 - DNA, 25 bp, Mus musculus
gaactgcccatgtcagtgcattgat

SEQ ID NO: 420088 - DNA, 25 bp, Mus musculus
gaactgcccattctttcagaactag

SEQ ID NO: 420089 - DNA, 25 bp, Mus musculus
gaactgcccattgtttcagaactag

SEQ ID NO: 420090 - DNA, 25 bp, Mus musculus
gaactgcccctgctgtaaggagtgc

SEQ ID NO: 420091 - DNA, 25 bp, Mus musculus
gaactgcccctggtgtaaggagtgc

SEQ ID NO: 420092 - DNA, 25 bp, Mus musculus
gaactgcccgcacaggtgctgagaa

SEQ ID NO: 420093 - DNA, 25 bp, Mus musculus
gaactgcccgcagaggtgctgagaa

SEQ ID NO: 420094 - DNA, 25 bp, Mus musculus
gaactgccctacatatcttaaattg

SEQ ID NO: 420095 - DNA, 25 bp, Mus musculus
gaactgccctacttatcttaaattg

SEQ ID NO: 420096 - DNA, 25 bp, Mus musculus
gaactgccctgaaatctgagactgc

SEQ ID NO: 420097 - DNA, 25 bp, Mus musculus
gaactgccctgatatctgagactgc

SEQ ID NO: 420098 - DNA, 25 bp, Mus musculus
gaactgccgatccttggtgaaatat

SEQ ID NO: 420099 - DNA, 25 bp, Mus musculus
gaactgccgatcgttggtgaaatat

SEQ ID NO: 420100 - DNA, 25 bp, Mus musculus
gaactgcctatgatattgtcctaca

SEQ ID NO: 420101 - DNA, 25 bp, Mus musculus
gaactgcctatgttattgtcctaca

SEQ ID NO: 420102 - DNA, 25 bp, Mus musculus
gaactgcctcataccagatgctgtg

SEQ ID NO: 420103 - DNA, 25 bp, Mus musculus
gaactgcctcattccagatgctgtg

SEQ ID NO: 420104 - DNA, 25 bp, Mus musculus
gaactgcctcccatcataaatgtga

SEQ ID NO: 420105 - DNA, 25 bp, Mus musculus
gaactgcctcccttcataaatgtga

SEQ ID NO: 420106 - DNA, 25 bp, Mus musculus
gaactgcctggtaggagccaatcta

SEQ ID NO: 420107 - DNA, 25 bp, Mus musculus
gaactgcctggtcatattttcagca

SEQ ID NO: 420108 - DNA, 25 bp, Mus musculus
gaactgcctggtgatattttcagca

SEQ ID NO: 420109 - DNA, 25 bp, Mus musculus
gaactgcctggttggagccaatcta

SEQ ID NO: 420110 - DNA, 25 bp, Mus musculus
gaactgcgacaccagtaaccttggt

SEQ ID NO: 420111 - DNA, 25 bp, Mus musculus
gaactgcgacacgagtaaccttggt

SEQ ID NO: 420112 - DNA, 25 bp, Mus musculus
gaactgcgacagatttactgcagcc

SEQ ID NO: 420113 - DNA, 25 bp, Mus musculus
gaactgcgacagttttactgcagcc

SEQ ID NO: 420114 - DNA, 25 bp, Mus musculus
gaactgcgacctaaaaccattactt

SEQ ID NO: 420115 - DNA, 25 bp, Mus musculus
gaactgcgaccttaaaccattactt

SEQ ID NO: 420116 - DNA, 25 bp, Mus musculus
gaactgcgatttatctctgtatgaa

SEQ ID NO: 420117 - DNA, 25 bp, Mus musculus
gaactgcgatttttctctgtatgaa

SEQ ID NO: 420118 - DNA, 25 bp, Mus musculus
gaactgcgccaacatctgtcaaaat

SEQ ID NO: 420119 - DNA, 25 bp, Mus musculus
gaactgcgccaagatctgtcaaaat

SEQ ID NO: 420120 - DNA, 25 bp, Mus musculus
gaactgcgctccaatctgcaaggaa

SEQ ID NO: 420121 - DNA, 25 bp, Mus musculus
gaactgcgctcctatctgcaaggaa

SEQ ID NO: 420122 - DNA, 25 bp, Mus musculus
gaactgcgtctaagacctgtttgtc

SEQ ID NO: 420123 - DNA, 25 bp, Mus musculus
gaactgcgtctatgacctgtttgtc

SEQ ID NO: 420124 - DNA, 25 bp, Mus musculus
gaactgctaacccacgggaactgcg

SEQ ID NO: 420125 - DNA, 25 bp, Mus musculus
gaactgctaaccgacgggaactgcg

SEQ ID NO: 420126 - DNA, 25 bp, Mus musculus
gaactgctacatatttatgatatga

SEQ ID NO: 420127 - DNA, 25 bp, Mus musculus
gaactgctacatttttatgatatga

SEQ ID NO: 420128 - DNA, 25 bp, Mus musculus
gaactgctactaagccagatgcgct

SEQ ID NO: 420129 - DNA, 25 bp, Mus musculus
gaactgctactatgccagatgcgct

SEQ ID NO: 420130 - DNA, 25 bp, Mus musculus
gaactgctactgagaatgtaagata

SEQ ID NO: 420131 - DNA, 25 bp, Mus musculus
gaactgctactgtgaatgtaagata

SEQ ID NO: 420132 - DNA, 25 bp, Mus musculus
gaactgctagagctttcctgcggtg

SEQ ID NO: 420133 - DNA, 25 bp, Mus musculus
gaactgctagaggtttcctgcggtg

SEQ ID NO: 420134 - DNA, 25 bp, Mus musculus
gaactgctcatgatgaagcttaagt

SEQ ID NO: 420135 - DNA, 25 bp, Mus musculus
gaactgctcatgttgaagcttaagt

SEQ ID NO: 420136 - DNA, 25 bp, Mus musculus
gaactgctccagattcttgatcaag

SEQ ID NO: 420137 - DNA, 25 bp, Mus musculus
gaactgctccagtttcttgatcaag

SEQ ID NO: 420138 - DNA, 25 bp, Mus musculus
gaactgctcctaagagtagccagcc

SEQ ID NO: 420139 - DNA, 25 bp, Mus musculus
gaactgctcctatgagtagccagcc

SEQ ID NO: 420140 - DNA, 25 bp, Mus musculus
gaactgctcgtgaatctgtttgatt

SEQ ID NO: 420141 - DNA, 25 bp, Mus musculus
gaactgctcgtgctctgagaggtcc

SEQ ID NO: 420142 - DNA, 25 bp, Mus musculus
gaactgctcgtggtctgagaggtcc

SEQ ID NO: 420143 - DNA, 25 bp, Mus musculus
gaactgctcgtgtatctgtttgatt

SEQ ID NO: 420144 - DNA, 25 bp, Mus musculus
gaactgctctctcgatccatgtaga

SEQ ID NO: 420145 - DNA, 25 bp, Mus musculus
gaactgctctctggatccatgtaga

SEQ ID NO: 420146 - DNA, 25 bp, Mus musculus
gaactgctgactctgggacaattgt

SEQ ID NO: 420147 - DNA, 25 bp, Mus musculus
gaactgctgactgtgggacaattgt

SEQ ID NO: 420148 - DNA, 25 bp, Mus musculus
gaactgctgagtactacatctatag

SEQ ID NO: 420149 - DNA, 25 bp, Mus musculus
gaactgctgagttctacatctatag

SEQ ID NO: 420150 - DNA, 25 bp, Mus musculus
gaactgctgattaagattgcttact

SEQ ID NO: 420151 - DNA, 25 bp, Mus musculus
gaactgctgatttagattgcttact

SEQ ID NO: 420152 - DNA, 25 bp, Mus musculus
gaactgctgcaaactattcctcttg

SEQ ID NO: 420153 - DNA, 25 bp, Mus musculus
gaactgctgcaatctattcctcttg

SEQ ID NO: 420154 - DNA, 25 bp, Mus musculus
gaactgctgcatcggtgagtgtcta

SEQ ID NO: 420155 - DNA, 25 bp, Mus musculus
gaactgctgcatgggtgagtgtcta

SEQ ID NO: 420156 - DNA, 25 bp, Mus musculus
gaactgctgcctaagtttggttttt

SEQ ID NO: 420157 - DNA, 25 bp, Mus musculus
gaactgctgccttagtttggttttt

SEQ ID NO: 420158 - DNA, 25 bp, Mus musculus
gaactgctggagactggctttacct

SEQ ID NO: 420159 - DNA, 25 bp, Mus musculus
gaactgctggagtctggctttacct

SEQ ID NO: 420160 - DNA, 25 bp, Mus musculus
gaactgctggtacttccagaccgac

SEQ ID NO: 420161 - DNA, 25 bp, Mus musculus
gaactgctggtagttccagaccgac

SEQ ID NO: 420162 - DNA, 25 bp, Mus musculus
gaactgctggtgcaaacactggaga

SEQ ID NO: 420163 - DNA, 25 bp, Mus musculus
gaactgctggtggaaacactggaga

SEQ ID NO: 420164 - DNA, 25 bp, Mus musculus
gaactgctgtgcagtctttcaggat

SEQ ID NO: 420165 - DNA, 25 bp, Mus musculus
gaactgctgtgcctgtcactgtaac

SEQ ID NO: 420166 - DNA, 25 bp, Mus musculus
gaactgctgtgcgtgtcactgtaac

SEQ ID NO: 420167 - DNA, 25 bp, Mus musculus
gaactgctgtgctgtctttcaggat

SEQ ID NO: 420168 - DNA, 25 bp, Mus musculus
gaactgctgttgaaagcggctcatc

SEQ ID NO: 420169 - DNA, 25 bp, Mus musculus
gaactgctgttgtaagcggctcatc

SEQ ID NO: 420170 - DNA, 25 bp, Mus musculus
gaactgctgtttcttctgcagctca

SEQ ID NO: 420171 - DNA, 25 bp, Mus musculus
gaactgctgtttgttctgcagctca

SEQ ID NO: 420172 - DNA, 25 bp, Mus musculus
gaactgcttcatccaacagtcacag

SEQ ID NO: 420173 - DNA, 25 bp, Mus musculus
gaactgcttcatgcaacagtcacag

SEQ ID NO: 420174 - DNA, 25 bp, Mus musculus
gaactgcttggaaactcccagctag

SEQ ID NO: 420175 - DNA, 25 bp, Mus musculus
gaactgcttggatactcccagctag

SEQ ID NO: 420176 - DNA, 25 bp, Mus musculus
gaactgcttgttaagactttgaatg

SEQ ID NO: 420177 - DNA, 25 bp, Mus musculus
gaactgcttgtttagactttgaatg

SEQ ID NO: 420178 - DNA, 25 bp, Mus musculus
gaactgctttatcgaaaaacactaa

SEQ ID NO: 420179 - DNA, 25 bp, Mus musculus
gaactgctttatggaaaaacactaa

SEQ ID NO: 420180 - DNA, 25 bp, Mus musculus
gaactggaaaacctctgaagttaca

SEQ ID NO: 420181 - DNA, 25 bp, Mus musculus
gaactggaaaacgtctgaagttaca

SEQ ID NO: 420182 - DNA, 25 bp, Mus musculus
gaactggaacaaagtgtctgctgtc

SEQ ID NO: 420183 - DNA, 25 bp, Mus musculus
gaactggaacaatgtgtctgctgtc

SEQ ID NO: 420184 - DNA, 25 bp, Mus musculus
gaactggaacccaaaaatcactttg

SEQ ID NO: 420185 - DNA, 25 bp, Mus musculus
gaactggaaccctaaaatcactttg

SEQ ID NO: 420186 - DNA, 25 bp, Mus musculus
gaactggaagctcaggtcactgcgc

SEQ ID NO: 420187 - DNA, 25 bp, Mus musculus
gaactggaagctgaggtcactgcgc

SEQ ID NO: 420188 - DNA, 25 bp, Mus musculus
gaactggaagttctgcctgctgcac

SEQ ID NO: 420189 - DNA, 25 bp, Mus musculus
gaactggaagttgtgcctgctgcac

SEQ ID NO: 420190 - DNA, 25 bp, Mus musculus
gaactggaatatcaccatgtaatat

SEQ ID NO: 420191 - DNA, 25 bp, Mus musculus
gaactggaatatgaccatgtaatat

SEQ ID NO: 420192 - DNA, 25 bp, Mus musculus
gaactggaatctcatacctactcat

SEQ ID NO: 420193 - DNA, 25 bp, Mus musculus
gaactggaatctctcttgtaacttt

SEQ ID NO: 420194 - DNA, 25 bp, Mus musculus
gaactggaatctgatacctactcat

SEQ ID NO: 420195 - DNA, 25 bp, Mus musculus
gaactggaatctgtcttgtaacttt

SEQ ID NO: 420196 - DNA, 25 bp, Mus musculus
gaactggaattcctatcggttacca

SEQ ID NO: 420197 - DNA, 25 bp, Mus musculus
gaactggaattcgtatcggttacca

SEQ ID NO: 420198 - DNA, 25 bp, Mus musculus
gaactggacaagatggaactcgccc

SEQ ID NO: 420199 - DNA, 25 bp, Mus musculus
gaactggacaagttggaactcgccc

SEQ ID NO: 420200 - DNA, 25 bp, Mus musculus
gaactggacaccaaatcgtactgga

SEQ ID NO: 420201 - DNA, 25 bp, Mus musculus
gaactggacacctaatcgtactgga

SEQ ID NO: 420202 - DNA, 25 bp, Mus musculus
gaactggaccacaccttggctcgag

SEQ ID NO: 420203 - DNA, 25 bp, Mus musculus
gaactggaccactccttggctcgag

SEQ ID NO: 420204 - DNA, 25 bp, Mus musculus
gaactggacctcagtaacaactgca

SEQ ID NO: 420205 - DNA, 25 bp, Mus musculus
gaactggacctctgtaacaactgca

SEQ ID NO: 420206 - DNA, 25 bp, Mus musculus
gaactggactcaaggaatcttggac

SEQ ID NO: 420207 - DNA, 25 bp, Mus musculus
gaactggactcatggaatcttggac

SEQ ID NO: 420208 - DNA, 25 bp, Mus musculus
gaactggactctaaatgggccctga

SEQ ID NO: 420209 - DNA, 25 bp, Mus musculus
gaactggactcttaatgggccctga

SEQ ID NO: 420210 - DNA, 25 bp, Mus musculus
gaactggactgcatggttttcttat

SEQ ID NO: 420211 - DNA, 25 bp, Mus musculus
gaactggactgcttggttttcttat

SEQ ID NO: 420212 - DNA, 25 bp, Mus musculus
gaactggagaaaagccgcggcgtct

SEQ ID NO: 420213 - DNA, 25 bp, Mus musculus
gaactggagaaatgccgcggcgtct

SEQ ID NO: 420214 - DNA, 25 bp, Mus musculus
gaactggagcccattggagctacac

SEQ ID NO: 420215 - DNA, 25 bp, Mus musculus
gaactggagccctttggagctacac

SEQ ID NO: 420216 - DNA, 25 bp, Mus musculus
gaactggagctcaagcacgccaagg

SEQ ID NO: 420217 - DNA, 25 bp, Mus musculus
gaactggagctctagcacgccaagg

SEQ ID NO: 420218 - DNA, 25 bp, Mus musculus
gaactggaggctaccttggccacac

SEQ ID NO: 420219 - DNA, 25 bp, Mus musculus
gaactggaggcttccttggccacac

SEQ ID NO: 420220 - DNA, 25 bp, Mus musculus
gaactggagtcccatcagctgcaaa

SEQ ID NO: 420221 - DNA, 25 bp, Mus musculus
gaactggagtccgatcagctgcaaa

SEQ ID NO: 420222 - DNA, 25 bp, Mus musculus
gaactggagtgaatccaaactgaaa

SEQ ID NO: 420223 - DNA, 25 bp, Mus musculus
gaactggagtgattccaaactgaaa

SEQ ID NO: 420224 - DNA, 25 bp, Mus musculus
gaactggatatgaaactggatgcct

SEQ ID NO: 420225 - DNA, 25 bp, Mus musculus
gaactggatatgtaactggatgcct

SEQ ID NO: 420226 - DNA, 25 bp, Mus musculus
gaactggatcgacaggaactcacct

SEQ ID NO: 420227 - DNA, 25 bp, Mus musculus
gaactggatcgagaggaactcacct

SEQ ID NO: 420228 - DNA, 25 bp, Mus musculus
gaactggatcgtagggcatcagaaa

SEQ ID NO: 420229 - DNA, 25 bp, Mus musculus
gaactggatcgttgggcatcagaaa

SEQ ID NO: 420230 - DNA, 25 bp, Mus musculus
gaactggatctgctcagggtctaca

SEQ ID NO: 420231 - DNA, 25 bp, Mus musculus
gaactggatctggtcagggtctaca

SEQ ID NO: 420232 - DNA, 25 bp, Mus musculus
gaactggcacgtcatcactgatatg

SEQ ID NO: 420233 - DNA, 25 bp, Mus musculus
gaactggcacgtgatcactgatatg

SEQ ID NO: 420234 - DNA, 25 bp, Mus musculus
gaactggcagagaccaacgctctat

SEQ ID NO: 420235 - DNA, 25 bp, Mus musculus
gaactggcagagtccaacgctctat

SEQ ID NO: 420236 - DNA, 25 bp, Mus musculus
gaactggcagcccactgtgtgagac

SEQ ID NO: 420237 - DNA, 25 bp, Mus musculus
gaactggcagccgactgtgtgagac

SEQ ID NO: 420238 - DNA, 25 bp, Mus musculus
gaactggcagttcatatacataagt

SEQ ID NO: 420239 - DNA, 25 bp, Mus musculus
gaactggcagttctgacactgggaa

SEQ ID NO: 420240 - DNA, 25 bp, Mus musculus
gaactggcagttgatatacataagt

SEQ ID NO: 420241 - DNA, 25 bp, Mus musculus
gaactggcagttgtgacactgggaa

SEQ ID NO: 420242 - DNA, 25 bp, Mus musculus
gaactggccaccaagaagccgcttt

SEQ ID NO: 420243 - DNA, 25 bp, Mus musculus
gaactggccacctagaagccgcttt

SEQ ID NO: 420244 - DNA, 25 bp, Mus musculus
gaactggccatccataaccgaggga

SEQ ID NO: 420245 - DNA, 25 bp, Mus musculus
gaactggccatcgataaccgaggga

SEQ ID NO: 420246 - DNA, 25 bp, Mus musculus
gaactggcccacaaagagatttccc

SEQ ID NO: 420247 - DNA, 25 bp, Mus musculus
gaactggcccactaagagatttccc

SEQ ID NO: 420248 - DNA, 25 bp, Mus musculus
gaactggccccaccttagatttttt

SEQ ID NO: 420249 - DNA, 25 bp, Mus musculus
gaactggccccactgcagattaagg

SEQ ID NO: 420250 - DNA, 25 bp, Mus musculus
gaactggccccagcttagatttttt

SEQ ID NO: 420251 - DNA, 25 bp, Mus musculus
gaactggccccagtgcagattaagg

SEQ ID NO: 420252 - DNA, 25 bp, Mus musculus
gaactggccggtcttgttcttaggt

SEQ ID NO: 420253 - DNA, 25 bp, Mus musculus
gaactggccggtgttgttcttaggt

SEQ ID NO: 420254 - DNA, 25 bp, Mus musculus
gaactggcggctcaagaacatcaca

SEQ ID NO: 420255 - DNA, 25 bp, Mus musculus
gaactggcggctgaagaacatcaca

SEQ ID NO: 420256 - DNA, 25 bp, Mus musculus
gaactggctatgaagatgctggaga

SEQ ID NO: 420257 - DNA, 25 bp, Mus musculus
gaactggctatgtagatgctggaga

SEQ ID NO: 420258 - DNA, 25 bp, Mus musculus
gaactggctgcacctggtaatcata

SEQ ID NO: 420259 - DNA, 25 bp, Mus musculus
gaactggctgcagctggtaatcata

SEQ ID NO: 420260 - DNA, 25 bp, Mus musculus
gaactggctgctaccttaggactga

SEQ ID NO: 420261 - DNA, 25 bp, Mus musculus
gaactggctgcttccttaggactga

SEQ ID NO: 420262 - DNA, 25 bp, Mus musculus
gaactggcttcaaggctaactctca

SEQ ID NO: 420263 - DNA, 25 bp, Mus musculus
gaactggcttcatggctaactctca

SEQ ID NO: 420264 - DNA, 25 bp, Mus musculus
gaactggcttctaactgagaaaaat

SEQ ID NO: 420265 - DNA, 25 bp, Mus musculus
gaactggcttcttactgagaaaaat

SEQ ID NO: 420266 - DNA, 25 bp, Mus musculus
gaactgggaaatagctggcatttta

SEQ ID NO: 420267 - DNA, 25 bp, Mus musculus
gaactgggaaattgctggcatttta

SEQ ID NO: 420268 - DNA, 25 bp, Mus musculus
gaactgggacccatgattcccagat

SEQ ID NO: 420269 - DNA, 25 bp, Mus musculus
gaactgggacccttgattcccagat

SEQ ID NO: 420270 - DNA, 25 bp, Mus musculus
gaactgggaggtagctcaggtactt

SEQ ID NO: 420271 - DNA, 25 bp, Mus musculus
gaactgggaggttgctcaggtactt

SEQ ID NO: 420272 - DNA, 25 bp, Mus musculus
gaactgggagtcaagccacagcttt

SEQ ID NO: 420273 - DNA, 25 bp, Mus musculus
gaactgggagtctagccacagcttt

SEQ ID NO: 420274 - DNA, 25 bp, Mus musculus
gaactgggatatcttccgaccataa

SEQ ID NO: 420275 - DNA, 25 bp, Mus musculus
gaactgggatatgttccgaccataa

SEQ ID NO: 420276 - DNA, 25 bp, Mus musculus
gaactgggatccagcttgcggtcac

SEQ ID NO: 420277 - DNA, 25 bp, Mus musculus
gaactgggatcctgcttgcggtcac

SEQ ID NO: 420278 - DNA, 25 bp, Mus musculus
gaactgggatttaagggtcacactt

SEQ ID NO: 420279 - DNA, 25 bp, Mus musculus
gaactgggattttagggtcacactt

SEQ ID NO: 420280 - DNA, 25 bp, Mus musculus
gaactgggcagacttccgttaactt

SEQ ID NO: 420281 - DNA, 25 bp, Mus musculus
gaactgggcagagttccgttaactt

SEQ ID NO: 420282 - DNA, 25 bp, Mus musculus
gaactgggcatgagttttcctgtga

SEQ ID NO: 420283 - DNA, 25 bp, Mus musculus
gaactgggcatgtgttttcctgtga

SEQ ID NO: 420284 - DNA, 25 bp, Mus musculus
gaactgggcgataaattgtatctaa

SEQ ID NO: 420285 - DNA, 25 bp, Mus musculus
gaactgggcgattaattgtatctaa

SEQ ID NO: 420286 - DNA, 25 bp, Mus musculus
gaactgggcgtcacactaaactata

SEQ ID NO: 420287 - DNA, 25 bp, Mus musculus
gaactgggcgtctcactaaactata

SEQ ID NO: 420288 - DNA, 25 bp, Mus musculus
gaactgggcgttccatgatatctta

SEQ ID NO: 420289 - DNA, 25 bp, Mus musculus
gaactgggcgttgcatgatatctta

SEQ ID NO: 420290 - DNA, 25 bp, Mus musculus
gaactgggctttccttaacgagtac

SEQ ID NO: 420291 - DNA, 25 bp, Mus musculus
gaactgggctttgcttaacgagtac

SEQ ID NO: 420292 - DNA, 25 bp, Mus musculus
gaactgggtcaaaaaagtgtactac

SEQ ID NO: 420293 - DNA, 25 bp, Mus musculus
gaactgggtcaataaagtgtactac

SEQ ID NO: 420294 - DNA, 25 bp, Mus musculus
gaactgggtcctaaactagatctaa

SEQ ID NO: 420295 - DNA, 25 bp, Mus musculus
gaactgggtccttaactagatctaa

SEQ ID NO: 420296 - DNA, 25 bp, Mus musculus
gaactgggtcttcctgactgttgaa

SEQ ID NO: 420297 - DNA, 25 bp, Mus musculus
gaactgggtcttgctgactgttgaa

SEQ ID NO: 420298 - DNA, 25 bp, Mus musculus
gaactgggtgctcgaaattacactt

SEQ ID NO: 420299 - DNA, 25 bp, Mus musculus
gaactgggtgctggaaattacactt

SEQ ID NO: 420300 - DNA, 25 bp, Mus musculus
gaactgggtgtactctcatgacggc

SEQ ID NO: 420301 - DNA, 25 bp, Mus musculus
gaactgggtgtagtctcatgacggc

SEQ ID NO: 420302 - DNA, 25 bp, Mus musculus
gaactgggttcacccatatggacat

SEQ ID NO: 420303 - DNA, 25 bp, Mus musculus
gaactgggttcagccatatggacat

SEQ ID NO: 420304 - DNA, 25 bp, Mus musculus
gaactggtaaagcagcctccggacg

SEQ ID NO: 420305 - DNA, 25 bp, Mus musculus
gaactggtaaaggagcctccggacg

SEQ ID NO: 420306 - DNA, 25 bp, Mus musculus
gaactggtagccacttggcttcatg

SEQ ID NO: 420307 - DNA, 25 bp, Mus musculus
gaactggtagcctcttggcttcatg

SEQ ID NO: 420308 - DNA, 25 bp, Mus musculus
gaactggtatccctattgcagagtg

SEQ ID NO: 420309 - DNA, 25 bp, Mus musculus
gaactggtatccgtattgcagagtg

SEQ ID NO: 420310 - DNA, 25 bp, Mus musculus
gaactggtcaatacttcctaatgag

SEQ ID NO: 420311 - DNA, 25 bp, Mus musculus
gaactggtcaattcttcctaatgag

SEQ ID NO: 420312 - DNA, 25 bp, Mus musculus
gaactggtcaggcaaattgcacgca

SEQ ID NO: 420313 - DNA, 25 bp, Mus musculus
gaactggtcagggaaattgcacgca

SEQ ID NO: 420314 - DNA, 25 bp, Mus musculus
gaactggtcctccagctgacagata

SEQ ID NO: 420315 - DNA, 25 bp, Mus musculus
gaactggtcctcgagctgacagata

SEQ ID NO: 420316 - DNA, 25 bp, Mus musculus
gaactggtctagcaaattttgtaag

SEQ ID NO: 420317 - DNA, 25 bp, Mus musculus
gaactggtctaggaaattttgtaag

SEQ ID NO: 420318 - DNA, 25 bp, Mus musculus
gaactggtctgtccttactactata

SEQ ID NO: 420319 - DNA, 25 bp, Mus musculus
gaactggtctgtgcttactactata

SEQ ID NO: 420320 - DNA, 25 bp, Mus musculus
gaactggtgagcagactactccatt

SEQ ID NO: 420321 - DNA, 25 bp, Mus musculus
gaactggtgagccacaatcacggat

SEQ ID NO: 420322 - DNA, 25 bp, Mus musculus
gaactggtgagcgacaatcacggat

SEQ ID NO: 420323 - DNA, 25 bp, Mus musculus
gaactggtgagctgactactccatt

SEQ ID NO: 420324 - DNA, 25 bp, Mus musculus
gaactggtgcatcaagcgacggtca

SEQ ID NO: 420325 - DNA, 25 bp, Mus musculus
gaactggtgcatgaagcgacggtca

SEQ ID NO: 420326 - DNA, 25 bp, Mus musculus
gaactggtgcctatcatgtagagta

SEQ ID NO: 420327 - DNA, 25 bp, Mus musculus
gaactggtgcctttcatgtagagta

SEQ ID NO: 420328 - DNA, 25 bp, Mus musculus
gaactggtggccattagtcactctt

SEQ ID NO: 420329 - DNA, 25 bp, Mus musculus
gaactggtggccctctcagagagac

SEQ ID NO: 420330 - DNA, 25 bp, Mus musculus
gaactggtggccgtctcagagagac

SEQ ID NO: 420331 - DNA, 25 bp, Mus musculus
gaactggtggcctttagtcactctt

SEQ ID NO: 420332 - DNA, 25 bp, Mus musculus
gaactggtggttcgacttatgtctg

SEQ ID NO: 420333 - DNA, 25 bp, Mus musculus
gaactggtggttggacttatgtctg

SEQ ID NO: 420334 - DNA, 25 bp, Mus musculus
gaactggtgtctctgccagatttgc

SEQ ID NO: 420335 - DNA, 25 bp, Mus musculus
gaactggtgtctgtgccagatttgc

SEQ ID NO: 420336 - DNA, 25 bp, Mus musculus
gaactggttaagcagtcaactgact

SEQ ID NO: 420337 - DNA, 25 bp, Mus musculus
gaactggttaaggagtcaactgact

SEQ ID NO: 420338 - DNA, 25 bp, Mus musculus
gaactggttactctgcaagcatttt

SEQ ID NO: 420339 - DNA, 25 bp, Mus musculus
gaactggttactgtgcaagcatttt

SEQ ID NO: 420340 - DNA, 25 bp, Mus musculus
gaactggttatcagctttgcgacag

SEQ ID NO: 420341 - DNA, 25 bp, Mus musculus
gaactggttatctgctttgcgacag

SEQ ID NO: 420342 - DNA, 25 bp, Mus musculus
gaactggttcgcatgcctaaatctt

SEQ ID NO: 420343 - DNA, 25 bp, Mus musculus
gaactggttcgcttgcctaaatctt

SEQ ID NO: 420344 - DNA, 25 bp, Mus musculus
gaactggttgttaaagattgcttct

SEQ ID NO: 420345 - DNA, 25 bp, Mus musculus
gaactggttgtttaagattgcttct

SEQ ID NO: 420346 - DNA, 25 bp, Mus musculus
gaactggtttccatgactttctaga

SEQ ID NO: 420347 - DNA, 25 bp, Mus musculus
gaactggtttccttgactttctaga

SEQ ID NO: 420348 - DNA, 25 bp, Mus musculus
gaactggttttcaaacaggatataa

SEQ ID NO: 420349 - DNA, 25 bp, Mus musculus
gaactggttttctaacaggatataa

SEQ ID NO: 420350 - DNA, 25 bp, Mus musculus
gaactgtaaaaaactgccacagaag

SEQ ID NO: 420351 - DNA, 25 bp, Mus musculus
gaactgtaaaaatctgccacagaag

SEQ ID NO: 420352 - DNA, 25 bp, Mus musculus
gaactgtaaaccatcacttttctag

SEQ ID NO: 420353 - DNA, 25 bp, Mus musculus
gaactgtaaaccttcacttttctag

SEQ ID NO: 420354 - DNA, 25 bp, Mus musculus
gaactgtaacttaatctcgaaacta

SEQ ID NO: 420355 - DNA, 25 bp, Mus musculus
gaactgtaactttatctcgaaacta

SEQ ID NO: 420356 - DNA, 25 bp, Mus musculus
gaactgtaagcccttctttacctag

SEQ ID NO: 420357 - DNA, 25 bp, Mus musculus
gaactgtaagccgttctttacctag

SEQ ID NO: 420358 - DNA, 25 bp, Mus musculus
gaactgtaatgaaatcctcatagct

SEQ ID NO: 420359 - DNA, 25 bp, Mus musculus
gaactgtaatgatatcctcatagct

SEQ ID NO: 420360 - DNA, 25 bp, Mus musculus
gaactgtacagcataatggccagaa

SEQ ID NO: 420361 - DNA, 25 bp, Mus musculus
gaactgtacagcttaatggccagaa

SEQ ID NO: 420362 - DNA, 25 bp, Mus musculus
gaactgtaccaaaccctacttacat

SEQ ID NO: 420363 - DNA, 25 bp, Mus musculus
gaactgtaccaatccctacttacat

SEQ ID NO: 420364 - DNA, 25 bp, Mus musculus
gaactgtaccaccaactggagagca

SEQ ID NO: 420365 - DNA, 25 bp, Mus musculus
gaactgtaccacgaactggagagca

SEQ ID NO: 420366 - DNA, 25 bp, Mus musculus
gaactgtaccccatattttatgctg

SEQ ID NO: 420367 - DNA, 25 bp, Mus musculus
gaactgtaccccttattttatgctg

SEQ ID NO: 420368 - DNA, 25 bp, Mus musculus
gaactgtactaaaggcctgagaact

SEQ ID NO: 420369 - DNA, 25 bp, Mus musculus
gaactgtactaatggcctgagaact

SEQ ID NO: 420370 - DNA, 25 bp, Mus musculus
gaactgtactgaccgcctcgtgcac

SEQ ID NO: 420371 - DNA, 25 bp, Mus musculus
gaactgtactgagcgcctcgtgcac

SEQ ID NO: 420372 - DNA, 25 bp, Mus musculus
gaactgtagaaaacattcatgcctt

SEQ ID NO: 420373 - DNA, 25 bp, Mus musculus
gaactgtagaaatcattcatgcctt

SEQ ID NO: 420374 - DNA, 25 bp, Mus musculus
gaactgtagagcatctattgtacat

SEQ ID NO: 420375 - DNA, 25 bp, Mus musculus
gaactgtagagcttctattgtacat

SEQ ID NO: 420376 - DNA, 25 bp, Mus musculus
gaactgtagataattcctttctctt

SEQ ID NO: 420377 - DNA, 25 bp, Mus musculus
gaactgtagatatttcctttctctt

SEQ ID NO: 420378 - DNA, 25 bp, Mus musculus
gaactgtagcaacattatccacaac

SEQ ID NO: 420379 - DNA, 25 bp, Mus musculus
gaactgtagcaagattatccacaac

SEQ ID NO: 420380 - DNA, 25 bp, Mus musculus
gaactgtagcagcagaacggagtct

SEQ ID NO: 420381 - DNA, 25 bp, Mus musculus
gaactgtagcaggagaacggagtct

SEQ ID NO: 420382 - DNA, 25 bp, Mus musculus
gaactgtagctaactagtcaagtga

SEQ ID NO: 420383 - DNA, 25 bp, Mus musculus
gaactgtagctatctagtcaagtga

SEQ ID NO: 420384 - DNA, 25 bp, Mus musculus
gaactgtagcttattgtcaacatct

SEQ ID NO: 420385 - DNA, 25 bp, Mus musculus
gaactgtagctttttgtcaacatct

SEQ ID NO: 420386 - DNA, 25 bp, Mus musculus
gaactgtaggtcctcgaggcaagaa

SEQ ID NO: 420387 - DNA, 25 bp, Mus musculus
gaactgtaggtcgtcgaggcaagaa

SEQ ID NO: 420388 - DNA, 25 bp, Mus musculus
gaactgtataatcctcgaatccagg

SEQ ID NO: 420389 - DNA, 25 bp, Mus musculus
gaactgtataatgctcgaatccagg

SEQ ID NO: 420390 - DNA, 25 bp, Mus musculus
gaactgtatactctgcgtgtggtgt

SEQ ID NO: 420391 - DNA, 25 bp, Mus musculus
gaactgtatactgtgcgtgtggtgt

SEQ ID NO: 420392 - DNA, 25 bp, Mus musculus
gaactgtatatgctttctctccatc

SEQ ID NO: 420393 - DNA, 25 bp, Mus musculus
gaactgtatatggtttctctccatc

SEQ ID NO: 420394 - DNA, 25 bp, Mus musculus
gaactgtatccgatgaaaggagtat

SEQ ID NO: 420395 - DNA, 25 bp, Mus musculus
gaactgtatccgttgaaaggagtat

SEQ ID NO: 420396 - DNA, 25 bp, Mus musculus
gaactgtatctccactttaaaagca

SEQ ID NO: 420397 - DNA, 25 bp, Mus musculus
gaactgtatctcgactttaaaagca

SEQ ID NO: 420398 - DNA, 25 bp, Mus musculus
gaactgtatctgaggacttctttcc

SEQ ID NO: 420399 - DNA, 25 bp, Mus musculus
gaactgtatctgtggacttctttcc

SEQ ID NO: 420400 - DNA, 25 bp, Mus musculus
gaactgtattaaacggtcgccacca

SEQ ID NO: 420401 - DNA, 25 bp, Mus musculus
gaactgtattaatcggtcgccacca

SEQ ID NO: 420402 - DNA, 25 bp, Mus musculus
gaactgtattccaaggcatttcctc

SEQ ID NO: 420403 - DNA, 25 bp, Mus musculus
gaactgtattccaggtttcactagt

SEQ ID NO: 420404 - DNA, 25 bp, Mus musculus
gaactgtattcctaggcatttcctc

SEQ ID NO: 420405 - DNA, 25 bp, Mus musculus
gaactgtattcctggtttcactagt

SEQ ID NO: 420406 - DNA, 25 bp, Mus musculus
gaactgtatttaacccatctcaaaa

SEQ ID NO: 420407 - DNA, 25 bp, Mus musculus
gaactgtatttatcccatctcaaaa

SEQ ID NO: 420408 - DNA, 25 bp, Mus musculus
gaactgtatttcctttgtgctactc

SEQ ID NO: 420409 - DNA, 25 bp, Mus musculus
gaactgtatttcgtttgtgctactc

SEQ ID NO: 420410 - DNA, 25 bp, Mus musculus
gaactgtattttctgaatggcaagt

SEQ ID NO: 420411 - DNA, 25 bp, Mus musculus
gaactgtattttgtgaatggcaagt

SEQ ID NO: 420412 - DNA, 25 bp, Mus musculus
gaactgtcaaggcaggaaatccaag

SEQ ID NO: 420413 - DNA, 25 bp, Mus musculus
gaactgtcaagggaggaaatccaag

SEQ ID NO: 420414 - DNA, 25 bp, Mus musculus
gaactgtcacacaaaaagaagaccc

SEQ ID NO: 420415 - DNA, 25 bp, Mus musculus
gaactgtcacactaaaagaagaccc

SEQ ID NO: 420416 - DNA, 25 bp, Mus musculus
gaactgtcacagaggcttgctcgtc

SEQ ID NO: 420417 - DNA, 25 bp, Mus musculus
gaactgtcacagtggcttgctcgtc

SEQ ID NO: 420418 - DNA, 25 bp, Mus musculus
gaactgtcacccaaaggagccagga

SEQ ID NO: 420419 - DNA, 25 bp, Mus musculus
gaactgtcaccctaaggagccagga

SEQ ID NO: 420420 - DNA, 25 bp, Mus musculus
gaactgtcaggcaggtctgctcagg

SEQ ID NO: 420421 - DNA, 25 bp, Mus musculus
gaactgtcaggctggtctgctcagg

SEQ ID NO: 420422 - DNA, 25 bp, Mus musculus
gaactgtcagggaacacaagcactt

SEQ ID NO: 420423 - DNA, 25 bp, Mus musculus
gaactgtcagggtacacaagcactt

SEQ ID NO: 420424 - DNA, 25 bp, Mus musculus
gaactgtcaggtattctaggctggc

SEQ ID NO: 420425 - DNA, 25 bp, Mus musculus
gaactgtcaggttttctaggctggc

SEQ ID NO: 420426 - DNA, 25 bp, Mus musculus
gaactgtcatatctacactctgaaa

SEQ ID NO: 420427 - DNA, 25 bp, Mus musculus
gaactgtcatatgtacactctgaaa

SEQ ID NO: 420428 - DNA, 25 bp, Mus musculus
gaactgtcatcacgtgttacatcat

SEQ ID NO: 420429 - DNA, 25 bp, Mus musculus
gaactgtcatcaggtgttacatcat

SEQ ID NO: 420430 - DNA, 25 bp, Mus musculus
gaactgtcatctctagtctttcaca

SEQ ID NO: 420431 - DNA, 25 bp, Mus musculus
gaactgtcatctgtagtctttcaca

SEQ ID NO: 420432 - DNA, 25 bp, Mus musculus
gaactgtcattcacagctgcgtgtc

SEQ ID NO: 420433 - DNA, 25 bp, Mus musculus
gaactgtcattctcagctgcgtgtc

SEQ ID NO: 420434 - DNA, 25 bp, Mus musculus
gaactgtccagtccttgtaacgtgt

SEQ ID NO: 420435 - DNA, 25 bp, Mus musculus
gaactgtccagtgcttgtaacgtgt

SEQ ID NO: 420436 - DNA, 25 bp, Mus musculus
gaactgtcccctaggagatgtgact

SEQ ID NO: 420437 - DNA, 25 bp, Mus musculus
gaactgtccccttggagatgtgact

SEQ ID NO: 420438 - DNA, 25 bp, Mus musculus
gaactgtcctatatttcatcccaag

SEQ ID NO: 420439 - DNA, 25 bp, Mus musculus
gaactgtcctatttttcatcccaag

SEQ ID NO: 420440 - DNA, 25 bp, Mus musculus
gaactgtcgcaacagatgctatcag

SEQ ID NO: 420441 - DNA, 25 bp, Mus musculus
gaactgtcgcaagagatgctatcag

SEQ ID NO: 420442 - DNA, 25 bp, Mus musculus
gaactgtcgcaccagaattctctgc

SEQ ID NO: 420443 - DNA, 25 bp, Mus musculus
gaactgtcgcacgagaattctctgc

SEQ ID NO: 420444 - DNA, 25 bp, Mus musculus
gaactgtctctcacaaattcatctt

SEQ ID NO: 420445 - DNA, 25 bp, Mus musculus
gaactgtctctctcaaattcatctt

SEQ ID NO: 420446 - DNA, 25 bp, Mus musculus
gaactgtctgacacagctcatccaa

SEQ ID NO: 420447 - DNA, 25 bp, Mus musculus
gaactgtctgacattatccatgagc

SEQ ID NO: 420448 - DNA, 25 bp, Mus musculus
gaactgtctgactcagctcatccaa

SEQ ID NO: 420449 - DNA, 25 bp, Mus musculus
gaactgtctgactttatccatgagc

SEQ ID NO: 420450 - DNA, 25 bp, Mus musculus
gaactgtctgatcttaaatggccaa

SEQ ID NO: 420451 - DNA, 25 bp, Mus musculus
gaactgtctgatgttaaatggccaa

SEQ ID NO: 420452 - DNA, 25 bp, Mus musculus
gaactgtctgcaactcatactggga

SEQ ID NO: 420453 - DNA, 25 bp, Mus musculus
gaactgtctgcatctcatactggga

SEQ ID NO: 420454 - DNA, 25 bp, Mus musculus
gaactgtctgttcaaaacctggtcc

SEQ ID NO: 420455 - DNA, 25 bp, Mus musculus
gaactgtctgttgaaaacctggtcc

SEQ ID NO: 420456 - DNA, 25 bp, Mus musculus
gaactgtcttcaattagtcccaaca

SEQ ID NO: 420457 - DNA, 25 bp, Mus musculus
gaactgtcttcatttagtcccaaca

SEQ ID NO: 420458 - DNA, 25 bp, Mus musculus
gaactgtcttccagaagatttgata

SEQ ID NO: 420459 - DNA, 25 bp, Mus musculus
gaactgtcttccagtttgcacgaga

SEQ ID NO: 420460 - DNA, 25 bp, Mus musculus
gaactgtcttcctgaagatttgata

SEQ ID NO: 420461 - DNA, 25 bp, Mus musculus
gaactgtcttcctgtttgcacgaga

SEQ ID NO: 420462 - DNA, 25 bp, Mus musculus
gaactgtctttactttcagcctctg

SEQ ID NO: 420463 - DNA, 25 bp, Mus musculus
gaactgtctttagtttcagcctctg

SEQ ID NO: 420464 - DNA, 25 bp, Mus musculus
gaactgtgaagtagtgaacacggaa

SEQ ID NO: 420465 - DNA, 25 bp, Mus musculus
gaactgtgaagttgtgaacacggaa

SEQ ID NO: 420466 - DNA, 25 bp, Mus musculus
gaactgtgacacagacatccaggag

SEQ ID NO: 420467 - DNA, 25 bp, Mus musculus
gaactgtgacactgacatccaggag

SEQ ID NO: 420468 - DNA, 25 bp, Mus musculus
gaactgtgaccaagtaagatgttaa

SEQ ID NO: 420469 - DNA, 25 bp, Mus musculus
gaactgtgaccatgtaagatgttaa

SEQ ID NO: 420470 - DNA, 25 bp, Mus musculus
gaactgtgactcctgatggctgtgt

SEQ ID NO: 420471 - DNA, 25 bp, Mus musculus
gaactgtgactcgtgatggctgtgt

SEQ ID NO: 420472 - DNA, 25 bp, Mus musculus
gaactgtgagacataacctggttac

SEQ ID NO: 420473 - DNA, 25 bp, Mus musculus
gaactgtgagacttaacctggttac

SEQ ID NO: 420474 - DNA, 25 bp, Mus musculus
gaactgtgagccaaaccctggacca

SEQ ID NO: 420475 - DNA, 25 bp, Mus musculus
gaactgtgagcctaaccctggacca

SEQ ID NO: 420476 - DNA, 25 bp, Mus musculus
gaactgtgagctaagatatgtcctt

SEQ ID NO: 420477 - DNA, 25 bp, Mus musculus
gaactgtgagcttagatatgtcctt

SEQ ID NO: 420478 - DNA, 25 bp, Mus musculus
gaactgtgagttacaagttggttgt

SEQ ID NO: 420479 - DNA, 25 bp, Mus musculus
gaactgtgagtttcaagttggttgt

SEQ ID NO: 420480 - DNA, 25 bp, Mus musculus
gaactgtgatccctaaccgcatctt

SEQ ID NO: 420481 - DNA, 25 bp, Mus musculus
gaactgtgatccctgctgttggcaa

SEQ ID NO: 420482 - DNA, 25 bp, Mus musculus
gaactgtgatccgtaaccgcatctt

SEQ ID NO: 420483 - DNA, 25 bp, Mus musculus
gaactgtgatccgtgctgttggcaa

SEQ ID NO: 420484 - DNA, 25 bp, Mus musculus
gaactgtgcaggaaaccggagccct

SEQ ID NO: 420485 - DNA, 25 bp, Mus musculus
gaactgtgcaggtaaccggagccct

SEQ ID NO: 420486 - DNA, 25 bp, Mus musculus
gaactgtgcatgacatgttatgggt

SEQ ID NO: 420487 - DNA, 25 bp, Mus musculus
gaactgtgcatgtcatgttatgggt

SEQ ID NO: 420488 - DNA, 25 bp, Mus musculus
gaactgtgccaaagtctacctacag

SEQ ID NO: 420489 - DNA, 25 bp, Mus musculus
gaactgtgccaatgtctacctacag

SEQ ID NO: 420490 - DNA, 25 bp, Mus musculus
gaactgtgcttgatgagggaccctg

SEQ ID NO: 420491 - DNA, 25 bp, Mus musculus
gaactgtgcttgttgagggaccctg

SEQ ID NO: 420492 - DNA, 25 bp, Mus musculus
gaactgtggaatatattggcagcca

SEQ ID NO: 420493 - DNA, 25 bp, Mus musculus
gaactgtggaatttattggcagcca

SEQ ID NO: 420494 - DNA, 25 bp, Mus musculus
gaactgtggagtcctttccccggca

SEQ ID NO: 420495 - DNA, 25 bp, Mus musculus
gaactgtggagtgctttccccggca

SEQ ID NO: 420496 - DNA, 25 bp, Mus musculus
gaactgtggatcacctacaatttta

SEQ ID NO: 420497 - DNA, 25 bp, Mus musculus
gaactgtggatctcctacaatttta

SEQ ID NO: 420498 - DNA, 25 bp, Mus musculus
gaactgtggcacactttaagaagac

SEQ ID NO: 420499 - DNA, 25 bp, Mus musculus
gaactgtggcactctttaagaagac

SEQ ID NO: 420500 - DNA, 25 bp, Mus musculus
gaactgtggcagaggagatatcctt

SEQ ID NO: 420501 - DNA, 25 bp, Mus musculus
gaactgtggcagtggagatatcctt

SEQ ID NO: 420502 - DNA, 25 bp, Mus musculus
gaactgtgggtaaggatttgactat

SEQ ID NO: 420503 - DNA, 25 bp, Mus musculus
gaactgtgggtatggatttgactat

SEQ ID NO: 420504 - DNA, 25 bp, Mus musculus
gaactgtgggtgaatccaagaagaa

SEQ ID NO: 420505 - DNA, 25 bp, Mus musculus
gaactgtgggtgtatccaagaagaa

SEQ ID NO: 420506 - DNA, 25 bp, Mus musculus
gaactgtggtgacccaatttgcttg

SEQ ID NO: 420507 - DNA, 25 bp, Mus musculus
gaactgtggtgagccaatttgcttg

SEQ ID NO: 420508 - DNA, 25 bp, Mus musculus
gaactgtgtaccaatctgttgttga

SEQ ID NO: 420509 - DNA, 25 bp, Mus musculus
gaactgtgtacctatctgttgttga

SEQ ID NO: 420510 - DNA, 25 bp, Mus musculus
gaactgtgtgtgacttagaggtgac

SEQ ID NO: 420511 - DNA, 25 bp, Mus musculus
gaactgtgtgtgatccacgttaaca

SEQ ID NO: 420512 - DNA, 25 bp, Mus musculus
gaactgtgtgtgtcttagaggtgac

SEQ ID NO: 420513 - DNA, 25 bp, Mus musculus
gaactgtgtgtgttccacgttaaca

SEQ ID NO: 420514 - DNA, 25 bp, Mus musculus
gaactgtgttttcataatccctttt

SEQ ID NO: 420515 - DNA, 25 bp, Mus musculus
gaactgtgttttcatgaaacagtac

SEQ ID NO: 420516 - DNA, 25 bp, Mus musculus
gaactgtgttttgataatccctttt

SEQ ID NO: 420517 - DNA, 25 bp, Mus musculus
gaactgtgttttgatgaaacagtac

SEQ ID NO: 420518 - DNA, 25 bp, Mus musculus
gaactgttaaacagcgtgtgtatgt

SEQ ID NO: 420519 - DNA, 25 bp, Mus musculus
gaactgttaaacatcccatttgaga

SEQ ID NO: 420520 - DNA, 25 bp, Mus musculus
gaactgttaaactgcgtgtgtatgt

SEQ ID NO: 420521 - DNA, 25 bp, Mus musculus
gaactgttaaacttcccatttgaga

SEQ ID NO: 420522 - DNA, 25 bp, Mus musculus
gaactgttaagtagcctttggctaa

SEQ ID NO: 420523 - DNA, 25 bp, Mus musculus
gaactgttaagttgcctttggctaa

SEQ ID NO: 420524 - DNA, 25 bp, Mus musculus
gaactgttacaaagactacgagaat

SEQ ID NO: 420525 - DNA, 25 bp, Mus musculus
gaactgttacaatgactacgagaat

SEQ ID NO: 420526 - DNA, 25 bp, Mus musculus
gaactgttcagccttttcaagattt

SEQ ID NO: 420527 - DNA, 25 bp, Mus musculus
gaactgttcagcgttttcaagattt

SEQ ID NO: 420528 - DNA, 25 bp, Mus musculus
gaactgttcgtgcagactatcgcaa

SEQ ID NO: 420529 - DNA, 25 bp, Mus musculus
gaactgttcgtggagactatcgcaa

SEQ ID NO: 420530 - DNA, 25 bp, Mus musculus
gaactgttctcaagtgactatggtt

SEQ ID NO: 420531 - DNA, 25 bp, Mus musculus
gaactgttctcatgtgactatggtt

SEQ ID NO: 420532 - DNA, 25 bp, Mus musculus
gaactgttgaaaccccgcagcatca

SEQ ID NO: 420533 - DNA, 25 bp, Mus musculus
gaactgttgaaagcccgcagcatca

SEQ ID NO: 420534 - DNA, 25 bp, Mus musculus
gaactgttgaatcttgcatttgcac

SEQ ID NO: 420535 - DNA, 25 bp, Mus musculus
gaactgttgaatgttgcatttgcac

SEQ ID NO: 420536 - DNA, 25 bp, Mus musculus
gaactgttgagcaccagggcctgcc

SEQ ID NO: 420537 - DNA, 25 bp, Mus musculus
gaactgttgagctccagggcctgcc

SEQ ID NO: 420538 - DNA, 25 bp, Mus musculus
gaactgttgattactctgtagttta

SEQ ID NO: 420539 - DNA, 25 bp, Mus musculus
gaactgttgatttctctgtagttta

SEQ ID NO: 420540 - DNA, 25 bp, Mus musculus
gaactgttgccacattagcactgtc

SEQ ID NO: 420541 - DNA, 25 bp, Mus musculus
gaactgttgccagattagcactgtc

SEQ ID NO: 420542 - DNA, 25 bp, Mus musculus
gaactgttgcccaattcagcagtgc

SEQ ID NO: 420543 - DNA, 25 bp, Mus musculus
gaactgttgccctattcagcagtgc

SEQ ID NO: 420544 - DNA, 25 bp, Mus musculus
gaactgttggaccacacctttgaca

SEQ ID NO: 420545 - DNA, 25 bp, Mus musculus
gaactgttggacgacacctttgaca

SEQ ID NO: 420546 - DNA, 25 bp, Mus musculus
gaactgttggatcttcagatgtgta

SEQ ID NO: 420547 - DNA, 25 bp, Mus musculus
gaactgttggatgttcagatgtgta

SEQ ID NO: 420548 - DNA, 25 bp, Mus musculus
gaactgttgggaccatgtcatgaga

SEQ ID NO: 420549 - DNA, 25 bp, Mus musculus
gaactgttgggagcatgtcatgaga

SEQ ID NO: 420550 - DNA, 25 bp, Mus musculus
gaactgttggtccttatagagccat

SEQ ID NO: 420551 - DNA, 25 bp, Mus musculus
gaactgttggtcgttatagagccat

SEQ ID NO: 420552 - DNA, 25 bp, Mus musculus
gaactgttgtagcactctactgaaa

SEQ ID NO: 420553 - DNA, 25 bp, Mus musculus
gaactgttgtaggactctactgaaa

SEQ ID NO: 420554 - DNA, 25 bp, Mus musculus
gaactgttgtcacccaatgctccca

SEQ ID NO: 420555 - DNA, 25 bp, Mus musculus
gaactgttgtcagccaatgctccca

SEQ ID NO: 420556 - DNA, 25 bp, Mus musculus
gaactgttgttcactaaggattatt

SEQ ID NO: 420557 - DNA, 25 bp, Mus musculus
gaactgttgttcagagtaggcatga

SEQ ID NO: 420558 - DNA, 25 bp, Mus musculus
gaactgttgttcatcatagcctcat

SEQ ID NO: 420559 - DNA, 25 bp, Mus musculus
gaactgttgttctctaaggattatt

SEQ ID NO: 420560 - DNA, 25 bp, Mus musculus
gaactgttgttctgagtaggcatga

SEQ ID NO: 420561 - DNA, 25 bp, Mus musculus
gaactgttgttcttcatagcctcat

SEQ ID NO: 420562 - DNA, 25 bp, Mus musculus
gaactgtttaacatggccaatctag

SEQ ID NO: 420563 - DNA, 25 bp, Mus musculus
gaactgtttaacttggccaatctag

SEQ ID NO: 420564 - DNA, 25 bp, Mus musculus
gaactgtttaggaagcactttgcca

SEQ ID NO: 420565 - DNA, 25 bp, Mus musculus
gaactgtttaggtagcactttgcca

SEQ ID NO: 420566 - DNA, 25 bp, Mus musculus
gaactgtttatcatgggcagcacca

SEQ ID NO: 420567 - DNA, 25 bp, Mus musculus
gaactgtttatcttgggcagcacca

SEQ ID NO: 420568 - DNA, 25 bp, Mus musculus
gaactgtttcagaggaattcttact

SEQ ID NO: 420569 - DNA, 25 bp, Mus musculus
gaactgtttcagtggaattcttact

SEQ ID NO: 420570 - DNA, 25 bp, Mus musculus
gaactgtttccactacaaatcaaga

SEQ ID NO: 420571 - DNA, 25 bp, Mus musculus
gaactgtttccagtacaaatcaaga

SEQ ID NO: 420572 - DNA, 25 bp, Mus musculus
gaactgtttctgactgcttgactaa

SEQ ID NO: 420573 - DNA, 25 bp, Mus musculus
gaactgtttctgtctgcttgactaa

SEQ ID NO: 420574 - DNA, 25 bp, Mus musculus
gaactgtttgcaccaaatggctttt

SEQ ID NO: 420575 - DNA, 25 bp, Mus musculus
gaactgtttgcagcaaatggctttt

SEQ ID NO: 420576 - DNA, 25 bp, Mus musculus
gaactgtttggcacagagctgcctc

SEQ ID NO: 420577 - DNA, 25 bp, Mus musculus
gaactgtttggcattgttggcagaa

SEQ ID NO: 420578 - DNA, 25 bp, Mus musculus
gaactgtttggctcagagctgcctc

SEQ ID NO: 420579 - DNA, 25 bp, Mus musculus
gaactgtttggctttgttggcagaa

SEQ ID NO: 420580 - DNA, 25 bp, Mus musculus
gaactgtttgtaaacagctccacta

SEQ ID NO: 420581 - DNA, 25 bp, Mus musculus
gaactgtttgtatacagctccacta

SEQ ID NO: 420582 - DNA, 25 bp, Mus musculus
gaactgtttgtcacaattggccatt

SEQ ID NO: 420583 - DNA, 25 bp, Mus musculus
gaactgtttgtctcaattggccatt

SEQ ID NO: 420584 - DNA, 25 bp, Mus musculus
gaactgtttgttcactaggtttttg

SEQ ID NO: 420585 - DNA, 25 bp, Mus musculus
gaactgtttgttgactaggtttttg

SEQ ID NO: 420586 - DNA, 25 bp, Mus musculus
gaactgttttccctgccagttaggg

SEQ ID NO: 420587 - DNA, 25 bp, Mus musculus
gaactgttttccgtgccagttaggg

SEQ ID NO: 420588 - DNA, 25 bp, Mus musculus
gaacttaaattactgcagttccgtt

SEQ ID NO: 420589 - DNA, 25 bp, Mus musculus
gaacttaaattagtgcagttccgtt

SEQ ID NO: 420590 - DNA, 25 bp, Mus musculus
gaacttaacattcgcagcattctaa

SEQ ID NO: 420591 - DNA, 25 bp, Mus musculus
gaacttaacattggcagcattctaa

SEQ ID NO: 420592 - DNA, 25 bp, Mus musculus
gaacttaaccaacatcttcccatgt

SEQ ID NO: 420593 - DNA, 25 bp, Mus musculus
gaacttaaccaagatcttcccatgt

SEQ ID NO: 420594 - DNA, 25 bp, Mus musculus
gaacttaagtcacgaaggaaaccat

SEQ ID NO: 420595 - DNA, 25 bp, Mus musculus
gaacttaagtcaggaaggaaaccat

SEQ ID NO: 420596 - DNA, 25 bp, Mus musculus
gaacttaatcttacttaccaagtga

SEQ ID NO: 420597 - DNA, 25 bp, Mus musculus
gaacttaatctttcttaccaagtga

SEQ ID NO: 420598 - DNA, 25 bp, Mus musculus
gaacttaattctcgatgccgatggc

SEQ ID NO: 420599 - DNA, 25 bp, Mus musculus
gaacttaattctggatgccgatggc

SEQ ID NO: 420600 - DNA, 25 bp, Mus musculus
gaacttacacgccattgtgagctgc

SEQ ID NO: 420601 - DNA, 25 bp, Mus musculus
gaacttacacgcgattgtgagctgc

SEQ ID NO: 420602 - DNA, 25 bp, Mus musculus
gaacttacagtcacaagagggcctt

SEQ ID NO: 420603 - DNA, 25 bp, Mus musculus
gaacttacagtctcaagagggcctt

SEQ ID NO: 420604 - DNA, 25 bp, Mus musculus
gaacttacattgagattccggtttt

SEQ ID NO: 420605 - DNA, 25 bp, Mus musculus
gaacttacattgtgattccggtttt

SEQ ID NO: 420606 - DNA, 25 bp, Mus musculus
gaacttacgtaaatgtagcatcgag

SEQ ID NO: 420607 - DNA, 25 bp, Mus musculus
gaacttacgtaattgtagcatcgag

SEQ ID NO: 420608 - DNA, 25 bp, Mus musculus
gaacttactcctatgttatgccatg

SEQ ID NO: 420609 - DNA, 25 bp, Mus musculus
gaacttactcctttgttatgccatg

SEQ ID NO: 420610 - DNA, 25 bp, Mus musculus
gaacttactgttcctcttacaaaga

SEQ ID NO: 420611 - DNA, 25 bp, Mus musculus
gaacttactgttgctcttacaaaga

SEQ ID NO: 420612 - DNA, 25 bp, Mus musculus
gaacttagaacaacaggcttggtaa

SEQ ID NO: 420613 - DNA, 25 bp, Mus musculus
gaacttagaacatcaggcttggtaa

SEQ ID NO: 420614 - DNA, 25 bp, Mus musculus
gaacttagaatcctcacctttgccc

SEQ ID NO: 420615 - DNA, 25 bp, Mus musculus
gaacttagaatcgtcacctttgccc

SEQ ID NO: 420616 - DNA, 25 bp, Mus musculus
gaacttagattcacatagccaattt

SEQ ID NO: 420617 - DNA, 25 bp, Mus musculus
gaacttagattctcatagccaattt

SEQ ID NO: 420618 - DNA, 25 bp, Mus musculus
gaacttagccttcacctgtgaaata

SEQ ID NO: 420619 - DNA, 25 bp, Mus musculus
gaacttagccttgacctgtgaaata

SEQ ID NO: 420620 - DNA, 25 bp, Mus musculus
gaacttagcgtgagtttatcagcca

SEQ ID NO: 420621 - DNA, 25 bp, Mus musculus
gaacttagcgtgtgtttatcagcca

SEQ ID NO: 420622 - DNA, 25 bp, Mus musculus
gaacttagctcacattaacttaatt

SEQ ID NO: 420623 - DNA, 25 bp, Mus musculus
gaacttagctcagattaacttaatt

SEQ ID NO: 420624 - DNA, 25 bp, Mus musculus
gaacttaggaccatatcaggcaaca

SEQ ID NO: 420625 - DNA, 25 bp, Mus musculus
gaacttaggacccagcttgggctag

SEQ ID NO: 420626 - DNA, 25 bp, Mus musculus
gaacttaggaccgagcttgggctag

SEQ ID NO: 420627 - DNA, 25 bp, Mus musculus
gaacttaggaccttatcaggcaaca

SEQ ID NO: 420628 - DNA, 25 bp, Mus musculus
gaacttaggcagatgttacatagga

SEQ ID NO: 420629 - DNA, 25 bp, Mus musculus
gaacttaggcagttgttacatagga

SEQ ID NO: 420630 - DNA, 25 bp, Mus musculus
gaacttaggtgacaccctcaggcac

SEQ ID NO: 420631 - DNA, 25 bp, Mus musculus
gaacttaggtgagaccctcaggcac

SEQ ID NO: 420632 - DNA, 25 bp, Mus musculus
gaacttagtactcctagcccaggga

SEQ ID NO: 420633 - DNA, 25 bp, Mus musculus
gaacttagtactgctagcccaggga

SEQ ID NO: 420634 - DNA, 25 bp, Mus musculus
gaacttagtagtccctttgtgatgt

SEQ ID NO: 420635 - DNA, 25 bp, Mus musculus
gaacttagtagtgcctttgtgatgt

SEQ ID NO: 420636 - DNA, 25 bp, Mus musculus
gaacttagtgatatggcccgtgacc

SEQ ID NO: 420637 - DNA, 25 bp, Mus musculus
gaacttagtgatttggcccgtgacc

SEQ ID NO: 420638 - DNA, 25 bp, Mus musculus
gaacttagtggaattgttattctca

SEQ ID NO: 420639 - DNA, 25 bp, Mus musculus
gaacttagtggatttgttattctca

SEQ ID NO: 420640 - DNA, 25 bp, Mus musculus
gaacttagtgttactgaggttgata

SEQ ID NO: 420641 - DNA, 25 bp, Mus musculus
gaacttagtgtttctgaggttgata

SEQ ID NO: 420642 - DNA, 25 bp, Mus musculus
gaacttatactacttatcatcttat

SEQ ID NO: 420643 - DNA, 25 bp, Mus musculus
gaacttatactagttatcatcttat

SEQ ID NO: 420644 - DNA, 25 bp, Mus musculus
gaacttatctcaattgtatcctggt

SEQ ID NO: 420645 - DNA, 25 bp, Mus musculus
gaacttatctcatttgtatcctggt

SEQ ID NO: 420646 - DNA, 25 bp, Mus musculus
gaacttatctgaactgtctgcttcc

SEQ ID NO: 420647 - DNA, 25 bp, Mus musculus
gaacttatctgatctgtctgcttcc

SEQ ID NO: 420648 - DNA, 25 bp, Mus musculus
gaacttatgaacacttgttacagta

SEQ ID NO: 420649 - DNA, 25 bp, Mus musculus
gaacttatgaactcttgttacagta

SEQ ID NO: 420650 - DNA, 25 bp, Mus musculus
gaacttatgatgaagaccagataga

SEQ ID NO: 420651 - DNA, 25 bp, Mus musculus
gaacttatgatgtagaccagataga

SEQ ID NO: 420652 - DNA, 25 bp, Mus musculus
gaacttatgcacagaggttttgact

SEQ ID NO: 420653 - DNA, 25 bp, Mus musculus
gaacttatgcactgaggttttgact

SEQ ID NO: 420654 - DNA, 25 bp, Mus musculus
gaacttatggagatcggcctgcttc

SEQ ID NO: 420655 - DNA, 25 bp, Mus musculus
gaacttatggagttcggcctgcttc

SEQ ID NO: 420656 - DNA, 25 bp, Mus musculus
gaacttatggctaagcttctatata

SEQ ID NO: 420657 - DNA, 25 bp, Mus musculus
gaacttatggcttagcttctatata

SEQ ID NO: 420658 - DNA, 25 bp, Mus musculus
gaacttattatgagtggaccttcct

SEQ ID NO: 420659 - DNA, 25 bp, Mus musculus
gaacttattatgtgtggaccttcct

SEQ ID NO: 420660 - DNA, 25 bp, Mus musculus
gaacttattcctcatgccaaggacc

SEQ ID NO: 420661 - DNA, 25 bp, Mus musculus
gaacttattcctgatgccaaggacc

SEQ ID NO: 420662 - DNA, 25 bp, Mus musculus
gaacttattgatcattaggcttggt

SEQ ID NO: 420663 - DNA, 25 bp, Mus musculus
gaacttattgatgattaggcttggt

SEQ ID NO: 420664 - DNA, 25 bp, Mus musculus
gaacttatttccatgactgtgttaa

SEQ ID NO: 420665 - DNA, 25 bp, Mus musculus
gaacttatttccttgactgtgttaa

SEQ ID NO: 420666 - DNA, 25 bp, Mus musculus
gaacttcaacaaccaaagctccatc

SEQ ID NO: 420667 - DNA, 25 bp, Mus musculus
gaacttcaacaagcaaagctccatc

SEQ ID NO: 420668 - DNA, 25 bp, Mus musculus
gaacttcaacagacattggagaatg

SEQ ID NO: 420669 - DNA, 25 bp, Mus musculus
gaacttcaacagtcattggagaatg

SEQ ID NO: 420670 - DNA, 25 bp, Mus musculus
gaacttcaagcaaatttattctcag

SEQ ID NO: 420671 - DNA, 25 bp, Mus musculus
gaacttcaagcatatttattctcag

SEQ ID NO: 420672 - DNA, 25 bp, Mus musculus
gaacttcaaggtctaggcagacccc

SEQ ID NO: 420673 - DNA, 25 bp, Mus musculus
gaacttcaaggtgtaggcagacccc

SEQ ID NO: 420674 - DNA, 25 bp, Mus musculus
gaacttcaagttcttaacactcaca

SEQ ID NO: 420675 - DNA, 25 bp, Mus musculus
gaacttcaagttgttaacactcaca

SEQ ID NO: 420676 - DNA, 25 bp, Mus musculus
gaacttcaattcattcagtaggaaa

SEQ ID NO: 420677 - DNA, 25 bp, Mus musculus
gaacttcaattcctttcttactaga

SEQ ID NO: 420678 - DNA, 25 bp, Mus musculus
gaacttcaattcgtttcttactaga

SEQ ID NO: 420679 - DNA, 25 bp, Mus musculus
gaacttcaattctttcagtaggaaa

SEQ ID NO: 420680 - DNA, 25 bp, Mus musculus
gaacttcacgtactcagcctattga

SEQ ID NO: 420681 - DNA, 25 bp, Mus musculus
gaacttcacgtagtcagcctattga

SEQ ID NO: 420682 - DNA, 25 bp, Mus musculus
gaacttcactcacacagtgctctaa

SEQ ID NO: 420683 - DNA, 25 bp, Mus musculus
gaacttcactcagacagtgctctaa

SEQ ID NO: 420684 - DNA, 25 bp, Mus musculus
gaacttcactcgcagactttgatat

SEQ ID NO: 420685 - DNA, 25 bp, Mus musculus
gaacttcactcggagactttgatat

SEQ ID NO: 420686 - DNA, 25 bp, Mus musculus
gaacttcactgactctaagcatggg

SEQ ID NO: 420687 - DNA, 25 bp, Mus musculus
gaacttcactgagtctaagcatggg

SEQ ID NO: 420688 - DNA, 25 bp, Mus musculus
gaacttcagacacagtcgtggtcaa

SEQ ID NO: 420689 - DNA, 25 bp, Mus musculus
gaacttcagacagagtcgtggtcaa

SEQ ID NO: 420690 - DNA, 25 bp, Mus musculus
gaacttcagactagtgtttcatttt

SEQ ID NO: 420691 - DNA, 25 bp, Mus musculus
gaacttcagacttgtgtttcatttt

SEQ ID NO: 420692 - DNA, 25 bp, Mus musculus
gaacttcagctcacgagcgtgaact

SEQ ID NO: 420693 - DNA, 25 bp, Mus musculus
gaacttcagctctcgagcgtgaact

SEQ ID NO: 420694 - DNA, 25 bp, Mus musculus
gaacttcaggaccagctgtttgaat

SEQ ID NO: 420695 - DNA, 25 bp, Mus musculus
gaacttcaggacgagctgtttgaat

SEQ ID NO: 420696 - DNA, 25 bp, Mus musculus
gaacttcagtgcataatacttgcag

SEQ ID NO: 420697 - DNA, 25 bp, Mus musculus
gaacttcagtgcttaatacttgcag

SEQ ID NO: 420698 - DNA, 25 bp, Mus musculus
gaacttcagtggacgtggtggcttt

SEQ ID NO: 420699 - DNA, 25 bp, Mus musculus
gaacttcagtggtcgtggtggcttt

SEQ ID NO: 420700 - DNA, 25 bp, Mus musculus
gaacttcagttaattgcttgctgct

SEQ ID NO: 420701 - DNA, 25 bp, Mus musculus
gaacttcagttatttgcttgctgct

SEQ ID NO: 420702 - DNA, 25 bp, Mus musculus
gaacttcatatacgtttagaggccc

SEQ ID NO: 420703 - DNA, 25 bp, Mus musculus
gaacttcatataggtttagaggccc

SEQ ID NO: 420704 - DNA, 25 bp, Mus musculus
gaacttcatcatacgggtcgggcct

SEQ ID NO: 420705 - DNA, 25 bp, Mus musculus
gaacttcatcattcgggtcgggcct

SEQ ID NO: 420706 - DNA, 25 bp, Mus musculus
gaacttcatcctctttatctgcatc

SEQ ID NO: 420707 - DNA, 25 bp, Mus musculus
gaacttcatcctgtttatctgcatc

SEQ ID NO: 420708 - DNA, 25 bp, Mus musculus
gaacttcatcttcgtttatgtactt

SEQ ID NO: 420709 - DNA, 25 bp, Mus musculus
gaacttcatcttggtttatgtactt

SEQ ID NO: 420710 - DNA, 25 bp, Mus musculus
gaacttcatggaccgggtacccgca

SEQ ID NO: 420711 - DNA, 25 bp, Mus musculus
gaacttcatggagcgggtacccgca

SEQ ID NO: 420712 - DNA, 25 bp, Mus musculus
gaacttcatggcctcactggatcac

SEQ ID NO: 420713 - DNA, 25 bp, Mus musculus
gaacttcatggcgtcactggatcac

SEQ ID NO: 420714 - DNA, 25 bp, Mus musculus
gaacttcattatcgccaataaacct

SEQ ID NO: 420715 - DNA, 25 bp, Mus musculus
gaacttcattatggccaataaacct

SEQ ID NO: 420716 - DNA, 25 bp, Mus musculus
gaacttcattgacatttcgggtttt

SEQ ID NO: 420717 - DNA, 25 bp, Mus musculus
gaacttcattgagatttcgggtttt

SEQ ID NO: 420718 - DNA, 25 bp, Mus musculus
gaacttcattgcaactgactttaca

SEQ ID NO: 420719 - DNA, 25 bp, Mus musculus
gaacttcattgcaggccgtgtgtca

SEQ ID NO: 420720 - DNA, 25 bp, Mus musculus
gaacttcattgctactgactttaca

SEQ ID NO: 420721 - DNA, 25 bp, Mus musculus
gaacttcattgctggccgtgtgtca

SEQ ID NO: 420722 - DNA, 25 bp, Mus musculus
gaacttcattggaaactttgcccca

SEQ ID NO: 420723 - DNA, 25 bp, Mus musculus
gaacttcattggtaactttgcccca

SEQ ID NO: 420724 - DNA, 25 bp, Mus musculus
gaacttccaaatcaggagtggtctg

SEQ ID NO: 420725 - DNA, 25 bp, Mus musculus
gaacttccaaatgaggagtggtctg

SEQ ID NO: 420726 - DNA, 25 bp, Mus musculus
gaacttccacaaactcacttgtaag

SEQ ID NO: 420727 - DNA, 25 bp, Mus musculus
gaacttccacaatctcacttgtaag

SEQ ID NO: 420728 - DNA, 25 bp, Mus musculus
gaacttccaccaacacttgttcttt

SEQ ID NO: 420729 - DNA, 25 bp, Mus musculus
gaacttccaccatcacttgttcttt

SEQ ID NO: 420730 - DNA, 25 bp, Mus musculus
gaacttccactacgatcctgaagaa

SEQ ID NO: 420731 - DNA, 25 bp, Mus musculus
gaacttccactaggatcctgaagaa

SEQ ID NO: 420732 - DNA, 25 bp, Mus musculus
gaacttccagagaattgcattcatg

SEQ ID NO: 420733 - DNA, 25 bp, Mus musculus
gaacttccagagtattgcattcatg

SEQ ID NO: 420734 - DNA, 25 bp, Mus musculus
gaacttccaggcagtgctcctacag

SEQ ID NO: 420735 - DNA, 25 bp, Mus musculus
gaacttccaggctgtgctcctacag

SEQ ID NO: 420736 - DNA, 25 bp, Mus musculus
gaacttccagtgaagcttttcttca

SEQ ID NO: 420737 - DNA, 25 bp, Mus musculus
gaacttccagtgtagcttttcttca

SEQ ID NO: 420738 - DNA, 25 bp, Mus musculus
gaacttccagttatgaaaagacagg

SEQ ID NO: 420739 - DNA, 25 bp, Mus musculus
gaacttccagttttgaaaagacagg

SEQ ID NO: 420740 - DNA, 25 bp, Mus musculus
gaacttccatctacccattattaag

SEQ ID NO: 420741 - DNA, 25 bp, Mus musculus
gaacttccatcttcccattattaag

SEQ ID NO: 420742 - DNA, 25 bp, Mus musculus
gaacttcccaagcttatttctgaat

SEQ ID NO: 420743 - DNA, 25 bp, Mus musculus
gaacttcccaaggttatttctgaat

SEQ ID NO: 420744 - DNA, 25 bp, Mus musculus
gaacttcccacacgattagctttat

SEQ ID NO: 420745 - DNA, 25 bp, Mus musculus
gaacttcccacaggattagctttat

SEQ ID NO: 420746 - DNA, 25 bp, Mus musculus
gaacttcccagactggaattttgtg

SEQ ID NO: 420747 - DNA, 25 bp, Mus musculus
gaacttcccagagtggaattttgtg

SEQ ID NO: 420748 - DNA, 25 bp, Mus musculus
gaacttccctcgacaatcaatgctg

SEQ ID NO: 420749 - DNA, 25 bp, Mus musculus
gaacttccctcgtcaatcaatgctg

SEQ ID NO: 420750 - DNA, 25 bp, Mus musculus
gaacttccctgaaaagtgatctagg

SEQ ID NO: 420751 - DNA, 25 bp, Mus musculus
gaacttccctgataagtgatctagg

SEQ ID NO: 420752 - DNA, 25 bp, Mus musculus
gaacttccgagtcctgatgcttttt

SEQ ID NO: 420753 - DNA, 25 bp, Mus musculus
gaacttccgagtgctgatgcttttt

SEQ ID NO: 420754 - DNA, 25 bp, Mus musculus
gaacttccgcttcggaaacccgctg

SEQ ID NO: 420755 - DNA, 25 bp, Mus musculus
gaacttccgcttgggaaacccgctg

SEQ ID NO: 420756 - DNA, 25 bp, Mus musculus
gaacttccggacactacagagcatt

SEQ ID NO: 420757 - DNA, 25 bp, Mus musculus
gaacttccggactctacagagcatt

SEQ ID NO: 420758 - DNA, 25 bp, Mus musculus
gaacttccgtggctgactccagtag

SEQ ID NO: 420759 - DNA, 25 bp, Mus musculus
gaacttccgtgggtgactccagtag

SEQ ID NO: 420760 - DNA, 25 bp, Mus musculus
gaacttcctaatagtgtcacatttt

SEQ ID NO: 420761 - DNA, 25 bp, Mus musculus
gaacttcctaattgtgtcacatttt

SEQ ID NO: 420762 - DNA, 25 bp, Mus musculus
gaacttcctccaccagcttaaaagg

SEQ ID NO: 420763 - DNA, 25 bp, Mus musculus
gaacttcctccagcagcttaaaagg

SEQ ID NO: 420764 - DNA, 25 bp, Mus musculus
gaacttcctgaactctacagcctct

SEQ ID NO: 420765 - DNA, 25 bp, Mus musculus
gaacttcctgaagtctacagcctct

SEQ ID NO: 420766 - DNA, 25 bp, Mus musculus
gaacttcctgctaatctcatgttag

SEQ ID NO: 420767 - DNA, 25 bp, Mus musculus
gaacttcctgcttatctcatgttag

SEQ ID NO: 420768 - DNA, 25 bp, Mus musculus
gaacttcctggaaactagacttaac

SEQ ID NO: 420769 - DNA, 25 bp, Mus musculus
gaacttcctggatactagacttaac

SEQ ID NO: 420770 - DNA, 25 bp, Mus musculus
gaacttcctgtcaaagttgtagtgg

SEQ ID NO: 420771 - DNA, 25 bp, Mus musculus
gaacttcctgtctaagttgtagtgg

SEQ ID NO: 420772 - DNA, 25 bp, Mus musculus
gaacttccttatacttggtgtggtc

SEQ ID NO: 420773 - DNA, 25 bp, Mus musculus
gaacttccttattcttggtgtggtc

SEQ ID NO: 420774 - DNA, 25 bp, Mus musculus
gaacttccttctcttataagataga

SEQ ID NO: 420775 - DNA, 25 bp, Mus musculus
gaacttccttctgttataagataga

SEQ ID NO: 420776 - DNA, 25 bp, Mus musculus
gaacttcctttcaagggcctgtggg

SEQ ID NO: 420777 - DNA, 25 bp, Mus musculus
gaacttcctttctagggcctgtggg

SEQ ID NO: 420778 - DNA, 25 bp, Mus musculus
gaacttcgacaaaaggattacaaag

SEQ ID NO: 420779 - DNA, 25 bp, Mus musculus
gaacttcgacaataggattacaaag

SEQ ID NO: 420780 - DNA, 25 bp, Mus musculus
gaacttcgagaacatctggcacaga

SEQ ID NO: 420781 - DNA, 25 bp, Mus musculus
gaacttcgagaagatctggcacaga

SEQ ID NO: 420782 - DNA, 25 bp, Mus musculus
gaacttcgagatcgcctattaactg

SEQ ID NO: 420783 - DNA, 25 bp, Mus musculus
gaacttcgagatggcctattaactg

SEQ ID NO: 420784 - DNA, 25 bp, Mus musculus
gaacttcgcccacatgtccagacag

SEQ ID NO: 420785 - DNA, 25 bp, Mus musculus
gaacttcgcccagatgtccagacag

SEQ ID NO: 420786 - DNA, 25 bp, Mus musculus
gaacttcgcctacaggctggctcaa

SEQ ID NO: 420787 - DNA, 25 bp, Mus musculus
gaacttcgcctagaggctggctcaa

SEQ ID NO: 420788 - DNA, 25 bp, Mus musculus
gaacttcgctgcactgcttgaggaa

SEQ ID NO: 420789 - DNA, 25 bp, Mus musculus
gaacttcgctgctctgcttgaggaa

SEQ ID NO: 420790 - DNA, 25 bp, Mus musculus
gaacttcggaagagaattgcccatt

SEQ ID NO: 420791 - DNA, 25 bp, Mus musculus
gaacttcggaagtgaattgcccatt

SEQ ID NO: 420792 - DNA, 25 bp, Mus musculus
gaacttcggagacacaccttatcca

SEQ ID NO: 420793 - DNA, 25 bp, Mus musculus
gaacttcggagagacaccttatcca

SEQ ID NO: 420794 - DNA, 25 bp, Mus musculus
gaacttcgggcacagctggctccag

SEQ ID NO: 420795 - DNA, 25 bp, Mus musculus
gaacttcgggcagagctggctccag

SEQ ID NO: 420796 - DNA, 25 bp, Mus musculus
gaacttcggtaaaccttgtctgtct

SEQ ID NO: 420797 - DNA, 25 bp, Mus musculus
gaacttcggtaatccttgtctgtct

SEQ ID NO: 420798 - DNA, 25 bp, Mus musculus
gaacttcgttggaatcctatctgtg

SEQ ID NO: 420799 - DNA, 25 bp, Mus musculus
gaacttcgttggtatcctatctgtg

SEQ ID NO: 420800 - DNA, 25 bp, Mus musculus
gaacttctaacaactgatctttact

SEQ ID NO: 420801 - DNA, 25 bp, Mus musculus
gaacttctaacatctgatctttact

SEQ ID NO: 420802 - DNA, 25 bp, Mus musculus
gaacttctaggacacatccctccag

SEQ ID NO: 420803 - DNA, 25 bp, Mus musculus
gaacttctaggagacatccctccag

SEQ ID NO: 420804 - DNA, 25 bp, Mus musculus
gaacttctaggtcctttttaaacag

SEQ ID NO: 420805 - DNA, 25 bp, Mus musculus
gaacttctaggtgctttttaaacag

SEQ ID NO: 420806 - DNA, 25 bp, Mus musculus
gaacttctagtcattttgcttacac

SEQ ID NO: 420807 - DNA, 25 bp, Mus musculus
gaacttctagtctttttgcttacac

SEQ ID NO: 420808 - DNA, 25 bp, Mus musculus
gaacttctcaaaacaacgaaatctg

SEQ ID NO: 420809 - DNA, 25 bp, Mus musculus
gaacttctcaaacatatgcacgctg

SEQ ID NO: 420810 - DNA, 25 bp, Mus musculus
gaacttctcaaagatatgcacgctg

SEQ ID NO: 420811 - DNA, 25 bp, Mus musculus
gaacttctcaaatcaacgaaatctg

SEQ ID NO: 420812 - DNA, 25 bp, Mus musculus
gaacttctcacacaccatttttagg

SEQ ID NO: 420813 - DNA, 25 bp, Mus musculus
gaacttctcacagaccatttttagg

SEQ ID NO: 420814 - DNA, 25 bp, Mus musculus
gaacttctcacgactccatgagtta

SEQ ID NO: 420815 - DNA, 25 bp, Mus musculus
gaacttctcacgtctccatgagtta

SEQ ID NO: 420816 - DNA, 25 bp, Mus musculus
gaacttctccatcgaactctgatca

SEQ ID NO: 420817 - DNA, 25 bp, Mus musculus
gaacttctccatggaactctgatca

SEQ ID NO: 420818 - DNA, 25 bp, Mus musculus
gaacttctccggcaagtaccaattg

SEQ ID NO: 420819 - DNA, 25 bp, Mus musculus
gaacttctccgggaagtaccaattg

SEQ ID NO: 420820 - DNA, 25 bp, Mus musculus
gaacttctcgggaagctgacacgac

SEQ ID NO: 420821 - DNA, 25 bp, Mus musculus
gaacttctcgggtagctgacacgac

SEQ ID NO: 420822 - DNA, 25 bp, Mus musculus
gaacttctgaataactgctcaggtt

SEQ ID NO: 420823 - DNA, 25 bp, Mus musculus
gaacttctgaattactgctcaggtt

SEQ ID NO: 420824 - DNA, 25 bp, Mus musculus
gaacttctgataaactccactgtgt

SEQ ID NO: 420825 - DNA, 25 bp, Mus musculus
gaacttctgatatactccactgtgt

SEQ ID NO: 420826 - DNA, 25 bp, Mus musculus
gaacttctgcagaccataggagccc

SEQ ID NO: 420827 - DNA, 25 bp, Mus musculus
gaacttctgcagtccataggagccc

SEQ ID NO: 420828 - DNA, 25 bp, Mus musculus
gaacttctgcccagcaaatgtgcaa

SEQ ID NO: 420829 - DNA, 25 bp, Mus musculus
gaacttctgccctgcaaatgtgcaa

SEQ ID NO: 420830 - DNA, 25 bp, Mus musculus
gaacttctgcggcatttttggtctt

SEQ ID NO: 420831 - DNA, 25 bp, Mus musculus
gaacttctgcgggatttttggtctt

SEQ ID NO: 420832 - DNA, 25 bp, Mus musculus
gaacttctggaacagatacaacaag

SEQ ID NO: 420833 - DNA, 25 bp, Mus musculus
gaacttctggaacattctgaacctt

SEQ ID NO: 420834 - DNA, 25 bp, Mus musculus
gaacttctggaagagatacaacaag

SEQ ID NO: 420835 - DNA, 25 bp, Mus musculus
gaacttctggaagattctgaacctt

SEQ ID NO: 420836 - DNA, 25 bp, Mus musculus
gaacttctggctatcagtgacgcag

SEQ ID NO: 420837 - DNA, 25 bp, Mus musculus
gaacttctggctttcagtgacgcag

SEQ ID NO: 420838 - DNA, 25 bp, Mus musculus
gaacttctgggaagaactgccacta

SEQ ID NO: 420839 - DNA, 25 bp, Mus musculus
gaacttctgggacacattgaaagca

SEQ ID NO: 420840 - DNA, 25 bp, Mus musculus
gaacttctgggagacattgaaagca

SEQ ID NO: 420841 - DNA, 25 bp, Mus musculus
gaacttctgggatgaactgccacta

SEQ ID NO: 420842 - DNA, 25 bp, Mus musculus
gaacttctgggtaatagccttagga

SEQ ID NO: 420843 - DNA, 25 bp, Mus musculus
gaacttctgggttatagccttagga

SEQ ID NO: 420844 - DNA, 25 bp, Mus musculus
gaacttctgtctaataggagctgta

SEQ ID NO: 420845 - DNA, 25 bp, Mus musculus
gaacttctgtcttataggagctgta

SEQ ID NO: 420846 - DNA, 25 bp, Mus musculus
gaacttctgtggcacactttcagtt

SEQ ID NO: 420847 - DNA, 25 bp, Mus musculus
gaacttctgtgggacactttcagtt

SEQ ID NO: 420848 - DNA, 25 bp, Mus musculus
gaacttctgtgtattgaagtagcaa

SEQ ID NO: 420849 - DNA, 25 bp, Mus musculus
gaacttctgtgttttgaagtagcaa

SEQ ID NO: 420850 - DNA, 25 bp, Mus musculus
gaacttctgttaacacattaatttt

SEQ ID NO: 420851 - DNA, 25 bp, Mus musculus
gaacttctgttatcacattaatttt

SEQ ID NO: 420852 - DNA, 25 bp, Mus musculus
gaacttctgttgactcttgggtgtt

SEQ ID NO: 420853 - DNA, 25 bp, Mus musculus
gaacttctgttgtctcttgggtgtt

SEQ ID NO: 420854 - DNA, 25 bp, Mus musculus
gaacttcttaaaagtgccacatttg

SEQ ID NO: 420855 - DNA, 25 bp, Mus musculus
gaacttcttaaatgtgccacatttg

SEQ ID NO: 420856 - DNA, 25 bp, Mus musculus
gaacttcttagtcactacattcgtc

SEQ ID NO: 420857 - DNA, 25 bp, Mus musculus
gaacttcttagtgactacattcgtc

SEQ ID NO: 420858 - DNA, 25 bp, Mus musculus
gaacttcttattcgcaagggagctc

SEQ ID NO: 420859 - DNA, 25 bp, Mus musculus
gaacttcttattggcaagggagctc

SEQ ID NO: 420860 - DNA, 25 bp, Mus musculus
gaacttcttcacagacgtctacgac

SEQ ID NO: 420861 - DNA, 25 bp, Mus musculus
gaacttcttcactgacgtctacgac

SEQ ID NO: 420862 - DNA, 25 bp, Mus musculus
gaacttcttcagctgaaggcacagt

SEQ ID NO: 420863 - DNA, 25 bp, Mus musculus
gaacttcttcaggtgaaggcacagt

SEQ ID NO: 420864 - DNA, 25 bp, Mus musculus
gaacttcttcttcgctcacacggaa

SEQ ID NO: 420865 - DNA, 25 bp, Mus musculus
gaacttcttcttggctcacacggaa

SEQ ID NO: 420866 - DNA, 25 bp, Mus musculus
gaacttcttgaaaacactggcagaa

SEQ ID NO: 420867 - DNA, 25 bp, Mus musculus
gaacttcttgaacatctttctccac

SEQ ID NO: 420868 - DNA, 25 bp, Mus musculus
gaacttcttgaagatctttctccac

SEQ ID NO: 420869 - DNA, 25 bp, Mus musculus
gaacttcttgaatacactggcagaa

SEQ ID NO: 420870 - DNA, 25 bp, Mus musculus
gaacttcttgagctttcatttcatg

SEQ ID NO: 420871 - DNA, 25 bp, Mus musculus
gaacttcttgaggtttcatttcatg

SEQ ID NO: 420872 - DNA, 25 bp, Mus musculus
gaacttcttgatacactgtttgtct

SEQ ID NO: 420873 - DNA, 25 bp, Mus musculus
gaacttcttgattcactgtttgtct

SEQ ID NO: 420874 - DNA, 25 bp, Mus musculus
gaacttcttggcactgttgctaaaa

SEQ ID NO: 420875 - DNA, 25 bp, Mus musculus
gaacttcttggctctgttgctaaaa

SEQ ID NO: 420876 - DNA, 25 bp, Mus musculus
gaacttcttggtcgagtctagtcaa

SEQ ID NO: 420877 - DNA, 25 bp, Mus musculus
gaacttcttggtggagtctagtcaa

SEQ ID NO: 420878 - DNA, 25 bp, Mus musculus
gaacttcttgtacctgaacacctag

SEQ ID NO: 420879 - DNA, 25 bp, Mus musculus
gaacttcttgtagctgaacacctag

SEQ ID NO: 420880 - DNA, 25 bp, Mus musculus
gaacttctttgcacttaattattgt

SEQ ID NO: 420881 - DNA, 25 bp, Mus musculus
gaacttctttgctcttaattattgt

SEQ ID NO: 420882 - DNA, 25 bp, Mus musculus
gaacttctttggagggatgacgcca

SEQ ID NO: 420883 - DNA, 25 bp, Mus musculus
gaacttctttggtgggatgacgcca

SEQ ID NO: 420884 - DNA, 25 bp, Mus musculus
gaacttctttgtaaactacaggcgt

SEQ ID NO: 420885 - DNA, 25 bp, Mus musculus
gaacttctttgttaactacaggcgt

SEQ ID NO: 420886 - DNA, 25 bp, Mus musculus
gaacttcttttccactggagacact

SEQ ID NO: 420887 - DNA, 25 bp, Mus musculus
gaacttcttttcgactggagacact

SEQ ID NO: 420888 - DNA, 25 bp, Mus musculus
gaacttcttttgctggactaccaga

SEQ ID NO: 420889 - DNA, 25 bp, Mus musculus
gaacttcttttggtggactaccaga

SEQ ID NO: 420890 - DNA, 25 bp, Mus musculus
gaacttgaaagcacagccctagcga

SEQ ID NO: 420891 - DNA, 25 bp, Mus musculus
gaacttgaaagctcagccctagcga

SEQ ID NO: 420892 - DNA, 25 bp, Mus musculus
gaacttgaaagtctacctggccttc

SEQ ID NO: 420893 - DNA, 25 bp, Mus musculus
gaacttgaaagtgtacctggccttc

SEQ ID NO: 420894 - DNA, 25 bp, Mus musculus
gaacttgaacctaggctgcattacc

SEQ ID NO: 420895 - DNA, 25 bp, Mus musculus
gaacttgaacctatgtaatatgata

SEQ ID NO: 420896 - DNA, 25 bp, Mus musculus
gaacttgaacctctgtcttatctga

SEQ ID NO: 420897 - DNA, 25 bp, Mus musculus
gaacttgaacctgtgtcttatctga

SEQ ID NO: 420898 - DNA, 25 bp, Mus musculus
gaacttgaaccttggctgcattacc

SEQ ID NO: 420899 - DNA, 25 bp, Mus musculus
gaacttgaacctttgtaatatgata

SEQ ID NO: 420900 - DNA, 25 bp, Mus musculus
gaacttgaagatctgttttgtgaaa

SEQ ID NO: 420901 - DNA, 25 bp, Mus musculus
gaacttgaagatgtgttttgtgaaa

SEQ ID NO: 420902 - DNA, 25 bp, Mus musculus
gaacttgaagcaatcctttatcact

SEQ ID NO: 420903 - DNA, 25 bp, Mus musculus
gaacttgaagcattcctttatcact

SEQ ID NO: 420904 - DNA, 25 bp, Mus musculus
gaacttgaagccatagctgtctacc

SEQ ID NO: 420905 - DNA, 25 bp, Mus musculus
gaacttgaagccatgggctcagtca

SEQ ID NO: 420906 - DNA, 25 bp, Mus musculus
gaacttgaagccttagctgtctacc

SEQ ID NO: 420907 - DNA, 25 bp, Mus musculus
gaacttgaagccttgggctcagtca

SEQ ID NO: 420908 - DNA, 25 bp, Mus musculus
gaacttgaagctagcacatacccgg

SEQ ID NO: 420909 - DNA, 25 bp, Mus musculus
gaacttgaagcttgcacatacccgg

SEQ ID NO: 420910 - DNA, 25 bp, Mus musculus
gaacttgaagtcagggctacacgaa

SEQ ID NO: 420911 - DNA, 25 bp, Mus musculus
gaacttgaagtctgggctacacgaa

SEQ ID NO: 420912 - DNA, 25 bp, Mus musculus
gaacttgaatagctgcctgcctctg

SEQ ID NO: 420913 - DNA, 25 bp, Mus musculus
gaacttgaataggtgcctgcctctg

SEQ ID NO: 420914 - DNA, 25 bp, Mus musculus
gaacttgaattgctctagaatgtga

SEQ ID NO: 420915 - DNA, 25 bp, Mus musculus
gaacttgaattggtctagaatgtga

SEQ ID NO: 420916 - DNA, 25 bp, Mus musculus
gaacttgacataataagctgggcgt

SEQ ID NO: 420917 - DNA, 25 bp, Mus musculus
gaacttgacatactgcctcctttac

SEQ ID NO: 420918 - DNA, 25 bp, Mus musculus
gaacttgacatagtgcctcctttac

SEQ ID NO: 420919 - DNA, 25 bp, Mus musculus
gaacttgacatattaagctgggcgt

SEQ ID NO: 420920 - DNA, 25 bp, Mus musculus
gaacttgaccaaaccacgttgccat

SEQ ID NO: 420921 - DNA, 25 bp, Mus musculus
gaacttgaccaatccacgttgccat

SEQ ID NO: 420922 - DNA, 25 bp, Mus musculus
gaacttgacctcctatcgatgagtt

SEQ ID NO: 420923 - DNA, 25 bp, Mus musculus
gaacttgacctcgtatcgatgagtt

SEQ ID NO: 420924 - DNA, 25 bp, Mus musculus
gaacttgaccttctatgtgcttcac

SEQ ID NO: 420925 - DNA, 25 bp, Mus musculus
gaacttgaccttgtatgtgcttcac

SEQ ID NO: 420926 - DNA, 25 bp, Mus musculus
gaacttgacttgatcgagtctactt

SEQ ID NO: 420927 - DNA, 25 bp, Mus musculus
gaacttgacttgttcgagtctactt

SEQ ID NO: 420928 - DNA, 25 bp, Mus musculus
gaacttgagcaaccgtatcacctac

SEQ ID NO: 420929 - DNA, 25 bp, Mus musculus
gaacttgagcaagcgtatcacctac

SEQ ID NO: 420930 - DNA, 25 bp, Mus musculus
gaacttgagcatagaaagtcctttg

SEQ ID NO: 420931 - DNA, 25 bp, Mus musculus
gaacttgagcattgaaagtcctttg

SEQ ID NO: 420932 - DNA, 25 bp, Mus musculus
gaacttgagccacagttaggtgtca

SEQ ID NO: 420933 - DNA, 25 bp, Mus musculus
gaacttgagccagagttaggtgtca

SEQ ID NO: 420934 - DNA, 25 bp, Mus musculus
gaacttgagcccaagctgacaagag

SEQ ID NO: 420935 - DNA, 25 bp, Mus musculus
gaacttgagccctagctgacaagag

SEQ ID NO: 420936 - DNA, 25 bp, Mus musculus
gaacttgagctcagtaacttacacc

SEQ ID NO: 420937 - DNA, 25 bp, Mus musculus
gaacttgagctctgtaacttacacc

SEQ ID NO: 420938 - DNA, 25 bp, Mus musculus
gaacttgagtagattgcctcgacct

SEQ ID NO: 420939 - DNA, 25 bp, Mus musculus
gaacttgagtagtttgcctcgacct

SEQ ID NO: 420940 - DNA, 25 bp, Mus musculus
gaacttgagttacggagctgcttaa

SEQ ID NO: 420941 - DNA, 25 bp, Mus musculus
gaacttgagttagggagctgcttaa

SEQ ID NO: 420942 - DNA, 25 bp, Mus musculus
gaacttgagttgatttccatggcag

SEQ ID NO: 420943 - DNA, 25 bp, Mus musculus
gaacttgagttgttttccatggcag

SEQ ID NO: 420944 - DNA, 25 bp, Mus musculus
gaacttgataaccagtgtcacatgc

SEQ ID NO: 420945 - DNA, 25 bp, Mus musculus
gaacttgataacgagtgtcacatgc

SEQ ID NO: 420946 - DNA, 25 bp, Mus musculus
gaacttgatcctatgcaaaagcaac

SEQ ID NO: 420947 - DNA, 25 bp, Mus musculus
gaacttgatcctttgcaaaagcaac

SEQ ID NO: 420948 - DNA, 25 bp, Mus musculus
gaacttgatctgagatttcctctcc

SEQ ID NO: 420949 - DNA, 25 bp, Mus musculus
gaacttgatctgtgatttcctctcc

SEQ ID NO: 420950 - DNA, 25 bp, Mus musculus
gaacttgatcttaaggacctacatt

SEQ ID NO: 420951 - DNA, 25 bp, Mus musculus
gaacttgatctttaggacctacatt

SEQ ID NO: 420952 - DNA, 25 bp, Mus musculus
gaacttgatgttacttctcagctgc

SEQ ID NO: 420953 - DNA, 25 bp, Mus musculus
gaacttgatgttccttggatgttta

SEQ ID NO: 420954 - DNA, 25 bp, Mus musculus
gaacttgatgttgcttggatgttta

SEQ ID NO: 420955 - DNA, 25 bp, Mus musculus
gaacttgatgtttcttctcagctgc

SEQ ID NO: 420956 - DNA, 25 bp, Mus musculus
gaacttgattatctaccttgctatc

SEQ ID NO: 420957 - DNA, 25 bp, Mus musculus
gaacttgattatgtaccttgctatc

SEQ ID NO: 420958 - DNA, 25 bp, Mus musculus
gaacttgattgcctatggtgtcttg

SEQ ID NO: 420959 - DNA, 25 bp, Mus musculus
gaacttgattgcgtatggtgtcttg

SEQ ID NO: 420960 - DNA, 25 bp, Mus musculus
gaacttgatttcactgtatgttggg

SEQ ID NO: 420961 - DNA, 25 bp, Mus musculus
gaacttgatttcagatgcacacgat

SEQ ID NO: 420962 - DNA, 25 bp, Mus musculus
gaacttgatttctctgtatgttggg

SEQ ID NO: 420963 - DNA, 25 bp, Mus musculus
gaacttgatttctgatgcacacgat

SEQ ID NO: 420964 - DNA, 25 bp, Mus musculus
gaacttgcaaacatctcaaaaagcc

SEQ ID NO: 420965 - DNA, 25 bp, Mus musculus
gaacttgcaaacttctcaaaaagcc

SEQ ID NO: 420966 - DNA, 25 bp, Mus musculus
gaacttgcaaagatatgtctgcctc

SEQ ID NO: 420967 - DNA, 25 bp, Mus musculus
gaacttgcaaagttatgtctgcctc

SEQ ID NO: 420968 - DNA, 25 bp, Mus musculus
gaacttgcacaaatggtggctgact

SEQ ID NO: 420969 - DNA, 25 bp, Mus musculus
gaacttgcacaattggtggctgact

SEQ ID NO: 420970 - DNA, 25 bp, Mus musculus
gaacttgcacagataatgcacgttt

SEQ ID NO: 420971 - DNA, 25 bp, Mus musculus
gaacttgcacagttaatgcacgttt

SEQ ID NO: 420972 - DNA, 25 bp, Mus musculus
gaacttgcacataaactctgggatt

SEQ ID NO: 420973 - DNA, 25 bp, Mus musculus
gaacttgcacattaactctgggatt

SEQ ID NO: 420974 - DNA, 25 bp, Mus musculus
gaacttgcagatagtcttccttgtg

SEQ ID NO: 420975 - DNA, 25 bp, Mus musculus
gaacttgcagattgtcttccttgtg

SEQ ID NO: 420976 - DNA, 25 bp, Mus musculus
gaacttgcaggaaatcaacactcta

SEQ ID NO: 420977 - DNA, 25 bp, Mus musculus
gaacttgcaggatatcaacactcta

SEQ ID NO: 420978 - DNA, 25 bp, Mus musculus
gaacttgcagtcatcttgctggagc

SEQ ID NO: 420979 - DNA, 25 bp, Mus musculus
gaacttgcagtcttcttgctggagc

SEQ ID NO: 420980 - DNA, 25 bp, Mus musculus
gaacttgccaaacagattcgtgtca

SEQ ID NO: 420981 - DNA, 25 bp, Mus musculus
gaacttgccaaagagattcgtgtca

SEQ ID NO: 420982 - DNA, 25 bp, Mus musculus
gaacttgccactattacagcaactg

SEQ ID NO: 420983 - DNA, 25 bp, Mus musculus
gaacttgccacttttacagcaactg

SEQ ID NO: 420984 - DNA, 25 bp, Mus musculus
gaacttgcccttcgactgaacgttt

SEQ ID NO: 420985 - DNA, 25 bp, Mus musculus
gaacttgcccttggactgaacgttt

SEQ ID NO: 420986 - DNA, 25 bp, Mus musculus
gaacttgcctgtcacagttactgga

SEQ ID NO: 420987 - DNA, 25 bp, Mus musculus
gaacttgcctgtgacagttactgga

SEQ ID NO: 420988 - DNA, 25 bp, Mus musculus
gaacttgcctttagtcagcttgact

SEQ ID NO: 420989 - DNA, 25 bp, Mus musculus
gaacttgccttttgtcagcttgact

SEQ ID NO: 420990 - DNA, 25 bp, Mus musculus
gaacttgcgaggaactggtcacaga

SEQ ID NO: 420991 - DNA, 25 bp, Mus musculus
gaacttgcgaggtactggtcacaga

SEQ ID NO: 420992 - DNA, 25 bp, Mus musculus
gaacttgctaccaaaggaggccttg

SEQ ID NO: 420993 - DNA, 25 bp, Mus musculus
gaacttgctacctaaggaggccttg

SEQ ID NO: 420994 - DNA, 25 bp, Mus musculus
gaacttgctccacaggaaggtccag

SEQ ID NO: 420995 - DNA, 25 bp, Mus musculus
gaacttgctccagaggaaggtccag

SEQ ID NO: 420996 - DNA, 25 bp, Mus musculus
gaacttgctccgatgccctcggtga

SEQ ID NO: 420997 - DNA, 25 bp, Mus musculus
gaacttgctccgttgccctcggtga

SEQ ID NO: 420998 - DNA, 25 bp, Mus musculus
gaacttgctgagaatgaaccaaact

SEQ ID NO: 420999 - DNA, 25 bp, Mus musculus
gaacttgctgagtatgaaccaaact

SEQ ID NO: 421000 - DNA, 25 bp, Mus musculus
gaacttgctgtaaggctaaggacct

SEQ ID NO: 421001 - DNA, 25 bp, Mus musculus
gaacttgctgtatggctaaggacct

SEQ ID NO: 421002 - DNA, 25 bp, Mus musculus
gaacttgctgttataagcatctgta

SEQ ID NO: 421003 - DNA, 25 bp, Mus musculus
gaacttgctgttctcttcggagatc

SEQ ID NO: 421004 - DNA, 25 bp, Mus musculus
gaacttgctgttgtcttcggagatc

SEQ ID NO: 421005 - DNA, 25 bp, Mus musculus
gaacttgctgttttaagcatctgta

SEQ ID NO: 421006 - DNA, 25 bp, Mus musculus
gaacttgcttgcaatgtagatctgg

SEQ ID NO: 421007 - DNA, 25 bp, Mus musculus
gaacttgcttgctatgtagatctgg

SEQ ID NO: 421008 - DNA, 25 bp, Mus musculus
gaacttgcttttagctcagacatat

SEQ ID NO: 421009 - DNA, 25 bp, Mus musculus
gaacttgctttttgctcagacatat

SEQ ID NO: 421010 - DNA, 25 bp, Mus musculus
gaacttggaaccaactgaaatgtca

SEQ ID NO: 421011 - DNA, 25 bp, Mus musculus
gaacttggaacctactgaaatgtca

SEQ ID NO: 421012 - DNA, 25 bp, Mus musculus
gaacttggaactagcctttagtcag

SEQ ID NO: 421013 - DNA, 25 bp, Mus musculus
gaacttggaacttgcctttagtcag

SEQ ID NO: 421014 - DNA, 25 bp, Mus musculus
gaacttggaaggactgccactcaca

SEQ ID NO: 421015 - DNA, 25 bp, Mus musculus
gaacttggaaggtctgccactcaca

SEQ ID NO: 421016 - DNA, 25 bp, Mus musculus
gaacttggactgatggaacctctca

SEQ ID NO: 421017 - DNA, 25 bp, Mus musculus
gaacttggactgttggaacctctca

SEQ ID NO: 421018 - DNA, 25 bp, Mus musculus
gaacttggagctcactgtttcagct

SEQ ID NO: 421019 - DNA, 25 bp, Mus musculus
gaacttggagctgactgtttcagct

SEQ ID NO: 421020 - DNA, 25 bp, Mus musculus
gaacttggaggtccttttcagaaga

SEQ ID NO: 421021 - DNA, 25 bp, Mus musculus
gaacttggaggtgcttttcagaaga

SEQ ID NO: 421022 - DNA, 25 bp, Mus musculus
gaacttggatagatttatactagga

SEQ ID NO: 421023 - DNA, 25 bp, Mus musculus
gaacttggatagttttatactagga

SEQ ID NO: 421024 - DNA, 25 bp, Mus musculus
gaacttggatttctctatacggcaa

SEQ ID NO: 421025 - DNA, 25 bp, Mus musculus
gaacttggatttgtctatacggcaa

SEQ ID NO: 421026 - DNA, 25 bp, Mus musculus
gaacttggcaaacaagagcgcgttt

SEQ ID NO: 421027 - DNA, 25 bp, Mus musculus
gaacttggcaaagaagagcgcgttt

SEQ ID NO: 421028 - DNA, 25 bp, Mus musculus
gaacttggcagacctatgtcttgaa

SEQ ID NO: 421029 - DNA, 25 bp, Mus musculus
gaacttggcagagctatgtcttgaa

SEQ ID NO: 421030 - DNA, 25 bp, Mus musculus
gaacttggcagcaaactctgcgaat

SEQ ID NO: 421031 - DNA, 25 bp, Mus musculus
gaacttggcagctaactctgcgaat

SEQ ID NO: 421032 - DNA, 25 bp, Mus musculus
gaacttggcccaaaggtcctatgtg

SEQ ID NO: 421033 - DNA, 25 bp, Mus musculus
gaacttggcccataggtcctatgtg

SEQ ID NO: 421034 - DNA, 25 bp, Mus musculus
gaacttggctaaaatcccattctta

SEQ ID NO: 421035 - DNA, 25 bp, Mus musculus
gaacttggctaatatcccattctta

SEQ ID NO: 421036 - DNA, 25 bp, Mus musculus
gaacttggctacagaggacctggtc

SEQ ID NO: 421037 - DNA, 25 bp, Mus musculus
gaacttggctactgaggacctggtc

SEQ ID NO: 421038 - DNA, 25 bp, Mus musculus
gaacttggctgaatttgctccatgg

SEQ ID NO: 421039 - DNA, 25 bp, Mus musculus
gaacttggctgattttgctccatgg

SEQ ID NO: 421040 - DNA, 25 bp, Mus musculus
gaacttggctggaacatggtgcaca

SEQ ID NO: 421041 - DNA, 25 bp, Mus musculus
gaacttggctggacctaattagaat

SEQ ID NO: 421042 - DNA, 25 bp, Mus musculus
gaacttggctggtacatggtgcaca

SEQ ID NO: 421043 - DNA, 25 bp, Mus musculus
gaacttggctggtcctaattagaat

SEQ ID NO: 421044 - DNA, 25 bp, Mus musculus
gaacttggcttcctatgtcttactg

SEQ ID NO: 421045 - DNA, 25 bp, Mus musculus
gaacttggcttcgtatgtcttactg

SEQ ID NO: 421046 - DNA, 25 bp, Mus musculus
gaacttgggactaactggttattca

SEQ ID NO: 421047 - DNA, 25 bp, Mus musculus
gaacttgggactacaaggtgaccaa

SEQ ID NO: 421048 - DNA, 25 bp, Mus musculus
gaacttgggactcctcctttgtgtt

SEQ ID NO: 421049 - DNA, 25 bp, Mus musculus
gaacttgggactgctcctttgtgtt

SEQ ID NO: 421050 - DNA, 25 bp, Mus musculus
gaacttgggacttactggttattca

SEQ ID NO: 421051 - DNA, 25 bp, Mus musculus
gaacttgggacttcaaggtgaccaa

SEQ ID NO: 421052 - DNA, 25 bp, Mus musculus
gaacttgggctcctcataactgaag

SEQ ID NO: 421053 - DNA, 25 bp, Mus musculus
gaacttgggctcgtcataactgaag

SEQ ID NO: 421054 - DNA, 25 bp, Mus musculus
gaacttgggcttacctgataggtcc

SEQ ID NO: 421055 - DNA, 25 bp, Mus musculus
gaacttgggctttcctgataggtcc

SEQ ID NO: 421056 - DNA, 25 bp, Mus musculus
gaacttgggtcgagaccacacgaga

SEQ ID NO: 421057 - DNA, 25 bp, Mus musculus
gaacttgggtcgtgaccacacgaga

SEQ ID NO: 421058 - DNA, 25 bp, Mus musculus
gaacttgggtctaggtgattgtgcc

SEQ ID NO: 421059 - DNA, 25 bp, Mus musculus
gaacttgggtcttggtgattgtgcc

SEQ ID NO: 421060 - DNA, 25 bp, Mus musculus
gaacttggtaacacacacggctaaa

SEQ ID NO: 421061 - DNA, 25 bp, Mus musculus
gaacttggtaactcacacggctaaa

SEQ ID NO: 421062 - DNA, 25 bp, Mus musculus
gaacttggtcaaaggcctttcctgc

SEQ ID NO: 421063 - DNA, 25 bp, Mus musculus
gaacttggtcaatggcctttcctgc

SEQ ID NO: 421064 - DNA, 25 bp, Mus musculus
gaacttggtgaacgctaagctactg

SEQ ID NO: 421065 - DNA, 25 bp, Mus musculus
gaacttggtgaaggctaagctactg

SEQ ID NO: 421066 - DNA, 25 bp, Mus musculus
gaacttggtgctcaattgctctcta

SEQ ID NO: 421067 - DNA, 25 bp, Mus musculus
gaacttggtgctgaattgctctcta

SEQ ID NO: 421068 - DNA, 25 bp, Mus musculus
gaacttggtgggaatctcatggcca

SEQ ID NO: 421069 - DNA, 25 bp, Mus musculus
gaacttggtgggtatctcatggcca

SEQ ID NO: 421070 - DNA, 25 bp, Mus musculus
gaacttgtaacacacactttgatgt

SEQ ID NO: 421071 - DNA, 25 bp, Mus musculus
gaacttgtaacagacactttgatgt

SEQ ID NO: 421072 - DNA, 25 bp, Mus musculus
gaacttgtaatcactgaatgcaggg

SEQ ID NO: 421073 - DNA, 25 bp, Mus musculus
gaacttgtaatctctgaatgcaggg

SEQ ID NO: 421074 - DNA, 25 bp, Mus musculus
gaacttgtacctatgtaagctatgt

SEQ ID NO: 421075 - DNA, 25 bp, Mus musculus
gaacttgtacctttgtaagctatgt

SEQ ID NO: 421076 - DNA, 25 bp, Mus musculus
gaacttgtactcagttgactgggat

SEQ ID NO: 421077 - DNA, 25 bp, Mus musculus
gaacttgtactctgttgactgggat

SEQ ID NO: 421078 - DNA, 25 bp, Mus musculus
gaacttgtacttcgtctaagccctc

SEQ ID NO: 421079 - DNA, 25 bp, Mus musculus
gaacttgtacttggtctaagccctc

SEQ ID NO: 421080 - DNA, 25 bp, Mus musculus
gaacttgtaggaatccctcactgga

SEQ ID NO: 421081 - DNA, 25 bp, Mus musculus
gaacttgtaggattccctcactgga

SEQ ID NO: 421082 - DNA, 25 bp, Mus musculus
gaacttgtattcagagtttaacagt

SEQ ID NO: 421083 - DNA, 25 bp, Mus musculus
gaacttgtattctgagtttaacagt

SEQ ID NO: 421084 - DNA, 25 bp, Mus musculus
gaacttgtcataatgctgtagccat

SEQ ID NO: 421085 - DNA, 25 bp, Mus musculus
gaacttgtcatattgctgtagccat

SEQ ID NO: 421086 - DNA, 25 bp, Mus musculus
gaacttgtctctacatggtggcagt

SEQ ID NO: 421087 - DNA, 25 bp, Mus musculus
gaacttgtctcttcatggtggcagt

SEQ ID NO: 421088 - DNA, 25 bp, Mus musculus
gaacttgtctgtatttgcattggta

SEQ ID NO: 421089 - DNA, 25 bp, Mus musculus
gaacttgtctgtttttgcattggta

SEQ ID NO: 421090 - DNA, 25 bp, Mus musculus
gaacttgtcttcagtcagaaaccat

SEQ ID NO: 421091 - DNA, 25 bp, Mus musculus
gaacttgtcttctgtcagaaaccat

SEQ ID NO: 421092 - DNA, 25 bp, Mus musculus
gaacttgtgaaaccattttagtgtt

SEQ ID NO: 421093 - DNA, 25 bp, Mus musculus
gaacttgtgaaagcattttagtgtt

SEQ ID NO: 421094 - DNA, 25 bp, Mus musculus
gaacttgtgagtccctatcagataa

SEQ ID NO: 421095 - DNA, 25 bp, Mus musculus
gaacttgtgagtgcctatcagataa

SEQ ID NO: 421096 - DNA, 25 bp, Mus musculus
gaacttgtgttcatctgtccaaatg

SEQ ID NO: 421097 - DNA, 25 bp, Mus musculus
gaacttgtgttcttctgtccaaatg

SEQ ID NO: 421098 - DNA, 25 bp, Mus musculus
gaacttgtgtttatctcatctttaa

SEQ ID NO: 421099 - DNA, 25 bp, Mus musculus
gaacttgtgtttcgaactgttgaca

SEQ ID NO: 421100 - DNA, 25 bp, Mus musculus
gaacttgtgtttggaactgttgaca

SEQ ID NO: 421101 - DNA, 25 bp, Mus musculus
gaacttgtgtttttctcatctttaa

SEQ ID NO: 421102 - DNA, 25 bp, Mus musculus
gaacttgttacacgcttttaaatga

SEQ ID NO: 421103 - DNA, 25 bp, Mus musculus
gaacttgttacaggcttttaaatga

SEQ ID NO: 421104 - DNA, 25 bp, Mus musculus
gaacttgttcaaccagctgcccgag

SEQ ID NO: 421105 - DNA, 25 bp, Mus musculus
gaacttgttcaagcagctgcccgag

SEQ ID NO: 421106 - DNA, 25 bp, Mus musculus
gaacttgttcacagagctgctgata

SEQ ID NO: 421107 - DNA, 25 bp, Mus musculus
gaacttgttcactgagctgctgata

SEQ ID NO: 421108 - DNA, 25 bp, Mus musculus
gaacttgttctcacaagtatatgag

SEQ ID NO: 421109 - DNA, 25 bp, Mus musculus
gaacttgttctccttgatggttgat

SEQ ID NO: 421110 - DNA, 25 bp, Mus musculus
gaacttgttctcgttgatggttgat

SEQ ID NO: 421111 - DNA, 25 bp, Mus musculus
gaacttgttctctcaagtatatgag

SEQ ID NO: 421112 - DNA, 25 bp, Mus musculus
gaacttgttcttagggtgactagct

SEQ ID NO: 421113 - DNA, 25 bp, Mus musculus
gaacttgttctttgggtgactagct

SEQ ID NO: 421114 - DNA, 25 bp, Mus musculus
gaacttgttgcgagcgtacgggtcc

SEQ ID NO: 421115 - DNA, 25 bp, Mus musculus
gaacttgttgcgtgcgtacgggtcc

SEQ ID NO: 421116 - DNA, 25 bp, Mus musculus
gaacttgttgctcatttttgacctt

SEQ ID NO: 421117 - DNA, 25 bp, Mus musculus
gaacttgttgctgatttttgacctt

SEQ ID NO: 421118 - DNA, 25 bp, Mus musculus
gaacttgtttataagccgatttgct

SEQ ID NO: 421119 - DNA, 25 bp, Mus musculus
gaacttgtttattagccgatttgct

SEQ ID NO: 421120 - DNA, 25 bp, Mus musculus
gaacttgtttctctgaaccactcac

SEQ ID NO: 421121 - DNA, 25 bp, Mus musculus
gaacttgtttctgtgaaccactcac

SEQ ID NO: 421122 - DNA, 25 bp, Mus musculus
gaactttaaactacatgttgctgtt

SEQ ID NO: 421123 - DNA, 25 bp, Mus musculus
gaactttaaacttcatgttgctgtt

SEQ ID NO: 421124 - DNA, 25 bp, Mus musculus
gaactttaacttcaaatctccagtt

SEQ ID NO: 421125 - DNA, 25 bp, Mus musculus
gaactttaacttgaaatctccagtt

SEQ ID NO: 421126 - DNA, 25 bp, Mus musculus
gaactttaaggacctcatcgagact

SEQ ID NO: 421127 - DNA, 25 bp, Mus musculus
gaactttaaggagctcatcgagact

SEQ ID NO: 421128 - DNA, 25 bp, Mus musculus
gaactttaaggcaagtgctctatat

SEQ ID NO: 421129 - DNA, 25 bp, Mus musculus
gaactttaaggcagcctgggtgcct

SEQ ID NO: 421130 - DNA, 25 bp, Mus musculus
gaactttaaggcatttgccagtctc

SEQ ID NO: 421131 - DNA, 25 bp, Mus musculus
gaactttaaggctagtgctctatat

SEQ ID NO: 421132 - DNA, 25 bp, Mus musculus
gaactttaaggctgcctgggtgcct

SEQ ID NO: 421133 - DNA, 25 bp, Mus musculus
gaactttaaggcttttgccagtctc

SEQ ID NO: 421134 - DNA, 25 bp, Mus musculus
gaactttaatacatgacttcagagg

SEQ ID NO: 421135 - DNA, 25 bp, Mus musculus
gaactttaatacatgtgttcttaac

SEQ ID NO: 421136 - DNA, 25 bp, Mus musculus
gaactttaatacttgacttcagagg

SEQ ID NO: 421137 - DNA, 25 bp, Mus musculus
gaactttaatacttgtgttcttaac

SEQ ID NO: 421138 - DNA, 25 bp, Mus musculus
gaactttacaatcctcctgagggtc

SEQ ID NO: 421139 - DNA, 25 bp, Mus musculus
gaactttacaatgctcctgagggtc

SEQ ID NO: 421140 - DNA, 25 bp, Mus musculus
gaactttacacactggaagctctaa

SEQ ID NO: 421141 - DNA, 25 bp, Mus musculus
gaactttacacagtggaagctctaa

SEQ ID NO: 421142 - DNA, 25 bp, Mus musculus
gaactttacaccagatggcggtgag

SEQ ID NO: 421143 - DNA, 25 bp, Mus musculus
gaactttacacctgatggcggtgag

SEQ ID NO: 421144 - DNA, 25 bp, Mus musculus
gaactttaccagaccagtgtggact

SEQ ID NO: 421145 - DNA, 25 bp, Mus musculus
gaactttaccagtccagtgtggact

SEQ ID NO: 421146 - DNA, 25 bp, Mus musculus
gaactttaggtcatccatgtcccca

SEQ ID NO: 421147 - DNA, 25 bp, Mus musculus
gaactttaggtcttccatgtcccca

SEQ ID NO: 421148 - DNA, 25 bp, Mus musculus
gaactttagtacactttggcagtca

SEQ ID NO: 421149 - DNA, 25 bp, Mus musculus
gaactttagtactctttggcagtca

SEQ ID NO: 421150 - DNA, 25 bp, Mus musculus
gaactttatactattgagccagact

SEQ ID NO: 421151 - DNA, 25 bp, Mus musculus
gaactttatactcagcttatttttc

SEQ ID NO: 421152 - DNA, 25 bp, Mus musculus
gaactttatactgagcttatttttc

SEQ ID NO: 421153 - DNA, 25 bp, Mus musculus
gaactttatacttttgagccagact

SEQ ID NO: 421154 - DNA, 25 bp, Mus musculus
gaactttatattcttgccccaagcc

SEQ ID NO: 421155 - DNA, 25 bp, Mus musculus
gaactttatattgttgccccaagcc

SEQ ID NO: 421156 - DNA, 25 bp, Mus musculus
gaactttatcacaaagtggccttct

SEQ ID NO: 421157 - DNA, 25 bp, Mus musculus
gaactttatcactaagtggccttct

SEQ ID NO: 421158 - DNA, 25 bp, Mus musculus
gaactttattacagtgccttggttt

SEQ ID NO: 421159 - DNA, 25 bp, Mus musculus
gaactttattactgtgccttggttt

SEQ ID NO: 421160 - DNA, 25 bp, Mus musculus
gaactttattggacgccagtgggaa

SEQ ID NO: 421161 - DNA, 25 bp, Mus musculus
gaactttattggtcgccagtgggaa

SEQ ID NO: 421162 - DNA, 25 bp, Mus musculus
gaactttatttcagctgccaggtta

SEQ ID NO: 421163 - DNA, 25 bp, Mus musculus
gaactttatttctgctgccaggtta

SEQ ID NO: 421164 - DNA, 25 bp, Mus musculus
gaactttcaagccttagtcagtgct

SEQ ID NO: 421165 - DNA, 25 bp, Mus musculus
gaactttcaagcgttagtcagtgct

SEQ ID NO: 421166 - DNA, 25 bp, Mus musculus
gaactttcactcagtaaccaagctc

SEQ ID NO: 421167 - DNA, 25 bp, Mus musculus
gaactttcactctgtaaccaagctc

SEQ ID NO: 421168 - DNA, 25 bp, Mus musculus
gaactttcagccacacatatgctag

SEQ ID NO: 421169 - DNA, 25 bp, Mus musculus
gaactttcagcctcacatatgctag

SEQ ID NO: 421170 - DNA, 25 bp, Mus musculus
gaactttcagctatcggccagagga

SEQ ID NO: 421171 - DNA, 25 bp, Mus musculus
gaactttcagctcttactttcccag

SEQ ID NO: 421172 - DNA, 25 bp, Mus musculus
gaactttcagctgttactttcccag

SEQ ID NO: 421173 - DNA, 25 bp, Mus musculus
gaactttcagctttcggccagagga

SEQ ID NO: 421174 - DNA, 25 bp, Mus musculus
gaactttcatctataaagagcccag

SEQ ID NO: 421175 - DNA, 25 bp, Mus musculus
gaactttcatctttaaagagcccag

SEQ ID NO: 421176 - DNA, 25 bp, Mus musculus
gaactttcattccatctttgctctg

SEQ ID NO: 421177 - DNA, 25 bp, Mus musculus
gaactttcattcgatctttgctctg

SEQ ID NO: 421178 - DNA, 25 bp, Mus musculus
gaactttccaacctggccaaagtgt

SEQ ID NO: 421179 - DNA, 25 bp, Mus musculus
gaactttccaacgtggccaaagtgt

SEQ ID NO: 421180 - DNA, 25 bp, Mus musculus
gaactttccagcactgccgtgggaa

SEQ ID NO: 421181 - DNA, 25 bp, Mus musculus
gaactttccagctctgccgtgggaa

SEQ ID NO: 421182 - DNA, 25 bp, Mus musculus
gaactttccatccattgtgacagct

SEQ ID NO: 421183 - DNA, 25 bp, Mus musculus
gaactttccatcgattgtgacagct

SEQ ID NO: 421184 - DNA, 25 bp, Mus musculus
gaactttccctgacccaagaagact

SEQ ID NO: 421185 - DNA, 25 bp, Mus musculus
gaactttccctgtcccaagaagact

SEQ ID NO: 421186 - DNA, 25 bp, Mus musculus
gaactttcctatataacaacataga

SEQ ID NO: 421187 - DNA, 25 bp, Mus musculus
gaactttcctatttaacaacataga

SEQ ID NO: 421188 - DNA, 25 bp, Mus musculus
gaactttcctgacgttttgatctag

SEQ ID NO: 421189 - DNA, 25 bp, Mus musculus
gaactttcctgaggttttgatctag

SEQ ID NO: 421190 - DNA, 25 bp, Mus musculus
gaactttcgaggctgttgatcctaa

SEQ ID NO: 421191 - DNA, 25 bp, Mus musculus
gaactttcgagggtgttgatcctaa

SEQ ID NO: 421192 - DNA, 25 bp, Mus musculus
gaactttctagaccaagtccctcag

SEQ ID NO: 421193 - DNA, 25 bp, Mus musculus
gaactttctagagcaagtccctcag

SEQ ID NO: 421194 - DNA, 25 bp, Mus musculus
gaactttctcatagttaagctacag

SEQ ID NO: 421195 - DNA, 25 bp, Mus musculus
gaactttctcattgttaagctacag

SEQ ID NO: 421196 - DNA, 25 bp, Mus musculus
gaactttctcttaagtaccccactg

SEQ ID NO: 421197 - DNA, 25 bp, Mus musculus
gaactttctctttagtaccccactg

SEQ ID NO: 421198 - DNA, 25 bp, Mus musculus
gaactttctggacagtattaccttg

SEQ ID NO: 421199 - DNA, 25 bp, Mus musculus
gaactttctggagagtattaccttg

SEQ ID NO: 421200 - DNA, 25 bp, Mus musculus
gaactttctgtgcttgttttaactg

SEQ ID NO: 421201 - DNA, 25 bp, Mus musculus
gaactttctgtggttgttttaactg

SEQ ID NO: 421202 - DNA, 25 bp, Mus musculus
gaactttctgttcgaagattcctca

SEQ ID NO: 421203 - DNA, 25 bp, Mus musculus
gaactttctgttggaagattcctca

SEQ ID NO: 421204 - DNA, 25 bp, Mus musculus
gaactttcttaacagcagtacaagc

SEQ ID NO: 421205 - DNA, 25 bp, Mus musculus
gaactttcttaagagcagtacaagc

SEQ ID NO: 421206 - DNA, 25 bp, Mus musculus
gaactttcttcactgtaccaaacta

SEQ ID NO: 421207 - DNA, 25 bp, Mus musculus
gaactttcttcagtgtaccaaacta

SEQ ID NO: 421208 - DNA, 25 bp, Mus musculus
gaactttcttctatctttctcttcc

SEQ ID NO: 421209 - DNA, 25 bp, Mus musculus
gaactttcttctttctttctcttcc

SEQ ID NO: 421210 - DNA, 25 bp, Mus musculus
gaactttcttgtcccgctgaaggta

SEQ ID NO: 421211 - DNA, 25 bp, Mus musculus
gaactttcttgtgccgctgaaggta

SEQ ID NO: 421212 - DNA, 25 bp, Mus musculus
gaactttctttcaccagttttgtga

SEQ ID NO: 421213 - DNA, 25 bp, Mus musculus
gaactttctttctccagttttgtga

SEQ ID NO: 421214 - DNA, 25 bp, Mus musculus
gaactttgaaatcgccttctcatcc

SEQ ID NO: 421215 - DNA, 25 bp, Mus musculus
gaactttgaaatggccttctcatcc

SEQ ID NO: 421216 - DNA, 25 bp, Mus musculus
gaactttgaacaacagtaccttcct

SEQ ID NO: 421217 - DNA, 25 bp, Mus musculus
gaactttgaacatcagtaccttcct

SEQ ID NO: 421218 - DNA, 25 bp, Mus musculus
gaactttgaactaccctggttggat

SEQ ID NO: 421219 - DNA, 25 bp, Mus musculus
gaactttgaacttccctggttggat

SEQ ID NO: 421220 - DNA, 25 bp, Mus musculus
gaactttgaatcatgccgggcattg

SEQ ID NO: 421221 - DNA, 25 bp, Mus musculus
gaactttgaatcttgccgggcattg

SEQ ID NO: 421222 - DNA, 25 bp, Mus musculus
gaactttgacataagatttcctgta

SEQ ID NO: 421223 - DNA, 25 bp, Mus musculus
gaactttgacattagatttcctgta

SEQ ID NO: 421224 - DNA, 25 bp, Mus musculus
gaactttgacctatgatctcaaggg

SEQ ID NO: 421225 - DNA, 25 bp, Mus musculus
gaactttgacctttgatctcaaggg

SEQ ID NO: 421226 - DNA, 25 bp, Mus musculus
gaactttgactgaggccgtcgccaa

SEQ ID NO: 421227 - DNA, 25 bp, Mus musculus
gaactttgactgtggccgtcgccaa

SEQ ID NO: 421228 - DNA, 25 bp, Mus musculus
gaactttgacttcgtcacggagacg

SEQ ID NO: 421229 - DNA, 25 bp, Mus musculus
gaactttgacttggtcacggagacg

SEQ ID NO: 421230 - DNA, 25 bp, Mus musculus
gaactttgagccattcatgaaggca

SEQ ID NO: 421231 - DNA, 25 bp, Mus musculus
gaactttgagcctttcatgaaggca

SEQ ID NO: 421232 - DNA, 25 bp, Mus musculus
gaactttgataacatgacttttcta

SEQ ID NO: 421233 - DNA, 25 bp, Mus musculus
gaactttgataagatgacttttcta

SEQ ID NO: 421234 - DNA, 25 bp, Mus musculus
gaactttgatcaagtatctctgcaa

SEQ ID NO: 421235 - DNA, 25 bp, Mus musculus
gaactttgatcatgtatctctgcaa

SEQ ID NO: 421236 - DNA, 25 bp, Mus musculus
gaactttgatgccttctcactgcag

SEQ ID NO: 421237 - DNA, 25 bp, Mus musculus
gaactttgatgcgttctcactgcag

SEQ ID NO: 421238 - DNA, 25 bp, Mus musculus
gaactttgattaacaagctatggct

SEQ ID NO: 421239 - DNA, 25 bp, Mus musculus
gaactttgattatcaagctatggct

SEQ ID NO: 421240 - DNA, 25 bp, Mus musculus
gaactttgatttcctcagagaagcc

SEQ ID NO: 421241 - DNA, 25 bp, Mus musculus
gaactttgatttcctgtctactacc

SEQ ID NO: 421242 - DNA, 25 bp, Mus musculus
gaactttgatttgctcagagaagcc

SEQ ID NO: 421243 - DNA, 25 bp, Mus musculus
gaactttgatttgctgtctactacc

SEQ ID NO: 421244 - DNA, 25 bp, Mus musculus
gaactttgcacactgggtttataaa

SEQ ID NO: 421245 - DNA, 25 bp, Mus musculus
gaactttgcacagtgggtttataaa

SEQ ID NO: 421246 - DNA, 25 bp, Mus musculus
gaactttgcacgctggaggtaccgt

SEQ ID NO: 421247 - DNA, 25 bp, Mus musculus
gaactttgcacggtggaggtaccgt

SEQ ID NO: 421248 - DNA, 25 bp, Mus musculus
gaactttgccctcaagccaggttgg

SEQ ID NO: 421249 - DNA, 25 bp, Mus musculus
gaactttgccctgaagccaggttgg

SEQ ID NO: 421250 - DNA, 25 bp, Mus musculus
gaactttgctgacacatgggtgtga

SEQ ID NO: 421251 - DNA, 25 bp, Mus musculus
gaactttgctgagacatgggtgtga

SEQ ID NO: 421252 - DNA, 25 bp, Mus musculus
gaactttgctgcagatggaaagaaa

SEQ ID NO: 421253 - DNA, 25 bp, Mus musculus
gaactttgctgcctcttctaggaaa

SEQ ID NO: 421254 - DNA, 25 bp, Mus musculus
gaactttgctgcgtcttctaggaaa

SEQ ID NO: 421255 - DNA, 25 bp, Mus musculus
gaactttgctgctgatggaaagaaa

SEQ ID NO: 421256 - DNA, 25 bp, Mus musculus
gaactttgctggaagtatctcgctg

SEQ ID NO: 421257 - DNA, 25 bp, Mus musculus
gaactttgctggtagtatctcgctg

SEQ ID NO: 421258 - DNA, 25 bp, Mus musculus
gaactttgctgtagaaggtctcact

SEQ ID NO: 421259 - DNA, 25 bp, Mus musculus
gaactttgctgttgaaggtctcact

SEQ ID NO: 421260 - DNA, 25 bp, Mus musculus
gaactttgctttactgtttatgctc

SEQ ID NO: 421261 - DNA, 25 bp, Mus musculus
gaactttgcttttctgtttatgctc

SEQ ID NO: 421262 - DNA, 25 bp, Mus musculus
gaactttggactatcaatcttgcag

SEQ ID NO: 421263 - DNA, 25 bp, Mus musculus
gaactttggactttcaatcttgcag

SEQ ID NO: 421264 - DNA, 25 bp, Mus musculus
gaactttggatcactgtatagactg

SEQ ID NO: 421265 - DNA, 25 bp, Mus musculus
gaactttggatctctgtatagactg

SEQ ID NO: 421266 - DNA, 25 bp, Mus musculus
gaactttggtagatccattgtctgt

SEQ ID NO: 421267 - DNA, 25 bp, Mus musculus
gaactttggtagttccattgtctgt

SEQ ID NO: 421268 - DNA, 25 bp, Mus musculus
gaactttggtatccgtttgagcttt

SEQ ID NO: 421269 - DNA, 25 bp, Mus musculus
gaactttggtatgcgtttgagcttt

SEQ ID NO: 421270 - DNA, 25 bp, Mus musculus
gaactttgtacacattctctttaga

SEQ ID NO: 421271 - DNA, 25 bp, Mus musculus
gaactttgtacagattctctttaga

SEQ ID NO: 421272 - DNA, 25 bp, Mus musculus
gaactttgtaccaattgacctcgat

SEQ ID NO: 421273 - DNA, 25 bp, Mus musculus
gaactttgtacctattgacctcgat

SEQ ID NO: 421274 - DNA, 25 bp, Mus musculus
gaactttgtcctacactttctgtgt

SEQ ID NO: 421275 - DNA, 25 bp, Mus musculus
gaactttgtccttcactttctgtgt

SEQ ID NO: 421276 - DNA, 25 bp, Mus musculus
gaactttgtgctcacaggtcacctg

SEQ ID NO: 421277 - DNA, 25 bp, Mus musculus
gaactttgtgctgacaggtcacctg

SEQ ID NO: 421278 - DNA, 25 bp, Mus musculus
gaactttgttagagtgatactgata

SEQ ID NO: 421279 - DNA, 25 bp, Mus musculus
gaactttgttagcaaactgcattca

SEQ ID NO: 421280 - DNA, 25 bp, Mus musculus
gaactttgttaggaaactgcattca

SEQ ID NO: 421281 - DNA, 25 bp, Mus musculus
gaactttgttagtgtgatactgata

SEQ ID NO: 421282 - DNA, 25 bp, Mus musculus
gaactttgttatcagcagcaagtga

SEQ ID NO: 421283 - DNA, 25 bp, Mus musculus
gaactttgttatgagcagcaagtga

SEQ ID NO: 421284 - DNA, 25 bp, Mus musculus
gaactttgttcaactcgtttgttac

SEQ ID NO: 421285 - DNA, 25 bp, Mus musculus
gaactttgttcatctcgtttgttac

SEQ ID NO: 421286 - DNA, 25 bp, Mus musculus
gaacttttaaaaatgccatctttgc

SEQ ID NO: 421287 - DNA, 25 bp, Mus musculus
gaacttttaaaattgccatctttgc

SEQ ID NO: 421288 - DNA, 25 bp, Mus musculus
gaacttttaagtctgtctattgcaa

SEQ ID NO: 421289 - DNA, 25 bp, Mus musculus
gaacttttaagtgtgtctattgcaa

SEQ ID NO: 421290 - DNA, 25 bp, Mus musculus
gaacttttaatcacaggactttatt

SEQ ID NO: 421291 - DNA, 25 bp, Mus musculus
gaacttttaatctcaggactttatt

SEQ ID NO: 421292 - DNA, 25 bp, Mus musculus
gaacttttacatcaccagtgggatg

SEQ ID NO: 421293 - DNA, 25 bp, Mus musculus
gaacttttacatgaccagtgggatg

SEQ ID NO: 421294 - DNA, 25 bp, Mus musculus
gaacttttaccactagactctatag

SEQ ID NO: 421295 - DNA, 25 bp, Mus musculus
gaacttttaccagtagactctatag

SEQ ID NO: 421296 - DNA, 25 bp, Mus musculus
gaacttttacttctacacgctggcc

SEQ ID NO: 421297 - DNA, 25 bp, Mus musculus
gaacttttacttgtacacgctggcc

SEQ ID NO: 421298 - DNA, 25 bp, Mus musculus
gaacttttagcacaatcatgactta

SEQ ID NO: 421299 - DNA, 25 bp, Mus musculus
gaacttttagcaccagcttcatttc

SEQ ID NO: 421300 - DNA, 25 bp, Mus musculus
gaacttttagcagaatcatgactta

SEQ ID NO: 421301 - DNA, 25 bp, Mus musculus
gaacttttagcagcagcttcatttc

SEQ ID NO: 421302 - DNA, 25 bp, Mus musculus
gaacttttaggcctgtgtctcagtt

SEQ ID NO: 421303 - DNA, 25 bp, Mus musculus
gaacttttaggcgtgtgtctcagtt

SEQ ID NO: 421304 - DNA, 25 bp, Mus musculus
gaacttttatatctacgtgacctat

SEQ ID NO: 421305 - DNA, 25 bp, Mus musculus
gaacttttatatgtacgtgacctat

SEQ ID NO: 421306 - DNA, 25 bp, Mus musculus
gaacttttcaaacatccaccagcct

SEQ ID NO: 421307 - DNA, 25 bp, Mus musculus
gaacttttcaaagatccaccagcct

SEQ ID NO: 421308 - DNA, 25 bp, Mus musculus
gaacttttccataaccaagaactca

SEQ ID NO: 421309 - DNA, 25 bp, Mus musculus
gaacttttccattaccaagaactca

SEQ ID NO: 421310 - DNA, 25 bp, Mus musculus
gaacttttcccacaggtggcataag

SEQ ID NO: 421311 - DNA, 25 bp, Mus musculus
gaacttttcccagaggtggcataag

SEQ ID NO: 421312 - DNA, 25 bp, Mus musculus
gaacttttcctaacacttcagaatg

SEQ ID NO: 421313 - DNA, 25 bp, Mus musculus
gaacttttcctatcacttcagaatg

SEQ ID NO: 421314 - DNA, 25 bp, Mus musculus
gaacttttcctcatttgtctcttac

SEQ ID NO: 421315 - DNA, 25 bp, Mus musculus
gaacttttcctcttttgtctcttac

SEQ ID NO: 421316 - DNA, 25 bp, Mus musculus
gaacttttcctgcactagcaaccca

SEQ ID NO: 421317 - DNA, 25 bp, Mus musculus
gaacttttcctggactagcaaccca

SEQ ID NO: 421318 - DNA, 25 bp, Mus musculus
gaacttttcggtatttgaggacatt

SEQ ID NO: 421319 - DNA, 25 bp, Mus musculus
gaacttttcggtttttgaggacatt

SEQ ID NO: 421320 - DNA, 25 bp, Mus musculus
gaacttttctcaaaacgtgttgcct

SEQ ID NO: 421321 - DNA, 25 bp, Mus musculus
gaacttttctcataacgtgttgcct

SEQ ID NO: 421322 - DNA, 25 bp, Mus musculus
gaacttttcttaatttgctcatcat

SEQ ID NO: 421323 - DNA, 25 bp, Mus musculus
gaacttttcttattttgctcatcat

SEQ ID NO: 421324 - DNA, 25 bp, Mus musculus
gaacttttcttgaatgtgccaggac

SEQ ID NO: 421325 - DNA, 25 bp, Mus musculus
gaacttttcttgtatgtgccaggac

SEQ ID NO: 421326 - DNA, 25 bp, Mus musculus
gaacttttgagcacttcagaccttg

SEQ ID NO: 421327 - DNA, 25 bp, Mus musculus
gaacttttgagcagaagaaatcggg

SEQ ID NO: 421328 - DNA, 25 bp, Mus musculus
gaacttttgagctcttcagaccttg

SEQ ID NO: 421329 - DNA, 25 bp, Mus musculus
gaacttttgagctgaagaaatcggg

SEQ ID NO: 421330 - DNA, 25 bp, Mus musculus
gaacttttggtcactttgtcatctt

SEQ ID NO: 421331 - DNA, 25 bp, Mus musculus
gaacttttggtctctttgtcatctt

SEQ ID NO: 421332 - DNA, 25 bp, Mus musculus
gaacttttggttagcccaggtgatt

SEQ ID NO: 421333 - DNA, 25 bp, Mus musculus
gaacttttggtttgcccaggtgatt

SEQ ID NO: 421334 - DNA, 25 bp, Mus musculus
gaacttttgtatcatcacgcctggt

SEQ ID NO: 421335 - DNA, 25 bp, Mus musculus
gaacttttgtatgatcacgcctggt

SEQ ID NO: 421336 - DNA, 25 bp, Mus musculus
gaactttttgagaaatcagccacca

SEQ ID NO: 421337 - DNA, 25 bp, Mus musculus
gaactttttgagtaatcagccacca

SEQ ID NO: 421338 - DNA, 25 bp, Mus musculus
gaactttttgatcctgtcgatacca

SEQ ID NO: 421339 - DNA, 25 bp, Mus musculus
gaactttttgatgctgtcgatacca

SEQ ID NO: 421340 - DNA, 25 bp, Mus musculus
gaactttttgctaaacctactcaga

SEQ ID NO: 421341 - DNA, 25 bp, Mus musculus
gaactttttgcttaacctactcaga

SEQ ID NO: 421342 - DNA, 25 bp, Mus musculus
gaactttttggccaggtctccgtgg

SEQ ID NO: 421343 - DNA, 25 bp, Mus musculus
gaactttttggcgaggtctccgtgg

SEQ ID NO: 421344 - DNA, 25 bp, Mus musculus
gaagaaaaaaataccactggtcctg

SEQ ID NO: 421345 - DNA, 25 bp, Mus musculus
gaagaaaaaaattccactggtcctg

SEQ ID NO: 421346 - DNA, 25 bp, Mus musculus
gaagaaaaacttagctgcccttttg

SEQ ID NO: 421347 - DNA, 25 bp, Mus musculus
gaagaaaaactttgctgcccttttg

SEQ ID NO: 421348 - DNA, 25 bp, Mus musculus
gaagaaaaagcgagacaccaggaaa

SEQ ID NO: 421349 - DNA, 25 bp, Mus musculus
gaagaaaaagcgtgacaccaggaaa

SEQ ID NO: 421350 - DNA, 25 bp, Mus musculus
gaagaaaacatcaattagctgggtg

SEQ ID NO: 421351 - DNA, 25 bp, Mus musculus
gaagaaaacatctattagctgggtg

SEQ ID NO: 421352 - DNA, 25 bp, Mus musculus
gaagaaaacatgcagcctttacttg

SEQ ID NO: 421353 - DNA, 25 bp, Mus musculus
gaagaaaacatggagcctttacttg

SEQ ID NO: 421354 - DNA, 25 bp, Mus musculus
gaagaaaaccatcaattgcgtagtg

SEQ ID NO: 421355 - DNA, 25 bp, Mus musculus
gaagaaaaccatgaattgcgtagtg

SEQ ID NO: 421356 - DNA, 25 bp, Mus musculus
gaagaaaaccgtcttctcaagcccg

SEQ ID NO: 421357 - DNA, 25 bp, Mus musculus
gaagaaaaccgtgttctcaagcccg

SEQ ID NO: 421358 - DNA, 25 bp, Mus musculus
gaagaaaaccttacgcgagagctaa

SEQ ID NO: 421359 - DNA, 25 bp, Mus musculus
gaagaaaacctttcgcgagagctaa

SEQ ID NO: 421360 - DNA, 25 bp, Mus musculus
gaagaaaacgcaccagttccaaatt

SEQ ID NO: 421361 - DNA, 25 bp, Mus musculus
gaagaaaacgcagcagttccaaatt

SEQ ID NO: 421362 - DNA, 25 bp, Mus musculus
gaagaaaacgtactcccagccttgc

SEQ ID NO: 421363 - DNA, 25 bp, Mus musculus
gaagaaaacgtagtcccagccttgc

SEQ ID NO: 421364 - DNA, 25 bp, Mus musculus
gaagaaaactaaaacctcagcacat

SEQ ID NO: 421365 - DNA, 25 bp, Mus musculus
gaagaaaactaatacctcagcacat

SEQ ID NO: 421366 - DNA, 25 bp, Mus musculus
gaagaaaactaccttctgatcttgt

SEQ ID NO: 421367 - DNA, 25 bp, Mus musculus
gaagaaaactacgttctgatcttgt

SEQ ID NO: 421368 - DNA, 25 bp, Mus musculus
gaagaaaactatcacctgctaaata

SEQ ID NO: 421369 - DNA, 25 bp, Mus musculus
gaagaaaactatgacctgctaaata

SEQ ID NO: 421370 - DNA, 25 bp, Mus musculus
gaagaaaactcgaggtgaccacttt

SEQ ID NO: 421371 - DNA, 25 bp, Mus musculus
gaagaaaactcgtggtgaccacttt

SEQ ID NO: 421372 - DNA, 25 bp, Mus musculus
gaagaaaactgcagaccacatatat

SEQ ID NO: 421373 - DNA, 25 bp, Mus musculus
gaagaaaactgctgaccacatatat

SEQ ID NO: 421374 - DNA, 25 bp, Mus musculus
gaagaaaactgtaacttcctgcctc

SEQ ID NO: 421375 - DNA, 25 bp, Mus musculus
gaagaaaactgttacttcctgcctc

SEQ ID NO: 421376 - DNA, 25 bp, Mus musculus
gaagaaaactttccaagctccatat

SEQ ID NO: 421377 - DNA, 25 bp, Mus musculus
gaagaaaactttgcaagctccatat

SEQ ID NO: 421378 - DNA, 25 bp, Mus musculus
gaagaaaagagaacagccagaagcc

SEQ ID NO: 421379 - DNA, 25 bp, Mus musculus
gaagaaaagagatcagccagaagcc

SEQ ID NO: 421380 - DNA, 25 bp, Mus musculus
gaagaaaagatcagccttcggtggg

SEQ ID NO: 421381 - DNA, 25 bp, Mus musculus
gaagaaaagatctgccttcggtggg

SEQ ID NO: 421382 - DNA, 25 bp, Mus musculus
gaagaaaagatgctctgccctgctt

SEQ ID NO: 421383 - DNA, 25 bp, Mus musculus
gaagaaaagatggtctgccctgctt

SEQ ID NO: 421384 - DNA, 25 bp, Mus musculus
gaagaaaagcccagagaccctgaag

SEQ ID NO: 421385 - DNA, 25 bp, Mus musculus
gaagaaaagcccctaatcaccttct

SEQ ID NO: 421386 - DNA, 25 bp, Mus musculus
gaagaaaagcccgtaatcaccttct

SEQ ID NO: 421387 - DNA, 25 bp, Mus musculus
gaagaaaagccctgagaccctgaag

SEQ ID NO: 421388 - DNA, 25 bp, Mus musculus
gaagaaaagcttcctttcccaccag

SEQ ID NO: 421389 - DNA, 25 bp, Mus musculus
gaagaaaagcttctgtgccccttgt

SEQ ID NO: 421390 - DNA, 25 bp, Mus musculus
gaagaaaagcttgctttcccaccag

SEQ ID NO: 421391 - DNA, 25 bp, Mus musculus
gaagaaaagcttgtgtgccccttgt

SEQ ID NO: 421392 - DNA, 25 bp, Mus musculus
gaagaaaaggcgactttccactcac

SEQ ID NO: 421393 - DNA, 25 bp, Mus musculus
gaagaaaaggcgtctttccactcac

SEQ ID NO: 421394 - DNA, 25 bp, Mus musculus
gaagaaaagtccaaccacctcaaca

SEQ ID NO: 421395 - DNA, 25 bp, Mus musculus
gaagaaaagtcctaccacctcaaca

SEQ ID NO: 421396 - DNA, 25 bp, Mus musculus
gaagaaaatccgacaagttatccga

SEQ ID NO: 421397 - DNA, 25 bp, Mus musculus
gaagaaaatccgtcaagttatccga

SEQ ID NO: 421398 - DNA, 25 bp, Mus musculus
gaagaaaatcctcctttagtggtta

SEQ ID NO: 421399 - DNA, 25 bp, Mus musculus
gaagaaaatcctgctttagtggtta

SEQ ID NO: 421400 - DNA, 25 bp, Mus musculus
gaagaaaatcttcgcatcgagactt

SEQ ID NO: 421401 - DNA, 25 bp, Mus musculus
gaagaaaatcttggcatcgagactt

SEQ ID NO: 421402 - DNA, 25 bp, Mus musculus
gaagaaaatgcactctcaaccctgg

SEQ ID NO: 421403 - DNA, 25 bp, Mus musculus
gaagaaaatgcagtctcaaccctgg

SEQ ID NO: 421404 - DNA, 25 bp, Mus musculus
gaagaaaatgccatccactgccttg

SEQ ID NO: 421405 - DNA, 25 bp, Mus musculus
gaagaaaatgccttccactgccttg

SEQ ID NO: 421406 - DNA, 25 bp, Mus musculus
gaagaaaatttgactcagtctcaga

SEQ ID NO: 421407 - DNA, 25 bp, Mus musculus
gaagaaaatttgtctcagtctcaga

SEQ ID NO: 421408 - DNA, 25 bp, Mus musculus
gaagaaacaccactcttggccacac

SEQ ID NO: 421409 - DNA, 25 bp, Mus musculus
gaagaaacaccagtcttggccacac

SEQ ID NO: 421410 - DNA, 25 bp, Mus musculus
gaagaaacacgcacttcgtgtctaa

SEQ ID NO: 421411 - DNA, 25 bp, Mus musculus
gaagaaacacgctcttcgtgtctaa

SEQ ID NO: 421412 - DNA, 25 bp, Mus musculus
gaagaaacagcacctccatgtggcc

SEQ ID NO: 421413 - DNA, 25 bp, Mus musculus
gaagaaacagcagctccatgtggcc

SEQ ID NO: 421414 - DNA, 25 bp, Mus musculus
gaagaaacagccatcttctttggaa

SEQ ID NO: 421415 - DNA, 25 bp, Mus musculus
gaagaaacagccttcttctttggaa

SEQ ID NO: 421416 - DNA, 25 bp, Mus musculus
gaagaaacagtacacatccatccat

SEQ ID NO: 421417 - DNA, 25 bp, Mus musculus
gaagaaacagtagacatccatccat

SEQ ID NO: 421418 - DNA, 25 bp, Mus musculus
gaagaaacatctagacctaactaag

SEQ ID NO: 421419 - DNA, 25 bp, Mus musculus
gaagaaacatcttgacctaactaag

SEQ ID NO: 421420 - DNA, 25 bp, Mus musculus
gaagaaaccaatacacatgagtata

SEQ ID NO: 421421 - DNA, 25 bp, Mus musculus
gaagaaaccaatctcctcagcccaa

SEQ ID NO: 421422 - DNA, 25 bp, Mus musculus
gaagaaaccaatgtcctcagcccaa

SEQ ID NO: 421423 - DNA, 25 bp, Mus musculus
gaagaaaccaattcacatgagtata

SEQ ID NO: 421424 - DNA, 25 bp, Mus musculus
gaagaaaccagcaatagtcacacct

SEQ ID NO: 421425 - DNA, 25 bp, Mus musculus
gaagaaaccagctatagtcacacct

SEQ ID NO: 421426 - DNA, 25 bp, Mus musculus
gaagaaaccagtacactctttccct

SEQ ID NO: 421427 - DNA, 25 bp, Mus musculus
gaagaaaccagttcactctttccct

SEQ ID NO: 421428 - DNA, 25 bp, Mus musculus
gaagaaaccatgacactaccagact

SEQ ID NO: 421429 - DNA, 25 bp, Mus musculus
gaagaaaccatgtcactaccagact

SEQ ID NO: 421430 - DNA, 25 bp, Mus musculus
gaagaaacccacaggaccaacttct

SEQ ID NO: 421431 - DNA, 25 bp, Mus musculus
gaagaaacccactggaccaacttct

SEQ ID NO: 421432 - DNA, 25 bp, Mus musculus
gaagaaaccgcacagctgggaaaat

SEQ ID NO: 421433 - DNA, 25 bp, Mus musculus
gaagaaaccgcagagctgggaaaat

SEQ ID NO: 421434 - DNA, 25 bp, Mus musculus
gaagaaaccggaccccttccagaga

SEQ ID NO: 421435 - DNA, 25 bp, Mus musculus
gaagaaaccggagcccttccagaga

SEQ ID NO: 421436 - DNA, 25 bp, Mus musculus
gaagaaaccgtgactgctcaaggta

SEQ ID NO: 421437 - DNA, 25 bp, Mus musculus
gaagaaaccgtgtctgctcaaggta

SEQ ID NO: 421438 - DNA, 25 bp, Mus musculus
gaagaaacgaacacggtgaccgcgc

SEQ ID NO: 421439 - DNA, 25 bp, Mus musculus
gaagaaacgaactcggtgaccgcgc

SEQ ID NO: 421440 - DNA, 25 bp, Mus musculus
gaagaaactccaagccgggcatggt

SEQ ID NO: 421441 - DNA, 25 bp, Mus musculus
gaagaaactccatgccgggcatggt

SEQ ID NO: 421442 - DNA, 25 bp, Mus musculus
gaagaaactcccagcctcctaaggt

SEQ ID NO: 421443 - DNA, 25 bp, Mus musculus
gaagaaactccctgcctcctaaggt

SEQ ID NO: 421444 - DNA, 25 bp, Mus musculus
gaagaaactgcacacccataggaca

SEQ ID NO: 421445 - DNA, 25 bp, Mus musculus
gaagaaactgcagacccataggaca

SEQ ID NO: 421446 - DNA, 25 bp, Mus musculus
gaagaaactggactttggccactac

SEQ ID NO: 421447 - DNA, 25 bp, Mus musculus
gaagaaactggagtttggccactac

SEQ ID NO: 421448 - DNA, 25 bp, Mus musculus
gaagaaactgttccatggcacccct

SEQ ID NO: 421449 - DNA, 25 bp, Mus musculus
gaagaaactgttgcatggcacccct

SEQ ID NO: 421450 - DNA, 25 bp, Mus musculus
gaagaaacttagcttagctaccata

SEQ ID NO: 421451 - DNA, 25 bp, Mus musculus
gaagaaacttaggttagctaccata

SEQ ID NO: 421452 - DNA, 25 bp, Mus musculus
gaagaaacttttcttcctggcgttg

SEQ ID NO: 421453 - DNA, 25 bp, Mus musculus
gaagaaacttttgttcctggcgttg

SEQ ID NO: 421454 - DNA, 25 bp, Mus musculus
gaagaaagaactcctgtgccatgtg

SEQ ID NO: 421455 - DNA, 25 bp, Mus musculus
gaagaaagaactgctgtgccatgtg

SEQ ID NO: 421456 - DNA, 25 bp, Mus musculus
gaagaaagaagaaccctcccatctc

SEQ ID NO: 421457 - DNA, 25 bp, Mus musculus
gaagaaagaagacgccctgatgccc

SEQ ID NO: 421458 - DNA, 25 bp, Mus musculus
gaagaaagaagaggccctgatgccc

SEQ ID NO: 421459 - DNA, 25 bp, Mus musculus
gaagaaagaagatccctcccatctc

SEQ ID NO: 421460 - DNA, 25 bp, Mus musculus
gaagaaagagttacagctgatacct

SEQ ID NO: 421461 - DNA, 25 bp, Mus musculus
gaagaaagagtttcagctgatacct

SEQ ID NO: 421462 - DNA, 25 bp, Mus musculus
gaagaaagatatcccaatacagtct

SEQ ID NO: 421463 - DNA, 25 bp, Mus musculus
gaagaaagatatgccaatacagtct

SEQ ID NO: 421464 - DNA, 25 bp, Mus musculus
gaagaaagatgtcccctaacctgcc

SEQ ID NO: 421465 - DNA, 25 bp, Mus musculus
gaagaaagatgtgccctaacctgcc

SEQ ID NO: 421466 - DNA, 25 bp, Mus musculus
gaagaaagcagacatctcgtacatg

SEQ ID NO: 421467 - DNA, 25 bp, Mus musculus
gaagaaagcagagatctcgtacatg

SEQ ID NO: 421468 - DNA, 25 bp, Mus musculus
gaagaaagcccaatgcagctccctg

SEQ ID NO: 421469 - DNA, 25 bp, Mus musculus
gaagaaagcccattgcagctccctg

SEQ ID NO: 421470 - DNA, 25 bp, Mus musculus
gaagaaagccccaggcacgaggcca

SEQ ID NO: 421471 - DNA, 25 bp, Mus musculus
gaagaaagcccctggcacgaggcca

SEQ ID NO: 421472 - DNA, 25 bp, Mus musculus
gaagaaagcctaacagccagaaata

SEQ ID NO: 421473 - DNA, 25 bp, Mus musculus
gaagaaagcctatcagccagaaata

SEQ ID NO: 421474 - DNA, 25 bp, Mus musculus
gaagaaagccttcatctactccaga

SEQ ID NO: 421475 - DNA, 25 bp, Mus musculus
gaagaaagccttgatctactccaga

SEQ ID NO: 421476 - DNA, 25 bp, Mus musculus
gaagaaagcttccttgccagaaaaa

SEQ ID NO: 421477 - DNA, 25 bp, Mus musculus
gaagaaagcttcgttgccagaaaaa

SEQ ID NO: 421478 - DNA, 25 bp, Mus musculus
gaagaaaggatcactcgatgttggg

SEQ ID NO: 421479 - DNA, 25 bp, Mus musculus
gaagaaaggatctctcgatgttggg

SEQ ID NO: 421480 - DNA, 25 bp, Mus musculus
gaagaaaggcaaatccccacaaagc

SEQ ID NO: 421481 - DNA, 25 bp, Mus musculus
gaagaaaggcaattccccacaaagc

SEQ ID NO: 421482 - DNA, 25 bp, Mus musculus
gaagaaaggccacttctcgtttgga

SEQ ID NO: 421483 - DNA, 25 bp, Mus musculus
gaagaaaggccagttctcgtttgga

SEQ ID NO: 421484 - DNA, 25 bp, Mus musculus
gaagaaaggctgagacacccggaca

SEQ ID NO: 421485 - DNA, 25 bp, Mus musculus
gaagaaaggctgtgacacccggaca

SEQ ID NO: 421486 - DNA, 25 bp, Mus musculus
gaagaaaggcttaggccgtgaccaa

SEQ ID NO: 421487 - DNA, 25 bp, Mus musculus
gaagaaaggctttggccgtgaccaa

SEQ ID NO: 421488 - DNA, 25 bp, Mus musculus
gaagaaaggtaccagtgtgtgccct

SEQ ID NO: 421489 - DNA, 25 bp, Mus musculus
gaagaaaggtacgagtgtgtgccct

SEQ ID NO: 421490 - DNA, 25 bp, Mus musculus
gaagaaagtaccacttccttccaag

SEQ ID NO: 421491 - DNA, 25 bp, Mus musculus
gaagaaagtacctcttccttccaag

SEQ ID NO: 421492 - DNA, 25 bp, Mus musculus
gaagaaagtcaaccggctgccctct

SEQ ID NO: 421493 - DNA, 25 bp, Mus musculus
gaagaaagtcaagcggctgccctct

SEQ ID NO: 421494 - DNA, 25 bp, Mus musculus
gaagaaagtccaccttgctcttgct

SEQ ID NO: 421495 - DNA, 25 bp, Mus musculus
gaagaaagtccagcttgctcttgct

SEQ ID NO: 421496 - DNA, 25 bp, Mus musculus
gaagaaagtgataccccaggcgtga

SEQ ID NO: 421497 - DNA, 25 bp, Mus musculus
gaagaaagtgattccccaggcgtga

SEQ ID NO: 421498 - DNA, 25 bp, Mus musculus
gaagaaagtggtccctggaccctgt

SEQ ID NO: 421499 - DNA, 25 bp, Mus musculus
gaagaaagtggtgcctggaccctgt

SEQ ID NO: 421500 - DNA, 25 bp, Mus musculus
gaagaaagttcactggactccatgt

SEQ ID NO: 421501 - DNA, 25 bp, Mus musculus
gaagaaagttcagtggactccatgt

SEQ ID NO: 421502 - DNA, 25 bp, Mus musculus
gaagaaataaacctctgccggatcc

SEQ ID NO: 421503 - DNA, 25 bp, Mus musculus
gaagaaataaacgtctgccggatcc

SEQ ID NO: 421504 - DNA, 25 bp, Mus musculus
gaagaaatacttcagggcttgactt

SEQ ID NO: 421505 - DNA, 25 bp, Mus musculus
gaagaaatacttgagggcttgactt

SEQ ID NO: 421506 - DNA, 25 bp, Mus musculus
gaagaaatagacctgttgggccata

SEQ ID NO: 421507 - DNA, 25 bp, Mus musculus
gaagaaatagacgtgttgggccata

SEQ ID NO: 421508 - DNA, 25 bp, Mus musculus
gaagaaataggtaagttctcccact

SEQ ID NO: 421509 - DNA, 25 bp, Mus musculus
gaagaaataggttagttctcccact

SEQ ID NO: 421510 - DNA, 25 bp, Mus musculus
gaagaaatagttatctccaggcaaa

SEQ ID NO: 421511 - DNA, 25 bp, Mus musculus
gaagaaatagttttctccaggcaaa

SEQ ID NO: 421512 - DNA, 25 bp, Mus musculus
gaagaaatcaccaaggtccaaggcg

SEQ ID NO: 421513 - DNA, 25 bp, Mus musculus
gaagaaatcacctaggtccaaggcg

SEQ ID NO: 421514 - DNA, 25 bp, Mus musculus
gaagaaatcagtagtcagctcagag

SEQ ID NO: 421515 - DNA, 25 bp, Mus musculus
gaagaaatcagttgtcagctcagag

SEQ ID NO: 421516 - DNA, 25 bp, Mus musculus
gaagaaatcattaatcatgcattaa

SEQ ID NO: 421517 - DNA, 25 bp, Mus musculus
gaagaaatcatttatcatgcattaa

SEQ ID NO: 421518 - DNA, 25 bp, Mus musculus
gaagaaatcccaactgtgagccagt

SEQ ID NO: 421519 - DNA, 25 bp, Mus musculus
gaagaaatcccatctgtgagccagt

SEQ ID NO: 421520 - DNA, 25 bp, Mus musculus
gaagaaatcctcagacattcattta

SEQ ID NO: 421521 - DNA, 25 bp, Mus musculus
gaagaaatcctctgacattcattta

SEQ ID NO: 421522 - DNA, 25 bp, Mus musculus
gaagaaatctcacctttcgttcttt

SEQ ID NO: 421523 - DNA, 25 bp, Mus musculus
gaagaaatctcagctttcgttcttt

SEQ ID NO: 421524 - DNA, 25 bp, Mus musculus
gaagaaatctgaaattcctacattt

SEQ ID NO: 421525 - DNA, 25 bp, Mus musculus
gaagaaatctgatattcctacattt

SEQ ID NO: 421526 - DNA, 25 bp, Mus musculus
gaagaaatcttccttacccactact

SEQ ID NO: 421527 - DNA, 25 bp, Mus musculus
gaagaaatcttcgttacccactact

SEQ ID NO: 421528 - DNA, 25 bp, Mus musculus
gaagaaatcttgaaatcccttaatt

SEQ ID NO: 421529 - DNA, 25 bp, Mus musculus
gaagaaatcttgtaatcccttaatt

SEQ ID NO: 421530 - DNA, 25 bp, Mus musculus
gaagaaatctttcggcaagtatggc

SEQ ID NO: 421531 - DNA, 25 bp, Mus musculus
gaagaaatctttgggcaagtatggc

SEQ ID NO: 421532 - DNA, 25 bp, Mus musculus
gaagaaatgagtctgccgcctcccg

SEQ ID NO: 421533 - DNA, 25 bp, Mus musculus
gaagaaatgagtgtgccgcctcccg

SEQ ID NO: 421534 - DNA, 25 bp, Mus musculus
gaagaaatgctcacttagcgtctaa

SEQ ID NO: 421535 - DNA, 25 bp, Mus musculus
gaagaaatgctctcttagcgtctaa

SEQ ID NO: 421536 - DNA, 25 bp, Mus musculus
gaagaaatgctgattactgccctcc

SEQ ID NO: 421537 - DNA, 25 bp, Mus musculus
gaagaaatgctgtttactgccctcc

SEQ ID NO: 421538 - DNA, 25 bp, Mus musculus
gaagaaatggcgcatctccacaatc

SEQ ID NO: 421539 - DNA, 25 bp, Mus musculus
gaagaaatggcggatctccacaatc

SEQ ID NO: 421540 - DNA, 25 bp, Mus musculus
gaagaaatgttcacacgtcctactt

SEQ ID NO: 421541 - DNA, 25 bp, Mus musculus
gaagaaatgttctcacgtcctactt

SEQ ID NO: 421542 - DNA, 25 bp, Mus musculus
gaagaaattgctcgtgtttacacag

SEQ ID NO: 421543 - DNA, 25 bp, Mus musculus
gaagaaattgctggtgtttacacag

SEQ ID NO: 421544 - DNA, 25 bp, Mus musculus
gaagaaattttaagcccttatttat

SEQ ID NO: 421545 - DNA, 25 bp, Mus musculus
gaagaaattttatgcccttatttat

SEQ ID NO: 421546 - DNA, 25 bp, Mus musculus
gaagaaattttcaaatgaatccaca

SEQ ID NO: 421547 - DNA, 25 bp, Mus musculus
gaagaaattttctaatgaatccaca

SEQ ID NO: 421548 - DNA, 25 bp, Mus musculus
gaagaacaaagcagcatcatataca

SEQ ID NO: 421549 - DNA, 25 bp, Mus musculus
gaagaacaaagctgcatcatataca

SEQ ID NO: 421550 - DNA, 25 bp, Mus musculus
gaagaacaaaggatctctcaagagg

SEQ ID NO: 421551 - DNA, 25 bp, Mus musculus
gaagaacaaaggttctctcaagagg

SEQ ID NO: 421552 - DNA, 25 bp, Mus musculus
gaagaacaaatgagacgccaacgag

SEQ ID NO: 421553 - DNA, 25 bp, Mus musculus
gaagaacaaatgtgacgccaacgag

SEQ ID NO: 421554 - DNA, 25 bp, Mus musculus
gaagaacaactgaagattctagtaa

SEQ ID NO: 421555 - DNA, 25 bp, Mus musculus
gaagaacaactgtagattctagtaa

SEQ ID NO: 421556 - DNA, 25 bp, Mus musculus
gaagaacaatccatccaccaattat

SEQ ID NO: 421557 - DNA, 25 bp, Mus musculus
gaagaacaatccttccaccaattat

SEQ ID NO: 421558 - DNA, 25 bp, Mus musculus
gaagaacaatgacttagtgcgcaag

SEQ ID NO: 421559 - DNA, 25 bp, Mus musculus
gaagaacaatgagttagtgcgcaag

SEQ ID NO: 421560 - DNA, 25 bp, Mus musculus
gaagaacacacccagcatcagcgag

SEQ ID NO: 421561 - DNA, 25 bp, Mus musculus
gaagaacacaccgagcatcagcgag

SEQ ID NO: 421562 - DNA, 25 bp, Mus musculus
gaagaacacagtatcatgactcggg

SEQ ID NO: 421563 - DNA, 25 bp, Mus musculus
gaagaacacagtttcatgactcggg

SEQ ID NO: 421564 - DNA, 25 bp, Mus musculus
gaagaacacatgcagaaacatcgaa

SEQ ID NO: 421565 - DNA, 25 bp, Mus musculus
gaagaacacatggagaaacatcgaa

SEQ ID NO: 421566 - DNA, 25 bp, Mus musculus
gaagaacaccagaacatttgtcaat

SEQ ID NO: 421567 - DNA, 25 bp, Mus musculus
gaagaacaccagtacatttgtcaat

SEQ ID NO: 421568 - DNA, 25 bp, Mus musculus
gaagaacaccataattgccgcaaag

SEQ ID NO: 421569 - DNA, 25 bp, Mus musculus
gaagaacaccattattgccgcaaag

SEQ ID NO: 421570 - DNA, 25 bp, Mus musculus
gaagaacacctgagcttgctctgtt

SEQ ID NO: 421571 - DNA, 25 bp, Mus musculus
gaagaacacctgtgcttgctctgtt

SEQ ID NO: 421572 - DNA, 25 bp, Mus musculus
gaagaacactgaactggaattcatc

SEQ ID NO: 421573 - DNA, 25 bp, Mus musculus
gaagaacactgatctggaattcatc

SEQ ID NO: 421574 - DNA, 25 bp, Mus musculus
gaagaacactgcagaccgggttgct

SEQ ID NO: 421575 - DNA, 25 bp, Mus musculus
gaagaacactgctgaccgggttgct

SEQ ID NO: 421576 - DNA, 25 bp, Mus musculus
gaagaacactggatgggtgtccgta

SEQ ID NO: 421577 - DNA, 25 bp, Mus musculus
gaagaacactggttgggtgtccgta

SEQ ID NO: 421578 - DNA, 25 bp, Mus musculus
gaagaacagattcggctccaagagg

SEQ ID NO: 421579 - DNA, 25 bp, Mus musculus
gaagaacagattgggctccaagagg

SEQ ID NO: 421580 - DNA, 25 bp, Mus musculus
gaagaacagctgatggatccctgca

SEQ ID NO: 421581 - DNA, 25 bp, Mus musculus
gaagaacagctgttggatccctgca

SEQ ID NO: 421582 - DNA, 25 bp, Mus musculus
gaagaacaggacacccagcttcctt

SEQ ID NO: 421583 - DNA, 25 bp, Mus musculus
gaagaacaggactcccagcttcctt

SEQ ID NO: 421584 - DNA, 25 bp, Mus musculus
gaagaacaggctctcgaagaacaaa

SEQ ID NO: 421585 - DNA, 25 bp, Mus musculus
gaagaacaggctgtcgaagaacaaa

SEQ ID NO: 421586 - DNA, 25 bp, Mus musculus
gaagaacagggtcaactaacctgga

SEQ ID NO: 421587 - DNA, 25 bp, Mus musculus
gaagaacagggtgaactaacctgga

SEQ ID NO: 421588 - DNA, 25 bp, Mus musculus
gaagaacagttcacgctcttaactg

SEQ ID NO: 421589 - DNA, 25 bp, Mus musculus
gaagaacagttctcgctcttaactg

SEQ ID NO: 421590 - DNA, 25 bp, Mus musculus
gaagaacataccaaactcatagcct

SEQ ID NO: 421591 - DNA, 25 bp, Mus musculus
gaagaacatacctaactcatagcct

SEQ ID NO: 421592 - DNA, 25 bp, Mus musculus
gaagaacatctcctacaagtaccgt

SEQ ID NO: 421593 - DNA, 25 bp, Mus musculus
gaagaacatctcgtacaagtaccgt

SEQ ID NO: 421594 - DNA, 25 bp, Mus musculus
gaagaacatctgactgtggcaatga

SEQ ID NO: 421595 - DNA, 25 bp, Mus musculus
gaagaacatctgtctgtggcaatga

SEQ ID NO: 421596 - DNA, 25 bp, Mus musculus
gaagaacatgacaggctgctttaga

SEQ ID NO: 421597 - DNA, 25 bp, Mus musculus
gaagaacatgactggctgctttaga

SEQ ID NO: 421598 - DNA, 25 bp, Mus musculus
gaagaacatgatatcctatttgctg

SEQ ID NO: 421599 - DNA, 25 bp, Mus musculus
gaagaacatgatttcctatttgctg

SEQ ID NO: 421600 - DNA, 25 bp, Mus musculus
gaagaacatgcacgaaagaccattt

SEQ ID NO: 421601 - DNA, 25 bp, Mus musculus
gaagaacatgcaggaaagaccattt

SEQ ID NO: 421602 - DNA, 25 bp, Mus musculus
gaagaacatgtacaatccagattcc

SEQ ID NO: 421603 - DNA, 25 bp, Mus musculus
gaagaacatgtagaatccagattcc

SEQ ID NO: 421604 - DNA, 25 bp, Mus musculus
gaagaacatgtcagtccatctcatt

SEQ ID NO: 421605 - DNA, 25 bp, Mus musculus
gaagaacatgtctgtccatctcatt

SEQ ID NO: 421606 - DNA, 25 bp, Mus musculus
gaagaacattctatttgctaaaaca

SEQ ID NO: 421607 - DNA, 25 bp, Mus musculus
gaagaacattctttttgctaaaaca

SEQ ID NO: 421608 - DNA, 25 bp, Mus musculus
gaagaacattgccaataccctcatg

SEQ ID NO: 421609 - DNA, 25 bp, Mus musculus
gaagaacattgccagtgacactaca

SEQ ID NO: 421610 - DNA, 25 bp, Mus musculus
gaagaacattgcgaataccctcatg

SEQ ID NO: 421611 - DNA, 25 bp, Mus musculus
gaagaacattgcgagtgacactaca

SEQ ID NO: 421612 - DNA, 25 bp, Mus musculus
gaagaacatttcatagttacttttg

SEQ ID NO: 421613 - DNA, 25 bp, Mus musculus
gaagaacatttcttagttacttttg

SEQ ID NO: 421614 - DNA, 25 bp, Mus musculus
gaagaaccaaatcctcaatctgatg

SEQ ID NO: 421615 - DNA, 25 bp, Mus musculus
gaagaaccaaatgctcaatctgatg

SEQ ID NO: 421616 - DNA, 25 bp, Mus musculus
gaagaaccaacacagtgcacctagc

SEQ ID NO: 421617 - DNA, 25 bp, Mus musculus
gaagaaccaacagagtgcacctagc

SEQ ID NO: 421618 - DNA, 25 bp, Mus musculus
gaagaaccacctctcagtcacttta

SEQ ID NO: 421619 - DNA, 25 bp, Mus musculus
gaagaaccacctgtcagtcacttta

SEQ ID NO: 421620 - DNA, 25 bp, Mus musculus
gaagaaccagacaccagtgatgacg

SEQ ID NO: 421621 - DNA, 25 bp, Mus musculus
gaagaaccagaccatctcatgatgt

SEQ ID NO: 421622 - DNA, 25 bp, Mus musculus
gaagaaccagacgatctcatgatgt

SEQ ID NO: 421623 - DNA, 25 bp, Mus musculus
gaagaaccagactccagtgatgacg

SEQ ID NO: 421624 - DNA, 25 bp, Mus musculus
gaagaaccaggtaacatatctttaa

SEQ ID NO: 421625 - DNA, 25 bp, Mus musculus
gaagaaccaggtaccaagatcatag

SEQ ID NO: 421626 - DNA, 25 bp, Mus musculus
gaagaaccaggttacatatctttaa

SEQ ID NO: 421627 - DNA, 25 bp, Mus musculus
gaagaaccaggttccaagatcatag

SEQ ID NO: 421628 - DNA, 25 bp, Mus musculus
gaagaaccagtcagtggttcaacag

SEQ ID NO: 421629 - DNA, 25 bp, Mus musculus
gaagaaccagtctgtggttcaacag

SEQ ID NO: 421630 - DNA, 25 bp, Mus musculus
gaagaaccagtgaatgcgccagaga

SEQ ID NO: 421631 - DNA, 25 bp, Mus musculus
gaagaaccagtgtatgcgccagaga

SEQ ID NO: 421632 - DNA, 25 bp, Mus musculus
gaagaaccagttaccactaaagaga

SEQ ID NO: 421633 - DNA, 25 bp, Mus musculus
gaagaaccagtttccactaaagaga

SEQ ID NO: 421634 - DNA, 25 bp, Mus musculus
gaagaacccaagctgccaggccagg

SEQ ID NO: 421635 - DNA, 25 bp, Mus musculus
gaagaacccaaggtgccaggccagg

SEQ ID NO: 421636 - DNA, 25 bp, Mus musculus
gaagaacccacgaaatgcagcagta

SEQ ID NO: 421637 - DNA, 25 bp, Mus musculus
gaagaacccacgtaatgcagcagta

SEQ ID NO: 421638 - DNA, 25 bp, Mus musculus
gaagaacccagactgaaacctccgt

SEQ ID NO: 421639 - DNA, 25 bp, Mus musculus
gaagaacccagagtgaaacctccgt

SEQ ID NO: 421640 - DNA, 25 bp, Mus musculus
gaagaacccagtctatgtgcaagca

SEQ ID NO: 421641 - DNA, 25 bp, Mus musculus
gaagaacccagtgtatgtgcaagca

SEQ ID NO: 421642 - DNA, 25 bp, Mus musculus
gaagaaccccaaaggctggtggtac

SEQ ID NO: 421643 - DNA, 25 bp, Mus musculus
gaagaaccccaatggctggtggtac

SEQ ID NO: 421644 - DNA, 25 bp, Mus musculus
gaagaaccccaccatctggaagagg

SEQ ID NO: 421645 - DNA, 25 bp, Mus musculus
gaagaaccccacgatctggaagagg

SEQ ID NO: 421646 - DNA, 25 bp, Mus musculus
gaagaacccctgatgcaagtacatg

SEQ ID NO: 421647 - DNA, 25 bp, Mus musculus
gaagaacccctgttgcaagtacatg

SEQ ID NO: 421648 - DNA, 25 bp, Mus musculus
gaagaacccgagacaaacacagtag

SEQ ID NO: 421649 - DNA, 25 bp, Mus musculus
gaagaacccgagtcaaacacagtag

SEQ ID NO: 421650 - DNA, 25 bp, Mus musculus
gaagaacccgcaacaaagcataaga

SEQ ID NO: 421651 - DNA, 25 bp, Mus musculus
gaagaacccgcatcaaagcataaga

SEQ ID NO: 421652 - DNA, 25 bp, Mus musculus
gaagaacccgggaatcctgaggcct

SEQ ID NO: 421653 - DNA, 25 bp, Mus musculus
gaagaacccgggtatcctgaggcct

SEQ ID NO: 421654 - DNA, 25 bp, Mus musculus
gaagaacccgtcatttacagcgctc

SEQ ID NO: 421655 - DNA, 25 bp, Mus musculus
gaagaacccgtcttttacagcgctc

SEQ ID NO: 421656 - DNA, 25 bp, Mus musculus
gaagaaccctaacaggtcagccaaa

SEQ ID NO: 421657 - DNA, 25 bp, Mus musculus
gaagaaccctaagaggtcagccaaa

SEQ ID NO: 421658 - DNA, 25 bp, Mus musculus
gaagaaccctcacaccacacacata

SEQ ID NO: 421659 - DNA, 25 bp, Mus musculus
gaagaaccctcagaccacacacata

SEQ ID NO: 421660 - DNA, 25 bp, Mus musculus
gaagaaccgaagaccagaggcccca

SEQ ID NO: 421661 - DNA, 25 bp, Mus musculus
gaagaaccgaagtccagaggcccca

SEQ ID NO: 421662 - DNA, 25 bp, Mus musculus
gaagaaccgattacctagttgacca

SEQ ID NO: 421663 - DNA, 25 bp, Mus musculus
gaagaaccgatttcctagttgacca

SEQ ID NO: 421664 - DNA, 25 bp, Mus musculus
gaagaaccgcagagacgggttttgc

SEQ ID NO: 421665 - DNA, 25 bp, Mus musculus
gaagaaccgcagtgacgggttttgc

SEQ ID NO: 421666 - DNA, 25 bp, Mus musculus
gaagaaccgccacgtggtcaccagc

SEQ ID NO: 421667 - DNA, 25 bp, Mus musculus
gaagaaccgccaggtggtcaccagc

SEQ ID NO: 421668 - DNA, 25 bp, Mus musculus
gaagaacctaacagcgtgactgaga

SEQ ID NO: 421669 - DNA, 25 bp, Mus musculus
gaagaacctaactgcgtgactgaga

SEQ ID NO: 421670 - DNA, 25 bp, Mus musculus
gaagaacctacactaacgtgggaag

SEQ ID NO: 421671 - DNA, 25 bp, Mus musculus
gaagaacctacagtaacgtgggaag

SEQ ID NO: 421672 - DNA, 25 bp, Mus musculus
gaagaacctcacataagtccgtgtc

SEQ ID NO: 421673 - DNA, 25 bp, Mus musculus
gaagaacctcacttaagtccgtgtc

SEQ ID NO: 421674 - DNA, 25 bp, Mus musculus
gaagaacctcagaggctgctggact

SEQ ID NO: 421675 - DNA, 25 bp, Mus musculus
gaagaacctcagtggctgctggact

SEQ ID NO: 421676 - DNA, 25 bp, Mus musculus
gaagaacctcatactttctgtgctc

SEQ ID NO: 421677 - DNA, 25 bp, Mus musculus
gaagaacctcattctttctgtgctc

SEQ ID NO: 421678 - DNA, 25 bp, Mus musculus
gaagaacctcctcaaaaggctgttg

SEQ ID NO: 421679 - DNA, 25 bp, Mus musculus
gaagaacctcctgaaaaggctgttg

SEQ ID NO: 421680 - DNA, 25 bp, Mus musculus
gaagaacctcggattggtggtccct

SEQ ID NO: 421681 - DNA, 25 bp, Mus musculus
gaagaacctcggtttggtggtccct

SEQ ID NO: 421682 - DNA, 25 bp, Mus musculus
gaagaacctctaactgatgctgagt

SEQ ID NO: 421683 - DNA, 25 bp, Mus musculus
gaagaacctctaagctgacattgat

SEQ ID NO: 421684 - DNA, 25 bp, Mus musculus
gaagaacctctatctgatgctgagt

SEQ ID NO: 421685 - DNA, 25 bp, Mus musculus
gaagaacctctatgctgacattgat

SEQ ID NO: 421686 - DNA, 25 bp, Mus musculus
gaagaacctgcaacaagactttgtg

SEQ ID NO: 421687 - DNA, 25 bp, Mus musculus
gaagaacctgcatcaagactttgtg

SEQ ID NO: 421688 - DNA, 25 bp, Mus musculus
gaagaacctggtcgaaccgtctcct

SEQ ID NO: 421689 - DNA, 25 bp, Mus musculus
gaagaacctggtggaaccgtctcct

SEQ ID NO: 421690 - DNA, 25 bp, Mus musculus
gaagaacctgtccttattgggagac

SEQ ID NO: 421691 - DNA, 25 bp, Mus musculus
gaagaacctgtcgttattgggagac

SEQ ID NO: 421692 - DNA, 25 bp, Mus musculus
gaagaacctgtgacgggctcaacta

SEQ ID NO: 421693 - DNA, 25 bp, Mus musculus
gaagaacctgtgtcgggctcaacta

SEQ ID NO: 421694 - DNA, 25 bp, Mus musculus
gaagaaccttaaaggacagtgtacc

SEQ ID NO: 421695 - DNA, 25 bp, Mus musculus
gaagaaccttaatggacagtgtacc

SEQ ID NO: 421696 - DNA, 25 bp, Mus musculus
gaagaaccttacctgtgagacagtg

SEQ ID NO: 421697 - DNA, 25 bp, Mus musculus
gaagaaccttacgtgtgagacagtg

SEQ ID NO: 421698 - DNA, 25 bp, Mus musculus
gaagaaccttatccggagactacag

SEQ ID NO: 421699 - DNA, 25 bp, Mus musculus
gaagaaccttatgcggagactacag

SEQ ID NO: 421700 - DNA, 25 bp, Mus musculus
gaagaaccttcacgagccgatgatt

SEQ ID NO: 421701 - DNA, 25 bp, Mus musculus
gaagaaccttcaggagccgatgatt

SEQ ID NO: 421702 - DNA, 25 bp, Mus musculus
gaagaacgacagctttctggtcccc

SEQ ID NO: 421703 - DNA, 25 bp, Mus musculus
gaagaacgacaggtttctggtcccc

SEQ ID NO: 421704 - DNA, 25 bp, Mus musculus
gaagaacgacttcacctgttgcctg

SEQ ID NO: 421705 - DNA, 25 bp, Mus musculus
gaagaacgacttgacctgttgcctg

SEQ ID NO: 421706 - DNA, 25 bp, Mus musculus
gaagaacgagaacgccgccaaggtg

SEQ ID NO: 421707 - DNA, 25 bp, Mus musculus
gaagaacgagaaggccgccaaggtg

SEQ ID NO: 421708 - DNA, 25 bp, Mus musculus
gaagaacgatttctttctcaggccc

SEQ ID NO: 421709 - DNA, 25 bp, Mus musculus
gaagaacgatttgtttctcaggccc

SEQ ID NO: 421710 - DNA, 25 bp, Mus musculus
gaagaacgcagtagagtcaccactt

SEQ ID NO: 421711 - DNA, 25 bp, Mus musculus
gaagaacgcagttgagtcaccactt

SEQ ID NO: 421712 - DNA, 25 bp, Mus musculus
gaagaacggacgagtccttaccctg

SEQ ID NO: 421713 - DNA, 25 bp, Mus musculus
gaagaacggacgtgtccttaccctg

SEQ ID NO: 421714 - DNA, 25 bp, Mus musculus
gaagaacgtgtgagagatcctcacc

SEQ ID NO: 421715 - DNA, 25 bp, Mus musculus
gaagaacgtgtgtgagatcctcacc

SEQ ID NO: 421716 - DNA, 25 bp, Mus musculus
gaagaacgttctctctattatgttt

SEQ ID NO: 421717 - DNA, 25 bp, Mus musculus
gaagaacgttctgtctattatgttt

SEQ ID NO: 421718 - DNA, 25 bp, Mus musculus
gaagaacgttttaactgtaagtcat

SEQ ID NO: 421719 - DNA, 25 bp, Mus musculus
gaagaacgtttttactgtaagtcat

SEQ ID NO: 421720 - DNA, 25 bp, Mus musculus
gaagaactacacagatgatgccatt

SEQ ID NO: 421721 - DNA, 25 bp, Mus musculus
gaagaactacactgatgatgccatt

SEQ ID NO: 421722 - DNA, 25 bp, Mus musculus
gaagaactacttaaccgtggcacaa

SEQ ID NO: 421723 - DNA, 25 bp, Mus musculus
gaagaactactttaccgtggcacaa

SEQ ID NO: 421724 - DNA, 25 bp, Mus musculus
gaagaactagacacctttggacact

SEQ ID NO: 421725 - DNA, 25 bp, Mus musculus
gaagaactagactcctttggacact

SEQ ID NO: 421726 - DNA, 25 bp, Mus musculus
gaagaactagctaggcctactgaag

SEQ ID NO: 421727 - DNA, 25 bp, Mus musculus
gaagaactagcttggcctactgaag

SEQ ID NO: 421728 - DNA, 25 bp, Mus musculus
gaagaactaggaatggactgcccct

SEQ ID NO: 421729 - DNA, 25 bp, Mus musculus
gaagaactaggattggactgcccct

SEQ ID NO: 421730 - DNA, 25 bp, Mus musculus
gaagaactatggcatctgtttaatt

SEQ ID NO: 421731 - DNA, 25 bp, Mus musculus
gaagaactatgggatctgtttaatt

SEQ ID NO: 421732 - DNA, 25 bp, Mus musculus
gaagaactattaagggctgctccaa

SEQ ID NO: 421733 - DNA, 25 bp, Mus musculus
gaagaactattaatcccagttaaca

SEQ ID NO: 421734 - DNA, 25 bp, Mus musculus
gaagaactattatgggctgctccaa

SEQ ID NO: 421735 - DNA, 25 bp, Mus musculus
gaagaactattattcccagttaaca

SEQ ID NO: 421736 - DNA, 25 bp, Mus musculus
gaagaactattgatccctgccacga

SEQ ID NO: 421737 - DNA, 25 bp, Mus musculus
gaagaactattgttccctgccacga

SEQ ID NO: 421738 - DNA, 25 bp, Mus musculus
gaagaactcaaaaacacactccaag

SEQ ID NO: 421739 - DNA, 25 bp, Mus musculus
gaagaactcaaatacacactccaag

SEQ ID NO: 421740 - DNA, 25 bp, Mus musculus
gaagaactcaacagtttcattactg

SEQ ID NO: 421741 - DNA, 25 bp, Mus musculus
gaagaactcaactgtttcattactg

SEQ ID NO: 421742 - DNA, 25 bp, Mus musculus
gaagaactcagtaggcaggcactct

SEQ ID NO: 421743 - DNA, 25 bp, Mus musculus
gaagaactcagttggcaggcactct

SEQ ID NO: 421744 - DNA, 25 bp, Mus musculus
gaagaactcataaacatttgtgtgt

SEQ ID NO: 421745 - DNA, 25 bp, Mus musculus
gaagaactcatatacatttgtgtgt

SEQ ID NO: 421746 - DNA, 25 bp, Mus musculus
gaagaactcatgatcccaagtaaat

SEQ ID NO: 421747 - DNA, 25 bp, Mus musculus
gaagaactcatgttcccaagtaaat

SEQ ID NO: 421748 - DNA, 25 bp, Mus musculus
gaagaactccctagatgttgcccag

SEQ ID NO: 421749 - DNA, 25 bp, Mus musculus
gaagaactcccttgatgttgcccag

SEQ ID NO: 421750 - DNA, 25 bp, Mus musculus
gaagaactcgttccaggttacgtca

SEQ ID NO: 421751 - DNA, 25 bp, Mus musculus
gaagaactcgttgcaggttacgtca

SEQ ID NO: 421752 - DNA, 25 bp, Mus musculus
gaagaactctgtacataggaccgct

SEQ ID NO: 421753 - DNA, 25 bp, Mus musculus
gaagaactctgttcataggaccgct

SEQ ID NO: 421754 - DNA, 25 bp, Mus musculus
gaagaactcttaaattgctccaata

SEQ ID NO: 421755 - DNA, 25 bp, Mus musculus
gaagaactcttatattgctccaata

SEQ ID NO: 421756 - DNA, 25 bp, Mus musculus
gaagaactcttcatggacctggcac

SEQ ID NO: 421757 - DNA, 25 bp, Mus musculus
gaagaactcttccaacgcctgttca

SEQ ID NO: 421758 - DNA, 25 bp, Mus musculus
gaagaactcttcgaacgcctgttca

SEQ ID NO: 421759 - DNA, 25 bp, Mus musculus
gaagaactcttcttggacctggcac

SEQ ID NO: 421760 - DNA, 25 bp, Mus musculus
gaagaactgaacacgcttggcctag

SEQ ID NO: 421761 - DNA, 25 bp, Mus musculus
gaagaactgaactcgcttggcctag

SEQ ID NO: 421762 - DNA, 25 bp, Mus musculus
gaagaactgactcacggaatacgca

SEQ ID NO: 421763 - DNA, 25 bp, Mus musculus
gaagaactgactcctcattgtggat

SEQ ID NO: 421764 - DNA, 25 bp, Mus musculus
gaagaactgactcgagctgatcctg

SEQ ID NO: 421765 - DNA, 25 bp, Mus musculus
gaagaactgactgacggaatacgca

SEQ ID NO: 421766 - DNA, 25 bp, Mus musculus
gaagaactgactgctcattgtggat

SEQ ID NO: 421767 - DNA, 25 bp, Mus musculus
gaagaactgactggagctgatcctg

SEQ ID NO: 421768 - DNA, 25 bp, Mus musculus
gaagaactgagaccttccctcggga

SEQ ID NO: 421769 - DNA, 25 bp, Mus musculus
gaagaactgagagcttccctcggga

SEQ ID NO: 421770 - DNA, 25 bp, Mus musculus
gaagaactgcaaccgaggagcctcg

SEQ ID NO: 421771 - DNA, 25 bp, Mus musculus
gaagaactgcaagcgaggagcctcg

SEQ ID NO: 421772 - DNA, 25 bp, Mus musculus
gaagaactgcacatatacacaggtg

SEQ ID NO: 421773 - DNA, 25 bp, Mus musculus
gaagaactgcacttatacacaggtg

SEQ ID NO: 421774 - DNA, 25 bp, Mus musculus
gaagaactgcagcttactaccacta

SEQ ID NO: 421775 - DNA, 25 bp, Mus musculus
gaagaactgcaggttactaccacta

SEQ ID NO: 421776 - DNA, 25 bp, Mus musculus
gaagaactgcccatggcatcagcag

SEQ ID NO: 421777 - DNA, 25 bp, Mus musculus
gaagaactgccccaggtcacctcgt

SEQ ID NO: 421778 - DNA, 25 bp, Mus musculus
gaagaactgcccgaggtcacctcgt

SEQ ID NO: 421779 - DNA, 25 bp, Mus musculus
gaagaactgcccttggcatcagcag

SEQ ID NO: 421780 - DNA, 25 bp, Mus musculus
gaagaactgcgcatcatctcagctg

SEQ ID NO: 421781 - DNA, 25 bp, Mus musculus
gaagaactgcgcttcatctcagctg

SEQ ID NO: 421782 - DNA, 25 bp, Mus musculus
gaagaactgcttaggaaccggcctg

SEQ ID NO: 421783 - DNA, 25 bp, Mus musculus
gaagaactgcttcatatgctgatgt

SEQ ID NO: 421784 - DNA, 25 bp, Mus musculus
gaagaactgcttgatatgctgatgt

SEQ ID NO: 421785 - DNA, 25 bp, Mus musculus
gaagaactgctttggaaccggcctg

SEQ ID NO: 421786 - DNA, 25 bp, Mus musculus
gaagaactggagaaccgacctcaac

SEQ ID NO: 421787 - DNA, 25 bp, Mus musculus
gaagaactggagtaccgacctcaac

SEQ ID NO: 421788 - DNA, 25 bp, Mus musculus
gaagaactgggtcatcctgcacgtt

SEQ ID NO: 421789 - DNA, 25 bp, Mus musculus
gaagaactgggtgatcctgcacgtt

SEQ ID NO: 421790 - DNA, 25 bp, Mus musculus
gaagaactggtcacccttagtaagg

SEQ ID NO: 421791 - DNA, 25 bp, Mus musculus
gaagaactggtctcccttagtaagg

SEQ ID NO: 421792 - DNA, 25 bp, Mus musculus
gaagaactgtacaatcctgcaagag

SEQ ID NO: 421793 - DNA, 25 bp, Mus musculus
gaagaactgtactatcctgcaagag

SEQ ID NO: 421794 - DNA, 25 bp, Mus musculus
gaagaactgtcaattgctcgctatt

SEQ ID NO: 421795 - DNA, 25 bp, Mus musculus
gaagaactgtcatttgctcgctatt

SEQ ID NO: 421796 - DNA, 25 bp, Mus musculus
gaagaactgtctcaacacctcacct

SEQ ID NO: 421797 - DNA, 25 bp, Mus musculus
gaagaactgtctgaacacctcacct

SEQ ID NO: 421798 - DNA, 25 bp, Mus musculus
gaagaactgtgtattatgtatagac

SEQ ID NO: 421799 - DNA, 25 bp, Mus musculus
gaagaactgtgttttatgtatagac

SEQ ID NO: 421800 - DNA, 25 bp, Mus musculus
gaagaactgtttattgcctgctggt

SEQ ID NO: 421801 - DNA, 25 bp, Mus musculus
gaagaactgttttttgcctgctggt

SEQ ID NO: 421802 - DNA, 25 bp, Mus musculus
gaagaacttaatccacctactgacg

SEQ ID NO: 421803 - DNA, 25 bp, Mus musculus
gaagaacttaatgcacctactgacg

SEQ ID NO: 421804 - DNA, 25 bp, Mus musculus
gaagaacttacaaattccctggaga

SEQ ID NO: 421805 - DNA, 25 bp, Mus musculus
gaagaacttacatattccctggaga

SEQ ID NO: 421806 - DNA, 25 bp, Mus musculus
gaagaacttcaaatcccaaccgtca

SEQ ID NO: 421807 - DNA, 25 bp, Mus musculus
gaagaacttcaattcccaaccgtca

SEQ ID NO: 421808 - DNA, 25 bp, Mus musculus
gaagaacttcagctaactaattaca

SEQ ID NO: 421809 - DNA, 25 bp, Mus musculus
gaagaacttcaggtaactaattaca

SEQ ID NO: 421810 - DNA, 25 bp, Mus musculus
gaagaacttccacatcatccacggc

SEQ ID NO: 421811 - DNA, 25 bp, Mus musculus
gaagaacttccagatcatccacggc

SEQ ID NO: 421812 - DNA, 25 bp, Mus musculus
gaagaacttcctacaatggataatt

SEQ ID NO: 421813 - DNA, 25 bp, Mus musculus
gaagaacttccttcaatggataatt

SEQ ID NO: 421814 - DNA, 25 bp, Mus musculus
gaagaacttcgcacaaatgacaaat

SEQ ID NO: 421815 - DNA, 25 bp, Mus musculus
gaagaacttcgctcaaatgacaaat

SEQ ID NO: 421816 - DNA, 25 bp, Mus musculus
gaagaacttgttatgcactgcacat

SEQ ID NO: 421817 - DNA, 25 bp, Mus musculus
gaagaacttgttttgcactgcacat

SEQ ID NO: 421818 - DNA, 25 bp, Mus musculus
gaagaacttttccagagattcgata

SEQ ID NO: 421819 - DNA, 25 bp, Mus musculus
gaagaacttttcgagagattcgata

SEQ ID NO: 421820 - DNA, 25 bp, Mus musculus
gaagaagaaatcaaattattccatt

SEQ ID NO: 421821 - DNA, 25 bp, Mus musculus
gaagaagaaatctaattattccatt

SEQ ID NO: 421822 - DNA, 25 bp, Mus musculus
gaagaagaacaaatcagcccctctc

SEQ ID NO: 421823 - DNA, 25 bp, Mus musculus
gaagaagaacaattcagcccctctc

SEQ ID NO: 421824 - DNA, 25 bp, Mus musculus
gaagaagaaccaaagcccatagaac

SEQ ID NO: 421825 - DNA, 25 bp, Mus musculus
gaagaagaaccacagtccagatgag

SEQ ID NO: 421826 - DNA, 25 bp, Mus musculus
gaagaagaaccagagtccagatgag

SEQ ID NO: 421827 - DNA, 25 bp, Mus musculus
gaagaagaaccatagcccatagaac

SEQ ID NO: 421828 - DNA, 25 bp, Mus musculus
gaagaagaacctcctgttgcagtat

SEQ ID NO: 421829 - DNA, 25 bp, Mus musculus
gaagaagaacctgctgttgcagtat

SEQ ID NO: 421830 - DNA, 25 bp, Mus musculus
gaagaagaacgaaccagaagatgag

SEQ ID NO: 421831 - DNA, 25 bp, Mus musculus
gaagaagaacgatccagaagatgag

SEQ ID NO: 421832 - DNA, 25 bp, Mus musculus
gaagaagaacgcctgagggcctcca

SEQ ID NO: 421833 - DNA, 25 bp, Mus musculus
gaagaagaacgcgtgagggcctcca

SEQ ID NO: 421834 - DNA, 25 bp, Mus musculus
gaagaagaagcaatgccggcctctg

SEQ ID NO: 421835 - DNA, 25 bp, Mus musculus
gaagaagaagcattgccggcctctg

SEQ ID NO: 421836 - DNA, 25 bp, Mus musculus
gaagaagaagctagctaccgcctct

SEQ ID NO: 421837 - DNA, 25 bp, Mus musculus
gaagaagaagcttgctaccgcctct

SEQ ID NO: 421838 - DNA, 25 bp, Mus musculus
gaagaagacaagagatcccaggatc

SEQ ID NO: 421839 - DNA, 25 bp, Mus musculus
gaagaagacaagtgatcccaggatc

SEQ ID NO: 421840 - DNA, 25 bp, Mus musculus
gaagaagacaatatcccctttgccg

SEQ ID NO: 421841 - DNA, 25 bp, Mus musculus
gaagaagacaatttcccctttgccg

SEQ ID NO: 421842 - DNA, 25 bp, Mus musculus
gaagaagacaccattacactcactt

SEQ ID NO: 421843 - DNA, 25 bp, Mus musculus
gaagaagacacctttacactcactt

SEQ ID NO: 421844 - DNA, 25 bp, Mus musculus
gaagaagacatactttccaagacaa

SEQ ID NO: 421845 - DNA, 25 bp, Mus musculus
gaagaagacatagtttccaagacaa

SEQ ID NO: 421846 - DNA, 25 bp, Mus musculus
gaagaagaccctaaactctctgttg

SEQ ID NO: 421847 - DNA, 25 bp, Mus musculus
gaagaagacccttaactctctgttg

SEQ ID NO: 421848 - DNA, 25 bp, Mus musculus
gaagaagacctcacaggctcactgg

SEQ ID NO: 421849 - DNA, 25 bp, Mus musculus
gaagaagacctctcaggctcactgg

SEQ ID NO: 421850 - DNA, 25 bp, Mus musculus
gaagaagacgatcctgccttcgtta

SEQ ID NO: 421851 - DNA, 25 bp, Mus musculus
gaagaagacgatgctgccttcgtta

SEQ ID NO: 421852 - DNA, 25 bp, Mus musculus
gaagaagacgctcctctagtggaaa

SEQ ID NO: 421853 - DNA, 25 bp, Mus musculus
gaagaagacgctgctctagtggaaa

SEQ ID NO: 421854 - DNA, 25 bp, Mus musculus
gaagaagactacagcgccttacaaa

SEQ ID NO: 421855 - DNA, 25 bp, Mus musculus
gaagaagactactgcgccttacaaa

SEQ ID NO: 421856 - DNA, 25 bp, Mus musculus
gaagaagactagctcaccacctcta

SEQ ID NO: 421857 - DNA, 25 bp, Mus musculus
gaagaagactaggtcaccacctcta

SEQ ID NO: 421858 - DNA, 25 bp, Mus musculus
gaagaagactgaccgctgcaactaa

SEQ ID NO: 421859 - DNA, 25 bp, Mus musculus
gaagaagactgagcgctgcaactaa

SEQ ID NO: 421860 - DNA, 25 bp, Mus musculus
gaagaagactgtacctcatgagaat

SEQ ID NO: 421861 - DNA, 25 bp, Mus musculus
gaagaagactgttcctcatgagaat

SEQ ID NO: 421862 - DNA, 25 bp, Mus musculus
gaagaagacttgagtccacctgtga

SEQ ID NO: 421863 - DNA, 25 bp, Mus musculus
gaagaagacttgtgtccacctgtga

SEQ ID NO: 421864 - DNA, 25 bp, Mus musculus
gaagaagagagacctcgctttccct

SEQ ID NO: 421865 - DNA, 25 bp, Mus musculus
gaagaagagagagctcgctttccct

SEQ ID NO: 421866 - DNA, 25 bp, Mus musculus
gaagaagagagtaccgtaatagggt

SEQ ID NO: 421867 - DNA, 25 bp, Mus musculus
gaagaagagagttccgtaatagggt

SEQ ID NO: 421868 - DNA, 25 bp, Mus musculus
gaagaagagcccatcctatgcggag

SEQ ID NO: 421869 - DNA, 25 bp, Mus musculus
gaagaagagcccttcctatgcggag

SEQ ID NO: 421870 - DNA, 25 bp, Mus musculus
gaagaagagtccaagtggcccctct

SEQ ID NO: 421871 - DNA, 25 bp, Mus musculus
gaagaagagtcctagtggcccctct

SEQ ID NO: 421872 - DNA, 25 bp, Mus musculus
gaagaagagtcgataccttggagat

SEQ ID NO: 421873 - DNA, 25 bp, Mus musculus
gaagaagagtcgttaccttggagat

SEQ ID NO: 421874 - DNA, 25 bp, Mus musculus
gaagaagataaaagtagcctaccaa

SEQ ID NO: 421875 - DNA, 25 bp, Mus musculus
gaagaagataaatgtagcctaccaa

SEQ ID NO: 421876 - DNA, 25 bp, Mus musculus
gaagaagatcacacatctaacttaa

SEQ ID NO: 421877 - DNA, 25 bp, Mus musculus
gaagaagatcactcatctaacttaa

SEQ ID NO: 421878 - DNA, 25 bp, Mus musculus
gaagaagatcatagttaattactat

SEQ ID NO: 421879 - DNA, 25 bp, Mus musculus
gaagaagatcattgttaattactat

SEQ ID NO: 421880 - DNA, 25 bp, Mus musculus
gaagaagatccgcagcctcatgaag

SEQ ID NO: 421881 - DNA, 25 bp, Mus musculus
gaagaagatccggagcctcatgaag

SEQ ID NO: 421882 - DNA, 25 bp, Mus musculus
gaagaagatcctcgtttcctaggaa

SEQ ID NO: 421883 - DNA, 25 bp, Mus musculus
gaagaagatcctggtttcctaggaa

SEQ ID NO: 421884 - DNA, 25 bp, Mus musculus
gaagaagatcttaccatgcctctca

SEQ ID NO: 421885 - DNA, 25 bp, Mus musculus
gaagaagatcttatggaagtagggt

SEQ ID NO: 421886 - DNA, 25 bp, Mus musculus
gaagaagatctttccatgcctctca

SEQ ID NO: 421887 - DNA, 25 bp, Mus musculus
gaagaagatcttttggaagtagggt

SEQ ID NO: 421888 - DNA, 25 bp, Mus musculus
gaagaagatgaaagcccctcagaaa

SEQ ID NO: 421889 - DNA, 25 bp, Mus musculus
gaagaagatgaatgcccctcagaaa

SEQ ID NO: 421890 - DNA, 25 bp, Mus musculus
gaagaagatgccagagtcagtgccc

SEQ ID NO: 421891 - DNA, 25 bp, Mus musculus
gaagaagatgcctgagtcagtgccc

SEQ ID NO: 421892 - DNA, 25 bp, Mus musculus
gaagaagattctctcagtgcaacga

SEQ ID NO: 421893 - DNA, 25 bp, Mus musculus
gaagaagattctgtcagtgcaacga

SEQ ID NO: 421894 - DNA, 25 bp, Mus musculus
gaagaagatttcaccctatctacca

SEQ ID NO: 421895 - DNA, 25 bp, Mus musculus
gaagaagatttctccctatctacca

SEQ ID NO: 421896 - DNA, 25 bp, Mus musculus
gaagaagcaaatacctcctctactt

SEQ ID NO: 421897 - DNA, 25 bp, Mus musculus
gaagaagcaaattcctcctctactt

SEQ ID NO: 421898 - DNA, 25 bp, Mus musculus
gaagaagcaacgcaacttaagaaag

SEQ ID NO: 421899 - DNA, 25 bp, Mus musculus
gaagaagcaacggaacttaagaaag

SEQ ID NO: 421900 - DNA, 25 bp, Mus musculus
gaagaagcaagacctagccccgtct

SEQ ID NO: 421901 - DNA, 25 bp, Mus musculus
gaagaagcaagagctagccccgtct

SEQ ID NO: 421902 - DNA, 25 bp, Mus musculus
gaagaagcacccagtagaaccatcc

SEQ ID NO: 421903 - DNA, 25 bp, Mus musculus
gaagaagcaccctgtagaaccatcc

SEQ ID NO: 421904 - DNA, 25 bp, Mus musculus
gaagaagcacttcctcagtggcatc

SEQ ID NO: 421905 - DNA, 25 bp, Mus musculus
gaagaagcacttgctcagtggcatc

SEQ ID NO: 421906 - DNA, 25 bp, Mus musculus
gaagaagcatcaattttgcctttgt

SEQ ID NO: 421907 - DNA, 25 bp, Mus musculus
gaagaagcatcatttttgcctttgt

SEQ ID NO: 421908 - DNA, 25 bp, Mus musculus
gaagaagcatctacaggacctgtct

SEQ ID NO: 421909 - DNA, 25 bp, Mus musculus
gaagaagcatcttcaggacctgtct

SEQ ID NO: 421910 - DNA, 25 bp, Mus musculus
gaagaagcattaactccttgcttgt

SEQ ID NO: 421911 - DNA, 25 bp, Mus musculus
gaagaagcattatctccttgcttgt

SEQ ID NO: 421912 - DNA, 25 bp, Mus musculus
gaagaagcattgatgagcccagcca

SEQ ID NO: 421913 - DNA, 25 bp, Mus musculus
gaagaagcattgttgagcccagcca

SEQ ID NO: 421914 - DNA, 25 bp, Mus musculus
gaagaagccacacctcctcgtaaaa

SEQ ID NO: 421915 - DNA, 25 bp, Mus musculus
gaagaagccacactgcagacatgca

SEQ ID NO: 421916 - DNA, 25 bp, Mus musculus
gaagaagccacagctcctcgtaaaa

SEQ ID NO: 421917 - DNA, 25 bp, Mus musculus
gaagaagccacagtgcagacatgca

SEQ ID NO: 421918 - DNA, 25 bp, Mus musculus
gaagaagccaccatgtacacaggga

SEQ ID NO: 421919 - DNA, 25 bp, Mus musculus
gaagaagccaccttgtacacaggga

SEQ ID NO: 421920 - DNA, 25 bp, Mus musculus
gaagaagccagaccgctccgacgat

SEQ ID NO: 421921 - DNA, 25 bp, Mus musculus
gaagaagccagacctcactcttgtt

SEQ ID NO: 421922 - DNA, 25 bp, Mus musculus
gaagaagccagagcgctccgacgat

SEQ ID NO: 421923 - DNA, 25 bp, Mus musculus
gaagaagccagagctcactcttgtt

SEQ ID NO: 421924 - DNA, 25 bp, Mus musculus
gaagaagccagtatagaacctcttt

SEQ ID NO: 421925 - DNA, 25 bp, Mus musculus
gaagaagccagtttagaacctcttt

SEQ ID NO: 421926 - DNA, 25 bp, Mus musculus
gaagaagccatgactatgccaaagg

SEQ ID NO: 421927 - DNA, 25 bp, Mus musculus
gaagaagccatgtctatgccaaagg

SEQ ID NO: 421928 - DNA, 25 bp, Mus musculus
gaagaagcccaaaatgtcatctctc

SEQ ID NO: 421929 - DNA, 25 bp, Mus musculus
gaagaagcccaatatgtcatctctc

SEQ ID NO: 421930 - DNA, 25 bp, Mus musculus
gaagaagcccagcagttcctgtgag

SEQ ID NO: 421931 - DNA, 25 bp, Mus musculus
gaagaagcccaggagttcctgtgag

SEQ ID NO: 421932 - DNA, 25 bp, Mus musculus
gaagaagcccataaactaccagtaa

SEQ ID NO: 421933 - DNA, 25 bp, Mus musculus
gaagaagcccattaactaccagtaa

SEQ ID NO: 421934 - DNA, 25 bp, Mus musculus
gaagaagcccgtaactggagagact

SEQ ID NO: 421935 - DNA, 25 bp, Mus musculus
gaagaagcccgttactggagagact

SEQ ID NO: 421936 - DNA, 25 bp, Mus musculus
gaagaagccctaataaacccagtga

SEQ ID NO: 421937 - DNA, 25 bp, Mus musculus
gaagaagccctattaaacccagtga

SEQ ID NO: 421938 - DNA, 25 bp, Mus musculus
gaagaagccgcactacttcacctga

SEQ ID NO: 421939 - DNA, 25 bp, Mus musculus
gaagaagccgcagtacttcacctga

SEQ ID NO: 421940 - DNA, 25 bp, Mus musculus
gaagaagccgccagagcactgtata

SEQ ID NO: 421941 - DNA, 25 bp, Mus musculus
gaagaagccgcctgagcactgtata

SEQ ID NO: 421942 - DNA, 25 bp, Mus musculus
gaagaagcctaacctcaccctgcaa

SEQ ID NO: 421943 - DNA, 25 bp, Mus musculus
gaagaagcctaagctcaccctgcaa

SEQ ID NO: 421944 - DNA, 25 bp, Mus musculus
gaagaagcctccagtaagtgattat

SEQ ID NO: 421945 - DNA, 25 bp, Mus musculus
gaagaagcctccagttggccttcag

SEQ ID NO: 421946 - DNA, 25 bp, Mus musculus
gaagaagcctcctgtaagtgattat

SEQ ID NO: 421947 - DNA, 25 bp, Mus musculus
gaagaagcctcctgttggccttcag

SEQ ID NO: 421948 - DNA, 25 bp, Mus musculus
gaagaagcctgcaatgctcagacca

SEQ ID NO: 421949 - DNA, 25 bp, Mus musculus
gaagaagcctgctatgctcagacca

SEQ ID NO: 421950 - DNA, 25 bp, Mus musculus
gaagaagcctggagatttatctgat

SEQ ID NO: 421951 - DNA, 25 bp, Mus musculus
gaagaagcctggtgatttatctgat

SEQ ID NO: 421952 - DNA, 25 bp, Mus musculus
gaagaagccttaccctgcacagaag

SEQ ID NO: 421953 - DNA, 25 bp, Mus musculus
gaagaagccttagcctgcacagaag

SEQ ID NO: 421954 - DNA, 25 bp, Mus musculus
gaagaagccttgagttctagtccca

SEQ ID NO: 421955 - DNA, 25 bp, Mus musculus
gaagaagccttgtgttctagtccca

SEQ ID NO: 421956 - DNA, 25 bp, Mus musculus
gaagaagcctttaatgttagatgaa

SEQ ID NO: 421957 - DNA, 25 bp, Mus musculus
gaagaagccttttatgttagatgaa

SEQ ID NO: 421958 - DNA, 25 bp, Mus musculus
gaagaagcgctccaaatctgcagac

SEQ ID NO: 421959 - DNA, 25 bp, Mus musculus
gaagaagcgctccaaggccaagcag

SEQ ID NO: 421960 - DNA, 25 bp, Mus musculus
gaagaagcgctcgaaatctgcagac

SEQ ID NO: 421961 - DNA, 25 bp, Mus musculus
gaagaagcgctcgaaggccaagcag

SEQ ID NO: 421962 - DNA, 25 bp, Mus musculus
gaagaagcgcttcttgtccacagtc

SEQ ID NO: 421963 - DNA, 25 bp, Mus musculus
gaagaagcgcttgttgtccacagtc

SEQ ID NO: 421964 - DNA, 25 bp, Mus musculus
gaagaagcggaacaggctcccagct

SEQ ID NO: 421965 - DNA, 25 bp, Mus musculus
gaagaagcggaagaggctcccagct

SEQ ID NO: 421966 - DNA, 25 bp, Mus musculus
gaagaagcgttgcactctccgaaga

SEQ ID NO: 421967 - DNA, 25 bp, Mus musculus
gaagaagcgttggactctccgaaga

SEQ ID NO: 421968 - DNA, 25 bp, Mus musculus
gaagaagctaacaaggccaggtatc

SEQ ID NO: 421969 - DNA, 25 bp, Mus musculus
gaagaagctaactaggccaggtatc

SEQ ID NO: 421970 - DNA, 25 bp, Mus musculus
gaagaagctcccatcaagactgaag

SEQ ID NO: 421971 - DNA, 25 bp, Mus musculus
gaagaagctcccttcaagactgaag

SEQ ID NO: 421972 - DNA, 25 bp, Mus musculus
gaagaagctcgaacccaaagcccag

SEQ ID NO: 421973 - DNA, 25 bp, Mus musculus
gaagaagctcgatcccaaagcccag

SEQ ID NO: 421974 - DNA, 25 bp, Mus musculus
gaagaagctctactgcaagctctag

SEQ ID NO: 421975 - DNA, 25 bp, Mus musculus
gaagaagctctagtgcaagctctag

SEQ ID NO: 421976 - DNA, 25 bp, Mus musculus
gaagaagctctcagccttgagccta

SEQ ID NO: 421977 - DNA, 25 bp, Mus musculus
gaagaagctctctgccttgagccta

SEQ ID NO: 421978 - DNA, 25 bp, Mus musculus
gaagaagctctgaacaacgccttta

SEQ ID NO: 421979 - DNA, 25 bp, Mus musculus
gaagaagctctgtacaacgccttta

SEQ ID NO: 421980 - DNA, 25 bp, Mus musculus
gaagaagctgcaatggctgcacagt

SEQ ID NO: 421981 - DNA, 25 bp, Mus musculus
gaagaagctgcattggctgcacagt

SEQ ID NO: 421982 - DNA, 25 bp, Mus musculus
gaagaagctgccaagatcctgctgg

SEQ ID NO: 421983 - DNA, 25 bp, Mus musculus
gaagaagctgccagcgtgcatgtat

SEQ ID NO: 421984 - DNA, 25 bp, Mus musculus
gaagaagctgcctagatcctgctgg

SEQ ID NO: 421985 - DNA, 25 bp, Mus musculus
gaagaagctgcctgcgtgcatgtat

SEQ ID NO: 421986 - DNA, 25 bp, Mus musculus
gaagaagctgcgattccacccacgg

SEQ ID NO: 421987 - DNA, 25 bp, Mus musculus
gaagaagctgcgctgcaaccatagc

SEQ ID NO: 421988 - DNA, 25 bp, Mus musculus
gaagaagctgcggtgcaaccatagc

SEQ ID NO: 421989 - DNA, 25 bp, Mus musculus
gaagaagctgcgtttccacccacgg

SEQ ID NO: 421990 - DNA, 25 bp, Mus musculus
gaagaagctgctcaaggcaggcccc

SEQ ID NO: 421991 - DNA, 25 bp, Mus musculus
gaagaagctgctgaaggcaggcccc

SEQ ID NO: 421992 - DNA, 25 bp, Mus musculus
gaagaagctttcctcaagtgcgcgc

SEQ ID NO: 421993 - DNA, 25 bp, Mus musculus
gaagaagctttcgtcaagtgcgcgc

SEQ ID NO: 421994 - DNA, 25 bp, Mus musculus
gaagaaggaatcagccctacatatt

SEQ ID NO: 421995 - DNA, 25 bp, Mus musculus
gaagaaggaatctgccctacatatt

SEQ ID NO: 421996 - DNA, 25 bp, Mus musculus
gaagaaggacaaccgcctggcctac

SEQ ID NO: 421997 - DNA, 25 bp, Mus musculus
gaagaaggacaagcgcctggcctac

SEQ ID NO: 421998 - DNA, 25 bp, Mus musculus
gaagaaggagccctgaccgggacag

SEQ ID NO: 421999 - DNA, 25 bp, Mus musculus
gaagaaggagccgtgaccgggacag

SEQ ID NO: 422000 - DNA, 25 bp, Mus musculus
gaagaaggaggccccgtctcctgca

SEQ ID NO: 422001 - DNA, 25 bp, Mus musculus
gaagaaggaggcgccgtctcctgca

SEQ ID NO: 422002 - DNA, 25 bp, Mus musculus
gaagaaggagtgctgccctatccca

SEQ ID NO: 422003 - DNA, 25 bp, Mus musculus
gaagaaggagtggtgccctatccca

SEQ ID NO: 422004 - DNA, 25 bp, Mus musculus
gaagaaggcctcctttggacacaag

SEQ ID NO: 422005 - DNA, 25 bp, Mus musculus
gaagaaggcctcgtttggacacaag

SEQ ID NO: 422006 - DNA, 25 bp, Mus musculus
gaagaaggcctgatgccccaaaatt

SEQ ID NO: 422007 - DNA, 25 bp, Mus musculus
gaagaaggcctgcaattgcctgctc

SEQ ID NO: 422008 - DNA, 25 bp, Mus musculus
gaagaaggcctggaattgcctgctc

SEQ ID NO: 422009 - DNA, 25 bp, Mus musculus
gaagaaggcctgttgccccaaaatt

SEQ ID NO: 422010 - DNA, 25 bp, Mus musculus
gaagaaggctcacttgatcccagga

SEQ ID NO: 422011 - DNA, 25 bp, Mus musculus
gaagaaggctcagttgatcccagga

SEQ ID NO: 422012 - DNA, 25 bp, Mus musculus
gaagaaggctctatctcagtgtcct

SEQ ID NO: 422013 - DNA, 25 bp, Mus musculus
gaagaaggctctttctcagtgtcct

SEQ ID NO: 422014 - DNA, 25 bp, Mus musculus
gaagaaggctttaatccctcggagc

SEQ ID NO: 422015 - DNA, 25 bp, Mus musculus
gaagaaggctttactgtggtttctg

SEQ ID NO: 422016 - DNA, 25 bp, Mus musculus
gaagaaggcttttatccctcggagc

SEQ ID NO: 422017 - DNA, 25 bp, Mus musculus
gaagaaggcttttctgtggtttctg

SEQ ID NO: 422018 - DNA, 25 bp, Mus musculus
gaagaagggctcaagagggcctaaa

SEQ ID NO: 422019 - DNA, 25 bp, Mus musculus
gaagaagggctctagagggcctaaa

SEQ ID NO: 422020 - DNA, 25 bp, Mus musculus
gaagaagggctgataaacatttcat

SEQ ID NO: 422021 - DNA, 25 bp, Mus musculus
gaagaagggctgttaaacatttcat

SEQ ID NO: 422022 - DNA, 25 bp, Mus musculus
gaagaaggtaaactgccaaggacca

SEQ ID NO: 422023 - DNA, 25 bp, Mus musculus
gaagaaggtaaagtgccaaggacca

SEQ ID NO: 422024 - DNA, 25 bp, Mus musculus
gaagaaggtagacggctctgtaaat

SEQ ID NO: 422025 - DNA, 25 bp, Mus musculus
gaagaaggtagagggctctgtaaat

SEQ ID NO: 422026 - DNA, 25 bp, Mus musculus
gaagaaggtcaaataaagctgtggt

SEQ ID NO: 422027 - DNA, 25 bp, Mus musculus
gaagaaggtcaactttgccccattc

SEQ ID NO: 422028 - DNA, 25 bp, Mus musculus
gaagaaggtcaagtttgccccattc

SEQ ID NO: 422029 - DNA, 25 bp, Mus musculus
gaagaaggtcaattaaagctgtggt

SEQ ID NO: 422030 - DNA, 25 bp, Mus musculus
gaagaaggtccaaacagtctgatta

SEQ ID NO: 422031 - DNA, 25 bp, Mus musculus
gaagaaggtccatacagtctgatta

SEQ ID NO: 422032 - DNA, 25 bp, Mus musculus
gaagaaggtgaacccctgctaaccg

SEQ ID NO: 422033 - DNA, 25 bp, Mus musculus
gaagaaggtgaagccctgctaaccg

SEQ ID NO: 422034 - DNA, 25 bp, Mus musculus
gaagaaggtgatacttgcagaaatt

SEQ ID NO: 422035 - DNA, 25 bp, Mus musculus
gaagaaggtgatccccagacagaag

SEQ ID NO: 422036 - DNA, 25 bp, Mus musculus
gaagaaggtgatgcccagacagaag

SEQ ID NO: 422037 - DNA, 25 bp, Mus musculus
gaagaaggtgattcttgcagaaatt

SEQ ID NO: 422038 - DNA, 25 bp, Mus musculus
gaagaagtaacacccactgcgagcc

SEQ ID NO: 422039 - DNA, 25 bp, Mus musculus
gaagaagtaacagccactgcgagcc

SEQ ID NO: 422040 - DNA, 25 bp, Mus musculus
gaagaagtaccccaaacagacagaa

SEQ ID NO: 422041 - DNA, 25 bp, Mus musculus
gaagaagtacccgaaacagacagaa

SEQ ID NO: 422042 - DNA, 25 bp, Mus musculus
gaagaagtacgcaaggcccaagctt

SEQ ID NO: 422043 - DNA, 25 bp, Mus musculus
gaagaagtacgctaggcccaagctt

SEQ ID NO: 422044 - DNA, 25 bp, Mus musculus
gaagaagtagagatgctagtggcgg

SEQ ID NO: 422045 - DNA, 25 bp, Mus musculus
gaagaagtagagttgctagtggcgg

SEQ ID NO: 422046 - DNA, 25 bp, Mus musculus
gaagaagtatccacactgcgcaagg

SEQ ID NO: 422047 - DNA, 25 bp, Mus musculus
gaagaagtatcctcactgcgcaagg

SEQ ID NO: 422048 - DNA, 25 bp, Mus musculus
gaagaagtcacaacactgtcctctt

SEQ ID NO: 422049 - DNA, 25 bp, Mus musculus
gaagaagtcacatcactgtcctctt

SEQ ID NO: 422050 - DNA, 25 bp, Mus musculus
gaagaagtcagtaatcctaccagca

SEQ ID NO: 422051 - DNA, 25 bp, Mus musculus
gaagaagtcagttatcctaccagca

SEQ ID NO: 422052 - DNA, 25 bp, Mus musculus
gaagaagtcccgatctgtaaactgg

SEQ ID NO: 422053 - DNA, 25 bp, Mus musculus
gaagaagtcccgttctgtaaactgg

SEQ ID NO: 422054 - DNA, 25 bp, Mus musculus
gaagaagtcctcagccctggcagag

SEQ ID NO: 422055 - DNA, 25 bp, Mus musculus
gaagaagtcctctgccctggcagag

SEQ ID NO: 422056 - DNA, 25 bp, Mus musculus
gaagaagtccttctccccgaagaga

SEQ ID NO: 422057 - DNA, 25 bp, Mus musculus
gaagaagtccttgtccccgaagaga

SEQ ID NO: 422058 - DNA, 25 bp, Mus musculus
gaagaagtcgtcaagagtcccacct

SEQ ID NO: 422059 - DNA, 25 bp, Mus musculus
gaagaagtcgtctagagtcccacct

SEQ ID NO: 422060 - DNA, 25 bp, Mus musculus
gaagaagtctacatttgcgcgcctg

SEQ ID NO: 422061 - DNA, 25 bp, Mus musculus
gaagaagtctacttttgcgcgcctg

SEQ ID NO: 422062 - DNA, 25 bp, Mus musculus
gaagaagtctctcatcacgtttgtg

SEQ ID NO: 422063 - DNA, 25 bp, Mus musculus
gaagaagtctctgatcacgtttgtg

SEQ ID NO: 422064 - DNA, 25 bp, Mus musculus
gaagaagtcttcagccaagaacaaa

SEQ ID NO: 422065 - DNA, 25 bp, Mus musculus
gaagaagtcttcatgagtgcctatg

SEQ ID NO: 422066 - DNA, 25 bp, Mus musculus
gaagaagtcttctgccaagaacaaa

SEQ ID NO: 422067 - DNA, 25 bp, Mus musculus
gaagaagtcttcttgagtgcctatg

SEQ ID NO: 422068 - DNA, 25 bp, Mus musculus
gaagaagtgacacctgccaaagccc

SEQ ID NO: 422069 - DNA, 25 bp, Mus musculus
gaagaagtgacagctgccaaagccc

SEQ ID NO: 422070 - DNA, 25 bp, Mus musculus
gaagaagtgccccagtcacggccca

SEQ ID NO: 422071 - DNA, 25 bp, Mus musculus
gaagaagtgcccgagtcacggccca

SEQ ID NO: 422072 - DNA, 25 bp, Mus musculus
gaagaagtgctcatctcagctggca

SEQ ID NO: 422073 - DNA, 25 bp, Mus musculus
gaagaagtgctcttctcagctggca

SEQ ID NO: 422074 - DNA, 25 bp, Mus musculus
gaagaagtgcttctgtctctaaccc

SEQ ID NO: 422075 - DNA, 25 bp, Mus musculus
gaagaagtgcttgtgtctctaaccc

SEQ ID NO: 422076 - DNA, 25 bp, Mus musculus
gaagaagtggaacccagcctcctgg

SEQ ID NO: 422077 - DNA, 25 bp, Mus musculus
gaagaagtggaagccagcctcctgg

SEQ ID NO: 422078 - DNA, 25 bp, Mus musculus
gaagaagtgttcatgggcccactcc

SEQ ID NO: 422079 - DNA, 25 bp, Mus musculus
gaagaagtgttcttgggcccactcc

SEQ ID NO: 422080 - DNA, 25 bp, Mus musculus
gaagaagtgtttcaaatgctgctgt

SEQ ID NO: 422081 - DNA, 25 bp, Mus musculus
gaagaagtgtttgaaatgctgctgt

SEQ ID NO: 422082 - DNA, 25 bp, Mus musculus
gaagaagttcacaagagcccgggat

SEQ ID NO: 422083 - DNA, 25 bp, Mus musculus
gaagaagttcactagagcccgggat

SEQ ID NO: 422084 - DNA, 25 bp, Mus musculus
gaagaagttcccagatctacttccc

SEQ ID NO: 422085 - DNA, 25 bp, Mus musculus
gaagaagttccccagtacagagaag

SEQ ID NO: 422086 - DNA, 25 bp, Mus musculus
gaagaagttcccgagtacagagaag

SEQ ID NO: 422087 - DNA, 25 bp, Mus musculus
gaagaagttccctgatctacttccc

SEQ ID NO: 422088 - DNA, 25 bp, Mus musculus
gaagaagttcctcactatctgcaaa

SEQ ID NO: 422089 - DNA, 25 bp, Mus musculus
gaagaagttcctgactatctgcaaa

SEQ ID NO: 422090 - DNA, 25 bp, Mus musculus
gaagaagttctaagcactgtttttt

SEQ ID NO: 422091 - DNA, 25 bp, Mus musculus
gaagaagttctatgcactgtttttt

SEQ ID NO: 422092 - DNA, 25 bp, Mus musculus
gaagaagttcttccatagtcgagac

SEQ ID NO: 422093 - DNA, 25 bp, Mus musculus
gaagaagttcttctgtgcgctcctc

SEQ ID NO: 422094 - DNA, 25 bp, Mus musculus
gaagaagttcttgcatagtcgagac

SEQ ID NO: 422095 - DNA, 25 bp, Mus musculus
gaagaagttcttgtgtgcgctcctc

SEQ ID NO: 422096 - DNA, 25 bp, Mus musculus
gaagaagtttagcatgtcaaagtca

SEQ ID NO: 422097 - DNA, 25 bp, Mus musculus
gaagaagtttaggatgtcaaagtca

SEQ ID NO: 422098 - DNA, 25 bp, Mus musculus
gaagaagtttatcagcccaaccctt

SEQ ID NO: 422099 - DNA, 25 bp, Mus musculus
gaagaagtttatgagcccaaccctt

SEQ ID NO: 422100 - DNA, 25 bp, Mus musculus
gaagaagtttctccacagctgttca

SEQ ID NO: 422101 - DNA, 25 bp, Mus musculus
gaagaagtttctgcacagctgttca

SEQ ID NO: 422102 - DNA, 25 bp, Mus musculus
gaagaataaaccattccgcccaatt

SEQ ID NO: 422103 - DNA, 25 bp, Mus musculus
gaagaataaacctttccgcccaatt

SEQ ID NO: 422104 - DNA, 25 bp, Mus musculus
gaagaataagctcgtcctttcctct

SEQ ID NO: 422105 - DNA, 25 bp, Mus musculus
gaagaataagctggtcctttcctct

SEQ ID NO: 422106 - DNA, 25 bp, Mus musculus
gaagaataagttcaaagggaagccg

SEQ ID NO: 422107 - DNA, 25 bp, Mus musculus
gaagaataagttgaaagggaagccg

SEQ ID NO: 422108 - DNA, 25 bp, Mus musculus
gaagaatacagtcggaacaaacctt

SEQ ID NO: 422109 - DNA, 25 bp, Mus musculus
gaagaatacagtgggaacaaacctt

SEQ ID NO: 422110 - DNA, 25 bp, Mus musculus
gaagaataccttactccagtacacc

SEQ ID NO: 422111 - DNA, 25 bp, Mus musculus
gaagaatacctttctccagtacacc

SEQ ID NO: 422112 - DNA, 25 bp, Mus musculus
gaagaatacttgacatcccgattgg

SEQ ID NO: 422113 - DNA, 25 bp, Mus musculus
gaagaatacttgtcatcccgattgg

SEQ ID NO: 422114 - DNA, 25 bp, Mus musculus
gaagaatagagaccctagagccaca

SEQ ID NO: 422115 - DNA, 25 bp, Mus musculus
gaagaatagagagcctagagccaca

SEQ ID NO: 422116 - DNA, 25 bp, Mus musculus
gaagaatagatcagccacattttat

SEQ ID NO: 422117 - DNA, 25 bp, Mus musculus
gaagaatagatctgccacattttat

SEQ ID NO: 422118 - DNA, 25 bp, Mus musculus
gaagaatagcgcatggtgtcctcat

SEQ ID NO: 422119 - DNA, 25 bp, Mus musculus
gaagaatagcgcttggtgtcctcat

SEQ ID NO: 422120 - DNA, 25 bp, Mus musculus
gaagaatatcacaatgcacctgcta

SEQ ID NO: 422121 - DNA, 25 bp, Mus musculus
gaagaatatcactatgcacctgcta

SEQ ID NO: 422122 - DNA, 25 bp, Mus musculus
gaagaatatgttacccgccaagcct

SEQ ID NO: 422123 - DNA, 25 bp, Mus musculus
gaagaatatgtttcccgccaagcct

SEQ ID NO: 422124 - DNA, 25 bp, Mus musculus
gaagaatattctcaccatggcctgt

SEQ ID NO: 422125 - DNA, 25 bp, Mus musculus
gaagaatattctgaccatggcctgt

SEQ ID NO: 422126 - DNA, 25 bp, Mus musculus
gaagaatatttacgtcacaaagcca

SEQ ID NO: 422127 - DNA, 25 bp, Mus musculus
gaagaatatttaggtcacaaagcca

SEQ ID NO: 422128 - DNA, 25 bp, Mus musculus
gaagaatcaactccgcttccttgca

SEQ ID NO: 422129 - DNA, 25 bp, Mus musculus
gaagaatcaactgcgcttccttgca

SEQ ID NO: 422130 - DNA, 25 bp, Mus musculus
gaagaatcaatgaccttgtgtggta

SEQ ID NO: 422131 - DNA, 25 bp, Mus musculus
gaagaatcaatgtccttgtgtggta

SEQ ID NO: 422132 - DNA, 25 bp, Mus musculus
gaagaatcacatatgcatggtccat

SEQ ID NO: 422133 - DNA, 25 bp, Mus musculus
gaagaatcacatttgcatggtccat

SEQ ID NO: 422134 - DNA, 25 bp, Mus musculus
gaagaatcactcagtttcctgaatt

SEQ ID NO: 422135 - DNA, 25 bp, Mus musculus
gaagaatcactctgtttcctgaatt

SEQ ID NO: 422136 - DNA, 25 bp, Mus musculus
gaagaatcagaaaggtaggttatat

SEQ ID NO: 422137 - DNA, 25 bp, Mus musculus
gaagaatcagaatggtaggttatat

SEQ ID NO: 422138 - DNA, 25 bp, Mus musculus
gaagaatcagctcaactctacccac

SEQ ID NO: 422139 - DNA, 25 bp, Mus musculus
gaagaatcagctgaactctacccac

SEQ ID NO: 422140 - DNA, 25 bp, Mus musculus
gaagaatcatccagaaccgtatcct

SEQ ID NO: 422141 - DNA, 25 bp, Mus musculus
gaagaatcatcctgaaccgtatcct

SEQ ID NO: 422142 - DNA, 25 bp, Mus musculus
gaagaatccacaacttcatcttggg

SEQ ID NO: 422143 - DNA, 25 bp, Mus musculus
gaagaatccacatcttcatcttggg

SEQ ID NO: 422144 - DNA, 25 bp, Mus musculus
gaagaatccactagggccttctttt

SEQ ID NO: 422145 - DNA, 25 bp, Mus musculus
gaagaatccacttgggccttctttt

SEQ ID NO: 422146 - DNA, 25 bp, Mus musculus
gaagaatccaggcacctcttaaata

SEQ ID NO: 422147 - DNA, 25 bp, Mus musculus
gaagaatccagggacctcttaaata

SEQ ID NO: 422148 - DNA, 25 bp, Mus musculus
gaagaatccatgcaggttagcctaa

SEQ ID NO: 422149 - DNA, 25 bp, Mus musculus
gaagaatccatggaggttagcctaa

SEQ ID NO: 422150 - DNA, 25 bp, Mus musculus
gaagaatccccgaggacagacagac

SEQ ID NO: 422151 - DNA, 25 bp, Mus musculus
gaagaatccccgtggacagacagac

SEQ ID NO: 422152 - DNA, 25 bp, Mus musculus
gaagaatccctaaccttgtgcggag

SEQ ID NO: 422153 - DNA, 25 bp, Mus musculus
gaagaatccctatccttgtgcggag

SEQ ID NO: 422154 - DNA, 25 bp, Mus musculus
gaagaatccgtcaccatgtgtcctt

SEQ ID NO: 422155 - DNA, 25 bp, Mus musculus
gaagaatccgtctccatgtgtcctt

SEQ ID NO: 422156 - DNA, 25 bp, Mus musculus
gaagaatcctctcttgtcaacttca

SEQ ID NO: 422157 - DNA, 25 bp, Mus musculus
gaagaatcctctgttgtcaacttca

SEQ ID NO: 422158 - DNA, 25 bp, Mus musculus
gaagaatccttcaacgctgtacaag

SEQ ID NO: 422159 - DNA, 25 bp, Mus musculus
gaagaatccttctacgctgtacaag

SEQ ID NO: 422160 - DNA, 25 bp, Mus musculus
gaagaatcctttcagctggtttgag

SEQ ID NO: 422161 - DNA, 25 bp, Mus musculus
gaagaatcctttgagctggtttgag

SEQ ID NO: 422162 - DNA, 25 bp, Mus musculus
gaagaatcgcacatctaccgcgtta

SEQ ID NO: 422163 - DNA, 25 bp, Mus musculus
gaagaatcgcacttctaccgcgtta

SEQ ID NO: 422164 - DNA, 25 bp, Mus musculus
gaagaatcggcacctgacagtcacc

SEQ ID NO: 422165 - DNA, 25 bp, Mus musculus
gaagaatcggcagctgacagtcacc

SEQ ID NO: 422166 - DNA, 25 bp, Mus musculus
gaagaatcgttcattctcaagtgaa

SEQ ID NO: 422167 - DNA, 25 bp, Mus musculus
gaagaatcgttctttctcaagtgaa

SEQ ID NO: 422168 - DNA, 25 bp, Mus musculus
gaagaatctcaactgcctgatggga

SEQ ID NO: 422169 - DNA, 25 bp, Mus musculus
gaagaatctcaagtgcctgatggga

SEQ ID NO: 422170 - DNA, 25 bp, Mus musculus
gaagaatctcatcctctgcagttac

SEQ ID NO: 422171 - DNA, 25 bp, Mus musculus
gaagaatctcatgctctgcagttac

SEQ ID NO: 422172 - DNA, 25 bp, Mus musculus
gaagaatctgaactgctgtgtgaca

SEQ ID NO: 422173 - DNA, 25 bp, Mus musculus
gaagaatctgaagtgctgtgtgaca

SEQ ID NO: 422174 - DNA, 25 bp, Mus musculus
gaagaatctgagacctccttagcat

SEQ ID NO: 422175 - DNA, 25 bp, Mus musculus
gaagaatctgagtcctccttagcat

SEQ ID NO: 422176 - DNA, 25 bp, Mus musculus
gaagaatctggaagaccctctccta

SEQ ID NO: 422177 - DNA, 25 bp, Mus musculus
gaagaatctggatgaccctctccta

SEQ ID NO: 422178 - DNA, 25 bp, Mus musculus
gaagaatcttctagcattcattcca

SEQ ID NO: 422179 - DNA, 25 bp, Mus musculus
gaagaatcttcttgcattcattcca

SEQ ID NO: 422180 - DNA, 25 bp, Mus musculus
gaagaatctttacaggcctagtttc

SEQ ID NO: 422181 - DNA, 25 bp, Mus musculus
gaagaatctttagaggcctagtttc

SEQ ID NO: 422182 - DNA, 25 bp, Mus musculus
gaagaatctttgacttcgtctgaaa

SEQ ID NO: 422183 - DNA, 25 bp, Mus musculus
gaagaatctttgtcttcgtctgaaa

SEQ ID NO: 422184 - DNA, 25 bp, Mus musculus
gaagaatgactacccaaccaatgtt

SEQ ID NO: 422185 - DNA, 25 bp, Mus musculus
gaagaatgactagccaaccaatgtt

SEQ ID NO: 422186 - DNA, 25 bp, Mus musculus
gaagaatgagccaaaacacagactg

SEQ ID NO: 422187 - DNA, 25 bp, Mus musculus
gaagaatgagcctaaacacagactg

SEQ ID NO: 422188 - DNA, 25 bp, Mus musculus
gaagaatgatggagcccagtctacc

SEQ ID NO: 422189 - DNA, 25 bp, Mus musculus
gaagaatgatggtgcccagtctacc

SEQ ID NO: 422190 - DNA, 25 bp, Mus musculus
gaagaatgatttcgcacaactgaat

SEQ ID NO: 422191 - DNA, 25 bp, Mus musculus
gaagaatgatttggcacaactgaat

SEQ ID NO: 422192 - DNA, 25 bp, Mus musculus
gaagaatgcaagatgtcctggtccg

SEQ ID NO: 422193 - DNA, 25 bp, Mus musculus
gaagaatgcaagttgtcctggtccg

SEQ ID NO: 422194 - DNA, 25 bp, Mus musculus
gaagaatgccacaactcccttgaaa

SEQ ID NO: 422195 - DNA, 25 bp, Mus musculus
gaagaatgccactactcccttgaaa

SEQ ID NO: 422196 - DNA, 25 bp, Mus musculus
gaagaatgccctctacgagtcccag

SEQ ID NO: 422197 - DNA, 25 bp, Mus musculus
gaagaatgccctgtacgagtcccag

SEQ ID NO: 422198 - DNA, 25 bp, Mus musculus
gaagaatgccttacccgaggcgagg

SEQ ID NO: 422199 - DNA, 25 bp, Mus musculus
gaagaatgcctttcccgaggcgagg

SEQ ID NO: 422200 - DNA, 25 bp, Mus musculus
gaagaatgcgaacccttccgcaagc

SEQ ID NO: 422201 - DNA, 25 bp, Mus musculus
gaagaatgcgaagccttccgcaagc

SEQ ID NO: 422202 - DNA, 25 bp, Mus musculus
gaagaatgcgccctggaaacctggc

SEQ ID NO: 422203 - DNA, 25 bp, Mus musculus
gaagaatgcgccgtggaaacctggc

SEQ ID NO: 422204 - DNA, 25 bp, Mus musculus
gaagaatgcgctagcgccgggttct

SEQ ID NO: 422205 - DNA, 25 bp, Mus musculus
gaagaatgcgcttgcgccgggttct

SEQ ID NO: 422206 - DNA, 25 bp, Mus musculus
gaagaatggaaaacccctctctctt

SEQ ID NO: 422207 - DNA, 25 bp, Mus musculus
gaagaatggaaatcccctctctctt

SEQ ID NO: 422208 - DNA, 25 bp, Mus musculus
gaagaatggaagactctcccttctt

SEQ ID NO: 422209 - DNA, 25 bp, Mus musculus
gaagaatggaagtctctcccttctt

SEQ ID NO: 422210 - DNA, 25 bp, Mus musculus
gaagaatggccaacatcccgaagaa

SEQ ID NO: 422211 - DNA, 25 bp, Mus musculus
gaagaatggccatcatcccgaagaa

SEQ ID NO: 422212 - DNA, 25 bp, Mus musculus
gaagaatgggagcacccacactttg

SEQ ID NO: 422213 - DNA, 25 bp, Mus musculus
gaagaatgggaggacccacactttg

SEQ ID NO: 422214 - DNA, 25 bp, Mus musculus
gaagaatgggcaccttgtcccttcc

SEQ ID NO: 422215 - DNA, 25 bp, Mus musculus
gaagaatgggcagcttgtcccttcc

SEQ ID NO: 422216 - DNA, 25 bp, Mus musculus
gaagaatgggtaatttatcaagcat

SEQ ID NO: 422217 - DNA, 25 bp, Mus musculus
gaagaatgggtattttatcaagcat

SEQ ID NO: 422218 - DNA, 25 bp, Mus musculus
gaagaatgggtcattctgccatagt

SEQ ID NO: 422219 - DNA, 25 bp, Mus musculus
gaagaatgggtctttctgccatagt

SEQ ID NO: 422220 - DNA, 25 bp, Mus musculus
gaagaatgtctcacggatttcagcc

SEQ ID NO: 422221 - DNA, 25 bp, Mus musculus
gaagaatgtctctcggatttcagcc

SEQ ID NO: 422222 - DNA, 25 bp, Mus musculus
gaagaatgtgcccaagacacagatg

SEQ ID NO: 422223 - DNA, 25 bp, Mus musculus
gaagaatgtgccgaagacacagatg

SEQ ID NO: 422224 - DNA, 25 bp, Mus musculus
gaagaatgttaaactgttcctatgc

SEQ ID NO: 422225 - DNA, 25 bp, Mus musculus
gaagaatgttaatctgttcctatgc

SEQ ID NO: 422226 - DNA, 25 bp, Mus musculus
gaagaatgttctcttagggcttaaa

SEQ ID NO: 422227 - DNA, 25 bp, Mus musculus
gaagaatgttctcttcgcccttggc

SEQ ID NO: 422228 - DNA, 25 bp, Mus musculus
gaagaatgttctgttagggcttaaa

SEQ ID NO: 422229 - DNA, 25 bp, Mus musculus
gaagaatgttctgttcgcccttggc

SEQ ID NO: 422230 - DNA, 25 bp, Mus musculus
gaagaatgttgtagcctcagatggg

SEQ ID NO: 422231 - DNA, 25 bp, Mus musculus
gaagaatgttgttgcctcagatggg

SEQ ID NO: 422232 - DNA, 25 bp, Mus musculus
gaagaatgtttcagggtcccgacat

SEQ ID NO: 422233 - DNA, 25 bp, Mus musculus
gaagaatgtttctgggtcccgacat

SEQ ID NO: 422234 - DNA, 25 bp, Mus musculus
gaagaattaagtagaccactctgat

SEQ ID NO: 422235 - DNA, 25 bp, Mus musculus
gaagaattaagttgaccactctgat

SEQ ID NO: 422236 - DNA, 25 bp, Mus musculus
gaagaattactaccaagacacccca

SEQ ID NO: 422237 - DNA, 25 bp, Mus musculus
gaagaattactagcaagacacccca

SEQ ID NO: 422238 - DNA, 25 bp, Mus musculus
gaagaattagacacctccataaagt

SEQ ID NO: 422239 - DNA, 25 bp, Mus musculus
gaagaattagactcctccataaagt

SEQ ID NO: 422240 - DNA, 25 bp, Mus musculus
gaagaattcagcactccaagcttag

SEQ ID NO: 422241 - DNA, 25 bp, Mus musculus
gaagaattcagctctccaagcttag

SEQ ID NO: 422242 - DNA, 25 bp, Mus musculus
gaagaattcatgactgaagatctgg

SEQ ID NO: 422243 - DNA, 25 bp, Mus musculus
gaagaattcatgcacccagcgtctt

SEQ ID NO: 422244 - DNA, 25 bp, Mus musculus
gaagaattcatggacccagcgtctt

SEQ ID NO: 422245 - DNA, 25 bp, Mus musculus
gaagaattcatgtctgaagatctgg

SEQ ID NO: 422246 - DNA, 25 bp, Mus musculus
gaagaattccccagggctactatga

SEQ ID NO: 422247 - DNA, 25 bp, Mus musculus
gaagaattcccctgggctactatga

SEQ ID NO: 422248 - DNA, 25 bp, Mus musculus
gaagaattcctgagattggccatct

SEQ ID NO: 422249 - DNA, 25 bp, Mus musculus
gaagaattcctgtgattggccatct

SEQ ID NO: 422250 - DNA, 25 bp, Mus musculus
gaagaattctgtcaatggcgggaac

SEQ ID NO: 422251 - DNA, 25 bp, Mus musculus
gaagaattctgtgaatggcgggaac

SEQ ID NO: 422252 - DNA, 25 bp, Mus musculus
gaagaattcttgacagccatagaga

SEQ ID NO: 422253 - DNA, 25 bp, Mus musculus
gaagaattcttgagcatcctagaca

SEQ ID NO: 422254 - DNA, 25 bp, Mus musculus
gaagaattcttgatagctgctaggt

SEQ ID NO: 422255 - DNA, 25 bp, Mus musculus
gaagaattcttgtcagccatagaga

SEQ ID NO: 422256 - DNA, 25 bp, Mus musculus
gaagaattcttgtgcatcctagaca

SEQ ID NO: 422257 - DNA, 25 bp, Mus musculus
gaagaattcttgttagctgctaggt

SEQ ID NO: 422258 - DNA, 25 bp, Mus musculus
gaagaattgcaacattccagtgtgg

SEQ ID NO: 422259 - DNA, 25 bp, Mus musculus
gaagaattgcaagattccagtgtgg

SEQ ID NO: 422260 - DNA, 25 bp, Mus musculus
gaagaattgctgatggaagacccta

SEQ ID NO: 422261 - DNA, 25 bp, Mus musculus
gaagaattgctgttggaagacccta

SEQ ID NO: 422262 - DNA, 25 bp, Mus musculus
gaagaattggtgcttgctgacttgc

SEQ ID NO: 422263 - DNA, 25 bp, Mus musculus
gaagaattggtggttgctgacttgc

SEQ ID NO: 422264 - DNA, 25 bp, Mus musculus
gaagaattggttccactacgctgcc

SEQ ID NO: 422265 - DNA, 25 bp, Mus musculus
gaagaattggttgcactacgctgcc

SEQ ID NO: 422266 - DNA, 25 bp, Mus musculus
gaagaattgttcactcattccctga

SEQ ID NO: 422267 - DNA, 25 bp, Mus musculus
gaagaattgttctctcattccctga

SEQ ID NO: 422268 - DNA, 25 bp, Mus musculus
gaagaatttaccaacttacagcttt

SEQ ID NO: 422269 - DNA, 25 bp, Mus musculus
gaagaatttacctacttacagcttt

SEQ ID NO: 422270 - DNA, 25 bp, Mus musculus
gaagaatttcacagtctctttattt

SEQ ID NO: 422271 - DNA, 25 bp, Mus musculus
gaagaatttcactgtctctttattt

SEQ ID NO: 422272 - DNA, 25 bp, Mus musculus
gaagaatttcagcatgccatcagga

SEQ ID NO: 422273 - DNA, 25 bp, Mus musculus
gaagaatttcaggatgccatcagga

SEQ ID NO: 422274 - DNA, 25 bp, Mus musculus
gaagaatttctgagcccactgctgg

SEQ ID NO: 422275 - DNA, 25 bp, Mus musculus
gaagaatttctgtgcccactgctgg

SEQ ID NO: 422276 - DNA, 25 bp, Mus musculus
gaagaatttgatatccaccaggcac

SEQ ID NO: 422277 - DNA, 25 bp, Mus musculus
gaagaatttgatttccaccaggcac

SEQ ID NO: 422278 - DNA, 25 bp, Mus musculus
gaagaatttgccagctttatataaa

SEQ ID NO: 422279 - DNA, 25 bp, Mus musculus
gaagaatttgcctgctttatataaa

SEQ ID NO: 422280 - DNA, 25 bp, Mus musculus
gaagaatttgtgctgttgaaacctt

SEQ ID NO: 422281 - DNA, 25 bp, Mus musculus
gaagaatttgtggtgttgaaacctt

SEQ ID NO: 422282 - DNA, 25 bp, Mus musculus
gaagacaaagttctcgtgtgccctg

SEQ ID NO: 422283 - DNA, 25 bp, Mus musculus
gaagacaaagttgtcgtgtgccctg

SEQ ID NO: 422284 - DNA, 25 bp, Mus musculus
gaagacaaatctagacaattctaga

SEQ ID NO: 422285 - DNA, 25 bp, Mus musculus
gaagacaaatcttgacaattctaga

SEQ ID NO: 422286 - DNA, 25 bp, Mus musculus
gaagacaaatggcatcacaggacag

SEQ ID NO: 422287 - DNA, 25 bp, Mus musculus
gaagacaaatgggatcacaggacag

SEQ ID NO: 422288 - DNA, 25 bp, Mus musculus
gaagacaacacaaggtgtctccaga

SEQ ID NO: 422289 - DNA, 25 bp, Mus musculus
gaagacaacacatggtgtctccaga

SEQ ID NO: 422290 - DNA, 25 bp, Mus musculus
gaagacaaccaaccaggatctcaaa

SEQ ID NO: 422291 - DNA, 25 bp, Mus musculus
gaagacaaccaagcaggatctcaaa

SEQ ID NO: 422292 - DNA, 25 bp, Mus musculus
gaagacaaccccagtacaggttcat

SEQ ID NO: 422293 - DNA, 25 bp, Mus musculus
gaagacaacccctgtacaggttcat

SEQ ID NO: 422294 - DNA, 25 bp, Mus musculus
gaagacaaccggcttatgctcaact

SEQ ID NO: 422295 - DNA, 25 bp, Mus musculus
gaagacaaccgggttatgctcaact

SEQ ID NO: 422296 - DNA, 25 bp, Mus musculus
gaagacaacgtacctctctcccttc

SEQ ID NO: 422297 - DNA, 25 bp, Mus musculus
gaagacaacgtagctctctcccttc

SEQ ID NO: 422298 - DNA, 25 bp, Mus musculus
gaagacaacgttatagctcaattct

SEQ ID NO: 422299 - DNA, 25 bp, Mus musculus
gaagacaacgttttagctcaattct

SEQ ID NO: 422300 - DNA, 25 bp, Mus musculus
gaagacaactttcgacactgagagt

SEQ ID NO: 422301 - DNA, 25 bp, Mus musculus
gaagacaactttggacactgagagt

SEQ ID NO: 422302 - DNA, 25 bp, Mus musculus
gaagacaagagcacatcctgttgga

SEQ ID NO: 422303 - DNA, 25 bp, Mus musculus
gaagacaagagctcatcctgttgga

SEQ ID NO: 422304 - DNA, 25 bp, Mus musculus
gaagacaaggacactgcagaagaca

SEQ ID NO: 422305 - DNA, 25 bp, Mus musculus
gaagacaaggactctgcagaagaca

SEQ ID NO: 422306 - DNA, 25 bp, Mus musculus
gaagacaagtctccgatcgacacat

SEQ ID NO: 422307 - DNA, 25 bp, Mus musculus
gaagacaagtctgcgatcgacacat

SEQ ID NO: 422308 - DNA, 25 bp, Mus musculus
gaagacaagttaaccattccattta

SEQ ID NO: 422309 - DNA, 25 bp, Mus musculus
gaagacaagttatccattccattta

SEQ ID NO: 422310 - DNA, 25 bp, Mus musculus
gaagacaatcgccagttcaactgcc

SEQ ID NO: 422311 - DNA, 25 bp, Mus musculus
gaagacaatcgcgagttcaactgcc

SEQ ID NO: 422312 - DNA, 25 bp, Mus musculus
gaagacaatgctatcaggctatcta

SEQ ID NO: 422313 - DNA, 25 bp, Mus musculus
gaagacaatgctttcaggctatcta

SEQ ID NO: 422314 - DNA, 25 bp, Mus musculus
gaagacaatgtcatacactctactt

SEQ ID NO: 422315 - DNA, 25 bp, Mus musculus
gaagacaatgtcttacactctactt

SEQ ID NO: 422316 - DNA, 25 bp, Mus musculus
gaagacaattacagcccggatcaca

SEQ ID NO: 422317 - DNA, 25 bp, Mus musculus
gaagacaattactgcccggatcaca

SEQ ID NO: 422318 - DNA, 25 bp, Mus musculus
gaagacacaaatcctggatcaggaa

SEQ ID NO: 422319 - DNA, 25 bp, Mus musculus
gaagacacaaatgctggatcaggaa

SEQ ID NO: 422320 - DNA, 25 bp, Mus musculus
gaagacacaaggatccttcgcacca

SEQ ID NO: 422321 - DNA, 25 bp, Mus musculus
gaagacacaaggttccttcgcacca

SEQ ID NO: 422322 - DNA, 25 bp, Mus musculus
gaagacacacacagttcttttccca

SEQ ID NO: 422323 - DNA, 25 bp, Mus musculus
gaagacacacactgttcttttccca

SEQ ID NO: 422324 - DNA, 25 bp, Mus musculus
gaagacacacagatagctaggcagt

SEQ ID NO: 422325 - DNA, 25 bp, Mus musculus
gaagacacacagttagctaggcagt

SEQ ID NO: 422326 - DNA, 25 bp, Mus musculus
gaagacacactgcttcgcacataag

SEQ ID NO: 422327 - DNA, 25 bp, Mus musculus
gaagacacactggttcgcacataag

SEQ ID NO: 422328 - DNA, 25 bp, Mus musculus
gaagacacagaacattccactgcag

SEQ ID NO: 422329 - DNA, 25 bp, Mus musculus
gaagacacagaagattccactgcag

SEQ ID NO: 422330 - DNA, 25 bp, Mus musculus
gaagacacagaccatttttattgct

SEQ ID NO: 422331 - DNA, 25 bp, Mus musculus
gaagacacagacgatttttattgct

SEQ ID NO: 422332 - DNA, 25 bp, Mus musculus
gaagacacagcgacagatgtcactg

SEQ ID NO: 422333 - DNA, 25 bp, Mus musculus
gaagacacagcgtcagatgtcactg

SEQ ID NO: 422334 - DNA, 25 bp, Mus musculus
gaagacacagggaggacaaacaaca

SEQ ID NO: 422335 - DNA, 25 bp, Mus musculus
gaagacacagggtggacaaacaaca

SEQ ID NO: 422336 - DNA, 25 bp, Mus musculus
gaagacacagttatctttccctact

SEQ ID NO: 422337 - DNA, 25 bp, Mus musculus
gaagacacagttttctttccctact

SEQ ID NO: 422338 - DNA, 25 bp, Mus musculus
gaagacacatctcctttttgtaatg

SEQ ID NO: 422339 - DNA, 25 bp, Mus musculus
gaagacacatctgctttttgtaatg

SEQ ID NO: 422340 - DNA, 25 bp, Mus musculus
gaagacacatgacaggcttatgtat

SEQ ID NO: 422341 - DNA, 25 bp, Mus musculus
gaagacacatgagaggcttatgtat

SEQ ID NO: 422342 - DNA, 25 bp, Mus musculus
gaagacaccaacattagcctctggc

SEQ ID NO: 422343 - DNA, 25 bp, Mus musculus
gaagacaccaactttagcctctggc

SEQ ID NO: 422344 - DNA, 25 bp, Mus musculus
gaagacaccaagaatctaccagctc

SEQ ID NO: 422345 - DNA, 25 bp, Mus musculus
gaagacaccaagatcaaccaccatc

SEQ ID NO: 422346 - DNA, 25 bp, Mus musculus
gaagacaccaagtatctaccagctc

SEQ ID NO: 422347 - DNA, 25 bp, Mus musculus
gaagacaccaagttcaaccaccatc

SEQ ID NO: 422348 - DNA, 25 bp, Mus musculus
gaagacaccaccacaactgactgaa

SEQ ID NO: 422349 - DNA, 25 bp, Mus musculus
gaagacaccacctcaactgactgaa

SEQ ID NO: 422350 - DNA, 25 bp, Mus musculus
gaagacaccagtagagcagctgtaa

SEQ ID NO: 422351 - DNA, 25 bp, Mus musculus
gaagacaccagttgagcagctgtaa

SEQ ID NO: 422352 - DNA, 25 bp, Mus musculus
gaagacaccatacggttacctccca

SEQ ID NO: 422353 - DNA, 25 bp, Mus musculus
gaagacaccatagggttacctccca

SEQ ID NO: 422354 - DNA, 25 bp, Mus musculus
gaagacaccatccaagaaaaacagt

SEQ ID NO: 422355 - DNA, 25 bp, Mus musculus
gaagacaccatcgaagaaaaacagt

SEQ ID NO: 422356 - DNA, 25 bp, Mus musculus
gaagacaccctcattcaattactca

SEQ ID NO: 422357 - DNA, 25 bp, Mus musculus
gaagacaccctctttcaattactca

SEQ ID NO: 422358 - DNA, 25 bp, Mus musculus
gaagacacctccactcagaaagaag

SEQ ID NO: 422359 - DNA, 25 bp, Mus musculus
gaagacacctcctctcagaaagaag

SEQ ID NO: 422360 - DNA, 25 bp, Mus musculus
gaagacacctgcaacggtgacgccg

SEQ ID NO: 422361 - DNA, 25 bp, Mus musculus
gaagacacctgctacggtgacgccg

SEQ ID NO: 422362 - DNA, 25 bp, Mus musculus
gaagacacctttaaagacaccgcaa

SEQ ID NO: 422363 - DNA, 25 bp, Mus musculus
gaagacacctttaaggaaattctgt

SEQ ID NO: 422364 - DNA, 25 bp, Mus musculus
gaagacaccttttaagacaccgcaa

SEQ ID NO: 422365 - DNA, 25 bp, Mus musculus
gaagacaccttttaggaaattctgt

SEQ ID NO: 422366 - DNA, 25 bp, Mus musculus
gaagacacgaccagacatgtaccac

SEQ ID NO: 422367 - DNA, 25 bp, Mus musculus
gaagacacgacctgacatgtaccac

SEQ ID NO: 422368 - DNA, 25 bp, Mus musculus
gaagacacgaggaaggtgagcacct

SEQ ID NO: 422369 - DNA, 25 bp, Mus musculus
gaagacacgaggtaggtgagcacct

SEQ ID NO: 422370 - DNA, 25 bp, Mus musculus
gaagacacgatcacccaggcaataa

SEQ ID NO: 422371 - DNA, 25 bp, Mus musculus
gaagacacgatctcccaggcaataa

SEQ ID NO: 422372 - DNA, 25 bp, Mus musculus
gaagacacgcccatcactgatcata

SEQ ID NO: 422373 - DNA, 25 bp, Mus musculus
gaagacacgcccttcactgatcata

SEQ ID NO: 422374 - DNA, 25 bp, Mus musculus
gaagacacggaaatttgaggctttt

SEQ ID NO: 422375 - DNA, 25 bp, Mus musculus
gaagacacggaattttgaggctttt

SEQ ID NO: 422376 - DNA, 25 bp, Mus musculus
gaagacacggcaccccttgaggaga

SEQ ID NO: 422377 - DNA, 25 bp, Mus musculus
gaagacacggcagcccttgaggaga

SEQ ID NO: 422378 - DNA, 25 bp, Mus musculus
gaagacacgtgaatgtataccaaag

SEQ ID NO: 422379 - DNA, 25 bp, Mus musculus
gaagacacgtgattgtataccaaag

SEQ ID NO: 422380 - DNA, 25 bp, Mus musculus
gaagacactacacaccctggacaga

SEQ ID NO: 422381 - DNA, 25 bp, Mus musculus
gaagacactacagaccctggacaga

SEQ ID NO: 422382 - DNA, 25 bp, Mus musculus
gaagacactagacgcttcctcacac

SEQ ID NO: 422383 - DNA, 25 bp, Mus musculus
gaagacactagaggcttcctcacac

SEQ ID NO: 422384 - DNA, 25 bp, Mus musculus
gaagacactaggacacccaggcaaa

SEQ ID NO: 422385 - DNA, 25 bp, Mus musculus
gaagacactaggtcacccaggcaaa

SEQ ID NO: 422386 - DNA, 25 bp, Mus musculus
gaagacactagtcagtactccttag

SEQ ID NO: 422387 - DNA, 25 bp, Mus musculus
gaagacactagtgagtactccttag

SEQ ID NO: 422388 - DNA, 25 bp, Mus musculus
gaagacactatcatttaccttggag

SEQ ID NO: 422389 - DNA, 25 bp, Mus musculus
gaagacactatcttttaccttggag

SEQ ID NO: 422390 - DNA, 25 bp, Mus musculus
gaagacactcagagctccaagtctg

SEQ ID NO: 422391 - DNA, 25 bp, Mus musculus
gaagacactcagctttctttacaga

SEQ ID NO: 422392 - DNA, 25 bp, Mus musculus
gaagacactcaggtttctttacaga

SEQ ID NO: 422393 - DNA, 25 bp, Mus musculus
gaagacactcagtgctccaagtctg

SEQ ID NO: 422394 - DNA, 25 bp, Mus musculus
gaagacactgaacaacgacattatg

SEQ ID NO: 422395 - DNA, 25 bp, Mus musculus
gaagacactgaagaacgacattatg

SEQ ID NO: 422396 - DNA, 25 bp, Mus musculus
gaagacactgacagtaacggcgcaa

SEQ ID NO: 422397 - DNA, 25 bp, Mus musculus
gaagacactgactgtaacggcgcaa

SEQ ID NO: 422398 - DNA, 25 bp, Mus musculus
gaagacactgatccggagacctgac

SEQ ID NO: 422399 - DNA, 25 bp, Mus musculus
gaagacactgatgcggagacctgac

SEQ ID NO: 422400 - DNA, 25 bp, Mus musculus
gaagacactgcacaatgaacatgag

SEQ ID NO: 422401 - DNA, 25 bp, Mus musculus
gaagacactgcagaatgaacatgag

SEQ ID NO: 422402 - DNA, 25 bp, Mus musculus
gaagacactgcgactccggagacag

SEQ ID NO: 422403 - DNA, 25 bp, Mus musculus
gaagacactgcgtctccggagacag

SEQ ID NO: 422404 - DNA, 25 bp, Mus musculus
gaagacactgctatgagcatctgaa

SEQ ID NO: 422405 - DNA, 25 bp, Mus musculus
gaagacactgctatgctatatttaa

SEQ ID NO: 422406 - DNA, 25 bp, Mus musculus
gaagacactgctcagccctgaagct

SEQ ID NO: 422407 - DNA, 25 bp, Mus musculus
gaagacactgctgagccctgaagct

SEQ ID NO: 422408 - DNA, 25 bp, Mus musculus
gaagacactgctttgagcatctgaa

SEQ ID NO: 422409 - DNA, 25 bp, Mus musculus
gaagacactgctttgctatatttaa

SEQ ID NO: 422410 - DNA, 25 bp, Mus musculus
gaagacactgtcatttcgtcagaaa

SEQ ID NO: 422411 - DNA, 25 bp, Mus musculus
gaagacactgtcttttcgtcagaaa

SEQ ID NO: 422412 - DNA, 25 bp, Mus musculus
gaagacacttaaattttgaccagta

SEQ ID NO: 422413 - DNA, 25 bp, Mus musculus
gaagacacttaatttttgaccagta

SEQ ID NO: 422414 - DNA, 25 bp, Mus musculus
gaagacacttccctgcatcgccgga

SEQ ID NO: 422415 - DNA, 25 bp, Mus musculus
gaagacacttccgtgcatcgccgga

SEQ ID NO: 422416 - DNA, 25 bp, Mus musculus
gaagacacttcgaattcccaaagcc

SEQ ID NO: 422417 - DNA, 25 bp, Mus musculus
gaagacacttcgtattcccaaagcc

SEQ ID NO: 422418 - DNA, 25 bp, Mus musculus
gaagacacttggaatttactcacag

SEQ ID NO: 422419 - DNA, 25 bp, Mus musculus
gaagacacttggacttgcacagttt

SEQ ID NO: 422420 - DNA, 25 bp, Mus musculus
gaagacacttggtatttactcacag

SEQ ID NO: 422421 - DNA, 25 bp, Mus musculus
gaagacacttggtcttgcacagttt

SEQ ID NO: 422422 - DNA, 25 bp, Mus musculus
gaagacactttcatcctggagctga

SEQ ID NO: 422423 - DNA, 25 bp, Mus musculus
gaagacactttcctgtaatcctgac

SEQ ID NO: 422424 - DNA, 25 bp, Mus musculus
gaagacactttcgtgtaatcctgac

SEQ ID NO: 422425 - DNA, 25 bp, Mus musculus
gaagacactttcttcctggagctga

SEQ ID NO: 422426 - DNA, 25 bp, Mus musculus
gaagacagaacccatctcgttgctc

SEQ ID NO: 422427 - DNA, 25 bp, Mus musculus
gaagacagaaccgatctcgttgctc

SEQ ID NO: 422428 - DNA, 25 bp, Mus musculus
gaagacagaagaatgttggccattc

SEQ ID NO: 422429 - DNA, 25 bp, Mus musculus
gaagacagaagacgcctttccagga

SEQ ID NO: 422430 - DNA, 25 bp, Mus musculus
gaagacagaagaggcctttccagga

SEQ ID NO: 422431 - DNA, 25 bp, Mus musculus
gaagacagaagattgttggccattc

SEQ ID NO: 422432 - DNA, 25 bp, Mus musculus
gaagacagacaactacactcttggg

SEQ ID NO: 422433 - DNA, 25 bp, Mus musculus
gaagacagacaagtacactcttggg

SEQ ID NO: 422434 - DNA, 25 bp, Mus musculus
gaagacagaccacctgctccagcaa

SEQ ID NO: 422435 - DNA, 25 bp, Mus musculus
gaagacagaccagctgctccagcaa

SEQ ID NO: 422436 - DNA, 25 bp, Mus musculus
gaagacagaccccagtgtaaaccta

SEQ ID NO: 422437 - DNA, 25 bp, Mus musculus
gaagacagacccgagtgtaaaccta

SEQ ID NO: 422438 - DNA, 25 bp, Mus musculus
gaagacagacggactgctgtgacac

SEQ ID NO: 422439 - DNA, 25 bp, Mus musculus
gaagacagacggtctgctgtgacac

SEQ ID NO: 422440 - DNA, 25 bp, Mus musculus
gaagacagactgctgcccacagttc

SEQ ID NO: 422441 - DNA, 25 bp, Mus musculus
gaagacagactggtgcccacagttc

SEQ ID NO: 422442 - DNA, 25 bp, Mus musculus
gaagacagacttcaagttatttcca

SEQ ID NO: 422443 - DNA, 25 bp, Mus musculus
gaagacagacttgaagttatttcca

SEQ ID NO: 422444 - DNA, 25 bp, Mus musculus
gaagacagcaacacacaaagagaaa

SEQ ID NO: 422445 - DNA, 25 bp, Mus musculus
gaagacagcaactcacaaagagaaa

SEQ ID NO: 422446 - DNA, 25 bp, Mus musculus
gaagacagcaagatccgcagctttt

SEQ ID NO: 422447 - DNA, 25 bp, Mus musculus
gaagacagcaagcatcgtggatcat

SEQ ID NO: 422448 - DNA, 25 bp, Mus musculus
gaagacagcaaggatcgtggatcat

SEQ ID NO: 422449 - DNA, 25 bp, Mus musculus
gaagacagcaagttccgcagctttt

SEQ ID NO: 422450 - DNA, 25 bp, Mus musculus
gaagacagcaggagataatatccac

SEQ ID NO: 422451 - DNA, 25 bp, Mus musculus
gaagacagcaggtgataatatccac

SEQ ID NO: 422452 - DNA, 25 bp, Mus musculus
gaagacagccatacggactcgctaa

SEQ ID NO: 422453 - DNA, 25 bp, Mus musculus
gaagacagccatctttttcgaaact

SEQ ID NO: 422454 - DNA, 25 bp, Mus musculus
gaagacagccatgtttttcgaaact

SEQ ID NO: 422455 - DNA, 25 bp, Mus musculus
gaagacagccattcggactcgctaa

SEQ ID NO: 422456 - DNA, 25 bp, Mus musculus
gaagacagctacagtgtctaaataa

SEQ ID NO: 422457 - DNA, 25 bp, Mus musculus
gaagacagctactgtgtctaaataa

SEQ ID NO: 422458 - DNA, 25 bp, Mus musculus
gaagacagctgaataacccttgttc

SEQ ID NO: 422459 - DNA, 25 bp, Mus musculus
gaagacagctgattaacccttgttc

SEQ ID NO: 422460 - DNA, 25 bp, Mus musculus
gaagacagctgcaccagagtttagc

SEQ ID NO: 422461 - DNA, 25 bp, Mus musculus
gaagacagctgctccagagtttagc

SEQ ID NO: 422462 - DNA, 25 bp, Mus musculus
gaagacagctggaagctcctgtgcc

SEQ ID NO: 422463 - DNA, 25 bp, Mus musculus
gaagacagctggtagctcctgtgcc

SEQ ID NO: 422464 - DNA, 25 bp, Mus musculus
gaagacagctgtcctgctctcttaa

SEQ ID NO: 422465 - DNA, 25 bp, Mus musculus
gaagacagctgtgctgctctcttaa

SEQ ID NO: 422466 - DNA, 25 bp, Mus musculus
gaagacagcttaactaactgtgcag

SEQ ID NO: 422467 - DNA, 25 bp, Mus musculus
gaagacagcttatctaactgtgcag

SEQ ID NO: 422468 - DNA, 25 bp, Mus musculus
gaagacagctttaaggagttgaaac

SEQ ID NO: 422469 - DNA, 25 bp, Mus musculus
gaagacagctttcacatcatccact

SEQ ID NO: 422470 - DNA, 25 bp, Mus musculus
gaagacagctttgacatcatccact

SEQ ID NO: 422471 - DNA, 25 bp, Mus musculus
gaagacagcttttaggagttgaaac

SEQ ID NO: 422472 - DNA, 25 bp, Mus musculus
gaagacaggactccggtccccacta

SEQ ID NO: 422473 - DNA, 25 bp, Mus musculus
gaagacaggactgcggtccccacta

SEQ ID NO: 422474 - DNA, 25 bp, Mus musculus
gaagacaggcaacactcagagtaca

SEQ ID NO: 422475 - DNA, 25 bp, Mus musculus
gaagacaggcaagactcagagtaca

SEQ ID NO: 422476 - DNA, 25 bp, Mus musculus
gaagacaggcagacatttcttgaat

SEQ ID NO: 422477 - DNA, 25 bp, Mus musculus
gaagacaggcagtcatttcttgaat

SEQ ID NO: 422478 - DNA, 25 bp, Mus musculus
gaagacaggccaccaacactcctag

SEQ ID NO: 422479 - DNA, 25 bp, Mus musculus
gaagacaggccagcaacactcctag

SEQ ID NO: 422480 - DNA, 25 bp, Mus musculus
gaagacaggcctacacacagacttg

SEQ ID NO: 422481 - DNA, 25 bp, Mus musculus
gaagacaggcctcctctagtttttg

SEQ ID NO: 422482 - DNA, 25 bp, Mus musculus
gaagacaggcctgctctagtttttg

SEQ ID NO: 422483 - DNA, 25 bp, Mus musculus
gaagacaggccttcacacagacttg

SEQ ID NO: 422484 - DNA, 25 bp, Mus musculus
gaagacaggcttacctcaagaagca

SEQ ID NO: 422485 - DNA, 25 bp, Mus musculus
gaagacaggctttcctcaagaagca

SEQ ID NO: 422486 - DNA, 25 bp, Mus musculus
gaagacagggaaagtatccagatgg

SEQ ID NO: 422487 - DNA, 25 bp, Mus musculus
gaagacagggaatgtatccagatgg

SEQ ID NO: 422488 - DNA, 25 bp, Mus musculus
gaagacagggcaattccaccaggat

SEQ ID NO: 422489 - DNA, 25 bp, Mus musculus
gaagacagggcatttccaccaggat

SEQ ID NO: 422490 - DNA, 25 bp, Mus musculus
gaagacagggctcctctttttggaa

SEQ ID NO: 422491 - DNA, 25 bp, Mus musculus
gaagacagggctgctctttttggaa

SEQ ID NO: 422492 - DNA, 25 bp, Mus musculus
gaagacagtaagagcccaggacata

SEQ ID NO: 422493 - DNA, 25 bp, Mus musculus
gaagacagtaagtgcccaggacata

SEQ ID NO: 422494 - DNA, 25 bp, Mus musculus
gaagacagtcgacgttagcatacac

SEQ ID NO: 422495 - DNA, 25 bp, Mus musculus
gaagacagtcgaggttagcatacac

SEQ ID NO: 422496 - DNA, 25 bp, Mus musculus
gaagacagtcgcaatgctcacactc

SEQ ID NO: 422497 - DNA, 25 bp, Mus musculus
gaagacagtcgctatgctcacactc

SEQ ID NO: 422498 - DNA, 25 bp, Mus musculus
gaagacagtctgattgatctaagat

SEQ ID NO: 422499 - DNA, 25 bp, Mus musculus
gaagacagtctgtttgatctaagat

SEQ ID NO: 422500 - DNA, 25 bp, Mus musculus
gaagacagtgccaaaaatcagttcc

SEQ ID NO: 422501 - DNA, 25 bp, Mus musculus
gaagacagtgcctaaaatcagttcc

SEQ ID NO: 422502 - DNA, 25 bp, Mus musculus
gaagacagtgctacagactctgagc

SEQ ID NO: 422503 - DNA, 25 bp, Mus musculus
gaagacagtgcttcagactctgagc

SEQ ID NO: 422504 - DNA, 25 bp, Mus musculus
gaagacagtggaccctgggtcacca

SEQ ID NO: 422505 - DNA, 25 bp, Mus musculus
gaagacagtggagcctgggtcacca

SEQ ID NO: 422506 - DNA, 25 bp, Mus musculus
gaagacagtgtcacatctgcgtctc

SEQ ID NO: 422507 - DNA, 25 bp, Mus musculus
gaagacagtgtctcatctgcgtctc

SEQ ID NO: 422508 - DNA, 25 bp, Mus musculus
gaagacagttccactctgaaaagct

SEQ ID NO: 422509 - DNA, 25 bp, Mus musculus
gaagacagttcctctctgaaaagct

SEQ ID NO: 422510 - DNA, 25 bp, Mus musculus
gaagacagtttcagtaccggctcca

SEQ ID NO: 422511 - DNA, 25 bp, Mus musculus
gaagacagtttctgtaccggctcca

SEQ ID NO: 422512 - DNA, 25 bp, Mus musculus
gaagacatacagatcaccaataggt

SEQ ID NO: 422513 - DNA, 25 bp, Mus musculus
gaagacatacagcagttaaacccta

SEQ ID NO: 422514 - DNA, 25 bp, Mus musculus
gaagacatacaggagttaaacccta

SEQ ID NO: 422515 - DNA, 25 bp, Mus musculus
gaagacatacagttcaccaataggt

SEQ ID NO: 422516 - DNA, 25 bp, Mus musculus
gaagacataccccatcagcatggat

SEQ ID NO: 422517 - DNA, 25 bp, Mus musculus
gaagacatacccgatcagcatggat

SEQ ID NO: 422518 - DNA, 25 bp, Mus musculus
gaagacatactacgaccctcagttc

SEQ ID NO: 422519 - DNA, 25 bp, Mus musculus
gaagacatactaggaccctcagttc

SEQ ID NO: 422520 - DNA, 25 bp, Mus musculus
gaagacatagctcagccattacgag

SEQ ID NO: 422521 - DNA, 25 bp, Mus musculus
gaagacatagctccatgtgtgacat

SEQ ID NO: 422522 - DNA, 25 bp, Mus musculus
gaagacatagctgagccattacgag

SEQ ID NO: 422523 - DNA, 25 bp, Mus musculus
gaagacatagctgcatgtgtgacat

SEQ ID NO: 422524 - DNA, 25 bp, Mus musculus
gaagacatattcctgcacatcacca

SEQ ID NO: 422525 - DNA, 25 bp, Mus musculus
gaagacatattcgtgcacatcacca

SEQ ID NO: 422526 - DNA, 25 bp, Mus musculus
gaagacatcatcaggccaggccaaa

SEQ ID NO: 422527 - DNA, 25 bp, Mus musculus
gaagacatcatctggccaggccaaa

SEQ ID NO: 422528 - DNA, 25 bp, Mus musculus
gaagacatcatgacctgtccattta

SEQ ID NO: 422529 - DNA, 25 bp, Mus musculus
gaagacatcatgtcctgtccattta

SEQ ID NO: 422530 - DNA, 25 bp, Mus musculus
gaagacatccaaaggaccccacaaa

SEQ ID NO: 422531 - DNA, 25 bp, Mus musculus
gaagacatccaatggaccccacaaa

SEQ ID NO: 422532 - DNA, 25 bp, Mus musculus
gaagacatccatacctaaatctaag

SEQ ID NO: 422533 - DNA, 25 bp, Mus musculus
gaagacatccatcacgcatgttgga

SEQ ID NO: 422534 - DNA, 25 bp, Mus musculus
gaagacatccatgacgcatgttgga

SEQ ID NO: 422535 - DNA, 25 bp, Mus musculus
gaagacatccattcctaaatctaag

SEQ ID NO: 422536 - DNA, 25 bp, Mus musculus
gaagacatcccacttactacaacca

SEQ ID NO: 422537 - DNA, 25 bp, Mus musculus
gaagacatcccagttactacaacca

SEQ ID NO: 422538 - DNA, 25 bp, Mus musculus
gaagacatcccgattatcacaaaga

SEQ ID NO: 422539 - DNA, 25 bp, Mus musculus
gaagacatcccgtttatcacaaaga

SEQ ID NO: 422540 - DNA, 25 bp, Mus musculus
gaagacatccttaatctgcaaacag

SEQ ID NO: 422541 - DNA, 25 bp, Mus musculus
gaagacatccttatacagctagaac

SEQ ID NO: 422542 - DNA, 25 bp, Mus musculus
gaagacatcctttatctgcaaacag

SEQ ID NO: 422543 - DNA, 25 bp, Mus musculus
gaagacatccttttacagctagaac

SEQ ID NO: 422544 - DNA, 25 bp, Mus musculus
gaagacatcgacagtttacctacat

SEQ ID NO: 422545 - DNA, 25 bp, Mus musculus
gaagacatcgactgtttacctacat

SEQ ID NO: 422546 - DNA, 25 bp, Mus musculus
gaagacatcgggattataaaataca

SEQ ID NO: 422547 - DNA, 25 bp, Mus musculus
gaagacatcgggtttataaaataca

SEQ ID NO: 422548 - DNA, 25 bp, Mus musculus
gaagacatcgttaatcgctaccaca

SEQ ID NO: 422549 - DNA, 25 bp, Mus musculus
gaagacatcgtttatcgctaccaca

SEQ ID NO: 422550 - DNA, 25 bp, Mus musculus
gaagacatctataacaggctcctat

SEQ ID NO: 422551 - DNA, 25 bp, Mus musculus
gaagacatctattacaggctcctat

SEQ ID NO: 422552 - DNA, 25 bp, Mus musculus
gaagacatctggaatgttcatcttg

SEQ ID NO: 422553 - DNA, 25 bp, Mus musculus
gaagacatctggtatgttcatcttg

SEQ ID NO: 422554 - DNA, 25 bp, Mus musculus
gaagacatctgtatctcatttccca

SEQ ID NO: 422555 - DNA, 25 bp, Mus musculus
gaagacatctgtttctcatttccca

SEQ ID NO: 422556 - DNA, 25 bp, Mus musculus
gaagacatcttcaacctagcgggca

SEQ ID NO: 422557 - DNA, 25 bp, Mus musculus
gaagacatcttctacctagcgggca

SEQ ID NO: 422558 - DNA, 25 bp, Mus musculus
gaagacatgaagacaccattttcag

SEQ ID NO: 422559 - DNA, 25 bp, Mus musculus
gaagacatgaagtcaccattttcag

SEQ ID NO: 422560 - DNA, 25 bp, Mus musculus
gaagacatgatcagccttttccatt

SEQ ID NO: 422561 - DNA, 25 bp, Mus musculus
gaagacatgatctgccttttccatt

SEQ ID NO: 422562 - DNA, 25 bp, Mus musculus
gaagacatggatatgttatgtcccc

SEQ ID NO: 422563 - DNA, 25 bp, Mus musculus
gaagacatggatttgttatgtcccc

SEQ ID NO: 422564 - DNA, 25 bp, Mus musculus
gaagacatgtcactctggctgcaga

SEQ ID NO: 422565 - DNA, 25 bp, Mus musculus
gaagacatgtcagtctggctgcaga

SEQ ID NO: 422566 - DNA, 25 bp, Mus musculus
gaagacatgtctacatctacatggc

SEQ ID NO: 422567 - DNA, 25 bp, Mus musculus
gaagacatgtcttcatctacatggc

SEQ ID NO: 422568 - DNA, 25 bp, Mus musculus
gaagacatgtttaagacaatactca

SEQ ID NO: 422569 - DNA, 25 bp, Mus musculus
gaagacatgttttagacaatactca

SEQ ID NO: 422570 - DNA, 25 bp, Mus musculus
gaagacattacaaccagtgcacagt

SEQ ID NO: 422571 - DNA, 25 bp, Mus musculus
gaagacattacatccagtgcacagt

SEQ ID NO: 422572 - DNA, 25 bp, Mus musculus
gaagacattatcctcctgtgaccaa

SEQ ID NO: 422573 - DNA, 25 bp, Mus musculus
gaagacattatcgtcctgtgaccaa

SEQ ID NO: 422574 - DNA, 25 bp, Mus musculus
gaagacattcacatcctgttagctt

SEQ ID NO: 422575 - DNA, 25 bp, Mus musculus
gaagacattcacattggttatccca

SEQ ID NO: 422576 - DNA, 25 bp, Mus musculus
gaagacattcacttcctgttagctt

SEQ ID NO: 422577 - DNA, 25 bp, Mus musculus
gaagacattcactttggttatccca

SEQ ID NO: 422578 - DNA, 25 bp, Mus musculus
gaagacattccaatactgcttaata

SEQ ID NO: 422579 - DNA, 25 bp, Mus musculus
gaagacattccattactgcttaata

SEQ ID NO: 422580 - DNA, 25 bp, Mus musculus
gaagacattctccagcatcaagata

SEQ ID NO: 422581 - DNA, 25 bp, Mus musculus
gaagacattctcgagcatcaagata

SEQ ID NO: 422582 - DNA, 25 bp, Mus musculus
gaagacattgccatgcagagccgtc

SEQ ID NO: 422583 - DNA, 25 bp, Mus musculus
gaagacattgccttgcagagccgtc

SEQ ID NO: 422584 - DNA, 25 bp, Mus musculus
gaagacattggcactattcctattt

SEQ ID NO: 422585 - DNA, 25 bp, Mus musculus
gaagacattggcagacttgcctgcc

SEQ ID NO: 422586 - DNA, 25 bp, Mus musculus
gaagacattggcattcacgctgaga

SEQ ID NO: 422587 - DNA, 25 bp, Mus musculus
gaagacattggccagtcctagtcat

SEQ ID NO: 422588 - DNA, 25 bp, Mus musculus
gaagacattggcgagtcctagtcat

SEQ ID NO: 422589 - DNA, 25 bp, Mus musculus
gaagacattggctctattcctattt

SEQ ID NO: 422590 - DNA, 25 bp, Mus musculus
gaagacattggctgacttgcctgcc

SEQ ID NO: 422591 - DNA, 25 bp, Mus musculus
gaagacattggctttcacgctgaga

SEQ ID NO: 422592 - DNA, 25 bp, Mus musculus
gaagacattgggacagcagctgaat

SEQ ID NO: 422593 - DNA, 25 bp, Mus musculus
gaagacattgggtcagcagctgaat

SEQ ID NO: 422594 - DNA, 25 bp, Mus musculus
gaagacattggtcgcagtctcctga

SEQ ID NO: 422595 - DNA, 25 bp, Mus musculus
gaagacattggtggcagtctcctga

SEQ ID NO: 422596 - DNA, 25 bp, Mus musculus
gaagacatttacctggagtggacca

SEQ ID NO: 422597 - DNA, 25 bp, Mus musculus
gaagacatttacgtggagtggacca

SEQ ID NO: 422598 - DNA, 25 bp, Mus musculus
gaagacatttatagctcccttagag

SEQ ID NO: 422599 - DNA, 25 bp, Mus musculus
gaagacatttattgctcccttagag

SEQ ID NO: 422600 - DNA, 25 bp, Mus musculus
gaagacatttgaaccccaactatgg

SEQ ID NO: 422601 - DNA, 25 bp, Mus musculus
gaagacatttgaccactttgctccc

SEQ ID NO: 422602 - DNA, 25 bp, Mus musculus
gaagacatttgagcactttgctccc

SEQ ID NO: 422603 - DNA, 25 bp, Mus musculus
gaagacatttgatccccaactatgg

SEQ ID NO: 422604 - DNA, 25 bp, Mus musculus
gaagacatttggataccccgcgagg

SEQ ID NO: 422605 - DNA, 25 bp, Mus musculus
gaagacatttggttaccccgcgagg

SEQ ID NO: 422606 - DNA, 25 bp, Mus musculus
gaagacatttttcctagcagctttt

SEQ ID NO: 422607 - DNA, 25 bp, Mus musculus
gaagacatttttgctagcagctttt

SEQ ID NO: 422608 - DNA, 25 bp, Mus musculus
gaagaccaacttccagtccagtgac

SEQ ID NO: 422609 - DNA, 25 bp, Mus musculus
gaagaccaacttgcagtccagtgac

SEQ ID NO: 422610 - DNA, 25 bp, Mus musculus
gaagaccaagaaccagcagcggaag

SEQ ID NO: 422611 - DNA, 25 bp, Mus musculus
gaagaccaagaagcagcagcggaag

SEQ ID NO: 422612 - DNA, 25 bp, Mus musculus
gaagaccaagctcttacaaatgtgc

SEQ ID NO: 422613 - DNA, 25 bp, Mus musculus
gaagaccaagctgttacaaatgtgc

SEQ ID NO: 422614 - DNA, 25 bp, Mus musculus
gaagaccaaggaactctgagccctc

SEQ ID NO: 422615 - DNA, 25 bp, Mus musculus
gaagaccaaggacatcaggtgcagt

SEQ ID NO: 422616 - DNA, 25 bp, Mus musculus
gaagaccaaggagatcaggtgcagt

SEQ ID NO: 422617 - DNA, 25 bp, Mus musculus
gaagaccaaggatctctgagccctc

SEQ ID NO: 422618 - DNA, 25 bp, Mus musculus
gaagaccaatcacctaacagaaata

SEQ ID NO: 422619 - DNA, 25 bp, Mus musculus
gaagaccaatcagctaacagaaata

SEQ ID NO: 422620 - DNA, 25 bp, Mus musculus
gaagaccacacaactctgatcggag

SEQ ID NO: 422621 - DNA, 25 bp, Mus musculus
gaagaccacacatctctgatcggag

SEQ ID NO: 422622 - DNA, 25 bp, Mus musculus
gaagaccacagtcttcaaatctttg

SEQ ID NO: 422623 - DNA, 25 bp, Mus musculus
gaagaccacagtgttcaaatctttg

SEQ ID NO: 422624 - DNA, 25 bp, Mus musculus
gaagaccacatacttgtctgccatg

SEQ ID NO: 422625 - DNA, 25 bp, Mus musculus
gaagaccacatagttgtctgccatg

SEQ ID NO: 422626 - DNA, 25 bp, Mus musculus
gaagaccacatgaggcctcacaagt

SEQ ID NO: 422627 - DNA, 25 bp, Mus musculus
gaagaccacatgtggcctcacaagt

SEQ ID NO: 422628 - DNA, 25 bp, Mus musculus
gaagaccaccctcaaatggttatct

SEQ ID NO: 422629 - DNA, 25 bp, Mus musculus
gaagaccaccctgaaatggttatct

SEQ ID NO: 422630 - DNA, 25 bp, Mus musculus
gaagaccaccggaggatgtgtctgt

SEQ ID NO: 422631 - DNA, 25 bp, Mus musculus
gaagaccaccggtggatgtgtctgt

SEQ ID NO: 422632 - DNA, 25 bp, Mus musculus
gaagaccactagacctgatcatgta

SEQ ID NO: 422633 - DNA, 25 bp, Mus musculus
gaagaccactagtcctgatcatgta

SEQ ID NO: 422634 - DNA, 25 bp, Mus musculus
gaagaccactgactctgcatgggag

SEQ ID NO: 422635 - DNA, 25 bp, Mus musculus
gaagaccactgagtctgcatgggag

SEQ ID NO: 422636 - DNA, 25 bp, Mus musculus
gaagaccactggaggtgcctgttgt

SEQ ID NO: 422637 - DNA, 25 bp, Mus musculus
gaagaccactggtggtgcctgttgt

SEQ ID NO: 422638 - DNA, 25 bp, Mus musculus
gaagaccactttactcccaataagg

SEQ ID NO: 422639 - DNA, 25 bp, Mus musculus
gaagaccacttttctcccaataagg

SEQ ID NO: 422640 - DNA, 25 bp, Mus musculus
gaagaccagcagcttcgctacaatg

SEQ ID NO: 422641 - DNA, 25 bp, Mus musculus
gaagaccagcaggttcgctacaatg

SEQ ID NO: 422642 - DNA, 25 bp, Mus musculus
gaagaccagcgtcctcttggactgc

SEQ ID NO: 422643 - DNA, 25 bp, Mus musculus
gaagaccagcgtgctcttggactgc

SEQ ID NO: 422644 - DNA, 25 bp, Mus musculus
gaagaccaggacaacagctttccta

SEQ ID NO: 422645 - DNA, 25 bp, Mus musculus
gaagaccaggactacagctttccta

SEQ ID NO: 422646 - DNA, 25 bp, Mus musculus
gaagaccaggatacccttgaattgt

SEQ ID NO: 422647 - DNA, 25 bp, Mus musculus
gaagaccaggattcccttgaattgt

SEQ ID NO: 422648 - DNA, 25 bp, Mus musculus
gaagaccagggcctcagaagacaag

SEQ ID NO: 422649 - DNA, 25 bp, Mus musculus
gaagaccagggcgtcagaagacaag

SEQ ID NO: 422650 - DNA, 25 bp, Mus musculus
gaagaccagtgaaggccctgcagta

SEQ ID NO: 422651 - DNA, 25 bp, Mus musculus
gaagaccagtgactctctcagccca

SEQ ID NO: 422652 - DNA, 25 bp, Mus musculus
gaagaccagtgagtctctcagccca

SEQ ID NO: 422653 - DNA, 25 bp, Mus musculus
gaagaccagtgatggccctgcagta

SEQ ID NO: 422654 - DNA, 25 bp, Mus musculus
gaagaccataacactttttgttgat

SEQ ID NO: 422655 - DNA, 25 bp, Mus musculus
gaagaccataactctttttgttgat

SEQ ID NO: 422656 - DNA, 25 bp, Mus musculus
gaagaccataataaaagccctagat

SEQ ID NO: 422657 - DNA, 25 bp, Mus musculus
gaagaccataattaaagccctagat

SEQ ID NO: 422658 - DNA, 25 bp, Mus musculus
gaagaccatagcactcacatttcag

SEQ ID NO: 422659 - DNA, 25 bp, Mus musculus
gaagaccatagctctcacatttcag

SEQ ID NO: 422660 - DNA, 25 bp, Mus musculus
gaagaccatgaacggctgccaacag

SEQ ID NO: 422661 - DNA, 25 bp, Mus musculus
gaagaccatgaagggctgccaacag

SEQ ID NO: 422662 - DNA, 25 bp, Mus musculus
gaagaccatgagcttcctgcacagc

SEQ ID NO: 422663 - DNA, 25 bp, Mus musculus
gaagaccatgaggttcctgcacagc

SEQ ID NO: 422664 - DNA, 25 bp, Mus musculus
gaagaccattccacagcagagggtt

SEQ ID NO: 422665 - DNA, 25 bp, Mus musculus
gaagaccattcctcagcagagggtt

SEQ ID NO: 422666 - DNA, 25 bp, Mus musculus
gaagaccattgactacatccagttt

SEQ ID NO: 422667 - DNA, 25 bp, Mus musculus
gaagaccattgagtacatccagttt

SEQ ID NO: 422668 - DNA, 25 bp, Mus musculus
gaagaccatttcaggtcggcagcat

SEQ ID NO: 422669 - DNA, 25 bp, Mus musculus
gaagaccatttctggtcggcagcat

SEQ ID NO: 422670 - DNA, 25 bp, Mus musculus
gaagacccaacaacagactcaaact

SEQ ID NO: 422671 - DNA, 25 bp, Mus musculus
gaagacccaacatcagactcaaact

SEQ ID NO: 422672 - DNA, 25 bp, Mus musculus
gaagacccaagcattccatcagtcc

SEQ ID NO: 422673 - DNA, 25 bp, Mus musculus
gaagacccaagctttccatcagtcc

SEQ ID NO: 422674 - DNA, 25 bp, Mus musculus
gaagacccaatgagtgacctaccaa

SEQ ID NO: 422675 - DNA, 25 bp, Mus musculus
gaagacccaatgtgtgacctaccaa

SEQ ID NO: 422676 - DNA, 25 bp, Mus musculus
gaagacccacctaccaacagatctg

SEQ ID NO: 422677 - DNA, 25 bp, Mus musculus
gaagacccacctagaatgcgctgtg

SEQ ID NO: 422678 - DNA, 25 bp, Mus musculus
gaagacccaccttccaacagatctg

SEQ ID NO: 422679 - DNA, 25 bp, Mus musculus
gaagacccaccttgaatgcgctgtg

SEQ ID NO: 422680 - DNA, 25 bp, Mus musculus
gaagacccactaccctgtcttttga

SEQ ID NO: 422681 - DNA, 25 bp, Mus musculus
gaagacccactagcctgtcttttga

SEQ ID NO: 422682 - DNA, 25 bp, Mus musculus
gaagacccagatcatgacctagata

SEQ ID NO: 422683 - DNA, 25 bp, Mus musculus
gaagacccagatgatgacctagata

SEQ ID NO: 422684 - DNA, 25 bp, Mus musculus
gaagacccagcacgagacgagtatg

SEQ ID NO: 422685 - DNA, 25 bp, Mus musculus
gaagacccagcaggagacgagtatg

SEQ ID NO: 422686 - DNA, 25 bp, Mus musculus
gaagacccagctctagaaaggaccc

SEQ ID NO: 422687 - DNA, 25 bp, Mus musculus
gaagacccagctgtagaaaggaccc

SEQ ID NO: 422688 - DNA, 25 bp, Mus musculus
gaagacccaggcaaaatatgaactg

SEQ ID NO: 422689 - DNA, 25 bp, Mus musculus
gaagacccaggcatatggcattcta

SEQ ID NO: 422690 - DNA, 25 bp, Mus musculus
gaagacccaggctaaatatgaactg

SEQ ID NO: 422691 - DNA, 25 bp, Mus musculus
gaagacccaggcttatggcattcta

SEQ ID NO: 422692 - DNA, 25 bp, Mus musculus
gaagacccagtacctcagcagcgga

SEQ ID NO: 422693 - DNA, 25 bp, Mus musculus
gaagacccagtagctcagcagcgga

SEQ ID NO: 422694 - DNA, 25 bp, Mus musculus
gaagacccatatcttttgctttgtg

SEQ ID NO: 422695 - DNA, 25 bp, Mus musculus
gaagacccatatgttttgctttgtg

SEQ ID NO: 422696 - DNA, 25 bp, Mus musculus
gaagacccatgaaagaacctgcagt

SEQ ID NO: 422697 - DNA, 25 bp, Mus musculus
gaagacccatgaaagtaagctttga

SEQ ID NO: 422698 - DNA, 25 bp, Mus musculus
gaagacccatgatagaacctgcagt

SEQ ID NO: 422699 - DNA, 25 bp, Mus musculus
gaagacccatgatagtaagctttga

SEQ ID NO: 422700 - DNA, 25 bp, Mus musculus
gaagacccatttaacagctggtgat

SEQ ID NO: 422701 - DNA, 25 bp, Mus musculus
gaagacccattttacagctggtgat

SEQ ID NO: 422702 - DNA, 25 bp, Mus musculus
gaagaccccaaacttcctattgaag

SEQ ID NO: 422703 - DNA, 25 bp, Mus musculus
gaagaccccaaagttcctattgaag

SEQ ID NO: 422704 - DNA, 25 bp, Mus musculus
gaagaccccaatcagtttgttcctt

SEQ ID NO: 422705 - DNA, 25 bp, Mus musculus
gaagaccccaatgagtttgttcctt

SEQ ID NO: 422706 - DNA, 25 bp, Mus musculus
gaagaccccagtcagtgagcatgtt

SEQ ID NO: 422707 - DNA, 25 bp, Mus musculus
gaagaccccagtgagtgagcatgtt

SEQ ID NO: 422708 - DNA, 25 bp, Mus musculus
gaagaccccatacgtgatcctgtgt

SEQ ID NO: 422709 - DNA, 25 bp, Mus musculus
gaagaccccataggtgatcctgtgt

SEQ ID NO: 422710 - DNA, 25 bp, Mus musculus
gaagaccccttccaaattacacatt

SEQ ID NO: 422711 - DNA, 25 bp, Mus musculus
gaagaccccttccatccccagagtg

SEQ ID NO: 422712 - DNA, 25 bp, Mus musculus
gaagaccccttcgaaattacacatt

SEQ ID NO: 422713 - DNA, 25 bp, Mus musculus
gaagaccccttcgatccccagagtg

SEQ ID NO: 422714 - DNA, 25 bp, Mus musculus
gaagaccccttgcacaaagaggcct

SEQ ID NO: 422715 - DNA, 25 bp, Mus musculus
gaagaccccttggacaaagaggcct

SEQ ID NO: 422716 - DNA, 25 bp, Mus musculus
gaagacccgaagaagcccaacaatg

SEQ ID NO: 422717 - DNA, 25 bp, Mus musculus
gaagacccgaagtagcccaacaatg

SEQ ID NO: 422718 - DNA, 25 bp, Mus musculus
gaagacccggaaatgaagctccttt

SEQ ID NO: 422719 - DNA, 25 bp, Mus musculus
gaagacccggaactcatcccagaga

SEQ ID NO: 422720 - DNA, 25 bp, Mus musculus
gaagacccggaagtcatcccagaga

SEQ ID NO: 422721 - DNA, 25 bp, Mus musculus
gaagacccggaattgaagctccttt

SEQ ID NO: 422722 - DNA, 25 bp, Mus musculus
gaagacccgggaaccttctatttct

SEQ ID NO: 422723 - DNA, 25 bp, Mus musculus
gaagacccgggatccttctatttct

SEQ ID NO: 422724 - DNA, 25 bp, Mus musculus
gaagacccgggtcttgaataattat

SEQ ID NO: 422725 - DNA, 25 bp, Mus musculus
gaagacccgggtgttgaataattat

SEQ ID NO: 422726 - DNA, 25 bp, Mus musculus
gaagaccctaagcacaatgatcgca

SEQ ID NO: 422727 - DNA, 25 bp, Mus musculus
gaagaccctaaggacaatgatcgca

SEQ ID NO: 422728 - DNA, 25 bp, Mus musculus
gaagaccctaatctagtcccgtcca

SEQ ID NO: 422729 - DNA, 25 bp, Mus musculus
gaagaccctaatgtagtcccgtcca

SEQ ID NO: 422730 - DNA, 25 bp, Mus musculus
gaagaccctataagagtactcataa

SEQ ID NO: 422731 - DNA, 25 bp, Mus musculus
gaagaccctatatgagtactcataa

SEQ ID NO: 422732 - DNA, 25 bp, Mus musculus
gaagaccctcacactgtaaggctct

SEQ ID NO: 422733 - DNA, 25 bp, Mus musculus
gaagaccctcactctgtaaggctct

SEQ ID NO: 422734 - DNA, 25 bp, Mus musculus
gaagaccctcatataacgtcagtgg

SEQ ID NO: 422735 - DNA, 25 bp, Mus musculus
gaagaccctcatttaacgtcagtgg

SEQ ID NO: 422736 - DNA, 25 bp, Mus musculus
gaagaccctctcctaatagcagatg

SEQ ID NO: 422737 - DNA, 25 bp, Mus musculus
gaagaccctctcgtaatagcagatg

SEQ ID NO: 422738 - DNA, 25 bp, Mus musculus
gaagaccctcttatgtagtgataga

SEQ ID NO: 422739 - DNA, 25 bp, Mus musculus
gaagaccctcttctgaggacctcac

SEQ ID NO: 422740 - DNA, 25 bp, Mus musculus
gaagaccctcttgtgaggacctcac

SEQ ID NO: 422741 - DNA, 25 bp, Mus musculus
gaagaccctcttttgtagtgataga

SEQ ID NO: 422742 - DNA, 25 bp, Mus musculus
gaagaccctgcaatattccattcag

SEQ ID NO: 422743 - DNA, 25 bp, Mus musculus
gaagaccctgcaatgagcatggtgc

SEQ ID NO: 422744 - DNA, 25 bp, Mus musculus
gaagaccctgcacgatttcaaacac

SEQ ID NO: 422745 - DNA, 25 bp, Mus musculus
gaagaccctgcaggatttcaaacac

SEQ ID NO: 422746 - DNA, 25 bp, Mus musculus
gaagaccctgcattattccattcag

SEQ ID NO: 422747 - DNA, 25 bp, Mus musculus
gaagaccctgcattgagcatggtgc

SEQ ID NO: 422748 - DNA, 25 bp, Mus musculus
gaagaccctgcgctatatattgttc

SEQ ID NO: 422749 - DNA, 25 bp, Mus musculus
gaagaccctgcggtatatattgttc

SEQ ID NO: 422750 - DNA, 25 bp, Mus musculus
gaagaccctgctacttgagattttt

SEQ ID NO: 422751 - DNA, 25 bp, Mus musculus
gaagaccctgctcgctctgaaacaa

SEQ ID NO: 422752 - DNA, 25 bp, Mus musculus
gaagaccctgctcggaaagcctagg

SEQ ID NO: 422753 - DNA, 25 bp, Mus musculus
gaagaccctgctggctctgaaacaa

SEQ ID NO: 422754 - DNA, 25 bp, Mus musculus
gaagaccctgctgggaaagcctagg

SEQ ID NO: 422755 - DNA, 25 bp, Mus musculus
gaagaccctgcttcttgagattttt

SEQ ID NO: 422756 - DNA, 25 bp, Mus musculus
gaagaccctggacagcccagagtcc

SEQ ID NO: 422757 - DNA, 25 bp, Mus musculus
gaagaccctggagagcccagagtcc

SEQ ID NO: 422758 - DNA, 25 bp, Mus musculus
gaagaccctgtccagacttgggaaa

SEQ ID NO: 422759 - DNA, 25 bp, Mus musculus
gaagaccctgtcgagacttgggaaa

SEQ ID NO: 422760 - DNA, 25 bp, Mus musculus
gaagaccctgttattgcagagtaca

SEQ ID NO: 422761 - DNA, 25 bp, Mus musculus
gaagaccctgtttttgcagagtaca

SEQ ID NO: 422762 - DNA, 25 bp, Mus musculus
gaagacccttgtactggactgtcac

SEQ ID NO: 422763 - DNA, 25 bp, Mus musculus
gaagacccttgttctggactgtcac

SEQ ID NO: 422764 - DNA, 25 bp, Mus musculus
gaagaccgcagaagcctaggccgag

SEQ ID NO: 422765 - DNA, 25 bp, Mus musculus
gaagaccgcagatgcctaggccgag

SEQ ID NO: 422766 - DNA, 25 bp, Mus musculus
gaagaccggaatagtttgctgctgt

SEQ ID NO: 422767 - DNA, 25 bp, Mus musculus
gaagaccggaattgtttgctgctgt

SEQ ID NO: 422768 - DNA, 25 bp, Mus musculus
gaagaccgtccccttcaagagtggc

SEQ ID NO: 422769 - DNA, 25 bp, Mus musculus
gaagaccgtcccgttcaagagtggc

SEQ ID NO: 422770 - DNA, 25 bp, Mus musculus
gaagaccgtgaaccttgctacaccg

SEQ ID NO: 422771 - DNA, 25 bp, Mus musculus
gaagaccgtgaagcttgctacaccg

SEQ ID NO: 422772 - DNA, 25 bp, Mus musculus
gaagacctaaacaacggcgtgacgc

SEQ ID NO: 422773 - DNA, 25 bp, Mus musculus
gaagacctaaactacggcgtgacgc

SEQ ID NO: 422774 - DNA, 25 bp, Mus musculus
gaagacctaaagatgagccctgtat

SEQ ID NO: 422775 - DNA, 25 bp, Mus musculus
gaagacctaaagttgagccctgtat

SEQ ID NO: 422776 - DNA, 25 bp, Mus musculus
gaagacctaaccatgagaaagagaa

SEQ ID NO: 422777 - DNA, 25 bp, Mus musculus
gaagacctaaccttgagaaagagaa

SEQ ID NO: 422778 - DNA, 25 bp, Mus musculus
gaagacctaactaaatcaattagat

SEQ ID NO: 422779 - DNA, 25 bp, Mus musculus
gaagacctaacttaatcaattagat

SEQ ID NO: 422780 - DNA, 25 bp, Mus musculus
gaagacctaagtatcggctgtccca

SEQ ID NO: 422781 - DNA, 25 bp, Mus musculus
gaagacctaagtttcggctgtccca

SEQ ID NO: 422782 - DNA, 25 bp, Mus musculus
gaagacctacctacaccatttttat

SEQ ID NO: 422783 - DNA, 25 bp, Mus musculus
gaagacctaccttcaccatttttat

SEQ ID NO: 422784 - DNA, 25 bp, Mus musculus
gaagacctactccaaaatccatcag

SEQ ID NO: 422785 - DNA, 25 bp, Mus musculus
gaagacctactcgaaaatccatcag

SEQ ID NO: 422786 - DNA, 25 bp, Mus musculus
gaagacctactgcttcgatgctttc

SEQ ID NO: 422787 - DNA, 25 bp, Mus musculus
gaagacctactggttcgatgctttc

SEQ ID NO: 422788 - DNA, 25 bp, Mus musculus
gaagacctacttctttgtagaggac

SEQ ID NO: 422789 - DNA, 25 bp, Mus musculus
gaagacctacttgtttgtagaggac

SEQ ID NO: 422790 - DNA, 25 bp, Mus musculus
gaagacctagagaccatgcaagcat

SEQ ID NO: 422791 - DNA, 25 bp, Mus musculus
gaagacctagagtccatgcaagcat

SEQ ID NO: 422792 - DNA, 25 bp, Mus musculus
gaagacctagatcccagaccagaaa

SEQ ID NO: 422793 - DNA, 25 bp, Mus musculus
gaagacctagatgccagaccagaaa

SEQ ID NO: 422794 - DNA, 25 bp, Mus musculus
gaagacctagggataaatactcata

SEQ ID NO: 422795 - DNA, 25 bp, Mus musculus
gaagacctagggttaaatactcata

SEQ ID NO: 422796 - DNA, 25 bp, Mus musculus
gaagacctagtgatctctcacatca

SEQ ID NO: 422797 - DNA, 25 bp, Mus musculus
gaagacctagtgttctctcacatca

SEQ ID NO: 422798 - DNA, 25 bp, Mus musculus
gaagacctatctactggcctgggag

SEQ ID NO: 422799 - DNA, 25 bp, Mus musculus
gaagacctatcttctggcctgggag

SEQ ID NO: 422800 - DNA, 25 bp, Mus musculus
gaagacctattcagacgcattgccc

SEQ ID NO: 422801 - DNA, 25 bp, Mus musculus
gaagacctattctgacgcattgccc

SEQ ID NO: 422802 - DNA, 25 bp, Mus musculus
gaagacctcaaacctgtggaatcac

SEQ ID NO: 422803 - DNA, 25 bp, Mus musculus
gaagacctcaaagctgtggaatcac

SEQ ID NO: 422804 - DNA, 25 bp, Mus musculus
gaagacctcactatcataacacgct

SEQ ID NO: 422805 - DNA, 25 bp, Mus musculus
gaagacctcactttcataacacgct

SEQ ID NO: 422806 - DNA, 25 bp, Mus musculus
gaagacctcagcactgactatgcct

SEQ ID NO: 422807 - DNA, 25 bp, Mus musculus
gaagacctcagctctgactatgcct

SEQ ID NO: 422808 - DNA, 25 bp, Mus musculus
gaagacctcaggaaaatcccggaca

SEQ ID NO: 422809 - DNA, 25 bp, Mus musculus
gaagacctcaggtaaatcccggaca

SEQ ID NO: 422810 - DNA, 25 bp, Mus musculus
gaagacctcagtcagctgatgccta

SEQ ID NO: 422811 - DNA, 25 bp, Mus musculus
gaagacctcagtgagctgatgccta

SEQ ID NO: 422812 - DNA, 25 bp, Mus musculus
gaagacctcatcagcagaaatgcct

SEQ ID NO: 422813 - DNA, 25 bp, Mus musculus
gaagacctcatctgcagaaatgcct

SEQ ID NO: 422814 - DNA, 25 bp, Mus musculus
gaagacctccatcagagatgtgtat

SEQ ID NO: 422815 - DNA, 25 bp, Mus musculus
gaagacctccatgagagatgtgtat

SEQ ID NO: 422816 - DNA, 25 bp, Mus musculus
gaagacctcgccaaggcacaaggat

SEQ ID NO: 422817 - DNA, 25 bp, Mus musculus
gaagacctcgcctaggcacaaggat

SEQ ID NO: 422818 - DNA, 25 bp, Mus musculus
gaagacctctatcagcgctattgca

SEQ ID NO: 422819 - DNA, 25 bp, Mus musculus
gaagacctctatgagcgctattgca

SEQ ID NO: 422820 - DNA, 25 bp, Mus musculus
gaagacctctgacccagaagacagg

SEQ ID NO: 422821 - DNA, 25 bp, Mus musculus
gaagacctctgagccagaagacagg

SEQ ID NO: 422822 - DNA, 25 bp, Mus musculus
gaagacctctgcagggctgggcttc

SEQ ID NO: 422823 - DNA, 25 bp, Mus musculus
gaagacctctgctgggctgggcttc

SEQ ID NO: 422824 - DNA, 25 bp, Mus musculus
gaagacctctttataaacagctgtg

SEQ ID NO: 422825 - DNA, 25 bp, Mus musculus
gaagacctctttttaaacagctgtg

SEQ ID NO: 422826 - DNA, 25 bp, Mus musculus
gaagacctgaagactaaactgcctt

SEQ ID NO: 422827 - DNA, 25 bp, Mus musculus
gaagacctgaagtctaaactgcctt

SEQ ID NO: 422828 - DNA, 25 bp, Mus musculus
gaagacctgatcaccagatgctgag

SEQ ID NO: 422829 - DNA, 25 bp, Mus musculus
gaagacctgatctccagatgctgag

SEQ ID NO: 422830 - DNA, 25 bp, Mus musculus
gaagacctgcatatcgtgctacaga

SEQ ID NO: 422831 - DNA, 25 bp, Mus musculus
gaagacctgcatttcgtgctacaga

SEQ ID NO: 422832 - DNA, 25 bp, Mus musculus
gaagacctgcgaagggttactgctt

SEQ ID NO: 422833 - DNA, 25 bp, Mus musculus
gaagacctgcgatgggttactgctt

SEQ ID NO: 422834 - DNA, 25 bp, Mus musculus
gaagacctgctaatatgatacacat

SEQ ID NO: 422835 - DNA, 25 bp, Mus musculus
gaagacctgctattatgatacacat

SEQ ID NO: 422836 - DNA, 25 bp, Mus musculus
gaagacctgcttcgttttcagaagc

SEQ ID NO: 422837 - DNA, 25 bp, Mus musculus
gaagacctgcttggttttcagaagc

SEQ ID NO: 422838 - DNA, 25 bp, Mus musculus
gaagacctggcaaagcggctgcagc

SEQ ID NO: 422839 - DNA, 25 bp, Mus musculus
gaagacctggcaaatgtaccctatt

SEQ ID NO: 422840 - DNA, 25 bp, Mus musculus
gaagacctggcatagcggctgcagc

SEQ ID NO: 422841 - DNA, 25 bp, Mus musculus
gaagacctggcatatgtaccctatt

SEQ ID NO: 422842 - DNA, 25 bp, Mus musculus
gaagacctggctactgatgacgtca

SEQ ID NO: 422843 - DNA, 25 bp, Mus musculus
gaagacctggctatggttacaacac

SEQ ID NO: 422844 - DNA, 25 bp, Mus musculus
gaagacctggcttctgatgacgtca

SEQ ID NO: 422845 - DNA, 25 bp, Mus musculus
gaagacctggctttggttacaacac

SEQ ID NO: 422846 - DNA, 25 bp, Mus musculus
gaagacctgggccagacagctgtcc

SEQ ID NO: 422847 - DNA, 25 bp, Mus musculus
gaagacctgggcgagacagctgtcc

SEQ ID NO: 422848 - DNA, 25 bp, Mus musculus
gaagacctgtggctttcaaaagtgg

SEQ ID NO: 422849 - DNA, 25 bp, Mus musculus
gaagacctgtgggtttcaaaagtgg

SEQ ID NO: 422850 - DNA, 25 bp, Mus musculus
gaagacctgtgtcgatacctacacc

SEQ ID NO: 422851 - DNA, 25 bp, Mus musculus
gaagacctgtgtggatacctacacc

SEQ ID NO: 422852 - DNA, 25 bp, Mus musculus
gaagacctgtttaccactggaacta

SEQ ID NO: 422853 - DNA, 25 bp, Mus musculus
gaagacctgttttccactggaacta

SEQ ID NO: 422854 - DNA, 25 bp, Mus musculus
gaagaccttcacctgtgtttagatg

SEQ ID NO: 422855 - DNA, 25 bp, Mus musculus
gaagaccttcacgtgtgtttagatg

SEQ ID NO: 422856 - DNA, 25 bp, Mus musculus
gaagaccttcagacggagctcccac

SEQ ID NO: 422857 - DNA, 25 bp, Mus musculus
gaagaccttcagtcggagctcccac

SEQ ID NO: 422858 - DNA, 25 bp, Mus musculus
gaagaccttccccaagacacagaag

SEQ ID NO: 422859 - DNA, 25 bp, Mus musculus
gaagaccttcccgaagacacagaag

SEQ ID NO: 422860 - DNA, 25 bp, Mus musculus
gaagaccttcctagaaggtcctgag

SEQ ID NO: 422861 - DNA, 25 bp, Mus musculus
gaagaccttcctctagagagtgata

SEQ ID NO: 422862 - DNA, 25 bp, Mus musculus
gaagaccttcctgtagagagtgata

SEQ ID NO: 422863 - DNA, 25 bp, Mus musculus
gaagaccttccttgaaggtcctgag

SEQ ID NO: 422864 - DNA, 25 bp, Mus musculus
gaagaccttctaccgtaagtcaggc

SEQ ID NO: 422865 - DNA, 25 bp, Mus musculus
gaagaccttctagcgtaagtcaggc

SEQ ID NO: 422866 - DNA, 25 bp, Mus musculus
gaagaccttctgaattcacaagtga

SEQ ID NO: 422867 - DNA, 25 bp, Mus musculus
gaagaccttctgtattcacaagtga

SEQ ID NO: 422868 - DNA, 25 bp, Mus musculus
gaagaccttcttctggcttgcagca

SEQ ID NO: 422869 - DNA, 25 bp, Mus musculus
gaagaccttcttgtggcttgcagca

SEQ ID NO: 422870 - DNA, 25 bp, Mus musculus
gaagaccttgacatcaggtatttgt

SEQ ID NO: 422871 - DNA, 25 bp, Mus musculus
gaagaccttgacttcaggtatttgt

SEQ ID NO: 422872 - DNA, 25 bp, Mus musculus
gaagaccttgcacagtaccaataat

SEQ ID NO: 422873 - DNA, 25 bp, Mus musculus
gaagaccttgcagagtaccaataat

SEQ ID NO: 422874 - DNA, 25 bp, Mus musculus
gaagaccttgtaaccccaagttgtc

SEQ ID NO: 422875 - DNA, 25 bp, Mus musculus
gaagaccttgtatccccaagttgtc

SEQ ID NO: 422876 - DNA, 25 bp, Mus musculus
gaagaccttgtcatcttctaccagc

SEQ ID NO: 422877 - DNA, 25 bp, Mus musculus
gaagaccttgtcttcttctaccagc

SEQ ID NO: 422878 - DNA, 25 bp, Mus musculus
gaagacctttctactacttccaggt

SEQ ID NO: 422879 - DNA, 25 bp, Mus musculus
gaagacctttcttctacttccaggt

SEQ ID NO: 422880 - DNA, 25 bp, Mus musculus
gaagacctttgcagcctggaggttc

SEQ ID NO: 422881 - DNA, 25 bp, Mus musculus
gaagacctttgctgcctggaggttc

SEQ ID NO: 422882 - DNA, 25 bp, Mus musculus
gaagaccttttaatggttcagcaac

SEQ ID NO: 422883 - DNA, 25 bp, Mus musculus
gaagaccttttattggttcagcaac

SEQ ID NO: 422884 - DNA, 25 bp, Mus musculus
gaagacctttttctgcactatatgc

SEQ ID NO: 422885 - DNA, 25 bp, Mus musculus
gaagacctttttgtgcactatatgc

SEQ ID NO: 422886 - DNA, 25 bp, Mus musculus
gaagacgaagcgcagtcggcaccac

SEQ ID NO: 422887 - DNA, 25 bp, Mus musculus
gaagacgaagcggagtcggcaccac

SEQ ID NO: 422888 - DNA, 25 bp, Mus musculus
gaagacgaatttaaacactcagttt

SEQ ID NO: 422889 - DNA, 25 bp, Mus musculus
gaagacgaattttaacactcagttt

SEQ ID NO: 422890 - DNA, 25 bp, Mus musculus
gaagacgacaaactcactgactgga

SEQ ID NO: 422891 - DNA, 25 bp, Mus musculus
gaagacgacaaagtcactgactgga

SEQ ID NO: 422892 - DNA, 25 bp, Mus musculus
gaagacgaccatcgtgtgcgccggc

SEQ ID NO: 422893 - DNA, 25 bp, Mus musculus
gaagacgaccatggtgtgcgccggc

SEQ ID NO: 422894 - DNA, 25 bp, Mus musculus
gaagacgacgataagacctccagga

SEQ ID NO: 422895 - DNA, 25 bp, Mus musculus
gaagacgacgattagacctccagga

SEQ ID NO: 422896 - DNA, 25 bp, Mus musculus
gaagacgattccaatttaattttga

SEQ ID NO: 422897 - DNA, 25 bp, Mus musculus
gaagacgattcctatttaattttga

SEQ ID NO: 422898 - DNA, 25 bp, Mus musculus
gaagacgatttgacatcacttgaaa

SEQ ID NO: 422899 - DNA, 25 bp, Mus musculus
gaagacgatttgtcatcacttgaaa

SEQ ID NO: 422900 - DNA, 25 bp, Mus musculus
gaagacgcacaaactgacacaggat

SEQ ID NO: 422901 - DNA, 25 bp, Mus musculus
gaagacgcacaatctgacacaggat

SEQ ID NO: 422902 - DNA, 25 bp, Mus musculus
gaagacgcagcgagctacacagcaa

SEQ ID NO: 422903 - DNA, 25 bp, Mus musculus
gaagacgcagcgtgctacacagcaa

SEQ ID NO: 422904 - DNA, 25 bp, Mus musculus
gaagacgcatgacctcaactgcaca

SEQ ID NO: 422905 - DNA, 25 bp, Mus musculus
gaagacgcatgagctcaactgcaca

SEQ ID NO: 422906 - DNA, 25 bp, Mus musculus
gaagacgcatttccttaagattaat

SEQ ID NO: 422907 - DNA, 25 bp, Mus musculus
gaagacgcatttgcttaagattaat

SEQ ID NO: 422908 - DNA, 25 bp, Mus musculus
gaagacgccattatgttgctcattg

SEQ ID NO: 422909 - DNA, 25 bp, Mus musculus
gaagacgccattttgttgctcattg

SEQ ID NO: 422910 - DNA, 25 bp, Mus musculus
gaagacgccctgaggcagcgcaaga

SEQ ID NO: 422911 - DNA, 25 bp, Mus musculus
gaagacgccctgagtgacgagcaca

SEQ ID NO: 422912 - DNA, 25 bp, Mus musculus
gaagacgccctgtggcagcgcaaga

SEQ ID NO: 422913 - DNA, 25 bp, Mus musculus
gaagacgccctgtgtgacgagcaca

SEQ ID NO: 422914 - DNA, 25 bp, Mus musculus
gaagacgccgatcaacctgaagctg

SEQ ID NO: 422915 - DNA, 25 bp, Mus musculus
gaagacgccgatgaacctgaagctg

SEQ ID NO: 422916 - DNA, 25 bp, Mus musculus
gaagacgcctatagtgattcagaag

SEQ ID NO: 422917 - DNA, 25 bp, Mus musculus
gaagacgcctattgtgattcagaag

SEQ ID NO: 422918 - DNA, 25 bp, Mus musculus
gaagacgcggatccattgtggactc

SEQ ID NO: 422919 - DNA, 25 bp, Mus musculus
gaagacgcggatgcattgtggactc

SEQ ID NO: 422920 - DNA, 25 bp, Mus musculus
gaagacgcgggtacgccgctgctgt

SEQ ID NO: 422921 - DNA, 25 bp, Mus musculus
gaagacgcgggttcgccgctgctgt

SEQ ID NO: 422922 - DNA, 25 bp, Mus musculus
gaagacgctcatagacgtccttcag

SEQ ID NO: 422923 - DNA, 25 bp, Mus musculus
gaagacgctcattgacgtccttcag

SEQ ID NO: 422924 - DNA, 25 bp, Mus musculus
gaagacgctgcaagtattgtatttg

SEQ ID NO: 422925 - DNA, 25 bp, Mus musculus
gaagacgctgcatgtattgtatttg

SEQ ID NO: 422926 - DNA, 25 bp, Mus musculus
gaagacgctgctagaagcctagaca

SEQ ID NO: 422927 - DNA, 25 bp, Mus musculus
gaagacgctgcttgaagcctagaca

SEQ ID NO: 422928 - DNA, 25 bp, Mus musculus
gaagacgctggaccttctttcgtag

SEQ ID NO: 422929 - DNA, 25 bp, Mus musculus
gaagacgctggagcttctttcgtag

SEQ ID NO: 422930 - DNA, 25 bp, Mus musculus
gaagacgcttctcaacgagggatgt

SEQ ID NO: 422931 - DNA, 25 bp, Mus musculus
gaagacgcttctgaacgagggatgt

SEQ ID NO: 422932 - DNA, 25 bp, Mus musculus
gaagacgctttacccgactctttgg

SEQ ID NO: 422933 - DNA, 25 bp, Mus musculus
gaagacgctttagccgactctttgg

SEQ ID NO: 422934 - DNA, 25 bp, Mus musculus
gaagacgctttccaatcctgacaga

SEQ ID NO: 422935 - DNA, 25 bp, Mus musculus
gaagacgctttcgaatcctgacaga

SEQ ID NO: 422936 - DNA, 25 bp, Mus musculus
gaagacggaaaaaactctaattcta

SEQ ID NO: 422937 - DNA, 25 bp, Mus musculus
gaagacggaaaatactctaattcta

SEQ ID NO: 422938 - DNA, 25 bp, Mus musculus
gaagacggaaacctgcctgcactga

SEQ ID NO: 422939 - DNA, 25 bp, Mus musculus
gaagacggaaacgtgcctgcactga

SEQ ID NO: 422940 - DNA, 25 bp, Mus musculus
gaagacggacttatgttggaggcat

SEQ ID NO: 422941 - DNA, 25 bp, Mus musculus
gaagacggacttttgttggaggcat

SEQ ID NO: 422942 - DNA, 25 bp, Mus musculus
gaagacggcgatcaagtgcgacttt

SEQ ID NO: 422943 - DNA, 25 bp, Mus musculus
gaagacggcgatgaagtgcgacttt

SEQ ID NO: 422944 - DNA, 25 bp, Mus musculus
gaagacggctgcatttacccagcta

SEQ ID NO: 422945 - DNA, 25 bp, Mus musculus
gaagacggctgcttttacccagcta

SEQ ID NO: 422946 - DNA, 25 bp, Mus musculus
gaagacggtcaacttctcgctccac

SEQ ID NO: 422947 - DNA, 25 bp, Mus musculus
gaagacggtcaagttctcgctccac

SEQ ID NO: 422948 - DNA, 25 bp, Mus musculus
gaagacggtcagattcctagtatag

SEQ ID NO: 422949 - DNA, 25 bp, Mus musculus
gaagacggtcagtttcctagtatag

SEQ ID NO: 422950 - DNA, 25 bp, Mus musculus
gaagacggtctgcatacctgagcca

SEQ ID NO: 422951 - DNA, 25 bp, Mus musculus
gaagacggtctggatacctgagcca

SEQ ID NO: 422952 - DNA, 25 bp, Mus musculus
gaagacggtgagacacaagctcttg

SEQ ID NO: 422953 - DNA, 25 bp, Mus musculus
gaagacggtgagtcacaagctcttg

SEQ ID NO: 422954 - DNA, 25 bp, Mus musculus
gaagacggtggtcctttagctcctt

SEQ ID NO: 422955 - DNA, 25 bp, Mus musculus
gaagacggtggtgctttagctcctt

SEQ ID NO: 422956 - DNA, 25 bp, Mus musculus
gaagacgtccatcgagtcactaatt

SEQ ID NO: 422957 - DNA, 25 bp, Mus musculus
gaagacgtccatggagtcactaatt

SEQ ID NO: 422958 - DNA, 25 bp, Mus musculus
gaagacgtcgcaattacagctgcag

SEQ ID NO: 422959 - DNA, 25 bp, Mus musculus
gaagacgtcgcatttacagctgcag

SEQ ID NO: 422960 - DNA, 25 bp, Mus musculus
gaagacgtcgtcaacagcatcctct

SEQ ID NO: 422961 - DNA, 25 bp, Mus musculus
gaagacgtcgtctacagcatcctct

SEQ ID NO: 422962 - DNA, 25 bp, Mus musculus
gaagacgtctcgcagtctacagttg

SEQ ID NO: 422963 - DNA, 25 bp, Mus musculus
gaagacgtctcggagtctacagttg

SEQ ID NO: 422964 - DNA, 25 bp, Mus musculus
gaagacgtgaccctactgaagatgc

SEQ ID NO: 422965 - DNA, 25 bp, Mus musculus
gaagacgtgaccgtactgaagatgc

SEQ ID NO: 422966 - DNA, 25 bp, Mus musculus
gaagacgtgatgagaacctatgtaa

SEQ ID NO: 422967 - DNA, 25 bp, Mus musculus
gaagacgtgatgtgaacctatgtaa

SEQ ID NO: 422968 - DNA, 25 bp, Mus musculus
gaagacgtgtgcctgcttctgttca

SEQ ID NO: 422969 - DNA, 25 bp, Mus musculus
gaagacgtgtgcgtgcttctgttca

SEQ ID NO: 422970 - DNA, 25 bp, Mus musculus
gaagacgttcacaggattcctcctt

SEQ ID NO: 422971 - DNA, 25 bp, Mus musculus
gaagacgttcactggattcctcctt

SEQ ID NO: 422972 - DNA, 25 bp, Mus musculus
gaagacgttggtaaacctccagcga

SEQ ID NO: 422973 - DNA, 25 bp, Mus musculus
gaagacgttggttaacctccagcga

SEQ ID NO: 422974 - DNA, 25 bp, Mus musculus
gaagactaaactcccttttccttcg

SEQ ID NO: 422975 - DNA, 25 bp, Mus musculus
gaagactaaactgccttttccttcg

SEQ ID NO: 422976 - DNA, 25 bp, Mus musculus
gaagactaagtacattggcatacaa

SEQ ID NO: 422977 - DNA, 25 bp, Mus musculus
gaagactaagtagattggcatacaa

SEQ ID NO: 422978 - DNA, 25 bp, Mus musculus
gaagactaattaccccttacaagaa

SEQ ID NO: 422979 - DNA, 25 bp, Mus musculus
gaagactaattagcccttacaagaa

SEQ ID NO: 422980 - DNA, 25 bp, Mus musculus
gaagactacactaatccgtgggtat

SEQ ID NO: 422981 - DNA, 25 bp, Mus musculus
gaagactacacttatccgtgggtat

SEQ ID NO: 422982 - DNA, 25 bp, Mus musculus
gaagactacagtagcagctcgacat

SEQ ID NO: 422983 - DNA, 25 bp, Mus musculus
gaagactacagttgcagctcgacat

SEQ ID NO: 422984 - DNA, 25 bp, Mus musculus
gaagactaccctccctggtcaggag

SEQ ID NO: 422985 - DNA, 25 bp, Mus musculus
gaagactaccctgcctggtcaggag

SEQ ID NO: 422986 - DNA, 25 bp, Mus musculus
gaagactactaaccctatacttgga

SEQ ID NO: 422987 - DNA, 25 bp, Mus musculus
gaagactactaagcctatacttgga

SEQ ID NO: 422988 - DNA, 25 bp, Mus musculus
gaagactacttcaatgactttgcca

SEQ ID NO: 422989 - DNA, 25 bp, Mus musculus
gaagactacttctatgactttgcca

SEQ ID NO: 422990 - DNA, 25 bp, Mus musculus
gaagactagaacaacagcatcagct

SEQ ID NO: 422991 - DNA, 25 bp, Mus musculus
gaagactagaactacagcatcagct

SEQ ID NO: 422992 - DNA, 25 bp, Mus musculus
gaagactagtttaccaggtcgtggt

SEQ ID NO: 422993 - DNA, 25 bp, Mus musculus
gaagactagttttccaggtcgtggt

SEQ ID NO: 422994 - DNA, 25 bp, Mus musculus
gaagactatcacagcttttagttaa

SEQ ID NO: 422995 - DNA, 25 bp, Mus musculus
gaagactatcactgcttttagttaa

SEQ ID NO: 422996 - DNA, 25 bp, Mus musculus
gaagactatcatagtagagccatat

SEQ ID NO: 422997 - DNA, 25 bp, Mus musculus
gaagactatcattgtagagccatat

SEQ ID NO: 422998 - DNA, 25 bp, Mus musculus
gaagactatcgtacaagctaggatt

SEQ ID NO: 422999 - DNA, 25 bp, Mus musculus
gaagactatcgttcaagctaggatt

SEQ ID NO: 423000 - DNA, 25 bp, Mus musculus
gaagactatctgactgcaatcctga

SEQ ID NO: 423001 - DNA, 25 bp, Mus musculus
gaagactatctgtctgcaatcctga

SEQ ID NO: 423002 - DNA, 25 bp, Mus musculus
gaagactatggtagttcctttcctg

SEQ ID NO: 423003 - DNA, 25 bp, Mus musculus
gaagactatggttgttcctttcctg

SEQ ID NO: 423004 - DNA, 25 bp, Mus musculus
gaagactatgtccagagagaacact

SEQ ID NO: 423005 - DNA, 25 bp, Mus musculus
gaagactatgtcctggtccagtgca

SEQ ID NO: 423006 - DNA, 25 bp, Mus musculus
gaagactatgtcgagagagaacact

SEQ ID NO: 423007 - DNA, 25 bp, Mus musculus
gaagactatgtcgtggtccagtgca

SEQ ID NO: 423008 - DNA, 25 bp, Mus musculus
gaagactattatcatcacgtgcagc

SEQ ID NO: 423009 - DNA, 25 bp, Mus musculus
gaagactattatgatcacgtgcagc

SEQ ID NO: 423010 - DNA, 25 bp, Mus musculus
gaagactcaaataaagctacgcaga

SEQ ID NO: 423011 - DNA, 25 bp, Mus musculus
gaagactcaaatctgattttctgag

SEQ ID NO: 423012 - DNA, 25 bp, Mus musculus
gaagactcaaatgtgattttctgag

SEQ ID NO: 423013 - DNA, 25 bp, Mus musculus
gaagactcaaattaagctacgcaga

SEQ ID NO: 423014 - DNA, 25 bp, Mus musculus
gaagactcaacaattaggactcaat

SEQ ID NO: 423015 - DNA, 25 bp, Mus musculus
gaagactcaacatttaggactcaat

SEQ ID NO: 423016 - DNA, 25 bp, Mus musculus
gaagactcaatgcaagtatcctttg

SEQ ID NO: 423017 - DNA, 25 bp, Mus musculus
gaagactcaatggaagtatcctttg

SEQ ID NO: 423018 - DNA, 25 bp, Mus musculus
gaagactcacacatatttgttcgta

SEQ ID NO: 423019 - DNA, 25 bp, Mus musculus
gaagactcacacttatttgttcgta

SEQ ID NO: 423020 - DNA, 25 bp, Mus musculus
gaagactcacgcatttgagagctga

SEQ ID NO: 423021 - DNA, 25 bp, Mus musculus
gaagactcacgcttttgagagctga

SEQ ID NO: 423022 - DNA, 25 bp, Mus musculus
gaagactcactccaggatcctggaa

SEQ ID NO: 423023 - DNA, 25 bp, Mus musculus
gaagactcactcgaggatcctggaa

SEQ ID NO: 423024 - DNA, 25 bp, Mus musculus
gaagactcagtactttagagaccca

SEQ ID NO: 423025 - DNA, 25 bp, Mus musculus
gaagactcagtagtttagagaccca

SEQ ID NO: 423026 - DNA, 25 bp, Mus musculus
gaagactcagttatgttgggtactt

SEQ ID NO: 423027 - DNA, 25 bp, Mus musculus
gaagactcagttttgttgggtactt

SEQ ID NO: 423028 - DNA, 25 bp, Mus musculus
gaagactcatcgacagacgtgtggt

SEQ ID NO: 423029 - DNA, 25 bp, Mus musculus
gaagactcatcgtcagacgtgtggt

SEQ ID NO: 423030 - DNA, 25 bp, Mus musculus
gaagactcatgaactcaccaatcct

SEQ ID NO: 423031 - DNA, 25 bp, Mus musculus
gaagactcatgatctcaccaatcct

SEQ ID NO: 423032 - DNA, 25 bp, Mus musculus
gaagactccacccactatggaggaa

SEQ ID NO: 423033 - DNA, 25 bp, Mus musculus
gaagactccaccgactatggaggaa

SEQ ID NO: 423034 - DNA, 25 bp, Mus musculus
gaagactccatgattacagaaagac

SEQ ID NO: 423035 - DNA, 25 bp, Mus musculus
gaagactccatgtttacagaaagac

SEQ ID NO: 423036 - DNA, 25 bp, Mus musculus
gaagactcccacagaggttctatag

SEQ ID NO: 423037 - DNA, 25 bp, Mus musculus
gaagactcccactgaggttctatag

SEQ ID NO: 423038 - DNA, 25 bp, Mus musculus
gaagactcccagctggctatgaaga

SEQ ID NO: 423039 - DNA, 25 bp, Mus musculus
gaagactcccaggtggctatgaaga

SEQ ID NO: 423040 - DNA, 25 bp, Mus musculus
gaagactccgttctttgcagtgatg

SEQ ID NO: 423041 - DNA, 25 bp, Mus musculus
gaagactccgttgtttgcagtgatg

SEQ ID NO: 423042 - DNA, 25 bp, Mus musculus
gaagactcctccaaaggtcactttg

SEQ ID NO: 423043 - DNA, 25 bp, Mus musculus
gaagactcctcctaaggtcactttg

SEQ ID NO: 423044 - DNA, 25 bp, Mus musculus
gaagactcgctaccacaagcgcact

SEQ ID NO: 423045 - DNA, 25 bp, Mus musculus
gaagactcgctagcacaagcgcact

SEQ ID NO: 423046 - DNA, 25 bp, Mus musculus
gaagactcggctctggtgacacttg

SEQ ID NO: 423047 - DNA, 25 bp, Mus musculus
gaagactcggctgtggtgacacttg

SEQ ID NO: 423048 - DNA, 25 bp, Mus musculus
gaagactcggttagaacccaggact

SEQ ID NO: 423049 - DNA, 25 bp, Mus musculus
gaagactcggtttgaacccaggact

SEQ ID NO: 423050 - DNA, 25 bp, Mus musculus
gaagactcgttgcatgactcaatgg

SEQ ID NO: 423051 - DNA, 25 bp, Mus musculus
gaagactcgttggatgactcaatgg

SEQ ID NO: 423052 - DNA, 25 bp, Mus musculus
gaagactctaaacatccgactcaca

SEQ ID NO: 423053 - DNA, 25 bp, Mus musculus
gaagactctaaagatccgactcaca

SEQ ID NO: 423054 - DNA, 25 bp, Mus musculus
gaagactctagaaggcgaacttgat

SEQ ID NO: 423055 - DNA, 25 bp, Mus musculus
gaagactctagatggcgaacttgat

SEQ ID NO: 423056 - DNA, 25 bp, Mus musculus
gaagactctcaactctataagccag

SEQ ID NO: 423057 - DNA, 25 bp, Mus musculus
gaagactctcaagtctataagccag

SEQ ID NO: 423058 - DNA, 25 bp, Mus musculus
gaagactctgagctatcaccatagc

SEQ ID NO: 423059 - DNA, 25 bp, Mus musculus
gaagactctgaggtatcaccatagc

SEQ ID NO: 423060 - DNA, 25 bp, Mus musculus
gaagactctgctcatgtgagcctcc

SEQ ID NO: 423061 - DNA, 25 bp, Mus musculus
gaagactctgctgatgtgagcctcc

SEQ ID NO: 423062 - DNA, 25 bp, Mus musculus
gaagactctgtgaggacttttccca

SEQ ID NO: 423063 - DNA, 25 bp, Mus musculus
gaagactctgtgtggacttttccca

SEQ ID NO: 423064 - DNA, 25 bp, Mus musculus
gaagactcttccagcatcagactca

SEQ ID NO: 423065 - DNA, 25 bp, Mus musculus
gaagactcttcctgcatcagactca

SEQ ID NO: 423066 - DNA, 25 bp, Mus musculus
gaagactcttctaaccaggtgactc

SEQ ID NO: 423067 - DNA, 25 bp, Mus musculus
gaagactcttcttaccaggtgactc

SEQ ID NO: 423068 - DNA, 25 bp, Mus musculus
gaagactctttccaggcaacagatg

SEQ ID NO: 423069 - DNA, 25 bp, Mus musculus
gaagactctttcgaggcaacagatg

SEQ ID NO: 423070 - DNA, 25 bp, Mus musculus
gaagactgaaggagcttctccatat

SEQ ID NO: 423071 - DNA, 25 bp, Mus musculus
gaagactgaaggtgcttctccatat

SEQ ID NO: 423072 - DNA, 25 bp, Mus musculus
gaagactgaatgatggctcccatgc

SEQ ID NO: 423073 - DNA, 25 bp, Mus musculus
gaagactgaatgttggctcccatgc

SEQ ID NO: 423074 - DNA, 25 bp, Mus musculus
gaagactgacatcttaagggtacag

SEQ ID NO: 423075 - DNA, 25 bp, Mus musculus
gaagactgacatgttaagggtacag

SEQ ID NO: 423076 - DNA, 25 bp, Mus musculus
gaagactgaccgctacgggacactc

SEQ ID NO: 423077 - DNA, 25 bp, Mus musculus
gaagactgaccggtacgggacactc

SEQ ID NO: 423078 - DNA, 25 bp, Mus musculus
gaagactgacgcagcctgggttgac

SEQ ID NO: 423079 - DNA, 25 bp, Mus musculus
gaagactgacgctgcctgggttgac

SEQ ID NO: 423080 - DNA, 25 bp, Mus musculus
gaagactgactcctgtggaacctgt

SEQ ID NO: 423081 - DNA, 25 bp, Mus musculus
gaagactgactcgtgtggaacctgt

SEQ ID NO: 423082 - DNA, 25 bp, Mus musculus
gaagactgatctccaggtgcttcct

SEQ ID NO: 423083 - DNA, 25 bp, Mus musculus
gaagactgatctgcaggtgcttcct

SEQ ID NO: 423084 - DNA, 25 bp, Mus musculus
gaagactgatgtatgtactttagta

SEQ ID NO: 423085 - DNA, 25 bp, Mus musculus
gaagactgatgtttgtactttagta

SEQ ID NO: 423086 - DNA, 25 bp, Mus musculus
gaagactgcatgcaagcacgcacta

SEQ ID NO: 423087 - DNA, 25 bp, Mus musculus
gaagactgcatggaagcacgcacta

SEQ ID NO: 423088 - DNA, 25 bp, Mus musculus
gaagactgccagatattgaccaaga

SEQ ID NO: 423089 - DNA, 25 bp, Mus musculus
gaagactgccagttattgaccaaga

SEQ ID NO: 423090 - DNA, 25 bp, Mus musculus
gaagactgccatatggatcctagta

SEQ ID NO: 423091 - DNA, 25 bp, Mus musculus
gaagactgccatttggatcctagta

SEQ ID NO: 423092 - DNA, 25 bp, Mus musculus
gaagactgcgtcagctcagtgggct

SEQ ID NO: 423093 - DNA, 25 bp, Mus musculus
gaagactgcgtctgctcagtgggct

SEQ ID NO: 423094 - DNA, 25 bp, Mus musculus
gaagactgcgttctgatcatttggc

SEQ ID NO: 423095 - DNA, 25 bp, Mus musculus
gaagactgcgttgtgatcatttggc

SEQ ID NO: 423096 - DNA, 25 bp, Mus musculus
gaagactgcttaagtaggtggtcaa

SEQ ID NO: 423097 - DNA, 25 bp, Mus musculus
gaagactgcttatgtaggtggtcaa

SEQ ID NO: 423098 - DNA, 25 bp, Mus musculus
gaagactggctaatcaccatccaac

SEQ ID NO: 423099 - DNA, 25 bp, Mus musculus
gaagactggctattcaccatccaac

SEQ ID NO: 423100 - DNA, 25 bp, Mus musculus
gaagactgggctcgccacttcattg

SEQ ID NO: 423101 - DNA, 25 bp, Mus musculus
gaagactgggctggccacttcattg

SEQ ID NO: 423102 - DNA, 25 bp, Mus musculus
gaagactgggtgatgccacacatcc

SEQ ID NO: 423103 - DNA, 25 bp, Mus musculus
gaagactgggtgttgccacacatcc

SEQ ID NO: 423104 - DNA, 25 bp, Mus musculus
gaagactgggttctagcactaggaa

SEQ ID NO: 423105 - DNA, 25 bp, Mus musculus
gaagactgggttgtagcactaggaa

SEQ ID NO: 423106 - DNA, 25 bp, Mus musculus
gaagactgtacaaaccacgggcttt

SEQ ID NO: 423107 - DNA, 25 bp, Mus musculus
gaagactgtacataccacgggcttt

SEQ ID NO: 423108 - DNA, 25 bp, Mus musculus
gaagactgtcatctcctgcacaatt

SEQ ID NO: 423109 - DNA, 25 bp, Mus musculus
gaagactgtcatgtcctgcacaatt

SEQ ID NO: 423110 - DNA, 25 bp, Mus musculus
gaagactgtccaaactctctaggaa

SEQ ID NO: 423111 - DNA, 25 bp, Mus musculus
gaagactgtccatactctctaggaa

SEQ ID NO: 423112 - DNA, 25 bp, Mus musculus
gaagactgtccgaacagtgtcctgg

SEQ ID NO: 423113 - DNA, 25 bp, Mus musculus
gaagactgtccgtacagtgtcctgg

SEQ ID NO: 423114 - DNA, 25 bp, Mus musculus
gaagactgtgatactacctgcgtgg

SEQ ID NO: 423115 - DNA, 25 bp, Mus musculus
gaagactgtgattctacctgcgtgg

SEQ ID NO: 423116 - DNA, 25 bp, Mus musculus
gaagactgtggcaactttagtgaag

SEQ ID NO: 423117 - DNA, 25 bp, Mus musculus
gaagactgtggctactttagtgaag

SEQ ID NO: 423118 - DNA, 25 bp, Mus musculus
gaagactgtgtacggtccttacgac

SEQ ID NO: 423119 - DNA, 25 bp, Mus musculus
gaagactgtgtagggtccttacgac

SEQ ID NO: 423120 - DNA, 25 bp, Mus musculus
gaagactgtgttcctaatgttgaaa

SEQ ID NO: 423121 - DNA, 25 bp, Mus musculus
gaagactgtgttgctaatgttgaaa

SEQ ID NO: 423122 - DNA, 25 bp, Mus musculus
gaagactgttcaaatgtcctaaact

SEQ ID NO: 423123 - DNA, 25 bp, Mus musculus
gaagactgttcatatgtcctaaact

SEQ ID NO: 423124 - DNA, 25 bp, Mus musculus
gaagacttaagtatgcacccaaatt

SEQ ID NO: 423125 - DNA, 25 bp, Mus musculus
gaagacttaagtttgcacccaaatt

SEQ ID NO: 423126 - DNA, 25 bp, Mus musculus
gaagacttacacaccactgatgatc

SEQ ID NO: 423127 - DNA, 25 bp, Mus musculus
gaagacttacactccactgatgatc

SEQ ID NO: 423128 - DNA, 25 bp, Mus musculus
gaagacttactacctggtcctaagc

SEQ ID NO: 423129 - DNA, 25 bp, Mus musculus
gaagacttactagctggtcctaagc

SEQ ID NO: 423130 - DNA, 25 bp, Mus musculus
gaagacttagcacaccagattgggt

SEQ ID NO: 423131 - DNA, 25 bp, Mus musculus
gaagacttagcagaccagattgggt

SEQ ID NO: 423132 - DNA, 25 bp, Mus musculus
gaagacttagctaccggcttggcat

SEQ ID NO: 423133 - DNA, 25 bp, Mus musculus
gaagacttagcttccggcttggcat

SEQ ID NO: 423134 - DNA, 25 bp, Mus musculus
gaagacttagtcagtaagctggcag

SEQ ID NO: 423135 - DNA, 25 bp, Mus musculus
gaagacttagtccttctgtcactct

SEQ ID NO: 423136 - DNA, 25 bp, Mus musculus
gaagacttagtcgttctgtcactct

SEQ ID NO: 423137 - DNA, 25 bp, Mus musculus
gaagacttagtctgtaagctggcag

SEQ ID NO: 423138 - DNA, 25 bp, Mus musculus
gaagacttatcaaggcagttgacag

SEQ ID NO: 423139 - DNA, 25 bp, Mus musculus
gaagacttatcatggcagttgacag

SEQ ID NO: 423140 - DNA, 25 bp, Mus musculus
gaagacttcaatcccgtttaaatac

SEQ ID NO: 423141 - DNA, 25 bp, Mus musculus
gaagacttcaatgccgtttaaatac

SEQ ID NO: 423142 - DNA, 25 bp, Mus musculus
gaagacttcacacccattgtactct

SEQ ID NO: 423143 - DNA, 25 bp, Mus musculus
gaagacttcacagccattgtactct

SEQ ID NO: 423144 - DNA, 25 bp, Mus musculus
gaagacttccaaagccataagcctg

SEQ ID NO: 423145 - DNA, 25 bp, Mus musculus
gaagacttccaatgccataagcctg

SEQ ID NO: 423146 - DNA, 25 bp, Mus musculus
gaagacttccacattcgcattcctt

SEQ ID NO: 423147 - DNA, 25 bp, Mus musculus
gaagacttccactttcgcattcctt

SEQ ID NO: 423148 - DNA, 25 bp, Mus musculus
gaagacttccctcggagctacagga

SEQ ID NO: 423149 - DNA, 25 bp, Mus musculus
gaagacttccctgggagctacagga

SEQ ID NO: 423150 - DNA, 25 bp, Mus musculus
gaagacttccggatgccgacgcggt

SEQ ID NO: 423151 - DNA, 25 bp, Mus musculus
gaagacttccggttgccgacgcggt

SEQ ID NO: 423152 - DNA, 25 bp, Mus musculus
gaagacttcctacatacactttaat

SEQ ID NO: 423153 - DNA, 25 bp, Mus musculus
gaagacttcctagatacactttaat

SEQ ID NO: 423154 - DNA, 25 bp, Mus musculus
gaagacttcctgctgtgagactaca

SEQ ID NO: 423155 - DNA, 25 bp, Mus musculus
gaagacttcctggtgtgagactaca

SEQ ID NO: 423156 - DNA, 25 bp, Mus musculus
gaagacttcggaccacacagggtgt

SEQ ID NO: 423157 - DNA, 25 bp, Mus musculus
gaagacttcggagcacacagggtgt

SEQ ID NO: 423158 - DNA, 25 bp, Mus musculus
gaagacttcggtcctcagtatgaaa

SEQ ID NO: 423159 - DNA, 25 bp, Mus musculus
gaagacttcggtgctcagtatgaaa

SEQ ID NO: 423160 - DNA, 25 bp, Mus musculus
gaagacttctgcctagtttacacaa

SEQ ID NO: 423161 - DNA, 25 bp, Mus musculus
gaagacttctgcgtagtttacacaa

SEQ ID NO: 423162 - DNA, 25 bp, Mus musculus
gaagacttctggcaacactataaga

SEQ ID NO: 423163 - DNA, 25 bp, Mus musculus
gaagacttctgggaacactataaga

SEQ ID NO: 423164 - DNA, 25 bp, Mus musculus
gaagacttctgtatgttcactagta

SEQ ID NO: 423165 - DNA, 25 bp, Mus musculus
gaagacttctgtttgttcactagta

SEQ ID NO: 423166 - DNA, 25 bp, Mus musculus
gaagacttcttaactaatcaagcaa

SEQ ID NO: 423167 - DNA, 25 bp, Mus musculus
gaagacttcttatctaatcaagcaa

SEQ ID NO: 423168 - DNA, 25 bp, Mus musculus
gaagacttgatgacaccagactaca

SEQ ID NO: 423169 - DNA, 25 bp, Mus musculus
gaagacttgatgtcaccagactaca

SEQ ID NO: 423170 - DNA, 25 bp, Mus musculus
gaagacttgctgagattgatttatt

SEQ ID NO: 423171 - DNA, 25 bp, Mus musculus
gaagacttgctgtgattgatttatt

SEQ ID NO: 423172 - DNA, 25 bp, Mus musculus
gaagacttggacacttttatcctga

SEQ ID NO: 423173 - DNA, 25 bp, Mus musculus
gaagacttggactcttttatcctga

SEQ ID NO: 423174 - DNA, 25 bp, Mus musculus
gaagacttggagaaactcttgccac

SEQ ID NO: 423175 - DNA, 25 bp, Mus musculus
gaagacttggagtaactcttgccac

SEQ ID NO: 423176 - DNA, 25 bp, Mus musculus
gaagacttgtatcttgtggcactag

SEQ ID NO: 423177 - DNA, 25 bp, Mus musculus
gaagacttgtatgttgtggcactag

SEQ ID NO: 423178 - DNA, 25 bp, Mus musculus
gaagactttaatctggatcatatga

SEQ ID NO: 423179 - DNA, 25 bp, Mus musculus
gaagactttaatgtggatcatatga

SEQ ID NO: 423180 - DNA, 25 bp, Mus musculus
gaagactttagcagctggccaggca

SEQ ID NO: 423181 - DNA, 25 bp, Mus musculus
gaagactttagctgctggccaggca

SEQ ID NO: 423182 - DNA, 25 bp, Mus musculus
gaagactttaggagtacaagaactg

SEQ ID NO: 423183 - DNA, 25 bp, Mus musculus
gaagactttaggtgtacaagaactg

SEQ ID NO: 423184 - DNA, 25 bp, Mus musculus
gaagactttcaaccagtattcctcc

SEQ ID NO: 423185 - DNA, 25 bp, Mus musculus
gaagactttcaagcagtattcctcc

SEQ ID NO: 423186 - DNA, 25 bp, Mus musculus
gaagactttccacatcattacagga

SEQ ID NO: 423187 - DNA, 25 bp, Mus musculus
gaagactttccagatcattacagga

SEQ ID NO: 423188 - DNA, 25 bp, Mus musculus
gaagactttccgaacagagcgtcct

SEQ ID NO: 423189 - DNA, 25 bp, Mus musculus
gaagactttccgtacagagcgtcct

SEQ ID NO: 423190 - DNA, 25 bp, Mus musculus
gaagactttcctacaataactccgc

SEQ ID NO: 423191 - DNA, 25 bp, Mus musculus
gaagactttcctcgaatcgactata

SEQ ID NO: 423192 - DNA, 25 bp, Mus musculus
gaagactttcctggaatcgactata

SEQ ID NO: 423193 - DNA, 25 bp, Mus musculus
gaagactttccttcaataactccgc

SEQ ID NO: 423194 - DNA, 25 bp, Mus musculus
gaagactttctgaaacctgccatag

SEQ ID NO: 423195 - DNA, 25 bp, Mus musculus
gaagactttctgcattctactgaga

SEQ ID NO: 423196 - DNA, 25 bp, Mus musculus
gaagactttctggattctactgaga

SEQ ID NO: 423197 - DNA, 25 bp, Mus musculus
gaagactttctgtaacctgccatag

SEQ ID NO: 423198 - DNA, 25 bp, Mus musculus
gaagactttcttatcaaccctgggc

SEQ ID NO: 423199 - DNA, 25 bp, Mus musculus
gaagactttcttttcaaccctgggc

SEQ ID NO: 423200 - DNA, 25 bp, Mus musculus
gaagactttgagcaacctggagaag

SEQ ID NO: 423201 - DNA, 25 bp, Mus musculus
gaagactttgaggaacctggagaag

SEQ ID NO: 423202 - DNA, 25 bp, Mus musculus
gaagactttgctcactattgcagat

SEQ ID NO: 423203 - DNA, 25 bp, Mus musculus
gaagactttgctgactattgcagat

SEQ ID NO: 423204 - DNA, 25 bp, Mus musculus
gaagactttggactatctgtgtcag

SEQ ID NO: 423205 - DNA, 25 bp, Mus musculus
gaagactttggagtatctgtgtcag

SEQ ID NO: 423206 - DNA, 25 bp, Mus musculus
gaagactttggccataaaaacctag

SEQ ID NO: 423207 - DNA, 25 bp, Mus musculus
gaagactttggcgataaaaacctag

SEQ ID NO: 423208 - DNA, 25 bp, Mus musculus
gaagacttttaacacctggaagctg

SEQ ID NO: 423209 - DNA, 25 bp, Mus musculus
gaagacttttaagacctggaagctg

SEQ ID NO: 423210 - DNA, 25 bp, Mus musculus
gaagactttttgcacagctttgcat

SEQ ID NO: 423211 - DNA, 25 bp, Mus musculus
gaagactttttggacagctttgcat

SEQ ID NO: 423212 - DNA, 25 bp, Mus musculus
gaagagaaaaccaagaccccaacat

SEQ ID NO: 423213 - DNA, 25 bp, Mus musculus
gaagagaaaacctagaccccaacat

SEQ ID NO: 423214 - DNA, 25 bp, Mus musculus
gaagagaaacaacgcaccatcaatt

SEQ ID NO: 423215 - DNA, 25 bp, Mus musculus
gaagagaaacaaggcaccatcaatt

SEQ ID NO: 423216 - DNA, 25 bp, Mus musculus
gaagagaaaccaagcaccggccatc

SEQ ID NO: 423217 - DNA, 25 bp, Mus musculus
gaagagaaaccatgcaccggccatc

SEQ ID NO: 423218 - DNA, 25 bp, Mus musculus
gaagagaaactcaacacagaatgta

SEQ ID NO: 423219 - DNA, 25 bp, Mus musculus
gaagagaaactcacaccaacaagca

SEQ ID NO: 423220 - DNA, 25 bp, Mus musculus
gaagagaaactctacacagaatgta

SEQ ID NO: 423221 - DNA, 25 bp, Mus musculus
gaagagaaactctcaccaacaagca

SEQ ID NO: 423222 - DNA, 25 bp, Mus musculus
gaagagaaagaccaaggccaaccaa

SEQ ID NO: 423223 - DNA, 25 bp, Mus musculus
gaagagaaagacgaaggccaaccaa

SEQ ID NO: 423224 - DNA, 25 bp, Mus musculus
gaagagaaagccctgatctactccc

SEQ ID NO: 423225 - DNA, 25 bp, Mus musculus
gaagagaaagccgtgatctactccc

SEQ ID NO: 423226 - DNA, 25 bp, Mus musculus
gaagagaaagctagcagtcataacc

SEQ ID NO: 423227 - DNA, 25 bp, Mus musculus
gaagagaaagcttgcagtcataacc

SEQ ID NO: 423228 - DNA, 25 bp, Mus musculus
gaagagaacaccactatgagcacac

SEQ ID NO: 423229 - DNA, 25 bp, Mus musculus
gaagagaacaccatctttgcaccca

SEQ ID NO: 423230 - DNA, 25 bp, Mus musculus
gaagagaacacctctatgagcacac

SEQ ID NO: 423231 - DNA, 25 bp, Mus musculus
gaagagaacaccttctttgcaccca

SEQ ID NO: 423232 - DNA, 25 bp, Mus musculus
gaagagaacactatccatcatggta

SEQ ID NO: 423233 - DNA, 25 bp, Mus musculus
gaagagaacactccttgctaagtaa

SEQ ID NO: 423234 - DNA, 25 bp, Mus musculus
gaagagaacactgcttgctaagtaa

SEQ ID NO: 423235 - DNA, 25 bp, Mus musculus
gaagagaacactttccatcatggta

SEQ ID NO: 423236 - DNA, 25 bp, Mus musculus
gaagagaaccacacccacgagttgt

SEQ ID NO: 423237 - DNA, 25 bp, Mus musculus
gaagagaaccactcccacgagttgt

SEQ ID NO: 423238 - DNA, 25 bp, Mus musculus
gaagagaaccttcttccttgccttt

SEQ ID NO: 423239 - DNA, 25 bp, Mus musculus
gaagagaaccttgttccttgccttt

SEQ ID NO: 423240 - DNA, 25 bp, Mus musculus
gaagagaacgcgattttgggacctg

SEQ ID NO: 423241 - DNA, 25 bp, Mus musculus
gaagagaacgcgtttttgggacctg

SEQ ID NO: 423242 - DNA, 25 bp, Mus musculus
gaagagaactcacctcccttagtca

SEQ ID NO: 423243 - DNA, 25 bp, Mus musculus
gaagagaactcagctcccttagtca

SEQ ID NO: 423244 - DNA, 25 bp, Mus musculus
gaagagaactgcaattagtcgcttt

SEQ ID NO: 423245 - DNA, 25 bp, Mus musculus
gaagagaactgctattagtcgcttt

SEQ ID NO: 423246 - DNA, 25 bp, Mus musculus
gaagagaactttatgacataactga

SEQ ID NO: 423247 - DNA, 25 bp, Mus musculus
gaagagaactttttgacataactga

SEQ ID NO: 423248 - DNA, 25 bp, Mus musculus
gaagagaagaaacgcccacgccagg

SEQ ID NO: 423249 - DNA, 25 bp, Mus musculus
gaagagaagaaaggcccacgccagg

SEQ ID NO: 423250 - DNA, 25 bp, Mus musculus
gaagagaagaccctgcaacctgctg

SEQ ID NO: 423251 - DNA, 25 bp, Mus musculus
gaagagaagaccgtgcaacctgctg

SEQ ID NO: 423252 - DNA, 25 bp, Mus musculus
gaagagaagcagatcctgacattat

SEQ ID NO: 423253 - DNA, 25 bp, Mus musculus
gaagagaagcagttcctgacattat

SEQ ID NO: 423254 - DNA, 25 bp, Mus musculus
gaagagaagcatcccttcgaccttc

SEQ ID NO: 423255 - DNA, 25 bp, Mus musculus
gaagagaagcatgccttcgaccttc

SEQ ID NO: 423256 - DNA, 25 bp, Mus musculus
gaagagaagtgactccttgcagctt

SEQ ID NO: 423257 - DNA, 25 bp, Mus musculus
gaagagaagtgagtccttgcagctt

SEQ ID NO: 423258 - DNA, 25 bp, Mus musculus
gaagagaatcaaccttcagatttgg

SEQ ID NO: 423259 - DNA, 25 bp, Mus musculus
gaagagaatcaagcttcagatttgg

SEQ ID NO: 423260 - DNA, 25 bp, Mus musculus
gaagagaatggaccgggttcatcaa

SEQ ID NO: 423261 - DNA, 25 bp, Mus musculus
gaagagaatggagcgggttcatcaa

SEQ ID NO: 423262 - DNA, 25 bp, Mus musculus
gaagagacacctaatctagcacaga

SEQ ID NO: 423263 - DNA, 25 bp, Mus musculus
gaagagacaccttatctagcacaga

SEQ ID NO: 423264 - DNA, 25 bp, Mus musculus
gaagagacagagaagaacccgcatc

SEQ ID NO: 423265 - DNA, 25 bp, Mus musculus
gaagagacagagtagaacccgcatc

SEQ ID NO: 423266 - DNA, 25 bp, Mus musculus
gaagagacagatagccctgccagtt

SEQ ID NO: 423267 - DNA, 25 bp, Mus musculus
gaagagacagattgccctgccagtt

SEQ ID NO: 423268 - DNA, 25 bp, Mus musculus
gaagagacagtcactcctagctgtc

SEQ ID NO: 423269 - DNA, 25 bp, Mus musculus
gaagagacagtctctcctagctgtc

SEQ ID NO: 423270 - DNA, 25 bp, Mus musculus
gaagagacatacactcccaaatggg

SEQ ID NO: 423271 - DNA, 25 bp, Mus musculus
gaagagacatactctcccaaatggg

SEQ ID NO: 423272 - DNA, 25 bp, Mus musculus
gaagagaccaaaacttgcagcccct

SEQ ID NO: 423273 - DNA, 25 bp, Mus musculus
gaagagaccaaacctgtgtatacag

SEQ ID NO: 423274 - DNA, 25 bp, Mus musculus
gaagagaccaaacgcagatactgta

SEQ ID NO: 423275 - DNA, 25 bp, Mus musculus
gaagagaccaaagctgtgtatacag

SEQ ID NO: 423276 - DNA, 25 bp, Mus musculus
gaagagaccaaaggcagatactgta

SEQ ID NO: 423277 - DNA, 25 bp, Mus musculus
gaagagaccaaatcttgcagcccct

SEQ ID NO: 423278 - DNA, 25 bp, Mus musculus
gaagagaccagtcgccgtgtacaac

SEQ ID NO: 423279 - DNA, 25 bp, Mus musculus
gaagagaccagtggccgtgtacaac

SEQ ID NO: 423280 - DNA, 25 bp, Mus musculus
gaagagaccataacctcaggacaaa

SEQ ID NO: 423281 - DNA, 25 bp, Mus musculus
gaagagaccatatcctcaggacaaa

SEQ ID NO: 423282 - DNA, 25 bp, Mus musculus
gaagagaccctcaggacatctcgtg

SEQ ID NO: 423283 - DNA, 25 bp, Mus musculus
gaagagaccctctggacatctcgtg

SEQ ID NO: 423284 - DNA, 25 bp, Mus musculus
gaagagaccgtacccctgaatccga

SEQ ID NO: 423285 - DNA, 25 bp, Mus musculus
gaagagaccgtagccctgaatccga

SEQ ID NO: 423286 - DNA, 25 bp, Mus musculus
gaagagacctatacacacgtgcagt

SEQ ID NO: 423287 - DNA, 25 bp, Mus musculus
gaagagacctattcacacgtgcagt

SEQ ID NO: 423288 - DNA, 25 bp, Mus musculus
gaagagacctctacctgtggaatcc

SEQ ID NO: 423289 - DNA, 25 bp, Mus musculus
gaagagacctctctggatgccggat

SEQ ID NO: 423290 - DNA, 25 bp, Mus musculus
gaagagacctctgtggatgccggat

SEQ ID NO: 423291 - DNA, 25 bp, Mus musculus
gaagagacctcttcctgtggaatcc

SEQ ID NO: 423292 - DNA, 25 bp, Mus musculus
gaagagaccttcagaacacctcggt

SEQ ID NO: 423293 - DNA, 25 bp, Mus musculus
gaagagaccttctgaacacctcggt

SEQ ID NO: 423294 - DNA, 25 bp, Mus musculus
gaagagaccttgacctgttacagca

SEQ ID NO: 423295 - DNA, 25 bp, Mus musculus
gaagagaccttgtcctgttacagca

SEQ ID NO: 423296 - DNA, 25 bp, Mus musculus
gaagagacgtctactggctgagaga

SEQ ID NO: 423297 - DNA, 25 bp, Mus musculus
gaagagacgtcttctggctgagaga

SEQ ID NO: 423298 - DNA, 25 bp, Mus musculus
gaagagactagaccaagtcccatat

SEQ ID NO: 423299 - DNA, 25 bp, Mus musculus
gaagagactagagcaagtcccatat

SEQ ID NO: 423300 - DNA, 25 bp, Mus musculus
gaagagactcataaaccttggcagt

SEQ ID NO: 423301 - DNA, 25 bp, Mus musculus
gaagagactcattaaccttggcagt

SEQ ID NO: 423302 - DNA, 25 bp, Mus musculus
gaagagactccaacctctgatgagt

SEQ ID NO: 423303 - DNA, 25 bp, Mus musculus
gaagagactccatcctctgatgagt

SEQ ID NO: 423304 - DNA, 25 bp, Mus musculus
gaagagactcggctgctgctatcca

SEQ ID NO: 423305 - DNA, 25 bp, Mus musculus
gaagagactcgggtgctgctatcca

SEQ ID NO: 423306 - DNA, 25 bp, Mus musculus
gaagagactctgcaaaactttcctc

SEQ ID NO: 423307 - DNA, 25 bp, Mus musculus
gaagagactctggaaaactttcctc

SEQ ID NO: 423308 - DNA, 25 bp, Mus musculus
gaagagactgcacgccactactgaa

SEQ ID NO: 423309 - DNA, 25 bp, Mus musculus
gaagagactgcaggccactactgaa

SEQ ID NO: 423310 - DNA, 25 bp, Mus musculus
gaagagactgcgatctctggaacct

SEQ ID NO: 423311 - DNA, 25 bp, Mus musculus
gaagagactgcgttctctggaacct

SEQ ID NO: 423312 - DNA, 25 bp, Mus musculus
gaagagactggcagaactgcaccca

SEQ ID NO: 423313 - DNA, 25 bp, Mus musculus
gaagagactggcatctgcgttgtgc

SEQ ID NO: 423314 - DNA, 25 bp, Mus musculus
gaagagactggctgaactgcaccca

SEQ ID NO: 423315 - DNA, 25 bp, Mus musculus
gaagagactggcttctgcgttgtgc

SEQ ID NO: 423316 - DNA, 25 bp, Mus musculus
gaagagacttacctatctatttaat

SEQ ID NO: 423317 - DNA, 25 bp, Mus musculus
gaagagacttacgtatctatttaat

SEQ ID NO: 423318 - DNA, 25 bp, Mus musculus
gaagagactttcacaaggtcacaaa

SEQ ID NO: 423319 - DNA, 25 bp, Mus musculus
gaagagactttctcaaggtcacaaa

SEQ ID NO: 423320 - DNA, 25 bp, Mus musculus
gaagagactttgacctgacctcaga

SEQ ID NO: 423321 - DNA, 25 bp, Mus musculus
gaagagactttgtcctgacctcaga

SEQ ID NO: 423322 - DNA, 25 bp, Mus musculus
gaagagagacaccaacttccccatc

SEQ ID NO: 423323 - DNA, 25 bp, Mus musculus
gaagagagacacgaacttccccatc

SEQ ID NO: 423324 - DNA, 25 bp, Mus musculus
gaagagagacatcgccacctctgac

SEQ ID NO: 423325 - DNA, 25 bp, Mus musculus
gaagagagacatggccacctctgac

SEQ ID NO: 423326 - DNA, 25 bp, Mus musculus
gaagagagatatctcccgagaggaa

SEQ ID NO: 423327 - DNA, 25 bp, Mus musculus
gaagagagatatgtcccgagaggaa

SEQ ID NO: 423328 - DNA, 25 bp, Mus musculus
gaagagagatccctgaatttatttt

SEQ ID NO: 423329 - DNA, 25 bp, Mus musculus
gaagagagatccgtgaatttatttt

SEQ ID NO: 423330 - DNA, 25 bp, Mus musculus
gaagagagcagcctcatttctgcgc

SEQ ID NO: 423331 - DNA, 25 bp, Mus musculus
gaagagagcagcgtcatttctgcgc

SEQ ID NO: 423332 - DNA, 25 bp, Mus musculus
gaagagagccatcccaagggtccag

SEQ ID NO: 423333 - DNA, 25 bp, Mus musculus
gaagagagccatgccaagggtccag

SEQ ID NO: 423334 - DNA, 25 bp, Mus musculus
gaagagagcgttccgtagaccctcc

SEQ ID NO: 423335 - DNA, 25 bp, Mus musculus
gaagagagcgttgcgtagaccctcc

SEQ ID NO: 423336 - DNA, 25 bp, Mus musculus
gaagagagctataccctcaactcta

SEQ ID NO: 423337 - DNA, 25 bp, Mus musculus
gaagagagctattccctcaactcta

SEQ ID NO: 423338 - DNA, 25 bp, Mus musculus
gaagagaggaccaggcctcctgatg

SEQ ID NO: 423339 - DNA, 25 bp, Mus musculus
gaagagaggacctggcctcctgatg

SEQ ID NO: 423340 - DNA, 25 bp, Mus musculus
gaagagaggcctatcaggaattctt

SEQ ID NO: 423341 - DNA, 25 bp, Mus musculus
gaagagaggcctttcaggaattctt

SEQ ID NO: 423342 - DNA, 25 bp, Mus musculus
gaagagaggcttaccttgactcact

SEQ ID NO: 423343 - DNA, 25 bp, Mus musculus
gaagagaggctttccttgactcact

SEQ ID NO: 423344 - DNA, 25 bp, Mus musculus
gaagagagtaccaatccgcacgagt

SEQ ID NO: 423345 - DNA, 25 bp, Mus musculus
gaagagagtacctatccgcacgagt

SEQ ID NO: 423346 - DNA, 25 bp, Mus musculus
gaagagagtcacagactgggcactc

SEQ ID NO: 423347 - DNA, 25 bp, Mus musculus
gaagagagtcactgactgggcactc

SEQ ID NO: 423348 - DNA, 25 bp, Mus musculus
gaagagagtcgaacctgtgatcatt

SEQ ID NO: 423349 - DNA, 25 bp, Mus musculus
gaagagagtcgatcctgtgatcatt

SEQ ID NO: 423350 - DNA, 25 bp, Mus musculus
gaagagatacccagaggaacgcctt

SEQ ID NO: 423351 - DNA, 25 bp, Mus musculus
gaagagataccctgaggaacgcctt

SEQ ID NO: 423352 - DNA, 25 bp, Mus musculus
gaagagatattactccacaccctct

SEQ ID NO: 423353 - DNA, 25 bp, Mus musculus
gaagagatattagtccacaccctct

SEQ ID NO: 423354 - DNA, 25 bp, Mus musculus
gaagagatcacacctgtgtcatgaa

SEQ ID NO: 423355 - DNA, 25 bp, Mus musculus
gaagagatcacagctgtgtcatgaa

SEQ ID NO: 423356 - DNA, 25 bp, Mus musculus
gaagagatccaaaaggcatcttgaa

SEQ ID NO: 423357 - DNA, 25 bp, Mus musculus
gaagagatccaataggcatcttgaa

SEQ ID NO: 423358 - DNA, 25 bp, Mus musculus
gaagagatccctctatgcccttttt

SEQ ID NO: 423359 - DNA, 25 bp, Mus musculus
gaagagatccctgtatgcccttttt

SEQ ID NO: 423360 - DNA, 25 bp, Mus musculus
gaagagatcctaactctaggcctag

SEQ ID NO: 423361 - DNA, 25 bp, Mus musculus
gaagagatcctatctctaggcctag

SEQ ID NO: 423362 - DNA, 25 bp, Mus musculus
gaagagatccttcagctgcactcag

SEQ ID NO: 423363 - DNA, 25 bp, Mus musculus
gaagagatccttgagctgcactcag

SEQ ID NO: 423364 - DNA, 25 bp, Mus musculus
gaagagatctcgctagtctgggaat

SEQ ID NO: 423365 - DNA, 25 bp, Mus musculus
gaagagatctcggtagtctgggaat

SEQ ID NO: 423366 - DNA, 25 bp, Mus musculus
gaagagatctttccccatctgggac

SEQ ID NO: 423367 - DNA, 25 bp, Mus musculus
gaagagatctttgcccatctgggac

SEQ ID NO: 423368 - DNA, 25 bp, Mus musculus
gaagagatgaacactcagcaggagg

SEQ ID NO: 423369 - DNA, 25 bp, Mus musculus
gaagagatgaactctcagcaggagg

SEQ ID NO: 423370 - DNA, 25 bp, Mus musculus
gaagagatgacacaccccaaatatg

SEQ ID NO: 423371 - DNA, 25 bp, Mus musculus
gaagagatgacagaccccaaatatg

SEQ ID NO: 423372 - DNA, 25 bp, Mus musculus
gaagagatgattctctggtgagcat

SEQ ID NO: 423373 - DNA, 25 bp, Mus musculus
gaagagatgattgtctggtgagcat

SEQ ID NO: 423374 - DNA, 25 bp, Mus musculus
gaagagatgcttaccttttactcta

SEQ ID NO: 423375 - DNA, 25 bp, Mus musculus
gaagagatgctttccttttactcta

SEQ ID NO: 423376 - DNA, 25 bp, Mus musculus
gaagagatggaacgacccgcctctc

SEQ ID NO: 423377 - DNA, 25 bp, Mus musculus
gaagagatggaaggacccgcctctc

SEQ ID NO: 423378 - DNA, 25 bp, Mus musculus
gaagagatggcacgccatgccctgc

SEQ ID NO: 423379 - DNA, 25 bp, Mus musculus
gaagagatggcaggccatgccctgc

SEQ ID NO: 423380 - DNA, 25 bp, Mus musculus
gaagagatgtgcagtattttgataa

SEQ ID NO: 423381 - DNA, 25 bp, Mus musculus
gaagagatgtgctgtattttgataa

SEQ ID NO: 423382 - DNA, 25 bp, Mus musculus
gaagagattggaagtgtttcacact

SEQ ID NO: 423383 - DNA, 25 bp, Mus musculus
gaagagattggatgtgtttcacact

SEQ ID NO: 423384 - DNA, 25 bp, Mus musculus
gaagagattggcagtgtcattaaat

SEQ ID NO: 423385 - DNA, 25 bp, Mus musculus
gaagagattggctgtgtcattaaat

SEQ ID NO: 423386 - DNA, 25 bp, Mus musculus
gaagagattgttattaacaggcaga

SEQ ID NO: 423387 - DNA, 25 bp, Mus musculus
gaagagattgtttttaacaggcaga

SEQ ID NO: 423388 - DNA, 25 bp, Mus musculus
gaagagcaaaccatgagcacgtagc

SEQ ID NO: 423389 - DNA, 25 bp, Mus musculus
gaagagcaaaccttgagcacgtagc

SEQ ID NO: 423390 - DNA, 25 bp, Mus musculus
gaagagcaaatcctcctgcactgct

SEQ ID NO: 423391 - DNA, 25 bp, Mus musculus
gaagagcaaatcgtcctgcactgct

SEQ ID NO: 423392 - DNA, 25 bp, Mus musculus
gaagagcaacccctgatgcattgct

SEQ ID NO: 423393 - DNA, 25 bp, Mus musculus
gaagagcaacccgtgatgcattgct

SEQ ID NO: 423394 - DNA, 25 bp, Mus musculus
gaagagcaacctctatttttaacca

SEQ ID NO: 423395 - DNA, 25 bp, Mus musculus
gaagagcaacctgtatttttaacca

SEQ ID NO: 423396 - DNA, 25 bp, Mus musculus
gaagagcaagcacatcctgttcacc

SEQ ID NO: 423397 - DNA, 25 bp, Mus musculus
gaagagcaagcagatcctgttcacc

SEQ ID NO: 423398 - DNA, 25 bp, Mus musculus
gaagagcaagtgaacccgacagacg

SEQ ID NO: 423399 - DNA, 25 bp, Mus musculus
gaagagcaagtgtacccgacagacg

SEQ ID NO: 423400 - DNA, 25 bp, Mus musculus
gaagagcaatgtccactgtcaggtg

SEQ ID NO: 423401 - DNA, 25 bp, Mus musculus
gaagagcaatgtgcactgtcaggtg

SEQ ID NO: 423402 - DNA, 25 bp, Mus musculus
gaagagcaattcacactggtaactt

SEQ ID NO: 423403 - DNA, 25 bp, Mus musculus
gaagagcaattctcactggtaactt

SEQ ID NO: 423404 - DNA, 25 bp, Mus musculus
gaagagcacaggctgtgactttgca

SEQ ID NO: 423405 - DNA, 25 bp, Mus musculus
gaagagcacagggtgtgactttgca

SEQ ID NO: 423406 - DNA, 25 bp, Mus musculus
gaagagcacatgagattagttataa

SEQ ID NO: 423407 - DNA, 25 bp, Mus musculus
gaagagcacatgtgattagttataa

SEQ ID NO: 423408 - DNA, 25 bp, Mus musculus
gaagagcacattctacttaactgta

SEQ ID NO: 423409 - DNA, 25 bp, Mus musculus
gaagagcacattgtacttaactgta

SEQ ID NO: 423410 - DNA, 25 bp, Mus musculus
gaagagcaccatcgactaatcaaag

SEQ ID NO: 423411 - DNA, 25 bp, Mus musculus
gaagagcaccatggactaatcaaag

SEQ ID NO: 423412 - DNA, 25 bp, Mus musculus
gaagagcacctgaactgcaccattt

SEQ ID NO: 423413 - DNA, 25 bp, Mus musculus
gaagagcacctgtactgcaccattt

SEQ ID NO: 423414 - DNA, 25 bp, Mus musculus
gaagagcactaccacagagaggttt

SEQ ID NO: 423415 - DNA, 25 bp, Mus musculus
gaagagcactacgacagagaggttt

SEQ ID NO: 423416 - DNA, 25 bp, Mus musculus
gaagagcagacccaacagcgagccg

SEQ ID NO: 423417 - DNA, 25 bp, Mus musculus
gaagagcagaccgaacagcgagccg

SEQ ID NO: 423418 - DNA, 25 bp, Mus musculus
gaagagcagcagagcccagccttgt

SEQ ID NO: 423419 - DNA, 25 bp, Mus musculus
gaagagcagcagtgcccagccttgt

SEQ ID NO: 423420 - DNA, 25 bp, Mus musculus
gaagagcagcatctactgttaactg

SEQ ID NO: 423421 - DNA, 25 bp, Mus musculus
gaagagcagcatgtactgttaactg

SEQ ID NO: 423422 - DNA, 25 bp, Mus musculus
gaagagcagcccagtgcaatccctc

SEQ ID NO: 423423 - DNA, 25 bp, Mus musculus
gaagagcagcccatgttcttaccta

SEQ ID NO: 423424 - DNA, 25 bp, Mus musculus
gaagagcagccctgtgcaatccctc

SEQ ID NO: 423425 - DNA, 25 bp, Mus musculus
gaagagcagcccttgttcttaccta

SEQ ID NO: 423426 - DNA, 25 bp, Mus musculus
gaagagcatcatcgctctaccctga

SEQ ID NO: 423427 - DNA, 25 bp, Mus musculus
gaagagcatcatggctctaccctga

SEQ ID NO: 423428 - DNA, 25 bp, Mus musculus
gaagagcatgagacacgctgcgtaa

SEQ ID NO: 423429 - DNA, 25 bp, Mus musculus
gaagagcatgagtcacgctgcgtaa

SEQ ID NO: 423430 - DNA, 25 bp, Mus musculus
gaagagcatggccaagcaccattat

SEQ ID NO: 423431 - DNA, 25 bp, Mus musculus
gaagagcatggcgaagcaccattat

SEQ ID NO: 423432 - DNA, 25 bp, Mus musculus
gaagagccaatcaaatcaaccatat

SEQ ID NO: 423433 - DNA, 25 bp, Mus musculus
gaagagccaatctaatcaaccatat

SEQ ID NO: 423434 - DNA, 25 bp, Mus musculus
gaagagccacatagtttttacagag

SEQ ID NO: 423435 - DNA, 25 bp, Mus musculus
gaagagccacattgtttttacagag

SEQ ID NO: 423436 - DNA, 25 bp, Mus musculus
gaagagccacttcctagagatcttt

SEQ ID NO: 423437 - DNA, 25 bp, Mus musculus
gaagagccacttgctagagatcttt

SEQ ID NO: 423438 - DNA, 25 bp, Mus musculus
gaagagccagaaccggaagttatca

SEQ ID NO: 423439 - DNA, 25 bp, Mus musculus
gaagagccagaagcggaagttatca

SEQ ID NO: 423440 - DNA, 25 bp, Mus musculus
gaagagccaggacttgtacacacac

SEQ ID NO: 423441 - DNA, 25 bp, Mus musculus
gaagagccaggagttgtacacacac

SEQ ID NO: 423442 - DNA, 25 bp, Mus musculus
gaagagccatatctcctattaaaac

SEQ ID NO: 423443 - DNA, 25 bp, Mus musculus
gaagagccatatgtcctattaaaac

SEQ ID NO: 423444 - DNA, 25 bp, Mus musculus
gaagagccattacatcgttgggaga

SEQ ID NO: 423445 - DNA, 25 bp, Mus musculus
gaagagccattagatcgttgggaga

SEQ ID NO: 423446 - DNA, 25 bp, Mus musculus
gaagagccattccatttagtgatca

SEQ ID NO: 423447 - DNA, 25 bp, Mus musculus
gaagagccattcgatttagtgatca

SEQ ID NO: 423448 - DNA, 25 bp, Mus musculus
gaagagcccataacctggagcccag

SEQ ID NO: 423449 - DNA, 25 bp, Mus musculus
gaagagcccatatcctggagcccag

SEQ ID NO: 423450 - DNA, 25 bp, Mus musculus
gaagagcccattccctgctaaaaga

SEQ ID NO: 423451 - DNA, 25 bp, Mus musculus
gaagagcccattctgaagtggtata

SEQ ID NO: 423452 - DNA, 25 bp, Mus musculus
gaagagcccattgcctgctaaaaga

SEQ ID NO: 423453 - DNA, 25 bp, Mus musculus
gaagagcccattgtgaagtggtata

SEQ ID NO: 423454 - DNA, 25 bp, Mus musculus
gaagagccccttatagtcacgaagt

SEQ ID NO: 423455 - DNA, 25 bp, Mus musculus
gaagagccccttttagtcacgaagt

SEQ ID NO: 423456 - DNA, 25 bp, Mus musculus
gaagagcccgacattcaatagaaac

SEQ ID NO: 423457 - DNA, 25 bp, Mus musculus
gaagagcccgactttcaatagaaac

SEQ ID NO: 423458 - DNA, 25 bp, Mus musculus
gaagagcccggcaccagctttggga

SEQ ID NO: 423459 - DNA, 25 bp, Mus musculus
gaagagcccggctccagctttggga

SEQ ID NO: 423460 - DNA, 25 bp, Mus musculus
gaagagcccttaaagagcttgtgct

SEQ ID NO: 423461 - DNA, 25 bp, Mus musculus
gaagagcccttatagagcttgtgct

SEQ ID NO: 423462 - DNA, 25 bp, Mus musculus
gaagagcccttgaccagtgtacaca

SEQ ID NO: 423463 - DNA, 25 bp, Mus musculus
gaagagcccttgtccagtgtacaca

SEQ ID NO: 423464 - DNA, 25 bp, Mus musculus
gaagagcctcgaaactgactccaaa

SEQ ID NO: 423465 - DNA, 25 bp, Mus musculus
gaagagcctcgatactgactccaaa

SEQ ID NO: 423466 - DNA, 25 bp, Mus musculus
gaagagcctgagacactgtagcaag

SEQ ID NO: 423467 - DNA, 25 bp, Mus musculus
gaagagcctgagtcactgtagcaag

SEQ ID NO: 423468 - DNA, 25 bp, Mus musculus
gaagagcctggaacacataggcaca

SEQ ID NO: 423469 - DNA, 25 bp, Mus musculus
gaagagcctggatcacataggcaca

SEQ ID NO: 423470 - DNA, 25 bp, Mus musculus
gaagagccttctaaccaagcaggta

SEQ ID NO: 423471 - DNA, 25 bp, Mus musculus
gaagagccttctatagccacataca

SEQ ID NO: 423472 - DNA, 25 bp, Mus musculus
gaagagccttcttaccaagcaggta

SEQ ID NO: 423473 - DNA, 25 bp, Mus musculus
gaagagccttctttagccacataca

SEQ ID NO: 423474 - DNA, 25 bp, Mus musculus
gaagagcctttaactgaggacctgg

SEQ ID NO: 423475 - DNA, 25 bp, Mus musculus
gaagagcctttatctgaggacctgg

SEQ ID NO: 423476 - DNA, 25 bp, Mus musculus
gaagagcgaccacgcactgggctct

SEQ ID NO: 423477 - DNA, 25 bp, Mus musculus
gaagagcgaccaggcactgggctct

SEQ ID NO: 423478 - DNA, 25 bp, Mus musculus
gaagagcgacgcatgcaggaggagc

SEQ ID NO: 423479 - DNA, 25 bp, Mus musculus
gaagagcgacgcttgcaggaggagc

SEQ ID NO: 423480 - DNA, 25 bp, Mus musculus
gaagagcgagctcttgctcctcttg

SEQ ID NO: 423481 - DNA, 25 bp, Mus musculus
gaagagcgagctgttgctcctcttg

SEQ ID NO: 423482 - DNA, 25 bp, Mus musculus
gaagagcgagtccaaggcttcctga

SEQ ID NO: 423483 - DNA, 25 bp, Mus musculus
gaagagcgagtcgaaggcttcctga

SEQ ID NO: 423484 - DNA, 25 bp, Mus musculus
gaagagcgcaccctcctcagtggta

SEQ ID NO: 423485 - DNA, 25 bp, Mus musculus
gaagagcgcaccgtcctcagtggta

SEQ ID NO: 423486 - DNA, 25 bp, Mus musculus
gaagagcgccagcacagcatggact

SEQ ID NO: 423487 - DNA, 25 bp, Mus musculus
gaagagcgccaggacagcatggact

SEQ ID NO: 423488 - DNA, 25 bp, Mus musculus
gaagagcgcctcagagggaaccaca

SEQ ID NO: 423489 - DNA, 25 bp, Mus musculus
gaagagcgcctctgagggaaccaca

SEQ ID NO: 423490 - DNA, 25 bp, Mus musculus
gaagagcgctgtacttttatctggc

SEQ ID NO: 423491 - DNA, 25 bp, Mus musculus
gaagagcgctgttcttttatctggc

SEQ ID NO: 423492 - DNA, 25 bp, Mus musculus
gaagagcgggatacagaacatgctg

SEQ ID NO: 423493 - DNA, 25 bp, Mus musculus
gaagagcgggattcagaacatgctg

SEQ ID NO: 423494 - DNA, 25 bp, Mus musculus
gaagagcgggctaacgtactttgtg

SEQ ID NO: 423495 - DNA, 25 bp, Mus musculus
gaagagcgggctacattgctgcagc

SEQ ID NO: 423496 - DNA, 25 bp, Mus musculus
gaagagcgggcttacgtactttgtg

SEQ ID NO: 423497 - DNA, 25 bp, Mus musculus
gaagagcgggcttcattgctgcagc

SEQ ID NO: 423498 - DNA, 25 bp, Mus musculus
gaagagcgggtaaccctgatcagga

SEQ ID NO: 423499 - DNA, 25 bp, Mus musculus
gaagagcgggtatccctgatcagga

SEQ ID NO: 423500 - DNA, 25 bp, Mus musculus
gaagagcggttcatggcttccaacc

SEQ ID NO: 423501 - DNA, 25 bp, Mus musculus
gaagagcggttcttggcttccaacc

SEQ ID NO: 423502 - DNA, 25 bp, Mus musculus
gaagagcgtcacctgaacaagatgc

SEQ ID NO: 423503 - DNA, 25 bp, Mus musculus
gaagagcgtcacgtgaacaagatgc

SEQ ID NO: 423504 - DNA, 25 bp, Mus musculus
gaagagcgttccaccttcacatcct

SEQ ID NO: 423505 - DNA, 25 bp, Mus musculus
gaagagcgttcctccttcacatcct

SEQ ID NO: 423506 - DNA, 25 bp, Mus musculus
gaagagcgttttacacctgtacgag

SEQ ID NO: 423507 - DNA, 25 bp, Mus musculus
gaagagcgtttttcacctgtacgag

SEQ ID NO: 423508 - DNA, 25 bp, Mus musculus
gaagagctaaggatgcccgagacaa

SEQ ID NO: 423509 - DNA, 25 bp, Mus musculus
gaagagctaaggttgcccgagacaa

SEQ ID NO: 423510 - DNA, 25 bp, Mus musculus
gaagagctaattaatcaacacacag

SEQ ID NO: 423511 - DNA, 25 bp, Mus musculus
gaagagctaatttatcaacacacag

SEQ ID NO: 423512 - DNA, 25 bp, Mus musculus
gaagagctagacatacagcagagtt

SEQ ID NO: 423513 - DNA, 25 bp, Mus musculus
gaagagctagacttacagcagagtt

SEQ ID NO: 423514 - DNA, 25 bp, Mus musculus
gaagagctagctaaacagctgcaga

SEQ ID NO: 423515 - DNA, 25 bp, Mus musculus
gaagagctagcttaacagctgcaga

SEQ ID NO: 423516 - DNA, 25 bp, Mus musculus
gaagagctagtcaccatactgctca

SEQ ID NO: 423517 - DNA, 25 bp, Mus musculus
gaagagctagtctccatactgctca

SEQ ID NO: 423518 - DNA, 25 bp, Mus musculus
gaagagctatttccatggagcaaca

SEQ ID NO: 423519 - DNA, 25 bp, Mus musculus
gaagagctatttgcatggagcaaca

SEQ ID NO: 423520 - DNA, 25 bp, Mus musculus
gaagagctcaataccaagatgatgg

SEQ ID NO: 423521 - DNA, 25 bp, Mus musculus
gaagagctcaatccccgcacagcag

SEQ ID NO: 423522 - DNA, 25 bp, Mus musculus
gaagagctcaatgcccgcacagcag

SEQ ID NO: 423523 - DNA, 25 bp, Mus musculus
gaagagctcaattccaagatgatgg

SEQ ID NO: 423524 - DNA, 25 bp, Mus musculus
gaagagctcataactaacccagcat

SEQ ID NO: 423525 - DNA, 25 bp, Mus musculus
gaagagctcataccctgcttggagg

SEQ ID NO: 423526 - DNA, 25 bp, Mus musculus
gaagagctcatagcctgcttggagg

SEQ ID NO: 423527 - DNA, 25 bp, Mus musculus
gaagagctcatatctaacccagcat

SEQ ID NO: 423528 - DNA, 25 bp, Mus musculus
gaagagctccatatatcaaaccatc

SEQ ID NO: 423529 - DNA, 25 bp, Mus musculus
gaagagctccatttatcaaaccatc

SEQ ID NO: 423530 - DNA, 25 bp, Mus musculus
gaagagctcgaaaatgtcacttagt

SEQ ID NO: 423531 - DNA, 25 bp, Mus musculus
gaagagctcgaatatgtcacttagt

SEQ ID NO: 423532 - DNA, 25 bp, Mus musculus
gaagagctcgagactaacaaggcca

SEQ ID NO: 423533 - DNA, 25 bp, Mus musculus
gaagagctcgagattgacgttgaaa

SEQ ID NO: 423534 - DNA, 25 bp, Mus musculus
gaagagctcgagtctaacaaggcca

SEQ ID NO: 423535 - DNA, 25 bp, Mus musculus
gaagagctcgagtttgacgttgaaa

SEQ ID NO: 423536 - DNA, 25 bp, Mus musculus
gaagagctctcaccaagtgtacagc

SEQ ID NO: 423537 - DNA, 25 bp, Mus musculus
gaagagctctcagcaagtgtacagc

SEQ ID NO: 423538 - DNA, 25 bp, Mus musculus
gaagagctctggatcttgaggtcca

SEQ ID NO: 423539 - DNA, 25 bp, Mus musculus
gaagagctctggttcttgaggtcca

SEQ ID NO: 423540 - DNA, 25 bp, Mus musculus
gaagagctctgtccaacaagccagc

SEQ ID NO: 423541 - DNA, 25 bp, Mus musculus
gaagagctctgtgcaacaagccagc

SEQ ID NO: 423542 - DNA, 25 bp, Mus musculus
gaagagctcttcagtgtattgaggt

SEQ ID NO: 423543 - DNA, 25 bp, Mus musculus
gaagagctcttctgtgtattgaggt

SEQ ID NO: 423544 - DNA, 25 bp, Mus musculus
gaagagctgaaaagtgtacctgcca

SEQ ID NO: 423545 - DNA, 25 bp, Mus musculus
gaagagctgaaatgtgtacctgcca

SEQ ID NO: 423546 - DNA, 25 bp, Mus musculus
gaagagctgaccctatcgtctatcc

SEQ ID NO: 423547 - DNA, 25 bp, Mus musculus
gaagagctgaccgtatcgtctatcc

SEQ ID NO: 423548 - DNA, 25 bp, Mus musculus
gaagagctgagtcgttgagcaccca

SEQ ID NO: 423549 - DNA, 25 bp, Mus musculus
gaagagctgagtggttgagcaccca

SEQ ID NO: 423550 - DNA, 25 bp, Mus musculus
gaagagctgcatcagacatacctag

SEQ ID NO: 423551 - DNA, 25 bp, Mus musculus
gaagagctgcatgagacatacctag

SEQ ID NO: 423552 - DNA, 25 bp, Mus musculus
gaagagctgccgaagactgtcagtg

SEQ ID NO: 423553 - DNA, 25 bp, Mus musculus
gaagagctgccgtagactgtcagtg

SEQ ID NO: 423554 - DNA, 25 bp, Mus musculus
gaagagctgctaagtgccagaaaat

SEQ ID NO: 423555 - DNA, 25 bp, Mus musculus
gaagagctgctatgtgccagaaaat

SEQ ID NO: 423556 - DNA, 25 bp, Mus musculus
gaagagctgctgaatttagcatgct

SEQ ID NO: 423557 - DNA, 25 bp, Mus musculus
gaagagctgctgtatttagcatgct

SEQ ID NO: 423558 - DNA, 25 bp, Mus musculus
gaagagctgcttacagagcgggcaa

SEQ ID NO: 423559 - DNA, 25 bp, Mus musculus
gaagagctgcttatcagccacaagc

SEQ ID NO: 423560 - DNA, 25 bp, Mus musculus
gaagagctgctttcagagcgggcaa

SEQ ID NO: 423561 - DNA, 25 bp, Mus musculus
gaagagctgcttttcagccacaagc

SEQ ID NO: 423562 - DNA, 25 bp, Mus musculus
gaagagctggacatcttcaccagca

SEQ ID NO: 423563 - DNA, 25 bp, Mus musculus
gaagagctggaccaacacacggcaa

SEQ ID NO: 423564 - DNA, 25 bp, Mus musculus
gaagagctggacgaacacacggcaa

SEQ ID NO: 423565 - DNA, 25 bp, Mus musculus
gaagagctggacttcttcaccagca

SEQ ID NO: 423566 - DNA, 25 bp, Mus musculus
gaagagctggcgcttcttttccctc

SEQ ID NO: 423567 - DNA, 25 bp, Mus musculus
gaagagctggcggttcttttccctc

SEQ ID NO: 423568 - DNA, 25 bp, Mus musculus
gaagagctggctacccagggaccct

SEQ ID NO: 423569 - DNA, 25 bp, Mus musculus
gaagagctggcttcccagggaccct

SEQ ID NO: 423570 - DNA, 25 bp, Mus musculus
gaagagctgtacaccagaaccctcc

SEQ ID NO: 423571 - DNA, 25 bp, Mus musculus
gaagagctgtactccagaaccctcc

SEQ ID NO: 423572 - DNA, 25 bp, Mus musculus
gaagagctgtatcccttcatgccag

SEQ ID NO: 423573 - DNA, 25 bp, Mus musculus
gaagagctgtatgccttcatgccag

SEQ ID NO: 423574 - DNA, 25 bp, Mus musculus
gaagagctgtccagattgccatgga

SEQ ID NO: 423575 - DNA, 25 bp, Mus musculus
gaagagctgtcctgattgccatgga

SEQ ID NO: 423576 - DNA, 25 bp, Mus musculus
gaagagctgtcgagcctgttggacc

SEQ ID NO: 423577 - DNA, 25 bp, Mus musculus
gaagagctgtcgtgcctgttggacc

SEQ ID NO: 423578 - DNA, 25 bp, Mus musculus
gaagagctgtggaatcattactcaa

SEQ ID NO: 423579 - DNA, 25 bp, Mus musculus
gaagagctgtggtatcattactcaa

SEQ ID NO: 423580 - DNA, 25 bp, Mus musculus
gaagagcttcagaaatagtgggagt

SEQ ID NO: 423581 - DNA, 25 bp, Mus musculus
gaagagcttcagtaatagtgggagt

SEQ ID NO: 423582 - DNA, 25 bp, Mus musculus
gaagagcttcccaattatgcaaaaa

SEQ ID NO: 423583 - DNA, 25 bp, Mus musculus
gaagagcttccctattatgcaaaaa

SEQ ID NO: 423584 - DNA, 25 bp, Mus musculus
gaagagcttcctctggaacacgagc

SEQ ID NO: 423585 - DNA, 25 bp, Mus musculus
gaagagcttcctgtggaacacgagc

SEQ ID NO: 423586 - DNA, 25 bp, Mus musculus
gaagagcttcttccttcaaaggatc

SEQ ID NO: 423587 - DNA, 25 bp, Mus musculus
gaagagcttcttgcttcaaaggatc

SEQ ID NO: 423588 - DNA, 25 bp, Mus musculus
gaagagcttgcaacaacaaagatgt

SEQ ID NO: 423589 - DNA, 25 bp, Mus musculus
gaagagcttgcaagtctgttgatta

SEQ ID NO: 423590 - DNA, 25 bp, Mus musculus
gaagagcttgcatcaacaaagatgt

SEQ ID NO: 423591 - DNA, 25 bp, Mus musculus
gaagagcttgcatgtctgttgatta

SEQ ID NO: 423592 - DNA, 25 bp, Mus musculus
gaagagctttacatagtctccgtgt

SEQ ID NO: 423593 - DNA, 25 bp, Mus musculus
gaagagctttacttagtctccgtgt

SEQ ID NO: 423594 - DNA, 25 bp, Mus musculus
gaagagctttagaccaacctgctgc

SEQ ID NO: 423595 - DNA, 25 bp, Mus musculus
gaagagctttagtccaacctgctgc

SEQ ID NO: 423596 - DNA, 25 bp, Mus musculus
gaagagctttgtcttttatgctaat

SEQ ID NO: 423597 - DNA, 25 bp, Mus musculus
gaagagctttgtgttttatgctaat

SEQ ID NO: 423598 - DNA, 25 bp, Mus musculus
gaagagcttttgagcatgcccctga

SEQ ID NO: 423599 - DNA, 25 bp, Mus musculus
gaagagcttttgtgcatgcccctga

SEQ ID NO: 423600 - DNA, 25 bp, Mus musculus
gaagaggaacagatctcctttcccg

SEQ ID NO: 423601 - DNA, 25 bp, Mus musculus
gaagaggaacagttctcctttcccg

SEQ ID NO: 423602 - DNA, 25 bp, Mus musculus
gaagaggaaccccttgaggaaagat

SEQ ID NO: 423603 - DNA, 25 bp, Mus musculus
gaagaggaacccgttgaggaaagat

SEQ ID NO: 423604 - DNA, 25 bp, Mus musculus
gaagaggaaccgctatcattgacaa

SEQ ID NO: 423605 - DNA, 25 bp, Mus musculus
gaagaggaaccggtatcattgacaa

SEQ ID NO: 423606 - DNA, 25 bp, Mus musculus
gaagaggaacgtaagacagccagcc

SEQ ID NO: 423607 - DNA, 25 bp, Mus musculus
gaagaggaacgttagacagccagcc

SEQ ID NO: 423608 - DNA, 25 bp, Mus musculus
gaagaggaactccatctcacatgcc

SEQ ID NO: 423609 - DNA, 25 bp, Mus musculus
gaagaggaactcgatctcacatgcc

SEQ ID NO: 423610 - DNA, 25 bp, Mus musculus
gaagaggaagggacacccaccacac

SEQ ID NO: 423611 - DNA, 25 bp, Mus musculus
gaagaggaagggtcacccaccacac

SEQ ID NO: 423612 - DNA, 25 bp, Mus musculus
gaagaggaagtcatctgctacgctt

SEQ ID NO: 423613 - DNA, 25 bp, Mus musculus
gaagaggaagtcttctgctacgctt

SEQ ID NO: 423614 - DNA, 25 bp, Mus musculus
gaagaggaatgcacctcaccaggcc

SEQ ID NO: 423615 - DNA, 25 bp, Mus musculus
gaagaggaatgctcctcaccaggcc

SEQ ID NO: 423616 - DNA, 25 bp, Mus musculus
gaagaggaattaacgtgtttctgtt

SEQ ID NO: 423617 - DNA, 25 bp, Mus musculus
gaagaggaattatcgtgtttctgtt

SEQ ID NO: 423618 - DNA, 25 bp, Mus musculus
gaagaggacactatagcagctgaag

SEQ ID NO: 423619 - DNA, 25 bp, Mus musculus
gaagaggacactcgcatttacacat

SEQ ID NO: 423620 - DNA, 25 bp, Mus musculus
gaagaggacactggcatttacacat

SEQ ID NO: 423621 - DNA, 25 bp, Mus musculus
gaagaggacactttagcagctgaag

SEQ ID NO: 423622 - DNA, 25 bp, Mus musculus
gaagaggacagtcccctgatcatca

SEQ ID NO: 423623 - DNA, 25 bp, Mus musculus
gaagaggacagtgccctgatcatca

SEQ ID NO: 423624 - DNA, 25 bp, Mus musculus
gaagaggaccaaatgctggagaata

SEQ ID NO: 423625 - DNA, 25 bp, Mus musculus
gaagaggaccaattgctggagaata

SEQ ID NO: 423626 - DNA, 25 bp, Mus musculus
gaagaggacctcaactcagtaggct

SEQ ID NO: 423627 - DNA, 25 bp, Mus musculus
gaagaggacctcattctgcagtgta

SEQ ID NO: 423628 - DNA, 25 bp, Mus musculus
gaagaggacctctactcagtaggct

SEQ ID NO: 423629 - DNA, 25 bp, Mus musculus
gaagaggacctctttctgcagtgta

SEQ ID NO: 423630 - DNA, 25 bp, Mus musculus
gaagaggactgtagcccacaagagc

SEQ ID NO: 423631 - DNA, 25 bp, Mus musculus
gaagaggactgttgcccacaagagc

SEQ ID NO: 423632 - DNA, 25 bp, Mus musculus
gaagaggagactactgtctgtggcc

SEQ ID NO: 423633 - DNA, 25 bp, Mus musculus
gaagaggagacttctgtctgtggcc

SEQ ID NO: 423634 - DNA, 25 bp, Mus musculus
gaagaggagcccacttttcagcatc

SEQ ID NO: 423635 - DNA, 25 bp, Mus musculus
gaagaggagcccagcgtcgtcatca

SEQ ID NO: 423636 - DNA, 25 bp, Mus musculus
gaagaggagccctcttttcagcatc

SEQ ID NO: 423637 - DNA, 25 bp, Mus musculus
gaagaggagccctgcgtcgtcatca

SEQ ID NO: 423638 - DNA, 25 bp, Mus musculus
gaagaggagcctattaaccatatga

SEQ ID NO: 423639 - DNA, 25 bp, Mus musculus
gaagaggagccttttaaccatatga

SEQ ID NO: 423640 - DNA, 25 bp, Mus musculus
gaagaggagcgcagcctgctgtctt

SEQ ID NO: 423641 - DNA, 25 bp, Mus musculus
gaagaggagcgctgcctgctgtctt

SEQ ID NO: 423642 - DNA, 25 bp, Mus musculus
gaagaggagctcacggatccaccgg

SEQ ID NO: 423643 - DNA, 25 bp, Mus musculus
gaagaggagctctcggatccaccgg

SEQ ID NO: 423644 - DNA, 25 bp, Mus musculus
gaagaggaggaacccgtccaagccc

SEQ ID NO: 423645 - DNA, 25 bp, Mus musculus
gaagaggaggaagccgtccaagccc

SEQ ID NO: 423646 - DNA, 25 bp, Mus musculus
gaagaggagggcatacccttgcaag

SEQ ID NO: 423647 - DNA, 25 bp, Mus musculus
gaagaggagggcttacccttgcaag

SEQ ID NO: 423648 - DNA, 25 bp, Mus musculus
gaagaggagtgaaccgtctcctccg

SEQ ID NO: 423649 - DNA, 25 bp, Mus musculus
gaagaggagtgatccgtctcctccg

SEQ ID NO: 423650 - DNA, 25 bp, Mus musculus
gaagaggatccaataccagctagtg

SEQ ID NO: 423651 - DNA, 25 bp, Mus musculus
gaagaggatccattaccagctagtg

SEQ ID NO: 423652 - DNA, 25 bp, Mus musculus
gaagaggatgctatctactccaaaa

SEQ ID NO: 423653 - DNA, 25 bp, Mus musculus
gaagaggatgctttctactccaaaa

SEQ ID NO: 423654 - DNA, 25 bp, Mus musculus
gaagaggatggcagcccacttaaag

SEQ ID NO: 423655 - DNA, 25 bp, Mus musculus
gaagaggatggctgcccacttaaag

SEQ ID NO: 423656 - DNA, 25 bp, Mus musculus
gaagaggattaaataatacttggct

SEQ ID NO: 423657 - DNA, 25 bp, Mus musculus
gaagaggattaattaatacttggct

SEQ ID NO: 423658 - DNA, 25 bp, Mus musculus
gaagaggcaccacagtcctataaga

SEQ ID NO: 423659 - DNA, 25 bp, Mus musculus
gaagaggcaccagagtcctataaga

SEQ ID NO: 423660 - DNA, 25 bp, Mus musculus
gaagaggcactaaagcagctgttcg

SEQ ID NO: 423661 - DNA, 25 bp, Mus musculus
gaagaggcactatagcagctgttcg

SEQ ID NO: 423662 - DNA, 25 bp, Mus musculus
gaagaggcacttataaatcccacgt

SEQ ID NO: 423663 - DNA, 25 bp, Mus musculus
gaagaggcacttttaaatcccacgt

SEQ ID NO: 423664 - DNA, 25 bp, Mus musculus
gaagaggcagctctggacctgaaca

SEQ ID NO: 423665 - DNA, 25 bp, Mus musculus
gaagaggcagctgtggacctgaaca

SEQ ID NO: 423666 - DNA, 25 bp, Mus musculus
gaagaggcagtacggcaccatcagc

SEQ ID NO: 423667 - DNA, 25 bp, Mus musculus
gaagaggcagtagggcaccatcagc

SEQ ID NO: 423668 - DNA, 25 bp, Mus musculus
gaagaggcagttagcccaccagcag

SEQ ID NO: 423669 - DNA, 25 bp, Mus musculus
gaagaggcagtttgcccaccagcag

SEQ ID NO: 423670 - DNA, 25 bp, Mus musculus
gaagaggcatctacatatcccagaa

SEQ ID NO: 423671 - DNA, 25 bp, Mus musculus
gaagaggcatcttcatatcccagaa

SEQ ID NO: 423672 - DNA, 25 bp, Mus musculus
gaagaggcatttctaccagttatca

SEQ ID NO: 423673 - DNA, 25 bp, Mus musculus
gaagaggcatttgtaccagttatca

SEQ ID NO: 423674 - DNA, 25 bp, Mus musculus
gaagaggccctgactcatatgtatc

SEQ ID NO: 423675 - DNA, 25 bp, Mus musculus
gaagaggccctgtctcatatgtatc

SEQ ID NO: 423676 - DNA, 25 bp, Mus musculus
gaagaggccttcaggatagacaaga

SEQ ID NO: 423677 - DNA, 25 bp, Mus musculus
gaagaggccttctggatagacaaga

SEQ ID NO: 423678 - DNA, 25 bp, Mus musculus
gaagaggccttgaatttctcctatg

SEQ ID NO: 423679 - DNA, 25 bp, Mus musculus
gaagaggccttgactgcgcaacacc

SEQ ID NO: 423680 - DNA, 25 bp, Mus musculus
gaagaggccttgtatttctcctatg

SEQ ID NO: 423681 - DNA, 25 bp, Mus musculus
gaagaggccttgtctgcgcaacacc

SEQ ID NO: 423682 - DNA, 25 bp, Mus musculus
gaagaggcctttctcagttttcatt

SEQ ID NO: 423683 - DNA, 25 bp, Mus musculus
gaagaggcctttgtcagttttcatt

SEQ ID NO: 423684 - DNA, 25 bp, Mus musculus
gaagaggcgagtcgcacgactactc

SEQ ID NO: 423685 - DNA, 25 bp, Mus musculus
gaagaggcgagtggcacgactactc

SEQ ID NO: 423686 - DNA, 25 bp, Mus musculus
gaagaggcgcataggctcaggactt

SEQ ID NO: 423687 - DNA, 25 bp, Mus musculus
gaagaggcgcattggctcaggactt

SEQ ID NO: 423688 - DNA, 25 bp, Mus musculus
gaagaggcggcactgataccaacat

SEQ ID NO: 423689 - DNA, 25 bp, Mus musculus
gaagaggcggcagtgataccaacat

SEQ ID NO: 423690 - DNA, 25 bp, Mus musculus
gaagaggcgtctctcatcaactgcc

SEQ ID NO: 423691 - DNA, 25 bp, Mus musculus
gaagaggcgtctgtcatcaactgcc

SEQ ID NO: 423692 - DNA, 25 bp, Mus musculus
gaagaggcgtgcacagtccttgtca

SEQ ID NO: 423693 - DNA, 25 bp, Mus musculus
gaagaggcgtgctcagtccttgtca

SEQ ID NO: 423694 - DNA, 25 bp, Mus musculus
gaagaggctaacatcaaggtgactg

SEQ ID NO: 423695 - DNA, 25 bp, Mus musculus
gaagaggctaacttcaaggtgactg

SEQ ID NO: 423696 - DNA, 25 bp, Mus musculus
gaagaggctcagagctctagccact

SEQ ID NO: 423697 - DNA, 25 bp, Mus musculus
gaagaggctcagtgctctagccact

SEQ ID NO: 423698 - DNA, 25 bp, Mus musculus
gaagaggctcgcagttcattttgat

SEQ ID NO: 423699 - DNA, 25 bp, Mus musculus
gaagaggctcgctgttcattttgat

SEQ ID NO: 423700 - DNA, 25 bp, Mus musculus
gaagaggctgccacgtgcttgtgtc

SEQ ID NO: 423701 - DNA, 25 bp, Mus musculus
gaagaggctgcctcgtgcttgtgtc

SEQ ID NO: 423702 - DNA, 25 bp, Mus musculus
gaagaggctggactttttactacca

SEQ ID NO: 423703 - DNA, 25 bp, Mus musculus
gaagaggctggagtttttactacca

SEQ ID NO: 423704 - DNA, 25 bp, Mus musculus
gaagaggctgtaactttctgcaacc

SEQ ID NO: 423705 - DNA, 25 bp, Mus musculus
gaagaggctgtatctttctgcaacc

SEQ ID NO: 423706 - DNA, 25 bp, Mus musculus
gaagaggctgtgattgcccgagatc

SEQ ID NO: 423707 - DNA, 25 bp, Mus musculus
gaagaggctgtgtttgcccgagatc

SEQ ID NO: 423708 - DNA, 25 bp, Mus musculus
gaagaggcttcaagttctactgtat

SEQ ID NO: 423709 - DNA, 25 bp, Mus musculus
gaagaggcttcatgttctactgtat

SEQ ID NO: 423710 - DNA, 25 bp, Mus musculus
gaagaggcttctatgtagtctgtgt

SEQ ID NO: 423711 - DNA, 25 bp, Mus musculus
gaagaggcttctttgtagtctgtgt

SEQ ID NO: 423712 - DNA, 25 bp, Mus musculus
gaagaggctttcaaacgtgtgattt

SEQ ID NO: 423713 - DNA, 25 bp, Mus musculus
gaagaggctttctaacgtgtgattt

SEQ ID NO: 423714 - DNA, 25 bp, Mus musculus
gaagaggcttttctattccaccttt

SEQ ID NO: 423715 - DNA, 25 bp, Mus musculus
gaagaggcttttgtattccaccttt

SEQ ID NO: 423716 - DNA, 25 bp, Mus musculus
gaagagggaattcgacctcctggaa

SEQ ID NO: 423717 - DNA, 25 bp, Mus musculus
gaagagggaattggacctcctggaa

SEQ ID NO: 423718 - DNA, 25 bp, Mus musculus
gaagagggacatacatgcatactga

SEQ ID NO: 423719 - DNA, 25 bp, Mus musculus
gaagagggacattcatgcatactga

SEQ ID NO: 423720 - DNA, 25 bp, Mus musculus
gaagagggatgtagccctctgctct

SEQ ID NO: 423721 - DNA, 25 bp, Mus musculus
gaagagggatgttgccctctgctct

SEQ ID NO: 423722 - DNA, 25 bp, Mus musculus
gaagagggcaatattgcaaccccta

SEQ ID NO: 423723 - DNA, 25 bp, Mus musculus
gaagagggcaattttgcaaccccta

SEQ ID NO: 423724 - DNA, 25 bp, Mus musculus
gaagagggccaacgagccgtacacc

SEQ ID NO: 423725 - DNA, 25 bp, Mus musculus
gaagagggccaaggagccgtacacc

SEQ ID NO: 423726 - DNA, 25 bp, Mus musculus
gaagagggcccactattcagaacag

SEQ ID NO: 423727 - DNA, 25 bp, Mus musculus
gaagagggcccagtattcagaacag

SEQ ID NO: 423728 - DNA, 25 bp, Mus musculus
gaagagggcctgaccgtcagttcat

SEQ ID NO: 423729 - DNA, 25 bp, Mus musculus
gaagagggcctgtccgtcagttcat

SEQ ID NO: 423730 - DNA, 25 bp, Mus musculus
gaagagggctaccagctaccgaagt

SEQ ID NO: 423731 - DNA, 25 bp, Mus musculus
gaagagggctacgagctaccgaagt

SEQ ID NO: 423732 - DNA, 25 bp, Mus musculus
gaagagggctcccttacctagttgg

SEQ ID NO: 423733 - DNA, 25 bp, Mus musculus
gaagagggctccgttacctagttgg

SEQ ID NO: 423734 - DNA, 25 bp, Mus musculus
gaagagggctgcctgcccactttct

SEQ ID NO: 423735 - DNA, 25 bp, Mus musculus
gaagagggctgcgtgcccactttct

SEQ ID NO: 423736 - DNA, 25 bp, Mus musculus
gaagagggcttcaatcccacagtca

SEQ ID NO: 423737 - DNA, 25 bp, Mus musculus
gaagagggcttcactcttggcggcc

SEQ ID NO: 423738 - DNA, 25 bp, Mus musculus
gaagagggcttcatcttagtcctcc

SEQ ID NO: 423739 - DNA, 25 bp, Mus musculus
gaagagggcttctatcccacagtca

SEQ ID NO: 423740 - DNA, 25 bp, Mus musculus
gaagagggcttctctcttggcggcc

SEQ ID NO: 423741 - DNA, 25 bp, Mus musculus
gaagagggcttcttcttagtcctcc

SEQ ID NO: 423742 - DNA, 25 bp, Mus musculus
gaagaggggtctacaggctctttcc

SEQ ID NO: 423743 - DNA, 25 bp, Mus musculus
gaagaggggtcttcaggctctttcc

SEQ ID NO: 423744 - DNA, 25 bp, Mus musculus
gaagagggtagacccacaatccgag

SEQ ID NO: 423745 - DNA, 25 bp, Mus musculus
gaagagggtagagccacaatccgag

SEQ ID NO: 423746 - DNA, 25 bp, Mus musculus
gaagagggtcccagtcactcataaa

SEQ ID NO: 423747 - DNA, 25 bp, Mus musculus
gaagagggtccctgtcactcataaa

SEQ ID NO: 423748 - DNA, 25 bp, Mus musculus
gaagaggtcaccattgaccccacgt

SEQ ID NO: 423749 - DNA, 25 bp, Mus musculus
gaagaggtcacctttgaccccacgt

SEQ ID NO: 423750 - DNA, 25 bp, Mus musculus
gaagaggtcagcagttacagtgtgt

SEQ ID NO: 423751 - DNA, 25 bp, Mus musculus
gaagaggtcagctgttacagtgtgt

SEQ ID NO: 423752 - DNA, 25 bp, Mus musculus
gaagaggtccatccagagagctgct

SEQ ID NO: 423753 - DNA, 25 bp, Mus musculus
gaagaggtccatgcagagagctgct

SEQ ID NO: 423754 - DNA, 25 bp, Mus musculus
gaagaggtcctgaatgcagtctcat

SEQ ID NO: 423755 - DNA, 25 bp, Mus musculus
gaagaggtcctgtatgcagtctcat

SEQ ID NO: 423756 - DNA, 25 bp, Mus musculus
gaagaggtccttacccctgatggct

SEQ ID NO: 423757 - DNA, 25 bp, Mus musculus
gaagaggtcctttcccctgatggct

SEQ ID NO: 423758 - DNA, 25 bp, Mus musculus
gaagaggtcggtacaccaggagtaa

SEQ ID NO: 423759 - DNA, 25 bp, Mus musculus
gaagaggtcggttcaccaggagtaa

SEQ ID NO: 423760 - DNA, 25 bp, Mus musculus
gaagaggtcttccaagaaaaaggct

SEQ ID NO: 423761 - DNA, 25 bp, Mus musculus
gaagaggtcttcgaagaaaaaggct

SEQ ID NO: 423762 - DNA, 25 bp, Mus musculus
gaagaggtgaccagttcagaacatt

SEQ ID NO: 423763 - DNA, 25 bp, Mus musculus
gaagaggtgacctgttcagaacatt

SEQ ID NO: 423764 - DNA, 25 bp, Mus musculus
gaagaggtgcagaggctaacacaga

SEQ ID NO: 423765 - DNA, 25 bp, Mus musculus
gaagaggtgcagtggctaacacaga

SEQ ID NO: 423766 - DNA, 25 bp, Mus musculus
gaagaggtggccacccatcctgact

SEQ ID NO: 423767 - DNA, 25 bp, Mus musculus
gaagaggtggcctcccatcctgact

SEQ ID NO: 423768 - DNA, 25 bp, Mus musculus
gaagaggtgtatacacacatgcata

SEQ ID NO: 423769 - DNA, 25 bp, Mus musculus
gaagaggtgtattcacacatgcata

SEQ ID NO: 423770 - DNA, 25 bp, Mus musculus
gaagaggtgtcaaatcgccaagcct

SEQ ID NO: 423771 - DNA, 25 bp, Mus musculus
gaagaggtgtcatatcgccaagcct

SEQ ID NO: 423772 - DNA, 25 bp, Mus musculus
gaagaggttaccacttgagttagaa

SEQ ID NO: 423773 - DNA, 25 bp, Mus musculus
gaagaggttacctcttgagttagaa

SEQ ID NO: 423774 - DNA, 25 bp, Mus musculus
gaagaggttcatacattgactgtct

SEQ ID NO: 423775 - DNA, 25 bp, Mus musculus
gaagaggttcattcattgactgtct

SEQ ID NO: 423776 - DNA, 25 bp, Mus musculus
gaagaggttcctcgcgagcttatgc

SEQ ID NO: 423777 - DNA, 25 bp, Mus musculus
gaagaggttcctggcgagcttatgc

SEQ ID NO: 423778 - DNA, 25 bp, Mus musculus
gaagaggttcttatctacgcccttg

SEQ ID NO: 423779 - DNA, 25 bp, Mus musculus
gaagaggttcttttctacgcccttg

SEQ ID NO: 423780 - DNA, 25 bp, Mus musculus
gaagaggttgatattctccaccatc

SEQ ID NO: 423781 - DNA, 25 bp, Mus musculus
gaagaggttgattttctccaccatc

SEQ ID NO: 423782 - DNA, 25 bp, Mus musculus
gaagaggttgctaatgcccatcact

SEQ ID NO: 423783 - DNA, 25 bp, Mus musculus
gaagaggttgctctttactctccat

SEQ ID NO: 423784 - DNA, 25 bp, Mus musculus
gaagaggttgctgtttactctccat

SEQ ID NO: 423785 - DNA, 25 bp, Mus musculus
gaagaggttgcttatgcccatcact

SEQ ID NO: 423786 - DNA, 25 bp, Mus musculus
gaagaggttggaatctgctacgaaa

SEQ ID NO: 423787 - DNA, 25 bp, Mus musculus
gaagaggttggattctgctacgaaa

SEQ ID NO: 423788 - DNA, 25 bp, Mus musculus
gaagaggttggtagtagagtccaca

SEQ ID NO: 423789 - DNA, 25 bp, Mus musculus
gaagaggttggttgtagagtccaca

SEQ ID NO: 423790 - DNA, 25 bp, Mus musculus
gaagaggttgtgcttcctgacaaat

SEQ ID NO: 423791 - DNA, 25 bp, Mus musculus
gaagaggttgtggttcctgacaaat

SEQ ID NO: 423792 - DNA, 25 bp, Mus musculus
gaagagtaaaataccaacccaccat

SEQ ID NO: 423793 - DNA, 25 bp, Mus musculus
gaagagtaaaattccaacccaccat

SEQ ID NO: 423794 - DNA, 25 bp, Mus musculus
gaagagtaacccatttcactttgta

SEQ ID NO: 423795 - DNA, 25 bp, Mus musculus
gaagagtaacccttttcactttgta

SEQ ID NO: 423796 - DNA, 25 bp, Mus musculus
gaagagtaagaacctagcctctgct

SEQ ID NO: 423797 - DNA, 25 bp, Mus musculus
gaagagtaagaagctagcctctgct

SEQ ID NO: 423798 - DNA, 25 bp, Mus musculus
gaagagtaaggccatggcttttttc

SEQ ID NO: 423799 - DNA, 25 bp, Mus musculus
gaagagtaaggcgatggcttttttc

SEQ ID NO: 423800 - DNA, 25 bp, Mus musculus
gaagagtaagtgcaacctactaaga

SEQ ID NO: 423801 - DNA, 25 bp, Mus musculus
gaagagtaagtggaacctactaaga

SEQ ID NO: 423802 - DNA, 25 bp, Mus musculus
gaagagtaccacaccagttaaggag

SEQ ID NO: 423803 - DNA, 25 bp, Mus musculus
gaagagtaccactccagttaaggag

SEQ ID NO: 423804 - DNA, 25 bp, Mus musculus
gaagagtagaggcatccatttccct

SEQ ID NO: 423805 - DNA, 25 bp, Mus musculus
gaagagtagagggatccatttccct

SEQ ID NO: 423806 - DNA, 25 bp, Mus musculus
gaagagtatcacctgacccttcagg

SEQ ID NO: 423807 - DNA, 25 bp, Mus musculus
gaagagtatcacgtgacccttcagg

SEQ ID NO: 423808 - DNA, 25 bp, Mus musculus
gaagagtatccaactacccaactca

SEQ ID NO: 423809 - DNA, 25 bp, Mus musculus
gaagagtatccatctacccaactca

SEQ ID NO: 423810 - DNA, 25 bp, Mus musculus
gaagagtatcctaataagccaccta

SEQ ID NO: 423811 - DNA, 25 bp, Mus musculus
gaagagtatccttataagccaccta

SEQ ID NO: 423812 - DNA, 25 bp, Mus musculus
gaagagtattaaaccgtccatgagg

SEQ ID NO: 423813 - DNA, 25 bp, Mus musculus
gaagagtattaatccgtccatgagg

SEQ ID NO: 423814 - DNA, 25 bp, Mus musculus
gaagagtcaaaaatacctggctttt

SEQ ID NO: 423815 - DNA, 25 bp, Mus musculus
gaagagtcaaaattacctggctttt

SEQ ID NO: 423816 - DNA, 25 bp, Mus musculus
gaagagtcaaagatctcaccacctt

SEQ ID NO: 423817 - DNA, 25 bp, Mus musculus
gaagagtcaaagttctcaccacctt

SEQ ID NO: 423818 - DNA, 25 bp, Mus musculus
gaagagtcaatcaagcttactcatt

SEQ ID NO: 423819 - DNA, 25 bp, Mus musculus
gaagagtcaatctagcttactcatt

SEQ ID NO: 423820 - DNA, 25 bp, Mus musculus
gaagagtcacccacacaaggtggct

SEQ ID NO: 423821 - DNA, 25 bp, Mus musculus
gaagagtcaccctcacaaggtggct

SEQ ID NO: 423822 - DNA, 25 bp, Mus musculus
gaagagtcagtcctacataattgct

SEQ ID NO: 423823 - DNA, 25 bp, Mus musculus
gaagagtcagtcgtacataattgct

SEQ ID NO: 423824 - DNA, 25 bp, Mus musculus
gaagagtcatccattactcccaaag

SEQ ID NO: 423825 - DNA, 25 bp, Mus musculus
gaagagtcatcccaattggcctcac

SEQ ID NO: 423826 - DNA, 25 bp, Mus musculus
gaagagtcatccgaattggcctcac

SEQ ID NO: 423827 - DNA, 25 bp, Mus musculus
gaagagtcatcctttactcccaaag

SEQ ID NO: 423828 - DNA, 25 bp, Mus musculus
gaagagtcattgctgcttagcctac

SEQ ID NO: 423829 - DNA, 25 bp, Mus musculus
gaagagtcattggtgcttagcctac

SEQ ID NO: 423830 - DNA, 25 bp, Mus musculus
gaagagtccacacgcaccaggatga

SEQ ID NO: 423831 - DNA, 25 bp, Mus musculus
gaagagtccacaggcaccaggatga

SEQ ID NO: 423832 - DNA, 25 bp, Mus musculus
gaagagtccagtactaccacagtgt

SEQ ID NO: 423833 - DNA, 25 bp, Mus musculus
gaagagtccagttctaccacagtgt

SEQ ID NO: 423834 - DNA, 25 bp, Mus musculus
gaagagtccattactggctgtccag

SEQ ID NO: 423835 - DNA, 25 bp, Mus musculus
gaagagtccattagcttgcagtgag

SEQ ID NO: 423836 - DNA, 25 bp, Mus musculus
gaagagtccatttctggctgtccag

SEQ ID NO: 423837 - DNA, 25 bp, Mus musculus
gaagagtccatttgcttgcagtgag

SEQ ID NO: 423838 - DNA, 25 bp, Mus musculus
gaagagtccccactgttgacaggag

SEQ ID NO: 423839 - DNA, 25 bp, Mus musculus
gaagagtccccagtgttgacaggag

SEQ ID NO: 423840 - DNA, 25 bp, Mus musculus
gaagagtcccctctgagtggaatca

SEQ ID NO: 423841 - DNA, 25 bp, Mus musculus
gaagagtcccctgtgagtggaatca

SEQ ID NO: 423842 - DNA, 25 bp, Mus musculus
gaagagtccgacaactttgtgaaca

SEQ ID NO: 423843 - DNA, 25 bp, Mus musculus
gaagagtccgactactttgtgaaca

SEQ ID NO: 423844 - DNA, 25 bp, Mus musculus
gaagagtctaggcaacaggccttgt

SEQ ID NO: 423845 - DNA, 25 bp, Mus musculus
gaagagtctagggaacaggccttgt

SEQ ID NO: 423846 - DNA, 25 bp, Mus musculus
gaagagtctcagattaacagcactg

SEQ ID NO: 423847 - DNA, 25 bp, Mus musculus
gaagagtctcagtttaacagcactg

SEQ ID NO: 423848 - DNA, 25 bp, Mus musculus
gaagagtctcccagagtcatgtctt

SEQ ID NO: 423849 - DNA, 25 bp, Mus musculus
gaagagtctcccatgacaggagttt

SEQ ID NO: 423850 - DNA, 25 bp, Mus musculus
gaagagtctccctgagtcatgtctt

SEQ ID NO: 423851 - DNA, 25 bp, Mus musculus
gaagagtctcccttgacaggagttt

SEQ ID NO: 423852 - DNA, 25 bp, Mus musculus
gaagagtctctcatacattcgcatc

SEQ ID NO: 423853 - DNA, 25 bp, Mus musculus
gaagagtctctcttacattcgcatc

SEQ ID NO: 423854 - DNA, 25 bp, Mus musculus
gaagagtctctgacaccattctaaa

SEQ ID NO: 423855 - DNA, 25 bp, Mus musculus
gaagagtctctgaggacctaccttt

SEQ ID NO: 423856 - DNA, 25 bp, Mus musculus
gaagagtctctgtcaccattctaaa

SEQ ID NO: 423857 - DNA, 25 bp, Mus musculus
gaagagtctctgtggacctaccttt

SEQ ID NO: 423858 - DNA, 25 bp, Mus musculus
gaagagtctcttcatacgggccact

SEQ ID NO: 423859 - DNA, 25 bp, Mus musculus
gaagagtctcttgatacgggccact

SEQ ID NO: 423860 - DNA, 25 bp, Mus musculus
gaagagtctgccaatctcaaagaaa

SEQ ID NO: 423861 - DNA, 25 bp, Mus musculus
gaagagtctgcctatctcaaagaaa

SEQ ID NO: 423862 - DNA, 25 bp, Mus musculus
gaagagtctgctcaggcatttgcaa

SEQ ID NO: 423863 - DNA, 25 bp, Mus musculus
gaagagtctgctgaggcatttgcaa

SEQ ID NO: 423864 - DNA, 25 bp, Mus musculus
gaagagtctggcactgcttggcacc

SEQ ID NO: 423865 - DNA, 25 bp, Mus musculus
gaagagtctggctctgcttggcacc

SEQ ID NO: 423866 - DNA, 25 bp, Mus musculus
gaagagtctgtcattgcctattaag

SEQ ID NO: 423867 - DNA, 25 bp, Mus musculus
gaagagtctgtctttgcctattaag

SEQ ID NO: 423868 - DNA, 25 bp, Mus musculus
gaagagtctgttattacatctgaga

SEQ ID NO: 423869 - DNA, 25 bp, Mus musculus
gaagagtctgtttttacatctgaga

SEQ ID NO: 423870 - DNA, 25 bp, Mus musculus
gaagagtcttctctatgccttgtcc

SEQ ID NO: 423871 - DNA, 25 bp, Mus musculus
gaagagtcttctgtatgccttgtcc

SEQ ID NO: 423872 - DNA, 25 bp, Mus musculus
gaagagtcttgacaccatcaccaga

SEQ ID NO: 423873 - DNA, 25 bp, Mus musculus
gaagagtcttgacccacttcctgct

SEQ ID NO: 423874 - DNA, 25 bp, Mus musculus
gaagagtcttgagaccatcaccaga

SEQ ID NO: 423875 - DNA, 25 bp, Mus musculus
gaagagtcttgagccacttcctgct

SEQ ID NO: 423876 - DNA, 25 bp, Mus musculus
gaagagtctttgattcaccaaacat

SEQ ID NO: 423877 - DNA, 25 bp, Mus musculus
gaagagtctttgtttcaccaaacat

SEQ ID NO: 423878 - DNA, 25 bp, Mus musculus
gaagagtgaatcagcttgtttaaac

SEQ ID NO: 423879 - DNA, 25 bp, Mus musculus
gaagagtgaatctgcttgtttaaac

SEQ ID NO: 423880 - DNA, 25 bp, Mus musculus
gaagagtgactgcagcttccccaca

SEQ ID NO: 423881 - DNA, 25 bp, Mus musculus
gaagagtgactggagcttccccaca

SEQ ID NO: 423882 - DNA, 25 bp, Mus musculus
gaagagtgattgatccaagtgcagg

SEQ ID NO: 423883 - DNA, 25 bp, Mus musculus
gaagagtgattgttccaagtgcagg

SEQ ID NO: 423884 - DNA, 25 bp, Mus musculus
gaagagtgcctcctagagtgacaga

SEQ ID NO: 423885 - DNA, 25 bp, Mus musculus
gaagagtgcctcgtagagtgacaga

SEQ ID NO: 423886 - DNA, 25 bp, Mus musculus
gaagagtgccttaattcctgatcct

SEQ ID NO: 423887 - DNA, 25 bp, Mus musculus
gaagagtgcctttattcctgatcct

SEQ ID NO: 423888 - DNA, 25 bp, Mus musculus
gaagagtgcggcaatcgcctggtcc

SEQ ID NO: 423889 - DNA, 25 bp, Mus musculus
gaagagtgcggctatcgcctggtcc

SEQ ID NO: 423890 - DNA, 25 bp, Mus musculus
gaagagtgctagagctcttaaatac

SEQ ID NO: 423891 - DNA, 25 bp, Mus musculus
gaagagtgctagtgctcttaaatac

SEQ ID NO: 423892 - DNA, 25 bp, Mus musculus
gaagagtgctttcgcaccagttgtc

SEQ ID NO: 423893 - DNA, 25 bp, Mus musculus
gaagagtgctttggcaccagttgtc

SEQ ID NO: 423894 - DNA, 25 bp, Mus musculus
gaagagtggcgcaaagttttccaat

SEQ ID NO: 423895 - DNA, 25 bp, Mus musculus
gaagagtggcgctaagttttccaat

SEQ ID NO: 423896 - DNA, 25 bp, Mus musculus
gaagagtggctcactactgccataa

SEQ ID NO: 423897 - DNA, 25 bp, Mus musculus
gaagagtggctctctactgccataa

SEQ ID NO: 423898 - DNA, 25 bp, Mus musculus
gaagagtgggacatctgttcccaat

SEQ ID NO: 423899 - DNA, 25 bp, Mus musculus
gaagagtgggacttctgttcccaat

SEQ ID NO: 423900 - DNA, 25 bp, Mus musculus
gaagagtgggcgcacaccaccagct

SEQ ID NO: 423901 - DNA, 25 bp, Mus musculus
gaagagtgggcggacaccaccagct

SEQ ID NO: 423902 - DNA, 25 bp, Mus musculus
gaagagtgtcgcatctgtttcagca

SEQ ID NO: 423903 - DNA, 25 bp, Mus musculus
gaagagtgtcgcttctgtttcagca

SEQ ID NO: 423904 - DNA, 25 bp, Mus musculus
gaagagtgtctgctagtccagtctc

SEQ ID NO: 423905 - DNA, 25 bp, Mus musculus
gaagagtgtctggtagtccagtctc

SEQ ID NO: 423906 - DNA, 25 bp, Mus musculus
gaagagtgtcttcccggccaggaca

SEQ ID NO: 423907 - DNA, 25 bp, Mus musculus
gaagagtgtcttgccggccaggaca

SEQ ID NO: 423908 - DNA, 25 bp, Mus musculus
gaagagtgtgaccatctaggcagat

SEQ ID NO: 423909 - DNA, 25 bp, Mus musculus
gaagagtgtgacgatctaggcagat

SEQ ID NO: 423910 - DNA, 25 bp, Mus musculus
gaagagtgtgctaccactttagatt

SEQ ID NO: 423911 - DNA, 25 bp, Mus musculus
gaagagtgtgcttccactttagatt

SEQ ID NO: 423912 - DNA, 25 bp, Mus musculus
gaagagtgttccagattgtgtttta

SEQ ID NO: 423913 - DNA, 25 bp, Mus musculus
gaagagtgttcctgattgtgtttta

SEQ ID NO: 423914 - DNA, 25 bp, Mus musculus
gaagagttaaccctggctatcccta

SEQ ID NO: 423915 - DNA, 25 bp, Mus musculus
gaagagttaaccgtggctatcccta

SEQ ID NO: 423916 - DNA, 25 bp, Mus musculus
gaagagttactaccacaaggtgact

SEQ ID NO: 423917 - DNA, 25 bp, Mus musculus
gaagagttactagcacaaggtgact

SEQ ID NO: 423918 - DNA, 25 bp, Mus musculus
gaagagttagttagggctccatact

SEQ ID NO: 423919 - DNA, 25 bp, Mus musculus
gaagagttagtttgggctccatact

SEQ ID NO: 423920 - DNA, 25 bp, Mus musculus
gaagagttatacacaggttctgcct

SEQ ID NO: 423921 - DNA, 25 bp, Mus musculus
gaagagttatactcaggttctgcct

SEQ ID NO: 423922 - DNA, 25 bp, Mus musculus
gaagagttatgtacacagactgaaa

SEQ ID NO: 423923 - DNA, 25 bp, Mus musculus
gaagagttatgttcacagactgaaa

SEQ ID NO: 423924 - DNA, 25 bp, Mus musculus
gaagagttcacgagtgtgcacattt

SEQ ID NO: 423925 - DNA, 25 bp, Mus musculus
gaagagttcacgtgtgtgcacattt

SEQ ID NO: 423926 - DNA, 25 bp, Mus musculus
gaagagttcactcagcaagacactg

SEQ ID NO: 423927 - DNA, 25 bp, Mus musculus
gaagagttcactgagcaagacactg

SEQ ID NO: 423928 - DNA, 25 bp, Mus musculus
gaagagttccaactactaaatagtt

SEQ ID NO: 423929 - DNA, 25 bp, Mus musculus
gaagagttccaagtactaaatagtt

SEQ ID NO: 423930 - DNA, 25 bp, Mus musculus
gaagagttccacatttatacccagt

SEQ ID NO: 423931 - DNA, 25 bp, Mus musculus
gaagagttccacttttatacccagt

SEQ ID NO: 423932 - DNA, 25 bp, Mus musculus
gaagagttccatatgctggaccact

SEQ ID NO: 423933 - DNA, 25 bp, Mus musculus
gaagagttccatctccaacttgcat

SEQ ID NO: 423934 - DNA, 25 bp, Mus musculus
gaagagttccatgtccaacttgcat

SEQ ID NO: 423935 - DNA, 25 bp, Mus musculus
gaagagttccatttgctggaccact

SEQ ID NO: 423936 - DNA, 25 bp, Mus musculus
gaagagttccgcctgcatgtgtgta

SEQ ID NO: 423937 - DNA, 25 bp, Mus musculus
gaagagttccgcgtgcatgtgtgta

SEQ ID NO: 423938 - DNA, 25 bp, Mus musculus
gaagagttcctacctcttgccgtta

SEQ ID NO: 423939 - DNA, 25 bp, Mus musculus
gaagagttcctagctcttgccgtta

SEQ ID NO: 423940 - DNA, 25 bp, Mus musculus
gaagagttcctccaaagggatagtt

SEQ ID NO: 423941 - DNA, 25 bp, Mus musculus
gaagagttcctcgaaagggatagtt

SEQ ID NO: 423942 - DNA, 25 bp, Mus musculus
gaagagttcctgaggttgcccagag

SEQ ID NO: 423943 - DNA, 25 bp, Mus musculus
gaagagttcctgtggttgcccagag

SEQ ID NO: 423944 - DNA, 25 bp, Mus musculus
gaagagttcggtcctttcaagccca

SEQ ID NO: 423945 - DNA, 25 bp, Mus musculus
gaagagttcggtgctttcaagccca

SEQ ID NO: 423946 - DNA, 25 bp, Mus musculus
gaagagttctagaaagatgtatttt

SEQ ID NO: 423947 - DNA, 25 bp, Mus musculus
gaagagttctagtaagatgtatttt

SEQ ID NO: 423948 - DNA, 25 bp, Mus musculus
gaagagttcttgcatagtacctttt

SEQ ID NO: 423949 - DNA, 25 bp, Mus musculus
gaagagttcttggatagtacctttt

SEQ ID NO: 423950 - DNA, 25 bp, Mus musculus
gaagagttgaatcggcatcgaacac

SEQ ID NO: 423951 - DNA, 25 bp, Mus musculus
gaagagttgaatgggcatcgaacac

SEQ ID NO: 423952 - DNA, 25 bp, Mus musculus
gaagagttgacaatctcaccgccca

SEQ ID NO: 423953 - DNA, 25 bp, Mus musculus
gaagagttgacattctcaccgccca

SEQ ID NO: 423954 - DNA, 25 bp, Mus musculus
gaagagttgcagcagtctaccctgt

SEQ ID NO: 423955 - DNA, 25 bp, Mus musculus
gaagagttgcaggagtctaccctgt

SEQ ID NO: 423956 - DNA, 25 bp, Mus musculus
gaagagttggaaccctcgtcttccc

SEQ ID NO: 423957 - DNA, 25 bp, Mus musculus
gaagagttggaagcctcgtcttccc

SEQ ID NO: 423958 - DNA, 25 bp, Mus musculus
gaagagttggccagattcatctttt

SEQ ID NO: 423959 - DNA, 25 bp, Mus musculus
gaagagttggcctgattcatctttt

SEQ ID NO: 423960 - DNA, 25 bp, Mus musculus
gaagagtttccaaatcactgtggct

SEQ ID NO: 423961 - DNA, 25 bp, Mus musculus
gaagagtttccatatcactgtggct

SEQ ID NO: 423962 - DNA, 25 bp, Mus musculus
gaagagtttctgcacacgctgttga

SEQ ID NO: 423963 - DNA, 25 bp, Mus musculus
gaagagtttctggacacgctgttga

SEQ ID NO: 423964 - DNA, 25 bp, Mus musculus
gaagagtttgcaccactaaaagtta

SEQ ID NO: 423965 - DNA, 25 bp, Mus musculus
gaagagtttgcagcactaaaagtta

SEQ ID NO: 423966 - DNA, 25 bp, Mus musculus
gaagagtttgctattgtctcgtttt

SEQ ID NO: 423967 - DNA, 25 bp, Mus musculus
gaagagtttgctcgccaaaatctga

SEQ ID NO: 423968 - DNA, 25 bp, Mus musculus
gaagagtttgctggccaaaatctga

SEQ ID NO: 423969 - DNA, 25 bp, Mus musculus
gaagagtttgcttttgtctcgtttt

SEQ ID NO: 423970 - DNA, 25 bp, Mus musculus
gaagagtttggaagccctgctccat

SEQ ID NO: 423971 - DNA, 25 bp, Mus musculus
gaagagtttggatgccctgctccat

SEQ ID NO: 423972 - DNA, 25 bp, Mus musculus
gaagagtttggtacacagcacccac

SEQ ID NO: 423973 - DNA, 25 bp, Mus musculus
gaagagtttggttcacagcacccac

SEQ ID NO: 423974 - DNA, 25 bp, Mus musculus
gaagagttttttcgccgactctcgt

SEQ ID NO: 423975 - DNA, 25 bp, Mus musculus
gaagagttttttggccgactctcgt

SEQ ID NO: 423976 - DNA, 25 bp, Mus musculus
gaagataaactgatcctgatgggta

SEQ ID NO: 423977 - DNA, 25 bp, Mus musculus
gaagataaactgttcctgatgggta

SEQ ID NO: 423978 - DNA, 25 bp, Mus musculus
gaagataacagaacctgccatccca

SEQ ID NO: 423979 - DNA, 25 bp, Mus musculus
gaagataacagatcctgccatccca

SEQ ID NO: 423980 - DNA, 25 bp, Mus musculus
gaagataacatgacggctggatact

SEQ ID NO: 423981 - DNA, 25 bp, Mus musculus
gaagataacatgtcggctggatact

SEQ ID NO: 423982 - DNA, 25 bp, Mus musculus
gaagataaccatccctgttcaaagc

SEQ ID NO: 423983 - DNA, 25 bp, Mus musculus
gaagataaccatgcctgttcaaagc

SEQ ID NO: 423984 - DNA, 25 bp, Mus musculus
gaagataacctcaccaaattgattt

SEQ ID NO: 423985 - DNA, 25 bp, Mus musculus
gaagataacctctccaaattgattt

SEQ ID NO: 423986 - DNA, 25 bp, Mus musculus
gaagataacgcacgggtcatagtaa

SEQ ID NO: 423987 - DNA, 25 bp, Mus musculus
gaagataacgcaggggtcatagtaa

SEQ ID NO: 423988 - DNA, 25 bp, Mus musculus
gaagataagagccaactactacaag

SEQ ID NO: 423989 - DNA, 25 bp, Mus musculus
gaagataagagcgaactactacaag

SEQ ID NO: 423990 - DNA, 25 bp, Mus musculus
gaagataaggccaggtcctggcccc

SEQ ID NO: 423991 - DNA, 25 bp, Mus musculus
gaagataaggccattcatgaaagct

SEQ ID NO: 423992 - DNA, 25 bp, Mus musculus
gaagataaggcctggtcctggcccc

SEQ ID NO: 423993 - DNA, 25 bp, Mus musculus
gaagataaggcctttcatgaaagct

SEQ ID NO: 423994 - DNA, 25 bp, Mus musculus
gaagataagttccttggggttccag

SEQ ID NO: 423995 - DNA, 25 bp, Mus musculus
gaagataagttcgttggggttccag

SEQ ID NO: 423996 - DNA, 25 bp, Mus musculus
gaagataatccactactcaagaatg

SEQ ID NO: 423997 - DNA, 25 bp, Mus musculus
gaagataatccagtactcaagaatg

SEQ ID NO: 423998 - DNA, 25 bp, Mus musculus
gaagataatcttacatagacataac

SEQ ID NO: 423999 - DNA, 25 bp, Mus musculus
gaagataatctttcatagacataac

SEQ ID NO: 424000 - DNA, 25 bp, Mus musculus
gaagataatgacatttcagattgat

SEQ ID NO: 424001 - DNA, 25 bp, Mus musculus
gaagataatgacttttcagattgat

SEQ ID NO: 424002 - DNA, 25 bp, Mus musculus
gaagatacacgcatttttacaacag

SEQ ID NO: 424003 - DNA, 25 bp, Mus musculus
gaagatacacgcttttttacaacag

SEQ ID NO: 424004 - DNA, 25 bp, Mus musculus
gaagatacactactcagttggtaaa

SEQ ID NO: 424005 - DNA, 25 bp, Mus musculus
gaagatacactagtcagttggtaaa

SEQ ID NO: 424006 - DNA, 25 bp, Mus musculus
gaagatacagaccagctgctgaaga

SEQ ID NO: 424007 - DNA, 25 bp, Mus musculus
gaagatacagacgagctgctgaaga

SEQ ID NO: 424008 - DNA, 25 bp, Mus musculus
gaagatacatcacatcacctgagac

SEQ ID NO: 424009 - DNA, 25 bp, Mus musculus
gaagatacatcagatcacctgagac

SEQ ID NO: 424010 - DNA, 25 bp, Mus musculus
gaagataccccaaagcacgagtgtt

SEQ ID NO: 424011 - DNA, 25 bp, Mus musculus
gaagataccccatagcacgagtgtt

SEQ ID NO: 424012 - DNA, 25 bp, Mus musculus
gaagataccgttaatctacctgttc

SEQ ID NO: 424013 - DNA, 25 bp, Mus musculus
gaagataccgtttatctacctgttc

SEQ ID NO: 424014 - DNA, 25 bp, Mus musculus
gaagatacctggcacacctgtatag

SEQ ID NO: 424015 - DNA, 25 bp, Mus musculus
gaagatacctgggacacctgtatag

SEQ ID NO: 424016 - DNA, 25 bp, Mus musculus
gaagataccttcacagaccttcttc

SEQ ID NO: 424017 - DNA, 25 bp, Mus musculus
gaagataccttctcagaccttcttc

SEQ ID NO: 424018 - DNA, 25 bp, Mus musculus
gaagatacgcttcgtacctgtgtta

SEQ ID NO: 424019 - DNA, 25 bp, Mus musculus
gaagatacgcttggtacctgtgtta

SEQ ID NO: 424020 - DNA, 25 bp, Mus musculus
gaagatactggccatttgctctcta

SEQ ID NO: 424021 - DNA, 25 bp, Mus musculus
gaagatactggcgatttgctctcta

SEQ ID NO: 424022 - DNA, 25 bp, Mus musculus
gaagatacttacagattggccagga

SEQ ID NO: 424023 - DNA, 25 bp, Mus musculus
gaagatacttacatgtgatgaatat

SEQ ID NO: 424024 - DNA, 25 bp, Mus musculus
gaagatacttactgattggccagga

SEQ ID NO: 424025 - DNA, 25 bp, Mus musculus
gaagatacttacttgtgatgaatat

SEQ ID NO: 424026 - DNA, 25 bp, Mus musculus
gaagatacttgcctgtgtttatgaa

SEQ ID NO: 424027 - DNA, 25 bp, Mus musculus
gaagatacttgcgtgtgtttatgaa

SEQ ID NO: 424028 - DNA, 25 bp, Mus musculus
gaagatacttttaataagccacagg

SEQ ID NO: 424029 - DNA, 25 bp, Mus musculus
gaagatactttttataagccacagg

SEQ ID NO: 424030 - DNA, 25 bp, Mus musculus
gaagatagaaacagaatccctcctc

SEQ ID NO: 424031 - DNA, 25 bp, Mus musculus
gaagatagaaactgaatccctcctc

SEQ ID NO: 424032 - DNA, 25 bp, Mus musculus
gaagatagaactaggcgcacgcctt

SEQ ID NO: 424033 - DNA, 25 bp, Mus musculus
gaagatagaacttggcgcacgcctt

SEQ ID NO: 424034 - DNA, 25 bp, Mus musculus
gaagatagaagtctccactggaaac

SEQ ID NO: 424035 - DNA, 25 bp, Mus musculus
gaagatagaagtgtccactggaaac

SEQ ID NO: 424036 - DNA, 25 bp, Mus musculus
gaagatagcaccaactgcatgaaaa

SEQ ID NO: 424037 - DNA, 25 bp, Mus musculus
gaagatagcacctactgcatgaaaa

SEQ ID NO: 424038 - DNA, 25 bp, Mus musculus
gaagatagcaggcactcctgggaca

SEQ ID NO: 424039 - DNA, 25 bp, Mus musculus
gaagatagcagggactcctgggaca

SEQ ID NO: 424040 - DNA, 25 bp, Mus musculus
gaagatagcctgacaccatgtttaa

SEQ ID NO: 424041 - DNA, 25 bp, Mus musculus
gaagatagcctgtcaccatgtttaa

SEQ ID NO: 424042 - DNA, 25 bp, Mus musculus
gaagatagctgacgactttccaggt

SEQ ID NO: 424043 - DNA, 25 bp, Mus musculus
gaagatagctgaggactttccaggt

SEQ ID NO: 424044 - DNA, 25 bp, Mus musculus
gaagatagctttcccaaggatcctc

SEQ ID NO: 424045 - DNA, 25 bp, Mus musculus
gaagatagctttgccaaggatcctc

SEQ ID NO: 424046 - DNA, 25 bp, Mus musculus
gaagataggcagacaaatgcttctc

SEQ ID NO: 424047 - DNA, 25 bp, Mus musculus
gaagataggcagtcaaatgcttctc

SEQ ID NO: 424048 - DNA, 25 bp, Mus musculus
gaagatagtatcactgcactgggtg

SEQ ID NO: 424049 - DNA, 25 bp, Mus musculus
gaagatagtatctctgcactgggtg

SEQ ID NO: 424050 - DNA, 25 bp, Mus musculus
gaagatagtattccataacacactg

SEQ ID NO: 424051 - DNA, 25 bp, Mus musculus
gaagatagtattgcataacacactg

SEQ ID NO: 424052 - DNA, 25 bp, Mus musculus
gaagatagtggcatcctgaccgaga

SEQ ID NO: 424053 - DNA, 25 bp, Mus musculus
gaagatagtggcttcctgaccgaga

SEQ ID NO: 424054 - DNA, 25 bp, Mus musculus
gaagatagttttctcccactggtta

SEQ ID NO: 424055 - DNA, 25 bp, Mus musculus
gaagatagttttgtcccactggtta

SEQ ID NO: 424056 - DNA, 25 bp, Mus musculus
gaagatatacacactgtacttataa

SEQ ID NO: 424057 - DNA, 25 bp, Mus musculus
gaagatatacactctgtacttataa

SEQ ID NO: 424058 - DNA, 25 bp, Mus musculus
gaagatatactaccctttggaagtg

SEQ ID NO: 424059 - DNA, 25 bp, Mus musculus
gaagatatactagcctttggaagtg

SEQ ID NO: 424060 - DNA, 25 bp, Mus musculus
gaagatatatcacccggacatcacg

SEQ ID NO: 424061 - DNA, 25 bp, Mus musculus
gaagatatatcagccggacatcacg

SEQ ID NO: 424062 - DNA, 25 bp, Mus musculus
gaagatatccccattgtcatcatat

SEQ ID NO: 424063 - DNA, 25 bp, Mus musculus
gaagatatcccctttgtcatcatat

SEQ ID NO: 424064 - DNA, 25 bp, Mus musculus
gaagatatccctagctgccttaaaa

SEQ ID NO: 424065 - DNA, 25 bp, Mus musculus
gaagatatcccttgctgccttaaaa

SEQ ID NO: 424066 - DNA, 25 bp, Mus musculus
gaagatatccttaactgagtagcaa

SEQ ID NO: 424067 - DNA, 25 bp, Mus musculus
gaagatatccttatgcgagctttcg

SEQ ID NO: 424068 - DNA, 25 bp, Mus musculus
gaagatatcctttactgagtagcaa

SEQ ID NO: 424069 - DNA, 25 bp, Mus musculus
gaagatatccttttgcgagctttcg

SEQ ID NO: 424070 - DNA, 25 bp, Mus musculus
gaagatatctgtagactgcctcagt

SEQ ID NO: 424071 - DNA, 25 bp, Mus musculus
gaagatatctgttgactgcctcagt

SEQ ID NO: 424072 - DNA, 25 bp, Mus musculus
gaagatatgaagctcagcggctttg

SEQ ID NO: 424073 - DNA, 25 bp, Mus musculus
gaagatatgaaggtcagcggctttg

SEQ ID NO: 424074 - DNA, 25 bp, Mus musculus
gaagatatgcctagtgctacagtaa

SEQ ID NO: 424075 - DNA, 25 bp, Mus musculus
gaagatatgccttgtgctacagtaa

SEQ ID NO: 424076 - DNA, 25 bp, Mus musculus
gaagatatgcgccaaccactatatt

SEQ ID NO: 424077 - DNA, 25 bp, Mus musculus
gaagatatgcgcgaaccactatatt

SEQ ID NO: 424078 - DNA, 25 bp, Mus musculus
gaagatatgctcctgaaagtgctgg

SEQ ID NO: 424079 - DNA, 25 bp, Mus musculus
gaagatatgctcgtgaaagtgctgg

SEQ ID NO: 424080 - DNA, 25 bp, Mus musculus
gaagatatgcttcttgctttatgat

SEQ ID NO: 424081 - DNA, 25 bp, Mus musculus
gaagatatgcttgttgctttatgat

SEQ ID NO: 424082 - DNA, 25 bp, Mus musculus
gaagatatggcacgcccagcataag

SEQ ID NO: 424083 - DNA, 25 bp, Mus musculus
gaagatatggcaggcccagcataag

SEQ ID NO: 424084 - DNA, 25 bp, Mus musculus
gaagatattcgcctctttgcatatt

SEQ ID NO: 424085 - DNA, 25 bp, Mus musculus
gaagatattcgcgtctttgcatatt

SEQ ID NO: 424086 - DNA, 25 bp, Mus musculus
gaagatattctacctgccctggagt

SEQ ID NO: 424087 - DNA, 25 bp, Mus musculus
gaagatattctagctgccctggagt

SEQ ID NO: 424088 - DNA, 25 bp, Mus musculus
gaagatattcttagtccttgtagta

SEQ ID NO: 424089 - DNA, 25 bp, Mus musculus
gaagatattctttgtccttgtagta

SEQ ID NO: 424090 - DNA, 25 bp, Mus musculus
gaagatattgccacttactttgcca

SEQ ID NO: 424091 - DNA, 25 bp, Mus musculus
gaagatattgccagcctctcccaga

SEQ ID NO: 424092 - DNA, 25 bp, Mus musculus
gaagatattgcctcttactttgcca

SEQ ID NO: 424093 - DNA, 25 bp, Mus musculus
gaagatattgcctgcctctcccaga

SEQ ID NO: 424094 - DNA, 25 bp, Mus musculus
gaagatatttcgatctattttgaag

SEQ ID NO: 424095 - DNA, 25 bp, Mus musculus
gaagatatttcgttctattttgaag

SEQ ID NO: 424096 - DNA, 25 bp, Mus musculus
gaagatatttgcatcacgtatcagt

SEQ ID NO: 424097 - DNA, 25 bp, Mus musculus
gaagatatttgcttcacgtatcagt

SEQ ID NO: 424098 - DNA, 25 bp, Mus musculus
gaagatcaaacaccattgccgcttc

SEQ ID NO: 424099 - DNA, 25 bp, Mus musculus
gaagatcaaacagcattgccgcttc

SEQ ID NO: 424100 - DNA, 25 bp, Mus musculus
gaagatcaacttcaagctttagaga

SEQ ID NO: 424101 - DNA, 25 bp, Mus musculus
gaagatcaacttgaagctttagaga

SEQ ID NO: 424102 - DNA, 25 bp, Mus musculus
gaagatcaattgattcacgccaatg

SEQ ID NO: 424103 - DNA, 25 bp, Mus musculus
gaagatcaattgtttcacgccaatg

SEQ ID NO: 424104 - DNA, 25 bp, Mus musculus
gaagatcacaaaacagctgcccagg

SEQ ID NO: 424105 - DNA, 25 bp, Mus musculus
gaagatcacaaacaacctcccaggg

SEQ ID NO: 424106 - DNA, 25 bp, Mus musculus
gaagatcacaaagaacctcccaggg

SEQ ID NO: 424107 - DNA, 25 bp, Mus musculus
gaagatcacaaatcagctgcccagg

SEQ ID NO: 424108 - DNA, 25 bp, Mus musculus
gaagatcacaccaatgagggcttga

SEQ ID NO: 424109 - DNA, 25 bp, Mus musculus
gaagatcacacctatgagggcttga

SEQ ID NO: 424110 - DNA, 25 bp, Mus musculus
gaagatcacatcacactacaagctg

SEQ ID NO: 424111 - DNA, 25 bp, Mus musculus
gaagatcacatctcactacaagctg

SEQ ID NO: 424112 - DNA, 25 bp, Mus musculus
gaagatcaccgacgctaggaacgag

SEQ ID NO: 424113 - DNA, 25 bp, Mus musculus
gaagatcaccgaggctaggaacgag

SEQ ID NO: 424114 - DNA, 25 bp, Mus musculus
gaagatcacctaagccaagaagtaa

SEQ ID NO: 424115 - DNA, 25 bp, Mus musculus
gaagatcacctatgccaagaagtaa

SEQ ID NO: 424116 - DNA, 25 bp, Mus musculus
gaagatcactggaaacatggtctgt

SEQ ID NO: 424117 - DNA, 25 bp, Mus musculus
gaagatcactggtaacatggtctgt

SEQ ID NO: 424118 - DNA, 25 bp, Mus musculus
gaagatcagaacaggacagctccat

SEQ ID NO: 424119 - DNA, 25 bp, Mus musculus
gaagatcagaactggacagctccat

SEQ ID NO: 424120 - DNA, 25 bp, Mus musculus
gaagatcagctgactggcaggcata

SEQ ID NO: 424121 - DNA, 25 bp, Mus musculus
gaagatcagctgtctggcaggcata

SEQ ID NO: 424122 - DNA, 25 bp, Mus musculus
gaagatcaggtaccccacatgtata

SEQ ID NO: 424123 - DNA, 25 bp, Mus musculus
gaagatcaggtagcccacatgtata

SEQ ID NO: 424124 - DNA, 25 bp, Mus musculus
gaagatcagtgcaatagaccaagtt

SEQ ID NO: 424125 - DNA, 25 bp, Mus musculus
gaagatcagtgctatagaccaagtt

SEQ ID NO: 424126 - DNA, 25 bp, Mus musculus
gaagatcatacaaaagccctccgct

SEQ ID NO: 424127 - DNA, 25 bp, Mus musculus
gaagatcatacataagccctccgct

SEQ ID NO: 424128 - DNA, 25 bp, Mus musculus
gaagatcatattatttatacaggta

SEQ ID NO: 424129 - DNA, 25 bp, Mus musculus
gaagatcatattttttatacaggta

SEQ ID NO: 424130 - DNA, 25 bp, Mus musculus
gaagatcatcaacacacgcccggtt

SEQ ID NO: 424131 - DNA, 25 bp, Mus musculus
gaagatcatcaagacacgcccggtt

SEQ ID NO: 424132 - DNA, 25 bp, Mus musculus
gaagatcatggaccctcttttccga

SEQ ID NO: 424133 - DNA, 25 bp, Mus musculus
gaagatcatggagcctcttttccga

SEQ ID NO: 424134 - DNA, 25 bp, Mus musculus
gaagatcatggcagcccggcagaag

SEQ ID NO: 424135 - DNA, 25 bp, Mus musculus
gaagatcatggcctgctgcaatacc

SEQ ID NO: 424136 - DNA, 25 bp, Mus musculus
gaagatcatggcgtgctgcaatacc

SEQ ID NO: 424137 - DNA, 25 bp, Mus musculus
gaagatcatggctgcccggcagaag

SEQ ID NO: 424138 - DNA, 25 bp, Mus musculus
gaagatcattttaatattgccgaaa

SEQ ID NO: 424139 - DNA, 25 bp, Mus musculus
gaagatcattttacccattgaataa

SEQ ID NO: 424140 - DNA, 25 bp, Mus musculus
gaagatcatttttatattgccgaaa

SEQ ID NO: 424141 - DNA, 25 bp, Mus musculus
gaagatcatttttcccattgaataa

SEQ ID NO: 424142 - DNA, 25 bp, Mus musculus
gaagatccaaacaagagttttaaat

SEQ ID NO: 424143 - DNA, 25 bp, Mus musculus
gaagatccaaactagagttttaaat

SEQ ID NO: 424144 - DNA, 25 bp, Mus musculus
gaagatccaaagagcacttgctgac

SEQ ID NO: 424145 - DNA, 25 bp, Mus musculus
gaagatccaaagtgcacttgctgac

SEQ ID NO: 424146 - DNA, 25 bp, Mus musculus
gaagatccaattctactttgctgat

SEQ ID NO: 424147 - DNA, 25 bp, Mus musculus
gaagatccaattgtactttgctgat

SEQ ID NO: 424148 - DNA, 25 bp, Mus musculus
gaagatccacttacactggtggctc

SEQ ID NO: 424149 - DNA, 25 bp, Mus musculus
gaagatccactttcactggtggctc

SEQ ID NO: 424150 - DNA, 25 bp, Mus musculus
gaagatccagatctgcagccccttc

SEQ ID NO: 424151 - DNA, 25 bp, Mus musculus
gaagatccagatgtgcagccccttc

SEQ ID NO: 424152 - DNA, 25 bp, Mus musculus
gaagatccagcaagaccctgagcat

SEQ ID NO: 424153 - DNA, 25 bp, Mus musculus
gaagatccagcatgaccctgagcat

SEQ ID NO: 424154 - DNA, 25 bp, Mus musculus
gaagatccatcacgactcgatctga

SEQ ID NO: 424155 - DNA, 25 bp, Mus musculus
gaagatccatcaggactcgatctga

SEQ ID NO: 424156 - DNA, 25 bp, Mus musculus
gaagatccattcagagaacctccct

SEQ ID NO: 424157 - DNA, 25 bp, Mus musculus
gaagatccattctgagaacctccct

SEQ ID NO: 424158 - DNA, 25 bp, Mus musculus
gaagatcccacgcttgctggtagga

SEQ ID NO: 424159 - DNA, 25 bp, Mus musculus
gaagatcccacggttgctggtagga

SEQ ID NO: 424160 - DNA, 25 bp, Mus musculus
gaagatcccattactctagaccaga

SEQ ID NO: 424161 - DNA, 25 bp, Mus musculus
gaagatcccatttctctagaccaga

SEQ ID NO: 424162 - DNA, 25 bp, Mus musculus
gaagatccccgtcagttcaaggcta

SEQ ID NO: 424163 - DNA, 25 bp, Mus musculus
gaagatccccgtgagttcaaggcta

SEQ ID NO: 424164 - DNA, 25 bp, Mus musculus
gaagatccctccaggttgtgagttg

SEQ ID NO: 424165 - DNA, 25 bp, Mus musculus
gaagatccctcctggttgtgagttg

SEQ ID NO: 424166 - DNA, 25 bp, Mus musculus
gaagatccgagacatcctggctcaa

SEQ ID NO: 424167 - DNA, 25 bp, Mus musculus
gaagatccgagagatcctggctcaa

SEQ ID NO: 424168 - DNA, 25 bp, Mus musculus
gaagatccggttccattgctgggat

SEQ ID NO: 424169 - DNA, 25 bp, Mus musculus
gaagatccggttgcattgctgggat

SEQ ID NO: 424170 - DNA, 25 bp, Mus musculus
gaagatcctacacgtgatgctccat

SEQ ID NO: 424171 - DNA, 25 bp, Mus musculus
gaagatcctacaggtgatgctccat

SEQ ID NO: 424172 - DNA, 25 bp, Mus musculus
gaagatcctcataaatacagaccag

SEQ ID NO: 424173 - DNA, 25 bp, Mus musculus
gaagatcctcatcagtgtggccatc

SEQ ID NO: 424174 - DNA, 25 bp, Mus musculus
gaagatcctcatgagtgtggccatc

SEQ ID NO: 424175 - DNA, 25 bp, Mus musculus
gaagatcctcattaatacagaccag

SEQ ID NO: 424176 - DNA, 25 bp, Mus musculus
gaagatcctctaagctgagtgttga

SEQ ID NO: 424177 - DNA, 25 bp, Mus musculus
gaagatcctctatgctgagtgttga

SEQ ID NO: 424178 - DNA, 25 bp, Mus musculus
gaagatcctgaacctgtgttgtgtc

SEQ ID NO: 424179 - DNA, 25 bp, Mus musculus
gaagatcctgaagctgtgttgtgtc

SEQ ID NO: 424180 - DNA, 25 bp, Mus musculus
gaagatcctgacactctaggattgt

SEQ ID NO: 424181 - DNA, 25 bp, Mus musculus
gaagatcctgactctctaggattgt

SEQ ID NO: 424182 - DNA, 25 bp, Mus musculus
gaagatcctgataactcgagaaata

SEQ ID NO: 424183 - DNA, 25 bp, Mus musculus
gaagatcctgattactcgagaaata

SEQ ID NO: 424184 - DNA, 25 bp, Mus musculus
gaagatcctgctatctgttgtgagc

SEQ ID NO: 424185 - DNA, 25 bp, Mus musculus
gaagatcctgctttctgttgtgagc

SEQ ID NO: 424186 - DNA, 25 bp, Mus musculus
gaagatcctggaaaccctgaaactt

SEQ ID NO: 424187 - DNA, 25 bp, Mus musculus
gaagatcctggataccctgaaactt

SEQ ID NO: 424188 - DNA, 25 bp, Mus musculus
gaagatcctgggaagatttcatata

SEQ ID NO: 424189 - DNA, 25 bp, Mus musculus
gaagatcctgggtagatttcatata

SEQ ID NO: 424190 - DNA, 25 bp, Mus musculus
gaagatcctgtgaagaaagttctgg

SEQ ID NO: 424191 - DNA, 25 bp, Mus musculus
gaagatcctgtgtagaaagttctgg

SEQ ID NO: 424192 - DNA, 25 bp, Mus musculus
gaagatcctgttagactctagagac

SEQ ID NO: 424193 - DNA, 25 bp, Mus musculus
gaagatcctgtttgactctagagac

SEQ ID NO: 424194 - DNA, 25 bp, Mus musculus
gaagatccttatccgcttcagtgac

SEQ ID NO: 424195 - DNA, 25 bp, Mus musculus
gaagatccttatgcgcttcagtgac

SEQ ID NO: 424196 - DNA, 25 bp, Mus musculus
gaagatccttctaatttagggcatg

SEQ ID NO: 424197 - DNA, 25 bp, Mus musculus
gaagatccttctagtggaacaacag

SEQ ID NO: 424198 - DNA, 25 bp, Mus musculus
gaagatccttcttatttagggcatg

SEQ ID NO: 424199 - DNA, 25 bp, Mus musculus
gaagatccttcttgtggaacaacag

SEQ ID NO: 424200 - DNA, 25 bp, Mus musculus
gaagatcgagatatcccactgatga

SEQ ID NO: 424201 - DNA, 25 bp, Mus musculus
gaagatcgagatttcccactgatga

SEQ ID NO: 424202 - DNA, 25 bp, Mus musculus
gaagatcgatgcagccatttctaat

SEQ ID NO: 424203 - DNA, 25 bp, Mus musculus
gaagatcgatgctgccatttctaat

SEQ ID NO: 424204 - DNA, 25 bp, Mus musculus
gaagatcgatttaaccagcatccct

SEQ ID NO: 424205 - DNA, 25 bp, Mus musculus
gaagatcgattttaccagcatccct

SEQ ID NO: 424206 - DNA, 25 bp, Mus musculus
gaagatcgccccactgaaagaaatt

SEQ ID NO: 424207 - DNA, 25 bp, Mus musculus
gaagatcgcccctctgaaagaaatt

SEQ ID NO: 424208 - DNA, 25 bp, Mus musculus
gaagatcggcccacttcaacaggtt

SEQ ID NO: 424209 - DNA, 25 bp, Mus musculus
gaagatcggccctcttcaacaggtt

SEQ ID NO: 424210 - DNA, 25 bp, Mus musculus
gaagatcggtccactgggtctgtct

SEQ ID NO: 424211 - DNA, 25 bp, Mus musculus
gaagatcggtcctctgggtctgtct

SEQ ID NO: 424212 - DNA, 25 bp, Mus musculus
gaagatcgtcggcaacaaatgggaa

SEQ ID NO: 424213 - DNA, 25 bp, Mus musculus
gaagatcgtcgggaacaaatgggaa

SEQ ID NO: 424214 - DNA, 25 bp, Mus musculus
gaagatcgtcttcagcaagaagtga

SEQ ID NO: 424215 - DNA, 25 bp, Mus musculus
gaagatcgtcttgagcaagaagtga

SEQ ID NO: 424216 - DNA, 25 bp, Mus musculus
gaagatcgtggacacgtcttctgca

SEQ ID NO: 424217 - DNA, 25 bp, Mus musculus
gaagatcgtggagacgtcttctgca

SEQ ID NO: 424218 - DNA, 25 bp, Mus musculus
gaagatctaagcacctttcccagag

SEQ ID NO: 424219 - DNA, 25 bp, Mus musculus
gaagatctaagctcctttcccagag

SEQ ID NO: 424220 - DNA, 25 bp, Mus musculus
gaagatctacgcagtgcttctttgc

SEQ ID NO: 424221 - DNA, 25 bp, Mus musculus
gaagatctacgctgtgcttctttgc

SEQ ID NO: 424222 - DNA, 25 bp, Mus musculus
gaagatctatctcgagcctcactga

SEQ ID NO: 424223 - DNA, 25 bp, Mus musculus
gaagatctatctggagcctcactga

SEQ ID NO: 424224 - DNA, 25 bp, Mus musculus
gaagatctcagactttgggtggtct

SEQ ID NO: 424225 - DNA, 25 bp, Mus musculus
gaagatctcagagtttgggtggtct

SEQ ID NO: 424226 - DNA, 25 bp, Mus musculus
gaagatctcgatcttagtcctcgtc

SEQ ID NO: 424227 - DNA, 25 bp, Mus musculus
gaagatctcgatgttagtcctcgtc

SEQ ID NO: 424228 - DNA, 25 bp, Mus musculus
gaagatctctaactatgaggctagc

SEQ ID NO: 424229 - DNA, 25 bp, Mus musculus
gaagatctctaagtatgaggctagc

SEQ ID NO: 424230 - DNA, 25 bp, Mus musculus
gaagatctctttctttactcggtca

SEQ ID NO: 424231 - DNA, 25 bp, Mus musculus
gaagatctctttgtttactcggtca

SEQ ID NO: 424232 - DNA, 25 bp, Mus musculus
gaagatctgaagactacacaaggag

SEQ ID NO: 424233 - DNA, 25 bp, Mus musculus
gaagatctgaagcaagtcccatgag

SEQ ID NO: 424234 - DNA, 25 bp, Mus musculus
gaagatctgaagctgccagccatat

SEQ ID NO: 424235 - DNA, 25 bp, Mus musculus
gaagatctgaaggaagtcccatgag

SEQ ID NO: 424236 - DNA, 25 bp, Mus musculus
gaagatctgaaggtgccagccatat

SEQ ID NO: 424237 - DNA, 25 bp, Mus musculus
gaagatctgaagtctacacaaggag

SEQ ID NO: 424238 - DNA, 25 bp, Mus musculus
gaagatctgactcagcacagtaact

SEQ ID NO: 424239 - DNA, 25 bp, Mus musculus
gaagatctgactgagcacagtaact

SEQ ID NO: 424240 - DNA, 25 bp, Mus musculus
gaagatctgccccaaatgatccaga

SEQ ID NO: 424241 - DNA, 25 bp, Mus musculus
gaagatctgcccgaaatgatccaga

SEQ ID NO: 424242 - DNA, 25 bp, Mus musculus
gaagatctgcgacattgcacgggaa

SEQ ID NO: 424243 - DNA, 25 bp, Mus musculus
gaagatctgcgacgtgtagctgaac

SEQ ID NO: 424244 - DNA, 25 bp, Mus musculus
gaagatctgcgagattgcacgggaa

SEQ ID NO: 424245 - DNA, 25 bp, Mus musculus
gaagatctgcgaggtgtagctgaac

SEQ ID NO: 424246 - DNA, 25 bp, Mus musculus
gaagatctgcgtcaccgttttcaca

SEQ ID NO: 424247 - DNA, 25 bp, Mus musculus
gaagatctgcgtgaccgttttcaca

SEQ ID NO: 424248 - DNA, 25 bp, Mus musculus
gaagatctggctattgagggaaccc

SEQ ID NO: 424249 - DNA, 25 bp, Mus musculus
gaagatctggcttttgagggaaccc

SEQ ID NO: 424250 - DNA, 25 bp, Mus musculus
gaagatctgggcattctttggaaag

SEQ ID NO: 424251 - DNA, 25 bp, Mus musculus
gaagatctgggctttctttggaaag

SEQ ID NO: 424252 - DNA, 25 bp, Mus musculus
gaagatctgtccatattcaggaatc

SEQ ID NO: 424253 - DNA, 25 bp, Mus musculus
gaagatctgtccttattcaggaatc

SEQ ID NO: 424254 - DNA, 25 bp, Mus musculus
gaagatcttaaccttgggcttgaac

SEQ ID NO: 424255 - DNA, 25 bp, Mus musculus
gaagatcttaacgttgggcttgaac

SEQ ID NO: 424256 - DNA, 25 bp, Mus musculus
gaagatcttcaactccctctgagga

SEQ ID NO: 424257 - DNA, 25 bp, Mus musculus
gaagatcttcaagtccctctgagga

SEQ ID NO: 424258 - DNA, 25 bp, Mus musculus
gaagatcttcctcaaatatcacccc

SEQ ID NO: 424259 - DNA, 25 bp, Mus musculus
gaagatcttcctctgcatacagtat

SEQ ID NO: 424260 - DNA, 25 bp, Mus musculus
gaagatcttcctgaaatatcacccc

SEQ ID NO: 424261 - DNA, 25 bp, Mus musculus
gaagatcttcctgtgcatacagtat

SEQ ID NO: 424262 - DNA, 25 bp, Mus musculus
gaagatctttaacctctcaggaggc

SEQ ID NO: 424263 - DNA, 25 bp, Mus musculus
gaagatctttaagctctcaggaggc

SEQ ID NO: 424264 - DNA, 25 bp, Mus musculus
gaagatctttcaccggcagagccac

SEQ ID NO: 424265 - DNA, 25 bp, Mus musculus
gaagatctttcagcggcagagccac

SEQ ID NO: 424266 - DNA, 25 bp, Mus musculus
gaagatctttcccttgtttggactc

SEQ ID NO: 424267 - DNA, 25 bp, Mus musculus
gaagatctttccgttgtttggactc

SEQ ID NO: 424268 - DNA, 25 bp, Mus musculus
gaagatctttctctacttgaatttt

SEQ ID NO: 424269 - DNA, 25 bp, Mus musculus
gaagatctttctgtacttgaatttt

SEQ ID NO: 424270 - DNA, 25 bp, Mus musculus
gaagatgaaaaccacgcttggcttg

SEQ ID NO: 424271 - DNA, 25 bp, Mus musculus
gaagatgaaaacgacgcttggcttg

SEQ ID NO: 424272 - DNA, 25 bp, Mus musculus
gaagatgaacacacctttctcgcca

SEQ ID NO: 424273 - DNA, 25 bp, Mus musculus
gaagatgaacactcctttctcgcca

SEQ ID NO: 424274 - DNA, 25 bp, Mus musculus
gaagatgaacctccttgaccaatgg

SEQ ID NO: 424275 - DNA, 25 bp, Mus musculus
gaagatgaacctgcttgaccaatgg

SEQ ID NO: 424276 - DNA, 25 bp, Mus musculus
gaagatgaactaatccttaccagtt

SEQ ID NO: 424277 - DNA, 25 bp, Mus musculus
gaagatgaactattccttaccagtt

SEQ ID NO: 424278 - DNA, 25 bp, Mus musculus
gaagatgaagaactgaatgccctct

SEQ ID NO: 424279 - DNA, 25 bp, Mus musculus
gaagatgaagaagtgaatgccctct

SEQ ID NO: 424280 - DNA, 25 bp, Mus musculus
gaagatgaagctcgcccaccggaag

SEQ ID NO: 424281 - DNA, 25 bp, Mus musculus
gaagatgaagctggcccaccggaag

SEQ ID NO: 424282 - DNA, 25 bp, Mus musculus
gaagatgaaggaagctctccccttt

SEQ ID NO: 424283 - DNA, 25 bp, Mus musculus
gaagatgaaggatgctctccccttt

SEQ ID NO: 424284 - DNA, 25 bp, Mus musculus
gaagatgaagtcaggtcccctccat

SEQ ID NO: 424285 - DNA, 25 bp, Mus musculus
gaagatgaagtctggtcccctccat

SEQ ID NO: 424286 - DNA, 25 bp, Mus musculus
gaagatgaatccagatcctgtgatg

SEQ ID NO: 424287 - DNA, 25 bp, Mus musculus
gaagatgaatcctgatcctgtgatg

SEQ ID NO: 424288 - DNA, 25 bp, Mus musculus
gaagatgaattaagtcccactgacc

SEQ ID NO: 424289 - DNA, 25 bp, Mus musculus
gaagatgaattatgtcccactgacc

SEQ ID NO: 424290 - DNA, 25 bp, Mus musculus
gaagatgaattgagtgagttgtata

SEQ ID NO: 424291 - DNA, 25 bp, Mus musculus
gaagatgaattgtgtgagttgtata

SEQ ID NO: 424292 - DNA, 25 bp, Mus musculus
gaagatgacacaccctggagcagca

SEQ ID NO: 424293 - DNA, 25 bp, Mus musculus
gaagatgacacagcctggagcagca

SEQ ID NO: 424294 - DNA, 25 bp, Mus musculus
gaagatgacaccagagtccttctta

SEQ ID NO: 424295 - DNA, 25 bp, Mus musculus
gaagatgacacctgagtccttctta

SEQ ID NO: 424296 - DNA, 25 bp, Mus musculus
gaagatgacagtcaccgcgctggcc

SEQ ID NO: 424297 - DNA, 25 bp, Mus musculus
gaagatgacagtgaccgcgctggcc

SEQ ID NO: 424298 - DNA, 25 bp, Mus musculus
gaagatgacatgctctcagccctgc

SEQ ID NO: 424299 - DNA, 25 bp, Mus musculus
gaagatgacatggtctcagccctgc

SEQ ID NO: 424300 - DNA, 25 bp, Mus musculus
gaagatgaccaacctgacggagctg

SEQ ID NO: 424301 - DNA, 25 bp, Mus musculus
gaagatgaccaagctgacggagctg

SEQ ID NO: 424302 - DNA, 25 bp, Mus musculus
gaagatgacccacaactggttggaa

SEQ ID NO: 424303 - DNA, 25 bp, Mus musculus
gaagatgacccagaactggttggaa

SEQ ID NO: 424304 - DNA, 25 bp, Mus musculus
gaagatgaccccaacacatcaagcg

SEQ ID NO: 424305 - DNA, 25 bp, Mus musculus
gaagatgacccctacacatcaagcg

SEQ ID NO: 424306 - DNA, 25 bp, Mus musculus
gaagatgaccgactctccaactggc

SEQ ID NO: 424307 - DNA, 25 bp, Mus musculus
gaagatgaccgagtctccaactggc

SEQ ID NO: 424308 - DNA, 25 bp, Mus musculus
gaagatgaccgcattgagctcatga

SEQ ID NO: 424309 - DNA, 25 bp, Mus musculus
gaagatgaccgctttgagctcatga

SEQ ID NO: 424310 - DNA, 25 bp, Mus musculus
gaagatgaccttatgcttcagtttg

SEQ ID NO: 424311 - DNA, 25 bp, Mus musculus
gaagatgaccttcagcgagtatccc

SEQ ID NO: 424312 - DNA, 25 bp, Mus musculus
gaagatgaccttgagcgagtatccc

SEQ ID NO: 424313 - DNA, 25 bp, Mus musculus
gaagatgaccttttgcttcagtttg

SEQ ID NO: 424314 - DNA, 25 bp, Mus musculus
gaagatgacgctctggagccaccga

SEQ ID NO: 424315 - DNA, 25 bp, Mus musculus
gaagatgacgctgtggagccaccga

SEQ ID NO: 424316 - DNA, 25 bp, Mus musculus
gaagatgactcgaggaatgaaatac

SEQ ID NO: 424317 - DNA, 25 bp, Mus musculus
gaagatgactcgtggaatgaaatac

SEQ ID NO: 424318 - DNA, 25 bp, Mus musculus
gaagatgactctcttaaggcttggg

SEQ ID NO: 424319 - DNA, 25 bp, Mus musculus
gaagatgactctgttaaggcttggg

SEQ ID NO: 424320 - DNA, 25 bp, Mus musculus
gaagatgactgaaggcttaccgagc

SEQ ID NO: 424321 - DNA, 25 bp, Mus musculus
gaagatgactgatggcttaccgagc

SEQ ID NO: 424322 - DNA, 25 bp, Mus musculus
gaagatgactgcatgatggcctaca

SEQ ID NO: 424323 - DNA, 25 bp, Mus musculus
gaagatgactgcctggtccacctgg

SEQ ID NO: 424324 - DNA, 25 bp, Mus musculus
gaagatgactgcgtggtccacctgg

SEQ ID NO: 424325 - DNA, 25 bp, Mus musculus
gaagatgactgcttgatggcctaca

SEQ ID NO: 424326 - DNA, 25 bp, Mus musculus
gaagatgacttcaacgattgacagt

SEQ ID NO: 424327 - DNA, 25 bp, Mus musculus
gaagatgacttcactaaccagttac

SEQ ID NO: 424328 - DNA, 25 bp, Mus musculus
gaagatgacttctacgattgacagt

SEQ ID NO: 424329 - DNA, 25 bp, Mus musculus
gaagatgacttctctaaccagttac

SEQ ID NO: 424330 - DNA, 25 bp, Mus musculus
gaagatgactttatggttcccacat

SEQ ID NO: 424331 - DNA, 25 bp, Mus musculus
gaagatgactttttggttcccacat

SEQ ID NO: 424332 - DNA, 25 bp, Mus musculus
gaagatgagaacaaccctggctggt

SEQ ID NO: 424333 - DNA, 25 bp, Mus musculus
gaagatgagaactaccctggctggt

SEQ ID NO: 424334 - DNA, 25 bp, Mus musculus
gaagatgagaccagctggctacctg

SEQ ID NO: 424335 - DNA, 25 bp, Mus musculus
gaagatgagacctgctggctacctg

SEQ ID NO: 424336 - DNA, 25 bp, Mus musculus
gaagatgagattcaccaccattcga

SEQ ID NO: 424337 - DNA, 25 bp, Mus musculus
gaagatgagattgaccaccattcga

SEQ ID NO: 424338 - DNA, 25 bp, Mus musculus
gaagatgagcataacctattataaa

SEQ ID NO: 424339 - DNA, 25 bp, Mus musculus
gaagatgagcattacctattataaa

SEQ ID NO: 424340 - DNA, 25 bp, Mus musculus
gaagatgagcccaagcctgcgttct

SEQ ID NO: 424341 - DNA, 25 bp, Mus musculus
gaagatgagccctagcctgcgttct

SEQ ID NO: 424342 - DNA, 25 bp, Mus musculus
gaagatgagcttaccaaggtcgagg

SEQ ID NO: 424343 - DNA, 25 bp, Mus musculus
gaagatgagctttccaaggtcgagg

SEQ ID NO: 424344 - DNA, 25 bp, Mus musculus
gaagatgaggaacgcgcccctccag

SEQ ID NO: 424345 - DNA, 25 bp, Mus musculus
gaagatgaggaaggcgcccctccag

SEQ ID NO: 424346 - DNA, 25 bp, Mus musculus
gaagatgatcacacaaccgcgcagt

SEQ ID NO: 424347 - DNA, 25 bp, Mus musculus
gaagatgatcactcaaccgcgcagt

SEQ ID NO: 424348 - DNA, 25 bp, Mus musculus
gaagatgatgaaaccctccgagaaa

SEQ ID NO: 424349 - DNA, 25 bp, Mus musculus
gaagatgatgaatccctccgagaaa

SEQ ID NO: 424350 - DNA, 25 bp, Mus musculus
gaagatgatgggaccctcttactaa

SEQ ID NO: 424351 - DNA, 25 bp, Mus musculus
gaagatgatgggtccctcttactaa

SEQ ID NO: 424352 - DNA, 25 bp, Mus musculus
gaagatgatgtgagtagaacctggt

SEQ ID NO: 424353 - DNA, 25 bp, Mus musculus
gaagatgatgtgtgtagaacctggt

SEQ ID NO: 424354 - DNA, 25 bp, Mus musculus
gaagatgattcaacactgactccag

SEQ ID NO: 424355 - DNA, 25 bp, Mus musculus
gaagatgattcatcactgactccag

SEQ ID NO: 424356 - DNA, 25 bp, Mus musculus
gaagatgattcccaagttcacaccc

SEQ ID NO: 424357 - DNA, 25 bp, Mus musculus
gaagatgattccgaagttcacaccc

SEQ ID NO: 424358 - DNA, 25 bp, Mus musculus
gaagatgattgtcgccaaggctttg

SEQ ID NO: 424359 - DNA, 25 bp, Mus musculus
gaagatgattgtggccaaggctttg

SEQ ID NO: 424360 - DNA, 25 bp, Mus musculus
gaagatgcaaagaaacctccaggtt

SEQ ID NO: 424361 - DNA, 25 bp, Mus musculus
gaagatgcaaagtaacctccaggtt

SEQ ID NO: 424362 - DNA, 25 bp, Mus musculus
gaagatgcacagaaccatccttacc

SEQ ID NO: 424363 - DNA, 25 bp, Mus musculus
gaagatgcacagtaccatccttacc

SEQ ID NO: 424364 - DNA, 25 bp, Mus musculus
gaagatgcacatacgtactcacacc

SEQ ID NO: 424365 - DNA, 25 bp, Mus musculus
gaagatgcacattcgtactcacacc

SEQ ID NO: 424366 - DNA, 25 bp, Mus musculus
gaagatgcaggacttaagaatttta

SEQ ID NO: 424367 - DNA, 25 bp, Mus musculus
gaagatgcaggagttaagaatttta

SEQ ID NO: 424368 - DNA, 25 bp, Mus musculus
gaagatgcaggccaacaatgcaaag

SEQ ID NO: 424369 - DNA, 25 bp, Mus musculus
gaagatgcaggcgaacaatgcaaag

SEQ ID NO: 424370 - DNA, 25 bp, Mus musculus
gaagatgcatccaagaacccaaaaa

SEQ ID NO: 424371 - DNA, 25 bp, Mus musculus
gaagatgcatcctagaacccaaaaa

SEQ ID NO: 424372 - DNA, 25 bp, Mus musculus
gaagatgcatgccagtgctccatga

SEQ ID NO: 424373 - DNA, 25 bp, Mus musculus
gaagatgcatgcgagtgctccatga

SEQ ID NO: 424374 - DNA, 25 bp, Mus musculus
gaagatgcattcacttgcgctttaa

SEQ ID NO: 424375 - DNA, 25 bp, Mus musculus
gaagatgcattctcttgcgctttaa

SEQ ID NO: 424376 - DNA, 25 bp, Mus musculus
gaagatgccacgcacatttagagtg

SEQ ID NO: 424377 - DNA, 25 bp, Mus musculus
gaagatgccacggacatttagagtg

SEQ ID NO: 424378 - DNA, 25 bp, Mus musculus
gaagatgccagaccagtttgatcag

SEQ ID NO: 424379 - DNA, 25 bp, Mus musculus
gaagatgccagagcagtttgatcag

SEQ ID NO: 424380 - DNA, 25 bp, Mus musculus
gaagatgccatcagtccagctgtga

SEQ ID NO: 424381 - DNA, 25 bp, Mus musculus
gaagatgccatcatacactcggaag

SEQ ID NO: 424382 - DNA, 25 bp, Mus musculus
gaagatgccatctgtccagctgtga

SEQ ID NO: 424383 - DNA, 25 bp, Mus musculus
gaagatgccatcttacactcggaag

SEQ ID NO: 424384 - DNA, 25 bp, Mus musculus
gaagatgccattcgccactgtggct

SEQ ID NO: 424385 - DNA, 25 bp, Mus musculus
gaagatgccattggccactgtggct

SEQ ID NO: 424386 - DNA, 25 bp, Mus musculus
gaagatgcccagagtcatcgtctgg

SEQ ID NO: 424387 - DNA, 25 bp, Mus musculus
gaagatgcccagctgagactcctgc

SEQ ID NO: 424388 - DNA, 25 bp, Mus musculus
gaagatgcccaggtgagactcctgc

SEQ ID NO: 424389 - DNA, 25 bp, Mus musculus
gaagatgcccagtgtcatcgtctgg

SEQ ID NO: 424390 - DNA, 25 bp, Mus musculus
gaagatgccgtgaagcattcttatt

SEQ ID NO: 424391 - DNA, 25 bp, Mus musculus
gaagatgccgtgtagcattcttatt

SEQ ID NO: 424392 - DNA, 25 bp, Mus musculus
gaagatgcctacaccacaggaagta

SEQ ID NO: 424393 - DNA, 25 bp, Mus musculus
gaagatgcctactccacaggaagta

SEQ ID NO: 424394 - DNA, 25 bp, Mus musculus
gaagatgcctggatgataatgtaca

SEQ ID NO: 424395 - DNA, 25 bp, Mus musculus
gaagatgcctggttgataatgtaca

SEQ ID NO: 424396 - DNA, 25 bp, Mus musculus
gaagatgcctgtattagcactatca

SEQ ID NO: 424397 - DNA, 25 bp, Mus musculus
gaagatgcctgttttagcactatca

SEQ ID NO: 424398 - DNA, 25 bp, Mus musculus
gaagatgcgcttagccagtcgagcc

SEQ ID NO: 424399 - DNA, 25 bp, Mus musculus
gaagatgcgctttgccagtcgagcc

SEQ ID NO: 424400 - DNA, 25 bp, Mus musculus
gaagatgctaaaatgcttcaagctg

SEQ ID NO: 424401 - DNA, 25 bp, Mus musculus
gaagatgctaaattgcttcaagctg

SEQ ID NO: 424402 - DNA, 25 bp, Mus musculus
gaagatgctaagctactggacaatg

SEQ ID NO: 424403 - DNA, 25 bp, Mus musculus
gaagatgctaaggtactggacaatg

SEQ ID NO: 424404 - DNA, 25 bp, Mus musculus
gaagatgctaccctaggcggccaac

SEQ ID NO: 424405 - DNA, 25 bp, Mus musculus
gaagatgctaccgtaggcggccaac

SEQ ID NO: 424406 - DNA, 25 bp, Mus musculus
gaagatgctatcaggtttcatccca

SEQ ID NO: 424407 - DNA, 25 bp, Mus musculus
gaagatgctatctggtttcatccca

SEQ ID NO: 424408 - DNA, 25 bp, Mus musculus
gaagatgctatgaactctaccaggg

SEQ ID NO: 424409 - DNA, 25 bp, Mus musculus
gaagatgctatgtactctaccaggg

SEQ ID NO: 424410 - DNA, 25 bp, Mus musculus
gaagatgctcaaattaccttgctca

SEQ ID NO: 424411 - DNA, 25 bp, Mus musculus
gaagatgctcaatttaccttgctca

SEQ ID NO: 424412 - DNA, 25 bp, Mus musculus
gaagatgctcccatgattactggat

SEQ ID NO: 424413 - DNA, 25 bp, Mus musculus
gaagatgctcccttgattactggat

SEQ ID NO: 424414 - DNA, 25 bp, Mus musculus
gaagatgctcctaagactgctacag

SEQ ID NO: 424415 - DNA, 25 bp, Mus musculus
gaagatgctccttagactgctacag

SEQ ID NO: 424416 - DNA, 25 bp, Mus musculus
gaagatgctcgcattcattctttat

SEQ ID NO: 424417 - DNA, 25 bp, Mus musculus
gaagatgctcgctttcattctttat

SEQ ID NO: 424418 - DNA, 25 bp, Mus musculus
gaagatgctcgtattggactcagat

SEQ ID NO: 424419 - DNA, 25 bp, Mus musculus
gaagatgctcgttttggactcagat

SEQ ID NO: 424420 - DNA, 25 bp, Mus musculus
gaagatgctctactacttacccaca

SEQ ID NO: 424421 - DNA, 25 bp, Mus musculus
gaagatgctctagtacttacccaca

SEQ ID NO: 424422 - DNA, 25 bp, Mus musculus
gaagatgctctcaggaatcccgacg

SEQ ID NO: 424423 - DNA, 25 bp, Mus musculus
gaagatgctctctggaatcccgacg

SEQ ID NO: 424424 - DNA, 25 bp, Mus musculus
gaagatgctctgagacctcgtcgaa

SEQ ID NO: 424425 - DNA, 25 bp, Mus musculus
gaagatgctctgtgacctcgtcgaa

SEQ ID NO: 424426 - DNA, 25 bp, Mus musculus
gaagatgctgatacctggccatttt

SEQ ID NO: 424427 - DNA, 25 bp, Mus musculus
gaagatgctgattcctggccatttt

SEQ ID NO: 424428 - DNA, 25 bp, Mus musculus
gaagatgctggaacaccttttgcaa

SEQ ID NO: 424429 - DNA, 25 bp, Mus musculus
gaagatgctggatcaccttttgcaa

SEQ ID NO: 424430 - DNA, 25 bp, Mus musculus
gaagatgctggcatgtctgtaccgt

SEQ ID NO: 424431 - DNA, 25 bp, Mus musculus
gaagatgctggccaacttctggaga

SEQ ID NO: 424432 - DNA, 25 bp, Mus musculus
gaagatgctggcgaacttctggaga

SEQ ID NO: 424433 - DNA, 25 bp, Mus musculus
gaagatgctggcttgtctgtaccgt

SEQ ID NO: 424434 - DNA, 25 bp, Mus musculus
gaagatgctgggatttaacatgaaa

SEQ ID NO: 424435 - DNA, 25 bp, Mus musculus
gaagatgctgggttttaacatgaaa

SEQ ID NO: 424436 - DNA, 25 bp, Mus musculus
gaagatgctgttatgacgtgttgtc

SEQ ID NO: 424437 - DNA, 25 bp, Mus musculus
gaagatgctgttcagcccagaagag

SEQ ID NO: 424438 - DNA, 25 bp, Mus musculus
gaagatgctgttgagcccagaagag

SEQ ID NO: 424439 - DNA, 25 bp, Mus musculus
gaagatgctgttttgacgtgttgtc

SEQ ID NO: 424440 - DNA, 25 bp, Mus musculus
gaagatgcttacactgtgcagtatt

SEQ ID NO: 424441 - DNA, 25 bp, Mus musculus
gaagatgcttactctgtgcagtatt

SEQ ID NO: 424442 - DNA, 25 bp, Mus musculus
gaagatgcttccaaggtcctttgtg

SEQ ID NO: 424443 - DNA, 25 bp, Mus musculus
gaagatgcttcctaggtcctttgtg

SEQ ID NO: 424444 - DNA, 25 bp, Mus musculus
gaagatgcttctcaaaaccctgggc

SEQ ID NO: 424445 - DNA, 25 bp, Mus musculus
gaagatgcttctgaaaaccctgggc

SEQ ID NO: 424446 - DNA, 25 bp, Mus musculus
gaagatgcttgaaaaactcaaccaa

SEQ ID NO: 424447 - DNA, 25 bp, Mus musculus
gaagatgcttgataaactcaaccaa

SEQ ID NO: 424448 - DNA, 25 bp, Mus musculus
gaagatgctttacctttatgtggga

SEQ ID NO: 424449 - DNA, 25 bp, Mus musculus
gaagatgctttagctttatgtggga

SEQ ID NO: 424450 - DNA, 25 bp, Mus musculus
gaagatggaccactgtactacccaa

SEQ ID NO: 424451 - DNA, 25 bp, Mus musculus
gaagatggaccagtgtactacccaa

SEQ ID NO: 424452 - DNA, 25 bp, Mus musculus
gaagatggacccactaacaatgcga

SEQ ID NO: 424453 - DNA, 25 bp, Mus musculus
gaagatggaccctctaacaatgcga

SEQ ID NO: 424454 - DNA, 25 bp, Mus musculus
gaagatggacctcgcagtgttcagc

SEQ ID NO: 424455 - DNA, 25 bp, Mus musculus
gaagatggacctggcagtgttcagc

SEQ ID NO: 424456 - DNA, 25 bp, Mus musculus
gaagatggagacctcacggacacca

SEQ ID NO: 424457 - DNA, 25 bp, Mus musculus
gaagatggagacgtcacggacacca

SEQ ID NO: 424458 - DNA, 25 bp, Mus musculus
gaagatggagctatcggcatctgga

SEQ ID NO: 424459 - DNA, 25 bp, Mus musculus
gaagatggagctcaccagtacccct

SEQ ID NO: 424460 - DNA, 25 bp, Mus musculus
gaagatggagctgaccagtacccct

SEQ ID NO: 424461 - DNA, 25 bp, Mus musculus
gaagatggagctttcggcatctgga

SEQ ID NO: 424462 - DNA, 25 bp, Mus musculus
gaagatggaggaataaggtccatta

SEQ ID NO: 424463 - DNA, 25 bp, Mus musculus
gaagatggaggattaaggtccatta

SEQ ID NO: 424464 - DNA, 25 bp, Mus musculus
gaagatggagtcagcagatcaggct

SEQ ID NO: 424465 - DNA, 25 bp, Mus musculus
gaagatggagtctgcagatcaggct

SEQ ID NO: 424466 - DNA, 25 bp, Mus musculus
gaagatggattaacggatgatctat

SEQ ID NO: 424467 - DNA, 25 bp, Mus musculus
gaagatggattatcggatgatctat

SEQ ID NO: 424468 - DNA, 25 bp, Mus musculus
gaagatggattcagtgaagcccagc

SEQ ID NO: 424469 - DNA, 25 bp, Mus musculus
gaagatggattccagtcaaccggaa

SEQ ID NO: 424470 - DNA, 25 bp, Mus musculus
gaagatggattcgagtcaaccggaa

SEQ ID NO: 424471 - DNA, 25 bp, Mus musculus
gaagatggattctgtgaagcccagc

SEQ ID NO: 424472 - DNA, 25 bp, Mus musculus
gaagatggcaatctcctgcagcttg

SEQ ID NO: 424473 - DNA, 25 bp, Mus musculus
gaagatggcaatgtcctgcagcttg

SEQ ID NO: 424474 - DNA, 25 bp, Mus musculus
gaagatggcactaccttctaggttt

SEQ ID NO: 424475 - DNA, 25 bp, Mus musculus
gaagatggcacttccttctaggttt

SEQ ID NO: 424476 - DNA, 25 bp, Mus musculus
gaagatggcagccatcttgaacctt

SEQ ID NO: 424477 - DNA, 25 bp, Mus musculus
gaagatggcagcgatcttgaacctt

SEQ ID NO: 424478 - DNA, 25 bp, Mus musculus
gaagatggcatactgctgctgtcag

SEQ ID NO: 424479 - DNA, 25 bp, Mus musculus
gaagatggcatagtgctgctgtcag

SEQ ID NO: 424480 - DNA, 25 bp, Mus musculus
gaagatggccaaccactagcagcct

SEQ ID NO: 424481 - DNA, 25 bp, Mus musculus
gaagatggccaagcactagcagcct

SEQ ID NO: 424482 - DNA, 25 bp, Mus musculus
gaagatggccacaaatccccttcgt

SEQ ID NO: 424483 - DNA, 25 bp, Mus musculus
gaagatggccactaatccccttcgt

SEQ ID NO: 424484 - DNA, 25 bp, Mus musculus
gaagatggcccacaccatgctagca

SEQ ID NO: 424485 - DNA, 25 bp, Mus musculus
gaagatggcccagaccatgctagca

SEQ ID NO: 424486 - DNA, 25 bp, Mus musculus
gaagatggccttcggtcaaaacaga

SEQ ID NO: 424487 - DNA, 25 bp, Mus musculus
gaagatggccttgggtcaaaacaga

SEQ ID NO: 424488 - DNA, 25 bp, Mus musculus
gaagatggcgcaaacagggattgtt

SEQ ID NO: 424489 - DNA, 25 bp, Mus musculus
gaagatggcgcatacagggattgtt

SEQ ID NO: 424490 - DNA, 25 bp, Mus musculus
gaagatggcgtcaacattcatggat

SEQ ID NO: 424491 - DNA, 25 bp, Mus musculus
gaagatggcgtctacattcatggat

SEQ ID NO: 424492 - DNA, 25 bp, Mus musculus
gaagatggctccaagaggacaggca

SEQ ID NO: 424493 - DNA, 25 bp, Mus musculus
gaagatggctcctagaggacaggca

SEQ ID NO: 424494 - DNA, 25 bp, Mus musculus
gaagatggctctctactctagtcaa

SEQ ID NO: 424495 - DNA, 25 bp, Mus musculus
gaagatggctctgtactctagtcaa

SEQ ID NO: 424496 - DNA, 25 bp, Mus musculus
gaagatgggcggaacactactgact

SEQ ID NO: 424497 - DNA, 25 bp, Mus musculus
gaagatgggcggtacactactgact

SEQ ID NO: 424498 - DNA, 25 bp, Mus musculus
gaagatgggtctcagtccacagaca

SEQ ID NO: 424499 - DNA, 25 bp, Mus musculus
gaagatgggtctgagtccacagaca

SEQ ID NO: 424500 - DNA, 25 bp, Mus musculus
gaagatggtcacagcctacaaaaca

SEQ ID NO: 424501 - DNA, 25 bp, Mus musculus
gaagatggtcactgcctacaaaaca

SEQ ID NO: 424502 - DNA, 25 bp, Mus musculus
gaagatggtccacaaaatcctgcaa

SEQ ID NO: 424503 - DNA, 25 bp, Mus musculus
gaagatggtccagaaaatcctgcaa

SEQ ID NO: 424504 - DNA, 25 bp, Mus musculus
gaagatggtctcaccactgtagaaa

SEQ ID NO: 424505 - DNA, 25 bp, Mus musculus
gaagatggtctctccactgtagaaa

SEQ ID NO: 424506 - DNA, 25 bp, Mus musculus
gaagatggtcttaggaaccccactc

SEQ ID NO: 424507 - DNA, 25 bp, Mus musculus
gaagatggtcttaggccttgacatg

SEQ ID NO: 424508 - DNA, 25 bp, Mus musculus
gaagatggtctttggaaccccactc

SEQ ID NO: 424509 - DNA, 25 bp, Mus musculus
gaagatggtctttggccttgacatg

SEQ ID NO: 424510 - DNA, 25 bp, Mus musculus
gaagatggttatctcctaactttta

SEQ ID NO: 424511 - DNA, 25 bp, Mus musculus
gaagatggttatgtcctaactttta

SEQ ID NO: 424512 - DNA, 25 bp, Mus musculus
gaagatggttttcatggactgtcac

SEQ ID NO: 424513 - DNA, 25 bp, Mus musculus
gaagatggttttgatggactgtcac

SEQ ID NO: 424514 - DNA, 25 bp, Mus musculus
gaagatgtaaccacggtgatgctat

SEQ ID NO: 424515 - DNA, 25 bp, Mus musculus
gaagatgtaacctcggtgatgctat

SEQ ID NO: 424516 - DNA, 25 bp, Mus musculus
gaagatgtacaacgcctgcatcaag

SEQ ID NO: 424517 - DNA, 25 bp, Mus musculus
gaagatgtacaaggcctgcatcaag

SEQ ID NO: 424518 - DNA, 25 bp, Mus musculus
gaagatgtacttcgacagcatccat

SEQ ID NO: 424519 - DNA, 25 bp, Mus musculus
gaagatgtacttggacagcatccat

SEQ ID NO: 424520 - DNA, 25 bp, Mus musculus
gaagatgtagacctccccgtagatc

SEQ ID NO: 424521 - DNA, 25 bp, Mus musculus
gaagatgtagacgtccccgtagatc

SEQ ID NO: 424522 - DNA, 25 bp, Mus musculus
gaagatgtaggccattctgagaaaa

SEQ ID NO: 424523 - DNA, 25 bp, Mus musculus
gaagatgtaggcgattctgagaaaa

SEQ ID NO: 424524 - DNA, 25 bp, Mus musculus
gaagatgtcacgatctcagagtgca

SEQ ID NO: 424525 - DNA, 25 bp, Mus musculus
gaagatgtcacgttctcagagtgca

SEQ ID NO: 424526 - DNA, 25 bp, Mus musculus
gaagatgtcagcaacagctggtgct

SEQ ID NO: 424527 - DNA, 25 bp, Mus musculus
gaagatgtcagctacagctggtgct

SEQ ID NO: 424528 - DNA, 25 bp, Mus musculus
gaagatgtcagtcagccaggagcca

SEQ ID NO: 424529 - DNA, 25 bp, Mus musculus
gaagatgtcagtcgtgctcggttct

SEQ ID NO: 424530 - DNA, 25 bp, Mus musculus
gaagatgtcagtgagccaggagcca

SEQ ID NO: 424531 - DNA, 25 bp, Mus musculus
gaagatgtcagtggtgctcggttct

SEQ ID NO: 424532 - DNA, 25 bp, Mus musculus
gaagatgtcatccacatgctgaaga

SEQ ID NO: 424533 - DNA, 25 bp, Mus musculus
gaagatgtcatcgacatgctgaaga

SEQ ID NO: 424534 - DNA, 25 bp, Mus musculus
gaagatgtccatcaacgactctccc

SEQ ID NO: 424535 - DNA, 25 bp, Mus musculus
gaagatgtccatgaacgactctccc

SEQ ID NO: 424536 - DNA, 25 bp, Mus musculus
gaagatgtcctgattcctatcctag

SEQ ID NO: 424537 - DNA, 25 bp, Mus musculus
gaagatgtcctgtttcctatcctag

SEQ ID NO: 424538 - DNA, 25 bp, Mus musculus
gaagatgtcgtgaacaccggagaat

SEQ ID NO: 424539 - DNA, 25 bp, Mus musculus
gaagatgtcgtgtacaccggagaat

SEQ ID NO: 424540 - DNA, 25 bp, Mus musculus
gaagatgtctccaacgtctctaatg

SEQ ID NO: 424541 - DNA, 25 bp, Mus musculus
gaagatgtctcctacgtctctaatg

SEQ ID NO: 424542 - DNA, 25 bp, Mus musculus
gaagatgtctttcggcagggctccc

SEQ ID NO: 424543 - DNA, 25 bp, Mus musculus
gaagatgtctttgggcagggctccc

SEQ ID NO: 424544 - DNA, 25 bp, Mus musculus
gaagatgtgcagagtcaccaggtat

SEQ ID NO: 424545 - DNA, 25 bp, Mus musculus
gaagatgtgcagtgtcaccaggtat

SEQ ID NO: 424546 - DNA, 25 bp, Mus musculus
gaagatgtgctcacacactcgactt

SEQ ID NO: 424547 - DNA, 25 bp, Mus musculus
gaagatgtgctctcacactcgactt

SEQ ID NO: 424548 - DNA, 25 bp, Mus musculus
gaagatgtggtacagaaagccctcc

SEQ ID NO: 424549 - DNA, 25 bp, Mus musculus
gaagatgtggtagagaaagccctcc

SEQ ID NO: 424550 - DNA, 25 bp, Mus musculus
gaagatgtgttccttatctgctgat

SEQ ID NO: 424551 - DNA, 25 bp, Mus musculus
gaagatgtgttcgttatctgctgat

SEQ ID NO: 424552 - DNA, 25 bp, Mus musculus
gaagatgttatgatgtcctcagaag

SEQ ID NO: 424553 - DNA, 25 bp, Mus musculus
gaagatgttatgttgtcctcagaag

SEQ ID NO: 424554 - DNA, 25 bp, Mus musculus
gaagatgttcgccattatcttctat

SEQ ID NO: 424555 - DNA, 25 bp, Mus musculus
gaagatgttcgcgattatcttctat

SEQ ID NO: 424556 - DNA, 25 bp, Mus musculus
gaagatgttgtacagcgccttgttg

SEQ ID NO: 424557 - DNA, 25 bp, Mus musculus
gaagatgttgtagagcgccttgttg

SEQ ID NO: 424558 - DNA, 25 bp, Mus musculus
gaagatgttgtcaggtgttcacttg

SEQ ID NO: 424559 - DNA, 25 bp, Mus musculus
gaagatgttgtctggtgttcacttg

SEQ ID NO: 424560 - DNA, 25 bp, Mus musculus
gaagatgtttatactctcaagggta

SEQ ID NO: 424561 - DNA, 25 bp, Mus musculus
gaagatgtttattctctcaagggta

SEQ ID NO: 424562 - DNA, 25 bp, Mus musculus
gaagatgtttcactcccaacgagga

SEQ ID NO: 424563 - DNA, 25 bp, Mus musculus
gaagatgtttcagtcccaacgagga

SEQ ID NO: 424564 - DNA, 25 bp, Mus musculus
gaagatgtttgtagatgtgcccgac

SEQ ID NO: 424565 - DNA, 25 bp, Mus musculus
gaagatgtttgttgatgtgcccgac

SEQ ID NO: 424566 - DNA, 25 bp, Mus musculus
gaagattaaaatatgcctggaagat

SEQ ID NO: 424567 - DNA, 25 bp, Mus musculus
gaagattaaaatttgcctggaagat

SEQ ID NO: 424568 - DNA, 25 bp, Mus musculus
gaagattaaattcccaggttctagg

SEQ ID NO: 424569 - DNA, 25 bp, Mus musculus
gaagattaaattgccaggttctagg

SEQ ID NO: 424570 - DNA, 25 bp, Mus musculus
gaagattaacatagcacaccagtag

SEQ ID NO: 424571 - DNA, 25 bp, Mus musculus
gaagattaacattgcacaccagtag

SEQ ID NO: 424572 - DNA, 25 bp, Mus musculus
gaagattaacccagagaactccaag

SEQ ID NO: 424573 - DNA, 25 bp, Mus musculus
gaagattaaccctgagaactccaag

SEQ ID NO: 424574 - DNA, 25 bp, Mus musculus
gaagattaatacaatgagctctgtt

SEQ ID NO: 424575 - DNA, 25 bp, Mus musculus
gaagattaatactatgagctctgtt

SEQ ID NO: 424576 - DNA, 25 bp, Mus musculus
gaagattacaggaccctcaaccagc

SEQ ID NO: 424577 - DNA, 25 bp, Mus musculus
gaagattacaggtccctcaaccagc

SEQ ID NO: 424578 - DNA, 25 bp, Mus musculus
gaagattacccgcactcgtaccagg

SEQ ID NO: 424579 - DNA, 25 bp, Mus musculus
gaagattacccggactcgtaccagg

SEQ ID NO: 424580 - DNA, 25 bp, Mus musculus
gaagattaccttctttgattgcaga

SEQ ID NO: 424581 - DNA, 25 bp, Mus musculus
gaagattaccttgtttgattgcaga

SEQ ID NO: 424582 - DNA, 25 bp, Mus musculus
gaagattacgtgaatgttcctgaga

SEQ ID NO: 424583 - DNA, 25 bp, Mus musculus
gaagattacgtgtatgttcctgaga

SEQ ID NO: 424584 - DNA, 25 bp, Mus musculus
gaagattactccaatcacttctcct

SEQ ID NO: 424585 - DNA, 25 bp, Mus musculus
gaagattactcctatcacttctcct

SEQ ID NO: 424586 - DNA, 25 bp, Mus musculus
gaagattactggcaggtccaaaaac

SEQ ID NO: 424587 - DNA, 25 bp, Mus musculus
gaagattactgggaggtccaaaaac

SEQ ID NO: 424588 - DNA, 25 bp, Mus musculus
gaagattatccaagagtttaaggct

SEQ ID NO: 424589 - DNA, 25 bp, Mus musculus
gaagattatccatgagtttaaggct

SEQ ID NO: 424590 - DNA, 25 bp, Mus musculus
gaagattatgaaccctagtacttgg

SEQ ID NO: 424591 - DNA, 25 bp, Mus musculus
gaagattatgaagcctagtacttgg

SEQ ID NO: 424592 - DNA, 25 bp, Mus musculus
gaagattatgctactcctaccacag

SEQ ID NO: 424593 - DNA, 25 bp, Mus musculus
gaagattatgcttctcctaccacag

SEQ ID NO: 424594 - DNA, 25 bp, Mus musculus
gaagattatttgaatgccattacca

SEQ ID NO: 424595 - DNA, 25 bp, Mus musculus
gaagattatttgtatgccattacca

SEQ ID NO: 424596 - DNA, 25 bp, Mus musculus
gaagattcacaccaggacctagagg

SEQ ID NO: 424597 - DNA, 25 bp, Mus musculus
gaagattcacacgaggacctagagg

SEQ ID NO: 424598 - DNA, 25 bp, Mus musculus
gaagattcacatcagatcccctggg

SEQ ID NO: 424599 - DNA, 25 bp, Mus musculus
gaagattcacatgagatcccctggg

SEQ ID NO: 424600 - DNA, 25 bp, Mus musculus
gaagattcagatcatgcacgcattt

SEQ ID NO: 424601 - DNA, 25 bp, Mus musculus
gaagattcagatgatgcacgcattt

SEQ ID NO: 424602 - DNA, 25 bp, Mus musculus
gaagattcaggcatgcgttcaaaga

SEQ ID NO: 424603 - DNA, 25 bp, Mus musculus
gaagattcaggcttgcgttcaaaga

SEQ ID NO: 424604 - DNA, 25 bp, Mus musculus
gaagattcatgaatgggttccacct

SEQ ID NO: 424605 - DNA, 25 bp, Mus musculus
gaagattcatgattgggttccacct

SEQ ID NO: 424606 - DNA, 25 bp, Mus musculus
gaagattcatgcagccctggaggct

SEQ ID NO: 424607 - DNA, 25 bp, Mus musculus
gaagattcatgctgccctggaggct

SEQ ID NO: 424608 - DNA, 25 bp, Mus musculus
gaagattcatttaaacgatcccaat

SEQ ID NO: 424609 - DNA, 25 bp, Mus musculus
gaagattcatttaagctccttccct

SEQ ID NO: 424610 - DNA, 25 bp, Mus musculus
gaagattcatttctcatactacaca

SEQ ID NO: 424611 - DNA, 25 bp, Mus musculus
gaagattcatttgtcatactacaca

SEQ ID NO: 424612 - DNA, 25 bp, Mus musculus
gaagattcattttaacgatcccaat

SEQ ID NO: 424613 - DNA, 25 bp, Mus musculus
gaagattcattttagctccttccct

SEQ ID NO: 424614 - DNA, 25 bp, Mus musculus
gaagattccaataagaaacacgaga

SEQ ID NO: 424615 - DNA, 25 bp, Mus musculus
gaagattccaattagaaacacgaga

SEQ ID NO: 424616 - DNA, 25 bp, Mus musculus
gaagattccacactgttactggttt

SEQ ID NO: 424617 - DNA, 25 bp, Mus musculus
gaagattccacagtgttactggttt

SEQ ID NO: 424618 - DNA, 25 bp, Mus musculus
gaagattccaccacagcaaatatat

SEQ ID NO: 424619 - DNA, 25 bp, Mus musculus
gaagattccacctcagcaaatatat

SEQ ID NO: 424620 - DNA, 25 bp, Mus musculus
gaagattccagccttgttcgtttta

SEQ ID NO: 424621 - DNA, 25 bp, Mus musculus
gaagattccagcgttgttcgtttta

SEQ ID NO: 424622 - DNA, 25 bp, Mus musculus
gaagattccagtcctgaatgtttat

SEQ ID NO: 424623 - DNA, 25 bp, Mus musculus
gaagattccagtgctgaatgtttat

SEQ ID NO: 424624 - DNA, 25 bp, Mus musculus
gaagattcctagaagcctttgcctt

SEQ ID NO: 424625 - DNA, 25 bp, Mus musculus
gaagattcctagtagcctttgcctt

SEQ ID NO: 424626 - DNA, 25 bp, Mus musculus
gaagattcgatgagcttgtccttgg

SEQ ID NO: 424627 - DNA, 25 bp, Mus musculus
gaagattcgatgtgcttgtccttgg

SEQ ID NO: 424628 - DNA, 25 bp, Mus musculus
gaagattcggagacgcctggaacac

SEQ ID NO: 424629 - DNA, 25 bp, Mus musculus
gaagattcggagtcgcctggaacac

SEQ ID NO: 424630 - DNA, 25 bp, Mus musculus
gaagattcggatcgcaacctgagct

SEQ ID NO: 424631 - DNA, 25 bp, Mus musculus
gaagattcggatggcaacctgagct

SEQ ID NO: 424632 - DNA, 25 bp, Mus musculus
gaagattctagacctcctaaatgaa

SEQ ID NO: 424633 - DNA, 25 bp, Mus musculus
gaagattctagagctcctaaatgaa

SEQ ID NO: 424634 - DNA, 25 bp, Mus musculus
gaagattctcccaggtagctgcctc

SEQ ID NO: 424635 - DNA, 25 bp, Mus musculus
gaagattctccctggtagctgcctc

SEQ ID NO: 424636 - DNA, 25 bp, Mus musculus
gaagattctctacttcccttggatc

SEQ ID NO: 424637 - DNA, 25 bp, Mus musculus
gaagattctctagttcccttggatc

SEQ ID NO: 424638 - DNA, 25 bp, Mus musculus
gaagattctggccttatctgtgact

SEQ ID NO: 424639 - DNA, 25 bp, Mus musculus
gaagattctggcgttatctgtgact

SEQ ID NO: 424640 - DNA, 25 bp, Mus musculus
gaagattctgtaatctcggtctcct

SEQ ID NO: 424641 - DNA, 25 bp, Mus musculus
gaagattctgtattctcggtctcct

SEQ ID NO: 424642 - DNA, 25 bp, Mus musculus
gaagattcttccaggatccacgtgg

SEQ ID NO: 424643 - DNA, 25 bp, Mus musculus
gaagattcttcctggatccacgtgg

SEQ ID NO: 424644 - DNA, 25 bp, Mus musculus
gaagattcttcgctcaatgtccaga

SEQ ID NO: 424645 - DNA, 25 bp, Mus musculus
gaagattcttcggtcaatgtccaga

SEQ ID NO: 424646 - DNA, 25 bp, Mus musculus
gaagattcttgcatattcctgctac

SEQ ID NO: 424647 - DNA, 25 bp, Mus musculus
gaagattcttgcttattcctgctac

SEQ ID NO: 424648 - DNA, 25 bp, Mus musculus
gaagattcttgtcttctcagtcaaa

SEQ ID NO: 424649 - DNA, 25 bp, Mus musculus
gaagattcttgtgttctcagtcaaa

SEQ ID NO: 424650 - DNA, 25 bp, Mus musculus
gaagattgaagcaactcctgctacg

SEQ ID NO: 424651 - DNA, 25 bp, Mus musculus
gaagattgaagctactcctgctacg

SEQ ID NO: 424652 - DNA, 25 bp, Mus musculus
gaagattgacctagtatgaatactg

SEQ ID NO: 424653 - DNA, 25 bp, Mus musculus
gaagattgaccttgtatgaatactg

SEQ ID NO: 424654 - DNA, 25 bp, Mus musculus
gaagattgacttctctctccgaagc

SEQ ID NO: 424655 - DNA, 25 bp, Mus musculus
gaagattgacttgtctctccgaagc

SEQ ID NO: 424656 - DNA, 25 bp, Mus musculus
gaagattgagcgctggcaccaactg

SEQ ID NO: 424657 - DNA, 25 bp, Mus musculus
gaagattgagcggtggcaccaactg

SEQ ID NO: 424658 - DNA, 25 bp, Mus musculus
gaagattgatatagccagtcggtcc

SEQ ID NO: 424659 - DNA, 25 bp, Mus musculus
gaagattgatattgccagtcggtcc

SEQ ID NO: 424660 - DNA, 25 bp, Mus musculus
gaagattgattgcatcatcgccatc

SEQ ID NO: 424661 - DNA, 25 bp, Mus musculus
gaagattgattggatcatcgccatc

SEQ ID NO: 424662 - DNA, 25 bp, Mus musculus
gaagattgcattcccgtgttctaaa

SEQ ID NO: 424663 - DNA, 25 bp, Mus musculus
gaagattgcattgccgtgttctaaa

SEQ ID NO: 424664 - DNA, 25 bp, Mus musculus
gaagattgccaacagctgtggcctc

SEQ ID NO: 424665 - DNA, 25 bp, Mus musculus
gaagattgccaagagctgtggcctc

SEQ ID NO: 424666 - DNA, 25 bp, Mus musculus
gaagattgcccactagttaagagta

SEQ ID NO: 424667 - DNA, 25 bp, Mus musculus
gaagattgcccagtagttaagagta

SEQ ID NO: 424668 - DNA, 25 bp, Mus musculus
gaagattgccctcacgcataaaaat

SEQ ID NO: 424669 - DNA, 25 bp, Mus musculus
gaagattgccctgacgcataaaaat

SEQ ID NO: 424670 - DNA, 25 bp, Mus musculus
gaagattgccgaacaggagcctgga

SEQ ID NO: 424671 - DNA, 25 bp, Mus musculus
gaagattgccgatcaggagcctgga

SEQ ID NO: 424672 - DNA, 25 bp, Mus musculus
gaagattgctgtacactgcacagtc

SEQ ID NO: 424673 - DNA, 25 bp, Mus musculus
gaagattgctgttcactgcacagtc

SEQ ID NO: 424674 - DNA, 25 bp, Mus musculus
gaagattgcttacgaaattccctct

SEQ ID NO: 424675 - DNA, 25 bp, Mus musculus
gaagattgcttaggaaattccctct

SEQ ID NO: 424676 - DNA, 25 bp, Mus musculus
gaagattggagtacagatccctgaa

SEQ ID NO: 424677 - DNA, 25 bp, Mus musculus
gaagattggagttcagatccctgaa

SEQ ID NO: 424678 - DNA, 25 bp, Mus musculus
gaagattggcaaagacatgagaccc

SEQ ID NO: 424679 - DNA, 25 bp, Mus musculus
gaagattggcaatgacatgagaccc

SEQ ID NO: 424680 - DNA, 25 bp, Mus musculus
gaagattggcccacgccgcatacac

SEQ ID NO: 424681 - DNA, 25 bp, Mus musculus
gaagattggccctcgccgcatacac

SEQ ID NO: 424682 - DNA, 25 bp, Mus musculus
gaagattggcttaaaatggctactg

SEQ ID NO: 424683 - DNA, 25 bp, Mus musculus
gaagattggctttaaatggctactg

SEQ ID NO: 424684 - DNA, 25 bp, Mus musculus
gaagattgggcaccgctacaccaga

SEQ ID NO: 424685 - DNA, 25 bp, Mus musculus
gaagattgggcagcgctacaccaga

SEQ ID NO: 424686 - DNA, 25 bp, Mus musculus
gaagattggttcctgacccatactg

SEQ ID NO: 424687 - DNA, 25 bp, Mus musculus
gaagattggttcgtgacccatactg

SEQ ID NO: 424688 - DNA, 25 bp, Mus musculus
gaagattgtaaaacacgtgaataaa

SEQ ID NO: 424689 - DNA, 25 bp, Mus musculus
gaagattgtaaatcacgtgaataaa

SEQ ID NO: 424690 - DNA, 25 bp, Mus musculus
gaagattgtaagacgcatggactgt

SEQ ID NO: 424691 - DNA, 25 bp, Mus musculus
gaagattgtaagtcgcatggactgt

SEQ ID NO: 424692 - DNA, 25 bp, Mus musculus
gaagattgtcctcgccgcgacctga

SEQ ID NO: 424693 - DNA, 25 bp, Mus musculus
gaagattgtcctggccgcgacctga

SEQ ID NO: 424694 - DNA, 25 bp, Mus musculus
gaagattgtctcagccaagaaccac

SEQ ID NO: 424695 - DNA, 25 bp, Mus musculus
gaagattgtctctgccaagaaccac

SEQ ID NO: 424696 - DNA, 25 bp, Mus musculus
gaagattgtggtcctcctgcaacgc

SEQ ID NO: 424697 - DNA, 25 bp, Mus musculus
gaagattgtggtgctcctgcaacgc

SEQ ID NO: 424698 - DNA, 25 bp, Mus musculus
gaagattgttccctgaaccacctgc

SEQ ID NO: 424699 - DNA, 25 bp, Mus musculus
gaagattgttccgtgaaccacctgc

SEQ ID NO: 424700 - DNA, 25 bp, Mus musculus
gaagatttaaatacgaggccatggc

SEQ ID NO: 424701 - DNA, 25 bp, Mus musculus
gaagatttaaattcgaggccatggc

SEQ ID NO: 424702 - DNA, 25 bp, Mus musculus
gaagatttacatatacgctcctgtt

SEQ ID NO: 424703 - DNA, 25 bp, Mus musculus
gaagatttacatttacgctcctgtt

SEQ ID NO: 424704 - DNA, 25 bp, Mus musculus
gaagatttacctatgagtgcctgtt

SEQ ID NO: 424705 - DNA, 25 bp, Mus musculus
gaagatttacctctgggctgagtga

SEQ ID NO: 424706 - DNA, 25 bp, Mus musculus
gaagatttacctgtgggctgagtga

SEQ ID NO: 424707 - DNA, 25 bp, Mus musculus
gaagatttacctttgagtgcctgtt

SEQ ID NO: 424708 - DNA, 25 bp, Mus musculus
gaagatttagaaatcattccttgtg

SEQ ID NO: 424709 - DNA, 25 bp, Mus musculus
gaagatttagaattcattccttgtg

SEQ ID NO: 424710 - DNA, 25 bp, Mus musculus
gaagatttagctatacctagtggta

SEQ ID NO: 424711 - DNA, 25 bp, Mus musculus
gaagatttagctttacctagtggta

SEQ ID NO: 424712 - DNA, 25 bp, Mus musculus
gaagatttattcaaggcctagccag

SEQ ID NO: 424713 - DNA, 25 bp, Mus musculus
gaagatttattccaactactttcat

SEQ ID NO: 424714 - DNA, 25 bp, Mus musculus
gaagatttattcgaactactttcat

SEQ ID NO: 424715 - DNA, 25 bp, Mus musculus
gaagatttattctaggcctagccag

SEQ ID NO: 424716 - DNA, 25 bp, Mus musculus
gaagatttcaccagcgggttacaaa

SEQ ID NO: 424717 - DNA, 25 bp, Mus musculus
gaagatttcacctgcgggttacaaa

SEQ ID NO: 424718 - DNA, 25 bp, Mus musculus
gaagatttcactactaaggcagaca

SEQ ID NO: 424719 - DNA, 25 bp, Mus musculus
gaagatttcacttctaaggcagaca

SEQ ID NO: 424720 - DNA, 25 bp, Mus musculus
gaagatttcagaataacgaagcttt

SEQ ID NO: 424721 - DNA, 25 bp, Mus musculus
gaagatttcagattaacgaagcttt

SEQ ID NO: 424722 - DNA, 25 bp, Mus musculus
gaagatttccacacttctatgcctc

SEQ ID NO: 424723 - DNA, 25 bp, Mus musculus
gaagatttccactcttctatgcctc

SEQ ID NO: 424724 - DNA, 25 bp, Mus musculus
gaagatttccatcacagctgagcat

SEQ ID NO: 424725 - DNA, 25 bp, Mus musculus
gaagatttccatcattacccaccac

SEQ ID NO: 424726 - DNA, 25 bp, Mus musculus
gaagatttccatgacagctgagcat

SEQ ID NO: 424727 - DNA, 25 bp, Mus musculus
gaagatttccatgattacccaccac

SEQ ID NO: 424728 - DNA, 25 bp, Mus musculus
gaagatttccctacccatttatcgg

SEQ ID NO: 424729 - DNA, 25 bp, Mus musculus
gaagatttcccttcccatttatcgg

SEQ ID NO: 424730 - DNA, 25 bp, Mus musculus
gaagatttccgacttgttccctcca

SEQ ID NO: 424731 - DNA, 25 bp, Mus musculus
gaagatttccgagttgttccctcca

SEQ ID NO: 424732 - DNA, 25 bp, Mus musculus
gaagatttccttcagatcatctatg

SEQ ID NO: 424733 - DNA, 25 bp, Mus musculus
gaagatttccttcatgatccatact

SEQ ID NO: 424734 - DNA, 25 bp, Mus musculus
gaagatttccttgagatcatctatg

SEQ ID NO: 424735 - DNA, 25 bp, Mus musculus
gaagatttccttgatgatccatact

SEQ ID NO: 424736 - DNA, 25 bp, Mus musculus
gaagatttcggacttcccaataagc

SEQ ID NO: 424737 - DNA, 25 bp, Mus musculus
gaagatttcggagttcccaataagc

SEQ ID NO: 424738 - DNA, 25 bp, Mus musculus
gaagatttctccactccagtgaagc

SEQ ID NO: 424739 - DNA, 25 bp, Mus musculus
gaagatttctcctctccagtgaagc

SEQ ID NO: 424740 - DNA, 25 bp, Mus musculus
gaagatttctgcctgatttgacaac

SEQ ID NO: 424741 - DNA, 25 bp, Mus musculus
gaagatttctgcgtgatttgacaac

SEQ ID NO: 424742 - DNA, 25 bp, Mus musculus
gaagatttgattagtgagccccaga

SEQ ID NO: 424743 - DNA, 25 bp, Mus musculus
gaagatttgatttgtgagccccaga

SEQ ID NO: 424744 - DNA, 25 bp, Mus musculus
gaagatttgcacacagatttgcccc

SEQ ID NO: 424745 - DNA, 25 bp, Mus musculus
gaagatttgcactcagatttgcccc

SEQ ID NO: 424746 - DNA, 25 bp, Mus musculus
gaagatttgcagctttccttatgtg

SEQ ID NO: 424747 - DNA, 25 bp, Mus musculus
gaagatttgcaggtttccttatgtg

SEQ ID NO: 424748 - DNA, 25 bp, Mus musculus
gaagatttgcccctcaccaggaaaa

SEQ ID NO: 424749 - DNA, 25 bp, Mus musculus
gaagatttgcccgtcaccaggaaaa

SEQ ID NO: 424750 - DNA, 25 bp, Mus musculus
gaagatttggatagctgcccctcaa

SEQ ID NO: 424751 - DNA, 25 bp, Mus musculus
gaagatttggatagctttctgaata

SEQ ID NO: 424752 - DNA, 25 bp, Mus musculus
gaagatttggattgctgcccctcaa

SEQ ID NO: 424753 - DNA, 25 bp, Mus musculus
gaagatttggattgctttctgaata

SEQ ID NO: 424754 - DNA, 25 bp, Mus musculus
gaagatttgggtctgctcttagcaa

SEQ ID NO: 424755 - DNA, 25 bp, Mus musculus
gaagatttgggtgtgctcttagcaa

SEQ ID NO: 424756 - DNA, 25 bp, Mus musculus
gaagatttggtgctgcctgaaacga

SEQ ID NO: 424757 - DNA, 25 bp, Mus musculus
gaagatttggtggtgcctgaaacga

SEQ ID NO: 424758 - DNA, 25 bp, Mus musculus
gaagattttacacgcaggcatctcc

SEQ ID NO: 424759 - DNA, 25 bp, Mus musculus
gaagattttacaggcaggcatctcc

SEQ ID NO: 424760 - DNA, 25 bp, Mus musculus
gaagattttatgaaattccagctcc

SEQ ID NO: 424761 - DNA, 25 bp, Mus musculus
gaagattttatgtaattccagctcc

SEQ ID NO: 424762 - DNA, 25 bp, Mus musculus
gaagattttcagaaaagagtgttgt

SEQ ID NO: 424763 - DNA, 25 bp, Mus musculus
gaagattttcagactagctgccacg

SEQ ID NO: 424764 - DNA, 25 bp, Mus musculus
gaagattttcagtaaagagtgttgt

SEQ ID NO: 424765 - DNA, 25 bp, Mus musculus
gaagattttcagtctagctgccacg

SEQ ID NO: 424766 - DNA, 25 bp, Mus musculus
gaagattttccaagacatgaatgtc

SEQ ID NO: 424767 - DNA, 25 bp, Mus musculus
gaagattttccaagttgattcagaa

SEQ ID NO: 424768 - DNA, 25 bp, Mus musculus
gaagattttccatgacatgaatgtc

SEQ ID NO: 424769 - DNA, 25 bp, Mus musculus
gaagattttccatgttgattcagaa

SEQ ID NO: 424770 - DNA, 25 bp, Mus musculus
gaagattttcctcacactaagatgc

SEQ ID NO: 424771 - DNA, 25 bp, Mus musculus
gaagattttcctgacactaagatgc

SEQ ID NO: 424772 - DNA, 25 bp, Mus musculus
gaagattttctacccactgggaaga

SEQ ID NO: 424773 - DNA, 25 bp, Mus musculus
gaagattttctagccactgggaaga

SEQ ID NO: 424774 - DNA, 25 bp, Mus musculus
gaagattttgcaacacttttgctat

SEQ ID NO: 424775 - DNA, 25 bp, Mus musculus
gaagattttgcatcacttttgctat

SEQ ID NO: 424776 - DNA, 25 bp, Mus musculus
gaagattttgccacactgataacaa

SEQ ID NO: 424777 - DNA, 25 bp, Mus musculus
gaagattttgcctcactgataacaa

SEQ ID NO: 424778 - DNA, 25 bp, Mus musculus
gaagattttggcctgcactgcaaac

SEQ ID NO: 424779 - DNA, 25 bp, Mus musculus
gaagattttggcgtgcactgcaaac

SEQ ID NO: 424780 - DNA, 25 bp, Mus musculus
gaagattttggtccccacgatgcca

SEQ ID NO: 424781 - DNA, 25 bp, Mus musculus
gaagattttggtgcccacgatgcca

SEQ ID NO: 424782 - DNA, 25 bp, Mus musculus
gaagattttgtacctggccttggtt

SEQ ID NO: 424783 - DNA, 25 bp, Mus musculus
gaagattttgtagctggccttggtt

SEQ ID NO: 424784 - DNA, 25 bp, Mus musculus
gaagatttttacagagccctaaagt

SEQ ID NO: 424785 - DNA, 25 bp, Mus musculus
gaagatttttactgagccctaaagt

SEQ ID NO: 424786 - DNA, 25 bp, Mus musculus
gaagatttttgaatcttggcaaagc

SEQ ID NO: 424787 - DNA, 25 bp, Mus musculus
gaagatttttgattcttggcaaagc

SEQ ID NO: 424788 - DNA, 25 bp, Mus musculus
gaagcaaaaagcagccctgcttgcc

SEQ ID NO: 424789 - DNA, 25 bp, Mus musculus
gaagcaaaaagctgccctgcttgcc

SEQ ID NO: 424790 - DNA, 25 bp, Mus musculus
gaagcaaaacccaggaccaagaaat

SEQ ID NO: 424791 - DNA, 25 bp, Mus musculus
gaagcaaaaccctggaccaagaaat

SEQ ID NO: 424792 - DNA, 25 bp, Mus musculus
gaagcaaaacgaactctccatgatg

SEQ ID NO: 424793 - DNA, 25 bp, Mus musculus
gaagcaaaacgatctctccatgatg

SEQ ID NO: 424794 - DNA, 25 bp, Mus musculus
gaagcaaaacttcccatatcaggta

SEQ ID NO: 424795 - DNA, 25 bp, Mus musculus
gaagcaaaacttgccatatcaggta

SEQ ID NO: 424796 - DNA, 25 bp, Mus musculus
gaagcaaaagacactacgctgtcat

SEQ ID NO: 424797 - DNA, 25 bp, Mus musculus
gaagcaaaagactctacgctgtcat

SEQ ID NO: 424798 - DNA, 25 bp, Mus musculus
gaagcaaaagtcattctccagggac

SEQ ID NO: 424799 - DNA, 25 bp, Mus musculus
gaagcaaaagtctttctccagggac

SEQ ID NO: 424800 - DNA, 25 bp, Mus musculus
gaagcaaaatggatgccttagcact

SEQ ID NO: 424801 - DNA, 25 bp, Mus musculus
gaagcaaaatggttgccttagcact

SEQ ID NO: 424802 - DNA, 25 bp, Mus musculus
gaagcaaacgagatcctgggccgca

SEQ ID NO: 424803 - DNA, 25 bp, Mus musculus
gaagcaaacgagttcctgggccgca

SEQ ID NO: 424804 - DNA, 25 bp, Mus musculus
gaagcaaactagatgaggtgtctaa

SEQ ID NO: 424805 - DNA, 25 bp, Mus musculus
gaagcaaactagttgaggtgtctaa

SEQ ID NO: 424806 - DNA, 25 bp, Mus musculus
gaagcaaactcacaactggcaaaca

SEQ ID NO: 424807 - DNA, 25 bp, Mus musculus
gaagcaaactcagaactggcaaaca

SEQ ID NO: 424808 - DNA, 25 bp, Mus musculus
gaagcaaactgtcccttctggcctg

SEQ ID NO: 424809 - DNA, 25 bp, Mus musculus
gaagcaaactgtgccttctggcctg

SEQ ID NO: 424810 - DNA, 25 bp, Mus musculus
gaagcaaacttgcaggccctaatag

SEQ ID NO: 424811 - DNA, 25 bp, Mus musculus
gaagcaaacttggaggccctaatag

SEQ ID NO: 424812 - DNA, 25 bp, Mus musculus
gaagcaaagacaatcccgaagccgt

SEQ ID NO: 424813 - DNA, 25 bp, Mus musculus
gaagcaaagacattcccgaagccgt

SEQ ID NO: 424814 - DNA, 25 bp, Mus musculus
gaagcaaagactccctctgggcttt

SEQ ID NO: 424815 - DNA, 25 bp, Mus musculus
gaagcaaagactgcctctgggcttt

SEQ ID NO: 424816 - DNA, 25 bp, Mus musculus
gaagcaaagcggcactccgggcttc

SEQ ID NO: 424817 - DNA, 25 bp, Mus musculus
gaagcaaagcgggactccgggcttc

SEQ ID NO: 424818 - DNA, 25 bp, Mus musculus
gaagcaaagctccaatgtagggtaa

SEQ ID NO: 424819 - DNA, 25 bp, Mus musculus
gaagcaaagctcgaatgtagggtaa

SEQ ID NO: 424820 - DNA, 25 bp, Mus musculus
gaagcaaaggccaccgatttcttac

SEQ ID NO: 424821 - DNA, 25 bp, Mus musculus
gaagcaaaggcccagtgtgttcaca

SEQ ID NO: 424822 - DNA, 25 bp, Mus musculus
gaagcaaaggccgagtgtgttcaca

SEQ ID NO: 424823 - DNA, 25 bp, Mus musculus
gaagcaaaggcctccgatttcttac

SEQ ID NO: 424824 - DNA, 25 bp, Mus musculus
gaagcaaaggttaacgccctagaag

SEQ ID NO: 424825 - DNA, 25 bp, Mus musculus
gaagcaaaggtttacgccctagaag

SEQ ID NO: 424826 - DNA, 25 bp, Mus musculus
gaagcaaagtgtagatgcgcctcac

SEQ ID NO: 424827 - DNA, 25 bp, Mus musculus
gaagcaaagtgttgatgcgcctcac

SEQ ID NO: 424828 - DNA, 25 bp, Mus musculus
gaagcaaatagtactaattcggatt

SEQ ID NO: 424829 - DNA, 25 bp, Mus musculus
gaagcaaatagttctaattcggatt

SEQ ID NO: 424830 - DNA, 25 bp, Mus musculus
gaagcaaatctacactgcctagtgt

SEQ ID NO: 424831 - DNA, 25 bp, Mus musculus
gaagcaaatctagactgcctagtgt

SEQ ID NO: 424832 - DNA, 25 bp, Mus musculus
gaagcaaatctgcttcaagacttgt

SEQ ID NO: 424833 - DNA, 25 bp, Mus musculus
gaagcaaatctggttcaagacttgt

SEQ ID NO: 424834 - DNA, 25 bp, Mus musculus
gaagcaaatgacctctcctggcaga

SEQ ID NO: 424835 - DNA, 25 bp, Mus musculus
gaagcaaatgacgtctcctggcaga

SEQ ID NO: 424836 - DNA, 25 bp, Mus musculus
gaagcaaatggtctccacgtctgaa

SEQ ID NO: 424837 - DNA, 25 bp, Mus musculus
gaagcaaatggtgtccacgtctgaa

SEQ ID NO: 424838 - DNA, 25 bp, Mus musculus
gaagcaaatgtgaccacctggatat

SEQ ID NO: 424839 - DNA, 25 bp, Mus musculus
gaagcaaatgtgtccacctggatat

SEQ ID NO: 424840 - DNA, 25 bp, Mus musculus
gaagcaaattcaactacattacagt

SEQ ID NO: 424841 - DNA, 25 bp, Mus musculus
gaagcaaattcatctacattacagt

SEQ ID NO: 424842 - DNA, 25 bp, Mus musculus
gaagcaacaacaacaacaccctctt

SEQ ID NO: 424843 - DNA, 25 bp, Mus musculus
gaagcaacaacatcaacaccctctt

SEQ ID NO: 424844 - DNA, 25 bp, Mus musculus
gaagcaacactgaccttggtgtgtc

SEQ ID NO: 424845 - DNA, 25 bp, Mus musculus
gaagcaacactgtccttggtgtgtc

SEQ ID NO: 424846 - DNA, 25 bp, Mus musculus
gaagcaacaggaaaccctgtgtcat

SEQ ID NO: 424847 - DNA, 25 bp, Mus musculus
gaagcaacaggataccctgtgtcat

SEQ ID NO: 424848 - DNA, 25 bp, Mus musculus
gaagcaacagggagctcagggcatt

SEQ ID NO: 424849 - DNA, 25 bp, Mus musculus
gaagcaacagggtgctcagggcatt

SEQ ID NO: 424850 - DNA, 25 bp, Mus musculus
gaagcaacaggtctgtttacctcca

SEQ ID NO: 424851 - DNA, 25 bp, Mus musculus
gaagcaacaggtgtgtttacctcca

SEQ ID NO: 424852 - DNA, 25 bp, Mus musculus
gaagcaacagttaacccaagaaggt

SEQ ID NO: 424853 - DNA, 25 bp, Mus musculus
gaagcaacagtttacccaagaaggt

SEQ ID NO: 424854 - DNA, 25 bp, Mus musculus
gaagcaacatagctgcagagaatcc

SEQ ID NO: 424855 - DNA, 25 bp, Mus musculus
gaagcaacataggtgcagagaatcc

SEQ ID NO: 424856 - DNA, 25 bp, Mus musculus
gaagcaacatctctgaggaatgtaa

SEQ ID NO: 424857 - DNA, 25 bp, Mus musculus
gaagcaacatctgtgaggaatgtaa

SEQ ID NO: 424858 - DNA, 25 bp, Mus musculus
gaagcaaccaggcttccatgcacct

SEQ ID NO: 424859 - DNA, 25 bp, Mus musculus
gaagcaaccagggttccatgcacct

SEQ ID NO: 424860 - DNA, 25 bp, Mus musculus
gaagcaacccgtactgatgaatttg

SEQ ID NO: 424861 - DNA, 25 bp, Mus musculus
gaagcaacccgttctgatgaatttg

SEQ ID NO: 424862 - DNA, 25 bp, Mus musculus
gaagcaaccctgatgtctgtccatt

SEQ ID NO: 424863 - DNA, 25 bp, Mus musculus
gaagcaaccctgttgtctgtccatt

SEQ ID NO: 424864 - DNA, 25 bp, Mus musculus
gaagcaaccgttattattctgtagc

SEQ ID NO: 424865 - DNA, 25 bp, Mus musculus
gaagcaaccgtttttattctgtagc

SEQ ID NO: 424866 - DNA, 25 bp, Mus musculus
gaagcaacctagacttacatcgtgt

SEQ ID NO: 424867 - DNA, 25 bp, Mus musculus
gaagcaacctagtcttacatcgtgt

SEQ ID NO: 424868 - DNA, 25 bp, Mus musculus
gaagcaacgcaacttaagaaagaac

SEQ ID NO: 424869 - DNA, 25 bp, Mus musculus
gaagcaacgcaagttaagaaagaac

SEQ ID NO: 424870 - DNA, 25 bp, Mus musculus
gaagcaacggcaattcctagacacg

SEQ ID NO: 424871 - DNA, 25 bp, Mus musculus
gaagcaacggcatttcctagacacg

SEQ ID NO: 424872 - DNA, 25 bp, Mus musculus
gaagcaacgttgaacagaaagcagt

SEQ ID NO: 424873 - DNA, 25 bp, Mus musculus
gaagcaacgttgtacagaaagcagt

SEQ ID NO: 424874 - DNA, 25 bp, Mus musculus
gaagcaactcctcagcatcttttcc

SEQ ID NO: 424875 - DNA, 25 bp, Mus musculus
gaagcaactcctgagcatcttttcc

SEQ ID NO: 424876 - DNA, 25 bp, Mus musculus
gaagcaactgggacatacttatttg

SEQ ID NO: 424877 - DNA, 25 bp, Mus musculus
gaagcaactgggtcatacttatttg

SEQ ID NO: 424878 - DNA, 25 bp, Mus musculus
gaagcaactgtcatcattttgccat

SEQ ID NO: 424879 - DNA, 25 bp, Mus musculus
gaagcaactgtcttcattttgccat

SEQ ID NO: 424880 - DNA, 25 bp, Mus musculus
gaagcaactgtgagccatctggcaa

SEQ ID NO: 424881 - DNA, 25 bp, Mus musculus
gaagcaactgtgtgccatctggcaa

SEQ ID NO: 424882 - DNA, 25 bp, Mus musculus
gaagcaacttagagccttgtaatct

SEQ ID NO: 424883 - DNA, 25 bp, Mus musculus
gaagcaacttagtgccttgtaatct

SEQ ID NO: 424884 - DNA, 25 bp, Mus musculus
gaagcaacttcaaaaagcacgtgga

SEQ ID NO: 424885 - DNA, 25 bp, Mus musculus
gaagcaacttcataaagcacgtgga

SEQ ID NO: 424886 - DNA, 25 bp, Mus musculus
gaagcaacttcccagagttatcctc

SEQ ID NO: 424887 - DNA, 25 bp, Mus musculus
gaagcaacttccgagagttatcctc

SEQ ID NO: 424888 - DNA, 25 bp, Mus musculus
gaagcaactttgaagcaccttgatt

SEQ ID NO: 424889 - DNA, 25 bp, Mus musculus
gaagcaactttgtagcaccttgatt

SEQ ID NO: 424890 - DNA, 25 bp, Mus musculus
gaagcaacttttccatgctcttact

SEQ ID NO: 424891 - DNA, 25 bp, Mus musculus
gaagcaacttttgcatgctcttact

SEQ ID NO: 424892 - DNA, 25 bp, Mus musculus
gaagcaagacctcagatcctggagt

SEQ ID NO: 424893 - DNA, 25 bp, Mus musculus
gaagcaagacctgagatcctggagt

SEQ ID NO: 424894 - DNA, 25 bp, Mus musculus
gaagcaagagagacacacaccccga

SEQ ID NO: 424895 - DNA, 25 bp, Mus musculus
gaagcaagagagtcacacaccccga

SEQ ID NO: 424896 - DNA, 25 bp, Mus musculus
gaagcaagagcgctcacttctccag

SEQ ID NO: 424897 - DNA, 25 bp, Mus musculus
gaagcaagagcggtcacttctccag

SEQ ID NO: 424898 - DNA, 25 bp, Mus musculus
gaagcaagaggcactgtccccagtt

SEQ ID NO: 424899 - DNA, 25 bp, Mus musculus
gaagcaagaggctctgtccccagtt

SEQ ID NO: 424900 - DNA, 25 bp, Mus musculus
gaagcaagagtcatggccctcaggc

SEQ ID NO: 424901 - DNA, 25 bp, Mus musculus
gaagcaagagtcttggccctcaggc

SEQ ID NO: 424902 - DNA, 25 bp, Mus musculus
gaagcaagagtgacctggactacag

SEQ ID NO: 424903 - DNA, 25 bp, Mus musculus
gaagcaagagtgtcctggactacag

SEQ ID NO: 424904 - DNA, 25 bp, Mus musculus
gaagcaagatctaacctggtgtcat

SEQ ID NO: 424905 - DNA, 25 bp, Mus musculus
gaagcaagatcttacctggtgtcat

SEQ ID NO: 424906 - DNA, 25 bp, Mus musculus
gaagcaagatgtcacctgtctcagt

SEQ ID NO: 424907 - DNA, 25 bp, Mus musculus
gaagcaagatgtgacctgtctcagt

SEQ ID NO: 424908 - DNA, 25 bp, Mus musculus
gaagcaagcaaccacgtaaagggaa

SEQ ID NO: 424909 - DNA, 25 bp, Mus musculus
gaagcaagcaacgacgtaaagggaa

SEQ ID NO: 424910 - DNA, 25 bp, Mus musculus
gaagcaagcacactcattttcaggg

SEQ ID NO: 424911 - DNA, 25 bp, Mus musculus
gaagcaagcacagtcattttcaggg

SEQ ID NO: 424912 - DNA, 25 bp, Mus musculus
gaagcaagcactcagtatcctaagg

SEQ ID NO: 424913 - DNA, 25 bp, Mus musculus
gaagcaagcactgagtatcctaagg

SEQ ID NO: 424914 - DNA, 25 bp, Mus musculus
gaagcaagcaggatgtctcaccata

SEQ ID NO: 424915 - DNA, 25 bp, Mus musculus
gaagcaagcaggttgtctcaccata

SEQ ID NO: 424916 - DNA, 25 bp, Mus musculus
gaagcaagcatacccatgtcctgac

SEQ ID NO: 424917 - DNA, 25 bp, Mus musculus
gaagcaagcatagccatgtcctgac

SEQ ID NO: 424918 - DNA, 25 bp, Mus musculus
gaagcaagcatgaatggcggccaac

SEQ ID NO: 424919 - DNA, 25 bp, Mus musculus
gaagcaagcatgtatggcggccaac

SEQ ID NO: 424920 - DNA, 25 bp, Mus musculus
gaagcaagccacattatctctttct

SEQ ID NO: 424921 - DNA, 25 bp, Mus musculus
gaagcaagccactttatctctttct

SEQ ID NO: 424922 - DNA, 25 bp, Mus musculus
gaagcaagccctctgaactctggta

SEQ ID NO: 424923 - DNA, 25 bp, Mus musculus
gaagcaagccctgtgaactctggta

SEQ ID NO: 424924 - DNA, 25 bp, Mus musculus
gaagcaagcctaaatgcagattcca

SEQ ID NO: 424925 - DNA, 25 bp, Mus musculus
gaagcaagcctatatgcagattcca

SEQ ID NO: 424926 - DNA, 25 bp, Mus musculus
gaagcaagcctcagtgacacacatg

SEQ ID NO: 424927 - DNA, 25 bp, Mus musculus
gaagcaagcctctgtgacacacatg

SEQ ID NO: 424928 - DNA, 25 bp, Mus musculus
gaagcaagcgctaattatcccgatt

SEQ ID NO: 424929 - DNA, 25 bp, Mus musculus
gaagcaagcgcttattatcccgatt

SEQ ID NO: 424930 - DNA, 25 bp, Mus musculus
gaagcaagctgccactacccgggta

SEQ ID NO: 424931 - DNA, 25 bp, Mus musculus
gaagcaagctgcgactacccgggta

SEQ ID NO: 424932 - DNA, 25 bp, Mus musculus
gaagcaagctttagagtccaagccg

SEQ ID NO: 424933 - DNA, 25 bp, Mus musculus
gaagcaagcttttgagtccaagccg

SEQ ID NO: 424934 - DNA, 25 bp, Mus musculus
gaagcaaggagtccactcactgcaa

SEQ ID NO: 424935 - DNA, 25 bp, Mus musculus
gaagcaaggagtgcactcactgcaa

SEQ ID NO: 424936 - DNA, 25 bp, Mus musculus
gaagcaaggcaaatcagcatccatg

SEQ ID NO: 424937 - DNA, 25 bp, Mus musculus
gaagcaaggcaattcagcatccatg

SEQ ID NO: 424938 - DNA, 25 bp, Mus musculus
gaagcaaggcatcaagacttcaaat

SEQ ID NO: 424939 - DNA, 25 bp, Mus musculus
gaagcaaggcatgaagacttcaaat

SEQ ID NO: 424940 - DNA, 25 bp, Mus musculus
gaagcaaggccgctagagctcctgc

SEQ ID NO: 424941 - DNA, 25 bp, Mus musculus
gaagcaaggccggtagagctcctgc

SEQ ID NO: 424942 - DNA, 25 bp, Mus musculus
gaagcaaggcttccctgttatgcca

SEQ ID NO: 424943 - DNA, 25 bp, Mus musculus
gaagcaaggcttgcctgttatgcca

SEQ ID NO: 424944 - DNA, 25 bp, Mus musculus
gaagcaagtagcacacctttggaat

SEQ ID NO: 424945 - DNA, 25 bp, Mus musculus
gaagcaagtagctcacctttggaat

SEQ ID NO: 424946 - DNA, 25 bp, Mus musculus
gaagcaagtcaaagcagtcccactt

SEQ ID NO: 424947 - DNA, 25 bp, Mus musculus
gaagcaagtcaatgcagtcccactt

SEQ ID NO: 424948 - DNA, 25 bp, Mus musculus
gaagcaagtctcaggacggcatgga

SEQ ID NO: 424949 - DNA, 25 bp, Mus musculus
gaagcaagtctctggacggcatgga

SEQ ID NO: 424950 - DNA, 25 bp, Mus musculus
gaagcaagtgcaataccacctctcc

SEQ ID NO: 424951 - DNA, 25 bp, Mus musculus
gaagcaagtgcattaccacctctcc

SEQ ID NO: 424952 - DNA, 25 bp, Mus musculus
gaagcaagtgttcgcctattggaat

SEQ ID NO: 424953 - DNA, 25 bp, Mus musculus
gaagcaagtgttggcctattggaat

SEQ ID NO: 424954 - DNA, 25 bp, Mus musculus
gaagcaataactccaagcaggctcc

SEQ ID NO: 424955 - DNA, 25 bp, Mus musculus
gaagcaataactgcaagcaggctcc

SEQ ID NO: 424956 - DNA, 25 bp, Mus musculus
gaagcaataccacgagccatctcat

SEQ ID NO: 424957 - DNA, 25 bp, Mus musculus
gaagcaataccaggagccatctcat

SEQ ID NO: 424958 - DNA, 25 bp, Mus musculus
gaagcaatagataccattacaaagg

SEQ ID NO: 424959 - DNA, 25 bp, Mus musculus
gaagcaatagattccattacaaagg

SEQ ID NO: 424960 - DNA, 25 bp, Mus musculus
gaagcaatagcactagtccacagca

SEQ ID NO: 424961 - DNA, 25 bp, Mus musculus
gaagcaatagcagtagtccacagca

SEQ ID NO: 424962 - DNA, 25 bp, Mus musculus
gaagcaatagctaggctctgtttac

SEQ ID NO: 424963 - DNA, 25 bp, Mus musculus
gaagcaatagcttggctctgtttac

SEQ ID NO: 424964 - DNA, 25 bp, Mus musculus
gaagcaatattcattttgtctcatt

SEQ ID NO: 424965 - DNA, 25 bp, Mus musculus
gaagcaatattctttttgtctcatt

SEQ ID NO: 424966 - DNA, 25 bp, Mus musculus
gaagcaatatttacactcctttagc

SEQ ID NO: 424967 - DNA, 25 bp, Mus musculus
gaagcaatattttcactcctttagc

SEQ ID NO: 424968 - DNA, 25 bp, Mus musculus
gaagcaatcaagaatgccatcgcaa

SEQ ID NO: 424969 - DNA, 25 bp, Mus musculus
gaagcaatcaagctccgaattctcc

SEQ ID NO: 424970 - DNA, 25 bp, Mus musculus
gaagcaatcaaggtccgaattctcc

SEQ ID NO: 424971 - DNA, 25 bp, Mus musculus
gaagcaatcaagtatgccatcgcaa

SEQ ID NO: 424972 - DNA, 25 bp, Mus musculus
gaagcaatccgtaacacgtgggtct

SEQ ID NO: 424973 - DNA, 25 bp, Mus musculus
gaagcaatccgttacacgtgggtct

SEQ ID NO: 424974 - DNA, 25 bp, Mus musculus
gaagcaatgcatcgtgtgttccttt

SEQ ID NO: 424975 - DNA, 25 bp, Mus musculus
gaagcaatgcatggtgtgttccttt

SEQ ID NO: 424976 - DNA, 25 bp, Mus musculus
gaagcaatggctctcagtcattttt

SEQ ID NO: 424977 - DNA, 25 bp, Mus musculus
gaagcaatggctgtcagtcattttt

SEQ ID NO: 424978 - DNA, 25 bp, Mus musculus
gaagcaatggttctcttcaaccctt

SEQ ID NO: 424979 - DNA, 25 bp, Mus musculus
gaagcaatggttgtcttcaaccctt

SEQ ID NO: 424980 - DNA, 25 bp, Mus musculus
gaagcaatgtaaactttgtcacaga

SEQ ID NO: 424981 - DNA, 25 bp, Mus musculus
gaagcaatgtaatctttgtcacaga

SEQ ID NO: 424982 - DNA, 25 bp, Mus musculus
gaagcaatgtataagggtcccgtgt

SEQ ID NO: 424983 - DNA, 25 bp, Mus musculus
gaagcaatgtatcaccctgttttca

SEQ ID NO: 424984 - DNA, 25 bp, Mus musculus
gaagcaatgtatgaccctgttttca

SEQ ID NO: 424985 - DNA, 25 bp, Mus musculus
gaagcaatgtattagggtcccgtgt

SEQ ID NO: 424986 - DNA, 25 bp, Mus musculus
gaagcaattaacatgtttgctacaa

SEQ ID NO: 424987 - DNA, 25 bp, Mus musculus
gaagcaattaacttgtttgctacaa

SEQ ID NO: 424988 - DNA, 25 bp, Mus musculus
gaagcaattatgctggccagagcag

SEQ ID NO: 424989 - DNA, 25 bp, Mus musculus
gaagcaattatggtggccagagcag

SEQ ID NO: 424990 - DNA, 25 bp, Mus musculus
gaagcaattcaactcctatttttat

SEQ ID NO: 424991 - DNA, 25 bp, Mus musculus
gaagcaattcaagtcctatttttat

SEQ ID NO: 424992 - DNA, 25 bp, Mus musculus
gaagcaattccacaactggtaccaa

SEQ ID NO: 424993 - DNA, 25 bp, Mus musculus
gaagcaattccagaactggtaccaa

SEQ ID NO: 424994 - DNA, 25 bp, Mus musculus
gaagcaattcccacactccatggag

SEQ ID NO: 424995 - DNA, 25 bp, Mus musculus
gaagcaattccctcactccatggag

SEQ ID NO: 424996 - DNA, 25 bp, Mus musculus
gaagcacaaatcacccacatagcgt

SEQ ID NO: 424997 - DNA, 25 bp, Mus musculus
gaagcacaaatctcccacatagcgt

SEQ ID NO: 424998 - DNA, 25 bp, Mus musculus
gaagcacaaatgactgtttcaattt

SEQ ID NO: 424999 - DNA, 25 bp, Mus musculus
gaagcacaaatgtctgtttcaattt

SEQ ID NO: 425000 - DNA, 25 bp, Mus musculus
gaagcacaagaacacctgagcaccg

SEQ ID NO: 425001 - DNA, 25 bp, Mus musculus
gaagcacaagaagacctgagcaccg

SEQ ID NO: 425002 - DNA, 25 bp, Mus musculus
gaagcacaagcacaccgactacatg

SEQ ID NO: 425003 - DNA, 25 bp, Mus musculus
gaagcacaagcagaccgactacatg

SEQ ID NO: 425004 - DNA, 25 bp, Mus musculus
gaagcacaagccaattccaccttgg

SEQ ID NO: 425005 - DNA, 25 bp, Mus musculus
gaagcacaagcctattccaccttgg

SEQ ID NO: 425006 - DNA, 25 bp, Mus musculus
gaagcacaagctcttaacagccggg

SEQ ID NO: 425007 - DNA, 25 bp, Mus musculus
gaagcacaagctgttaacagccggg

SEQ ID NO: 425008 - DNA, 25 bp, Mus musculus
gaagcacaagtcataggtggagaag

SEQ ID NO: 425009 - DNA, 25 bp, Mus musculus
gaagcacaagtcttaggtggagaag

SEQ ID NO: 425010 - DNA, 25 bp, Mus musculus
gaagcacaagttatactcactgagt

SEQ ID NO: 425011 - DNA, 25 bp, Mus musculus
gaagcacaagttttactcactgagt

SEQ ID NO: 425012 - DNA, 25 bp, Mus musculus
gaagcacaatgacattctgtggact

SEQ ID NO: 425013 - DNA, 25 bp, Mus musculus
gaagcacaatgagattctgtggact

SEQ ID NO: 425014 - DNA, 25 bp, Mus musculus
gaagcacacaaaagggctcacttat

SEQ ID NO: 425015 - DNA, 25 bp, Mus musculus
gaagcacacaaatgggctcacttat

SEQ ID NO: 425016 - DNA, 25 bp, Mus musculus
gaagcacacaatactctcgaagtcc

SEQ ID NO: 425017 - DNA, 25 bp, Mus musculus
gaagcacacaattctctcgaagtcc

SEQ ID NO: 425018 - DNA, 25 bp, Mus musculus
gaagcacacacgcatgaccatgact

SEQ ID NO: 425019 - DNA, 25 bp, Mus musculus
gaagcacacacggatgaccatgact

SEQ ID NO: 425020 - DNA, 25 bp, Mus musculus
gaagcacacactactgagaaccagg

SEQ ID NO: 425021 - DNA, 25 bp, Mus musculus
gaagcacacacttctgagaaccagg

SEQ ID NO: 425022 - DNA, 25 bp, Mus musculus
gaagcacacatcagttcaatgacac

SEQ ID NO: 425023 - DNA, 25 bp, Mus musculus
gaagcacacatctgttcaatgacac

SEQ ID NO: 425024 - DNA, 25 bp, Mus musculus
gaagcacacattactgttagtagtg

SEQ ID NO: 425025 - DNA, 25 bp, Mus musculus
gaagcacacatttctgttagtagtg

SEQ ID NO: 425026 - DNA, 25 bp, Mus musculus
gaagcacacctcagcaggcaacaat

SEQ ID NO: 425027 - DNA, 25 bp, Mus musculus
gaagcacacctctgcaggcaacaat

SEQ ID NO: 425028 - DNA, 25 bp, Mus musculus
gaagcacacctgactgtatttgcat

SEQ ID NO: 425029 - DNA, 25 bp, Mus musculus
gaagcacacctgtctgtatttgcat

SEQ ID NO: 425030 - DNA, 25 bp, Mus musculus
gaagcacactaacaagctcgctcat

SEQ ID NO: 425031 - DNA, 25 bp, Mus musculus
gaagcacactaagaagctcgctcat

SEQ ID NO: 425032 - DNA, 25 bp, Mus musculus
gaagcacactggactacaagcggtt

SEQ ID NO: 425033 - DNA, 25 bp, Mus musculus
gaagcacactggtctacaagcggtt

SEQ ID NO: 425034 - DNA, 25 bp, Mus musculus
gaagcacacttgatgtaactgcatc

SEQ ID NO: 425035 - DNA, 25 bp, Mus musculus
gaagcacacttgttgtaactgcatc

SEQ ID NO: 425036 - DNA, 25 bp, Mus musculus
gaagcacagaacaactgcctacact

SEQ ID NO: 425037 - DNA, 25 bp, Mus musculus
gaagcacagaactactgcctacact

SEQ ID NO: 425038 - DNA, 25 bp, Mus musculus
gaagcacagatacgcagctccctgg

SEQ ID NO: 425039 - DNA, 25 bp, Mus musculus
gaagcacagataggcagctccctgg

SEQ ID NO: 425040 - DNA, 25 bp, Mus musculus
gaagcacagcagacactcagagttt

SEQ ID NO: 425041 - DNA, 25 bp, Mus musculus
gaagcacagcagaggacacagtatg

SEQ ID NO: 425042 - DNA, 25 bp, Mus musculus
gaagcacagcagtcactcagagttt

SEQ ID NO: 425043 - DNA, 25 bp, Mus musculus
gaagcacagcagtggacacagtatg

SEQ ID NO: 425044 - DNA, 25 bp, Mus musculus
gaagcacagcgcaaaaactccatgt

SEQ ID NO: 425045 - DNA, 25 bp, Mus musculus
gaagcacagcgctaaaactccatgt

SEQ ID NO: 425046 - DNA, 25 bp, Mus musculus
gaagcacagctaacagtggcattga

SEQ ID NO: 425047 - DNA, 25 bp, Mus musculus
gaagcacagctatcagtggcattga

SEQ ID NO: 425048 - DNA, 25 bp, Mus musculus
gaagcacagcttcttactggtaaaa

SEQ ID NO: 425049 - DNA, 25 bp, Mus musculus
gaagcacagcttgttactggtaaaa

SEQ ID NO: 425050 - DNA, 25 bp, Mus musculus
gaagcacaggatcgctcatgaacct

SEQ ID NO: 425051 - DNA, 25 bp, Mus musculus
gaagcacaggatggctcatgaacct

SEQ ID NO: 425052 - DNA, 25 bp, Mus musculus
gaagcacaggcccaatgaatttatt

SEQ ID NO: 425053 - DNA, 25 bp, Mus musculus
gaagcacaggccgaatgaatttatt

SEQ ID NO: 425054 - DNA, 25 bp, Mus musculus
gaagcacagtatacgggctcctgat

SEQ ID NO: 425055 - DNA, 25 bp, Mus musculus
gaagcacagtattcgggctcctgat

SEQ ID NO: 425056 - DNA, 25 bp, Mus musculus
gaagcacagtctcccaaaaggcagg

SEQ ID NO: 425057 - DNA, 25 bp, Mus musculus
gaagcacagtctgccaaaaggcagg

SEQ ID NO: 425058 - DNA, 25 bp, Mus musculus
gaagcacagtggctgccagacgcct

SEQ ID NO: 425059 - DNA, 25 bp, Mus musculus
gaagcacagtgggtgccagacgcct

SEQ ID NO: 425060 - DNA, 25 bp, Mus musculus
gaagcacagtgtctcctctgtagaa

SEQ ID NO: 425061 - DNA, 25 bp, Mus musculus
gaagcacagtgtgtcctctgtagaa

SEQ ID NO: 425062 - DNA, 25 bp, Mus musculus
gaagcacagtttcgcagactaggac

SEQ ID NO: 425063 - DNA, 25 bp, Mus musculus
gaagcacagtttggcagactaggac

SEQ ID NO: 425064 - DNA, 25 bp, Mus musculus
gaagcacatactctaccaatgaact

SEQ ID NO: 425065 - DNA, 25 bp, Mus musculus
gaagcacatactgtaccaatgaact

SEQ ID NO: 425066 - DNA, 25 bp, Mus musculus
gaagcacatccgattccttgagtat

SEQ ID NO: 425067 - DNA, 25 bp, Mus musculus
gaagcacatccgtttccttgagtat

SEQ ID NO: 425068 - DNA, 25 bp, Mus musculus
gaagcacatcgtaagctacctccta

SEQ ID NO: 425069 - DNA, 25 bp, Mus musculus
gaagcacatcgttagctacctccta

SEQ ID NO: 425070 - DNA, 25 bp, Mus musculus
gaagcacatctcaacattcagggcc

SEQ ID NO: 425071 - DNA, 25 bp, Mus musculus
gaagcacatctcagatcttaccata

SEQ ID NO: 425072 - DNA, 25 bp, Mus musculus
gaagcacatctctacattcagggcc

SEQ ID NO: 425073 - DNA, 25 bp, Mus musculus
gaagcacatctctgatcttaccata

SEQ ID NO: 425074 - DNA, 25 bp, Mus musculus
gaagcacatgatagaccctacagaa

SEQ ID NO: 425075 - DNA, 25 bp, Mus musculus
gaagcacatgattgaccctacagaa

SEQ ID NO: 425076 - DNA, 25 bp, Mus musculus
gaagcacatggcagtatgtccattc

SEQ ID NO: 425077 - DNA, 25 bp, Mus musculus
gaagcacatggctgtatgtccattc

SEQ ID NO: 425078 - DNA, 25 bp, Mus musculus
gaagcacatgtccacccagcgggag

SEQ ID NO: 425079 - DNA, 25 bp, Mus musculus
gaagcacatgtcgacccagcgggag

SEQ ID NO: 425080 - DNA, 25 bp, Mus musculus
gaagcacatttgactcctacccaaa

SEQ ID NO: 425081 - DNA, 25 bp, Mus musculus
gaagcacatttgatcattctatcca

SEQ ID NO: 425082 - DNA, 25 bp, Mus musculus
gaagcacatttgtctcctacccaaa

SEQ ID NO: 425083 - DNA, 25 bp, Mus musculus
gaagcacatttgttcattctatcca

SEQ ID NO: 425084 - DNA, 25 bp, Mus musculus
gaagcaccaaaaactcctctgcaga

SEQ ID NO: 425085 - DNA, 25 bp, Mus musculus
gaagcaccaaaatctcctctgcaga

SEQ ID NO: 425086 - DNA, 25 bp, Mus musculus
gaagcaccaagaacagtctcacaag

SEQ ID NO: 425087 - DNA, 25 bp, Mus musculus
gaagcaccaagatcagtctcacaag

SEQ ID NO: 425088 - DNA, 25 bp, Mus musculus
gaagcaccaggtctgatgggcctca

SEQ ID NO: 425089 - DNA, 25 bp, Mus musculus
gaagcaccaggtgtgatgggcctca

SEQ ID NO: 425090 - DNA, 25 bp, Mus musculus
gaagcaccatagactgctggcagtt

SEQ ID NO: 425091 - DNA, 25 bp, Mus musculus
gaagcaccatagtctgctggcagtt

SEQ ID NO: 425092 - DNA, 25 bp, Mus musculus
gaagcaccatgaaaatgaaccagct

SEQ ID NO: 425093 - DNA, 25 bp, Mus musculus
gaagcaccatgataatgaaccagct

SEQ ID NO: 425094 - DNA, 25 bp, Mus musculus
gaagcaccattcaggaccagtgaga

SEQ ID NO: 425095 - DNA, 25 bp, Mus musculus
gaagcaccattctggaccagtgaga

SEQ ID NO: 425096 - DNA, 25 bp, Mus musculus
gaagcacccacaattatggttttag

SEQ ID NO: 425097 - DNA, 25 bp, Mus musculus
gaagcacccacatttatggttttag

SEQ ID NO: 425098 - DNA, 25 bp, Mus musculus
gaagcacccactctgttccctgtag

SEQ ID NO: 425099 - DNA, 25 bp, Mus musculus
gaagcacccactgtgttccctgtag

SEQ ID NO: 425100 - DNA, 25 bp, Mus musculus
gaagcaccctgacatattcctactt

SEQ ID NO: 425101 - DNA, 25 bp, Mus musculus
gaagcaccctgagatattcctactt

SEQ ID NO: 425102 - DNA, 25 bp, Mus musculus
gaagcaccctgtctatcattacatg

SEQ ID NO: 425103 - DNA, 25 bp, Mus musculus
gaagcaccctgtgtatcattacatg

SEQ ID NO: 425104 - DNA, 25 bp, Mus musculus
gaagcacccttgacaaagatctgtt

SEQ ID NO: 425105 - DNA, 25 bp, Mus musculus
gaagcacccttgtcaaagatctgtt

SEQ ID NO: 425106 - DNA, 25 bp, Mus musculus
gaagcaccgagcaataaatactagt

SEQ ID NO: 425107 - DNA, 25 bp, Mus musculus
gaagcaccgagctataaatactagt

SEQ ID NO: 425108 - DNA, 25 bp, Mus musculus
gaagcaccggcacggcaagaatcac

SEQ ID NO: 425109 - DNA, 25 bp, Mus musculus
gaagcaccggcagggcaagaatcac

SEQ ID NO: 425110 - DNA, 25 bp, Mus musculus
gaagcaccgtgaccttatacaggaa

SEQ ID NO: 425111 - DNA, 25 bp, Mus musculus
gaagcaccgtgagcttatacaggaa

SEQ ID NO: 425112 - DNA, 25 bp, Mus musculus
gaagcaccgtgtcatttgccagagt

SEQ ID NO: 425113 - DNA, 25 bp, Mus musculus
gaagcaccgtgtgatttgccagagt

SEQ ID NO: 425114 - DNA, 25 bp, Mus musculus
gaagcacctacaacggatgctgcag

SEQ ID NO: 425115 - DNA, 25 bp, Mus musculus
gaagcacctacatcggatgctgcag

SEQ ID NO: 425116 - DNA, 25 bp, Mus musculus
gaagcacctactattcttgaatatt

SEQ ID NO: 425117 - DNA, 25 bp, Mus musculus
gaagcacctacttttcttgaatatt

SEQ ID NO: 425118 - DNA, 25 bp, Mus musculus
gaagcacctcatcctattgaaacgc

SEQ ID NO: 425119 - DNA, 25 bp, Mus musculus
gaagcacctcatgctattgaaacgc

SEQ ID NO: 425120 - DNA, 25 bp, Mus musculus
gaagcacctcccagataccaaatgc

SEQ ID NO: 425121 - DNA, 25 bp, Mus musculus
gaagcacctccctgataccaaatgc

SEQ ID NO: 425122 - DNA, 25 bp, Mus musculus
gaagcacctgaaatctcatttctct

SEQ ID NO: 425123 - DNA, 25 bp, Mus musculus
gaagcacctgaattctcatttctct

SEQ ID NO: 425124 - DNA, 25 bp, Mus musculus
gaagcacctgcaagtatcaccatcc

SEQ ID NO: 425125 - DNA, 25 bp, Mus musculus
gaagcacctgcatgtatcaccatcc

SEQ ID NO: 425126 - DNA, 25 bp, Mus musculus
gaagcacctggcaagatccttgagg

SEQ ID NO: 425127 - DNA, 25 bp, Mus musculus
gaagcacctggctagatccttgagg

SEQ ID NO: 425128 - DNA, 25 bp, Mus musculus
gaagcacctggtagtagcactgagt

SEQ ID NO: 425129 - DNA, 25 bp, Mus musculus
gaagcacctggttgtagcactgagt

SEQ ID NO: 425130 - DNA, 25 bp, Mus musculus
gaagcacctgtcctagggagcttaa

SEQ ID NO: 425131 - DNA, 25 bp, Mus musculus
gaagcacctgtcgtagggagcttaa

SEQ ID NO: 425132 - DNA, 25 bp, Mus musculus
gaagcaccttccatcggaatgctat

SEQ ID NO: 425133 - DNA, 25 bp, Mus musculus
gaagcaccttccttcggaatgctat

SEQ ID NO: 425134 - DNA, 25 bp, Mus musculus
gaagcaccttctacaagctgttatg

SEQ ID NO: 425135 - DNA, 25 bp, Mus musculus
gaagcaccttcttcaagctgttatg

SEQ ID NO: 425136 - DNA, 25 bp, Mus musculus
gaagcaccttttaccctatcaaggg

SEQ ID NO: 425137 - DNA, 25 bp, Mus musculus
gaagcacctttttccctatcaaggg

SEQ ID NO: 425138 - DNA, 25 bp, Mus musculus
gaagcacgaactcgctgagatcatc

SEQ ID NO: 425139 - DNA, 25 bp, Mus musculus
gaagcacgaactggctgagatcatc

SEQ ID NO: 425140 - DNA, 25 bp, Mus musculus
gaagcacgaatgcatcctaggtccc

SEQ ID NO: 425141 - DNA, 25 bp, Mus musculus
gaagcacgaatggatcctaggtccc

SEQ ID NO: 425142 - DNA, 25 bp, Mus musculus
gaagcacgacttcaatgccctgaag

SEQ ID NO: 425143 - DNA, 25 bp, Mus musculus
gaagcacgacttgaatgccctgaag

SEQ ID NO: 425144 - DNA, 25 bp, Mus musculus
gaagcacgagtgacacttcacaaat

SEQ ID NO: 425145 - DNA, 25 bp, Mus musculus
gaagcacgagtgtcacttcacaaat

SEQ ID NO: 425146 - DNA, 25 bp, Mus musculus
gaagcacgcagccttaagcctcagc

SEQ ID NO: 425147 - DNA, 25 bp, Mus musculus
gaagcacgcagcgttaagcctcagc

SEQ ID NO: 425148 - DNA, 25 bp, Mus musculus
gaagcacggatacattggtgaattt

SEQ ID NO: 425149 - DNA, 25 bp, Mus musculus
gaagcacggatagattggtgaattt

SEQ ID NO: 425150 - DNA, 25 bp, Mus musculus
gaagcacggcgtacagggtttaatg

SEQ ID NO: 425151 - DNA, 25 bp, Mus musculus
gaagcacggcgttcagggtttaatg

SEQ ID NO: 425152 - DNA, 25 bp, Mus musculus
gaagcacgggacagttggcacactc

SEQ ID NO: 425153 - DNA, 25 bp, Mus musculus
gaagcacgggactgttggcacactc

SEQ ID NO: 425154 - DNA, 25 bp, Mus musculus
gaagcacgggtcacttctcaatctt

SEQ ID NO: 425155 - DNA, 25 bp, Mus musculus
gaagcacgggtctcttctcaatctt

SEQ ID NO: 425156 - DNA, 25 bp, Mus musculus
gaagcacggtatatctcagccagtt

SEQ ID NO: 425157 - DNA, 25 bp, Mus musculus
gaagcacggtatttctcagccagtt

SEQ ID NO: 425158 - DNA, 25 bp, Mus musculus
gaagcacggtcaccactgaagacgt

SEQ ID NO: 425159 - DNA, 25 bp, Mus musculus
gaagcacggtcagcactgaagacgt

SEQ ID NO: 425160 - DNA, 25 bp, Mus musculus
gaagcacggttgacccattgaacaa

SEQ ID NO: 425161 - DNA, 25 bp, Mus musculus
gaagcacggttgtcccattgaacaa

SEQ ID NO: 425162 - DNA, 25 bp, Mus musculus
gaagcacgtggcagaaactatccct

SEQ ID NO: 425163 - DNA, 25 bp, Mus musculus
gaagcacgtggcattcctgaagtct

SEQ ID NO: 425164 - DNA, 25 bp, Mus musculus
gaagcacgtggctgaaactatccct

SEQ ID NO: 425165 - DNA, 25 bp, Mus musculus
gaagcacgtggctttcctgaagtct

SEQ ID NO: 425166 - DNA, 25 bp, Mus musculus
gaagcacgtgtacggcaacggctac

SEQ ID NO: 425167 - DNA, 25 bp, Mus musculus
gaagcacgtgtagggcaacggctac

SEQ ID NO: 425168 - DNA, 25 bp, Mus musculus
gaagcacgtgttcttttttgacacc

SEQ ID NO: 425169 - DNA, 25 bp, Mus musculus
gaagcacgtgttgttttttgacacc

SEQ ID NO: 425170 - DNA, 25 bp, Mus musculus
gaagcactaaagacactcacttggg

SEQ ID NO: 425171 - DNA, 25 bp, Mus musculus
gaagcactaaagtcactcacttggg

SEQ ID NO: 425172 - DNA, 25 bp, Mus musculus
gaagcactaacgattgatccccaga

SEQ ID NO: 425173 - DNA, 25 bp, Mus musculus
gaagcactaacgtttgatccccaga

SEQ ID NO: 425174 - DNA, 25 bp, Mus musculus
gaagcactacgtctctccattcaga

SEQ ID NO: 425175 - DNA, 25 bp, Mus musculus
gaagcactacgtgtctccattcaga

SEQ ID NO: 425176 - DNA, 25 bp, Mus musculus
gaagcactagatagcactttgttcc

SEQ ID NO: 425177 - DNA, 25 bp, Mus musculus
gaagcactagattgcactttgttcc

SEQ ID NO: 425178 - DNA, 25 bp, Mus musculus
gaagcactagggatatgggttccat

SEQ ID NO: 425179 - DNA, 25 bp, Mus musculus
gaagcactagggttatgggttccat

SEQ ID NO: 425180 - DNA, 25 bp, Mus musculus
gaagcactatcacgccaagctggtg

SEQ ID NO: 425181 - DNA, 25 bp, Mus musculus
gaagcactatcaggccaagctggtg

SEQ ID NO: 425182 - DNA, 25 bp, Mus musculus
gaagcactcaagatgaactttcaac

SEQ ID NO: 425183 - DNA, 25 bp, Mus musculus
gaagcactcaagatttccagagagg

SEQ ID NO: 425184 - DNA, 25 bp, Mus musculus
gaagcactcaagttgaactttcaac

SEQ ID NO: 425185 - DNA, 25 bp, Mus musculus
gaagcactcaagttttccagagagg

SEQ ID NO: 425186 - DNA, 25 bp, Mus musculus
gaagcactcagtatgccttcagagg

SEQ ID NO: 425187 - DNA, 25 bp, Mus musculus
gaagcactcagtcgtatccagacga

SEQ ID NO: 425188 - DNA, 25 bp, Mus musculus
gaagcactcagtggtatccagacga

SEQ ID NO: 425189 - DNA, 25 bp, Mus musculus
gaagcactcagtttgccttcagagg

SEQ ID NO: 425190 - DNA, 25 bp, Mus musculus
gaagcactcctacggtttctaccat

SEQ ID NO: 425191 - DNA, 25 bp, Mus musculus
gaagcactcctagggtttctaccat

SEQ ID NO: 425192 - DNA, 25 bp, Mus musculus
gaagcactctaaccctgagctatgt

SEQ ID NO: 425193 - DNA, 25 bp, Mus musculus
gaagcactctaagcctgagctatgt

SEQ ID NO: 425194 - DNA, 25 bp, Mus musculus
gaagcactctcccaaaagacctaaa

SEQ ID NO: 425195 - DNA, 25 bp, Mus musculus
gaagcactctccgaaaagacctaaa

SEQ ID NO: 425196 - DNA, 25 bp, Mus musculus
gaagcactctctcctcagaacaagt

SEQ ID NO: 425197 - DNA, 25 bp, Mus musculus
gaagcactctctgctcagaacaagt

SEQ ID NO: 425198 - DNA, 25 bp, Mus musculus
gaagcactcttgaaatgatctggat

SEQ ID NO: 425199 - DNA, 25 bp, Mus musculus
gaagcactcttgtaatgatctggat

SEQ ID NO: 425200 - DNA, 25 bp, Mus musculus
gaagcactctttcaatatggctagt

SEQ ID NO: 425201 - DNA, 25 bp, Mus musculus
gaagcactctttgaatatggctagt

SEQ ID NO: 425202 - DNA, 25 bp, Mus musculus
gaagcactgaacagcactcagtagg

SEQ ID NO: 425203 - DNA, 25 bp, Mus musculus
gaagcactgaactgcactcagtagg

SEQ ID NO: 425204 - DNA, 25 bp, Mus musculus
gaagcactgactatggcattttcca

SEQ ID NO: 425205 - DNA, 25 bp, Mus musculus
gaagcactgactttggcattttcca

SEQ ID NO: 425206 - DNA, 25 bp, Mus musculus
gaagcactgagcaagaatcctggct

SEQ ID NO: 425207 - DNA, 25 bp, Mus musculus
gaagcactgagctagaatcctggct

SEQ ID NO: 425208 - DNA, 25 bp, Mus musculus
gaagcactgcaacgccttgtggagc

SEQ ID NO: 425209 - DNA, 25 bp, Mus musculus
gaagcactgcaaggccttgtggagc

SEQ ID NO: 425210 - DNA, 25 bp, Mus musculus
gaagcactgcccaaggattctagaa

SEQ ID NO: 425211 - DNA, 25 bp, Mus musculus
gaagcactgccctaggattctagaa

SEQ ID NO: 425212 - DNA, 25 bp, Mus musculus
gaagcactggtcactaattataagt

SEQ ID NO: 425213 - DNA, 25 bp, Mus musculus
gaagcactggtctctaattataagt

SEQ ID NO: 425214 - DNA, 25 bp, Mus musculus
gaagcactggttcggcattttaatt

SEQ ID NO: 425215 - DNA, 25 bp, Mus musculus
gaagcactggttgggcattttaatt

SEQ ID NO: 425216 - DNA, 25 bp, Mus musculus
gaagcactgtggcagtcacagccat

SEQ ID NO: 425217 - DNA, 25 bp, Mus musculus
gaagcactgtgggagtcacagccat

SEQ ID NO: 425218 - DNA, 25 bp, Mus musculus
gaagcactgttgagctagctgtctt

SEQ ID NO: 425219 - DNA, 25 bp, Mus musculus
gaagcactgttgtgctagctgtctt

SEQ ID NO: 425220 - DNA, 25 bp, Mus musculus
gaagcacttaagactggagcctaga

SEQ ID NO: 425221 - DNA, 25 bp, Mus musculus
gaagcacttaagtctggagcctaga

SEQ ID NO: 425222 - DNA, 25 bp, Mus musculus
gaagcacttacaagcatccttcatt

SEQ ID NO: 425223 - DNA, 25 bp, Mus musculus
gaagcacttacatgcatccttcatt

SEQ ID NO: 425224 - DNA, 25 bp, Mus musculus
gaagcacttaccctaaaagcccaat

SEQ ID NO: 425225 - DNA, 25 bp, Mus musculus
gaagcacttaccgtaaaagcccaat

SEQ ID NO: 425226 - DNA, 25 bp, Mus musculus
gaagcacttcagcttgcaatcaaca

SEQ ID NO: 425227 - DNA, 25 bp, Mus musculus
gaagcacttcaggttgcaatcaaca

SEQ ID NO: 425228 - DNA, 25 bp, Mus musculus
gaagcacttccaagggctggtgaga

SEQ ID NO: 425229 - DNA, 25 bp, Mus musculus
gaagcacttccatgggctggtgaga

SEQ ID NO: 425230 - DNA, 25 bp, Mus musculus
gaagcacttgaaatgacgttctgga

SEQ ID NO: 425231 - DNA, 25 bp, Mus musculus
gaagcacttgaattgacgttctgga

SEQ ID NO: 425232 - DNA, 25 bp, Mus musculus
gaagcacttgatctttggcgagcct

SEQ ID NO: 425233 - DNA, 25 bp, Mus musculus
gaagcacttgatgtttggcgagcct

SEQ ID NO: 425234 - DNA, 25 bp, Mus musculus
gaagcacttggaacctgcgtccaga

SEQ ID NO: 425235 - DNA, 25 bp, Mus musculus
gaagcacttggaatacctgagcact

SEQ ID NO: 425236 - DNA, 25 bp, Mus musculus
gaagcacttggatcctgcgtccaga

SEQ ID NO: 425237 - DNA, 25 bp, Mus musculus
gaagcacttggattacctgagcact

SEQ ID NO: 425238 - DNA, 25 bp, Mus musculus
gaagcacttggtattgttgaggaaa

SEQ ID NO: 425239 - DNA, 25 bp, Mus musculus
gaagcacttggtcaaggcgaagtct

SEQ ID NO: 425240 - DNA, 25 bp, Mus musculus
gaagcacttggtcaatgaatggtta

SEQ ID NO: 425241 - DNA, 25 bp, Mus musculus
gaagcacttggtgaaggcgaagtct

SEQ ID NO: 425242 - DNA, 25 bp, Mus musculus
gaagcacttggtgaatgaatggtta

SEQ ID NO: 425243 - DNA, 25 bp, Mus musculus
gaagcacttggttttgttgaggaaa

SEQ ID NO: 425244 - DNA, 25 bp, Mus musculus
gaagcactttataacacatcccgga

SEQ ID NO: 425245 - DNA, 25 bp, Mus musculus
gaagcactttattacacatcccgga

SEQ ID NO: 425246 - DNA, 25 bp, Mus musculus
gaagcactttcgcagtcaagactct

SEQ ID NO: 425247 - DNA, 25 bp, Mus musculus
gaagcactttcggagtcaagactct

SEQ ID NO: 425248 - DNA, 25 bp, Mus musculus
gaagcactttgcacaccgtgatgaa

SEQ ID NO: 425249 - DNA, 25 bp, Mus musculus
gaagcactttgcaccttaagacaga

SEQ ID NO: 425250 - DNA, 25 bp, Mus musculus
gaagcactttgctcaccgtgatgaa

SEQ ID NO: 425251 - DNA, 25 bp, Mus musculus
gaagcactttgctccttaagacaga

SEQ ID NO: 425252 - DNA, 25 bp, Mus musculus
gaagcagaaacaagtcctttgtgga

SEQ ID NO: 425253 - DNA, 25 bp, Mus musculus
gaagcagaaacatgtcctttgtgga

SEQ ID NO: 425254 - DNA, 25 bp, Mus musculus
gaagcagaaactcgccccatgagaa

SEQ ID NO: 425255 - DNA, 25 bp, Mus musculus
gaagcagaaactggccccatgagaa

SEQ ID NO: 425256 - DNA, 25 bp, Mus musculus
gaagcagaaccactacgtctaccgc

SEQ ID NO: 425257 - DNA, 25 bp, Mus musculus
gaagcagaaccagtacgtctaccgc

SEQ ID NO: 425258 - DNA, 25 bp, Mus musculus
gaagcagaacccaatggccaactat

SEQ ID NO: 425259 - DNA, 25 bp, Mus musculus
gaagcagaacccatcgggctttggg

SEQ ID NO: 425260 - DNA, 25 bp, Mus musculus
gaagcagaaccctatggccaactat

SEQ ID NO: 425261 - DNA, 25 bp, Mus musculus
gaagcagaacccttcgggctttggg

SEQ ID NO: 425262 - DNA, 25 bp, Mus musculus
gaagcagaactcagacctgggacag

SEQ ID NO: 425263 - DNA, 25 bp, Mus musculus
gaagcagaactctgacctgggacag

SEQ ID NO: 425264 - DNA, 25 bp, Mus musculus
gaagcagaacttactttcgagaagt

SEQ ID NO: 425265 - DNA, 25 bp, Mus musculus
gaagcagaacttcaccactgccaca

SEQ ID NO: 425266 - DNA, 25 bp, Mus musculus
gaagcagaacttgaccactgccaca

SEQ ID NO: 425267 - DNA, 25 bp, Mus musculus
gaagcagaactttctttcgagaagt

SEQ ID NO: 425268 - DNA, 25 bp, Mus musculus
gaagcagaagccctaccagataaga

SEQ ID NO: 425269 - DNA, 25 bp, Mus musculus
gaagcagaagccgtaccagataaga

SEQ ID NO: 425270 - DNA, 25 bp, Mus musculus
gaagcagaagctaacctcgtttggt

SEQ ID NO: 425271 - DNA, 25 bp, Mus musculus
gaagcagaagctccaagtatcataa

SEQ ID NO: 425272 - DNA, 25 bp, Mus musculus
gaagcagaagctgcaagtatcataa

SEQ ID NO: 425273 - DNA, 25 bp, Mus musculus
gaagcagaagcttacctcgtttggt

SEQ ID NO: 425274 - DNA, 25 bp, Mus musculus
gaagcagaaggaacgccttgagctg

SEQ ID NO: 425275 - DNA, 25 bp, Mus musculus
gaagcagaaggatcgccttgagctg

SEQ ID NO: 425276 - DNA, 25 bp, Mus musculus
gaagcagaatcccagtcaacttttt

SEQ ID NO: 425277 - DNA, 25 bp, Mus musculus
gaagcagaatccgagtcaacttttt

SEQ ID NO: 425278 - DNA, 25 bp, Mus musculus
gaagcagaatcgatagaaccagaac

SEQ ID NO: 425279 - DNA, 25 bp, Mus musculus
gaagcagaatcgttagaaccagaac

SEQ ID NO: 425280 - DNA, 25 bp, Mus musculus
gaagcagaatttcctgctcttcgac

SEQ ID NO: 425281 - DNA, 25 bp, Mus musculus
gaagcagaatttgctgctcttcgac

SEQ ID NO: 425282 - DNA, 25 bp, Mus musculus
gaagcagacacaactttgctatgaa

SEQ ID NO: 425283 - DNA, 25 bp, Mus musculus
gaagcagacacatctttgctatgaa

SEQ ID NO: 425284 - DNA, 25 bp, Mus musculus
gaagcagacagaagtccgtaagttc

SEQ ID NO: 425285 - DNA, 25 bp, Mus musculus
gaagcagacagatgtccgtaagttc

SEQ ID NO: 425286 - DNA, 25 bp, Mus musculus
gaagcagacagtagagggcaacata

SEQ ID NO: 425287 - DNA, 25 bp, Mus musculus
gaagcagacagttgagggcaacata

SEQ ID NO: 425288 - DNA, 25 bp, Mus musculus
gaagcagacatgaccctactgcaag

SEQ ID NO: 425289 - DNA, 25 bp, Mus musculus
gaagcagacatgtccctactgcaag

SEQ ID NO: 425290 - DNA, 25 bp, Mus musculus
gaagcagaccctaagaagagcgccc

SEQ ID NO: 425291 - DNA, 25 bp, Mus musculus
gaagcagacccttagaagagcgccc

SEQ ID NO: 425292 - DNA, 25 bp, Mus musculus
gaagcagacctaccattggttttaa

SEQ ID NO: 425293 - DNA, 25 bp, Mus musculus
gaagcagacctagcattggttttaa

SEQ ID NO: 425294 - DNA, 25 bp, Mus musculus
gaagcagacctcagtagctgacctg

SEQ ID NO: 425295 - DNA, 25 bp, Mus musculus
gaagcagacctctgtagctgacctg

SEQ ID NO: 425296 - DNA, 25 bp, Mus musculus
gaagcagactcaatagtaacagcca

SEQ ID NO: 425297 - DNA, 25 bp, Mus musculus
gaagcagactcattagtaacagcca

SEQ ID NO: 425298 - DNA, 25 bp, Mus musculus
gaagcagagcaaactgtgtgtccaa

SEQ ID NO: 425299 - DNA, 25 bp, Mus musculus
gaagcagagcaatctgtgtgtccaa

SEQ ID NO: 425300 - DNA, 25 bp, Mus musculus
gaagcagagccaagactgcggccag

SEQ ID NO: 425301 - DNA, 25 bp, Mus musculus
gaagcagagccactctgatctctat

SEQ ID NO: 425302 - DNA, 25 bp, Mus musculus
gaagcagagccagtctgatctctat

SEQ ID NO: 425303 - DNA, 25 bp, Mus musculus
gaagcagagccatgactgcggccag

SEQ ID NO: 425304 - DNA, 25 bp, Mus musculus
gaagcagagcccacaactggagatc

SEQ ID NO: 425305 - DNA, 25 bp, Mus musculus
gaagcagagccctcaactggagatc

SEQ ID NO: 425306 - DNA, 25 bp, Mus musculus
gaagcagagcctcacaagggaccac

SEQ ID NO: 425307 - DNA, 25 bp, Mus musculus
gaagcagagcctgacaagggaccac

SEQ ID NO: 425308 - DNA, 25 bp, Mus musculus
gaagcagagctaactgaggccgctg

SEQ ID NO: 425309 - DNA, 25 bp, Mus musculus
gaagcagagctatctgaggccgctg

SEQ ID NO: 425310 - DNA, 25 bp, Mus musculus
gaagcagagctcagtatctactgta

SEQ ID NO: 425311 - DNA, 25 bp, Mus musculus
gaagcagagctctgtatctactgta

SEQ ID NO: 425312 - DNA, 25 bp, Mus musculus
gaagcagagctgaacagtatcacat

SEQ ID NO: 425313 - DNA, 25 bp, Mus musculus
gaagcagagctgtacagtatcacat

SEQ ID NO: 425314 - DNA, 25 bp, Mus musculus
gaagcagagcttacttcctgaggct

SEQ ID NO: 425315 - DNA, 25 bp, Mus musculus
gaagcagagcttatccctaagttcc

SEQ ID NO: 425316 - DNA, 25 bp, Mus musculus
gaagcagagcttcatcagacattag

SEQ ID NO: 425317 - DNA, 25 bp, Mus musculus
gaagcagagcttgatcagacattag

SEQ ID NO: 425318 - DNA, 25 bp, Mus musculus
gaagcagagctttcttcctgaggct

SEQ ID NO: 425319 - DNA, 25 bp, Mus musculus
gaagcagagcttttccctaagttcc

SEQ ID NO: 425320 - DNA, 25 bp, Mus musculus
gaagcagaggacactcccgagcctg

SEQ ID NO: 425321 - DNA, 25 bp, Mus musculus
gaagcagaggactctcccgagcctg

SEQ ID NO: 425322 - DNA, 25 bp, Mus musculus
gaagcagaggatactgtcaacatgt

SEQ ID NO: 425323 - DNA, 25 bp, Mus musculus
gaagcagaggatagccatcgcccga

SEQ ID NO: 425324 - DNA, 25 bp, Mus musculus
gaagcagaggattctgtcaacatgt

SEQ ID NO: 425325 - DNA, 25 bp, Mus musculus
gaagcagaggattgccatcgcccga

SEQ ID NO: 425326 - DNA, 25 bp, Mus musculus
gaagcagaggtcatcagccaggctg

SEQ ID NO: 425327 - DNA, 25 bp, Mus musculus
gaagcagaggtcttcagccaggctg

SEQ ID NO: 425328 - DNA, 25 bp, Mus musculus
gaagcagagtctacggtgcacccga

SEQ ID NO: 425329 - DNA, 25 bp, Mus musculus
gaagcagagtcttcggtgcacccga

SEQ ID NO: 425330 - DNA, 25 bp, Mus musculus
gaagcagagtgcaagacagcctggc

SEQ ID NO: 425331 - DNA, 25 bp, Mus musculus
gaagcagagtgctagacagcctggc

SEQ ID NO: 425332 - DNA, 25 bp, Mus musculus
gaagcagataataagcgcctcgcct

SEQ ID NO: 425333 - DNA, 25 bp, Mus musculus
gaagcagataattagcgcctcgcct

SEQ ID NO: 425334 - DNA, 25 bp, Mus musculus
gaagcagatactaaatacatgggca

SEQ ID NO: 425335 - DNA, 25 bp, Mus musculus
gaagcagatacttaatacatgggca

SEQ ID NO: 425336 - DNA, 25 bp, Mus musculus
gaagcagatagccagccgcaccagt

SEQ ID NO: 425337 - DNA, 25 bp, Mus musculus
gaagcagatagcgagccgcaccagt

SEQ ID NO: 425338 - DNA, 25 bp, Mus musculus
gaagcagataggaggctgtcactgt

SEQ ID NO: 425339 - DNA, 25 bp, Mus musculus
gaagcagataggtggctgtcactgt

SEQ ID NO: 425340 - DNA, 25 bp, Mus musculus
gaagcagatatgacctcacatcctt

SEQ ID NO: 425341 - DNA, 25 bp, Mus musculus
gaagcagatatgtcctcacatcctt

SEQ ID NO: 425342 - DNA, 25 bp, Mus musculus
gaagcagatattcccagagtgccac

SEQ ID NO: 425343 - DNA, 25 bp, Mus musculus
gaagcagatattgccagagtgccac

SEQ ID NO: 425344 - DNA, 25 bp, Mus musculus
gaagcagatcaacaagcgggcctct

SEQ ID NO: 425345 - DNA, 25 bp, Mus musculus
gaagcagatcaagaagcgggcctct

SEQ ID NO: 425346 - DNA, 25 bp, Mus musculus
gaagcagatcatcccgttgcagact

SEQ ID NO: 425347 - DNA, 25 bp, Mus musculus
gaagcagatcatgccgttgcagact

SEQ ID NO: 425348 - DNA, 25 bp, Mus musculus
gaagcagatccactttgcagctgtt

SEQ ID NO: 425349 - DNA, 25 bp, Mus musculus
gaagcagatccagtttgcagctgtt

SEQ ID NO: 425350 - DNA, 25 bp, Mus musculus
gaagcagatcctagttctgtctgtc

SEQ ID NO: 425351 - DNA, 25 bp, Mus musculus
gaagcagatccttgttctgtctgtc

SEQ ID NO: 425352 - DNA, 25 bp, Mus musculus
gaagcagatgacactcgagaggcct

SEQ ID NO: 425353 - DNA, 25 bp, Mus musculus
gaagcagatgactctcgagaggcct

SEQ ID NO: 425354 - DNA, 25 bp, Mus musculus
gaagcagatgctctctgagactatt

SEQ ID NO: 425355 - DNA, 25 bp, Mus musculus
gaagcagatgctgtctgagactatt

SEQ ID NO: 425356 - DNA, 25 bp, Mus musculus
gaagcagatgtcactctcctaattg

SEQ ID NO: 425357 - DNA, 25 bp, Mus musculus
gaagcagatgtctctctcctaattg

SEQ ID NO: 425358 - DNA, 25 bp, Mus musculus
gaagcagcaactcttcctgatcacc

SEQ ID NO: 425359 - DNA, 25 bp, Mus musculus
gaagcagcaactgttcctgatcacc

SEQ ID NO: 425360 - DNA, 25 bp, Mus musculus
gaagcagcaagaacgagccaaggca

SEQ ID NO: 425361 - DNA, 25 bp, Mus musculus
gaagcagcaagacgctgcacagcag

SEQ ID NO: 425362 - DNA, 25 bp, Mus musculus
gaagcagcaagactctaggctgtca

SEQ ID NO: 425363 - DNA, 25 bp, Mus musculus
gaagcagcaagaggctgcacagcag

SEQ ID NO: 425364 - DNA, 25 bp, Mus musculus
gaagcagcaagagtctaggctgtca

SEQ ID NO: 425365 - DNA, 25 bp, Mus musculus
gaagcagcaagatcgagccaaggca

SEQ ID NO: 425366 - DNA, 25 bp, Mus musculus
gaagcagcacataggcctgggacag

SEQ ID NO: 425367 - DNA, 25 bp, Mus musculus
gaagcagcacattggcctgggacag

SEQ ID NO: 425368 - DNA, 25 bp, Mus musculus
gaagcagcaccgaattccagaagga

SEQ ID NO: 425369 - DNA, 25 bp, Mus musculus
gaagcagcaccgtattccagaagga

SEQ ID NO: 425370 - DNA, 25 bp, Mus musculus
gaagcagcactcaagccgcctgcaa

SEQ ID NO: 425371 - DNA, 25 bp, Mus musculus
gaagcagcactctagccgcctgcaa

SEQ ID NO: 425372 - DNA, 25 bp, Mus musculus
gaagcagcactgaaagcccctgatt

SEQ ID NO: 425373 - DNA, 25 bp, Mus musculus
gaagcagcactgagagtgaacctaa

SEQ ID NO: 425374 - DNA, 25 bp, Mus musculus
gaagcagcactgtaagcccctgatt

SEQ ID NO: 425375 - DNA, 25 bp, Mus musculus
gaagcagcactgtgagtgaacctaa

SEQ ID NO: 425376 - DNA, 25 bp, Mus musculus
gaagcagcagaaacaaccctctgtg

SEQ ID NO: 425377 - DNA, 25 bp, Mus musculus
gaagcagcagaatcaaccctctgtg

SEQ ID NO: 425378 - DNA, 25 bp, Mus musculus
gaagcagcagacacgtgttgttaag

SEQ ID NO: 425379 - DNA, 25 bp, Mus musculus
gaagcagcagacagtcctgtagaca

SEQ ID NO: 425380 - DNA, 25 bp, Mus musculus
gaagcagcagacatcccgtgagatc

SEQ ID NO: 425381 - DNA, 25 bp, Mus musculus
gaagcagcagactcgtgttgttaag

SEQ ID NO: 425382 - DNA, 25 bp, Mus musculus
gaagcagcagactgtcctgtagaca

SEQ ID NO: 425383 - DNA, 25 bp, Mus musculus
gaagcagcagacttcccgtgagatc

SEQ ID NO: 425384 - DNA, 25 bp, Mus musculus
gaagcagcagagaatggacctggaa

SEQ ID NO: 425385 - DNA, 25 bp, Mus musculus
gaagcagcagagacaccaggccaga

SEQ ID NO: 425386 - DNA, 25 bp, Mus musculus
gaagcagcagagtatggacctggaa

SEQ ID NO: 425387 - DNA, 25 bp, Mus musculus
gaagcagcagagtcaccaggccaga

SEQ ID NO: 425388 - DNA, 25 bp, Mus musculus
gaagcagcagcccatcacgccatgg

SEQ ID NO: 425389 - DNA, 25 bp, Mus musculus
gaagcagcagccgatcacgccatgg

SEQ ID NO: 425390 - DNA, 25 bp, Mus musculus
gaagcagcagctaggcatttcatct

SEQ ID NO: 425391 - DNA, 25 bp, Mus musculus
gaagcagcagcttggcatttcatct

SEQ ID NO: 425392 - DNA, 25 bp, Mus musculus
gaagcagcaggcacccgggacaaga

SEQ ID NO: 425393 - DNA, 25 bp, Mus musculus
gaagcagcaggctcccgggacaaga

SEQ ID NO: 425394 - DNA, 25 bp, Mus musculus
gaagcagcagggatcacccagggtc

SEQ ID NO: 425395 - DNA, 25 bp, Mus musculus
gaagcagcagggttcacccagggtc

SEQ ID NO: 425396 - DNA, 25 bp, Mus musculus
gaagcagcagttcacatctctaaag

SEQ ID NO: 425397 - DNA, 25 bp, Mus musculus
gaagcagcagttgacatctctaaag

SEQ ID NO: 425398 - DNA, 25 bp, Mus musculus
gaagcagcatcacaagccacctgaa

SEQ ID NO: 425399 - DNA, 25 bp, Mus musculus
gaagcagcatcagaagccacctgaa

SEQ ID NO: 425400 - DNA, 25 bp, Mus musculus
gaagcagcatccagtttcattgttt

SEQ ID NO: 425401 - DNA, 25 bp, Mus musculus
gaagcagcatcctgtttcattgttt

SEQ ID NO: 425402 - DNA, 25 bp, Mus musculus
gaagcagcatgaaacctgagcagaa

SEQ ID NO: 425403 - DNA, 25 bp, Mus musculus
gaagcagcatgatacctgagcagaa

SEQ ID NO: 425404 - DNA, 25 bp, Mus musculus
gaagcagcatgtattggaggctttc

SEQ ID NO: 425405 - DNA, 25 bp, Mus musculus
gaagcagcatgttttggaggctttc

SEQ ID NO: 425406 - DNA, 25 bp, Mus musculus
gaagcagcattgatcactatgagca

SEQ ID NO: 425407 - DNA, 25 bp, Mus musculus
gaagcagcattgttcactatgagca

SEQ ID NO: 425408 - DNA, 25 bp, Mus musculus
gaagcagccacaagctttggtcacc

SEQ ID NO: 425409 - DNA, 25 bp, Mus musculus
gaagcagccacactttggcccaaat

SEQ ID NO: 425410 - DNA, 25 bp, Mus musculus
gaagcagccacagtttggcccaaat

SEQ ID NO: 425411 - DNA, 25 bp, Mus musculus
gaagcagccacatgctttggtcacc

SEQ ID NO: 425412 - DNA, 25 bp, Mus musculus
gaagcagccagccaaattcacggta

SEQ ID NO: 425413 - DNA, 25 bp, Mus musculus
gaagcagccagccttagagtactct

SEQ ID NO: 425414 - DNA, 25 bp, Mus musculus
gaagcagccagcgaaattcacggta

SEQ ID NO: 425415 - DNA, 25 bp, Mus musculus
gaagcagccagcgttagagtactct

SEQ ID NO: 425416 - DNA, 25 bp, Mus musculus
gaagcagccatgatgtccatttctt

SEQ ID NO: 425417 - DNA, 25 bp, Mus musculus
gaagcagccatgttgtccatttctt

SEQ ID NO: 425418 - DNA, 25 bp, Mus musculus
gaagcagcccagatttctctgtctc

SEQ ID NO: 425419 - DNA, 25 bp, Mus musculus
gaagcagcccagttttctctgtctc

SEQ ID NO: 425420 - DNA, 25 bp, Mus musculus
gaagcagccgatcttttccaaaact

SEQ ID NO: 425421 - DNA, 25 bp, Mus musculus
gaagcagccgatgttttccaaaact

SEQ ID NO: 425422 - DNA, 25 bp, Mus musculus
gaagcagccggacctcttggtctca

SEQ ID NO: 425423 - DNA, 25 bp, Mus musculus
gaagcagccggagctcttggtctca

SEQ ID NO: 425424 - DNA, 25 bp, Mus musculus
gaagcagccgttagtacgtggctca

SEQ ID NO: 425425 - DNA, 25 bp, Mus musculus
gaagcagccgtttgtacgtggctca

SEQ ID NO: 425426 - DNA, 25 bp, Mus musculus
gaagcagcctacatactcagttcca

SEQ ID NO: 425427 - DNA, 25 bp, Mus musculus
gaagcagcctacttactcagttcca

SEQ ID NO: 425428 - DNA, 25 bp, Mus musculus
gaagcagcctcaccaaacctaggga

SEQ ID NO: 425429 - DNA, 25 bp, Mus musculus
gaagcagcctcagcaaacctaggga

SEQ ID NO: 425430 - DNA, 25 bp, Mus musculus
gaagcagcctgactaatgagacagt

SEQ ID NO: 425431 - DNA, 25 bp, Mus musculus
gaagcagcctgagtaatgagacagt

SEQ ID NO: 425432 - DNA, 25 bp, Mus musculus
gaagcagccttcagcgaagagctca

SEQ ID NO: 425433 - DNA, 25 bp, Mus musculus
gaagcagccttctgcgaagagctca

SEQ ID NO: 425434 - DNA, 25 bp, Mus musculus
gaagcagcggcacacaaagacaagg

SEQ ID NO: 425435 - DNA, 25 bp, Mus musculus
gaagcagcggcagacaaagacaagg

SEQ ID NO: 425436 - DNA, 25 bp, Mus musculus
gaagcagcgttaaacacagagcaat

SEQ ID NO: 425437 - DNA, 25 bp, Mus musculus
gaagcagcgttatacacagagcaat

SEQ ID NO: 425438 - DNA, 25 bp, Mus musculus
gaagcagcgtttcctttcttccttc

SEQ ID NO: 425439 - DNA, 25 bp, Mus musculus
gaagcagcgtttgctttcttccttc

SEQ ID NO: 425440 - DNA, 25 bp, Mus musculus
gaagcagctacaagaatcttacaaa

SEQ ID NO: 425441 - DNA, 25 bp, Mus musculus
gaagcagctacatgaatcttacaaa

SEQ ID NO: 425442 - DNA, 25 bp, Mus musculus
gaagcagctagaccggtcatcgtcc

SEQ ID NO: 425443 - DNA, 25 bp, Mus musculus
gaagcagctagaccttggaaagtag

SEQ ID NO: 425444 - DNA, 25 bp, Mus musculus
gaagcagctagagcggtcatcgtcc

SEQ ID NO: 425445 - DNA, 25 bp, Mus musculus
gaagcagctagagcttggaaagtag

SEQ ID NO: 425446 - DNA, 25 bp, Mus musculus
gaagcagctatgcaggtcattccta

SEQ ID NO: 425447 - DNA, 25 bp, Mus musculus
gaagcagctatggaggtcattccta

SEQ ID NO: 425448 - DNA, 25 bp, Mus musculus
gaagcagctattacttaggctatct

SEQ ID NO: 425449 - DNA, 25 bp, Mus musculus
gaagcagctatttcttaggctatct

SEQ ID NO: 425450 - DNA, 25 bp, Mus musculus
gaagcagctcggacgatccagaaga

SEQ ID NO: 425451 - DNA, 25 bp, Mus musculus
gaagcagctcggtcgatccagaaga

SEQ ID NO: 425452 - DNA, 25 bp, Mus musculus
gaagcagctgaaccagcccgcatat

SEQ ID NO: 425453 - DNA, 25 bp, Mus musculus
gaagcagctgaagcagcccgcatat

SEQ ID NO: 425454 - DNA, 25 bp, Mus musculus
gaagcagctgagctagttgaacaga

SEQ ID NO: 425455 - DNA, 25 bp, Mus musculus
gaagcagctgaggtagttgaacaga

SEQ ID NO: 425456 - DNA, 25 bp, Mus musculus
gaagcagctgctaactttgcgatta

SEQ ID NO: 425457 - DNA, 25 bp, Mus musculus
gaagcagctgctacttgctaggaca

SEQ ID NO: 425458 - DNA, 25 bp, Mus musculus
gaagcagctgctcttcagtgaccac

SEQ ID NO: 425459 - DNA, 25 bp, Mus musculus
gaagcagctgctgttcagtgaccac

SEQ ID NO: 425460 - DNA, 25 bp, Mus musculus
gaagcagctgcttactttgcgatta

SEQ ID NO: 425461 - DNA, 25 bp, Mus musculus
gaagcagctgcttcttgctaggaca

SEQ ID NO: 425462 - DNA, 25 bp, Mus musculus
gaagcagctggaacacgacatcagt

SEQ ID NO: 425463 - DNA, 25 bp, Mus musculus
gaagcagctggatcacgacatcagt

SEQ ID NO: 425464 - DNA, 25 bp, Mus musculus
gaagcagctgtaaacagcctggaat

SEQ ID NO: 425465 - DNA, 25 bp, Mus musculus
gaagcagctgtatacagcctggaat

SEQ ID NO: 425466 - DNA, 25 bp, Mus musculus
gaagcagcttcaacccagtgacgat

SEQ ID NO: 425467 - DNA, 25 bp, Mus musculus
gaagcagcttcatcccagtgacgat

SEQ ID NO: 425468 - DNA, 25 bp, Mus musculus
gaagcagcttccagcgcagactgga

SEQ ID NO: 425469 - DNA, 25 bp, Mus musculus
gaagcagcttcctgcgcagactgga

SEQ ID NO: 425470 - DNA, 25 bp, Mus musculus
gaagcagcttcgatctgagacatgt

SEQ ID NO: 425471 - DNA, 25 bp, Mus musculus
gaagcagcttcgttctgagacatgt

SEQ ID NO: 425472 - DNA, 25 bp, Mus musculus
gaagcagcttctcactgctaggtgc

SEQ ID NO: 425473 - DNA, 25 bp, Mus musculus
gaagcagcttctgactgctaggtgc

SEQ ID NO: 425474 - DNA, 25 bp, Mus musculus
gaagcagctttcagcacgcaaccga

SEQ ID NO: 425475 - DNA, 25 bp, Mus musculus
gaagcagctttcagctctctgaggg

SEQ ID NO: 425476 - DNA, 25 bp, Mus musculus
gaagcagctttctgcacgcaaccga

SEQ ID NO: 425477 - DNA, 25 bp, Mus musculus
gaagcagctttctgctctctgaggg

SEQ ID NO: 425478 - DNA, 25 bp, Mus musculus
gaagcaggaaatcccaccacagtcg

SEQ ID NO: 425479 - DNA, 25 bp, Mus musculus
gaagcaggaaatgccaccacagtcg

SEQ ID NO: 425480 - DNA, 25 bp, Mus musculus
gaagcaggaagcaatcaagccaaat

SEQ ID NO: 425481 - DNA, 25 bp, Mus musculus
gaagcaggaagctatcaagccaaat

SEQ ID NO: 425482 - DNA, 25 bp, Mus musculus
gaagcaggaccccttgtcaggaaac

SEQ ID NO: 425483 - DNA, 25 bp, Mus musculus
gaagcaggacccgttgtcaggaaac

SEQ ID NO: 425484 - DNA, 25 bp, Mus musculus
gaagcaggacgacatttagaggaat

SEQ ID NO: 425485 - DNA, 25 bp, Mus musculus
gaagcaggacgagatttagaggaat

SEQ ID NO: 425486 - DNA, 25 bp, Mus musculus
gaagcaggactcactgctttgactc

SEQ ID NO: 425487 - DNA, 25 bp, Mus musculus
gaagcaggactctctgctttgactc

SEQ ID NO: 425488 - DNA, 25 bp, Mus musculus
gaagcaggagacagcctcagcacat

SEQ ID NO: 425489 - DNA, 25 bp, Mus musculus
gaagcaggagactgcctcagcacat

SEQ ID NO: 425490 - DNA, 25 bp, Mus musculus
gaagcaggaggactcatttcatgat

SEQ ID NO: 425491 - DNA, 25 bp, Mus musculus
gaagcaggaggagtcatttcatgat

SEQ ID NO: 425492 - DNA, 25 bp, Mus musculus
gaagcaggaggcaccgtccgcaagc

SEQ ID NO: 425493 - DNA, 25 bp, Mus musculus
gaagcaggaggctccgtccgcaagc

SEQ ID NO: 425494 - DNA, 25 bp, Mus musculus
gaagcaggagtaacatcaggccgtc

SEQ ID NO: 425495 - DNA, 25 bp, Mus musculus
gaagcaggagtatcatcaggccgtc

SEQ ID NO: 425496 - DNA, 25 bp, Mus musculus
gaagcaggatctcactgtttagcat

SEQ ID NO: 425497 - DNA, 25 bp, Mus musculus
gaagcaggatctgactgtttagcat

SEQ ID NO: 425498 - DNA, 25 bp, Mus musculus
gaagcaggcagaaaggagtatagtt

SEQ ID NO: 425499 - DNA, 25 bp, Mus musculus
gaagcaggcagataggagtatagtt

SEQ ID NO: 425500 - DNA, 25 bp, Mus musculus
gaagcaggccatcattcactcctat

SEQ ID NO: 425501 - DNA, 25 bp, Mus musculus
gaagcaggccatgattcactcctat

SEQ ID NO: 425502 - DNA, 25 bp, Mus musculus
gaagcaggccccatttaaagccaat

SEQ ID NO: 425503 - DNA, 25 bp, Mus musculus
gaagcaggccccttttaaagccaat

SEQ ID NO: 425504 - DNA, 25 bp, Mus musculus
gaagcaggcgctcagtagagcacca

SEQ ID NO: 425505 - DNA, 25 bp, Mus musculus
gaagcaggcgctctctgaggaaatc

SEQ ID NO: 425506 - DNA, 25 bp, Mus musculus
gaagcaggcgctgagtagagcacca

SEQ ID NO: 425507 - DNA, 25 bp, Mus musculus
gaagcaggcgctgtctgaggaaatc

SEQ ID NO: 425508 - DNA, 25 bp, Mus musculus
gaagcaggcgggactctgtgaacaa

SEQ ID NO: 425509 - DNA, 25 bp, Mus musculus
gaagcaggcgggtctctgtgaacaa

SEQ ID NO: 425510 - DNA, 25 bp, Mus musculus
gaagcaggcgttataagacggtaat

SEQ ID NO: 425511 - DNA, 25 bp, Mus musculus
gaagcaggcgttttaagacggtaat

SEQ ID NO: 425512 - DNA, 25 bp, Mus musculus
gaagcaggctatccagacctcgatc

SEQ ID NO: 425513 - DNA, 25 bp, Mus musculus
gaagcaggctatgcagacctcgatc

SEQ ID NO: 425514 - DNA, 25 bp, Mus musculus
gaagcaggctctcaacatacgtgga

SEQ ID NO: 425515 - DNA, 25 bp, Mus musculus
gaagcaggctctgaacatacgtgga

SEQ ID NO: 425516 - DNA, 25 bp, Mus musculus
gaagcaggctgactcaggcttgact

SEQ ID NO: 425517 - DNA, 25 bp, Mus musculus
gaagcaggctgagtcaggcttgact

SEQ ID NO: 425518 - DNA, 25 bp, Mus musculus
gaagcaggcttcagatccacaaccg

SEQ ID NO: 425519 - DNA, 25 bp, Mus musculus
gaagcaggcttccttttaagtttat

SEQ ID NO: 425520 - DNA, 25 bp, Mus musculus
gaagcaggcttcgttttaagtttat

SEQ ID NO: 425521 - DNA, 25 bp, Mus musculus
gaagcaggcttctgatccacaaccg

SEQ ID NO: 425522 - DNA, 25 bp, Mus musculus
gaagcagggagcatcctttcagcca

SEQ ID NO: 425523 - DNA, 25 bp, Mus musculus
gaagcagggagcttcctttcagcca

SEQ ID NO: 425524 - DNA, 25 bp, Mus musculus
gaagcagggcgtaatattgaaattt

SEQ ID NO: 425525 - DNA, 25 bp, Mus musculus
gaagcagggcgtcttatttatagaa

SEQ ID NO: 425526 - DNA, 25 bp, Mus musculus
gaagcagggcgtgttatttatagaa

SEQ ID NO: 425527 - DNA, 25 bp, Mus musculus
gaagcagggcgttatattgaaattt

SEQ ID NO: 425528 - DNA, 25 bp, Mus musculus
gaagcagggttgaactcccggtgtc

SEQ ID NO: 425529 - DNA, 25 bp, Mus musculus
gaagcagggttgtactcccggtgtc

SEQ ID NO: 425530 - DNA, 25 bp, Mus musculus
gaagcagggtttcgcacagcccaga

SEQ ID NO: 425531 - DNA, 25 bp, Mus musculus
gaagcagggtttggcacagcccaga

SEQ ID NO: 425532 - DNA, 25 bp, Mus musculus
gaagcaggtcaccatcgtcgtgaac

SEQ ID NO: 425533 - DNA, 25 bp, Mus musculus
gaagcaggtcacgatcgtcgtgaac

SEQ ID NO: 425534 - DNA, 25 bp, Mus musculus
gaagcaggtctgagtctgagcactt

SEQ ID NO: 425535 - DNA, 25 bp, Mus musculus
gaagcaggtctgtgtctgagcactt

SEQ ID NO: 425536 - DNA, 25 bp, Mus musculus
gaagcaggtcttcctgtttcagttt

SEQ ID NO: 425537 - DNA, 25 bp, Mus musculus
gaagcaggtcttgctgtttcagttt

SEQ ID NO: 425538 - DNA, 25 bp, Mus musculus
gaagcaggtgacattccatattgga

SEQ ID NO: 425539 - DNA, 25 bp, Mus musculus
gaagcaggtgactttccatattgga

SEQ ID NO: 425540 - DNA, 25 bp, Mus musculus
gaagcaggtgcacccgcatgggcct

SEQ ID NO: 425541 - DNA, 25 bp, Mus musculus
gaagcaggtgcagccgcatgggcct

SEQ ID NO: 425542 - DNA, 25 bp, Mus musculus
gaagcaggtggcacacacagggctt

SEQ ID NO: 425543 - DNA, 25 bp, Mus musculus
gaagcaggtggctcacacagggctt

SEQ ID NO: 425544 - DNA, 25 bp, Mus musculus
gaagcaggtgggacaactcctcaca

SEQ ID NO: 425545 - DNA, 25 bp, Mus musculus
gaagcaggtgggtcaactcctcaca

SEQ ID NO: 425546 - DNA, 25 bp, Mus musculus
gaagcaggttcccaggttctcagac

SEQ ID NO: 425547 - DNA, 25 bp, Mus musculus
gaagcaggttccgaggttctcagac

SEQ ID NO: 425548 - DNA, 25 bp, Mus musculus
gaagcaggttgcataattcgatata

SEQ ID NO: 425549 - DNA, 25 bp, Mus musculus
gaagcaggttgcttaattcgatata

SEQ ID NO: 425550 - DNA, 25 bp, Mus musculus
gaagcaggttttcaagttcaccctg

SEQ ID NO: 425551 - DNA, 25 bp, Mus musculus
gaagcaggttttgaagttcaccctg

SEQ ID NO: 425552 - DNA, 25 bp, Mus musculus
gaagcagtaacgactttccagctgt

SEQ ID NO: 425553 - DNA, 25 bp, Mus musculus
gaagcagtaacgtctttccagctgt

SEQ ID NO: 425554 - DNA, 25 bp, Mus musculus
gaagcagtaactcgaactctgtccc

SEQ ID NO: 425555 - DNA, 25 bp, Mus musculus
gaagcagtaactggaactctgtccc

SEQ ID NO: 425556 - DNA, 25 bp, Mus musculus
gaagcagtaagtaggcaccttgcca

SEQ ID NO: 425557 - DNA, 25 bp, Mus musculus
gaagcagtaagttggcaccttgcca

SEQ ID NO: 425558 - DNA, 25 bp, Mus musculus
gaagcagtacaaccagacgatagga

SEQ ID NO: 425559 - DNA, 25 bp, Mus musculus
gaagcagtacaagcagacgatagga

SEQ ID NO: 425560 - DNA, 25 bp, Mus musculus
gaagcagtacatcaggagatccaca

SEQ ID NO: 425561 - DNA, 25 bp, Mus musculus
gaagcagtacatgaggagatccaca

SEQ ID NO: 425562 - DNA, 25 bp, Mus musculus
gaagcagtaccgatcaagaggtaaa

SEQ ID NO: 425563 - DNA, 25 bp, Mus musculus
gaagcagtaccgttcaagaggtaaa

SEQ ID NO: 425564 - DNA, 25 bp, Mus musculus
gaagcagtacttcaacattctatgg

SEQ ID NO: 425565 - DNA, 25 bp, Mus musculus
gaagcagtacttgaacattctatgg

SEQ ID NO: 425566 - DNA, 25 bp, Mus musculus
gaagcagtaggcctggctttctcaa

SEQ ID NO: 425567 - DNA, 25 bp, Mus musculus
gaagcagtaggcgtggctttctcaa

SEQ ID NO: 425568 - DNA, 25 bp, Mus musculus
gaagcagtagggaccccagcagcac

SEQ ID NO: 425569 - DNA, 25 bp, Mus musculus
gaagcagtagggtccccagcagcac

SEQ ID NO: 425570 - DNA, 25 bp, Mus musculus
gaagcagtagttaagttacggcaca

SEQ ID NO: 425571 - DNA, 25 bp, Mus musculus
gaagcagtagtttagttacggcaca

SEQ ID NO: 425572 - DNA, 25 bp, Mus musculus
gaagcagtatgtcatgtctctctcc

SEQ ID NO: 425573 - DNA, 25 bp, Mus musculus
gaagcagtatgtgatgtctctctcc

SEQ ID NO: 425574 - DNA, 25 bp, Mus musculus
gaagcagtatttctacgagaccaag

SEQ ID NO: 425575 - DNA, 25 bp, Mus musculus
gaagcagtatttgtacgagaccaag

SEQ ID NO: 425576 - DNA, 25 bp, Mus musculus
gaagcagtcacaagcaaccgcagtg

SEQ ID NO: 425577 - DNA, 25 bp, Mus musculus
gaagcagtcacatgcaaccgcagtg

SEQ ID NO: 425578 - DNA, 25 bp, Mus musculus
gaagcagtcatgcttccgacctgta

SEQ ID NO: 425579 - DNA, 25 bp, Mus musculus
gaagcagtcatggttccgacctgta

SEQ ID NO: 425580 - DNA, 25 bp, Mus musculus
gaagcagtccccagtgttgaagctg

SEQ ID NO: 425581 - DNA, 25 bp, Mus musculus
gaagcagtcccctgtgttgaagctg

SEQ ID NO: 425582 - DNA, 25 bp, Mus musculus
gaagcagtccgtactctctgagttt

SEQ ID NO: 425583 - DNA, 25 bp, Mus musculus
gaagcagtccgttctctctgagttt

SEQ ID NO: 425584 - DNA, 25 bp, Mus musculus
gaagcagtcctgcacagctgactga

SEQ ID NO: 425585 - DNA, 25 bp, Mus musculus
gaagcagtcctggacagctgactga

SEQ ID NO: 425586 - DNA, 25 bp, Mus musculus
gaagcagtcgctactacaaccatga

SEQ ID NO: 425587 - DNA, 25 bp, Mus musculus
gaagcagtcgcttctacaaccatga

SEQ ID NO: 425588 - DNA, 25 bp, Mus musculus
gaagcagtctacctagctgagctgt

SEQ ID NO: 425589 - DNA, 25 bp, Mus musculus
gaagcagtctacgtagctgagctgt

SEQ ID NO: 425590 - DNA, 25 bp, Mus musculus
gaagcagtctataccctgataccag

SEQ ID NO: 425591 - DNA, 25 bp, Mus musculus
gaagcagtctattccctgataccag

SEQ ID NO: 425592 - DNA, 25 bp, Mus musculus
gaagcagtctgacggccttaccaaa

SEQ ID NO: 425593 - DNA, 25 bp, Mus musculus
gaagcagtctgagggccttaccaaa

SEQ ID NO: 425594 - DNA, 25 bp, Mus musculus
gaagcagtcttccagacatacgtga

SEQ ID NO: 425595 - DNA, 25 bp, Mus musculus
gaagcagtcttcgagacatacgtga

SEQ ID NO: 425596 - DNA, 25 bp, Mus musculus
gaagcagtgactccatcaggcaagg

SEQ ID NO: 425597 - DNA, 25 bp, Mus musculus
gaagcagtgactgcatcaggcaagg

SEQ ID NO: 425598 - DNA, 25 bp, Mus musculus
gaagcagtgcaactttgagttattt

SEQ ID NO: 425599 - DNA, 25 bp, Mus musculus
gaagcagtgcaagtttgagttattt

SEQ ID NO: 425600 - DNA, 25 bp, Mus musculus
gaagcagtgcacacaagctccattg

SEQ ID NO: 425601 - DNA, 25 bp, Mus musculus
gaagcagtgcactcaagctccattg

SEQ ID NO: 425602 - DNA, 25 bp, Mus musculus
gaagcagtgccgatgcatatccatc

SEQ ID NO: 425603 - DNA, 25 bp, Mus musculus
gaagcagtgccgttgcatatccatc

SEQ ID NO: 425604 - DNA, 25 bp, Mus musculus
gaagcagtgctgaagtgactgttgt

SEQ ID NO: 425605 - DNA, 25 bp, Mus musculus
gaagcagtgctgaatttgcgggcca

SEQ ID NO: 425606 - DNA, 25 bp, Mus musculus
gaagcagtgctgcattccagtgatt

SEQ ID NO: 425607 - DNA, 25 bp, Mus musculus
gaagcagtgctggattccagtgatt

SEQ ID NO: 425608 - DNA, 25 bp, Mus musculus
gaagcagtgctgtagtgactgttgt

SEQ ID NO: 425609 - DNA, 25 bp, Mus musculus
gaagcagtgctgtatttgcgggcca

SEQ ID NO: 425610 - DNA, 25 bp, Mus musculus
gaagcagtggcacctatgtccaagg

SEQ ID NO: 425611 - DNA, 25 bp, Mus musculus
gaagcagtggcagctatgtccaagg

SEQ ID NO: 425612 - DNA, 25 bp, Mus musculus
gaagcagtggctaggacagtcatta

SEQ ID NO: 425613 - DNA, 25 bp, Mus musculus
gaagcagtggctccataccgccgag

SEQ ID NO: 425614 - DNA, 25 bp, Mus musculus
gaagcagtggctgcataccgccgag

SEQ ID NO: 425615 - DNA, 25 bp, Mus musculus
gaagcagtggcttggacagtcatta

SEQ ID NO: 425616 - DNA, 25 bp, Mus musculus
gaagcagtgtcgatcatggatgcta

SEQ ID NO: 425617 - DNA, 25 bp, Mus musculus
gaagcagtgtcgttcatggatgcta

SEQ ID NO: 425618 - DNA, 25 bp, Mus musculus
gaagcagtgtgcacgtagtccgact

SEQ ID NO: 425619 - DNA, 25 bp, Mus musculus
gaagcagtgtgctcgtagtccgact

SEQ ID NO: 425620 - DNA, 25 bp, Mus musculus
gaagcagtgtggatcgcagccctga

SEQ ID NO: 425621 - DNA, 25 bp, Mus musculus
gaagcagtgtggttcgcagccctga

SEQ ID NO: 425622 - DNA, 25 bp, Mus musculus
gaagcagttagcaggatagagtcca

SEQ ID NO: 425623 - DNA, 25 bp, Mus musculus
gaagcagttagctggatagagtcca

SEQ ID NO: 425624 - DNA, 25 bp, Mus musculus
gaagcagttcttcgcatgcaagata

SEQ ID NO: 425625 - DNA, 25 bp, Mus musculus
gaagcagttcttggcatgcaagata

SEQ ID NO: 425626 - DNA, 25 bp, Mus musculus
gaagcagttgagcaatccacagcaa

SEQ ID NO: 425627 - DNA, 25 bp, Mus musculus
gaagcagttgaggaatccacagcaa

SEQ ID NO: 425628 - DNA, 25 bp, Mus musculus
gaagcagttgcactgaacttgtcaa

SEQ ID NO: 425629 - DNA, 25 bp, Mus musculus
gaagcagttgcagtgaacttgtcaa

SEQ ID NO: 425630 - DNA, 25 bp, Mus musculus
gaagcagttgccattcttaattaaa

SEQ ID NO: 425631 - DNA, 25 bp, Mus musculus
gaagcagttgcctttcttaattaaa

SEQ ID NO: 425632 - DNA, 25 bp, Mus musculus
gaagcagttgtacccaaagccacct

SEQ ID NO: 425633 - DNA, 25 bp, Mus musculus
gaagcagttgtagccaaagccacct

SEQ ID NO: 425634 - DNA, 25 bp, Mus musculus
gaagcagttgttcaaggatacacta

SEQ ID NO: 425635 - DNA, 25 bp, Mus musculus
gaagcagttgttgaaggatacacta

SEQ ID NO: 425636 - DNA, 25 bp, Mus musculus
gaagcagtttcaactagctccagtg

SEQ ID NO: 425637 - DNA, 25 bp, Mus musculus
gaagcagtttcatctagctccagtg

SEQ ID NO: 425638 - DNA, 25 bp, Mus musculus
gaagcagtttccagactttgtacca

SEQ ID NO: 425639 - DNA, 25 bp, Mus musculus
gaagcagtttcctgactttgtacca

SEQ ID NO: 425640 - DNA, 25 bp, Mus musculus
gaagcagtttctagctcaccctcaa

SEQ ID NO: 425641 - DNA, 25 bp, Mus musculus
gaagcagtttcttgctcaccctcaa

SEQ ID NO: 425642 - DNA, 25 bp, Mus musculus
gaagcataaattaggtcgtaaacct

SEQ ID NO: 425643 - DNA, 25 bp, Mus musculus
gaagcataaatttggtcgtaaacct

SEQ ID NO: 425644 - DNA, 25 bp, Mus musculus
gaagcataactgacaaccgacggga

SEQ ID NO: 425645 - DNA, 25 bp, Mus musculus
gaagcataactgtcaaccgacggga

SEQ ID NO: 425646 - DNA, 25 bp, Mus musculus
gaagcataagcaaatccacactagg

SEQ ID NO: 425647 - DNA, 25 bp, Mus musculus
gaagcataagcatatccacactagg

SEQ ID NO: 425648 - DNA, 25 bp, Mus musculus
gaagcataagtgctttactgaagtt

SEQ ID NO: 425649 - DNA, 25 bp, Mus musculus
gaagcataagtggtttactgaagtt

SEQ ID NO: 425650 - DNA, 25 bp, Mus musculus
gaagcataatgcagtcaccctcacc

SEQ ID NO: 425651 - DNA, 25 bp, Mus musculus
gaagcataatgctgtcaccctcacc

SEQ ID NO: 425652 - DNA, 25 bp, Mus musculus
gaagcatacaaccttgaatttagta

SEQ ID NO: 425653 - DNA, 25 bp, Mus musculus
gaagcatacaacgttgaatttagta

SEQ ID NO: 425654 - DNA, 25 bp, Mus musculus
gaagcatacaggatcgcgctcagac

SEQ ID NO: 425655 - DNA, 25 bp, Mus musculus
gaagcatacaggttcgcgctcagac

SEQ ID NO: 425656 - DNA, 25 bp, Mus musculus
gaagcatacattatacgctgctaat

SEQ ID NO: 425657 - DNA, 25 bp, Mus musculus
gaagcatacattttacgctgctaat

SEQ ID NO: 425658 - DNA, 25 bp, Mus musculus
gaagcataccatctttggacgggtt

SEQ ID NO: 425659 - DNA, 25 bp, Mus musculus
gaagcataccatgtttggacgggtt

SEQ ID NO: 425660 - DNA, 25 bp, Mus musculus
gaagcatacctacactgaaaaccat

SEQ ID NO: 425661 - DNA, 25 bp, Mus musculus
gaagcatacctagactgaaaaccat

SEQ ID NO: 425662 - DNA, 25 bp, Mus musculus
gaagcatactgaacattgtcaacga

SEQ ID NO: 425663 - DNA, 25 bp, Mus musculus
gaagcatactgatcattgtcaacga

SEQ ID NO: 425664 - DNA, 25 bp, Mus musculus
gaagcatacttccactgacacaaag

SEQ ID NO: 425665 - DNA, 25 bp, Mus musculus
gaagcatacttcgactgacacaaag

SEQ ID NO: 425666 - DNA, 25 bp, Mus musculus
gaagcatagctcaacttgggtattt

SEQ ID NO: 425667 - DNA, 25 bp, Mus musculus
gaagcatagctctacttgggtattt

SEQ ID NO: 425668 - DNA, 25 bp, Mus musculus
gaagcatagtagcattgtgctgtaa

SEQ ID NO: 425669 - DNA, 25 bp, Mus musculus
gaagcatagtaggattgtgctgtaa

SEQ ID NO: 425670 - DNA, 25 bp, Mus musculus
gaagcatatactcgccaagttggaa

SEQ ID NO: 425671 - DNA, 25 bp, Mus musculus
gaagcatatactggccaagttggaa

SEQ ID NO: 425672 - DNA, 25 bp, Mus musculus
gaagcatatccccagattctcacaa

SEQ ID NO: 425673 - DNA, 25 bp, Mus musculus
gaagcatatcccgagattctcacaa

SEQ ID NO: 425674 - DNA, 25 bp, Mus musculus
gaagcatatctcaagcatcaaaatt

SEQ ID NO: 425675 - DNA, 25 bp, Mus musculus
gaagcatatctctagcatcaaaatt

SEQ ID NO: 425676 - DNA, 25 bp, Mus musculus
gaagcatatcttatttggagtttta

SEQ ID NO: 425677 - DNA, 25 bp, Mus musculus
gaagcatatcttttttggagtttta

SEQ ID NO: 425678 - DNA, 25 bp, Mus musculus
gaagcatatgacagatttacagcat

SEQ ID NO: 425679 - DNA, 25 bp, Mus musculus
gaagcatatgactgatttacagcat

SEQ ID NO: 425680 - DNA, 25 bp, Mus musculus
gaagcatatgcacggacacaacaat

SEQ ID NO: 425681 - DNA, 25 bp, Mus musculus
gaagcatatgcagggacacaacaat

SEQ ID NO: 425682 - DNA, 25 bp, Mus musculus
gaagcatattatacctggcatcata

SEQ ID NO: 425683 - DNA, 25 bp, Mus musculus
gaagcatattattcctggcatcata

SEQ ID NO: 425684 - DNA, 25 bp, Mus musculus
gaagcatattgtattcttgactgac

SEQ ID NO: 425685 - DNA, 25 bp, Mus musculus
gaagcatattgttttcttgactgac

SEQ ID NO: 425686 - DNA, 25 bp, Mus musculus
gaagcatatttcctcatagtctata

SEQ ID NO: 425687 - DNA, 25 bp, Mus musculus
gaagcatatttcgtcatagtctata

SEQ ID NO: 425688 - DNA, 25 bp, Mus musculus
gaagcatcaactctcctgtcaagca

SEQ ID NO: 425689 - DNA, 25 bp, Mus musculus
gaagcatcaactgtcctgtcaagca

SEQ ID NO: 425690 - DNA, 25 bp, Mus musculus
gaagcatcaagccttctctagaggt

SEQ ID NO: 425691 - DNA, 25 bp, Mus musculus
gaagcatcaagcgttctctagaggt

SEQ ID NO: 425692 - DNA, 25 bp, Mus musculus
gaagcatcacttcagatatcctcct

SEQ ID NO: 425693 - DNA, 25 bp, Mus musculus
gaagcatcacttgagatatcctcct

SEQ ID NO: 425694 - DNA, 25 bp, Mus musculus
gaagcatcagctatgacccaaagca

SEQ ID NO: 425695 - DNA, 25 bp, Mus musculus
gaagcatcagctttgacccaaagca

SEQ ID NO: 425696 - DNA, 25 bp, Mus musculus
gaagcatcaggcacacaggtgtgtg

SEQ ID NO: 425697 - DNA, 25 bp, Mus musculus
gaagcatcaggctcacaggtgtgtg

SEQ ID NO: 425698 - DNA, 25 bp, Mus musculus
gaagcatcatatagttatccacgtt

SEQ ID NO: 425699 - DNA, 25 bp, Mus musculus
gaagcatcatattgttatccacgtt

SEQ ID NO: 425700 - DNA, 25 bp, Mus musculus
gaagcatcatccatatagtctaaca

SEQ ID NO: 425701 - DNA, 25 bp, Mus musculus
gaagcatcatccttatagtctaaca

SEQ ID NO: 425702 - DNA, 25 bp, Mus musculus
gaagcatccaagaggcactccacag

SEQ ID NO: 425703 - DNA, 25 bp, Mus musculus
gaagcatccaagtggcactccacag

SEQ ID NO: 425704 - DNA, 25 bp, Mus musculus
gaagcatccactagccagtttgaga

SEQ ID NO: 425705 - DNA, 25 bp, Mus musculus
gaagcatccacttgccagtttgaga

SEQ ID NO: 425706 - DNA, 25 bp, Mus musculus
gaagcatccatcaggcagagtatta

SEQ ID NO: 425707 - DNA, 25 bp, Mus musculus
gaagcatccatctggcagagtatta

SEQ ID NO: 425708 - DNA, 25 bp, Mus musculus
gaagcatccattaccaaattgatag

SEQ ID NO: 425709 - DNA, 25 bp, Mus musculus
gaagcatccatttccaaattgatag

SEQ ID NO: 425710 - DNA, 25 bp, Mus musculus
gaagcatccgagctgagtgtcagtc

SEQ ID NO: 425711 - DNA, 25 bp, Mus musculus
gaagcatccgaggtgagtgtcagtc

SEQ ID NO: 425712 - DNA, 25 bp, Mus musculus
gaagcatcctacacgggataacata

SEQ ID NO: 425713 - DNA, 25 bp, Mus musculus
gaagcatcctactcgggataacata

SEQ ID NO: 425714 - DNA, 25 bp, Mus musculus
gaagcatcctctattgaatcaccct

SEQ ID NO: 425715 - DNA, 25 bp, Mus musculus
gaagcatcctcttttgaatcaccct

SEQ ID NO: 425716 - DNA, 25 bp, Mus musculus
gaagcatccttacattcaggacctg

SEQ ID NO: 425717 - DNA, 25 bp, Mus musculus
gaagcatccttagattcaggacctg

SEQ ID NO: 425718 - DNA, 25 bp, Mus musculus
gaagcatccttcaggaacttccttt

SEQ ID NO: 425719 - DNA, 25 bp, Mus musculus
gaagcatccttctggaacttccttt

SEQ ID NO: 425720 - DNA, 25 bp, Mus musculus
gaagcatcggccaacattgcaggac

SEQ ID NO: 425721 - DNA, 25 bp, Mus musculus
gaagcatcggccacatccgggtgtg

SEQ ID NO: 425722 - DNA, 25 bp, Mus musculus
gaagcatcggcctacattgcaggac

SEQ ID NO: 425723 - DNA, 25 bp, Mus musculus
gaagcatcggcctcatccgggtgtg

SEQ ID NO: 425724 - DNA, 25 bp, Mus musculus
gaagcatcgtctacactgtgaggag

SEQ ID NO: 425725 - DNA, 25 bp, Mus musculus
gaagcatcgtcttcactgtgaggag

SEQ ID NO: 425726 - DNA, 25 bp, Mus musculus
gaagcatctatgcagctcctcgaga

SEQ ID NO: 425727 - DNA, 25 bp, Mus musculus
gaagcatctatggagctcctcgaga

SEQ ID NO: 425728 - DNA, 25 bp, Mus musculus
gaagcatctcatagtacaacccagg

SEQ ID NO: 425729 - DNA, 25 bp, Mus musculus
gaagcatctcattgtacaacccagg

SEQ ID NO: 425730 - DNA, 25 bp, Mus musculus
gaagcatctgatctaccagtcggtc

SEQ ID NO: 425731 - DNA, 25 bp, Mus musculus
gaagcatctgatgtaccagtcggtc

SEQ ID NO: 425732 - DNA, 25 bp, Mus musculus
gaagcatctgtgatctacagtctct

SEQ ID NO: 425733 - DNA, 25 bp, Mus musculus
gaagcatctgtgttctacagtctct

SEQ ID NO: 425734 - DNA, 25 bp, Mus musculus
gaagcatcttttaaaatccttggat

SEQ ID NO: 425735 - DNA, 25 bp, Mus musculus
gaagcatcttttagctcagtgttga

SEQ ID NO: 425736 - DNA, 25 bp, Mus musculus
gaagcatctttttaaatccttggat

SEQ ID NO: 425737 - DNA, 25 bp, Mus musculus
gaagcatctttttgctcagtgttga

SEQ ID NO: 425738 - DNA, 25 bp, Mus musculus
gaagcatgaatgaagcagccaagca

SEQ ID NO: 425739 - DNA, 25 bp, Mus musculus
gaagcatgaatgtagcagccaagca

SEQ ID NO: 425740 - DNA, 25 bp, Mus musculus
gaagcatgagcaactcagacttgaa

SEQ ID NO: 425741 - DNA, 25 bp, Mus musculus
gaagcatgagcatctcagacttgaa

SEQ ID NO: 425742 - DNA, 25 bp, Mus musculus
gaagcatgagctacgggccaaaggt

SEQ ID NO: 425743 - DNA, 25 bp, Mus musculus
gaagcatgagctacgggccaaagtt

SEQ ID NO: 425744 - DNA, 25 bp, Mus musculus
gaagcatgagcttcgggccaaaggt

SEQ ID NO: 425745 - DNA, 25 bp, Mus musculus
gaagcatgagcttcgggccaaagtt

SEQ ID NO: 425746 - DNA, 25 bp, Mus musculus
gaagcatgatccagtgctgccgtgg

SEQ ID NO: 425747 - DNA, 25 bp, Mus musculus
gaagcatgatcctgtgctgccgtgg

SEQ ID NO: 425748 - DNA, 25 bp, Mus musculus
gaagcatgatctcagtcgaccaata

SEQ ID NO: 425749 - DNA, 25 bp, Mus musculus
gaagcatgatctgagtcgaccaata

SEQ ID NO: 425750 - DNA, 25 bp, Mus musculus
gaagcatgatgtcttagttcattct

SEQ ID NO: 425751 - DNA, 25 bp, Mus musculus
gaagcatgatgtgttagttcattct

SEQ ID NO: 425752 - DNA, 25 bp, Mus musculus
gaagcatgattccagcagggctcat

SEQ ID NO: 425753 - DNA, 25 bp, Mus musculus
gaagcatgattcgagcagggctcat

SEQ ID NO: 425754 - DNA, 25 bp, Mus musculus
gaagcatgcacacaactcactgttg

SEQ ID NO: 425755 - DNA, 25 bp, Mus musculus
gaagcatgcacagaactcactgttg

SEQ ID NO: 425756 - DNA, 25 bp, Mus musculus
gaagcatgcccaactcttcatgctg

SEQ ID NO: 425757 - DNA, 25 bp, Mus musculus
gaagcatgcccatctcttcatgctg

SEQ ID NO: 425758 - DNA, 25 bp, Mus musculus
gaagcatgcctaaagtcctggcaca

SEQ ID NO: 425759 - DNA, 25 bp, Mus musculus
gaagcatgcctatagtcctggcaca

SEQ ID NO: 425760 - DNA, 25 bp, Mus musculus
gaagcatgctaaccggactctgcta

SEQ ID NO: 425761 - DNA, 25 bp, Mus musculus
gaagcatgctaagcggactctgcta

SEQ ID NO: 425762 - DNA, 25 bp, Mus musculus
gaagcatgctgaaatagtctggtaa

SEQ ID NO: 425763 - DNA, 25 bp, Mus musculus
gaagcatgctgatatagtctggtaa

SEQ ID NO: 425764 - DNA, 25 bp, Mus musculus
gaagcatgctgcctatgcgtggccc

SEQ ID NO: 425765 - DNA, 25 bp, Mus musculus
gaagcatgctgcgtatgcgtggccc

SEQ ID NO: 425766 - DNA, 25 bp, Mus musculus
gaagcatggcaaaacacctactgtt

SEQ ID NO: 425767 - DNA, 25 bp, Mus musculus
gaagcatggcaactgggcatcaata

SEQ ID NO: 425768 - DNA, 25 bp, Mus musculus
gaagcatggcaagtgggcatcaata

SEQ ID NO: 425769 - DNA, 25 bp, Mus musculus
gaagcatggcaatacacctactgtt

SEQ ID NO: 425770 - DNA, 25 bp, Mus musculus
gaagcatggcccctctgagattttc

SEQ ID NO: 425771 - DNA, 25 bp, Mus musculus
gaagcatggcccgtctgagattttc

SEQ ID NO: 425772 - DNA, 25 bp, Mus musculus
gaagcatggcctccttgctgatgaa

SEQ ID NO: 425773 - DNA, 25 bp, Mus musculus
gaagcatggcctgcttgctgatgaa

SEQ ID NO: 425774 - DNA, 25 bp, Mus musculus
gaagcatggctgattgcccttgaag

SEQ ID NO: 425775 - DNA, 25 bp, Mus musculus
gaagcatggctgtttgcccttgaag

SEQ ID NO: 425776 - DNA, 25 bp, Mus musculus
gaagcatgggtaactaggtcagcat

SEQ ID NO: 425777 - DNA, 25 bp, Mus musculus
gaagcatgggtatctaggtcagcat

SEQ ID NO: 425778 - DNA, 25 bp, Mus musculus
gaagcatgtacgattggtacatcct

SEQ ID NO: 425779 - DNA, 25 bp, Mus musculus
gaagcatgtacgtttggtacatcct

SEQ ID NO: 425780 - DNA, 25 bp, Mus musculus
gaagcatgtatgatttttactgttt

SEQ ID NO: 425781 - DNA, 25 bp, Mus musculus
gaagcatgtatgttttttactgttt

SEQ ID NO: 425782 - DNA, 25 bp, Mus musculus
gaagcatgtcacagttgggataaaa

SEQ ID NO: 425783 - DNA, 25 bp, Mus musculus
gaagcatgtcacataggtacagtca

SEQ ID NO: 425784 - DNA, 25 bp, Mus musculus
gaagcatgtcactgttgggataaaa

SEQ ID NO: 425785 - DNA, 25 bp, Mus musculus
gaagcatgtcacttaggtacagtca

SEQ ID NO: 425786 - DNA, 25 bp, Mus musculus
gaagcatgtccaaacaagttctaga

SEQ ID NO: 425787 - DNA, 25 bp, Mus musculus
gaagcatgtccatacaagttctaga

SEQ ID NO: 425788 - DNA, 25 bp, Mus musculus
gaagcatgtgcaaggcagtttacaa

SEQ ID NO: 425789 - DNA, 25 bp, Mus musculus
gaagcatgtgcatggcagtttacaa

SEQ ID NO: 425790 - DNA, 25 bp, Mus musculus
gaagcatgtgctagcaacttaaata

SEQ ID NO: 425791 - DNA, 25 bp, Mus musculus
gaagcatgtgctcttttgcataaga

SEQ ID NO: 425792 - DNA, 25 bp, Mus musculus
gaagcatgtgctgttttgcataaga

SEQ ID NO: 425793 - DNA, 25 bp, Mus musculus
gaagcatgtgcttgcaacttaaata

SEQ ID NO: 425794 - DNA, 25 bp, Mus musculus
gaagcatgtggactccactctggaa

SEQ ID NO: 425795 - DNA, 25 bp, Mus musculus
gaagcatgtggagtccactctggaa

SEQ ID NO: 425796 - DNA, 25 bp, Mus musculus
gaagcatgtggcaacccataaaagt

SEQ ID NO: 425797 - DNA, 25 bp, Mus musculus
gaagcatgtggctacccataaaagt

SEQ ID NO: 425798 - DNA, 25 bp, Mus musculus
gaagcatgtgtcacacaagctccag

SEQ ID NO: 425799 - DNA, 25 bp, Mus musculus
gaagcatgtgtctcacaagctccag

SEQ ID NO: 425800 - DNA, 25 bp, Mus musculus
gaagcatgtgttccatgcgcacgct

SEQ ID NO: 425801 - DNA, 25 bp, Mus musculus
gaagcatgtgttgcatgcgcacgct

SEQ ID NO: 425802 - DNA, 25 bp, Mus musculus
gaagcatgttccaatattccattct

SEQ ID NO: 425803 - DNA, 25 bp, Mus musculus
gaagcatgttcctatattccattct

SEQ ID NO: 425804 - DNA, 25 bp, Mus musculus
gaagcattaaaacgagccccgccgt

SEQ ID NO: 425805 - DNA, 25 bp, Mus musculus
gaagcattaaaaggagccccgccgt

SEQ ID NO: 425806 - DNA, 25 bp, Mus musculus
gaagcattagcaagcagaactctct

SEQ ID NO: 425807 - DNA, 25 bp, Mus musculus
gaagcattagcatgcagaactctct

SEQ ID NO: 425808 - DNA, 25 bp, Mus musculus
gaagcattagctatctcagcatacg

SEQ ID NO: 425809 - DNA, 25 bp, Mus musculus
gaagcattagctttctcagcatacg

SEQ ID NO: 425810 - DNA, 25 bp, Mus musculus
gaagcattaggaacgtaggcagaac

SEQ ID NO: 425811 - DNA, 25 bp, Mus musculus
gaagcattaggatcgtaggcagaac

SEQ ID NO: 425812 - DNA, 25 bp, Mus musculus
gaagcattatccatgctgtcacctg

SEQ ID NO: 425813 - DNA, 25 bp, Mus musculus
gaagcattatccttgctgtcacctg

SEQ ID NO: 425814 - DNA, 25 bp, Mus musculus
gaagcattatcgactttatgtgatt

SEQ ID NO: 425815 - DNA, 25 bp, Mus musculus
gaagcattatcgtctttatgtgatt

SEQ ID NO: 425816 - DNA, 25 bp, Mus musculus
gaagcattatggagtcctcttccta

SEQ ID NO: 425817 - DNA, 25 bp, Mus musculus
gaagcattatggtgtcctcttccta

SEQ ID NO: 425818 - DNA, 25 bp, Mus musculus
gaagcattcaaacgattcagccaag

SEQ ID NO: 425819 - DNA, 25 bp, Mus musculus
gaagcattcaaaggattcagccaag

SEQ ID NO: 425820 - DNA, 25 bp, Mus musculus
gaagcattcaacagagggtccatga

SEQ ID NO: 425821 - DNA, 25 bp, Mus musculus
gaagcattcaactgagggtccatga

SEQ ID NO: 425822 - DNA, 25 bp, Mus musculus
gaagcattcaccatctatcagtcac

SEQ ID NO: 425823 - DNA, 25 bp, Mus musculus
gaagcattcaccttctatcagtcac

SEQ ID NO: 425824 - DNA, 25 bp, Mus musculus
gaagcattcactagtgccttgttta

SEQ ID NO: 425825 - DNA, 25 bp, Mus musculus
gaagcattcacttgtgccttgttta

SEQ ID NO: 425826 - DNA, 25 bp, Mus musculus
gaagcattcagccaggagcagcgct

SEQ ID NO: 425827 - DNA, 25 bp, Mus musculus
gaagcattcagcgaggagcagcgct

SEQ ID NO: 425828 - DNA, 25 bp, Mus musculus
gaagcattcagtattcggctatccg

SEQ ID NO: 425829 - DNA, 25 bp, Mus musculus
gaagcattcagttttcggctatccg

SEQ ID NO: 425830 - DNA, 25 bp, Mus musculus
gaagcattccatagtcttgtagaga

SEQ ID NO: 425831 - DNA, 25 bp, Mus musculus
gaagcattccattgtcttgtagaga

SEQ ID NO: 425832 - DNA, 25 bp, Mus musculus
gaagcattccttctttgataatgtt

SEQ ID NO: 425833 - DNA, 25 bp, Mus musculus
gaagcattccttgtttgataatgtt

SEQ ID NO: 425834 - DNA, 25 bp, Mus musculus
gaagcattcgccacttctgagcttt

SEQ ID NO: 425835 - DNA, 25 bp, Mus musculus
gaagcattcgcctcttctgagcttt

SEQ ID NO: 425836 - DNA, 25 bp, Mus musculus
gaagcattcggtcacagacagggca

SEQ ID NO: 425837 - DNA, 25 bp, Mus musculus
gaagcattcggtgacagacagggca

SEQ ID NO: 425838 - DNA, 25 bp, Mus musculus
gaagcattctagagctatacaaaat

SEQ ID NO: 425839 - DNA, 25 bp, Mus musculus
gaagcattctagtgctatacaaaat

SEQ ID NO: 425840 - DNA, 25 bp, Mus musculus
gaagcattctcaatggaaatttagc

SEQ ID NO: 425841 - DNA, 25 bp, Mus musculus
gaagcattctcacgttatttaaaac

SEQ ID NO: 425842 - DNA, 25 bp, Mus musculus
gaagcattctcaggttatttaaaac

SEQ ID NO: 425843 - DNA, 25 bp, Mus musculus
gaagcattctcattggaaatttagc

SEQ ID NO: 425844 - DNA, 25 bp, Mus musculus
gaagcattgacactcactacacaaa

SEQ ID NO: 425845 - DNA, 25 bp, Mus musculus
gaagcattgacagtcactacacaaa

SEQ ID NO: 425846 - DNA, 25 bp, Mus musculus
gaagcattgcctctggtataccaat

SEQ ID NO: 425847 - DNA, 25 bp, Mus musculus
gaagcattgcctgtggtataccaat

SEQ ID NO: 425848 - DNA, 25 bp, Mus musculus
gaagcattgcttctgggaaattcaa

SEQ ID NO: 425849 - DNA, 25 bp, Mus musculus
gaagcattgcttgtgggaaattcaa

SEQ ID NO: 425850 - DNA, 25 bp, Mus musculus
gaagcattggccatggaggaccact

SEQ ID NO: 425851 - DNA, 25 bp, Mus musculus
gaagcattggccttggaggaccact

SEQ ID NO: 425852 - DNA, 25 bp, Mus musculus
gaagcattgtgcacacagagaccgt

SEQ ID NO: 425853 - DNA, 25 bp, Mus musculus
gaagcattgtgctcacagagaccgt

SEQ ID NO: 425854 - DNA, 25 bp, Mus musculus
gaagcattgtgtccatgtttcccct

SEQ ID NO: 425855 - DNA, 25 bp, Mus musculus
gaagcattgtgtgcatgtttcccct

SEQ ID NO: 425856 - DNA, 25 bp, Mus musculus
gaagcattgttgagcccagccatcc

SEQ ID NO: 425857 - DNA, 25 bp, Mus musculus
gaagcattgttgtgcccagccatcc

SEQ ID NO: 425858 - DNA, 25 bp, Mus musculus
gaagcatttactcagtccctttatg

SEQ ID NO: 425859 - DNA, 25 bp, Mus musculus
gaagcatttactgagtccctttatg

SEQ ID NO: 425860 - DNA, 25 bp, Mus musculus
gaagcatttcagcacatctgctaaa

SEQ ID NO: 425861 - DNA, 25 bp, Mus musculus
gaagcatttcaggacatctgctaaa

SEQ ID NO: 425862 - DNA, 25 bp, Mus musculus
gaagcatttccacgtctttccttcc

SEQ ID NO: 425863 - DNA, 25 bp, Mus musculus
gaagcatttccaggtctttccttcc

SEQ ID NO: 425864 - DNA, 25 bp, Mus musculus
gaagcatttcctaaatcggtggatg

SEQ ID NO: 425865 - DNA, 25 bp, Mus musculus
gaagcatttcctcgcctgtatcttt

SEQ ID NO: 425866 - DNA, 25 bp, Mus musculus
gaagcatttcctggcctgtatcttt

SEQ ID NO: 425867 - DNA, 25 bp, Mus musculus
gaagcatttccttaatcggtggatg

SEQ ID NO: 425868 - DNA, 25 bp, Mus musculus
gaagcatttctgagttacacctaat

SEQ ID NO: 425869 - DNA, 25 bp, Mus musculus
gaagcatttctgtgttacacctaat

SEQ ID NO: 425870 - DNA, 25 bp, Mus musculus
gaagcatttgagcatgaaaataaat

SEQ ID NO: 425871 - DNA, 25 bp, Mus musculus
gaagcatttgaggatgaaaataaat

SEQ ID NO: 425872 - DNA, 25 bp, Mus musculus
gaagcatttggccagtgacactctc

SEQ ID NO: 425873 - DNA, 25 bp, Mus musculus
gaagcatttggcgagtgacactctc

SEQ ID NO: 425874 - DNA, 25 bp, Mus musculus
gaagcatttgttcgccatgggagct

SEQ ID NO: 425875 - DNA, 25 bp, Mus musculus
gaagcatttgttggccatgggagct

SEQ ID NO: 425876 - DNA, 25 bp, Mus musculus
gaagcattttccaggctgattaaaa

SEQ ID NO: 425877 - DNA, 25 bp, Mus musculus
gaagcattttcctggctgattaaaa

SEQ ID NO: 425878 - DNA, 25 bp, Mus musculus
gaagcattttgcactctaggaagta

SEQ ID NO: 425879 - DNA, 25 bp, Mus musculus
gaagcattttgcactcttttgcatt

SEQ ID NO: 425880 - DNA, 25 bp, Mus musculus
gaagcattttgctctctaggaagta

SEQ ID NO: 425881 - DNA, 25 bp, Mus musculus
gaagcattttgctctcttttgcatt

SEQ ID NO: 425882 - DNA, 25 bp, Mus musculus
gaagcattttggacactgcctgtga

SEQ ID NO: 425883 - DNA, 25 bp, Mus musculus
gaagcattttggacagttggtggct

SEQ ID NO: 425884 - DNA, 25 bp, Mus musculus
gaagcattttggtcactgcctgtga

SEQ ID NO: 425885 - DNA, 25 bp, Mus musculus
gaagcattttggtcagttggtggct

SEQ ID NO: 425886 - DNA, 25 bp, Mus musculus
gaagccaaaaatccctaagacctgt

SEQ ID NO: 425887 - DNA, 25 bp, Mus musculus
gaagccaaaaatgcctaagacctgt

SEQ ID NO: 425888 - DNA, 25 bp, Mus musculus
gaagccaaaatccatgacaactgca

SEQ ID NO: 425889 - DNA, 25 bp, Mus musculus
gaagccaaaatcgatgacaactgca

SEQ ID NO: 425890 - DNA, 25 bp, Mus musculus
gaagccaaacaaagtatttctctta

SEQ ID NO: 425891 - DNA, 25 bp, Mus musculus
gaagccaaacaatgtatttctctta

SEQ ID NO: 425892 - DNA, 25 bp, Mus musculus
gaagccaaaccaagtcactatcagt

SEQ ID NO: 425893 - DNA, 25 bp, Mus musculus
gaagccaaaccaatagtcctgcatt

SEQ ID NO: 425894 - DNA, 25 bp, Mus musculus
gaagccaaaccactagggagagcag

SEQ ID NO: 425895 - DNA, 25 bp, Mus musculus
gaagccaaaccagtagggagagcag

SEQ ID NO: 425896 - DNA, 25 bp, Mus musculus
gaagccaaaccatgtcactatcagt

SEQ ID NO: 425897 - DNA, 25 bp, Mus musculus
gaagccaaaccattagtcctgcatt

SEQ ID NO: 425898 - DNA, 25 bp, Mus musculus
gaagccaaacttccactgacgggaa

SEQ ID NO: 425899 - DNA, 25 bp, Mus musculus
gaagccaaacttgcactgacgggaa

SEQ ID NO: 425900 - DNA, 25 bp, Mus musculus
gaagccaaagaactgctggtggaaa

SEQ ID NO: 425901 - DNA, 25 bp, Mus musculus
gaagccaaagaagtgctggtggaaa

SEQ ID NO: 425902 - DNA, 25 bp, Mus musculus
gaagccaaagctagaagacaagaat

SEQ ID NO: 425903 - DNA, 25 bp, Mus musculus
gaagccaaagcttgaagacaagaat

SEQ ID NO: 425904 - DNA, 25 bp, Mus musculus
gaagccaaaggtcccgtgtgtacaa

SEQ ID NO: 425905 - DNA, 25 bp, Mus musculus
gaagccaaaggtctcaacgctcctg

SEQ ID NO: 425906 - DNA, 25 bp, Mus musculus
gaagccaaaggtctctaatctgaag

SEQ ID NO: 425907 - DNA, 25 bp, Mus musculus
gaagccaaaggtgccgtgtgtacaa

SEQ ID NO: 425908 - DNA, 25 bp, Mus musculus
gaagccaaaggtgtcaacgctcctg

SEQ ID NO: 425909 - DNA, 25 bp, Mus musculus
gaagccaaaggtgtctaatctgaag

SEQ ID NO: 425910 - DNA, 25 bp, Mus musculus
gaagccaaagttatgatgcctgtca

SEQ ID NO: 425911 - DNA, 25 bp, Mus musculus
gaagccaaagttttgatgcctgtca

SEQ ID NO: 425912 - DNA, 25 bp, Mus musculus
gaagccaaatggcttcctctgtgaa

SEQ ID NO: 425913 - DNA, 25 bp, Mus musculus
gaagccaaatgggttcctctgtgaa

SEQ ID NO: 425914 - DNA, 25 bp, Mus musculus
gaagccaaatgtactgcaatactta

SEQ ID NO: 425915 - DNA, 25 bp, Mus musculus
gaagccaaatgtctggatttaaaac

SEQ ID NO: 425916 - DNA, 25 bp, Mus musculus
gaagccaaatgtgtggatttaaaac

SEQ ID NO: 425917 - DNA, 25 bp, Mus musculus
gaagccaaatgttctgcaatactta

SEQ ID NO: 425918 - DNA, 25 bp, Mus musculus
gaagccaacaacaaggctggccctg

SEQ ID NO: 425919 - DNA, 25 bp, Mus musculus
gaagccaacaactaggctggccctg

SEQ ID NO: 425920 - DNA, 25 bp, Mus musculus
gaagccaacagacatggccgcagtg

SEQ ID NO: 425921 - DNA, 25 bp, Mus musculus
gaagccaacagagatggccgcagtg

SEQ ID NO: 425922 - DNA, 25 bp, Mus musculus
gaagccaacagccattacggttatg

SEQ ID NO: 425923 - DNA, 25 bp, Mus musculus
gaagccaacagcgattacggttatg

SEQ ID NO: 425924 - DNA, 25 bp, Mus musculus
gaagccaacaggatcagtgactgct

SEQ ID NO: 425925 - DNA, 25 bp, Mus musculus
gaagccaacaggttcagtgactgct

SEQ ID NO: 425926 - DNA, 25 bp, Mus musculus
gaagccaaccatcctgaactgtcat

SEQ ID NO: 425927 - DNA, 25 bp, Mus musculus
gaagccaaccatgctgaactgtcat

SEQ ID NO: 425928 - DNA, 25 bp, Mus musculus
gaagccaaccctcaggatattcctt

SEQ ID NO: 425929 - DNA, 25 bp, Mus musculus
gaagccaaccctgaggatattcctt

SEQ ID NO: 425930 - DNA, 25 bp, Mus musculus
gaagccaacctcaaggaatcactcg

SEQ ID NO: 425931 - DNA, 25 bp, Mus musculus
gaagccaacctctaggaatcactcg

SEQ ID NO: 425932 - DNA, 25 bp, Mus musculus
gaagccaacctgcaattcagcacca

SEQ ID NO: 425933 - DNA, 25 bp, Mus musculus
gaagccaacctggaattcagcacca

SEQ ID NO: 425934 - DNA, 25 bp, Mus musculus
gaagccaacggcctgacgactctgt

SEQ ID NO: 425935 - DNA, 25 bp, Mus musculus
gaagccaacggcgtgacgactctgt

SEQ ID NO: 425936 - DNA, 25 bp, Mus musculus
gaagccaacgtcaatccaagaggaa

SEQ ID NO: 425937 - DNA, 25 bp, Mus musculus
gaagccaacgtctatccaagaggaa

SEQ ID NO: 425938 - DNA, 25 bp, Mus musculus
gaagccaactagcttgtctgccaga

SEQ ID NO: 425939 - DNA, 25 bp, Mus musculus
gaagccaactaggttgtctgccaga

SEQ ID NO: 425940 - DNA, 25 bp, Mus musculus
gaagccaactcgcacattcatgata

SEQ ID NO: 425941 - DNA, 25 bp, Mus musculus
gaagccaactcggacattcatgata

SEQ ID NO: 425942 - DNA, 25 bp, Mus musculus
gaagccaagaacattccagcctttc

SEQ ID NO: 425943 - DNA, 25 bp, Mus musculus
gaagccaagaactttccagcctttc

SEQ ID NO: 425944 - DNA, 25 bp, Mus musculus
gaagccaagcacatcgctgaggact

SEQ ID NO: 425945 - DNA, 25 bp, Mus musculus
gaagccaagcacttcgctgaggact

SEQ ID NO: 425946 - DNA, 25 bp, Mus musculus
gaagccaagccaagtaccattgcca

SEQ ID NO: 425947 - DNA, 25 bp, Mus musculus
gaagccaagccatgtaccattgcca

SEQ ID NO: 425948 - DNA, 25 bp, Mus musculus
gaagccaaggacagcactttgatca

SEQ ID NO: 425949 - DNA, 25 bp, Mus musculus
gaagccaaggactgcactttgatca

SEQ ID NO: 425950 - DNA, 25 bp, Mus musculus
gaagccaaggatcccgagagaacaa

SEQ ID NO: 425951 - DNA, 25 bp, Mus musculus
gaagccaaggatgccgagagaacaa

SEQ ID NO: 425952 - DNA, 25 bp, Mus musculus
gaagccaaggcgcaaaaggacatgt

SEQ ID NO: 425953 - DNA, 25 bp, Mus musculus
gaagccaaggcggaaaaggacatgt

SEQ ID NO: 425954 - DNA, 25 bp, Mus musculus
gaagccaaggtactcatctcctaat

SEQ ID NO: 425955 - DNA, 25 bp, Mus musculus
gaagccaaggtagtcatctcctaat

SEQ ID NO: 425956 - DNA, 25 bp, Mus musculus
gaagccaagtaactacccacagacg

SEQ ID NO: 425957 - DNA, 25 bp, Mus musculus
gaagccaagtaagtacccacagacg

SEQ ID NO: 425958 - DNA, 25 bp, Mus musculus
gaagccaagtaccacagggagtccc

SEQ ID NO: 425959 - DNA, 25 bp, Mus musculus
gaagccaagtacgacagggagtccc

SEQ ID NO: 425960 - DNA, 25 bp, Mus musculus
gaagccaagtctctaattgaacgtt

SEQ ID NO: 425961 - DNA, 25 bp, Mus musculus
gaagccaagtctgtaattgaacgtt

SEQ ID NO: 425962 - DNA, 25 bp, Mus musculus
gaagccaagttaactcaggaattat

SEQ ID NO: 425963 - DNA, 25 bp, Mus musculus
gaagccaagttatctcaggaattat

SEQ ID NO: 425964 - DNA, 25 bp, Mus musculus
gaagccaatcaacccgaggtccaat

SEQ ID NO: 425965 - DNA, 25 bp, Mus musculus
gaagccaatcaagccgaggtccaat

SEQ ID NO: 425966 - DNA, 25 bp, Mus musculus
gaagccaatggtaccggtttgctat

SEQ ID NO: 425967 - DNA, 25 bp, Mus musculus
gaagccaatggttccggtttgctat

SEQ ID NO: 425968 - DNA, 25 bp, Mus musculus
gaagccaatgtgacacagctaataa

SEQ ID NO: 425969 - DNA, 25 bp, Mus musculus
gaagccaatgtgtcacagctaataa

SEQ ID NO: 425970 - DNA, 25 bp, Mus musculus
gaagccaattccagcacagagcatg

SEQ ID NO: 425971 - DNA, 25 bp, Mus musculus
gaagccaattcctgcacagagcatg

SEQ ID NO: 425972 - DNA, 25 bp, Mus musculus
gaagccaattctaagggtttacgca

SEQ ID NO: 425973 - DNA, 25 bp, Mus musculus
gaagccaattcttagggtttacgca

SEQ ID NO: 425974 - DNA, 25 bp, Mus musculus
gaagccaattggaatttccctcaag

SEQ ID NO: 425975 - DNA, 25 bp, Mus musculus
gaagccaattggtatttccctcaag

SEQ ID NO: 425976 - DNA, 25 bp, Mus musculus
gaagccacaacaaaccctggcgtat

SEQ ID NO: 425977 - DNA, 25 bp, Mus musculus
gaagccacaacataccctggcgtat

SEQ ID NO: 425978 - DNA, 25 bp, Mus musculus
gaagccacacacatggcatgatgac

SEQ ID NO: 425979 - DNA, 25 bp, Mus musculus
gaagccacacacatttctgtatttt

SEQ ID NO: 425980 - DNA, 25 bp, Mus musculus
gaagccacacacttggcatgatgac

SEQ ID NO: 425981 - DNA, 25 bp, Mus musculus
gaagccacacacttttctgtatttt

SEQ ID NO: 425982 - DNA, 25 bp, Mus musculus
gaagccacacctaacgtgaagaaag

SEQ ID NO: 425983 - DNA, 25 bp, Mus musculus
gaagccacaccttacgtgaagaaag

SEQ ID NO: 425984 - DNA, 25 bp, Mus musculus
gaagccacagaaaggccactggata

SEQ ID NO: 425985 - DNA, 25 bp, Mus musculus
gaagccacagaatggccactggata

SEQ ID NO: 425986 - DNA, 25 bp, Mus musculus
gaagccacagaccacacaagacaga

SEQ ID NO: 425987 - DNA, 25 bp, Mus musculus
gaagccacagacgacacaagacaga

SEQ ID NO: 425988 - DNA, 25 bp, Mus musculus
gaagccacagatcacctggattgaa

SEQ ID NO: 425989 - DNA, 25 bp, Mus musculus
gaagccacagatgacctggattgaa

SEQ ID NO: 425990 - DNA, 25 bp, Mus musculus
gaagccacagtgcagacatgcatca

SEQ ID NO: 425991 - DNA, 25 bp, Mus musculus
gaagccacagtggagacatgcatca

SEQ ID NO: 425992 - DNA, 25 bp, Mus musculus
gaagccacatacatttcacttttcc

SEQ ID NO: 425993 - DNA, 25 bp, Mus musculus
gaagccacatacttttcacttttcc

SEQ ID NO: 425994 - DNA, 25 bp, Mus musculus
gaagccacatgacattcctcagcag

SEQ ID NO: 425995 - DNA, 25 bp, Mus musculus
gaagccacatgagattcctcagcag

SEQ ID NO: 425996 - DNA, 25 bp, Mus musculus
gaagccacatgcaagttgggcctct

SEQ ID NO: 425997 - DNA, 25 bp, Mus musculus
gaagccacatgctagttgggcctct

SEQ ID NO: 425998 - DNA, 25 bp, Mus musculus
gaagccacatggaactatggtacac

SEQ ID NO: 425999 - DNA, 25 bp, Mus musculus
gaagccacatggtactatggtacac

SEQ ID NO: 426000 - DNA, 25 bp, Mus musculus
gaagccaccacaacgtgttaaatgg

SEQ ID NO: 426001 - DNA, 25 bp, Mus musculus
gaagccaccacatcgtgttaaatgg

SEQ ID NO: 426002 - DNA, 25 bp, Mus musculus
gaagccaccactcaatgatcctaaa

SEQ ID NO: 426003 - DNA, 25 bp, Mus musculus
gaagccaccactgaatgatcctaaa

SEQ ID NO: 426004 - DNA, 25 bp, Mus musculus
gaagccaccagcaaaactgcagcca

SEQ ID NO: 426005 - DNA, 25 bp, Mus musculus
gaagccaccagctaaactgcagcca

SEQ ID NO: 426006 - DNA, 25 bp, Mus musculus
gaagccaccagtattcagtttgctg

SEQ ID NO: 426007 - DNA, 25 bp, Mus musculus
gaagccaccagttttcagtttgctg

SEQ ID NO: 426008 - DNA, 25 bp, Mus musculus
gaagccaccatgattgaccaaaaca

SEQ ID NO: 426009 - DNA, 25 bp, Mus musculus
gaagccaccatgtttgaccaaaaca

SEQ ID NO: 426010 - DNA, 25 bp, Mus musculus
gaagccacccgaatctagaggaagc

SEQ ID NO: 426011 - DNA, 25 bp, Mus musculus
gaagccacccgattctagaggaagc

SEQ ID NO: 426012 - DNA, 25 bp, Mus musculus
gaagccaccctgatcgaaagtctaa

SEQ ID NO: 426013 - DNA, 25 bp, Mus musculus
gaagccaccctgttcgaaagtctaa

SEQ ID NO: 426014 - DNA, 25 bp, Mus musculus
gaagccaccgatctccaaggttctg

SEQ ID NO: 426015 - DNA, 25 bp, Mus musculus
gaagccaccgatgtccaaggttctg

SEQ ID NO: 426016 - DNA, 25 bp, Mus musculus
gaagccaccggcacagtccagagaa

SEQ ID NO: 426017 - DNA, 25 bp, Mus musculus
gaagccaccggctcagtccagagaa

SEQ ID NO: 426018 - DNA, 25 bp, Mus musculus
gaagccacctgaaccagaactgcac

SEQ ID NO: 426019 - DNA, 25 bp, Mus musculus
gaagccacctgatccagaactgcac

SEQ ID NO: 426020 - DNA, 25 bp, Mus musculus
gaagccacgcccacggctacggagg

SEQ ID NO: 426021 - DNA, 25 bp, Mus musculus
gaagccacgccctcggctacggagg

SEQ ID NO: 426022 - DNA, 25 bp, Mus musculus
gaagccacgggaagctacttgcttt

SEQ ID NO: 426023 - DNA, 25 bp, Mus musculus
gaagccacgggatgctacttgcttt

SEQ ID NO: 426024 - DNA, 25 bp, Mus musculus
gaagccacgttacttcaaccccaat

SEQ ID NO: 426025 - DNA, 25 bp, Mus musculus
gaagccacgttagttcaaccccaat

SEQ ID NO: 426026 - DNA, 25 bp, Mus musculus
gaagccactactacctagtacaagt

SEQ ID NO: 426027 - DNA, 25 bp, Mus musculus
gaagccactacttcctagtacaagt

SEQ ID NO: 426028 - DNA, 25 bp, Mus musculus
gaagccactcacaggaaggccctgt

SEQ ID NO: 426029 - DNA, 25 bp, Mus musculus
gaagccactcactggaaggccctgt

SEQ ID NO: 426030 - DNA, 25 bp, Mus musculus
gaagccactccaagtactgggttat

SEQ ID NO: 426031 - DNA, 25 bp, Mus musculus
gaagccactccatgtactgggttat

SEQ ID NO: 426032 - DNA, 25 bp, Mus musculus
gaagccactctgagccatataatga

SEQ ID NO: 426033 - DNA, 25 bp, Mus musculus
gaagccactctgtgccatataatga

SEQ ID NO: 426034 - DNA, 25 bp, Mus musculus
gaagccactgaactggaaatgcaca

SEQ ID NO: 426035 - DNA, 25 bp, Mus musculus
gaagccactgaactgtttcacccat

SEQ ID NO: 426036 - DNA, 25 bp, Mus musculus
gaagccactgaagtggaaatgcaca

SEQ ID NO: 426037 - DNA, 25 bp, Mus musculus
gaagccactgaagtgtttcacccat

SEQ ID NO: 426038 - DNA, 25 bp, Mus musculus
gaagccactgacatctgcgagtgtg

SEQ ID NO: 426039 - DNA, 25 bp, Mus musculus
gaagccactgacttctgcgagtgtg

SEQ ID NO: 426040 - DNA, 25 bp, Mus musculus
gaagccactgcgcttgactgaaaag

SEQ ID NO: 426041 - DNA, 25 bp, Mus musculus
gaagccactgcggttgactgaaaag

SEQ ID NO: 426042 - DNA, 25 bp, Mus musculus
gaagccactggaaccttgcctaggt

SEQ ID NO: 426043 - DNA, 25 bp, Mus musculus
gaagccactggatccttgcctaggt

SEQ ID NO: 426044 - DNA, 25 bp, Mus musculus
gaagccactggcaagatcacatttg

SEQ ID NO: 426045 - DNA, 25 bp, Mus musculus
gaagccactggctagatcacatttg

SEQ ID NO: 426046 - DNA, 25 bp, Mus musculus
gaagccactgggaatttgaaacagc

SEQ ID NO: 426047 - DNA, 25 bp, Mus musculus
gaagccactgggatccaatcgtcaa

SEQ ID NO: 426048 - DNA, 25 bp, Mus musculus
gaagccactgggtatttgaaacagc

SEQ ID NO: 426049 - DNA, 25 bp, Mus musculus
gaagccactgggttccaatcgtcaa

SEQ ID NO: 426050 - DNA, 25 bp, Mus musculus
gaagccactgtaagatcggtaccga

SEQ ID NO: 426051 - DNA, 25 bp, Mus musculus
gaagccactgtatgatcggtaccga

SEQ ID NO: 426052 - DNA, 25 bp, Mus musculus
gaagccactgtgagaccactgatgt

SEQ ID NO: 426053 - DNA, 25 bp, Mus musculus
gaagccactgtgctatgacatatat

SEQ ID NO: 426054 - DNA, 25 bp, Mus musculus
gaagccactgtggtatgacatatat

SEQ ID NO: 426055 - DNA, 25 bp, Mus musculus
gaagccactgtgtgaccactgatgt

SEQ ID NO: 426056 - DNA, 25 bp, Mus musculus
gaagccactgttcttttgacactca

SEQ ID NO: 426057 - DNA, 25 bp, Mus musculus
gaagccactgttgttttgacactca

SEQ ID NO: 426058 - DNA, 25 bp, Mus musculus
gaagccacttaaagactatgcccca

SEQ ID NO: 426059 - DNA, 25 bp, Mus musculus
gaagccacttaatgactatgcccca

SEQ ID NO: 426060 - DNA, 25 bp, Mus musculus
gaagccacttcacagcaagctattg

SEQ ID NO: 426061 - DNA, 25 bp, Mus musculus
gaagccacttcagagcaagctattg

SEQ ID NO: 426062 - DNA, 25 bp, Mus musculus
gaagccacttgacgtgggccccttg

SEQ ID NO: 426063 - DNA, 25 bp, Mus musculus
gaagccacttgaggtgggccccttg

SEQ ID NO: 426064 - DNA, 25 bp, Mus musculus
gaagccacttgtcttctaagcagaa

SEQ ID NO: 426065 - DNA, 25 bp, Mus musculus
gaagccacttgtgttctaagcagaa

SEQ ID NO: 426066 - DNA, 25 bp, Mus musculus
gaagccactttcaccatgactttct

SEQ ID NO: 426067 - DNA, 25 bp, Mus musculus
gaagccactttctccatgactttct

SEQ ID NO: 426068 - DNA, 25 bp, Mus musculus
gaagccagaaaaagttacgattcct

SEQ ID NO: 426069 - DNA, 25 bp, Mus musculus
gaagccagaaaacatcgttctgcag

SEQ ID NO: 426070 - DNA, 25 bp, Mus musculus
gaagccagaaaagatcgttctgcag

SEQ ID NO: 426071 - DNA, 25 bp, Mus musculus
gaagccagaaaatgttacgattcct

SEQ ID NO: 426072 - DNA, 25 bp, Mus musculus
gaagccagaaagaagggcacacact

SEQ ID NO: 426073 - DNA, 25 bp, Mus musculus
gaagccagaaagtagggcacacact

SEQ ID NO: 426074 - DNA, 25 bp, Mus musculus
gaagccagaacactgttccagaaaa

SEQ ID NO: 426075 - DNA, 25 bp, Mus musculus
gaagccagaacagtgttccagaaaa

SEQ ID NO: 426076 - DNA, 25 bp, Mus musculus
gaagccagaagtcttcttctcctgg

SEQ ID NO: 426077 - DNA, 25 bp, Mus musculus
gaagccagaagtgttcttctcctgg

SEQ ID NO: 426078 - DNA, 25 bp, Mus musculus
gaagccagaatcaccttgggctgca

SEQ ID NO: 426079 - DNA, 25 bp, Mus musculus
gaagccagaatctccttgggctgca

SEQ ID NO: 426080 - DNA, 25 bp, Mus musculus
gaagccagactgactagagcaccct

SEQ ID NO: 426081 - DNA, 25 bp, Mus musculus
gaagccagactgtctagagcaccct

SEQ ID NO: 426082 - DNA, 25 bp, Mus musculus
gaagccagagaacaagccagctgaa

SEQ ID NO: 426083 - DNA, 25 bp, Mus musculus
gaagccagagaagaagccagctgaa

SEQ ID NO: 426084 - DNA, 25 bp, Mus musculus
gaagccagagataaaaccacagcct

SEQ ID NO: 426085 - DNA, 25 bp, Mus musculus
gaagccagagattaaaccacagcct

SEQ ID NO: 426086 - DNA, 25 bp, Mus musculus
gaagccagagccagtgcaaccaaga

SEQ ID NO: 426087 - DNA, 25 bp, Mus musculus
gaagccagagcctgtgcaaccaaga

SEQ ID NO: 426088 - DNA, 25 bp, Mus musculus
gaagccagataactgatacagttct

SEQ ID NO: 426089 - DNA, 25 bp, Mus musculus
gaagccagataagtgatacagttct

SEQ ID NO: 426090 - DNA, 25 bp, Mus musculus
gaagccagatccattatttcctgtt

SEQ ID NO: 426091 - DNA, 25 bp, Mus musculus
gaagccagatcctttatttcctgtt

SEQ ID NO: 426092 - DNA, 25 bp, Mus musculus
gaagccagatggaggcatccagact

SEQ ID NO: 426093 - DNA, 25 bp, Mus musculus
gaagccagatggtggcatccagact

SEQ ID NO: 426094 - DNA, 25 bp, Mus musculus
gaagccagcaacagtatggctgcag

SEQ ID NO: 426095 - DNA, 25 bp, Mus musculus
gaagccagcaactgtatggctgcag

SEQ ID NO: 426096 - DNA, 25 bp, Mus musculus
gaagccagcattattggtcactagc

SEQ ID NO: 426097 - DNA, 25 bp, Mus musculus
gaagccagcatttttggtcactagc

SEQ ID NO: 426098 - DNA, 25 bp, Mus musculus
gaagccagccaaatccaaggcggca

SEQ ID NO: 426099 - DNA, 25 bp, Mus musculus
gaagccagccaattccaaggcggca

SEQ ID NO: 426100 - DNA, 25 bp, Mus musculus
gaagccagccatctttctgaaaata

SEQ ID NO: 426101 - DNA, 25 bp, Mus musculus
gaagccagccatgtttctgaaaata

SEQ ID NO: 426102 - DNA, 25 bp, Mus musculus
gaagccagcccgaggactgccgtgc

SEQ ID NO: 426103 - DNA, 25 bp, Mus musculus
gaagccagcccgtggactgccgtgc

SEQ ID NO: 426104 - DNA, 25 bp, Mus musculus
gaagccagcctgacggtttcaggag

SEQ ID NO: 426105 - DNA, 25 bp, Mus musculus
gaagccagcctgtcggtttcaggag

SEQ ID NO: 426106 - DNA, 25 bp, Mus musculus
gaagccagcgaacattttgatcagt

SEQ ID NO: 426107 - DNA, 25 bp, Mus musculus
gaagccagcgaagattttgatcagt

SEQ ID NO: 426108 - DNA, 25 bp, Mus musculus
gaagccagctagacttaggatctct

SEQ ID NO: 426109 - DNA, 25 bp, Mus musculus
gaagccagctagtcttaggatctct

SEQ ID NO: 426110 - DNA, 25 bp, Mus musculus
gaagccagctgcacttgctaaggct

SEQ ID NO: 426111 - DNA, 25 bp, Mus musculus
gaagccagctgctcttgctaaggct

SEQ ID NO: 426112 - DNA, 25 bp, Mus musculus
gaagccagctggattactgagatga

SEQ ID NO: 426113 - DNA, 25 bp, Mus musculus
gaagccagctggtttactgagatga

SEQ ID NO: 426114 - DNA, 25 bp, Mus musculus
gaagccagcttaactgtcacatgca

SEQ ID NO: 426115 - DNA, 25 bp, Mus musculus
gaagccagcttatctgtcacatgca

SEQ ID NO: 426116 - DNA, 25 bp, Mus musculus
gaagccagcttcatggcgcgtcaag

SEQ ID NO: 426117 - DNA, 25 bp, Mus musculus
gaagccagcttcattggagcctttt

SEQ ID NO: 426118 - DNA, 25 bp, Mus musculus
gaagccagcttcttggcgcgtcaag

SEQ ID NO: 426119 - DNA, 25 bp, Mus musculus
gaagccagcttctttggagcctttt

SEQ ID NO: 426120 - DNA, 25 bp, Mus musculus
gaagccaggaaacctcgacgcgaaa

SEQ ID NO: 426121 - DNA, 25 bp, Mus musculus
gaagccaggaaagctcgacgcgaaa

SEQ ID NO: 426122 - DNA, 25 bp, Mus musculus
gaagccaggactattgattaagatt

SEQ ID NO: 426123 - DNA, 25 bp, Mus musculus
gaagccaggacttttgattaagatt

SEQ ID NO: 426124 - DNA, 25 bp, Mus musculus
gaagccaggagtactgaagcccatt

SEQ ID NO: 426125 - DNA, 25 bp, Mus musculus
gaagccaggagtctacactcaagtc

SEQ ID NO: 426126 - DNA, 25 bp, Mus musculus
gaagccaggagtgtacactcaagtc

SEQ ID NO: 426127 - DNA, 25 bp, Mus musculus
gaagccaggagttctgaagcccatt

SEQ ID NO: 426128 - DNA, 25 bp, Mus musculus
gaagccaggattatcttgagaacgt

SEQ ID NO: 426129 - DNA, 25 bp, Mus musculus
gaagccaggattccacgttagtgct

SEQ ID NO: 426130 - DNA, 25 bp, Mus musculus
gaagccaggattgcacgttagtgct

SEQ ID NO: 426131 - DNA, 25 bp, Mus musculus
gaagccaggattttcttgagaacgt

SEQ ID NO: 426132 - DNA, 25 bp, Mus musculus
gaagccaggctgaacatcctacggg

SEQ ID NO: 426133 - DNA, 25 bp, Mus musculus
gaagccaggctgtacatcctacggg

SEQ ID NO: 426134 - DNA, 25 bp, Mus musculus
gaagccaggcttagcttagcctatt

SEQ ID NO: 426135 - DNA, 25 bp, Mus musculus
gaagccaggcttcacatggacaaga

SEQ ID NO: 426136 - DNA, 25 bp, Mus musculus
gaagccaggcttgacatggacaaga

SEQ ID NO: 426137 - DNA, 25 bp, Mus musculus
gaagccaggctttgcttagcctatt

SEQ ID NO: 426138 - DNA, 25 bp, Mus musculus
gaagccagggcacaaaacaagtcaa

SEQ ID NO: 426139 - DNA, 25 bp, Mus musculus
gaagccagggcactgtttctctgag

SEQ ID NO: 426140 - DNA, 25 bp, Mus musculus
gaagccagggcagaaaacaagtcaa

SEQ ID NO: 426141 - DNA, 25 bp, Mus musculus
gaagccagggcagtgtttctctgag

SEQ ID NO: 426142 - DNA, 25 bp, Mus musculus
gaagccaggtatctaagcatttcag

SEQ ID NO: 426143 - DNA, 25 bp, Mus musculus
gaagccaggtatgtaagcatttcag

SEQ ID NO: 426144 - DNA, 25 bp, Mus musculus
gaagccaggtgtccaggtcattgtt

SEQ ID NO: 426145 - DNA, 25 bp, Mus musculus
gaagccaggtgtgcaggtcattgtt

SEQ ID NO: 426146 - DNA, 25 bp, Mus musculus
gaagccagtattaaccacctcattt

SEQ ID NO: 426147 - DNA, 25 bp, Mus musculus
gaagccagtatttaccacctcattt

SEQ ID NO: 426148 - DNA, 25 bp, Mus musculus
gaagccagtcctaactcatagctaa

SEQ ID NO: 426149 - DNA, 25 bp, Mus musculus
gaagccagtccttactcatagctaa

SEQ ID NO: 426150 - DNA, 25 bp, Mus musculus
gaagccagtcgacctggttgtcaga

SEQ ID NO: 426151 - DNA, 25 bp, Mus musculus
gaagccagtcgagctggttgtcaga

SEQ ID NO: 426152 - DNA, 25 bp, Mus musculus
gaagccagtcttccctatgaaacgg

SEQ ID NO: 426153 - DNA, 25 bp, Mus musculus
gaagccagtcttgcctatgaaacgg

SEQ ID NO: 426154 - DNA, 25 bp, Mus musculus
gaagccagtgagagaccatgtttca

SEQ ID NO: 426155 - DNA, 25 bp, Mus musculus
gaagccagtgagtgaccatgtttca

SEQ ID NO: 426156 - DNA, 25 bp, Mus musculus
gaagccagtggcatggtgactcagc

SEQ ID NO: 426157 - DNA, 25 bp, Mus musculus
gaagccagtggcttggtgactcagc

SEQ ID NO: 426158 - DNA, 25 bp, Mus musculus
gaagccagtgttatccgcatagaga

SEQ ID NO: 426159 - DNA, 25 bp, Mus musculus
gaagccagtgttttccgcatagaga

SEQ ID NO: 426160 - DNA, 25 bp, Mus musculus
gaagccagttcaccagggaccagat

SEQ ID NO: 426161 - DNA, 25 bp, Mus musculus
gaagccagttcagcagggaccagat

SEQ ID NO: 426162 - DNA, 25 bp, Mus musculus
gaagccagttgtaccatcagctgaa

SEQ ID NO: 426163 - DNA, 25 bp, Mus musculus
gaagccagttgtagagcatttaaca

SEQ ID NO: 426164 - DNA, 25 bp, Mus musculus
gaagccagttgttccatcagctgaa

SEQ ID NO: 426165 - DNA, 25 bp, Mus musculus
gaagccagttgttgagcatttaaca

SEQ ID NO: 426166 - DNA, 25 bp, Mus musculus
gaagccagtttcaagaatggtccac

SEQ ID NO: 426167 - DNA, 25 bp, Mus musculus
gaagccagtttctagaatggtccac

SEQ ID NO: 426168 - DNA, 25 bp, Mus musculus
gaagccataaagatggaaacatcaa

SEQ ID NO: 426169 - DNA, 25 bp, Mus musculus
gaagccataaagttggaaacatcaa

SEQ ID NO: 426170 - DNA, 25 bp, Mus musculus
gaagccataacaattagactgcaat

SEQ ID NO: 426171 - DNA, 25 bp, Mus musculus
gaagccataacatttagactgcaat

SEQ ID NO: 426172 - DNA, 25 bp, Mus musculus
gaagccataataactattttcctaa

SEQ ID NO: 426173 - DNA, 25 bp, Mus musculus
gaagccataatatctattttcctaa

SEQ ID NO: 426174 - DNA, 25 bp, Mus musculus
gaagccatagtcacattaataatag

SEQ ID NO: 426175 - DNA, 25 bp, Mus musculus
gaagccatagtctcattaataatag

SEQ ID NO: 426176 - DNA, 25 bp, Mus musculus
gaagccatattaatttctgacttat

SEQ ID NO: 426177 - DNA, 25 bp, Mus musculus
gaagccatattattttctgacttat

SEQ ID NO: 426178 - DNA, 25 bp, Mus musculus
gaagccatcaacaagagagtgcaga

SEQ ID NO: 426179 - DNA, 25 bp, Mus musculus
gaagccatcaactagagagtgcaga

SEQ ID NO: 426180 - DNA, 25 bp, Mus musculus
gaagccatcaagaagtctgtctcaa

SEQ ID NO: 426181 - DNA, 25 bp, Mus musculus
gaagccatcaagatctaccgtaggg

SEQ ID NO: 426182 - DNA, 25 bp, Mus musculus
gaagccatcaagtagtctgtctcaa

SEQ ID NO: 426183 - DNA, 25 bp, Mus musculus
gaagccatcaagttctaccgtaggg

SEQ ID NO: 426184 - DNA, 25 bp, Mus musculus
gaagccatcatcaatctggaccaag

SEQ ID NO: 426185 - DNA, 25 bp, Mus musculus
gaagccatcatctatctggaccaag

SEQ ID NO: 426186 - DNA, 25 bp, Mus musculus
gaagccatcatgctactgactctgc

SEQ ID NO: 426187 - DNA, 25 bp, Mus musculus
gaagccatcatggtactgactctgc

SEQ ID NO: 426188 - DNA, 25 bp, Mus musculus
gaagccatcattctttgggcagctt

SEQ ID NO: 426189 - DNA, 25 bp, Mus musculus
gaagccatcattgtttgggcagctt

SEQ ID NO: 426190 - DNA, 25 bp, Mus musculus
gaagccatccagagttgctgaggag

SEQ ID NO: 426191 - DNA, 25 bp, Mus musculus
gaagccatccagtgttgctgaggag

SEQ ID NO: 426192 - DNA, 25 bp, Mus musculus
gaagccatcgaaagtcttgaccctg

SEQ ID NO: 426193 - DNA, 25 bp, Mus musculus
gaagccatcgaatgtcttgaccctg

SEQ ID NO: 426194 - DNA, 25 bp, Mus musculus
gaagccatctacactacgagagttg

SEQ ID NO: 426195 - DNA, 25 bp, Mus musculus
gaagccatctactctacgagagttg

SEQ ID NO: 426196 - DNA, 25 bp, Mus musculus
gaagccatctcacaggaacgtcaag

SEQ ID NO: 426197 - DNA, 25 bp, Mus musculus
gaagccatctcagaggaacgtcaag

SEQ ID NO: 426198 - DNA, 25 bp, Mus musculus
gaagccatcttcatttccaaagcaa

SEQ ID NO: 426199 - DNA, 25 bp, Mus musculus
gaagccatcttcttttccaaagcaa

SEQ ID NO: 426200 - DNA, 25 bp, Mus musculus
gaagccatgaagctgtgcctagcca

SEQ ID NO: 426201 - DNA, 25 bp, Mus musculus
gaagccatgaaggtgtgcctagcca

SEQ ID NO: 426202 - DNA, 25 bp, Mus musculus
gaagccatgagaatagtcacagcag

SEQ ID NO: 426203 - DNA, 25 bp, Mus musculus
gaagccatgagattagtcacagcag

SEQ ID NO: 426204 - DNA, 25 bp, Mus musculus
gaagccatgatccagtgcagacaac

SEQ ID NO: 426205 - DNA, 25 bp, Mus musculus
gaagccatgatcgagtgcagacaac

SEQ ID NO: 426206 - DNA, 25 bp, Mus musculus
gaagccatgctaccaaagggcccaa

SEQ ID NO: 426207 - DNA, 25 bp, Mus musculus
gaagccatgctagcaaagggcccaa

SEQ ID NO: 426208 - DNA, 25 bp, Mus musculus
gaagccatgctccaggaaccagact

SEQ ID NO: 426209 - DNA, 25 bp, Mus musculus
gaagccatgctcctgacagcagcgg

SEQ ID NO: 426210 - DNA, 25 bp, Mus musculus
gaagccatgctcgaggaaccagact

SEQ ID NO: 426211 - DNA, 25 bp, Mus musculus
gaagccatgctcgtgacagcagcgg

SEQ ID NO: 426212 - DNA, 25 bp, Mus musculus
gaagccatgcttcagtgacctaact

SEQ ID NO: 426213 - DNA, 25 bp, Mus musculus
gaagccatgcttgagtgacctaact

SEQ ID NO: 426214 - DNA, 25 bp, Mus musculus
gaagccatggatctcactcttgtct

SEQ ID NO: 426215 - DNA, 25 bp, Mus musculus
gaagccatggatgtcactcttgtct

SEQ ID NO: 426216 - DNA, 25 bp, Mus musculus
gaagccatggcacactagactctat

SEQ ID NO: 426217 - DNA, 25 bp, Mus musculus
gaagccatggcagactagactctat

SEQ ID NO: 426218 - DNA, 25 bp, Mus musculus
gaagccatggccattctgggaaagc

SEQ ID NO: 426219 - DNA, 25 bp, Mus musculus
gaagccatggcctttctgggaaagc

SEQ ID NO: 426220 - DNA, 25 bp, Mus musculus
gaagccatggcgagtttaaaacttt

SEQ ID NO: 426221 - DNA, 25 bp, Mus musculus
gaagccatggcgtgtttaaaacttt

SEQ ID NO: 426222 - DNA, 25 bp, Mus musculus
gaagccatgggacccattggtggaa

SEQ ID NO: 426223 - DNA, 25 bp, Mus musculus
gaagccatgggagccattggtggaa

SEQ ID NO: 426224 - DNA, 25 bp, Mus musculus
gaagccatggtgagttgtagtctgc

SEQ ID NO: 426225 - DNA, 25 bp, Mus musculus
gaagccatggtgtgttgtagtctgc

SEQ ID NO: 426226 - DNA, 25 bp, Mus musculus
gaagccatggttaggttgatatgct

SEQ ID NO: 426227 - DNA, 25 bp, Mus musculus
gaagccatggtttggttgatatgct

SEQ ID NO: 426228 - DNA, 25 bp, Mus musculus
gaagccatgtaaatctgcacacagt

SEQ ID NO: 426229 - DNA, 25 bp, Mus musculus
gaagccatgtaattctgcacacagt

SEQ ID NO: 426230 - DNA, 25 bp, Mus musculus
gaagccatgtgcacaggtttgaatt

SEQ ID NO: 426231 - DNA, 25 bp, Mus musculus
gaagccatgtgctcaggtttgaatt

SEQ ID NO: 426232 - DNA, 25 bp, Mus musculus
gaagccatgtgtcgcgacgttccct

SEQ ID NO: 426233 - DNA, 25 bp, Mus musculus
gaagccatgtgtggcgacgttccct

SEQ ID NO: 426234 - DNA, 25 bp, Mus musculus
gaagccatgttaactccacagtcat

SEQ ID NO: 426235 - DNA, 25 bp, Mus musculus
gaagccatgttatctccacagtcat

SEQ ID NO: 426236 - DNA, 25 bp, Mus musculus
gaagccatgtttatacagcagcccg

SEQ ID NO: 426237 - DNA, 25 bp, Mus musculus
gaagccatgtttcgaagaccagccc

SEQ ID NO: 426238 - DNA, 25 bp, Mus musculus
gaagccatgtttggaagaccagccc

SEQ ID NO: 426239 - DNA, 25 bp, Mus musculus
gaagccatgtttttacagcagcccg

SEQ ID NO: 426240 - DNA, 25 bp, Mus musculus
gaagccattaagctgagcggactga

SEQ ID NO: 426241 - DNA, 25 bp, Mus musculus
gaagccattaaggtgagcggactga

SEQ ID NO: 426242 - DNA, 25 bp, Mus musculus
gaagccattagtcttgtctgagaga

SEQ ID NO: 426243 - DNA, 25 bp, Mus musculus
gaagccattagtgttgtctgagaga

SEQ ID NO: 426244 - DNA, 25 bp, Mus musculus
gaagccattatcagtggcccttctg

SEQ ID NO: 426245 - DNA, 25 bp, Mus musculus
gaagccattatctgtggcccttctg

SEQ ID NO: 426246 - DNA, 25 bp, Mus musculus
gaagccattcaaagatttgtcacca

SEQ ID NO: 426247 - DNA, 25 bp, Mus musculus
gaagccattcaatgatttgtcacca

SEQ ID NO: 426248 - DNA, 25 bp, Mus musculus
gaagccattccaacacctgggtaaa

SEQ ID NO: 426249 - DNA, 25 bp, Mus musculus
gaagccattccatcacctgggtaaa

SEQ ID NO: 426250 - DNA, 25 bp, Mus musculus
gaagccattctaactggtatctagt

SEQ ID NO: 426251 - DNA, 25 bp, Mus musculus
gaagccattctatctggtatctagt

SEQ ID NO: 426252 - DNA, 25 bp, Mus musculus
gaagccattctgaaggaagcggaaa

SEQ ID NO: 426253 - DNA, 25 bp, Mus musculus
gaagccattctgattctagatgttt

SEQ ID NO: 426254 - DNA, 25 bp, Mus musculus
gaagccattctgtaggaagcggaaa

SEQ ID NO: 426255 - DNA, 25 bp, Mus musculus
gaagccattctgtttctagatgttt

SEQ ID NO: 426256 - DNA, 25 bp, Mus musculus
gaagccattgaaaaactatgttttt

SEQ ID NO: 426257 - DNA, 25 bp, Mus musculus
gaagccattgaataactatgttttt

SEQ ID NO: 426258 - DNA, 25 bp, Mus musculus
gaagccattgagctcattcataagc

SEQ ID NO: 426259 - DNA, 25 bp, Mus musculus
gaagccattgaggtcattcataagc

SEQ ID NO: 426260 - DNA, 25 bp, Mus musculus
gaagccattgcacaacacagttatc

SEQ ID NO: 426261 - DNA, 25 bp, Mus musculus
gaagccattgcagaacacagttatc

SEQ ID NO: 426262 - DNA, 25 bp, Mus musculus
gaagccattgggagattgatccact

SEQ ID NO: 426263 - DNA, 25 bp, Mus musculus
gaagccattgggtgattgatccact

SEQ ID NO: 426264 - DNA, 25 bp, Mus musculus
gaagccatttgacaaagcctggaaa

SEQ ID NO: 426265 - DNA, 25 bp, Mus musculus
gaagccatttgaccagcacttaggt

SEQ ID NO: 426266 - DNA, 25 bp, Mus musculus
gaagccatttgagaaagcctggaaa

SEQ ID NO: 426267 - DNA, 25 bp, Mus musculus
gaagccatttgagcagcacttaggt

SEQ ID NO: 426268 - DNA, 25 bp, Mus musculus
gaagccatttggaggtaactcctcc

SEQ ID NO: 426269 - DNA, 25 bp, Mus musculus
gaagccatttggtggtaactcctcc

SEQ ID NO: 426270 - DNA, 25 bp, Mus musculus
gaagccattttgacttaattgctgg

SEQ ID NO: 426271 - DNA, 25 bp, Mus musculus
gaagccattttgataggctatatta

SEQ ID NO: 426272 - DNA, 25 bp, Mus musculus
gaagccattttgcactacagtcaaa

SEQ ID NO: 426273 - DNA, 25 bp, Mus musculus
gaagccattttggactacagtcaaa

SEQ ID NO: 426274 - DNA, 25 bp, Mus musculus
gaagccattttgtcttaattgctgg

SEQ ID NO: 426275 - DNA, 25 bp, Mus musculus
gaagccattttgttaggctatatta

SEQ ID NO: 426276 - DNA, 25 bp, Mus musculus
gaagcccaaaacctgactgctgggc

SEQ ID NO: 426277 - DNA, 25 bp, Mus musculus
gaagcccaaaacctgcagttgcctg

SEQ ID NO: 426278 - DNA, 25 bp, Mus musculus
gaagcccaaaacgtgactgctgggc

SEQ ID NO: 426279 - DNA, 25 bp, Mus musculus
gaagcccaaaacgtgcagttgcctg

SEQ ID NO: 426280 - DNA, 25 bp, Mus musculus
gaagcccaaaccaggaggattccat

SEQ ID NO: 426281 - DNA, 25 bp, Mus musculus
gaagcccaaaccatatataccagac

SEQ ID NO: 426282 - DNA, 25 bp, Mus musculus
gaagcccaaacctggaggattccat

SEQ ID NO: 426283 - DNA, 25 bp, Mus musculus
gaagcccaaaccttatataccagac

SEQ ID NO: 426284 - DNA, 25 bp, Mus musculus
gaagcccaacttcagacaagacttt

SEQ ID NO: 426285 - DNA, 25 bp, Mus musculus
gaagcccaacttgagacaagacttt

SEQ ID NO: 426286 - DNA, 25 bp, Mus musculus
gaagcccaagacaccagcctaggag

SEQ ID NO: 426287 - DNA, 25 bp, Mus musculus
gaagcccaagacatcatgtggtgtg

SEQ ID NO: 426288 - DNA, 25 bp, Mus musculus
gaagcccaagactccagcctaggag

SEQ ID NO: 426289 - DNA, 25 bp, Mus musculus
gaagcccaagacttcatgtggtgtg

SEQ ID NO: 426290 - DNA, 25 bp, Mus musculus
gaagcccaagatcaacagtggttaa

SEQ ID NO: 426291 - DNA, 25 bp, Mus musculus
gaagcccaagatgaacagtggttaa

SEQ ID NO: 426292 - DNA, 25 bp, Mus musculus
gaagcccaagcaaggtaccatatca

SEQ ID NO: 426293 - DNA, 25 bp, Mus musculus
gaagcccaagcatggtaccatatca

SEQ ID NO: 426294 - DNA, 25 bp, Mus musculus
gaagcccaagcgcacaagtattcca

SEQ ID NO: 426295 - DNA, 25 bp, Mus musculus
gaagcccaagcggacaagtattcca

SEQ ID NO: 426296 - DNA, 25 bp, Mus musculus
gaagcccaaggcagaggacttaaga

SEQ ID NO: 426297 - DNA, 25 bp, Mus musculus
gaagcccaaggctgaggacttaaga

SEQ ID NO: 426298 - DNA, 25 bp, Mus musculus
gaagcccaagggatgcctcggagtc

SEQ ID NO: 426299 - DNA, 25 bp, Mus musculus
gaagcccaagggttgcctcggagtc

SEQ ID NO: 426300 - DNA, 25 bp, Mus musculus
gaagcccaaggtagaaagctgtcac

SEQ ID NO: 426301 - DNA, 25 bp, Mus musculus
gaagcccaaggttgaaagctgtcac

SEQ ID NO: 426302 - DNA, 25 bp, Mus musculus
gaagcccaagtaatcaaagatccaa

SEQ ID NO: 426303 - DNA, 25 bp, Mus musculus
gaagcccaagtattcaaagatccaa

SEQ ID NO: 426304 - DNA, 25 bp, Mus musculus
gaagcccaccataatcactaactta

SEQ ID NO: 426305 - DNA, 25 bp, Mus musculus
gaagcccaccattatcactaactta

SEQ ID NO: 426306 - DNA, 25 bp, Mus musculus
gaagcccacctaccactatttttgt

SEQ ID NO: 426307 - DNA, 25 bp, Mus musculus
gaagcccacctacggcatgcactaa

SEQ ID NO: 426308 - DNA, 25 bp, Mus musculus
gaagcccacctagcactatttttgt

SEQ ID NO: 426309 - DNA, 25 bp, Mus musculus
gaagcccacctagggcatgcactaa

SEQ ID NO: 426310 - DNA, 25 bp, Mus musculus
gaagcccactccaggaactatgcaa

SEQ ID NO: 426311 - DNA, 25 bp, Mus musculus
gaagcccactcctggaactatgcaa

SEQ ID NO: 426312 - DNA, 25 bp, Mus musculus
gaagcccactgaaagattttccact

SEQ ID NO: 426313 - DNA, 25 bp, Mus musculus
gaagcccactgatagattttccact

SEQ ID NO: 426314 - DNA, 25 bp, Mus musculus
gaagcccacttcaaggaggtgaggt

SEQ ID NO: 426315 - DNA, 25 bp, Mus musculus
gaagcccacttctaggaggtgaggt

SEQ ID NO: 426316 - DNA, 25 bp, Mus musculus
gaagcccagaaaagtgtcctgagaa

SEQ ID NO: 426317 - DNA, 25 bp, Mus musculus
gaagcccagaaatgtgtcctgagaa

SEQ ID NO: 426318 - DNA, 25 bp, Mus musculus
gaagcccagacaaaacagtggcccc

SEQ ID NO: 426319 - DNA, 25 bp, Mus musculus
gaagcccagacataacagtggcccc

SEQ ID NO: 426320 - DNA, 25 bp, Mus musculus
gaagcccagaccacatagggtcaga

SEQ ID NO: 426321 - DNA, 25 bp, Mus musculus
gaagcccagacctcatagggtcaga

SEQ ID NO: 426322 - DNA, 25 bp, Mus musculus
gaagcccagagtaccacgagtatca

SEQ ID NO: 426323 - DNA, 25 bp, Mus musculus
gaagcccagagtcttgcaatacaat

SEQ ID NO: 426324 - DNA, 25 bp, Mus musculus
gaagcccagagtgttgcaatacaat

SEQ ID NO: 426325 - DNA, 25 bp, Mus musculus
gaagcccagagttccacgagtatca

SEQ ID NO: 426326 - DNA, 25 bp, Mus musculus
gaagcccagataagatcgccaattg

SEQ ID NO: 426327 - DNA, 25 bp, Mus musculus
gaagcccagatatgatcgccaattg

SEQ ID NO: 426328 - DNA, 25 bp, Mus musculus
gaagcccagcagaaaacgttaccag

SEQ ID NO: 426329 - DNA, 25 bp, Mus musculus
gaagcccagcagatttggcctggca

SEQ ID NO: 426330 - DNA, 25 bp, Mus musculus
gaagcccagcagtaaacgttaccag

SEQ ID NO: 426331 - DNA, 25 bp, Mus musculus
gaagcccagcagttttggcctggca

SEQ ID NO: 426332 - DNA, 25 bp, Mus musculus
gaagcccagcctctgatggaactaa

SEQ ID NO: 426333 - DNA, 25 bp, Mus musculus
gaagcccagcctgtgatggaactaa

SEQ ID NO: 426334 - DNA, 25 bp, Mus musculus
gaagcccagcttatgcaggaatggt

SEQ ID NO: 426335 - DNA, 25 bp, Mus musculus
gaagcccagcttttgcaggaatggt

SEQ ID NO: 426336 - DNA, 25 bp, Mus musculus
gaagcccaggctaacaggaacactg

SEQ ID NO: 426337 - DNA, 25 bp, Mus musculus
gaagcccaggctcgttttgaacttg

SEQ ID NO: 426338 - DNA, 25 bp, Mus musculus
gaagcccaggctggttttgaacttg

SEQ ID NO: 426339 - DNA, 25 bp, Mus musculus
gaagcccaggcttacaggaacactg

SEQ ID NO: 426340 - DNA, 25 bp, Mus musculus
gaagcccagggaacatattctcaga

SEQ ID NO: 426341 - DNA, 25 bp, Mus musculus
gaagcccagggatcatattctcaga

SEQ ID NO: 426342 - DNA, 25 bp, Mus musculus
gaagcccaggtaagaggttcccgct

SEQ ID NO: 426343 - DNA, 25 bp, Mus musculus
gaagcccaggtatgaggttcccgct

SEQ ID NO: 426344 - DNA, 25 bp, Mus musculus
gaagcccagtgcatttgggcagcct

SEQ ID NO: 426345 - DNA, 25 bp, Mus musculus
gaagcccagtgcttttgggcagcct

SEQ ID NO: 426346 - DNA, 25 bp, Mus musculus
gaagcccagtgtaaggtataattct

SEQ ID NO: 426347 - DNA, 25 bp, Mus musculus
gaagcccagtgttaggtataattct

SEQ ID NO: 426348 - DNA, 25 bp, Mus musculus
gaagcccagttaagcactctgagtt

SEQ ID NO: 426349 - DNA, 25 bp, Mus musculus
gaagcccagttatgcactctgagtt

SEQ ID NO: 426350 - DNA, 25 bp, Mus musculus
gaagcccatagaaattgtgagagat

SEQ ID NO: 426351 - DNA, 25 bp, Mus musculus
gaagcccatagatattgtgagagat

SEQ ID NO: 426352 - DNA, 25 bp, Mus musculus
gaagcccatattaattagcatctaa

SEQ ID NO: 426353 - DNA, 25 bp, Mus musculus
gaagcccatatttattagcatctaa

SEQ ID NO: 426354 - DNA, 25 bp, Mus musculus
gaagcccatccacgtatgccaagtg

SEQ ID NO: 426355 - DNA, 25 bp, Mus musculus
gaagcccatccaggtatgccaagtg

SEQ ID NO: 426356 - DNA, 25 bp, Mus musculus
gaagcccatctgcaccacagagtaa

SEQ ID NO: 426357 - DNA, 25 bp, Mus musculus
gaagcccatctggaccacagagtaa

SEQ ID NO: 426358 - DNA, 25 bp, Mus musculus
gaagcccatggaagctcccccttgt

SEQ ID NO: 426359 - DNA, 25 bp, Mus musculus
gaagcccatggatgctcccccttgt

SEQ ID NO: 426360 - DNA, 25 bp, Mus musculus
gaagcccatggtcactcataactgt

SEQ ID NO: 426361 - DNA, 25 bp, Mus musculus
gaagcccatggtgactcataactgt

SEQ ID NO: 426362 - DNA, 25 bp, Mus musculus
gaagcccatgtcattagacctgaga

SEQ ID NO: 426363 - DNA, 25 bp, Mus musculus
gaagcccatgtctttagacctgaga

SEQ ID NO: 426364 - DNA, 25 bp, Mus musculus
gaagcccatgtgcatgtgaagtttc

SEQ ID NO: 426365 - DNA, 25 bp, Mus musculus
gaagcccatgtggatgtgaagtttc

SEQ ID NO: 426366 - DNA, 25 bp, Mus musculus
gaagcccattaaagctgaaaaccct

SEQ ID NO: 426367 - DNA, 25 bp, Mus musculus
gaagcccattaactgggttccccat

SEQ ID NO: 426368 - DNA, 25 bp, Mus musculus
gaagcccattaagtgggttccccat

SEQ ID NO: 426369 - DNA, 25 bp, Mus musculus
gaagcccattaatgctgaaaaccct

SEQ ID NO: 426370 - DNA, 25 bp, Mus musculus
gaagcccattctatcactctgaact

SEQ ID NO: 426371 - DNA, 25 bp, Mus musculus
gaagcccattctttcactctgaact

SEQ ID NO: 426372 - DNA, 25 bp, Mus musculus
gaagcccattgcacgggaggccgta

SEQ ID NO: 426373 - DNA, 25 bp, Mus musculus
gaagcccattgctcgggaggccgta

SEQ ID NO: 426374 - DNA, 25 bp, Mus musculus
gaagcccatttaagttatctaagtg

SEQ ID NO: 426375 - DNA, 25 bp, Mus musculus
gaagcccatttatgttatctaagtg

SEQ ID NO: 426376 - DNA, 25 bp, Mus musculus
gaagcccatttgcttttccttggcc

SEQ ID NO: 426377 - DNA, 25 bp, Mus musculus
gaagcccatttggttttccttggcc

SEQ ID NO: 426378 - DNA, 25 bp, Mus musculus
gaagccccaacactttgatgtcatg

SEQ ID NO: 426379 - DNA, 25 bp, Mus musculus
gaagccccaacagtttgatgtcatg

SEQ ID NO: 426380 - DNA, 25 bp, Mus musculus
gaagccccaaccacttatgtactat

SEQ ID NO: 426381 - DNA, 25 bp, Mus musculus
gaagccccaacctcttatgtactat

SEQ ID NO: 426382 - DNA, 25 bp, Mus musculus
gaagccccaagtagaaactgatgtg

SEQ ID NO: 426383 - DNA, 25 bp, Mus musculus
gaagccccaagttgaaactgatgtg

SEQ ID NO: 426384 - DNA, 25 bp, Mus musculus
gaagccccacataaaatttgaacta

SEQ ID NO: 426385 - DNA, 25 bp, Mus musculus
gaagccccacattaaatttgaacta

SEQ ID NO: 426386 - DNA, 25 bp, Mus musculus
gaagccccaccaacttctgtgtgaa

SEQ ID NO: 426387 - DNA, 25 bp, Mus musculus
gaagccccaccaaggattgttggac

SEQ ID NO: 426388 - DNA, 25 bp, Mus musculus
gaagccccaccatcttctgtgtgaa

SEQ ID NO: 426389 - DNA, 25 bp, Mus musculus
gaagccccaccatggattgttggac

SEQ ID NO: 426390 - DNA, 25 bp, Mus musculus
gaagccccagaaatacctccaaagg

SEQ ID NO: 426391 - DNA, 25 bp, Mus musculus
gaagccccagaattacctccaaagg

SEQ ID NO: 426392 - DNA, 25 bp, Mus musculus
gaagccccagagacaactactagta

SEQ ID NO: 426393 - DNA, 25 bp, Mus musculus
gaagccccagagtcaactactagta

SEQ ID NO: 426394 - DNA, 25 bp, Mus musculus
gaagccccagccagtgatggtaact

SEQ ID NO: 426395 - DNA, 25 bp, Mus musculus
gaagccccagcctgtgatggtaact

SEQ ID NO: 426396 - DNA, 25 bp, Mus musculus
gaagccccaggcatatggagtttgg

SEQ ID NO: 426397 - DNA, 25 bp, Mus musculus
gaagccccaggcttatggagtttgg

SEQ ID NO: 426398 - DNA, 25 bp, Mus musculus
gaagccccatctcggaggtggactc

SEQ ID NO: 426399 - DNA, 25 bp, Mus musculus
gaagccccatctgggaggtggactc

SEQ ID NO: 426400 - DNA, 25 bp, Mus musculus
gaagccccatgacacagttgatcga

SEQ ID NO: 426401 - DNA, 25 bp, Mus musculus
gaagccccatgagacagttgatcga

SEQ ID NO: 426402 - DNA, 25 bp, Mus musculus
gaagccccatgtcattgtagcagga

SEQ ID NO: 426403 - DNA, 25 bp, Mus musculus
gaagccccatgtgattgtagcagga

SEQ ID NO: 426404 - DNA, 25 bp, Mus musculus
gaagccccgagactcagaaaactgt

SEQ ID NO: 426405 - DNA, 25 bp, Mus musculus
gaagccccgagagtcagaaaactgt

SEQ ID NO: 426406 - DNA, 25 bp, Mus musculus
gaagccccgaggaaactcaagctga

SEQ ID NO: 426407 - DNA, 25 bp, Mus musculus
gaagccccgaggtaactcaagctga

SEQ ID NO: 426408 - DNA, 25 bp, Mus musculus
gaagccccgagtagtcttcttaaag

SEQ ID NO: 426409 - DNA, 25 bp, Mus musculus
gaagccccgagttgtcttcttaaag

SEQ ID NO: 426410 - DNA, 25 bp, Mus musculus
gaagcccctatgatggtaggtgtca

SEQ ID NO: 426411 - DNA, 25 bp, Mus musculus
gaagcccctatgttggtaggtgtca

SEQ ID NO: 426412 - DNA, 25 bp, Mus musculus
gaagcccctcctcgtcagagggaaa

SEQ ID NO: 426413 - DNA, 25 bp, Mus musculus
gaagcccctcctggtcagagggaaa

SEQ ID NO: 426414 - DNA, 25 bp, Mus musculus
gaagcccctgaaacaaagaaccatg

SEQ ID NO: 426415 - DNA, 25 bp, Mus musculus
gaagcccctgaaacagcccaagaag

SEQ ID NO: 426416 - DNA, 25 bp, Mus musculus
gaagcccctgaaatttgctcagtgt

SEQ ID NO: 426417 - DNA, 25 bp, Mus musculus
gaagcccctgaatcaaagaaccatg

SEQ ID NO: 426418 - DNA, 25 bp, Mus musculus
gaagcccctgaatcagcccaagaag

SEQ ID NO: 426419 - DNA, 25 bp, Mus musculus
gaagcccctgaattttgctcagtgt

SEQ ID NO: 426420 - DNA, 25 bp, Mus musculus
gaagcccctgatatcagagcttttt

SEQ ID NO: 426421 - DNA, 25 bp, Mus musculus
gaagcccctgatttcagagcttttt

SEQ ID NO: 426422 - DNA, 25 bp, Mus musculus
gaagcccctgtacatagtgacggag

SEQ ID NO: 426423 - DNA, 25 bp, Mus musculus
gaagcccctgtagatagtgacggag

SEQ ID NO: 426424 - DNA, 25 bp, Mus musculus
gaagccccttcaaataccttcttca

SEQ ID NO: 426425 - DNA, 25 bp, Mus musculus
gaagccccttcatataccttcttca

SEQ ID NO: 426426 - DNA, 25 bp, Mus musculus
gaagccccttccaggcaaatgagag

SEQ ID NO: 426427 - DNA, 25 bp, Mus musculus
gaagccccttcctggcaaatgagag

SEQ ID NO: 426428 - DNA, 25 bp, Mus musculus
gaagcccgaactcaatgctcttata

SEQ ID NO: 426429 - DNA, 25 bp, Mus musculus
gaagcccgaactgaatgctcttata

SEQ ID NO: 426430 - DNA, 25 bp, Mus musculus
gaagcccgatgcaggtccatttaga

SEQ ID NO: 426431 - DNA, 25 bp, Mus musculus
gaagcccgatgctggtccatttaga

SEQ ID NO: 426432 - DNA, 25 bp, Mus musculus
gaagccctaagaagtttgtgccagg

SEQ ID NO: 426433 - DNA, 25 bp, Mus musculus
gaagccctaagatgtttgtgccagg

SEQ ID NO: 426434 - DNA, 25 bp, Mus musculus
gaagccctaagcactcacagacgaa

SEQ ID NO: 426435 - DNA, 25 bp, Mus musculus
gaagccctaagctctcacagacgaa

SEQ ID NO: 426436 - DNA, 25 bp, Mus musculus
gaagccctacagacaggtgcagcat

SEQ ID NO: 426437 - DNA, 25 bp, Mus musculus
gaagccctacagtcaggtgcagcat

SEQ ID NO: 426438 - DNA, 25 bp, Mus musculus
gaagccctacttcttacaactttct

SEQ ID NO: 426439 - DNA, 25 bp, Mus musculus
gaagccctacttgttacaactttct

SEQ ID NO: 426440 - DNA, 25 bp, Mus musculus
gaagccctagaccatggaatcctac

SEQ ID NO: 426441 - DNA, 25 bp, Mus musculus
gaagccctagacgatggaatcctac

SEQ ID NO: 426442 - DNA, 25 bp, Mus musculus
gaagccctagtacttctgaaggaac

SEQ ID NO: 426443 - DNA, 25 bp, Mus musculus
gaagccctagtagttctgaaggaac

SEQ ID NO: 426444 - DNA, 25 bp, Mus musculus
gaagccctataactggtgcccagtg

SEQ ID NO: 426445 - DNA, 25 bp, Mus musculus
gaagccctataagtggtgcccagtg

SEQ ID NO: 426446 - DNA, 25 bp, Mus musculus
gaagccctatagatgcgaccagtgt

SEQ ID NO: 426447 - DNA, 25 bp, Mus musculus
gaagccctatagttgcgaccagtgt

SEQ ID NO: 426448 - DNA, 25 bp, Mus musculus
gaagccctatctctcagtatcacca

SEQ ID NO: 426449 - DNA, 25 bp, Mus musculus
gaagccctatctgtcagtatcacca

SEQ ID NO: 426450 - DNA, 25 bp, Mus musculus
gaagccctcaacactcaggtctcaa

SEQ ID NO: 426451 - DNA, 25 bp, Mus musculus
gaagccctcaactctcaggtctcaa

SEQ ID NO: 426452 - DNA, 25 bp, Mus musculus
gaagccctcaagagaccctagggaa

SEQ ID NO: 426453 - DNA, 25 bp, Mus musculus
gaagccctcaagtgaccctagggaa

SEQ ID NO: 426454 - DNA, 25 bp, Mus musculus
gaagccctcagtatcttcatgagag

SEQ ID NO: 426455 - DNA, 25 bp, Mus musculus
gaagccctcagtttcttcatgagag

SEQ ID NO: 426456 - DNA, 25 bp, Mus musculus
gaagccctcattcttagttcttaga

SEQ ID NO: 426457 - DNA, 25 bp, Mus musculus
gaagccctcattgttagttcttaga

SEQ ID NO: 426458 - DNA, 25 bp, Mus musculus
gaagccctccagataactcttgttg

SEQ ID NO: 426459 - DNA, 25 bp, Mus musculus
gaagccctccagttaactcttgttg

SEQ ID NO: 426460 - DNA, 25 bp, Mus musculus
gaagccctcgaactgatccttgatg

SEQ ID NO: 426461 - DNA, 25 bp, Mus musculus
gaagccctcgaagtgatccttgatg

SEQ ID NO: 426462 - DNA, 25 bp, Mus musculus
gaagccctcgatcccaattctcgga

SEQ ID NO: 426463 - DNA, 25 bp, Mus musculus
gaagccctcgatgccaattctcgga

SEQ ID NO: 426464 - DNA, 25 bp, Mus musculus
gaagccctcgccctgcaattctgta

SEQ ID NO: 426465 - DNA, 25 bp, Mus musculus
gaagccctcgccgtgcaattctgta

SEQ ID NO: 426466 - DNA, 25 bp, Mus musculus
gaagccctgaaacgtgactctgatg

SEQ ID NO: 426467 - DNA, 25 bp, Mus musculus
gaagccctgaaaggtgactctgatg

SEQ ID NO: 426468 - DNA, 25 bp, Mus musculus
gaagccctgaacatgtacacatcca

SEQ ID NO: 426469 - DNA, 25 bp, Mus musculus
gaagccctgaacttgtacacatcca

SEQ ID NO: 426470 - DNA, 25 bp, Mus musculus
gaagccctgaagaatgagcacaact

SEQ ID NO: 426471 - DNA, 25 bp, Mus musculus
gaagccctgaagactttctcaaagt

SEQ ID NO: 426472 - DNA, 25 bp, Mus musculus
gaagccctgaagtatgagcacaact

SEQ ID NO: 426473 - DNA, 25 bp, Mus musculus
gaagccctgaagtctttctcaaagt

SEQ ID NO: 426474 - DNA, 25 bp, Mus musculus
gaagccctgacgagattgtgtttgt

SEQ ID NO: 426475 - DNA, 25 bp, Mus musculus
gaagccctgacgtgattgtgtttgt

SEQ ID NO: 426476 - DNA, 25 bp, Mus musculus
gaagccctgactagatctgtgtact

SEQ ID NO: 426477 - DNA, 25 bp, Mus musculus
gaagccctgacttgatctgtgtact

SEQ ID NO: 426478 - DNA, 25 bp, Mus musculus
gaagccctgagactaagcagcaccc

SEQ ID NO: 426479 - DNA, 25 bp, Mus musculus
gaagccctgagagtaagcagcaccc

SEQ ID NO: 426480 - DNA, 25 bp, Mus musculus
gaagccctgagcaagatttgccctg

SEQ ID NO: 426481 - DNA, 25 bp, Mus musculus
gaagccctgagctagatttgccctg

SEQ ID NO: 426482 - DNA, 25 bp, Mus musculus
gaagccctgcatagtggcctgcaga

SEQ ID NO: 426483 - DNA, 25 bp, Mus musculus
gaagccctgcatcatagattggaca

SEQ ID NO: 426484 - DNA, 25 bp, Mus musculus
gaagccctgcatgatagattggaca

SEQ ID NO: 426485 - DNA, 25 bp, Mus musculus
gaagccctgcattgtggcctgcaga

SEQ ID NO: 426486 - DNA, 25 bp, Mus musculus
gaagccctgcgactttacagaacaa

SEQ ID NO: 426487 - DNA, 25 bp, Mus musculus
gaagccctgcgagtttacagaacaa

SEQ ID NO: 426488 - DNA, 25 bp, Mus musculus
gaagccctggaaaaagccttggtca

SEQ ID NO: 426489 - DNA, 25 bp, Mus musculus
gaagccctggaataagccttggtca

SEQ ID NO: 426490 - DNA, 25 bp, Mus musculus
gaagccctggcacagaagttcttgg

SEQ ID NO: 426491 - DNA, 25 bp, Mus musculus
gaagccctggcagagaagttcttgg

SEQ ID NO: 426492 - DNA, 25 bp, Mus musculus
gaagccctggctcaatgcaaactgg

SEQ ID NO: 426493 - DNA, 25 bp, Mus musculus
gaagccctggctgaatgcaaactgg

SEQ ID NO: 426494 - DNA, 25 bp, Mus musculus
gaagccctgggcagcattgcacttg

SEQ ID NO: 426495 - DNA, 25 bp, Mus musculus
gaagccctgggcatagcaaccgtga

SEQ ID NO: 426496 - DNA, 25 bp, Mus musculus
gaagccctgggctgcattgcacttg

SEQ ID NO: 426497 - DNA, 25 bp, Mus musculus
gaagccctgggcttagcaaccgtga

SEQ ID NO: 426498 - DNA, 25 bp, Mus musculus
gaagccctgggtacgtcctttgaca

SEQ ID NO: 426499 - DNA, 25 bp, Mus musculus
gaagccctgggttcgtcctttgaca

SEQ ID NO: 426500 - DNA, 25 bp, Mus musculus
gaagccctggtcagtttgttcactg

SEQ ID NO: 426501 - DNA, 25 bp, Mus musculus
gaagccctggtctgtttgttcactg

SEQ ID NO: 426502 - DNA, 25 bp, Mus musculus
gaagccctgtagctactgaggcaga

SEQ ID NO: 426503 - DNA, 25 bp, Mus musculus
gaagccctgtaggtactgaggcaga

SEQ ID NO: 426504 - DNA, 25 bp, Mus musculus
gaagccctgtcgctcacatggaaag

SEQ ID NO: 426505 - DNA, 25 bp, Mus musculus
gaagccctgtcggtcacatggaaag

SEQ ID NO: 426506 - DNA, 25 bp, Mus musculus
gaagccctgtttaagatctccagta

SEQ ID NO: 426507 - DNA, 25 bp, Mus musculus
gaagccctgttttagatctccagta

SEQ ID NO: 426508 - DNA, 25 bp, Mus musculus
gaagcccttacacagaaaacttaag

SEQ ID NO: 426509 - DNA, 25 bp, Mus musculus
gaagcccttacagagaaaacttaag

SEQ ID NO: 426510 - DNA, 25 bp, Mus musculus
gaagcccttactaccttttctctgt

SEQ ID NO: 426511 - DNA, 25 bp, Mus musculus
gaagcccttacttccttttctctgt

SEQ ID NO: 426512 - DNA, 25 bp, Mus musculus
gaagcccttatgcacgaaatttaag

SEQ ID NO: 426513 - DNA, 25 bp, Mus musculus
gaagcccttatggacgaaatttaag

SEQ ID NO: 426514 - DNA, 25 bp, Mus musculus
gaagcccttattattctcagcactt

SEQ ID NO: 426515 - DNA, 25 bp, Mus musculus
gaagcccttatttttctcagcactt

SEQ ID NO: 426516 - DNA, 25 bp, Mus musculus
gaagcccttgctaaggtcatcatca

SEQ ID NO: 426517 - DNA, 25 bp, Mus musculus
gaagcccttgcttaggtcatcatca

SEQ ID NO: 426518 - DNA, 25 bp, Mus musculus
gaagcccttggtaacctcgtggaag

SEQ ID NO: 426519 - DNA, 25 bp, Mus musculus
gaagcccttggtctgcctatcgtgt

SEQ ID NO: 426520 - DNA, 25 bp, Mus musculus
gaagcccttggtgtgcctatcgtgt

SEQ ID NO: 426521 - DNA, 25 bp, Mus musculus
gaagcccttggttacctcgtggaag

SEQ ID NO: 426522 - DNA, 25 bp, Mus musculus
gaagcccttgtcctctgagtaaata

SEQ ID NO: 426523 - DNA, 25 bp, Mus musculus
gaagcccttgtcgtctgagtaaata

SEQ ID NO: 426524 - DNA, 25 bp, Mus musculus
gaagcccttgttaaatccattttca

SEQ ID NO: 426525 - DNA, 25 bp, Mus musculus
gaagcccttgttaagatatctttgg

SEQ ID NO: 426526 - DNA, 25 bp, Mus musculus
gaagcccttgtttaatccattttca

SEQ ID NO: 426527 - DNA, 25 bp, Mus musculus
gaagcccttgtttagatatctttgg

SEQ ID NO: 426528 - DNA, 25 bp, Mus musculus
gaagccctttcaattgtgaaacaca

SEQ ID NO: 426529 - DNA, 25 bp, Mus musculus
gaagccctttcatttgtgaaacaca

SEQ ID NO: 426530 - DNA, 25 bp, Mus musculus
gaagccctttccatgtgtacaaata

SEQ ID NO: 426531 - DNA, 25 bp, Mus musculus
gaagccctttccttgtgtacaaata

SEQ ID NO: 426532 - DNA, 25 bp, Mus musculus
gaagccctttgacatgattatgaat

SEQ ID NO: 426533 - DNA, 25 bp, Mus musculus
gaagccctttgagatgattatgaat

SEQ ID NO: 426534 - DNA, 25 bp, Mus musculus
gaagccgaaggcagaccctgacgtt

SEQ ID NO: 426535 - DNA, 25 bp, Mus musculus
gaagccgaaggctgaccctgacgtt

SEQ ID NO: 426536 - DNA, 25 bp, Mus musculus
gaagccgaagttattctgtgctatc

SEQ ID NO: 426537 - DNA, 25 bp, Mus musculus
gaagccgaagtttttctgtgctatc

SEQ ID NO: 426538 - DNA, 25 bp, Mus musculus
gaagccgaatgcaggcagtgaccga

SEQ ID NO: 426539 - DNA, 25 bp, Mus musculus
gaagccgaatgctggcagtgaccga

SEQ ID NO: 426540 - DNA, 25 bp, Mus musculus
gaagccgacacgaggatcttgagaa

SEQ ID NO: 426541 - DNA, 25 bp, Mus musculus
gaagccgacacgtggatcttgagaa

SEQ ID NO: 426542 - DNA, 25 bp, Mus musculus
gaagccgaccagcatatttattccc

SEQ ID NO: 426543 - DNA, 25 bp, Mus musculus
gaagccgaccaggatatttattccc

SEQ ID NO: 426544 - DNA, 25 bp, Mus musculus
gaagccgaccggattgacttttcat

SEQ ID NO: 426545 - DNA, 25 bp, Mus musculus
gaagccgaccggtttgacttttcat

SEQ ID NO: 426546 - DNA, 25 bp, Mus musculus
gaagccgactttcgataagccctct

SEQ ID NO: 426547 - DNA, 25 bp, Mus musculus
gaagccgactttggataagccctct

SEQ ID NO: 426548 - DNA, 25 bp, Mus musculus
gaagccgagaagatcaccgaggcta

SEQ ID NO: 426549 - DNA, 25 bp, Mus musculus
gaagccgagaagttcaccgaggcta

SEQ ID NO: 426550 - DNA, 25 bp, Mus musculus
gaagccgagacactcatccagattg

SEQ ID NO: 426551 - DNA, 25 bp, Mus musculus
gaagccgagacagtcatccagattg

SEQ ID NO: 426552 - DNA, 25 bp, Mus musculus
gaagccgagactcgccatattgtgc

SEQ ID NO: 426553 - DNA, 25 bp, Mus musculus
gaagccgagactggccatattgtgc

SEQ ID NO: 426554 - DNA, 25 bp, Mus musculus
gaagccgagatgcaaacccatgttt

SEQ ID NO: 426555 - DNA, 25 bp, Mus musculus
gaagccgagatggaaacccatgttt

SEQ ID NO: 426556 - DNA, 25 bp, Mus musculus
gaagccgaggtaactctggtgactc

SEQ ID NO: 426557 - DNA, 25 bp, Mus musculus
gaagccgaggtatctctggtgactc

SEQ ID NO: 426558 - DNA, 25 bp, Mus musculus
gaagccgagttcaccaagtccattg

SEQ ID NO: 426559 - DNA, 25 bp, Mus musculus
gaagccgagttctccaagtccattg

SEQ ID NO: 426560 - DNA, 25 bp, Mus musculus
gaagccgatcgaccgcgagaagacc

SEQ ID NO: 426561 - DNA, 25 bp, Mus musculus
gaagccgatcgagcgcgagaagacc

SEQ ID NO: 426562 - DNA, 25 bp, Mus musculus
gaagccgatggaactgctgtcagca

SEQ ID NO: 426563 - DNA, 25 bp, Mus musculus
gaagccgatggacagtctctttccc

SEQ ID NO: 426564 - DNA, 25 bp, Mus musculus
gaagccgatggagagtctctttccc

SEQ ID NO: 426565 - DNA, 25 bp, Mus musculus
gaagccgatggatctgctgtcagca

SEQ ID NO: 426566 - DNA, 25 bp, Mus musculus
gaagccgatttcctgtgcaatctga

SEQ ID NO: 426567 - DNA, 25 bp, Mus musculus
gaagccgatttcgtgtgcaatctga

SEQ ID NO: 426568 - DNA, 25 bp, Mus musculus
gaagccgattttcctgtaggaagat

SEQ ID NO: 426569 - DNA, 25 bp, Mus musculus
gaagccgattttgctgtaggaagat

SEQ ID NO: 426570 - DNA, 25 bp, Mus musculus
gaagccgcaaaactgctgcaaggca

SEQ ID NO: 426571 - DNA, 25 bp, Mus musculus
gaagccgcaaaagtgctgcaaggca

SEQ ID NO: 426572 - DNA, 25 bp, Mus musculus
gaagccgcagaaaaaccctactaag

SEQ ID NO: 426573 - DNA, 25 bp, Mus musculus
gaagccgcagaataaccctactaag

SEQ ID NO: 426574 - DNA, 25 bp, Mus musculus
gaagccgcagtgaaagcactgacgt

SEQ ID NO: 426575 - DNA, 25 bp, Mus musculus
gaagccgcagtgtaagcactgacgt

SEQ ID NO: 426576 - DNA, 25 bp, Mus musculus
gaagccgcataacgtttctctaaag

SEQ ID NO: 426577 - DNA, 25 bp, Mus musculus
gaagccgcataaggtttctctaaag

SEQ ID NO: 426578 - DNA, 25 bp, Mus musculus
gaagccgcatcacaataggccttgt

SEQ ID NO: 426579 - DNA, 25 bp, Mus musculus
gaagccgcatcagaataggccttgt

SEQ ID NO: 426580 - DNA, 25 bp, Mus musculus
gaagccgccagacctcatgtttctc

SEQ ID NO: 426581 - DNA, 25 bp, Mus musculus
gaagccgccagagctcatgtttctc

SEQ ID NO: 426582 - DNA, 25 bp, Mus musculus
gaagccgccctgaaggctgctttga

SEQ ID NO: 426583 - DNA, 25 bp, Mus musculus
gaagccgccctgtaggctgctttga

SEQ ID NO: 426584 - DNA, 25 bp, Mus musculus
gaagccgccttgatatcagaaccgt

SEQ ID NO: 426585 - DNA, 25 bp, Mus musculus
gaagccgccttgttatcagaaccgt

SEQ ID NO: 426586 - DNA, 25 bp, Mus musculus
gaagccgcgctcagttttgggaata

SEQ ID NO: 426587 - DNA, 25 bp, Mus musculus
gaagccgcgctctgttttgggaata

SEQ ID NO: 426588 - DNA, 25 bp, Mus musculus
gaagccgctattcgcgccaaattgg

SEQ ID NO: 426589 - DNA, 25 bp, Mus musculus
gaagccgctattggcgccaaattgg

SEQ ID NO: 426590 - DNA, 25 bp, Mus musculus
gaagccgctgctctcagggacatat

SEQ ID NO: 426591 - DNA, 25 bp, Mus musculus
gaagccgctgctgtcagggacatat

SEQ ID NO: 426592 - DNA, 25 bp, Mus musculus
gaagccgcttatctgtatcgctcag

SEQ ID NO: 426593 - DNA, 25 bp, Mus musculus
gaagccgcttatgtgtatcgctcag

SEQ ID NO: 426594 - DNA, 25 bp, Mus musculus
gaagccgctttgctcgacgcattgc

SEQ ID NO: 426595 - DNA, 25 bp, Mus musculus
gaagccgctttggtcgacgcattgc

SEQ ID NO: 426596 - DNA, 25 bp, Mus musculus
gaagccggagtcaccattatttggg

SEQ ID NO: 426597 - DNA, 25 bp, Mus musculus
gaagccggagtctccattatttggg

SEQ ID NO: 426598 - DNA, 25 bp, Mus musculus
gaagccggatacagatgctgtcaca

SEQ ID NO: 426599 - DNA, 25 bp, Mus musculus
gaagccggatactgatgctgtcaca

SEQ ID NO: 426600 - DNA, 25 bp, Mus musculus
gaagccggccatctgagaactctac

SEQ ID NO: 426601 - DNA, 25 bp, Mus musculus
gaagccggccatgtgagaactctac

SEQ ID NO: 426602 - DNA, 25 bp, Mus musculus
gaagccggcgcaagaaggccaatga

SEQ ID NO: 426603 - DNA, 25 bp, Mus musculus
gaagccggcgcatgaaggccaatga

SEQ ID NO: 426604 - DNA, 25 bp, Mus musculus
gaagccggcttgaccatgatgccaa

SEQ ID NO: 426605 - DNA, 25 bp, Mus musculus
gaagccggcttgtccatgatgccaa

SEQ ID NO: 426606 - DNA, 25 bp, Mus musculus
gaagccgggcgcaaaagccaagcag

SEQ ID NO: 426607 - DNA, 25 bp, Mus musculus
gaagccgggcgctaaagccaagcag

SEQ ID NO: 426608 - DNA, 25 bp, Mus musculus
gaagccgggcggataactgagctct

SEQ ID NO: 426609 - DNA, 25 bp, Mus musculus
gaagccgggcggttaactgagctct

SEQ ID NO: 426610 - DNA, 25 bp, Mus musculus
gaagccggtctgaagccatttgaac

SEQ ID NO: 426611 - DNA, 25 bp, Mus musculus
gaagccggtctgtagccatttgaac

SEQ ID NO: 426612 - DNA, 25 bp, Mus musculus
gaagccgtactaagctcagatcagg

SEQ ID NO: 426613 - DNA, 25 bp, Mus musculus
gaagccgtactatgctcagatcagg

SEQ ID NO: 426614 - DNA, 25 bp, Mus musculus
gaagccgtaggtatcatcgtgagca

SEQ ID NO: 426615 - DNA, 25 bp, Mus musculus
gaagccgtaggtttcatcgtgagca

SEQ ID NO: 426616 - DNA, 25 bp, Mus musculus
gaagccgtgcttctgacacaaagac

SEQ ID NO: 426617 - DNA, 25 bp, Mus musculus
gaagccgtgcttgtgacacaaagac

SEQ ID NO: 426618 - DNA, 25 bp, Mus musculus
gaagccgtggccacatggagaccag

SEQ ID NO: 426619 - DNA, 25 bp, Mus musculus
gaagccgtggcctcatggagaccag

SEQ ID NO: 426620 - DNA, 25 bp, Mus musculus
gaagccgttgcacgttggagatcca

SEQ ID NO: 426621 - DNA, 25 bp, Mus musculus
gaagccgttgcaggttggagatcca

SEQ ID NO: 426622 - DNA, 25 bp, Mus musculus
gaagccgtttacactcatggtgtgt

SEQ ID NO: 426623 - DNA, 25 bp, Mus musculus
gaagccgtttactctcatggtgtgt

SEQ ID NO: 426624 - DNA, 25 bp, Mus musculus
gaagccgtttatcagctaacccgaa

SEQ ID NO: 426625 - DNA, 25 bp, Mus musculus
gaagccgtttatgagctaacccgaa

SEQ ID NO: 426626 - DNA, 25 bp, Mus musculus
gaagcctaaacaaagtcgatcgcgc

SEQ ID NO: 426627 - DNA, 25 bp, Mus musculus
gaagcctaaacatagtcgatcgcgc

SEQ ID NO: 426628 - DNA, 25 bp, Mus musculus
gaagcctaaagcattcagtggacat

SEQ ID NO: 426629 - DNA, 25 bp, Mus musculus
gaagcctaaagctttcagtggacat

SEQ ID NO: 426630 - DNA, 25 bp, Mus musculus
gaagcctaacctaggttctgtatgg

SEQ ID NO: 426631 - DNA, 25 bp, Mus musculus
gaagcctaaccttggttctgtatgg

SEQ ID NO: 426632 - DNA, 25 bp, Mus musculus
gaagcctaagaaagtcactagttct

SEQ ID NO: 426633 - DNA, 25 bp, Mus musculus
gaagcctaagaatgtcactagttct

SEQ ID NO: 426634 - DNA, 25 bp, Mus musculus
gaagcctaaggacctattcatttcc

SEQ ID NO: 426635 - DNA, 25 bp, Mus musculus
gaagcctaaggagctattcatttcc

SEQ ID NO: 426636 - DNA, 25 bp, Mus musculus
gaagcctaaggccaataacactttg

SEQ ID NO: 426637 - DNA, 25 bp, Mus musculus
gaagcctaaggcgaataacactttg

SEQ ID NO: 426638 - DNA, 25 bp, Mus musculus
gaagcctacaaaagctgcatatgct

SEQ ID NO: 426639 - DNA, 25 bp, Mus musculus
gaagcctacaaatgctgcatatgct

SEQ ID NO: 426640 - DNA, 25 bp, Mus musculus
gaagcctacacacatgacctgggtg

SEQ ID NO: 426641 - DNA, 25 bp, Mus musculus
gaagcctacacagatgacctgggtg

SEQ ID NO: 426642 - DNA, 25 bp, Mus musculus
gaagcctacaggcatgtttatgtca

SEQ ID NO: 426643 - DNA, 25 bp, Mus musculus
gaagcctacagggatgtttatgtca

SEQ ID NO: 426644 - DNA, 25 bp, Mus musculus
gaagcctacataactaatccctgaa

SEQ ID NO: 426645 - DNA, 25 bp, Mus musculus
gaagcctacatatctaatccctgaa

SEQ ID NO: 426646 - DNA, 25 bp, Mus musculus
gaagcctacatgcttggcatcaggt

SEQ ID NO: 426647 - DNA, 25 bp, Mus musculus
gaagcctacatggttggcatcaggt

SEQ ID NO: 426648 - DNA, 25 bp, Mus musculus
gaagcctacctgattgtatatgata

SEQ ID NO: 426649 - DNA, 25 bp, Mus musculus
gaagcctacctgtttgtatatgata

SEQ ID NO: 426650 - DNA, 25 bp, Mus musculus
gaagcctacggacaagatgactgga

SEQ ID NO: 426651 - DNA, 25 bp, Mus musculus
gaagcctacggagaagatgactgga

SEQ ID NO: 426652 - DNA, 25 bp, Mus musculus
gaagcctactgaagaccttgaggga

SEQ ID NO: 426653 - DNA, 25 bp, Mus musculus
gaagcctactgaccctgccatggga

SEQ ID NO: 426654 - DNA, 25 bp, Mus musculus
gaagcctactgagcctgccatggga

SEQ ID NO: 426655 - DNA, 25 bp, Mus musculus
gaagcctactgatgaccttgaggga

SEQ ID NO: 426656 - DNA, 25 bp, Mus musculus
gaagcctacttgaacatcctagatg

SEQ ID NO: 426657 - DNA, 25 bp, Mus musculus
gaagcctacttgctcataatgtgta

SEQ ID NO: 426658 - DNA, 25 bp, Mus musculus
gaagcctacttggtcataatgtgta

SEQ ID NO: 426659 - DNA, 25 bp, Mus musculus
gaagcctacttgtacatcctagatg

SEQ ID NO: 426660 - DNA, 25 bp, Mus musculus
gaagcctagacaacagcaccgcaag

SEQ ID NO: 426661 - DNA, 25 bp, Mus musculus
gaagcctagacatcagcaccgcaag

SEQ ID NO: 426662 - DNA, 25 bp, Mus musculus
gaagcctagagcatcctagaggtga

SEQ ID NO: 426663 - DNA, 25 bp, Mus musculus
gaagcctagagcttcctagaggtga

SEQ ID NO: 426664 - DNA, 25 bp, Mus musculus
gaagcctagcagaattgacctaccc

SEQ ID NO: 426665 - DNA, 25 bp, Mus musculus
gaagcctagcagactgaggttgtca

SEQ ID NO: 426666 - DNA, 25 bp, Mus musculus
gaagcctagcagtattgacctaccc

SEQ ID NO: 426667 - DNA, 25 bp, Mus musculus
gaagcctagcagtctgaggttgtca

SEQ ID NO: 426668 - DNA, 25 bp, Mus musculus
gaagcctagctcatttcatgatgat

SEQ ID NO: 426669 - DNA, 25 bp, Mus musculus
gaagcctagctcttttcatgatgat

SEQ ID NO: 426670 - DNA, 25 bp, Mus musculus
gaagcctagggtacaagccttttca

SEQ ID NO: 426671 - DNA, 25 bp, Mus musculus
gaagcctagggttcaagccttttca

SEQ ID NO: 426672 - DNA, 25 bp, Mus musculus
gaagcctagtacactacatcgaagt

SEQ ID NO: 426673 - DNA, 25 bp, Mus musculus
gaagcctagtactctacatcgaagt

SEQ ID NO: 426674 - DNA, 25 bp, Mus musculus
gaagcctagtagaactcccagccct

SEQ ID NO: 426675 - DNA, 25 bp, Mus musculus
gaagcctagtagtactcccagccct

SEQ ID NO: 426676 - DNA, 25 bp, Mus musculus
gaagcctagttccatggtctacggt

SEQ ID NO: 426677 - DNA, 25 bp, Mus musculus
gaagcctagttcgatggtctacggt

SEQ ID NO: 426678 - DNA, 25 bp, Mus musculus
gaagcctataatcatagctctgatg

SEQ ID NO: 426679 - DNA, 25 bp, Mus musculus
gaagcctataatgatagctctgatg

SEQ ID NO: 426680 - DNA, 25 bp, Mus musculus
gaagcctatataatcaaactgattc

SEQ ID NO: 426681 - DNA, 25 bp, Mus musculus
gaagcctatatattcaaactgattc

SEQ ID NO: 426682 - DNA, 25 bp, Mus musculus
gaagcctatgatattgtcaccgtgg

SEQ ID NO: 426683 - DNA, 25 bp, Mus musculus
gaagcctatgattttgtcaccgtgg

SEQ ID NO: 426684 - DNA, 25 bp, Mus musculus
gaagcctatggacggtgatcaatac

SEQ ID NO: 426685 - DNA, 25 bp, Mus musculus
gaagcctatggagggtgatcaatac

SEQ ID NO: 426686 - DNA, 25 bp, Mus musculus
gaagcctatggcaggttattgtcag

SEQ ID NO: 426687 - DNA, 25 bp, Mus musculus
gaagcctatggctggttattgtcag

SEQ ID NO: 426688 - DNA, 25 bp, Mus musculus
gaagcctatgtgagaagccatgtaa

SEQ ID NO: 426689 - DNA, 25 bp, Mus musculus
gaagcctatgtgaggtagcgtgtcc

SEQ ID NO: 426690 - DNA, 25 bp, Mus musculus
gaagcctatgtgtgaagccatgtaa

SEQ ID NO: 426691 - DNA, 25 bp, Mus musculus
gaagcctatgtgtggtagcgtgtcc

SEQ ID NO: 426692 - DNA, 25 bp, Mus musculus
gaagcctattacaccagagactgct

SEQ ID NO: 426693 - DNA, 25 bp, Mus musculus
gaagcctattactccagagactgct

SEQ ID NO: 426694 - DNA, 25 bp, Mus musculus
gaagcctattccctgagagcgaaac

SEQ ID NO: 426695 - DNA, 25 bp, Mus musculus
gaagcctattccgtgagagcgaaac

SEQ ID NO: 426696 - DNA, 25 bp, Mus musculus
gaagcctattgtacacacagatctt

SEQ ID NO: 426697 - DNA, 25 bp, Mus musculus
gaagcctattgttcacacagatctt

SEQ ID NO: 426698 - DNA, 25 bp, Mus musculus
gaagcctatttcatagcttgctctg

SEQ ID NO: 426699 - DNA, 25 bp, Mus musculus
gaagcctatttcttagcttgctctg

SEQ ID NO: 426700 - DNA, 25 bp, Mus musculus
gaagcctcaaggcaaatgcgcaaaa

SEQ ID NO: 426701 - DNA, 25 bp, Mus musculus
gaagcctcaagggaaatgcgcaaaa

SEQ ID NO: 426702 - DNA, 25 bp, Mus musculus
gaagcctcacacatctttgagttaa

SEQ ID NO: 426703 - DNA, 25 bp, Mus musculus
gaagcctcacacttctttgagttaa

SEQ ID NO: 426704 - DNA, 25 bp, Mus musculus
gaagcctcaccaacctcagggaaaa

SEQ ID NO: 426705 - DNA, 25 bp, Mus musculus
gaagcctcaccatcctcagggaaaa

SEQ ID NO: 426706 - DNA, 25 bp, Mus musculus
gaagcctcaggtcagtcaccagatt

SEQ ID NO: 426707 - DNA, 25 bp, Mus musculus
gaagcctcaggtgagtcaccagatt

SEQ ID NO: 426708 - DNA, 25 bp, Mus musculus
gaagcctcatttaaactgactgtgg

SEQ ID NO: 426709 - DNA, 25 bp, Mus musculus
gaagcctcattttaactgactgtgg

SEQ ID NO: 426710 - DNA, 25 bp, Mus musculus
gaagcctccactagtattctgtaat

SEQ ID NO: 426711 - DNA, 25 bp, Mus musculus
gaagcctccacttgtattctgtaat

SEQ ID NO: 426712 - DNA, 25 bp, Mus musculus
gaagcctccagaactcactgcaagg

SEQ ID NO: 426713 - DNA, 25 bp, Mus musculus
gaagcctccagatctcactgcaagg

SEQ ID NO: 426714 - DNA, 25 bp, Mus musculus
gaagcctccagcaggcattttagtg

SEQ ID NO: 426715 - DNA, 25 bp, Mus musculus
gaagcctccagctggcattttagtg

SEQ ID NO: 426716 - DNA, 25 bp, Mus musculus
gaagcctcccctagaagatgttttt

SEQ ID NO: 426717 - DNA, 25 bp, Mus musculus
gaagcctccccttgaagatgttttt

SEQ ID NO: 426718 - DNA, 25 bp, Mus musculus
gaagcctcccgaaattccagcaaaa

SEQ ID NO: 426719 - DNA, 25 bp, Mus musculus
gaagcctcccgatattccagcaaaa

SEQ ID NO: 426720 - DNA, 25 bp, Mus musculus
gaagcctccgtgaagtgtagtagaa

SEQ ID NO: 426721 - DNA, 25 bp, Mus musculus
gaagcctccgtgtagtgtagtagaa

SEQ ID NO: 426722 - DNA, 25 bp, Mus musculus
gaagcctcctggattcctgaggaag

SEQ ID NO: 426723 - DNA, 25 bp, Mus musculus
gaagcctcctggtttcctgaggaag

SEQ ID NO: 426724 - DNA, 25 bp, Mus musculus
gaagcctcgaagagcaatgtctgga

SEQ ID NO: 426725 - DNA, 25 bp, Mus musculus
gaagcctcgaagtgcaatgtctgga

SEQ ID NO: 426726 - DNA, 25 bp, Mus musculus
gaagcctcgataaacatctctgccg

SEQ ID NO: 426727 - DNA, 25 bp, Mus musculus
gaagcctcgatatacatctctgccg

SEQ ID NO: 426728 - DNA, 25 bp, Mus musculus
gaagcctcgattcgccacattttgg

SEQ ID NO: 426729 - DNA, 25 bp, Mus musculus
gaagcctcgattggccacattttgg

SEQ ID NO: 426730 - DNA, 25 bp, Mus musculus
gaagcctcgtgcagccttggagaga

SEQ ID NO: 426731 - DNA, 25 bp, Mus musculus
gaagcctcgtgctgccttggagaga

SEQ ID NO: 426732 - DNA, 25 bp, Mus musculus
gaagcctctagtataatcaatccag

SEQ ID NO: 426733 - DNA, 25 bp, Mus musculus
gaagcctctagtttaatcaatccag

SEQ ID NO: 426734 - DNA, 25 bp, Mus musculus
gaagcctctcatatcaaaggcactt

SEQ ID NO: 426735 - DNA, 25 bp, Mus musculus
gaagcctctcatttcaaaggcactt

SEQ ID NO: 426736 - DNA, 25 bp, Mus musculus
gaagcctctcccaagagtaaggcca

SEQ ID NO: 426737 - DNA, 25 bp, Mus musculus
gaagcctctccctagagtaaggcca

SEQ ID NO: 426738 - DNA, 25 bp, Mus musculus
gaagcctctcgacaccctgatacaa

SEQ ID NO: 426739 - DNA, 25 bp, Mus musculus
gaagcctctcgagaccctgatacaa

SEQ ID NO: 426740 - DNA, 25 bp, Mus musculus
gaagcctctcgtacagtaaggaaat

SEQ ID NO: 426741 - DNA, 25 bp, Mus musculus
gaagcctctcgttcagtaaggaaat

SEQ ID NO: 426742 - DNA, 25 bp, Mus musculus
gaagcctctctcatataaacatgca

SEQ ID NO: 426743 - DNA, 25 bp, Mus musculus
gaagcctctctcttataaacatgca

SEQ ID NO: 426744 - DNA, 25 bp, Mus musculus
gaagcctctctgagttcacactcct

SEQ ID NO: 426745 - DNA, 25 bp, Mus musculus
gaagcctctctgtgttcacactcct

SEQ ID NO: 426746 - DNA, 25 bp, Mus musculus
gaagcctctgaaagctttcatgtta

SEQ ID NO: 426747 - DNA, 25 bp, Mus musculus
gaagcctctgaatgctttcatgtta

SEQ ID NO: 426748 - DNA, 25 bp, Mus musculus
gaagcctctgagctatctaccatgg

SEQ ID NO: 426749 - DNA, 25 bp, Mus musculus
gaagcctctgaggtatctaccatgg

SEQ ID NO: 426750 - DNA, 25 bp, Mus musculus
gaagcctctgcactcaattgatcta

SEQ ID NO: 426751 - DNA, 25 bp, Mus musculus
gaagcctctgcagtcaattgatcta

SEQ ID NO: 426752 - DNA, 25 bp, Mus musculus
gaagcctctgctatgttagtcacac

SEQ ID NO: 426753 - DNA, 25 bp, Mus musculus
gaagcctctgctttgttagtcacac

SEQ ID NO: 426754 - DNA, 25 bp, Mus musculus
gaagcctctggaactgtgcaggaaa

SEQ ID NO: 426755 - DNA, 25 bp, Mus musculus
gaagcctctggacatagggctcagt

SEQ ID NO: 426756 - DNA, 25 bp, Mus musculus
gaagcctctggagatagggctcagt

SEQ ID NO: 426757 - DNA, 25 bp, Mus musculus
gaagcctctggatctgtgcaggaaa

SEQ ID NO: 426758 - DNA, 25 bp, Mus musculus
gaagcctctgttcacggaagccagt

SEQ ID NO: 426759 - DNA, 25 bp, Mus musculus
gaagcctctgttgacggaagccagt

SEQ ID NO: 426760 - DNA, 25 bp, Mus musculus
gaagcctcttagagagctatctcag

SEQ ID NO: 426761 - DNA, 25 bp, Mus musculus
gaagcctcttagtgagctatctcag

SEQ ID NO: 426762 - DNA, 25 bp, Mus musculus
gaagcctcttcaatatgctgcagat

SEQ ID NO: 426763 - DNA, 25 bp, Mus musculus
gaagcctcttcattatgctgcagat

SEQ ID NO: 426764 - DNA, 25 bp, Mus musculus
gaagcctgaaaacagaccccgtgac

SEQ ID NO: 426765 - DNA, 25 bp, Mus musculus
gaagcctgaaaagagaccccgtgac

SEQ ID NO: 426766 - DNA, 25 bp, Mus musculus
gaagcctgaaggacatctacagaat

SEQ ID NO: 426767 - DNA, 25 bp, Mus musculus
gaagcctgaaggtcatctacagaat

SEQ ID NO: 426768 - DNA, 25 bp, Mus musculus
gaagcctgaattcttttctgtcaca

SEQ ID NO: 426769 - DNA, 25 bp, Mus musculus
gaagcctgaattgttttctgtcaca

SEQ ID NO: 426770 - DNA, 25 bp, Mus musculus
gaagcctgacagcaatatgtcctcc

SEQ ID NO: 426771 - DNA, 25 bp, Mus musculus
gaagcctgacaggaatatgtcctcc

SEQ ID NO: 426772 - DNA, 25 bp, Mus musculus
gaagcctgaccgcgaccgccatggt

SEQ ID NO: 426773 - DNA, 25 bp, Mus musculus
gaagcctgaccgggaccgccatggt

SEQ ID NO: 426774 - DNA, 25 bp, Mus musculus
gaagcctgacttactgtgcatgcca

SEQ ID NO: 426775 - DNA, 25 bp, Mus musculus
gaagcctgactttctgtgcatgcca

SEQ ID NO: 426776 - DNA, 25 bp, Mus musculus
gaagcctgaggaatccattacggaa

SEQ ID NO: 426777 - DNA, 25 bp, Mus musculus
gaagcctgaggattccattacggaa

SEQ ID NO: 426778 - DNA, 25 bp, Mus musculus
gaagcctgaggccacagagtcactc

SEQ ID NO: 426779 - DNA, 25 bp, Mus musculus
gaagcctgaggcgacagagtcactc

SEQ ID NO: 426780 - DNA, 25 bp, Mus musculus
gaagcctgaggtactaattcataca

SEQ ID NO: 426781 - DNA, 25 bp, Mus musculus
gaagcctgaggtcagcatccttata

SEQ ID NO: 426782 - DNA, 25 bp, Mus musculus
gaagcctgaggtcgccacagacagc

SEQ ID NO: 426783 - DNA, 25 bp, Mus musculus
gaagcctgaggtgagcatccttata

SEQ ID NO: 426784 - DNA, 25 bp, Mus musculus
gaagcctgaggtggccacagacagc

SEQ ID NO: 426785 - DNA, 25 bp, Mus musculus
gaagcctgaggttctaattcataca

SEQ ID NO: 426786 - DNA, 25 bp, Mus musculus
gaagcctgagtcagagcatagctga

SEQ ID NO: 426787 - DNA, 25 bp, Mus musculus
gaagcctgagtctgagcatagctga

SEQ ID NO: 426788 - DNA, 25 bp, Mus musculus
gaagcctgatcacctaaaactagag

SEQ ID NO: 426789 - DNA, 25 bp, Mus musculus
gaagcctgatcactctagctagtgt

SEQ ID NO: 426790 - DNA, 25 bp, Mus musculus
gaagcctgatcagctaaaactagag

SEQ ID NO: 426791 - DNA, 25 bp, Mus musculus
gaagcctgatcagtctagctagtgt

SEQ ID NO: 426792 - DNA, 25 bp, Mus musculus
gaagcctgcaagaatatctccaaaa

SEQ ID NO: 426793 - DNA, 25 bp, Mus musculus
gaagcctgcaagtatatctccaaaa

SEQ ID NO: 426794 - DNA, 25 bp, Mus musculus
gaagcctgcaccctaagtgaaactc

SEQ ID NO: 426795 - DNA, 25 bp, Mus musculus
gaagcctgcaccgtaagtgaaactc

SEQ ID NO: 426796 - DNA, 25 bp, Mus musculus
gaagcctgcagtctcagcatccagg

SEQ ID NO: 426797 - DNA, 25 bp, Mus musculus
gaagcctgcagtgtcagcatccagg

SEQ ID NO: 426798 - DNA, 25 bp, Mus musculus
gaagcctgccatagcttgaagctga

SEQ ID NO: 426799 - DNA, 25 bp, Mus musculus
gaagcctgccattgcttgaagctga

SEQ ID NO: 426800 - DNA, 25 bp, Mus musculus
gaagcctgccgtcaagtaacaccag

SEQ ID NO: 426801 - DNA, 25 bp, Mus musculus
gaagcctgccgtgaagtaacaccag

SEQ ID NO: 426802 - DNA, 25 bp, Mus musculus
gaagcctgccttcgacatggctagg

SEQ ID NO: 426803 - DNA, 25 bp, Mus musculus
gaagcctgccttggacatggctagg

SEQ ID NO: 426804 - DNA, 25 bp, Mus musculus
gaagcctgcgacacctgtggcaaag

SEQ ID NO: 426805 - DNA, 25 bp, Mus musculus
gaagcctgcgactcctgtggcaaag

SEQ ID NO: 426806 - DNA, 25 bp, Mus musculus
gaagcctgcgagagagccttgtgca

SEQ ID NO: 426807 - DNA, 25 bp, Mus musculus
gaagcctgcgagtgagccttgtgca

SEQ ID NO: 426808 - DNA, 25 bp, Mus musculus
gaagcctgcgtgatacatcctgtaa

SEQ ID NO: 426809 - DNA, 25 bp, Mus musculus
gaagcctgcgtgttacatcctgtaa

SEQ ID NO: 426810 - DNA, 25 bp, Mus musculus
gaagcctgctgaactaattctgcct

SEQ ID NO: 426811 - DNA, 25 bp, Mus musculus
gaagcctgctgatctaattctgcct

SEQ ID NO: 426812 - DNA, 25 bp, Mus musculus
gaagcctgctttaataccggatgtt

SEQ ID NO: 426813 - DNA, 25 bp, Mus musculus
gaagcctgcttttataccggatgtt

SEQ ID NO: 426814 - DNA, 25 bp, Mus musculus
gaagcctggaaaagttctttcactg

SEQ ID NO: 426815 - DNA, 25 bp, Mus musculus
gaagcctggaaatgttctttcactg

SEQ ID NO: 426816 - DNA, 25 bp, Mus musculus
gaagcctggaagaccttagtgctcc

SEQ ID NO: 426817 - DNA, 25 bp, Mus musculus
gaagcctggaagcatattgattcac

SEQ ID NO: 426818 - DNA, 25 bp, Mus musculus
gaagcctggaaggatattgattcac

SEQ ID NO: 426819 - DNA, 25 bp, Mus musculus
gaagcctggaagtccttagtgctcc

SEQ ID NO: 426820 - DNA, 25 bp, Mus musculus
gaagcctggactagaccggcatcgt

SEQ ID NO: 426821 - DNA, 25 bp, Mus musculus
gaagcctggacttgaccggcatcgt

SEQ ID NO: 426822 - DNA, 25 bp, Mus musculus
gaagcctggaggcacagatcaaatt

SEQ ID NO: 426823 - DNA, 25 bp, Mus musculus
gaagcctggagggacagatcaaatt

SEQ ID NO: 426824 - DNA, 25 bp, Mus musculus
gaagcctggagtactttctgtttat

SEQ ID NO: 426825 - DNA, 25 bp, Mus musculus
gaagcctggagttctttctgtttat

SEQ ID NO: 426826 - DNA, 25 bp, Mus musculus
gaagcctggcaacagtgtacctcag

SEQ ID NO: 426827 - DNA, 25 bp, Mus musculus
gaagcctggcaagagtgtacctcag

SEQ ID NO: 426828 - DNA, 25 bp, Mus musculus
gaagcctggcagaagtgtcacatgc

SEQ ID NO: 426829 - DNA, 25 bp, Mus musculus
gaagcctggcagtagtgtcacatgc

SEQ ID NO: 426830 - DNA, 25 bp, Mus musculus
gaagcctggcatcttctttaaccct

SEQ ID NO: 426831 - DNA, 25 bp, Mus musculus
gaagcctggcatgttctttaaccct

SEQ ID NO: 426832 - DNA, 25 bp, Mus musculus
gaagcctggcttcggagctgtttcc

SEQ ID NO: 426833 - DNA, 25 bp, Mus musculus
gaagcctggcttgggagctgtttcc

SEQ ID NO: 426834 - DNA, 25 bp, Mus musculus
gaagcctgggacatgtgcatacgag

SEQ ID NO: 426835 - DNA, 25 bp, Mus musculus
gaagcctgggacttgtgcatacgag

SEQ ID NO: 426836 - DNA, 25 bp, Mus musculus
gaagcctgggcaagttttagagtct

SEQ ID NO: 426837 - DNA, 25 bp, Mus musculus
gaagcctgggcatgttttagagtct

SEQ ID NO: 426838 - DNA, 25 bp, Mus musculus
gaagcctgggccagcttccagcctt

SEQ ID NO: 426839 - DNA, 25 bp, Mus musculus
gaagcctgggcctgcttccagcctt

SEQ ID NO: 426840 - DNA, 25 bp, Mus musculus
gaagcctgggtaatattttctaagc

SEQ ID NO: 426841 - DNA, 25 bp, Mus musculus
gaagcctgggtattattttctaagc

SEQ ID NO: 426842 - DNA, 25 bp, Mus musculus
gaagcctgggtcagcaagacagcca

SEQ ID NO: 426843 - DNA, 25 bp, Mus musculus
gaagcctgggtctgcaagacagcca

SEQ ID NO: 426844 - DNA, 25 bp, Mus musculus
gaagcctggtgacggctacactgta

SEQ ID NO: 426845 - DNA, 25 bp, Mus musculus
gaagcctggtgagggctacactgta

SEQ ID NO: 426846 - DNA, 25 bp, Mus musculus
gaagcctggttacgtgggattccca

SEQ ID NO: 426847 - DNA, 25 bp, Mus musculus
gaagcctggttaggtgggattccca

SEQ ID NO: 426848 - DNA, 25 bp, Mus musculus
gaagcctggtttaacattatatcct

SEQ ID NO: 426849 - DNA, 25 bp, Mus musculus
gaagcctggttttacattatatcct

SEQ ID NO: 426850 - DNA, 25 bp, Mus musculus
gaagcctgtcatattgtcaactgag

SEQ ID NO: 426851 - DNA, 25 bp, Mus musculus
gaagcctgtcattttgtcaactgag

SEQ ID NO: 426852 - DNA, 25 bp, Mus musculus
gaagcctgtccacagatttcacatt

SEQ ID NO: 426853 - DNA, 25 bp, Mus musculus
gaagcctgtccagagatttcacatt

SEQ ID NO: 426854 - DNA, 25 bp, Mus musculus
gaagcctgtccgatgcttagtgact

SEQ ID NO: 426855 - DNA, 25 bp, Mus musculus
gaagcctgtccgttgcttagtgact

SEQ ID NO: 426856 - DNA, 25 bp, Mus musculus
gaagcctgtctgcagttttcacaaa

SEQ ID NO: 426857 - DNA, 25 bp, Mus musculus
gaagcctgtctggagttttcacaaa

SEQ ID NO: 426858 - DNA, 25 bp, Mus musculus
gaagcctgtgcaaatgtgactctgg

SEQ ID NO: 426859 - DNA, 25 bp, Mus musculus
gaagcctgtgcatatgtgactctgg

SEQ ID NO: 426860 - DNA, 25 bp, Mus musculus
gaagcctgtgccacagcctgactgt

SEQ ID NO: 426861 - DNA, 25 bp, Mus musculus
gaagcctgtgcctcagcctgactgt

SEQ ID NO: 426862 - DNA, 25 bp, Mus musculus
gaagcctgtgtaagcagtctcatcc

SEQ ID NO: 426863 - DNA, 25 bp, Mus musculus
gaagcctgtgtatgcagtctcatcc

SEQ ID NO: 426864 - DNA, 25 bp, Mus musculus
gaagcctgttcaaactttgggatta

SEQ ID NO: 426865 - DNA, 25 bp, Mus musculus
gaagcctgttcatactttgggatta

SEQ ID NO: 426866 - DNA, 25 bp, Mus musculus
gaagcctgttccacgctatggatat

SEQ ID NO: 426867 - DNA, 25 bp, Mus musculus
gaagcctgttcctcgctatggatat

SEQ ID NO: 426868 - DNA, 25 bp, Mus musculus
gaagcctgttggatcagcaaactga

SEQ ID NO: 426869 - DNA, 25 bp, Mus musculus
gaagcctgttggttcagcaaactga

SEQ ID NO: 426870 - DNA, 25 bp, Mus musculus
gaagcctgttttactgtgtgactat

SEQ ID NO: 426871 - DNA, 25 bp, Mus musculus
gaagcctgtttttctgtgtgactat

SEQ ID NO: 426872 - DNA, 25 bp, Mus musculus
gaagccttaatgcttgcagggtaac

SEQ ID NO: 426873 - DNA, 25 bp, Mus musculus
gaagccttaatggttgcagggtaac

SEQ ID NO: 426874 - DNA, 25 bp, Mus musculus
gaagccttaattagcacagggtgac

SEQ ID NO: 426875 - DNA, 25 bp, Mus musculus
gaagccttaatttgcacagggtgac

SEQ ID NO: 426876 - DNA, 25 bp, Mus musculus
gaagccttactaatgcaatgaattt

SEQ ID NO: 426877 - DNA, 25 bp, Mus musculus
gaagccttactattgcaatgaattt

SEQ ID NO: 426878 - DNA, 25 bp, Mus musculus
gaagccttagggattgttagtatga

SEQ ID NO: 426879 - DNA, 25 bp, Mus musculus
gaagccttagggtttgttagtatga

SEQ ID NO: 426880 - DNA, 25 bp, Mus musculus
gaagccttcaggcagcctttgttac

SEQ ID NO: 426881 - DNA, 25 bp, Mus musculus
gaagccttcaggcaggaagcccaga

SEQ ID NO: 426882 - DNA, 25 bp, Mus musculus
gaagccttcagggagcctttgttac

SEQ ID NO: 426883 - DNA, 25 bp, Mus musculus
gaagccttcagggaggaagcccaga

SEQ ID NO: 426884 - DNA, 25 bp, Mus musculus
gaagccttcagtctgttgctgagga

SEQ ID NO: 426885 - DNA, 25 bp, Mus musculus
gaagccttcagtgtgttgctgagga

SEQ ID NO: 426886 - DNA, 25 bp, Mus musculus
gaagccttcattaaatctctgcagt

SEQ ID NO: 426887 - DNA, 25 bp, Mus musculus
gaagccttcatttaatctctgcagt

SEQ ID NO: 426888 - DNA, 25 bp, Mus musculus
gaagccttcccaagctgtttggaat

SEQ ID NO: 426889 - DNA, 25 bp, Mus musculus
gaagccttcccatgctgtttggaat

SEQ ID NO: 426890 - DNA, 25 bp, Mus musculus
gaagccttccgacactttgtaatta

SEQ ID NO: 426891 - DNA, 25 bp, Mus musculus
gaagccttccgagactttgtaatta

SEQ ID NO: 426892 - DNA, 25 bp, Mus musculus
gaagccttcctgagattctttgatt

SEQ ID NO: 426893 - DNA, 25 bp, Mus musculus
gaagccttcctgtgattctttgatt

SEQ ID NO: 426894 - DNA, 25 bp, Mus musculus
gaagccttccttcctgaggcaaagg

SEQ ID NO: 426895 - DNA, 25 bp, Mus musculus
gaagccttccttgctgaggcaaagg

SEQ ID NO: 426896 - DNA, 25 bp, Mus musculus
gaagccttcgccaggacaggaaaaa

SEQ ID NO: 426897 - DNA, 25 bp, Mus musculus
gaagccttcgcctggacaggaaaaa

SEQ ID NO: 426898 - DNA, 25 bp, Mus musculus
gaagccttcgtaacctcagttagat

SEQ ID NO: 426899 - DNA, 25 bp, Mus musculus
gaagccttcgtatcctcagttagat

SEQ ID NO: 426900 - DNA, 25 bp, Mus musculus
gaagccttcgtgcaagctcgaccct

SEQ ID NO: 426901 - DNA, 25 bp, Mus musculus
gaagccttcgtggaagctcgaccct

SEQ ID NO: 426902 - DNA, 25 bp, Mus musculus
gaagccttctctcggagttgttcac

SEQ ID NO: 426903 - DNA, 25 bp, Mus musculus
gaagccttctctgggagttgttcac

SEQ ID NO: 426904 - DNA, 25 bp, Mus musculus
gaagccttctgaaatgactctaccc

SEQ ID NO: 426905 - DNA, 25 bp, Mus musculus
gaagccttctgatatgactctaccc

SEQ ID NO: 426906 - DNA, 25 bp, Mus musculus
gaagccttcttcaaccatagcaact

SEQ ID NO: 426907 - DNA, 25 bp, Mus musculus
gaagccttcttcaagcatgtttctt

SEQ ID NO: 426908 - DNA, 25 bp, Mus musculus
gaagccttcttctaccatagcaact

SEQ ID NO: 426909 - DNA, 25 bp, Mus musculus
gaagccttcttctagcatgtttctt

SEQ ID NO: 426910 - DNA, 25 bp, Mus musculus
gaagccttctttccagagctagcta

SEQ ID NO: 426911 - DNA, 25 bp, Mus musculus
gaagccttctttgcagagctagcta

SEQ ID NO: 426912 - DNA, 25 bp, Mus musculus
gaagccttgaccaagcctgggtaaa

SEQ ID NO: 426913 - DNA, 25 bp, Mus musculus
gaagccttgacctagcctgggtaaa

SEQ ID NO: 426914 - DNA, 25 bp, Mus musculus
gaagccttgagtcaatccattgctg

SEQ ID NO: 426915 - DNA, 25 bp, Mus musculus
gaagccttgagtgaatccattgctg

SEQ ID NO: 426916 - DNA, 25 bp, Mus musculus
gaagccttgataatgatactgcgaa

SEQ ID NO: 426917 - DNA, 25 bp, Mus musculus
gaagccttgatattgatactgcgaa

SEQ ID NO: 426918 - DNA, 25 bp, Mus musculus
gaagccttgatcatgagaactctct

SEQ ID NO: 426919 - DNA, 25 bp, Mus musculus
gaagccttgatcttgagaactctct

SEQ ID NO: 426920 - DNA, 25 bp, Mus musculus
gaagccttgattcagtgacactgcc

SEQ ID NO: 426921 - DNA, 25 bp, Mus musculus
gaagccttgattgagtgacactgcc

SEQ ID NO: 426922 - DNA, 25 bp, Mus musculus
gaagccttgcaaaggtgttagctca

SEQ ID NO: 426923 - DNA, 25 bp, Mus musculus
gaagccttgcaatggtgttagctca

SEQ ID NO: 426924 - DNA, 25 bp, Mus musculus
gaagccttgcaccaagagttaacta

SEQ ID NO: 426925 - DNA, 25 bp, Mus musculus
gaagccttgcacgaagagttaacta

SEQ ID NO: 426926 - DNA, 25 bp, Mus musculus
gaagccttgcagaatctccaaggtt

SEQ ID NO: 426927 - DNA, 25 bp, Mus musculus
gaagccttgcagtatctccaaggtt

SEQ ID NO: 426928 - DNA, 25 bp, Mus musculus
gaagccttgcgcaagtcaggccctg

SEQ ID NO: 426929 - DNA, 25 bp, Mus musculus
gaagccttgcgctagtcaggccctg

SEQ ID NO: 426930 - DNA, 25 bp, Mus musculus
gaagccttgctgaactaagttttgt

SEQ ID NO: 426931 - DNA, 25 bp, Mus musculus
gaagccttgctgtactaagttttgt

SEQ ID NO: 426932 - DNA, 25 bp, Mus musculus
gaagccttgcttaacgatgaacaga

SEQ ID NO: 426933 - DNA, 25 bp, Mus musculus
gaagccttgcttcttatgtttagtg

SEQ ID NO: 426934 - DNA, 25 bp, Mus musculus
gaagccttgcttgttatgtttagtg

SEQ ID NO: 426935 - DNA, 25 bp, Mus musculus
gaagccttgctttacgatgaacaga

SEQ ID NO: 426936 - DNA, 25 bp, Mus musculus
gaagccttggacaacacacatttca

SEQ ID NO: 426937 - DNA, 25 bp, Mus musculus
gaagccttggactacacacatttca

SEQ ID NO: 426938 - DNA, 25 bp, Mus musculus
gaagccttggccatagacactttgc

SEQ ID NO: 426939 - DNA, 25 bp, Mus musculus
gaagccttggccttagacactttgc

SEQ ID NO: 426940 - DNA, 25 bp, Mus musculus
gaagccttgggtcacagagtctgat

SEQ ID NO: 426941 - DNA, 25 bp, Mus musculus
gaagccttgggtgacagagtctgat

SEQ ID NO: 426942 - DNA, 25 bp, Mus musculus
gaagccttgtggactatgatagact

SEQ ID NO: 426943 - DNA, 25 bp, Mus musculus
gaagccttgtggtctatgatagact

SEQ ID NO: 426944 - DNA, 25 bp, Mus musculus
gaagccttgttgagatggtagccta

SEQ ID NO: 426945 - DNA, 25 bp, Mus musculus
gaagccttgttgtgatggtagccta

SEQ ID NO: 426946 - DNA, 25 bp, Mus musculus
gaagccttgtttagttttgttcctg

SEQ ID NO: 426947 - DNA, 25 bp, Mus musculus
gaagccttgtttcttttagtcttcg

SEQ ID NO: 426948 - DNA, 25 bp, Mus musculus
gaagccttgtttgttttagtcttcg

SEQ ID NO: 426949 - DNA, 25 bp, Mus musculus
gaagccttgttttgttttgttcctg

SEQ ID NO: 426950 - DNA, 25 bp, Mus musculus
gaagcctttagtatgctatagcacc

SEQ ID NO: 426951 - DNA, 25 bp, Mus musculus
gaagcctttagtttgctatagcacc

SEQ ID NO: 426952 - DNA, 25 bp, Mus musculus
gaagcctttcagacgagtaagactt

SEQ ID NO: 426953 - DNA, 25 bp, Mus musculus
gaagcctttcagtcgagtaagactt

SEQ ID NO: 426954 - DNA, 25 bp, Mus musculus
gaagcctttcctagccttgcattgg

SEQ ID NO: 426955 - DNA, 25 bp, Mus musculus
gaagcctttccttgccttgcattgg

SEQ ID NO: 426956 - DNA, 25 bp, Mus musculus
gaagcctttctcattagtctctttg

SEQ ID NO: 426957 - DNA, 25 bp, Mus musculus
gaagcctttctctttagtctctttg

SEQ ID NO: 426958 - DNA, 25 bp, Mus musculus
gaagcctttctgaagcctgagaggt

SEQ ID NO: 426959 - DNA, 25 bp, Mus musculus
gaagcctttctgtagcctgagaggt

SEQ ID NO: 426960 - DNA, 25 bp, Mus musculus
gaagcctttgaacagaccccaaaga

SEQ ID NO: 426961 - DNA, 25 bp, Mus musculus
gaagcctttgaagagaccccaaaga

SEQ ID NO: 426962 - DNA, 25 bp, Mus musculus
gaagcctttgccctcaggagtgtct

SEQ ID NO: 426963 - DNA, 25 bp, Mus musculus
gaagcctttgccgtcaggagtgtct

SEQ ID NO: 426964 - DNA, 25 bp, Mus musculus
gaagcctttggtagaagcggtgtat

SEQ ID NO: 426965 - DNA, 25 bp, Mus musculus
gaagcctttggtatataactctgac

SEQ ID NO: 426966 - DNA, 25 bp, Mus musculus
gaagcctttggttgaagcggtgtat

SEQ ID NO: 426967 - DNA, 25 bp, Mus musculus
gaagcctttggtttataactctgac

SEQ ID NO: 426968 - DNA, 25 bp, Mus musculus
gaagcctttgtaattcaaaacatca

SEQ ID NO: 426969 - DNA, 25 bp, Mus musculus
gaagcctttgtatttcaaaacatca

SEQ ID NO: 426970 - DNA, 25 bp, Mus musculus
gaagccttttgaattctcctgtttc

SEQ ID NO: 426971 - DNA, 25 bp, Mus musculus
gaagccttttgatttctcctgtttc

SEQ ID NO: 426972 - DNA, 25 bp, Mus musculus
gaagccttttggcaccgttgcctct

SEQ ID NO: 426973 - DNA, 25 bp, Mus musculus
gaagccttttgggaccgttgcctct

SEQ ID NO: 426974 - DNA, 25 bp, Mus musculus
gaagcgaaacatccatgcggcagct

SEQ ID NO: 426975 - DNA, 25 bp, Mus musculus
gaagcgaaacatgcatgcggcagct

SEQ ID NO: 426976 - DNA, 25 bp, Mus musculus
gaagcgaaacccaagttctaagctt

SEQ ID NO: 426977 - DNA, 25 bp, Mus musculus
gaagcgaaaccctagttctaagctt

SEQ ID NO: 426978 - DNA, 25 bp, Mus musculus
gaagcgaactccactttaggcaaag

SEQ ID NO: 426979 - DNA, 25 bp, Mus musculus
gaagcgaactcctctttaggcaaag

SEQ ID NO: 426980 - DNA, 25 bp, Mus musculus
gaagcgaagaccagcaacagtacct

SEQ ID NO: 426981 - DNA, 25 bp, Mus musculus
gaagcgaagacctgcaacagtacct

SEQ ID NO: 426982 - DNA, 25 bp, Mus musculus
gaagcgaagggaaacttcaggacta

SEQ ID NO: 426983 - DNA, 25 bp, Mus musculus
gaagcgaagggatacttcaggacta

SEQ ID NO: 426984 - DNA, 25 bp, Mus musculus
gaagcgaagtctatcctcaagcaaa

SEQ ID NO: 426985 - DNA, 25 bp, Mus musculus
gaagcgaagtctttcctcaagcaaa

SEQ ID NO: 426986 - DNA, 25 bp, Mus musculus
gaagcgacacaaagctctgctgagt

SEQ ID NO: 426987 - DNA, 25 bp, Mus musculus
gaagcgacacaatgctctgctgagt

SEQ ID NO: 426988 - DNA, 25 bp, Mus musculus
gaagcgacacgactaatggctcagt

SEQ ID NO: 426989 - DNA, 25 bp, Mus musculus
gaagcgacacgagtaatggctcagt

SEQ ID NO: 426990 - DNA, 25 bp, Mus musculus
gaagcgacagctccagcctaaggaa

SEQ ID NO: 426991 - DNA, 25 bp, Mus musculus
gaagcgacagctgcagcctaaggaa

SEQ ID NO: 426992 - DNA, 25 bp, Mus musculus
gaagcgacatggaaagaatgattga

SEQ ID NO: 426993 - DNA, 25 bp, Mus musculus
gaagcgacatggtaagaatgattga

SEQ ID NO: 426994 - DNA, 25 bp, Mus musculus
gaagcgacatgtccacagtgtgtac

SEQ ID NO: 426995 - DNA, 25 bp, Mus musculus
gaagcgacatgtgcacagtgtgtac

SEQ ID NO: 426996 - DNA, 25 bp, Mus musculus
gaagcgaccattccctctaggagcc

SEQ ID NO: 426997 - DNA, 25 bp, Mus musculus
gaagcgaccattgcctctaggagcc

SEQ ID NO: 426998 - DNA, 25 bp, Mus musculus
gaagcgaccgcgactagtagagaac

SEQ ID NO: 426999 - DNA, 25 bp, Mus musculus
gaagcgaccgcgtctagtagagaac

SEQ ID NO: 427000 - DNA, 25 bp, Mus musculus
gaagcgacgaagacttccggttgcc

SEQ ID NO: 427001 - DNA, 25 bp, Mus musculus
gaagcgacgaagtcttccggttgcc

SEQ ID NO: 427002 - DNA, 25 bp, Mus musculus
gaagcgacgacgacagcgtttgaat

SEQ ID NO: 427003 - DNA, 25 bp, Mus musculus
gaagcgacgacgtcagcgtttgaat

SEQ ID NO: 427004 - DNA, 25 bp, Mus musculus
gaagcgactcagagtcctctatgtc

SEQ ID NO: 427005 - DNA, 25 bp, Mus musculus
gaagcgactcagtgtcctctatgtc

SEQ ID NO: 427006 - DNA, 25 bp, Mus musculus
gaagcgactggacgtctatttacag

SEQ ID NO: 427007 - DNA, 25 bp, Mus musculus
gaagcgactggaggtctatttacag

SEQ ID NO: 427008 - DNA, 25 bp, Mus musculus
gaagcgactgggatggtccgaacct

SEQ ID NO: 427009 - DNA, 25 bp, Mus musculus
gaagcgactgggttggtccgaacct

SEQ ID NO: 427010 - DNA, 25 bp, Mus musculus
gaagcgagaatccatcgcgactctg

SEQ ID NO: 427011 - DNA, 25 bp, Mus musculus
gaagcgagaatcgatcgcgactctg

SEQ ID NO: 427012 - DNA, 25 bp, Mus musculus
gaagcgagacggcactttccttgtc

SEQ ID NO: 427013 - DNA, 25 bp, Mus musculus
gaagcgagacgggactttccttgtc

SEQ ID NO: 427014 - DNA, 25 bp, Mus musculus
gaagcgagacttccacatagttttt

SEQ ID NO: 427015 - DNA, 25 bp, Mus musculus
gaagcgagacttgcacatagttttt

SEQ ID NO: 427016 - DNA, 25 bp, Mus musculus
gaagcgagcattcgcttaacccagt

SEQ ID NO: 427017 - DNA, 25 bp, Mus musculus
gaagcgagcattggcttaacccagt

SEQ ID NO: 427018 - DNA, 25 bp, Mus musculus
gaagcgaggacgagaccgttgtaca

SEQ ID NO: 427019 - DNA, 25 bp, Mus musculus
gaagcgaggacgtgaccgttgtaca

SEQ ID NO: 427020 - DNA, 25 bp, Mus musculus
gaagcgagggcaagtaagaaattaa

SEQ ID NO: 427021 - DNA, 25 bp, Mus musculus
gaagcgagggcatgtaagaaattaa

SEQ ID NO: 427022 - DNA, 25 bp, Mus musculus
gaagcgagtactaactcttcgtaag

SEQ ID NO: 427023 - DNA, 25 bp, Mus musculus
gaagcgagtacttactcttcgtaag

SEQ ID NO: 427024 - DNA, 25 bp, Mus musculus
gaagcgagtcacaaacacatacagc

SEQ ID NO: 427025 - DNA, 25 bp, Mus musculus
gaagcgagtcactaacacatacagc

SEQ ID NO: 427026 - DNA, 25 bp, Mus musculus
gaagcgataccacgcaaattccagg

SEQ ID NO: 427027 - DNA, 25 bp, Mus musculus
gaagcgataccaggcaaattccagg

SEQ ID NO: 427028 - DNA, 25 bp, Mus musculus
gaagcgatcaggcactccactgtag

SEQ ID NO: 427029 - DNA, 25 bp, Mus musculus
gaagcgatcagggactccactgtag

SEQ ID NO: 427030 - DNA, 25 bp, Mus musculus
gaagcgatcattaatgttgtttctg

SEQ ID NO: 427031 - DNA, 25 bp, Mus musculus
gaagcgatcatttatgttgtttctg

SEQ ID NO: 427032 - DNA, 25 bp, Mus musculus
gaagcgatccagcacagctctgtca

SEQ ID NO: 427033 - DNA, 25 bp, Mus musculus
gaagcgatccaggacagctctgtca

SEQ ID NO: 427034 - DNA, 25 bp, Mus musculus
gaagcgatcgaaatccctggccagg

SEQ ID NO: 427035 - DNA, 25 bp, Mus musculus
gaagcgatcgaattccctggccagg

SEQ ID NO: 427036 - DNA, 25 bp, Mus musculus
gaagcgatctttaccgccggaatcc

SEQ ID NO: 427037 - DNA, 25 bp, Mus musculus
gaagcgatcttttccgccggaatcc

SEQ ID NO: 427038 - DNA, 25 bp, Mus musculus
gaagcgattactcctttactcaagt

SEQ ID NO: 427039 - DNA, 25 bp, Mus musculus
gaagcgattactgctttactcaagt

SEQ ID NO: 427040 - DNA, 25 bp, Mus musculus
gaagcgattccacggagccacaatc

SEQ ID NO: 427041 - DNA, 25 bp, Mus musculus
gaagcgattccagggagccacaatc

SEQ ID NO: 427042 - DNA, 25 bp, Mus musculus
gaagcgcaagaacaccaccaacgtg

SEQ ID NO: 427043 - DNA, 25 bp, Mus musculus
gaagcgcaagaagaccaccaacgtg

SEQ ID NO: 427044 - DNA, 25 bp, Mus musculus
gaagcgcaagacagccaagctccag

SEQ ID NO: 427045 - DNA, 25 bp, Mus musculus
gaagcgcaagactgccaagctccag

SEQ ID NO: 427046 - DNA, 25 bp, Mus musculus
gaagcgcaagttagttcgttggtgc

SEQ ID NO: 427047 - DNA, 25 bp, Mus musculus
gaagcgcaagtttgttcgttggtgc

SEQ ID NO: 427048 - DNA, 25 bp, Mus musculus
gaagcgcagcctctctgtcaatggc

SEQ ID NO: 427049 - DNA, 25 bp, Mus musculus
gaagcgcagcctgtctgtcaatggc

SEQ ID NO: 427050 - DNA, 25 bp, Mus musculus
gaagcgcagcttccagtactgatcc

SEQ ID NO: 427051 - DNA, 25 bp, Mus musculus
gaagcgcagcttgcagtactgatcc

SEQ ID NO: 427052 - DNA, 25 bp, Mus musculus
gaagcgcaggaaactcttgcagcag

SEQ ID NO: 427053 - DNA, 25 bp, Mus musculus
gaagcgcaggaatctcttgcagcag

SEQ ID NO: 427054 - DNA, 25 bp, Mus musculus
gaagcgcagtacagtttttccttcc

SEQ ID NO: 427055 - DNA, 25 bp, Mus musculus
gaagcgcagtactgtttttccttcc

SEQ ID NO: 427056 - DNA, 25 bp, Mus musculus
gaagcgcatccgataccatggccga

SEQ ID NO: 427057 - DNA, 25 bp, Mus musculus
gaagcgcatccgttaccatggccga

SEQ ID NO: 427058 - DNA, 25 bp, Mus musculus
gaagcgcatcctccattgcctggag

SEQ ID NO: 427059 - DNA, 25 bp, Mus musculus
gaagcgcatcctgcattgcctggag

SEQ ID NO: 427060 - DNA, 25 bp, Mus musculus
gaagcgcatggcagacaagtatgcc

SEQ ID NO: 427061 - DNA, 25 bp, Mus musculus
gaagcgcatggctgacaagtatgcc

SEQ ID NO: 427062 - DNA, 25 bp, Mus musculus
gaagcgcattctaattttcaaaacc

SEQ ID NO: 427063 - DNA, 25 bp, Mus musculus
gaagcgcattcttattttcaaaacc

SEQ ID NO: 427064 - DNA, 25 bp, Mus musculus
gaagcgccagacagaactgtgactc

SEQ ID NO: 427065 - DNA, 25 bp, Mus musculus
gaagcgccagactgaactgtgactc

SEQ ID NO: 427066 - DNA, 25 bp, Mus musculus
gaagcgccatgaattgtatgtgcat

SEQ ID NO: 427067 - DNA, 25 bp, Mus musculus
gaagcgccatgatttgtatgtgcat

SEQ ID NO: 427068 - DNA, 25 bp, Mus musculus
gaagcgccattacctcttcgatgtg

SEQ ID NO: 427069 - DNA, 25 bp, Mus musculus
gaagcgccattagctcttcgatgtg

SEQ ID NO: 427070 - DNA, 25 bp, Mus musculus
gaagcgcccgttaggactgaagtac

SEQ ID NO: 427071 - DNA, 25 bp, Mus musculus
gaagcgcccgtttggactgaagtac

SEQ ID NO: 427072 - DNA, 25 bp, Mus musculus
gaagcgccctgtattatcctaaagt

SEQ ID NO: 427073 - DNA, 25 bp, Mus musculus
gaagcgccctgttttatcctaaagt

SEQ ID NO: 427074 - DNA, 25 bp, Mus musculus
gaagcgccgctcaggaagtacgttc

SEQ ID NO: 427075 - DNA, 25 bp, Mus musculus
gaagcgccgctctggaagtacgttc

SEQ ID NO: 427076 - DNA, 25 bp, Mus musculus
gaagcgcctagcagtgtacaaggca

SEQ ID NO: 427077 - DNA, 25 bp, Mus musculus
gaagcgcctagctgtgtacaaggca

SEQ ID NO: 427078 - DNA, 25 bp, Mus musculus
gaagcgcctggcacagtcctgcctg

SEQ ID NO: 427079 - DNA, 25 bp, Mus musculus
gaagcgcctggctcagtcctgcctg

SEQ ID NO: 427080 - DNA, 25 bp, Mus musculus
gaagcgcgacatcggctcagagcac

SEQ ID NO: 427081 - DNA, 25 bp, Mus musculus
gaagcgcgacatgggctcagagcac

SEQ ID NO: 427082 - DNA, 25 bp, Mus musculus
gaagcgcgggacaccggaggcagaa

SEQ ID NO: 427083 - DNA, 25 bp, Mus musculus
gaagcgcgggactccggaggcagaa

SEQ ID NO: 427084 - DNA, 25 bp, Mus musculus
gaagcgctaaaaatgcctatcaggc

SEQ ID NO: 427085 - DNA, 25 bp, Mus musculus
gaagcgctaaaattgcctatcaggc

SEQ ID NO: 427086 - DNA, 25 bp, Mus musculus
gaagcgctatttacctataggctct

SEQ ID NO: 427087 - DNA, 25 bp, Mus musculus
gaagcgctattttcctataggctct

SEQ ID NO: 427088 - DNA, 25 bp, Mus musculus
gaagcgctcaccatgcaggaagcaa

SEQ ID NO: 427089 - DNA, 25 bp, Mus musculus
gaagcgctcaccttgcaggaagcaa

SEQ ID NO: 427090 - DNA, 25 bp, Mus musculus
gaagcgctcttacaagcaggacaga

SEQ ID NO: 427091 - DNA, 25 bp, Mus musculus
gaagcgctcttagaagcaggacaga

SEQ ID NO: 427092 - DNA, 25 bp, Mus musculus
gaagcgctcttgactatgagtaaag

SEQ ID NO: 427093 - DNA, 25 bp, Mus musculus
gaagcgctcttgtctatgagtaaag

SEQ ID NO: 427094 - DNA, 25 bp, Mus musculus
gaagcgctgcacaggctgttgtaac

SEQ ID NO: 427095 - DNA, 25 bp, Mus musculus
gaagcgctgcactggctgttgtaac

SEQ ID NO: 427096 - DNA, 25 bp, Mus musculus
gaagcgctgctacatttgactgcaa

SEQ ID NO: 427097 - DNA, 25 bp, Mus musculus
gaagcgctgctagatttgactgcaa

SEQ ID NO: 427098 - DNA, 25 bp, Mus musculus
gaagcgctgcttacatctaatatag

SEQ ID NO: 427099 - DNA, 25 bp, Mus musculus
gaagcgctgcttagaatgttccata

SEQ ID NO: 427100 - DNA, 25 bp, Mus musculus
gaagcgctgctttcatctaatatag

SEQ ID NO: 427101 - DNA, 25 bp, Mus musculus
gaagcgctgctttgaatgttccata

SEQ ID NO: 427102 - DNA, 25 bp, Mus musculus
gaagcgctggtgcacactaaatgtt

SEQ ID NO: 427103 - DNA, 25 bp, Mus musculus
gaagcgctggtggacactaaatgtt

SEQ ID NO: 427104 - DNA, 25 bp, Mus musculus
gaagcgctggttagtgctctctgac

SEQ ID NO: 427105 - DNA, 25 bp, Mus musculus
gaagcgctggtttgtgctctctgac

SEQ ID NO: 427106 - DNA, 25 bp, Mus musculus
gaagcgctgtaaagactgctacaag

SEQ ID NO: 427107 - DNA, 25 bp, Mus musculus
gaagcgctgtaatgactgctacaag

SEQ ID NO: 427108 - DNA, 25 bp, Mus musculus
gaagcgctgtgaagacactgtccca

SEQ ID NO: 427109 - DNA, 25 bp, Mus musculus
gaagcgctgtgatgacactgtccca

SEQ ID NO: 427110 - DNA, 25 bp, Mus musculus
gaagcgcttaccatttgatttcctg

SEQ ID NO: 427111 - DNA, 25 bp, Mus musculus
gaagcgcttaccttttgatttcctg

SEQ ID NO: 427112 - DNA, 25 bp, Mus musculus
gaagcgcttcaactatgcctcagac

SEQ ID NO: 427113 - DNA, 25 bp, Mus musculus
gaagcgcttcaagtatgcctcagac

SEQ ID NO: 427114 - DNA, 25 bp, Mus musculus
gaagcgcttctgactcagtgtggca

SEQ ID NO: 427115 - DNA, 25 bp, Mus musculus
gaagcgcttctgtctcagtgtggca

SEQ ID NO: 427116 - DNA, 25 bp, Mus musculus
gaagcgctttccatttttatgtcaa

SEQ ID NO: 427117 - DNA, 25 bp, Mus musculus
gaagcgctttcccacaggattgact

SEQ ID NO: 427118 - DNA, 25 bp, Mus musculus
gaagcgctttccgacaggattgact

SEQ ID NO: 427119 - DNA, 25 bp, Mus musculus
gaagcgctttccttttttatgtcaa

SEQ ID NO: 427120 - DNA, 25 bp, Mus musculus
gaagcgctttggacaggatctcaaa

SEQ ID NO: 427121 - DNA, 25 bp, Mus musculus
gaagcgctttggtcaggatctcaaa

SEQ ID NO: 427122 - DNA, 25 bp, Mus musculus
gaagcggaaaggatcccatgtccct

SEQ ID NO: 427123 - DNA, 25 bp, Mus musculus
gaagcggaaaggttcccatgtccct

SEQ ID NO: 427124 - DNA, 25 bp, Mus musculus
gaagcggaatgcagaggccgtcaaa

SEQ ID NO: 427125 - DNA, 25 bp, Mus musculus
gaagcggaatgctgaggccgtcaaa

SEQ ID NO: 427126 - DNA, 25 bp, Mus musculus
gaagcggacacaatgtttccaatct

SEQ ID NO: 427127 - DNA, 25 bp, Mus musculus
gaagcggacacattgtttccaatct

SEQ ID NO: 427128 - DNA, 25 bp, Mus musculus
gaagcggacattaatgagaccaaat

SEQ ID NO: 427129 - DNA, 25 bp, Mus musculus
gaagcggacattcttaacactgtga

SEQ ID NO: 427130 - DNA, 25 bp, Mus musculus
gaagcggacattgttaacactgtga

SEQ ID NO: 427131 - DNA, 25 bp, Mus musculus
gaagcggacatttatgagaccaaat

SEQ ID NO: 427132 - DNA, 25 bp, Mus musculus
gaagcggacctccatcgaggttagc

SEQ ID NO: 427133 - DNA, 25 bp, Mus musculus
gaagcggacctcgatcgaggttagc

SEQ ID NO: 427134 - DNA, 25 bp, Mus musculus
gaagcggacgaaccggagttacaac

SEQ ID NO: 427135 - DNA, 25 bp, Mus musculus
gaagcggacgaagcggagttacaac

SEQ ID NO: 427136 - DNA, 25 bp, Mus musculus
gaagcggagcacacctagggagcat

SEQ ID NO: 427137 - DNA, 25 bp, Mus musculus
gaagcggagcactcctagggagcat

SEQ ID NO: 427138 - DNA, 25 bp, Mus musculus
gaagcggatatgctgggaactcact

SEQ ID NO: 427139 - DNA, 25 bp, Mus musculus
gaagcggatatggtgggaactcact

SEQ ID NO: 427140 - DNA, 25 bp, Mus musculus
gaagcggatccgagcgactgtcacc

SEQ ID NO: 427141 - DNA, 25 bp, Mus musculus
gaagcggatccgtgcgactgtcacc

SEQ ID NO: 427142 - DNA, 25 bp, Mus musculus
gaagcggcactgattgcacatcatt

SEQ ID NO: 427143 - DNA, 25 bp, Mus musculus
gaagcggcactgtttgcacatcatt

SEQ ID NO: 427144 - DNA, 25 bp, Mus musculus
gaagcggcagaaaatcaggctgtta

SEQ ID NO: 427145 - DNA, 25 bp, Mus musculus
gaagcggcagaaccacagctcctga

SEQ ID NO: 427146 - DNA, 25 bp, Mus musculus
gaagcggcagaagcacagctcctga

SEQ ID NO: 427147 - DNA, 25 bp, Mus musculus
gaagcggcagaatatcaggctgtta

SEQ ID NO: 427148 - DNA, 25 bp, Mus musculus
gaagcggcataactggtcagtcctg

SEQ ID NO: 427149 - DNA, 25 bp, Mus musculus
gaagcggcataagtggtcagtcctg

SEQ ID NO: 427150 - DNA, 25 bp, Mus musculus
gaagcggccaaaccactcaggagct

SEQ ID NO: 427151 - DNA, 25 bp, Mus musculus
gaagcggccaaagcactcaggagct

SEQ ID NO: 427152 - DNA, 25 bp, Mus musculus
gaagcggcctgcaagcaacatttct

SEQ ID NO: 427153 - DNA, 25 bp, Mus musculus
gaagcggcctgctagcaacatttct

SEQ ID NO: 427154 - DNA, 25 bp, Mus musculus
gaagcggccttcagcgttcttttta

SEQ ID NO: 427155 - DNA, 25 bp, Mus musculus
gaagcggccttctgcgttcttttta

SEQ ID NO: 427156 - DNA, 25 bp, Mus musculus
gaagcggcgggtcacacctctgcct

SEQ ID NO: 427157 - DNA, 25 bp, Mus musculus
gaagcggcgggtgacacctctgcct

SEQ ID NO: 427158 - DNA, 25 bp, Mus musculus
gaagcggctcggaacatagcagttt

SEQ ID NO: 427159 - DNA, 25 bp, Mus musculus
gaagcggctcggtacatagcagttt

SEQ ID NO: 427160 - DNA, 25 bp, Mus musculus
gaagcggctctcagtagcacaggca

SEQ ID NO: 427161 - DNA, 25 bp, Mus musculus
gaagcggctctctgtagcacaggca

SEQ ID NO: 427162 - DNA, 25 bp, Mus musculus
gaagcggctcttcccaaacaagcca

SEQ ID NO: 427163 - DNA, 25 bp, Mus musculus
gaagcggctcttgccaaacaagcca

SEQ ID NO: 427164 - DNA, 25 bp, Mus musculus
gaagcggctgctcaaatcaccagaa

SEQ ID NO: 427165 - DNA, 25 bp, Mus musculus
gaagcggctgctgaaatcaccagaa

SEQ ID NO: 427166 - DNA, 25 bp, Mus musculus
gaagcggcttgccaagacagtactg

SEQ ID NO: 427167 - DNA, 25 bp, Mus musculus
gaagcggcttgcgaagacagtactg

SEQ ID NO: 427168 - DNA, 25 bp, Mus musculus
gaagcggcttgtcctgttcctgaag

SEQ ID NO: 427169 - DNA, 25 bp, Mus musculus
gaagcggcttgtgctgttcctgaag

SEQ ID NO: 427170 - DNA, 25 bp, Mus musculus
gaagcgggacaaagcagcctcccag

SEQ ID NO: 427171 - DNA, 25 bp, Mus musculus
gaagcgggacaatgcagcctcccag

SEQ ID NO: 427172 - DNA, 25 bp, Mus musculus
gaagcgggagcaattctccctgatt

SEQ ID NO: 427173 - DNA, 25 bp, Mus musculus
gaagcgggagcatttctccctgatt

SEQ ID NO: 427174 - DNA, 25 bp, Mus musculus
gaagcgggcaagacattgacctttt

SEQ ID NO: 427175 - DNA, 25 bp, Mus musculus
gaagcgggcaagtcattgacctttt

SEQ ID NO: 427176 - DNA, 25 bp, Mus musculus
gaagcgggcatccagcgaaagtacc

SEQ ID NO: 427177 - DNA, 25 bp, Mus musculus
gaagcgggcatcgagcgaaagtacc

SEQ ID NO: 427178 - DNA, 25 bp, Mus musculus
gaagcgggcattatgccatctgtgt

SEQ ID NO: 427179 - DNA, 25 bp, Mus musculus
gaagcgggcattttgccatctgtgt

SEQ ID NO: 427180 - DNA, 25 bp, Mus musculus
gaagcgggcccacacagatgaacca

SEQ ID NO: 427181 - DNA, 25 bp, Mus musculus
gaagcgggcccagacagatgaacca

SEQ ID NO: 427182 - DNA, 25 bp, Mus musculus
gaagcgggcttgagttttgttgtct

SEQ ID NO: 427183 - DNA, 25 bp, Mus musculus
gaagcgggcttgtgttttgttgtct

SEQ ID NO: 427184 - DNA, 25 bp, Mus musculus
gaagcggggtggcacaatgtgattt

SEQ ID NO: 427185 - DNA, 25 bp, Mus musculus
gaagcggggtgggacaatgtgattt

SEQ ID NO: 427186 - DNA, 25 bp, Mus musculus
gaagcgggtgcgacttcagcaagcc

SEQ ID NO: 427187 - DNA, 25 bp, Mus musculus
gaagcgggtgcgtcttcagcaagcc

SEQ ID NO: 427188 - DNA, 25 bp, Mus musculus
gaagcggtaggtccacgcctcattg

SEQ ID NO: 427189 - DNA, 25 bp, Mus musculus
gaagcggtaggtgcacgcctcattg

SEQ ID NO: 427190 - DNA, 25 bp, Mus musculus
gaagcggtcctaaagaaacccagac

SEQ ID NO: 427191 - DNA, 25 bp, Mus musculus
gaagcggtcctatagaaacccagac

SEQ ID NO: 427192 - DNA, 25 bp, Mus musculus
gaagcggtgatcagtagcaccccag

SEQ ID NO: 427193 - DNA, 25 bp, Mus musculus
gaagcggtgatctgtagcaccccag

SEQ ID NO: 427194 - DNA, 25 bp, Mus musculus
gaagcggtgcctcttgactttgaga

SEQ ID NO: 427195 - DNA, 25 bp, Mus musculus
gaagcggtgcctgttgactttgaga

SEQ ID NO: 427196 - DNA, 25 bp, Mus musculus
gaagcggttcaaacctgtttcggac

SEQ ID NO: 427197 - DNA, 25 bp, Mus musculus
gaagcggttcaatcctgtttcggac

SEQ ID NO: 427198 - DNA, 25 bp, Mus musculus
gaagcggttcgacaagctcctggac

SEQ ID NO: 427199 - DNA, 25 bp, Mus musculus
gaagcggttcgagaagctcctggac

SEQ ID NO: 427200 - DNA, 25 bp, Mus musculus
gaagcggttgacacttggcatctaa

SEQ ID NO: 427201 - DNA, 25 bp, Mus musculus
gaagcggttgactcttggcatctaa

SEQ ID NO: 427202 - DNA, 25 bp, Mus musculus
gaagcgtaaaatcctagttaggtac

SEQ ID NO: 427203 - DNA, 25 bp, Mus musculus
gaagcgtaaaatgctagttaggtac

SEQ ID NO: 427204 - DNA, 25 bp, Mus musculus
gaagcgtcagtgattacctcctttt

SEQ ID NO: 427205 - DNA, 25 bp, Mus musculus
gaagcgtcagtgtttacctcctttt

SEQ ID NO: 427206 - DNA, 25 bp, Mus musculus
gaagcgtccacaagaaccctcgaac

SEQ ID NO: 427207 - DNA, 25 bp, Mus musculus
gaagcgtccacatgaaccctcgaac

SEQ ID NO: 427208 - DNA, 25 bp, Mus musculus
gaagcgtccatgcttatcaccgagt

SEQ ID NO: 427209 - DNA, 25 bp, Mus musculus
gaagcgtccatggttatcaccgagt

SEQ ID NO: 427210 - DNA, 25 bp, Mus musculus
gaagcgtcgctaaagtctacacact

SEQ ID NO: 427211 - DNA, 25 bp, Mus musculus
gaagcgtcgctatagtctacacact

SEQ ID NO: 427212 - DNA, 25 bp, Mus musculus
gaagcgtctcaactttccaattgaa

SEQ ID NO: 427213 - DNA, 25 bp, Mus musculus
gaagcgtctcaagtttccaattgaa

SEQ ID NO: 427214 - DNA, 25 bp, Mus musculus
gaagcgtctcacacccgaagggcaa

SEQ ID NO: 427215 - DNA, 25 bp, Mus musculus
gaagcgtctcactcccgaagggcaa

SEQ ID NO: 427216 - DNA, 25 bp, Mus musculus
gaagcgtctctcagagttttgcatg

SEQ ID NO: 427217 - DNA, 25 bp, Mus musculus
gaagcgtctctctgagttttgcatg

SEQ ID NO: 427218 - DNA, 25 bp, Mus musculus
gaagcgtctgttaacaaactttcac

SEQ ID NO: 427219 - DNA, 25 bp, Mus musculus
gaagcgtctgtttacaaactttcac

SEQ ID NO: 427220 - DNA, 25 bp, Mus musculus
gaagcgtcttacctccgggagtcca

SEQ ID NO: 427221 - DNA, 25 bp, Mus musculus
gaagcgtcttacgtccgggagtcca

SEQ ID NO: 427222 - DNA, 25 bp, Mus musculus
gaagcgtctttcaccattgttttaa

SEQ ID NO: 427223 - DNA, 25 bp, Mus musculus
gaagcgtctttctccattgttttaa

SEQ ID NO: 427224 - DNA, 25 bp, Mus musculus
gaagcgtgaaccaaacttacaagca

SEQ ID NO: 427225 - DNA, 25 bp, Mus musculus
gaagcgtgaacctaacttacaagca

SEQ ID NO: 427226 - DNA, 25 bp, Mus musculus
gaagcgtgaccccaagatcgtgaca

SEQ ID NO: 427227 - DNA, 25 bp, Mus musculus
gaagcgtgacccgaagatcgtgaca

SEQ ID NO: 427228 - DNA, 25 bp, Mus musculus
gaagcgtgactgactggtgtattgt

SEQ ID NO: 427229 - DNA, 25 bp, Mus musculus
gaagcgtgactgtctggtgtattgt

SEQ ID NO: 427230 - DNA, 25 bp, Mus musculus
gaagcgtgctgcacagcggagcaca

SEQ ID NO: 427231 - DNA, 25 bp, Mus musculus
gaagcgtgctgctcagcggagcaca

SEQ ID NO: 427232 - DNA, 25 bp, Mus musculus
gaagcgtgcttccagtaaccaaatg

SEQ ID NO: 427233 - DNA, 25 bp, Mus musculus
gaagcgtgcttcgagtaaccaaatg

SEQ ID NO: 427234 - DNA, 25 bp, Mus musculus
gaagcgtgggacaatctgaatcatc

SEQ ID NO: 427235 - DNA, 25 bp, Mus musculus
gaagcgtgggactatctgaatcatc

SEQ ID NO: 427236 - DNA, 25 bp, Mus musculus
gaagcgtggttactacagccagccc

SEQ ID NO: 427237 - DNA, 25 bp, Mus musculus
gaagcgtggttagtacagccagccc

SEQ ID NO: 427238 - DNA, 25 bp, Mus musculus
gaagcgtgtacaacttaggctcaag

SEQ ID NO: 427239 - DNA, 25 bp, Mus musculus
gaagcgtgtacatcttaggctcaag

SEQ ID NO: 427240 - DNA, 25 bp, Mus musculus
gaagcgtgtaccagtcagctccaag

SEQ ID NO: 427241 - DNA, 25 bp, Mus musculus
gaagcgtgtacctgtcagctccaag

SEQ ID NO: 427242 - DNA, 25 bp, Mus musculus
gaagcgtgttaaaatttccactaca

SEQ ID NO: 427243 - DNA, 25 bp, Mus musculus
gaagcgtgttaatatttccactaca

SEQ ID NO: 427244 - DNA, 25 bp, Mus musculus
gaagcgttacagaccgggccaggct

SEQ ID NO: 427245 - DNA, 25 bp, Mus musculus
gaagcgttacagtccgggccaggct

SEQ ID NO: 427246 - DNA, 25 bp, Mus musculus
gaagcgttagctatatccccaagca

SEQ ID NO: 427247 - DNA, 25 bp, Mus musculus
gaagcgttagctttatccccaagca

SEQ ID NO: 427248 - DNA, 25 bp, Mus musculus
gaagcgttatgaatcccttcttctc

SEQ ID NO: 427249 - DNA, 25 bp, Mus musculus
gaagcgttatgattcccttcttctc

SEQ ID NO: 427250 - DNA, 25 bp, Mus musculus
gaagcgttcattcctaggcagttgc

SEQ ID NO: 427251 - DNA, 25 bp, Mus musculus
gaagcgttcattgctaggcagttgc

SEQ ID NO: 427252 - DNA, 25 bp, Mus musculus
gaagcgttctaactgacttttagct

SEQ ID NO: 427253 - DNA, 25 bp, Mus musculus
gaagcgttctaagtgacttttagct

SEQ ID NO: 427254 - DNA, 25 bp, Mus musculus
gaagcgttctagagagtctgagcag

SEQ ID NO: 427255 - DNA, 25 bp, Mus musculus
gaagcgttctagtgagtctgagcag

SEQ ID NO: 427256 - DNA, 25 bp, Mus musculus
gaagcgttgactaaagagatgccaa

SEQ ID NO: 427257 - DNA, 25 bp, Mus musculus
gaagcgttgacttaagagatgccaa

SEQ ID NO: 427258 - DNA, 25 bp, Mus musculus
gaagcgttgcaacaagtcctgaaga

SEQ ID NO: 427259 - DNA, 25 bp, Mus musculus
gaagcgttgcaagaagtcctgaaga

SEQ ID NO: 427260 - DNA, 25 bp, Mus musculus
gaagcgttgctcacggagctttcct

SEQ ID NO: 427261 - DNA, 25 bp, Mus musculus
gaagcgttgctctcggagctttcct

SEQ ID NO: 427262 - DNA, 25 bp, Mus musculus
gaagcgtttatgctgctcacaggtt

SEQ ID NO: 427263 - DNA, 25 bp, Mus musculus
gaagcgtttatggtgctcacaggtt

SEQ ID NO: 427264 - DNA, 25 bp, Mus musculus
gaagcgtttcctccttttcttcaga

SEQ ID NO: 427265 - DNA, 25 bp, Mus musculus
gaagcgtttcctgcttttcttcaga

SEQ ID NO: 427266 - DNA, 25 bp, Mus musculus
gaagcgtttgagagtccaggaccca

SEQ ID NO: 427267 - DNA, 25 bp, Mus musculus
gaagcgtttgagtgtccaggaccca

SEQ ID NO: 427268 - DNA, 25 bp, Mus musculus
gaagcgttttcaacctttggaacag

SEQ ID NO: 427269 - DNA, 25 bp, Mus musculus
gaagcgttttcatcctttggaacag

SEQ ID NO: 427270 - DNA, 25 bp, Mus musculus
gaagctaaaagcagcgggccaccaa

SEQ ID NO: 427271 - DNA, 25 bp, Mus musculus
gaagctaaaagctgcgggccaccaa

SEQ ID NO: 427272 - DNA, 25 bp, Mus musculus
gaagctaaacccagatttcaatgat

SEQ ID NO: 427273 - DNA, 25 bp, Mus musculus
gaagctaaaccctgatttcaatgat

SEQ ID NO: 427274 - DNA, 25 bp, Mus musculus
gaagctaaactgcaagccccgcgtt

SEQ ID NO: 427275 - DNA, 25 bp, Mus musculus
gaagctaaactggaagccccgcgtt

SEQ ID NO: 427276 - DNA, 25 bp, Mus musculus
gaagctaaagccactctggatgcgt

SEQ ID NO: 427277 - DNA, 25 bp, Mus musculus
gaagctaaagcctctctggatgcgt

SEQ ID NO: 427278 - DNA, 25 bp, Mus musculus
gaagctaaagtgatcctccatttta

SEQ ID NO: 427279 - DNA, 25 bp, Mus musculus
gaagctaaagtgttcctccatttta

SEQ ID NO: 427280 - DNA, 25 bp, Mus musculus
gaagctaaagttaccaactccagtt

SEQ ID NO: 427281 - DNA, 25 bp, Mus musculus
gaagctaaagtttccaactccagtt

SEQ ID NO: 427282 - DNA, 25 bp, Mus musculus
gaagctaaatagatccctgcctttc

SEQ ID NO: 427283 - DNA, 25 bp, Mus musculus
gaagctaaatagttccctgcctttc

SEQ ID NO: 427284 - DNA, 25 bp, Mus musculus
gaagctaaattcaggtttccaccat

SEQ ID NO: 427285 - DNA, 25 bp, Mus musculus
gaagctaaattctggtttccaccat

SEQ ID NO: 427286 - DNA, 25 bp, Mus musculus
gaagctaacaacagttcccagctgt

SEQ ID NO: 427287 - DNA, 25 bp, Mus musculus
gaagctaacaactgttcccagctgt

SEQ ID NO: 427288 - DNA, 25 bp, Mus musculus
gaagctaacaccatctatgtgaggt

SEQ ID NO: 427289 - DNA, 25 bp, Mus musculus
gaagctaacaccttctatgtgaggt

SEQ ID NO: 427290 - DNA, 25 bp, Mus musculus
gaagctaacagtacttaagtctagt

SEQ ID NO: 427291 - DNA, 25 bp, Mus musculus
gaagctaacagttcttaagtctagt

SEQ ID NO: 427292 - DNA, 25 bp, Mus musculus
gaagctaacataaacccatcaccgg

SEQ ID NO: 427293 - DNA, 25 bp, Mus musculus
gaagctaacatatacccatcaccgg

SEQ ID NO: 427294 - DNA, 25 bp, Mus musculus
gaagctaacattacactgccaggac

SEQ ID NO: 427295 - DNA, 25 bp, Mus musculus
gaagctaacatttcactgccaggac

SEQ ID NO: 427296 - DNA, 25 bp, Mus musculus
gaagctaaccacactttattgtacc

SEQ ID NO: 427297 - DNA, 25 bp, Mus musculus
gaagctaaccactctttattgtacc

SEQ ID NO: 427298 - DNA, 25 bp, Mus musculus
gaagctaaccagcattctagatcct

SEQ ID NO: 427299 - DNA, 25 bp, Mus musculus
gaagctaaccaggattctagatcct

SEQ ID NO: 427300 - DNA, 25 bp, Mus musculus
gaagctaaccctatagcagaccacg

SEQ ID NO: 427301 - DNA, 25 bp, Mus musculus
gaagctaaccctttagcagaccacg

SEQ ID NO: 427302 - DNA, 25 bp, Mus musculus
gaagctaaccgcaggccccgaatca

SEQ ID NO: 427303 - DNA, 25 bp, Mus musculus
gaagctaaccgctggccccgaatca

SEQ ID NO: 427304 - DNA, 25 bp, Mus musculus
gaagctaactgcatctatcctgagg

SEQ ID NO: 427305 - DNA, 25 bp, Mus musculus
gaagctaactgcttctatcctgagg

SEQ ID NO: 427306 - DNA, 25 bp, Mus musculus
gaagctaagagtacagtcctgggac

SEQ ID NO: 427307 - DNA, 25 bp, Mus musculus
gaagctaagagtctttgtggttgta

SEQ ID NO: 427308 - DNA, 25 bp, Mus musculus
gaagctaagagtgtttgtggttgta

SEQ ID NO: 427309 - DNA, 25 bp, Mus musculus
gaagctaagagttcagtcctgggac

SEQ ID NO: 427310 - DNA, 25 bp, Mus musculus
gaagctaagattccttggcagcgtt

SEQ ID NO: 427311 - DNA, 25 bp, Mus musculus
gaagctaagattgcttggcagcgtt

SEQ ID NO: 427312 - DNA, 25 bp, Mus musculus
gaagctaagccaactcacagaagga

SEQ ID NO: 427313 - DNA, 25 bp, Mus musculus
gaagctaagccatctcacagaagga

SEQ ID NO: 427314 - DNA, 25 bp, Mus musculus
gaagctaaggagatcccatcctggt

SEQ ID NO: 427315 - DNA, 25 bp, Mus musculus
gaagctaaggagatttctgacttta

SEQ ID NO: 427316 - DNA, 25 bp, Mus musculus
gaagctaaggagttcccatcctggt

SEQ ID NO: 427317 - DNA, 25 bp, Mus musculus
gaagctaaggagttttctgacttta

SEQ ID NO: 427318 - DNA, 25 bp, Mus musculus
gaagctaaggcaccgtctctcctta

SEQ ID NO: 427319 - DNA, 25 bp, Mus musculus
gaagctaaggcagcgtctctcctta

SEQ ID NO: 427320 - DNA, 25 bp, Mus musculus
gaagctaaggtaaggccagttcagg

SEQ ID NO: 427321 - DNA, 25 bp, Mus musculus
gaagctaaggtatggccagttcagg

SEQ ID NO: 427322 - DNA, 25 bp, Mus musculus
gaagctaagttaatctcaggagcag

SEQ ID NO: 427323 - DNA, 25 bp, Mus musculus
gaagctaagttattctcaggagcag

SEQ ID NO: 427324 - DNA, 25 bp, Mus musculus
gaagctaatactcacctgcctgtga

SEQ ID NO: 427325 - DNA, 25 bp, Mus musculus
gaagctaatactcttgctcagcagt

SEQ ID NO: 427326 - DNA, 25 bp, Mus musculus
gaagctaatactgacctgcctgtga

SEQ ID NO: 427327 - DNA, 25 bp, Mus musculus
gaagctaatactgttgctcagcagt

SEQ ID NO: 427328 - DNA, 25 bp, Mus musculus
gaagctaatatgatgttcattctaa

SEQ ID NO: 427329 - DNA, 25 bp, Mus musculus
gaagctaatatgttgttcattctaa

SEQ ID NO: 427330 - DNA, 25 bp, Mus musculus
gaagctaatctaacaccagcaaacc

SEQ ID NO: 427331 - DNA, 25 bp, Mus musculus
gaagctaatctatcaccagcaaacc

SEQ ID NO: 427332 - DNA, 25 bp, Mus musculus
gaagctaatctcatccttgggaatg

SEQ ID NO: 427333 - DNA, 25 bp, Mus musculus
gaagctaatctcttccttgggaatg

SEQ ID NO: 427334 - DNA, 25 bp, Mus musculus
gaagctaatgctagccagatctgtg

SEQ ID NO: 427335 - DNA, 25 bp, Mus musculus
gaagctaatgcttgccagatctgtg

SEQ ID NO: 427336 - DNA, 25 bp, Mus musculus
gaagctaattaaacgaagcatcacc

SEQ ID NO: 427337 - DNA, 25 bp, Mus musculus
gaagctaattaatcgaagcatcacc

SEQ ID NO: 427338 - DNA, 25 bp, Mus musculus
gaagctaatttcactgacatcagtg

SEQ ID NO: 427339 - DNA, 25 bp, Mus musculus
gaagctaatttctctgacatcagtg

SEQ ID NO: 427340 - DNA, 25 bp, Mus musculus
gaagctacaaaaaacctccagagag

SEQ ID NO: 427341 - DNA, 25 bp, Mus musculus
gaagctacaaaatacctccagagag

SEQ ID NO: 427342 - DNA, 25 bp, Mus musculus
gaagctacaatcagggcaaaatcag

SEQ ID NO: 427343 - DNA, 25 bp, Mus musculus
gaagctacaatctgggcaaaatcag

SEQ ID NO: 427344 - DNA, 25 bp, Mus musculus
gaagctacaattataggcgtgagaa

SEQ ID NO: 427345 - DNA, 25 bp, Mus musculus
gaagctacaattttaggcgtgagaa

SEQ ID NO: 427346 - DNA, 25 bp, Mus musculus
gaagctacacagacatctttaaagt

SEQ ID NO: 427347 - DNA, 25 bp, Mus musculus
gaagctacacagtcatctttaaagt

SEQ ID NO: 427348 - DNA, 25 bp, Mus musculus
gaagctacacataacgcagtggatt

SEQ ID NO: 427349 - DNA, 25 bp, Mus musculus
gaagctacacattacgcagtggatt

SEQ ID NO: 427350 - DNA, 25 bp, Mus musculus
gaagctacaccaatatctgttcctg

SEQ ID NO: 427351 - DNA, 25 bp, Mus musculus
gaagctacaccattatctgttcctg

SEQ ID NO: 427352 - DNA, 25 bp, Mus musculus
gaagctacacccagagacagagctg

SEQ ID NO: 427353 - DNA, 25 bp, Mus musculus
gaagctacaccctgagacagagctg

SEQ ID NO: 427354 - DNA, 25 bp, Mus musculus
gaagctacacctcctaacctgggat

SEQ ID NO: 427355 - DNA, 25 bp, Mus musculus
gaagctacacctgctaacctgggat

SEQ ID NO: 427356 - DNA, 25 bp, Mus musculus
gaagctacacgtcggctgagctgac

SEQ ID NO: 427357 - DNA, 25 bp, Mus musculus
gaagctacacgtgggctgagctgac

SEQ ID NO: 427358 - DNA, 25 bp, Mus musculus
gaagctacacttcgcagagaatgct

SEQ ID NO: 427359 - DNA, 25 bp, Mus musculus
gaagctacacttggcagagaatgct

SEQ ID NO: 427360 - DNA, 25 bp, Mus musculus
gaagctacagaaccattgttaggaa

SEQ ID NO: 427361 - DNA, 25 bp, Mus musculus
gaagctacagaagcattgttaggaa

SEQ ID NO: 427362 - DNA, 25 bp, Mus musculus
gaagctacagctagcccaagatctg

SEQ ID NO: 427363 - DNA, 25 bp, Mus musculus
gaagctacagctatcccttagatta

SEQ ID NO: 427364 - DNA, 25 bp, Mus musculus
gaagctacagcttgcccaagatctg

SEQ ID NO: 427365 - DNA, 25 bp, Mus musculus
gaagctacagctttcccttagatta

SEQ ID NO: 427366 - DNA, 25 bp, Mus musculus
gaagctacaggcaagggccaacgga

SEQ ID NO: 427367 - DNA, 25 bp, Mus musculus
gaagctacaggctagggccaacgga

SEQ ID NO: 427368 - DNA, 25 bp, Mus musculus
gaagctacataaatcagagtttttg

SEQ ID NO: 427369 - DNA, 25 bp, Mus musculus
gaagctacataattcagagtttttg

SEQ ID NO: 427370 - DNA, 25 bp, Mus musculus
gaagctacatgtagctaacctagaa

SEQ ID NO: 427371 - DNA, 25 bp, Mus musculus
gaagctacatgttgctaacctagaa

SEQ ID NO: 427372 - DNA, 25 bp, Mus musculus
gaagctacattacttgattttgttt

SEQ ID NO: 427373 - DNA, 25 bp, Mus musculus
gaagctacattagttgattttgttt

SEQ ID NO: 427374 - DNA, 25 bp, Mus musculus
gaagctaccaacatagttccctact

SEQ ID NO: 427375 - DNA, 25 bp, Mus musculus
gaagctaccaacttagttccctact

SEQ ID NO: 427376 - DNA, 25 bp, Mus musculus
gaagctaccattaagcccagtagag

SEQ ID NO: 427377 - DNA, 25 bp, Mus musculus
gaagctaccattatatccaggtgag

SEQ ID NO: 427378 - DNA, 25 bp, Mus musculus
gaagctaccatttagcccagtagag

SEQ ID NO: 427379 - DNA, 25 bp, Mus musculus
gaagctaccattttatccaggtgag

SEQ ID NO: 427380 - DNA, 25 bp, Mus musculus
gaagctacccctcaaaatgacccta

SEQ ID NO: 427381 - DNA, 25 bp, Mus musculus
gaagctacccctgaaaatgacccta

SEQ ID NO: 427382 - DNA, 25 bp, Mus musculus
gaagctacctaaaccacatggtgtg

SEQ ID NO: 427383 - DNA, 25 bp, Mus musculus
gaagctacctaatccacatggtgtg

SEQ ID NO: 427384 - DNA, 25 bp, Mus musculus
gaagctacctgacctgcaccatgct

SEQ ID NO: 427385 - DNA, 25 bp, Mus musculus
gaagctacctgagctgcaccatgct

SEQ ID NO: 427386 - DNA, 25 bp, Mus musculus
gaagctacgcaaaacgcacactatt

SEQ ID NO: 427387 - DNA, 25 bp, Mus musculus
gaagctacgcaatacgcacactatt

SEQ ID NO: 427388 - DNA, 25 bp, Mus musculus
gaagctacgctaagacacggctgtc

SEQ ID NO: 427389 - DNA, 25 bp, Mus musculus
gaagctacgctaatgtcatagcaaa

SEQ ID NO: 427390 - DNA, 25 bp, Mus musculus
gaagctacgctatgacacggctgtc

SEQ ID NO: 427391 - DNA, 25 bp, Mus musculus
gaagctacgctattgtcatagcaaa

SEQ ID NO: 427392 - DNA, 25 bp, Mus musculus
gaagctacggcactgaccccgagga

SEQ ID NO: 427393 - DNA, 25 bp, Mus musculus
gaagctacggcagtgaccccgagga

SEQ ID NO: 427394 - DNA, 25 bp, Mus musculus
gaagctacgtgaagtctaccgtaaa

SEQ ID NO: 427395 - DNA, 25 bp, Mus musculus
gaagctacgtgatgtctaccgtaaa

SEQ ID NO: 427396 - DNA, 25 bp, Mus musculus
gaagctacgtgcagaaggacctcaa

SEQ ID NO: 427397 - DNA, 25 bp, Mus musculus
gaagctacgtgctgaaggacctcaa

SEQ ID NO: 427398 - DNA, 25 bp, Mus musculus
gaagctactaagaggttcttggaac

SEQ ID NO: 427399 - DNA, 25 bp, Mus musculus
gaagctactaagtggttcttggaac

SEQ ID NO: 427400 - DNA, 25 bp, Mus musculus
gaagctactatgagcctgtgaccag

SEQ ID NO: 427401 - DNA, 25 bp, Mus musculus
gaagctactatgtgcctgtgaccag

SEQ ID NO: 427402 - DNA, 25 bp, Mus musculus
gaagctactccaatcatgtccttta

SEQ ID NO: 427403 - DNA, 25 bp, Mus musculus
gaagctactccattcatgtccttta

SEQ ID NO: 427404 - DNA, 25 bp, Mus musculus
gaagctactcctcagtaatcgagaa

SEQ ID NO: 427405 - DNA, 25 bp, Mus musculus
gaagctactcctgagtaatcgagaa

SEQ ID NO: 427406 - DNA, 25 bp, Mus musculus
gaagctactctgatgtattcctgat

SEQ ID NO: 427407 - DNA, 25 bp, Mus musculus
gaagctactctgttgtattcctgat

SEQ ID NO: 427408 - DNA, 25 bp, Mus musculus
gaagctactgctcaacttgaatctg

SEQ ID NO: 427409 - DNA, 25 bp, Mus musculus
gaagctactgctgaacttgaatctg

SEQ ID NO: 427410 - DNA, 25 bp, Mus musculus
gaagctactgttactatatctctgt

SEQ ID NO: 427411 - DNA, 25 bp, Mus musculus
gaagctactgtttctatatctctgt

SEQ ID NO: 427412 - DNA, 25 bp, Mus musculus
gaagctacttagagaagctctcctt

SEQ ID NO: 427413 - DNA, 25 bp, Mus musculus
gaagctacttagtgaagctctcctt

SEQ ID NO: 427414 - DNA, 25 bp, Mus musculus
gaagctacttctccaaatgcattgc

SEQ ID NO: 427415 - DNA, 25 bp, Mus musculus
gaagctacttctcggcttcatcagt

SEQ ID NO: 427416 - DNA, 25 bp, Mus musculus
gaagctacttctgcaaatgcattgc

SEQ ID NO: 427417 - DNA, 25 bp, Mus musculus
gaagctacttctgggcttcatcagt

SEQ ID NO: 427418 - DNA, 25 bp, Mus musculus
gaagctacttgcaagcctgaaagac

SEQ ID NO: 427419 - DNA, 25 bp, Mus musculus
gaagctacttgcatgacttggtcac

SEQ ID NO: 427420 - DNA, 25 bp, Mus musculus
gaagctacttgctagcctgaaagac

SEQ ID NO: 427421 - DNA, 25 bp, Mus musculus
gaagctacttgcttgacttggtcac

SEQ ID NO: 427422 - DNA, 25 bp, Mus musculus
gaagctagagtgcagacccggaact

SEQ ID NO: 427423 - DNA, 25 bp, Mus musculus
gaagctagagtggagacccggaact

SEQ ID NO: 427424 - DNA, 25 bp, Mus musculus
gaagctagatgcaacctccttgtaa

SEQ ID NO: 427425 - DNA, 25 bp, Mus musculus
gaagctagatgctacctccttgtaa

SEQ ID NO: 427426 - DNA, 25 bp, Mus musculus
gaagctagatgtcactgcagaagtc

SEQ ID NO: 427427 - DNA, 25 bp, Mus musculus
gaagctagatgtgactgcagaagtc

SEQ ID NO: 427428 - DNA, 25 bp, Mus musculus
gaagctagctacctttcaagtggaa

SEQ ID NO: 427429 - DNA, 25 bp, Mus musculus
gaagctagctacgtttcaagtggaa

SEQ ID NO: 427430 - DNA, 25 bp, Mus musculus
gaagctagctgcctaagcggcctct

SEQ ID NO: 427431 - DNA, 25 bp, Mus musculus
gaagctagctgcgtaagcggcctct

SEQ ID NO: 427432 - DNA, 25 bp, Mus musculus
gaagctagcttcaacttctgtgaaa

SEQ ID NO: 427433 - DNA, 25 bp, Mus musculus
gaagctagcttcctgacaatcatgt

SEQ ID NO: 427434 - DNA, 25 bp, Mus musculus
gaagctagcttcgtgacaatcatgt

SEQ ID NO: 427435 - DNA, 25 bp, Mus musculus
gaagctagcttctacttctgtgaaa

SEQ ID NO: 427436 - DNA, 25 bp, Mus musculus
gaagctaggcagcagcatccggcca

SEQ ID NO: 427437 - DNA, 25 bp, Mus musculus
gaagctaggcaggagcatccggcca

SEQ ID NO: 427438 - DNA, 25 bp, Mus musculus
gaagctaggcttaaactctgtagtc

SEQ ID NO: 427439 - DNA, 25 bp, Mus musculus
gaagctaggcttcactatagagtga

SEQ ID NO: 427440 - DNA, 25 bp, Mus musculus
gaagctaggcttgactatagagtga

SEQ ID NO: 427441 - DNA, 25 bp, Mus musculus
gaagctaggctttaactctgtagtc

SEQ ID NO: 427442 - DNA, 25 bp, Mus musculus
gaagctaggtacagactgacgtcaa

SEQ ID NO: 427443 - DNA, 25 bp, Mus musculus
gaagctaggtactgactgacgtcaa

SEQ ID NO: 427444 - DNA, 25 bp, Mus musculus
gaagctaggtgaacagagaactgca

SEQ ID NO: 427445 - DNA, 25 bp, Mus musculus
gaagctaggtgatcagagaactgca

SEQ ID NO: 427446 - DNA, 25 bp, Mus musculus
gaagctaggtggaagctcgtcccag

SEQ ID NO: 427447 - DNA, 25 bp, Mus musculus
gaagctaggtggtagctcgtcccag

SEQ ID NO: 427448 - DNA, 25 bp, Mus musculus
gaagctagtcagcagcagtcttctg

SEQ ID NO: 427449 - DNA, 25 bp, Mus musculus
gaagctagtcaggagcagtcttctg

SEQ ID NO: 427450 - DNA, 25 bp, Mus musculus
gaagctagtgacactttgaggttaa

SEQ ID NO: 427451 - DNA, 25 bp, Mus musculus
gaagctagtgactctttgaggttaa

SEQ ID NO: 427452 - DNA, 25 bp, Mus musculus
gaagctagttgaacacttcaacggt

SEQ ID NO: 427453 - DNA, 25 bp, Mus musculus
gaagctagttgatcacttcaacggt

SEQ ID NO: 427454 - DNA, 25 bp, Mus musculus
gaagctagtttcaacatatggaagt

SEQ ID NO: 427455 - DNA, 25 bp, Mus musculus
gaagctagtttctacatatggaagt

SEQ ID NO: 427456 - DNA, 25 bp, Mus musculus
gaagctataagaactcataacatta

SEQ ID NO: 427457 - DNA, 25 bp, Mus musculus
gaagctataagatctcataacatta

SEQ ID NO: 427458 - DNA, 25 bp, Mus musculus
gaagctataccccatttaattccag

SEQ ID NO: 427459 - DNA, 25 bp, Mus musculus
gaagctatacccgatttaattccag

SEQ ID NO: 427460 - DNA, 25 bp, Mus musculus
gaagctatacttctccaggaagccc

SEQ ID NO: 427461 - DNA, 25 bp, Mus musculus
gaagctatacttgtccaggaagccc

SEQ ID NO: 427462 - DNA, 25 bp, Mus musculus
gaagctatatgtcgaattttgcctt

SEQ ID NO: 427463 - DNA, 25 bp, Mus musculus
gaagctatatgtggaattttgcctt

SEQ ID NO: 427464 - DNA, 25 bp, Mus musculus
gaagctatcacaacaccagggctgt

SEQ ID NO: 427465 - DNA, 25 bp, Mus musculus
gaagctatcacatcaccagggctgt

SEQ ID NO: 427466 - DNA, 25 bp, Mus musculus
gaagctatcagtatgtcctatggtt

SEQ ID NO: 427467 - DNA, 25 bp, Mus musculus
gaagctatcagtttgtcctatggtt

SEQ ID NO: 427468 - DNA, 25 bp, Mus musculus
gaagctatcatgctcccagggacta

SEQ ID NO: 427469 - DNA, 25 bp, Mus musculus
gaagctatcatggtcccagggacta

SEQ ID NO: 427470 - DNA, 25 bp, Mus musculus
gaagctatccctatctatgcagaaa

SEQ ID NO: 427471 - DNA, 25 bp, Mus musculus
gaagctatccctttctatgcagaaa

SEQ ID NO: 427472 - DNA, 25 bp, Mus musculus
gaagctatccgaccggttctctgtc

SEQ ID NO: 427473 - DNA, 25 bp, Mus musculus
gaagctatccgagcggttctctgtc

SEQ ID NO: 427474 - DNA, 25 bp, Mus musculus
gaagctatctagagctggccagcac

SEQ ID NO: 427475 - DNA, 25 bp, Mus musculus
gaagctatctagtgctggccagcac

SEQ ID NO: 427476 - DNA, 25 bp, Mus musculus
gaagctatctttcatgtcagtatta

SEQ ID NO: 427477 - DNA, 25 bp, Mus musculus
gaagctatctttgatgtcagtatta

SEQ ID NO: 427478 - DNA, 25 bp, Mus musculus
gaagctatgattacagacacctgtc

SEQ ID NO: 427479 - DNA, 25 bp, Mus musculus
gaagctatgattctgtatcaagttg

SEQ ID NO: 427480 - DNA, 25 bp, Mus musculus
gaagctatgattgtgtatcaagttg

SEQ ID NO: 427481 - DNA, 25 bp, Mus musculus
gaagctatgatttcagacacctgtc

SEQ ID NO: 427482 - DNA, 25 bp, Mus musculus
gaagctatgcaaatgagctgtctta

SEQ ID NO: 427483 - DNA, 25 bp, Mus musculus
gaagctatgcaactagtaattacat

SEQ ID NO: 427484 - DNA, 25 bp, Mus musculus
gaagctatgcaagtagtaattacat

SEQ ID NO: 427485 - DNA, 25 bp, Mus musculus
gaagctatgcaattgagctgtctta

SEQ ID NO: 427486 - DNA, 25 bp, Mus musculus
gaagctatgctacgcacctgggagc

SEQ ID NO: 427487 - DNA, 25 bp, Mus musculus
gaagctatgctaggcacctgggagc

SEQ ID NO: 427488 - DNA, 25 bp, Mus musculus
gaagctatgggtagagccccagttt

SEQ ID NO: 427489 - DNA, 25 bp, Mus musculus
gaagctatgggtctcttttgtttga

SEQ ID NO: 427490 - DNA, 25 bp, Mus musculus
gaagctatgggtgtcttttgtttga

SEQ ID NO: 427491 - DNA, 25 bp, Mus musculus
gaagctatgggttgagccccagttt

SEQ ID NO: 427492 - DNA, 25 bp, Mus musculus
gaagctatggtgctactatatctag

SEQ ID NO: 427493 - DNA, 25 bp, Mus musculus
gaagctatggtggtactatatctag

SEQ ID NO: 427494 - DNA, 25 bp, Mus musculus
gaagctattcgacagggaccctgac

SEQ ID NO: 427495 - DNA, 25 bp, Mus musculus
gaagctattcgagagggaccctgac

SEQ ID NO: 427496 - DNA, 25 bp, Mus musculus
gaagctattgagatttcctttgact

SEQ ID NO: 427497 - DNA, 25 bp, Mus musculus
gaagctattgagttttcctttgact

SEQ ID NO: 427498 - DNA, 25 bp, Mus musculus
gaagctattggacactatctgggta

SEQ ID NO: 427499 - DNA, 25 bp, Mus musculus
gaagctattggagactatctgggta

SEQ ID NO: 427500 - DNA, 25 bp, Mus musculus
gaagctattggtagctgctggcaaa

SEQ ID NO: 427501 - DNA, 25 bp, Mus musculus
gaagctattggttgctgctggcaaa

SEQ ID NO: 427502 - DNA, 25 bp, Mus musculus
gaagctatttaccatgtgcatcaaa

SEQ ID NO: 427503 - DNA, 25 bp, Mus musculus
gaagctatttacgatgtgcatcaaa

SEQ ID NO: 427504 - DNA, 25 bp, Mus musculus
gaagctatttccaactcagtggcag

SEQ ID NO: 427505 - DNA, 25 bp, Mus musculus
gaagctatttcctactcagtggcag

SEQ ID NO: 427506 - DNA, 25 bp, Mus musculus
gaagctatttcgagaaagcgtagtg

SEQ ID NO: 427507 - DNA, 25 bp, Mus musculus
gaagctatttcgtgaaagcgtagtg

SEQ ID NO: 427508 - DNA, 25 bp, Mus musculus
gaagctatttgcacaatttgggcat

SEQ ID NO: 427509 - DNA, 25 bp, Mus musculus
gaagctatttgctcaatttgggcat

SEQ ID NO: 427510 - DNA, 25 bp, Mus musculus
gaagctcaaaacctccattcaaggg

SEQ ID NO: 427511 - DNA, 25 bp, Mus musculus
gaagctcaaaacgtccattcaaggg

SEQ ID NO: 427512 - DNA, 25 bp, Mus musculus
gaagctcaaagcagtgatcactcag

SEQ ID NO: 427513 - DNA, 25 bp, Mus musculus
gaagctcaaagctgtgatcactcag

SEQ ID NO: 427514 - DNA, 25 bp, Mus musculus
gaagctcaaattaacgcttggctat

SEQ ID NO: 427515 - DNA, 25 bp, Mus musculus
gaagctcaaatttacgcttggctat

SEQ ID NO: 427516 - DNA, 25 bp, Mus musculus
gaagctcaacaaaaggtggtttaca

SEQ ID NO: 427517 - DNA, 25 bp, Mus musculus
gaagctcaacaataggtggtttaca

SEQ ID NO: 427518 - DNA, 25 bp, Mus musculus
gaagctcaagcaatgtctcttcttg

SEQ ID NO: 427519 - DNA, 25 bp, Mus musculus
gaagctcaagcattgtctcttcttg

SEQ ID NO: 427520 - DNA, 25 bp, Mus musculus
gaagctcaagcgcacccatagcgtc

SEQ ID NO: 427521 - DNA, 25 bp, Mus musculus
gaagctcaagcggacccatagcgtc

SEQ ID NO: 427522 - DNA, 25 bp, Mus musculus
gaagctcaaggaccattttaataga

SEQ ID NO: 427523 - DNA, 25 bp, Mus musculus
gaagctcaaggagcattttaataga

SEQ ID NO: 427524 - DNA, 25 bp, Mus musculus
gaagctcaataaaatggcacgtaat

SEQ ID NO: 427525 - DNA, 25 bp, Mus musculus
gaagctcaataatatggcacgtaat

SEQ ID NO: 427526 - DNA, 25 bp, Mus musculus
gaagctcaatgcagaccgatcacgc

SEQ ID NO: 427527 - DNA, 25 bp, Mus musculus
gaagctcaatgctgaccgatcacgc

SEQ ID NO: 427528 - DNA, 25 bp, Mus musculus
gaagctcaatggatttctagctgaa

SEQ ID NO: 427529 - DNA, 25 bp, Mus musculus
gaagctcaatggcacggaccccgag

SEQ ID NO: 427530 - DNA, 25 bp, Mus musculus
gaagctcaatgggacggaccccgag

SEQ ID NO: 427531 - DNA, 25 bp, Mus musculus
gaagctcaatggttttctagctgaa

SEQ ID NO: 427532 - DNA, 25 bp, Mus musculus
gaagctcaattcagtaagggcccct

SEQ ID NO: 427533 - DNA, 25 bp, Mus musculus
gaagctcaattctgtaagggcccct

SEQ ID NO: 427534 - DNA, 25 bp, Mus musculus
gaagctcacaataatgttagcgaga

SEQ ID NO: 427535 - DNA, 25 bp, Mus musculus
gaagctcacaattatgttagcgaga

SEQ ID NO: 427536 - DNA, 25 bp, Mus musculus
gaagctcacagaaggatcggcacac

SEQ ID NO: 427537 - DNA, 25 bp, Mus musculus
gaagctcacagatggatcggcacac

SEQ ID NO: 427538 - DNA, 25 bp, Mus musculus
gaagctcacctgatgcttacaattt

SEQ ID NO: 427539 - DNA, 25 bp, Mus musculus
gaagctcacctgttgcttacaattt

SEQ ID NO: 427540 - DNA, 25 bp, Mus musculus
gaagctcacgcaagggattcaaatt

SEQ ID NO: 427541 - DNA, 25 bp, Mus musculus
gaagctcacgcatgggattcaaatt

SEQ ID NO: 427542 - DNA, 25 bp, Mus musculus
gaagctcactacatcagacagcagg

SEQ ID NO: 427543 - DNA, 25 bp, Mus musculus
gaagctcactacttcagacagcagg

SEQ ID NO: 427544 - DNA, 25 bp, Mus musculus
gaagctcactataactatctcctac

SEQ ID NO: 427545 - DNA, 25 bp, Mus musculus
gaagctcactattactatctcctac

SEQ ID NO: 427546 - DNA, 25 bp, Mus musculus
gaagctcactcaacaaggcgcctga

SEQ ID NO: 427547 - DNA, 25 bp, Mus musculus
gaagctcactcactacctcaaggag

SEQ ID NO: 427548 - DNA, 25 bp, Mus musculus
gaagctcactcagtacctcaaggag

SEQ ID NO: 427549 - DNA, 25 bp, Mus musculus
gaagctcactcatcaaggcgcctga

SEQ ID NO: 427550 - DNA, 25 bp, Mus musculus
gaagctcactgaccaggtactgtgt

SEQ ID NO: 427551 - DNA, 25 bp, Mus musculus
gaagctcactgagcaggtactgtgt

SEQ ID NO: 427552 - DNA, 25 bp, Mus musculus
gaagctcagaacatgccttaggcag

SEQ ID NO: 427553 - DNA, 25 bp, Mus musculus
gaagctcagaacttgccttaggcag

SEQ ID NO: 427554 - DNA, 25 bp, Mus musculus
gaagctcagagcctggtaccactgc

SEQ ID NO: 427555 - DNA, 25 bp, Mus musculus
gaagctcagagcgtggtaccactgc

SEQ ID NO: 427556 - DNA, 25 bp, Mus musculus
gaagctcagcttaagtctctatgac

SEQ ID NO: 427557 - DNA, 25 bp, Mus musculus
gaagctcagctttagtctctatgac

SEQ ID NO: 427558 - DNA, 25 bp, Mus musculus
gaagctcaggcacctctgactttat

SEQ ID NO: 427559 - DNA, 25 bp, Mus musculus
gaagctcaggcagctctgactttat

SEQ ID NO: 427560 - DNA, 25 bp, Mus musculus
gaagctcagggcaggtcacctgcgt

SEQ ID NO: 427561 - DNA, 25 bp, Mus musculus
gaagctcagggctggtcacctgcgt

SEQ ID NO: 427562 - DNA, 25 bp, Mus musculus
gaagctcagggtaagaatggcgcac

SEQ ID NO: 427563 - DNA, 25 bp, Mus musculus
gaagctcagggttagaatggcgcac

SEQ ID NO: 427564 - DNA, 25 bp, Mus musculus
gaagctcagtccaacattcacaaac

SEQ ID NO: 427565 - DNA, 25 bp, Mus musculus
gaagctcagtcctacattcacaaac

SEQ ID NO: 427566 - DNA, 25 bp, Mus musculus
gaagctcagtgcataaaatctgcag

SEQ ID NO: 427567 - DNA, 25 bp, Mus musculus
gaagctcagtgcttaaaatctgcag

SEQ ID NO: 427568 - DNA, 25 bp, Mus musculus
gaagctcatacacaacacagggaca

SEQ ID NO: 427569 - DNA, 25 bp, Mus musculus
gaagctcatacagaacacagggaca

SEQ ID NO: 427570 - DNA, 25 bp, Mus musculus
gaagctcatatcaagaaccctaggt

SEQ ID NO: 427571 - DNA, 25 bp, Mus musculus
gaagctcatatctagaaccctaggt

SEQ ID NO: 427572 - DNA, 25 bp, Mus musculus
gaagctcatcacacaagatttcgta

SEQ ID NO: 427573 - DNA, 25 bp, Mus musculus
gaagctcatcactcaagatttcgta

SEQ ID NO: 427574 - DNA, 25 bp, Mus musculus
gaagctcatctcacatagaagccct

SEQ ID NO: 427575 - DNA, 25 bp, Mus musculus
gaagctcatctctcatagaagccct

SEQ ID NO: 427576 - DNA, 25 bp, Mus musculus
gaagctcatgatcaaatcacagtaa

SEQ ID NO: 427577 - DNA, 25 bp, Mus musculus
gaagctcatgatgaaatcacagtaa

SEQ ID NO: 427578 - DNA, 25 bp, Mus musculus
gaagctccaaacctgagtcttagga

SEQ ID NO: 427579 - DNA, 25 bp, Mus musculus
gaagctccaaacgtgagtcttagga

SEQ ID NO: 427580 - DNA, 25 bp, Mus musculus
gaagctccacagacaatatccctga

SEQ ID NO: 427581 - DNA, 25 bp, Mus musculus
gaagctccacagcaaccggatccat

SEQ ID NO: 427582 - DNA, 25 bp, Mus musculus
gaagctccacaggaaccggatccat

SEQ ID NO: 427583 - DNA, 25 bp, Mus musculus
gaagctccacagtcaatatccctga

SEQ ID NO: 427584 - DNA, 25 bp, Mus musculus
gaagctccacctcagaaacactgtg

SEQ ID NO: 427585 - DNA, 25 bp, Mus musculus
gaagctccacctgagaaacactgtg

SEQ ID NO: 427586 - DNA, 25 bp, Mus musculus
gaagctccacggatagcacagcaga

SEQ ID NO: 427587 - DNA, 25 bp, Mus musculus
gaagctccacggttagcacagcaga

SEQ ID NO: 427588 - DNA, 25 bp, Mus musculus
gaagctccagcaaatatcgtcagaa

SEQ ID NO: 427589 - DNA, 25 bp, Mus musculus
gaagctccagcatatatcgtcagaa

SEQ ID NO: 427590 - DNA, 25 bp, Mus musculus
gaagctccaggacatttcatgacta

SEQ ID NO: 427591 - DNA, 25 bp, Mus musculus
gaagctccaggagatttcatgacta

SEQ ID NO: 427592 - DNA, 25 bp, Mus musculus
gaagctccaggcagttcgagtgacc

SEQ ID NO: 427593 - DNA, 25 bp, Mus musculus
gaagctccaggccacattgagggca

SEQ ID NO: 427594 - DNA, 25 bp, Mus musculus
gaagctccaggcgacattgagggca

SEQ ID NO: 427595 - DNA, 25 bp, Mus musculus
gaagctccaggctgttcgagtgacc

SEQ ID NO: 427596 - DNA, 25 bp, Mus musculus
gaagctccaggtattaagtctgtaa

SEQ ID NO: 427597 - DNA, 25 bp, Mus musculus
gaagctccaggttttaagtctgtaa

SEQ ID NO: 427598 - DNA, 25 bp, Mus musculus
gaagctccagtaaagtaccacacat

SEQ ID NO: 427599 - DNA, 25 bp, Mus musculus
gaagctccagtatagtaccacacat

SEQ ID NO: 427600 - DNA, 25 bp, Mus musculus
gaagctccagttctgagtctgttga

SEQ ID NO: 427601 - DNA, 25 bp, Mus musculus
gaagctccagttgtgagtctgttga

SEQ ID NO: 427602 - DNA, 25 bp, Mus musculus
gaagctccatccattcagcagtcag

SEQ ID NO: 427603 - DNA, 25 bp, Mus musculus
gaagctccatcctttcagcagtcag

SEQ ID NO: 427604 - DNA, 25 bp, Mus musculus
gaagctccatcgataacatccagaa

SEQ ID NO: 427605 - DNA, 25 bp, Mus musculus
gaagctccatcgttaacatccagaa

SEQ ID NO: 427606 - DNA, 25 bp, Mus musculus
gaagctccattaactcctggttaat

SEQ ID NO: 427607 - DNA, 25 bp, Mus musculus
gaagctccattaagccagactaaag

SEQ ID NO: 427608 - DNA, 25 bp, Mus musculus
gaagctccattatctcctggttaat

SEQ ID NO: 427609 - DNA, 25 bp, Mus musculus
gaagctccattatgccagactaaag

SEQ ID NO: 427610 - DNA, 25 bp, Mus musculus
gaagctccccgaccagggcttgcgt

SEQ ID NO: 427611 - DNA, 25 bp, Mus musculus
gaagctccccgagcagggcttgcgt

SEQ ID NO: 427612 - DNA, 25 bp, Mus musculus
gaagctcccgacaaacagttattat

SEQ ID NO: 427613 - DNA, 25 bp, Mus musculus
gaagctcccgactaacagttattat

SEQ ID NO: 427614 - DNA, 25 bp, Mus musculus
gaagctccctgaagtttcagctaag

SEQ ID NO: 427615 - DNA, 25 bp, Mus musculus
gaagctccctgatgtttcagctaag

SEQ ID NO: 427616 - DNA, 25 bp, Mus musculus
gaagctccgagtaacaagagatcat

SEQ ID NO: 427617 - DNA, 25 bp, Mus musculus
gaagctccgagttacaagagatcat

SEQ ID NO: 427618 - DNA, 25 bp, Mus musculus
gaagctccgttcctttattcatggg

SEQ ID NO: 427619 - DNA, 25 bp, Mus musculus
gaagctccgttcgtttattcatggg

SEQ ID NO: 427620 - DNA, 25 bp, Mus musculus
gaagctcctaacagttattccagtt

SEQ ID NO: 427621 - DNA, 25 bp, Mus musculus
gaagctcctaactgttattccagtt

SEQ ID NO: 427622 - DNA, 25 bp, Mus musculus
gaagctcctacaacaccagtgagat

SEQ ID NO: 427623 - DNA, 25 bp, Mus musculus
gaagctcctacatcaccagtgagat

SEQ ID NO: 427624 - DNA, 25 bp, Mus musculus
gaagctcctagaacctgaaatacaa

SEQ ID NO: 427625 - DNA, 25 bp, Mus musculus
gaagctcctagatcctgaaatacaa

SEQ ID NO: 427626 - DNA, 25 bp, Mus musculus
gaagctcctcatcgcgactatattt

SEQ ID NO: 427627 - DNA, 25 bp, Mus musculus
gaagctcctcatggcgactatattt

SEQ ID NO: 427628 - DNA, 25 bp, Mus musculus
gaagctcctctcagtatctgctgtg

SEQ ID NO: 427629 - DNA, 25 bp, Mus musculus
gaagctcctctctgtatctgctgtg

SEQ ID NO: 427630 - DNA, 25 bp, Mus musculus
gaagctcctggaacatgccacacaa

SEQ ID NO: 427631 - DNA, 25 bp, Mus musculus
gaagctcctggatcatgccacacaa

SEQ ID NO: 427632 - DNA, 25 bp, Mus musculus
gaagctcctgggactaaccgatgtt

SEQ ID NO: 427633 - DNA, 25 bp, Mus musculus
gaagctcctgggtctaaccgatgtt

SEQ ID NO: 427634 - DNA, 25 bp, Mus musculus
gaagctcctgtgaatgcagctggga

SEQ ID NO: 427635 - DNA, 25 bp, Mus musculus
gaagctcctgtgtatgcagctggga

SEQ ID NO: 427636 - DNA, 25 bp, Mus musculus
gaagctccttaaccataccaagcca

SEQ ID NO: 427637 - DNA, 25 bp, Mus musculus
gaagctccttaagcataccaagcca

SEQ ID NO: 427638 - DNA, 25 bp, Mus musculus
gaagctccttgtcttgatttattgc

SEQ ID NO: 427639 - DNA, 25 bp, Mus musculus
gaagctccttgtgttgatttattgc

SEQ ID NO: 427640 - DNA, 25 bp, Mus musculus
gaagctcgaaggatgcgttaatctt

SEQ ID NO: 427641 - DNA, 25 bp, Mus musculus
gaagctcgaaggttgcgttaatctt

SEQ ID NO: 427642 - DNA, 25 bp, Mus musculus
gaagctcgaataccgacagcggcta

SEQ ID NO: 427643 - DNA, 25 bp, Mus musculus
gaagctcgaatagcgacagcggcta

SEQ ID NO: 427644 - DNA, 25 bp, Mus musculus
gaagctcgagttccggatccatact

SEQ ID NO: 427645 - DNA, 25 bp, Mus musculus
gaagctcgagttgcggatccatact

SEQ ID NO: 427646 - DNA, 25 bp, Mus musculus
gaagctcggaagaacagtcaccact

SEQ ID NO: 427647 - DNA, 25 bp, Mus musculus
gaagctcggaagtacagtcaccact

SEQ ID NO: 427648 - DNA, 25 bp, Mus musculus
gaagctcggaccctgcttcatggca

SEQ ID NO: 427649 - DNA, 25 bp, Mus musculus
gaagctcggaccgtgcttcatggca

SEQ ID NO: 427650 - DNA, 25 bp, Mus musculus
gaagctcggagtagttgtacacgta

SEQ ID NO: 427651 - DNA, 25 bp, Mus musculus
gaagctcggagtcgttgtcaacacc

SEQ ID NO: 427652 - DNA, 25 bp, Mus musculus
gaagctcggagtggttgtcaacacc

SEQ ID NO: 427653 - DNA, 25 bp, Mus musculus
gaagctcggagttgttgtacacgta

SEQ ID NO: 427654 - DNA, 25 bp, Mus musculus
gaagctcggcctcggagacttcatc

SEQ ID NO: 427655 - DNA, 25 bp, Mus musculus
gaagctcggcctgggagacttcatc

SEQ ID NO: 427656 - DNA, 25 bp, Mus musculus
gaagctcggctaccgaaaagcagaa

SEQ ID NO: 427657 - DNA, 25 bp, Mus musculus
gaagctcggctagcgaaaagcagaa

SEQ ID NO: 427658 - DNA, 25 bp, Mus musculus
gaagctcgtcatctccagaggagta

SEQ ID NO: 427659 - DNA, 25 bp, Mus musculus
gaagctcgtcatgtccagaggagta

SEQ ID NO: 427660 - DNA, 25 bp, Mus musculus
gaagctcgtgaaacatggcgtcaaa

SEQ ID NO: 427661 - DNA, 25 bp, Mus musculus
gaagctcgtgaatcatggcgtcaaa

SEQ ID NO: 427662 - DNA, 25 bp, Mus musculus
gaagctcgtgagatttttgatgaaa

SEQ ID NO: 427663 - DNA, 25 bp, Mus musculus
gaagctcgtgagttttttgatgaaa

SEQ ID NO: 427664 - DNA, 25 bp, Mus musculus
gaagctcgtgatccaagtagaagct

SEQ ID NO: 427665 - DNA, 25 bp, Mus musculus
gaagctcgtgatgcaagtagaagct

SEQ ID NO: 427666 - DNA, 25 bp, Mus musculus
gaagctctaacacagttattcaaga

SEQ ID NO: 427667 - DNA, 25 bp, Mus musculus
gaagctctaacagagttattcaaga

SEQ ID NO: 427668 - DNA, 25 bp, Mus musculus
gaagctctactgcaagctctagtaa

SEQ ID NO: 427669 - DNA, 25 bp, Mus musculus
gaagctctactggaagctctagtaa

SEQ ID NO: 427670 - DNA, 25 bp, Mus musculus
gaagctctagttatctagatctttt

SEQ ID NO: 427671 - DNA, 25 bp, Mus musculus
gaagctctagttttctagatctttt

SEQ ID NO: 427672 - DNA, 25 bp, Mus musculus
gaagctctatctctggatggtttct

SEQ ID NO: 427673 - DNA, 25 bp, Mus musculus
gaagctctatctgtggatggtttct

SEQ ID NO: 427674 - DNA, 25 bp, Mus musculus
gaagctctatgcaaatatataacac

SEQ ID NO: 427675 - DNA, 25 bp, Mus musculus
gaagctctatgctaatatataacac

SEQ ID NO: 427676 - DNA, 25 bp, Mus musculus
gaagctctcaagaaacttaccaaga

SEQ ID NO: 427677 - DNA, 25 bp, Mus musculus
gaagctctcaagagccgaattatcc

SEQ ID NO: 427678 - DNA, 25 bp, Mus musculus
gaagctctcaagtaacttaccaaga

SEQ ID NO: 427679 - DNA, 25 bp, Mus musculus
gaagctctcaagtgccgaattatcc

SEQ ID NO: 427680 - DNA, 25 bp, Mus musculus
gaagctctcagaaaccttgcagcat

SEQ ID NO: 427681 - DNA, 25 bp, Mus musculus
gaagctctcagataccttgcagcat

SEQ ID NO: 427682 - DNA, 25 bp, Mus musculus
gaagctctcagcatctcaaaggcag

SEQ ID NO: 427683 - DNA, 25 bp, Mus musculus
gaagctctcagcttctcaaaggcag

SEQ ID NO: 427684 - DNA, 25 bp, Mus musculus
gaagctctcataatactagtgggtt

SEQ ID NO: 427685 - DNA, 25 bp, Mus musculus
gaagctctcatattactagtgggtt

SEQ ID NO: 427686 - DNA, 25 bp, Mus musculus
gaagctctcatcagaaatactatta

SEQ ID NO: 427687 - DNA, 25 bp, Mus musculus
gaagctctcatctgaaatactatta

SEQ ID NO: 427688 - DNA, 25 bp, Mus musculus
gaagctctccacagcctagtaactg

SEQ ID NO: 427689 - DNA, 25 bp, Mus musculus
gaagctctccactgcctagtaactg

SEQ ID NO: 427690 - DNA, 25 bp, Mus musculus
gaagctctccatactgaagtaccag

SEQ ID NO: 427691 - DNA, 25 bp, Mus musculus
gaagctctccattctgaagtaccag

SEQ ID NO: 427692 - DNA, 25 bp, Mus musculus
gaagctctcccacgctgccagtgat

SEQ ID NO: 427693 - DNA, 25 bp, Mus musculus
gaagctctcccaggctgccagtgat

SEQ ID NO: 427694 - DNA, 25 bp, Mus musculus
gaagctctccttcggcatttgatgg

SEQ ID NO: 427695 - DNA, 25 bp, Mus musculus
gaagctctccttgggcatttgatgg

SEQ ID NO: 427696 - DNA, 25 bp, Mus musculus
gaagctctcggaatgatttatagaa

SEQ ID NO: 427697 - DNA, 25 bp, Mus musculus
gaagctctcggattgatttatagaa

SEQ ID NO: 427698 - DNA, 25 bp, Mus musculus
gaagctctctacaacagactactga

SEQ ID NO: 427699 - DNA, 25 bp, Mus musculus
gaagctctctacaaccgagtttcat

SEQ ID NO: 427700 - DNA, 25 bp, Mus musculus
gaagctctctactacagactactga

SEQ ID NO: 427701 - DNA, 25 bp, Mus musculus
gaagctctctactaccgagtttcat

SEQ ID NO: 427702 - DNA, 25 bp, Mus musculus
gaagctctctgaagataattggact

SEQ ID NO: 427703 - DNA, 25 bp, Mus musculus
gaagctctctgatgataattggact

SEQ ID NO: 427704 - DNA, 25 bp, Mus musculus
gaagctctctgtataaacattaatt

SEQ ID NO: 427705 - DNA, 25 bp, Mus musculus
gaagctctctgtttaaacattaatt

SEQ ID NO: 427706 - DNA, 25 bp, Mus musculus
gaagctctcttcagacttacatggt

SEQ ID NO: 427707 - DNA, 25 bp, Mus musculus
gaagctctcttctgacttacatggt

SEQ ID NO: 427708 - DNA, 25 bp, Mus musculus
gaagctctgaagcatgactctaatc

SEQ ID NO: 427709 - DNA, 25 bp, Mus musculus
gaagctctgaaggatgactctaatc

SEQ ID NO: 427710 - DNA, 25 bp, Mus musculus
gaagctctgaatattccctggtggt

SEQ ID NO: 427711 - DNA, 25 bp, Mus musculus
gaagctctgaattttccctggtggt

SEQ ID NO: 427712 - DNA, 25 bp, Mus musculus
gaagctctgacaatggcccgcagga

SEQ ID NO: 427713 - DNA, 25 bp, Mus musculus
gaagctctgacattggcccgcagga

SEQ ID NO: 427714 - DNA, 25 bp, Mus musculus
gaagctctgaccacaggagcagact

SEQ ID NO: 427715 - DNA, 25 bp, Mus musculus
gaagctctgacctcaggagcagact

SEQ ID NO: 427716 - DNA, 25 bp, Mus musculus
gaagctctgagtcactgcctcctga

SEQ ID NO: 427717 - DNA, 25 bp, Mus musculus
gaagctctgagtgactgcctcctga

SEQ ID NO: 427718 - DNA, 25 bp, Mus musculus
gaagctctgctcagttgccaagtta

SEQ ID NO: 427719 - DNA, 25 bp, Mus musculus
gaagctctgctctgttgccaagtta

SEQ ID NO: 427720 - DNA, 25 bp, Mus musculus
gaagctctggaacaacctatctggt

SEQ ID NO: 427721 - DNA, 25 bp, Mus musculus
gaagctctggaagaacctatctggt

SEQ ID NO: 427722 - DNA, 25 bp, Mus musculus
gaagctctggcaccagcatagtatc

SEQ ID NO: 427723 - DNA, 25 bp, Mus musculus
gaagctctggcagcagcatagtatc

SEQ ID NO: 427724 - DNA, 25 bp, Mus musculus
gaagctctgggtcatcataggaaca

SEQ ID NO: 427725 - DNA, 25 bp, Mus musculus
gaagctctgggtgatcataggaaca

SEQ ID NO: 427726 - DNA, 25 bp, Mus musculus
gaagctctggttaactgtcagtaaa

SEQ ID NO: 427727 - DNA, 25 bp, Mus musculus
gaagctctggtttactgtcagtaaa

SEQ ID NO: 427728 - DNA, 25 bp, Mus musculus
gaagctctgtctaatttgactagta

SEQ ID NO: 427729 - DNA, 25 bp, Mus musculus
gaagctctgtcttatttgactagta

SEQ ID NO: 427730 - DNA, 25 bp, Mus musculus
gaagctcttactcggtcggacatgg

SEQ ID NO: 427731 - DNA, 25 bp, Mus musculus
gaagctcttactgggtcggacatgg

SEQ ID NO: 427732 - DNA, 25 bp, Mus musculus
gaagctcttagaaatcgccaccaag

SEQ ID NO: 427733 - DNA, 25 bp, Mus musculus
gaagctcttagatatcgccaccaag

SEQ ID NO: 427734 - DNA, 25 bp, Mus musculus
gaagctcttccacagacaagagggt

SEQ ID NO: 427735 - DNA, 25 bp, Mus musculus
gaagctcttccagagacaagagggt

SEQ ID NO: 427736 - DNA, 25 bp, Mus musculus
gaagctcttcctatacggagacacc

SEQ ID NO: 427737 - DNA, 25 bp, Mus musculus
gaagctcttcctcggctgcagatta

SEQ ID NO: 427738 - DNA, 25 bp, Mus musculus
gaagctcttcctgggctgcagatta

SEQ ID NO: 427739 - DNA, 25 bp, Mus musculus
gaagctcttcctttacggagacacc

SEQ ID NO: 427740 - DNA, 25 bp, Mus musculus
gaagctcttcgtagctgacctgcag

SEQ ID NO: 427741 - DNA, 25 bp, Mus musculus
gaagctcttcgttgctgacctgcag

SEQ ID NO: 427742 - DNA, 25 bp, Mus musculus
gaagctcttgatcgacatggcccta

SEQ ID NO: 427743 - DNA, 25 bp, Mus musculus
gaagctcttgatggacatggcccta

SEQ ID NO: 427744 - DNA, 25 bp, Mus musculus
gaagctcttgggatcggtagtctac

SEQ ID NO: 427745 - DNA, 25 bp, Mus musculus
gaagctcttgggttcggtagtctac

SEQ ID NO: 427746 - DNA, 25 bp, Mus musculus
gaagctcttgtgaaacagcaggata

SEQ ID NO: 427747 - DNA, 25 bp, Mus musculus
gaagctcttgtgtaacagcaggata

SEQ ID NO: 427748 - DNA, 25 bp, Mus musculus
gaagctcttgttccacagaacactt

SEQ ID NO: 427749 - DNA, 25 bp, Mus musculus
gaagctcttgttgcacagaacactt

SEQ ID NO: 427750 - DNA, 25 bp, Mus musculus
gaagctctttatcaccagcacagca

SEQ ID NO: 427751 - DNA, 25 bp, Mus musculus
gaagctctttatcagtaccagcccc

SEQ ID NO: 427752 - DNA, 25 bp, Mus musculus
gaagctctttatgaccagcacagca

SEQ ID NO: 427753 - DNA, 25 bp, Mus musculus
gaagctctttatgagtaccagcccc

SEQ ID NO: 427754 - DNA, 25 bp, Mus musculus
gaagctctttgtcttatccaggatt

SEQ ID NO: 427755 - DNA, 25 bp, Mus musculus
gaagctctttgtgttatccaggatt

SEQ ID NO: 427756 - DNA, 25 bp, Mus musculus
gaagctgaaagacaaggcggccaaa

SEQ ID NO: 427757 - DNA, 25 bp, Mus musculus
gaagctgaaagagaaggcggccaaa

SEQ ID NO: 427758 - DNA, 25 bp, Mus musculus
gaagctgaaatgaatgaccccatcc

SEQ ID NO: 427759 - DNA, 25 bp, Mus musculus
gaagctgaaatgtatgaccccatcc

SEQ ID NO: 427760 - DNA, 25 bp, Mus musculus
gaagctgaacaccaaacttgacaac

SEQ ID NO: 427761 - DNA, 25 bp, Mus musculus
gaagctgaacacgaaacttgacaac

SEQ ID NO: 427762 - DNA, 25 bp, Mus musculus
gaagctgaacatatgaaaccctaag

SEQ ID NO: 427763 - DNA, 25 bp, Mus musculus
gaagctgaacatttgaaaccctaag

SEQ ID NO: 427764 - DNA, 25 bp, Mus musculus
gaagctgaaccaaaaactcccaatg

SEQ ID NO: 427765 - DNA, 25 bp, Mus musculus
gaagctgaaccataaactcccaatg

SEQ ID NO: 427766 - DNA, 25 bp, Mus musculus
gaagctgaacgaccacttcctgaac

SEQ ID NO: 427767 - DNA, 25 bp, Mus musculus
gaagctgaacgagcacttcctgaac

SEQ ID NO: 427768 - DNA, 25 bp, Mus musculus
gaagctgaactccagaaagtacgaa

SEQ ID NO: 427769 - DNA, 25 bp, Mus musculus
gaagctgaactcgagaaagtacgaa

SEQ ID NO: 427770 - DNA, 25 bp, Mus musculus
gaagctgaactgaggctgttgccac

SEQ ID NO: 427771 - DNA, 25 bp, Mus musculus
gaagctgaactgtggctgttgccac

SEQ ID NO: 427772 - DNA, 25 bp, Mus musculus
gaagctgaacttacctggaaatcca

SEQ ID NO: 427773 - DNA, 25 bp, Mus musculus
gaagctgaactttcctggaaatcca

SEQ ID NO: 427774 - DNA, 25 bp, Mus musculus
gaagctgaagacatcccgggacaag

SEQ ID NO: 427775 - DNA, 25 bp, Mus musculus
gaagctgaagacttcccgggacaag

SEQ ID NO: 427776 - DNA, 25 bp, Mus musculus
gaagctgaagggatgtcaaagtcat

SEQ ID NO: 427777 - DNA, 25 bp, Mus musculus
gaagctgaagggttgtcaaagtcat

SEQ ID NO: 427778 - DNA, 25 bp, Mus musculus
gaagctgaaggtccagacccttaaa

SEQ ID NO: 427779 - DNA, 25 bp, Mus musculus
gaagctgaaggtgcagacccttaaa

SEQ ID NO: 427780 - DNA, 25 bp, Mus musculus
gaagctgaattcaatgttgccaaca

SEQ ID NO: 427781 - DNA, 25 bp, Mus musculus
gaagctgaattctatgttgccaaca

SEQ ID NO: 427782 - DNA, 25 bp, Mus musculus
gaagctgacagcctttgtgaacaca

SEQ ID NO: 427783 - DNA, 25 bp, Mus musculus
gaagctgacagcgtttgtgaacaca

SEQ ID NO: 427784 - DNA, 25 bp, Mus musculus
gaagctgacagtaataggagaggtt

SEQ ID NO: 427785 - DNA, 25 bp, Mus musculus
gaagctgacagttataggagaggtt

SEQ ID NO: 427786 - DNA, 25 bp, Mus musculus
gaagctgaccacataagacccgttt

SEQ ID NO: 427787 - DNA, 25 bp, Mus musculus
gaagctgaccacttaagacccgttt

SEQ ID NO: 427788 - DNA, 25 bp, Mus musculus
gaagctgaccatcgtggttctggaa

SEQ ID NO: 427789 - DNA, 25 bp, Mus musculus
gaagctgaccatggtggttctggaa

SEQ ID NO: 427790 - DNA, 25 bp, Mus musculus
gaagctgacctcaatgactacacat

SEQ ID NO: 427791 - DNA, 25 bp, Mus musculus
gaagctgacctctatgactacacat

SEQ ID NO: 427792 - DNA, 25 bp, Mus musculus
gaagctgaccttaaatcctgaccct

SEQ ID NO: 427793 - DNA, 25 bp, Mus musculus
gaagctgaccttcaaactgagggct

SEQ ID NO: 427794 - DNA, 25 bp, Mus musculus
gaagctgaccttcatctgatggaga

SEQ ID NO: 427795 - DNA, 25 bp, Mus musculus
gaagctgaccttgaaactgagggct

SEQ ID NO: 427796 - DNA, 25 bp, Mus musculus
gaagctgaccttgatctgatggaga

SEQ ID NO: 427797 - DNA, 25 bp, Mus musculus
gaagctgacctttaatcctgaccct

SEQ ID NO: 427798 - DNA, 25 bp, Mus musculus
gaagctgacgagattccagtttaaa

SEQ ID NO: 427799 - DNA, 25 bp, Mus musculus
gaagctgacgagtttccagtttaaa

SEQ ID NO: 427800 - DNA, 25 bp, Mus musculus
gaagctgacggaccaatccaacacc

SEQ ID NO: 427801 - DNA, 25 bp, Mus musculus
gaagctgacggagcaatccaacacc

SEQ ID NO: 427802 - DNA, 25 bp, Mus musculus
gaagctgacggtacaatttcagaag

SEQ ID NO: 427803 - DNA, 25 bp, Mus musculus
gaagctgacggttcaatttcagaag

SEQ ID NO: 427804 - DNA, 25 bp, Mus musculus
gaagctgactatagtaagtacttac

SEQ ID NO: 427805 - DNA, 25 bp, Mus musculus
gaagctgactattgtaagtacttac

SEQ ID NO: 427806 - DNA, 25 bp, Mus musculus
gaagctgagaataacttgtgtctag

SEQ ID NO: 427807 - DNA, 25 bp, Mus musculus
gaagctgagaattacttgtgtctag

SEQ ID NO: 427808 - DNA, 25 bp, Mus musculus
gaagctgagactataccacaaacaa

SEQ ID NO: 427809 - DNA, 25 bp, Mus musculus
gaagctgagactttaccacaaacaa

SEQ ID NO: 427810 - DNA, 25 bp, Mus musculus
gaagctgagcagaatttctctacac

SEQ ID NO: 427811 - DNA, 25 bp, Mus musculus
gaagctgagcagtatttctctacac

SEQ ID NO: 427812 - DNA, 25 bp, Mus musculus
gaagctgagcttatgaacctgtgca

SEQ ID NO: 427813 - DNA, 25 bp, Mus musculus
gaagctgagcttcccttcacgtgga

SEQ ID NO: 427814 - DNA, 25 bp, Mus musculus
gaagctgagcttgccttcacgtgga

SEQ ID NO: 427815 - DNA, 25 bp, Mus musculus
gaagctgagcttttgaacctgtgca

SEQ ID NO: 427816 - DNA, 25 bp, Mus musculus
gaagctgaggagagacctgacagat

SEQ ID NO: 427817 - DNA, 25 bp, Mus musculus
gaagctgaggagctttctgtccagt

SEQ ID NO: 427818 - DNA, 25 bp, Mus musculus
gaagctgaggaggtttctgtccagt

SEQ ID NO: 427819 - DNA, 25 bp, Mus musculus
gaagctgaggagtgacctgacagat

SEQ ID NO: 427820 - DNA, 25 bp, Mus musculus
gaagctgaggatcacccttccagag

SEQ ID NO: 427821 - DNA, 25 bp, Mus musculus
gaagctgaggatgacccttccagag

SEQ ID NO: 427822 - DNA, 25 bp, Mus musculus
gaagctgaggcaagtcaatcaacta

SEQ ID NO: 427823 - DNA, 25 bp, Mus musculus
gaagctgaggcatgtcaatcaacta

SEQ ID NO: 427824 - DNA, 25 bp, Mus musculus
gaagctgaggcgacttgtcattctc

SEQ ID NO: 427825 - DNA, 25 bp, Mus musculus
gaagctgaggcgtcttgtcattctc

SEQ ID NO: 427826 - DNA, 25 bp, Mus musculus
gaagctgaggttacttgtctaccca

SEQ ID NO: 427827 - DNA, 25 bp, Mus musculus
gaagctgaggtttcttgtctaccca

SEQ ID NO: 427828 - DNA, 25 bp, Mus musculus
gaagctgagtgaccaagccaacacc

SEQ ID NO: 427829 - DNA, 25 bp, Mus musculus
gaagctgagtgagcaagccaacacc

SEQ ID NO: 427830 - DNA, 25 bp, Mus musculus
gaagctgagtggaaacctcccgagg

SEQ ID NO: 427831 - DNA, 25 bp, Mus musculus
gaagctgagtggtaacctcccgagg

SEQ ID NO: 427832 - DNA, 25 bp, Mus musculus
gaagctgagttcaacaatcccgctg

SEQ ID NO: 427833 - DNA, 25 bp, Mus musculus
gaagctgagttctacaatcccgctg

SEQ ID NO: 427834 - DNA, 25 bp, Mus musculus
gaagctgagtttaagtatgtcccta

SEQ ID NO: 427835 - DNA, 25 bp, Mus musculus
gaagctgagtttatggccaggacag

SEQ ID NO: 427836 - DNA, 25 bp, Mus musculus
gaagctgagttttagtatgtcccta

SEQ ID NO: 427837 - DNA, 25 bp, Mus musculus
gaagctgagtttttggccaggacag

SEQ ID NO: 427838 - DNA, 25 bp, Mus musculus
gaagctgatcaacaaccgtgccaaa

SEQ ID NO: 427839 - DNA, 25 bp, Mus musculus
gaagctgatcaagaaccgtgccaaa

SEQ ID NO: 427840 - DNA, 25 bp, Mus musculus
gaagctgatcacaggccagcctaac

SEQ ID NO: 427841 - DNA, 25 bp, Mus musculus
gaagctgatcactggccagcctaac

SEQ ID NO: 427842 - DNA, 25 bp, Mus musculus
gaagctgatccactttgggctgatg

SEQ ID NO: 427843 - DNA, 25 bp, Mus musculus
gaagctgatccagtttgggctgatg

SEQ ID NO: 427844 - DNA, 25 bp, Mus musculus
gaagctgatcccaacctggtttcca

SEQ ID NO: 427845 - DNA, 25 bp, Mus musculus
gaagctgatccctacctggtttcca

SEQ ID NO: 427846 - DNA, 25 bp, Mus musculus
gaagctgatcctccagcggttccta

SEQ ID NO: 427847 - DNA, 25 bp, Mus musculus
gaagctgatcctgcagcggttccta

SEQ ID NO: 427848 - DNA, 25 bp, Mus musculus
gaagctgatctcatggtcggaggca

SEQ ID NO: 427849 - DNA, 25 bp, Mus musculus
gaagctgatctcttggtcggaggca

SEQ ID NO: 427850 - DNA, 25 bp, Mus musculus
gaagctgatcttccgaatagagcta

SEQ ID NO: 427851 - DNA, 25 bp, Mus musculus
gaagctgatcttgcgaatagagcta

SEQ ID NO: 427852 - DNA, 25 bp, Mus musculus
gaagctgatgccaatttctctcttg

SEQ ID NO: 427853 - DNA, 25 bp, Mus musculus
gaagctgatgcctatttctctcttg

SEQ ID NO: 427854 - DNA, 25 bp, Mus musculus
gaagctgatggcatagctcagtggt

SEQ ID NO: 427855 - DNA, 25 bp, Mus musculus
gaagctgatggcttagctcagtggt

SEQ ID NO: 427856 - DNA, 25 bp, Mus musculus
gaagctgatgggatctatgccgcct

SEQ ID NO: 427857 - DNA, 25 bp, Mus musculus
gaagctgatgggttctatgccgcct

SEQ ID NO: 427858 - DNA, 25 bp, Mus musculus
gaagctgatgtaacctgtaaatctt

SEQ ID NO: 427859 - DNA, 25 bp, Mus musculus
gaagctgatgtatcctgtaaatctt

SEQ ID NO: 427860 - DNA, 25 bp, Mus musculus
gaagctgattcaaatgtcccatata

SEQ ID NO: 427861 - DNA, 25 bp, Mus musculus
gaagctgattcatatgtcccatata

SEQ ID NO: 427862 - DNA, 25 bp, Mus musculus
gaagctgattgaatctttagaatgg

SEQ ID NO: 427863 - DNA, 25 bp, Mus musculus
gaagctgattgattctttagaatgg

SEQ ID NO: 427864 - DNA, 25 bp, Mus musculus
gaagctgcaaaaattactcatttta

SEQ ID NO: 427865 - DNA, 25 bp, Mus musculus
gaagctgcaaaacatctctgatgag

SEQ ID NO: 427866 - DNA, 25 bp, Mus musculus
gaagctgcaaaaccatgcctgctct

SEQ ID NO: 427867 - DNA, 25 bp, Mus musculus
gaagctgcaaaacgagcgcctggca

SEQ ID NO: 427868 - DNA, 25 bp, Mus musculus
gaagctgcaaaagatctctgatgag

SEQ ID NO: 427869 - DNA, 25 bp, Mus musculus
gaagctgcaaaagcatgcctgctct

SEQ ID NO: 427870 - DNA, 25 bp, Mus musculus
gaagctgcaaaaggagcgcctggca

SEQ ID NO: 427871 - DNA, 25 bp, Mus musculus
gaagctgcaaaatttactcatttta

SEQ ID NO: 427872 - DNA, 25 bp, Mus musculus
gaagctgcaaagcttcaccaggaac

SEQ ID NO: 427873 - DNA, 25 bp, Mus musculus
gaagctgcaaaggttcaccaggaac

SEQ ID NO: 427874 - DNA, 25 bp, Mus musculus
gaagctgcaaccaaccaagtttacc

SEQ ID NO: 427875 - DNA, 25 bp, Mus musculus
gaagctgcaacctaccaagtttacc

SEQ ID NO: 427876 - DNA, 25 bp, Mus musculus
gaagctgcaagtcagcaaaggtctc

SEQ ID NO: 427877 - DNA, 25 bp, Mus musculus
gaagctgcaagtgagcaaaggtctc

SEQ ID NO: 427878 - DNA, 25 bp, Mus musculus
gaagctgcacagaccgatgggagaa

SEQ ID NO: 427879 - DNA, 25 bp, Mus musculus
gaagctgcacagtccgatgggagaa

SEQ ID NO: 427880 - DNA, 25 bp, Mus musculus
gaagctgcacatccactcccaggat

SEQ ID NO: 427881 - DNA, 25 bp, Mus musculus
gaagctgcacatgcactcccaggat

SEQ ID NO: 427882 - DNA, 25 bp, Mus musculus
gaagctgcacgacatggaggcctct

SEQ ID NO: 427883 - DNA, 25 bp, Mus musculus
gaagctgcacgagatggaggcctct

SEQ ID NO: 427884 - DNA, 25 bp, Mus musculus
gaagctgcacgcctgcgatgactgc

SEQ ID NO: 427885 - DNA, 25 bp, Mus musculus
gaagctgcacgcgtgcgatgactgc

SEQ ID NO: 427886 - DNA, 25 bp, Mus musculus
gaagctgcactacattactgctaaa

SEQ ID NO: 427887 - DNA, 25 bp, Mus musculus
gaagctgcactagattactgctaaa

SEQ ID NO: 427888 - DNA, 25 bp, Mus musculus
gaagctgcactgaagaattgtccac

SEQ ID NO: 427889 - DNA, 25 bp, Mus musculus
gaagctgcactgtagaattgtccac

SEQ ID NO: 427890 - DNA, 25 bp, Mus musculus
gaagctgcagaacattgtgtacaaa

SEQ ID NO: 427891 - DNA, 25 bp, Mus musculus
gaagctgcagaagattgtgtacaaa

SEQ ID NO: 427892 - DNA, 25 bp, Mus musculus
gaagctgcagcactatcgccaggtg

SEQ ID NO: 427893 - DNA, 25 bp, Mus musculus
gaagctgcagcagtatcgccaggtg

SEQ ID NO: 427894 - DNA, 25 bp, Mus musculus
gaagctgcaggaagttgtcttgtct

SEQ ID NO: 427895 - DNA, 25 bp, Mus musculus
gaagctgcaggactacatccaactg

SEQ ID NO: 427896 - DNA, 25 bp, Mus musculus
gaagctgcaggagtacatccaactg

SEQ ID NO: 427897 - DNA, 25 bp, Mus musculus
gaagctgcaggatgttgtcttgtct

SEQ ID NO: 427898 - DNA, 25 bp, Mus musculus
gaagctgcagtcaacacaaactcac

SEQ ID NO: 427899 - DNA, 25 bp, Mus musculus
gaagctgcagtcatctgggcaccat

SEQ ID NO: 427900 - DNA, 25 bp, Mus musculus
gaagctgcagtccaagtgtcccagt

SEQ ID NO: 427901 - DNA, 25 bp, Mus musculus
gaagctgcagtcgaagtgtcccagt

SEQ ID NO: 427902 - DNA, 25 bp, Mus musculus
gaagctgcagtctacacaaactcac

SEQ ID NO: 427903 - DNA, 25 bp, Mus musculus
gaagctgcagtcttctgggcaccat

SEQ ID NO: 427904 - DNA, 25 bp, Mus musculus
gaagctgcatctccatttgttagca

SEQ ID NO: 427905 - DNA, 25 bp, Mus musculus
gaagctgcatctgcatttgttagca

SEQ ID NO: 427906 - DNA, 25 bp, Mus musculus
gaagctgcatgacaacaacccacgt

SEQ ID NO: 427907 - DNA, 25 bp, Mus musculus
gaagctgcatgagaacaacccacgt

SEQ ID NO: 427908 - DNA, 25 bp, Mus musculus
gaagctgccaaaacatacgtgcaag

SEQ ID NO: 427909 - DNA, 25 bp, Mus musculus
gaagctgccaaacccctaaaatcag

SEQ ID NO: 427910 - DNA, 25 bp, Mus musculus
gaagctgccaaagccctaaaatcag

SEQ ID NO: 427911 - DNA, 25 bp, Mus musculus
gaagctgccaaatcatacgtgcaag

SEQ ID NO: 427912 - DNA, 25 bp, Mus musculus
gaagctgccagcacagttaatctaa

SEQ ID NO: 427913 - DNA, 25 bp, Mus musculus
gaagctgccagctcagttaatctaa

SEQ ID NO: 427914 - DNA, 25 bp, Mus musculus
gaagctgccagtatggcactgtttt

SEQ ID NO: 427915 - DNA, 25 bp, Mus musculus
gaagctgccagtttggcactgtttt

SEQ ID NO: 427916 - DNA, 25 bp, Mus musculus
gaagctgccatgcaaaggccccaga

SEQ ID NO: 427917 - DNA, 25 bp, Mus musculus
gaagctgccatggaaaggccccaga

SEQ ID NO: 427918 - DNA, 25 bp, Mus musculus
gaagctgccattcagaacctcagtg

SEQ ID NO: 427919 - DNA, 25 bp, Mus musculus
gaagctgccattccagagattggtg

SEQ ID NO: 427920 - DNA, 25 bp, Mus musculus
gaagctgccattccataccaagaac

SEQ ID NO: 427921 - DNA, 25 bp, Mus musculus
gaagctgccattgagaacctcagtg

SEQ ID NO: 427922 - DNA, 25 bp, Mus musculus
gaagctgccattgcagagattggtg

SEQ ID NO: 427923 - DNA, 25 bp, Mus musculus
gaagctgccattgcataccaagaac

SEQ ID NO: 427924 - DNA, 25 bp, Mus musculus
gaagctgcccatcattggtgtggta

SEQ ID NO: 427925 - DNA, 25 bp, Mus musculus
gaagctgcccatctgtgacaaatgt

SEQ ID NO: 427926 - DNA, 25 bp, Mus musculus
gaagctgcccatgattggtgtggta

SEQ ID NO: 427927 - DNA, 25 bp, Mus musculus
gaagctgcccatgtgtgacaaatgt

SEQ ID NO: 427928 - DNA, 25 bp, Mus musculus
gaagctgcccgcagtggtgactgct

SEQ ID NO: 427929 - DNA, 25 bp, Mus musculus
gaagctgcccgctgtggtgactgct

SEQ ID NO: 427930 - DNA, 25 bp, Mus musculus
gaagctgccctaatttccaggaaaa

SEQ ID NO: 427931 - DNA, 25 bp, Mus musculus
gaagctgccctattttccaggaaaa

SEQ ID NO: 427932 - DNA, 25 bp, Mus musculus
gaagctgcccttcaaggaacaccag

SEQ ID NO: 427933 - DNA, 25 bp, Mus musculus
gaagctgcccttgaaggaacaccag

SEQ ID NO: 427934 - DNA, 25 bp, Mus musculus
gaagctgccgaaccctacagagcaa

SEQ ID NO: 427935 - DNA, 25 bp, Mus musculus
gaagctgccgaagcctacagagcaa

SEQ ID NO: 427936 - DNA, 25 bp, Mus musculus
gaagctgcgacccagaaacttccag

SEQ ID NO: 427937 - DNA, 25 bp, Mus musculus
gaagctgcgaccgagaaacttccag

SEQ ID NO: 427938 - DNA, 25 bp, Mus musculus
gaagctgcgagtcatgaactctcag

SEQ ID NO: 427939 - DNA, 25 bp, Mus musculus
gaagctgcgagtcgaatctcgttta

SEQ ID NO: 427940 - DNA, 25 bp, Mus musculus
gaagctgcgagtgatgaactctcag

SEQ ID NO: 427941 - DNA, 25 bp, Mus musculus
gaagctgcgagtggaatctcgttta

SEQ ID NO: 427942 - DNA, 25 bp, Mus musculus
gaagctgcggagaagggacggcgac

SEQ ID NO: 427943 - DNA, 25 bp, Mus musculus
gaagctgcggagtagggacggcgac

SEQ ID NO: 427944 - DNA, 25 bp, Mus musculus
gaagctgcggtgagacgagaacata

SEQ ID NO: 427945 - DNA, 25 bp, Mus musculus
gaagctgcggtgtgacgagaacata

SEQ ID NO: 427946 - DNA, 25 bp, Mus musculus
gaagctgcgtgtaggaaacatcccc

SEQ ID NO: 427947 - DNA, 25 bp, Mus musculus
gaagctgcgtgttggaaacatcccc

SEQ ID NO: 427948 - DNA, 25 bp, Mus musculus
gaagctgctaacaaccaggacacta

SEQ ID NO: 427949 - DNA, 25 bp, Mus musculus
gaagctgctaactaccaggacacta

SEQ ID NO: 427950 - DNA, 25 bp, Mus musculus
gaagctgctaagcagggtgctactt

SEQ ID NO: 427951 - DNA, 25 bp, Mus musculus
gaagctgctaaggagggtgctactt

SEQ ID NO: 427952 - DNA, 25 bp, Mus musculus
gaagctgctactcagcagctgctat

SEQ ID NO: 427953 - DNA, 25 bp, Mus musculus
gaagctgctactgagcagctgctat

SEQ ID NO: 427954 - DNA, 25 bp, Mus musculus
gaagctgctatcctcactgacagag

SEQ ID NO: 427955 - DNA, 25 bp, Mus musculus
gaagctgctatcgtcactgacagag

SEQ ID NO: 427956 - DNA, 25 bp, Mus musculus
gaagctgctcaaaggtgacacctgg

SEQ ID NO: 427957 - DNA, 25 bp, Mus musculus
gaagctgctcaatggtgacacctgg

SEQ ID NO: 427958 - DNA, 25 bp, Mus musculus
gaagctgctcacagttaagacaatc

SEQ ID NO: 427959 - DNA, 25 bp, Mus musculus
gaagctgctcactgttaagacaatc

SEQ ID NO: 427960 - DNA, 25 bp, Mus musculus
gaagctgctcataacttaactttaa

SEQ ID NO: 427961 - DNA, 25 bp, Mus musculus
gaagctgctcatctaggccaggaag

SEQ ID NO: 427962 - DNA, 25 bp, Mus musculus
gaagctgctcatgtaggccaggaag

SEQ ID NO: 427963 - DNA, 25 bp, Mus musculus
gaagctgctcattacttaactttaa

SEQ ID NO: 427964 - DNA, 25 bp, Mus musculus
gaagctgctcctagtcaccgatgga

SEQ ID NO: 427965 - DNA, 25 bp, Mus musculus
gaagctgctccttgtcaccgatgga

SEQ ID NO: 427966 - DNA, 25 bp, Mus musculus
gaagctgctcgcaatggtcgcactg

SEQ ID NO: 427967 - DNA, 25 bp, Mus musculus
gaagctgctcgctatggtcgcactg

SEQ ID NO: 427968 - DNA, 25 bp, Mus musculus
gaagctgctcttaaccttctgaaag

SEQ ID NO: 427969 - DNA, 25 bp, Mus musculus
gaagctgctctttaccttctgaaag

SEQ ID NO: 427970 - DNA, 25 bp, Mus musculus
gaagctgctgaacctttacatcaag

SEQ ID NO: 427971 - DNA, 25 bp, Mus musculus
gaagctgctgaagctttacatcaag

SEQ ID NO: 427972 - DNA, 25 bp, Mus musculus
gaagctgctgatacttagaagtaga

SEQ ID NO: 427973 - DNA, 25 bp, Mus musculus
gaagctgctgatatcctgctagaat

SEQ ID NO: 427974 - DNA, 25 bp, Mus musculus
gaagctgctgattcttagaagtaga

SEQ ID NO: 427975 - DNA, 25 bp, Mus musculus
gaagctgctgatttcctgctagaat

SEQ ID NO: 427976 - DNA, 25 bp, Mus musculus
gaagctgctgcaatttaatcttgag

SEQ ID NO: 427977 - DNA, 25 bp, Mus musculus
gaagctgctgcattttaatcttgag

SEQ ID NO: 427978 - DNA, 25 bp, Mus musculus
gaagctgctgctaaaggagatccct

SEQ ID NO: 427979 - DNA, 25 bp, Mus musculus
gaagctgctgcttaaggagatccct

SEQ ID NO: 427980 - DNA, 25 bp, Mus musculus
gaagctgctggtatcatttcatgac

SEQ ID NO: 427981 - DNA, 25 bp, Mus musculus
gaagctgctggtttcatttcatgac

SEQ ID NO: 427982 - DNA, 25 bp, Mus musculus
gaagctgctgttcagcacctcggtc

SEQ ID NO: 427983 - DNA, 25 bp, Mus musculus
gaagctgctgttgagcacctcggtc

SEQ ID NO: 427984 - DNA, 25 bp, Mus musculus
gaagctgcttagattctcctccttc

SEQ ID NO: 427985 - DNA, 25 bp, Mus musculus
gaagctgcttagtttctcctccttc

SEQ ID NO: 427986 - DNA, 25 bp, Mus musculus
gaagctgcttcccatctgatgtcac

SEQ ID NO: 427987 - DNA, 25 bp, Mus musculus
gaagctgcttccgatctgatgtcac

SEQ ID NO: 427988 - DNA, 25 bp, Mus musculus
gaagctgcttgcacagtcagggact

SEQ ID NO: 427989 - DNA, 25 bp, Mus musculus
gaagctgcttgctcagtcagggact

SEQ ID NO: 427990 - DNA, 25 bp, Mus musculus
gaagctgcttggacaactcgagcca

SEQ ID NO: 427991 - DNA, 25 bp, Mus musculus
gaagctgcttggtcaactcgagcca

SEQ ID NO: 427992 - DNA, 25 bp, Mus musculus
gaagctggaaatacacctcctgaag

SEQ ID NO: 427993 - DNA, 25 bp, Mus musculus
gaagctggaaattcacctcctgaag

SEQ ID NO: 427994 - DNA, 25 bp, Mus musculus
gaagctggaactcgcacttttccca

SEQ ID NO: 427995 - DNA, 25 bp, Mus musculus
gaagctggaactggcacttttccca

SEQ ID NO: 427996 - DNA, 25 bp, Mus musculus
gaagctggacgtctctgcccataga

SEQ ID NO: 427997 - DNA, 25 bp, Mus musculus
gaagctggacgtgtctgcccataga

SEQ ID NO: 427998 - DNA, 25 bp, Mus musculus
gaagctggactcagcactttgcctt

SEQ ID NO: 427999 - DNA, 25 bp, Mus musculus
gaagctggactctgcactttgcctt

SEQ ID NO: 428000 - DNA, 25 bp, Mus musculus
gaagctggagaaccaaagtctcaag

SEQ ID NO: 428001 - DNA, 25 bp, Mus musculus
gaagctggagaagcaaagtctcaag

SEQ ID NO: 428002 - DNA, 25 bp, Mus musculus
gaagctggagacaactacgtgccta

SEQ ID NO: 428003 - DNA, 25 bp, Mus musculus
gaagctggagactactacgtgccta

SEQ ID NO: 428004 - DNA, 25 bp, Mus musculus
gaagctggagatactgtgcagagca

SEQ ID NO: 428005 - DNA, 25 bp, Mus musculus
gaagctggagatatgccacggccct

SEQ ID NO: 428006 - DNA, 25 bp, Mus musculus
gaagctggagatcagctcctcttat

SEQ ID NO: 428007 - DNA, 25 bp, Mus musculus
gaagctggagatgagctcctcttat

SEQ ID NO: 428008 - DNA, 25 bp, Mus musculus
gaagctggagattctgtgcagagca

SEQ ID NO: 428009 - DNA, 25 bp, Mus musculus
gaagctggagatttgccacggccct

SEQ ID NO: 428010 - DNA, 25 bp, Mus musculus
gaagctggagccaggcagatccgat

SEQ ID NO: 428011 - DNA, 25 bp, Mus musculus
gaagctggagcctggcagatccgat

SEQ ID NO: 428012 - DNA, 25 bp, Mus musculus
gaagctggagctcttaaatttatct

SEQ ID NO: 428013 - DNA, 25 bp, Mus musculus
gaagctggagctgttaaatttatct

SEQ ID NO: 428014 - DNA, 25 bp, Mus musculus
gaagctggattcatgatttggcccc

SEQ ID NO: 428015 - DNA, 25 bp, Mus musculus
gaagctggattcttgatttggcccc

SEQ ID NO: 428016 - DNA, 25 bp, Mus musculus
gaagctggatttaaaccattggtct

SEQ ID NO: 428017 - DNA, 25 bp, Mus musculus
gaagctggattttaaccattggtct

SEQ ID NO: 428018 - DNA, 25 bp, Mus musculus
gaagctggcagtcgtctccaacttt

SEQ ID NO: 428019 - DNA, 25 bp, Mus musculus
gaagctggcagtggtctccaacttt

SEQ ID NO: 428020 - DNA, 25 bp, Mus musculus
gaagctggcatcagagctcagtttt

SEQ ID NO: 428021 - DNA, 25 bp, Mus musculus
gaagctggcatctgagctcagtttt

SEQ ID NO: 428022 - DNA, 25 bp, Mus musculus
gaagctggcatgcactagatttaac

SEQ ID NO: 428023 - DNA, 25 bp, Mus musculus
gaagctggcatggactagatttaac

SEQ ID NO: 428024 - DNA, 25 bp, Mus musculus
gaagctggcattaattgtcaggaca

SEQ ID NO: 428025 - DNA, 25 bp, Mus musculus
gaagctggcatttattgtcaggaca

SEQ ID NO: 428026 - DNA, 25 bp, Mus musculus
gaagctggccacctcgaagctgtac

SEQ ID NO: 428027 - DNA, 25 bp, Mus musculus
gaagctggccacgtcgaagctgtac

SEQ ID NO: 428028 - DNA, 25 bp, Mus musculus
gaagctggccataaaacccttctac

SEQ ID NO: 428029 - DNA, 25 bp, Mus musculus
gaagctggccatattcatgtgtact

SEQ ID NO: 428030 - DNA, 25 bp, Mus musculus
gaagctggccattaaacccttctac

SEQ ID NO: 428031 - DNA, 25 bp, Mus musculus
gaagctggccattttcatgtgtact

SEQ ID NO: 428032 - DNA, 25 bp, Mus musculus
gaagctggcctgacagtcattacaa

SEQ ID NO: 428033 - DNA, 25 bp, Mus musculus
gaagctggcctgtcagtcattacaa

SEQ ID NO: 428034 - DNA, 25 bp, Mus musculus
gaagctggctatcattgtgtggcat

SEQ ID NO: 428035 - DNA, 25 bp, Mus musculus
gaagctggctatgattgtgtggcat

SEQ ID NO: 428036 - DNA, 25 bp, Mus musculus
gaagctggctccactctagtcccaa

SEQ ID NO: 428037 - DNA, 25 bp, Mus musculus
gaagctggctcctctctagtcccaa

SEQ ID NO: 428038 - DNA, 25 bp, Mus musculus
gaagctggctctagatggctcagga

SEQ ID NO: 428039 - DNA, 25 bp, Mus musculus
gaagctggctcttgatggctcagga

SEQ ID NO: 428040 - DNA, 25 bp, Mus musculus
gaagctggctgtcaagtcttctcca

SEQ ID NO: 428041 - DNA, 25 bp, Mus musculus
gaagctggctgtgaagtcttctcca

SEQ ID NO: 428042 - DNA, 25 bp, Mus musculus
gaagctggcttacttccctccaggt

SEQ ID NO: 428043 - DNA, 25 bp, Mus musculus
gaagctggcttagttccctccaggt

SEQ ID NO: 428044 - DNA, 25 bp, Mus musculus
gaagctggcttcagttccctggctg

SEQ ID NO: 428045 - DNA, 25 bp, Mus musculus
gaagctggcttctgttccctggctg

SEQ ID NO: 428046 - DNA, 25 bp, Mus musculus
gaagctggctttctatggccttttc

SEQ ID NO: 428047 - DNA, 25 bp, Mus musculus
gaagctggctttgtatggccttttc

SEQ ID NO: 428048 - DNA, 25 bp, Mus musculus
gaagctgggagacagacctccgtcc

SEQ ID NO: 428049 - DNA, 25 bp, Mus musculus
gaagctgggagagagacctccgtcc

SEQ ID NO: 428050 - DNA, 25 bp, Mus musculus
gaagctgggatgaacttaagtctca

SEQ ID NO: 428051 - DNA, 25 bp, Mus musculus
gaagctgggatgtacttaagtctca

SEQ ID NO: 428052 - DNA, 25 bp, Mus musculus
gaagctgggcctctattgaataaac

SEQ ID NO: 428053 - DNA, 25 bp, Mus musculus
gaagctgggcctgtattgaataaac

SEQ ID NO: 428054 - DNA, 25 bp, Mus musculus
gaagctgggctaacctgatttgaac

SEQ ID NO: 428055 - DNA, 25 bp, Mus musculus
gaagctgggctatcctgatttgaac

SEQ ID NO: 428056 - DNA, 25 bp, Mus musculus
gaagctgggctcattccacgcattg

SEQ ID NO: 428057 - DNA, 25 bp, Mus musculus
gaagctgggctctttccacgcattg

SEQ ID NO: 428058 - DNA, 25 bp, Mus musculus
gaagctgggtttcaccatctgtctt

SEQ ID NO: 428059 - DNA, 25 bp, Mus musculus
gaagctgggtttgaccatctgtctt

SEQ ID NO: 428060 - DNA, 25 bp, Mus musculus
gaagctggtaacatctatacttgta

SEQ ID NO: 428061 - DNA, 25 bp, Mus musculus
gaagctggtaacttctatacttgta

SEQ ID NO: 428062 - DNA, 25 bp, Mus musculus
gaagctggtacaaaatgtacctctg

SEQ ID NO: 428063 - DNA, 25 bp, Mus musculus
gaagctggtacataatgtacctctg

SEQ ID NO: 428064 - DNA, 25 bp, Mus musculus
gaagctggtactctcctgggtacag

SEQ ID NO: 428065 - DNA, 25 bp, Mus musculus
gaagctggtactgtcctgggtacag

SEQ ID NO: 428066 - DNA, 25 bp, Mus musculus
gaagctggtattactatttcttttg

SEQ ID NO: 428067 - DNA, 25 bp, Mus musculus
gaagctggtatttctatttcttttg

SEQ ID NO: 428068 - DNA, 25 bp, Mus musculus
gaagctggtcctccatatgaagaac

SEQ ID NO: 428069 - DNA, 25 bp, Mus musculus
gaagctggtcctgcatatgaagaac

SEQ ID NO: 428070 - DNA, 25 bp, Mus musculus
gaagctggtctcaactaaaaaggta

SEQ ID NO: 428071 - DNA, 25 bp, Mus musculus
gaagctggtctctactaaaaaggta

SEQ ID NO: 428072 - DNA, 25 bp, Mus musculus
gaagctggtctgcaactgccatcca

SEQ ID NO: 428073 - DNA, 25 bp, Mus musculus
gaagctggtctggaactgccatcca

SEQ ID NO: 428074 - DNA, 25 bp, Mus musculus
gaagctggtgataggagtggccaat

SEQ ID NO: 428075 - DNA, 25 bp, Mus musculus
gaagctggtgatatggtggactaca

SEQ ID NO: 428076 - DNA, 25 bp, Mus musculus
gaagctggtgattggagtggccaat

SEQ ID NO: 428077 - DNA, 25 bp, Mus musculus
gaagctggtgatttggtggactaca

SEQ ID NO: 428078 - DNA, 25 bp, Mus musculus
gaagctggtgcaaacacaggaacct

SEQ ID NO: 428079 - DNA, 25 bp, Mus musculus
gaagctggtgcactcaaacctggag

SEQ ID NO: 428080 - DNA, 25 bp, Mus musculus
gaagctggtgcagtcaaacctggag

SEQ ID NO: 428081 - DNA, 25 bp, Mus musculus
gaagctggtgcatacacaggaacct

SEQ ID NO: 428082 - DNA, 25 bp, Mus musculus
gaagctggtgccactgaatcaggag

SEQ ID NO: 428083 - DNA, 25 bp, Mus musculus
gaagctggtgcctctgaatcaggag

SEQ ID NO: 428084 - DNA, 25 bp, Mus musculus
gaagctggtgtcaaacaagtgttcc

SEQ ID NO: 428085 - DNA, 25 bp, Mus musculus
gaagctggtgtctaacaagtgttcc

SEQ ID NO: 428086 - DNA, 25 bp, Mus musculus
gaagctggtgtgaccttcacataga

SEQ ID NO: 428087 - DNA, 25 bp, Mus musculus
gaagctggtgtgactcctgagtgcc

SEQ ID NO: 428088 - DNA, 25 bp, Mus musculus
gaagctggtgtgcactcagacgaaa

SEQ ID NO: 428089 - DNA, 25 bp, Mus musculus
gaagctggtgtggactcagacgaaa

SEQ ID NO: 428090 - DNA, 25 bp, Mus musculus
gaagctggtgtgtccttcacataga

SEQ ID NO: 428091 - DNA, 25 bp, Mus musculus
gaagctggtgtgtctcctgagtgcc

SEQ ID NO: 428092 - DNA, 25 bp, Mus musculus
gaagctggtgttagaggtatctcag

SEQ ID NO: 428093 - DNA, 25 bp, Mus musculus
gaagctggtgtttgaggtatctcag

SEQ ID NO: 428094 - DNA, 25 bp, Mus musculus
gaagctggttacagttttcactgga

SEQ ID NO: 428095 - DNA, 25 bp, Mus musculus
gaagctggttactgttttcactgga

SEQ ID NO: 428096 - DNA, 25 bp, Mus musculus
gaagctggttatcttgcacacagtt

SEQ ID NO: 428097 - DNA, 25 bp, Mus musculus
gaagctggttatgttgcacacagtt

SEQ ID NO: 428098 - DNA, 25 bp, Mus musculus
gaagctggttcaaggttagagtcat

SEQ ID NO: 428099 - DNA, 25 bp, Mus musculus
gaagctggttcatggttagagtcat

SEQ ID NO: 428100 - DNA, 25 bp, Mus musculus
gaagctggttccagtcaccttctgt

SEQ ID NO: 428101 - DNA, 25 bp, Mus musculus
gaagctggttcctgtcaccttctgt

SEQ ID NO: 428102 - DNA, 25 bp, Mus musculus
gaagctggttgtacgatgggcccac

SEQ ID NO: 428103 - DNA, 25 bp, Mus musculus
gaagctggttgttcgatgggcccac

SEQ ID NO: 428104 - DNA, 25 bp, Mus musculus
gaagctggtttgaatcggtcaactt

SEQ ID NO: 428105 - DNA, 25 bp, Mus musculus
gaagctggtttgtatcggtcaactt

SEQ ID NO: 428106 - DNA, 25 bp, Mus musculus
gaagctgtaagacgtcactgtcaca

SEQ ID NO: 428107 - DNA, 25 bp, Mus musculus
gaagctgtaagaggtcactgtcaca

SEQ ID NO: 428108 - DNA, 25 bp, Mus musculus
gaagctgtacggattcacagagaac

SEQ ID NO: 428109 - DNA, 25 bp, Mus musculus
gaagctgtacggtttcacagagaac

SEQ ID NO: 428110 - DNA, 25 bp, Mus musculus
gaagctgtacgtctgtcctatctac

SEQ ID NO: 428111 - DNA, 25 bp, Mus musculus
gaagctgtacgtgtgtcctatctac

SEQ ID NO: 428112 - DNA, 25 bp, Mus musculus
gaagctgtactacaactgaactgta

SEQ ID NO: 428113 - DNA, 25 bp, Mus musculus
gaagctgtactagaactgaactgta

SEQ ID NO: 428114 - DNA, 25 bp, Mus musculus
gaagctgtagcaatggagtcgtttg

SEQ ID NO: 428115 - DNA, 25 bp, Mus musculus
gaagctgtagcattggagtcgtttg

SEQ ID NO: 428116 - DNA, 25 bp, Mus musculus
gaagctgtaggcagtatttatctgt

SEQ ID NO: 428117 - DNA, 25 bp, Mus musculus
gaagctgtaggctgtatttatctgt

SEQ ID NO: 428118 - DNA, 25 bp, Mus musculus
gaagctgtagtccaaagcccatcat

SEQ ID NO: 428119 - DNA, 25 bp, Mus musculus
gaagctgtagtcgaaagcccatcat

SEQ ID NO: 428120 - DNA, 25 bp, Mus musculus
gaagctgtatctaagtgatctgaac

SEQ ID NO: 428121 - DNA, 25 bp, Mus musculus
gaagctgtatcttagtgatctgaac

SEQ ID NO: 428122 - DNA, 25 bp, Mus musculus
gaagctgtatgacattgatgtggcc

SEQ ID NO: 428123 - DNA, 25 bp, Mus musculus
gaagctgtatgagattgatgtggcc

SEQ ID NO: 428124 - DNA, 25 bp, Mus musculus
gaagctgtatgtagtacctgcctgg

SEQ ID NO: 428125 - DNA, 25 bp, Mus musculus
gaagctgtatgttgtacctgcctgg

SEQ ID NO: 428126 - DNA, 25 bp, Mus musculus
gaagctgtcaccattgaattctgga

SEQ ID NO: 428127 - DNA, 25 bp, Mus musculus
gaagctgtcacctttgaattctgga

SEQ ID NO: 428128 - DNA, 25 bp, Mus musculus
gaagctgtcagaagcaccagccctg

SEQ ID NO: 428129 - DNA, 25 bp, Mus musculus
gaagctgtcagatgcaccagccctg

SEQ ID NO: 428130 - DNA, 25 bp, Mus musculus
gaagctgtcagtattcgttcttgta

SEQ ID NO: 428131 - DNA, 25 bp, Mus musculus
gaagctgtcagtcagttcaactact

SEQ ID NO: 428132 - DNA, 25 bp, Mus musculus
gaagctgtcagtgagttcaactact

SEQ ID NO: 428133 - DNA, 25 bp, Mus musculus
gaagctgtcagttttcgttcttgta

SEQ ID NO: 428134 - DNA, 25 bp, Mus musculus
gaagctgtcatcctgctactgggca

SEQ ID NO: 428135 - DNA, 25 bp, Mus musculus
gaagctgtcatcgtgctactgggca

SEQ ID NO: 428136 - DNA, 25 bp, Mus musculus
gaagctgtcatgcactatacattgt

SEQ ID NO: 428137 - DNA, 25 bp, Mus musculus
gaagctgtcatggactatacattgt

SEQ ID NO: 428138 - DNA, 25 bp, Mus musculus
gaagctgtcattcttgatgatacaa

SEQ ID NO: 428139 - DNA, 25 bp, Mus musculus
gaagctgtcattgttgatgatacaa

SEQ ID NO: 428140 - DNA, 25 bp, Mus musculus
gaagctgtccagaaggtccacttcc

SEQ ID NO: 428141 - DNA, 25 bp, Mus musculus
gaagctgtccagtaggtccacttcc

SEQ ID NO: 428142 - DNA, 25 bp, Mus musculus
gaagctgtccatatgcccaaagtat

SEQ ID NO: 428143 - DNA, 25 bp, Mus musculus
gaagctgtccatttgcccaaagtat

SEQ ID NO: 428144 - DNA, 25 bp, Mus musculus
gaagctgtcccacttgctgtaaaga

SEQ ID NO: 428145 - DNA, 25 bp, Mus musculus
gaagctgtcccagttgctgtaaaga

SEQ ID NO: 428146 - DNA, 25 bp, Mus musculus
gaagctgtcctgcagaggaatccat

SEQ ID NO: 428147 - DNA, 25 bp, Mus musculus
gaagctgtcctggagaggaatccat

SEQ ID NO: 428148 - DNA, 25 bp, Mus musculus
gaagctgtcgatatgtttctgttat

SEQ ID NO: 428149 - DNA, 25 bp, Mus musculus
gaagctgtcgatttgtttctgttat

SEQ ID NO: 428150 - DNA, 25 bp, Mus musculus
gaagctgtcgctcaacacagactga

SEQ ID NO: 428151 - DNA, 25 bp, Mus musculus
gaagctgtcgctgaacacagactga

SEQ ID NO: 428152 - DNA, 25 bp, Mus musculus
gaagctgtctaactatggtcctcgc

SEQ ID NO: 428153 - DNA, 25 bp, Mus musculus
gaagctgtctaagtatggtcctcgc

SEQ ID NO: 428154 - DNA, 25 bp, Mus musculus
gaagctgtctcccaaaggcaggaac

SEQ ID NO: 428155 - DNA, 25 bp, Mus musculus
gaagctgtctcccagatggtagaga

SEQ ID NO: 428156 - DNA, 25 bp, Mus musculus
gaagctgtctccgaaaggcaggaac

SEQ ID NO: 428157 - DNA, 25 bp, Mus musculus
gaagctgtctccgagatggtagaga

SEQ ID NO: 428158 - DNA, 25 bp, Mus musculus
gaagctgtctgcacacaggtaaaca

SEQ ID NO: 428159 - DNA, 25 bp, Mus musculus
gaagctgtctgctcacaggtaaaca

SEQ ID NO: 428160 - DNA, 25 bp, Mus musculus
gaagctgtctggacacgtctttagt

SEQ ID NO: 428161 - DNA, 25 bp, Mus musculus
gaagctgtctggtcacgtctttagt

SEQ ID NO: 428162 - DNA, 25 bp, Mus musculus
gaagctgtcttcatcatgctcatat

SEQ ID NO: 428163 - DNA, 25 bp, Mus musculus
gaagctgtcttcttcatgctcatat

SEQ ID NO: 428164 - DNA, 25 bp, Mus musculus
gaagctgtctttacacatctttcac

SEQ ID NO: 428165 - DNA, 25 bp, Mus musculus
gaagctgtctttagtccatgagtag

SEQ ID NO: 428166 - DNA, 25 bp, Mus musculus
gaagctgtcttttcacatctttcac

SEQ ID NO: 428167 - DNA, 25 bp, Mus musculus
gaagctgtcttttgtccatgagtag

SEQ ID NO: 428168 - DNA, 25 bp, Mus musculus
gaagctgtgaaaaacatgcctcaaa

SEQ ID NO: 428169 - DNA, 25 bp, Mus musculus
gaagctgtgaaatacatgcctcaaa

SEQ ID NO: 428170 - DNA, 25 bp, Mus musculus
gaagctgtgaacattctttctgtgc

SEQ ID NO: 428171 - DNA, 25 bp, Mus musculus
gaagctgtgaactttctttctgtgc

SEQ ID NO: 428172 - DNA, 25 bp, Mus musculus
gaagctgtgactagggtgtcaataa

SEQ ID NO: 428173 - DNA, 25 bp, Mus musculus
gaagctgtgacttgggtgtcaataa

SEQ ID NO: 428174 - DNA, 25 bp, Mus musculus
gaagctgtgagaatcagttgccaaa

SEQ ID NO: 428175 - DNA, 25 bp, Mus musculus
gaagctgtgagattcagttgccaaa

SEQ ID NO: 428176 - DNA, 25 bp, Mus musculus
gaagctgtgatcagtttagcaaaga

SEQ ID NO: 428177 - DNA, 25 bp, Mus musculus
gaagctgtgatctgtttagcaaaga

SEQ ID NO: 428178 - DNA, 25 bp, Mus musculus
gaagctgtgatgacccatctcatgc

SEQ ID NO: 428179 - DNA, 25 bp, Mus musculus
gaagctgtgatgtcccatctcatgc

SEQ ID NO: 428180 - DNA, 25 bp, Mus musculus
gaagctgtgcgaaaggtgttgttaa

SEQ ID NO: 428181 - DNA, 25 bp, Mus musculus
gaagctgtgcgataggtgttgttaa

SEQ ID NO: 428182 - DNA, 25 bp, Mus musculus
gaagctgtgcttcaactgatgtctg

SEQ ID NO: 428183 - DNA, 25 bp, Mus musculus
gaagctgtgcttgaactgatgtctg

SEQ ID NO: 428184 - DNA, 25 bp, Mus musculus
gaagctgtggccaacatgcaaatgt

SEQ ID NO: 428185 - DNA, 25 bp, Mus musculus
gaagctgtggcctacatgcaaatgt

SEQ ID NO: 428186 - DNA, 25 bp, Mus musculus
gaagctgtggtacacctggtcatca

SEQ ID NO: 428187 - DNA, 25 bp, Mus musculus
gaagctgtggtagacctggtcatca

SEQ ID NO: 428188 - DNA, 25 bp, Mus musculus
gaagctgtggtcactactgcacttt

SEQ ID NO: 428189 - DNA, 25 bp, Mus musculus
gaagctgtggtctctactgcacttt

SEQ ID NO: 428190 - DNA, 25 bp, Mus musculus
gaagctgtgtccaaatgggttctaa

SEQ ID NO: 428191 - DNA, 25 bp, Mus musculus
gaagctgtgtcctaatgggttctaa

SEQ ID NO: 428192 - DNA, 25 bp, Mus musculus
gaagctgtgtgaaccgcactagcac

SEQ ID NO: 428193 - DNA, 25 bp, Mus musculus
gaagctgtgtgatccgcactagcac

SEQ ID NO: 428194 - DNA, 25 bp, Mus musculus
gaagctgtgtggatctgcagtctgc

SEQ ID NO: 428195 - DNA, 25 bp, Mus musculus
gaagctgtgtggttctgcagtctgc

SEQ ID NO: 428196 - DNA, 25 bp, Mus musculus
gaagctgtgttgcagcctaagtcct

SEQ ID NO: 428197 - DNA, 25 bp, Mus musculus
gaagctgtgttggagcctaagtcct

SEQ ID NO: 428198 - DNA, 25 bp, Mus musculus
gaagctgttactcacacaaatgttt

SEQ ID NO: 428199 - DNA, 25 bp, Mus musculus
gaagctgttactcgtcagcagaatc

SEQ ID NO: 428200 - DNA, 25 bp, Mus musculus
gaagctgttactgacacaaatgttt

SEQ ID NO: 428201 - DNA, 25 bp, Mus musculus
gaagctgttactggtcagcagaatc

SEQ ID NO: 428202 - DNA, 25 bp, Mus musculus
gaagctgttcacagcctgctggtaa

SEQ ID NO: 428203 - DNA, 25 bp, Mus musculus
gaagctgttcacatagctcgggatt

SEQ ID NO: 428204 - DNA, 25 bp, Mus musculus
gaagctgttcactgcctgctggtaa

SEQ ID NO: 428205 - DNA, 25 bp, Mus musculus
gaagctgttcacttagctcgggatt

SEQ ID NO: 428206 - DNA, 25 bp, Mus musculus
gaagctgttcagactctgatttata

SEQ ID NO: 428207 - DNA, 25 bp, Mus musculus
gaagctgttcagtctctgatttata

SEQ ID NO: 428208 - DNA, 25 bp, Mus musculus
gaagctgttcccatgtgaggagcac

SEQ ID NO: 428209 - DNA, 25 bp, Mus musculus
gaagctgttcccttgtgaggagcac

SEQ ID NO: 428210 - DNA, 25 bp, Mus musculus
gaagctgttcctacaaaggttgaca

SEQ ID NO: 428211 - DNA, 25 bp, Mus musculus
gaagctgttccttcaaaggttgaca

SEQ ID NO: 428212 - DNA, 25 bp, Mus musculus
gaagctgttcgaaagcatctgtaac

SEQ ID NO: 428213 - DNA, 25 bp, Mus musculus
gaagctgttcgatagcatctgtaac

SEQ ID NO: 428214 - DNA, 25 bp, Mus musculus
gaagctgttcgcagttagtgatgga

SEQ ID NO: 428215 - DNA, 25 bp, Mus musculus
gaagctgttcgcattctcggcgcgc

SEQ ID NO: 428216 - DNA, 25 bp, Mus musculus
gaagctgttcgctgttagtgatgga

SEQ ID NO: 428217 - DNA, 25 bp, Mus musculus
gaagctgttcgctttctcggcgcgc

SEQ ID NO: 428218 - DNA, 25 bp, Mus musculus
gaagctgttctaaggactttcctgc

SEQ ID NO: 428219 - DNA, 25 bp, Mus musculus
gaagctgttctatggactttcctgc

SEQ ID NO: 428220 - DNA, 25 bp, Mus musculus
gaagctgttctcaggcgtttcatta

SEQ ID NO: 428221 - DNA, 25 bp, Mus musculus
gaagctgttctcatgcagcaggtgg

SEQ ID NO: 428222 - DNA, 25 bp, Mus musculus
gaagctgttctcattcatttgacaa

SEQ ID NO: 428223 - DNA, 25 bp, Mus musculus
gaagctgttctctggcgtttcatta

SEQ ID NO: 428224 - DNA, 25 bp, Mus musculus
gaagctgttctcttgcagcaggtgg

SEQ ID NO: 428225 - DNA, 25 bp, Mus musculus
gaagctgttctctttcatttgacaa

SEQ ID NO: 428226 - DNA, 25 bp, Mus musculus
gaagctgttcttataagctcacttt

SEQ ID NO: 428227 - DNA, 25 bp, Mus musculus
gaagctgttcttttaagctcacttt

SEQ ID NO: 428228 - DNA, 25 bp, Mus musculus
gaagctgttgaaattgcatcatgtg

SEQ ID NO: 428229 - DNA, 25 bp, Mus musculus
gaagctgttgaacatctccaagcag

SEQ ID NO: 428230 - DNA, 25 bp, Mus musculus
gaagctgttgaagatctccaagcag

SEQ ID NO: 428231 - DNA, 25 bp, Mus musculus
gaagctgttgaatttgcatcatgtg

SEQ ID NO: 428232 - DNA, 25 bp, Mus musculus
gaagctgttgacctgatacctttga

SEQ ID NO: 428233 - DNA, 25 bp, Mus musculus
gaagctgttgacgtgatacctttga

SEQ ID NO: 428234 - DNA, 25 bp, Mus musculus
gaagctgttgatctataaccctgag

SEQ ID NO: 428235 - DNA, 25 bp, Mus musculus
gaagctgttgatcttataatgattc

SEQ ID NO: 428236 - DNA, 25 bp, Mus musculus
gaagctgttgatgtataaccctgag

SEQ ID NO: 428237 - DNA, 25 bp, Mus musculus
gaagctgttgatgttataatgattc

SEQ ID NO: 428238 - DNA, 25 bp, Mus musculus
gaagctgttgccatcctcaagagga

SEQ ID NO: 428239 - DNA, 25 bp, Mus musculus
gaagctgttgcccagttaaggtaac

SEQ ID NO: 428240 - DNA, 25 bp, Mus musculus
gaagctgttgccgagttaaggtaac

SEQ ID NO: 428241 - DNA, 25 bp, Mus musculus
gaagctgttgccttcctcaagagga

SEQ ID NO: 428242 - DNA, 25 bp, Mus musculus
gaagctgttgtccactccagacctg

SEQ ID NO: 428243 - DNA, 25 bp, Mus musculus
gaagctgttgtcgactccagacctg

SEQ ID NO: 428244 - DNA, 25 bp, Mus musculus
gaagctgttgttatgttatgtatga

SEQ ID NO: 428245 - DNA, 25 bp, Mus musculus
gaagctgttgttttgttatgtatga

SEQ ID NO: 428246 - DNA, 25 bp, Mus musculus
gaagctgtttccatgtacaggacca

SEQ ID NO: 428247 - DNA, 25 bp, Mus musculus
gaagctgtttccttgtacaggacca

SEQ ID NO: 428248 - DNA, 25 bp, Mus musculus
gaagctgtttgtcttctttaaggat

SEQ ID NO: 428249 - DNA, 25 bp, Mus musculus
gaagctgtttgtgttctttaaggat

SEQ ID NO: 428250 - DNA, 25 bp, Mus musculus
gaagctgttttacgaacaccccatt

SEQ ID NO: 428251 - DNA, 25 bp, Mus musculus
gaagctgttttaggaacaccccatt

SEQ ID NO: 428252 - DNA, 25 bp, Mus musculus
gaagctgtttttaccatgcagtgtt

SEQ ID NO: 428253 - DNA, 25 bp, Mus musculus
gaagctgttttttccatgcagtgtt

SEQ ID NO: 428254 - DNA, 25 bp, Mus musculus
gaagcttaaagcctgtctgcacaga

SEQ ID NO: 428255 - DNA, 25 bp, Mus musculus
gaagcttaaagcgtgtctgcacaga

SEQ ID NO: 428256 - DNA, 25 bp, Mus musculus
gaagcttaaagtctgaactaacgca

SEQ ID NO: 428257 - DNA, 25 bp, Mus musculus
gaagcttaaagtgtgaactaacgca

SEQ ID NO: 428258 - DNA, 25 bp, Mus musculus
gaagcttaaatcactcttgcactgc

SEQ ID NO: 428259 - DNA, 25 bp, Mus musculus
gaagcttaaatctctcttgcactgc

SEQ ID NO: 428260 - DNA, 25 bp, Mus musculus
gaagcttaaattccagacttactca

SEQ ID NO: 428261 - DNA, 25 bp, Mus musculus
gaagcttaaattgcagacttactca

SEQ ID NO: 428262 - DNA, 25 bp, Mus musculus
gaagcttaagtgatgtcgaccagac

SEQ ID NO: 428263 - DNA, 25 bp, Mus musculus
gaagcttaagtgttgtcgaccagac

SEQ ID NO: 428264 - DNA, 25 bp, Mus musculus
gaagcttaatcgaaccagagtggaa

SEQ ID NO: 428265 - DNA, 25 bp, Mus musculus
gaagcttaatcgtaccagagtggaa

SEQ ID NO: 428266 - DNA, 25 bp, Mus musculus
gaagcttaatgtagtagcccagaaa

SEQ ID NO: 428267 - DNA, 25 bp, Mus musculus
gaagcttaatgtagttgcagaatgc

SEQ ID NO: 428268 - DNA, 25 bp, Mus musculus
gaagcttaatgttgtagcccagaaa

SEQ ID NO: 428269 - DNA, 25 bp, Mus musculus
gaagcttaatgttgttgcagaatgc

SEQ ID NO: 428270 - DNA, 25 bp, Mus musculus
gaagcttacaataacgccaccatgt

SEQ ID NO: 428271 - DNA, 25 bp, Mus musculus
gaagcttacaattacgccaccatgt

SEQ ID NO: 428272 - DNA, 25 bp, Mus musculus
gaagcttacactatatcgagcaaat

SEQ ID NO: 428273 - DNA, 25 bp, Mus musculus
gaagcttacactttatcgagcaaat

SEQ ID NO: 428274 - DNA, 25 bp, Mus musculus
gaagcttacagtcatgtaggccaga

SEQ ID NO: 428275 - DNA, 25 bp, Mus musculus
gaagcttacagtgatgtaggccaga

SEQ ID NO: 428276 - DNA, 25 bp, Mus musculus
gaagcttacccaactttgaggtgca

SEQ ID NO: 428277 - DNA, 25 bp, Mus musculus
gaagcttacccatctttgaggtgca

SEQ ID NO: 428278 - DNA, 25 bp, Mus musculus
gaagcttaccctctctttgagccag

SEQ ID NO: 428279 - DNA, 25 bp, Mus musculus
gaagcttaccctgtctttgagccag

SEQ ID NO: 428280 - DNA, 25 bp, Mus musculus
gaagcttactctatgaaggcacata

SEQ ID NO: 428281 - DNA, 25 bp, Mus musculus
gaagcttactctttgaaggcacata

SEQ ID NO: 428282 - DNA, 25 bp, Mus musculus
gaagcttactttaattggctttgaa

SEQ ID NO: 428283 - DNA, 25 bp, Mus musculus
gaagcttacttttattggctttgaa

SEQ ID NO: 428284 - DNA, 25 bp, Mus musculus
gaagcttagcagaaaacacccagag

SEQ ID NO: 428285 - DNA, 25 bp, Mus musculus
gaagcttagcagtaaacacccagag

SEQ ID NO: 428286 - DNA, 25 bp, Mus musculus
gaagcttagcgcatagtgcgcactg

SEQ ID NO: 428287 - DNA, 25 bp, Mus musculus
gaagcttagcgcttagtgcgcactg

SEQ ID NO: 428288 - DNA, 25 bp, Mus musculus
gaagcttagctcataatttggtgat

SEQ ID NO: 428289 - DNA, 25 bp, Mus musculus
gaagcttagctcttaatttggtgat

SEQ ID NO: 428290 - DNA, 25 bp, Mus musculus
gaagcttagtatctatcttggtcca

SEQ ID NO: 428291 - DNA, 25 bp, Mus musculus
gaagcttagtatgtatcttggtcca

SEQ ID NO: 428292 - DNA, 25 bp, Mus musculus
gaagcttagtgaattgcccaaggac

SEQ ID NO: 428293 - DNA, 25 bp, Mus musculus
gaagcttagtgatttgcccaaggac

SEQ ID NO: 428294 - DNA, 25 bp, Mus musculus
gaagcttagtggagtcatctccagc

SEQ ID NO: 428295 - DNA, 25 bp, Mus musculus
gaagcttagtggtgtcatctccagc

SEQ ID NO: 428296 - DNA, 25 bp, Mus musculus
gaagcttatacccaggataacagga

SEQ ID NO: 428297 - DNA, 25 bp, Mus musculus
gaagcttataccgaggataacagga

SEQ ID NO: 428298 - DNA, 25 bp, Mus musculus
gaagcttatccgaaaggtgtccacg

SEQ ID NO: 428299 - DNA, 25 bp, Mus musculus
gaagcttatccgtaaggtgtccacg

SEQ ID NO: 428300 - DNA, 25 bp, Mus musculus
gaagcttatcgaatgcacggacact

SEQ ID NO: 428301 - DNA, 25 bp, Mus musculus
gaagcttatcgattgcacggacact

SEQ ID NO: 428302 - DNA, 25 bp, Mus musculus
gaagcttatgagcagctgccctaga

SEQ ID NO: 428303 - DNA, 25 bp, Mus musculus
gaagcttatgaggagctgccctaga

SEQ ID NO: 428304 - DNA, 25 bp, Mus musculus
gaagcttatggaactgcagtctcag

SEQ ID NO: 428305 - DNA, 25 bp, Mus musculus
gaagcttatggatctgcagtctcag

SEQ ID NO: 428306 - DNA, 25 bp, Mus musculus
gaagcttatgtgatatggatttgcc

SEQ ID NO: 428307 - DNA, 25 bp, Mus musculus
gaagcttatgtgttatggatttgcc

SEQ ID NO: 428308 - DNA, 25 bp, Mus musculus
gaagcttatgttatcattccaggtc

SEQ ID NO: 428309 - DNA, 25 bp, Mus musculus
gaagcttatgttctgacccattgtg

SEQ ID NO: 428310 - DNA, 25 bp, Mus musculus
gaagcttatgttgtgacccattgtg

SEQ ID NO: 428311 - DNA, 25 bp, Mus musculus
gaagcttatgttttcattccaggtc

SEQ ID NO: 428312 - DNA, 25 bp, Mus musculus
gaagcttattaacactttccagttt

SEQ ID NO: 428313 - DNA, 25 bp, Mus musculus
gaagcttattaagactttccagttt

SEQ ID NO: 428314 - DNA, 25 bp, Mus musculus
gaagcttatttacttgtgtctcaat

SEQ ID NO: 428315 - DNA, 25 bp, Mus musculus
gaagcttatttagttgtgtctcaat

SEQ ID NO: 428316 - DNA, 25 bp, Mus musculus
gaagcttcaacgatcaaggccatca

SEQ ID NO: 428317 - DNA, 25 bp, Mus musculus
gaagcttcaacgttcaaggccatca

SEQ ID NO: 428318 - DNA, 25 bp, Mus musculus
gaagcttcaagccatggtgattgag

SEQ ID NO: 428319 - DNA, 25 bp, Mus musculus
gaagcttcaagcgatggtgattgag

SEQ ID NO: 428320 - DNA, 25 bp, Mus musculus
gaagcttcaagtatgggccaggcca

SEQ ID NO: 428321 - DNA, 25 bp, Mus musculus
gaagcttcaagtttgggccaggcca

SEQ ID NO: 428322 - DNA, 25 bp, Mus musculus
gaagcttcaccgcacagagactttc

SEQ ID NO: 428323 - DNA, 25 bp, Mus musculus
gaagcttcaccggacagagactttc

SEQ ID NO: 428324 - DNA, 25 bp, Mus musculus
gaagcttcagaacacgacgacctgt

SEQ ID NO: 428325 - DNA, 25 bp, Mus musculus
gaagcttcagaagacgacgacctgt

SEQ ID NO: 428326 - DNA, 25 bp, Mus musculus
gaagcttcagctcggcgttttctca

SEQ ID NO: 428327 - DNA, 25 bp, Mus musculus
gaagcttcagctgggcgttttctca

SEQ ID NO: 428328 - DNA, 25 bp, Mus musculus
gaagcttcaggactatatcctattg

SEQ ID NO: 428329 - DNA, 25 bp, Mus musculus
gaagcttcaggagtatatcctattg

SEQ ID NO: 428330 - DNA, 25 bp, Mus musculus
gaagcttcaggtacggcccgtgaga

SEQ ID NO: 428331 - DNA, 25 bp, Mus musculus
gaagcttcaggttcggcccgtgaga

SEQ ID NO: 428332 - DNA, 25 bp, Mus musculus
gaagcttcagtaaatcaccggtcag

SEQ ID NO: 428333 - DNA, 25 bp, Mus musculus
gaagcttcagtatatcaccggtcag

SEQ ID NO: 428334 - DNA, 25 bp, Mus musculus
gaagcttcagtcaaccatggctcca

SEQ ID NO: 428335 - DNA, 25 bp, Mus musculus
gaagcttcagtctaccatggctcca

SEQ ID NO: 428336 - DNA, 25 bp, Mus musculus
gaagcttcagttagatcagccctcc

SEQ ID NO: 428337 - DNA, 25 bp, Mus musculus
gaagcttcagtttgatcagccctcc

SEQ ID NO: 428338 - DNA, 25 bp, Mus musculus
gaagcttcatgtatattagttgaca

SEQ ID NO: 428339 - DNA, 25 bp, Mus musculus
gaagcttcatgtttattagttgaca

SEQ ID NO: 428340 - DNA, 25 bp, Mus musculus
gaagcttcattaataacccacaccc

SEQ ID NO: 428341 - DNA, 25 bp, Mus musculus
gaagcttcattattaacccacaccc

SEQ ID NO: 428342 - DNA, 25 bp, Mus musculus
gaagcttccaagagccatcgaggca

SEQ ID NO: 428343 - DNA, 25 bp, Mus musculus
gaagcttccaagtgccatcgaggca

SEQ ID NO: 428344 - DNA, 25 bp, Mus musculus
gaagcttccaatatgcttgctgctg

SEQ ID NO: 428345 - DNA, 25 bp, Mus musculus
gaagcttccaatttgcttgctgctg

SEQ ID NO: 428346 - DNA, 25 bp, Mus musculus
gaagcttccacacctaagtggctgg

SEQ ID NO: 428347 - DNA, 25 bp, Mus musculus
gaagcttccacagctaagtggctgg

SEQ ID NO: 428348 - DNA, 25 bp, Mus musculus
gaagcttccaccagttggtggcgct

SEQ ID NO: 428349 - DNA, 25 bp, Mus musculus
gaagcttccacctgttggtggcgct

SEQ ID NO: 428350 - DNA, 25 bp, Mus musculus
gaagcttccagaagtgaccccataa

SEQ ID NO: 428351 - DNA, 25 bp, Mus musculus
gaagcttccagaatctgtattatgg

SEQ ID NO: 428352 - DNA, 25 bp, Mus musculus
gaagcttccagatgtgaccccataa

SEQ ID NO: 428353 - DNA, 25 bp, Mus musculus
gaagcttccagattctgtattatgg

SEQ ID NO: 428354 - DNA, 25 bp, Mus musculus
gaagcttccagtaataactcagagt

SEQ ID NO: 428355 - DNA, 25 bp, Mus musculus
gaagcttccagttataactcagagt

SEQ ID NO: 428356 - DNA, 25 bp, Mus musculus
gaagcttcccagaatgcatagtcat

SEQ ID NO: 428357 - DNA, 25 bp, Mus musculus
gaagcttcccagtatgcatagtcat

SEQ ID NO: 428358 - DNA, 25 bp, Mus musculus
gaagcttcccctcagaggactgata

SEQ ID NO: 428359 - DNA, 25 bp, Mus musculus
gaagcttcccctgagaggactgata

SEQ ID NO: 428360 - DNA, 25 bp, Mus musculus
gaagcttccctcagatgaaagtggc

SEQ ID NO: 428361 - DNA, 25 bp, Mus musculus
gaagcttccctctgatgaaagtggc

SEQ ID NO: 428362 - DNA, 25 bp, Mus musculus
gaagcttccgctataacttgtttgc

SEQ ID NO: 428363 - DNA, 25 bp, Mus musculus
gaagcttccgctttaacttgtttgc

SEQ ID NO: 428364 - DNA, 25 bp, Mus musculus
gaagcttcctatattgcgttgccat

SEQ ID NO: 428365 - DNA, 25 bp, Mus musculus
gaagcttcctattttgcgttgccat

SEQ ID NO: 428366 - DNA, 25 bp, Mus musculus
gaagcttcctgaccggccgagctga

SEQ ID NO: 428367 - DNA, 25 bp, Mus musculus
gaagcttcctgagcggccgagctga

SEQ ID NO: 428368 - DNA, 25 bp, Mus musculus
gaagcttccttaaagattcttcaaa

SEQ ID NO: 428369 - DNA, 25 bp, Mus musculus
gaagcttccttatagattcttcaaa

SEQ ID NO: 428370 - DNA, 25 bp, Mus musculus
gaagcttccttgctcagtgttttct

SEQ ID NO: 428371 - DNA, 25 bp, Mus musculus
gaagcttccttggtcagtgttttct

SEQ ID NO: 428372 - DNA, 25 bp, Mus musculus
gaagcttcctttcagagccgagagc

SEQ ID NO: 428373 - DNA, 25 bp, Mus musculus
gaagcttcctttgagagccgagagc

SEQ ID NO: 428374 - DNA, 25 bp, Mus musculus
gaagcttcgggaactggtcagtatg

SEQ ID NO: 428375 - DNA, 25 bp, Mus musculus
gaagcttcgggatctggtcagtatg

SEQ ID NO: 428376 - DNA, 25 bp, Mus musculus
gaagcttcggtccaacccaatgccg

SEQ ID NO: 428377 - DNA, 25 bp, Mus musculus
gaagcttcggtcgaacccaatgccg

SEQ ID NO: 428378 - DNA, 25 bp, Mus musculus
gaagcttctaatctcagtgcaatga

SEQ ID NO: 428379 - DNA, 25 bp, Mus musculus
gaagcttctaatgtcagtgcaatga

SEQ ID NO: 428380 - DNA, 25 bp, Mus musculus
gaagcttctacaagccccacactta

SEQ ID NO: 428381 - DNA, 25 bp, Mus musculus
gaagcttctacacttgtaggtgcat

SEQ ID NO: 428382 - DNA, 25 bp, Mus musculus
gaagcttctacagttgtaggtgcat

SEQ ID NO: 428383 - DNA, 25 bp, Mus musculus
gaagcttctacatgccccacactta

SEQ ID NO: 428384 - DNA, 25 bp, Mus musculus
gaagcttctagactgtgttcacgga

SEQ ID NO: 428385 - DNA, 25 bp, Mus musculus
gaagcttctagagtgtgttcacgga

SEQ ID NO: 428386 - DNA, 25 bp, Mus musculus
gaagcttctagtatgccttgggaat

SEQ ID NO: 428387 - DNA, 25 bp, Mus musculus
gaagcttctagtttgccttgggaat

SEQ ID NO: 428388 - DNA, 25 bp, Mus musculus
gaagcttctattctaaggctggcca

SEQ ID NO: 428389 - DNA, 25 bp, Mus musculus
gaagcttctattgtaaggctggcca

SEQ ID NO: 428390 - DNA, 25 bp, Mus musculus
gaagcttctcataccagagtagtct

SEQ ID NO: 428391 - DNA, 25 bp, Mus musculus
gaagcttctcattccagagtagtct

SEQ ID NO: 428392 - DNA, 25 bp, Mus musculus
gaagcttctcccagtgggttgctaa

SEQ ID NO: 428393 - DNA, 25 bp, Mus musculus
gaagcttctccctgtgggttgctaa

SEQ ID NO: 428394 - DNA, 25 bp, Mus musculus
gaagcttctctaagcatcttgactt

SEQ ID NO: 428395 - DNA, 25 bp, Mus musculus
gaagcttctctatgcatcttgactt

SEQ ID NO: 428396 - DNA, 25 bp, Mus musculus
gaagcttctctgaaaggcaaaaacc

SEQ ID NO: 428397 - DNA, 25 bp, Mus musculus
gaagcttctctgtaaggcaaaaacc

SEQ ID NO: 428398 - DNA, 25 bp, Mus musculus
gaagcttctgaactgccgactgatc

SEQ ID NO: 428399 - DNA, 25 bp, Mus musculus
gaagcttctgaagtgccgactgatc

SEQ ID NO: 428400 - DNA, 25 bp, Mus musculus
gaagcttctgatcaaggtcctaaaa

SEQ ID NO: 428401 - DNA, 25 bp, Mus musculus
gaagcttctgatccagctggttttc

SEQ ID NO: 428402 - DNA, 25 bp, Mus musculus
gaagcttctgatgaaggtcctaaaa

SEQ ID NO: 428403 - DNA, 25 bp, Mus musculus
gaagcttctgatgcagctggttttc

SEQ ID NO: 428404 - DNA, 25 bp, Mus musculus
gaagcttctgcaaatctgcttggta

SEQ ID NO: 428405 - DNA, 25 bp, Mus musculus
gaagcttctgcatatctgcttggta

SEQ ID NO: 428406 - DNA, 25 bp, Mus musculus
gaagcttctgccagattggatttag

SEQ ID NO: 428407 - DNA, 25 bp, Mus musculus
gaagcttctgcctgattggatttag

SEQ ID NO: 428408 - DNA, 25 bp, Mus musculus
gaagcttctggactgtgatcttgaa

SEQ ID NO: 428409 - DNA, 25 bp, Mus musculus
gaagcttctggagtgtgatcttgaa

SEQ ID NO: 428410 - DNA, 25 bp, Mus musculus
gaagcttctggtaggctgatgcatc

SEQ ID NO: 428411 - DNA, 25 bp, Mus musculus
gaagcttctggtcggacacctgtga

SEQ ID NO: 428412 - DNA, 25 bp, Mus musculus
gaagcttctggtgggacacctgtga

SEQ ID NO: 428413 - DNA, 25 bp, Mus musculus
gaagcttctggttggctgatgcatc

SEQ ID NO: 428414 - DNA, 25 bp, Mus musculus
gaagcttctgtgatggtgtggatcc

SEQ ID NO: 428415 - DNA, 25 bp, Mus musculus
gaagcttctgtgttggtgtggatcc

SEQ ID NO: 428416 - DNA, 25 bp, Mus musculus
gaagcttctgttcaggctcatgcca

SEQ ID NO: 428417 - DNA, 25 bp, Mus musculus
gaagcttctgttgaggctcatgcca

SEQ ID NO: 428418 - DNA, 25 bp, Mus musculus
gaagcttcttgaagggcatccagca

SEQ ID NO: 428419 - DNA, 25 bp, Mus musculus
gaagcttcttgacctagatcctgaa

SEQ ID NO: 428420 - DNA, 25 bp, Mus musculus
gaagcttcttgagctagatcctgaa

SEQ ID NO: 428421 - DNA, 25 bp, Mus musculus
gaagcttcttgatgggcatccagca

SEQ ID NO: 428422 - DNA, 25 bp, Mus musculus
gaagcttctttgatccacatgacaa

SEQ ID NO: 428423 - DNA, 25 bp, Mus musculus
gaagcttctttgatcccacctctca

SEQ ID NO: 428424 - DNA, 25 bp, Mus musculus
gaagcttctttgttccacatgacaa

SEQ ID NO: 428425 - DNA, 25 bp, Mus musculus
gaagcttctttgttcccacctctca

SEQ ID NO: 428426 - DNA, 25 bp, Mus musculus
gaagcttgaaatccctttatagaga

SEQ ID NO: 428427 - DNA, 25 bp, Mus musculus
gaagcttgaaatgcctttatagaga

SEQ ID NO: 428428 - DNA, 25 bp, Mus musculus
gaagcttgaagcacttgcagctgaa

SEQ ID NO: 428429 - DNA, 25 bp, Mus musculus
gaagcttgaagctcttgcagctgaa

SEQ ID NO: 428430 - DNA, 25 bp, Mus musculus
gaagcttgaattaatcccactgggt

SEQ ID NO: 428431 - DNA, 25 bp, Mus musculus
gaagcttgaatttatcccactgggt

SEQ ID NO: 428432 - DNA, 25 bp, Mus musculus
gaagcttgacgcaccaagcggaact

SEQ ID NO: 428433 - DNA, 25 bp, Mus musculus
gaagcttgacgctccaagcggaact

SEQ ID NO: 428434 - DNA, 25 bp, Mus musculus
gaagcttgacggatcccatcaggaa

SEQ ID NO: 428435 - DNA, 25 bp, Mus musculus
gaagcttgacggttcccatcaggaa

SEQ ID NO: 428436 - DNA, 25 bp, Mus musculus
gaagcttgacttcacctccgaggaa

SEQ ID NO: 428437 - DNA, 25 bp, Mus musculus
gaagcttgacttgacctccgaggaa

SEQ ID NO: 428438 - DNA, 25 bp, Mus musculus
gaagcttgatgactctaaacctagt

SEQ ID NO: 428439 - DNA, 25 bp, Mus musculus
gaagcttgatgagtctaaacctagt

SEQ ID NO: 428440 - DNA, 25 bp, Mus musculus
gaagcttgatggatcacctagacct

SEQ ID NO: 428441 - DNA, 25 bp, Mus musculus
gaagcttgatggttcacctagacct

SEQ ID NO: 428442 - DNA, 25 bp, Mus musculus
gaagcttgccaaatcttctcagatc

SEQ ID NO: 428443 - DNA, 25 bp, Mus musculus
gaagcttgccaattcttctcagatc

SEQ ID NO: 428444 - DNA, 25 bp, Mus musculus
gaagcttgccctacagcagcagaaa

SEQ ID NO: 428445 - DNA, 25 bp, Mus musculus
gaagcttgcccttcagcagcagaaa

SEQ ID NO: 428446 - DNA, 25 bp, Mus musculus
gaagcttgccgcaggtggtgccctc

SEQ ID NO: 428447 - DNA, 25 bp, Mus musculus
gaagcttgccgctggtggtgccctc

SEQ ID NO: 428448 - DNA, 25 bp, Mus musculus
gaagcttgccggcaaggtctgtaaa

SEQ ID NO: 428449 - DNA, 25 bp, Mus musculus
gaagcttgccgggaaggtctgtaaa

SEQ ID NO: 428450 - DNA, 25 bp, Mus musculus
gaagcttgctaacatgagacctgaa

SEQ ID NO: 428451 - DNA, 25 bp, Mus musculus
gaagcttgctaagatgagacctgaa

SEQ ID NO: 428452 - DNA, 25 bp, Mus musculus
gaagcttgctacatctttctcatta

SEQ ID NO: 428453 - DNA, 25 bp, Mus musculus
gaagcttgctacttctttctcatta

SEQ ID NO: 428454 - DNA, 25 bp, Mus musculus
gaagcttgctctccctagatgggtg

SEQ ID NO: 428455 - DNA, 25 bp, Mus musculus
gaagcttgctctgcctagatgggtg

SEQ ID NO: 428456 - DNA, 25 bp, Mus musculus
gaagcttgctgaagcgattgtacat

SEQ ID NO: 428457 - DNA, 25 bp, Mus musculus
gaagcttgctgatgcgattgtacat

SEQ ID NO: 428458 - DNA, 25 bp, Mus musculus
gaagcttgcttcaaactgtactcct

SEQ ID NO: 428459 - DNA, 25 bp, Mus musculus
gaagcttgcttctaactgtactcct

SEQ ID NO: 428460 - DNA, 25 bp, Mus musculus
gaagcttgcttgattatgtcacaga

SEQ ID NO: 428461 - DNA, 25 bp, Mus musculus
gaagcttgcttgtttatgtcacaga

SEQ ID NO: 428462 - DNA, 25 bp, Mus musculus
gaagcttggagcacatgacaatctg

SEQ ID NO: 428463 - DNA, 25 bp, Mus musculus
gaagcttggagcattccagacagaa

SEQ ID NO: 428464 - DNA, 25 bp, Mus musculus
gaagcttggagctcatgacaatctg

SEQ ID NO: 428465 - DNA, 25 bp, Mus musculus
gaagcttggagctttccagacagaa

SEQ ID NO: 428466 - DNA, 25 bp, Mus musculus
gaagcttggaggacttggacaaaca

SEQ ID NO: 428467 - DNA, 25 bp, Mus musculus
gaagcttggaggtcttggacaaaca

SEQ ID NO: 428468 - DNA, 25 bp, Mus musculus
gaagcttggcatatccacattgctt

SEQ ID NO: 428469 - DNA, 25 bp, Mus musculus
gaagcttggcatttccacattgctt

SEQ ID NO: 428470 - DNA, 25 bp, Mus musculus
gaagcttggccaagttgtctctctt

SEQ ID NO: 428471 - DNA, 25 bp, Mus musculus
gaagcttggccatgttgtctctctt

SEQ ID NO: 428472 - DNA, 25 bp, Mus musculus
gaagcttgggtacatacaggcctga

SEQ ID NO: 428473 - DNA, 25 bp, Mus musculus
gaagcttgggtagatacaggcctga

SEQ ID NO: 428474 - DNA, 25 bp, Mus musculus
gaagcttggtgcaaagtatatccta

SEQ ID NO: 428475 - DNA, 25 bp, Mus musculus
gaagcttggtgctaagtatatccta

SEQ ID NO: 428476 - DNA, 25 bp, Mus musculus
gaagcttggtggaaccccactttca

SEQ ID NO: 428477 - DNA, 25 bp, Mus musculus
gaagcttggtggtaccccactttca

SEQ ID NO: 428478 - DNA, 25 bp, Mus musculus
gaagcttggtgtaatcctcaacgat

SEQ ID NO: 428479 - DNA, 25 bp, Mus musculus
gaagcttggtgttatcctcaacgat

SEQ ID NO: 428480 - DNA, 25 bp, Mus musculus
gaagcttgtatcaggcttgacaaag

SEQ ID NO: 428481 - DNA, 25 bp, Mus musculus
gaagcttgtatctggcttgacaaag

SEQ ID NO: 428482 - DNA, 25 bp, Mus musculus
gaagcttgtccacagactgtgagta

SEQ ID NO: 428483 - DNA, 25 bp, Mus musculus
gaagcttgtccagagactgtgagta

SEQ ID NO: 428484 - DNA, 25 bp, Mus musculus
gaagcttgtctcagagttatgggat

SEQ ID NO: 428485 - DNA, 25 bp, Mus musculus
gaagcttgtctctgagttatgggat

SEQ ID NO: 428486 - DNA, 25 bp, Mus musculus
gaagcttgtgtgctgtcagcatttt

SEQ ID NO: 428487 - DNA, 25 bp, Mus musculus
gaagcttgtgtggtgtcagcatttt

SEQ ID NO: 428488 - DNA, 25 bp, Mus musculus
gaagcttgtgttagcgtttttgttg

SEQ ID NO: 428489 - DNA, 25 bp, Mus musculus
gaagcttgtgttagctacctcttgt

SEQ ID NO: 428490 - DNA, 25 bp, Mus musculus
gaagcttgtgttagggcatctgtag

SEQ ID NO: 428491 - DNA, 25 bp, Mus musculus
gaagcttgtgtttgcgtttttgttg

SEQ ID NO: 428492 - DNA, 25 bp, Mus musculus
gaagcttgtgtttgctacctcttgt

SEQ ID NO: 428493 - DNA, 25 bp, Mus musculus
gaagcttgtgtttgggcatctgtag

SEQ ID NO: 428494 - DNA, 25 bp, Mus musculus
gaagcttgttagaactccttagatt

SEQ ID NO: 428495 - DNA, 25 bp, Mus musculus
gaagcttgttagtactccttagatt

SEQ ID NO: 428496 - DNA, 25 bp, Mus musculus
gaagcttgttcaagattttctgata

SEQ ID NO: 428497 - DNA, 25 bp, Mus musculus
gaagcttgttcatgattttctgata

SEQ ID NO: 428498 - DNA, 25 bp, Mus musculus
gaagcttgttctcatggcatggacc

SEQ ID NO: 428499 - DNA, 25 bp, Mus musculus
gaagcttgttctgatggcatggacc

SEQ ID NO: 428500 - DNA, 25 bp, Mus musculus
gaagcttgttgaacttcgatcaagt

SEQ ID NO: 428501 - DNA, 25 bp, Mus musculus
gaagcttgttgatcttcgatcaagt

SEQ ID NO: 428502 - DNA, 25 bp, Mus musculus
gaagcttgttgcctggtacgacaac

SEQ ID NO: 428503 - DNA, 25 bp, Mus musculus
gaagcttgttgcgtggtacgacaac

SEQ ID NO: 428504 - DNA, 25 bp, Mus musculus
gaagcttgtttgcttccctcctttt

SEQ ID NO: 428505 - DNA, 25 bp, Mus musculus
gaagcttgtttggttccctcctttt

SEQ ID NO: 428506 - DNA, 25 bp, Mus musculus
gaagctttaactcatgttggcatgt

SEQ ID NO: 428507 - DNA, 25 bp, Mus musculus
gaagctttaactgatgttggcatgt

SEQ ID NO: 428508 - DNA, 25 bp, Mus musculus
gaagctttaaggcatggagactgta

SEQ ID NO: 428509 - DNA, 25 bp, Mus musculus
gaagctttaagggatggagactgta

SEQ ID NO: 428510 - DNA, 25 bp, Mus musculus
gaagctttaataccactgcgtcctt

SEQ ID NO: 428511 - DNA, 25 bp, Mus musculus
gaagctttaatagcactgcgtcctt

SEQ ID NO: 428512 - DNA, 25 bp, Mus musculus
gaagctttaattactccactggact

SEQ ID NO: 428513 - DNA, 25 bp, Mus musculus
gaagctttaattatcctactcaggg

SEQ ID NO: 428514 - DNA, 25 bp, Mus musculus
gaagctttaatttctccactggact

SEQ ID NO: 428515 - DNA, 25 bp, Mus musculus
gaagctttaattttcctactcaggg

SEQ ID NO: 428516 - DNA, 25 bp, Mus musculus
gaagctttacttcgcacaggtgcag

SEQ ID NO: 428517 - DNA, 25 bp, Mus musculus
gaagctttacttggcacaggtgcag

SEQ ID NO: 428518 - DNA, 25 bp, Mus musculus
gaagctttagatccagcccataata

SEQ ID NO: 428519 - DNA, 25 bp, Mus musculus
gaagctttagatgcagcccataata

SEQ ID NO: 428520 - DNA, 25 bp, Mus musculus
gaagctttagcgcagactgcctgga

SEQ ID NO: 428521 - DNA, 25 bp, Mus musculus
gaagctttagcggagactgcctgga

SEQ ID NO: 428522 - DNA, 25 bp, Mus musculus
gaagctttagctcaaagtacagcaa

SEQ ID NO: 428523 - DNA, 25 bp, Mus musculus
gaagctttagctgaaagtacagcaa

SEQ ID NO: 428524 - DNA, 25 bp, Mus musculus
gaagctttagttagccagttcttta

SEQ ID NO: 428525 - DNA, 25 bp, Mus musculus
gaagctttagtttgccagttcttta

SEQ ID NO: 428526 - DNA, 25 bp, Mus musculus
gaagctttatgtaatggaaggccca

SEQ ID NO: 428527 - DNA, 25 bp, Mus musculus
gaagctttatgttatggaaggccca

SEQ ID NO: 428528 - DNA, 25 bp, Mus musculus
gaagctttcagaaaagtctcttaca

SEQ ID NO: 428529 - DNA, 25 bp, Mus musculus
gaagctttcagataagtctcttaca

SEQ ID NO: 428530 - DNA, 25 bp, Mus musculus
gaagctttcatcaggagttcctgtg

SEQ ID NO: 428531 - DNA, 25 bp, Mus musculus
gaagctttcatctggagttcctgtg

SEQ ID NO: 428532 - DNA, 25 bp, Mus musculus
gaagctttccaaatacagactgtgt

SEQ ID NO: 428533 - DNA, 25 bp, Mus musculus
gaagctttccaattacagactgtgt

SEQ ID NO: 428534 - DNA, 25 bp, Mus musculus
gaagctttccagacacacagcaagg

SEQ ID NO: 428535 - DNA, 25 bp, Mus musculus
gaagctttccagtcacacagcaagg

SEQ ID NO: 428536 - DNA, 25 bp, Mus musculus
gaagctttcccaatgtttgtcagag

SEQ ID NO: 428537 - DNA, 25 bp, Mus musculus
gaagctttcccattgtttgtcagag

SEQ ID NO: 428538 - DNA, 25 bp, Mus musculus
gaagctttcctcacactagacacag

SEQ ID NO: 428539 - DNA, 25 bp, Mus musculus
gaagctttcctctcactagacacag

SEQ ID NO: 428540 - DNA, 25 bp, Mus musculus
gaagctttccttcttcccaggtact

SEQ ID NO: 428541 - DNA, 25 bp, Mus musculus
gaagctttccttgttcccaggtact

SEQ ID NO: 428542 - DNA, 25 bp, Mus musculus
gaagctttcgcccttggatgagatg

SEQ ID NO: 428543 - DNA, 25 bp, Mus musculus
gaagctttcgccgttggatgagatg

SEQ ID NO: 428544 - DNA, 25 bp, Mus musculus
gaagctttcggtcagctttatctgt

SEQ ID NO: 428545 - DNA, 25 bp, Mus musculus
gaagctttcggtgagctttatctgt

SEQ ID NO: 428546 - DNA, 25 bp, Mus musculus
gaagctttctatacacccgtccttt

SEQ ID NO: 428547 - DNA, 25 bp, Mus musculus
gaagctttctatagtgacttttatg

SEQ ID NO: 428548 - DNA, 25 bp, Mus musculus
gaagctttctattcacccgtccttt

SEQ ID NO: 428549 - DNA, 25 bp, Mus musculus
gaagctttctattgtgacttttatg

SEQ ID NO: 428550 - DNA, 25 bp, Mus musculus
gaagctttctccctattcgataaag

SEQ ID NO: 428551 - DNA, 25 bp, Mus musculus
gaagctttctccgtattcgataaag

SEQ ID NO: 428552 - DNA, 25 bp, Mus musculus
gaagctttctctcccaaatcagata

SEQ ID NO: 428553 - DNA, 25 bp, Mus musculus
gaagctttctctgccaaatcagata

SEQ ID NO: 428554 - DNA, 25 bp, Mus musculus
gaagctttctgtatggtattgacac

SEQ ID NO: 428555 - DNA, 25 bp, Mus musculus
gaagctttctgtttggtattgacac

SEQ ID NO: 428556 - DNA, 25 bp, Mus musculus
gaagctttcttccttaatatctgaa

SEQ ID NO: 428557 - DNA, 25 bp, Mus musculus
gaagctttcttcgttaatatctgaa

SEQ ID NO: 428558 - DNA, 25 bp, Mus musculus
gaagctttcttgaggcgacaggcaa

SEQ ID NO: 428559 - DNA, 25 bp, Mus musculus
gaagctttcttgatctcatgacttt

SEQ ID NO: 428560 - DNA, 25 bp, Mus musculus
gaagctttcttgtggcgacaggcaa

SEQ ID NO: 428561 - DNA, 25 bp, Mus musculus
gaagctttcttgttctcatgacttt

SEQ ID NO: 428562 - DNA, 25 bp, Mus musculus
gaagctttgaaacaaccatttttcg

SEQ ID NO: 428563 - DNA, 25 bp, Mus musculus
gaagctttgaaagaaccatttttcg

SEQ ID NO: 428564 - DNA, 25 bp, Mus musculus
gaagctttgaagactccacgggtat

SEQ ID NO: 428565 - DNA, 25 bp, Mus musculus
gaagctttgaagtctccacgggtat

SEQ ID NO: 428566 - DNA, 25 bp, Mus musculus
gaagctttgataaaacgtgttccac

SEQ ID NO: 428567 - DNA, 25 bp, Mus musculus
gaagctttgatataacgtgttccac

SEQ ID NO: 428568 - DNA, 25 bp, Mus musculus
gaagctttgcagacgtatttccctg

SEQ ID NO: 428569 - DNA, 25 bp, Mus musculus
gaagctttgcagtcgtatttccctg

SEQ ID NO: 428570 - DNA, 25 bp, Mus musculus
gaagctttgcatcgaagtcccttag

SEQ ID NO: 428571 - DNA, 25 bp, Mus musculus
gaagctttgcatggaagtcccttag

SEQ ID NO: 428572 - DNA, 25 bp, Mus musculus
gaagctttgcggaagcaacagccaa

SEQ ID NO: 428573 - DNA, 25 bp, Mus musculus
gaagctttgcggtagcaacagccaa

SEQ ID NO: 428574 - DNA, 25 bp, Mus musculus
gaagctttgcttactccatatgtct

SEQ ID NO: 428575 - DNA, 25 bp, Mus musculus
gaagctttgctttctccatatgtct

SEQ ID NO: 428576 - DNA, 25 bp, Mus musculus
gaagctttggaaacccataacttaa

SEQ ID NO: 428577 - DNA, 25 bp, Mus musculus
gaagctttggaaacttttactatga

SEQ ID NO: 428578 - DNA, 25 bp, Mus musculus
gaagctttggaatcccataacttaa

SEQ ID NO: 428579 - DNA, 25 bp, Mus musculus
gaagctttggaatcttttactatga

SEQ ID NO: 428580 - DNA, 25 bp, Mus musculus
gaagctttgggaagaactgggacct

SEQ ID NO: 428581 - DNA, 25 bp, Mus musculus
gaagctttgggatgaactgggacct

SEQ ID NO: 428582 - DNA, 25 bp, Mus musculus
gaagctttggtgctactaagccaac

SEQ ID NO: 428583 - DNA, 25 bp, Mus musculus
gaagctttggtggtactaagccaac

SEQ ID NO: 428584 - DNA, 25 bp, Mus musculus
gaagctttgtatcactattgtacta

SEQ ID NO: 428585 - DNA, 25 bp, Mus musculus
gaagctttgtatgactattgtacta

SEQ ID NO: 428586 - DNA, 25 bp, Mus musculus
gaagctttgtgaccttgaagaatcc

SEQ ID NO: 428587 - DNA, 25 bp, Mus musculus
gaagctttgtgagcttgaagaatcc

SEQ ID NO: 428588 - DNA, 25 bp, Mus musculus
gaagcttttaacacttggccgaaat

SEQ ID NO: 428589 - DNA, 25 bp, Mus musculus
gaagcttttaactcttggccgaaat

SEQ ID NO: 428590 - DNA, 25 bp, Mus musculus
gaagcttttaccagaagaacctgca

SEQ ID NO: 428591 - DNA, 25 bp, Mus musculus
gaagcttttacctgaagaacctgca

SEQ ID NO: 428592 - DNA, 25 bp, Mus musculus
gaagcttttatacttctcgttcatt

SEQ ID NO: 428593 - DNA, 25 bp, Mus musculus
gaagcttttatagttctcgttcatt

SEQ ID NO: 428594 - DNA, 25 bp, Mus musculus
gaagcttttatcaatcaccactccc

SEQ ID NO: 428595 - DNA, 25 bp, Mus musculus
gaagcttttatctatcaccactccc

SEQ ID NO: 428596 - DNA, 25 bp, Mus musculus
gaagcttttcagcttggtattcccc

SEQ ID NO: 428597 - DNA, 25 bp, Mus musculus
gaagcttttcaggttggtattcccc

SEQ ID NO: 428598 - DNA, 25 bp, Mus musculus
gaagcttttcctacagttcctgtga

SEQ ID NO: 428599 - DNA, 25 bp, Mus musculus
gaagcttttccttcagttcctgtga

SEQ ID NO: 428600 - DNA, 25 bp, Mus musculus
gaagcttttcggcacccttacccat

SEQ ID NO: 428601 - DNA, 25 bp, Mus musculus
gaagcttttcggcatgcctgcaaaa

SEQ ID NO: 428602 - DNA, 25 bp, Mus musculus
gaagcttttcgggacccttacccat

SEQ ID NO: 428603 - DNA, 25 bp, Mus musculus
gaagcttttcgggatgcctgcaaaa

SEQ ID NO: 428604 - DNA, 25 bp, Mus musculus
gaagcttttctcaagcctacagtag

SEQ ID NO: 428605 - DNA, 25 bp, Mus musculus
gaagcttttctctagcctacagtag

SEQ ID NO: 428606 - DNA, 25 bp, Mus musculus
gaagcttttctgataattatcacat

SEQ ID NO: 428607 - DNA, 25 bp, Mus musculus
gaagcttttctgttaattatcacat

SEQ ID NO: 428608 - DNA, 25 bp, Mus musculus
gaagcttttgcgagtcttgaaggac

SEQ ID NO: 428609 - DNA, 25 bp, Mus musculus
gaagcttttgcgtgtcttgaaggac

SEQ ID NO: 428610 - DNA, 25 bp, Mus musculus
gaagctttttccctatgtacgatgt

SEQ ID NO: 428611 - DNA, 25 bp, Mus musculus
gaagctttttccgtatgtacgatgt

SEQ ID NO: 428612 - DNA, 25 bp, Mus musculus
gaagctttttctaatgtcttacagg

SEQ ID NO: 428613 - DNA, 25 bp, Mus musculus
gaagctttttcttatgtcttacagg

SEQ ID NO: 428614 - DNA, 25 bp, Mus musculus
gaagcttttttcactttgcgacacc

SEQ ID NO: 428615 - DNA, 25 bp, Mus musculus
gaagcttttttctctttgcgacacc

SEQ ID NO: 428616 - DNA, 25 bp, Mus musculus
gaaggaaaacctctcctactggtca

SEQ ID NO: 428617 - DNA, 25 bp, Mus musculus
gaaggaaaacctgtcctactggtca

SEQ ID NO: 428618 - DNA, 25 bp, Mus musculus
gaaggaaaactaaggatgatcgtct

SEQ ID NO: 428619 - DNA, 25 bp, Mus musculus
gaaggaaaactatggatgatcgtct

SEQ ID NO: 428620 - DNA, 25 bp, Mus musculus
gaaggaaaacttccaacccagtcag

SEQ ID NO: 428621 - DNA, 25 bp, Mus musculus
gaaggaaaacttgcaacccagtcag

SEQ ID NO: 428622 - DNA, 25 bp, Mus musculus
gaaggaaaagctccacagacccttt

SEQ ID NO: 428623 - DNA, 25 bp, Mus musculus
gaaggaaaagctgcacagacccttt

SEQ ID NO: 428624 - DNA, 25 bp, Mus musculus
gaaggaaaataaccagcctctgggt

SEQ ID NO: 428625 - DNA, 25 bp, Mus musculus
gaaggaaaataagcagcctctgggt

SEQ ID NO: 428626 - DNA, 25 bp, Mus musculus
gaaggaaaattaatcagggcagcta

SEQ ID NO: 428627 - DNA, 25 bp, Mus musculus
gaaggaaaattattcagggcagcta

SEQ ID NO: 428628 - DNA, 25 bp, Mus musculus
gaaggaaacaacaccagttctggtc

SEQ ID NO: 428629 - DNA, 25 bp, Mus musculus
gaaggaaacaactccagttctggtc

SEQ ID NO: 428630 - DNA, 25 bp, Mus musculus
gaaggaaacaagaattttagtggat

SEQ ID NO: 428631 - DNA, 25 bp, Mus musculus
gaaggaaacaagtattttagtggat

SEQ ID NO: 428632 - DNA, 25 bp, Mus musculus
gaaggaaacaccagactcaccattg

SEQ ID NO: 428633 - DNA, 25 bp, Mus musculus
gaaggaaacaccatccaataccctg

SEQ ID NO: 428634 - DNA, 25 bp, Mus musculus
gaaggaaacacctgactcaccattg

SEQ ID NO: 428635 - DNA, 25 bp, Mus musculus
gaaggaaacaccttccaataccctg

SEQ ID NO: 428636 - DNA, 25 bp, Mus musculus
gaaggaaaccctccctatatcttca

SEQ ID NO: 428637 - DNA, 25 bp, Mus musculus
gaaggaaaccctgcctatatcttca

SEQ ID NO: 428638 - DNA, 25 bp, Mus musculus
gaaggaaacctaagtctcaagagga

SEQ ID NO: 428639 - DNA, 25 bp, Mus musculus
gaaggaaacctactactagcccact

SEQ ID NO: 428640 - DNA, 25 bp, Mus musculus
gaaggaaacctagtactagcccact

SEQ ID NO: 428641 - DNA, 25 bp, Mus musculus
gaaggaaacctatgtctcaagagga

SEQ ID NO: 428642 - DNA, 25 bp, Mus musculus
gaaggaaacgtcctcactggacctc

SEQ ID NO: 428643 - DNA, 25 bp, Mus musculus
gaaggaaacgtcgtcactggacctc

SEQ ID NO: 428644 - DNA, 25 bp, Mus musculus
gaaggaaactaaagacccgtcagtg

SEQ ID NO: 428645 - DNA, 25 bp, Mus musculus
gaaggaaactaatgacccgtcagtg

SEQ ID NO: 428646 - DNA, 25 bp, Mus musculus
gaaggaaactatctgccctcatgtc

SEQ ID NO: 428647 - DNA, 25 bp, Mus musculus
gaaggaaactatgtgccctcatgtc

SEQ ID NO: 428648 - DNA, 25 bp, Mus musculus
gaaggaaactcccaccagctacagg

SEQ ID NO: 428649 - DNA, 25 bp, Mus musculus
gaaggaaactccgaccagctacagg

SEQ ID NO: 428650 - DNA, 25 bp, Mus musculus
gaaggaaactgaagagctctaacat

SEQ ID NO: 428651 - DNA, 25 bp, Mus musculus
gaaggaaactgaccattctaccatg

SEQ ID NO: 428652 - DNA, 25 bp, Mus musculus
gaaggaaactgagcattctaccatg

SEQ ID NO: 428653 - DNA, 25 bp, Mus musculus
gaaggaaactgatgagctctaacat

SEQ ID NO: 428654 - DNA, 25 bp, Mus musculus
gaaggaaagaaacttttacgcaatg

SEQ ID NO: 428655 - DNA, 25 bp, Mus musculus
gaaggaaagaaagttttacgcaatg

SEQ ID NO: 428656 - DNA, 25 bp, Mus musculus
gaaggaaagcctcatgtgttacaaa

SEQ ID NO: 428657 - DNA, 25 bp, Mus musculus
gaaggaaagcctgatgtgttacaaa

SEQ ID NO: 428658 - DNA, 25 bp, Mus musculus
gaaggaaagcgtctgccatgtccac

SEQ ID NO: 428659 - DNA, 25 bp, Mus musculus
gaaggaaagcgtgtgccatgtccac

SEQ ID NO: 428660 - DNA, 25 bp, Mus musculus
gaaggaaagctaacagccactttgt

SEQ ID NO: 428661 - DNA, 25 bp, Mus musculus
gaaggaaagctatcagccactttgt

SEQ ID NO: 428662 - DNA, 25 bp, Mus musculus
gaaggaaaggctacaacagggctct

SEQ ID NO: 428663 - DNA, 25 bp, Mus musculus
gaaggaaaggctagcctcttcacta

SEQ ID NO: 428664 - DNA, 25 bp, Mus musculus
gaaggaaaggcttcaacagggctct

SEQ ID NO: 428665 - DNA, 25 bp, Mus musculus
gaaggaaaggcttgcctcttcacta

SEQ ID NO: 428666 - DNA, 25 bp, Mus musculus
gaaggaaatcacagccttggctccc

SEQ ID NO: 428667 - DNA, 25 bp, Mus musculus
gaaggaaatcactgccttggctccc

SEQ ID NO: 428668 - DNA, 25 bp, Mus musculus
gaaggaaatgagctgcacagcccat

SEQ ID NO: 428669 - DNA, 25 bp, Mus musculus
gaaggaaatgaggtgcacagcccat

SEQ ID NO: 428670 - DNA, 25 bp, Mus musculus
gaaggaaatgctcctctaggatcaa

SEQ ID NO: 428671 - DNA, 25 bp, Mus musculus
gaaggaaatgctgctctaggatcaa

SEQ ID NO: 428672 - DNA, 25 bp, Mus musculus
gaaggaaattctcagaccatgaaga

SEQ ID NO: 428673 - DNA, 25 bp, Mus musculus
gaaggaaattctgagaccatgaaga

SEQ ID NO: 428674 - DNA, 25 bp, Mus musculus
gaaggaacacacactccgcacttgg

SEQ ID NO: 428675 - DNA, 25 bp, Mus musculus
gaaggaacacactctccgcacttgg

SEQ ID NO: 428676 - DNA, 25 bp, Mus musculus
gaaggaacactacctgactcattct

SEQ ID NO: 428677 - DNA, 25 bp, Mus musculus
gaaggaacactagctgactcattct

SEQ ID NO: 428678 - DNA, 25 bp, Mus musculus
gaaggaacacttcatcagtcaggtt

SEQ ID NO: 428679 - DNA, 25 bp, Mus musculus
gaaggaacacttgatcagtcaggtt

SEQ ID NO: 428680 - DNA, 25 bp, Mus musculus
gaaggaacagacctttccaaggcca

SEQ ID NO: 428681 - DNA, 25 bp, Mus musculus
gaaggaacagacgtttccaaggcca

SEQ ID NO: 428682 - DNA, 25 bp, Mus musculus
gaaggaacagatcacaaattcagga

SEQ ID NO: 428683 - DNA, 25 bp, Mus musculus
gaaggaacagatgacaaattcagga

SEQ ID NO: 428684 - DNA, 25 bp, Mus musculus
gaaggaacagtcaaggctttattct

SEQ ID NO: 428685 - DNA, 25 bp, Mus musculus
gaaggaacagtctaggctttattct

SEQ ID NO: 428686 - DNA, 25 bp, Mus musculus
gaaggaacagtgacccaagaagcat

SEQ ID NO: 428687 - DNA, 25 bp, Mus musculus
gaaggaacagtgtcccaagaagcat

SEQ ID NO: 428688 - DNA, 25 bp, Mus musculus
gaaggaacataccaaacactgagct

SEQ ID NO: 428689 - DNA, 25 bp, Mus musculus
gaaggaacatacgaaacactgagct

SEQ ID NO: 428690 - DNA, 25 bp, Mus musculus
gaaggaacatccaagaagctcttgt

SEQ ID NO: 428691 - DNA, 25 bp, Mus musculus
gaaggaacatcctagaagctcttgt

SEQ ID NO: 428692 - DNA, 25 bp, Mus musculus
gaaggaacatctagaagccttctag

SEQ ID NO: 428693 - DNA, 25 bp, Mus musculus
gaaggaacatcttgaagccttctag

SEQ ID NO: 428694 - DNA, 25 bp, Mus musculus
gaaggaaccaccatattaggatggt

SEQ ID NO: 428695 - DNA, 25 bp, Mus musculus
gaaggaaccaccttattaggatggt

SEQ ID NO: 428696 - DNA, 25 bp, Mus musculus
gaaggaacccaactgctggtgcact

SEQ ID NO: 428697 - DNA, 25 bp, Mus musculus
gaaggaacccaagtgctggtgcact

SEQ ID NO: 428698 - DNA, 25 bp, Mus musculus
gaaggaacccagatagaccatgtct

SEQ ID NO: 428699 - DNA, 25 bp, Mus musculus
gaaggaacccagttagaccatgtct

SEQ ID NO: 428700 - DNA, 25 bp, Mus musculus
gaaggaacccggcagtcgctctcat

SEQ ID NO: 428701 - DNA, 25 bp, Mus musculus
gaaggaacccgggagtcgctctcat

SEQ ID NO: 428702 - DNA, 25 bp, Mus musculus
gaaggaaccgctcctttacagacag

SEQ ID NO: 428703 - DNA, 25 bp, Mus musculus
gaaggaaccgctgctttacagacag

SEQ ID NO: 428704 - DNA, 25 bp, Mus musculus
gaaggaaccgtgaacattttagaca

SEQ ID NO: 428705 - DNA, 25 bp, Mus musculus
gaaggaaccgtgtacattttagaca

SEQ ID NO: 428706 - DNA, 25 bp, Mus musculus
gaaggaacctggaatctctgaccac

SEQ ID NO: 428707 - DNA, 25 bp, Mus musculus
gaaggaacctggtatctctgaccac

SEQ ID NO: 428708 - DNA, 25 bp, Mus musculus
gaaggaaccttcactcaagcaggta

SEQ ID NO: 428709 - DNA, 25 bp, Mus musculus
gaaggaaccttctctcaagcaggta

SEQ ID NO: 428710 - DNA, 25 bp, Mus musculus
gaaggaacctttaagtacacttgtg

SEQ ID NO: 428711 - DNA, 25 bp, Mus musculus
gaaggaaccttttagtacacttgtg

SEQ ID NO: 428712 - DNA, 25 bp, Mus musculus
gaaggaacgccgaagccgctttggt

SEQ ID NO: 428713 - DNA, 25 bp, Mus musculus
gaaggaacgccgtagccgctttggt

SEQ ID NO: 428714 - DNA, 25 bp, Mus musculus
gaaggaactactccgctaaaggccc

SEQ ID NO: 428715 - DNA, 25 bp, Mus musculus
gaaggaactactgcgctaaaggccc

SEQ ID NO: 428716 - DNA, 25 bp, Mus musculus
gaaggaactagcagtcttcccaaca

SEQ ID NO: 428717 - DNA, 25 bp, Mus musculus
gaaggaactagctgtcttcccaaca

SEQ ID NO: 428718 - DNA, 25 bp, Mus musculus
gaaggaactcagctactcatttatg

SEQ ID NO: 428719 - DNA, 25 bp, Mus musculus
gaaggaactcaggtactcatttatg

SEQ ID NO: 428720 - DNA, 25 bp, Mus musculus
gaaggaactcatactgtgcattcta

SEQ ID NO: 428721 - DNA, 25 bp, Mus musculus
gaaggaactcattctgtgcattcta

SEQ ID NO: 428722 - DNA, 25 bp, Mus musculus
gaaggaactccaccacagtttctgc

SEQ ID NO: 428723 - DNA, 25 bp, Mus musculus
gaaggaactccagcacagtttctgc

SEQ ID NO: 428724 - DNA, 25 bp, Mus musculus
gaaggaactcttcattttgttttgt

SEQ ID NO: 428725 - DNA, 25 bp, Mus musculus
gaaggaactcttgattttgttttgt

SEQ ID NO: 428726 - DNA, 25 bp, Mus musculus
gaaggaactggaaacatcccgactg

SEQ ID NO: 428727 - DNA, 25 bp, Mus musculus
gaaggaactggatacatcccgactg

SEQ ID NO: 428728 - DNA, 25 bp, Mus musculus
gaaggaactgtcagagggatcattt

SEQ ID NO: 428729 - DNA, 25 bp, Mus musculus
gaaggaactgtctgagggatcattt

SEQ ID NO: 428730 - DNA, 25 bp, Mus musculus
gaaggaacttgaaccccaaattgct

SEQ ID NO: 428731 - DNA, 25 bp, Mus musculus
gaaggaacttgatccccaaattgct

SEQ ID NO: 428732 - DNA, 25 bp, Mus musculus
gaaggaacttggcttccgggacact

SEQ ID NO: 428733 - DNA, 25 bp, Mus musculus
gaaggaacttgggttccgggacact

SEQ ID NO: 428734 - DNA, 25 bp, Mus musculus
gaaggaactttcctgcgtgggactt

SEQ ID NO: 428735 - DNA, 25 bp, Mus musculus
gaaggaactttcgtgcgtgggactt

SEQ ID NO: 428736 - DNA, 25 bp, Mus musculus
gaaggaagaacccatccactgcaca

SEQ ID NO: 428737 - DNA, 25 bp, Mus musculus
gaaggaagaaccgatccactgcaca

SEQ ID NO: 428738 - DNA, 25 bp, Mus musculus
gaaggaagaataagttacccgccaa

SEQ ID NO: 428739 - DNA, 25 bp, Mus musculus
gaaggaagaatatgttacccgccaa

SEQ ID NO: 428740 - DNA, 25 bp, Mus musculus
gaaggaagactgaacccagcctgac

SEQ ID NO: 428741 - DNA, 25 bp, Mus musculus
gaaggaagactgtacccagcctgac

SEQ ID NO: 428742 - DNA, 25 bp, Mus musculus
gaaggaagagatacaaaagctggat

SEQ ID NO: 428743 - DNA, 25 bp, Mus musculus
gaaggaagagattcaaaagctggat

SEQ ID NO: 428744 - DNA, 25 bp, Mus musculus
gaaggaagatgtacacccctctatt

SEQ ID NO: 428745 - DNA, 25 bp, Mus musculus
gaaggaagatgtccaaacccgctcc

SEQ ID NO: 428746 - DNA, 25 bp, Mus musculus
gaaggaagatgtgcaaacccgctcc

SEQ ID NO: 428747 - DNA, 25 bp, Mus musculus
gaaggaagatgttcacccctctatt

SEQ ID NO: 428748 - DNA, 25 bp, Mus musculus
gaaggaagattacgactccctggaa

SEQ ID NO: 428749 - DNA, 25 bp, Mus musculus
gaaggaagattaggactccctggaa

SEQ ID NO: 428750 - DNA, 25 bp, Mus musculus
gaaggaagattcaccaggcatggtt

SEQ ID NO: 428751 - DNA, 25 bp, Mus musculus
gaaggaagattctccaggcatggtt

SEQ ID NO: 428752 - DNA, 25 bp, Mus musculus
gaaggaagcaatcggtggctccatc

SEQ ID NO: 428753 - DNA, 25 bp, Mus musculus
gaaggaagcaatgggtggctccatc

SEQ ID NO: 428754 - DNA, 25 bp, Mus musculus
gaaggaagcccaatcttcgtgttca

SEQ ID NO: 428755 - DNA, 25 bp, Mus musculus
gaaggaagcccattcttcgtgttca

SEQ ID NO: 428756 - DNA, 25 bp, Mus musculus
gaaggaagcctaacatctgtcccta

SEQ ID NO: 428757 - DNA, 25 bp, Mus musculus
gaaggaagcctatcatctgtcccta

SEQ ID NO: 428758 - DNA, 25 bp, Mus musculus
gaaggaagcgcgactctatcggaat

SEQ ID NO: 428759 - DNA, 25 bp, Mus musculus
gaaggaagcgcgtctctatcggaat

SEQ ID NO: 428760 - DNA, 25 bp, Mus musculus
gaaggaagctggctgtcttgtaaaa

SEQ ID NO: 428761 - DNA, 25 bp, Mus musculus
gaaggaagctgggtgtcttgtaaaa

SEQ ID NO: 428762 - DNA, 25 bp, Mus musculus
gaaggaaggacacaacagcatcctc

SEQ ID NO: 428763 - DNA, 25 bp, Mus musculus
gaaggaaggacaccctgacaccctg

SEQ ID NO: 428764 - DNA, 25 bp, Mus musculus
gaaggaaggacagaacagcatcctc

SEQ ID NO: 428765 - DNA, 25 bp, Mus musculus
gaaggaaggacagcctgacaccctg

SEQ ID NO: 428766 - DNA, 25 bp, Mus musculus
gaaggaaggactattgtacactgaa

SEQ ID NO: 428767 - DNA, 25 bp, Mus musculus
gaaggaaggacttttgtacactgaa

SEQ ID NO: 428768 - DNA, 25 bp, Mus musculus
gaaggaaggagactgcctcacgcct

SEQ ID NO: 428769 - DNA, 25 bp, Mus musculus
gaaggaaggagagtgcctcacgcct

SEQ ID NO: 428770 - DNA, 25 bp, Mus musculus
gaaggaaggcacatgctccactctc

SEQ ID NO: 428771 - DNA, 25 bp, Mus musculus
gaaggaaggcacttgctccactctc

SEQ ID NO: 428772 - DNA, 25 bp, Mus musculus
gaaggaaggcgcacacacctctggt

SEQ ID NO: 428773 - DNA, 25 bp, Mus musculus
gaaggaaggcgctcacacctctggt

SEQ ID NO: 428774 - DNA, 25 bp, Mus musculus
gaaggaaggctcacttttcttcgcc

SEQ ID NO: 428775 - DNA, 25 bp, Mus musculus
gaaggaaggctctcttttcttcgcc

SEQ ID NO: 428776 - DNA, 25 bp, Mus musculus
gaaggaaggtctcgttctcttctgc

SEQ ID NO: 428777 - DNA, 25 bp, Mus musculus
gaaggaaggtctggttctcttctgc

SEQ ID NO: 428778 - DNA, 25 bp, Mus musculus
gaaggaaggtgcaacaatcctcttc

SEQ ID NO: 428779 - DNA, 25 bp, Mus musculus
gaaggaaggtgctacaatcctcttc

SEQ ID NO: 428780 - DNA, 25 bp, Mus musculus
gaaggaaggtgtagctgcctctcaa

SEQ ID NO: 428781 - DNA, 25 bp, Mus musculus
gaaggaaggtgttgctgcctctcaa

SEQ ID NO: 428782 - DNA, 25 bp, Mus musculus
gaaggaagtaagactcagcataaaa

SEQ ID NO: 428783 - DNA, 25 bp, Mus musculus
gaaggaagtaagtctcagcataaaa

SEQ ID NO: 428784 - DNA, 25 bp, Mus musculus
gaaggaagtcacacaaactttcatt

SEQ ID NO: 428785 - DNA, 25 bp, Mus musculus
gaaggaagtcactcaaactttcatt

SEQ ID NO: 428786 - DNA, 25 bp, Mus musculus
gaaggaagtccccaggaatggcaat

SEQ ID NO: 428787 - DNA, 25 bp, Mus musculus
gaaggaagtcccgaggaatggcaat

SEQ ID NO: 428788 - DNA, 25 bp, Mus musculus
gaaggaagtgctctttgcccaaaaa

SEQ ID NO: 428789 - DNA, 25 bp, Mus musculus
gaaggaagtgctgtttgcccaaaaa

SEQ ID NO: 428790 - DNA, 25 bp, Mus musculus
gaaggaagtggacactccccacgct

SEQ ID NO: 428791 - DNA, 25 bp, Mus musculus
gaaggaagtggagactccccacgct

SEQ ID NO: 428792 - DNA, 25 bp, Mus musculus
gaaggaataagtcagccctccactg

SEQ ID NO: 428793 - DNA, 25 bp, Mus musculus
gaaggaataagtgagccctccactg

SEQ ID NO: 428794 - DNA, 25 bp, Mus musculus
gaaggaatatatacctgccagtttt

SEQ ID NO: 428795 - DNA, 25 bp, Mus musculus
gaaggaatatattcctgccagtttt

SEQ ID NO: 428796 - DNA, 25 bp, Mus musculus
gaaggaatcaacaggctaaacatgg

SEQ ID NO: 428797 - DNA, 25 bp, Mus musculus
gaaggaatcaactggctaaacatgg

SEQ ID NO: 428798 - DNA, 25 bp, Mus musculus
gaaggaatcacgctcccagaaacac

SEQ ID NO: 428799 - DNA, 25 bp, Mus musculus
gaaggaatcacggtcccagaaacac

SEQ ID NO: 428800 - DNA, 25 bp, Mus musculus
gaaggaatcccaaaaacccttgcat

SEQ ID NO: 428801 - DNA, 25 bp, Mus musculus
gaaggaatcccataaacccttgcat

SEQ ID NO: 428802 - DNA, 25 bp, Mus musculus
gaaggaatccggaatatgcctcggg

SEQ ID NO: 428803 - DNA, 25 bp, Mus musculus
gaaggaatccggtatatgcctcggg

SEQ ID NO: 428804 - DNA, 25 bp, Mus musculus
gaaggaatctcaaatccaccactaa

SEQ ID NO: 428805 - DNA, 25 bp, Mus musculus
gaaggaatctcatatccaccactaa

SEQ ID NO: 428806 - DNA, 25 bp, Mus musculus
gaaggaatctccaacaccagttcca

SEQ ID NO: 428807 - DNA, 25 bp, Mus musculus
gaaggaatctcctacaccagttcca

SEQ ID NO: 428808 - DNA, 25 bp, Mus musculus
gaaggaatctctatgccatcctcta

SEQ ID NO: 428809 - DNA, 25 bp, Mus musculus
gaaggaatctctttgccatcctcta

SEQ ID NO: 428810 - DNA, 25 bp, Mus musculus
gaaggaatctggacactgcaggttt

SEQ ID NO: 428811 - DNA, 25 bp, Mus musculus
gaaggaatctggtcactgcaggttt

SEQ ID NO: 428812 - DNA, 25 bp, Mus musculus
gaaggaatgactatcactcctgaaa

SEQ ID NO: 428813 - DNA, 25 bp, Mus musculus
gaaggaatgactttcactcctgaaa

SEQ ID NO: 428814 - DNA, 25 bp, Mus musculus
gaaggaatggaacctcaccacaaca

SEQ ID NO: 428815 - DNA, 25 bp, Mus musculus
gaaggaatggaagctcaccacaaca

SEQ ID NO: 428816 - DNA, 25 bp, Mus musculus
gaaggaatggctcagtgtctcccat

SEQ ID NO: 428817 - DNA, 25 bp, Mus musculus
gaaggaatggctgagtgtctcccat

SEQ ID NO: 428818 - DNA, 25 bp, Mus musculus
gaaggaatgggtccagacatacatt

SEQ ID NO: 428819 - DNA, 25 bp, Mus musculus
gaaggaatgggtgcagacatacatt

SEQ ID NO: 428820 - DNA, 25 bp, Mus musculus
gaaggaatgtagatttttgcttttc

SEQ ID NO: 428821 - DNA, 25 bp, Mus musculus
gaaggaatgtagttttttgcttttc

SEQ ID NO: 428822 - DNA, 25 bp, Mus musculus
gaaggaatgtatcggtgactggcag

SEQ ID NO: 428823 - DNA, 25 bp, Mus musculus
gaaggaatgtatgggtgactggcag

SEQ ID NO: 428824 - DNA, 25 bp, Mus musculus
gaaggaattaccaccacccttctct

SEQ ID NO: 428825 - DNA, 25 bp, Mus musculus
gaaggaattacctccacccttctct

SEQ ID NO: 428826 - DNA, 25 bp, Mus musculus
gaaggaattacgatgcaaccactgt

SEQ ID NO: 428827 - DNA, 25 bp, Mus musculus
gaaggaattacgttgcaaccactgt

SEQ ID NO: 428828 - DNA, 25 bp, Mus musculus
gaaggaattccaattgcaatcagca

SEQ ID NO: 428829 - DNA, 25 bp, Mus musculus
gaaggaattccatttgcaatcagca

SEQ ID NO: 428830 - DNA, 25 bp, Mus musculus
gaaggaattctaactcactcccagc

SEQ ID NO: 428831 - DNA, 25 bp, Mus musculus
gaaggaattctatctcactcccagc

SEQ ID NO: 428832 - DNA, 25 bp, Mus musculus
gaaggaattcttcagttcttgcagc

SEQ ID NO: 428833 - DNA, 25 bp, Mus musculus
gaaggaattcttgagttcttgcagc

SEQ ID NO: 428834 - DNA, 25 bp, Mus musculus
gaaggaattggaatgcttgcacatt

SEQ ID NO: 428835 - DNA, 25 bp, Mus musculus
gaaggaattggattgcttgcacatt

SEQ ID NO: 428836 - DNA, 25 bp, Mus musculus
gaaggaattgtaaccaccgcactga

SEQ ID NO: 428837 - DNA, 25 bp, Mus musculus
gaaggaattgtatccaccgcactga

SEQ ID NO: 428838 - DNA, 25 bp, Mus musculus
gaaggaatttgacggtctgacttaa

SEQ ID NO: 428839 - DNA, 25 bp, Mus musculus
gaaggaatttgagggtctgacttaa

SEQ ID NO: 428840 - DNA, 25 bp, Mus musculus
gaaggacaaagaccagggacaaaaa

SEQ ID NO: 428841 - DNA, 25 bp, Mus musculus
gaaggacaaagagcagggacaaaaa

SEQ ID NO: 428842 - DNA, 25 bp, Mus musculus
gaaggacaacacctccagcttttgt

SEQ ID NO: 428843 - DNA, 25 bp, Mus musculus
gaaggacaacacgtccagcttttgt

SEQ ID NO: 428844 - DNA, 25 bp, Mus musculus
gaaggacaacgacatcaccacctct

SEQ ID NO: 428845 - DNA, 25 bp, Mus musculus
gaaggacaacgagatcaccacctct

SEQ ID NO: 428846 - DNA, 25 bp, Mus musculus
gaaggacaactgactccatcaagga

SEQ ID NO: 428847 - DNA, 25 bp, Mus musculus
gaaggacaactgtctccatcaagga

SEQ ID NO: 428848 - DNA, 25 bp, Mus musculus
gaaggacaagccactttgcaaaaaa

SEQ ID NO: 428849 - DNA, 25 bp, Mus musculus
gaaggacaagccagtgagccacatt

SEQ ID NO: 428850 - DNA, 25 bp, Mus musculus
gaaggacaagcctctttgcaaaaaa

SEQ ID NO: 428851 - DNA, 25 bp, Mus musculus
gaaggacaagcctgtgagccacatt

SEQ ID NO: 428852 - DNA, 25 bp, Mus musculus
gaaggacaaggacccactgatcagg

SEQ ID NO: 428853 - DNA, 25 bp, Mus musculus
gaaggacaaggagccactgatcagg

SEQ ID NO: 428854 - DNA, 25 bp, Mus musculus
gaaggacacaacagcatcctcacat

SEQ ID NO: 428855 - DNA, 25 bp, Mus musculus
gaaggacacaactgcatcctcacat

SEQ ID NO: 428856 - DNA, 25 bp, Mus musculus
gaaggacacaccctctctggctgag

SEQ ID NO: 428857 - DNA, 25 bp, Mus musculus
gaaggacacaccgtctctggctgag

SEQ ID NO: 428858 - DNA, 25 bp, Mus musculus
gaaggacacactctttatgccccaa

SEQ ID NO: 428859 - DNA, 25 bp, Mus musculus
gaaggacacactgtttatgccccaa

SEQ ID NO: 428860 - DNA, 25 bp, Mus musculus
gaaggacacagaccacgtcccttga

SEQ ID NO: 428861 - DNA, 25 bp, Mus musculus
gaaggacacagagcacgtcccttga

SEQ ID NO: 428862 - DNA, 25 bp, Mus musculus
gaaggacacaggcacaccggaattc

SEQ ID NO: 428863 - DNA, 25 bp, Mus musculus
gaaggacacagggacaccggaattc

SEQ ID NO: 428864 - DNA, 25 bp, Mus musculus
gaaggacaccaaactgttcagcttg

SEQ ID NO: 428865 - DNA, 25 bp, Mus musculus
gaaggacaccaatctgttcagcttg

SEQ ID NO: 428866 - DNA, 25 bp, Mus musculus
gaaggacaccagaactgaatctagt

SEQ ID NO: 428867 - DNA, 25 bp, Mus musculus
gaaggacaccagtactgaatctagt

SEQ ID NO: 428868 - DNA, 25 bp, Mus musculus
gaaggacaccatagattcacccaca

SEQ ID NO: 428869 - DNA, 25 bp, Mus musculus
gaaggacaccattgattcacccaca

SEQ ID NO: 428870 - DNA, 25 bp, Mus musculus
gaaggacacccaaatccgggagcta

SEQ ID NO: 428871 - DNA, 25 bp, Mus musculus
gaaggacacccatatccgggagcta

SEQ ID NO: 428872 - DNA, 25 bp, Mus musculus
gaaggacacctacgtggccagtgca

SEQ ID NO: 428873 - DNA, 25 bp, Mus musculus
gaaggacacctaggtggccagtgca

SEQ ID NO: 428874 - DNA, 25 bp, Mus musculus
gaaggacacctgcatcacacctgca

SEQ ID NO: 428875 - DNA, 25 bp, Mus musculus
gaaggacacctggatcacacctgca

SEQ ID NO: 428876 - DNA, 25 bp, Mus musculus
gaaggacacgacaccagtttgttgt

SEQ ID NO: 428877 - DNA, 25 bp, Mus musculus
gaaggacacgactccagtttgttgt

SEQ ID NO: 428878 - DNA, 25 bp, Mus musculus
gaaggacacgctcacaaacatcaac

SEQ ID NO: 428879 - DNA, 25 bp, Mus musculus
gaaggacacgctgacaaacatcaac

SEQ ID NO: 428880 - DNA, 25 bp, Mus musculus
gaaggacactagacggctgcttcct

SEQ ID NO: 428881 - DNA, 25 bp, Mus musculus
gaaggacactagtcggctgcttcct

SEQ ID NO: 428882 - DNA, 25 bp, Mus musculus
gaaggacactttactatgctgtata

SEQ ID NO: 428883 - DNA, 25 bp, Mus musculus
gaaggacacttttctatgctgtata

SEQ ID NO: 428884 - DNA, 25 bp, Mus musculus
gaaggacagagtacctcctgagcca

SEQ ID NO: 428885 - DNA, 25 bp, Mus musculus
gaaggacagagttcctcctgagcca

SEQ ID NO: 428886 - DNA, 25 bp, Mus musculus
gaaggacagataacgctcttgccac

SEQ ID NO: 428887 - DNA, 25 bp, Mus musculus
gaaggacagatatcgctcttgccac

SEQ ID NO: 428888 - DNA, 25 bp, Mus musculus
gaaggacagatcacctgccagcttt

SEQ ID NO: 428889 - DNA, 25 bp, Mus musculus
gaaggacagatctcctgccagcttt

SEQ ID NO: 428890 - DNA, 25 bp, Mus musculus
gaaggacagcaacgactctctccac

SEQ ID NO: 428891 - DNA, 25 bp, Mus musculus
gaaggacagcaaggactctctccac

SEQ ID NO: 428892 - DNA, 25 bp, Mus musculus
gaaggacagcgtcattcctgagaac

SEQ ID NO: 428893 - DNA, 25 bp, Mus musculus
gaaggacagcgtgattcctgagaac

SEQ ID NO: 428894 - DNA, 25 bp, Mus musculus
gaaggacagcttagctactttaatt

SEQ ID NO: 428895 - DNA, 25 bp, Mus musculus
gaaggacagctttgctactttaatt

SEQ ID NO: 428896 - DNA, 25 bp, Mus musculus
gaaggacaggagaggtggctcagtg

SEQ ID NO: 428897 - DNA, 25 bp, Mus musculus
gaaggacaggagtggtggctcagtg

SEQ ID NO: 428898 - DNA, 25 bp, Mus musculus
gaaggacaggcaatctgctttatac

SEQ ID NO: 428899 - DNA, 25 bp, Mus musculus
gaaggacaggcacggaaccagctac

SEQ ID NO: 428900 - DNA, 25 bp, Mus musculus
gaaggacaggcagggaaccagctac

SEQ ID NO: 428901 - DNA, 25 bp, Mus musculus
gaaggacaggcattctgctttatac

SEQ ID NO: 428902 - DNA, 25 bp, Mus musculus
gaaggacagtaacggctctatacta

SEQ ID NO: 428903 - DNA, 25 bp, Mus musculus
gaaggacagtaagggctctatacta

SEQ ID NO: 428904 - DNA, 25 bp, Mus musculus
gaaggacagtatccatctatctgcc

SEQ ID NO: 428905 - DNA, 25 bp, Mus musculus
gaaggacagtatgcatctatctgcc

SEQ ID NO: 428906 - DNA, 25 bp, Mus musculus
gaaggacagtctcctcatcgacagc

SEQ ID NO: 428907 - DNA, 25 bp, Mus musculus
gaaggacagtctgctcatcgacagc

SEQ ID NO: 428908 - DNA, 25 bp, Mus musculus
gaaggacagtgacctcaatgggaaa

SEQ ID NO: 428909 - DNA, 25 bp, Mus musculus
gaaggacagtgagctcaatgggaaa

SEQ ID NO: 428910 - DNA, 25 bp, Mus musculus
gaaggacagttcactcagctaatga

SEQ ID NO: 428911 - DNA, 25 bp, Mus musculus
gaaggacagttctctcagctaatga

SEQ ID NO: 428912 - DNA, 25 bp, Mus musculus
gaaggacatagcactccactttttt

SEQ ID NO: 428913 - DNA, 25 bp, Mus musculus
gaaggacatagctctccactttttt

SEQ ID NO: 428914 - DNA, 25 bp, Mus musculus
gaaggacatctcaggctgtgctaca

SEQ ID NO: 428915 - DNA, 25 bp, Mus musculus
gaaggacatctctggctgtgctaca

SEQ ID NO: 428916 - DNA, 25 bp, Mus musculus
gaaggacatgagctgctcttaacca

SEQ ID NO: 428917 - DNA, 25 bp, Mus musculus
gaaggacatgaggtgctcttaacca

SEQ ID NO: 428918 - DNA, 25 bp, Mus musculus
gaaggacatggtcgaccccgtgaat

SEQ ID NO: 428919 - DNA, 25 bp, Mus musculus
gaaggacatggtggaccccgtgaat

SEQ ID NO: 428920 - DNA, 25 bp, Mus musculus
gaaggacattctcccattaaaccgt

SEQ ID NO: 428921 - DNA, 25 bp, Mus musculus
gaaggacattctccccaaacttgtt

SEQ ID NO: 428922 - DNA, 25 bp, Mus musculus
gaaggacattctgccattaaaccgt

SEQ ID NO: 428923 - DNA, 25 bp, Mus musculus
gaaggacattctgcccaaacttgtt

SEQ ID NO: 428924 - DNA, 25 bp, Mus musculus
gaaggacattgcagcctatatcaag

SEQ ID NO: 428925 - DNA, 25 bp, Mus musculus
gaaggacattgctgcctatatcaag

SEQ ID NO: 428926 - DNA, 25 bp, Mus musculus
gaaggacatttgatggcagtggttt

SEQ ID NO: 428927 - DNA, 25 bp, Mus musculus
gaaggacatttgttggcagtggttt

SEQ ID NO: 428928 - DNA, 25 bp, Mus musculus
gaaggaccaagtacacctatccggt

SEQ ID NO: 428929 - DNA, 25 bp, Mus musculus
gaaggaccaagttcacctatccggt

SEQ ID NO: 428930 - DNA, 25 bp, Mus musculus
gaaggaccaatactcccgtctgcat

SEQ ID NO: 428931 - DNA, 25 bp, Mus musculus
gaaggaccaatagtcccgtctgcat

SEQ ID NO: 428932 - DNA, 25 bp, Mus musculus
gaaggaccacgccaggccagatagt

SEQ ID NO: 428933 - DNA, 25 bp, Mus musculus
gaaggaccacgcgaggccagatagt

SEQ ID NO: 428934 - DNA, 25 bp, Mus musculus
gaaggaccacgtactgggcacagat

SEQ ID NO: 428935 - DNA, 25 bp, Mus musculus
gaaggaccacgttctgggcacagat

SEQ ID NO: 428936 - DNA, 25 bp, Mus musculus
gaaggaccactgaggccttcagcgg

SEQ ID NO: 428937 - DNA, 25 bp, Mus musculus
gaaggaccactgtggccttcagcgg

SEQ ID NO: 428938 - DNA, 25 bp, Mus musculus
gaaggaccacttacctaggaggctc

SEQ ID NO: 428939 - DNA, 25 bp, Mus musculus
gaaggaccactttcctaggaggctc

SEQ ID NO: 428940 - DNA, 25 bp, Mus musculus
gaaggaccagtgacatactcagaag

SEQ ID NO: 428941 - DNA, 25 bp, Mus musculus
gaaggaccagtgtcatactcagaag

SEQ ID NO: 428942 - DNA, 25 bp, Mus musculus
gaaggaccagttagctctcatgaag

SEQ ID NO: 428943 - DNA, 25 bp, Mus musculus
gaaggaccagtttgctctcatgaag

SEQ ID NO: 428944 - DNA, 25 bp, Mus musculus
gaaggaccataactgcagactctaa

SEQ ID NO: 428945 - DNA, 25 bp, Mus musculus
gaaggaccataagtgcagactctaa

SEQ ID NO: 428946 - DNA, 25 bp, Mus musculus
gaaggaccatatattgccacctacc

SEQ ID NO: 428947 - DNA, 25 bp, Mus musculus
gaaggaccatattttgccacctacc

SEQ ID NO: 428948 - DNA, 25 bp, Mus musculus
gaaggaccatccaggcattagccta

SEQ ID NO: 428949 - DNA, 25 bp, Mus musculus
gaaggaccatcctggcattagccta

SEQ ID NO: 428950 - DNA, 25 bp, Mus musculus
gaaggaccattgctgcttctttctc

SEQ ID NO: 428951 - DNA, 25 bp, Mus musculus
gaaggaccattggtgcttctttctc

SEQ ID NO: 428952 - DNA, 25 bp, Mus musculus
gaaggacccaagaatctacactttg

SEQ ID NO: 428953 - DNA, 25 bp, Mus musculus
gaaggacccaagtatctacactttg

SEQ ID NO: 428954 - DNA, 25 bp, Mus musculus
gaaggacccagaaatctacacagag

SEQ ID NO: 428955 - DNA, 25 bp, Mus musculus
gaaggacccagatatctacacagag

SEQ ID NO: 428956 - DNA, 25 bp, Mus musculus
gaaggacccatcaattatcacctga

SEQ ID NO: 428957 - DNA, 25 bp, Mus musculus
gaaggacccatcagcctgatacagg

SEQ ID NO: 428958 - DNA, 25 bp, Mus musculus
gaaggacccatctattatcacctga

SEQ ID NO: 428959 - DNA, 25 bp, Mus musculus
gaaggacccatctgcctgatacagg

SEQ ID NO: 428960 - DNA, 25 bp, Mus musculus
gaaggaccccagaggcctcaaggtg

SEQ ID NO: 428961 - DNA, 25 bp, Mus musculus
gaaggaccccagtggcctcaaggtg

SEQ ID NO: 428962 - DNA, 25 bp, Mus musculus
gaaggacccctgatttcagtctggc

SEQ ID NO: 428963 - DNA, 25 bp, Mus musculus
gaaggacccctgttttcagtctggc

SEQ ID NO: 428964 - DNA, 25 bp, Mus musculus
gaaggacccgacacaagcaaaccaa

SEQ ID NO: 428965 - DNA, 25 bp, Mus musculus
gaaggacccgactcaagcaaaccaa

SEQ ID NO: 428966 - DNA, 25 bp, Mus musculus
gaaggaccctacacagaggctcggt

SEQ ID NO: 428967 - DNA, 25 bp, Mus musculus
gaaggaccctactcagaggctcggt

SEQ ID NO: 428968 - DNA, 25 bp, Mus musculus
gaaggaccctcaaaacctcgaaggt

SEQ ID NO: 428969 - DNA, 25 bp, Mus musculus
gaaggaccctcataacctcgaaggt

SEQ ID NO: 428970 - DNA, 25 bp, Mus musculus
gaaggaccctgacctaagtgaccag

SEQ ID NO: 428971 - DNA, 25 bp, Mus musculus
gaaggaccctgagctaagtgaccag

SEQ ID NO: 428972 - DNA, 25 bp, Mus musculus
gaaggaccctgcattgttttaattt

SEQ ID NO: 428973 - DNA, 25 bp, Mus musculus
gaaggaccctgctttgttttaattt

SEQ ID NO: 428974 - DNA, 25 bp, Mus musculus
gaaggacccttcagagtcacctagt

SEQ ID NO: 428975 - DNA, 25 bp, Mus musculus
gaaggacccttccaagtctattctg

SEQ ID NO: 428976 - DNA, 25 bp, Mus musculus
gaaggacccttcgaagtctattctg

SEQ ID NO: 428977 - DNA, 25 bp, Mus musculus
gaaggacccttctgagtcacctagt

SEQ ID NO: 428978 - DNA, 25 bp, Mus musculus
gaaggaccctttaactacagcacag

SEQ ID NO: 428979 - DNA, 25 bp, Mus musculus
gaaggacccttttactacagcacag

SEQ ID NO: 428980 - DNA, 25 bp, Mus musculus
gaaggaccgcttcccagagtcgagt

SEQ ID NO: 428981 - DNA, 25 bp, Mus musculus
gaaggaccgcttgccagagtcgagt

SEQ ID NO: 428982 - DNA, 25 bp, Mus musculus
gaaggaccggtacgtattaatccag

SEQ ID NO: 428983 - DNA, 25 bp, Mus musculus
gaaggaccggtaggtattaatccag

SEQ ID NO: 428984 - DNA, 25 bp, Mus musculus
gaaggaccgtgtatggagccataaa

SEQ ID NO: 428985 - DNA, 25 bp, Mus musculus
gaaggaccgtgtttggagccataaa

SEQ ID NO: 428986 - DNA, 25 bp, Mus musculus
gaaggacctagcaagataccgccta

SEQ ID NO: 428987 - DNA, 25 bp, Mus musculus
gaaggacctagctagataccgccta

SEQ ID NO: 428988 - DNA, 25 bp, Mus musculus
gaaggacctattcgagaccgttcat

SEQ ID NO: 428989 - DNA, 25 bp, Mus musculus
gaaggacctattggagaccgttcat

SEQ ID NO: 428990 - DNA, 25 bp, Mus musculus
gaaggacctcacagactttgtgcat

SEQ ID NO: 428991 - DNA, 25 bp, Mus musculus
gaaggacctcactgactttgtgcat

SEQ ID NO: 428992 - DNA, 25 bp, Mus musculus
gaaggacctccaagccctgctgtgg

SEQ ID NO: 428993 - DNA, 25 bp, Mus musculus
gaaggacctccatgccctgctgtgg

SEQ ID NO: 428994 - DNA, 25 bp, Mus musculus
gaaggacctcggaggctgagaactt

SEQ ID NO: 428995 - DNA, 25 bp, Mus musculus
gaaggacctcggtggctgagaactt

SEQ ID NO: 428996 - DNA, 25 bp, Mus musculus
gaaggacctcttagacatgaagccc

SEQ ID NO: 428997 - DNA, 25 bp, Mus musculus
gaaggacctctttgacatgaagccc

SEQ ID NO: 428998 - DNA, 25 bp, Mus musculus
gaaggacctgaacgtcccacgcacg

SEQ ID NO: 428999 - DNA, 25 bp, Mus musculus
gaaggacctgaaggtcccacgcacg

SEQ ID NO: 429000 - DNA, 25 bp, Mus musculus
gaaggacctgcactacggtatcctg

SEQ ID NO: 429001 - DNA, 25 bp, Mus musculus
gaaggacctgcagtacggtatcctg

SEQ ID NO: 429002 - DNA, 25 bp, Mus musculus
gaaggacctgctaatccaagagctg

SEQ ID NO: 429003 - DNA, 25 bp, Mus musculus
gaaggacctgcttatccaagagctg

SEQ ID NO: 429004 - DNA, 25 bp, Mus musculus
gaaggacctggtcatcgccaagatg

SEQ ID NO: 429005 - DNA, 25 bp, Mus musculus
gaaggacctggtgatcgccaagatg

SEQ ID NO: 429006 - DNA, 25 bp, Mus musculus
gaaggacctgtcatgttgtttgcat

SEQ ID NO: 429007 - DNA, 25 bp, Mus musculus
gaaggacctgtcttgttgtttgcat

SEQ ID NO: 429008 - DNA, 25 bp, Mus musculus
gaaggacctgttccacagagctctt

SEQ ID NO: 429009 - DNA, 25 bp, Mus musculus
gaaggacctgttgcacagagctctt

SEQ ID NO: 429010 - DNA, 25 bp, Mus musculus
gaaggaccttatcgctttgtagata

SEQ ID NO: 429011 - DNA, 25 bp, Mus musculus
gaaggaccttatggctttgtagata

SEQ ID NO: 429012 - DNA, 25 bp, Mus musculus
gaaggaccttccaagacagtgacag

SEQ ID NO: 429013 - DNA, 25 bp, Mus musculus
gaaggaccttcctagacagtgacag

SEQ ID NO: 429014 - DNA, 25 bp, Mus musculus
gaaggacgacttcagaagccaggaa

SEQ ID NO: 429015 - DNA, 25 bp, Mus musculus
gaaggacgacttgagaagccaggaa

SEQ ID NO: 429016 - DNA, 25 bp, Mus musculus
gaaggacgaggtcctatctcccagc

SEQ ID NO: 429017 - DNA, 25 bp, Mus musculus
gaaggacgaggtgctatctcccagc

SEQ ID NO: 429018 - DNA, 25 bp, Mus musculus
gaaggacgagttccctcattggctg

SEQ ID NO: 429019 - DNA, 25 bp, Mus musculus
gaaggacgagttgcctcattggctg

SEQ ID NO: 429020 - DNA, 25 bp, Mus musculus
gaaggacgattaagtggttcccaca

SEQ ID NO: 429021 - DNA, 25 bp, Mus musculus
gaaggacgattatgtggttcccaca

SEQ ID NO: 429022 - DNA, 25 bp, Mus musculus
gaaggacgcattcagcttactagca

SEQ ID NO: 429023 - DNA, 25 bp, Mus musculus
gaaggacgcattgagcttactagca

SEQ ID NO: 429024 - DNA, 25 bp, Mus musculus
gaaggacgcgcacattccacagagt

SEQ ID NO: 429025 - DNA, 25 bp, Mus musculus
gaaggacgcgcagattccacagagt

SEQ ID NO: 429026 - DNA, 25 bp, Mus musculus
gaaggacgcgtcagagcccaggtaa

SEQ ID NO: 429027 - DNA, 25 bp, Mus musculus
gaaggacgcgtctgagcccaggtaa

SEQ ID NO: 429028 - DNA, 25 bp, Mus musculus
gaaggacgctcaccagatcaataga

SEQ ID NO: 429029 - DNA, 25 bp, Mus musculus
gaaggacgctcagcagatcaataga

SEQ ID NO: 429030 - DNA, 25 bp, Mus musculus
gaaggacgctttacaaacctgccaa

SEQ ID NO: 429031 - DNA, 25 bp, Mus musculus
gaaggacgcttttcaaacctgccaa

SEQ ID NO: 429032 - DNA, 25 bp, Mus musculus
gaaggacggaaaaccagacgattca

SEQ ID NO: 429033 - DNA, 25 bp, Mus musculus
gaaggacggaaatccagacgattca

SEQ ID NO: 429034 - DNA, 25 bp, Mus musculus
gaaggacggcatcttccacggagaa

SEQ ID NO: 429035 - DNA, 25 bp, Mus musculus
gaaggacggcatgttccacggagaa

SEQ ID NO: 429036 - DNA, 25 bp, Mus musculus
gaaggacggtggctcattccagcta

SEQ ID NO: 429037 - DNA, 25 bp, Mus musculus
gaaggacggtgggtcattccagcta

SEQ ID NO: 429038 - DNA, 25 bp, Mus musculus
gaaggacgtgacctactcctacggg

SEQ ID NO: 429039 - DNA, 25 bp, Mus musculus
gaaggacgtgacgtactcctacggg

SEQ ID NO: 429040 - DNA, 25 bp, Mus musculus
gaaggacgttaacggtgagcactat

SEQ ID NO: 429041 - DNA, 25 bp, Mus musculus
gaaggacgttaagggtgagcactat

SEQ ID NO: 429042 - DNA, 25 bp, Mus musculus
gaaggacgttcacatcacagtaggt

SEQ ID NO: 429043 - DNA, 25 bp, Mus musculus
gaaggacgttcagatcacagtaggt

SEQ ID NO: 429044 - DNA, 25 bp, Mus musculus
gaaggacgttcccaatagccaactg

SEQ ID NO: 429045 - DNA, 25 bp, Mus musculus
gaaggacgttccgaatagccaactg

SEQ ID NO: 429046 - DNA, 25 bp, Mus musculus
gaaggacgttctcactactaaccat

SEQ ID NO: 429047 - DNA, 25 bp, Mus musculus
gaaggacgttctgactactaaccat

SEQ ID NO: 429048 - DNA, 25 bp, Mus musculus
gaaggactaagcaatcaagttcgta

SEQ ID NO: 429049 - DNA, 25 bp, Mus musculus
gaaggactaagctatcaagttcgta

SEQ ID NO: 429050 - DNA, 25 bp, Mus musculus
gaaggactaaggctatggcacgtta

SEQ ID NO: 429051 - DNA, 25 bp, Mus musculus
gaaggactaagggtatggcacgtta

SEQ ID NO: 429052 - DNA, 25 bp, Mus musculus
gaaggactacctcagctggcgacag

SEQ ID NO: 429053 - DNA, 25 bp, Mus musculus
gaaggactacctgagctggcgacag

SEQ ID NO: 429054 - DNA, 25 bp, Mus musculus
gaaggactacggatacaggatacag

SEQ ID NO: 429055 - DNA, 25 bp, Mus musculus
gaaggactacggttacaggatacag

SEQ ID NO: 429056 - DNA, 25 bp, Mus musculus
gaaggactacttagcctgtgaatag

SEQ ID NO: 429057 - DNA, 25 bp, Mus musculus
gaaggactactttgcctgtgaatag

SEQ ID NO: 429058 - DNA, 25 bp, Mus musculus
gaaggactagagacacttaaactgt

SEQ ID NO: 429059 - DNA, 25 bp, Mus musculus
gaaggactagagtcacttaaactgt

SEQ ID NO: 429060 - DNA, 25 bp, Mus musculus
gaaggactagtcagcctgacagtat

SEQ ID NO: 429061 - DNA, 25 bp, Mus musculus
gaaggactagtctgcctgacagtat

SEQ ID NO: 429062 - DNA, 25 bp, Mus musculus
gaaggactatgcactgttttcctac

SEQ ID NO: 429063 - DNA, 25 bp, Mus musculus
gaaggactatgctctgttttcctac

SEQ ID NO: 429064 - DNA, 25 bp, Mus musculus
gaaggactcaatattctttagaggg

SEQ ID NO: 429065 - DNA, 25 bp, Mus musculus
gaaggactcaattttctttagaggg

SEQ ID NO: 429066 - DNA, 25 bp, Mus musculus
gaaggactccacctcatcaaccttt

SEQ ID NO: 429067 - DNA, 25 bp, Mus musculus
gaaggactccacgtcatcaaccttt

SEQ ID NO: 429068 - DNA, 25 bp, Mus musculus
gaaggactccatccaggaaacctag

SEQ ID NO: 429069 - DNA, 25 bp, Mus musculus
gaaggactccatgcaggaaacctag

SEQ ID NO: 429070 - DNA, 25 bp, Mus musculus
gaaggactccccaaaccaggatgca

SEQ ID NO: 429071 - DNA, 25 bp, Mus musculus
gaaggactcccctaaccaggatgca

SEQ ID NO: 429072 - DNA, 25 bp, Mus musculus
gaaggactccctactaggtgaaaag

SEQ ID NO: 429073 - DNA, 25 bp, Mus musculus
gaaggactcccttctaggtgaaaag

SEQ ID NO: 429074 - DNA, 25 bp, Mus musculus
gaaggactcctaagtgggtgacgag

SEQ ID NO: 429075 - DNA, 25 bp, Mus musculus
gaaggactcctatgtgggtgacgag

SEQ ID NO: 429076 - DNA, 25 bp, Mus musculus
gaaggactcgacacgcaaggctgca

SEQ ID NO: 429077 - DNA, 25 bp, Mus musculus
gaaggactcgactcgcaaggctgca

SEQ ID NO: 429078 - DNA, 25 bp, Mus musculus
gaaggactctaacaccctcaagtgg

SEQ ID NO: 429079 - DNA, 25 bp, Mus musculus
gaaggactctaagaccctcaagtgg

SEQ ID NO: 429080 - DNA, 25 bp, Mus musculus
gaaggactctcccaagtgcaattga

SEQ ID NO: 429081 - DNA, 25 bp, Mus musculus
gaaggactctccgaagtgcaattga

SEQ ID NO: 429082 - DNA, 25 bp, Mus musculus
gaaggactcttcatgcatatggccc

SEQ ID NO: 429083 - DNA, 25 bp, Mus musculus
gaaggactcttcttgcatatggccc

SEQ ID NO: 429084 - DNA, 25 bp, Mus musculus
gaaggactcttgaaccactgtgcta

SEQ ID NO: 429085 - DNA, 25 bp, Mus musculus
gaaggactcttgtaccactgtgcta

SEQ ID NO: 429086 - DNA, 25 bp, Mus musculus
gaaggactgactctgcaaagacccc

SEQ ID NO: 429087 - DNA, 25 bp, Mus musculus
gaaggactgactgtgcaaagacccc

SEQ ID NO: 429088 - DNA, 25 bp, Mus musculus
gaaggactgatgacagctagaactt

SEQ ID NO: 429089 - DNA, 25 bp, Mus musculus
gaaggactgatgtcagctagaactt

SEQ ID NO: 429090 - DNA, 25 bp, Mus musculus
gaaggactgattcgtgacttcaccc

SEQ ID NO: 429091 - DNA, 25 bp, Mus musculus
gaaggactgattggtgacttcaccc

SEQ ID NO: 429092 - DNA, 25 bp, Mus musculus
gaaggactgcctattctcatactct

SEQ ID NO: 429093 - DNA, 25 bp, Mus musculus
gaaggactgccttttctcatactct

SEQ ID NO: 429094 - DNA, 25 bp, Mus musculus
gaaggactggataatttttggacca

SEQ ID NO: 429095 - DNA, 25 bp, Mus musculus
gaaggactggatatatcacacctcc

SEQ ID NO: 429096 - DNA, 25 bp, Mus musculus
gaaggactggattatttttggacca

SEQ ID NO: 429097 - DNA, 25 bp, Mus musculus
gaaggactggatttatcacacctcc

SEQ ID NO: 429098 - DNA, 25 bp, Mus musculus
gaaggactggctcctgaacttcagc

SEQ ID NO: 429099 - DNA, 25 bp, Mus musculus
gaaggactggctgctgaacttcagc

SEQ ID NO: 429100 - DNA, 25 bp, Mus musculus
gaaggactggtgaggttatcctctc

SEQ ID NO: 429101 - DNA, 25 bp, Mus musculus
gaaggactggtgtggttatcctctc

SEQ ID NO: 429102 - DNA, 25 bp, Mus musculus
gaaggacttaaaacattcacatgct

SEQ ID NO: 429103 - DNA, 25 bp, Mus musculus
gaaggacttaaatcattcacatgct

SEQ ID NO: 429104 - DNA, 25 bp, Mus musculus
gaaggacttaggatctccgatcctg

SEQ ID NO: 429105 - DNA, 25 bp, Mus musculus
gaaggacttaggttctccgatcctg

SEQ ID NO: 429106 - DNA, 25 bp, Mus musculus
gaaggacttcatagcaagtactgta

SEQ ID NO: 429107 - DNA, 25 bp, Mus musculus
gaaggacttcatccatcttactgaa

SEQ ID NO: 429108 - DNA, 25 bp, Mus musculus
gaaggacttcatgcatcttactgaa

SEQ ID NO: 429109 - DNA, 25 bp, Mus musculus
gaaggacttcattgcaagtactgta

SEQ ID NO: 429110 - DNA, 25 bp, Mus musculus
gaaggacttccaatcatgtgcagta

SEQ ID NO: 429111 - DNA, 25 bp, Mus musculus
gaaggacttccattcatgtgcagta

SEQ ID NO: 429112 - DNA, 25 bp, Mus musculus
gaaggacttcgtctctacagtcatc

SEQ ID NO: 429113 - DNA, 25 bp, Mus musculus
gaaggacttcgtgtctacagtcatc

SEQ ID NO: 429114 - DNA, 25 bp, Mus musculus
gaaggacttctcaatccaagtaggg

SEQ ID NO: 429115 - DNA, 25 bp, Mus musculus
gaaggacttctctatccaagtaggg

SEQ ID NO: 429116 - DNA, 25 bp, Mus musculus
gaaggacttctgactgagaaggact

SEQ ID NO: 429117 - DNA, 25 bp, Mus musculus
gaaggacttctgtctgagaaggact

SEQ ID NO: 429118 - DNA, 25 bp, Mus musculus
gaaggacttggtacaggttcttctc

SEQ ID NO: 429119 - DNA, 25 bp, Mus musculus
gaaggacttggttcaggttcttctc

SEQ ID NO: 429120 - DNA, 25 bp, Mus musculus
gaaggagaaacccaatctctgggcc

SEQ ID NO: 429121 - DNA, 25 bp, Mus musculus
gaaggagaaaccgaatctctgggcc

SEQ ID NO: 429122 - DNA, 25 bp, Mus musculus
gaaggagaacacagccctgcggacg

SEQ ID NO: 429123 - DNA, 25 bp, Mus musculus
gaaggagaacaccaaggatgcccaa

SEQ ID NO: 429124 - DNA, 25 bp, Mus musculus
gaaggagaacacgaaggatgcccaa

SEQ ID NO: 429125 - DNA, 25 bp, Mus musculus
gaaggagaacactgccctgcggacg

SEQ ID NO: 429126 - DNA, 25 bp, Mus musculus
gaaggagaaccacgcactaccacca

SEQ ID NO: 429127 - DNA, 25 bp, Mus musculus
gaaggagaaccaggcactaccacca

SEQ ID NO: 429128 - DNA, 25 bp, Mus musculus
gaaggagaactgctgcctgtccttt

SEQ ID NO: 429129 - DNA, 25 bp, Mus musculus
gaaggagaactggtgcctgtccttt

SEQ ID NO: 429130 - DNA, 25 bp, Mus musculus
gaaggagaagatactcaactcaaag

SEQ ID NO: 429131 - DNA, 25 bp, Mus musculus
gaaggagaagattctcaactcaaag

SEQ ID NO: 429132 - DNA, 25 bp, Mus musculus
gaaggagaagcactcctggaacccc

SEQ ID NO: 429133 - DNA, 25 bp, Mus musculus
gaaggagaagcagtcctggaacccc

SEQ ID NO: 429134 - DNA, 25 bp, Mus musculus
gaaggagaagttcccactaggtgca

SEQ ID NO: 429135 - DNA, 25 bp, Mus musculus
gaaggagaagttgccactaggtgca

SEQ ID NO: 429136 - DNA, 25 bp, Mus musculus
gaaggagaatccacgagttgtaaga

SEQ ID NO: 429137 - DNA, 25 bp, Mus musculus
gaaggagaatcctcgagttgtaaga

SEQ ID NO: 429138 - DNA, 25 bp, Mus musculus
gaaggagacattcgattccccagtg

SEQ ID NO: 429139 - DNA, 25 bp, Mus musculus
gaaggagacattggattccccagtg

SEQ ID NO: 429140 - DNA, 25 bp, Mus musculus
gaaggagaccacatctttgtctcta

SEQ ID NO: 429141 - DNA, 25 bp, Mus musculus
gaaggagaccacttctttgtctcta

SEQ ID NO: 429142 - DNA, 25 bp, Mus musculus
gaaggagacccaattctagttattt

SEQ ID NO: 429143 - DNA, 25 bp, Mus musculus
gaaggagacccacttgtgctccgaa

SEQ ID NO: 429144 - DNA, 25 bp, Mus musculus
gaaggagacccagttgtgctccgaa

SEQ ID NO: 429145 - DNA, 25 bp, Mus musculus
gaaggagacccatttctagttattt

SEQ ID NO: 429146 - DNA, 25 bp, Mus musculus
gaaggagaccgcatctggagatgtt

SEQ ID NO: 429147 - DNA, 25 bp, Mus musculus
gaaggagaccgcttctggagatgtt

SEQ ID NO: 429148 - DNA, 25 bp, Mus musculus
gaaggagactatacctaccagctca

SEQ ID NO: 429149 - DNA, 25 bp, Mus musculus
gaaggagactattcctaccagctca

SEQ ID NO: 429150 - DNA, 25 bp, Mus musculus
gaaggagactggctgctgctgtgca

SEQ ID NO: 429151 - DNA, 25 bp, Mus musculus
gaaggagactgggtgctgctgtgca

SEQ ID NO: 429152 - DNA, 25 bp, Mus musculus
gaaggagacttaagctcagcaactc

SEQ ID NO: 429153 - DNA, 25 bp, Mus musculus
gaaggagacttatgctcagcaactc

SEQ ID NO: 429154 - DNA, 25 bp, Mus musculus
gaaggagagaagacatccattgacc

SEQ ID NO: 429155 - DNA, 25 bp, Mus musculus
gaaggagagaagtcatccattgacc

SEQ ID NO: 429156 - DNA, 25 bp, Mus musculus
gaaggagagacactctggccgcact

SEQ ID NO: 429157 - DNA, 25 bp, Mus musculus
gaaggagagacagtctggccgcact

SEQ ID NO: 429158 - DNA, 25 bp, Mus musculus
gaaggagagcttagcccttatgcac

SEQ ID NO: 429159 - DNA, 25 bp, Mus musculus
gaaggagagctttgcccttatgcac

SEQ ID NO: 429160 - DNA, 25 bp, Mus musculus
gaaggagatcaaagggatacagatt

SEQ ID NO: 429161 - DNA, 25 bp, Mus musculus
gaaggagatcaatgggatacagatt

SEQ ID NO: 429162 - DNA, 25 bp, Mus musculus
gaaggagatccccagtctccactga

SEQ ID NO: 429163 - DNA, 25 bp, Mus musculus
gaaggagatcccgagtctccactga

SEQ ID NO: 429164 - DNA, 25 bp, Mus musculus
gaaggagatgaccacacatcacgca

SEQ ID NO: 429165 - DNA, 25 bp, Mus musculus
gaaggagatgacgacacatcacgca

SEQ ID NO: 429166 - DNA, 25 bp, Mus musculus
gaaggagatgcccaccggtgctcac

SEQ ID NO: 429167 - DNA, 25 bp, Mus musculus
gaaggagatgccgaccggtgctcac

SEQ ID NO: 429168 - DNA, 25 bp, Mus musculus
gaaggagattccctgctgtgacaga

SEQ ID NO: 429169 - DNA, 25 bp, Mus musculus
gaaggagattccgtgctgtgacaga

SEQ ID NO: 429170 - DNA, 25 bp, Mus musculus
gaaggagattgcaacactaaagagt

SEQ ID NO: 429171 - DNA, 25 bp, Mus musculus
gaaggagattgctacactaaagagt

SEQ ID NO: 429172 - DNA, 25 bp, Mus musculus
gaaggagcaaatcactgccctgatg

SEQ ID NO: 429173 - DNA, 25 bp, Mus musculus
gaaggagcaaatgactgccctgatg

SEQ ID NO: 429174 - DNA, 25 bp, Mus musculus
gaaggagcaagacccctggtcccct

SEQ ID NO: 429175 - DNA, 25 bp, Mus musculus
gaaggagcaagagccctggtcccct

SEQ ID NO: 429176 - DNA, 25 bp, Mus musculus
gaaggagcaagccacacttctttcc

SEQ ID NO: 429177 - DNA, 25 bp, Mus musculus
gaaggagcaagcgacacttctttcc

SEQ ID NO: 429178 - DNA, 25 bp, Mus musculus
gaaggagcacatcgacagctttgag

SEQ ID NO: 429179 - DNA, 25 bp, Mus musculus
gaaggagcacatggacagctttgag

SEQ ID NO: 429180 - DNA, 25 bp, Mus musculus
gaaggagcactcctttgaggccaga

SEQ ID NO: 429181 - DNA, 25 bp, Mus musculus
gaaggagcactcgtttgaggccaga

SEQ ID NO: 429182 - DNA, 25 bp, Mus musculus
gaaggagcagacacccgctgaccgg

SEQ ID NO: 429183 - DNA, 25 bp, Mus musculus
gaaggagcagactcccgctgaccgg

SEQ ID NO: 429184 - DNA, 25 bp, Mus musculus
gaaggagcagtactcagacgcccca

SEQ ID NO: 429185 - DNA, 25 bp, Mus musculus
gaaggagcagtagtcagacgcccca

SEQ ID NO: 429186 - DNA, 25 bp, Mus musculus
gaaggagcagtgatctggttaataa

SEQ ID NO: 429187 - DNA, 25 bp, Mus musculus
gaaggagcagtgttctggttaataa

SEQ ID NO: 429188 - DNA, 25 bp, Mus musculus
gaaggagcagttccgaatcccccgg

SEQ ID NO: 429189 - DNA, 25 bp, Mus musculus
gaaggagcagttgcgaatcccccgg

SEQ ID NO: 429190 - DNA, 25 bp, Mus musculus
gaaggagcatacacatctctgtata

SEQ ID NO: 429191 - DNA, 25 bp, Mus musculus
gaaggagcatactcatctctgtata

SEQ ID NO: 429192 - DNA, 25 bp, Mus musculus
gaaggagcatgcagctcagtgttga

SEQ ID NO: 429193 - DNA, 25 bp, Mus musculus
gaaggagcatgctgctcagtgttga

SEQ ID NO: 429194 - DNA, 25 bp, Mus musculus
gaaggagccagccaagtccttcatg

SEQ ID NO: 429195 - DNA, 25 bp, Mus musculus
gaaggagccagcgaagtccttcatg

SEQ ID NO: 429196 - DNA, 25 bp, Mus musculus
gaaggagccaggaacgccatcctca

SEQ ID NO: 429197 - DNA, 25 bp, Mus musculus
gaaggagccaggcactcttgacatc

SEQ ID NO: 429198 - DNA, 25 bp, Mus musculus
gaaggagccagggactcttgacatc

SEQ ID NO: 429199 - DNA, 25 bp, Mus musculus
gaaggagccaggtacgccatcctca

SEQ ID NO: 429200 - DNA, 25 bp, Mus musculus
gaaggagccatccaaatgcagcaga

SEQ ID NO: 429201 - DNA, 25 bp, Mus musculus
gaaggagccatcgaaatgcagcaga

SEQ ID NO: 429202 - DNA, 25 bp, Mus musculus
gaaggagcccacaagttaggcatca

SEQ ID NO: 429203 - DNA, 25 bp, Mus musculus
gaaggagcccactagttaggcatca

SEQ ID NO: 429204 - DNA, 25 bp, Mus musculus
gaaggagcccagacgatgattgaac

SEQ ID NO: 429205 - DNA, 25 bp, Mus musculus
gaaggagcccagtcgatgattgaac

SEQ ID NO: 429206 - DNA, 25 bp, Mus musculus
gaaggagcccataagctctgtgtga

SEQ ID NO: 429207 - DNA, 25 bp, Mus musculus
gaaggagcccattagctctgtgtga

SEQ ID NO: 429208 - DNA, 25 bp, Mus musculus
gaaggagccctacaatctgactcct

SEQ ID NO: 429209 - DNA, 25 bp, Mus musculus
gaaggagccctagaatctgactcct

SEQ ID NO: 429210 - DNA, 25 bp, Mus musculus
gaaggagcccttatgtattgggatc

SEQ ID NO: 429211 - DNA, 25 bp, Mus musculus
gaaggagcccttctctgaatacagc

SEQ ID NO: 429212 - DNA, 25 bp, Mus musculus
gaaggagcccttgtctgaatacagc

SEQ ID NO: 429213 - DNA, 25 bp, Mus musculus
gaaggagcccttttgtattgggatc

SEQ ID NO: 429214 - DNA, 25 bp, Mus musculus
gaaggagccgtcaggtttagaaaga

SEQ ID NO: 429215 - DNA, 25 bp, Mus musculus
gaaggagccgtctggtttagaaaga

SEQ ID NO: 429216 - DNA, 25 bp, Mus musculus
gaaggagccgtgattaactagatga

SEQ ID NO: 429217 - DNA, 25 bp, Mus musculus
gaaggagccgtgtttaactagatga

SEQ ID NO: 429218 - DNA, 25 bp, Mus musculus
gaaggagcctaactctgagaaacac

SEQ ID NO: 429219 - DNA, 25 bp, Mus musculus
gaaggagcctaagtctgagaaacac

SEQ ID NO: 429220 - DNA, 25 bp, Mus musculus
gaaggagcctttaccaatcagagtc

SEQ ID NO: 429221 - DNA, 25 bp, Mus musculus
gaaggagcctttcccggccttaaag

SEQ ID NO: 429222 - DNA, 25 bp, Mus musculus
gaaggagcctttgccggccttaaag

SEQ ID NO: 429223 - DNA, 25 bp, Mus musculus
gaaggagccttttccaatcagagtc

SEQ ID NO: 429224 - DNA, 25 bp, Mus musculus
gaaggagcgaacatgtcagtgctga

SEQ ID NO: 429225 - DNA, 25 bp, Mus musculus
gaaggagcgaacctcctgcgtttgc

SEQ ID NO: 429226 - DNA, 25 bp, Mus musculus
gaaggagcgaacgtcctgcgtttgc

SEQ ID NO: 429227 - DNA, 25 bp, Mus musculus
gaaggagcgaacttgtcagtgctga

SEQ ID NO: 429228 - DNA, 25 bp, Mus musculus
gaaggagcgagcactgcagtcacct

SEQ ID NO: 429229 - DNA, 25 bp, Mus musculus
gaaggagcgagctctgcagtcacct

SEQ ID NO: 429230 - DNA, 25 bp, Mus musculus
gaaggagcgctgagacaagtccctg

SEQ ID NO: 429231 - DNA, 25 bp, Mus musculus
gaaggagcgctgtgacaagtccctg

SEQ ID NO: 429232 - DNA, 25 bp, Mus musculus
gaaggagcgggtagcttcaatttct

SEQ ID NO: 429233 - DNA, 25 bp, Mus musculus
gaaggagcgggttgcttcaatttct

SEQ ID NO: 429234 - DNA, 25 bp, Mus musculus
gaaggagctaccctttgtctgacca

SEQ ID NO: 429235 - DNA, 25 bp, Mus musculus
gaaggagctaccgtttgtctgacca

SEQ ID NO: 429236 - DNA, 25 bp, Mus musculus
gaaggagctcaaagcacagatacag

SEQ ID NO: 429237 - DNA, 25 bp, Mus musculus
gaaggagctcaatgcacagatacag

SEQ ID NO: 429238 - DNA, 25 bp, Mus musculus
gaaggagctcatcttcacaggccgg

SEQ ID NO: 429239 - DNA, 25 bp, Mus musculus
gaaggagctcatgttcacaggccgg

SEQ ID NO: 429240 - DNA, 25 bp, Mus musculus
gaaggagctccgctggaaacctgaa

SEQ ID NO: 429241 - DNA, 25 bp, Mus musculus
gaaggagctccggtggaaacctgaa

SEQ ID NO: 429242 - DNA, 25 bp, Mus musculus
gaaggagctgaacctggctctgcac

SEQ ID NO: 429243 - DNA, 25 bp, Mus musculus
gaaggagctgaagctggctctgcac

SEQ ID NO: 429244 - DNA, 25 bp, Mus musculus
gaaggagctggcaaacacccctgac

SEQ ID NO: 429245 - DNA, 25 bp, Mus musculus
gaaggagctggctaacacccctgac

SEQ ID NO: 429246 - DNA, 25 bp, Mus musculus
gaaggagcttccagctattttagaa

SEQ ID NO: 429247 - DNA, 25 bp, Mus musculus
gaaggagcttcctgctattttagaa

SEQ ID NO: 429248 - DNA, 25 bp, Mus musculus
gaaggaggaacccaagtagccttgt

SEQ ID NO: 429249 - DNA, 25 bp, Mus musculus
gaaggaggaaccgaagtagccttgt

SEQ ID NO: 429250 - DNA, 25 bp, Mus musculus
gaaggaggaagcctcccaagacctt

SEQ ID NO: 429251 - DNA, 25 bp, Mus musculus
gaaggaggaagcgtcccaagacctt

SEQ ID NO: 429252 - DNA, 25 bp, Mus musculus
gaaggaggacttagcttccacacct

SEQ ID NO: 429253 - DNA, 25 bp, Mus musculus
gaaggaggactttgcttccacacct

SEQ ID NO: 429254 - DNA, 25 bp, Mus musculus
gaaggaggagcaacccatgtctacc

SEQ ID NO: 429255 - DNA, 25 bp, Mus musculus
gaaggaggagcatcccatgtctacc

SEQ ID NO: 429256 - DNA, 25 bp, Mus musculus
gaaggaggagctcaatgctatctca

SEQ ID NO: 429257 - DNA, 25 bp, Mus musculus
gaaggaggagctgaatgctatctca

SEQ ID NO: 429258 - DNA, 25 bp, Mus musculus
gaaggaggataccacactctttctc

SEQ ID NO: 429259 - DNA, 25 bp, Mus musculus
gaaggaggatacgacactctttctc

SEQ ID NO: 429260 - DNA, 25 bp, Mus musculus
gaaggaggccccactgagaatactg

SEQ ID NO: 429261 - DNA, 25 bp, Mus musculus
gaaggaggccccagacattatgtca

SEQ ID NO: 429262 - DNA, 25 bp, Mus musculus
gaaggaggcccctctgagaatactg

SEQ ID NO: 429263 - DNA, 25 bp, Mus musculus
gaaggaggcccctgacattatgtca

SEQ ID NO: 429264 - DNA, 25 bp, Mus musculus
gaaggaggcccgaatgaccctagaa

SEQ ID NO: 429265 - DNA, 25 bp, Mus musculus
gaaggaggcccgtatgaccctagaa

SEQ ID NO: 429266 - DNA, 25 bp, Mus musculus
gaaggaggcttacttaacccacagt

SEQ ID NO: 429267 - DNA, 25 bp, Mus musculus
gaaggaggcttagttaacccacagt

SEQ ID NO: 429268 - DNA, 25 bp, Mus musculus
gaaggagggcacacaggagcatttc

SEQ ID NO: 429269 - DNA, 25 bp, Mus musculus
gaaggagggcactcaggagcatttc

SEQ ID NO: 429270 - DNA, 25 bp, Mus musculus
gaaggagggcccactgtatttatgg

SEQ ID NO: 429271 - DNA, 25 bp, Mus musculus
gaaggagggcccagcatcacttcct

SEQ ID NO: 429272 - DNA, 25 bp, Mus musculus
gaaggagggccctctgtatttatgg

SEQ ID NO: 429273 - DNA, 25 bp, Mus musculus
gaaggagggccctgcatcacttcct

SEQ ID NO: 429274 - DNA, 25 bp, Mus musculus
gaaggagggtttactgtggtcaatc

SEQ ID NO: 429275 - DNA, 25 bp, Mus musculus
gaaggagggttttctgtggtcaatc

SEQ ID NO: 429276 - DNA, 25 bp, Mus musculus
gaaggaggtcctatcagagctcctt

SEQ ID NO: 429277 - DNA, 25 bp, Mus musculus
gaaggaggtcctttcagagctcctt

SEQ ID NO: 429278 - DNA, 25 bp, Mus musculus
gaaggaggtctccaggacacctgtt

SEQ ID NO: 429279 - DNA, 25 bp, Mus musculus
gaaggaggtctcgaggacacctgtt

SEQ ID NO: 429280 - DNA, 25 bp, Mus musculus
gaaggaggtcttaggaccctgtttg

SEQ ID NO: 429281 - DNA, 25 bp, Mus musculus
gaaggaggtcttcgaaccagtcttt

SEQ ID NO: 429282 - DNA, 25 bp, Mus musculus
gaaggaggtcttggaaccagtcttt

SEQ ID NO: 429283 - DNA, 25 bp, Mus musculus
gaaggaggtctttggaccctgtttg

SEQ ID NO: 429284 - DNA, 25 bp, Mus musculus
gaaggaggtgatacttgggtaccac

SEQ ID NO: 429285 - DNA, 25 bp, Mus musculus
gaaggaggtgatcgatcaattcaat

SEQ ID NO: 429286 - DNA, 25 bp, Mus musculus
gaaggaggtgatggatcaattcaat

SEQ ID NO: 429287 - DNA, 25 bp, Mus musculus
gaaggaggtgattcttgggtaccac

SEQ ID NO: 429288 - DNA, 25 bp, Mus musculus
gaaggaggttccagatttacctgaa

SEQ ID NO: 429289 - DNA, 25 bp, Mus musculus
gaaggaggttcctgatttacctgaa

SEQ ID NO: 429290 - DNA, 25 bp, Mus musculus
gaaggagtaaggaaagcctcagcct

SEQ ID NO: 429291 - DNA, 25 bp, Mus musculus
gaaggagtaaggtaagcctcagcct

SEQ ID NO: 429292 - DNA, 25 bp, Mus musculus
gaaggagtacatagtgccacacccc

SEQ ID NO: 429293 - DNA, 25 bp, Mus musculus
gaaggagtacattgtgccacacccc

SEQ ID NO: 429294 - DNA, 25 bp, Mus musculus
gaaggagtacttacagttcacaatt

SEQ ID NO: 429295 - DNA, 25 bp, Mus musculus
gaaggagtactttcagttcacaatt

SEQ ID NO: 429296 - DNA, 25 bp, Mus musculus
gaaggagtatgcaccactcaaaact

SEQ ID NO: 429297 - DNA, 25 bp, Mus musculus
gaaggagtatgctccactcaaaact

SEQ ID NO: 429298 - DNA, 25 bp, Mus musculus
gaaggagtattcatggctgctcgct

SEQ ID NO: 429299 - DNA, 25 bp, Mus musculus
gaaggagtattcttggctgctcgct

SEQ ID NO: 429300 - DNA, 25 bp, Mus musculus
gaaggagtcaccaccacagagtgag

SEQ ID NO: 429301 - DNA, 25 bp, Mus musculus
gaaggagtcacctccacagagtgag

SEQ ID NO: 429302 - DNA, 25 bp, Mus musculus
gaaggagtcaggctgtctctgtaac

SEQ ID NO: 429303 - DNA, 25 bp, Mus musculus
gaaggagtcagggtgtctctgtaac

SEQ ID NO: 429304 - DNA, 25 bp, Mus musculus
gaaggagtcataaccaacggcagca

SEQ ID NO: 429305 - DNA, 25 bp, Mus musculus
gaaggagtcataagcacagatctta

SEQ ID NO: 429306 - DNA, 25 bp, Mus musculus
gaaggagtcataatggtcatatcta

SEQ ID NO: 429307 - DNA, 25 bp, Mus musculus
gaaggagtcatatccaacggcagca

SEQ ID NO: 429308 - DNA, 25 bp, Mus musculus
gaaggagtcatatgcacagatctta

SEQ ID NO: 429309 - DNA, 25 bp, Mus musculus
gaaggagtcatattggtcatatcta

SEQ ID NO: 429310 - DNA, 25 bp, Mus musculus
gaaggagtcatgactcttggctcca

SEQ ID NO: 429311 - DNA, 25 bp, Mus musculus
gaaggagtcatgtctcttggctcca

SEQ ID NO: 429312 - DNA, 25 bp, Mus musculus
gaaggagtcccaacaagtgccagag

SEQ ID NO: 429313 - DNA, 25 bp, Mus musculus
gaaggagtcccatcaagtgccagag

SEQ ID NO: 429314 - DNA, 25 bp, Mus musculus
gaaggagtctcgctcacacgagtcc

SEQ ID NO: 429315 - DNA, 25 bp, Mus musculus
gaaggagtctcggtcacacgagtcc

SEQ ID NO: 429316 - DNA, 25 bp, Mus musculus
gaaggagtctgaacctctgtgcctc

SEQ ID NO: 429317 - DNA, 25 bp, Mus musculus
gaaggagtctgaccaagcccagtac

SEQ ID NO: 429318 - DNA, 25 bp, Mus musculus
gaaggagtctgagcaagcccagtac

SEQ ID NO: 429319 - DNA, 25 bp, Mus musculus
gaaggagtctgatcctctgtgcctc

SEQ ID NO: 429320 - DNA, 25 bp, Mus musculus
gaaggagtctttattggcaggagta

SEQ ID NO: 429321 - DNA, 25 bp, Mus musculus
gaaggagtcttttttggcaggagta

SEQ ID NO: 429322 - DNA, 25 bp, Mus musculus
gaaggagtgagcaccgctgcctgtc

SEQ ID NO: 429323 - DNA, 25 bp, Mus musculus
gaaggagtgagctccgctgcctgtc

SEQ ID NO: 429324 - DNA, 25 bp, Mus musculus
gaaggagtgatgacctcagcactgt

SEQ ID NO: 429325 - DNA, 25 bp, Mus musculus
gaaggagtgatgtcctcagcactgt

SEQ ID NO: 429326 - DNA, 25 bp, Mus musculus
gaaggagtgcgaccccgagaatcat

SEQ ID NO: 429327 - DNA, 25 bp, Mus musculus
gaaggagtgcgagcccgagaatcat

SEQ ID NO: 429328 - DNA, 25 bp, Mus musculus
gaaggagtggccctgtttgtttatt

SEQ ID NO: 429329 - DNA, 25 bp, Mus musculus
gaaggagtggccgtgtttgtttatt

SEQ ID NO: 429330 - DNA, 25 bp, Mus musculus
gaaggagtggttcggactcctgcag

SEQ ID NO: 429331 - DNA, 25 bp, Mus musculus
gaaggagtggttgggactcctgcag

SEQ ID NO: 429332 - DNA, 25 bp, Mus musculus
gaaggagtgtacagtggctctacaa

SEQ ID NO: 429333 - DNA, 25 bp, Mus musculus
gaaggagtgtactgtggctctacaa

SEQ ID NO: 429334 - DNA, 25 bp, Mus musculus
gaaggagtgtctctttgccaagcta

SEQ ID NO: 429335 - DNA, 25 bp, Mus musculus
gaaggagtgtctgtttgccaagcta

SEQ ID NO: 429336 - DNA, 25 bp, Mus musculus
gaaggagtgtgcacaatacacagag

SEQ ID NO: 429337 - DNA, 25 bp, Mus musculus
gaaggagtgtgctcaatacacagag

SEQ ID NO: 429338 - DNA, 25 bp, Mus musculus
gaaggagttcaaacccaacgagcag

SEQ ID NO: 429339 - DNA, 25 bp, Mus musculus
gaaggagttcaatcccaacgagcag

SEQ ID NO: 429340 - DNA, 25 bp, Mus musculus
gaaggagttcagcttcgtgcagcaa

SEQ ID NO: 429341 - DNA, 25 bp, Mus musculus
gaaggagttcaggttcgtgcagcaa

SEQ ID NO: 429342 - DNA, 25 bp, Mus musculus
gaaggagttccaacagcacctactg

SEQ ID NO: 429343 - DNA, 25 bp, Mus musculus
gaaggagttccatcagcacctactg

SEQ ID NO: 429344 - DNA, 25 bp, Mus musculus
gaaggagttcccactggtggtgtct

SEQ ID NO: 429345 - DNA, 25 bp, Mus musculus
gaaggagttcccagtcccaaatcag

SEQ ID NO: 429346 - DNA, 25 bp, Mus musculus
gaaggagttccctctggtggtgtct

SEQ ID NO: 429347 - DNA, 25 bp, Mus musculus
gaaggagttccctgtcccaaatcag

SEQ ID NO: 429348 - DNA, 25 bp, Mus musculus
gaaggagttgtgcaccccacctgat

SEQ ID NO: 429349 - DNA, 25 bp, Mus musculus
gaaggagttgtggaccccacctgat

SEQ ID NO: 429350 - DNA, 25 bp, Mus musculus
gaaggagtttatacggatttgaaca

SEQ ID NO: 429351 - DNA, 25 bp, Mus musculus
gaaggagtttattcggatttgaaca

SEQ ID NO: 429352 - DNA, 25 bp, Mus musculus
gaaggagtttcactttagtcgatac

SEQ ID NO: 429353 - DNA, 25 bp, Mus musculus
gaaggagtttcagtttagtcgatac

SEQ ID NO: 429354 - DNA, 25 bp, Mus musculus
gaaggagtttccatatgccgatgcc

SEQ ID NO: 429355 - DNA, 25 bp, Mus musculus
gaaggagtttccttatgccgatgcc

SEQ ID NO: 429356 - DNA, 25 bp, Mus musculus
gaaggagtttgaaccgaccataaca

SEQ ID NO: 429357 - DNA, 25 bp, Mus musculus
gaaggagtttgatccgaccataaca

SEQ ID NO: 429358 - DNA, 25 bp, Mus musculus
gaaggagtttgtctgtgtttagatt

SEQ ID NO: 429359 - DNA, 25 bp, Mus musculus
gaaggagtttgtgtgtgtttagatt

SEQ ID NO: 429360 - DNA, 25 bp, Mus musculus
gaaggagtttttacagtgcttttgt

SEQ ID NO: 429361 - DNA, 25 bp, Mus musculus
gaaggagttttttcagtgcttttgt

SEQ ID NO: 429362 - DNA, 25 bp, Mus musculus
gaaggataacctcattgtaccaatt

SEQ ID NO: 429363 - DNA, 25 bp, Mus musculus
gaaggataacctgattgtaccaatt

SEQ ID NO: 429364 - DNA, 25 bp, Mus musculus
gaaggataactgctgtgtcgccccg

SEQ ID NO: 429365 - DNA, 25 bp, Mus musculus
gaaggataactggtgtgtcgccccg

SEQ ID NO: 429366 - DNA, 25 bp, Mus musculus
gaaggataattcaccctttcccatg

SEQ ID NO: 429367 - DNA, 25 bp, Mus musculus
gaaggataattctccctttcccatg

SEQ ID NO: 429368 - DNA, 25 bp, Mus musculus
gaaggatacagaaacttgcctagta

SEQ ID NO: 429369 - DNA, 25 bp, Mus musculus
gaaggatacagatacttgcctagta

SEQ ID NO: 429370 - DNA, 25 bp, Mus musculus
gaaggatacatacgctcagaagtgt

SEQ ID NO: 429371 - DNA, 25 bp, Mus musculus
gaaggatacataggctcagaagtgt

SEQ ID NO: 429372 - DNA, 25 bp, Mus musculus
gaaggatacattccctgtctagaat

SEQ ID NO: 429373 - DNA, 25 bp, Mus musculus
gaaggatacattgcctgtctagaat

SEQ ID NO: 429374 - DNA, 25 bp, Mus musculus
gaaggataccttcaactggcctaga

SEQ ID NO: 429375 - DNA, 25 bp, Mus musculus
gaaggataccttgaactggcctaga

SEQ ID NO: 429376 - DNA, 25 bp, Mus musculus
gaaggatagatcacctagcaccctc

SEQ ID NO: 429377 - DNA, 25 bp, Mus musculus
gaaggatagatctcctagcaccctc

SEQ ID NO: 429378 - DNA, 25 bp, Mus musculus
gaaggatagctcagtgtccagcctg

SEQ ID NO: 429379 - DNA, 25 bp, Mus musculus
gaaggatagctctgtgtccagcctg

SEQ ID NO: 429380 - DNA, 25 bp, Mus musculus
gaaggatagtaaatcctccctgcct

SEQ ID NO: 429381 - DNA, 25 bp, Mus musculus
gaaggatagtaattcctccctgcct

SEQ ID NO: 429382 - DNA, 25 bp, Mus musculus
gaaggatatgaccaccctctgggag

SEQ ID NO: 429383 - DNA, 25 bp, Mus musculus
gaaggatatgacgaccctctgggag

SEQ ID NO: 429384 - DNA, 25 bp, Mus musculus
gaaggatatggcactgaagccacat

SEQ ID NO: 429385 - DNA, 25 bp, Mus musculus
gaaggatatggctctgaagccacat

SEQ ID NO: 429386 - DNA, 25 bp, Mus musculus
gaaggatatgttccatcagccgtac

SEQ ID NO: 429387 - DNA, 25 bp, Mus musculus
gaaggatatgttgcatcagccgtac

SEQ ID NO: 429388 - DNA, 25 bp, Mus musculus
gaaggatattctagcctgtcttgcc

SEQ ID NO: 429389 - DNA, 25 bp, Mus musculus
gaaggatattcttgcctgtcttgcc

SEQ ID NO: 429390 - DNA, 25 bp, Mus musculus
gaaggatcaatgagttctcatctta

SEQ ID NO: 429391 - DNA, 25 bp, Mus musculus
gaaggatcaatgtgttctcatctta

SEQ ID NO: 429392 - DNA, 25 bp, Mus musculus
gaaggatcacgtatagcctgttaaa

SEQ ID NO: 429393 - DNA, 25 bp, Mus musculus
gaaggatcacgtttagcctgttaaa

SEQ ID NO: 429394 - DNA, 25 bp, Mus musculus
gaaggatcactgaccagtaaagact

SEQ ID NO: 429395 - DNA, 25 bp, Mus musculus
gaaggatcactgtccagtaaagact

SEQ ID NO: 429396 - DNA, 25 bp, Mus musculus
gaaggatcagaactcgttcccgatc

SEQ ID NO: 429397 - DNA, 25 bp, Mus musculus
gaaggatcagaagtcgttcccgatc

SEQ ID NO: 429398 - DNA, 25 bp, Mus musculus
gaaggatcaggactcttgtgaaagc

SEQ ID NO: 429399 - DNA, 25 bp, Mus musculus
gaaggatcaggagtcttgtgaaagc

SEQ ID NO: 429400 - DNA, 25 bp, Mus musculus
gaaggatcatgcactacttctcata

SEQ ID NO: 429401 - DNA, 25 bp, Mus musculus
gaaggatcatgctctacttctcata

SEQ ID NO: 429402 - DNA, 25 bp, Mus musculus
gaaggatcatggctacatcaagtaa

SEQ ID NO: 429403 - DNA, 25 bp, Mus musculus
gaaggatcatgggtacatcaagtaa

SEQ ID NO: 429404 - DNA, 25 bp, Mus musculus
gaaggatcattactccatcgaccat

SEQ ID NO: 429405 - DNA, 25 bp, Mus musculus
gaaggatcattagtccatcgaccat

SEQ ID NO: 429406 - DNA, 25 bp, Mus musculus
gaaggatccactaaccatagaagtt

SEQ ID NO: 429407 - DNA, 25 bp, Mus musculus
gaaggatccactagggaatgctgaa

SEQ ID NO: 429408 - DNA, 25 bp, Mus musculus
gaaggatccacttaccatagaagtt

SEQ ID NO: 429409 - DNA, 25 bp, Mus musculus
gaaggatccacttgggaatgctgaa

SEQ ID NO: 429410 - DNA, 25 bp, Mus musculus
gaaggatccattcctccaggacaag

SEQ ID NO: 429411 - DNA, 25 bp, Mus musculus
gaaggatccattgctccaggacaag

SEQ ID NO: 429412 - DNA, 25 bp, Mus musculus
gaaggatcccttagcacagaatatg

SEQ ID NO: 429413 - DNA, 25 bp, Mus musculus
gaaggatccctttgcacagaatatg

SEQ ID NO: 429414 - DNA, 25 bp, Mus musculus
gaaggatccggtcctctacgtctat

SEQ ID NO: 429415 - DNA, 25 bp, Mus musculus
gaaggatccggtgctctacgtctat

SEQ ID NO: 429416 - DNA, 25 bp, Mus musculus
gaaggatcctccaggagggacctcg

SEQ ID NO: 429417 - DNA, 25 bp, Mus musculus
gaaggatcctcctggagggacctcg

SEQ ID NO: 429418 - DNA, 25 bp, Mus musculus
gaaggatcctgacagcctccggcag

SEQ ID NO: 429419 - DNA, 25 bp, Mus musculus
gaaggatcctgagagcctccggcag

SEQ ID NO: 429420 - DNA, 25 bp, Mus musculus
gaaggatcctggaagattccctgtg

SEQ ID NO: 429421 - DNA, 25 bp, Mus musculus
gaaggatcctggtagattccctgtg

SEQ ID NO: 429422 - DNA, 25 bp, Mus musculus
gaaggatcctttcccggcagtggac

SEQ ID NO: 429423 - DNA, 25 bp, Mus musculus
gaaggatcctttgccggcagtggac

SEQ ID NO: 429424 - DNA, 25 bp, Mus musculus
gaaggatcgagcctagattcagaac

SEQ ID NO: 429425 - DNA, 25 bp, Mus musculus
gaaggatcgagcgtagattcagaac

SEQ ID NO: 429426 - DNA, 25 bp, Mus musculus
gaaggatcgcaacgcagtgactgtc

SEQ ID NO: 429427 - DNA, 25 bp, Mus musculus
gaaggatcgcaaggcagtgactgtc

SEQ ID NO: 429428 - DNA, 25 bp, Mus musculus
gaaggatcgggtcgctattcttgta

SEQ ID NO: 429429 - DNA, 25 bp, Mus musculus
gaaggatcgggtggctattcttgta

SEQ ID NO: 429430 - DNA, 25 bp, Mus musculus
gaaggatctattcgttgtctgaata

SEQ ID NO: 429431 - DNA, 25 bp, Mus musculus
gaaggatctattggttgtctgaata

SEQ ID NO: 429432 - DNA, 25 bp, Mus musculus
gaaggatctctcacacatgttcaag

SEQ ID NO: 429433 - DNA, 25 bp, Mus musculus
gaaggatctctctcacatgttcaag

SEQ ID NO: 429434 - DNA, 25 bp, Mus musculus
gaaggatctcttcagcccagtggtt

SEQ ID NO: 429435 - DNA, 25 bp, Mus musculus
gaaggatctcttgagcccagtggtt

SEQ ID NO: 429436 - DNA, 25 bp, Mus musculus
gaaggatcttatccaacagtgtaca

SEQ ID NO: 429437 - DNA, 25 bp, Mus musculus
gaaggatcttatgcaacagtgtaca

SEQ ID NO: 429438 - DNA, 25 bp, Mus musculus
gaaggatcttcgacaacaagcacag

SEQ ID NO: 429439 - DNA, 25 bp, Mus musculus
gaaggatcttcgtcaacaagcacag

SEQ ID NO: 429440 - DNA, 25 bp, Mus musculus
gaaggatcttctcgactaataacca

SEQ ID NO: 429441 - DNA, 25 bp, Mus musculus
gaaggatcttctctaaactctctta

SEQ ID NO: 429442 - DNA, 25 bp, Mus musculus
gaaggatcttctggactaataacca

SEQ ID NO: 429443 - DNA, 25 bp, Mus musculus
gaaggatcttctgtaaactctctta

SEQ ID NO: 429444 - DNA, 25 bp, Mus musculus
gaaggatcttgactttgccgggctt

SEQ ID NO: 429445 - DNA, 25 bp, Mus musculus
gaaggatcttgagtttgccgggctt

SEQ ID NO: 429446 - DNA, 25 bp, Mus musculus
gaaggatctttcaaatgggttgtta

SEQ ID NO: 429447 - DNA, 25 bp, Mus musculus
gaaggatctttctaatgggttgtta

SEQ ID NO: 429448 - DNA, 25 bp, Mus musculus
gaaggatcttttacttcaaggccag

SEQ ID NO: 429449 - DNA, 25 bp, Mus musculus
gaaggatcttttcgtgtgacaccga

SEQ ID NO: 429450 - DNA, 25 bp, Mus musculus
gaaggatcttttggtgtgacaccga

SEQ ID NO: 429451 - DNA, 25 bp, Mus musculus
gaaggatctttttcttcaaggccag

SEQ ID NO: 429452 - DNA, 25 bp, Mus musculus
gaaggatgaaccaacaccctaactt

SEQ ID NO: 429453 - DNA, 25 bp, Mus musculus
gaaggatgaacctacaccctaactt

SEQ ID NO: 429454 - DNA, 25 bp, Mus musculus
gaaggatgacctacgggacatgttt

SEQ ID NO: 429455 - DNA, 25 bp, Mus musculus
gaaggatgaccttcgggacatgttt

SEQ ID NO: 429456 - DNA, 25 bp, Mus musculus
gaaggatgacgtcatgctgcctgcc

SEQ ID NO: 429457 - DNA, 25 bp, Mus musculus
gaaggatgacgtgatgctgcctgcc

SEQ ID NO: 429458 - DNA, 25 bp, Mus musculus
gaaggatgactcacctgtggcctca

SEQ ID NO: 429459 - DNA, 25 bp, Mus musculus
gaaggatgactctcctgtggcctca

SEQ ID NO: 429460 - DNA, 25 bp, Mus musculus
gaaggatgagcactcatccacagaa

SEQ ID NO: 429461 - DNA, 25 bp, Mus musculus
gaaggatgagcagtcatccacagaa

SEQ ID NO: 429462 - DNA, 25 bp, Mus musculus
gaaggatgagggacttataacccac

SEQ ID NO: 429463 - DNA, 25 bp, Mus musculus
gaaggatgagggtcttataacccac

SEQ ID NO: 429464 - DNA, 25 bp, Mus musculus
gaaggatgattcctatgacatgttc

SEQ ID NO: 429465 - DNA, 25 bp, Mus musculus
gaaggatgattcgtatgacatgttc

SEQ ID NO: 429466 - DNA, 25 bp, Mus musculus
gaaggatgcagcacctcttcaggat

SEQ ID NO: 429467 - DNA, 25 bp, Mus musculus
gaaggatgcagctcctcttcaggat

SEQ ID NO: 429468 - DNA, 25 bp, Mus musculus
gaaggatgcatgaatttccccataa

SEQ ID NO: 429469 - DNA, 25 bp, Mus musculus
gaaggatgcatgtatttccccataa

SEQ ID NO: 429470 - DNA, 25 bp, Mus musculus
gaaggatgctaacagcatgcctctg

SEQ ID NO: 429471 - DNA, 25 bp, Mus musculus
gaaggatgctaagagcatgcctctg

SEQ ID NO: 429472 - DNA, 25 bp, Mus musculus
gaaggatgctagactaatactaact

SEQ ID NO: 429473 - DNA, 25 bp, Mus musculus
gaaggatgctagactcagctcgttt

SEQ ID NO: 429474 - DNA, 25 bp, Mus musculus
gaaggatgctagtctaatactaact

SEQ ID NO: 429475 - DNA, 25 bp, Mus musculus
gaaggatgctagtctcagctcgttt

SEQ ID NO: 429476 - DNA, 25 bp, Mus musculus
gaaggatgctgtacctaccatcagg

SEQ ID NO: 429477 - DNA, 25 bp, Mus musculus
gaaggatgctgttcctaccatcagg

SEQ ID NO: 429478 - DNA, 25 bp, Mus musculus
gaaggatgcttccactgagggccca

SEQ ID NO: 429479 - DNA, 25 bp, Mus musculus
gaaggatgcttcgactgagggccca

SEQ ID NO: 429480 - DNA, 25 bp, Mus musculus
gaaggatgctttcccaacactcaga

SEQ ID NO: 429481 - DNA, 25 bp, Mus musculus
gaaggatgctttgccaacactcaga

SEQ ID NO: 429482 - DNA, 25 bp, Mus musculus
gaaggatggcatatgggaatacata

SEQ ID NO: 429483 - DNA, 25 bp, Mus musculus
gaaggatggcatttgggaatacata

SEQ ID NO: 429484 - DNA, 25 bp, Mus musculus
gaaggatggtatactcagtcccctc

SEQ ID NO: 429485 - DNA, 25 bp, Mus musculus
gaaggatggtattctcagtcccctc

SEQ ID NO: 429486 - DNA, 25 bp, Mus musculus
gaaggatggttcacctgccagggcc

SEQ ID NO: 429487 - DNA, 25 bp, Mus musculus
gaaggatggttctcctgccagggcc

SEQ ID NO: 429488 - DNA, 25 bp, Mus musculus
gaaggatgtaccaacgctgcagaca

SEQ ID NO: 429489 - DNA, 25 bp, Mus musculus
gaaggatgtacctacgctgcagaca

SEQ ID NO: 429490 - DNA, 25 bp, Mus musculus
gaaggatgtactcgcccacacgtgt

SEQ ID NO: 429491 - DNA, 25 bp, Mus musculus
gaaggatgtactggcccacacgtgt

SEQ ID NO: 429492 - DNA, 25 bp, Mus musculus
gaaggatgtagtaacccacaagtac

SEQ ID NO: 429493 - DNA, 25 bp, Mus musculus
gaaggatgtagttacccacaagtac

SEQ ID NO: 429494 - DNA, 25 bp, Mus musculus
gaaggatgtcaaagctctgtttgta

SEQ ID NO: 429495 - DNA, 25 bp, Mus musculus
gaaggatgtcaatgctctgtttgta

SEQ ID NO: 429496 - DNA, 25 bp, Mus musculus
gaaggatgtccgcattccaggaaag

SEQ ID NO: 429497 - DNA, 25 bp, Mus musculus
gaaggatgtccggattccaggaaag

SEQ ID NO: 429498 - DNA, 25 bp, Mus musculus
gaaggatgtggcatcctaccacgcc

SEQ ID NO: 429499 - DNA, 25 bp, Mus musculus
gaaggatgtggcttcctaccacgcc

SEQ ID NO: 429500 - DNA, 25 bp, Mus musculus
gaaggatgtgtacttttatctaaaa

SEQ ID NO: 429501 - DNA, 25 bp, Mus musculus
gaaggatgtgtagttttatctaaaa

SEQ ID NO: 429502 - DNA, 25 bp, Mus musculus
gaaggattacctctgtctgtccatc

SEQ ID NO: 429503 - DNA, 25 bp, Mus musculus
gaaggattacctgtgtctgtccatc

SEQ ID NO: 429504 - DNA, 25 bp, Mus musculus
gaaggattatgccttcgttcatttt

SEQ ID NO: 429505 - DNA, 25 bp, Mus musculus
gaaggattatgcgttcgttcatttt

SEQ ID NO: 429506 - DNA, 25 bp, Mus musculus
gaaggattcacaaagaaattccagg

SEQ ID NO: 429507 - DNA, 25 bp, Mus musculus
gaaggattcacatagaaattccagg

SEQ ID NO: 429508 - DNA, 25 bp, Mus musculus
gaaggattcaccatcctagcgaagg

SEQ ID NO: 429509 - DNA, 25 bp, Mus musculus
gaaggattcaccttcctagcgaagg

SEQ ID NO: 429510 - DNA, 25 bp, Mus musculus
gaaggattccttacacaaggcccag

SEQ ID NO: 429511 - DNA, 25 bp, Mus musculus
gaaggattccttatcagtgtggata

SEQ ID NO: 429512 - DNA, 25 bp, Mus musculus
gaaggattcctttcacaaggcccag

SEQ ID NO: 429513 - DNA, 25 bp, Mus musculus
gaaggattccttttcagtgtggata

SEQ ID NO: 429514 - DNA, 25 bp, Mus musculus
gaaggattcgtgcatgcagccccat

SEQ ID NO: 429515 - DNA, 25 bp, Mus musculus
gaaggattcgtggatgcagccccat

SEQ ID NO: 429516 - DNA, 25 bp, Mus musculus
gaaggattctagatgcactgcctcc

SEQ ID NO: 429517 - DNA, 25 bp, Mus musculus
gaaggattctagttgcactgcctcc

SEQ ID NO: 429518 - DNA, 25 bp, Mus musculus
gaaggattcttgacccataacatgg

SEQ ID NO: 429519 - DNA, 25 bp, Mus musculus
gaaggattcttgtcccataacatgg

SEQ ID NO: 429520 - DNA, 25 bp, Mus musculus
gaaggattgaaaaccgctgctaagc

SEQ ID NO: 429521 - DNA, 25 bp, Mus musculus
gaaggattgaaatccgctgctaagc

SEQ ID NO: 429522 - DNA, 25 bp, Mus musculus
gaaggattgcagctcactcctaagc

SEQ ID NO: 429523 - DNA, 25 bp, Mus musculus
gaaggattgcaggtcactcctaagc

SEQ ID NO: 429524 - DNA, 25 bp, Mus musculus
gaaggattgccaactgtggtgccat

SEQ ID NO: 429525 - DNA, 25 bp, Mus musculus
gaaggattgccatctgtggtgccat

SEQ ID NO: 429526 - DNA, 25 bp, Mus musculus
gaaggattgcctcagcagcaaggta

SEQ ID NO: 429527 - DNA, 25 bp, Mus musculus
gaaggattgcctgagcagcaaggta

SEQ ID NO: 429528 - DNA, 25 bp, Mus musculus
gaaggatttataactcctcctgtgg

SEQ ID NO: 429529 - DNA, 25 bp, Mus musculus
gaaggatttatatctcctcctgtgg

SEQ ID NO: 429530 - DNA, 25 bp, Mus musculus
gaaggatttccacgctcatgactag

SEQ ID NO: 429531 - DNA, 25 bp, Mus musculus
gaaggatttccaggctcatgactag

SEQ ID NO: 429532 - DNA, 25 bp, Mus musculus
gaaggatttcccaatgtgctccaag

SEQ ID NO: 429533 - DNA, 25 bp, Mus musculus
gaaggatttccctatgtgctccaag

SEQ ID NO: 429534 - DNA, 25 bp, Mus musculus
gaaggatttcggcatccagccagtg

SEQ ID NO: 429535 - DNA, 25 bp, Mus musculus
gaaggatttcgggatccagccagtg

SEQ ID NO: 429536 - DNA, 25 bp, Mus musculus
gaaggatttctacagcatgatgcac

SEQ ID NO: 429537 - DNA, 25 bp, Mus musculus
gaaggatttctagagcatgatgcac

SEQ ID NO: 429538 - DNA, 25 bp, Mus musculus
gaaggatttctgcttccagttccgg

SEQ ID NO: 429539 - DNA, 25 bp, Mus musculus
gaaggatttctggttccagttccgg

SEQ ID NO: 429540 - DNA, 25 bp, Mus musculus
gaaggatttgccaacactgaaaaga

SEQ ID NO: 429541 - DNA, 25 bp, Mus musculus
gaaggatttgcctacactgaaaaga

SEQ ID NO: 429542 - DNA, 25 bp, Mus musculus
gaaggatttgctctgttctaacatt

SEQ ID NO: 429543 - DNA, 25 bp, Mus musculus
gaaggatttgctgtgttctaacatt

SEQ ID NO: 429544 - DNA, 25 bp, Mus musculus
gaaggattttaacgccattgcctgg

SEQ ID NO: 429545 - DNA, 25 bp, Mus musculus
gaaggattttaaggccattgcctgg

SEQ ID NO: 429546 - DNA, 25 bp, Mus musculus
gaaggattttcaatgctgtatgtca

SEQ ID NO: 429547 - DNA, 25 bp, Mus musculus
gaaggattttcattgctgtatgtca

SEQ ID NO: 429548 - DNA, 25 bp, Mus musculus
gaaggattttccatatcccaaatta

SEQ ID NO: 429549 - DNA, 25 bp, Mus musculus
gaaggattttccttatcccaaatta

SEQ ID NO: 429550 - DNA, 25 bp, Mus musculus
gaaggattttctacactaatgcaca

SEQ ID NO: 429551 - DNA, 25 bp, Mus musculus
gaaggattttcttcactaatgcaca

SEQ ID NO: 429552 - DNA, 25 bp, Mus musculus
gaaggatttttcacagtctgagcaa

SEQ ID NO: 429553 - DNA, 25 bp, Mus musculus
gaaggatttttcctagactgcggat

SEQ ID NO: 429554 - DNA, 25 bp, Mus musculus
gaaggatttttcgtagactgcggat

SEQ ID NO: 429555 - DNA, 25 bp, Mus musculus
gaaggatttttctcagtctgagcaa

SEQ ID NO: 429556 - DNA, 25 bp, Mus musculus
gaaggcaaaatgcttcccgttgttt

SEQ ID NO: 429557 - DNA, 25 bp, Mus musculus
gaaggcaaaatggttcccgttgttt

SEQ ID NO: 429558 - DNA, 25 bp, Mus musculus
gaaggcaaaccgaatcacagagcta

SEQ ID NO: 429559 - DNA, 25 bp, Mus musculus
gaaggcaaaccgtatcacagagcta

SEQ ID NO: 429560 - DNA, 25 bp, Mus musculus
gaaggcaaacggaagctgcagattg

SEQ ID NO: 429561 - DNA, 25 bp, Mus musculus
gaaggcaaacggtagctgcagattg

SEQ ID NO: 429562 - DNA, 25 bp, Mus musculus
gaaggcaaactgctctacttgtggt

SEQ ID NO: 429563 - DNA, 25 bp, Mus musculus
gaaggcaaactggtctacttgtggt

SEQ ID NO: 429564 - DNA, 25 bp, Mus musculus
gaaggcaaagccagtagctactact

SEQ ID NO: 429565 - DNA, 25 bp, Mus musculus
gaaggcaaagcctgtagctactact

SEQ ID NO: 429566 - DNA, 25 bp, Mus musculus
gaaggcaaaggacccaacctgcagc

SEQ ID NO: 429567 - DNA, 25 bp, Mus musculus
gaaggcaaaggagccaacctgcagc

SEQ ID NO: 429568 - DNA, 25 bp, Mus musculus
gaaggcaaaggcaccatggctggct

SEQ ID NO: 429569 - DNA, 25 bp, Mus musculus
gaaggcaaaggctccatggctggct

SEQ ID NO: 429570 - DNA, 25 bp, Mus musculus
gaaggcaaagtaagtctgactgcat

SEQ ID NO: 429571 - DNA, 25 bp, Mus musculus
gaaggcaaagtatgtctgactgcat

SEQ ID NO: 429572 - DNA, 25 bp, Mus musculus
gaaggcaaatcaactcctagtcttg

SEQ ID NO: 429573 - DNA, 25 bp, Mus musculus
gaaggcaaatcatctcctagtcttg

SEQ ID NO: 429574 - DNA, 25 bp, Mus musculus
gaaggcaaattaacagaggctggga

SEQ ID NO: 429575 - DNA, 25 bp, Mus musculus
gaaggcaaattatcagaggctggga

SEQ ID NO: 429576 - DNA, 25 bp, Mus musculus
gaaggcaacaacaaaggccccaggt

SEQ ID NO: 429577 - DNA, 25 bp, Mus musculus
gaaggcaacaactaaggccccaggt

SEQ ID NO: 429578 - DNA, 25 bp, Mus musculus
gaaggcaacactcgctttgggcagc

SEQ ID NO: 429579 - DNA, 25 bp, Mus musculus
gaaggcaacactggctttgggcagc

SEQ ID NO: 429580 - DNA, 25 bp, Mus musculus
gaaggcaaccccatctggatggatc

SEQ ID NO: 429581 - DNA, 25 bp, Mus musculus
gaaggcaaccccttctggatggatc

SEQ ID NO: 429582 - DNA, 25 bp, Mus musculus
gaaggcaaccttagaacgctctttg

SEQ ID NO: 429583 - DNA, 25 bp, Mus musculus
gaaggcaaccttcatgggcaagatc

SEQ ID NO: 429584 - DNA, 25 bp, Mus musculus
gaaggcaaccttcggcattgttcct

SEQ ID NO: 429585 - DNA, 25 bp, Mus musculus
gaaggcaaccttgatgggcaagatc

SEQ ID NO: 429586 - DNA, 25 bp, Mus musculus
gaaggcaaccttgggcattgttcct

SEQ ID NO: 429587 - DNA, 25 bp, Mus musculus
gaaggcaacctttgaacgctctttg

SEQ ID NO: 429588 - DNA, 25 bp, Mus musculus
gaaggcaacgctcagacagctggtc

SEQ ID NO: 429589 - DNA, 25 bp, Mus musculus
gaaggcaacgctgagacagctggtc

SEQ ID NO: 429590 - DNA, 25 bp, Mus musculus
gaaggcaactcactctcctcttctt

SEQ ID NO: 429591 - DNA, 25 bp, Mus musculus
gaaggcaactcagtctcctcttctt

SEQ ID NO: 429592 - DNA, 25 bp, Mus musculus
gaaggcaactttctgctcatagagc

SEQ ID NO: 429593 - DNA, 25 bp, Mus musculus
gaaggcaactttgtgctcatagagc

SEQ ID NO: 429594 - DNA, 25 bp, Mus musculus
gaaggcaagaaacccacagtagcat

SEQ ID NO: 429595 - DNA, 25 bp, Mus musculus
gaaggcaagaaagccacagtagcat

SEQ ID NO: 429596 - DNA, 25 bp, Mus musculus
gaaggcaagacgcattccacatctt

SEQ ID NO: 429597 - DNA, 25 bp, Mus musculus
gaaggcaagacggattccacatctt

SEQ ID NO: 429598 - DNA, 25 bp, Mus musculus
gaaggcaagagaaccctgggaactg

SEQ ID NO: 429599 - DNA, 25 bp, Mus musculus
gaaggcaagagatccctgggaactg

SEQ ID NO: 429600 - DNA, 25 bp, Mus musculus
gaaggcaagcaactccacataccta

SEQ ID NO: 429601 - DNA, 25 bp, Mus musculus
gaaggcaagcaagtccacataccta

SEQ ID NO: 429602 - DNA, 25 bp, Mus musculus
gaaggcaagcaccatctttgtttat

SEQ ID NO: 429603 - DNA, 25 bp, Mus musculus
gaaggcaagcacgatctttgtttat

SEQ ID NO: 429604 - DNA, 25 bp, Mus musculus
gaaggcaagcatccaggttcatctg

SEQ ID NO: 429605 - DNA, 25 bp, Mus musculus
gaaggcaagcatgcaggttcatctg

SEQ ID NO: 429606 - DNA, 25 bp, Mus musculus
gaaggcaagccacgttacctcgggc

SEQ ID NO: 429607 - DNA, 25 bp, Mus musculus
gaaggcaagccaggttacctcgggc

SEQ ID NO: 429608 - DNA, 25 bp, Mus musculus
gaaggcaagccgcaaacacaagtct

SEQ ID NO: 429609 - DNA, 25 bp, Mus musculus
gaaggcaagccggaaacacaagtct

SEQ ID NO: 429610 - DNA, 25 bp, Mus musculus
gaaggcaagctactctcataacttt

SEQ ID NO: 429611 - DNA, 25 bp, Mus musculus
gaaggcaagctagtctcataacttt

SEQ ID NO: 429612 - DNA, 25 bp, Mus musculus
gaaggcaaggaacgctatgtccaaa

SEQ ID NO: 429613 - DNA, 25 bp, Mus musculus
gaaggcaaggaaggctatgtccaaa

SEQ ID NO: 429614 - DNA, 25 bp, Mus musculus
gaaggcaaggatacagttgtctact

SEQ ID NO: 429615 - DNA, 25 bp, Mus musculus
gaaggcaaggattcagttgtctact

SEQ ID NO: 429616 - DNA, 25 bp, Mus musculus
gaaggcaataggactgcccgaggac

SEQ ID NO: 429617 - DNA, 25 bp, Mus musculus
gaaggcaataggtctgcccgaggac

SEQ ID NO: 429618 - DNA, 25 bp, Mus musculus
gaaggcaatatcactccagaccaga

SEQ ID NO: 429619 - DNA, 25 bp, Mus musculus
gaaggcaatatctctccagaccaga

SEQ ID NO: 429620 - DNA, 25 bp, Mus musculus
gaaggcaatcccagcagtgtaactt

SEQ ID NO: 429621 - DNA, 25 bp, Mus musculus
gaaggcaatccctgcagtgtaactt

SEQ ID NO: 429622 - DNA, 25 bp, Mus musculus
gaaggcaatcttcagcttaagtgtt

SEQ ID NO: 429623 - DNA, 25 bp, Mus musculus
gaaggcaatcttgagcttaagtgtt

SEQ ID NO: 429624 - DNA, 25 bp, Mus musculus
gaaggcaatgacaagactgaacaaa

SEQ ID NO: 429625 - DNA, 25 bp, Mus musculus
gaaggcaatgacacgattatgtgcg

SEQ ID NO: 429626 - DNA, 25 bp, Mus musculus
gaaggcaatgactagactgaacaaa

SEQ ID NO: 429627 - DNA, 25 bp, Mus musculus
gaaggcaatgactcgattatgtgcg

SEQ ID NO: 429628 - DNA, 25 bp, Mus musculus
gaaggcaatgctctcctactattat

SEQ ID NO: 429629 - DNA, 25 bp, Mus musculus
gaaggcaatgctgtcctactattat

SEQ ID NO: 429630 - DNA, 25 bp, Mus musculus
gaaggcaatgggatggcgtcctttt

SEQ ID NO: 429631 - DNA, 25 bp, Mus musculus
gaaggcaatgggttggcgtcctttt

SEQ ID NO: 429632 - DNA, 25 bp, Mus musculus
gaaggcaattatcctgattgtatgt

SEQ ID NO: 429633 - DNA, 25 bp, Mus musculus
gaaggcaattatgctgattgtatgt

SEQ ID NO: 429634 - DNA, 25 bp, Mus musculus
gaaggcaattttagcccattaaatg

SEQ ID NO: 429635 - DNA, 25 bp, Mus musculus
gaaggcaatttttgcccattaaatg

SEQ ID NO: 429636 - DNA, 25 bp, Mus musculus
gaaggcacaagtagactgtacatca

SEQ ID NO: 429637 - DNA, 25 bp, Mus musculus
gaaggcacaagttgactgtacatca

SEQ ID NO: 429638 - DNA, 25 bp, Mus musculus
gaaggcacaataatctctgtcatct

SEQ ID NO: 429639 - DNA, 25 bp, Mus musculus
gaaggcacaatattctctgtcatct

SEQ ID NO: 429640 - DNA, 25 bp, Mus musculus
gaaggcacacaactgggctattgtt

SEQ ID NO: 429641 - DNA, 25 bp, Mus musculus
gaaggcacacaagtgggctattgtt

SEQ ID NO: 429642 - DNA, 25 bp, Mus musculus
gaaggcacactacctctgcagagga

SEQ ID NO: 429643 - DNA, 25 bp, Mus musculus
gaaggcacactagctctgcagagga

SEQ ID NO: 429644 - DNA, 25 bp, Mus musculus
gaaggcacagctacaccaggagctt

SEQ ID NO: 429645 - DNA, 25 bp, Mus musculus
gaaggcacagctacagttgtggcct

SEQ ID NO: 429646 - DNA, 25 bp, Mus musculus
gaaggcacagcttcaccaggagctt

SEQ ID NO: 429647 - DNA, 25 bp, Mus musculus
gaaggcacagcttcagttgtggcct

SEQ ID NO: 429648 - DNA, 25 bp, Mus musculus
gaaggcacagtaatgtagcagcact

SEQ ID NO: 429649 - DNA, 25 bp, Mus musculus
gaaggcacagtattgtagcagcact

SEQ ID NO: 429650 - DNA, 25 bp, Mus musculus
gaaggcacatagacattccctgatt

SEQ ID NO: 429651 - DNA, 25 bp, Mus musculus
gaaggcacatagtcattccctgatt

SEQ ID NO: 429652 - DNA, 25 bp, Mus musculus
gaaggcacatcacgacaaccctcat

SEQ ID NO: 429653 - DNA, 25 bp, Mus musculus
gaaggcacatcaggacaaccctcat

SEQ ID NO: 429654 - DNA, 25 bp, Mus musculus
gaaggcacattcagaggtcccagta

SEQ ID NO: 429655 - DNA, 25 bp, Mus musculus
gaaggcacattctgaggtcccagta

SEQ ID NO: 429656 - DNA, 25 bp, Mus musculus
gaaggcaccacacgatctctcctga

SEQ ID NO: 429657 - DNA, 25 bp, Mus musculus
gaaggcaccacaggatctctcctga

SEQ ID NO: 429658 - DNA, 25 bp, Mus musculus
gaaggcaccatacaatcttccaaag

SEQ ID NO: 429659 - DNA, 25 bp, Mus musculus
gaaggcaccatagaatcttccaaag

SEQ ID NO: 429660 - DNA, 25 bp, Mus musculus
gaaggcaccatcagcactaagggta

SEQ ID NO: 429661 - DNA, 25 bp, Mus musculus
gaaggcaccatctgcactaagggta

SEQ ID NO: 429662 - DNA, 25 bp, Mus musculus
gaaggcacccagagactgcatggtt

SEQ ID NO: 429663 - DNA, 25 bp, Mus musculus
gaaggcacccagtgactgcatggtt

SEQ ID NO: 429664 - DNA, 25 bp, Mus musculus
gaaggcaccgtccatggtagccgct

SEQ ID NO: 429665 - DNA, 25 bp, Mus musculus
gaaggcaccgtcgatggtagccgct

SEQ ID NO: 429666 - DNA, 25 bp, Mus musculus
gaaggcacctctcgaattctaggcc

SEQ ID NO: 429667 - DNA, 25 bp, Mus musculus
gaaggcacctctggaattctaggcc

SEQ ID NO: 429668 - DNA, 25 bp, Mus musculus
gaaggcacctgacaaccaaaaactt

SEQ ID NO: 429669 - DNA, 25 bp, Mus musculus
gaaggcacctgagaaccaaaaactt

SEQ ID NO: 429670 - DNA, 25 bp, Mus musculus
gaaggcaccttgatccatggagttt

SEQ ID NO: 429671 - DNA, 25 bp, Mus musculus
gaaggcaccttgttccatggagttt

SEQ ID NO: 429672 - DNA, 25 bp, Mus musculus
gaaggcacctttcctctgtagacaa

SEQ ID NO: 429673 - DNA, 25 bp, Mus musculus
gaaggcacctttgctctgtagacaa

SEQ ID NO: 429674 - DNA, 25 bp, Mus musculus
gaaggcacgagaacctagctcctga

SEQ ID NO: 429675 - DNA, 25 bp, Mus musculus
gaaggcacgagatcctagctcctga

SEQ ID NO: 429676 - DNA, 25 bp, Mus musculus
gaaggcacgaggcttcctgcctctt

SEQ ID NO: 429677 - DNA, 25 bp, Mus musculus
gaaggcacgagggttcctgcctctt

SEQ ID NO: 429678 - DNA, 25 bp, Mus musculus
gaaggcacgagtcagggtcaaatat

SEQ ID NO: 429679 - DNA, 25 bp, Mus musculus
gaaggcacgagtgagggtcaaatat

SEQ ID NO: 429680 - DNA, 25 bp, Mus musculus
gaaggcacggtaacagttggaacaa

SEQ ID NO: 429681 - DNA, 25 bp, Mus musculus
gaaggcacggtatcagttggaacaa

SEQ ID NO: 429682 - DNA, 25 bp, Mus musculus
gaaggcacgtggcttccctgtgttt

SEQ ID NO: 429683 - DNA, 25 bp, Mus musculus
gaaggcacgtgggttccctgtgttt

SEQ ID NO: 429684 - DNA, 25 bp, Mus musculus
gaaggcactagacctcaatcctgga

SEQ ID NO: 429685 - DNA, 25 bp, Mus musculus
gaaggcactagagctcaatcctgga

SEQ ID NO: 429686 - DNA, 25 bp, Mus musculus
gaaggcactcatacattttattctc

SEQ ID NO: 429687 - DNA, 25 bp, Mus musculus
gaaggcactcattcattttattctc

SEQ ID NO: 429688 - DNA, 25 bp, Mus musculus
gaaggcactcggctagctagcgaat

SEQ ID NO: 429689 - DNA, 25 bp, Mus musculus
gaaggcactcgggtagctagcgaat

SEQ ID NO: 429690 - DNA, 25 bp, Mus musculus
gaaggcactgccacacagtgtatct

SEQ ID NO: 429691 - DNA, 25 bp, Mus musculus
gaaggcactgccatgacaaccctag

SEQ ID NO: 429692 - DNA, 25 bp, Mus musculus
gaaggcactgcctcacagtgtatct

SEQ ID NO: 429693 - DNA, 25 bp, Mus musculus
gaaggcactgccttgacaaccctag

SEQ ID NO: 429694 - DNA, 25 bp, Mus musculus
gaaggcactgctagtataagtgtga

SEQ ID NO: 429695 - DNA, 25 bp, Mus musculus
gaaggcactgcttgtataagtgtga

SEQ ID NO: 429696 - DNA, 25 bp, Mus musculus
gaaggcactggacttgctgcccaag

SEQ ID NO: 429697 - DNA, 25 bp, Mus musculus
gaaggcactggagttgctgcccaag

SEQ ID NO: 429698 - DNA, 25 bp, Mus musculus
gaaggcactggccacagaccctgtg

SEQ ID NO: 429699 - DNA, 25 bp, Mus musculus
gaaggcactggcgacagaccctgtg

SEQ ID NO: 429700 - DNA, 25 bp, Mus musculus
gaaggcactgttcgtgtctgccaac

SEQ ID NO: 429701 - DNA, 25 bp, Mus musculus
gaaggcactgttctgggacgcacaa

SEQ ID NO: 429702 - DNA, 25 bp, Mus musculus
gaaggcactgttggtgtctgccaac

SEQ ID NO: 429703 - DNA, 25 bp, Mus musculus
gaaggcactgttgtgggacgcacaa

SEQ ID NO: 429704 - DNA, 25 bp, Mus musculus
gaaggcacttctcgatccagctgtt

SEQ ID NO: 429705 - DNA, 25 bp, Mus musculus
gaaggcacttctggatccagctgtt

SEQ ID NO: 429706 - DNA, 25 bp, Mus musculus
gaaggcacttgtcacccagataagg

SEQ ID NO: 429707 - DNA, 25 bp, Mus musculus
gaaggcacttgtgacccagataagg

SEQ ID NO: 429708 - DNA, 25 bp, Mus musculus
gaaggcactttgacagtacatcaca

SEQ ID NO: 429709 - DNA, 25 bp, Mus musculus
gaaggcactttgtcagtacatcaca

SEQ ID NO: 429710 - DNA, 25 bp, Mus musculus
gaaggcagacccctaccagtatgtg

SEQ ID NO: 429711 - DNA, 25 bp, Mus musculus
gaaggcagacccgtaccagtatgtg

SEQ ID NO: 429712 - DNA, 25 bp, Mus musculus
gaaggcagaccgaaaccacgagaag

SEQ ID NO: 429713 - DNA, 25 bp, Mus musculus
gaaggcagaccgtaaccacgagaag

SEQ ID NO: 429714 - DNA, 25 bp, Mus musculus
gaaggcagactcattgtcatgggat

SEQ ID NO: 429715 - DNA, 25 bp, Mus musculus
gaaggcagactctttgtcatgggat

SEQ ID NO: 429716 - DNA, 25 bp, Mus musculus
gaaggcagagacatccacacggcac

SEQ ID NO: 429717 - DNA, 25 bp, Mus musculus
gaaggcagagacttccacacggcac

SEQ ID NO: 429718 - DNA, 25 bp, Mus musculus
gaaggcagagcgaagccccgtacat

SEQ ID NO: 429719 - DNA, 25 bp, Mus musculus
gaaggcagagcgtagccccgtacat

SEQ ID NO: 429720 - DNA, 25 bp, Mus musculus
gaaggcagagctccgaatgctcaac

SEQ ID NO: 429721 - DNA, 25 bp, Mus musculus
gaaggcagagctgcgaatgctcaac

SEQ ID NO: 429722 - DNA, 25 bp, Mus musculus
gaaggcagatccctagagctcttga

SEQ ID NO: 429723 - DNA, 25 bp, Mus musculus
gaaggcagatccgtagagctcttga

SEQ ID NO: 429724 - DNA, 25 bp, Mus musculus
gaaggcagcaacaaaagtagtggaa

SEQ ID NO: 429725 - DNA, 25 bp, Mus musculus
gaaggcagcaaccgttggaatctta

SEQ ID NO: 429726 - DNA, 25 bp, Mus musculus
gaaggcagcaacggttggaatctta

SEQ ID NO: 429727 - DNA, 25 bp, Mus musculus
gaaggcagcaactaaagtagtggaa

SEQ ID NO: 429728 - DNA, 25 bp, Mus musculus
gaaggcagcacaaatccaaatttat

SEQ ID NO: 429729 - DNA, 25 bp, Mus musculus
gaaggcagcacatatccaaatttat

SEQ ID NO: 429730 - DNA, 25 bp, Mus musculus
gaaggcagcagacgtctacacccgg

SEQ ID NO: 429731 - DNA, 25 bp, Mus musculus
gaaggcagcagaggtctacacccgg

SEQ ID NO: 429732 - DNA, 25 bp, Mus musculus
gaaggcagccagagtaatacctaca

SEQ ID NO: 429733 - DNA, 25 bp, Mus musculus
gaaggcagccagtgtaatacctaca

SEQ ID NO: 429734 - DNA, 25 bp, Mus musculus
gaaggcagccatactgtgaccgctt

SEQ ID NO: 429735 - DNA, 25 bp, Mus musculus
gaaggcagccatcctaggcttctgt

SEQ ID NO: 429736 - DNA, 25 bp, Mus musculus
gaaggcagccatgctaggcttctgt

SEQ ID NO: 429737 - DNA, 25 bp, Mus musculus
gaaggcagccattctgtgaccgctt

SEQ ID NO: 429738 - DNA, 25 bp, Mus musculus
gaaggcagcccacgaggagtacatc

SEQ ID NO: 429739 - DNA, 25 bp, Mus musculus
gaaggcagcccaggaggagtacatc

SEQ ID NO: 429740 - DNA, 25 bp, Mus musculus
gaaggcagcccgcacagatatctgg

SEQ ID NO: 429741 - DNA, 25 bp, Mus musculus
gaaggcagcccggacagatatctgg

SEQ ID NO: 429742 - DNA, 25 bp, Mus musculus
gaaggcagcctacactgcttgctga

SEQ ID NO: 429743 - DNA, 25 bp, Mus musculus
gaaggcagcctagactgcttgctga

SEQ ID NO: 429744 - DNA, 25 bp, Mus musculus
gaaggcagcgagcatgaacactctg

SEQ ID NO: 429745 - DNA, 25 bp, Mus musculus
gaaggcagcgaggatgaacactctg

SEQ ID NO: 429746 - DNA, 25 bp, Mus musculus
gaaggcagctacaccttggaggagc

SEQ ID NO: 429747 - DNA, 25 bp, Mus musculus
gaaggcagctactccttggaggagc

SEQ ID NO: 429748 - DNA, 25 bp, Mus musculus
gaaggcagctctcaaggcagaccaa

SEQ ID NO: 429749 - DNA, 25 bp, Mus musculus
gaaggcagctctgaaggcagaccaa

SEQ ID NO: 429750 - DNA, 25 bp, Mus musculus
gaaggcagctggacatgataaccct

SEQ ID NO: 429751 - DNA, 25 bp, Mus musculus
gaaggcagctggtcatgataaccct

SEQ ID NO: 429752 - DNA, 25 bp, Mus musculus
gaaggcagcttcctatatgcagcgt

SEQ ID NO: 429753 - DNA, 25 bp, Mus musculus
gaaggcagcttcgtatatgcagcgt

SEQ ID NO: 429754 - DNA, 25 bp, Mus musculus
gaaggcagcttgatccctagtaaat

SEQ ID NO: 429755 - DNA, 25 bp, Mus musculus
gaaggcagcttgttccctagtaaat

SEQ ID NO: 429756 - DNA, 25 bp, Mus musculus
gaaggcaggcaaatcgtttagcagt

SEQ ID NO: 429757 - DNA, 25 bp, Mus musculus
gaaggcaggcaattcgtttagcagt

SEQ ID NO: 429758 - DNA, 25 bp, Mus musculus
gaaggcaggcacacgagagagaact

SEQ ID NO: 429759 - DNA, 25 bp, Mus musculus
gaaggcaggcactcgagagagaact

SEQ ID NO: 429760 - DNA, 25 bp, Mus musculus
gaaggcaggcatctctggttgtaca

SEQ ID NO: 429761 - DNA, 25 bp, Mus musculus
gaaggcaggcatgtctggttgtaca

SEQ ID NO: 429762 - DNA, 25 bp, Mus musculus
gaaggcaggcctcatggacaccttt

SEQ ID NO: 429763 - DNA, 25 bp, Mus musculus
gaaggcaggcctgatggacaccttt

SEQ ID NO: 429764 - DNA, 25 bp, Mus musculus
gaaggcaggcggacccgtctatcag

SEQ ID NO: 429765 - DNA, 25 bp, Mus musculus
gaaggcaggcggtcccgtctatcag

SEQ ID NO: 429766 - DNA, 25 bp, Mus musculus
gaaggcagggacaatggcctcctca

SEQ ID NO: 429767 - DNA, 25 bp, Mus musculus
gaaggcagggactatggcctcctca

SEQ ID NO: 429768 - DNA, 25 bp, Mus musculus
gaaggcaggttcacttgacaaaaca

SEQ ID NO: 429769 - DNA, 25 bp, Mus musculus
gaaggcaggttctcttgacaaaaca

SEQ ID NO: 429770 - DNA, 25 bp, Mus musculus
gaaggcagtaagcacgctacctggc

SEQ ID NO: 429771 - DNA, 25 bp, Mus musculus
gaaggcagtaaggacgctacctggc

SEQ ID NO: 429772 - DNA, 25 bp, Mus musculus
gaaggcagtctaccatcaccaacat

SEQ ID NO: 429773 - DNA, 25 bp, Mus musculus
gaaggcagtctagcatcaccaacat

SEQ ID NO: 429774 - DNA, 25 bp, Mus musculus
gaaggcagtctcctggtccctgaga

SEQ ID NO: 429775 - DNA, 25 bp, Mus musculus
gaaggcagtctcgtggtccctgaga

SEQ ID NO: 429776 - DNA, 25 bp, Mus musculus
gaaggcagtcttacctgttgtaaat

SEQ ID NO: 429777 - DNA, 25 bp, Mus musculus
gaaggcagtcttactcccaagctgg

SEQ ID NO: 429778 - DNA, 25 bp, Mus musculus
gaaggcagtctttcctgttgtaaat

SEQ ID NO: 429779 - DNA, 25 bp, Mus musculus
gaaggcagtctttctcccaagctgg

SEQ ID NO: 429780 - DNA, 25 bp, Mus musculus
gaaggcagtgaacgctttagtcatc

SEQ ID NO: 429781 - DNA, 25 bp, Mus musculus
gaaggcagtgaaggctttagtcatc

SEQ ID NO: 429782 - DNA, 25 bp, Mus musculus
gaaggcagtggcatgcaatccagaa

SEQ ID NO: 429783 - DNA, 25 bp, Mus musculus
gaaggcagtggcttgcaatccagaa

SEQ ID NO: 429784 - DNA, 25 bp, Mus musculus
gaaggcagtggtccgtttccgtttc

SEQ ID NO: 429785 - DNA, 25 bp, Mus musculus
gaaggcagtggtgcgtttccgtttc

SEQ ID NO: 429786 - DNA, 25 bp, Mus musculus
gaaggcagttgcacccctacaacct

SEQ ID NO: 429787 - DNA, 25 bp, Mus musculus
gaaggcagttgctcccctacaacct

SEQ ID NO: 429788 - DNA, 25 bp, Mus musculus
gaaggcagttgtcacactgttaagt

SEQ ID NO: 429789 - DNA, 25 bp, Mus musculus
gaaggcagttgtgacactgttaagt

SEQ ID NO: 429790 - DNA, 25 bp, Mus musculus
gaaggcagttttcattttcctggaa

SEQ ID NO: 429791 - DNA, 25 bp, Mus musculus
gaaggcagttttgattttcctggaa

SEQ ID NO: 429792 - DNA, 25 bp, Mus musculus
gaaggcatagctaacctgggcttag

SEQ ID NO: 429793 - DNA, 25 bp, Mus musculus
gaaggcatagcttacctgggcttag

SEQ ID NO: 429794 - DNA, 25 bp, Mus musculus
gaaggcatagttccacatgcctaca

SEQ ID NO: 429795 - DNA, 25 bp, Mus musculus
gaaggcatagttgcacatgcctaca

SEQ ID NO: 429796 - DNA, 25 bp, Mus musculus
gaaggcatatctaaccaacctgtat

SEQ ID NO: 429797 - DNA, 25 bp, Mus musculus
gaaggcatatcttaccaacctgtat

SEQ ID NO: 429798 - DNA, 25 bp, Mus musculus
gaaggcatatgtacgactggctcct

SEQ ID NO: 429799 - DNA, 25 bp, Mus musculus
gaaggcatatgttcgactggctcct

SEQ ID NO: 429800 - DNA, 25 bp, Mus musculus
gaaggcatatttacactttgtactg

SEQ ID NO: 429801 - DNA, 25 bp, Mus musculus
gaaggcatatttcgttccactaaat

SEQ ID NO: 429802 - DNA, 25 bp, Mus musculus
gaaggcatatttggttccactaaat

SEQ ID NO: 429803 - DNA, 25 bp, Mus musculus
gaaggcatattttcactttgtactg

SEQ ID NO: 429804 - DNA, 25 bp, Mus musculus
gaaggcatcacgagagcatgatact

SEQ ID NO: 429805 - DNA, 25 bp, Mus musculus
gaaggcatcacgtgagcatgatact

SEQ ID NO: 429806 - DNA, 25 bp, Mus musculus
gaaggcatcagaaaccctgaaactg

SEQ ID NO: 429807 - DNA, 25 bp, Mus musculus
gaaggcatcagataccctgaaactg

SEQ ID NO: 429808 - DNA, 25 bp, Mus musculus
gaaggcatcattctatagactctgg

SEQ ID NO: 429809 - DNA, 25 bp, Mus musculus
gaaggcatcattgtatagactctgg

SEQ ID NO: 429810 - DNA, 25 bp, Mus musculus
gaaggcatccctcgagtggtttctt

SEQ ID NO: 429811 - DNA, 25 bp, Mus musculus
gaaggcatccctctcaatgtttgcg

SEQ ID NO: 429812 - DNA, 25 bp, Mus musculus
gaaggcatccctggagtggtttctt

SEQ ID NO: 429813 - DNA, 25 bp, Mus musculus
gaaggcatccctgtcaatgtttgcg

SEQ ID NO: 429814 - DNA, 25 bp, Mus musculus
gaaggcatccttactgcaggagctc

SEQ ID NO: 429815 - DNA, 25 bp, Mus musculus
gaaggcatccttccaaatctaagat

SEQ ID NO: 429816 - DNA, 25 bp, Mus musculus
gaaggcatccttgcaaatctaagat

SEQ ID NO: 429817 - DNA, 25 bp, Mus musculus
gaaggcatcctttctgcaggagctc

SEQ ID NO: 429818 - DNA, 25 bp, Mus musculus
gaaggcatctccatagctcaaataa

SEQ ID NO: 429819 - DNA, 25 bp, Mus musculus
gaaggcatctccttagctcaaataa

SEQ ID NO: 429820 - DNA, 25 bp, Mus musculus
gaaggcatctgaactcttggaatta

SEQ ID NO: 429821 - DNA, 25 bp, Mus musculus
gaaggcatctgatctcttggaatta

SEQ ID NO: 429822 - DNA, 25 bp, Mus musculus
gaaggcatctgtcagtttagaaaga

SEQ ID NO: 429823 - DNA, 25 bp, Mus musculus
gaaggcatctgtgagtttagaaaga

SEQ ID NO: 429824 - DNA, 25 bp, Mus musculus
gaaggcatcttcatcaaggattcca

SEQ ID NO: 429825 - DNA, 25 bp, Mus musculus
gaaggcatcttccaagtgcttagta

SEQ ID NO: 429826 - DNA, 25 bp, Mus musculus
gaaggcatcttccatggtacatgtt

SEQ ID NO: 429827 - DNA, 25 bp, Mus musculus
gaaggcatcttcgaagtgcttagta

SEQ ID NO: 429828 - DNA, 25 bp, Mus musculus
gaaggcatcttcgatggtacatgtt

SEQ ID NO: 429829 - DNA, 25 bp, Mus musculus
gaaggcatcttcttcaaggattcca

SEQ ID NO: 429830 - DNA, 25 bp, Mus musculus
gaaggcatgacaaccatctcactgt

SEQ ID NO: 429831 - DNA, 25 bp, Mus musculus
gaaggcatgacatccatctcactgt

SEQ ID NO: 429832 - DNA, 25 bp, Mus musculus
gaaggcatgtaactggtgcacattt

SEQ ID NO: 429833 - DNA, 25 bp, Mus musculus
gaaggcatgtaagtggtgcacattt

SEQ ID NO: 429834 - DNA, 25 bp, Mus musculus
gaaggcatgtagatccaacttgtaa

SEQ ID NO: 429835 - DNA, 25 bp, Mus musculus
gaaggcatgtagttccaacttgtaa

SEQ ID NO: 429836 - DNA, 25 bp, Mus musculus
gaaggcatgtcacgtttctctaaca

SEQ ID NO: 429837 - DNA, 25 bp, Mus musculus
gaaggcatgtcaggtttctctaaca

SEQ ID NO: 429838 - DNA, 25 bp, Mus musculus
gaaggcatgtgtagtgacacccaac

SEQ ID NO: 429839 - DNA, 25 bp, Mus musculus
gaaggcatgtgttgtgacacccaac

SEQ ID NO: 429840 - DNA, 25 bp, Mus musculus
gaaggcatgttactctctttctcac

SEQ ID NO: 429841 - DNA, 25 bp, Mus musculus
gaaggcatgttagtctctttctcac

SEQ ID NO: 429842 - DNA, 25 bp, Mus musculus
gaaggcatgttcagatccaaagtgt

SEQ ID NO: 429843 - DNA, 25 bp, Mus musculus
gaaggcatgttccagcccattacat

SEQ ID NO: 429844 - DNA, 25 bp, Mus musculus
gaaggcatgttcgagcccattacat

SEQ ID NO: 429845 - DNA, 25 bp, Mus musculus
gaaggcatgttctgatccaaagtgt

SEQ ID NO: 429846 - DNA, 25 bp, Mus musculus
gaaggcatgtttatcatcctggaaa

SEQ ID NO: 429847 - DNA, 25 bp, Mus musculus
gaaggcatgtttttcatcctggaaa

SEQ ID NO: 429848 - DNA, 25 bp, Mus musculus
gaaggcattcagcaacagctcaggc

SEQ ID NO: 429849 - DNA, 25 bp, Mus musculus
gaaggcattcaggaacagctcaggc

SEQ ID NO: 429850 - DNA, 25 bp, Mus musculus
gaaggcattcccatcaagagcacaa

SEQ ID NO: 429851 - DNA, 25 bp, Mus musculus
gaaggcattcccctgcctacaaaaa

SEQ ID NO: 429852 - DNA, 25 bp, Mus musculus
gaaggcattcccgtgcctacaaaaa

SEQ ID NO: 429853 - DNA, 25 bp, Mus musculus
gaaggcattcccttcaagagcacaa

SEQ ID NO: 429854 - DNA, 25 bp, Mus musculus
gaaggcattcgtactctctgttcag

SEQ ID NO: 429855 - DNA, 25 bp, Mus musculus
gaaggcattcgttctctctgttcag

SEQ ID NO: 429856 - DNA, 25 bp, Mus musculus
gaaggcattctgctcacaagggaga

SEQ ID NO: 429857 - DNA, 25 bp, Mus musculus
gaaggcattctggtcacaagggaga

SEQ ID NO: 429858 - DNA, 25 bp, Mus musculus
gaaggcattgcacagctagcacatt

SEQ ID NO: 429859 - DNA, 25 bp, Mus musculus
gaaggcattgcagagctagcacatt

SEQ ID NO: 429860 - DNA, 25 bp, Mus musculus
gaaggcattgctatagtcagtcatt

SEQ ID NO: 429861 - DNA, 25 bp, Mus musculus
gaaggcattgctttagtcagtcatt

SEQ ID NO: 429862 - DNA, 25 bp, Mus musculus
gaaggcattggtacccctagagatg

SEQ ID NO: 429863 - DNA, 25 bp, Mus musculus
gaaggcattggttcccctagagatg

SEQ ID NO: 429864 - DNA, 25 bp, Mus musculus
gaaggcattgtaattaacacacaga

SEQ ID NO: 429865 - DNA, 25 bp, Mus musculus
gaaggcattgtatttaacacacaga

SEQ ID NO: 429866 - DNA, 25 bp, Mus musculus
gaaggcattgtgacatttgtgtata

SEQ ID NO: 429867 - DNA, 25 bp, Mus musculus
gaaggcattgtgtcatttgtgtata

SEQ ID NO: 429868 - DNA, 25 bp, Mus musculus
gaaggcatttgaacgccaggctcca

SEQ ID NO: 429869 - DNA, 25 bp, Mus musculus
gaaggcatttgaccacttacaacag

SEQ ID NO: 429870 - DNA, 25 bp, Mus musculus
gaaggcatttgagcacttacaacag

SEQ ID NO: 429871 - DNA, 25 bp, Mus musculus
gaaggcatttgatcgccaggctcca

SEQ ID NO: 429872 - DNA, 25 bp, Mus musculus
gaaggcatttggctttaagtcctag

SEQ ID NO: 429873 - DNA, 25 bp, Mus musculus
gaaggcatttgggtttaagtcctag

SEQ ID NO: 429874 - DNA, 25 bp, Mus musculus
gaaggcatttgtacccaaggtgttg

SEQ ID NO: 429875 - DNA, 25 bp, Mus musculus
gaaggcatttgtacctgggtttgtc

SEQ ID NO: 429876 - DNA, 25 bp, Mus musculus
gaaggcatttgttcccaaggtgttg

SEQ ID NO: 429877 - DNA, 25 bp, Mus musculus
gaaggcatttgttcctgggtttgtc

SEQ ID NO: 429878 - DNA, 25 bp, Mus musculus
gaaggcattttgactgaagtaggaa

SEQ ID NO: 429879 - DNA, 25 bp, Mus musculus
gaaggcattttgtctgaagtaggaa

SEQ ID NO: 429880 - DNA, 25 bp, Mus musculus
gaaggcatttttcaatatgatccat

SEQ ID NO: 429881 - DNA, 25 bp, Mus musculus
gaaggcatttttgaatatgatccat

SEQ ID NO: 429882 - DNA, 25 bp, Mus musculus
gaaggccaaaagacactggatcttg

SEQ ID NO: 429883 - DNA, 25 bp, Mus musculus
gaaggccaaaagtcactggatcttg

SEQ ID NO: 429884 - DNA, 25 bp, Mus musculus
gaaggccaaaatattcccctccaag

SEQ ID NO: 429885 - DNA, 25 bp, Mus musculus
gaaggccaaaattttcccctccaag

SEQ ID NO: 429886 - DNA, 25 bp, Mus musculus
gaaggccaacgacatctctgtcatt

SEQ ID NO: 429887 - DNA, 25 bp, Mus musculus
gaaggccaacgagatctctgtcatt

SEQ ID NO: 429888 - DNA, 25 bp, Mus musculus
gaaggccaactactgccaagtccct

SEQ ID NO: 429889 - DNA, 25 bp, Mus musculus
gaaggccaactagtgccaagtccct

SEQ ID NO: 429890 - DNA, 25 bp, Mus musculus
gaaggccaagacacccttgtttctg

SEQ ID NO: 429891 - DNA, 25 bp, Mus musculus
gaaggccaagactcccttgtttctg

SEQ ID NO: 429892 - DNA, 25 bp, Mus musculus
gaaggccaaggaagttcttttctac

SEQ ID NO: 429893 - DNA, 25 bp, Mus musculus
gaaggccaaggatgttcttttctac

SEQ ID NO: 429894 - DNA, 25 bp, Mus musculus
gaaggccaataccatgtccaactac

SEQ ID NO: 429895 - DNA, 25 bp, Mus musculus
gaaggccaatacgatgtccaactac

SEQ ID NO: 429896 - DNA, 25 bp, Mus musculus
gaaggccaatgcactttagtcacca

SEQ ID NO: 429897 - DNA, 25 bp, Mus musculus
gaaggccaatgctctttagtcacca

SEQ ID NO: 429898 - DNA, 25 bp, Mus musculus
gaaggccaatttcaggaccagtctt

SEQ ID NO: 429899 - DNA, 25 bp, Mus musculus
gaaggccaatttgaggaccagtctt

SEQ ID NO: 429900 - DNA, 25 bp, Mus musculus
gaaggccacaaaccacccattgtgt

SEQ ID NO: 429901 - DNA, 25 bp, Mus musculus
gaaggccacaaagcacccattgtgt

SEQ ID NO: 429902 - DNA, 25 bp, Mus musculus
gaaggccacacaataaagagctctt

SEQ ID NO: 429903 - DNA, 25 bp, Mus musculus
gaaggccacacattaaagagctctt

SEQ ID NO: 429904 - DNA, 25 bp, Mus musculus
gaaggccacaggacactcaggaaaa

SEQ ID NO: 429905 - DNA, 25 bp, Mus musculus
gaaggccacaggtcactcaggaaaa

SEQ ID NO: 429906 - DNA, 25 bp, Mus musculus
gaaggccacatacatcaacctcaag

SEQ ID NO: 429907 - DNA, 25 bp, Mus musculus
gaaggccacatagatcaacctcaag

SEQ ID NO: 429908 - DNA, 25 bp, Mus musculus
gaaggccaccatcaaagatgggtct

SEQ ID NO: 429909 - DNA, 25 bp, Mus musculus
gaaggccaccatgaaagatgggtct

SEQ ID NO: 429910 - DNA, 25 bp, Mus musculus
gaaggccactgtacttttagacaga

SEQ ID NO: 429911 - DNA, 25 bp, Mus musculus
gaaggccactgttcttttagacaga

SEQ ID NO: 429912 - DNA, 25 bp, Mus musculus
gaaggccacttcctgtcataggctg

SEQ ID NO: 429913 - DNA, 25 bp, Mus musculus
gaaggccacttcgtgtcataggctg

SEQ ID NO: 429914 - DNA, 25 bp, Mus musculus
gaaggccacttgcactctggctgca

SEQ ID NO: 429915 - DNA, 25 bp, Mus musculus
gaaggccacttggactctggctgca

SEQ ID NO: 429916 - DNA, 25 bp, Mus musculus
gaaggccagaagcacaccttctttg

SEQ ID NO: 429917 - DNA, 25 bp, Mus musculus
gaaggccagaaggacaccttctttg

SEQ ID NO: 429918 - DNA, 25 bp, Mus musculus
gaaggccagacacgtggcacccagt

SEQ ID NO: 429919 - DNA, 25 bp, Mus musculus
gaaggccagacaggtggcacccagt

SEQ ID NO: 429920 - DNA, 25 bp, Mus musculus
gaaggccagatcaacatcgccatgg

SEQ ID NO: 429921 - DNA, 25 bp, Mus musculus
gaaggccagatctacatcgccatgg

SEQ ID NO: 429922 - DNA, 25 bp, Mus musculus
gaaggccagcacattgtcacggcga

SEQ ID NO: 429923 - DNA, 25 bp, Mus musculus
gaaggccagcactttgtcacggcga

SEQ ID NO: 429924 - DNA, 25 bp, Mus musculus
gaaggccagcagacacaacgacagt

SEQ ID NO: 429925 - DNA, 25 bp, Mus musculus
gaaggccagcagtcacaacgacagt

SEQ ID NO: 429926 - DNA, 25 bp, Mus musculus
gaaggccaggagatgtttcccagga

SEQ ID NO: 429927 - DNA, 25 bp, Mus musculus
gaaggccaggagttgtttcccagga

SEQ ID NO: 429928 - DNA, 25 bp, Mus musculus
gaaggccagggtattacacacatgc

SEQ ID NO: 429929 - DNA, 25 bp, Mus musculus
gaaggccagggttttacacacatgc

SEQ ID NO: 429930 - DNA, 25 bp, Mus musculus
gaaggccagtccatcaaatcagata

SEQ ID NO: 429931 - DNA, 25 bp, Mus musculus
gaaggccagtccttcaaatcagata

SEQ ID NO: 429932 - DNA, 25 bp, Mus musculus
gaaggccagtttcacattcctgaag

SEQ ID NO: 429933 - DNA, 25 bp, Mus musculus
gaaggccagtttgacattcctgaag

SEQ ID NO: 429934 - DNA, 25 bp, Mus musculus
gaaggccataaaacataagctattg

SEQ ID NO: 429935 - DNA, 25 bp, Mus musculus
gaaggccataaatcataagctattg

SEQ ID NO: 429936 - DNA, 25 bp, Mus musculus
gaaggccatagcatttgactgtatc

SEQ ID NO: 429937 - DNA, 25 bp, Mus musculus
gaaggccatagcttttgactgtatc

SEQ ID NO: 429938 - DNA, 25 bp, Mus musculus
gaaggccatatcctatgatctccga

SEQ ID NO: 429939 - DNA, 25 bp, Mus musculus
gaaggccatatcgtatgatctccga

SEQ ID NO: 429940 - DNA, 25 bp, Mus musculus
gaaggccatattcgttcatattgca

SEQ ID NO: 429941 - DNA, 25 bp, Mus musculus
gaaggccatattggttcatattgca

SEQ ID NO: 429942 - DNA, 25 bp, Mus musculus
gaaggccatcaaaagatccaccagt

SEQ ID NO: 429943 - DNA, 25 bp, Mus musculus
gaaggccatcaatagatccaccagt

SEQ ID NO: 429944 - DNA, 25 bp, Mus musculus
gaaggccatcagatagcacctgaga

SEQ ID NO: 429945 - DNA, 25 bp, Mus musculus
gaaggccatcagttagcacctgaga

SEQ ID NO: 429946 - DNA, 25 bp, Mus musculus
gaaggccatcatagactttcggaac

SEQ ID NO: 429947 - DNA, 25 bp, Mus musculus
gaaggccatcattgactttcggaac

SEQ ID NO: 429948 - DNA, 25 bp, Mus musculus
gaaggccatgaaataacctctctga

SEQ ID NO: 429949 - DNA, 25 bp, Mus musculus
gaaggccatgaattaacctctctga

SEQ ID NO: 429950 - DNA, 25 bp, Mus musculus
gaaggccatgcacaggttacgtttt

SEQ ID NO: 429951 - DNA, 25 bp, Mus musculus
gaaggccatgcagaggttacgtttt

SEQ ID NO: 429952 - DNA, 25 bp, Mus musculus
gaaggccatgtcatctaaagcccag

SEQ ID NO: 429953 - DNA, 25 bp, Mus musculus
gaaggccatgtcttctaaagcccag

SEQ ID NO: 429954 - DNA, 25 bp, Mus musculus
gaaggccatgttagatgctgctctg

SEQ ID NO: 429955 - DNA, 25 bp, Mus musculus
gaaggccatgtttgatgctgctctg

SEQ ID NO: 429956 - DNA, 25 bp, Mus musculus
gaaggccattaaagacgccctaaag

SEQ ID NO: 429957 - DNA, 25 bp, Mus musculus
gaaggccattaatgacgccctaaag

SEQ ID NO: 429958 - DNA, 25 bp, Mus musculus
gaaggccattggagctcggaacttg

SEQ ID NO: 429959 - DNA, 25 bp, Mus musculus
gaaggccattggtgctcggaacttg

SEQ ID NO: 429960 - DNA, 25 bp, Mus musculus
gaaggccatttcctttacttctcaa

SEQ ID NO: 429961 - DNA, 25 bp, Mus musculus
gaaggccatttcgtttacttctcaa

SEQ ID NO: 429962 - DNA, 25 bp, Mus musculus
gaaggccatttgacacatatgtggg

SEQ ID NO: 429963 - DNA, 25 bp, Mus musculus
gaaggccatttgtcacatatgtggg

SEQ ID NO: 429964 - DNA, 25 bp, Mus musculus
gaaggcccaagaaattatcacagca

SEQ ID NO: 429965 - DNA, 25 bp, Mus musculus
gaaggcccaagatattatcacagca

SEQ ID NO: 429966 - DNA, 25 bp, Mus musculus
gaaggcccaagcaatagccactagt

SEQ ID NO: 429967 - DNA, 25 bp, Mus musculus
gaaggcccaagctatagccactagt

SEQ ID NO: 429968 - DNA, 25 bp, Mus musculus
gaaggcccaatgacaggccttgcct

SEQ ID NO: 429969 - DNA, 25 bp, Mus musculus
gaaggcccaatgtcaggccttgcct

SEQ ID NO: 429970 - DNA, 25 bp, Mus musculus
gaaggcccacatcaggaagactgat

SEQ ID NO: 429971 - DNA, 25 bp, Mus musculus
gaaggcccacatgaggaagactgat

SEQ ID NO: 429972 - DNA, 25 bp, Mus musculus
gaaggcccacctagccaaaggccgg

SEQ ID NO: 429973 - DNA, 25 bp, Mus musculus
gaaggcccaccttgccaaaggccgg

SEQ ID NO: 429974 - DNA, 25 bp, Mus musculus
gaaggcccaggacagcaagcagctc

SEQ ID NO: 429975 - DNA, 25 bp, Mus musculus
gaaggcccaggagagcaagcagctc

SEQ ID NO: 429976 - DNA, 25 bp, Mus musculus
gaaggcccaggtaatgtcttccata

SEQ ID NO: 429977 - DNA, 25 bp, Mus musculus
gaaggcccaggttatgtcttccata

SEQ ID NO: 429978 - DNA, 25 bp, Mus musculus
gaaggcccagtgagtgtttttactt

SEQ ID NO: 429979 - DNA, 25 bp, Mus musculus
gaaggcccagtgtgtgtttttactt

SEQ ID NO: 429980 - DNA, 25 bp, Mus musculus
gaaggcccatcacaaggccagcctg

SEQ ID NO: 429981 - DNA, 25 bp, Mus musculus
gaaggcccatcagaaggccagcctg

SEQ ID NO: 429982 - DNA, 25 bp, Mus musculus
gaaggccccaatagagaacctcgat

SEQ ID NO: 429983 - DNA, 25 bp, Mus musculus
gaaggccccaatctggtccatatct

SEQ ID NO: 429984 - DNA, 25 bp, Mus musculus
gaaggccccaatgtggtccatatct

SEQ ID NO: 429985 - DNA, 25 bp, Mus musculus
gaaggccccaattgagaacctcgat

SEQ ID NO: 429986 - DNA, 25 bp, Mus musculus
gaaggccccacaccatggtctagtg

SEQ ID NO: 429987 - DNA, 25 bp, Mus musculus
gaaggccccacagcatggtctagtg

SEQ ID NO: 429988 - DNA, 25 bp, Mus musculus
gaaggccccactcagtaggacagca

SEQ ID NO: 429989 - DNA, 25 bp, Mus musculus
gaaggccccactgagtaggacagca

SEQ ID NO: 429990 - DNA, 25 bp, Mus musculus
gaaggccccgaacctcaagaagtct

SEQ ID NO: 429991 - DNA, 25 bp, Mus musculus
gaaggccccgaagctcaagaagtct

SEQ ID NO: 429992 - DNA, 25 bp, Mus musculus
gaaggccccgggacactgcacattt

SEQ ID NO: 429993 - DNA, 25 bp, Mus musculus
gaaggccccgggtcactgcacattt

SEQ ID NO: 429994 - DNA, 25 bp, Mus musculus
gaaggcccctgtactgagaagcaca

SEQ ID NO: 429995 - DNA, 25 bp, Mus musculus
gaaggcccctgttctgagaagcaca

SEQ ID NO: 429996 - DNA, 25 bp, Mus musculus
gaaggcccgaatagctatgactgga

SEQ ID NO: 429997 - DNA, 25 bp, Mus musculus
gaaggcccgaattgctatgactgga

SEQ ID NO: 429998 - DNA, 25 bp, Mus musculus
gaaggcccgagccaggcttacgcac

SEQ ID NO: 429999 - DNA, 25 bp, Mus musculus
gaaggcccgagcgaggcttacgcac

SEQ ID NO: 430000 - DNA, 25 bp, Mus musculus
gaaggcccggatcgactaacctgtg

SEQ ID NO: 430001 - DNA, 25 bp, Mus musculus
gaaggcccggatggactaacctgtg

SEQ ID NO: 430002 - DNA, 25 bp, Mus musculus
gaaggcccgggacctgttccgtaat

SEQ ID NO: 430003 - DNA, 25 bp, Mus musculus
gaaggcccgggagctgttccgtaat

SEQ ID NO: 430004 - DNA, 25 bp, Mus musculus
gaaggccctacactaatatggtctt

SEQ ID NO: 430005 - DNA, 25 bp, Mus musculus
gaaggccctacagtaatatggtctt

SEQ ID NO: 430006 - DNA, 25 bp, Mus musculus
gaaggccctagcatatatattcgtg

SEQ ID NO: 430007 - DNA, 25 bp, Mus musculus
gaaggccctagcttatatattcgtg

SEQ ID NO: 430008 - DNA, 25 bp, Mus musculus
gaaggccctcaaagacataagctga

SEQ ID NO: 430009 - DNA, 25 bp, Mus musculus
gaaggccctcaacatcatgcaacag

SEQ ID NO: 430010 - DNA, 25 bp, Mus musculus
gaaggccctcaagatcatgcaacag

SEQ ID NO: 430011 - DNA, 25 bp, Mus musculus
gaaggccctcaatgacataagctga

SEQ ID NO: 430012 - DNA, 25 bp, Mus musculus
gaaggccctcctcatagttttgaga

SEQ ID NO: 430013 - DNA, 25 bp, Mus musculus
gaaggccctcctgatagttttgaga

SEQ ID NO: 430014 - DNA, 25 bp, Mus musculus
gaaggccctctgaccttagtgacaa

SEQ ID NO: 430015 - DNA, 25 bp, Mus musculus
gaaggccctctgtccttagtgacaa

SEQ ID NO: 430016 - DNA, 25 bp, Mus musculus
gaaggccctggactttgtaactaat

SEQ ID NO: 430017 - DNA, 25 bp, Mus musculus
gaaggccctggagtttgtaactaat

SEQ ID NO: 430018 - DNA, 25 bp, Mus musculus
gaaggccctgtaagtgtttattaat

SEQ ID NO: 430019 - DNA, 25 bp, Mus musculus
gaaggccctgtatgtgtttattaat

SEQ ID NO: 430020 - DNA, 25 bp, Mus musculus
gaaggccctgttagcaggtgacatt

SEQ ID NO: 430021 - DNA, 25 bp, Mus musculus
gaaggccctgtttgcaggtgacatt

SEQ ID NO: 430022 - DNA, 25 bp, Mus musculus
gaaggcccttcaattagtggatatc

SEQ ID NO: 430023 - DNA, 25 bp, Mus musculus
gaaggcccttcatttagtggatatc

SEQ ID NO: 430024 - DNA, 25 bp, Mus musculus
gaaggccctttaatttgagtacaca

SEQ ID NO: 430025 - DNA, 25 bp, Mus musculus
gaaggccctttattttgagtacaca

SEQ ID NO: 430026 - DNA, 25 bp, Mus musculus
gaaggccgagcaaaacctctgctta

SEQ ID NO: 430027 - DNA, 25 bp, Mus musculus
gaaggccgagcataacctctgctta

SEQ ID NO: 430028 - DNA, 25 bp, Mus musculus
gaaggccgatttccagtggccagac

SEQ ID NO: 430029 - DNA, 25 bp, Mus musculus
gaaggccgatttgcagtggccagac

SEQ ID NO: 430030 - DNA, 25 bp, Mus musculus
gaaggccggcaacgcactgacagca

SEQ ID NO: 430031 - DNA, 25 bp, Mus musculus
gaaggccggcaaggcactgacagca

SEQ ID NO: 430032 - DNA, 25 bp, Mus musculus
gaaggccggcataagagctcttcgg

SEQ ID NO: 430033 - DNA, 25 bp, Mus musculus
gaaggccggcattagagctcttcgg

SEQ ID NO: 430034 - DNA, 25 bp, Mus musculus
gaaggccggccgcaacgtatcagga

SEQ ID NO: 430035 - DNA, 25 bp, Mus musculus
gaaggccggccggaacgtatcagga

SEQ ID NO: 430036 - DNA, 25 bp, Mus musculus
gaaggccggcctcagcaatttagta

SEQ ID NO: 430037 - DNA, 25 bp, Mus musculus
gaaggccggcctgagcaatttagta

SEQ ID NO: 430038 - DNA, 25 bp, Mus musculus
gaaggccgtctcagtgctaagttga

SEQ ID NO: 430039 - DNA, 25 bp, Mus musculus
gaaggccgtctctgtgctaagttga

SEQ ID NO: 430040 - DNA, 25 bp, Mus musculus
gaaggccgtgctctctgacatcggt

SEQ ID NO: 430041 - DNA, 25 bp, Mus musculus
gaaggccgtgctgtctgacatcggt

SEQ ID NO: 430042 - DNA, 25 bp, Mus musculus
gaaggccgttgcagaaaaaatactc

SEQ ID NO: 430043 - DNA, 25 bp, Mus musculus
gaaggccgttgctgaaaaaatactc

SEQ ID NO: 430044 - DNA, 25 bp, Mus musculus
gaaggcctaagaaatcccaatggta

SEQ ID NO: 430045 - DNA, 25 bp, Mus musculus
gaaggcctaagacgcccaaccggca

SEQ ID NO: 430046 - DNA, 25 bp, Mus musculus
gaaggcctaagaggcccaaccggca

SEQ ID NO: 430047 - DNA, 25 bp, Mus musculus
gaaggcctaagatatcccaatggta

SEQ ID NO: 430048 - DNA, 25 bp, Mus musculus
gaaggcctaatgaagtggagttgat

SEQ ID NO: 430049 - DNA, 25 bp, Mus musculus
gaaggcctaatgtagtggagttgat

SEQ ID NO: 430050 - DNA, 25 bp, Mus musculus
gaaggcctacaaccgccaggctgag

SEQ ID NO: 430051 - DNA, 25 bp, Mus musculus
gaaggcctacaagcgccaggctgag

SEQ ID NO: 430052 - DNA, 25 bp, Mus musculus
gaaggcctacagatactatccaggg

SEQ ID NO: 430053 - DNA, 25 bp, Mus musculus
gaaggcctacagttactatccaggg

SEQ ID NO: 430054 - DNA, 25 bp, Mus musculus
gaaggcctactaaatgcgcgcacgt

SEQ ID NO: 430055 - DNA, 25 bp, Mus musculus
gaaggcctactatatgcgcgcacgt

SEQ ID NO: 430056 - DNA, 25 bp, Mus musculus
gaaggcctagctactagaaccgctg

SEQ ID NO: 430057 - DNA, 25 bp, Mus musculus
gaaggcctagcttctagaaccgctg

SEQ ID NO: 430058 - DNA, 25 bp, Mus musculus
gaaggcctatctcatgtttctcaaa

SEQ ID NO: 430059 - DNA, 25 bp, Mus musculus
gaaggcctatctgatgtttctcaaa

SEQ ID NO: 430060 - DNA, 25 bp, Mus musculus
gaaggcctatggaaagaacacagtt

SEQ ID NO: 430061 - DNA, 25 bp, Mus musculus
gaaggcctatggtaagaacacagtt

SEQ ID NO: 430062 - DNA, 25 bp, Mus musculus
gaaggcctcaatattgctactgtga

SEQ ID NO: 430063 - DNA, 25 bp, Mus musculus
gaaggcctcaattttgctactgtga

SEQ ID NO: 430064 - DNA, 25 bp, Mus musculus
gaaggcctcacccaagacaggcaga

SEQ ID NO: 430065 - DNA, 25 bp, Mus musculus
gaaggcctcaccgaagacaggcaga

SEQ ID NO: 430066 - DNA, 25 bp, Mus musculus
gaaggcctcaggcagtttggcactt

SEQ ID NO: 430067 - DNA, 25 bp, Mus musculus
gaaggcctcagggagtttggcactt

SEQ ID NO: 430068 - DNA, 25 bp, Mus musculus
gaaggcctcagtaccccgaggaaga

SEQ ID NO: 430069 - DNA, 25 bp, Mus musculus
gaaggcctcagttccccgaggaaga

SEQ ID NO: 430070 - DNA, 25 bp, Mus musculus
gaaggcctccaacgcacttgcagaa

SEQ ID NO: 430071 - DNA, 25 bp, Mus musculus
gaaggcctccaaggcacttgcagaa

SEQ ID NO: 430072 - DNA, 25 bp, Mus musculus
gaaggcctccacattgttttttgat

SEQ ID NO: 430073 - DNA, 25 bp, Mus musculus
gaaggcctccactttgttttttgat

SEQ ID NO: 430074 - DNA, 25 bp, Mus musculus
gaaggcctccagctaatctttgcta

SEQ ID NO: 430075 - DNA, 25 bp, Mus musculus
gaaggcctccaggtaatctttgcta

SEQ ID NO: 430076 - DNA, 25 bp, Mus musculus
gaaggcctccttcaaatagagctct

SEQ ID NO: 430077 - DNA, 25 bp, Mus musculus
gaaggcctccttgaaatagagctct

SEQ ID NO: 430078 - DNA, 25 bp, Mus musculus
gaaggcctctccagacacgtggctg

SEQ ID NO: 430079 - DNA, 25 bp, Mus musculus
gaaggcctctccaggctttaaagga

SEQ ID NO: 430080 - DNA, 25 bp, Mus musculus
gaaggcctctcctgacacgtggctg

SEQ ID NO: 430081 - DNA, 25 bp, Mus musculus
gaaggcctctcctggctttaaagga

SEQ ID NO: 430082 - DNA, 25 bp, Mus musculus
gaaggcctcttacacaagacggaaa

SEQ ID NO: 430083 - DNA, 25 bp, Mus musculus
gaaggcctcttagacaagacggaaa

SEQ ID NO: 430084 - DNA, 25 bp, Mus musculus
gaaggcctcttgaacagccccagct

SEQ ID NO: 430085 - DNA, 25 bp, Mus musculus
gaaggcctcttgtacagccccagct

SEQ ID NO: 430086 - DNA, 25 bp, Mus musculus
gaaggcctgagtactcagcctgtgg

SEQ ID NO: 430087 - DNA, 25 bp, Mus musculus
gaaggcctgagtccaataacaatat

SEQ ID NO: 430088 - DNA, 25 bp, Mus musculus
gaaggcctgagtgcaataacaatat

SEQ ID NO: 430089 - DNA, 25 bp, Mus musculus
gaaggcctgagttctcagcctgtgg

SEQ ID NO: 430090 - DNA, 25 bp, Mus musculus
gaaggcctgcaacatttcacgcttt

SEQ ID NO: 430091 - DNA, 25 bp, Mus musculus
gaaggcctgcaagatttcacgcttt

SEQ ID NO: 430092 - DNA, 25 bp, Mus musculus
gaaggcctgccaccggttcattgac

SEQ ID NO: 430093 - DNA, 25 bp, Mus musculus
gaaggcctgccagcggttcattgac

SEQ ID NO: 430094 - DNA, 25 bp, Mus musculus
gaaggcctgcctagcagaggttcca

SEQ ID NO: 430095 - DNA, 25 bp, Mus musculus
gaaggcctgcctcttatgaatcaga

SEQ ID NO: 430096 - DNA, 25 bp, Mus musculus
gaaggcctgcctgttatgaatcaga

SEQ ID NO: 430097 - DNA, 25 bp, Mus musculus
gaaggcctgccttgcagaggttcca

SEQ ID NO: 430098 - DNA, 25 bp, Mus musculus
gaaggcctgcgaaattcagtacagt

SEQ ID NO: 430099 - DNA, 25 bp, Mus musculus
gaaggcctgcgatattcagtacagt

SEQ ID NO: 430100 - DNA, 25 bp, Mus musculus
gaaggcctgctgagtgcatcatctc

SEQ ID NO: 430101 - DNA, 25 bp, Mus musculus
gaaggcctgctgtgtgcatcatctc

SEQ ID NO: 430102 - DNA, 25 bp, Mus musculus
gaaggcctggtcactctcaccgagg

SEQ ID NO: 430103 - DNA, 25 bp, Mus musculus
gaaggcctggtctctctcaccgagg

SEQ ID NO: 430104 - DNA, 25 bp, Mus musculus
gaaggcctgtcacagcttgctgtag

SEQ ID NO: 430105 - DNA, 25 bp, Mus musculus
gaaggcctgtcagagcttgctgtag

SEQ ID NO: 430106 - DNA, 25 bp, Mus musculus
gaaggcctgtgtacactttccagca

SEQ ID NO: 430107 - DNA, 25 bp, Mus musculus
gaaggcctgtgttcactttccagca

SEQ ID NO: 430108 - DNA, 25 bp, Mus musculus
gaaggccttaaaaccgcttgcctcg

SEQ ID NO: 430109 - DNA, 25 bp, Mus musculus
gaaggccttaaatccgcttgcctcg

SEQ ID NO: 430110 - DNA, 25 bp, Mus musculus
gaaggccttagcagtgtggacaaaa

SEQ ID NO: 430111 - DNA, 25 bp, Mus musculus
gaaggccttagctgtgtggacaaaa

SEQ ID NO: 430112 - DNA, 25 bp, Mus musculus
gaaggccttaggattgtctatcagc

SEQ ID NO: 430113 - DNA, 25 bp, Mus musculus
gaaggccttaggtttgtctatcagc

SEQ ID NO: 430114 - DNA, 25 bp, Mus musculus
gaaggccttcctaagcctaagggat

SEQ ID NO: 430115 - DNA, 25 bp, Mus musculus
gaaggccttccttagcctaagggat

SEQ ID NO: 430116 - DNA, 25 bp, Mus musculus
gaaggccttcgtctattttactatt

SEQ ID NO: 430117 - DNA, 25 bp, Mus musculus
gaaggccttcgtgtattttactatt

SEQ ID NO: 430118 - DNA, 25 bp, Mus musculus
gaaggccttctgagttctgctgaca

SEQ ID NO: 430119 - DNA, 25 bp, Mus musculus
gaaggccttctgtgttctgctgaca

SEQ ID NO: 430120 - DNA, 25 bp, Mus musculus
gaaggccttcttagatgtgaagaca

SEQ ID NO: 430121 - DNA, 25 bp, Mus musculus
gaaggccttcttcctagtagtatgg

SEQ ID NO: 430122 - DNA, 25 bp, Mus musculus
gaaggccttcttgctagtagtatgg

SEQ ID NO: 430123 - DNA, 25 bp, Mus musculus
gaaggccttctttgatgtgaagaca

SEQ ID NO: 430124 - DNA, 25 bp, Mus musculus
gaaggccttgacaatgacaggctga

SEQ ID NO: 430125 - DNA, 25 bp, Mus musculus
gaaggccttgactatgacaggctga

SEQ ID NO: 430126 - DNA, 25 bp, Mus musculus
gaaggccttgctactgaggatgagc

SEQ ID NO: 430127 - DNA, 25 bp, Mus musculus
gaaggccttgctcgctacagagact

SEQ ID NO: 430128 - DNA, 25 bp, Mus musculus
gaaggccttgctggctacagagact

SEQ ID NO: 430129 - DNA, 25 bp, Mus musculus
gaaggccttgcttctgaggatgagc

SEQ ID NO: 430130 - DNA, 25 bp, Mus musculus
gaaggccttggacctccttaaatga

SEQ ID NO: 430131 - DNA, 25 bp, Mus musculus
gaaggccttggagctccttaaatga

SEQ ID NO: 430132 - DNA, 25 bp, Mus musculus
gaaggccttggtaagccagtaattc

SEQ ID NO: 430133 - DNA, 25 bp, Mus musculus
gaaggccttggttagccagtaattc

SEQ ID NO: 430134 - DNA, 25 bp, Mus musculus
gaaggcctttacagcttgtgaccca

SEQ ID NO: 430135 - DNA, 25 bp, Mus musculus
gaaggcctttactgcttgtgaccca

SEQ ID NO: 430136 - DNA, 25 bp, Mus musculus
gaaggcctttagacaacattctcac

SEQ ID NO: 430137 - DNA, 25 bp, Mus musculus
gaaggcctttagtcaacattctcac

SEQ ID NO: 430138 - DNA, 25 bp, Mus musculus
gaaggcctttcactgtagttattaa

SEQ ID NO: 430139 - DNA, 25 bp, Mus musculus
gaaggcctttcagtgtagttattaa

SEQ ID NO: 430140 - DNA, 25 bp, Mus musculus
gaaggcctttggcacacaggacctt

SEQ ID NO: 430141 - DNA, 25 bp, Mus musculus
gaaggcctttgggacacaggacctt

SEQ ID NO: 430142 - DNA, 25 bp, Mus musculus
gaaggcctttgtcagcagacgaaat

SEQ ID NO: 430143 - DNA, 25 bp, Mus musculus
gaaggcctttgtgagcagacgaaat

SEQ ID NO: 430144 - DNA, 25 bp, Mus musculus
gaaggccttttaagagagctcccaa

SEQ ID NO: 430145 - DNA, 25 bp, Mus musculus
gaaggccttttatgagagctcccaa

SEQ ID NO: 430146 - DNA, 25 bp, Mus musculus
gaaggcgaagtaactgatgaggaca

SEQ ID NO: 430147 - DNA, 25 bp, Mus musculus
gaaggcgaagtatctgatgaggaca

SEQ ID NO: 430148 - DNA, 25 bp, Mus musculus
gaaggcgaatcacttgaccagtcga

SEQ ID NO: 430149 - DNA, 25 bp, Mus musculus
gaaggcgaatcagttgaccagtcga

SEQ ID NO: 430150 - DNA, 25 bp, Mus musculus
gaaggcgacacacaccttagttggg

SEQ ID NO: 430151 - DNA, 25 bp, Mus musculus
gaaggcgacacagaccttagttggg

SEQ ID NO: 430152 - DNA, 25 bp, Mus musculus
gaaggcgacatgaacaatgactact

SEQ ID NO: 430153 - DNA, 25 bp, Mus musculus
gaaggcgacatgtacaatgactact

SEQ ID NO: 430154 - DNA, 25 bp, Mus musculus
gaaggcgaccccaaatggctgttac

SEQ ID NO: 430155 - DNA, 25 bp, Mus musculus
gaaggcgacccctaatggctgttac

SEQ ID NO: 430156 - DNA, 25 bp, Mus musculus
gaaggcgactatatttcccgagcca

SEQ ID NO: 430157 - DNA, 25 bp, Mus musculus
gaaggcgactatttttcccgagcca

SEQ ID NO: 430158 - DNA, 25 bp, Mus musculus
gaaggcgagactatgtctgtctaat

SEQ ID NO: 430159 - DNA, 25 bp, Mus musculus
gaaggcgagactttgtctgtctaat

SEQ ID NO: 430160 - DNA, 25 bp, Mus musculus
gaaggcgagctcaagaaggcgattt

SEQ ID NO: 430161 - DNA, 25 bp, Mus musculus
gaaggcgagctctagaaggcgattt

SEQ ID NO: 430162 - DNA, 25 bp, Mus musculus
gaaggcgagcttatccatgatttat

SEQ ID NO: 430163 - DNA, 25 bp, Mus musculus
gaaggcgagcttttccatgatttat

SEQ ID NO: 430164 - DNA, 25 bp, Mus musculus
gaaggcgaggtcaaatgtcatcagt

SEQ ID NO: 430165 - DNA, 25 bp, Mus musculus
gaaggcgaggtctaatgtcatcagt

SEQ ID NO: 430166 - DNA, 25 bp, Mus musculus
gaaggcgagttccaccagtttgatc

SEQ ID NO: 430167 - DNA, 25 bp, Mus musculus
gaaggcgagttcgaccagtttgatc

SEQ ID NO: 430168 - DNA, 25 bp, Mus musculus
gaaggcgatcctcgacagcaacctt

SEQ ID NO: 430169 - DNA, 25 bp, Mus musculus
gaaggcgatcctggacagcaacctt

SEQ ID NO: 430170 - DNA, 25 bp, Mus musculus
gaaggcgattttcgcgcgctttgtc

SEQ ID NO: 430171 - DNA, 25 bp, Mus musculus
gaaggcgattttggcgcgctttgtc

SEQ ID NO: 430172 - DNA, 25 bp, Mus musculus
gaaggcgcacctcacctcggagaca

SEQ ID NO: 430173 - DNA, 25 bp, Mus musculus
gaaggcgcacctcgaagactactac

SEQ ID NO: 430174 - DNA, 25 bp, Mus musculus
gaaggcgcacctgacctcggagaca

SEQ ID NO: 430175 - DNA, 25 bp, Mus musculus
gaaggcgcacctggaagactactac

SEQ ID NO: 430176 - DNA, 25 bp, Mus musculus
gaaggcgcagtcagaactgtcaggt

SEQ ID NO: 430177 - DNA, 25 bp, Mus musculus
gaaggcgcagtctgaactgtcaggt

SEQ ID NO: 430178 - DNA, 25 bp, Mus musculus
gaaggcgcatccacatctctgggaa

SEQ ID NO: 430179 - DNA, 25 bp, Mus musculus
gaaggcgcatcctcatctctgggaa

SEQ ID NO: 430180 - DNA, 25 bp, Mus musculus
gaaggcgccaaacctttgccacggc

SEQ ID NO: 430181 - DNA, 25 bp, Mus musculus
gaaggcgccaaagctttgccacggc

SEQ ID NO: 430182 - DNA, 25 bp, Mus musculus
gaaggcgccaggaaatttgtgtttt

SEQ ID NO: 430183 - DNA, 25 bp, Mus musculus
gaaggcgccaggtaatttgtgtttt

SEQ ID NO: 430184 - DNA, 25 bp, Mus musculus
gaaggcgccccaactgcatggatct

SEQ ID NO: 430185 - DNA, 25 bp, Mus musculus
gaaggcgccccatctgcatggatct

SEQ ID NO: 430186 - DNA, 25 bp, Mus musculus
gaaggcgccgatcgacaatggaaaa

SEQ ID NO: 430187 - DNA, 25 bp, Mus musculus
gaaggcgccgatggacaatggaaaa

SEQ ID NO: 430188 - DNA, 25 bp, Mus musculus
gaaggcgcggcgataaccccttgag

SEQ ID NO: 430189 - DNA, 25 bp, Mus musculus
gaaggcgcggcgttaaccccttgag

SEQ ID NO: 430190 - DNA, 25 bp, Mus musculus
gaaggcgcgtccatcagagactcta

SEQ ID NO: 430191 - DNA, 25 bp, Mus musculus
gaaggcgcgtccttcagagactcta

SEQ ID NO: 430192 - DNA, 25 bp, Mus musculus
gaaggcgcgtgccagcgcttacaca

SEQ ID NO: 430193 - DNA, 25 bp, Mus musculus
gaaggcgcgtgcgagcgcttacaca

SEQ ID NO: 430194 - DNA, 25 bp, Mus musculus
gaaggcgctgatcccctgcaagaga

SEQ ID NO: 430195 - DNA, 25 bp, Mus musculus
gaaggcgctgatgccctgcaagaga

SEQ ID NO: 430196 - DNA, 25 bp, Mus musculus
gaaggcgctggcacttcacaggctg

SEQ ID NO: 430197 - DNA, 25 bp, Mus musculus
gaaggcgctggctcttcacaggctg

SEQ ID NO: 430198 - DNA, 25 bp, Mus musculus
gaaggcgcttacatagttgagcatt

SEQ ID NO: 430199 - DNA, 25 bp, Mus musculus
gaaggcgcttacttagttgagcatt

SEQ ID NO: 430200 - DNA, 25 bp, Mus musculus
gaaggcggaaatccctggcctgcat

SEQ ID NO: 430201 - DNA, 25 bp, Mus musculus
gaaggcggaaatgcctggcctgcat

SEQ ID NO: 430202 - DNA, 25 bp, Mus musculus
gaaggcggaggcattgagcaccaat

SEQ ID NO: 430203 - DNA, 25 bp, Mus musculus
gaaggcggaggctttgagcaccaat

SEQ ID NO: 430204 - DNA, 25 bp, Mus musculus
gaaggcggcagcatgtgatgcttat

SEQ ID NO: 430205 - DNA, 25 bp, Mus musculus
gaaggcggcagcttgtgatgcttat

SEQ ID NO: 430206 - DNA, 25 bp, Mus musculus
gaaggcggcctcagtgatgtagaaa

SEQ ID NO: 430207 - DNA, 25 bp, Mus musculus
gaaggcggcctctgtgatgtagaaa

SEQ ID NO: 430208 - DNA, 25 bp, Mus musculus
gaaggcggcttcaatggcagtgaga

SEQ ID NO: 430209 - DNA, 25 bp, Mus musculus
gaaggcggcttctatggcagtgaga

SEQ ID NO: 430210 - DNA, 25 bp, Mus musculus
gaaggcgggagcaccaacgtgttct

SEQ ID NO: 430211 - DNA, 25 bp, Mus musculus
gaaggcgggagctccaacgtgttct

SEQ ID NO: 430212 - DNA, 25 bp, Mus musculus
gaaggcgggttcacattttttcatt

SEQ ID NO: 430213 - DNA, 25 bp, Mus musculus
gaaggcgggttctcattttttcatt

SEQ ID NO: 430214 - DNA, 25 bp, Mus musculus
gaaggcgtaacaaaagcccgtgtat

SEQ ID NO: 430215 - DNA, 25 bp, Mus musculus
gaaggcgtaacataagcccgtgtat

SEQ ID NO: 430216 - DNA, 25 bp, Mus musculus
gaaggcgtaactcttgtaacaactt

SEQ ID NO: 430217 - DNA, 25 bp, Mus musculus
gaaggcgtaactgttgtaacaactt

SEQ ID NO: 430218 - DNA, 25 bp, Mus musculus
gaaggcgtatacaatgcactgcaga

SEQ ID NO: 430219 - DNA, 25 bp, Mus musculus
gaaggcgtatactatgcactgcaga

SEQ ID NO: 430220 - DNA, 25 bp, Mus musculus
gaaggcgtatgcagaattctacaga

SEQ ID NO: 430221 - DNA, 25 bp, Mus musculus
gaaggcgtatgctgaattctacaga

SEQ ID NO: 430222 - DNA, 25 bp, Mus musculus
gaaggcgtcacaacttgttacaggt

SEQ ID NO: 430223 - DNA, 25 bp, Mus musculus
gaaggcgtcacatcttgttacaggt

SEQ ID NO: 430224 - DNA, 25 bp, Mus musculus
gaaggcgtcagaatcactgggtctt

SEQ ID NO: 430225 - DNA, 25 bp, Mus musculus
gaaggcgtcagattcactgggtctt

SEQ ID NO: 430226 - DNA, 25 bp, Mus musculus
gaaggcgtcattcttagagtattta

SEQ ID NO: 430227 - DNA, 25 bp, Mus musculus
gaaggcgtcattgttagagtattta

SEQ ID NO: 430228 - DNA, 25 bp, Mus musculus
gaaggcgtctctcgtgtctgaataa

SEQ ID NO: 430229 - DNA, 25 bp, Mus musculus
gaaggcgtctctggtgtctgaataa

SEQ ID NO: 430230 - DNA, 25 bp, Mus musculus
gaaggcgtctgcagtctgtagtgtt

SEQ ID NO: 430231 - DNA, 25 bp, Mus musculus
gaaggcgtctgctgtctgtagtgtt

SEQ ID NO: 430232 - DNA, 25 bp, Mus musculus
gaaggcgtgaccacttattcctaaa

SEQ ID NO: 430233 - DNA, 25 bp, Mus musculus
gaaggcgtgacctcttattcctaaa

SEQ ID NO: 430234 - DNA, 25 bp, Mus musculus
gaaggcgtgccccagatcctgagat

SEQ ID NO: 430235 - DNA, 25 bp, Mus musculus
gaaggcgtgcccgagatcctgagat

SEQ ID NO: 430236 - DNA, 25 bp, Mus musculus
gaaggcgtggctctctgaaacctta

SEQ ID NO: 430237 - DNA, 25 bp, Mus musculus
gaaggcgtggctgtctgaaacctta

SEQ ID NO: 430238 - DNA, 25 bp, Mus musculus
gaaggcgttacacgacatacccgaa

SEQ ID NO: 430239 - DNA, 25 bp, Mus musculus
gaaggcgttacaggacatacccgaa

SEQ ID NO: 430240 - DNA, 25 bp, Mus musculus
gaaggcgttcagaagccgaaccctg

SEQ ID NO: 430241 - DNA, 25 bp, Mus musculus
gaaggcgttcagacgctactcacag

SEQ ID NO: 430242 - DNA, 25 bp, Mus musculus
gaaggcgttcagtagccgaaccctg

SEQ ID NO: 430243 - DNA, 25 bp, Mus musculus
gaaggcgttcagtcgctactcacag

SEQ ID NO: 430244 - DNA, 25 bp, Mus musculus
gaaggcgttgagaaccagcaaggcc

SEQ ID NO: 430245 - DNA, 25 bp, Mus musculus
gaaggcgttgagtaccagcaaggcc

SEQ ID NO: 430246 - DNA, 25 bp, Mus musculus
gaaggcgttggaaatctgcatgaaa

SEQ ID NO: 430247 - DNA, 25 bp, Mus musculus
gaaggcgttggatatctgcatgaaa

SEQ ID NO: 430248 - DNA, 25 bp, Mus musculus
gaaggcgtttatagtcctcaaccca

SEQ ID NO: 430249 - DNA, 25 bp, Mus musculus
gaaggcgtttattgtcctcaaccca

SEQ ID NO: 430250 - DNA, 25 bp, Mus musculus
gaaggcgtttgacgtgcacgggaca

SEQ ID NO: 430251 - DNA, 25 bp, Mus musculus
gaaggcgtttgaggtgcacgggaca

SEQ ID NO: 430252 - DNA, 25 bp, Mus musculus
gaaggcgtttgtaccagactctttc

SEQ ID NO: 430253 - DNA, 25 bp, Mus musculus
gaaggcgtttgttccagactctttc

SEQ ID NO: 430254 - DNA, 25 bp, Mus musculus
gaaggctaaattagctgtcttaaaa

SEQ ID NO: 430255 - DNA, 25 bp, Mus musculus
gaaggctaaatttgctgtcttaaaa

SEQ ID NO: 430256 - DNA, 25 bp, Mus musculus
gaaggctaacggctgtgcttgccct

SEQ ID NO: 430257 - DNA, 25 bp, Mus musculus
gaaggctaacgggtgtgcttgccct

SEQ ID NO: 430258 - DNA, 25 bp, Mus musculus
gaaggctaagctactcaccaggcag

SEQ ID NO: 430259 - DNA, 25 bp, Mus musculus
gaaggctaagcttctcaccaggcag

SEQ ID NO: 430260 - DNA, 25 bp, Mus musculus
gaaggctaagggatccaggcaaaag

SEQ ID NO: 430261 - DNA, 25 bp, Mus musculus
gaaggctaagggttccaggcaaaag

SEQ ID NO: 430262 - DNA, 25 bp, Mus musculus
gaaggctaagtcaaaccgtgtaagt

SEQ ID NO: 430263 - DNA, 25 bp, Mus musculus
gaaggctaagtccaactttagagga

SEQ ID NO: 430264 - DNA, 25 bp, Mus musculus
gaaggctaagtcgaactttagagga

SEQ ID NO: 430265 - DNA, 25 bp, Mus musculus
gaaggctaagtctaaccgtgtaagt

SEQ ID NO: 430266 - DNA, 25 bp, Mus musculus
gaaggctaatctcatgtgcaagact

SEQ ID NO: 430267 - DNA, 25 bp, Mus musculus
gaaggctaatctgatgtgcaagact

SEQ ID NO: 430268 - DNA, 25 bp, Mus musculus
gaaggctaatggcacaaccgtccat

SEQ ID NO: 430269 - DNA, 25 bp, Mus musculus
gaaggctaatgggacaaccgtccat

SEQ ID NO: 430270 - DNA, 25 bp, Mus musculus
gaaggctacaaacatgtctccctga

SEQ ID NO: 430271 - DNA, 25 bp, Mus musculus
gaaggctacaaacgagttcctatga

SEQ ID NO: 430272 - DNA, 25 bp, Mus musculus
gaaggctacaaagatgtctccctga

SEQ ID NO: 430273 - DNA, 25 bp, Mus musculus
gaaggctacaaaggagttcctatga

SEQ ID NO: 430274 - DNA, 25 bp, Mus musculus
gaaggctacaagctcctggacatca

SEQ ID NO: 430275 - DNA, 25 bp, Mus musculus
gaaggctacaaggtcctggacatca

SEQ ID NO: 430276 - DNA, 25 bp, Mus musculus
gaaggctacaggacatgatcccata

SEQ ID NO: 430277 - DNA, 25 bp, Mus musculus
gaaggctacaggtcatgatcccata

SEQ ID NO: 430278 - DNA, 25 bp, Mus musculus
gaaggctaccacagatttctgagga

SEQ ID NO: 430279 - DNA, 25 bp, Mus musculus
gaaggctaccactgatttctgagga

SEQ ID NO: 430280 - DNA, 25 bp, Mus musculus
gaaggctacctaagacaaggcttac

SEQ ID NO: 430281 - DNA, 25 bp, Mus musculus
gaaggctacctatgacaaggcttac

SEQ ID NO: 430282 - DNA, 25 bp, Mus musculus
gaaggctacctcaaagttggtcaga

SEQ ID NO: 430283 - DNA, 25 bp, Mus musculus
gaaggctacctctaagttggtcaga

SEQ ID NO: 430284 - DNA, 25 bp, Mus musculus
gaaggctactatatctgctcagtca

SEQ ID NO: 430285 - DNA, 25 bp, Mus musculus
gaaggctactatttctgctcagtca

SEQ ID NO: 430286 - DNA, 25 bp, Mus musculus
gaaggctactgaaatgtttgagtta

SEQ ID NO: 430287 - DNA, 25 bp, Mus musculus
gaaggctactgatatgtttgagtta

SEQ ID NO: 430288 - DNA, 25 bp, Mus musculus
gaaggctacttgaaagggctttcct

SEQ ID NO: 430289 - DNA, 25 bp, Mus musculus
gaaggctacttgtaagggctttcct

SEQ ID NO: 430290 - DNA, 25 bp, Mus musculus
gaaggctagattactggcaggaaaa

SEQ ID NO: 430291 - DNA, 25 bp, Mus musculus
gaaggctagatttctggcaggaaaa

SEQ ID NO: 430292 - DNA, 25 bp, Mus musculus
gaaggctaggagcttctaagactag

SEQ ID NO: 430293 - DNA, 25 bp, Mus musculus
gaaggctaggaggttctaagactag

SEQ ID NO: 430294 - DNA, 25 bp, Mus musculus
gaaggctagggtcccacggctggaa

SEQ ID NO: 430295 - DNA, 25 bp, Mus musculus
gaaggctagggtgccacggctggaa

SEQ ID NO: 430296 - DNA, 25 bp, Mus musculus
gaaggctagtgtcagaaaacccaag

SEQ ID NO: 430297 - DNA, 25 bp, Mus musculus
gaaggctagtgtgagaaaacccaag

SEQ ID NO: 430298 - DNA, 25 bp, Mus musculus
gaaggctatcacaagaacgctggct

SEQ ID NO: 430299 - DNA, 25 bp, Mus musculus
gaaggctatcactagaacgctggct

SEQ ID NO: 430300 - DNA, 25 bp, Mus musculus
gaaggctatccaatacattctgaaa

SEQ ID NO: 430301 - DNA, 25 bp, Mus musculus
gaaggctatccattacattctgaaa

SEQ ID NO: 430302 - DNA, 25 bp, Mus musculus
gaaggctatcttcgctgagctgaat

SEQ ID NO: 430303 - DNA, 25 bp, Mus musculus
gaaggctatcttggctgagctgaat

SEQ ID NO: 430304 - DNA, 25 bp, Mus musculus
gaaggctatgtaactcttttttaaa

SEQ ID NO: 430305 - DNA, 25 bp, Mus musculus
gaaggctatgtatctcttttttaaa

SEQ ID NO: 430306 - DNA, 25 bp, Mus musculus
gaaggctatgtccaaactgggtctt

SEQ ID NO: 430307 - DNA, 25 bp, Mus musculus
gaaggctatgtcgaaactgggtctt

SEQ ID NO: 430308 - DNA, 25 bp, Mus musculus
gaaggctatgttaccagaaagcaca

SEQ ID NO: 430309 - DNA, 25 bp, Mus musculus
gaaggctatgtttccagaaagcaca

SEQ ID NO: 430310 - DNA, 25 bp, Mus musculus
gaaggctattacaaaacatttgtgt

SEQ ID NO: 430311 - DNA, 25 bp, Mus musculus
gaaggctattactaaacatttgtgt

SEQ ID NO: 430312 - DNA, 25 bp, Mus musculus
gaaggctattgcacttgacccaaga

SEQ ID NO: 430313 - DNA, 25 bp, Mus musculus
gaaggctattgctcttgacccaaga

SEQ ID NO: 430314 - DNA, 25 bp, Mus musculus
gaaggctatttaatctactgataac

SEQ ID NO: 430315 - DNA, 25 bp, Mus musculus
gaaggctatttattctactgataac

SEQ ID NO: 430316 - DNA, 25 bp, Mus musculus
gaaggctattttccaaccctgtgac

SEQ ID NO: 430317 - DNA, 25 bp, Mus musculus
gaaggctattttgcaaccctgtgac

SEQ ID NO: 430318 - DNA, 25 bp, Mus musculus
gaaggctcacctcattcagggagtt

SEQ ID NO: 430319 - DNA, 25 bp, Mus musculus
gaaggctcacctgattcagggagtt

SEQ ID NO: 430320 - DNA, 25 bp, Mus musculus
gaaggctcactcatctcttgtagaa

SEQ ID NO: 430321 - DNA, 25 bp, Mus musculus
gaaggctcactcttctcttgtagaa

SEQ ID NO: 430322 - DNA, 25 bp, Mus musculus
gaaggctcagaacggcatctcctgt

SEQ ID NO: 430323 - DNA, 25 bp, Mus musculus
gaaggctcagaagggcatctcctgt

SEQ ID NO: 430324 - DNA, 25 bp, Mus musculus
gaaggctcagccattaagcttcaga

SEQ ID NO: 430325 - DNA, 25 bp, Mus musculus
gaaggctcagcctttaagcttcaga

SEQ ID NO: 430326 - DNA, 25 bp, Mus musculus
gaaggctcagctacagagggattca

SEQ ID NO: 430327 - DNA, 25 bp, Mus musculus
gaaggctcagctcgttctacctgac

SEQ ID NO: 430328 - DNA, 25 bp, Mus musculus
gaaggctcagctggttctacctgac

SEQ ID NO: 430329 - DNA, 25 bp, Mus musculus
gaaggctcagcttcagagggattca

SEQ ID NO: 430330 - DNA, 25 bp, Mus musculus
gaaggctcagtaattcctctctttg

SEQ ID NO: 430331 - DNA, 25 bp, Mus musculus
gaaggctcagtatttcctctctttg

SEQ ID NO: 430332 - DNA, 25 bp, Mus musculus
gaaggctcatacaacactgctaggt

SEQ ID NO: 430333 - DNA, 25 bp, Mus musculus
gaaggctcatactacactgctaggt

SEQ ID NO: 430334 - DNA, 25 bp, Mus musculus
gaaggctcatatatgctactgtgct

SEQ ID NO: 430335 - DNA, 25 bp, Mus musculus
gaaggctcatatttgctactgtgct

SEQ ID NO: 430336 - DNA, 25 bp, Mus musculus
gaaggctcattcattaggctagata

SEQ ID NO: 430337 - DNA, 25 bp, Mus musculus
gaaggctcattctttaggctagata

SEQ ID NO: 430338 - DNA, 25 bp, Mus musculus
gaaggctccattacttggactctta

SEQ ID NO: 430339 - DNA, 25 bp, Mus musculus
gaaggctccattatagtgaactctc

SEQ ID NO: 430340 - DNA, 25 bp, Mus musculus
gaaggctccatttcttggactctta

SEQ ID NO: 430341 - DNA, 25 bp, Mus musculus
gaaggctccattttagtgaactctc

SEQ ID NO: 430342 - DNA, 25 bp, Mus musculus
gaaggctcccagagtaagggtctga

SEQ ID NO: 430343 - DNA, 25 bp, Mus musculus
gaaggctcccagtgtaagggtctga

SEQ ID NO: 430344 - DNA, 25 bp, Mus musculus
gaaggctcccttcgtatagacctgc

SEQ ID NO: 430345 - DNA, 25 bp, Mus musculus
gaaggctcccttctaggtcaaagga

SEQ ID NO: 430346 - DNA, 25 bp, Mus musculus
gaaggctcccttggtatagacctgc

SEQ ID NO: 430347 - DNA, 25 bp, Mus musculus
gaaggctcccttgtaggtcaaagga

SEQ ID NO: 430348 - DNA, 25 bp, Mus musculus
gaaggctcctgaatgtttacccatg

SEQ ID NO: 430349 - DNA, 25 bp, Mus musculus
gaaggctcctgattgtttacccatg

SEQ ID NO: 430350 - DNA, 25 bp, Mus musculus
gaaggctcctgcacaaaccaaaatc

SEQ ID NO: 430351 - DNA, 25 bp, Mus musculus
gaaggctcctgctcaaaccaaaatc

SEQ ID NO: 430352 - DNA, 25 bp, Mus musculus
gaaggctcctggaaggaactgctca

SEQ ID NO: 430353 - DNA, 25 bp, Mus musculus
gaaggctcctggtaggaactgctca

SEQ ID NO: 430354 - DNA, 25 bp, Mus musculus
gaaggctccttacctgaagggtcct

SEQ ID NO: 430355 - DNA, 25 bp, Mus musculus
gaaggctccttagctgaagggtcct

SEQ ID NO: 430356 - DNA, 25 bp, Mus musculus
gaaggctccttcagtcagcatgttg

SEQ ID NO: 430357 - DNA, 25 bp, Mus musculus
gaaggctccttctgtcagcatgttg

SEQ ID NO: 430358 - DNA, 25 bp, Mus musculus
gaaggctccttgcaatctggagaga

SEQ ID NO: 430359 - DNA, 25 bp, Mus musculus
gaaggctccttggaatctggagaga

SEQ ID NO: 430360 - DNA, 25 bp, Mus musculus
gaaggctcctttagcacattctttc

SEQ ID NO: 430361 - DNA, 25 bp, Mus musculus
gaaggctccttttgcacattctttc

SEQ ID NO: 430362 - DNA, 25 bp, Mus musculus
gaaggctcgagcaggtagccacttc

SEQ ID NO: 430363 - DNA, 25 bp, Mus musculus
gaaggctcgagctggtagccacttc

SEQ ID NO: 430364 - DNA, 25 bp, Mus musculus
gaaggctcgccaatcatacaggttg

SEQ ID NO: 430365 - DNA, 25 bp, Mus musculus
gaaggctcgccattcatacaggttg

SEQ ID NO: 430366 - DNA, 25 bp, Mus musculus
gaaggctcggaaaaaccgcttcaac

SEQ ID NO: 430367 - DNA, 25 bp, Mus musculus
gaaggctcggaataaccgcttcaac

SEQ ID NO: 430368 - DNA, 25 bp, Mus musculus
gaaggctcgtctcgaagttctgatt

SEQ ID NO: 430369 - DNA, 25 bp, Mus musculus
gaaggctcgtctggaagttctgatt

SEQ ID NO: 430370 - DNA, 25 bp, Mus musculus
gaaggctcgtgaagggcagtcatta

SEQ ID NO: 430371 - DNA, 25 bp, Mus musculus
gaaggctcgtgatgggcagtcatta

SEQ ID NO: 430372 - DNA, 25 bp, Mus musculus
gaaggctctactcagatgtgtttaa

SEQ ID NO: 430373 - DNA, 25 bp, Mus musculus
gaaggctctactgagatgtgtttaa

SEQ ID NO: 430374 - DNA, 25 bp, Mus musculus
gaaggctctagacacacacgaccag

SEQ ID NO: 430375 - DNA, 25 bp, Mus musculus
gaaggctctagagacacacgaccag

SEQ ID NO: 430376 - DNA, 25 bp, Mus musculus
gaaggctctagcaattgcccacaag

SEQ ID NO: 430377 - DNA, 25 bp, Mus musculus
gaaggctctagctattgcccacaag

SEQ ID NO: 430378 - DNA, 25 bp, Mus musculus
gaaggctctataactatactgactt

SEQ ID NO: 430379 - DNA, 25 bp, Mus musculus
gaaggctctatatctatactgactt

SEQ ID NO: 430380 - DNA, 25 bp, Mus musculus
gaaggctctatgctagtggatccaa

SEQ ID NO: 430381 - DNA, 25 bp, Mus musculus
gaaggctctatggtagtggatccaa

SEQ ID NO: 430382 - DNA, 25 bp, Mus musculus
gaaggctctcaactaaagcagcaga

SEQ ID NO: 430383 - DNA, 25 bp, Mus musculus
gaaggctctcaagtaaagcagcaga

SEQ ID NO: 430384 - DNA, 25 bp, Mus musculus
gaaggctctcatcaacagcaggaaa

SEQ ID NO: 430385 - DNA, 25 bp, Mus musculus
gaaggctctcatgaacagcaggaaa

SEQ ID NO: 430386 - DNA, 25 bp, Mus musculus
gaaggctctgctctcaccagatgga

SEQ ID NO: 430387 - DNA, 25 bp, Mus musculus
gaaggctctgctgtcaccagatgga

SEQ ID NO: 430388 - DNA, 25 bp, Mus musculus
gaaggctctggcagtgagactccaa

SEQ ID NO: 430389 - DNA, 25 bp, Mus musculus
gaaggctctggctgtgagactccaa

SEQ ID NO: 430390 - DNA, 25 bp, Mus musculus
gaaggctctgtccaacatgatgcac

SEQ ID NO: 430391 - DNA, 25 bp, Mus musculus
gaaggctctgtcctggccatgtgcc

SEQ ID NO: 430392 - DNA, 25 bp, Mus musculus
gaaggctctgtcgaacatgatgcac

SEQ ID NO: 430393 - DNA, 25 bp, Mus musculus
gaaggctctgtcgtggccatgtgcc

SEQ ID NO: 430394 - DNA, 25 bp, Mus musculus
gaaggctcttagctcccggtggcaa

SEQ ID NO: 430395 - DNA, 25 bp, Mus musculus
gaaggctcttaggtcccggtggcaa

SEQ ID NO: 430396 - DNA, 25 bp, Mus musculus
gaaggctcttcaaacaagggtgtgt

SEQ ID NO: 430397 - DNA, 25 bp, Mus musculus
gaaggctcttcatacaagggtgtgt

SEQ ID NO: 430398 - DNA, 25 bp, Mus musculus
gaaggctgaagactccggctattat

SEQ ID NO: 430399 - DNA, 25 bp, Mus musculus
gaaggctgaagagtccggctattat

SEQ ID NO: 430400 - DNA, 25 bp, Mus musculus
gaaggctgaagccagatgaccaagt

SEQ ID NO: 430401 - DNA, 25 bp, Mus musculus
gaaggctgaagcgagatgaccaagt

SEQ ID NO: 430402 - DNA, 25 bp, Mus musculus
gaaggctgaccgagatgagtcctct

SEQ ID NO: 430403 - DNA, 25 bp, Mus musculus
gaaggctgaccgagtgtttcctcag

SEQ ID NO: 430404 - DNA, 25 bp, Mus musculus
gaaggctgaccgtgatgagtcctct

SEQ ID NO: 430405 - DNA, 25 bp, Mus musculus
gaaggctgaccgtgtgtttcctcag

SEQ ID NO: 430406 - DNA, 25 bp, Mus musculus
gaaggctgacttctgcctaggtgtt

SEQ ID NO: 430407 - DNA, 25 bp, Mus musculus
gaaggctgacttctttaggtttctg

SEQ ID NO: 430408 - DNA, 25 bp, Mus musculus
gaaggctgacttgtgcctaggtgtt

SEQ ID NO: 430409 - DNA, 25 bp, Mus musculus
gaaggctgacttgtttaggtttctg

SEQ ID NO: 430410 - DNA, 25 bp, Mus musculus
gaaggctgagaaccatccatctaga

SEQ ID NO: 430411 - DNA, 25 bp, Mus musculus
gaaggctgagaagcatccatctaga

SEQ ID NO: 430412 - DNA, 25 bp, Mus musculus
gaaggctgaggcaaaagcaccctcc

SEQ ID NO: 430413 - DNA, 25 bp, Mus musculus
gaaggctgaggctaaagcaccctcc

SEQ ID NO: 430414 - DNA, 25 bp, Mus musculus
gaaggctgagtaaggctcccaactt

SEQ ID NO: 430415 - DNA, 25 bp, Mus musculus
gaaggctgagtatggctcccaactt

SEQ ID NO: 430416 - DNA, 25 bp, Mus musculus
gaaggctgatggaaacccaggaagc

SEQ ID NO: 430417 - DNA, 25 bp, Mus musculus
gaaggctgatggtaacccaggaagc

SEQ ID NO: 430418 - DNA, 25 bp, Mus musculus
gaaggctgcaatcattctcctagaa

SEQ ID NO: 430419 - DNA, 25 bp, Mus musculus
gaaggctgcaatgattctcctagaa

SEQ ID NO: 430420 - DNA, 25 bp, Mus musculus
gaaggctgcacacggctcagtgaaa

SEQ ID NO: 430421 - DNA, 25 bp, Mus musculus
gaaggctgcacagggctcagtgaaa

SEQ ID NO: 430422 - DNA, 25 bp, Mus musculus
gaaggctgcactcatactggtttta

SEQ ID NO: 430423 - DNA, 25 bp, Mus musculus
gaaggctgcactgatactggtttta

SEQ ID NO: 430424 - DNA, 25 bp, Mus musculus
gaaggctgcagcaacctttgacttt

SEQ ID NO: 430425 - DNA, 25 bp, Mus musculus
gaaggctgcagctacctttgacttt

SEQ ID NO: 430426 - DNA, 25 bp, Mus musculus
gaaggctgccgcacacgtccaaggc

SEQ ID NO: 430427 - DNA, 25 bp, Mus musculus
gaaggctgccgctcacgtccaaggc

SEQ ID NO: 430428 - DNA, 25 bp, Mus musculus
gaaggctgctatcatcagagggaat

SEQ ID NO: 430429 - DNA, 25 bp, Mus musculus
gaaggctgctatgatcagagggaat

SEQ ID NO: 430430 - DNA, 25 bp, Mus musculus
gaaggctgctggaaacccactttgt

SEQ ID NO: 430431 - DNA, 25 bp, Mus musculus
gaaggctgctggtaacccactttgt

SEQ ID NO: 430432 - DNA, 25 bp, Mus musculus
gaaggctgcttcatcaatccatctg

SEQ ID NO: 430433 - DNA, 25 bp, Mus musculus
gaaggctgcttcttcaatccatctg

SEQ ID NO: 430434 - DNA, 25 bp, Mus musculus
gaaggctgctttcactgcattgtta

SEQ ID NO: 430435 - DNA, 25 bp, Mus musculus
gaaggctgctttgactgcattgtta

SEQ ID NO: 430436 - DNA, 25 bp, Mus musculus
gaaggctggaccacccacacatggg

SEQ ID NO: 430437 - DNA, 25 bp, Mus musculus
gaaggctggacctcccacacatggg

SEQ ID NO: 430438 - DNA, 25 bp, Mus musculus
gaaggctggattagcacctcagctt

SEQ ID NO: 430439 - DNA, 25 bp, Mus musculus
gaaggctggattattctgtccaatt

SEQ ID NO: 430440 - DNA, 25 bp, Mus musculus
gaaggctggatttgcacctcagctt

SEQ ID NO: 430441 - DNA, 25 bp, Mus musculus
gaaggctggatttttctgtccaatt

SEQ ID NO: 430442 - DNA, 25 bp, Mus musculus
gaaggctggcaaacctgagcagaac

SEQ ID NO: 430443 - DNA, 25 bp, Mus musculus
gaaggctggcaatcctgagcagaac

SEQ ID NO: 430444 - DNA, 25 bp, Mus musculus
gaaggctggcttcacattattaaac

SEQ ID NO: 430445 - DNA, 25 bp, Mus musculus
gaaggctggcttgacattattaaac

SEQ ID NO: 430446 - DNA, 25 bp, Mus musculus
gaaggctgggatattctttatagta

SEQ ID NO: 430447 - DNA, 25 bp, Mus musculus
gaaggctgggattttctttatagta

SEQ ID NO: 430448 - DNA, 25 bp, Mus musculus
gaaggctggtatcaactgaactagt

SEQ ID NO: 430449 - DNA, 25 bp, Mus musculus
gaaggctggtatgaactgaactagt

SEQ ID NO: 430450 - DNA, 25 bp, Mus musculus
gaaggctggtctatgtcttcagcta

SEQ ID NO: 430451 - DNA, 25 bp, Mus musculus
gaaggctggtctttgtcttcagcta

SEQ ID NO: 430452 - DNA, 25 bp, Mus musculus
gaaggctggtgcaacgattcacact

SEQ ID NO: 430453 - DNA, 25 bp, Mus musculus
gaaggctggtgctacgattcacact

SEQ ID NO: 430454 - DNA, 25 bp, Mus musculus
gaaggctggtttcctagcacagaga

SEQ ID NO: 430455 - DNA, 25 bp, Mus musculus
gaaggctggtttgctagcacagaga

SEQ ID NO: 430456 - DNA, 25 bp, Mus musculus
gaaggctgtaacaaacctcgactct

SEQ ID NO: 430457 - DNA, 25 bp, Mus musculus
gaaggctgtaacactgttccaggga

SEQ ID NO: 430458 - DNA, 25 bp, Mus musculus
gaaggctgtaactaacctcgactct

SEQ ID NO: 430459 - DNA, 25 bp, Mus musculus
gaaggctgtaactctgttccaggga

SEQ ID NO: 430460 - DNA, 25 bp, Mus musculus
gaaggctgtcaccatggacactgag

SEQ ID NO: 430461 - DNA, 25 bp, Mus musculus
gaaggctgtcacgatggacactgag

SEQ ID NO: 430462 - DNA, 25 bp, Mus musculus
gaaggctgtcagagtaaaaccagaa

SEQ ID NO: 430463 - DNA, 25 bp, Mus musculus
gaaggctgtcagtgtaaaaccagaa

SEQ ID NO: 430464 - DNA, 25 bp, Mus musculus
gaaggctgtcataatgatttccatt

SEQ ID NO: 430465 - DNA, 25 bp, Mus musculus
gaaggctgtcattatgatttccatt

SEQ ID NO: 430466 - DNA, 25 bp, Mus musculus
gaaggctgtcctaaggaacctgtat

SEQ ID NO: 430467 - DNA, 25 bp, Mus musculus
gaaggctgtccttaggaacctgtat

SEQ ID NO: 430468 - DNA, 25 bp, Mus musculus
gaaggctgtggcaatctcaagaaat

SEQ ID NO: 430469 - DNA, 25 bp, Mus musculus
gaaggctgtggctatctcaagaaat

SEQ ID NO: 430470 - DNA, 25 bp, Mus musculus
gaaggctgttgtctacccatattta

SEQ ID NO: 430471 - DNA, 25 bp, Mus musculus
gaaggctgttgtgtacccatattta

SEQ ID NO: 430472 - DNA, 25 bp, Mus musculus
gaaggcttaaccacagaggagagct

SEQ ID NO: 430473 - DNA, 25 bp, Mus musculus
gaaggcttaacctcagaggagagct

SEQ ID NO: 430474 - DNA, 25 bp, Mus musculus
gaaggcttacacacttgctgaatga

SEQ ID NO: 430475 - DNA, 25 bp, Mus musculus
gaaggcttacactcttgctgaatga

SEQ ID NO: 430476 - DNA, 25 bp, Mus musculus
gaaggcttagcacatctttcctcat

SEQ ID NO: 430477 - DNA, 25 bp, Mus musculus
gaaggcttagcagatctttcctcat

SEQ ID NO: 430478 - DNA, 25 bp, Mus musculus
gaaggcttagctacctaaatccaat

SEQ ID NO: 430479 - DNA, 25 bp, Mus musculus
gaaggcttagcttcctaaatccaat

SEQ ID NO: 430480 - DNA, 25 bp, Mus musculus
gaaggcttagggacttctcccttgt

SEQ ID NO: 430481 - DNA, 25 bp, Mus musculus
gaaggcttagggtcttctcccttgt

SEQ ID NO: 430482 - DNA, 25 bp, Mus musculus
gaaggcttataactctcgggaaact

SEQ ID NO: 430483 - DNA, 25 bp, Mus musculus
gaaggcttataagtctcgggaaact

SEQ ID NO: 430484 - DNA, 25 bp, Mus musculus
gaaggcttatcaatagctggcagat

SEQ ID NO: 430485 - DNA, 25 bp, Mus musculus
gaaggcttatcaatcctgtttccag

SEQ ID NO: 430486 - DNA, 25 bp, Mus musculus
gaaggcttatcattagctggcagat

SEQ ID NO: 430487 - DNA, 25 bp, Mus musculus
gaaggcttatcattcctgtttccag

SEQ ID NO: 430488 - DNA, 25 bp, Mus musculus
gaaggcttcactcaccactgactgg

SEQ ID NO: 430489 - DNA, 25 bp, Mus musculus
gaaggcttcactgaccactgactgg

SEQ ID NO: 430490 - DNA, 25 bp, Mus musculus
gaaggcttcagacaagcaataaaga

SEQ ID NO: 430491 - DNA, 25 bp, Mus musculus
gaaggcttcagaccatttccctgta

SEQ ID NO: 430492 - DNA, 25 bp, Mus musculus
gaaggcttcagagaagcaataaaga

SEQ ID NO: 430493 - DNA, 25 bp, Mus musculus
gaaggcttcagagcatttccctgta

SEQ ID NO: 430494 - DNA, 25 bp, Mus musculus
gaaggcttcctcatttggatatgtg

SEQ ID NO: 430495 - DNA, 25 bp, Mus musculus
gaaggcttcctcttttggatatgtg

SEQ ID NO: 430496 - DNA, 25 bp, Mus musculus
gaaggcttcgctaactaagtttctg

SEQ ID NO: 430497 - DNA, 25 bp, Mus musculus
gaaggcttcgcttactaagtttctg

SEQ ID NO: 430498 - DNA, 25 bp, Mus musculus
gaaggcttcgtgattcattctatat

SEQ ID NO: 430499 - DNA, 25 bp, Mus musculus
gaaggcttcgtgtttcattctatat

SEQ ID NO: 430500 - DNA, 25 bp, Mus musculus
gaaggcttctcaaccctaagttcag

SEQ ID NO: 430501 - DNA, 25 bp, Mus musculus
gaaggcttctcatccctaagttcag

SEQ ID NO: 430502 - DNA, 25 bp, Mus musculus
gaaggcttctgaactgcttggctac

SEQ ID NO: 430503 - DNA, 25 bp, Mus musculus
gaaggcttctgatctgcttggctac

SEQ ID NO: 430504 - DNA, 25 bp, Mus musculus
gaaggcttcttacagaccggttgct

SEQ ID NO: 430505 - DNA, 25 bp, Mus musculus
gaaggcttcttagagaccggttgct

SEQ ID NO: 430506 - DNA, 25 bp, Mus musculus
gaaggcttcttcaactttcaagacc

SEQ ID NO: 430507 - DNA, 25 bp, Mus musculus
gaaggcttcttctactttcaagacc

SEQ ID NO: 430508 - DNA, 25 bp, Mus musculus
gaaggcttgagacaacaggaagtac

SEQ ID NO: 430509 - DNA, 25 bp, Mus musculus
gaaggcttgagagaacaggaagtac

SEQ ID NO: 430510 - DNA, 25 bp, Mus musculus
gaaggcttgagtcattctaccaggt

SEQ ID NO: 430511 - DNA, 25 bp, Mus musculus
gaaggcttgagtgattctaccaggt

SEQ ID NO: 430512 - DNA, 25 bp, Mus musculus
gaaggcttgcggatttatccaaatt

SEQ ID NO: 430513 - DNA, 25 bp, Mus musculus
gaaggcttgcggttttatccaaatt

SEQ ID NO: 430514 - DNA, 25 bp, Mus musculus
gaaggcttgcttagcatacctgagg

SEQ ID NO: 430515 - DNA, 25 bp, Mus musculus
gaaggcttgcttagtgagctcactt

SEQ ID NO: 430516 - DNA, 25 bp, Mus musculus
gaaggcttgcttatccattcaggcc

SEQ ID NO: 430517 - DNA, 25 bp, Mus musculus
gaaggcttgctttgcatacctgagg

SEQ ID NO: 430518 - DNA, 25 bp, Mus musculus
gaaggcttgctttgtgagctcactt

SEQ ID NO: 430519 - DNA, 25 bp, Mus musculus
gaaggcttgcttttccattcaggcc

SEQ ID NO: 430520 - DNA, 25 bp, Mus musculus
gaaggcttggaaccgctagacgtca

SEQ ID NO: 430521 - DNA, 25 bp, Mus musculus
gaaggcttggaagcgctagacgtca

SEQ ID NO: 430522 - DNA, 25 bp, Mus musculus
gaaggcttggagatatttagctcat

SEQ ID NO: 430523 - DNA, 25 bp, Mus musculus
gaaggcttggagcacgctcactaat

SEQ ID NO: 430524 - DNA, 25 bp, Mus musculus
gaaggcttggaggacgctcactaat

SEQ ID NO: 430525 - DNA, 25 bp, Mus musculus
gaaggcttggagttatttagctcat

SEQ ID NO: 430526 - DNA, 25 bp, Mus musculus
gaaggcttggatctcagttttccat

SEQ ID NO: 430527 - DNA, 25 bp, Mus musculus
gaaggcttggatgtcagttttccat

SEQ ID NO: 430528 - DNA, 25 bp, Mus musculus
gaaggcttgggcagctagtgtttaa

SEQ ID NO: 430529 - DNA, 25 bp, Mus musculus
gaaggcttgggctgctagtgtttaa

SEQ ID NO: 430530 - DNA, 25 bp, Mus musculus
gaaggcttggtaacgccctggacca

SEQ ID NO: 430531 - DNA, 25 bp, Mus musculus
gaaggcttggtatcgccctggacca

SEQ ID NO: 430532 - DNA, 25 bp, Mus musculus
gaaggcttgtctattggtgatgatg

SEQ ID NO: 430533 - DNA, 25 bp, Mus musculus
gaaggcttgtcttttggtgatgatg

SEQ ID NO: 430534 - DNA, 25 bp, Mus musculus
gaaggctttatgaagtgggtctcac

SEQ ID NO: 430535 - DNA, 25 bp, Mus musculus
gaaggctttatgatttcacatgaga

SEQ ID NO: 430536 - DNA, 25 bp, Mus musculus
gaaggctttatgtagtgggtctcac

SEQ ID NO: 430537 - DNA, 25 bp, Mus musculus
gaaggctttatgttttcacatgaga

SEQ ID NO: 430538 - DNA, 25 bp, Mus musculus
gaaggctttcagcttgtttgatgac

SEQ ID NO: 430539 - DNA, 25 bp, Mus musculus
gaaggctttcaggttgtttgatgac

SEQ ID NO: 430540 - DNA, 25 bp, Mus musculus
gaaggctttcgcagggcaaaattct

SEQ ID NO: 430541 - DNA, 25 bp, Mus musculus
gaaggctttcgctgggcaaaattct

SEQ ID NO: 430542 - DNA, 25 bp, Mus musculus
gaaggctttgatcatgctccaaaca

SEQ ID NO: 430543 - DNA, 25 bp, Mus musculus
gaaggctttgatcgattgtgcacat

SEQ ID NO: 430544 - DNA, 25 bp, Mus musculus
gaaggctttgatgatgctccaaaca

SEQ ID NO: 430545 - DNA, 25 bp, Mus musculus
gaaggctttgatggattgtgcacat

SEQ ID NO: 430546 - DNA, 25 bp, Mus musculus
gaaggctttgcaacttattttgaac

SEQ ID NO: 430547 - DNA, 25 bp, Mus musculus
gaaggctttgcatcttattttgaac

SEQ ID NO: 430548 - DNA, 25 bp, Mus musculus
gaaggctttgtgactggtttccaga

SEQ ID NO: 430549 - DNA, 25 bp, Mus musculus
gaaggctttgtgtctggtttccaga

SEQ ID NO: 430550 - DNA, 25 bp, Mus musculus
gaaggcttttatctttggaaatgct

SEQ ID NO: 430551 - DNA, 25 bp, Mus musculus
gaaggcttttatgtttggaaatgct

SEQ ID NO: 430552 - DNA, 25 bp, Mus musculus
gaaggcttttcacactagtaattat

SEQ ID NO: 430553 - DNA, 25 bp, Mus musculus
gaaggcttttcacttgcatggtagt

SEQ ID NO: 430554 - DNA, 25 bp, Mus musculus
gaaggcttttcagactagtaattat

SEQ ID NO: 430555 - DNA, 25 bp, Mus musculus
gaaggcttttcagttgcatggtagt

SEQ ID NO: 430556 - DNA, 25 bp, Mus musculus
gaaggctttttcatgtggaaatcat

SEQ ID NO: 430557 - DNA, 25 bp, Mus musculus
gaaggctttttcttgtggaaatcat

SEQ ID NO: 430558 - DNA, 25 bp, Mus musculus
gaagggaaagctccttgcctatggc

SEQ ID NO: 430559 - DNA, 25 bp, Mus musculus
gaagggaaagctgcttgcctatggc

SEQ ID NO: 430560 - DNA, 25 bp, Mus musculus
gaagggaaattcctgccgtgccact

SEQ ID NO: 430561 - DNA, 25 bp, Mus musculus
gaagggaaattcgtgccgtgccact

SEQ ID NO: 430562 - DNA, 25 bp, Mus musculus
gaagggaacagtagcttgcggccaa

SEQ ID NO: 430563 - DNA, 25 bp, Mus musculus
gaagggaacagttgcttgcggccaa

SEQ ID NO: 430564 - DNA, 25 bp, Mus musculus
gaagggaacccaaggcatcatgcag

SEQ ID NO: 430565 - DNA, 25 bp, Mus musculus
gaagggaacccatggcatcatgcag

SEQ ID NO: 430566 - DNA, 25 bp, Mus musculus
gaagggaaccccatcaactgcaagg

SEQ ID NO: 430567 - DNA, 25 bp, Mus musculus
gaagggaaccccttcaactgcaagg

SEQ ID NO: 430568 - DNA, 25 bp, Mus musculus
gaagggaaccctaactactctagtg

SEQ ID NO: 430569 - DNA, 25 bp, Mus musculus
gaagggaacccttactactctagtg

SEQ ID NO: 430570 - DNA, 25 bp, Mus musculus
gaagggaaccgaccctactcacagt

SEQ ID NO: 430571 - DNA, 25 bp, Mus musculus
gaagggaaccgagcctactcacagt

SEQ ID NO: 430572 - DNA, 25 bp, Mus musculus
gaagggaacctgagttgcccatctc

SEQ ID NO: 430573 - DNA, 25 bp, Mus musculus
gaagggaacctgtgttgcccatctc

SEQ ID NO: 430574 - DNA, 25 bp, Mus musculus
gaagggaacgtcatcctttggtaag

SEQ ID NO: 430575 - DNA, 25 bp, Mus musculus
gaagggaacgtcttcctttggtaag

SEQ ID NO: 430576 - DNA, 25 bp, Mus musculus
gaagggaactacaaggaaagcaggt

SEQ ID NO: 430577 - DNA, 25 bp, Mus musculus
gaagggaactactaggaaagcaggt

SEQ ID NO: 430578 - DNA, 25 bp, Mus musculus
gaagggaagacaaacccatccccat

SEQ ID NO: 430579 - DNA, 25 bp, Mus musculus
gaagggaagacatacccatccccat

SEQ ID NO: 430580 - DNA, 25 bp, Mus musculus
gaagggaagccaaccaggtcttcag

SEQ ID NO: 430581 - DNA, 25 bp, Mus musculus
gaagggaagccatccaggtcttcag

SEQ ID NO: 430582 - DNA, 25 bp, Mus musculus
gaagggaagcttcagtcagtgtcat

SEQ ID NO: 430583 - DNA, 25 bp, Mus musculus
gaagggaagcttgagtcagtgtcat

SEQ ID NO: 430584 - DNA, 25 bp, Mus musculus
gaagggaaggtgacttgcccccact

SEQ ID NO: 430585 - DNA, 25 bp, Mus musculus
gaagggaaggtgtcttgcccccact

SEQ ID NO: 430586 - DNA, 25 bp, Mus musculus
gaagggaagtctccacaccaggcaa

SEQ ID NO: 430587 - DNA, 25 bp, Mus musculus
gaagggaagtctgcacaccaggcaa

SEQ ID NO: 430588 - DNA, 25 bp, Mus musculus
gaagggaatcatagtctcacgagag

SEQ ID NO: 430589 - DNA, 25 bp, Mus musculus
gaagggaatcattgtctcacgagag

SEQ ID NO: 430590 - DNA, 25 bp, Mus musculus
gaagggaatccacgcacacacacaa

SEQ ID NO: 430591 - DNA, 25 bp, Mus musculus
gaagggaatccaggcacacacacaa

SEQ ID NO: 430592 - DNA, 25 bp, Mus musculus
gaagggaatggtcttcctcaaagga

SEQ ID NO: 430593 - DNA, 25 bp, Mus musculus
gaagggaatggtgttcctcaaagga

SEQ ID NO: 430594 - DNA, 25 bp, Mus musculus
gaagggaattctatttagacatctg

SEQ ID NO: 430595 - DNA, 25 bp, Mus musculus
gaagggaattctttttagacatctg

SEQ ID NO: 430596 - DNA, 25 bp, Mus musculus
gaagggacaccaacacagagacata

SEQ ID NO: 430597 - DNA, 25 bp, Mus musculus
gaagggacaccatcacagagacata

SEQ ID NO: 430598 - DNA, 25 bp, Mus musculus
gaagggacacccaggtgttgtcact

SEQ ID NO: 430599 - DNA, 25 bp, Mus musculus
gaagggacaccctggtgttgtcact

SEQ ID NO: 430600 - DNA, 25 bp, Mus musculus
gaagggacagacctgaacagagata

SEQ ID NO: 430601 - DNA, 25 bp, Mus musculus
gaagggacagacgtgaacagagata

SEQ ID NO: 430602 - DNA, 25 bp, Mus musculus
gaagggacagcaccttttgttttag

SEQ ID NO: 430603 - DNA, 25 bp, Mus musculus
gaagggacagcagcttttgttttag

SEQ ID NO: 430604 - DNA, 25 bp, Mus musculus
gaagggacagtaattcacctgtagc

SEQ ID NO: 430605 - DNA, 25 bp, Mus musculus
gaagggacagtatttcacctgtagc

SEQ ID NO: 430606 - DNA, 25 bp, Mus musculus
gaagggacatatctacccacagaga

SEQ ID NO: 430607 - DNA, 25 bp, Mus musculus
gaagggacatatgtacccacagaga

SEQ ID NO: 430608 - DNA, 25 bp, Mus musculus
gaagggacatctacagacctcggtt

SEQ ID NO: 430609 - DNA, 25 bp, Mus musculus
gaagggacatcttcagacctcggtt

SEQ ID NO: 430610 - DNA, 25 bp, Mus musculus
gaagggaccaagctaaattaccgct

SEQ ID NO: 430611 - DNA, 25 bp, Mus musculus
gaagggaccaaggtaaattaccgct

SEQ ID NO: 430612 - DNA, 25 bp, Mus musculus
gaagggaccaccatttaatcaggaa

SEQ ID NO: 430613 - DNA, 25 bp, Mus musculus
gaagggaccaccttttaatcaggaa

SEQ ID NO: 430614 - DNA, 25 bp, Mus musculus
gaagggaccatcatatcccagtgaa

SEQ ID NO: 430615 - DNA, 25 bp, Mus musculus
gaagggaccatcttatcccagtgaa

SEQ ID NO: 430616 - DNA, 25 bp, Mus musculus
gaagggaccctgatttccccaggat

SEQ ID NO: 430617 - DNA, 25 bp, Mus musculus
gaagggaccctgttttccccaggat

SEQ ID NO: 430618 - DNA, 25 bp, Mus musculus
gaagggacgacgactgcctcaggct

SEQ ID NO: 430619 - DNA, 25 bp, Mus musculus
gaagggacgacgtctgcctcaggct

SEQ ID NO: 430620 - DNA, 25 bp, Mus musculus
gaagggacgccccagggcttggtgc

SEQ ID NO: 430621 - DNA, 25 bp, Mus musculus
gaagggacgcccgagggcttggtgc

SEQ ID NO: 430622 - DNA, 25 bp, Mus musculus
gaagggacggacatgttcatcatca

SEQ ID NO: 430623 - DNA, 25 bp, Mus musculus
gaagggacggacttgttcatcatca

SEQ ID NO: 430624 - DNA, 25 bp, Mus musculus
gaagggactactcaggcaccccact

SEQ ID NO: 430625 - DNA, 25 bp, Mus musculus
gaagggactactgaggcaccccact

SEQ ID NO: 430626 - DNA, 25 bp, Mus musculus
gaagggactcagctttccaaggccg

SEQ ID NO: 430627 - DNA, 25 bp, Mus musculus
gaagggactcaggtttccaaggccg

SEQ ID NO: 430628 - DNA, 25 bp, Mus musculus
gaagggactcgtattacatcatgat

SEQ ID NO: 430629 - DNA, 25 bp, Mus musculus
gaagggactcgttttacatcatgat

SEQ ID NO: 430630 - DNA, 25 bp, Mus musculus
gaagggactctgatatagctatctc

SEQ ID NO: 430631 - DNA, 25 bp, Mus musculus
gaagggactctgttatagctatctc

SEQ ID NO: 430632 - DNA, 25 bp, Mus musculus
gaagggactgacaactagactgtaa

SEQ ID NO: 430633 - DNA, 25 bp, Mus musculus
gaagggactgactactagactgtaa

SEQ ID NO: 430634 - DNA, 25 bp, Mus musculus
gaagggactgcccattcctgtccaa

SEQ ID NO: 430635 - DNA, 25 bp, Mus musculus
gaagggactgccgattcctgtccaa

SEQ ID NO: 430636 - DNA, 25 bp, Mus musculus
gaagggactgctcaccagttgtttt

SEQ ID NO: 430637 - DNA, 25 bp, Mus musculus
gaagggactgctgaccagttgtttt

SEQ ID NO: 430638 - DNA, 25 bp, Mus musculus
gaagggactgtcatgccagactccg

SEQ ID NO: 430639 - DNA, 25 bp, Mus musculus
gaagggactgtcttgccagactccg

SEQ ID NO: 430640 - DNA, 25 bp, Mus musculus
gaagggacttcgactttctgtaact

SEQ ID NO: 430641 - DNA, 25 bp, Mus musculus
gaagggacttcgtctttctgtaact

SEQ ID NO: 430642 - DNA, 25 bp, Mus musculus
gaagggagaaccaaggaccagattc

SEQ ID NO: 430643 - DNA, 25 bp, Mus musculus
gaagggagaacctaggaccagattc

SEQ ID NO: 430644 - DNA, 25 bp, Mus musculus
gaagggagaagaaccacgcccctga

SEQ ID NO: 430645 - DNA, 25 bp, Mus musculus
gaagggagaagatccacgcccctga

SEQ ID NO: 430646 - DNA, 25 bp, Mus musculus
gaagggagacagatctgctgaagaa

SEQ ID NO: 430647 - DNA, 25 bp, Mus musculus
gaagggagacagttctgctgaagaa

SEQ ID NO: 430648 - DNA, 25 bp, Mus musculus
gaagggagacatacagactgacata

SEQ ID NO: 430649 - DNA, 25 bp, Mus musculus
gaagggagacattcagactgacata

SEQ ID NO: 430650 - DNA, 25 bp, Mus musculus
gaagggagagccacaatcctcttct

SEQ ID NO: 430651 - DNA, 25 bp, Mus musculus
gaagggagagcctcaatcctcttct

SEQ ID NO: 430652 - DNA, 25 bp, Mus musculus
gaagggagcagtcttccctcatcct

SEQ ID NO: 430653 - DNA, 25 bp, Mus musculus
gaagggagcagtgttccctcatcct

SEQ ID NO: 430654 - DNA, 25 bp, Mus musculus
gaagggagccaacacatggttgaat

SEQ ID NO: 430655 - DNA, 25 bp, Mus musculus
gaagggagccaagacatggttgaat

SEQ ID NO: 430656 - DNA, 25 bp, Mus musculus
gaagggagccacagagttaacgttt

SEQ ID NO: 430657 - DNA, 25 bp, Mus musculus
gaagggagccactgagttaacgttt

SEQ ID NO: 430658 - DNA, 25 bp, Mus musculus
gaagggagccagattctttctcaaa

SEQ ID NO: 430659 - DNA, 25 bp, Mus musculus
gaagggagccagtttctttctcaaa

SEQ ID NO: 430660 - DNA, 25 bp, Mus musculus
gaagggagcctactgtttatgaaaa

SEQ ID NO: 430661 - DNA, 25 bp, Mus musculus
gaagggagcctagtgtttatgaaaa

SEQ ID NO: 430662 - DNA, 25 bp, Mus musculus
gaagggaggacgatgcgcaaccctc

SEQ ID NO: 430663 - DNA, 25 bp, Mus musculus
gaagggaggacgttgcgcaaccctc

SEQ ID NO: 430664 - DNA, 25 bp, Mus musculus
gaagggaggcaaacattcctgttca

SEQ ID NO: 430665 - DNA, 25 bp, Mus musculus
gaagggaggcaatcattcctgttca

SEQ ID NO: 430666 - DNA, 25 bp, Mus musculus
gaagggaggcctcagtactcctcca

SEQ ID NO: 430667 - DNA, 25 bp, Mus musculus
gaagggaggcctgagtactcctcca

SEQ ID NO: 430668 - DNA, 25 bp, Mus musculus
gaagggaggtccaccactacggaga

SEQ ID NO: 430669 - DNA, 25 bp, Mus musculus
gaagggaggtcctccactacggaga

SEQ ID NO: 430670 - DNA, 25 bp, Mus musculus
gaagggagtcctattatctgacagg

SEQ ID NO: 430671 - DNA, 25 bp, Mus musculus
gaagggagtccttttatctgacagg

SEQ ID NO: 430672 - DNA, 25 bp, Mus musculus
gaagggagttacatgctggccactg

SEQ ID NO: 430673 - DNA, 25 bp, Mus musculus
gaagggagttacttgctggccactg

SEQ ID NO: 430674 - DNA, 25 bp, Mus musculus
gaagggagttcacccacaggtgaaa

SEQ ID NO: 430675 - DNA, 25 bp, Mus musculus
gaagggagttcagccacaggtgaaa

SEQ ID NO: 430676 - DNA, 25 bp, Mus musculus
gaagggataagtccagatattcata

SEQ ID NO: 430677 - DNA, 25 bp, Mus musculus
gaagggataagtgcagatattcata

SEQ ID NO: 430678 - DNA, 25 bp, Mus musculus
gaagggatacctaaagagcatgctg

SEQ ID NO: 430679 - DNA, 25 bp, Mus musculus
gaagggataccttaagagcatgctg

SEQ ID NO: 430680 - DNA, 25 bp, Mus musculus
gaagggatactaatgggctcaattt

SEQ ID NO: 430681 - DNA, 25 bp, Mus musculus
gaagggatactattgggctcaattt

SEQ ID NO: 430682 - DNA, 25 bp, Mus musculus
gaagggataggcactgatgctccaa

SEQ ID NO: 430683 - DNA, 25 bp, Mus musculus
gaagggataggctctgatgctccaa

SEQ ID NO: 430684 - DNA, 25 bp, Mus musculus
gaagggatatgcctcagccaggcca

SEQ ID NO: 430685 - DNA, 25 bp, Mus musculus
gaagggatatgcgtcagccaggcca

SEQ ID NO: 430686 - DNA, 25 bp, Mus musculus
gaagggatccatccctttgactgtt

SEQ ID NO: 430687 - DNA, 25 bp, Mus musculus
gaagggatccatgcctttgactgtt

SEQ ID NO: 430688 - DNA, 25 bp, Mus musculus
gaagggatccccaacagggtcagcc

SEQ ID NO: 430689 - DNA, 25 bp, Mus musculus
gaagggatcccctacagggtcagcc

SEQ ID NO: 430690 - DNA, 25 bp, Mus musculus
gaagggatcgtcatttctatgccag

SEQ ID NO: 430691 - DNA, 25 bp, Mus musculus
gaagggatcgtcttttctatgccag

SEQ ID NO: 430692 - DNA, 25 bp, Mus musculus
gaagggatctgtcccagctctggaa

SEQ ID NO: 430693 - DNA, 25 bp, Mus musculus
gaagggatctgtgccagctctggaa

SEQ ID NO: 430694 - DNA, 25 bp, Mus musculus
gaagggatctttcatgcttttaaac

SEQ ID NO: 430695 - DNA, 25 bp, Mus musculus
gaagggatctttgatgcttttaaac

SEQ ID NO: 430696 - DNA, 25 bp, Mus musculus
gaagggatgggtacccctcttatga

SEQ ID NO: 430697 - DNA, 25 bp, Mus musculus
gaagggatgggttcccctcttatga

SEQ ID NO: 430698 - DNA, 25 bp, Mus musculus
gaagggatggttcaatgctgtattt

SEQ ID NO: 430699 - DNA, 25 bp, Mus musculus
gaagggatggttgaatgctgtattt

SEQ ID NO: 430700 - DNA, 25 bp, Mus musculus
gaagggattattacttatagctcaa

SEQ ID NO: 430701 - DNA, 25 bp, Mus musculus
gaagggattatttcttatagctcaa

SEQ ID NO: 430702 - DNA, 25 bp, Mus musculus
gaagggattgtaaacttggcacaaa

SEQ ID NO: 430703 - DNA, 25 bp, Mus musculus
gaagggattgtatacttggcacaaa

SEQ ID NO: 430704 - DNA, 25 bp, Mus musculus
gaagggcaaacccatttggtggcaa

SEQ ID NO: 430705 - DNA, 25 bp, Mus musculus
gaagggcaaaccgatttggtggcaa

SEQ ID NO: 430706 - DNA, 25 bp, Mus musculus
gaagggcaacggcatatatacaaaa

SEQ ID NO: 430707 - DNA, 25 bp, Mus musculus
gaagggcaacgggatatatacaaaa

SEQ ID NO: 430708 - DNA, 25 bp, Mus musculus
gaagggcaactacttctgttattta

SEQ ID NO: 430709 - DNA, 25 bp, Mus musculus
gaagggcaactagttctgttattta

SEQ ID NO: 430710 - DNA, 25 bp, Mus musculus
gaagggcaactgagagcctcagctc

SEQ ID NO: 430711 - DNA, 25 bp, Mus musculus
gaagggcaactgtgagcctcagctc

SEQ ID NO: 430712 - DNA, 25 bp, Mus musculus
gaagggcaaggacaccattattaaa

SEQ ID NO: 430713 - DNA, 25 bp, Mus musculus
gaagggcaaggagaccattattaaa

SEQ ID NO: 430714 - DNA, 25 bp, Mus musculus
gaagggcaatgactccacctattgt

SEQ ID NO: 430715 - DNA, 25 bp, Mus musculus
gaagggcaatgagtccacctattgt

SEQ ID NO: 430716 - DNA, 25 bp, Mus musculus
gaagggcaatgtatcctcttttgtt

SEQ ID NO: 430717 - DNA, 25 bp, Mus musculus
gaagggcaatgtttcctcttttgtt

SEQ ID NO: 430718 - DNA, 25 bp, Mus musculus
gaagggcacaagaccaggaactcac

SEQ ID NO: 430719 - DNA, 25 bp, Mus musculus
gaagggcacaagtccaggaactcac

SEQ ID NO: 430720 - DNA, 25 bp, Mus musculus
gaagggcacaggatcctaacttata

SEQ ID NO: 430721 - DNA, 25 bp, Mus musculus
gaagggcacaggttcctaacttata

SEQ ID NO: 430722 - DNA, 25 bp, Mus musculus
gaagggcacgtcctaagtgccagct

SEQ ID NO: 430723 - DNA, 25 bp, Mus musculus
gaagggcacgtcgtaagtgccagct

SEQ ID NO: 430724 - DNA, 25 bp, Mus musculus
gaagggcactgaagactccatgacc

SEQ ID NO: 430725 - DNA, 25 bp, Mus musculus
gaagggcactgatgactccatgacc

SEQ ID NO: 430726 - DNA, 25 bp, Mus musculus
gaagggcactttcaaatgcatttca

SEQ ID NO: 430727 - DNA, 25 bp, Mus musculus
gaagggcactttgaaatgcatttca

SEQ ID NO: 430728 - DNA, 25 bp, Mus musculus
gaagggcagacgctctgctcccttc

SEQ ID NO: 430729 - DNA, 25 bp, Mus musculus
gaagggcagacggtctgctcccttc

SEQ ID NO: 430730 - DNA, 25 bp, Mus musculus
gaagggcagagcatctgtcctgtgc

SEQ ID NO: 430731 - DNA, 25 bp, Mus musculus
gaagggcagagcttctgtcctgtgc

SEQ ID NO: 430732 - DNA, 25 bp, Mus musculus
gaagggcagataccaagacctgtct

SEQ ID NO: 430733 - DNA, 25 bp, Mus musculus
gaagggcagatagcaagacctgtct

SEQ ID NO: 430734 - DNA, 25 bp, Mus musculus
gaagggcagcaaacccctgtataaa

SEQ ID NO: 430735 - DNA, 25 bp, Mus musculus
gaagggcagcaatcccctgtataaa

SEQ ID NO: 430736 - DNA, 25 bp, Mus musculus
gaagggcagcgcatcaatttgaaga

SEQ ID NO: 430737 - DNA, 25 bp, Mus musculus
gaagggcagcgcttcaatttgaaga

SEQ ID NO: 430738 - DNA, 25 bp, Mus musculus
gaagggcaggccaacctgggtacta

SEQ ID NO: 430739 - DNA, 25 bp, Mus musculus
gaagggcaggcctacctgggtacta

SEQ ID NO: 430740 - DNA, 25 bp, Mus musculus
gaagggcaggttaatgttcaccatt

SEQ ID NO: 430741 - DNA, 25 bp, Mus musculus
gaagggcaggtttatgttcaccatt

SEQ ID NO: 430742 - DNA, 25 bp, Mus musculus
gaagggcagttaaccaccactgtgt

SEQ ID NO: 430743 - DNA, 25 bp, Mus musculus
gaagggcagttatccaccactgtgt

SEQ ID NO: 430744 - DNA, 25 bp, Mus musculus
gaagggcagttcatgtacgtgacag

SEQ ID NO: 430745 - DNA, 25 bp, Mus musculus
gaagggcagttcttgtacgtgacag

SEQ ID NO: 430746 - DNA, 25 bp, Mus musculus
gaagggcataccacaaagcggataa

SEQ ID NO: 430747 - DNA, 25 bp, Mus musculus
gaagggcatacctcaaagcggataa

SEQ ID NO: 430748 - DNA, 25 bp, Mus musculus
gaagggcatccactgttaaagtgca

SEQ ID NO: 430749 - DNA, 25 bp, Mus musculus
gaagggcatccagtgttaaagtgca

SEQ ID NO: 430750 - DNA, 25 bp, Mus musculus
gaagggcatccgagagcccgtcagt

SEQ ID NO: 430751 - DNA, 25 bp, Mus musculus
gaagggcatccgtgagcccgtcagt

SEQ ID NO: 430752 - DNA, 25 bp, Mus musculus
gaagggcatcctcgacaaggaagaa

SEQ ID NO: 430753 - DNA, 25 bp, Mus musculus
gaagggcatcctcgaccacaggcag

SEQ ID NO: 430754 - DNA, 25 bp, Mus musculus
gaagggcatcctcttacttagtttg

SEQ ID NO: 430755 - DNA, 25 bp, Mus musculus
gaagggcatcctggacaaggaagaa

SEQ ID NO: 430756 - DNA, 25 bp, Mus musculus
gaagggcatcctggaccacaggcag

SEQ ID NO: 430757 - DNA, 25 bp, Mus musculus
gaagggcatcctgttacttagtttg

SEQ ID NO: 430758 - DNA, 25 bp, Mus musculus
gaagggcatctaaatagcatgttca

SEQ ID NO: 430759 - DNA, 25 bp, Mus musculus
gaagggcatctatatagcatgttca

SEQ ID NO: 430760 - DNA, 25 bp, Mus musculus
gaagggcatctcctgtagctcctgg

SEQ ID NO: 430761 - DNA, 25 bp, Mus musculus
gaagggcatctcgtgtagctcctgg

SEQ ID NO: 430762 - DNA, 25 bp, Mus musculus
gaagggcatgccactatccatagaa

SEQ ID NO: 430763 - DNA, 25 bp, Mus musculus
gaagggcatgcctctatccatagaa

SEQ ID NO: 430764 - DNA, 25 bp, Mus musculus
gaagggcatgctctggaccagacac

SEQ ID NO: 430765 - DNA, 25 bp, Mus musculus
gaagggcatgctgtggaccagacac

SEQ ID NO: 430766 - DNA, 25 bp, Mus musculus
gaagggcatggacgacccctgcctt

SEQ ID NO: 430767 - DNA, 25 bp, Mus musculus
gaagggcatggaggacccctgcctt

SEQ ID NO: 430768 - DNA, 25 bp, Mus musculus
gaagggcattgtatgctctttcaga

SEQ ID NO: 430769 - DNA, 25 bp, Mus musculus
gaagggcattgtttgctctttcaga

SEQ ID NO: 430770 - DNA, 25 bp, Mus musculus
gaagggccaagcactgtctttttga

SEQ ID NO: 430771 - DNA, 25 bp, Mus musculus
gaagggccaagctctgtctttttga

SEQ ID NO: 430772 - DNA, 25 bp, Mus musculus
gaagggccaataaagcaactgcaag

SEQ ID NO: 430773 - DNA, 25 bp, Mus musculus
gaagggccaatatagcaactgcaag

SEQ ID NO: 430774 - DNA, 25 bp, Mus musculus
gaagggccacatcaaaagactggaa

SEQ ID NO: 430775 - DNA, 25 bp, Mus musculus
gaagggccacatgaaaagactggaa

SEQ ID NO: 430776 - DNA, 25 bp, Mus musculus
gaagggccacgtaggaacccacagt

SEQ ID NO: 430777 - DNA, 25 bp, Mus musculus
gaagggccacgttggaacccacagt

SEQ ID NO: 430778 - DNA, 25 bp, Mus musculus
gaagggccatgacataagctgtaag

SEQ ID NO: 430779 - DNA, 25 bp, Mus musculus
gaagggccatgagataagctgtaag

SEQ ID NO: 430780 - DNA, 25 bp, Mus musculus
gaagggccatggacactgactggtt

SEQ ID NO: 430781 - DNA, 25 bp, Mus musculus
gaagggccatggtcactgactggtt

SEQ ID NO: 430782 - DNA, 25 bp, Mus musculus
gaagggccattcagaagtcacaaac

SEQ ID NO: 430783 - DNA, 25 bp, Mus musculus
gaagggccattctgaagtcacaaac

SEQ ID NO: 430784 - DNA, 25 bp, Mus musculus
gaagggcccataactgcattagtgt

SEQ ID NO: 430785 - DNA, 25 bp, Mus musculus
gaagggcccatatctgcattagtgt

SEQ ID NO: 430786 - DNA, 25 bp, Mus musculus
gaagggccccagactgagatgactc

SEQ ID NO: 430787 - DNA, 25 bp, Mus musculus
gaagggccccagcaggctgaccatt

SEQ ID NO: 430788 - DNA, 25 bp, Mus musculus
gaagggccccaggaggctgaccatt

SEQ ID NO: 430789 - DNA, 25 bp, Mus musculus
gaagggccccagtctgagatgactc

SEQ ID NO: 430790 - DNA, 25 bp, Mus musculus
gaagggcccctgattaagattgaca

SEQ ID NO: 430791 - DNA, 25 bp, Mus musculus
gaagggcccctgtttaagattgaca

SEQ ID NO: 430792 - DNA, 25 bp, Mus musculus
gaagggcccggcaataccagagcat

SEQ ID NO: 430793 - DNA, 25 bp, Mus musculus
gaagggcccggctataccagagcat

SEQ ID NO: 430794 - DNA, 25 bp, Mus musculus
gaagggccctgcctctatgcagcgt

SEQ ID NO: 430795 - DNA, 25 bp, Mus musculus
gaagggccctgcgtctatgcagcgt

SEQ ID NO: 430796 - DNA, 25 bp, Mus musculus
gaagggccctgtataagatctagta

SEQ ID NO: 430797 - DNA, 25 bp, Mus musculus
gaagggccctgtttaagatctagta

SEQ ID NO: 430798 - DNA, 25 bp, Mus musculus
gaagggcccttgatttacaacacag

SEQ ID NO: 430799 - DNA, 25 bp, Mus musculus
gaagggcccttgttttacaacacag

SEQ ID NO: 430800 - DNA, 25 bp, Mus musculus
gaagggccgctcagtcaagaatcag

SEQ ID NO: 430801 - DNA, 25 bp, Mus musculus
gaagggccgctctgtcaagaatcag

SEQ ID NO: 430802 - DNA, 25 bp, Mus musculus
gaagggccggccaacagccaatcag

SEQ ID NO: 430803 - DNA, 25 bp, Mus musculus
gaagggccggcctacagccaatcag

SEQ ID NO: 430804 - DNA, 25 bp, Mus musculus
gaagggccggcgactggactacatc

SEQ ID NO: 430805 - DNA, 25 bp, Mus musculus
gaagggccggcgtctggactacatc

SEQ ID NO: 430806 - DNA, 25 bp, Mus musculus
gaagggcctaagacattcctgaatt

SEQ ID NO: 430807 - DNA, 25 bp, Mus musculus
gaagggcctaagtcattcctgaatt

SEQ ID NO: 430808 - DNA, 25 bp, Mus musculus
gaagggcctcaaagaagatacttta

SEQ ID NO: 430809 - DNA, 25 bp, Mus musculus
gaagggcctcaatgaagatacttta

SEQ ID NO: 430810 - DNA, 25 bp, Mus musculus
gaagggcctctaacatgaagtcacc

SEQ ID NO: 430811 - DNA, 25 bp, Mus musculus
gaagggcctctatcatgaagtcacc

SEQ ID NO: 430812 - DNA, 25 bp, Mus musculus
gaagggcgacctcagcacatactgc

SEQ ID NO: 430813 - DNA, 25 bp, Mus musculus
gaagggcgacctgagcacatactgc

SEQ ID NO: 430814 - DNA, 25 bp, Mus musculus
gaagggcgcaggcattgatgggatt

SEQ ID NO: 430815 - DNA, 25 bp, Mus musculus
gaagggcgcagggattgatgggatt

SEQ ID NO: 430816 - DNA, 25 bp, Mus musculus
gaagggcgcataaggaacggctctc

SEQ ID NO: 430817 - DNA, 25 bp, Mus musculus
gaagggcgcatatggaacggctctc

SEQ ID NO: 430818 - DNA, 25 bp, Mus musculus
gaagggcgcccacacatgaaaacag

SEQ ID NO: 430819 - DNA, 25 bp, Mus musculus
gaagggcgcccagacatgaaaacag

SEQ ID NO: 430820 - DNA, 25 bp, Mus musculus
gaagggcgctatctttattctcatt

SEQ ID NO: 430821 - DNA, 25 bp, Mus musculus
gaagggcgctatgtttattctcatt

SEQ ID NO: 430822 - DNA, 25 bp, Mus musculus
gaagggctaattccagtccccagag

SEQ ID NO: 430823 - DNA, 25 bp, Mus musculus
gaagggctaattgcagtccccagag

SEQ ID NO: 430824 - DNA, 25 bp, Mus musculus
gaagggctacaaagtcaagtctgat

SEQ ID NO: 430825 - DNA, 25 bp, Mus musculus
gaagggctacaatgtcaagtctgat

SEQ ID NO: 430826 - DNA, 25 bp, Mus musculus
gaagggctacaccaagtgactggct

SEQ ID NO: 430827 - DNA, 25 bp, Mus musculus
gaagggctacacgaagtgactggct

SEQ ID NO: 430828 - DNA, 25 bp, Mus musculus
gaagggctacagacagtttccatcc

SEQ ID NO: 430829 - DNA, 25 bp, Mus musculus
gaagggctacagtcagtttccatcc

SEQ ID NO: 430830 - DNA, 25 bp, Mus musculus
gaagggctaccacaaccatcctgct

SEQ ID NO: 430831 - DNA, 25 bp, Mus musculus
gaagggctaccagaaccatcctgct

SEQ ID NO: 430832 - DNA, 25 bp, Mus musculus
gaagggctacctaaacggcatttat

SEQ ID NO: 430833 - DNA, 25 bp, Mus musculus
gaagggctaccttaacggcatttat

SEQ ID NO: 430834 - DNA, 25 bp, Mus musculus
gaagggctatacctcttgggctatc

SEQ ID NO: 430835 - DNA, 25 bp, Mus musculus
gaagggctatacgtcttgggctatc

SEQ ID NO: 430836 - DNA, 25 bp, Mus musculus
gaagggctatttctcctagagggac

SEQ ID NO: 430837 - DNA, 25 bp, Mus musculus
gaagggctatttgtcctagagggac

SEQ ID NO: 430838 - DNA, 25 bp, Mus musculus
gaagggctcacaaagctgacacact

SEQ ID NO: 430839 - DNA, 25 bp, Mus musculus
gaagggctcacatagctgacacact

SEQ ID NO: 430840 - DNA, 25 bp, Mus musculus
gaagggctcacgaagctcactctgt

SEQ ID NO: 430841 - DNA, 25 bp, Mus musculus
gaagggctcacgtagctcactctgt

SEQ ID NO: 430842 - DNA, 25 bp, Mus musculus
gaagggctcataaggctataggcaa

SEQ ID NO: 430843 - DNA, 25 bp, Mus musculus
gaagggctcatatggctataggcaa

SEQ ID NO: 430844 - DNA, 25 bp, Mus musculus
gaagggctcatgaccacagtccatg

SEQ ID NO: 430845 - DNA, 25 bp, Mus musculus
gaagggctcatgtccacagtccatg

SEQ ID NO: 430846 - DNA, 25 bp, Mus musculus
gaagggctccgtagctacaaatatg

SEQ ID NO: 430847 - DNA, 25 bp, Mus musculus
gaagggctccgttgctacaaatatg

SEQ ID NO: 430848 - DNA, 25 bp, Mus musculus
gaagggctcctcacggacagtctgg

SEQ ID NO: 430849 - DNA, 25 bp, Mus musculus
gaagggctcctctcggacagtctgg

SEQ ID NO: 430850 - DNA, 25 bp, Mus musculus
gaagggctcctgagctagttgcgct

SEQ ID NO: 430851 - DNA, 25 bp, Mus musculus
gaagggctcctgtgctagttgcgct

SEQ ID NO: 430852 - DNA, 25 bp, Mus musculus
gaagggctcttaatgtctataccga

SEQ ID NO: 430853 - DNA, 25 bp, Mus musculus
gaagggctcttattgtctataccga

SEQ ID NO: 430854 - DNA, 25 bp, Mus musculus
gaagggctgaacctatcctattggc

SEQ ID NO: 430855 - DNA, 25 bp, Mus musculus
gaagggctgaacgtatcctattggc

SEQ ID NO: 430856 - DNA, 25 bp, Mus musculus
gaagggctgacaccagatgacgtcc

SEQ ID NO: 430857 - DNA, 25 bp, Mus musculus
gaagggctgacagcagatgacgtcc

SEQ ID NO: 430858 - DNA, 25 bp, Mus musculus
gaagggctgaggagttttccccaca

SEQ ID NO: 430859 - DNA, 25 bp, Mus musculus
gaagggctgaggtgttttccccaca

SEQ ID NO: 430860 - DNA, 25 bp, Mus musculus
gaagggctgatgagtgtgatttcca

SEQ ID NO: 430861 - DNA, 25 bp, Mus musculus
gaagggctgatgtgtgtgatttcca

SEQ ID NO: 430862 - DNA, 25 bp, Mus musculus
gaagggctgcccaactttgataaca

SEQ ID NO: 430863 - DNA, 25 bp, Mus musculus
gaagggctgccctactttgataaca

SEQ ID NO: 430864 - DNA, 25 bp, Mus musculus
gaagggctggacagagctcagcatc

SEQ ID NO: 430865 - DNA, 25 bp, Mus musculus
gaagggctggaccatcccattaacc

SEQ ID NO: 430866 - DNA, 25 bp, Mus musculus
gaagggctggacgatcccattaacc

SEQ ID NO: 430867 - DNA, 25 bp, Mus musculus
gaagggctggactgagctcagcatc

SEQ ID NO: 430868 - DNA, 25 bp, Mus musculus
gaagggctgggcacaaatatctcct

SEQ ID NO: 430869 - DNA, 25 bp, Mus musculus
gaagggctgggctcaaatatctcct

SEQ ID NO: 430870 - DNA, 25 bp, Mus musculus
gaagggctggtcatgaactcggata

SEQ ID NO: 430871 - DNA, 25 bp, Mus musculus
gaagggctggtcttgaactcggata

SEQ ID NO: 430872 - DNA, 25 bp, Mus musculus
gaagggctggtgagctctcagcacc

SEQ ID NO: 430873 - DNA, 25 bp, Mus musculus
gaagggctggtgtgctctcagcacc

SEQ ID NO: 430874 - DNA, 25 bp, Mus musculus
gaagggctgttcctctaggcaagtt

SEQ ID NO: 430875 - DNA, 25 bp, Mus musculus
gaagggctgttcgtctaggcaagtt

SEQ ID NO: 430876 - DNA, 25 bp, Mus musculus
gaagggcttaccacagcaagactta

SEQ ID NO: 430877 - DNA, 25 bp, Mus musculus
gaagggcttacctcagcaagactta

SEQ ID NO: 430878 - DNA, 25 bp, Mus musculus
gaagggcttaggcactgatgacaac

SEQ ID NO: 430879 - DNA, 25 bp, Mus musculus
gaagggcttagggactgatgacaac

SEQ ID NO: 430880 - DNA, 25 bp, Mus musculus
gaagggcttgcaacatttctgagat

SEQ ID NO: 430881 - DNA, 25 bp, Mus musculus
gaagggcttgcatcatttctgagat

SEQ ID NO: 430882 - DNA, 25 bp, Mus musculus
gaagggcttggcagttctgtttttt

SEQ ID NO: 430883 - DNA, 25 bp, Mus musculus
gaagggcttggctgttctgtttttt

SEQ ID NO: 430884 - DNA, 25 bp, Mus musculus
gaagggcttggtactgatacctagc

SEQ ID NO: 430885 - DNA, 25 bp, Mus musculus
gaagggcttggttctgatacctagc

SEQ ID NO: 430886 - DNA, 25 bp, Mus musculus
gaagggctttgaaacgcctggtaag

SEQ ID NO: 430887 - DNA, 25 bp, Mus musculus
gaagggctttgatacgcctggtaag

SEQ ID NO: 430888 - DNA, 25 bp, Mus musculus
gaagggcttttgagacttcctggaa

SEQ ID NO: 430889 - DNA, 25 bp, Mus musculus
gaagggcttttgtgacttcctggaa

SEQ ID NO: 430890 - DNA, 25 bp, Mus musculus
gaagggctttttatgtaatatcaga

SEQ ID NO: 430891 - DNA, 25 bp, Mus musculus
gaagggctttttttgtaatatcaga

SEQ ID NO: 430892 - DNA, 25 bp, Mus musculus
gaagggtaacagaaagcctgctcca

SEQ ID NO: 430893 - DNA, 25 bp, Mus musculus
gaagggtaacagtaagcctgctcca

SEQ ID NO: 430894 - DNA, 25 bp, Mus musculus
gaagggtaaccgagccactgagcaa

SEQ ID NO: 430895 - DNA, 25 bp, Mus musculus
gaagggtaaccgtgccactgagcaa

SEQ ID NO: 430896 - DNA, 25 bp, Mus musculus
gaagggtaacttctcctgtgctgaa

SEQ ID NO: 430897 - DNA, 25 bp, Mus musculus
gaagggtaacttgtcctgtgctgaa

SEQ ID NO: 430898 - DNA, 25 bp, Mus musculus
gaagggtaaggcatttctgccctat

SEQ ID NO: 430899 - DNA, 25 bp, Mus musculus
gaagggtaaggcttttctgccctat

SEQ ID NO: 430900 - DNA, 25 bp, Mus musculus
gaagggtaatttcttcctagacaat

SEQ ID NO: 430901 - DNA, 25 bp, Mus musculus
gaagggtaatttgttcctagacaat

SEQ ID NO: 430902 - DNA, 25 bp, Mus musculus
gaagggtacacacactagctctcca

SEQ ID NO: 430903 - DNA, 25 bp, Mus musculus
gaagggtacacagactagctctcca

SEQ ID NO: 430904 - DNA, 25 bp, Mus musculus
gaagggtacagcaaagacacctgag

SEQ ID NO: 430905 - DNA, 25 bp, Mus musculus
gaagggtacagctaagacacctgag

SEQ ID NO: 430906 - DNA, 25 bp, Mus musculus
gaagggtactatagccaggtggctc

SEQ ID NO: 430907 - DNA, 25 bp, Mus musculus
gaagggtactattgccaggtggctc

SEQ ID NO: 430908 - DNA, 25 bp, Mus musculus
gaagggtacttaacttgagcactgg

SEQ ID NO: 430909 - DNA, 25 bp, Mus musculus
gaagggtacttatcttgagcactgg

SEQ ID NO: 430910 - DNA, 25 bp, Mus musculus
gaagggtagactaactcttacaagt

SEQ ID NO: 430911 - DNA, 25 bp, Mus musculus
gaagggtagacttactcttacaagt

SEQ ID NO: 430912 - DNA, 25 bp, Mus musculus
gaagggtagagaagctggcatcaca

SEQ ID NO: 430913 - DNA, 25 bp, Mus musculus
gaagggtagagatgctggcatcaca

SEQ ID NO: 430914 - DNA, 25 bp, Mus musculus
gaagggtatttactgttctatcaca

SEQ ID NO: 430915 - DNA, 25 bp, Mus musculus
gaagggtatttagtgttctatcaca

SEQ ID NO: 430916 - DNA, 25 bp, Mus musculus
gaagggtcaaagcacatggatcatg

SEQ ID NO: 430917 - DNA, 25 bp, Mus musculus
gaagggtcaaaggacatggatcatg

SEQ ID NO: 430918 - DNA, 25 bp, Mus musculus
gaagggtcaactatgcagctggttc

SEQ ID NO: 430919 - DNA, 25 bp, Mus musculus
gaagggtcaactttgcagctggttc

SEQ ID NO: 430920 - DNA, 25 bp, Mus musculus
gaagggtcacatcacatcccaagta

SEQ ID NO: 430921 - DNA, 25 bp, Mus musculus
gaagggtcacatgacatcccaagta

SEQ ID NO: 430922 - DNA, 25 bp, Mus musculus
gaagggtcacctcgatccaatgttt

SEQ ID NO: 430923 - DNA, 25 bp, Mus musculus
gaagggtcacctggatccaatgttt

SEQ ID NO: 430924 - DNA, 25 bp, Mus musculus
gaagggtcagaaacactagcaccag

SEQ ID NO: 430925 - DNA, 25 bp, Mus musculus
gaagggtcagaatcactagcaccag

SEQ ID NO: 430926 - DNA, 25 bp, Mus musculus
gaagggtcatgaatttgctgttagt

SEQ ID NO: 430927 - DNA, 25 bp, Mus musculus
gaagggtcatgacgcactcgaagaa

SEQ ID NO: 430928 - DNA, 25 bp, Mus musculus
gaagggtcatgaggcactcgaagaa

SEQ ID NO: 430929 - DNA, 25 bp, Mus musculus
gaagggtcatgattttgctgttagt

SEQ ID NO: 430930 - DNA, 25 bp, Mus musculus
gaagggtcattgcaaagctatttgt

SEQ ID NO: 430931 - DNA, 25 bp, Mus musculus
gaagggtcattggaaagctatttgt

SEQ ID NO: 430932 - DNA, 25 bp, Mus musculus
gaagggtcccatcggcagaagacac

SEQ ID NO: 430933 - DNA, 25 bp, Mus musculus
gaagggtcccatgggcagaagacac

SEQ ID NO: 430934 - DNA, 25 bp, Mus musculus
gaagggtccgctcccagagacagat

SEQ ID NO: 430935 - DNA, 25 bp, Mus musculus
gaagggtccgctgccagagacagat

SEQ ID NO: 430936 - DNA, 25 bp, Mus musculus
gaagggtcctgtcctctaggctttc

SEQ ID NO: 430937 - DNA, 25 bp, Mus musculus
gaagggtcctgtgctctaggctttc

SEQ ID NO: 430938 - DNA, 25 bp, Mus musculus
gaagggtcggctacagttctggaca

SEQ ID NO: 430939 - DNA, 25 bp, Mus musculus
gaagggtcggcttcagttctggaca

SEQ ID NO: 430940 - DNA, 25 bp, Mus musculus
gaagggtcggtcaccgctgtgccac

SEQ ID NO: 430941 - DNA, 25 bp, Mus musculus
gaagggtcggtctccgctgtgccac

SEQ ID NO: 430942 - DNA, 25 bp, Mus musculus
gaagggtctaagctacttggcagta

SEQ ID NO: 430943 - DNA, 25 bp, Mus musculus
gaagggtctaaggtacttggcagta

SEQ ID NO: 430944 - DNA, 25 bp, Mus musculus
gaagggtctagtatctcagagtcct

SEQ ID NO: 430945 - DNA, 25 bp, Mus musculus
gaagggtctagtttctcagagtcct

SEQ ID NO: 430946 - DNA, 25 bp, Mus musculus
gaagggtctcttcagttttttagat

SEQ ID NO: 430947 - DNA, 25 bp, Mus musculus
gaagggtctcttcttatttccaagt

SEQ ID NO: 430948 - DNA, 25 bp, Mus musculus
gaagggtctcttgagttttttagat

SEQ ID NO: 430949 - DNA, 25 bp, Mus musculus
gaagggtctcttgttatttccaagt

SEQ ID NO: 430950 - DNA, 25 bp, Mus musculus
gaagggtctgagctcccatttggac

SEQ ID NO: 430951 - DNA, 25 bp, Mus musculus
gaagggtctgaggtcccatttggac

SEQ ID NO: 430952 - DNA, 25 bp, Mus musculus
gaagggtctgctatagtcttctgtt

SEQ ID NO: 430953 - DNA, 25 bp, Mus musculus
gaagggtctgctttagtcttctgtt

SEQ ID NO: 430954 - DNA, 25 bp, Mus musculus
gaagggtctgtgaggctctcaaagt

SEQ ID NO: 430955 - DNA, 25 bp, Mus musculus
gaagggtctgtgaggtcccacttat

SEQ ID NO: 430956 - DNA, 25 bp, Mus musculus
gaagggtctgtgtggctctcaaagt

SEQ ID NO: 430957 - DNA, 25 bp, Mus musculus
gaagggtctgtgtggtcccacttat

SEQ ID NO: 430958 - DNA, 25 bp, Mus musculus
gaagggtcttaacagtcttgttcat

SEQ ID NO: 430959 - DNA, 25 bp, Mus musculus
gaagggtcttaagagtcttgttcat

SEQ ID NO: 430960 - DNA, 25 bp, Mus musculus
gaagggtgacatacgattttagaac

SEQ ID NO: 430961 - DNA, 25 bp, Mus musculus
gaagggtgacatataggatccaagt

SEQ ID NO: 430962 - DNA, 25 bp, Mus musculus
gaagggtgacattcgattttagaac

SEQ ID NO: 430963 - DNA, 25 bp, Mus musculus
gaagggtgacatttaggatccaagt

SEQ ID NO: 430964 - DNA, 25 bp, Mus musculus
gaagggtgaccactagacagatgac

SEQ ID NO: 430965 - DNA, 25 bp, Mus musculus
gaagggtgaccactgccatctagtg

SEQ ID NO: 430966 - DNA, 25 bp, Mus musculus
gaagggtgaccagtagacagatgac

SEQ ID NO: 430967 - DNA, 25 bp, Mus musculus
gaagggtgaccagtgccatctagtg

SEQ ID NO: 430968 - DNA, 25 bp, Mus musculus
gaagggtgagatccatccccagctt

SEQ ID NO: 430969 - DNA, 25 bp, Mus musculus
gaagggtgagatgcatccccagctt

SEQ ID NO: 430970 - DNA, 25 bp, Mus musculus
gaagggtgaggacgcccacagcaca

SEQ ID NO: 430971 - DNA, 25 bp, Mus musculus
gaagggtgaggaggcccacagcaca

SEQ ID NO: 430972 - DNA, 25 bp, Mus musculus
gaagggtgcaacacgtgtcaaataa

SEQ ID NO: 430973 - DNA, 25 bp, Mus musculus
gaagggtgcaactcgtgtcaaataa

SEQ ID NO: 430974 - DNA, 25 bp, Mus musculus
gaagggtgcaccagcgtgtctttcc

SEQ ID NO: 430975 - DNA, 25 bp, Mus musculus
gaagggtgcacctgcgtgtctttcc

SEQ ID NO: 430976 - DNA, 25 bp, Mus musculus
gaagggtgcagtaccgactcctaac

SEQ ID NO: 430977 - DNA, 25 bp, Mus musculus
gaagggtgcagttccgactcctaac

SEQ ID NO: 430978 - DNA, 25 bp, Mus musculus
gaagggtgccccaccacgtgttagg

SEQ ID NO: 430979 - DNA, 25 bp, Mus musculus
gaagggtgcccctccacgtgttagg

SEQ ID NO: 430980 - DNA, 25 bp, Mus musculus
gaagggtgcctgagcaggatctcaa

SEQ ID NO: 430981 - DNA, 25 bp, Mus musculus
gaagggtgcctgctctaggactttt

SEQ ID NO: 430982 - DNA, 25 bp, Mus musculus
gaagggtgcctggtctaggactttt

SEQ ID NO: 430983 - DNA, 25 bp, Mus musculus
gaagggtgcctgtgcaggatctcaa

SEQ ID NO: 430984 - DNA, 25 bp, Mus musculus
gaagggtgcttgatccctaagtatc

SEQ ID NO: 430985 - DNA, 25 bp, Mus musculus
gaagggtgcttgttccctaagtatc

SEQ ID NO: 430986 - DNA, 25 bp, Mus musculus
gaagggtgtattctgctttgtaact

SEQ ID NO: 430987 - DNA, 25 bp, Mus musculus
gaagggtgtattgtgctttgtaact

SEQ ID NO: 430988 - DNA, 25 bp, Mus musculus
gaagggtgttcaaattgctctgact

SEQ ID NO: 430989 - DNA, 25 bp, Mus musculus
gaagggtgttcatattgctctgact

SEQ ID NO: 430990 - DNA, 25 bp, Mus musculus
gaagggtgtttccactctcggcagc

SEQ ID NO: 430991 - DNA, 25 bp, Mus musculus
gaagggtgtttcgactctcggcagc

SEQ ID NO: 430992 - DNA, 25 bp, Mus musculus
gaagggttaaacacaggttcatata

SEQ ID NO: 430993 - DNA, 25 bp, Mus musculus
gaagggttaaactcaggttcatata

SEQ ID NO: 430994 - DNA, 25 bp, Mus musculus
gaagggttacatatgctttagcaag

SEQ ID NO: 430995 - DNA, 25 bp, Mus musculus
gaagggttacatttgctttagcaag

SEQ ID NO: 430996 - DNA, 25 bp, Mus musculus
gaagggttactgagttttgttctgt

SEQ ID NO: 430997 - DNA, 25 bp, Mus musculus
gaagggttactgtgttttgttctgt

SEQ ID NO: 430998 - DNA, 25 bp, Mus musculus
gaagggttagacaaatatgcactta

SEQ ID NO: 430999 - DNA, 25 bp, Mus musculus
gaagggttagactaatatgcactta

SEQ ID NO: 431000 - DNA, 25 bp, Mus musculus
gaagggttagctaaatatgtccaaa

SEQ ID NO: 431001 - DNA, 25 bp, Mus musculus
gaagggttagcttaatatgtccaaa

SEQ ID NO: 431002 - DNA, 25 bp, Mus musculus
gaagggttatctcgccatggtactt

SEQ ID NO: 431003 - DNA, 25 bp, Mus musculus
gaagggttatctggccatggtactt

SEQ ID NO: 431004 - DNA, 25 bp, Mus musculus
gaagggttatgtctgtggagctggc

SEQ ID NO: 431005 - DNA, 25 bp, Mus musculus
gaagggttatgtgtgtggagctggc

SEQ ID NO: 431006 - DNA, 25 bp, Mus musculus
gaagggttcaccattgtctgagcac

SEQ ID NO: 431007 - DNA, 25 bp, Mus musculus
gaagggttcacctttgtctgagcac

SEQ ID NO: 431008 - DNA, 25 bp, Mus musculus
gaagggttcctacatggctcattct

SEQ ID NO: 431009 - DNA, 25 bp, Mus musculus
gaagggttcctagatggctcattct

SEQ ID NO: 431010 - DNA, 25 bp, Mus musculus
gaagggttcctgaatgcctcatgaa

SEQ ID NO: 431011 - DNA, 25 bp, Mus musculus
gaagggttcctgtatgcctcatgaa

SEQ ID NO: 431012 - DNA, 25 bp, Mus musculus
gaagggttcttcaatgactcattgc

SEQ ID NO: 431013 - DNA, 25 bp, Mus musculus
gaagggttcttctatgactcattgc

SEQ ID NO: 431014 - DNA, 25 bp, Mus musculus
gaagggttgcataggcacacaccag

SEQ ID NO: 431015 - DNA, 25 bp, Mus musculus
gaagggttgcattggcacacaccag

SEQ ID NO: 431016 - DNA, 25 bp, Mus musculus
gaagggttggttatctgaattccag

SEQ ID NO: 431017 - DNA, 25 bp, Mus musculus
gaagggttggttttctgaattccag

SEQ ID NO: 431018 - DNA, 25 bp, Mus musculus
gaagggtttactactcagacagact

SEQ ID NO: 431019 - DNA, 25 bp, Mus musculus
gaagggtttacttctcagacagact

SEQ ID NO: 431020 - DNA, 25 bp, Mus musculus
gaagggtttctgaactgtccaaagc

SEQ ID NO: 431021 - DNA, 25 bp, Mus musculus
gaagggtttctgtactgtccaaagc

SEQ ID NO: 431022 - DNA, 25 bp, Mus musculus
gaagggtttttccagtccagccaag

SEQ ID NO: 431023 - DNA, 25 bp, Mus musculus
gaagggtttttcgagtccagccaag

SEQ ID NO: 431024 - DNA, 25 bp, Mus musculus
gaaggtaaattcaagattgtctttt

SEQ ID NO: 431025 - DNA, 25 bp, Mus musculus
gaaggtaaattctagattgtctttt

SEQ ID NO: 431026 - DNA, 25 bp, Mus musculus
gaaggtaaccacagtcaggatcccc

SEQ ID NO: 431027 - DNA, 25 bp, Mus musculus
gaaggtaaccactgtcaggatcccc

SEQ ID NO: 431028 - DNA, 25 bp, Mus musculus
gaaggtaacccaagctctgtaggta

SEQ ID NO: 431029 - DNA, 25 bp, Mus musculus
gaaggtaacccatgctctgtaggta

SEQ ID NO: 431030 - DNA, 25 bp, Mus musculus
gaaggtaaccgtcttaaagtatctg

SEQ ID NO: 431031 - DNA, 25 bp, Mus musculus
gaaggtaaccgtgttaaagtatctg

SEQ ID NO: 431032 - DNA, 25 bp, Mus musculus
gaaggtaaccttagcctacatatgg

SEQ ID NO: 431033 - DNA, 25 bp, Mus musculus
gaaggtaacctttgcctacatatgg

SEQ ID NO: 431034 - DNA, 25 bp, Mus musculus
gaaggtaacggccatcgtaacgcag

SEQ ID NO: 431035 - DNA, 25 bp, Mus musculus
gaaggtaacggcgatcgtaacgcag

SEQ ID NO: 431036 - DNA, 25 bp, Mus musculus
gaaggtaactacaacacccagctct

SEQ ID NO: 431037 - DNA, 25 bp, Mus musculus
gaaggtaactactacacccagctct

SEQ ID NO: 431038 - DNA, 25 bp, Mus musculus
gaaggtaagcaaatgtccatccaaa

SEQ ID NO: 431039 - DNA, 25 bp, Mus musculus
gaaggtaagcaattgtccatccaaa

SEQ ID NO: 431040 - DNA, 25 bp, Mus musculus
gaaggtaagccccacctctgagaac

SEQ ID NO: 431041 - DNA, 25 bp, Mus musculus
gaaggtaagcccgacctctgagaac

SEQ ID NO: 431042 - DNA, 25 bp, Mus musculus
gaaggtaatcatcgccacaaacaga

SEQ ID NO: 431043 - DNA, 25 bp, Mus musculus
gaaggtaatcatggccacaaacaga

SEQ ID NO: 431044 - DNA, 25 bp, Mus musculus
gaaggtaattctcataggtgtttta

SEQ ID NO: 431045 - DNA, 25 bp, Mus musculus
gaaggtaattctgataggtgtttta

SEQ ID NO: 431046 - DNA, 25 bp, Mus musculus
gaaggtaattggcaaacaaccccag

SEQ ID NO: 431047 - DNA, 25 bp, Mus musculus
gaaggtaattgggaaacaaccccag

SEQ ID NO: 431048 - DNA, 25 bp, Mus musculus
gaaggtacaaaacctcccatctgtc

SEQ ID NO: 431049 - DNA, 25 bp, Mus musculus
gaaggtacaaaagctcccatctgtc

SEQ ID NO: 431050 - DNA, 25 bp, Mus musculus
gaaggtacaagaccagtgcctctgt

SEQ ID NO: 431051 - DNA, 25 bp, Mus musculus
gaaggtacaagagcagtgcctctgt

SEQ ID NO: 431052 - DNA, 25 bp, Mus musculus
gaaggtacattcacggtgactctca

SEQ ID NO: 431053 - DNA, 25 bp, Mus musculus
gaaggtacattctcggtgactctca

SEQ ID NO: 431054 - DNA, 25 bp, Mus musculus
gaaggtacattgaatgactcctatg

SEQ ID NO: 431055 - DNA, 25 bp, Mus musculus
gaaggtacattgtatgactcctatg

SEQ ID NO: 431056 - DNA, 25 bp, Mus musculus
gaaggtaccaaaattactgttgagt

SEQ ID NO: 431057 - DNA, 25 bp, Mus musculus
gaaggtaccaaatttactgttgagt

SEQ ID NO: 431058 - DNA, 25 bp, Mus musculus
gaaggtaccagaaacctcttctgag

SEQ ID NO: 431059 - DNA, 25 bp, Mus musculus
gaaggtaccagatacctcttctgag

SEQ ID NO: 431060 - DNA, 25 bp, Mus musculus
gaaggtacccatcatgttccaaagg

SEQ ID NO: 431061 - DNA, 25 bp, Mus musculus
gaaggtacccatgatgttccaaagg

SEQ ID NO: 431062 - DNA, 25 bp, Mus musculus
gaaggtaccgggagctcagtgcact

SEQ ID NO: 431063 - DNA, 25 bp, Mus musculus
gaaggtaccgggtgctcagtgcact

SEQ ID NO: 431064 - DNA, 25 bp, Mus musculus
gaaggtaccttccaccaagtctgac

SEQ ID NO: 431065 - DNA, 25 bp, Mus musculus
gaaggtaccttcgaccaagtctgac

SEQ ID NO: 431066 - DNA, 25 bp, Mus musculus
gaaggtaccttgcataaactgatat

SEQ ID NO: 431067 - DNA, 25 bp, Mus musculus
gaaggtaccttggataaactgatat

SEQ ID NO: 431068 - DNA, 25 bp, Mus musculus
gaaggtactgacacacagggatctg

SEQ ID NO: 431069 - DNA, 25 bp, Mus musculus
gaaggtactgactcacagggatctg

SEQ ID NO: 431070 - DNA, 25 bp, Mus musculus
gaaggtagaaggacttggctgctct

SEQ ID NO: 431071 - DNA, 25 bp, Mus musculus
gaaggtagaaggtcttggctgctct

SEQ ID NO: 431072 - DNA, 25 bp, Mus musculus
gaaggtagaatacctctcactgtag

SEQ ID NO: 431073 - DNA, 25 bp, Mus musculus
gaaggtagaatagctctcactgtag

SEQ ID NO: 431074 - DNA, 25 bp, Mus musculus
gaaggtagactgagctcacctctgg

SEQ ID NO: 431075 - DNA, 25 bp, Mus musculus
gaaggtagactgtgctcacctctgg

SEQ ID NO: 431076 - DNA, 25 bp, Mus musculus
gaaggtagcagcctgacagtgccca

SEQ ID NO: 431077 - DNA, 25 bp, Mus musculus
gaaggtagcagcgtgacagtgccca

SEQ ID NO: 431078 - DNA, 25 bp, Mus musculus
gaaggtagcagtacagcctccatct

SEQ ID NO: 431079 - DNA, 25 bp, Mus musculus
gaaggtagcagttcagcctccatct

SEQ ID NO: 431080 - DNA, 25 bp, Mus musculus
gaaggtagccacagacatttgttgt

SEQ ID NO: 431081 - DNA, 25 bp, Mus musculus
gaaggtagccactgacatttgttgt

SEQ ID NO: 431082 - DNA, 25 bp, Mus musculus
gaaggtagctcccatataggtacta

SEQ ID NO: 431083 - DNA, 25 bp, Mus musculus
gaaggtagctccgatataggtacta

SEQ ID NO: 431084 - DNA, 25 bp, Mus musculus
gaaggtagcttgctacctggctgcc

SEQ ID NO: 431085 - DNA, 25 bp, Mus musculus
gaaggtagcttggtacctggctgcc

SEQ ID NO: 431086 - DNA, 25 bp, Mus musculus
gaaggtaggacaccagctctctgct

SEQ ID NO: 431087 - DNA, 25 bp, Mus musculus
gaaggtaggacagcagctctctgct

SEQ ID NO: 431088 - DNA, 25 bp, Mus musculus
gaaggtaggagcagacttcctgact

SEQ ID NO: 431089 - DNA, 25 bp, Mus musculus
gaaggtaggagctgacttcctgact

SEQ ID NO: 431090 - DNA, 25 bp, Mus musculus
gaaggtaggcaacaggccccacaga

SEQ ID NO: 431091 - DNA, 25 bp, Mus musculus
gaaggtaggcaagaggccccacaga

SEQ ID NO: 431092 - DNA, 25 bp, Mus musculus
gaaggtaggtccatgtagcatatga

SEQ ID NO: 431093 - DNA, 25 bp, Mus musculus
gaaggtaggtccctgcatgcagatt

SEQ ID NO: 431094 - DNA, 25 bp, Mus musculus
gaaggtaggtccgtgcatgcagatt

SEQ ID NO: 431095 - DNA, 25 bp, Mus musculus
gaaggtaggtccttgtagcatatga

SEQ ID NO: 431096 - DNA, 25 bp, Mus musculus
gaaggtagtcttactcaaacagtac

SEQ ID NO: 431097 - DNA, 25 bp, Mus musculus
gaaggtagtctttctcaaacagtac

SEQ ID NO: 431098 - DNA, 25 bp, Mus musculus
gaaggtagtgtaccatgattttaaa

SEQ ID NO: 431099 - DNA, 25 bp, Mus musculus
gaaggtagtgtagcatgattttaaa

SEQ ID NO: 431100 - DNA, 25 bp, Mus musculus
gaaggtagttaactactgccgataa

SEQ ID NO: 431101 - DNA, 25 bp, Mus musculus
gaaggtagttaagtactgccgataa

SEQ ID NO: 431102 - DNA, 25 bp, Mus musculus
gaaggtagttacatccaggtggtta

SEQ ID NO: 431103 - DNA, 25 bp, Mus musculus
gaaggtagttacttccaggtggtta

SEQ ID NO: 431104 - DNA, 25 bp, Mus musculus
gaaggtatcacaaattttcactata

SEQ ID NO: 431105 - DNA, 25 bp, Mus musculus
gaaggtatcacatattttcactata

SEQ ID NO: 431106 - DNA, 25 bp, Mus musculus
gaaggtatcactcaaagacatgcgt

SEQ ID NO: 431107 - DNA, 25 bp, Mus musculus
gaaggtatcactgaaagacatgcgt

SEQ ID NO: 431108 - DNA, 25 bp, Mus musculus
gaaggtatcataatgctcattttgc

SEQ ID NO: 431109 - DNA, 25 bp, Mus musculus
gaaggtatcatattgctcattttgc

SEQ ID NO: 431110 - DNA, 25 bp, Mus musculus
gaaggtatccagactttcagagaat

SEQ ID NO: 431111 - DNA, 25 bp, Mus musculus
gaaggtatccagtctttcagagaat

SEQ ID NO: 431112 - DNA, 25 bp, Mus musculus
gaaggtatccatctatctgcttact

SEQ ID NO: 431113 - DNA, 25 bp, Mus musculus
gaaggtatccatgtatctgcttact

SEQ ID NO: 431114 - DNA, 25 bp, Mus musculus
gaaggtatctcaatggacacgtatt

SEQ ID NO: 431115 - DNA, 25 bp, Mus musculus
gaaggtatctcattggacacgtatt

SEQ ID NO: 431116 - DNA, 25 bp, Mus musculus
gaaggtatcttcaccggctaggata

SEQ ID NO: 431117 - DNA, 25 bp, Mus musculus
gaaggtatcttcatggtcttgccca

SEQ ID NO: 431118 - DNA, 25 bp, Mus musculus
gaaggtatcttctccggctaggata

SEQ ID NO: 431119 - DNA, 25 bp, Mus musculus
gaaggtatcttcttggtcttgccca

SEQ ID NO: 431120 - DNA, 25 bp, Mus musculus
gaaggtatgatgctgccctagcaga

SEQ ID NO: 431121 - DNA, 25 bp, Mus musculus
gaaggtatgatggtgccctagcaga

SEQ ID NO: 431122 - DNA, 25 bp, Mus musculus
gaaggtatgctgacacaccaattga

SEQ ID NO: 431123 - DNA, 25 bp, Mus musculus
gaaggtatgctgtcacaccaattga

SEQ ID NO: 431124 - DNA, 25 bp, Mus musculus
gaaggtatggctcccacagagttat

SEQ ID NO: 431125 - DNA, 25 bp, Mus musculus
gaaggtatggctgccacagagttat

SEQ ID NO: 431126 - DNA, 25 bp, Mus musculus
gaaggtattggtaaagtatcacgtt

SEQ ID NO: 431127 - DNA, 25 bp, Mus musculus
gaaggtattggttaagtatcacgtt

SEQ ID NO: 431128 - DNA, 25 bp, Mus musculus
gaaggtattgtgcatttctgtttta

SEQ ID NO: 431129 - DNA, 25 bp, Mus musculus
gaaggtattgtggatttctgtttta

SEQ ID NO: 431130 - DNA, 25 bp, Mus musculus
gaaggtatttcactagagttggaat

SEQ ID NO: 431131 - DNA, 25 bp, Mus musculus
gaaggtatttcagtagagttggaat

SEQ ID NO: 431132 - DNA, 25 bp, Mus musculus
gaaggtattttacatctgactgaaa

SEQ ID NO: 431133 - DNA, 25 bp, Mus musculus
gaaggtattttagatctgactgaaa

SEQ ID NO: 431134 - DNA, 25 bp, Mus musculus
gaaggtcaaaatctaaacctatgga

SEQ ID NO: 431135 - DNA, 25 bp, Mus musculus
gaaggtcaaaatgtaaacctatgga

SEQ ID NO: 431136 - DNA, 25 bp, Mus musculus
gaaggtcaaactcggctcagcacta

SEQ ID NO: 431137 - DNA, 25 bp, Mus musculus
gaaggtcaaactgggctcagcacta

SEQ ID NO: 431138 - DNA, 25 bp, Mus musculus
gaaggtcaactcctttatgagcacc

SEQ ID NO: 431139 - DNA, 25 bp, Mus musculus
gaaggtcaactcgtttatgagcacc

SEQ ID NO: 431140 - DNA, 25 bp, Mus musculus
gaaggtcaacttctggctgcaaggt

SEQ ID NO: 431141 - DNA, 25 bp, Mus musculus
gaaggtcaacttgtggctgcaaggt

SEQ ID NO: 431142 - DNA, 25 bp, Mus musculus
gaaggtcaagcacgtgccctttact

SEQ ID NO: 431143 - DNA, 25 bp, Mus musculus
gaaggtcaagcaggtgccctttact

SEQ ID NO: 431144 - DNA, 25 bp, Mus musculus
gaaggtcaagcccctaggctgccac

SEQ ID NO: 431145 - DNA, 25 bp, Mus musculus
gaaggtcaagccgctaggctgccac

SEQ ID NO: 431146 - DNA, 25 bp, Mus musculus
gaaggtcaagtaccccaaactcatc

SEQ ID NO: 431147 - DNA, 25 bp, Mus musculus
gaaggtcaagtagcccaaactcatc

SEQ ID NO: 431148 - DNA, 25 bp, Mus musculus
gaaggtcaatctaggttgtcagctt

SEQ ID NO: 431149 - DNA, 25 bp, Mus musculus
gaaggtcaatcttggttgtcagctt

SEQ ID NO: 431150 - DNA, 25 bp, Mus musculus
gaaggtcacacgacattactgcagt

SEQ ID NO: 431151 - DNA, 25 bp, Mus musculus
gaaggtcacacgtcattactgcagt

SEQ ID NO: 431152 - DNA, 25 bp, Mus musculus
gaaggtcaccacactcctggaggtg

SEQ ID NO: 431153 - DNA, 25 bp, Mus musculus
gaaggtcaccactctcctggaggtg

SEQ ID NO: 431154 - DNA, 25 bp, Mus musculus
gaaggtcacccaagggcatctgtta

SEQ ID NO: 431155 - DNA, 25 bp, Mus musculus
gaaggtcacccatgggcatctgtta

SEQ ID NO: 431156 - DNA, 25 bp, Mus musculus
gaaggtcacggacaaaatggtgccc

SEQ ID NO: 431157 - DNA, 25 bp, Mus musculus
gaaggtcacggagaaaatggtgccc

SEQ ID NO: 431158 - DNA, 25 bp, Mus musculus
gaaggtcacttaatttcatttggaa

SEQ ID NO: 431159 - DNA, 25 bp, Mus musculus
gaaggtcacttattttcatttggaa

SEQ ID NO: 431160 - DNA, 25 bp, Mus musculus
gaaggtcagaacattgggccacagc

SEQ ID NO: 431161 - DNA, 25 bp, Mus musculus
gaaggtcagaactttgggccacagc

SEQ ID NO: 431162 - DNA, 25 bp, Mus musculus
gaaggtcagacccaacttcttggtc

SEQ ID NO: 431163 - DNA, 25 bp, Mus musculus
gaaggtcagaccgaacttcttggtc

SEQ ID NO: 431164 - DNA, 25 bp, Mus musculus
gaaggtcagagcacaacgttgggaa

SEQ ID NO: 431165 - DNA, 25 bp, Mus musculus
gaaggtcagagctcaacgttgggaa

SEQ ID NO: 431166 - DNA, 25 bp, Mus musculus
gaaggtcagcatattatatgaagca

SEQ ID NO: 431167 - DNA, 25 bp, Mus musculus
gaaggtcagcattttatatgaagca

SEQ ID NO: 431168 - DNA, 25 bp, Mus musculus
gaaggtcagccactgttgatgctcc

SEQ ID NO: 431169 - DNA, 25 bp, Mus musculus
gaaggtcagccagtgttgatgctcc

SEQ ID NO: 431170 - DNA, 25 bp, Mus musculus
gaaggtcagcccaaccataaggtat

SEQ ID NO: 431171 - DNA, 25 bp, Mus musculus
gaaggtcagccctaccataaggtat

SEQ ID NO: 431172 - DNA, 25 bp, Mus musculus
gaaggtcagcgaagctgccacgcag

SEQ ID NO: 431173 - DNA, 25 bp, Mus musculus
gaaggtcagcgatgctgccacgcag

SEQ ID NO: 431174 - DNA, 25 bp, Mus musculus
gaaggtcagtgaccctggtatgaca

SEQ ID NO: 431175 - DNA, 25 bp, Mus musculus
gaaggtcagtgagcctggtatgaca

SEQ ID NO: 431176 - DNA, 25 bp, Mus musculus
gaaggtcatagcaagcctcagctaa

SEQ ID NO: 431177 - DNA, 25 bp, Mus musculus
gaaggtcatagctagcctcagctaa

SEQ ID NO: 431178 - DNA, 25 bp, Mus musculus
gaaggtcatcttccgatactgtgct

SEQ ID NO: 431179 - DNA, 25 bp, Mus musculus
gaaggtcatcttgcgatactgtgct

SEQ ID NO: 431180 - DNA, 25 bp, Mus musculus
gaaggtcatgacactctaagacttt

SEQ ID NO: 431181 - DNA, 25 bp, Mus musculus
gaaggtcatgactctctaagacttt

SEQ ID NO: 431182 - DNA, 25 bp, Mus musculus
gaaggtcattacagaacccatgctt

SEQ ID NO: 431183 - DNA, 25 bp, Mus musculus
gaaggtcattactgaacccatgctt

SEQ ID NO: 431184 - DNA, 25 bp, Mus musculus
gaaggtcattcactggtgcacccac

SEQ ID NO: 431185 - DNA, 25 bp, Mus musculus
gaaggtcattcagtggtgcacccac

SEQ ID NO: 431186 - DNA, 25 bp, Mus musculus
gaaggtcattccacatcagtttgat

SEQ ID NO: 431187 - DNA, 25 bp, Mus musculus
gaaggtcattcctcatcagtttgat

SEQ ID NO: 431188 - DNA, 25 bp, Mus musculus
gaaggtcattgaaccaccacagagg

SEQ ID NO: 431189 - DNA, 25 bp, Mus musculus
gaaggtcattgaaccctacaggaga

SEQ ID NO: 431190 - DNA, 25 bp, Mus musculus
gaaggtcattgatccaccacagagg

SEQ ID NO: 431191 - DNA, 25 bp, Mus musculus
gaaggtcattgatccctacaggaga

SEQ ID NO: 431192 - DNA, 25 bp, Mus musculus
gaaggtcattgtcagccttggctat

SEQ ID NO: 431193 - DNA, 25 bp, Mus musculus
gaaggtcattgtgagccttggctat

SEQ ID NO: 431194 - DNA, 25 bp, Mus musculus
gaaggtccaagtctgccagcaatag

SEQ ID NO: 431195 - DNA, 25 bp, Mus musculus
gaaggtccaagtgtgccagcaatag

SEQ ID NO: 431196 - DNA, 25 bp, Mus musculus
gaaggtccacccagatggaaaagcc

SEQ ID NO: 431197 - DNA, 25 bp, Mus musculus
gaaggtccaccctgatggaaaagcc

SEQ ID NO: 431198 - DNA, 25 bp, Mus musculus
gaaggtccaggactagttacccatg

SEQ ID NO: 431199 - DNA, 25 bp, Mus musculus
gaaggtccaggagtagttacccatg

SEQ ID NO: 431200 - DNA, 25 bp, Mus musculus
gaaggtccatccagttgcattggga

SEQ ID NO: 431201 - DNA, 25 bp, Mus musculus
gaaggtccatcctgttgcattggga

SEQ ID NO: 431202 - DNA, 25 bp, Mus musculus
gaaggtccatcgaccctggaggaaa

SEQ ID NO: 431203 - DNA, 25 bp, Mus musculus
gaaggtccatcgtccctggaggaaa

SEQ ID NO: 431204 - DNA, 25 bp, Mus musculus
gaaggtcccagcctgtaccattttg

SEQ ID NO: 431205 - DNA, 25 bp, Mus musculus
gaaggtcccagcgtgtaccattttg

SEQ ID NO: 431206 - DNA, 25 bp, Mus musculus
gaaggtccccatccagaagaggtga

SEQ ID NO: 431207 - DNA, 25 bp, Mus musculus
gaaggtccccatgcagaagaggtga

SEQ ID NO: 431208 - DNA, 25 bp, Mus musculus
gaaggtccctctaacaagttggtgg

SEQ ID NO: 431209 - DNA, 25 bp, Mus musculus
gaaggtccctcttacaagttggtgg

SEQ ID NO: 431210 - DNA, 25 bp, Mus musculus
gaaggtccgacgctctgaagccatt

SEQ ID NO: 431211 - DNA, 25 bp, Mus musculus
gaaggtccgacggtctgaagccatt

SEQ ID NO: 431212 - DNA, 25 bp, Mus musculus
gaaggtccgagacacattggcagca

SEQ ID NO: 431213 - DNA, 25 bp, Mus musculus
gaaggtccgagagacattggcagca

SEQ ID NO: 431214 - DNA, 25 bp, Mus musculus
gaaggtcctagactcagtgtttcgt

SEQ ID NO: 431215 - DNA, 25 bp, Mus musculus
gaaggtcctagagtcagtgtttcgt

SEQ ID NO: 431216 - DNA, 25 bp, Mus musculus
gaaggtcctcaccagctgagtgtag

SEQ ID NO: 431217 - DNA, 25 bp, Mus musculus
gaaggtcctcacgagctgagtgtag

SEQ ID NO: 431218 - DNA, 25 bp, Mus musculus
gaaggtcctcagatgaattcctagc

SEQ ID NO: 431219 - DNA, 25 bp, Mus musculus
gaaggtcctcagttgaattcctagc

SEQ ID NO: 431220 - DNA, 25 bp, Mus musculus
gaaggtcctgtcaaaagctcaaagt

SEQ ID NO: 431221 - DNA, 25 bp, Mus musculus
gaaggtcctgtctaaagctcaaagt

SEQ ID NO: 431222 - DNA, 25 bp, Mus musculus
gaaggtccttgtaccttacaatgct

SEQ ID NO: 431223 - DNA, 25 bp, Mus musculus
gaaggtccttgttccttacaatgct

SEQ ID NO: 431224 - DNA, 25 bp, Mus musculus
gaaggtcctttacttctttgcagta

SEQ ID NO: 431225 - DNA, 25 bp, Mus musculus
gaaggtcctttagttctttgcagta

SEQ ID NO: 431226 - DNA, 25 bp, Mus musculus
gaaggtcgacagatcaagccttaca

SEQ ID NO: 431227 - DNA, 25 bp, Mus musculus
gaaggtcgacagttcaagccttaca

SEQ ID NO: 431228 - DNA, 25 bp, Mus musculus
gaaggtcgagataccacaggactgt

SEQ ID NO: 431229 - DNA, 25 bp, Mus musculus
gaaggtcgagattccacaggactgt

SEQ ID NO: 431230 - DNA, 25 bp, Mus musculus
gaaggtcgagctagctctaccaggc

SEQ ID NO: 431231 - DNA, 25 bp, Mus musculus
gaaggtcgagcttgctctaccaggc

SEQ ID NO: 431232 - DNA, 25 bp, Mus musculus
gaaggtcgagtgattcctgcctgat

SEQ ID NO: 431233 - DNA, 25 bp, Mus musculus
gaaggtcgagtgtttcctgcctgat

SEQ ID NO: 431234 - DNA, 25 bp, Mus musculus
gaaggtcgccgaagctctggccaat

SEQ ID NO: 431235 - DNA, 25 bp, Mus musculus
gaaggtcgccgatgctctggccaat

SEQ ID NO: 431236 - DNA, 25 bp, Mus musculus
gaaggtcggcatacccatagcgcct

SEQ ID NO: 431237 - DNA, 25 bp, Mus musculus
gaaggtcggcattcccatagcgcct

SEQ ID NO: 431238 - DNA, 25 bp, Mus musculus
gaaggtcgtcggaaagccctgtcca

SEQ ID NO: 431239 - DNA, 25 bp, Mus musculus
gaaggtcgtcggtaagccctgtcca

SEQ ID NO: 431240 - DNA, 25 bp, Mus musculus
gaaggtcgtgatcatcctggaaaca

SEQ ID NO: 431241 - DNA, 25 bp, Mus musculus
gaaggtcgtgatgatcctggaaaca

SEQ ID NO: 431242 - DNA, 25 bp, Mus musculus
gaaggtctaaacacagtggccccat

SEQ ID NO: 431243 - DNA, 25 bp, Mus musculus
gaaggtctaaactcagtggccccat

SEQ ID NO: 431244 - DNA, 25 bp, Mus musculus
gaaggtctaactccatatgtgaaca

SEQ ID NO: 431245 - DNA, 25 bp, Mus musculus
gaaggtctaactgcatatgtgaaca

SEQ ID NO: 431246 - DNA, 25 bp, Mus musculus
gaaggtctaagaatccaggagttgt

SEQ ID NO: 431247 - DNA, 25 bp, Mus musculus
gaaggtctaagattccaggagttgt

SEQ ID NO: 431248 - DNA, 25 bp, Mus musculus
gaaggtctagttatcagttgcaaac

SEQ ID NO: 431249 - DNA, 25 bp, Mus musculus
gaaggtctagttcattgtgatggaa

SEQ ID NO: 431250 - DNA, 25 bp, Mus musculus
gaaggtctagttgattgtgatggaa

SEQ ID NO: 431251 - DNA, 25 bp, Mus musculus
gaaggtctagttttcagttgcaaac

SEQ ID NO: 431252 - DNA, 25 bp, Mus musculus
gaaggtctatcaagctctagttgtg

SEQ ID NO: 431253 - DNA, 25 bp, Mus musculus
gaaggtctatcatgctctagttgtg

SEQ ID NO: 431254 - DNA, 25 bp, Mus musculus
gaaggtctatctcaagaggctacag

SEQ ID NO: 431255 - DNA, 25 bp, Mus musculus
gaaggtctatctgaagaggctacag

SEQ ID NO: 431256 - DNA, 25 bp, Mus musculus
gaaggtctatggaggctgtcattca

SEQ ID NO: 431257 - DNA, 25 bp, Mus musculus
gaaggtctatggctacagtgcagcc

SEQ ID NO: 431258 - DNA, 25 bp, Mus musculus
gaaggtctatgggtacagtgcagcc

SEQ ID NO: 431259 - DNA, 25 bp, Mus musculus
gaaggtctatggtggctgtcattca

SEQ ID NO: 431260 - DNA, 25 bp, Mus musculus
gaaggtctattcctggctgcacagt

SEQ ID NO: 431261 - DNA, 25 bp, Mus musculus
gaaggtctattcgtggctgcacagt

SEQ ID NO: 431262 - DNA, 25 bp, Mus musculus
gaaggtctatttatgatgtcacaat

SEQ ID NO: 431263 - DNA, 25 bp, Mus musculus
gaaggtctatttttgatgtcacaat

SEQ ID NO: 431264 - DNA, 25 bp, Mus musculus
gaaggtctcacaacatgcatggagt

SEQ ID NO: 431265 - DNA, 25 bp, Mus musculus
gaaggtctcacatcatgcatggagt

SEQ ID NO: 431266 - DNA, 25 bp, Mus musculus
gaaggtctcacgagggtaacgtcca

SEQ ID NO: 431267 - DNA, 25 bp, Mus musculus
gaaggtctcacgtgggtaacgtcca

SEQ ID NO: 431268 - DNA, 25 bp, Mus musculus
gaaggtctccaaaacgttcagtaaa

SEQ ID NO: 431269 - DNA, 25 bp, Mus musculus
gaaggtctccaatacgttcagtaaa

SEQ ID NO: 431270 - DNA, 25 bp, Mus musculus
gaaggtctcctgcactgaggctcat

SEQ ID NO: 431271 - DNA, 25 bp, Mus musculus
gaaggtctcctggactgaggctcat

SEQ ID NO: 431272 - DNA, 25 bp, Mus musculus
gaaggtctcgatatcatgagtttca

SEQ ID NO: 431273 - DNA, 25 bp, Mus musculus
gaaggtctcgatttcatgagtttca

SEQ ID NO: 431274 - DNA, 25 bp, Mus musculus
gaaggtctcgtacagcaccattctc

SEQ ID NO: 431275 - DNA, 25 bp, Mus musculus
gaaggtctcgtagagcaccattctc

SEQ ID NO: 431276 - DNA, 25 bp, Mus musculus
gaaggtctctaacaactcaactggg

SEQ ID NO: 431277 - DNA, 25 bp, Mus musculus
gaaggtctctaagaactcaactggg

SEQ ID NO: 431278 - DNA, 25 bp, Mus musculus
gaaggtctctctcacagctgtcatt

SEQ ID NO: 431279 - DNA, 25 bp, Mus musculus
gaaggtctctctgacagctgtcatt

SEQ ID NO: 431280 - DNA, 25 bp, Mus musculus
gaaggtctctgcataatgagccaat

SEQ ID NO: 431281 - DNA, 25 bp, Mus musculus
gaaggtctctgcttaatgagccaat

SEQ ID NO: 431282 - DNA, 25 bp, Mus musculus
gaaggtctctgtctgccttacgttg

SEQ ID NO: 431283 - DNA, 25 bp, Mus musculus
gaaggtctctgtgtgccttacgttg

SEQ ID NO: 431284 - DNA, 25 bp, Mus musculus
gaaggtctcttcagatctttcacag

SEQ ID NO: 431285 - DNA, 25 bp, Mus musculus
gaaggtctcttccatagtcagctac

SEQ ID NO: 431286 - DNA, 25 bp, Mus musculus
gaaggtctcttcgatagtcagctac

SEQ ID NO: 431287 - DNA, 25 bp, Mus musculus
gaaggtctcttctgatctttcacag

SEQ ID NO: 431288 - DNA, 25 bp, Mus musculus
gaaggtctgactacgaaggactaga

SEQ ID NO: 431289 - DNA, 25 bp, Mus musculus
gaaggtctgacttcgaaggactaga

SEQ ID NO: 431290 - DNA, 25 bp, Mus musculus
gaaggtctgataccagcctaagaac

SEQ ID NO: 431291 - DNA, 25 bp, Mus musculus
gaaggtctgatagcagcctaagaac

SEQ ID NO: 431292 - DNA, 25 bp, Mus musculus
gaaggtctgcaaaacattcttattt

SEQ ID NO: 431293 - DNA, 25 bp, Mus musculus
gaaggtctgcaaccccgaaaaagat

SEQ ID NO: 431294 - DNA, 25 bp, Mus musculus
gaaggtctgcaagcccgaaaaagat

SEQ ID NO: 431295 - DNA, 25 bp, Mus musculus
gaaggtctgcaatacattcttattt

SEQ ID NO: 431296 - DNA, 25 bp, Mus musculus
gaaggtctgccacccagttctaagg

SEQ ID NO: 431297 - DNA, 25 bp, Mus musculus
gaaggtctgccagccagttctaagg

SEQ ID NO: 431298 - DNA, 25 bp, Mus musculus
gaaggtctggtacgacactgccctg

SEQ ID NO: 431299 - DNA, 25 bp, Mus musculus
gaaggtctggtaggacactgccctg

SEQ ID NO: 431300 - DNA, 25 bp, Mus musculus
gaaggtctgtggagtctctgtccga

SEQ ID NO: 431301 - DNA, 25 bp, Mus musculus
gaaggtctgtggtgtctctgtccga

SEQ ID NO: 431302 - DNA, 25 bp, Mus musculus
gaaggtcttaaaaaatccaataaat

SEQ ID NO: 431303 - DNA, 25 bp, Mus musculus
gaaggtcttaaataatccaataaat

SEQ ID NO: 431304 - DNA, 25 bp, Mus musculus
gaaggtcttagacccagcatcaggg

SEQ ID NO: 431305 - DNA, 25 bp, Mus musculus
gaaggtcttagagccagcatcaggg

SEQ ID NO: 431306 - DNA, 25 bp, Mus musculus
gaaggtcttattcttttggttctct

SEQ ID NO: 431307 - DNA, 25 bp, Mus musculus
gaaggtcttattgttttggttctct

SEQ ID NO: 431308 - DNA, 25 bp, Mus musculus
gaaggtcttcaaccctgtttggcag

SEQ ID NO: 431309 - DNA, 25 bp, Mus musculus
gaaggtcttcaagcctgtttggcag

SEQ ID NO: 431310 - DNA, 25 bp, Mus musculus
gaaggtcttcatcgacagggctaag

SEQ ID NO: 431311 - DNA, 25 bp, Mus musculus
gaaggtcttcatggacagggctaag

SEQ ID NO: 431312 - DNA, 25 bp, Mus musculus
gaaggtcttcccaactgagaatgta

SEQ ID NO: 431313 - DNA, 25 bp, Mus musculus
gaaggtcttccctactgagaatgta

SEQ ID NO: 431314 - DNA, 25 bp, Mus musculus
gaaggtcttcgcaggctattataca

SEQ ID NO: 431315 - DNA, 25 bp, Mus musculus
gaaggtcttcgctggctattataca

SEQ ID NO: 431316 - DNA, 25 bp, Mus musculus
gaaggtcttctccatttatgaggta

SEQ ID NO: 431317 - DNA, 25 bp, Mus musculus
gaaggtcttctcgatttatgaggta

SEQ ID NO: 431318 - DNA, 25 bp, Mus musculus
gaaggtcttgttatcaccactgtat

SEQ ID NO: 431319 - DNA, 25 bp, Mus musculus
gaaggtcttgttttcaccactgtat

SEQ ID NO: 431320 - DNA, 25 bp, Mus musculus
gaaggtctttagatccggatccttg

SEQ ID NO: 431321 - DNA, 25 bp, Mus musculus
gaaggtctttagttccggatccttg

SEQ ID NO: 431322 - DNA, 25 bp, Mus musculus
gaaggtctttcacaagccatccgca

SEQ ID NO: 431323 - DNA, 25 bp, Mus musculus
gaaggtctttcagaagccatccgca

SEQ ID NO: 431324 - DNA, 25 bp, Mus musculus
gaaggtctttgaacactgtgtgaac

SEQ ID NO: 431325 - DNA, 25 bp, Mus musculus
gaaggtctttgacttccacttgcca

SEQ ID NO: 431326 - DNA, 25 bp, Mus musculus
gaaggtctttgagttccacttgcca

SEQ ID NO: 431327 - DNA, 25 bp, Mus musculus
gaaggtctttgatcactgtgtgaac

SEQ ID NO: 431328 - DNA, 25 bp, Mus musculus
gaaggtctttggatatgatgatcac

SEQ ID NO: 431329 - DNA, 25 bp, Mus musculus
gaaggtctttggttatgatgatcac

SEQ ID NO: 431330 - DNA, 25 bp, Mus musculus
gaaggtgaaaggaggcatctaagtt

SEQ ID NO: 431331 - DNA, 25 bp, Mus musculus
gaaggtgaaaggtggcatctaagtt

SEQ ID NO: 431332 - DNA, 25 bp, Mus musculus
gaaggtgaaagtccagttcagtaat

SEQ ID NO: 431333 - DNA, 25 bp, Mus musculus
gaaggtgaaagtgcagttcagtaat

SEQ ID NO: 431334 - DNA, 25 bp, Mus musculus
gaaggtgaaatcctacaagagacag

SEQ ID NO: 431335 - DNA, 25 bp, Mus musculus
gaaggtgaaatcgtacaagagacag

SEQ ID NO: 431336 - DNA, 25 bp, Mus musculus
gaaggtgaacacaaccctcattgct

SEQ ID NO: 431337 - DNA, 25 bp, Mus musculus
gaaggtgaacacaacgtcgccgttg

SEQ ID NO: 431338 - DNA, 25 bp, Mus musculus
gaaggtgaacactaccctcattgct

SEQ ID NO: 431339 - DNA, 25 bp, Mus musculus
gaaggtgaacactacgtcgccgttg

SEQ ID NO: 431340 - DNA, 25 bp, Mus musculus
gaaggtgaacctcagcccaagtttg

SEQ ID NO: 431341 - DNA, 25 bp, Mus musculus
gaaggtgaacctctaccatcactta

SEQ ID NO: 431342 - DNA, 25 bp, Mus musculus
gaaggtgaacctgagcccaagtttg

SEQ ID NO: 431343 - DNA, 25 bp, Mus musculus
gaaggtgaacctgtaccatcactta

SEQ ID NO: 431344 - DNA, 25 bp, Mus musculus
gaaggtgaatctatttggactggaa

SEQ ID NO: 431345 - DNA, 25 bp, Mus musculus
gaaggtgaatctttttggactggaa

SEQ ID NO: 431346 - DNA, 25 bp, Mus musculus
gaaggtgaatgaatgctgcccgtcc

SEQ ID NO: 431347 - DNA, 25 bp, Mus musculus
gaaggtgaatgattgctgcccgtcc

SEQ ID NO: 431348 - DNA, 25 bp, Mus musculus
gaaggtgacaataaaatggtgacaa

SEQ ID NO: 431349 - DNA, 25 bp, Mus musculus
gaaggtgacaattaaatggtgacaa

SEQ ID NO: 431350 - DNA, 25 bp, Mus musculus
gaaggtgacactcactcctgaggaa

SEQ ID NO: 431351 - DNA, 25 bp, Mus musculus
gaaggtgacactgactcctgaggaa

SEQ ID NO: 431352 - DNA, 25 bp, Mus musculus
gaaggtgacagcctgacaatgtgtt

SEQ ID NO: 431353 - DNA, 25 bp, Mus musculus
gaaggtgacagcgtgacaatgtgtt

SEQ ID NO: 431354 - DNA, 25 bp, Mus musculus
gaaggtgacagtccttcctctcctg

SEQ ID NO: 431355 - DNA, 25 bp, Mus musculus
gaaggtgacagtgcttcctctcctg

SEQ ID NO: 431356 - DNA, 25 bp, Mus musculus
gaaggtgacatgactgcacaactgt

SEQ ID NO: 431357 - DNA, 25 bp, Mus musculus
gaaggtgacatgtctgcacaactgt

SEQ ID NO: 431358 - DNA, 25 bp, Mus musculus
gaaggtgaccatcagatgccctgaa

SEQ ID NO: 431359 - DNA, 25 bp, Mus musculus
gaaggtgaccatctatgatcccaga

SEQ ID NO: 431360 - DNA, 25 bp, Mus musculus
gaaggtgaccatgagatgccctgaa

SEQ ID NO: 431361 - DNA, 25 bp, Mus musculus
gaaggtgaccatgtatgatcccaga

SEQ ID NO: 431362 - DNA, 25 bp, Mus musculus
gaaggtgaccccatgcaggtttatg

SEQ ID NO: 431363 - DNA, 25 bp, Mus musculus
gaaggtgaccccttgcaggtttatg

SEQ ID NO: 431364 - DNA, 25 bp, Mus musculus
gaaggtgaccctagaccctttgact

SEQ ID NO: 431365 - DNA, 25 bp, Mus musculus
gaaggtgacccttgaccctttgact

SEQ ID NO: 431366 - DNA, 25 bp, Mus musculus
gaaggtgaccgcagaggacctgatt

SEQ ID NO: 431367 - DNA, 25 bp, Mus musculus
gaaggtgaccgctgaggacctgatt

SEQ ID NO: 431368 - DNA, 25 bp, Mus musculus
gaaggtgaccgtcgagcgtaaacaa

SEQ ID NO: 431369 - DNA, 25 bp, Mus musculus
gaaggtgaccgtggagcgtaaacaa

SEQ ID NO: 431370 - DNA, 25 bp, Mus musculus
gaaggtgaccttaacctatacactt

SEQ ID NO: 431371 - DNA, 25 bp, Mus musculus
gaaggtgacctttacctatacactt

SEQ ID NO: 431372 - DNA, 25 bp, Mus musculus
gaaggtgactgtcttgcctgatgtc

SEQ ID NO: 431373 - DNA, 25 bp, Mus musculus
gaaggtgactgtgttgcctgatgtc

SEQ ID NO: 431374 - DNA, 25 bp, Mus musculus
gaaggtgactttctaggaaggtctt

SEQ ID NO: 431375 - DNA, 25 bp, Mus musculus
gaaggtgactttgtaggaaggtctt

SEQ ID NO: 431376 - DNA, 25 bp, Mus musculus
gaaggtgagactctcaggcagcccc

SEQ ID NO: 431377 - DNA, 25 bp, Mus musculus
gaaggtgagactgtcaggcagcccc

SEQ ID NO: 431378 - DNA, 25 bp, Mus musculus
gaaggtgagctaaacagtctgcaaa

SEQ ID NO: 431379 - DNA, 25 bp, Mus musculus
gaaggtgagctatacagtctgcaaa

SEQ ID NO: 431380 - DNA, 25 bp, Mus musculus
gaaggtgagctgaccatccactgca

SEQ ID NO: 431381 - DNA, 25 bp, Mus musculus
gaaggtgagctgtccatccactgca

SEQ ID NO: 431382 - DNA, 25 bp, Mus musculus
gaaggtgagtccaagatccctcctc

SEQ ID NO: 431383 - DNA, 25 bp, Mus musculus
gaaggtgagtcctagatccctcctc

SEQ ID NO: 431384 - DNA, 25 bp, Mus musculus
gaaggtgatcacaagaccatggcta

SEQ ID NO: 431385 - DNA, 25 bp, Mus musculus
gaaggtgatcactagaccatggcta

SEQ ID NO: 431386 - DNA, 25 bp, Mus musculus
gaaggtgatcctcctatgactcaat

SEQ ID NO: 431387 - DNA, 25 bp, Mus musculus
gaaggtgatcctgctatgactcaat

SEQ ID NO: 431388 - DNA, 25 bp, Mus musculus
gaaggtgatcgccagccttccagac

SEQ ID NO: 431389 - DNA, 25 bp, Mus musculus
gaaggtgatcgcgagccttccagac

SEQ ID NO: 431390 - DNA, 25 bp, Mus musculus
gaaggtgatcttcctccatgtagcc

SEQ ID NO: 431391 - DNA, 25 bp, Mus musculus
gaaggtgatcttgctccatgtagcc

SEQ ID NO: 431392 - DNA, 25 bp, Mus musculus
gaaggtgatggtagcaagactgaat

SEQ ID NO: 431393 - DNA, 25 bp, Mus musculus
gaaggtgatggttgcaagactgaat

SEQ ID NO: 431394 - DNA, 25 bp, Mus musculus
gaaggtgatgtaattttcactttta

SEQ ID NO: 431395 - DNA, 25 bp, Mus musculus
gaaggtgatgtatttttcactttta

SEQ ID NO: 431396 - DNA, 25 bp, Mus musculus
gaaggtgatgttctaaccctgctca

SEQ ID NO: 431397 - DNA, 25 bp, Mus musculus
gaaggtgatgttctagatcctgcct

SEQ ID NO: 431398 - DNA, 25 bp, Mus musculus
gaaggtgatgttgtaaccctgctca

SEQ ID NO: 431399 - DNA, 25 bp, Mus musculus
gaaggtgatgttgtagatcctgcct

SEQ ID NO: 431400 - DNA, 25 bp, Mus musculus
gaaggtgattcactttctgacaatc

SEQ ID NO: 431401 - DNA, 25 bp, Mus musculus
gaaggtgattcagtttctgacaatc

SEQ ID NO: 431402 - DNA, 25 bp, Mus musculus
gaaggtgattccatccgctttggac

SEQ ID NO: 431403 - DNA, 25 bp, Mus musculus
gaaggtgattccttccgctttggac

SEQ ID NO: 431404 - DNA, 25 bp, Mus musculus
gaaggtgcaactcttactctgcagt

SEQ ID NO: 431405 - DNA, 25 bp, Mus musculus
gaaggtgcaactgttactctgcagt

SEQ ID NO: 431406 - DNA, 25 bp, Mus musculus
gaaggtgcaagcatttatgtctact

SEQ ID NO: 431407 - DNA, 25 bp, Mus musculus
gaaggtgcaagcttttatgtctact

SEQ ID NO: 431408 - DNA, 25 bp, Mus musculus
gaaggtgcacagaccactcacaaat

SEQ ID NO: 431409 - DNA, 25 bp, Mus musculus
gaaggtgcacagactctcatgaggg

SEQ ID NO: 431410 - DNA, 25 bp, Mus musculus
gaaggtgcacagtccactcacaaat

SEQ ID NO: 431411 - DNA, 25 bp, Mus musculus
gaaggtgcacagtctctcatgaggg

SEQ ID NO: 431412 - DNA, 25 bp, Mus musculus
gaaggtgcacctccagcttcacggc

SEQ ID NO: 431413 - DNA, 25 bp, Mus musculus
gaaggtgcacctgcagcttcacggc

SEQ ID NO: 431414 - DNA, 25 bp, Mus musculus
gaaggtgcactaacagagcagacat

SEQ ID NO: 431415 - DNA, 25 bp, Mus musculus
gaaggtgcactatcagagcagacat

SEQ ID NO: 431416 - DNA, 25 bp, Mus musculus
gaaggtgccatgcagtcctcttaaa

SEQ ID NO: 431417 - DNA, 25 bp, Mus musculus
gaaggtgccatggagtcctcttaaa

SEQ ID NO: 431418 - DNA, 25 bp, Mus musculus
gaaggtgcccacaacgctggccgag

SEQ ID NO: 431419 - DNA, 25 bp, Mus musculus
gaaggtgcccacaagtaacactgag

SEQ ID NO: 431420 - DNA, 25 bp, Mus musculus
gaaggtgcccactacgctggccgag

SEQ ID NO: 431421 - DNA, 25 bp, Mus musculus
gaaggtgcccactagtaacactgag

SEQ ID NO: 431422 - DNA, 25 bp, Mus musculus
gaaggtgcccatccgtatcatagag

SEQ ID NO: 431423 - DNA, 25 bp, Mus musculus
gaaggtgcccatgcgtatcatagag

SEQ ID NO: 431424 - DNA, 25 bp, Mus musculus
gaaggtgcccgcagtgcagcctgaa

SEQ ID NO: 431425 - DNA, 25 bp, Mus musculus
gaaggtgcccgctgtgcagcctgaa

SEQ ID NO: 431426 - DNA, 25 bp, Mus musculus
gaaggtgccctcagggttctatgtc

SEQ ID NO: 431427 - DNA, 25 bp, Mus musculus
gaaggtgccctctgggttctatgtc

SEQ ID NO: 431428 - DNA, 25 bp, Mus musculus
gaaggtgcctctatcaaggctctat

SEQ ID NO: 431429 - DNA, 25 bp, Mus musculus
gaaggtgcctctttcaaggctctat

SEQ ID NO: 431430 - DNA, 25 bp, Mus musculus
gaaggtgctaaaactgctcatccct

SEQ ID NO: 431431 - DNA, 25 bp, Mus musculus
gaaggtgctaaatctgctcatccct

SEQ ID NO: 431432 - DNA, 25 bp, Mus musculus
gaaggtgctaataccaattgagaaa

SEQ ID NO: 431433 - DNA, 25 bp, Mus musculus
gaaggtgctaattccaattgagaaa

SEQ ID NO: 431434 - DNA, 25 bp, Mus musculus
gaaggtgctcctaaggtctgttcca

SEQ ID NO: 431435 - DNA, 25 bp, Mus musculus
gaaggtgctccttaggtctgttcca

SEQ ID NO: 431436 - DNA, 25 bp, Mus musculus
gaaggtgctgacatgctcaaagatg

SEQ ID NO: 431437 - DNA, 25 bp, Mus musculus
gaaggtgctgacttgctcaaagatg

SEQ ID NO: 431438 - DNA, 25 bp, Mus musculus
gaaggtgctgcaatggtgtcttatg

SEQ ID NO: 431439 - DNA, 25 bp, Mus musculus
gaaggtgctgcattggtgtcttatg

SEQ ID NO: 431440 - DNA, 25 bp, Mus musculus
gaaggtgctgctagacaacctggac

SEQ ID NO: 431441 - DNA, 25 bp, Mus musculus
gaaggtgctgcttgacaacctggac

SEQ ID NO: 431442 - DNA, 25 bp, Mus musculus
gaaggtgctggtctcacacattttt

SEQ ID NO: 431443 - DNA, 25 bp, Mus musculus
gaaggtgctggtgtcacacattttt

SEQ ID NO: 431444 - DNA, 25 bp, Mus musculus
gaaggtgctgtcctttggatttcct

SEQ ID NO: 431445 - DNA, 25 bp, Mus musculus
gaaggtgctgtcgtttggatttcct

SEQ ID NO: 431446 - DNA, 25 bp, Mus musculus
gaaggtgcttctcagcagacacagc

SEQ ID NO: 431447 - DNA, 25 bp, Mus musculus
gaaggtgcttctccatatttgatgt

SEQ ID NO: 431448 - DNA, 25 bp, Mus musculus
gaaggtgcttctgagcagacacagc

SEQ ID NO: 431449 - DNA, 25 bp, Mus musculus
gaaggtgcttctgcatatttgatgt

SEQ ID NO: 431450 - DNA, 25 bp, Mus musculus
gaaggtgcttgcaagcagggacact

SEQ ID NO: 431451 - DNA, 25 bp, Mus musculus
gaaggtgcttgctagcagggacact

SEQ ID NO: 431452 - DNA, 25 bp, Mus musculus
gaaggtgcttggactcctgacacaa

SEQ ID NO: 431453 - DNA, 25 bp, Mus musculus
gaaggtgcttggattgtttgtcatt

SEQ ID NO: 431454 - DNA, 25 bp, Mus musculus
gaaggtgcttggtctcctgacacaa

SEQ ID NO: 431455 - DNA, 25 bp, Mus musculus
gaaggtgcttggtttgtttgtcatt

SEQ ID NO: 431456 - DNA, 25 bp, Mus musculus
gaaggtgcttgtcacagacctaatg

SEQ ID NO: 431457 - DNA, 25 bp, Mus musculus
gaaggtgcttgtgacagacctaatg

SEQ ID NO: 431458 - DNA, 25 bp, Mus musculus
gaaggtggacctcacacccaactat

SEQ ID NO: 431459 - DNA, 25 bp, Mus musculus
gaaggtggacctcagacttctccac

SEQ ID NO: 431460 - DNA, 25 bp, Mus musculus
gaaggtggacctgacacccaactat

SEQ ID NO: 431461 - DNA, 25 bp, Mus musculus
gaaggtggacctgagacttctccac

SEQ ID NO: 431462 - DNA, 25 bp, Mus musculus
gaaggtggagaacacccgccacacc

SEQ ID NO: 431463 - DNA, 25 bp, Mus musculus
gaaggtggagaagacccgccacacc

SEQ ID NO: 431464 - DNA, 25 bp, Mus musculus
gaaggtggagctctccccaaagcaa

SEQ ID NO: 431465 - DNA, 25 bp, Mus musculus
gaaggtggagctgtccccaaagcaa

SEQ ID NO: 431466 - DNA, 25 bp, Mus musculus
gaaggtggattcaagcttgtcgctc

SEQ ID NO: 431467 - DNA, 25 bp, Mus musculus
gaaggtggattcctgagcacgcata

SEQ ID NO: 431468 - DNA, 25 bp, Mus musculus
gaaggtggattcgtgagcacgcata

SEQ ID NO: 431469 - DNA, 25 bp, Mus musculus
gaaggtggattctagcttgtcgctc

SEQ ID NO: 431470 - DNA, 25 bp, Mus musculus
gaaggtggcacaatgcttagtgttt

SEQ ID NO: 431471 - DNA, 25 bp, Mus musculus
gaaggtggcacattgcttagtgttt

SEQ ID NO: 431472 - DNA, 25 bp, Mus musculus
gaaggtggcagccatcatttctgct

SEQ ID NO: 431473 - DNA, 25 bp, Mus musculus
gaaggtggcagcgatcatttctgct

SEQ ID NO: 431474 - DNA, 25 bp, Mus musculus
gaaggtggcgtccacagcctccatt

SEQ ID NO: 431475 - DNA, 25 bp, Mus musculus
gaaggtggcgtcgacagcctccatt

SEQ ID NO: 431476 - DNA, 25 bp, Mus musculus
gaaggtggctagattgcatcagctc

SEQ ID NO: 431477 - DNA, 25 bp, Mus musculus
gaaggtggctagtttgcatcagctc

SEQ ID NO: 431478 - DNA, 25 bp, Mus musculus
gaaggtggctttatatatgttatgt

SEQ ID NO: 431479 - DNA, 25 bp, Mus musculus
gaaggtggctttctcccaaaggtgc

SEQ ID NO: 431480 - DNA, 25 bp, Mus musculus
gaaggtggctttgtcccaaaggtgc

SEQ ID NO: 431481 - DNA, 25 bp, Mus musculus
gaaggtggctttttatatgttatgt

SEQ ID NO: 431482 - DNA, 25 bp, Mus musculus
gaaggtgggataactttcagagaga

SEQ ID NO: 431483 - DNA, 25 bp, Mus musculus
gaaggtgggatatctttcagagaga

SEQ ID NO: 431484 - DNA, 25 bp, Mus musculus
gaaggtgggcacacttaggtttcca

SEQ ID NO: 431485 - DNA, 25 bp, Mus musculus
gaaggtgggcactcttaggtttcca

SEQ ID NO: 431486 - DNA, 25 bp, Mus musculus
gaaggtgggcatacaccagactcgt

SEQ ID NO: 431487 - DNA, 25 bp, Mus musculus
gaaggtgggcatattaatccatatt

SEQ ID NO: 431488 - DNA, 25 bp, Mus musculus
gaaggtgggcatcaccatttctggt

SEQ ID NO: 431489 - DNA, 25 bp, Mus musculus
gaaggtgggcatgaccatttctggt

SEQ ID NO: 431490 - DNA, 25 bp, Mus musculus
gaaggtgggcattcaccagactcgt

SEQ ID NO: 431491 - DNA, 25 bp, Mus musculus
gaaggtgggcattttaatccatatt

SEQ ID NO: 431492 - DNA, 25 bp, Mus musculus
gaaggtgggtcaatgatccagatcc

SEQ ID NO: 431493 - DNA, 25 bp, Mus musculus
gaaggtgggtcattgatccagatcc

SEQ ID NO: 431494 - DNA, 25 bp, Mus musculus
gaaggtggtcagcatctccagtgaa

SEQ ID NO: 431495 - DNA, 25 bp, Mus musculus
gaaggtggtcaggatctccagtgaa

SEQ ID NO: 431496 - DNA, 25 bp, Mus musculus
gaaggtggtctccatactccactga

SEQ ID NO: 431497 - DNA, 25 bp, Mus musculus
gaaggtggtctcgatactccactga

SEQ ID NO: 431498 - DNA, 25 bp, Mus musculus
gaaggtggtgatattccgaagccaa

SEQ ID NO: 431499 - DNA, 25 bp, Mus musculus
gaaggtggtgattttccgaagccaa

SEQ ID NO: 431500 - DNA, 25 bp, Mus musculus
gaaggtgtaacacttcctcccgagg

SEQ ID NO: 431501 - DNA, 25 bp, Mus musculus
gaaggtgtaacagttcctcccgagg

SEQ ID NO: 431502 - DNA, 25 bp, Mus musculus
gaaggtgtaatccacccatgggcct

SEQ ID NO: 431503 - DNA, 25 bp, Mus musculus
gaaggtgtaatcgacccatgggcct

SEQ ID NO: 431504 - DNA, 25 bp, Mus musculus
gaaggtgtaccccaacgttgctgag

SEQ ID NO: 431505 - DNA, 25 bp, Mus musculus
gaaggtgtacccgaacgttgctgag

SEQ ID NO: 431506 - DNA, 25 bp, Mus musculus
gaaggtgtagctcacttgcttatta

SEQ ID NO: 431507 - DNA, 25 bp, Mus musculus
gaaggtgtagctgacttgcttatta

SEQ ID NO: 431508 - DNA, 25 bp, Mus musculus
gaaggtgtaggacccattttcttct

SEQ ID NO: 431509 - DNA, 25 bp, Mus musculus
gaaggtgtaggagccattttcttct

SEQ ID NO: 431510 - DNA, 25 bp, Mus musculus
gaaggtgtatgcctttgaccccaga

SEQ ID NO: 431511 - DNA, 25 bp, Mus musculus
gaaggtgtatgcgtttgaccccaga

SEQ ID NO: 431512 - DNA, 25 bp, Mus musculus
gaaggtgtcaccaaaaatccacaca

SEQ ID NO: 431513 - DNA, 25 bp, Mus musculus
gaaggtgtcacctaaaatccacaca

SEQ ID NO: 431514 - DNA, 25 bp, Mus musculus
gaaggtgtccacctagtacagcagg

SEQ ID NO: 431515 - DNA, 25 bp, Mus musculus
gaaggtgtccacgtagtacagcagg

SEQ ID NO: 431516 - DNA, 25 bp, Mus musculus
gaaggtgtccagcaccgcttcgacc

SEQ ID NO: 431517 - DNA, 25 bp, Mus musculus
gaaggtgtccaggaccgcttcgacc

SEQ ID NO: 431518 - DNA, 25 bp, Mus musculus
gaaggtgtccctaacattattgcta

SEQ ID NO: 431519 - DNA, 25 bp, Mus musculus
gaaggtgtcccttacattattgcta

SEQ ID NO: 431520 - DNA, 25 bp, Mus musculus
gaaggtgtctgtagactcttccagc

SEQ ID NO: 431521 - DNA, 25 bp, Mus musculus
gaaggtgtctgttgactcttccagc

SEQ ID NO: 431522 - DNA, 25 bp, Mus musculus
gaaggtgtcttgctgcaggtaacta

SEQ ID NO: 431523 - DNA, 25 bp, Mus musculus
gaaggtgtcttggtgcaggtaacta

SEQ ID NO: 431524 - DNA, 25 bp, Mus musculus
gaaggtgtgagaccacatgtcctat

SEQ ID NO: 431525 - DNA, 25 bp, Mus musculus
gaaggtgtgagagcacatgtcctat

SEQ ID NO: 431526 - DNA, 25 bp, Mus musculus
gaaggtgtgcgactaacttaaggtt

SEQ ID NO: 431527 - DNA, 25 bp, Mus musculus
gaaggtgtgcgagtaacttaaggtt

SEQ ID NO: 431528 - DNA, 25 bp, Mus musculus
gaaggtgtgctaacctctctggcca

SEQ ID NO: 431529 - DNA, 25 bp, Mus musculus
gaaggtgtgctatcctctctggcca

SEQ ID NO: 431530 - DNA, 25 bp, Mus musculus
gaaggtgtgggtagccaccaccctg

SEQ ID NO: 431531 - DNA, 25 bp, Mus musculus
gaaggtgtgggttgccaccaccctg

SEQ ID NO: 431532 - DNA, 25 bp, Mus musculus
gaaggtgtgtcccaacttggcccac

SEQ ID NO: 431533 - DNA, 25 bp, Mus musculus
gaaggtgtgtcccacagatcatcgc

SEQ ID NO: 431534 - DNA, 25 bp, Mus musculus
gaaggtgtgtccgaacttggcccac

SEQ ID NO: 431535 - DNA, 25 bp, Mus musculus
gaaggtgtgtccgacagatcatcgc

SEQ ID NO: 431536 - DNA, 25 bp, Mus musculus
gaaggtgtgtctacacatactttaa

SEQ ID NO: 431537 - DNA, 25 bp, Mus musculus
gaaggtgtgtcttcacatactttaa

SEQ ID NO: 431538 - DNA, 25 bp, Mus musculus
gaaggtgtgtgcagttgctttcccc

SEQ ID NO: 431539 - DNA, 25 bp, Mus musculus
gaaggtgtgtgctgttgctttcccc

SEQ ID NO: 431540 - DNA, 25 bp, Mus musculus
gaaggtgtgttcatgggtcaataac

SEQ ID NO: 431541 - DNA, 25 bp, Mus musculus
gaaggtgtgttccattcaacgcgtc

SEQ ID NO: 431542 - DNA, 25 bp, Mus musculus
gaaggtgtgttcgattcaacgcgtc

SEQ ID NO: 431543 - DNA, 25 bp, Mus musculus
gaaggtgtgttcttgggtcaataac

SEQ ID NO: 431544 - DNA, 25 bp, Mus musculus
gaaggtgtgttgacctccactgctg

SEQ ID NO: 431545 - DNA, 25 bp, Mus musculus
gaaggtgtgttgtcctccactgctg

SEQ ID NO: 431546 - DNA, 25 bp, Mus musculus
gaaggtgttaccaaagctgcaatag

SEQ ID NO: 431547 - DNA, 25 bp, Mus musculus
gaaggtgttacctaagctgcaatag

SEQ ID NO: 431548 - DNA, 25 bp, Mus musculus
gaaggtgttagacaacggctttgca

SEQ ID NO: 431549 - DNA, 25 bp, Mus musculus
gaaggtgttagagaacggctttgca

SEQ ID NO: 431550 - DNA, 25 bp, Mus musculus
gaaggtgttatgctcatcaagacaa

SEQ ID NO: 431551 - DNA, 25 bp, Mus musculus
gaaggtgttatggtcatcaagacaa

SEQ ID NO: 431552 - DNA, 25 bp, Mus musculus
gaaggtgttcagaccatgtggtcct

SEQ ID NO: 431553 - DNA, 25 bp, Mus musculus
gaaggtgttcagtccatgtggtcct

SEQ ID NO: 431554 - DNA, 25 bp, Mus musculus
gaaggtgttcctctcactcgtgcca

SEQ ID NO: 431555 - DNA, 25 bp, Mus musculus
gaaggtgttcctgtcactcgtgcca

SEQ ID NO: 431556 - DNA, 25 bp, Mus musculus
gaaggtgttctcataaactgttgaa

SEQ ID NO: 431557 - DNA, 25 bp, Mus musculus
gaaggtgttctcttaaactgttgaa

SEQ ID NO: 431558 - DNA, 25 bp, Mus musculus
gaaggtgttggaaccccaagaactg

SEQ ID NO: 431559 - DNA, 25 bp, Mus musculus
gaaggtgttggaacctctgcagctg

SEQ ID NO: 431560 - DNA, 25 bp, Mus musculus
gaaggtgttggatccccaagaactg

SEQ ID NO: 431561 - DNA, 25 bp, Mus musculus
gaaggtgttggatcctctgcagctg

SEQ ID NO: 431562 - DNA, 25 bp, Mus musculus
gaaggtgttgttcatgctggctaaa

SEQ ID NO: 431563 - DNA, 25 bp, Mus musculus
gaaggtgttgttgatgctggctaaa

SEQ ID NO: 431564 - DNA, 25 bp, Mus musculus
gaaggtgttttaaacactctgtgtc

SEQ ID NO: 431565 - DNA, 25 bp, Mus musculus
gaaggtgttttatacactctgtgtc

SEQ ID NO: 431566 - DNA, 25 bp, Mus musculus
gaaggtgtttttcgcatgtgctcgc

SEQ ID NO: 431567 - DNA, 25 bp, Mus musculus
gaaggtgtttttggcatgtgctcgc

SEQ ID NO: 431568 - DNA, 25 bp, Mus musculus
gaaggttaagaactggctagaaaca

SEQ ID NO: 431569 - DNA, 25 bp, Mus musculus
gaaggttaagaagtggctagaaaca

SEQ ID NO: 431570 - DNA, 25 bp, Mus musculus
gaaggttacacacggccagactcaa

SEQ ID NO: 431571 - DNA, 25 bp, Mus musculus
gaaggttacacagggccagactcaa

SEQ ID NO: 431572 - DNA, 25 bp, Mus musculus
gaaggttaccgaaggaggcatgctt

SEQ ID NO: 431573 - DNA, 25 bp, Mus musculus
gaaggttaccgatggaggcatgctt

SEQ ID NO: 431574 - DNA, 25 bp, Mus musculus
gaaggttactgcatgccagccctgg

SEQ ID NO: 431575 - DNA, 25 bp, Mus musculus
gaaggttactgcttgccagccctgg

SEQ ID NO: 431576 - DNA, 25 bp, Mus musculus
gaaggttagccaattcggcttccga

SEQ ID NO: 431577 - DNA, 25 bp, Mus musculus
gaaggttagccatttcggcttccga

SEQ ID NO: 431578 - DNA, 25 bp, Mus musculus
gaaggttagcgcagaggcacatgcc

SEQ ID NO: 431579 - DNA, 25 bp, Mus musculus
gaaggttagcgctgaggcacatgcc

SEQ ID NO: 431580 - DNA, 25 bp, Mus musculus
gaaggttagtccagatccatatccc

SEQ ID NO: 431581 - DNA, 25 bp, Mus musculus
gaaggttagtcctgatccatatccc

SEQ ID NO: 431582 - DNA, 25 bp, Mus musculus
gaaggttatagtataagccccaact

SEQ ID NO: 431583 - DNA, 25 bp, Mus musculus
gaaggttatagtttaagccccaact

SEQ ID NO: 431584 - DNA, 25 bp, Mus musculus
gaaggttatcatctgccatcgaggc

SEQ ID NO: 431585 - DNA, 25 bp, Mus musculus
gaaggttatcatgtgccatcgaggc

SEQ ID NO: 431586 - DNA, 25 bp, Mus musculus
gaaggttatccacagagtgcatttg

SEQ ID NO: 431587 - DNA, 25 bp, Mus musculus
gaaggttatccagagagtgcatttg

SEQ ID NO: 431588 - DNA, 25 bp, Mus musculus
gaaggttatctgctgttgaattcaa

SEQ ID NO: 431589 - DNA, 25 bp, Mus musculus
gaaggttatctggtgttgaattcaa

SEQ ID NO: 431590 - DNA, 25 bp, Mus musculus
gaaggttatgtgacgctcctttctt

SEQ ID NO: 431591 - DNA, 25 bp, Mus musculus
gaaggttatgtgtcgctcctttctt

SEQ ID NO: 431592 - DNA, 25 bp, Mus musculus
gaaggttattgcagctttgtcaaat

SEQ ID NO: 431593 - DNA, 25 bp, Mus musculus
gaaggttattgctgctttgtcaaat

SEQ ID NO: 431594 - DNA, 25 bp, Mus musculus
gaaggttcaagaatgatctccaaag

SEQ ID NO: 431595 - DNA, 25 bp, Mus musculus
gaaggttcaagattgatctccaaag

SEQ ID NO: 431596 - DNA, 25 bp, Mus musculus
gaaggttcacaaaagttacaaggct

SEQ ID NO: 431597 - DNA, 25 bp, Mus musculus
gaaggttcacaatagttacaaggct

SEQ ID NO: 431598 - DNA, 25 bp, Mus musculus
gaaggttcacagcaaatcgcctgct

SEQ ID NO: 431599 - DNA, 25 bp, Mus musculus
gaaggttcacaggaaatcgcctgct

SEQ ID NO: 431600 - DNA, 25 bp, Mus musculus
gaaggttcacccaaaatctgagcca

SEQ ID NO: 431601 - DNA, 25 bp, Mus musculus
gaaggttcaccctaaatctgagcca

SEQ ID NO: 431602 - DNA, 25 bp, Mus musculus
gaaggttcagaaagtgatcctgatt

SEQ ID NO: 431603 - DNA, 25 bp, Mus musculus
gaaggttcagaatgtgatcctgatt

SEQ ID NO: 431604 - DNA, 25 bp, Mus musculus
gaaggttcagacatcttgaataggg

SEQ ID NO: 431605 - DNA, 25 bp, Mus musculus
gaaggttcagacttcttgaataggg

SEQ ID NO: 431606 - DNA, 25 bp, Mus musculus
gaaggttcagtgacctagttccctt

SEQ ID NO: 431607 - DNA, 25 bp, Mus musculus
gaaggttcagtgtcctagttccctt

SEQ ID NO: 431608 - DNA, 25 bp, Mus musculus
gaaggttcatcacccaaggtggatc

SEQ ID NO: 431609 - DNA, 25 bp, Mus musculus
gaaggttcatcagccaaggtggatc

SEQ ID NO: 431610 - DNA, 25 bp, Mus musculus
gaaggttcatgactctgttatccta

SEQ ID NO: 431611 - DNA, 25 bp, Mus musculus
gaaggttcatgagtctgttatccta

SEQ ID NO: 431612 - DNA, 25 bp, Mus musculus
gaaggttccaagacctgggatcgat

SEQ ID NO: 431613 - DNA, 25 bp, Mus musculus
gaaggttccaagagttgcactcacc

SEQ ID NO: 431614 - DNA, 25 bp, Mus musculus
gaaggttccaagtcctgggatcgat

SEQ ID NO: 431615 - DNA, 25 bp, Mus musculus
gaaggttccaagtgttgcactcacc

SEQ ID NO: 431616 - DNA, 25 bp, Mus musculus
gaaggttccatgatgagtcccaggc

SEQ ID NO: 431617 - DNA, 25 bp, Mus musculus
gaaggttccatgttgagtcccaggc

SEQ ID NO: 431618 - DNA, 25 bp, Mus musculus
gaaggttccgatacatctgttagat

SEQ ID NO: 431619 - DNA, 25 bp, Mus musculus
gaaggttccgattcatctgttagat

SEQ ID NO: 431620 - DNA, 25 bp, Mus musculus
gaaggttccgctcaggatggcccac

SEQ ID NO: 431621 - DNA, 25 bp, Mus musculus
gaaggttccgctgaggatggcccac

SEQ ID NO: 431622 - DNA, 25 bp, Mus musculus
gaaggttcctataccacgatgatat

SEQ ID NO: 431623 - DNA, 25 bp, Mus musculus
gaaggttcctattccacgatgatat

SEQ ID NO: 431624 - DNA, 25 bp, Mus musculus
gaaggttcctgtaagcaaaagcttt

SEQ ID NO: 431625 - DNA, 25 bp, Mus musculus
gaaggttcctgtatcagggtgcgca

SEQ ID NO: 431626 - DNA, 25 bp, Mus musculus
gaaggttcctgtctggcttagccag

SEQ ID NO: 431627 - DNA, 25 bp, Mus musculus
gaaggttcctgtgtggcttagccag

SEQ ID NO: 431628 - DNA, 25 bp, Mus musculus
gaaggttcctgttagcaaaagcttt

SEQ ID NO: 431629 - DNA, 25 bp, Mus musculus
gaaggttcctgtttcagggtgcgca

SEQ ID NO: 431630 - DNA, 25 bp, Mus musculus
gaaggttcctttccaaagaatgcca

SEQ ID NO: 431631 - DNA, 25 bp, Mus musculus
gaaggttcctttgcaaagaatgcca

SEQ ID NO: 431632 - DNA, 25 bp, Mus musculus
gaaggttcgagcagttcctatcctg

SEQ ID NO: 431633 - DNA, 25 bp, Mus musculus
gaaggttcgagctgttcctatcctg

SEQ ID NO: 431634 - DNA, 25 bp, Mus musculus
gaaggttcgcacacatgtgaataca

SEQ ID NO: 431635 - DNA, 25 bp, Mus musculus
gaaggttcgcactcatgtgaataca

SEQ ID NO: 431636 - DNA, 25 bp, Mus musculus
gaaggttcggtaattattccctcag

SEQ ID NO: 431637 - DNA, 25 bp, Mus musculus
gaaggttcggtatttattccctcag

SEQ ID NO: 431638 - DNA, 25 bp, Mus musculus
gaaggttctaaaccaggagtctgta

SEQ ID NO: 431639 - DNA, 25 bp, Mus musculus
gaaggttctaaagcaggagtctgta

SEQ ID NO: 431640 - DNA, 25 bp, Mus musculus
gaaggttctcacaggcacaggtaat

SEQ ID NO: 431641 - DNA, 25 bp, Mus musculus
gaaggttctcacatgggcattcata

SEQ ID NO: 431642 - DNA, 25 bp, Mus musculus
gaaggttctcactggcacaggtaat

SEQ ID NO: 431643 - DNA, 25 bp, Mus musculus
gaaggttctcacttgggcattcata

SEQ ID NO: 431644 - DNA, 25 bp, Mus musculus
gaaggttctcataacgaccaatgtc

SEQ ID NO: 431645 - DNA, 25 bp, Mus musculus
gaaggttctcattacgaccaatgtc

SEQ ID NO: 431646 - DNA, 25 bp, Mus musculus
gaaggttctcctatgaaatgggtgg

SEQ ID NO: 431647 - DNA, 25 bp, Mus musculus
gaaggttctcctttgaaatgggtgg

SEQ ID NO: 431648 - DNA, 25 bp, Mus musculus
gaaggttctcttaggtggtgtttct

SEQ ID NO: 431649 - DNA, 25 bp, Mus musculus
gaaggttctctttggtggtgtttct

SEQ ID NO: 431650 - DNA, 25 bp, Mus musculus
gaaggttctgtcaccatgacttgga

SEQ ID NO: 431651 - DNA, 25 bp, Mus musculus
gaaggttctgtctccatgacttgga

SEQ ID NO: 431652 - DNA, 25 bp, Mus musculus
gaaggttctttgcacacagcctact

SEQ ID NO: 431653 - DNA, 25 bp, Mus musculus
gaaggttctttggacacagcctact

SEQ ID NO: 431654 - DNA, 25 bp, Mus musculus
gaaggttgacctcatccacgagaag

SEQ ID NO: 431655 - DNA, 25 bp, Mus musculus
gaaggttgacctgatccacgagaag

SEQ ID NO: 431656 - DNA, 25 bp, Mus musculus
gaaggttgacttaggctgcatatct

SEQ ID NO: 431657 - DNA, 25 bp, Mus musculus
gaaggttgactttggctgcatatct

SEQ ID NO: 431658 - DNA, 25 bp, Mus musculus
gaaggttgagctagcgcagctgcaa

SEQ ID NO: 431659 - DNA, 25 bp, Mus musculus
gaaggttgagcttgcgcagctgcaa

SEQ ID NO: 431660 - DNA, 25 bp, Mus musculus
gaaggttgcactactaagtgtccta

SEQ ID NO: 431661 - DNA, 25 bp, Mus musculus
gaaggttgcacttctaagtgtccta

SEQ ID NO: 431662 - DNA, 25 bp, Mus musculus
gaaggttgccaaacctgatacccgc

SEQ ID NO: 431663 - DNA, 25 bp, Mus musculus
gaaggttgccaatcctgatacccgc

SEQ ID NO: 431664 - DNA, 25 bp, Mus musculus
gaaggttgccgaccagcagagcaca

SEQ ID NO: 431665 - DNA, 25 bp, Mus musculus
gaaggttgccgagcagcagagcaca

SEQ ID NO: 431666 - DNA, 25 bp, Mus musculus
gaaggttgccttaacttcagcatgg

SEQ ID NO: 431667 - DNA, 25 bp, Mus musculus
gaaggttgcctttacttcagcatgg

SEQ ID NO: 431668 - DNA, 25 bp, Mus musculus
gaaggttgcgttaatcttgcagctg

SEQ ID NO: 431669 - DNA, 25 bp, Mus musculus
gaaggttgcgtttatcttgcagctg

SEQ ID NO: 431670 - DNA, 25 bp, Mus musculus
gaaggttgctgaccaaagtgcttgc

SEQ ID NO: 431671 - DNA, 25 bp, Mus musculus
gaaggttgctgagcaaagtgcttgc

SEQ ID NO: 431672 - DNA, 25 bp, Mus musculus
gaaggttggattctctttgtcactg

SEQ ID NO: 431673 - DNA, 25 bp, Mus musculus
gaaggttggattgtctttgtcactg

SEQ ID NO: 431674 - DNA, 25 bp, Mus musculus
gaaggttggcaccattttatctggg

SEQ ID NO: 431675 - DNA, 25 bp, Mus musculus
gaaggttggcacgattttatctggg

SEQ ID NO: 431676 - DNA, 25 bp, Mus musculus
gaaggttggcttatgcatctttagt

SEQ ID NO: 431677 - DNA, 25 bp, Mus musculus
gaaggttggcttttgcatctttagt

SEQ ID NO: 431678 - DNA, 25 bp, Mus musculus
gaaggttgtacacgcctctggctca

SEQ ID NO: 431679 - DNA, 25 bp, Mus musculus
gaaggttgtacaggcctctggctca

SEQ ID NO: 431680 - DNA, 25 bp, Mus musculus
gaaggttgtacccagctatactctt

SEQ ID NO: 431681 - DNA, 25 bp, Mus musculus
gaaggttgtaccgagctatactctt

SEQ ID NO: 431682 - DNA, 25 bp, Mus musculus
gaaggttgtctgaaagttactattt

SEQ ID NO: 431683 - DNA, 25 bp, Mus musculus
gaaggttgtctgtaagttactattt

SEQ ID NO: 431684 - DNA, 25 bp, Mus musculus
gaaggttgtgagaatccatagataa

SEQ ID NO: 431685 - DNA, 25 bp, Mus musculus
gaaggttgtgagtatccatagataa

SEQ ID NO: 431686 - DNA, 25 bp, Mus musculus
gaaggtttaagtatgtgatactctt

SEQ ID NO: 431687 - DNA, 25 bp, Mus musculus
gaaggtttaagtttgtgatactctt

SEQ ID NO: 431688 - DNA, 25 bp, Mus musculus
gaaggtttacaaatctctgcctgga

SEQ ID NO: 431689 - DNA, 25 bp, Mus musculus
gaaggtttacaattctctgcctgga

SEQ ID NO: 431690 - DNA, 25 bp, Mus musculus
gaaggtttacctccctgtagacaat

SEQ ID NO: 431691 - DNA, 25 bp, Mus musculus
gaaggtttacctgcctgtagacaat

SEQ ID NO: 431692 - DNA, 25 bp, Mus musculus
gaaggtttagctatcctgactcagc

SEQ ID NO: 431693 - DNA, 25 bp, Mus musculus
gaaggtttagctttcctgactcagc

SEQ ID NO: 431694 - DNA, 25 bp, Mus musculus
gaaggtttatcaacttgaacttggt

SEQ ID NO: 431695 - DNA, 25 bp, Mus musculus
gaaggtttatcatcttgaacttggt

SEQ ID NO: 431696 - DNA, 25 bp, Mus musculus
gaaggtttatgacctctacgccgta

SEQ ID NO: 431697 - DNA, 25 bp, Mus musculus
gaaggtttatgagctctacgccgta

SEQ ID NO: 431698 - DNA, 25 bp, Mus musculus
gaaggtttatttcaaggctattttg

SEQ ID NO: 431699 - DNA, 25 bp, Mus musculus
gaaggtttatttgaaggctattttg

SEQ ID NO: 431700 - DNA, 25 bp, Mus musculus
gaaggtttcatcacatagctatgga

SEQ ID NO: 431701 - DNA, 25 bp, Mus musculus
gaaggtttcatctcatagctatgga

SEQ ID NO: 431702 - DNA, 25 bp, Mus musculus
gaaggtttccaactaggtacagagg

SEQ ID NO: 431703 - DNA, 25 bp, Mus musculus
gaaggtttccaagtaggtacagagg

SEQ ID NO: 431704 - DNA, 25 bp, Mus musculus
gaaggtttccagaatgacaggaaca

SEQ ID NO: 431705 - DNA, 25 bp, Mus musculus
gaaggtttccagtatgacaggaaca

SEQ ID NO: 431706 - DNA, 25 bp, Mus musculus
gaaggtttccatatgactttccaaa

SEQ ID NO: 431707 - DNA, 25 bp, Mus musculus
gaaggtttccatttgactttccaaa

SEQ ID NO: 431708 - DNA, 25 bp, Mus musculus
gaaggtttccgacagcagctcaact

SEQ ID NO: 431709 - DNA, 25 bp, Mus musculus
gaaggtttccgagagcagctcaact

SEQ ID NO: 431710 - DNA, 25 bp, Mus musculus
gaaggtttccggacagctgaaggct

SEQ ID NO: 431711 - DNA, 25 bp, Mus musculus
gaaggtttccggcacgacgtagtca

SEQ ID NO: 431712 - DNA, 25 bp, Mus musculus
gaaggtttccgggacgacgtagtca

SEQ ID NO: 431713 - DNA, 25 bp, Mus musculus
gaaggtttccggtcagctgaaggct

SEQ ID NO: 431714 - DNA, 25 bp, Mus musculus
gaaggtttccgtcgtgccggaagtg

SEQ ID NO: 431715 - DNA, 25 bp, Mus musculus
gaaggtttccgtggtgccggaagtg

SEQ ID NO: 431716 - DNA, 25 bp, Mus musculus
gaaggtttctaaatctatgccagaa

SEQ ID NO: 431717 - DNA, 25 bp, Mus musculus
gaaggtttctaattctatgccagaa

SEQ ID NO: 431718 - DNA, 25 bp, Mus musculus
gaaggtttctgtaagagagcccaca

SEQ ID NO: 431719 - DNA, 25 bp, Mus musculus
gaaggtttctgttagagagcccaca

SEQ ID NO: 431720 - DNA, 25 bp, Mus musculus
gaaggtttgaatccccttagtgtaa

SEQ ID NO: 431721 - DNA, 25 bp, Mus musculus
gaaggtttgaatgcccttagtgtaa

SEQ ID NO: 431722 - DNA, 25 bp, Mus musculus
gaaggtttgatgcatcagttctcat

SEQ ID NO: 431723 - DNA, 25 bp, Mus musculus
gaaggtttgatggatcagttctcat

SEQ ID NO: 431724 - DNA, 25 bp, Mus musculus
gaaggtttgccactagcttttagtc

SEQ ID NO: 431725 - DNA, 25 bp, Mus musculus
gaaggtttgccagtagcttttagtc

SEQ ID NO: 431726 - DNA, 25 bp, Mus musculus
gaaggtttgctcagctttctataga

SEQ ID NO: 431727 - DNA, 25 bp, Mus musculus
gaaggtttgctctgctttctataga

SEQ ID NO: 431728 - DNA, 25 bp, Mus musculus
gaaggtttgctgagtactttcccaa

SEQ ID NO: 431729 - DNA, 25 bp, Mus musculus
gaaggtttgctgtgtactttcccaa

SEQ ID NO: 431730 - DNA, 25 bp, Mus musculus
gaaggtttgtccacatggcatttgg

SEQ ID NO: 431731 - DNA, 25 bp, Mus musculus
gaaggtttgtcctcatggcatttgg

SEQ ID NO: 431732 - DNA, 25 bp, Mus musculus
gaaggtttgtctcggcaccatgtgt

SEQ ID NO: 431733 - DNA, 25 bp, Mus musculus
gaaggtttgtctgggcaccatgtgt

SEQ ID NO: 431734 - DNA, 25 bp, Mus musculus
gaaggtttgtgtaccgagtccaaat

SEQ ID NO: 431735 - DNA, 25 bp, Mus musculus
gaaggtttgtgtctttccatggtcc

SEQ ID NO: 431736 - DNA, 25 bp, Mus musculus
gaaggtttgtgtgtttccatggtcc

SEQ ID NO: 431737 - DNA, 25 bp, Mus musculus
gaaggtttgtgttccgagtccaaat

SEQ ID NO: 431738 - DNA, 25 bp, Mus musculus
gaaggtttgttcaaccacttacttg

SEQ ID NO: 431739 - DNA, 25 bp, Mus musculus
gaaggtttgttctaccacttacttg

SEQ ID NO: 431740 - DNA, 25 bp, Mus musculus
gaaggtttgtttctggtcgtgaaca

SEQ ID NO: 431741 - DNA, 25 bp, Mus musculus
gaaggtttgtttgtggtcgtgaaca

SEQ ID NO: 431742 - DNA, 25 bp, Mus musculus
gaaggttttaagctatgtggatagt

SEQ ID NO: 431743 - DNA, 25 bp, Mus musculus
gaaggttttaaggtatgtggatagt

SEQ ID NO: 431744 - DNA, 25 bp, Mus musculus
gaaggttttatgacctcagtccgca

SEQ ID NO: 431745 - DNA, 25 bp, Mus musculus
gaaggttttatgtcctcagtccgca

SEQ ID NO: 431746 - DNA, 25 bp, Mus musculus
gaaggttttcacaggttacagactt

SEQ ID NO: 431747 - DNA, 25 bp, Mus musculus
gaaggttttcactggttacagactt

SEQ ID NO: 431748 - DNA, 25 bp, Mus musculus
gaaggttttctaattgtcctgcctt

SEQ ID NO: 431749 - DNA, 25 bp, Mus musculus
gaaggttttctatttgtcctgcctt

SEQ ID NO: 431750 - DNA, 25 bp, Mus musculus
gaaggttttctccaggctgaccata

SEQ ID NO: 431751 - DNA, 25 bp, Mus musculus
gaaggttttctcgaggctgaccata

SEQ ID NO: 431752 - DNA, 25 bp, Mus musculus
gaaggttttgctcaaggtacctttg

SEQ ID NO: 431753 - DNA, 25 bp, Mus musculus
gaaggttttgctctagttggtcttg

SEQ ID NO: 431754 - DNA, 25 bp, Mus musculus
gaaggttttgctgaaggtacctttg

SEQ ID NO: 431755 - DNA, 25 bp, Mus musculus
gaaggttttgctgtagttggtcttg

SEQ ID NO: 431756 - DNA, 25 bp, Mus musculus
gaaggttttggcaacctcggtgctt

SEQ ID NO: 431757 - DNA, 25 bp, Mus musculus
gaaggttttggctacctcggtgctt

SEQ ID NO: 431758 - DNA, 25 bp, Mus musculus
gaaggttttggtaggtgccatatat

SEQ ID NO: 431759 - DNA, 25 bp, Mus musculus
gaaggttttggttggtgccatatat

SEQ ID NO: 431760 - DNA, 25 bp, Mus musculus
gaaggttttgtgaacttgtatttct

SEQ ID NO: 431761 - DNA, 25 bp, Mus musculus
gaaggttttgtgatacagtggccct

SEQ ID NO: 431762 - DNA, 25 bp, Mus musculus
gaaggttttgtgtacttgtatttct

SEQ ID NO: 431763 - DNA, 25 bp, Mus musculus
gaaggttttgtgttacagtggccct

SEQ ID NO: 431764 - DNA, 25 bp, Mus musculus
gaaggtttttgaccctcagagtgat

SEQ ID NO: 431765 - DNA, 25 bp, Mus musculus
gaaggtttttgagcctcagagtgat

SEQ ID NO: 431766 - DNA, 25 bp, Mus musculus
gaagtaaaagtcacccgagtctcag

SEQ ID NO: 431767 - DNA, 25 bp, Mus musculus
gaagtaaaagtctcccgagtctcag

SEQ ID NO: 431768 - DNA, 25 bp, Mus musculus
gaagtaaccaccatgaagcctgcaa

SEQ ID NO: 431769 - DNA, 25 bp, Mus musculus
gaagtaaccaccttgaagcctgcaa

SEQ ID NO: 431770 - DNA, 25 bp, Mus musculus
gaagtaaccataaaccattcccagc

SEQ ID NO: 431771 - DNA, 25 bp, Mus musculus
gaagtaaccatataccattcccagc

SEQ ID NO: 431772 - DNA, 25 bp, Mus musculus
gaagtaaccatcaagcgagggcctg

SEQ ID NO: 431773 - DNA, 25 bp, Mus musculus
gaagtaaccatctagcgagggcctg

SEQ ID NO: 431774 - DNA, 25 bp, Mus musculus
gaagtaaccatgagcaggcaacgtt

SEQ ID NO: 431775 - DNA, 25 bp, Mus musculus
gaagtaaccatgtgcaggcaacgtt

SEQ ID NO: 431776 - DNA, 25 bp, Mus musculus
gaagtaaccgctagtgatgtctccg

SEQ ID NO: 431777 - DNA, 25 bp, Mus musculus
gaagtaaccgcttgtgatgtctccg

SEQ ID NO: 431778 - DNA, 25 bp, Mus musculus
gaagtaacgcctccaactgttgtcg

SEQ ID NO: 431779 - DNA, 25 bp, Mus musculus
gaagtaacgcctgcaactgttgtcg

SEQ ID NO: 431780 - DNA, 25 bp, Mus musculus
gaagtaacgctactccgggacaatc

SEQ ID NO: 431781 - DNA, 25 bp, Mus musculus
gaagtaacgctagtccgggacaatc

SEQ ID NO: 431782 - DNA, 25 bp, Mus musculus
gaagtaactaaccatactcactatg

SEQ ID NO: 431783 - DNA, 25 bp, Mus musculus
gaagtaactaacgatactcactatg

SEQ ID NO: 431784 - DNA, 25 bp, Mus musculus
gaagtaactaataaccttggaacag

SEQ ID NO: 431785 - DNA, 25 bp, Mus musculus
gaagtaactaattaccttggaacag

SEQ ID NO: 431786 - DNA, 25 bp, Mus musculus
gaagtaactcaacccttctcttgaa

SEQ ID NO: 431787 - DNA, 25 bp, Mus musculus
gaagtaactcaagccttctcttgaa

SEQ ID NO: 431788 - DNA, 25 bp, Mus musculus
gaagtaactcatcaagcctcgtgta

SEQ ID NO: 431789 - DNA, 25 bp, Mus musculus
gaagtaactcatgaagcctcgtgta

SEQ ID NO: 431790 - DNA, 25 bp, Mus musculus
gaagtaactgctacacagggcatac

SEQ ID NO: 431791 - DNA, 25 bp, Mus musculus
gaagtaactgcttcacagggcatac

SEQ ID NO: 431792 - DNA, 25 bp, Mus musculus
gaagtaactggactcacacccaagt

SEQ ID NO: 431793 - DNA, 25 bp, Mus musculus
gaagtaactggagtcacacccaagt

SEQ ID NO: 431794 - DNA, 25 bp, Mus musculus
gaagtaactggtcacgaggcttccc

SEQ ID NO: 431795 - DNA, 25 bp, Mus musculus
gaagtaactggtgacgaggcttccc

SEQ ID NO: 431796 - DNA, 25 bp, Mus musculus
gaagtaactgtacgctagggaagta

SEQ ID NO: 431797 - DNA, 25 bp, Mus musculus
gaagtaactgtaggctagggaagta

SEQ ID NO: 431798 - DNA, 25 bp, Mus musculus
gaagtaactttaccacactgtgaac

SEQ ID NO: 431799 - DNA, 25 bp, Mus musculus
gaagtaactttagcacactgtgaac

SEQ ID NO: 431800 - DNA, 25 bp, Mus musculus
gaagtaactttcaatccctgatgcc

SEQ ID NO: 431801 - DNA, 25 bp, Mus musculus
gaagtaactttctatccctgatgcc

SEQ ID NO: 431802 - DNA, 25 bp, Mus musculus
gaagtaagaagcactcgggcagcgt

SEQ ID NO: 431803 - DNA, 25 bp, Mus musculus
gaagtaagaagctctcgggcagcgt

SEQ ID NO: 431804 - DNA, 25 bp, Mus musculus
gaagtaagaatccaagcgtgtgcat

SEQ ID NO: 431805 - DNA, 25 bp, Mus musculus
gaagtaagaatcgaagcgtgtgcat

SEQ ID NO: 431806 - DNA, 25 bp, Mus musculus
gaagtaagagctactcgcggccagc

SEQ ID NO: 431807 - DNA, 25 bp, Mus musculus
gaagtaagagcttctcgcggccagc

SEQ ID NO: 431808 - DNA, 25 bp, Mus musculus
gaagtaagaggtaagttcatcactg

SEQ ID NO: 431809 - DNA, 25 bp, Mus musculus
gaagtaagaggttagttcatcactg

SEQ ID NO: 431810 - DNA, 25 bp, Mus musculus
gaagtaagatttcctgtctctgaca

SEQ ID NO: 431811 - DNA, 25 bp, Mus musculus
gaagtaagatttgctgtctctgaca

SEQ ID NO: 431812 - DNA, 25 bp, Mus musculus
gaagtaagcactcctcccaaggtga

SEQ ID NO: 431813 - DNA, 25 bp, Mus musculus
gaagtaagcactgctcccaaggtga

SEQ ID NO: 431814 - DNA, 25 bp, Mus musculus
gaagtaaggactccctggctaccca

SEQ ID NO: 431815 - DNA, 25 bp, Mus musculus
gaagtaaggactgcctggctaccca

SEQ ID NO: 431816 - DNA, 25 bp, Mus musculus
gaagtaaggcctcgtacctgcttta

SEQ ID NO: 431817 - DNA, 25 bp, Mus musculus
gaagtaaggcctggtacctgcttta

SEQ ID NO: 431818 - DNA, 25 bp, Mus musculus
gaagtaagtctcaatcctgatcagc

SEQ ID NO: 431819 - DNA, 25 bp, Mus musculus
gaagtaagtctctatcctgatcagc

SEQ ID NO: 431820 - DNA, 25 bp, Mus musculus
gaagtaataatgaacatgcccagaa

SEQ ID NO: 431821 - DNA, 25 bp, Mus musculus
gaagtaataatgtacatgcccagaa

SEQ ID NO: 431822 - DNA, 25 bp, Mus musculus
gaagtaatacaaatggtctacacat

SEQ ID NO: 431823 - DNA, 25 bp, Mus musculus
gaagtaatacaacattggctgtctt

SEQ ID NO: 431824 - DNA, 25 bp, Mus musculus
gaagtaatacaagattggctgtctt

SEQ ID NO: 431825 - DNA, 25 bp, Mus musculus
gaagtaatacaattggtctacacat

SEQ ID NO: 431826 - DNA, 25 bp, Mus musculus
gaagtaataccacaggagtttcaaa

SEQ ID NO: 431827 - DNA, 25 bp, Mus musculus
gaagtaataccagaggagtttcaaa

SEQ ID NO: 431828 - DNA, 25 bp, Mus musculus
gaagtaatacccagacacacatatg

SEQ ID NO: 431829 - DNA, 25 bp, Mus musculus
gaagtaataccctgacacacatatg

SEQ ID NO: 431830 - DNA, 25 bp, Mus musculus
gaagtaatatcccttctcactggcc

SEQ ID NO: 431831 - DNA, 25 bp, Mus musculus
gaagtaatatccgttctcactggcc

SEQ ID NO: 431832 - DNA, 25 bp, Mus musculus
gaagtaatattcagcctatacgtta

SEQ ID NO: 431833 - DNA, 25 bp, Mus musculus
gaagtaatattctgcctatacgtta

SEQ ID NO: 431834 - DNA, 25 bp, Mus musculus
gaagtaatcatcaaggacattttca

SEQ ID NO: 431835 - DNA, 25 bp, Mus musculus
gaagtaatcatcacaggaccgctac

SEQ ID NO: 431836 - DNA, 25 bp, Mus musculus
gaagtaatcatctaggacattttca

SEQ ID NO: 431837 - DNA, 25 bp, Mus musculus
gaagtaatcatctcaggaccgctac

SEQ ID NO: 431838 - DNA, 25 bp, Mus musculus
gaagtaatccgtctgggacacagtt

SEQ ID NO: 431839 - DNA, 25 bp, Mus musculus
gaagtaatccgtgtgggacacagtt

SEQ ID NO: 431840 - DNA, 25 bp, Mus musculus
gaagtaatcctacccaacctgaatt

SEQ ID NO: 431841 - DNA, 25 bp, Mus musculus
gaagtaatcctagccaacctgaatt

SEQ ID NO: 431842 - DNA, 25 bp, Mus musculus
gaagtaatcctgctagttgatgtgg

SEQ ID NO: 431843 - DNA, 25 bp, Mus musculus
gaagtaatcctggtagttgatgtgg

SEQ ID NO: 431844 - DNA, 25 bp, Mus musculus
gaagtaatctccaggcttggaagtt

SEQ ID NO: 431845 - DNA, 25 bp, Mus musculus
gaagtaatctcctggcttggaagtt

SEQ ID NO: 431846 - DNA, 25 bp, Mus musculus
gaagtaatctgaactgttctctgaa

SEQ ID NO: 431847 - DNA, 25 bp, Mus musculus
gaagtaatctgatctgttctctgaa

SEQ ID NO: 431848 - DNA, 25 bp, Mus musculus
gaagtaatgcaaatcctctgggaat

SEQ ID NO: 431849 - DNA, 25 bp, Mus musculus
gaagtaatgcaattcctctgggaat

SEQ ID NO: 431850 - DNA, 25 bp, Mus musculus
gaagtaatgtatattctccttaaag

SEQ ID NO: 431851 - DNA, 25 bp, Mus musculus
gaagtaatgtattttctccttaaag

SEQ ID NO: 431852 - DNA, 25 bp, Mus musculus
gaagtaattaacactgtcatgctag

SEQ ID NO: 431853 - DNA, 25 bp, Mus musculus
gaagtaattaactctgtcatgctag

SEQ ID NO: 431854 - DNA, 25 bp, Mus musculus
gaagtaattccaagtcttgtccaga

SEQ ID NO: 431855 - DNA, 25 bp, Mus musculus
gaagtaattccaccaatgagagatt

SEQ ID NO: 431856 - DNA, 25 bp, Mus musculus
gaagtaattccagcaatgagagatt

SEQ ID NO: 431857 - DNA, 25 bp, Mus musculus
gaagtaattccatgtcttgtccaga

SEQ ID NO: 431858 - DNA, 25 bp, Mus musculus
gaagtaattggtcaaccggaagaga

SEQ ID NO: 431859 - DNA, 25 bp, Mus musculus
gaagtaattggtgaaccggaagaga

SEQ ID NO: 431860 - DNA, 25 bp, Mus musculus
gaagtaatttcaatactgttcaggg

SEQ ID NO: 431861 - DNA, 25 bp, Mus musculus
gaagtaatttcattactgttcaggg

SEQ ID NO: 431862 - DNA, 25 bp, Mus musculus
gaagtaattttcacgaagtcacaga

SEQ ID NO: 431863 - DNA, 25 bp, Mus musculus
gaagtaattttctcgaagtcacaga

SEQ ID NO: 431864 - DNA, 25 bp, Mus musculus
gaagtacaaaccagtctgcaaccag

SEQ ID NO: 431865 - DNA, 25 bp, Mus musculus
gaagtacaaacctgtctgcaaccag

SEQ ID NO: 431866 - DNA, 25 bp, Mus musculus
gaagtacaacctaattacagtgaac

SEQ ID NO: 431867 - DNA, 25 bp, Mus musculus
gaagtacaaccttattacagtgaac

SEQ ID NO: 431868 - DNA, 25 bp, Mus musculus
gaagtacaagaaataccatcaggga

SEQ ID NO: 431869 - DNA, 25 bp, Mus musculus
gaagtacaagaattaccatcaggga

SEQ ID NO: 431870 - DNA, 25 bp, Mus musculus
gaagtacaagcgcactccagccctg

SEQ ID NO: 431871 - DNA, 25 bp, Mus musculus
gaagtacaagcggactccagccctg

SEQ ID NO: 431872 - DNA, 25 bp, Mus musculus
gaagtacaatatagcactcctgtaa

SEQ ID NO: 431873 - DNA, 25 bp, Mus musculus
gaagtacaatattgcactcctgtaa

SEQ ID NO: 431874 - DNA, 25 bp, Mus musculus
gaagtacacagactgcctgcagctg

SEQ ID NO: 431875 - DNA, 25 bp, Mus musculus
gaagtacacagagtgcctgcagctg

SEQ ID NO: 431876 - DNA, 25 bp, Mus musculus
gaagtacactaactccatccagaaa

SEQ ID NO: 431877 - DNA, 25 bp, Mus musculus
gaagtacactaagtccatccagaaa

SEQ ID NO: 431878 - DNA, 25 bp, Mus musculus
gaagtacacttcctcttttgaacat

SEQ ID NO: 431879 - DNA, 25 bp, Mus musculus
gaagtacacttcgtcttttgaacat

SEQ ID NO: 431880 - DNA, 25 bp, Mus musculus
gaagtacagcaccttatgttctatt

SEQ ID NO: 431881 - DNA, 25 bp, Mus musculus
gaagtacagcacgttatgttctatt

SEQ ID NO: 431882 - DNA, 25 bp, Mus musculus
gaagtacagtccatgctgttgtctt

SEQ ID NO: 431883 - DNA, 25 bp, Mus musculus
gaagtacagtccttgctgttgtctt

SEQ ID NO: 431884 - DNA, 25 bp, Mus musculus
gaagtacagtctaggtcacctcatg

SEQ ID NO: 431885 - DNA, 25 bp, Mus musculus
gaagtacagtcttggtcacctcatg

SEQ ID NO: 431886 - DNA, 25 bp, Mus musculus
gaagtacatccaaaagcttcccacc

SEQ ID NO: 431887 - DNA, 25 bp, Mus musculus
gaagtacatccacttgctctgaata

SEQ ID NO: 431888 - DNA, 25 bp, Mus musculus
gaagtacatccagttgctctgaata

SEQ ID NO: 431889 - DNA, 25 bp, Mus musculus
gaagtacatccataagcttcccacc

SEQ ID NO: 431890 - DNA, 25 bp, Mus musculus
gaagtacatggacgatcagaagaac

SEQ ID NO: 431891 - DNA, 25 bp, Mus musculus
gaagtacatggaggatcagaagaac

SEQ ID NO: 431892 - DNA, 25 bp, Mus musculus
gaagtaccaagccaattgtcctaca

SEQ ID NO: 431893 - DNA, 25 bp, Mus musculus
gaagtaccaagcgaattgtcctaca

SEQ ID NO: 431894 - DNA, 25 bp, Mus musculus
gaagtaccaataaatgccaccgcat

SEQ ID NO: 431895 - DNA, 25 bp, Mus musculus
gaagtaccaatatatgccaccgcat

SEQ ID NO: 431896 - DNA, 25 bp, Mus musculus
gaagtaccagatccagcccaagtga

SEQ ID NO: 431897 - DNA, 25 bp, Mus musculus
gaagtaccagatgcagcccaagtga

SEQ ID NO: 431898 - DNA, 25 bp, Mus musculus
gaagtaccagcaccatgggtttcct

SEQ ID NO: 431899 - DNA, 25 bp, Mus musculus
gaagtaccagcagcatgggtttcct

SEQ ID NO: 431900 - DNA, 25 bp, Mus musculus
gaagtaccatgactatatgattcac

SEQ ID NO: 431901 - DNA, 25 bp, Mus musculus
gaagtaccatgagtatatgattcac

SEQ ID NO: 431902 - DNA, 25 bp, Mus musculus
gaagtaccattcatcataagaccag

SEQ ID NO: 431903 - DNA, 25 bp, Mus musculus
gaagtaccattcttcataagaccag

SEQ ID NO: 431904 - DNA, 25 bp, Mus musculus
gaagtaccccaactctgtgtacctg

SEQ ID NO: 431905 - DNA, 25 bp, Mus musculus
gaagtaccccaagtctgtgtacctg

SEQ ID NO: 431906 - DNA, 25 bp, Mus musculus
gaagtaccctagcacagtgcttact

SEQ ID NO: 431907 - DNA, 25 bp, Mus musculus
gaagtaccctaggacagtgcttact

SEQ ID NO: 431908 - DNA, 25 bp, Mus musculus
gaagtacctagtcgacccagacgga

SEQ ID NO: 431909 - DNA, 25 bp, Mus musculus
gaagtacctagtggacccagacgga

SEQ ID NO: 431910 - DNA, 25 bp, Mus musculus
gaagtacctataacagacaaatttt

SEQ ID NO: 431911 - DNA, 25 bp, Mus musculus
gaagtacctatatcagacaaatttt

SEQ ID NO: 431912 - DNA, 25 bp, Mus musculus
gaagtacctctactattcctttact

SEQ ID NO: 431913 - DNA, 25 bp, Mus musculus
gaagtacctctagtattcctttact

SEQ ID NO: 431914 - DNA, 25 bp, Mus musculus
gaagtacctctgaattctctcaaag

SEQ ID NO: 431915 - DNA, 25 bp, Mus musculus
gaagtacctctgtattctctcaaag

SEQ ID NO: 431916 - DNA, 25 bp, Mus musculus
gaagtacctgcccagagaaacactt

SEQ ID NO: 431917 - DNA, 25 bp, Mus musculus
gaagtacctgccgagagaaacactt

SEQ ID NO: 431918 - DNA, 25 bp, Mus musculus
gaagtacctgttctgccatagaatg

SEQ ID NO: 431919 - DNA, 25 bp, Mus musculus
gaagtacctgttgtgccatagaatg

SEQ ID NO: 431920 - DNA, 25 bp, Mus musculus
gaagtaccttttcatggtccctaat

SEQ ID NO: 431921 - DNA, 25 bp, Mus musculus
gaagtaccttttgatggtccctaat

SEQ ID NO: 431922 - DNA, 25 bp, Mus musculus
gaagtacgagccatcgaggctccta

SEQ ID NO: 431923 - DNA, 25 bp, Mus musculus
gaagtacgagccttcgaggctccta

SEQ ID NO: 431924 - DNA, 25 bp, Mus musculus
gaagtacgcctgaacacacctggag

SEQ ID NO: 431925 - DNA, 25 bp, Mus musculus
gaagtacgcctgtacacacctggag

SEQ ID NO: 431926 - DNA, 25 bp, Mus musculus
gaagtacgggcgctctacaaccact

SEQ ID NO: 431927 - DNA, 25 bp, Mus musculus
gaagtacgggcggtctacaaccact

SEQ ID NO: 431928 - DNA, 25 bp, Mus musculus
gaagtacgtcatcaacatctcgctg

SEQ ID NO: 431929 - DNA, 25 bp, Mus musculus
gaagtacgtcatgaacatctcgctg

SEQ ID NO: 431930 - DNA, 25 bp, Mus musculus
gaagtactaaaaaggcggcagcgcc

SEQ ID NO: 431931 - DNA, 25 bp, Mus musculus
gaagtactaaaatggcggcagcgcc

SEQ ID NO: 431932 - DNA, 25 bp, Mus musculus
gaagtactaggaaaactgacctaat

SEQ ID NO: 431933 - DNA, 25 bp, Mus musculus
gaagtactaggataactgacctaat

SEQ ID NO: 431934 - DNA, 25 bp, Mus musculus
gaagtactatgacggatcacatctt

SEQ ID NO: 431935 - DNA, 25 bp, Mus musculus
gaagtactatgagggatcacatctt

SEQ ID NO: 431936 - DNA, 25 bp, Mus musculus
gaagtactcaagactcttgggtaga

SEQ ID NO: 431937 - DNA, 25 bp, Mus musculus
gaagtactcaagtctcttgggtaga

SEQ ID NO: 431938 - DNA, 25 bp, Mus musculus
gaagtactcaccacacataatgact

SEQ ID NO: 431939 - DNA, 25 bp, Mus musculus
gaagtactcacctcacataatgact

SEQ ID NO: 431940 - DNA, 25 bp, Mus musculus
gaagtactcagaactccgattccga

SEQ ID NO: 431941 - DNA, 25 bp, Mus musculus
gaagtactcagatctccgattccga

SEQ ID NO: 431942 - DNA, 25 bp, Mus musculus
gaagtactcagtcactttaagtgga

SEQ ID NO: 431943 - DNA, 25 bp, Mus musculus
gaagtactcagtgactttaagtgga

SEQ ID NO: 431944 - DNA, 25 bp, Mus musculus
gaagtactccttattccaacaattt

SEQ ID NO: 431945 - DNA, 25 bp, Mus musculus
gaagtactcctttttccaacaattt

SEQ ID NO: 431946 - DNA, 25 bp, Mus musculus
gaagtactcgagacagtgatgctac

SEQ ID NO: 431947 - DNA, 25 bp, Mus musculus
gaagtactcgagtcagtgatgctac

SEQ ID NO: 431948 - DNA, 25 bp, Mus musculus
gaagtactctgccaatccaatgaaa

SEQ ID NO: 431949 - DNA, 25 bp, Mus musculus
gaagtactctgcgaatccaatgaaa

SEQ ID NO: 431950 - DNA, 25 bp, Mus musculus
gaagtactgaagaaatgtggcttag

SEQ ID NO: 431951 - DNA, 25 bp, Mus musculus
gaagtactgaagtaatgtggcttag

SEQ ID NO: 431952 - DNA, 25 bp, Mus musculus
gaagtactgaccacctaatatttaa

SEQ ID NO: 431953 - DNA, 25 bp, Mus musculus
gaagtactgacctcctaatatttaa

SEQ ID NO: 431954 - DNA, 25 bp, Mus musculus
gaagtactgcaaacctgacatctgg

SEQ ID NO: 431955 - DNA, 25 bp, Mus musculus
gaagtactgcaatcctgacatctgg

SEQ ID NO: 431956 - DNA, 25 bp, Mus musculus
gaagtactgctgagcccggtcggct

SEQ ID NO: 431957 - DNA, 25 bp, Mus musculus
gaagtactgctgtgcccggtcggct

SEQ ID NO: 431958 - DNA, 25 bp, Mus musculus
gaagtactgcttaaatttaagccct

SEQ ID NO: 431959 - DNA, 25 bp, Mus musculus
gaagtactgctttaatttaagccct

SEQ ID NO: 431960 - DNA, 25 bp, Mus musculus
gaagtactggacatcttgagccgcc

SEQ ID NO: 431961 - DNA, 25 bp, Mus musculus
gaagtactggacttcttgagccgcc

SEQ ID NO: 431962 - DNA, 25 bp, Mus musculus
gaagtactggcgacatactcaggct

SEQ ID NO: 431963 - DNA, 25 bp, Mus musculus
gaagtactggcgtcatactcaggct

SEQ ID NO: 431964 - DNA, 25 bp, Mus musculus
gaagtactggtaacatggctcacca

SEQ ID NO: 431965 - DNA, 25 bp, Mus musculus
gaagtactggtatcatggctcacca

SEQ ID NO: 431966 - DNA, 25 bp, Mus musculus
gaagtactgtagaacactccgagga

SEQ ID NO: 431967 - DNA, 25 bp, Mus musculus
gaagtactgtagtacactccgagga

SEQ ID NO: 431968 - DNA, 25 bp, Mus musculus
gaagtactgtgtatggtaccagcat

SEQ ID NO: 431969 - DNA, 25 bp, Mus musculus
gaagtactgtgtttggtaccagcat

SEQ ID NO: 431970 - DNA, 25 bp, Mus musculus
gaagtacttactctggccttttagt

SEQ ID NO: 431971 - DNA, 25 bp, Mus musculus
gaagtacttactgtggccttttagt

SEQ ID NO: 431972 - DNA, 25 bp, Mus musculus
gaagtacttcagaagcctgttggag

SEQ ID NO: 431973 - DNA, 25 bp, Mus musculus
gaagtacttcagtagcctgttggag

SEQ ID NO: 431974 - DNA, 25 bp, Mus musculus
gaagtacttgcaacataacagtcta

SEQ ID NO: 431975 - DNA, 25 bp, Mus musculus
gaagtacttgcatcataacagtcta

SEQ ID NO: 431976 - DNA, 25 bp, Mus musculus
gaagtacttggcaccgtcagagcgc

SEQ ID NO: 431977 - DNA, 25 bp, Mus musculus
gaagtacttggctccgtcagagcgc

SEQ ID NO: 431978 - DNA, 25 bp, Mus musculus
gaagtactttgtcctattcacaatg

SEQ ID NO: 431979 - DNA, 25 bp, Mus musculus
gaagtactttgtgctattcacaatg

SEQ ID NO: 431980 - DNA, 25 bp, Mus musculus
gaagtagaaccaagtttcctacgac

SEQ ID NO: 431981 - DNA, 25 bp, Mus musculus
gaagtagaaccatgtttcctacgac

SEQ ID NO: 431982 - DNA, 25 bp, Mus musculus
gaagtagaacgtcaatttgaaagct

SEQ ID NO: 431983 - DNA, 25 bp, Mus musculus
gaagtagaacgtgaatttgaaagct

SEQ ID NO: 431984 - DNA, 25 bp, Mus musculus
gaagtagaagttctcctccagtgtc

SEQ ID NO: 431985 - DNA, 25 bp, Mus musculus
gaagtagaagttgtcctccagtgtc

SEQ ID NO: 431986 - DNA, 25 bp, Mus musculus
gaagtagaattgacccagggaatag

SEQ ID NO: 431987 - DNA, 25 bp, Mus musculus
gaagtagaattgtcccagggaatag

SEQ ID NO: 431988 - DNA, 25 bp, Mus musculus
gaagtagacactagtgtgttactac

SEQ ID NO: 431989 - DNA, 25 bp, Mus musculus
gaagtagacacttgtgtgttactac

SEQ ID NO: 431990 - DNA, 25 bp, Mus musculus
gaagtagaccttcgctgtaaacaca

SEQ ID NO: 431991 - DNA, 25 bp, Mus musculus
gaagtagaccttggctgtaaacaca

SEQ ID NO: 431992 - DNA, 25 bp, Mus musculus
gaagtagacgctaacactgcaagaa

SEQ ID NO: 431993 - DNA, 25 bp, Mus musculus
gaagtagacgcttacactgcaagaa

SEQ ID NO: 431994 - DNA, 25 bp, Mus musculus
gaagtagacttacatgtgtgcttaa

SEQ ID NO: 431995 - DNA, 25 bp, Mus musculus
gaagtagacttagatgtgtgcttaa

SEQ ID NO: 431996 - DNA, 25 bp, Mus musculus
gaagtagagaaaaccgtttgttcat

SEQ ID NO: 431997 - DNA, 25 bp, Mus musculus
gaagtagagaaatccgtttgttcat

SEQ ID NO: 431998 - DNA, 25 bp, Mus musculus
gaagtagagcctaaaacagcatctt

SEQ ID NO: 431999 - DNA, 25 bp, Mus musculus
gaagtagagccttaaacagcatctt

SEQ ID NO: 432000 - DNA, 25 bp, Mus musculus
gaagtagaggatctcagcgcaactc

SEQ ID NO: 432001 - DNA, 25 bp, Mus musculus
gaagtagaggatgtcagcgcaactc

SEQ ID NO: 432002 - DNA, 25 bp, Mus musculus
gaagtagaggcccattagtcgtgca

SEQ ID NO: 432003 - DNA, 25 bp, Mus musculus
gaagtagaggccgattagtcgtgca

SEQ ID NO: 432004 - DNA, 25 bp, Mus musculus
gaagtagagtccaggttttccttat

SEQ ID NO: 432005 - DNA, 25 bp, Mus musculus
gaagtagagtcctggttttccttat

SEQ ID NO: 432006 - DNA, 25 bp, Mus musculus
gaagtagatgaccttggccagcctt

SEQ ID NO: 432007 - DNA, 25 bp, Mus musculus
gaagtagatgacgttggccagcctt

SEQ ID NO: 432008 - DNA, 25 bp, Mus musculus
gaagtagatgagactgcccaggact

SEQ ID NO: 432009 - DNA, 25 bp, Mus musculus
gaagtagatgagtctgcccaggact

SEQ ID NO: 432010 - DNA, 25 bp, Mus musculus
gaagtagatgatcccgtgccatgat

SEQ ID NO: 432011 - DNA, 25 bp, Mus musculus
gaagtagatgatctcttcagcaata

SEQ ID NO: 432012 - DNA, 25 bp, Mus musculus
gaagtagatgatgccgtgccatgat

SEQ ID NO: 432013 - DNA, 25 bp, Mus musculus
gaagtagatgatgtcttcagcaata

SEQ ID NO: 432014 - DNA, 25 bp, Mus musculus
gaagtagattccctgtcctggcaat

SEQ ID NO: 432015 - DNA, 25 bp, Mus musculus
gaagtagattccgtgtcctggcaat

SEQ ID NO: 432016 - DNA, 25 bp, Mus musculus
gaagtagcaaagaaacaactctcca

SEQ ID NO: 432017 - DNA, 25 bp, Mus musculus
gaagtagcaaagtaacaactctcca

SEQ ID NO: 432018 - DNA, 25 bp, Mus musculus
gaagtagcactgacaccttcctttc

SEQ ID NO: 432019 - DNA, 25 bp, Mus musculus
gaagtagcactgtcaccttcctttc

SEQ ID NO: 432020 - DNA, 25 bp, Mus musculus
gaagtagcagctcattccttgggct

SEQ ID NO: 432021 - DNA, 25 bp, Mus musculus
gaagtagcagctgattccttgggct

SEQ ID NO: 432022 - DNA, 25 bp, Mus musculus
gaagtagcaggtatgtcctacacca

SEQ ID NO: 432023 - DNA, 25 bp, Mus musculus
gaagtagcaggtttgtcctacacca

SEQ ID NO: 432024 - DNA, 25 bp, Mus musculus
gaagtagcatcgatgtcctcgcagc

SEQ ID NO: 432025 - DNA, 25 bp, Mus musculus
gaagtagcatcgttgtcctcgcagc

SEQ ID NO: 432026 - DNA, 25 bp, Mus musculus
gaagtagccaatcgtaagacctgaa

SEQ ID NO: 432027 - DNA, 25 bp, Mus musculus
gaagtagccaatggtaagacctgaa

SEQ ID NO: 432028 - DNA, 25 bp, Mus musculus
gaagtagccacccagcctatttaga

SEQ ID NO: 432029 - DNA, 25 bp, Mus musculus
gaagtagccaccgagcctatttaga

SEQ ID NO: 432030 - DNA, 25 bp, Mus musculus
gaagtagccagaccagccttgctag

SEQ ID NO: 432031 - DNA, 25 bp, Mus musculus
gaagtagccagagcagccttgctag

SEQ ID NO: 432032 - DNA, 25 bp, Mus musculus
gaagtagccatgcttgcttggtcca

SEQ ID NO: 432033 - DNA, 25 bp, Mus musculus
gaagtagccatggttgcttggtcca

SEQ ID NO: 432034 - DNA, 25 bp, Mus musculus
gaagtagcctcaaccctaaattttt

SEQ ID NO: 432035 - DNA, 25 bp, Mus musculus
gaagtagcctcatccctaaattttt

SEQ ID NO: 432036 - DNA, 25 bp, Mus musculus
gaagtagccttgatcattcatatag

SEQ ID NO: 432037 - DNA, 25 bp, Mus musculus
gaagtagccttgttcattcatatag

SEQ ID NO: 432038 - DNA, 25 bp, Mus musculus
gaagtagctagcctgcctcttgaat

SEQ ID NO: 432039 - DNA, 25 bp, Mus musculus
gaagtagctagcgtgcctcttgaat

SEQ ID NO: 432040 - DNA, 25 bp, Mus musculus
gaagtagctcttacacgtacatttc

SEQ ID NO: 432041 - DNA, 25 bp, Mus musculus
gaagtagctctttcacgtacatttc

SEQ ID NO: 432042 - DNA, 25 bp, Mus musculus
gaagtagctgttcccaaagcgaaga

SEQ ID NO: 432043 - DNA, 25 bp, Mus musculus
gaagtagctgttgccaaagcgaaga

SEQ ID NO: 432044 - DNA, 25 bp, Mus musculus
gaagtagcttccctatcaaatcctt

SEQ ID NO: 432045 - DNA, 25 bp, Mus musculus
gaagtagcttccgtatcaaatcctt

SEQ ID NO: 432046 - DNA, 25 bp, Mus musculus
gaagtagcttgtcgcgatgatcgaa

SEQ ID NO: 432047 - DNA, 25 bp, Mus musculus
gaagtagcttgtggcgatgatcgaa

SEQ ID NO: 432048 - DNA, 25 bp, Mus musculus
gaagtaggaatcacagcgcagcagt

SEQ ID NO: 432049 - DNA, 25 bp, Mus musculus
gaagtaggaatctcagcgcagcagt

SEQ ID NO: 432050 - DNA, 25 bp, Mus musculus
gaagtaggatgtcctcctgcgactt

SEQ ID NO: 432051 - DNA, 25 bp, Mus musculus
gaagtaggatgtgctcctgcgactt

SEQ ID NO: 432052 - DNA, 25 bp, Mus musculus
gaagtaggcattacactcatcaaat

SEQ ID NO: 432053 - DNA, 25 bp, Mus musculus
gaagtaggcattactggtgcagaac

SEQ ID NO: 432054 - DNA, 25 bp, Mus musculus
gaagtaggcatttcactcatcaaat

SEQ ID NO: 432055 - DNA, 25 bp, Mus musculus
gaagtaggcatttctggtgcagaac

SEQ ID NO: 432056 - DNA, 25 bp, Mus musculus
gaagtaggcccaaaaaagctccatt

SEQ ID NO: 432057 - DNA, 25 bp, Mus musculus
gaagtaggcccataaaagctccatt

SEQ ID NO: 432058 - DNA, 25 bp, Mus musculus
gaagtaggcgcaactctgtgacttt

SEQ ID NO: 432059 - DNA, 25 bp, Mus musculus
gaagtaggcgcatctctgtgacttt

SEQ ID NO: 432060 - DNA, 25 bp, Mus musculus
gaagtaggctgtaatatgtgtgaat

SEQ ID NO: 432061 - DNA, 25 bp, Mus musculus
gaagtaggctgtctcccatcagatc

SEQ ID NO: 432062 - DNA, 25 bp, Mus musculus
gaagtaggctgtgtcccatcagatc

SEQ ID NO: 432063 - DNA, 25 bp, Mus musculus
gaagtaggctgttatatgtgtgaat

SEQ ID NO: 432064 - DNA, 25 bp, Mus musculus
gaagtagggaaccatcttctcctgc

SEQ ID NO: 432065 - DNA, 25 bp, Mus musculus
gaagtagggaacgatcttctcctgc

SEQ ID NO: 432066 - DNA, 25 bp, Mus musculus
gaagtagggcagagctgacatgcta

SEQ ID NO: 432067 - DNA, 25 bp, Mus musculus
gaagtagggcagtgctgacatgcta

SEQ ID NO: 432068 - DNA, 25 bp, Mus musculus
gaagtaggtaaaaccccagagtcat

SEQ ID NO: 432069 - DNA, 25 bp, Mus musculus
gaagtaggtaaatccccagagtcat

SEQ ID NO: 432070 - DNA, 25 bp, Mus musculus
gaagtaggttgtcgcaatctaatat

SEQ ID NO: 432071 - DNA, 25 bp, Mus musculus
gaagtaggttgtggcaatctaatat

SEQ ID NO: 432072 - DNA, 25 bp, Mus musculus
gaagtaggtttaactttcccgctgt

SEQ ID NO: 432073 - DNA, 25 bp, Mus musculus
gaagtaggtttatctttcccgctgt

SEQ ID NO: 432074 - DNA, 25 bp, Mus musculus
gaagtaggtttcactggaactcata

SEQ ID NO: 432075 - DNA, 25 bp, Mus musculus
gaagtaggtttctctggaactcata

SEQ ID NO: 432076 - DNA, 25 bp, Mus musculus
gaagtagtaactctgtgccatcaaa

SEQ ID NO: 432077 - DNA, 25 bp, Mus musculus
gaagtagtaactgtgtgccatcaaa

SEQ ID NO: 432078 - DNA, 25 bp, Mus musculus
gaagtagtaccaccgttaaagatct

SEQ ID NO: 432079 - DNA, 25 bp, Mus musculus
gaagtagtaccagcgttaaagatct

SEQ ID NO: 432080 - DNA, 25 bp, Mus musculus
gaagtagtattgatcaagccacgct

SEQ ID NO: 432081 - DNA, 25 bp, Mus musculus
gaagtagtattgttcaagccacgct

SEQ ID NO: 432082 - DNA, 25 bp, Mus musculus
gaagtagtcagtaacagccatgcta

SEQ ID NO: 432083 - DNA, 25 bp, Mus musculus
gaagtagtcagttacagccatgcta

SEQ ID NO: 432084 - DNA, 25 bp, Mus musculus
gaagtagtcgtccagtcacccacag

SEQ ID NO: 432085 - DNA, 25 bp, Mus musculus
gaagtagtcgtcgagtcacccacag

SEQ ID NO: 432086 - DNA, 25 bp, Mus musculus
gaagtagtgacaccttaagggccgc

SEQ ID NO: 432087 - DNA, 25 bp, Mus musculus
gaagtagtgacagcttaagggccgc

SEQ ID NO: 432088 - DNA, 25 bp, Mus musculus
gaagtagttaaaaactcacagagaa

SEQ ID NO: 432089 - DNA, 25 bp, Mus musculus
gaagtagttaaatactcacagagaa

SEQ ID NO: 432090 - DNA, 25 bp, Mus musculus
gaagtagttacacttgtattcatga

SEQ ID NO: 432091 - DNA, 25 bp, Mus musculus
gaagtagttacagttgtattcatga

SEQ ID NO: 432092 - DNA, 25 bp, Mus musculus
gaagtagttcaccatttgctctata

SEQ ID NO: 432093 - DNA, 25 bp, Mus musculus
gaagtagttcacgatttgctctata

SEQ ID NO: 432094 - DNA, 25 bp, Mus musculus
gaagtagttcttattgccatgccgt

SEQ ID NO: 432095 - DNA, 25 bp, Mus musculus
gaagtagttctttttgccatgccgt

SEQ ID NO: 432096 - DNA, 25 bp, Mus musculus
gaagtatacatcattacccaccact

SEQ ID NO: 432097 - DNA, 25 bp, Mus musculus
gaagtatacatctttacccaccact

SEQ ID NO: 432098 - DNA, 25 bp, Mus musculus
gaagtatagaccagtgttcccatat

SEQ ID NO: 432099 - DNA, 25 bp, Mus musculus
gaagtatagacctgtgttcccatat

SEQ ID NO: 432100 - DNA, 25 bp, Mus musculus
gaagtatagctaattactctatttg

SEQ ID NO: 432101 - DNA, 25 bp, Mus musculus
gaagtatagctatttactctatttg

SEQ ID NO: 432102 - DNA, 25 bp, Mus musculus
gaagtatatcatataaggagttcac

SEQ ID NO: 432103 - DNA, 25 bp, Mus musculus
gaagtatatcatttaaggagttcac

SEQ ID NO: 432104 - DNA, 25 bp, Mus musculus
gaagtatatgagagaagccacacct

SEQ ID NO: 432105 - DNA, 25 bp, Mus musculus
gaagtatatgagtgaagccacacct

SEQ ID NO: 432106 - DNA, 25 bp, Mus musculus
gaagtatcacacagtgcctcataaa

SEQ ID NO: 432107 - DNA, 25 bp, Mus musculus
gaagtatcacactgtgcctcataaa

SEQ ID NO: 432108 - DNA, 25 bp, Mus musculus
gaagtatcagagaacccgacctttt

SEQ ID NO: 432109 - DNA, 25 bp, Mus musculus
gaagtatcagagtacccgacctttt

SEQ ID NO: 432110 - DNA, 25 bp, Mus musculus
gaagtatcatcacggcatcaaggca

SEQ ID NO: 432111 - DNA, 25 bp, Mus musculus
gaagtatcatcagggcatcaaggca

SEQ ID NO: 432112 - DNA, 25 bp, Mus musculus
gaagtatcatggaaggcttagcatt

SEQ ID NO: 432113 - DNA, 25 bp, Mus musculus
gaagtatcatggtaggcttagcatt

SEQ ID NO: 432114 - DNA, 25 bp, Mus musculus
gaagtatccaaccatggcccaggtg

SEQ ID NO: 432115 - DNA, 25 bp, Mus musculus
gaagtatccaacgatggcccaggtg

SEQ ID NO: 432116 - DNA, 25 bp, Mus musculus
gaagtatccaggctaacagtattcc

SEQ ID NO: 432117 - DNA, 25 bp, Mus musculus
gaagtatccagggtaacagtattcc

SEQ ID NO: 432118 - DNA, 25 bp, Mus musculus
gaagtatccatgaatgtctgcaaag

SEQ ID NO: 432119 - DNA, 25 bp, Mus musculus
gaagtatccatgtatgtctgcaaag

SEQ ID NO: 432120 - DNA, 25 bp, Mus musculus
gaagtatccctgaccgagaatatag

SEQ ID NO: 432121 - DNA, 25 bp, Mus musculus
gaagtatccctgtccgagaatatag

SEQ ID NO: 432122 - DNA, 25 bp, Mus musculus
gaagtatctcatcttctgaagtaga

SEQ ID NO: 432123 - DNA, 25 bp, Mus musculus
gaagtatctcatgttctgaagtaga

SEQ ID NO: 432124 - DNA, 25 bp, Mus musculus
gaagtatctgaacccttggcacttt

SEQ ID NO: 432125 - DNA, 25 bp, Mus musculus
gaagtatctgaagccttggcacttt

SEQ ID NO: 432126 - DNA, 25 bp, Mus musculus
gaagtatcttaaaatgcatggtatc

SEQ ID NO: 432127 - DNA, 25 bp, Mus musculus
gaagtatcttaatatgcatggtatc

SEQ ID NO: 432128 - DNA, 25 bp, Mus musculus
gaagtatcttagagcagcttgtcac

SEQ ID NO: 432129 - DNA, 25 bp, Mus musculus
gaagtatcttagtgcagcttgtcac

SEQ ID NO: 432130 - DNA, 25 bp, Mus musculus
gaagtatgaaccagctttcttgtta

SEQ ID NO: 432131 - DNA, 25 bp, Mus musculus
gaagtatgaacctgctttcttgtta

SEQ ID NO: 432132 - DNA, 25 bp, Mus musculus
gaagtatgacgtagggtccctctga

SEQ ID NO: 432133 - DNA, 25 bp, Mus musculus
gaagtatgacgttgggtccctctga

SEQ ID NO: 432134 - DNA, 25 bp, Mus musculus
gaagtatgagatagccctggctccc

SEQ ID NO: 432135 - DNA, 25 bp, Mus musculus
gaagtatgagattgccctggctccc

SEQ ID NO: 432136 - DNA, 25 bp, Mus musculus
gaagtatgcaatcgtcagttaccca

SEQ ID NO: 432137 - DNA, 25 bp, Mus musculus
gaagtatgcaatggtcagttaccca

SEQ ID NO: 432138 - DNA, 25 bp, Mus musculus
gaagtatgccagattttgagcacgg

SEQ ID NO: 432139 - DNA, 25 bp, Mus musculus
gaagtatgccagctttgtctcgagg

SEQ ID NO: 432140 - DNA, 25 bp, Mus musculus
gaagtatgccaggtttgtctcgagg

SEQ ID NO: 432141 - DNA, 25 bp, Mus musculus
gaagtatgccagtttttgagcacgg

SEQ ID NO: 432142 - DNA, 25 bp, Mus musculus
gaagtatgccatctgatgctacctt

SEQ ID NO: 432143 - DNA, 25 bp, Mus musculus
gaagtatgccatgtgatgctacctt

SEQ ID NO: 432144 - DNA, 25 bp, Mus musculus
gaagtatgcccgctgtcccgtctaa

SEQ ID NO: 432145 - DNA, 25 bp, Mus musculus
gaagtatgcccggtgtcccgtctaa

SEQ ID NO: 432146 - DNA, 25 bp, Mus musculus
gaagtatgcctgagacttccagccc

SEQ ID NO: 432147 - DNA, 25 bp, Mus musculus
gaagtatgcctgtgacttccagccc

SEQ ID NO: 432148 - DNA, 25 bp, Mus musculus
gaagtatgccttctgatcctgaccg

SEQ ID NO: 432149 - DNA, 25 bp, Mus musculus
gaagtatgccttgtgatcctgaccg

SEQ ID NO: 432150 - DNA, 25 bp, Mus musculus
gaagtatgcgcgacaagccatcaat

SEQ ID NO: 432151 - DNA, 25 bp, Mus musculus
gaagtatgcgcgtcaagccatcaat

SEQ ID NO: 432152 - DNA, 25 bp, Mus musculus
gaagtatgctctagccacagtgaga

SEQ ID NO: 432153 - DNA, 25 bp, Mus musculus
gaagtatgctcttgccacagtgaga

SEQ ID NO: 432154 - DNA, 25 bp, Mus musculus
gaagtatgctgcagatgcccagaca

SEQ ID NO: 432155 - DNA, 25 bp, Mus musculus
gaagtatgctgctgatgcccagaca

SEQ ID NO: 432156 - DNA, 25 bp, Mus musculus
gaagtatggattcccgaactgccat

SEQ ID NO: 432157 - DNA, 25 bp, Mus musculus
gaagtatggattgccgaactgccat

SEQ ID NO: 432158 - DNA, 25 bp, Mus musculus
gaagtatgggtgaagcttagcagta

SEQ ID NO: 432159 - DNA, 25 bp, Mus musculus
gaagtatgggtgtagcttagcagta

SEQ ID NO: 432160 - DNA, 25 bp, Mus musculus
gaagtatgtgtgaagcagatgctgt

SEQ ID NO: 432161 - DNA, 25 bp, Mus musculus
gaagtatgtgtgtagcagatgctgt

SEQ ID NO: 432162 - DNA, 25 bp, Mus musculus
gaagtatgttctaaccttccaagta

SEQ ID NO: 432163 - DNA, 25 bp, Mus musculus
gaagtatgttcttaccttccaagta

SEQ ID NO: 432164 - DNA, 25 bp, Mus musculus
gaagtatgtttgatccagtagcaaa

SEQ ID NO: 432165 - DNA, 25 bp, Mus musculus
gaagtatgtttgttccagtagcaaa

SEQ ID NO: 432166 - DNA, 25 bp, Mus musculus
gaagtatgttttaagtttccaagtg

SEQ ID NO: 432167 - DNA, 25 bp, Mus musculus
gaagtatgtttttagtttccaagtg

SEQ ID NO: 432168 - DNA, 25 bp, Mus musculus
gaagtattaactacagaatttacac

SEQ ID NO: 432169 - DNA, 25 bp, Mus musculus
gaagtattaacttcagaatttacac

SEQ ID NO: 432170 - DNA, 25 bp, Mus musculus
gaagtattaatgaacaactcaccac

SEQ ID NO: 432171 - DNA, 25 bp, Mus musculus
gaagtattaatgtacaactcaccac

SEQ ID NO: 432172 - DNA, 25 bp, Mus musculus
gaagtattacatacccagacactaa

SEQ ID NO: 432173 - DNA, 25 bp, Mus musculus
gaagtattacattcccagacactaa

SEQ ID NO: 432174 - DNA, 25 bp, Mus musculus
gaagtattaggcctgttcctgccat

SEQ ID NO: 432175 - DNA, 25 bp, Mus musculus
gaagtattaggcgtgttcctgccat

SEQ ID NO: 432176 - DNA, 25 bp, Mus musculus
gaagtattagtgagaccctccaagg

SEQ ID NO: 432177 - DNA, 25 bp, Mus musculus
gaagtattagtgtgaccctccaagg

SEQ ID NO: 432178 - DNA, 25 bp, Mus musculus
gaagtattatttcatagatctccaa

SEQ ID NO: 432179 - DNA, 25 bp, Mus musculus
gaagtattatttgatagatctccaa

SEQ ID NO: 432180 - DNA, 25 bp, Mus musculus
gaagtattcactctggatcacccat

SEQ ID NO: 432181 - DNA, 25 bp, Mus musculus
gaagtattcactgtggatcacccat

SEQ ID NO: 432182 - DNA, 25 bp, Mus musculus
gaagtattcatacgctggctttcca

SEQ ID NO: 432183 - DNA, 25 bp, Mus musculus
gaagtattcataggctggctttcca

SEQ ID NO: 432184 - DNA, 25 bp, Mus musculus
gaagtattcctacctcaacgtggtg

SEQ ID NO: 432185 - DNA, 25 bp, Mus musculus
gaagtattcctagctcaacgtggtg

SEQ ID NO: 432186 - DNA, 25 bp, Mus musculus
gaagtattctctcaacactgcacta

SEQ ID NO: 432187 - DNA, 25 bp, Mus musculus
gaagtattctctgaacactgcacta

SEQ ID NO: 432188 - DNA, 25 bp, Mus musculus
gaagtattcttaagcccgggctccg

SEQ ID NO: 432189 - DNA, 25 bp, Mus musculus
gaagtattcttatgcccgggctccg

SEQ ID NO: 432190 - DNA, 25 bp, Mus musculus
gaagtattgctaactgaagccagtt

SEQ ID NO: 432191 - DNA, 25 bp, Mus musculus
gaagtattgctatctgaagccagtt

SEQ ID NO: 432192 - DNA, 25 bp, Mus musculus
gaagtattgctgaagcttttcccac

SEQ ID NO: 432193 - DNA, 25 bp, Mus musculus
gaagtattgctgtagcttttcccac

SEQ ID NO: 432194 - DNA, 25 bp, Mus musculus
gaagtattgtaacgcgcagtcagga

SEQ ID NO: 432195 - DNA, 25 bp, Mus musculus
gaagtattgtaaggcgcagtcagga

SEQ ID NO: 432196 - DNA, 25 bp, Mus musculus
gaagtattgtagacccagcctctca

SEQ ID NO: 432197 - DNA, 25 bp, Mus musculus
gaagtattgtagtcccagcctctca

SEQ ID NO: 432198 - DNA, 25 bp, Mus musculus
gaagtattgtatacctcgattccat

SEQ ID NO: 432199 - DNA, 25 bp, Mus musculus
gaagtattgtattcctcgattccat

SEQ ID NO: 432200 - DNA, 25 bp, Mus musculus
gaagtattgtttcaccttacagtca

SEQ ID NO: 432201 - DNA, 25 bp, Mus musculus
gaagtattgtttgaccttacagtca

SEQ ID NO: 432202 - DNA, 25 bp, Mus musculus
gaagtatttcacaaagtcaaaacac

SEQ ID NO: 432203 - DNA, 25 bp, Mus musculus
gaagtatttcactaagtcaaaacac

SEQ ID NO: 432204 - DNA, 25 bp, Mus musculus
gaagtatttcgacaagctaaactga

SEQ ID NO: 432205 - DNA, 25 bp, Mus musculus
gaagtatttcgagaagctaaactga

SEQ ID NO: 432206 - DNA, 25 bp, Mus musculus
gaagtatttgctccagtttttttta

SEQ ID NO: 432207 - DNA, 25 bp, Mus musculus
gaagtatttgctgcagtttttttta

SEQ ID NO: 432208 - DNA, 25 bp, Mus musculus
gaagtattttccagatccagaccat

SEQ ID NO: 432209 - DNA, 25 bp, Mus musculus
gaagtattttcctgatccagaccat

SEQ ID NO: 432210 - DNA, 25 bp, Mus musculus
gaagtcaaaatcatacctccagaag

SEQ ID NO: 432211 - DNA, 25 bp, Mus musculus
gaagtcaaaatcttacctccagaag

SEQ ID NO: 432212 - DNA, 25 bp, Mus musculus
gaagtcaaacctcagattttcagtc

SEQ ID NO: 432213 - DNA, 25 bp, Mus musculus
gaagtcaaacctgagattttcagtc

SEQ ID NO: 432214 - DNA, 25 bp, Mus musculus
gaagtcaaactcaaaatggcacctg

SEQ ID NO: 432215 - DNA, 25 bp, Mus musculus
gaagtcaaactctaaatggcacctg

SEQ ID NO: 432216 - DNA, 25 bp, Mus musculus
gaagtcaaacttcgagagctgccga

SEQ ID NO: 432217 - DNA, 25 bp, Mus musculus
gaagtcaaacttggagagctgccga

SEQ ID NO: 432218 - DNA, 25 bp, Mus musculus
gaagtcaaagagaattcaacactgg

SEQ ID NO: 432219 - DNA, 25 bp, Mus musculus
gaagtcaaagagtattcaacactgg

SEQ ID NO: 432220 - DNA, 25 bp, Mus musculus
gaagtcaaagctataatccgtgcct

SEQ ID NO: 432221 - DNA, 25 bp, Mus musculus
gaagtcaaagctttaatccgtgcct

SEQ ID NO: 432222 - DNA, 25 bp, Mus musculus
gaagtcaaatgtacttgcccttttt

SEQ ID NO: 432223 - DNA, 25 bp, Mus musculus
gaagtcaaatgttcttgcccttttt

SEQ ID NO: 432224 - DNA, 25 bp, Mus musculus
gaagtcaacagccagtttctgcctt

SEQ ID NO: 432225 - DNA, 25 bp, Mus musculus
gaagtcaacagcgagtttctgcctt

SEQ ID NO: 432226 - DNA, 25 bp, Mus musculus
gaagtcaaccaacagttcatcaata

SEQ ID NO: 432227 - DNA, 25 bp, Mus musculus
gaagtcaaccaagagttcatcaata

SEQ ID NO: 432228 - DNA, 25 bp, Mus musculus
gaagtcaaccacagatatcctcatg

SEQ ID NO: 432229 - DNA, 25 bp, Mus musculus
gaagtcaaccactgatatcctcatg

SEQ ID NO: 432230 - DNA, 25 bp, Mus musculus
gaagtcaactaacgcaggtcccctc

SEQ ID NO: 432231 - DNA, 25 bp, Mus musculus
gaagtcaactaaggcaggtcccctc

SEQ ID NO: 432232 - DNA, 25 bp, Mus musculus
gaagtcaactctctacagggaatgt

SEQ ID NO: 432233 - DNA, 25 bp, Mus musculus
gaagtcaactctgtacagggaatgt

SEQ ID NO: 432234 - DNA, 25 bp, Mus musculus
gaagtcaactgtactgccatggcca

SEQ ID NO: 432235 - DNA, 25 bp, Mus musculus
gaagtcaactgttctgccatggcca

SEQ ID NO: 432236 - DNA, 25 bp, Mus musculus
gaagtcaagattcctttctccaaat

SEQ ID NO: 432237 - DNA, 25 bp, Mus musculus
gaagtcaagattgctttctccaaat

SEQ ID NO: 432238 - DNA, 25 bp, Mus musculus
gaagtcaagcaactggtttctttaa

SEQ ID NO: 432239 - DNA, 25 bp, Mus musculus
gaagtcaagcaagtggtttctttaa

SEQ ID NO: 432240 - DNA, 25 bp, Mus musculus
gaagtcaagcccatcctggagaagc

SEQ ID NO: 432241 - DNA, 25 bp, Mus musculus
gaagtcaagcccttcctggagaagc

SEQ ID NO: 432242 - DNA, 25 bp, Mus musculus
gaagtcaaggaacgagtctccagaa

SEQ ID NO: 432243 - DNA, 25 bp, Mus musculus
gaagtcaaggaaggagtctccagaa

SEQ ID NO: 432244 - DNA, 25 bp, Mus musculus
gaagtcaagtaaaactgtactccat

SEQ ID NO: 432245 - DNA, 25 bp, Mus musculus
gaagtcaagtaatactgtactccat

SEQ ID NO: 432246 - DNA, 25 bp, Mus musculus
gaagtcaattccagtgaccaataca

SEQ ID NO: 432247 - DNA, 25 bp, Mus musculus
gaagtcaattcctgtgaccaataca

SEQ ID NO: 432248 - DNA, 25 bp, Mus musculus
gaagtcaatttgcaggctcctggat

SEQ ID NO: 432249 - DNA, 25 bp, Mus musculus
gaagtcaatttggaggctcctggat

SEQ ID NO: 432250 - DNA, 25 bp, Mus musculus
gaagtcacacaacacccgaaaccag

SEQ ID NO: 432251 - DNA, 25 bp, Mus musculus
gaagtcacacaagacccgaaaccag

SEQ ID NO: 432252 - DNA, 25 bp, Mus musculus
gaagtcacacatcctgtcccatgat

SEQ ID NO: 432253 - DNA, 25 bp, Mus musculus
gaagtcacacatgctgtcccatgat

SEQ ID NO: 432254 - DNA, 25 bp, Mus musculus
gaagtcacaccaagctggtggtgaa

SEQ ID NO: 432255 - DNA, 25 bp, Mus musculus
gaagtcacaccatgctggtggtgaa

SEQ ID NO: 432256 - DNA, 25 bp, Mus musculus
gaagtcacacccaagagtcttctag

SEQ ID NO: 432257 - DNA, 25 bp, Mus musculus
gaagtcacaccctagagtcttctag

SEQ ID NO: 432258 - DNA, 25 bp, Mus musculus
gaagtcacagttatcataccaacag

SEQ ID NO: 432259 - DNA, 25 bp, Mus musculus
gaagtcacagttttcataccaacag

SEQ ID NO: 432260 - DNA, 25 bp, Mus musculus
gaagtcacatctatctgaatgcaaa

SEQ ID NO: 432261 - DNA, 25 bp, Mus musculus
gaagtcacatctttctgaatgcaaa

SEQ ID NO: 432262 - DNA, 25 bp, Mus musculus
gaagtcacatgaccggcccaagagg

SEQ ID NO: 432263 - DNA, 25 bp, Mus musculus
gaagtcacatgagcggcccaagagg

SEQ ID NO: 432264 - DNA, 25 bp, Mus musculus
gaagtcaccaacaattactgcagta

SEQ ID NO: 432265 - DNA, 25 bp, Mus musculus
gaagtcaccaactattactgcagta

SEQ ID NO: 432266 - DNA, 25 bp, Mus musculus
gaagtcaccagccttttgatgtttc

SEQ ID NO: 432267 - DNA, 25 bp, Mus musculus
gaagtcaccagcgttttgatgtttc

SEQ ID NO: 432268 - DNA, 25 bp, Mus musculus
gaagtcaccaggcatactcgtgctg

SEQ ID NO: 432269 - DNA, 25 bp, Mus musculus
gaagtcaccagggatactcgtgctg

SEQ ID NO: 432270 - DNA, 25 bp, Mus musculus
gaagtcacccctatcatatctggat

SEQ ID NO: 432271 - DNA, 25 bp, Mus musculus
gaagtcacccctttcatatctggat

SEQ ID NO: 432272 - DNA, 25 bp, Mus musculus
gaagtcacctggcaagtcctgcaag

SEQ ID NO: 432273 - DNA, 25 bp, Mus musculus
gaagtcacctggcagctgtctgtaa

SEQ ID NO: 432274 - DNA, 25 bp, Mus musculus
gaagtcacctgggaagtcctgcaag

SEQ ID NO: 432275 - DNA, 25 bp, Mus musculus
gaagtcacctgggagctgtctgtaa

SEQ ID NO: 432276 - DNA, 25 bp, Mus musculus
gaagtcacctgtctttatgcagatt

SEQ ID NO: 432277 - DNA, 25 bp, Mus musculus
gaagtcacctgtgtttatgcagatt

SEQ ID NO: 432278 - DNA, 25 bp, Mus musculus
gaagtcacctttcgaccttcgacct

SEQ ID NO: 432279 - DNA, 25 bp, Mus musculus
gaagtcacctttggaccttcgacct

SEQ ID NO: 432280 - DNA, 25 bp, Mus musculus
gaagtcacgaagctgaaccaggagc

SEQ ID NO: 432281 - DNA, 25 bp, Mus musculus
gaagtcacgaaggtgaaccaggagc

SEQ ID NO: 432282 - DNA, 25 bp, Mus musculus
gaagtcacgcctctcggtcacttgg

SEQ ID NO: 432283 - DNA, 25 bp, Mus musculus
gaagtcacgcctgtcggtcacttgg

SEQ ID NO: 432284 - DNA, 25 bp, Mus musculus
gaagtcacgggactcgtcagcgcat

SEQ ID NO: 432285 - DNA, 25 bp, Mus musculus
gaagtcacgggagtcgtcagcgcat

SEQ ID NO: 432286 - DNA, 25 bp, Mus musculus
gaagtcacgtaaaatgtgttcttgt

SEQ ID NO: 432287 - DNA, 25 bp, Mus musculus
gaagtcacgtaatatgtgttcttgt

SEQ ID NO: 432288 - DNA, 25 bp, Mus musculus
gaagtcacgtgcaaaattttaaagt

SEQ ID NO: 432289 - DNA, 25 bp, Mus musculus
gaagtcacgtgctaaattttaaagt

SEQ ID NO: 432290 - DNA, 25 bp, Mus musculus
gaagtcactaaactcattgtccgaa

SEQ ID NO: 432291 - DNA, 25 bp, Mus musculus
gaagtcactaaagtcattgtccgaa

SEQ ID NO: 432292 - DNA, 25 bp, Mus musculus
gaagtcactatgacacttgctacat

SEQ ID NO: 432293 - DNA, 25 bp, Mus musculus
gaagtcactatgtcacttgctacat

SEQ ID NO: 432294 - DNA, 25 bp, Mus musculus
gaagtcactcgtacaagcgcagcct

SEQ ID NO: 432295 - DNA, 25 bp, Mus musculus
gaagtcactcgtcttaacgttgtac

SEQ ID NO: 432296 - DNA, 25 bp, Mus musculus
gaagtcactcgtgttaacgttgtac

SEQ ID NO: 432297 - DNA, 25 bp, Mus musculus
gaagtcactcgttcaagcgcagcct

SEQ ID NO: 432298 - DNA, 25 bp, Mus musculus
gaagtcactcttcggaataacggtc

SEQ ID NO: 432299 - DNA, 25 bp, Mus musculus
gaagtcactcttgggaataacggtc

SEQ ID NO: 432300 - DNA, 25 bp, Mus musculus
gaagtcactgataaatgccaccatg

SEQ ID NO: 432301 - DNA, 25 bp, Mus musculus
gaagtcactgattaatgccaccatg

SEQ ID NO: 432302 - DNA, 25 bp, Mus musculus
gaagtcactggccacaggattgtca

SEQ ID NO: 432303 - DNA, 25 bp, Mus musculus
gaagtcactggcgacaggattgtca

SEQ ID NO: 432304 - DNA, 25 bp, Mus musculus
gaagtcactggtcttataatatgga

SEQ ID NO: 432305 - DNA, 25 bp, Mus musculus
gaagtcactggtgttataatatgga

SEQ ID NO: 432306 - DNA, 25 bp, Mus musculus
gaagtcactgtgaataatagattta

SEQ ID NO: 432307 - DNA, 25 bp, Mus musculus
gaagtcactgtgtataatagattta

SEQ ID NO: 432308 - DNA, 25 bp, Mus musculus
gaagtcactgttctgtgtcttctgt

SEQ ID NO: 432309 - DNA, 25 bp, Mus musculus
gaagtcactgttgtgtgtcttctgt

SEQ ID NO: 432310 - DNA, 25 bp, Mus musculus
gaagtcacttctattccttcggtaa

SEQ ID NO: 432311 - DNA, 25 bp, Mus musculus
gaagtcacttcttttccttcggtaa

SEQ ID NO: 432312 - DNA, 25 bp, Mus musculus
gaagtcactttcaatcattttaggt

SEQ ID NO: 432313 - DNA, 25 bp, Mus musculus
gaagtcactttcactagtccattat

SEQ ID NO: 432314 - DNA, 25 bp, Mus musculus
gaagtcactttctatcattttaggt

SEQ ID NO: 432315 - DNA, 25 bp, Mus musculus
gaagtcactttctctagtccattat

SEQ ID NO: 432316 - DNA, 25 bp, Mus musculus
gaagtcacttttctacactgaaccc

SEQ ID NO: 432317 - DNA, 25 bp, Mus musculus
gaagtcacttttgtacactgaaccc

SEQ ID NO: 432318 - DNA, 25 bp, Mus musculus
gaagtcagaaccacaggaatatcca

SEQ ID NO: 432319 - DNA, 25 bp, Mus musculus
gaagtcagaacctcaggaatatcca

SEQ ID NO: 432320 - DNA, 25 bp, Mus musculus
gaagtcagaactagccttgtattgt

SEQ ID NO: 432321 - DNA, 25 bp, Mus musculus
gaagtcagaacttgccttgtattgt

SEQ ID NO: 432322 - DNA, 25 bp, Mus musculus
gaagtcagacatatgcaaaatcctg

SEQ ID NO: 432323 - DNA, 25 bp, Mus musculus
gaagtcagacatttgcaaaatcctg

SEQ ID NO: 432324 - DNA, 25 bp, Mus musculus
gaagtcagaccgaccagtttctaac

SEQ ID NO: 432325 - DNA, 25 bp, Mus musculus
gaagtcagaccgtccagtttctaac

SEQ ID NO: 432326 - DNA, 25 bp, Mus musculus
gaagtcagacgtctgttgatatcaa

SEQ ID NO: 432327 - DNA, 25 bp, Mus musculus
gaagtcagacgtgtgttgatatcaa

SEQ ID NO: 432328 - DNA, 25 bp, Mus musculus
gaagtcagatggagctcaggattaa

SEQ ID NO: 432329 - DNA, 25 bp, Mus musculus
gaagtcagatggtgctcaggattaa

SEQ ID NO: 432330 - DNA, 25 bp, Mus musculus
gaagtcagcaagaggacgccgcaaa

SEQ ID NO: 432331 - DNA, 25 bp, Mus musculus
gaagtcagcaagatttcagccaaca

SEQ ID NO: 432332 - DNA, 25 bp, Mus musculus
gaagtcagcaagtggacgccgcaaa

SEQ ID NO: 432333 - DNA, 25 bp, Mus musculus
gaagtcagcaagttttcagccaaca

SEQ ID NO: 432334 - DNA, 25 bp, Mus musculus
gaagtcagcagtaccaggagctcag

SEQ ID NO: 432335 - DNA, 25 bp, Mus musculus
gaagtcagcagttccaggagctcag

SEQ ID NO: 432336 - DNA, 25 bp, Mus musculus
gaagtcagcatgacatccagatggc

SEQ ID NO: 432337 - DNA, 25 bp, Mus musculus
gaagtcagcatgtcatccagatggc

SEQ ID NO: 432338 - DNA, 25 bp, Mus musculus
gaagtcagccaaacagtcatggtca

SEQ ID NO: 432339 - DNA, 25 bp, Mus musculus
gaagtcagccaatcagtcatggtca

SEQ ID NO: 432340 - DNA, 25 bp, Mus musculus
gaagtcagcctactttatgtatatg

SEQ ID NO: 432341 - DNA, 25 bp, Mus musculus
gaagtcagcctagtttatgtatatg

SEQ ID NO: 432342 - DNA, 25 bp, Mus musculus
gaagtcagcgctccgactgagcaag

SEQ ID NO: 432343 - DNA, 25 bp, Mus musculus
gaagtcagcgctgcgactgagcaag

SEQ ID NO: 432344 - DNA, 25 bp, Mus musculus
gaagtcagctcactcttagctcagc

SEQ ID NO: 432345 - DNA, 25 bp, Mus musculus
gaagtcagctcagtcttagctcagc

SEQ ID NO: 432346 - DNA, 25 bp, Mus musculus
gaagtcagcttcatacagtaagttc

SEQ ID NO: 432347 - DNA, 25 bp, Mus musculus
gaagtcagcttcttacagtaagttc

SEQ ID NO: 432348 - DNA, 25 bp, Mus musculus
gaagtcagctttctcatttgaagca

SEQ ID NO: 432349 - DNA, 25 bp, Mus musculus
gaagtcagctttgtcatttgaagca

SEQ ID NO: 432350 - DNA, 25 bp, Mus musculus
gaagtcaggctgagcgctcacttgt

SEQ ID NO: 432351 - DNA, 25 bp, Mus musculus
gaagtcaggctgtgcgctcacttgt

SEQ ID NO: 432352 - DNA, 25 bp, Mus musculus
gaagtcagggagaccaagtgctaga

SEQ ID NO: 432353 - DNA, 25 bp, Mus musculus
gaagtcagggagtccaagtgctaga

SEQ ID NO: 432354 - DNA, 25 bp, Mus musculus
gaagtcagggtactacaccctctac

SEQ ID NO: 432355 - DNA, 25 bp, Mus musculus
gaagtcagggtagtacaccctctac

SEQ ID NO: 432356 - DNA, 25 bp, Mus musculus
gaagtcaggtacattaagtcggtaa

SEQ ID NO: 432357 - DNA, 25 bp, Mus musculus
gaagtcaggtactttaagtcggtaa

SEQ ID NO: 432358 - DNA, 25 bp, Mus musculus
gaagtcaggtcccagcaaaatctaa

SEQ ID NO: 432359 - DNA, 25 bp, Mus musculus
gaagtcaggtccgagcaaaatctaa

SEQ ID NO: 432360 - DNA, 25 bp, Mus musculus
gaagtcagtattccagccaggcagt

SEQ ID NO: 432361 - DNA, 25 bp, Mus musculus
gaagtcagtattgcagccaggcagt

SEQ ID NO: 432362 - DNA, 25 bp, Mus musculus
gaagtcagtcatattaaggccccta

SEQ ID NO: 432363 - DNA, 25 bp, Mus musculus
gaagtcagtcattttaaggccccta

SEQ ID NO: 432364 - DNA, 25 bp, Mus musculus
gaagtcagtgacaggaggttatcct

SEQ ID NO: 432365 - DNA, 25 bp, Mus musculus
gaagtcagtgactggaggttatcct

SEQ ID NO: 432366 - DNA, 25 bp, Mus musculus
gaagtcagtgttctcctatgtgcct

SEQ ID NO: 432367 - DNA, 25 bp, Mus musculus
gaagtcagtgttgtcctatgtgcct

SEQ ID NO: 432368 - DNA, 25 bp, Mus musculus
gaagtcagttcaaggaagggtttct

SEQ ID NO: 432369 - DNA, 25 bp, Mus musculus
gaagtcagttcatggaagggtttct

SEQ ID NO: 432370 - DNA, 25 bp, Mus musculus
gaagtcagttgaaggcaagattgcc

SEQ ID NO: 432371 - DNA, 25 bp, Mus musculus
gaagtcagttgatggcaagattgcc

SEQ ID NO: 432372 - DNA, 25 bp, Mus musculus
gaagtcagttgtcaggctaatttac

SEQ ID NO: 432373 - DNA, 25 bp, Mus musculus
gaagtcagttgtgaggctaatttac

SEQ ID NO: 432374 - DNA, 25 bp, Mus musculus
gaagtcagttttagtcatgttgcta

SEQ ID NO: 432375 - DNA, 25 bp, Mus musculus
gaagtcagtttttgtcatgttgcta

SEQ ID NO: 432376 - DNA, 25 bp, Mus musculus
gaagtcataaacatgacccacagtt

SEQ ID NO: 432377 - DNA, 25 bp, Mus musculus
gaagtcataaacttgacccacagtt

SEQ ID NO: 432378 - DNA, 25 bp, Mus musculus
gaagtcataagcattaaacccctgt

SEQ ID NO: 432379 - DNA, 25 bp, Mus musculus
gaagtcataagctttaaacccctgt

SEQ ID NO: 432380 - DNA, 25 bp, Mus musculus
gaagtcataatacgcgccaatcgct

SEQ ID NO: 432381 - DNA, 25 bp, Mus musculus
gaagtcataataggcgccaatcgct

SEQ ID NO: 432382 - DNA, 25 bp, Mus musculus
gaagtcatactgaaattttgctcga

SEQ ID NO: 432383 - DNA, 25 bp, Mus musculus
gaagtcatactgtaattttgctcga

SEQ ID NO: 432384 - DNA, 25 bp, Mus musculus
gaagtcatcactatttggtaataag

SEQ ID NO: 432385 - DNA, 25 bp, Mus musculus
gaagtcatcactttttggtaataag

SEQ ID NO: 432386 - DNA, 25 bp, Mus musculus
gaagtcatcagaactcttattccta

SEQ ID NO: 432387 - DNA, 25 bp, Mus musculus
gaagtcatcagatctcttattccta

SEQ ID NO: 432388 - DNA, 25 bp, Mus musculus
gaagtcatcagcagctcgaaagcga

SEQ ID NO: 432389 - DNA, 25 bp, Mus musculus
gaagtcatcagctgctcgaaagcga

SEQ ID NO: 432390 - DNA, 25 bp, Mus musculus
gaagtcatcataagtgcatggctta

SEQ ID NO: 432391 - DNA, 25 bp, Mus musculus
gaagtcatcatatgtgcatggctta

SEQ ID NO: 432392 - DNA, 25 bp, Mus musculus
gaagtcatcatgctgtcccagggtg

SEQ ID NO: 432393 - DNA, 25 bp, Mus musculus
gaagtcatcatggtgtcccagggtg

SEQ ID NO: 432394 - DNA, 25 bp, Mus musculus
gaagtcatccggagctgaaggcaga

SEQ ID NO: 432395 - DNA, 25 bp, Mus musculus
gaagtcatccggtgctgaaggcaga

SEQ ID NO: 432396 - DNA, 25 bp, Mus musculus
gaagtcatcctcagtaggccctgta

SEQ ID NO: 432397 - DNA, 25 bp, Mus musculus
gaagtcatcctcatggtggccatca

SEQ ID NO: 432398 - DNA, 25 bp, Mus musculus
gaagtcatcctctgtaggccctgta

SEQ ID NO: 432399 - DNA, 25 bp, Mus musculus
gaagtcatcctcttggtggccatca

SEQ ID NO: 432400 - DNA, 25 bp, Mus musculus
gaagtcatcctgcacagagcaaaat

SEQ ID NO: 432401 - DNA, 25 bp, Mus musculus
gaagtcatcctggacagagcaaaat

SEQ ID NO: 432402 - DNA, 25 bp, Mus musculus
gaagtcatccttccattccttgtgg

SEQ ID NO: 432403 - DNA, 25 bp, Mus musculus
gaagtcatccttgcattccttgtgg

SEQ ID NO: 432404 - DNA, 25 bp, Mus musculus
gaagtcatcgtgagtctcctaaagt

SEQ ID NO: 432405 - DNA, 25 bp, Mus musculus
gaagtcatcgtgtgtctcctaaagt

SEQ ID NO: 432406 - DNA, 25 bp, Mus musculus
gaagtcatctctcagcattagcatc

SEQ ID NO: 432407 - DNA, 25 bp, Mus musculus
gaagtcatctctgagcattagcatc

SEQ ID NO: 432408 - DNA, 25 bp, Mus musculus
gaagtcatctggcatttctcctgct

SEQ ID NO: 432409 - DNA, 25 bp, Mus musculus
gaagtcatctgggatttctcctgct

SEQ ID NO: 432410 - DNA, 25 bp, Mus musculus
gaagtcatgagcaatcaaaggtaag

SEQ ID NO: 432411 - DNA, 25 bp, Mus musculus
gaagtcatgagctatcaaaggtaag

SEQ ID NO: 432412 - DNA, 25 bp, Mus musculus
gaagtcatgatgattctctactcaa

SEQ ID NO: 432413 - DNA, 25 bp, Mus musculus
gaagtcatgatgtttctctactcaa

SEQ ID NO: 432414 - DNA, 25 bp, Mus musculus
gaagtcatgattatccttgagctca

SEQ ID NO: 432415 - DNA, 25 bp, Mus musculus
gaagtcatgattttccttgagctca

SEQ ID NO: 432416 - DNA, 25 bp, Mus musculus
gaagtcatgcatagtgcacagaatg

SEQ ID NO: 432417 - DNA, 25 bp, Mus musculus
gaagtcatgcattgtgcacagaatg

SEQ ID NO: 432418 - DNA, 25 bp, Mus musculus
gaagtcatgccgaaacctcaggaaa

SEQ ID NO: 432419 - DNA, 25 bp, Mus musculus
gaagtcatgccgtaacctcaggaaa

SEQ ID NO: 432420 - DNA, 25 bp, Mus musculus
gaagtcatgctacgcttttttctct

SEQ ID NO: 432421 - DNA, 25 bp, Mus musculus
gaagtcatgctaggcttttttctct

SEQ ID NO: 432422 - DNA, 25 bp, Mus musculus
gaagtcatggacacacatgcctgta

SEQ ID NO: 432423 - DNA, 25 bp, Mus musculus
gaagtcatggactcacatgcctgta

SEQ ID NO: 432424 - DNA, 25 bp, Mus musculus
gaagtcatggttactgcagtccaga

SEQ ID NO: 432425 - DNA, 25 bp, Mus musculus
gaagtcatggtttctgcagtccaga

SEQ ID NO: 432426 - DNA, 25 bp, Mus musculus
gaagtcattacaaacgctggctcct

SEQ ID NO: 432427 - DNA, 25 bp, Mus musculus
gaagtcattacatacgctggctcct

SEQ ID NO: 432428 - DNA, 25 bp, Mus musculus
gaagtcattcagaggcaaagtcagt

SEQ ID NO: 432429 - DNA, 25 bp, Mus musculus
gaagtcattcagtggcaaagtcagt

SEQ ID NO: 432430 - DNA, 25 bp, Mus musculus
gaagtcattctaacaaagctgtcag

SEQ ID NO: 432431 - DNA, 25 bp, Mus musculus
gaagtcattctatcaaagctgtcag

SEQ ID NO: 432432 - DNA, 25 bp, Mus musculus
gaagtcattggtatgtccgtgttta

SEQ ID NO: 432433 - DNA, 25 bp, Mus musculus
gaagtcattggtttgtccgtgttta

SEQ ID NO: 432434 - DNA, 25 bp, Mus musculus
gaagtcatttccacctcaacaagag

SEQ ID NO: 432435 - DNA, 25 bp, Mus musculus
gaagtcatttcctcctcaacaagag

SEQ ID NO: 432436 - DNA, 25 bp, Mus musculus
gaagtcatttcgagtttgtttccca

SEQ ID NO: 432437 - DNA, 25 bp, Mus musculus
gaagtcatttcgtgtttgtttccca

SEQ ID NO: 432438 - DNA, 25 bp, Mus musculus
gaagtcatttctaaggcttgatatc

SEQ ID NO: 432439 - DNA, 25 bp, Mus musculus
gaagtcatttcttaggcttgatatc

SEQ ID NO: 432440 - DNA, 25 bp, Mus musculus
gaagtcatttggctggctctggttc

SEQ ID NO: 432441 - DNA, 25 bp, Mus musculus
gaagtcatttgggtggctctggttc

SEQ ID NO: 432442 - DNA, 25 bp, Mus musculus
gaagtcattttaaggagaacaaagc

SEQ ID NO: 432443 - DNA, 25 bp, Mus musculus
gaagtcattttatggagaacaaagc

SEQ ID NO: 432444 - DNA, 25 bp, Mus musculus
gaagtcatttttctcggtttgtgag

SEQ ID NO: 432445 - DNA, 25 bp, Mus musculus
gaagtcatttttgtcggtttgtgag

SEQ ID NO: 432446 - DNA, 25 bp, Mus musculus
gaagtccaactaagaagtattagaa

SEQ ID NO: 432447 - DNA, 25 bp, Mus musculus
gaagtccaactatgaagtattagaa

SEQ ID NO: 432448 - DNA, 25 bp, Mus musculus
gaagtccaactgaagctttttaatc

SEQ ID NO: 432449 - DNA, 25 bp, Mus musculus
gaagtccaactgtagctttttaatc

SEQ ID NO: 432450 - DNA, 25 bp, Mus musculus
gaagtccaacttccaggtctgttct

SEQ ID NO: 432451 - DNA, 25 bp, Mus musculus
gaagtccaacttgcaggtctgttct

SEQ ID NO: 432452 - DNA, 25 bp, Mus musculus
gaagtccaagcaattcttatctaat

SEQ ID NO: 432453 - DNA, 25 bp, Mus musculus
gaagtccaagcacgctacccaaagg

SEQ ID NO: 432454 - DNA, 25 bp, Mus musculus
gaagtccaagcaggctacccaaagg

SEQ ID NO: 432455 - DNA, 25 bp, Mus musculus
gaagtccaagcatttcttatctaat

SEQ ID NO: 432456 - DNA, 25 bp, Mus musculus
gaagtccaaggaaagcaaatgccta

SEQ ID NO: 432457 - DNA, 25 bp, Mus musculus
gaagtccaaggatagcaaatgccta

SEQ ID NO: 432458 - DNA, 25 bp, Mus musculus
gaagtccacaatatcctggctggga

SEQ ID NO: 432459 - DNA, 25 bp, Mus musculus
gaagtccacaatcggcaccgtgact

SEQ ID NO: 432460 - DNA, 25 bp, Mus musculus
gaagtccacaatgggcaccgtgact

SEQ ID NO: 432461 - DNA, 25 bp, Mus musculus
gaagtccacaatttcctggctggga

SEQ ID NO: 432462 - DNA, 25 bp, Mus musculus
gaagtccacacaaacagcatcgttt

SEQ ID NO: 432463 - DNA, 25 bp, Mus musculus
gaagtccacacatacagcatcgttt

SEQ ID NO: 432464 - DNA, 25 bp, Mus musculus
gaagtccacatgaacaaaatagtta

SEQ ID NO: 432465 - DNA, 25 bp, Mus musculus
gaagtccacatgtacaaaatagtta

SEQ ID NO: 432466 - DNA, 25 bp, Mus musculus
gaagtccaccttagacgtttggcct

SEQ ID NO: 432467 - DNA, 25 bp, Mus musculus
gaagtccacctttgacgtttggcct

SEQ ID NO: 432468 - DNA, 25 bp, Mus musculus
gaagtccacgacatccccatgatag

SEQ ID NO: 432469 - DNA, 25 bp, Mus musculus
gaagtccacgacttccccatgatag

SEQ ID NO: 432470 - DNA, 25 bp, Mus musculus
gaagtccacgagataagtagacact

SEQ ID NO: 432471 - DNA, 25 bp, Mus musculus
gaagtccacgagttaagtagacact

SEQ ID NO: 432472 - DNA, 25 bp, Mus musculus
gaagtccactaaaacccattatgct

SEQ ID NO: 432473 - DNA, 25 bp, Mus musculus
gaagtccactaatacccattatgct

SEQ ID NO: 432474 - DNA, 25 bp, Mus musculus
gaagtccactcaacagagcgaccat

SEQ ID NO: 432475 - DNA, 25 bp, Mus musculus
gaagtccactcaacatcaaaactgt

SEQ ID NO: 432476 - DNA, 25 bp, Mus musculus
gaagtccactcatcagagcgaccat

SEQ ID NO: 432477 - DNA, 25 bp, Mus musculus
gaagtccactcatcatcaaaactgt

SEQ ID NO: 432478 - DNA, 25 bp, Mus musculus
gaagtccactgcctaatgacaggga

SEQ ID NO: 432479 - DNA, 25 bp, Mus musculus
gaagtccactgcgtaatgacaggga

SEQ ID NO: 432480 - DNA, 25 bp, Mus musculus
gaagtccagactaccatgtgaagat

SEQ ID NO: 432481 - DNA, 25 bp, Mus musculus
gaagtccagacttccatgtgaagat

SEQ ID NO: 432482 - DNA, 25 bp, Mus musculus
gaagtccagatcatccgacatggag

SEQ ID NO: 432483 - DNA, 25 bp, Mus musculus
gaagtccagatcttccgacatggag

SEQ ID NO: 432484 - DNA, 25 bp, Mus musculus
gaagtccagcctccacatttgtggc

SEQ ID NO: 432485 - DNA, 25 bp, Mus musculus
gaagtccagcctgcacatttgtggc

SEQ ID NO: 432486 - DNA, 25 bp, Mus musculus
gaagtccaggagctagtgtccacca

SEQ ID NO: 432487 - DNA, 25 bp, Mus musculus
gaagtccaggaggtagtgtccacca

SEQ ID NO: 432488 - DNA, 25 bp, Mus musculus
gaagtccaggatattctgatcccca

SEQ ID NO: 432489 - DNA, 25 bp, Mus musculus
gaagtccaggattttctgatcccca

SEQ ID NO: 432490 - DNA, 25 bp, Mus musculus
gaagtccagtaacaagctggcatct

SEQ ID NO: 432491 - DNA, 25 bp, Mus musculus
gaagtccagtaacggtccattctcg

SEQ ID NO: 432492 - DNA, 25 bp, Mus musculus
gaagtccagtaagaagctggcatct

SEQ ID NO: 432493 - DNA, 25 bp, Mus musculus
gaagtccagtaagggtccattctcg

SEQ ID NO: 432494 - DNA, 25 bp, Mus musculus
gaagtccagttcatcccgttgatgc

SEQ ID NO: 432495 - DNA, 25 bp, Mus musculus
gaagtccagttcttcccgttgatgc

SEQ ID NO: 432496 - DNA, 25 bp, Mus musculus
gaagtccatcccaaaaacaacgtca

SEQ ID NO: 432497 - DNA, 25 bp, Mus musculus
gaagtccatccctaaaacaacgtca

SEQ ID NO: 432498 - DNA, 25 bp, Mus musculus
gaagtccatctaaaaacatgtctag

SEQ ID NO: 432499 - DNA, 25 bp, Mus musculus
gaagtccatctataaacatgtctag

SEQ ID NO: 432500 - DNA, 25 bp, Mus musculus
gaagtccatggcatacagctagcag

SEQ ID NO: 432501 - DNA, 25 bp, Mus musculus
gaagtccatggcttacagctagcag

SEQ ID NO: 432502 - DNA, 25 bp, Mus musculus
gaagtcccaaccatttcattttgct

SEQ ID NO: 432503 - DNA, 25 bp, Mus musculus
gaagtcccaaccttttcattttgct

SEQ ID NO: 432504 - DNA, 25 bp, Mus musculus
gaagtcccacacctgactcatatca

SEQ ID NO: 432505 - DNA, 25 bp, Mus musculus
gaagtcccacacgtgactcatatca

SEQ ID NO: 432506 - DNA, 25 bp, Mus musculus
gaagtcccacggagcaagctctgaa

SEQ ID NO: 432507 - DNA, 25 bp, Mus musculus
gaagtcccacggtgcaagctctgaa

SEQ ID NO: 432508 - DNA, 25 bp, Mus musculus
gaagtcccagcactgtggtatcagt

SEQ ID NO: 432509 - DNA, 25 bp, Mus musculus
gaagtcccagcagtgtggtatcagt

SEQ ID NO: 432510 - DNA, 25 bp, Mus musculus
gaagtcccaggaaccaatttctaat

SEQ ID NO: 432511 - DNA, 25 bp, Mus musculus
gaagtcccaggatccaatttctaat

SEQ ID NO: 432512 - DNA, 25 bp, Mus musculus
gaagtcccagttacctcaagagagg

SEQ ID NO: 432513 - DNA, 25 bp, Mus musculus
gaagtcccagtttcctcaagagagg

SEQ ID NO: 432514 - DNA, 25 bp, Mus musculus
gaagtcccattactcagaaagccta

SEQ ID NO: 432515 - DNA, 25 bp, Mus musculus
gaagtcccattagtcagaaagccta

SEQ ID NO: 432516 - DNA, 25 bp, Mus musculus
gaagtcccattgaatgaccaaacat

SEQ ID NO: 432517 - DNA, 25 bp, Mus musculus
gaagtcccattgtatgaccaaacat

SEQ ID NO: 432518 - DNA, 25 bp, Mus musculus
gaagtccccaaactagaactgccta

SEQ ID NO: 432519 - DNA, 25 bp, Mus musculus
gaagtccccaaagtagaactgccta

SEQ ID NO: 432520 - DNA, 25 bp, Mus musculus
gaagtccccatcataggaggaccca

SEQ ID NO: 432521 - DNA, 25 bp, Mus musculus
gaagtccccatcttaggaggaccca

SEQ ID NO: 432522 - DNA, 25 bp, Mus musculus
gaagtccccgatctgatccagaagg

SEQ ID NO: 432523 - DNA, 25 bp, Mus musculus
gaagtccccgatgtgatccagaagg

SEQ ID NO: 432524 - DNA, 25 bp, Mus musculus
gaagtccccttaccgagtgcctggt

SEQ ID NO: 432525 - DNA, 25 bp, Mus musculus
gaagtccccttagcgagtgcctggt

SEQ ID NO: 432526 - DNA, 25 bp, Mus musculus
gaagtcccgcttccttgagaacaag

SEQ ID NO: 432527 - DNA, 25 bp, Mus musculus
gaagtcccgcttgcttgagaacaag

SEQ ID NO: 432528 - DNA, 25 bp, Mus musculus
gaagtccctaaaaacagagtcccta

SEQ ID NO: 432529 - DNA, 25 bp, Mus musculus
gaagtccctaaatacagagtcccta

SEQ ID NO: 432530 - DNA, 25 bp, Mus musculus
gaagtccctacacatgtacttggaa

SEQ ID NO: 432531 - DNA, 25 bp, Mus musculus
gaagtccctacagatgtacttggaa

SEQ ID NO: 432532 - DNA, 25 bp, Mus musculus
gaagtccctagtatgtaattgttat

SEQ ID NO: 432533 - DNA, 25 bp, Mus musculus
gaagtccctagtttgtaattgttat

SEQ ID NO: 432534 - DNA, 25 bp, Mus musculus
gaagtccctcacaggactggactat

SEQ ID NO: 432535 - DNA, 25 bp, Mus musculus
gaagtccctcactggactggactat

SEQ ID NO: 432536 - DNA, 25 bp, Mus musculus
gaagtccctcttagggaagatcaaa

SEQ ID NO: 432537 - DNA, 25 bp, Mus musculus
gaagtccctctttgggaagatcaaa

SEQ ID NO: 432538 - DNA, 25 bp, Mus musculus
gaagtccctgaacatgggatgtttt

SEQ ID NO: 432539 - DNA, 25 bp, Mus musculus
gaagtccctgaactagaagtgccat

SEQ ID NO: 432540 - DNA, 25 bp, Mus musculus
gaagtccctgaagatgggatgtttt

SEQ ID NO: 432541 - DNA, 25 bp, Mus musculus
gaagtccctgaagtagaagtgccat

SEQ ID NO: 432542 - DNA, 25 bp, Mus musculus
gaagtccctgacaagatggtgtttg

SEQ ID NO: 432543 - DNA, 25 bp, Mus musculus
gaagtccctgactagatggtgtttg

SEQ ID NO: 432544 - DNA, 25 bp, Mus musculus
gaagtccctgctcatgggcaaggaa

SEQ ID NO: 432545 - DNA, 25 bp, Mus musculus
gaagtccctgctgatgggcaaggaa

SEQ ID NO: 432546 - DNA, 25 bp, Mus musculus
gaagtcccttctaaggaagttccag

SEQ ID NO: 432547 - DNA, 25 bp, Mus musculus
gaagtcccttcttaggaagttccag

SEQ ID NO: 432548 - DNA, 25 bp, Mus musculus
gaagtccgacggctggaaacccaag

SEQ ID NO: 432549 - DNA, 25 bp, Mus musculus
gaagtccgacgggtggaaacccaag

SEQ ID NO: 432550 - DNA, 25 bp, Mus musculus
gaagtccgagctctcagttcttctt

SEQ ID NO: 432551 - DNA, 25 bp, Mus musculus
gaagtccgagctgtcagttcttctt

SEQ ID NO: 432552 - DNA, 25 bp, Mus musculus
gaagtccgtattaacacgttggagc

SEQ ID NO: 432553 - DNA, 25 bp, Mus musculus
gaagtccgtatttacacgttggagc

SEQ ID NO: 432554 - DNA, 25 bp, Mus musculus
gaagtcctacaccatagttagatga

SEQ ID NO: 432555 - DNA, 25 bp, Mus musculus
gaagtcctacacgatagttagatga

SEQ ID NO: 432556 - DNA, 25 bp, Mus musculus
gaagtcctagcacaagtcatatgag

SEQ ID NO: 432557 - DNA, 25 bp, Mus musculus
gaagtcctagcagaagtcatatgag

SEQ ID NO: 432558 - DNA, 25 bp, Mus musculus
gaagtcctatgactgctacatctgc

SEQ ID NO: 432559 - DNA, 25 bp, Mus musculus
gaagtcctatgagtgctacatctgc

SEQ ID NO: 432560 - DNA, 25 bp, Mus musculus
gaagtcctattgatatcctccaaga

SEQ ID NO: 432561 - DNA, 25 bp, Mus musculus
gaagtcctattgttatcctccaaga

SEQ ID NO: 432562 - DNA, 25 bp, Mus musculus
gaagtcctcagtagtccaaagctgt

SEQ ID NO: 432563 - DNA, 25 bp, Mus musculus
gaagtcctcagttgtccaaagctgt

SEQ ID NO: 432564 - DNA, 25 bp, Mus musculus
gaagtcctcatcacaagggagctca

SEQ ID NO: 432565 - DNA, 25 bp, Mus musculus
gaagtcctcatctcaagggagctca

SEQ ID NO: 432566 - DNA, 25 bp, Mus musculus
gaagtcctccaaaggagtccatttc

SEQ ID NO: 432567 - DNA, 25 bp, Mus musculus
gaagtcctccaatggagtccatttc

SEQ ID NO: 432568 - DNA, 25 bp, Mus musculus
gaagtcctccttcatatattcctca

SEQ ID NO: 432569 - DNA, 25 bp, Mus musculus
gaagtcctccttgatatattcctca

SEQ ID NO: 432570 - DNA, 25 bp, Mus musculus
gaagtcctctccaagctgttaaaag

SEQ ID NO: 432571 - DNA, 25 bp, Mus musculus
gaagtcctctcctagctgttaaaag

SEQ ID NO: 432572 - DNA, 25 bp, Mus musculus
gaagtcctctgaagtcttgtgcttt

SEQ ID NO: 432573 - DNA, 25 bp, Mus musculus
gaagtcctctgatgtcttgtgcttt

SEQ ID NO: 432574 - DNA, 25 bp, Mus musculus
gaagtcctgagaccatgtccactgt

SEQ ID NO: 432575 - DNA, 25 bp, Mus musculus
gaagtcctgagagcatgtccactgt

SEQ ID NO: 432576 - DNA, 25 bp, Mus musculus
gaagtcctgcttagtacagacctaa

SEQ ID NO: 432577 - DNA, 25 bp, Mus musculus
gaagtcctgctttgtacagacctaa

SEQ ID NO: 432578 - DNA, 25 bp, Mus musculus
gaagtcctggaaagattctgccact

SEQ ID NO: 432579 - DNA, 25 bp, Mus musculus
gaagtcctggaatgattctgccact

SEQ ID NO: 432580 - DNA, 25 bp, Mus musculus
gaagtcctgggcaagtagtcttcag

SEQ ID NO: 432581 - DNA, 25 bp, Mus musculus
gaagtcctgggctagtagtcttcag

SEQ ID NO: 432582 - DNA, 25 bp, Mus musculus
gaagtcctggtaaacttagcttgaa

SEQ ID NO: 432583 - DNA, 25 bp, Mus musculus
gaagtcctggtatacttagcttgaa

SEQ ID NO: 432584 - DNA, 25 bp, Mus musculus
gaagtcctgtctaactggcttcctt

SEQ ID NO: 432585 - DNA, 25 bp, Mus musculus
gaagtcctgtctagaatagcctctc

SEQ ID NO: 432586 - DNA, 25 bp, Mus musculus
gaagtcctgtctatacggatggttt

SEQ ID NO: 432587 - DNA, 25 bp, Mus musculus
gaagtcctgtcttactggcttcctt

SEQ ID NO: 432588 - DNA, 25 bp, Mus musculus
gaagtcctgtcttgaatagcctctc

SEQ ID NO: 432589 - DNA, 25 bp, Mus musculus
gaagtcctgtctttacggatggttt

SEQ ID NO: 432590 - DNA, 25 bp, Mus musculus
gaagtcctgttcaataattacagaa

SEQ ID NO: 432591 - DNA, 25 bp, Mus musculus
gaagtcctgttcaatcgtaatgctg

SEQ ID NO: 432592 - DNA, 25 bp, Mus musculus
gaagtcctgttctataattacagaa

SEQ ID NO: 432593 - DNA, 25 bp, Mus musculus
gaagtcctgttctatcgtaatgctg

SEQ ID NO: 432594 - DNA, 25 bp, Mus musculus
gaagtcctgtttaaagaagttgcat

SEQ ID NO: 432595 - DNA, 25 bp, Mus musculus
gaagtcctgttttaagaagttgcat

SEQ ID NO: 432596 - DNA, 25 bp, Mus musculus
gaagtccttaaaatgcctgcactgt

SEQ ID NO: 432597 - DNA, 25 bp, Mus musculus
gaagtccttaaattgcctgcactgt

SEQ ID NO: 432598 - DNA, 25 bp, Mus musculus
gaagtccttacaagcaagctgtggc

SEQ ID NO: 432599 - DNA, 25 bp, Mus musculus
gaagtccttacatgcaagctgtggc

SEQ ID NO: 432600 - DNA, 25 bp, Mus musculus
gaagtccttccaaaacaagggcagt

SEQ ID NO: 432601 - DNA, 25 bp, Mus musculus
gaagtccttccataacaagggcagt

SEQ ID NO: 432602 - DNA, 25 bp, Mus musculus
gaagtccttcctacgagtggacaaa

SEQ ID NO: 432603 - DNA, 25 bp, Mus musculus
gaagtccttcctctaacattgtgaa

SEQ ID NO: 432604 - DNA, 25 bp, Mus musculus
gaagtccttcctgtaacattgtgaa

SEQ ID NO: 432605 - DNA, 25 bp, Mus musculus
gaagtccttccttcgagtggacaaa

SEQ ID NO: 432606 - DNA, 25 bp, Mus musculus
gaagtccttcttagaaatatgctca

SEQ ID NO: 432607 - DNA, 25 bp, Mus musculus
gaagtccttctttgaaatatgctca

SEQ ID NO: 432608 - DNA, 25 bp, Mus musculus
gaagtccttgcaagtgaatagtgag

SEQ ID NO: 432609 - DNA, 25 bp, Mus musculus
gaagtccttgcatgtgaatagtgag

SEQ ID NO: 432610 - DNA, 25 bp, Mus musculus
gaagtccttggcaagaatttaaaat

SEQ ID NO: 432611 - DNA, 25 bp, Mus musculus
gaagtccttggctagaatttaaaat

SEQ ID NO: 432612 - DNA, 25 bp, Mus musculus
gaagtcctttctatgctggacacat

SEQ ID NO: 432613 - DNA, 25 bp, Mus musculus
gaagtcctttctatgtctcttttga

SEQ ID NO: 432614 - DNA, 25 bp, Mus musculus
gaagtcctttctttgctggacacat

SEQ ID NO: 432615 - DNA, 25 bp, Mus musculus
gaagtcctttctttgtctcttttga

SEQ ID NO: 432616 - DNA, 25 bp, Mus musculus
gaagtcctttgaagttgtgcttata

SEQ ID NO: 432617 - DNA, 25 bp, Mus musculus
gaagtcctttgatgttgtgcttata

SEQ ID NO: 432618 - DNA, 25 bp, Mus musculus
gaagtccttttaccattctacctca

SEQ ID NO: 432619 - DNA, 25 bp, Mus musculus
gaagtccttttagcattctacctca

SEQ ID NO: 432620 - DNA, 25 bp, Mus musculus
gaagtccttttgcaacttagtgctc

SEQ ID NO: 432621 - DNA, 25 bp, Mus musculus
gaagtccttttggaacttagtgctc

SEQ ID NO: 432622 - DNA, 25 bp, Mus musculus
gaagtcgaagtcaaggatctcctga

SEQ ID NO: 432623 - DNA, 25 bp, Mus musculus
gaagtcgaagtctaggatctcctga

SEQ ID NO: 432624 - DNA, 25 bp, Mus musculus
gaagtcgactctaggaattttccgt

SEQ ID NO: 432625 - DNA, 25 bp, Mus musculus
gaagtcgactcttggaattttccgt

SEQ ID NO: 432626 - DNA, 25 bp, Mus musculus
gaagtcgagcctctcaagagttatt

SEQ ID NO: 432627 - DNA, 25 bp, Mus musculus
gaagtcgagcctgtcaagagttatt

SEQ ID NO: 432628 - DNA, 25 bp, Mus musculus
gaagtcgattataaagctgccaaag

SEQ ID NO: 432629 - DNA, 25 bp, Mus musculus
gaagtcgattattaagctgccaaag

SEQ ID NO: 432630 - DNA, 25 bp, Mus musculus
gaagtcgattccaaggagtttccgg

SEQ ID NO: 432631 - DNA, 25 bp, Mus musculus
gaagtcgattcctaggagtttccgg

SEQ ID NO: 432632 - DNA, 25 bp, Mus musculus
gaagtcgcaaaaacctcaggtagct

SEQ ID NO: 432633 - DNA, 25 bp, Mus musculus
gaagtcgcaaaatcctcaggtagct

SEQ ID NO: 432634 - DNA, 25 bp, Mus musculus
gaagtcgcacctacggtaatgaggt

SEQ ID NO: 432635 - DNA, 25 bp, Mus musculus
gaagtcgcaccttcggtaatgaggt

SEQ ID NO: 432636 - DNA, 25 bp, Mus musculus
gaagtcgccaacaaggtcaccatgg

SEQ ID NO: 432637 - DNA, 25 bp, Mus musculus
gaagtcgccaactaggtcaccatgg

SEQ ID NO: 432638 - DNA, 25 bp, Mus musculus
gaagtcgccataacgggagtcccgg

SEQ ID NO: 432639 - DNA, 25 bp, Mus musculus
gaagtcgccatatcgggagtcccgg

SEQ ID NO: 432640 - DNA, 25 bp, Mus musculus
gaagtcgccctcacaggaactgatt

SEQ ID NO: 432641 - DNA, 25 bp, Mus musculus
gaagtcgccctctcaggaactgatt

SEQ ID NO: 432642 - DNA, 25 bp, Mus musculus
gaagtcgccttacacgagatcctct

SEQ ID NO: 432643 - DNA, 25 bp, Mus musculus
gaagtcgccttagacgagatcctct

SEQ ID NO: 432644 - DNA, 25 bp, Mus musculus
gaagtcgctagcaggacccctggat

SEQ ID NO: 432645 - DNA, 25 bp, Mus musculus
gaagtcgctagctggacccctggat

SEQ ID NO: 432646 - DNA, 25 bp, Mus musculus
gaagtcgctggaacatcagcatcga

SEQ ID NO: 432647 - DNA, 25 bp, Mus musculus
gaagtcgctggatcatcagcatcga

SEQ ID NO: 432648 - DNA, 25 bp, Mus musculus
gaagtcggaggaacattcaaggcca

SEQ ID NO: 432649 - DNA, 25 bp, Mus musculus
gaagtcggaggatcattcaaggcca

SEQ ID NO: 432650 - DNA, 25 bp, Mus musculus
gaagtcggagtgcagcacttactaa

SEQ ID NO: 432651 - DNA, 25 bp, Mus musculus
gaagtcggagtggagcacttactaa

SEQ ID NO: 432652 - DNA, 25 bp, Mus musculus
gaagtcggcaatcctgctcaggctc

SEQ ID NO: 432653 - DNA, 25 bp, Mus musculus
gaagtcggcaatgctgctcaggctc

SEQ ID NO: 432654 - DNA, 25 bp, Mus musculus
gaagtcggtactcccgagagtcaga

SEQ ID NO: 432655 - DNA, 25 bp, Mus musculus
gaagtcggtactgccgagagtcaga

SEQ ID NO: 432656 - DNA, 25 bp, Mus musculus
gaagtcggtcctcatgctgatcctc

SEQ ID NO: 432657 - DNA, 25 bp, Mus musculus
gaagtcggtcctgatgctgatcctc

SEQ ID NO: 432658 - DNA, 25 bp, Mus musculus
gaagtcggtgcacaagctcctggca

SEQ ID NO: 432659 - DNA, 25 bp, Mus musculus
gaagtcggtgcagaagctcctggca

SEQ ID NO: 432660 - DNA, 25 bp, Mus musculus
gaagtcggttacagggtgctgcctc

SEQ ID NO: 432661 - DNA, 25 bp, Mus musculus
gaagtcggttactgggtgctgcctc

SEQ ID NO: 432662 - DNA, 25 bp, Mus musculus
gaagtcgtacttcatttaccagcgt

SEQ ID NO: 432663 - DNA, 25 bp, Mus musculus
gaagtcgtacttgatttaccagcgt

SEQ ID NO: 432664 - DNA, 25 bp, Mus musculus
gaagtcgtccagagcaacctgcaag

SEQ ID NO: 432665 - DNA, 25 bp, Mus musculus
gaagtcgtccagtgcaacctgcaag

SEQ ID NO: 432666 - DNA, 25 bp, Mus musculus
gaagtcgtctctaacgagttctcct

SEQ ID NO: 432667 - DNA, 25 bp, Mus musculus
gaagtcgtctcttacgagttctcct

SEQ ID NO: 432668 - DNA, 25 bp, Mus musculus
gaagtcgtgtgaaagatccagtcgt

SEQ ID NO: 432669 - DNA, 25 bp, Mus musculus
gaagtcgtgtgatagatccagtcgt

SEQ ID NO: 432670 - DNA, 25 bp, Mus musculus
gaagtcgtgttcattttcattgcaa

SEQ ID NO: 432671 - DNA, 25 bp, Mus musculus
gaagtcgtgttctttttcattgcaa

SEQ ID NO: 432672 - DNA, 25 bp, Mus musculus
gaagtcgttcagctacagctcactt

SEQ ID NO: 432673 - DNA, 25 bp, Mus musculus
gaagtcgttcaggtacagctcactt

SEQ ID NO: 432674 - DNA, 25 bp, Mus musculus
gaagtcgttcctaatgcactgtgat

SEQ ID NO: 432675 - DNA, 25 bp, Mus musculus
gaagtcgttccttatgcactgtgat

SEQ ID NO: 432676 - DNA, 25 bp, Mus musculus
gaagtcgttcgcatcctggtggagc

SEQ ID NO: 432677 - DNA, 25 bp, Mus musculus
gaagtcgttcgcttcctggtggagc

SEQ ID NO: 432678 - DNA, 25 bp, Mus musculus
gaagtcgttgatcagctcggtgatc

SEQ ID NO: 432679 - DNA, 25 bp, Mus musculus
gaagtcgttgatgagctcggtgatc

SEQ ID NO: 432680 - DNA, 25 bp, Mus musculus
gaagtcgttgctaccagtcaccaag

SEQ ID NO: 432681 - DNA, 25 bp, Mus musculus
gaagtcgttgcttccagtcaccaag

SEQ ID NO: 432682 - DNA, 25 bp, Mus musculus
gaagtcgtttatccgttccgaggat

SEQ ID NO: 432683 - DNA, 25 bp, Mus musculus
gaagtcgtttatgcgttccgaggat

SEQ ID NO: 432684 - DNA, 25 bp, Mus musculus
gaagtctaacatacgggtggccgaa

SEQ ID NO: 432685 - DNA, 25 bp, Mus musculus
gaagtctaacattcgggtggccgaa

SEQ ID NO: 432686 - DNA, 25 bp, Mus musculus
gaagtctaacttagcgctcaggctg

SEQ ID NO: 432687 - DNA, 25 bp, Mus musculus
gaagtctaacttcaggatgtagcct

SEQ ID NO: 432688 - DNA, 25 bp, Mus musculus
gaagtctaacttgaggatgtagcct

SEQ ID NO: 432689 - DNA, 25 bp, Mus musculus
gaagtctaactttgcgctcaggctg

SEQ ID NO: 432690 - DNA, 25 bp, Mus musculus
gaagtctaagacaccccaagttaca

SEQ ID NO: 432691 - DNA, 25 bp, Mus musculus
gaagtctaagactccccaagttaca

SEQ ID NO: 432692 - DNA, 25 bp, Mus musculus
gaagtctaagtcacgtttcgtctga

SEQ ID NO: 432693 - DNA, 25 bp, Mus musculus
gaagtctaagtctcgtttcgtctga

SEQ ID NO: 432694 - DNA, 25 bp, Mus musculus
gaagtctaatcactgttcgtttttt

SEQ ID NO: 432695 - DNA, 25 bp, Mus musculus
gaagtctaatcagtgttcgtttttt

SEQ ID NO: 432696 - DNA, 25 bp, Mus musculus
gaagtctacaacaactcctgtgaac

SEQ ID NO: 432697 - DNA, 25 bp, Mus musculus
gaagtctacaactactcctgtgaac

SEQ ID NO: 432698 - DNA, 25 bp, Mus musculus
gaagtctacatcagttttccaaaag

SEQ ID NO: 432699 - DNA, 25 bp, Mus musculus
gaagtctacatctgttttccaaaag

SEQ ID NO: 432700 - DNA, 25 bp, Mus musculus
gaagtctaccttataagactctcct

SEQ ID NO: 432701 - DNA, 25 bp, Mus musculus
gaagtctaccttttaagactctcct

SEQ ID NO: 432702 - DNA, 25 bp, Mus musculus
gaagtctactaaactgcacctggga

SEQ ID NO: 432703 - DNA, 25 bp, Mus musculus
gaagtctactaatctgcacctggga

SEQ ID NO: 432704 - DNA, 25 bp, Mus musculus
gaagtctactctataacgagatctg

SEQ ID NO: 432705 - DNA, 25 bp, Mus musculus
gaagtctactctttaacgagatctg

SEQ ID NO: 432706 - DNA, 25 bp, Mus musculus
gaagtctagacccatgcttgccatg

SEQ ID NO: 432707 - DNA, 25 bp, Mus musculus
gaagtctagaccgatgcttgccatg

SEQ ID NO: 432708 - DNA, 25 bp, Mus musculus
gaagtctagactagaaaaccaatga

SEQ ID NO: 432709 - DNA, 25 bp, Mus musculus
gaagtctagacttgaaaaccaatga

SEQ ID NO: 432710 - DNA, 25 bp, Mus musculus
gaagtctaggaaaccctggatttat

SEQ ID NO: 432711 - DNA, 25 bp, Mus musculus
gaagtctaggaatccctggatttat

SEQ ID NO: 432712 - DNA, 25 bp, Mus musculus
gaagtctagtgaagttccctcttaa

SEQ ID NO: 432713 - DNA, 25 bp, Mus musculus
gaagtctagtgatgttccctcttaa

SEQ ID NO: 432714 - DNA, 25 bp, Mus musculus
gaagtctataggctattttcttgaa

SEQ ID NO: 432715 - DNA, 25 bp, Mus musculus
gaagtctatagggtattttcttgaa

SEQ ID NO: 432716 - DNA, 25 bp, Mus musculus
gaagtctatgacacactggctttca

SEQ ID NO: 432717 - DNA, 25 bp, Mus musculus
gaagtctatgactcactggctttca

SEQ ID NO: 432718 - DNA, 25 bp, Mus musculus
gaagtctatgttctgaagttggaat

SEQ ID NO: 432719 - DNA, 25 bp, Mus musculus
gaagtctatgttgtgaagttggaat

SEQ ID NO: 432720 - DNA, 25 bp, Mus musculus
gaagtctattagcatctgctgtgac

SEQ ID NO: 432721 - DNA, 25 bp, Mus musculus
gaagtctattaggatctgctgtgac

SEQ ID NO: 432722 - DNA, 25 bp, Mus musculus
gaagtctattcaagtcatactccag

SEQ ID NO: 432723 - DNA, 25 bp, Mus musculus
gaagtctattcatgtcatactccag

SEQ ID NO: 432724 - DNA, 25 bp, Mus musculus
gaagtctattctctctttggtgccc

SEQ ID NO: 432725 - DNA, 25 bp, Mus musculus
gaagtctattctgtctttggtgccc

SEQ ID NO: 432726 - DNA, 25 bp, Mus musculus
gaagtctcaaatactgcagccttga

SEQ ID NO: 432727 - DNA, 25 bp, Mus musculus
gaagtctcaaattctgcagccttga

SEQ ID NO: 432728 - DNA, 25 bp, Mus musculus
gaagtctcaactactccacggagga

SEQ ID NO: 432729 - DNA, 25 bp, Mus musculus
gaagtctcaacttctccacggagga

SEQ ID NO: 432730 - DNA, 25 bp, Mus musculus
gaagtctcacaaaaccatcattcca

SEQ ID NO: 432731 - DNA, 25 bp, Mus musculus
gaagtctcacaataccatcattcca

SEQ ID NO: 432732 - DNA, 25 bp, Mus musculus
gaagtctcagagatcagctacaata

SEQ ID NO: 432733 - DNA, 25 bp, Mus musculus
gaagtctcagagttcagctacaata

SEQ ID NO: 432734 - DNA, 25 bp, Mus musculus
gaagtctcagttaacccaaagaagg

SEQ ID NO: 432735 - DNA, 25 bp, Mus musculus
gaagtctcagtttacccaaagaagg

SEQ ID NO: 432736 - DNA, 25 bp, Mus musculus
gaagtctcatagctaagctcaccct

SEQ ID NO: 432737 - DNA, 25 bp, Mus musculus
gaagtctcataggtaagctcaccct

SEQ ID NO: 432738 - DNA, 25 bp, Mus musculus
gaagtctcatcactccagaggtaga

SEQ ID NO: 432739 - DNA, 25 bp, Mus musculus
gaagtctcatcagtccagaggtaga

SEQ ID NO: 432740 - DNA, 25 bp, Mus musculus
gaagtctcatgtaattctgatagca

SEQ ID NO: 432741 - DNA, 25 bp, Mus musculus
gaagtctcatgtccggaaccatctg

SEQ ID NO: 432742 - DNA, 25 bp, Mus musculus
gaagtctcatgtgcggaaccatctg

SEQ ID NO: 432743 - DNA, 25 bp, Mus musculus
gaagtctcatgttattctgatagca

SEQ ID NO: 432744 - DNA, 25 bp, Mus musculus
gaagtctcatttaaacaagcgcagg

SEQ ID NO: 432745 - DNA, 25 bp, Mus musculus
gaagtctcatttaggctcatggtat

SEQ ID NO: 432746 - DNA, 25 bp, Mus musculus
gaagtctcatttctggcagtcgggc

SEQ ID NO: 432747 - DNA, 25 bp, Mus musculus
gaagtctcatttgtggcagtcgggc

SEQ ID NO: 432748 - DNA, 25 bp, Mus musculus
gaagtctcattttaacaagcgcagg

SEQ ID NO: 432749 - DNA, 25 bp, Mus musculus
gaagtctcattttggctcatggtat

SEQ ID NO: 432750 - DNA, 25 bp, Mus musculus
gaagtctccaatcccattcagaagg

SEQ ID NO: 432751 - DNA, 25 bp, Mus musculus
gaagtctccaatgccattcagaagg

SEQ ID NO: 432752 - DNA, 25 bp, Mus musculus
gaagtctccagtcgctgcaaacaag

SEQ ID NO: 432753 - DNA, 25 bp, Mus musculus
gaagtctccagtggctgcaaacaag

SEQ ID NO: 432754 - DNA, 25 bp, Mus musculus
gaagtctcctccagtcgagagctat

SEQ ID NO: 432755 - DNA, 25 bp, Mus musculus
gaagtctcctcctgtcgagagctat

SEQ ID NO: 432756 - DNA, 25 bp, Mus musculus
gaagtctccttcactgatgagccgt

SEQ ID NO: 432757 - DNA, 25 bp, Mus musculus
gaagtctccttctctgatgagccgt

SEQ ID NO: 432758 - DNA, 25 bp, Mus musculus
gaagtctcgaatcgagtctccgtct

SEQ ID NO: 432759 - DNA, 25 bp, Mus musculus
gaagtctcgaatggagtctccgtct

SEQ ID NO: 432760 - DNA, 25 bp, Mus musculus
gaagtctcgataacattcctgtcca

SEQ ID NO: 432761 - DNA, 25 bp, Mus musculus
gaagtctcgatatcattcctgtcca

SEQ ID NO: 432762 - DNA, 25 bp, Mus musculus
gaagtctcggatatgtttgcgttca

SEQ ID NO: 432763 - DNA, 25 bp, Mus musculus
gaagtctcggatttgtttgcgttca

SEQ ID NO: 432764 - DNA, 25 bp, Mus musculus
gaagtctctacgaactgtgaggcta

SEQ ID NO: 432765 - DNA, 25 bp, Mus musculus
gaagtctctacgtactgtgaggcta

SEQ ID NO: 432766 - DNA, 25 bp, Mus musculus
gaagtctctagaaaaggatccctta

SEQ ID NO: 432767 - DNA, 25 bp, Mus musculus
gaagtctctagaattacctcatttt

SEQ ID NO: 432768 - DNA, 25 bp, Mus musculus
gaagtctctagataaggatccctta

SEQ ID NO: 432769 - DNA, 25 bp, Mus musculus
gaagtctctagatttacctcatttt

SEQ ID NO: 432770 - DNA, 25 bp, Mus musculus
gaagtctctagtaagcatttatcat

SEQ ID NO: 432771 - DNA, 25 bp, Mus musculus
gaagtctctagttagcatttatcat

SEQ ID NO: 432772 - DNA, 25 bp, Mus musculus
gaagtctctcagaaactcagggaat

SEQ ID NO: 432773 - DNA, 25 bp, Mus musculus
gaagtctctcagtaactcagggaat

SEQ ID NO: 432774 - DNA, 25 bp, Mus musculus
gaagtctctcgacgccaaggtactg

SEQ ID NO: 432775 - DNA, 25 bp, Mus musculus
gaagtctctcgaggccaaggtactg

SEQ ID NO: 432776 - DNA, 25 bp, Mus musculus
gaagtctctctacctgcgggagcat

SEQ ID NO: 432777 - DNA, 25 bp, Mus musculus
gaagtctctctagctgcgggagcat

SEQ ID NO: 432778 - DNA, 25 bp, Mus musculus
gaagtctctgaaactgaccagggac

SEQ ID NO: 432779 - DNA, 25 bp, Mus musculus
gaagtctctgaacactacttgtaaa

SEQ ID NO: 432780 - DNA, 25 bp, Mus musculus
gaagtctctgaagactacttgtaaa

SEQ ID NO: 432781 - DNA, 25 bp, Mus musculus
gaagtctctgaatctgaccagggac

SEQ ID NO: 432782 - DNA, 25 bp, Mus musculus
gaagtctctgcaatattgatcactg

SEQ ID NO: 432783 - DNA, 25 bp, Mus musculus
gaagtctctgcattattgatcactg

SEQ ID NO: 432784 - DNA, 25 bp, Mus musculus
gaagtctcttacaaggagctgaact

SEQ ID NO: 432785 - DNA, 25 bp, Mus musculus
gaagtctcttactaggagctgaact

SEQ ID NO: 432786 - DNA, 25 bp, Mus musculus
gaagtctcttatcgcttgtggatcc

SEQ ID NO: 432787 - DNA, 25 bp, Mus musculus
gaagtctcttatctccaatagttta

SEQ ID NO: 432788 - DNA, 25 bp, Mus musculus
gaagtctcttatggcttgtggatcc

SEQ ID NO: 432789 - DNA, 25 bp, Mus musculus
gaagtctcttatgtccaatagttta

SEQ ID NO: 432790 - DNA, 25 bp, Mus musculus
gaagtctcttcaatgcctgcctgca

SEQ ID NO: 432791 - DNA, 25 bp, Mus musculus
gaagtctcttcattgcctgcctgca

SEQ ID NO: 432792 - DNA, 25 bp, Mus musculus
gaagtctcttgaactcaatccaaat

SEQ ID NO: 432793 - DNA, 25 bp, Mus musculus
gaagtctcttgatctcaatccaaat

SEQ ID NO: 432794 - DNA, 25 bp, Mus musculus
gaagtctcttggattatcagtgcat

SEQ ID NO: 432795 - DNA, 25 bp, Mus musculus
gaagtctcttggtttatcagtgcat

SEQ ID NO: 432796 - DNA, 25 bp, Mus musculus
gaagtctcttgtataagcgcccagt

SEQ ID NO: 432797 - DNA, 25 bp, Mus musculus
gaagtctcttgtttaagcgcccagt

SEQ ID NO: 432798 - DNA, 25 bp, Mus musculus
gaagtctctttgattcacttacctc

SEQ ID NO: 432799 - DNA, 25 bp, Mus musculus
gaagtctctttgtttcacttacctc

SEQ ID NO: 432800 - DNA, 25 bp, Mus musculus
gaagtctgaagaagaccccactacc

SEQ ID NO: 432801 - DNA, 25 bp, Mus musculus
gaagtctgaagatgaccccactacc

SEQ ID NO: 432802 - DNA, 25 bp, Mus musculus
gaagtctgaagcaaccgaggtgctg

SEQ ID NO: 432803 - DNA, 25 bp, Mus musculus
gaagtctgaagcatcaaaattctag

SEQ ID NO: 432804 - DNA, 25 bp, Mus musculus
gaagtctgaagccatgccagccctg

SEQ ID NO: 432805 - DNA, 25 bp, Mus musculus
gaagtctgaagcgatgccagccctg

SEQ ID NO: 432806 - DNA, 25 bp, Mus musculus
gaagtctgaagctaccgaggtgctg

SEQ ID NO: 432807 - DNA, 25 bp, Mus musculus
gaagtctgaagcttcaaaattctag

SEQ ID NO: 432808 - DNA, 25 bp, Mus musculus
gaagtctgacttaccccttgttgca

SEQ ID NO: 432809 - DNA, 25 bp, Mus musculus
gaagtctgacttatgcaaatctctc

SEQ ID NO: 432810 - DNA, 25 bp, Mus musculus
gaagtctgacttctttctgaaaccc

SEQ ID NO: 432811 - DNA, 25 bp, Mus musculus
gaagtctgacttgtttctgaaaccc

SEQ ID NO: 432812 - DNA, 25 bp, Mus musculus
gaagtctgactttccccttgttgca

SEQ ID NO: 432813 - DNA, 25 bp, Mus musculus
gaagtctgacttttgcaaatctctc

SEQ ID NO: 432814 - DNA, 25 bp, Mus musculus
gaagtctgagacaggacaatggtgc

SEQ ID NO: 432815 - DNA, 25 bp, Mus musculus
gaagtctgagactggacaatggtgc

SEQ ID NO: 432816 - DNA, 25 bp, Mus musculus
gaagtctgaggaagcgtgtttccga

SEQ ID NO: 432817 - DNA, 25 bp, Mus musculus
gaagtctgaggatgcgtgtttccga

SEQ ID NO: 432818 - DNA, 25 bp, Mus musculus
gaagtctgatacagcgtatctcaaa

SEQ ID NO: 432819 - DNA, 25 bp, Mus musculus
gaagtctgatactgcgtatctcaaa

SEQ ID NO: 432820 - DNA, 25 bp, Mus musculus
gaagtctgcagaactatttgctcta

SEQ ID NO: 432821 - DNA, 25 bp, Mus musculus
gaagtctgcagaatatacgtggtat

SEQ ID NO: 432822 - DNA, 25 bp, Mus musculus
gaagtctgcagaatcagggccagct

SEQ ID NO: 432823 - DNA, 25 bp, Mus musculus
gaagtctgcagatctatttgctcta

SEQ ID NO: 432824 - DNA, 25 bp, Mus musculus
gaagtctgcagattatacgtggtat

SEQ ID NO: 432825 - DNA, 25 bp, Mus musculus
gaagtctgcagattcagggccagct

SEQ ID NO: 432826 - DNA, 25 bp, Mus musculus
gaagtctgcagcaaagagcctgaga

SEQ ID NO: 432827 - DNA, 25 bp, Mus musculus
gaagtctgcagctaagagcctgaga

SEQ ID NO: 432828 - DNA, 25 bp, Mus musculus
gaagtctgccagcttcaaatgttgc

SEQ ID NO: 432829 - DNA, 25 bp, Mus musculus
gaagtctgccaggttcaaatgttgc

SEQ ID NO: 432830 - DNA, 25 bp, Mus musculus
gaagtctgccttatcacgtgaagga

SEQ ID NO: 432831 - DNA, 25 bp, Mus musculus
gaagtctgccttttcacgtgaagga

SEQ ID NO: 432832 - DNA, 25 bp, Mus musculus
gaagtctgcgtgctgtttgtgaata

SEQ ID NO: 432833 - DNA, 25 bp, Mus musculus
gaagtctgcgtggtgtttgtgaata

SEQ ID NO: 432834 - DNA, 25 bp, Mus musculus
gaagtctgctctacataattgatat

SEQ ID NO: 432835 - DNA, 25 bp, Mus musculus
gaagtctgctcttcataattgatat

SEQ ID NO: 432836 - DNA, 25 bp, Mus musculus
gaagtctgctgcagttctcttggga

SEQ ID NO: 432837 - DNA, 25 bp, Mus musculus
gaagtctgctgctgttctcttggga

SEQ ID NO: 432838 - DNA, 25 bp, Mus musculus
gaagtctgcttaattactgagaact

SEQ ID NO: 432839 - DNA, 25 bp, Mus musculus
gaagtctgcttatttactgagaact

SEQ ID NO: 432840 - DNA, 25 bp, Mus musculus
gaagtctgcttgaacaatgtcaaat

SEQ ID NO: 432841 - DNA, 25 bp, Mus musculus
gaagtctgcttgtacaatgtcaaat

SEQ ID NO: 432842 - DNA, 25 bp, Mus musculus
gaagtctgctttcgtgaggttgcat

SEQ ID NO: 432843 - DNA, 25 bp, Mus musculus
gaagtctgctttggtgaggttgcat

SEQ ID NO: 432844 - DNA, 25 bp, Mus musculus
gaagtctggagaatactacgttaca

SEQ ID NO: 432845 - DNA, 25 bp, Mus musculus
gaagtctggagactgtatgcccaag

SEQ ID NO: 432846 - DNA, 25 bp, Mus musculus
gaagtctggagagtgtatgcccaag

SEQ ID NO: 432847 - DNA, 25 bp, Mus musculus
gaagtctggagattactacgttaca

SEQ ID NO: 432848 - DNA, 25 bp, Mus musculus
gaagtctggcaactccgacgtgtat

SEQ ID NO: 432849 - DNA, 25 bp, Mus musculus
gaagtctggcaagtccgacgtgtat

SEQ ID NO: 432850 - DNA, 25 bp, Mus musculus
gaagtctggcacaccatggatgaca

SEQ ID NO: 432851 - DNA, 25 bp, Mus musculus
gaagtctggcactccatggatgaca

SEQ ID NO: 432852 - DNA, 25 bp, Mus musculus
gaagtctggctaacatactgctgat

SEQ ID NO: 432853 - DNA, 25 bp, Mus musculus
gaagtctggctatcatactgctgat

SEQ ID NO: 432854 - DNA, 25 bp, Mus musculus
gaagtctggtacagtggcacatgcc

SEQ ID NO: 432855 - DNA, 25 bp, Mus musculus
gaagtctggtactgtggcacatgcc

SEQ ID NO: 432856 - DNA, 25 bp, Mus musculus
gaagtctggtcaccttgagggtcct

SEQ ID NO: 432857 - DNA, 25 bp, Mus musculus
gaagtctggtcagcttgagggtcct

SEQ ID NO: 432858 - DNA, 25 bp, Mus musculus
gaagtctggttaacatccatcagca

SEQ ID NO: 432859 - DNA, 25 bp, Mus musculus
gaagtctggttatcatccatcagca

SEQ ID NO: 432860 - DNA, 25 bp, Mus musculus
gaagtctggttcattggcataatgt

SEQ ID NO: 432861 - DNA, 25 bp, Mus musculus
gaagtctggttctttggcataatgt

SEQ ID NO: 432862 - DNA, 25 bp, Mus musculus
gaagtctgtactatccttataactg

SEQ ID NO: 432863 - DNA, 25 bp, Mus musculus
gaagtctgtactttccttataactg

SEQ ID NO: 432864 - DNA, 25 bp, Mus musculus
gaagtctgtatgcacagctcttgga

SEQ ID NO: 432865 - DNA, 25 bp, Mus musculus
gaagtctgtatggacagctcttgga

SEQ ID NO: 432866 - DNA, 25 bp, Mus musculus
gaagtctgtgacaattcggtgttat

SEQ ID NO: 432867 - DNA, 25 bp, Mus musculus
gaagtctgtgacctcgttggccaaa

SEQ ID NO: 432868 - DNA, 25 bp, Mus musculus
gaagtctgtgacgtcgttggccaaa

SEQ ID NO: 432869 - DNA, 25 bp, Mus musculus
gaagtctgtgactattcggtgttat

SEQ ID NO: 432870 - DNA, 25 bp, Mus musculus
gaagtctgtgctaataatgcttgtc

SEQ ID NO: 432871 - DNA, 25 bp, Mus musculus
gaagtctgtgcttataatgcttgtc

SEQ ID NO: 432872 - DNA, 25 bp, Mus musculus
gaagtctgtgtcatgcaggcatcag

SEQ ID NO: 432873 - DNA, 25 bp, Mus musculus
gaagtctgtgtcttgcaggcatcag

SEQ ID NO: 432874 - DNA, 25 bp, Mus musculus
gaagtctgttaaatccatgggtgaa

SEQ ID NO: 432875 - DNA, 25 bp, Mus musculus
gaagtctgttaattccatgggtgaa

SEQ ID NO: 432876 - DNA, 25 bp, Mus musculus
gaagtctgtttaaaatacccatttg

SEQ ID NO: 432877 - DNA, 25 bp, Mus musculus
gaagtctgtttataatacccatttg

SEQ ID NO: 432878 - DNA, 25 bp, Mus musculus
gaagtcttaattcacatccccagag

SEQ ID NO: 432879 - DNA, 25 bp, Mus musculus
gaagtcttaattgacatccccagag

SEQ ID NO: 432880 - DNA, 25 bp, Mus musculus
gaagtcttagacagctggcattttg

SEQ ID NO: 432881 - DNA, 25 bp, Mus musculus
gaagtcttagactgctggcattttg

SEQ ID NO: 432882 - DNA, 25 bp, Mus musculus
gaagtcttatgaccaagtccctgtt

SEQ ID NO: 432883 - DNA, 25 bp, Mus musculus
gaagtcttatgagcaagtccctgtt

SEQ ID NO: 432884 - DNA, 25 bp, Mus musculus
gaagtcttcaacactgactgcaaaa

SEQ ID NO: 432885 - DNA, 25 bp, Mus musculus
gaagtcttcaactctgactgcaaaa

SEQ ID NO: 432886 - DNA, 25 bp, Mus musculus
gaagtcttcactccaaatcatgtgc

SEQ ID NO: 432887 - DNA, 25 bp, Mus musculus
gaagtcttcactgcaaatcatgtgc

SEQ ID NO: 432888 - DNA, 25 bp, Mus musculus
gaagtcttcagacacagtgtctggt

SEQ ID NO: 432889 - DNA, 25 bp, Mus musculus
gaagtcttcagagacagtgtctggt

SEQ ID NO: 432890 - DNA, 25 bp, Mus musculus
gaagtcttcagcatgttacgtgatg

SEQ ID NO: 432891 - DNA, 25 bp, Mus musculus
gaagtcttcagcttgttacgtgatg

SEQ ID NO: 432892 - DNA, 25 bp, Mus musculus
gaagtcttcataacagtacaatcat

SEQ ID NO: 432893 - DNA, 25 bp, Mus musculus
gaagtcttcatatcagtacaatcat

SEQ ID NO: 432894 - DNA, 25 bp, Mus musculus
gaagtcttccagaaaaccacaagtt

SEQ ID NO: 432895 - DNA, 25 bp, Mus musculus
gaagtcttccagtaaaccacaagtt

SEQ ID NO: 432896 - DNA, 25 bp, Mus musculus
gaagtcttccgaatggtgttctgaa

SEQ ID NO: 432897 - DNA, 25 bp, Mus musculus
gaagtcttccgattggtgttctgaa

SEQ ID NO: 432898 - DNA, 25 bp, Mus musculus
gaagtcttccgtaggtaccactaga

SEQ ID NO: 432899 - DNA, 25 bp, Mus musculus
gaagtcttccgttggtaccactaga

SEQ ID NO: 432900 - DNA, 25 bp, Mus musculus
gaagtcttcctaccagaagggtcat

SEQ ID NO: 432901 - DNA, 25 bp, Mus musculus
gaagtcttcctagcagaagggtcat

SEQ ID NO: 432902 - DNA, 25 bp, Mus musculus
gaagtcttcctcagtctcccgtgca

SEQ ID NO: 432903 - DNA, 25 bp, Mus musculus
gaagtcttcctcagtttgtgctcta

SEQ ID NO: 432904 - DNA, 25 bp, Mus musculus
gaagtcttcctctgtctcccgtgca

SEQ ID NO: 432905 - DNA, 25 bp, Mus musculus
gaagtcttcctctgtttgtgctcta

SEQ ID NO: 432906 - DNA, 25 bp, Mus musculus
gaagtcttccttcgcccaatagggc

SEQ ID NO: 432907 - DNA, 25 bp, Mus musculus
gaagtcttccttggcccaatagggc

SEQ ID NO: 432908 - DNA, 25 bp, Mus musculus
gaagtcttcgttactgtgtaaaaga

SEQ ID NO: 432909 - DNA, 25 bp, Mus musculus
gaagtcttcgtttctgtgtaaaaga

SEQ ID NO: 432910 - DNA, 25 bp, Mus musculus
gaagtcttctccagtcaaagtggga

SEQ ID NO: 432911 - DNA, 25 bp, Mus musculus
gaagtcttctcctgtcaaagtggga

SEQ ID NO: 432912 - DNA, 25 bp, Mus musculus
gaagtcttcttcaaagtgccaatga

SEQ ID NO: 432913 - DNA, 25 bp, Mus musculus
gaagtcttcttctaagtgccaatga

SEQ ID NO: 432914 - DNA, 25 bp, Mus musculus
gaagtcttgaccacttatttcaata

SEQ ID NO: 432915 - DNA, 25 bp, Mus musculus
gaagtcttgacctcttatttcaata

SEQ ID NO: 432916 - DNA, 25 bp, Mus musculus
gaagtcttgattacatgtgattaca

SEQ ID NO: 432917 - DNA, 25 bp, Mus musculus
gaagtcttgatttcatgtgattaca

SEQ ID NO: 432918 - DNA, 25 bp, Mus musculus
gaagtcttgctgaccagcccaagag

SEQ ID NO: 432919 - DNA, 25 bp, Mus musculus
gaagtcttgctgtccagcccaagag

SEQ ID NO: 432920 - DNA, 25 bp, Mus musculus
gaagtcttggacaggcgaactcaga

SEQ ID NO: 432921 - DNA, 25 bp, Mus musculus
gaagtcttggactggcgaactcaga

SEQ ID NO: 432922 - DNA, 25 bp, Mus musculus
gaagtcttggcaagggctcttcagc

SEQ ID NO: 432923 - DNA, 25 bp, Mus musculus
gaagtcttggcatgggctcttcagc

SEQ ID NO: 432924 - DNA, 25 bp, Mus musculus
gaagtcttggcccagtacttacagc

SEQ ID NO: 432925 - DNA, 25 bp, Mus musculus
gaagtcttggccgagtacttacagc

SEQ ID NO: 432926 - DNA, 25 bp, Mus musculus
gaagtcttggttccctgtgtcctag

SEQ ID NO: 432927 - DNA, 25 bp, Mus musculus
gaagtcttggttgcctgtgtcctag

SEQ ID NO: 432928 - DNA, 25 bp, Mus musculus
gaagtcttgtgcacagtgtctgtgg

SEQ ID NO: 432929 - DNA, 25 bp, Mus musculus
gaagtcttgtgctcagtgtctgtgg

SEQ ID NO: 432930 - DNA, 25 bp, Mus musculus
gaagtcttgttaatgtcagccacct

SEQ ID NO: 432931 - DNA, 25 bp, Mus musculus
gaagtcttgttattgtcagccacct

SEQ ID NO: 432932 - DNA, 25 bp, Mus musculus
gaagtcttgtttagctcagcatctc

SEQ ID NO: 432933 - DNA, 25 bp, Mus musculus
gaagtcttgttttgctcagcatctc

SEQ ID NO: 432934 - DNA, 25 bp, Mus musculus
gaagtctttacgctctttgaggagt

SEQ ID NO: 432935 - DNA, 25 bp, Mus musculus
gaagtctttacggtctttgaggagt

SEQ ID NO: 432936 - DNA, 25 bp, Mus musculus
gaagtctttagcctggtgcatacat

SEQ ID NO: 432937 - DNA, 25 bp, Mus musculus
gaagtctttagcgtggtgcatacat

SEQ ID NO: 432938 - DNA, 25 bp, Mus musculus
gaagtctttatcatactgtacctca

SEQ ID NO: 432939 - DNA, 25 bp, Mus musculus
gaagtctttatcttactgtacctca

SEQ ID NO: 432940 - DNA, 25 bp, Mus musculus
gaagtctttccactaagtttttctg

SEQ ID NO: 432941 - DNA, 25 bp, Mus musculus
gaagtctttccagtaagtttttctg

SEQ ID NO: 432942 - DNA, 25 bp, Mus musculus
gaagtctttcccatgtcgcagggta

SEQ ID NO: 432943 - DNA, 25 bp, Mus musculus
gaagtctttccccataaatgtctta

SEQ ID NO: 432944 - DNA, 25 bp, Mus musculus
gaagtctttcccctttgaggtgaga

SEQ ID NO: 432945 - DNA, 25 bp, Mus musculus
gaagtctttcccgataaatgtctta

SEQ ID NO: 432946 - DNA, 25 bp, Mus musculus
gaagtctttcccgtttgaggtgaga

SEQ ID NO: 432947 - DNA, 25 bp, Mus musculus
gaagtctttcccttgtcgcagggta

SEQ ID NO: 432948 - DNA, 25 bp, Mus musculus
gaagtctttctaaccagaggccatt

SEQ ID NO: 432949 - DNA, 25 bp, Mus musculus
gaagtctttctatccagaggccatt

SEQ ID NO: 432950 - DNA, 25 bp, Mus musculus
gaagtctttggtctgccatgtccac

SEQ ID NO: 432951 - DNA, 25 bp, Mus musculus
gaagtctttggtgtgccatgtccac

SEQ ID NO: 432952 - DNA, 25 bp, Mus musculus
gaagtctttgtactctttcatcaag

SEQ ID NO: 432953 - DNA, 25 bp, Mus musculus
gaagtctttgtagtctttcatcaag

SEQ ID NO: 432954 - DNA, 25 bp, Mus musculus
gaagtcttttgcagggtgtcacaca

SEQ ID NO: 432955 - DNA, 25 bp, Mus musculus
gaagtcttttgctgggtgtcacaca

SEQ ID NO: 432956 - DNA, 25 bp, Mus musculus
gaagtcttttgtaggttcttgttgt

SEQ ID NO: 432957 - DNA, 25 bp, Mus musculus
gaagtcttttgttggttcttgttgt

SEQ ID NO: 432958 - DNA, 25 bp, Mus musculus
gaagtcttttttcagcccagccatt

SEQ ID NO: 432959 - DNA, 25 bp, Mus musculus
gaagtcttttttccagccttgtact

SEQ ID NO: 432960 - DNA, 25 bp, Mus musculus
gaagtcttttttgagcccagccatt

SEQ ID NO: 432961 - DNA, 25 bp, Mus musculus
gaagtcttttttgcagccttgtact

SEQ ID NO: 432962 - DNA, 25 bp, Mus musculus
gaagtgaaactcaggtccgcttctc

SEQ ID NO: 432963 - DNA, 25 bp, Mus musculus
gaagtgaaactctggtccgcttctc

SEQ ID NO: 432964 - DNA, 25 bp, Mus musculus
gaagtgaaagacctccagtgtttgt

SEQ ID NO: 432965 - DNA, 25 bp, Mus musculus
gaagtgaaagacgtccagtgtttgt

SEQ ID NO: 432966 - DNA, 25 bp, Mus musculus
gaagtgaaagcgacagctctacaac

SEQ ID NO: 432967 - DNA, 25 bp, Mus musculus
gaagtgaaagcgtcagctctacaac

SEQ ID NO: 432968 - DNA, 25 bp, Mus musculus
gaagtgaaattcagcctggatcttt

SEQ ID NO: 432969 - DNA, 25 bp, Mus musculus
gaagtgaaattctgcctggatcttt

SEQ ID NO: 432970 - DNA, 25 bp, Mus musculus
gaagtgaacaacaggtgctaatcca

SEQ ID NO: 432971 - DNA, 25 bp, Mus musculus
gaagtgaacaactggtgctaatcca

SEQ ID NO: 432972 - DNA, 25 bp, Mus musculus
gaagtgaacaagattcagatggcct

SEQ ID NO: 432973 - DNA, 25 bp, Mus musculus
gaagtgaacaagtttcagatggcct

SEQ ID NO: 432974 - DNA, 25 bp, Mus musculus
gaagtgaacaccaatgcccgaagct

SEQ ID NO: 432975 - DNA, 25 bp, Mus musculus
gaagtgaacacctatgcccgaagct

SEQ ID NO: 432976 - DNA, 25 bp, Mus musculus
gaagtgaacagcaaccgtcagtttt

SEQ ID NO: 432977 - DNA, 25 bp, Mus musculus
gaagtgaacagctaccgtcagtttt

SEQ ID NO: 432978 - DNA, 25 bp, Mus musculus
gaagtgaacccacgttctcatttaa

SEQ ID NO: 432979 - DNA, 25 bp, Mus musculus
gaagtgaacccaggttctcatttaa

SEQ ID NO: 432980 - DNA, 25 bp, Mus musculus
gaagtgaacctgcactacgaacgta

SEQ ID NO: 432981 - DNA, 25 bp, Mus musculus
gaagtgaacctggactacgaacgta

SEQ ID NO: 432982 - DNA, 25 bp, Mus musculus
gaagtgaaccttctcagtggcttta

SEQ ID NO: 432983 - DNA, 25 bp, Mus musculus
gaagtgaaccttgtcagtggcttta

SEQ ID NO: 432984 - DNA, 25 bp, Mus musculus
gaagtgaacgcacccatggtctatg

SEQ ID NO: 432985 - DNA, 25 bp, Mus musculus
gaagtgaacgcagccatggtctatg

SEQ ID NO: 432986 - DNA, 25 bp, Mus musculus
gaagtgaactcccagcgatgtagcc

SEQ ID NO: 432987 - DNA, 25 bp, Mus musculus
gaagtgaactccgagcgatgtagcc

SEQ ID NO: 432988 - DNA, 25 bp, Mus musculus
gaagtgaactgtcccttaagtcaaa

SEQ ID NO: 432989 - DNA, 25 bp, Mus musculus
gaagtgaactgtgccttaagtcaaa

SEQ ID NO: 432990 - DNA, 25 bp, Mus musculus
gaagtgaagactcgctgacccaaga

SEQ ID NO: 432991 - DNA, 25 bp, Mus musculus
gaagtgaagactggctgacccaaga

SEQ ID NO: 432992 - DNA, 25 bp, Mus musculus
gaagtgaagcccctagtgtccagca

SEQ ID NO: 432993 - DNA, 25 bp, Mus musculus
gaagtgaagcccgtagtgtccagca

SEQ ID NO: 432994 - DNA, 25 bp, Mus musculus
gaagtgaaggtcagctccgacatgc

SEQ ID NO: 432995 - DNA, 25 bp, Mus musculus
gaagtgaaggtctgctccgacatgc

SEQ ID NO: 432996 - DNA, 25 bp, Mus musculus
gaagtgaagtcccagccagcagcgc

SEQ ID NO: 432997 - DNA, 25 bp, Mus musculus
gaagtgaagtccgagccagcagcgc

SEQ ID NO: 432998 - DNA, 25 bp, Mus musculus
gaagtgaagtgtcgccctactctga

SEQ ID NO: 432999 - DNA, 25 bp, Mus musculus
gaagtgaagtgtggccctactctga

SEQ ID NO: 433000 - DNA, 25 bp, Mus musculus
gaagtgaagttcaagcccatcccgc

SEQ ID NO: 433001 - DNA, 25 bp, Mus musculus
gaagtgaagttctagcccatcccgc

SEQ ID NO: 433002 - DNA, 25 bp, Mus musculus
gaagtgaatgccctctttgagctga

SEQ ID NO: 433003 - DNA, 25 bp, Mus musculus
gaagtgaatgccgtctttgagctga

SEQ ID NO: 433004 - DNA, 25 bp, Mus musculus
gaagtgaattttatccctccaagtt

SEQ ID NO: 433005 - DNA, 25 bp, Mus musculus
gaagtgaattttttccctccaagtt

SEQ ID NO: 433006 - DNA, 25 bp, Mus musculus
gaagtgacaaataccacgctcaatg

SEQ ID NO: 433007 - DNA, 25 bp, Mus musculus
gaagtgacaaattccacgctcaatg

SEQ ID NO: 433008 - DNA, 25 bp, Mus musculus
gaagtgacaagtcgacagcaacagc

SEQ ID NO: 433009 - DNA, 25 bp, Mus musculus
gaagtgacaagtggacagcaacagc

SEQ ID NO: 433010 - DNA, 25 bp, Mus musculus
gaagtgacacacctttgtttttttg

SEQ ID NO: 433011 - DNA, 25 bp, Mus musculus
gaagtgacacacgtttgtttttttg

SEQ ID NO: 433012 - DNA, 25 bp, Mus musculus
gaagtgacacatactgcctcagttt

SEQ ID NO: 433013 - DNA, 25 bp, Mus musculus
gaagtgacacattctgcctcagttt

SEQ ID NO: 433014 - DNA, 25 bp, Mus musculus
gaagtgacacttagggttctcatgc

SEQ ID NO: 433015 - DNA, 25 bp, Mus musculus
gaagtgacacttccccatctattaa

SEQ ID NO: 433016 - DNA, 25 bp, Mus musculus
gaagtgacacttgcccatctattaa

SEQ ID NO: 433017 - DNA, 25 bp, Mus musculus
gaagtgacactttgggttctcatgc

SEQ ID NO: 433018 - DNA, 25 bp, Mus musculus
gaagtgacagacacattttatgcag

SEQ ID NO: 433019 - DNA, 25 bp, Mus musculus
gaagtgacagactcattttatgcag

SEQ ID NO: 433020 - DNA, 25 bp, Mus musculus
gaagtgacagatatccagccaggaa

SEQ ID NO: 433021 - DNA, 25 bp, Mus musculus
gaagtgacagatttccagccaggaa

SEQ ID NO: 433022 - DNA, 25 bp, Mus musculus
gaagtgacaggaagggtactaccca

SEQ ID NO: 433023 - DNA, 25 bp, Mus musculus
gaagtgacaggatgggtactaccca

SEQ ID NO: 433024 - DNA, 25 bp, Mus musculus
gaagtgacaggtaactgttttaact

SEQ ID NO: 433025 - DNA, 25 bp, Mus musculus
gaagtgacaggttactgttttaact

SEQ ID NO: 433026 - DNA, 25 bp, Mus musculus
gaagtgaccaagctctttcagctgt

SEQ ID NO: 433027 - DNA, 25 bp, Mus musculus
gaagtgaccaaggtctttcagctgt

SEQ ID NO: 433028 - DNA, 25 bp, Mus musculus
gaagtgaccacgctctacttttact

SEQ ID NO: 433029 - DNA, 25 bp, Mus musculus
gaagtgaccacggtctacttttact

SEQ ID NO: 433030 - DNA, 25 bp, Mus musculus
gaagtgaccactaatcagcgcatct

SEQ ID NO: 433031 - DNA, 25 bp, Mus musculus
gaagtgaccacttatcagcgcatct

SEQ ID NO: 433032 - DNA, 25 bp, Mus musculus
gaagtgaccataatccttggagtag

SEQ ID NO: 433033 - DNA, 25 bp, Mus musculus
gaagtgaccatattccttggagtag

SEQ ID NO: 433034 - DNA, 25 bp, Mus musculus
gaagtgaccattcggtccttctgat

SEQ ID NO: 433035 - DNA, 25 bp, Mus musculus
gaagtgaccattgggtccttctgat

SEQ ID NO: 433036 - DNA, 25 bp, Mus musculus
gaagtgacccaaattccgagtcttt

SEQ ID NO: 433037 - DNA, 25 bp, Mus musculus
gaagtgacccaatttccgagtcttt

SEQ ID NO: 433038 - DNA, 25 bp, Mus musculus
gaagtgacccgacctcacaaaggct

SEQ ID NO: 433039 - DNA, 25 bp, Mus musculus
gaagtgacccgagctcacaaaggct

SEQ ID NO: 433040 - DNA, 25 bp, Mus musculus
gaagtgacccggctccttccctcag

SEQ ID NO: 433041 - DNA, 25 bp, Mus musculus
gaagtgacccgggtccttccctcag

SEQ ID NO: 433042 - DNA, 25 bp, Mus musculus
gaagtgacctaccttttctagaact

SEQ ID NO: 433043 - DNA, 25 bp, Mus musculus
gaagtgacctacgttttctagaact

SEQ ID NO: 433044 - DNA, 25 bp, Mus musculus
gaagtgacctatattcataaggagc

SEQ ID NO: 433045 - DNA, 25 bp, Mus musculus
gaagtgacctattttcataaggagc

SEQ ID NO: 433046 - DNA, 25 bp, Mus musculus
gaagtgacctttccattccaaatat

SEQ ID NO: 433047 - DNA, 25 bp, Mus musculus
gaagtgacctttgcattccaaatat

SEQ ID NO: 433048 - DNA, 25 bp, Mus musculus
gaagtgacgacaactggttggagaa

SEQ ID NO: 433049 - DNA, 25 bp, Mus musculus
gaagtgacgacatctggttggagaa

SEQ ID NO: 433050 - DNA, 25 bp, Mus musculus
gaagtgacggaaatcatgctcaaca

SEQ ID NO: 433051 - DNA, 25 bp, Mus musculus
gaagtgacggaattcatgctcaaca

SEQ ID NO: 433052 - DNA, 25 bp, Mus musculus
gaagtgacggacaggaagtcccgcc

SEQ ID NO: 433053 - DNA, 25 bp, Mus musculus
gaagtgacggactggaagtcccgcc

SEQ ID NO: 433054 - DNA, 25 bp, Mus musculus
gaagtgactcatcttggctttagta

SEQ ID NO: 433055 - DNA, 25 bp, Mus musculus
gaagtgactcatgttggctttagta

SEQ ID NO: 433056 - DNA, 25 bp, Mus musculus
gaagtgactccacgttctctgaagt

SEQ ID NO: 433057 - DNA, 25 bp, Mus musculus
gaagtgactccaggttctctgaagt

SEQ ID NO: 433058 - DNA, 25 bp, Mus musculus
gaagtgactctaccagaagatttta

SEQ ID NO: 433059 - DNA, 25 bp, Mus musculus
gaagtgactctagcagaagatttta

SEQ ID NO: 433060 - DNA, 25 bp, Mus musculus
gaagtgactggaatggtcccatgat

SEQ ID NO: 433061 - DNA, 25 bp, Mus musculus
gaagtgactggattggtcccatgat

SEQ ID NO: 433062 - DNA, 25 bp, Mus musculus
gaagtgactggtccaaccactaaaa

SEQ ID NO: 433063 - DNA, 25 bp, Mus musculus
gaagtgactggtgcaaccactaaaa

SEQ ID NO: 433064 - DNA, 25 bp, Mus musculus
gaagtgacttgcatcactttcacag

SEQ ID NO: 433065 - DNA, 25 bp, Mus musculus
gaagtgacttgcttcactttcacag

SEQ ID NO: 433066 - DNA, 25 bp, Mus musculus
gaagtgactttcatcaggtgtgaca

SEQ ID NO: 433067 - DNA, 25 bp, Mus musculus
gaagtgactttcttcaggtgtgaca

SEQ ID NO: 433068 - DNA, 25 bp, Mus musculus
gaagtgactttgcaagatcctacct

SEQ ID NO: 433069 - DNA, 25 bp, Mus musculus
gaagtgactttggaagatcctacct

SEQ ID NO: 433070 - DNA, 25 bp, Mus musculus
gaagtgacttttcgctgagctggct

SEQ ID NO: 433071 - DNA, 25 bp, Mus musculus
gaagtgacttttggctgagctggct

SEQ ID NO: 433072 - DNA, 25 bp, Mus musculus
gaagtgagaactacaagcacccagt

SEQ ID NO: 433073 - DNA, 25 bp, Mus musculus
gaagtgagaacttcaagcacccagt

SEQ ID NO: 433074 - DNA, 25 bp, Mus musculus
gaagtgagacaaacagggcatcctt

SEQ ID NO: 433075 - DNA, 25 bp, Mus musculus
gaagtgagacaatcagggcatcctt

SEQ ID NO: 433076 - DNA, 25 bp, Mus musculus
gaagtgagaccactgcattaatttt

SEQ ID NO: 433077 - DNA, 25 bp, Mus musculus
gaagtgagaccagtgcattaatttt

SEQ ID NO: 433078 - DNA, 25 bp, Mus musculus
gaagtgagacccacagtcgctcggg

SEQ ID NO: 433079 - DNA, 25 bp, Mus musculus
gaagtgagacccatggacggagtcc

SEQ ID NO: 433080 - DNA, 25 bp, Mus musculus
gaagtgagacccctgaccctggaac

SEQ ID NO: 433081 - DNA, 25 bp, Mus musculus
gaagtgagacccgtgaccctggaac

SEQ ID NO: 433082 - DNA, 25 bp, Mus musculus
gaagtgagaccctcagtcgctcggg

SEQ ID NO: 433083 - DNA, 25 bp, Mus musculus
gaagtgagacccttggacggagtcc

SEQ ID NO: 433084 - DNA, 25 bp, Mus musculus
gaagtgagacctcctctttacagat

SEQ ID NO: 433085 - DNA, 25 bp, Mus musculus
gaagtgagacctgctctttacagat

SEQ ID NO: 433086 - DNA, 25 bp, Mus musculus
gaagtgagattgaccttgttcagat

SEQ ID NO: 433087 - DNA, 25 bp, Mus musculus
gaagtgagattgtccttgttcagat

SEQ ID NO: 433088 - DNA, 25 bp, Mus musculus
gaagtgagcaccacccatatggcag

SEQ ID NO: 433089 - DNA, 25 bp, Mus musculus
gaagtgagcacctcccatatggcag

SEQ ID NO: 433090 - DNA, 25 bp, Mus musculus
gaagtgagcagcactcaaggccagc

SEQ ID NO: 433091 - DNA, 25 bp, Mus musculus
gaagtgagcagcatgcaccatctgt

SEQ ID NO: 433092 - DNA, 25 bp, Mus musculus
gaagtgagcagccaactcccctggt

SEQ ID NO: 433093 - DNA, 25 bp, Mus musculus
gaagtgagcagcgaactcccctggt

SEQ ID NO: 433094 - DNA, 25 bp, Mus musculus
gaagtgagcagctctcaaggccagc

SEQ ID NO: 433095 - DNA, 25 bp, Mus musculus
gaagtgagcagcttgcaccatctgt

SEQ ID NO: 433096 - DNA, 25 bp, Mus musculus
gaagtgagcataatctgtccgtctg

SEQ ID NO: 433097 - DNA, 25 bp, Mus musculus
gaagtgagcatattctgtccgtctg

SEQ ID NO: 433098 - DNA, 25 bp, Mus musculus
gaagtgagcatgcattctcagtcca

SEQ ID NO: 433099 - DNA, 25 bp, Mus musculus
gaagtgagcatggattctcagtcca

SEQ ID NO: 433100 - DNA, 25 bp, Mus musculus
gaagtgagccataaccttttctaca

SEQ ID NO: 433101 - DNA, 25 bp, Mus musculus
gaagtgagccatacacaaccaccca

SEQ ID NO: 433102 - DNA, 25 bp, Mus musculus
gaagtgagccattaccttttctaca

SEQ ID NO: 433103 - DNA, 25 bp, Mus musculus
gaagtgagccattcacaaccaccca

SEQ ID NO: 433104 - DNA, 25 bp, Mus musculus
gaagtgagcctactctagtttttga

SEQ ID NO: 433105 - DNA, 25 bp, Mus musculus
gaagtgagcctagtctagtttttga

SEQ ID NO: 433106 - DNA, 25 bp, Mus musculus
gaagtgagctccattctaggcagaa

SEQ ID NO: 433107 - DNA, 25 bp, Mus musculus
gaagtgagctcctttctaggcagaa

SEQ ID NO: 433108 - DNA, 25 bp, Mus musculus
gaagtgaggcagagctttttctact

SEQ ID NO: 433109 - DNA, 25 bp, Mus musculus
gaagtgaggcagtgctttttctact

SEQ ID NO: 433110 - DNA, 25 bp, Mus musculus
gaagtgaggctcagtggcttcacac

SEQ ID NO: 433111 - DNA, 25 bp, Mus musculus
gaagtgaggctctgtggcttcacac

SEQ ID NO: 433112 - DNA, 25 bp, Mus musculus
gaagtgagggcaccatgttcccagc

SEQ ID NO: 433113 - DNA, 25 bp, Mus musculus
gaagtgagggcagcatgttcccagc

SEQ ID NO: 433114 - DNA, 25 bp, Mus musculus
gaagtgagtaacagtaacctttttg

SEQ ID NO: 433115 - DNA, 25 bp, Mus musculus
gaagtgagtaactgtaacctttttg

SEQ ID NO: 433116 - DNA, 25 bp, Mus musculus
gaagtgagtcaccatagctcctggc

SEQ ID NO: 433117 - DNA, 25 bp, Mus musculus
gaagtgagtcacgatagctcctggc

SEQ ID NO: 433118 - DNA, 25 bp, Mus musculus
gaagtgagttcccaatcatctcgtc

SEQ ID NO: 433119 - DNA, 25 bp, Mus musculus
gaagtgagttccgaatcatctcgtc

SEQ ID NO: 433120 - DNA, 25 bp, Mus musculus
gaagtgataaccatcaagttcagtg

SEQ ID NO: 433121 - DNA, 25 bp, Mus musculus
gaagtgataaccttcaagttcagtg

SEQ ID NO: 433122 - DNA, 25 bp, Mus musculus
gaagtgatatgaagatgctgttaaa

SEQ ID NO: 433123 - DNA, 25 bp, Mus musculus
gaagtgatatgatgatgctgttaaa

SEQ ID NO: 433124 - DNA, 25 bp, Mus musculus
gaagtgatcggcactgaagatttca

SEQ ID NO: 433125 - DNA, 25 bp, Mus musculus
gaagtgatcggctctgaagatttca

SEQ ID NO: 433126 - DNA, 25 bp, Mus musculus
gaagtgatgagaagcccaggttcaa

SEQ ID NO: 433127 - DNA, 25 bp, Mus musculus
gaagtgatgagatgcccaggttcaa

SEQ ID NO: 433128 - DNA, 25 bp, Mus musculus
gaagtgatgctgactgttagctgaa

SEQ ID NO: 433129 - DNA, 25 bp, Mus musculus
gaagtgatgctgtctgttagctgaa

SEQ ID NO: 433130 - DNA, 25 bp, Mus musculus
gaagtgatggaaccgacctggcaca

SEQ ID NO: 433131 - DNA, 25 bp, Mus musculus
gaagtgatggaagcgacctggcaca

SEQ ID NO: 433132 - DNA, 25 bp, Mus musculus
gaagtgatggacaacaagttgtaat

SEQ ID NO: 433133 - DNA, 25 bp, Mus musculus
gaagtgatggactacaagttgtaat

SEQ ID NO: 433134 - DNA, 25 bp, Mus musculus
gaagtgatggcacacctggaccagc

SEQ ID NO: 433135 - DNA, 25 bp, Mus musculus
gaagtgatggcagacctggaccagc

SEQ ID NO: 433136 - DNA, 25 bp, Mus musculus
gaagtgatggtcaccaaaggacaaa

SEQ ID NO: 433137 - DNA, 25 bp, Mus musculus
gaagtgatggtctccaaaggacaaa

SEQ ID NO: 433138 - DNA, 25 bp, Mus musculus
gaagtgatggttcgcattctaaaat

SEQ ID NO: 433139 - DNA, 25 bp, Mus musculus
gaagtgatggttggcattctaaaat

SEQ ID NO: 433140 - DNA, 25 bp, Mus musculus
gaagtgatgttacctgccaagccag

SEQ ID NO: 433141 - DNA, 25 bp, Mus musculus
gaagtgatgttagctgccaagccag

SEQ ID NO: 433142 - DNA, 25 bp, Mus musculus
gaagtgatgttccagtgtcttcaca

SEQ ID NO: 433143 - DNA, 25 bp, Mus musculus
gaagtgatgttcgagtgtcttcaca

SEQ ID NO: 433144 - DNA, 25 bp, Mus musculus
gaagtgattatgacccttttaacaa

SEQ ID NO: 433145 - DNA, 25 bp, Mus musculus
gaagtgattatgtcccttttaacaa

SEQ ID NO: 433146 - DNA, 25 bp, Mus musculus
gaagtgattcacaacatgactgagt

SEQ ID NO: 433147 - DNA, 25 bp, Mus musculus
gaagtgattcacaccatgtgtacaa

SEQ ID NO: 433148 - DNA, 25 bp, Mus musculus
gaagtgattcactacatgactgagt

SEQ ID NO: 433149 - DNA, 25 bp, Mus musculus
gaagtgattcactccatgtgtacaa

SEQ ID NO: 433150 - DNA, 25 bp, Mus musculus
gaagtgattttcattgcccagtaga

SEQ ID NO: 433151 - DNA, 25 bp, Mus musculus
gaagtgattttctttgcccagtaga

SEQ ID NO: 433152 - DNA, 25 bp, Mus musculus
gaagtgcaaaaaatatcccctgaaa

SEQ ID NO: 433153 - DNA, 25 bp, Mus musculus
gaagtgcaaaaattatcccctgaaa

SEQ ID NO: 433154 - DNA, 25 bp, Mus musculus
gaagtgcaaaccatgcgtcagtaag

SEQ ID NO: 433155 - DNA, 25 bp, Mus musculus
gaagtgcaaaccttgcgtcagtaag

SEQ ID NO: 433156 - DNA, 25 bp, Mus musculus
gaagtgcaaagtcacattgttcagg

SEQ ID NO: 433157 - DNA, 25 bp, Mus musculus
gaagtgcaaagtgacattgttcagg

SEQ ID NO: 433158 - DNA, 25 bp, Mus musculus
gaagtgcaaataaaccccatatagc

SEQ ID NO: 433159 - DNA, 25 bp, Mus musculus
gaagtgcaaatataccccatatagc

SEQ ID NO: 433160 - DNA, 25 bp, Mus musculus
gaagtgcaactgagattccacatca

SEQ ID NO: 433161 - DNA, 25 bp, Mus musculus
gaagtgcaactgtgattccacatca

SEQ ID NO: 433162 - DNA, 25 bp, Mus musculus
gaagtgcaagtcacaacatgctgaa

SEQ ID NO: 433163 - DNA, 25 bp, Mus musculus
gaagtgcaagtctcaacatgctgaa

SEQ ID NO: 433164 - DNA, 25 bp, Mus musculus
gaagtgcacattctttggtcagaac

SEQ ID NO: 433165 - DNA, 25 bp, Mus musculus
gaagtgcacattgtttggtcagaac

SEQ ID NO: 433166 - DNA, 25 bp, Mus musculus
gaagtgcacccgatagaatcaacca

SEQ ID NO: 433167 - DNA, 25 bp, Mus musculus
gaagtgcacccgttagaatcaacca

SEQ ID NO: 433168 - DNA, 25 bp, Mus musculus
gaagtgcacgtacgtaagccccagc

SEQ ID NO: 433169 - DNA, 25 bp, Mus musculus
gaagtgcacgtaggtaagccccagc

SEQ ID NO: 433170 - DNA, 25 bp, Mus musculus
gaagtgcactgtagatgctaccctg

SEQ ID NO: 433171 - DNA, 25 bp, Mus musculus
gaagtgcactgttgatgctaccctg

SEQ ID NO: 433172 - DNA, 25 bp, Mus musculus
gaagtgcagaagaaacgcccttctt

SEQ ID NO: 433173 - DNA, 25 bp, Mus musculus
gaagtgcagaagtaacgcccttctt

SEQ ID NO: 433174 - DNA, 25 bp, Mus musculus
gaagtgcagactcagaacgtcccct

SEQ ID NO: 433175 - DNA, 25 bp, Mus musculus
gaagtgcagactgagaacgtcccct

SEQ ID NO: 433176 - DNA, 25 bp, Mus musculus
gaagtgcagcctcgtgctgttatga

SEQ ID NO: 433177 - DNA, 25 bp, Mus musculus
gaagtgcagcctggtgctgttatga

SEQ ID NO: 433178 - DNA, 25 bp, Mus musculus
gaagtgcagctgatgccgagagtaa

SEQ ID NO: 433179 - DNA, 25 bp, Mus musculus
gaagtgcagctgttgccgagagtaa

SEQ ID NO: 433180 - DNA, 25 bp, Mus musculus
gaagtgcaggcgacccagggaaacc

SEQ ID NO: 433181 - DNA, 25 bp, Mus musculus
gaagtgcaggcgtcccagggaaacc

SEQ ID NO: 433182 - DNA, 25 bp, Mus musculus
gaagtgcagtgcagtttatgctaat

SEQ ID NO: 433183 - DNA, 25 bp, Mus musculus
gaagtgcagtgctgtttatgctaat

SEQ ID NO: 433184 - DNA, 25 bp, Mus musculus
gaagtgcagtggataccggagtcca

SEQ ID NO: 433185 - DNA, 25 bp, Mus musculus
gaagtgcagtggttaccggagtcca

SEQ ID NO: 433186 - DNA, 25 bp, Mus musculus
gaagtgcatactagagaccagtcta

SEQ ID NO: 433187 - DNA, 25 bp, Mus musculus
gaagtgcatacttgagaccagtcta

SEQ ID NO: 433188 - DNA, 25 bp, Mus musculus
gaagtgcatccgactttcttagata

SEQ ID NO: 433189 - DNA, 25 bp, Mus musculus
gaagtgcatccgtctttcttagata

SEQ ID NO: 433190 - DNA, 25 bp, Mus musculus
gaagtgcatggaccatcacatcctg

SEQ ID NO: 433191 - DNA, 25 bp, Mus musculus
gaagtgcatggagcatcacatcctg

SEQ ID NO: 433192 - DNA, 25 bp, Mus musculus
gaagtgcattatatccttatatata

SEQ ID NO: 433193 - DNA, 25 bp, Mus musculus
gaagtgcattatttccttatatata

SEQ ID NO: 433194 - DNA, 25 bp, Mus musculus
gaagtgcattctcaagccccaggaa

SEQ ID NO: 433195 - DNA, 25 bp, Mus musculus
gaagtgcattctgaagccccaggaa

SEQ ID NO: 433196 - DNA, 25 bp, Mus musculus
gaagtgcatttgctcctcaagtaaa

SEQ ID NO: 433197 - DNA, 25 bp, Mus musculus
gaagtgcatttggtcctcaagtaaa

SEQ ID NO: 433198 - DNA, 25 bp, Mus musculus
gaagtgccaactcctgtcgttcacc

SEQ ID NO: 433199 - DNA, 25 bp, Mus musculus
gaagtgccaactgctgtcgttcacc

SEQ ID NO: 433200 - DNA, 25 bp, Mus musculus
gaagtgccaagtagggtccttttct

SEQ ID NO: 433201 - DNA, 25 bp, Mus musculus
gaagtgccaagttgggtccttttct

SEQ ID NO: 433202 - DNA, 25 bp, Mus musculus
gaagtgccacagaaggaaatactat

SEQ ID NO: 433203 - DNA, 25 bp, Mus musculus
gaagtgccacagtaggaaatactat

SEQ ID NO: 433204 - DNA, 25 bp, Mus musculus
gaagtgccaggcatcctgggaaccc

SEQ ID NO: 433205 - DNA, 25 bp, Mus musculus
gaagtgccaggcttcctgggaaccc

SEQ ID NO: 433206 - DNA, 25 bp, Mus musculus
gaagtgccagtaacaggctcctgat

SEQ ID NO: 433207 - DNA, 25 bp, Mus musculus
gaagtgccagtatcaggctcctgat

SEQ ID NO: 433208 - DNA, 25 bp, Mus musculus
gaagtgccagtgacatctatatata

SEQ ID NO: 433209 - DNA, 25 bp, Mus musculus
gaagtgccagtgtcatctatatata

SEQ ID NO: 433210 - DNA, 25 bp, Mus musculus
gaagtgccattcatagagcatccaa

SEQ ID NO: 433211 - DNA, 25 bp, Mus musculus
gaagtgccattcttagagcatccaa

SEQ ID NO: 433212 - DNA, 25 bp, Mus musculus
gaagtgcccaacagtattaccagaa

SEQ ID NO: 433213 - DNA, 25 bp, Mus musculus
gaagtgcccaactgtattaccagaa

SEQ ID NO: 433214 - DNA, 25 bp, Mus musculus
gaagtgcccaagaagtactcccagg

SEQ ID NO: 433215 - DNA, 25 bp, Mus musculus
gaagtgcccaagtagtactcccagg

SEQ ID NO: 433216 - DNA, 25 bp, Mus musculus
gaagtgcccaatatggcccaaacct

SEQ ID NO: 433217 - DNA, 25 bp, Mus musculus
gaagtgcccaatttggcccaaacct

SEQ ID NO: 433218 - DNA, 25 bp, Mus musculus
gaagtgcccctcaatatacttctgc

SEQ ID NO: 433219 - DNA, 25 bp, Mus musculus
gaagtgcccctctatatacttctgc

SEQ ID NO: 433220 - DNA, 25 bp, Mus musculus
gaagtgccctacatatctttttgct

SEQ ID NO: 433221 - DNA, 25 bp, Mus musculus
gaagtgccctacttatctttttgct

SEQ ID NO: 433222 - DNA, 25 bp, Mus musculus
gaagtgccctcgactgctaaggtca

SEQ ID NO: 433223 - DNA, 25 bp, Mus musculus
gaagtgccctcgtctgctaaggtca

SEQ ID NO: 433224 - DNA, 25 bp, Mus musculus
gaagtgcccttcctcaaattttaag

SEQ ID NO: 433225 - DNA, 25 bp, Mus musculus
gaagtgcccttcgtcaaattttaag

SEQ ID NO: 433226 - DNA, 25 bp, Mus musculus
gaagtgccggcaaacatttaggaag

SEQ ID NO: 433227 - DNA, 25 bp, Mus musculus
gaagtgccggcatacatttaggaag

SEQ ID NO: 433228 - DNA, 25 bp, Mus musculus
gaagtgccgtttacccctcaagaat

SEQ ID NO: 433229 - DNA, 25 bp, Mus musculus
gaagtgccgttttcccctcaagaat

SEQ ID NO: 433230 - DNA, 25 bp, Mus musculus
gaagtgcctagcattgatctttgta

SEQ ID NO: 433231 - DNA, 25 bp, Mus musculus
gaagtgcctagctttgatctttgta

SEQ ID NO: 433232 - DNA, 25 bp, Mus musculus
gaagtgcctcccacatagggttagg

SEQ ID NO: 433233 - DNA, 25 bp, Mus musculus
gaagtgcctccctcatagggttagg

SEQ ID NO: 433234 - DNA, 25 bp, Mus musculus
gaagtgcctctaccataagtaagtc

SEQ ID NO: 433235 - DNA, 25 bp, Mus musculus
gaagtgcctctagcataagtaagtc

SEQ ID NO: 433236 - DNA, 25 bp, Mus musculus
gaagtgcctctgacgtaaatcaggc

SEQ ID NO: 433237 - DNA, 25 bp, Mus musculus
gaagtgcctctgtcgtaaatcaggc

SEQ ID NO: 433238 - DNA, 25 bp, Mus musculus
gaagtgcctgcacaaagtgtcacca

SEQ ID NO: 433239 - DNA, 25 bp, Mus musculus
gaagtgcctgcagaaagtgtcacca

SEQ ID NO: 433240 - DNA, 25 bp, Mus musculus
gaagtgcctgctattcatgtggtcc

SEQ ID NO: 433241 - DNA, 25 bp, Mus musculus
gaagtgcctgcttttcatgtggtcc

SEQ ID NO: 433242 - DNA, 25 bp, Mus musculus
gaagtgcctgtgacctttccacccg

SEQ ID NO: 433243 - DNA, 25 bp, Mus musculus
gaagtgcctgtgcttttatttattg

SEQ ID NO: 433244 - DNA, 25 bp, Mus musculus
gaagtgcctgtggttttatttattg

SEQ ID NO: 433245 - DNA, 25 bp, Mus musculus
gaagtgcctgtgtcctttccacccg

SEQ ID NO: 433246 - DNA, 25 bp, Mus musculus
gaagtgccttgtattctctgataga

SEQ ID NO: 433247 - DNA, 25 bp, Mus musculus
gaagtgccttgttttctctgataga

SEQ ID NO: 433248 - DNA, 25 bp, Mus musculus
gaagtgcctttgaaatcccattacg

SEQ ID NO: 433249 - DNA, 25 bp, Mus musculus
gaagtgcctttgtaatcccattacg

SEQ ID NO: 433250 - DNA, 25 bp, Mus musculus
gaagtgcgaatcagtggcatgcaat

SEQ ID NO: 433251 - DNA, 25 bp, Mus musculus
gaagtgcgaatctgtggcatgcaat

SEQ ID NO: 433252 - DNA, 25 bp, Mus musculus
gaagtgcgatccagcaagaggacca

SEQ ID NO: 433253 - DNA, 25 bp, Mus musculus
gaagtgcgatcctgcaagaggacca

SEQ ID NO: 433254 - DNA, 25 bp, Mus musculus
gaagtgcgccacaattctcaatgga

SEQ ID NO: 433255 - DNA, 25 bp, Mus musculus
gaagtgcgccactattctcaatgga

SEQ ID NO: 433256 - DNA, 25 bp, Mus musculus
gaagtgcgccttcatggaaacctca

SEQ ID NO: 433257 - DNA, 25 bp, Mus musculus
gaagtgcgccttgatggaaacctca

SEQ ID NO: 433258 - DNA, 25 bp, Mus musculus
gaagtgcgttaacttggaccggcct

SEQ ID NO: 433259 - DNA, 25 bp, Mus musculus
gaagtgcgttaagttggaccggcct

SEQ ID NO: 433260 - DNA, 25 bp, Mus musculus
gaagtgcgttcccatctagtgaagt

SEQ ID NO: 433261 - DNA, 25 bp, Mus musculus
gaagtgcgttccgatctagtgaagt

SEQ ID NO: 433262 - DNA, 25 bp, Mus musculus
gaagtgctaactattactttcatcc

SEQ ID NO: 433263 - DNA, 25 bp, Mus musculus
gaagtgctaacttttactttcatcc

SEQ ID NO: 433264 - DNA, 25 bp, Mus musculus
gaagtgctaagcaactgtcacagct

SEQ ID NO: 433265 - DNA, 25 bp, Mus musculus
gaagtgctaagctactgtcacagct

SEQ ID NO: 433266 - DNA, 25 bp, Mus musculus
gaagtgctaatcatgtttccatcag

SEQ ID NO: 433267 - DNA, 25 bp, Mus musculus
gaagtgctaatcttgtttccatcag

SEQ ID NO: 433268 - DNA, 25 bp, Mus musculus
gaagtgctacacatagctagcagat

SEQ ID NO: 433269 - DNA, 25 bp, Mus musculus
gaagtgctacacttagctagcagat

SEQ ID NO: 433270 - DNA, 25 bp, Mus musculus
gaagtgctacccaatggtgcctcgt

SEQ ID NO: 433271 - DNA, 25 bp, Mus musculus
gaagtgctaccctatggtgcctcgt

SEQ ID NO: 433272 - DNA, 25 bp, Mus musculus
gaagtgctatataccacaagggtta

SEQ ID NO: 433273 - DNA, 25 bp, Mus musculus
gaagtgctatattccacaagggtta

SEQ ID NO: 433274 - DNA, 25 bp, Mus musculus
gaagtgctatttaatatgctgttaa

SEQ ID NO: 433275 - DNA, 25 bp, Mus musculus
gaagtgctattttatatgctgttaa

SEQ ID NO: 433276 - DNA, 25 bp, Mus musculus
gaagtgctcaacatcagaaggctag

SEQ ID NO: 433277 - DNA, 25 bp, Mus musculus
gaagtgctcaacttcagaaggctag

SEQ ID NO: 433278 - DNA, 25 bp, Mus musculus
gaagtgctcaatactaattcctatt

SEQ ID NO: 433279 - DNA, 25 bp, Mus musculus
gaagtgctcaatccacagctaccga

SEQ ID NO: 433280 - DNA, 25 bp, Mus musculus
gaagtgctcaatgcacagctaccga

SEQ ID NO: 433281 - DNA, 25 bp, Mus musculus
gaagtgctcaattctaattcctatt

SEQ ID NO: 433282 - DNA, 25 bp, Mus musculus
gaagtgctcatgatctttatagacg

SEQ ID NO: 433283 - DNA, 25 bp, Mus musculus
gaagtgctcatgttctttatagacg

SEQ ID NO: 433284 - DNA, 25 bp, Mus musculus
gaagtgctccaaaagaaggccctaa

SEQ ID NO: 433285 - DNA, 25 bp, Mus musculus
gaagtgctccaatagaaggccctaa

SEQ ID NO: 433286 - DNA, 25 bp, Mus musculus
gaagtgctcgaactgctgcgtcctc

SEQ ID NO: 433287 - DNA, 25 bp, Mus musculus
gaagtgctcgaagtgctgcgtcctc

SEQ ID NO: 433288 - DNA, 25 bp, Mus musculus
gaagtgctcgggagacctgcccaga

SEQ ID NO: 433289 - DNA, 25 bp, Mus musculus
gaagtgctcgggtgacctgcccaga

SEQ ID NO: 433290 - DNA, 25 bp, Mus musculus
gaagtgctcggtacaagatcaacca

SEQ ID NO: 433291 - DNA, 25 bp, Mus musculus
gaagtgctcggttcaagatcaacca

SEQ ID NO: 433292 - DNA, 25 bp, Mus musculus
gaagtgctctcaagtgttactctcc

SEQ ID NO: 433293 - DNA, 25 bp, Mus musculus
gaagtgctctcaattggccaaaatc

SEQ ID NO: 433294 - DNA, 25 bp, Mus musculus
gaagtgctctcatgtgttactctcc

SEQ ID NO: 433295 - DNA, 25 bp, Mus musculus
gaagtgctctcatttggccaaaatc

SEQ ID NO: 433296 - DNA, 25 bp, Mus musculus
gaagtgctgcgcagtttgtatttgt

SEQ ID NO: 433297 - DNA, 25 bp, Mus musculus
gaagtgctgcgctgtttgtatttgt

SEQ ID NO: 433298 - DNA, 25 bp, Mus musculus
gaagtgctgctcagtgtagacccac

SEQ ID NO: 433299 - DNA, 25 bp, Mus musculus
gaagtgctgctctgtgtagacccac

SEQ ID NO: 433300 - DNA, 25 bp, Mus musculus
gaagtgctgctgcaagtgaagtata

SEQ ID NO: 433301 - DNA, 25 bp, Mus musculus
gaagtgctgctggaagtgaagtata

SEQ ID NO: 433302 - DNA, 25 bp, Mus musculus
gaagtgctggagatcgtcatggcta

SEQ ID NO: 433303 - DNA, 25 bp, Mus musculus
gaagtgctggagttcgtcatggcta

SEQ ID NO: 433304 - DNA, 25 bp, Mus musculus
gaagtgctggccaatgagttaagac

SEQ ID NO: 433305 - DNA, 25 bp, Mus musculus
gaagtgctggcctatgagttaagac

SEQ ID NO: 433306 - DNA, 25 bp, Mus musculus
gaagtgctgggtcatcctgaactca

SEQ ID NO: 433307 - DNA, 25 bp, Mus musculus
gaagtgctgggtgatcctgaactca

SEQ ID NO: 433308 - DNA, 25 bp, Mus musculus
gaagtgctggtactgagctcagaac

SEQ ID NO: 433309 - DNA, 25 bp, Mus musculus
gaagtgctggtagtgagctcagaac

SEQ ID NO: 433310 - DNA, 25 bp, Mus musculus
gaagtgctggtgatgtacccgcttc

SEQ ID NO: 433311 - DNA, 25 bp, Mus musculus
gaagtgctggtgttgtacccgcttc

SEQ ID NO: 433312 - DNA, 25 bp, Mus musculus
gaagtgctgtccaagcaaacgtaga

SEQ ID NO: 433313 - DNA, 25 bp, Mus musculus
gaagtgctgtcctagcaaacgtaga

SEQ ID NO: 433314 - DNA, 25 bp, Mus musculus
gaagtgcttaacagtttttgtgata

SEQ ID NO: 433315 - DNA, 25 bp, Mus musculus
gaagtgcttaactgtttttgtgata

SEQ ID NO: 433316 - DNA, 25 bp, Mus musculus
gaagtgcttattactgttttctgca

SEQ ID NO: 433317 - DNA, 25 bp, Mus musculus
gaagtgcttatttctgttttctgca

SEQ ID NO: 433318 - DNA, 25 bp, Mus musculus
gaagtgcttcatcgtatctcaacag

SEQ ID NO: 433319 - DNA, 25 bp, Mus musculus
gaagtgcttcatggtatctcaacag

SEQ ID NO: 433320 - DNA, 25 bp, Mus musculus
gaagtgcttttaacgtttgcgaaca

SEQ ID NO: 433321 - DNA, 25 bp, Mus musculus
gaagtgcttttatcgtttgcgaaca

SEQ ID NO: 433322 - DNA, 25 bp, Mus musculus
gaagtggaaaagacttggctctcca

SEQ ID NO: 433323 - DNA, 25 bp, Mus musculus
gaagtggaaaagtcttggctctcca

SEQ ID NO: 433324 - DNA, 25 bp, Mus musculus
gaagtggaatggactttctgtctca

SEQ ID NO: 433325 - DNA, 25 bp, Mus musculus
gaagtggaatggtctttctgtctca

SEQ ID NO: 433326 - DNA, 25 bp, Mus musculus
gaagtggacaatatcagggttctgt

SEQ ID NO: 433327 - DNA, 25 bp, Mus musculus
gaagtggacaatttcagggttctgt

SEQ ID NO: 433328 - DNA, 25 bp, Mus musculus
gaagtggacagacctggccttacag

SEQ ID NO: 433329 - DNA, 25 bp, Mus musculus
gaagtggacagagctggccttacag

SEQ ID NO: 433330 - DNA, 25 bp, Mus musculus
gaagtggacagtagcagatacatat

SEQ ID NO: 433331 - DNA, 25 bp, Mus musculus
gaagtggacagtatcctttcctgcc

SEQ ID NO: 433332 - DNA, 25 bp, Mus musculus
gaagtggacagttgcagatacatat

SEQ ID NO: 433333 - DNA, 25 bp, Mus musculus
gaagtggacagtttcctttcctgcc

SEQ ID NO: 433334 - DNA, 25 bp, Mus musculus
gaagtggacatcatgagccccgcag

SEQ ID NO: 433335 - DNA, 25 bp, Mus musculus
gaagtggacatcttgagccccgcag

SEQ ID NO: 433336 - DNA, 25 bp, Mus musculus
gaagtggacattattgttcataccc

SEQ ID NO: 433337 - DNA, 25 bp, Mus musculus
gaagtggacatttttgttcataccc

SEQ ID NO: 433338 - DNA, 25 bp, Mus musculus
gaagtggaccaccaccacagtgatg

SEQ ID NO: 433339 - DNA, 25 bp, Mus musculus
gaagtggaccaccatgtctagctaa

SEQ ID NO: 433340 - DNA, 25 bp, Mus musculus
gaagtggaccacgaccacagtgatg

SEQ ID NO: 433341 - DNA, 25 bp, Mus musculus
gaagtggaccacgatgtctagctaa

SEQ ID NO: 433342 - DNA, 25 bp, Mus musculus
gaagtggacccgactggcaccatgg

SEQ ID NO: 433343 - DNA, 25 bp, Mus musculus
gaagtggacccgtctggcaccatgg

SEQ ID NO: 433344 - DNA, 25 bp, Mus musculus
gaagtggaccggcagacatgtctcc

SEQ ID NO: 433345 - DNA, 25 bp, Mus musculus
gaagtggaccgggagacatgtctcc

SEQ ID NO: 433346 - DNA, 25 bp, Mus musculus
gaagtggacctaagtgtagcagtat

SEQ ID NO: 433347 - DNA, 25 bp, Mus musculus
gaagtggacctaattcgcttttctt

SEQ ID NO: 433348 - DNA, 25 bp, Mus musculus
gaagtggacctatgtgtagcagtat

SEQ ID NO: 433349 - DNA, 25 bp, Mus musculus
gaagtggacctatttcgcttttctt

SEQ ID NO: 433350 - DNA, 25 bp, Mus musculus
gaagtggacgacaactcgttgcatg

SEQ ID NO: 433351 - DNA, 25 bp, Mus musculus
gaagtggacgactactcgttgcatg

SEQ ID NO: 433352 - DNA, 25 bp, Mus musculus
gaagtggacggacgaggatcagcag

SEQ ID NO: 433353 - DNA, 25 bp, Mus musculus
gaagtggacggaggaggatcagcag

SEQ ID NO: 433354 - DNA, 25 bp, Mus musculus
gaagtggactaacagtagagataca

SEQ ID NO: 433355 - DNA, 25 bp, Mus musculus
gaagtggactaagagtagagataca

SEQ ID NO: 433356 - DNA, 25 bp, Mus musculus
gaagtggacttcaaagaattcattg

SEQ ID NO: 433357 - DNA, 25 bp, Mus musculus
gaagtggacttctaagaattcattg

SEQ ID NO: 433358 - DNA, 25 bp, Mus musculus
gaagtggagaaacttcgtgcaaaga

SEQ ID NO: 433359 - DNA, 25 bp, Mus musculus
gaagtggagaaagttcgtgcaaaga

SEQ ID NO: 433360 - DNA, 25 bp, Mus musculus
gaagtggagataagcctacaaagtt

SEQ ID NO: 433361 - DNA, 25 bp, Mus musculus
gaagtggagatatgcctacaaagtt

SEQ ID NO: 433362 - DNA, 25 bp, Mus musculus
gaagtggagcacagcagaccgcata

SEQ ID NO: 433363 - DNA, 25 bp, Mus musculus
gaagtggagcactgcagaccgcata

SEQ ID NO: 433364 - DNA, 25 bp, Mus musculus
gaagtggagcgtccacatcgccatg

SEQ ID NO: 433365 - DNA, 25 bp, Mus musculus
gaagtggagcgtgcacatcgccatg

SEQ ID NO: 433366 - DNA, 25 bp, Mus musculus
gaagtggagcttcaaacactacagt

SEQ ID NO: 433367 - DNA, 25 bp, Mus musculus
gaagtggagcttgaaacactacagt

SEQ ID NO: 433368 - DNA, 25 bp, Mus musculus
gaagtggaggcaagtccctgcccca

SEQ ID NO: 433369 - DNA, 25 bp, Mus musculus
gaagtggaggcatgtccctgcccca

SEQ ID NO: 433370 - DNA, 25 bp, Mus musculus
gaagtggagtggatcttagcaacct

SEQ ID NO: 433371 - DNA, 25 bp, Mus musculus
gaagtggagtggttcttagcaacct

SEQ ID NO: 433372 - DNA, 25 bp, Mus musculus
gaagtggcaatcatagaccttgaaa

SEQ ID NO: 433373 - DNA, 25 bp, Mus musculus
gaagtggcaatcttagaccttgaaa

SEQ ID NO: 433374 - DNA, 25 bp, Mus musculus
gaagtggcacctcgcaagatcattt

SEQ ID NO: 433375 - DNA, 25 bp, Mus musculus
gaagtggcacctggcaagatcattt

SEQ ID NO: 433376 - DNA, 25 bp, Mus musculus
gaagtggcaggtattgctcacctct

SEQ ID NO: 433377 - DNA, 25 bp, Mus musculus
gaagtggcaggttttgctcacctct

SEQ ID NO: 433378 - DNA, 25 bp, Mus musculus
gaagtggcagttatatgactctata

SEQ ID NO: 433379 - DNA, 25 bp, Mus musculus
gaagtggcagttttatgactctata

SEQ ID NO: 433380 - DNA, 25 bp, Mus musculus
gaagtggccagactgcatccttgag

SEQ ID NO: 433381 - DNA, 25 bp, Mus musculus
gaagtggccagagtgcatccttgag

SEQ ID NO: 433382 - DNA, 25 bp, Mus musculus
gaagtggccaggcatcaagcccaac

SEQ ID NO: 433383 - DNA, 25 bp, Mus musculus
gaagtggccagggatcaagcccaac

SEQ ID NO: 433384 - DNA, 25 bp, Mus musculus
gaagtggcccaaagaacatggttgt

SEQ ID NO: 433385 - DNA, 25 bp, Mus musculus
gaagtggcccaatgaacatggttgt

SEQ ID NO: 433386 - DNA, 25 bp, Mus musculus
gaagtggcctgaaatacttatagct

SEQ ID NO: 433387 - DNA, 25 bp, Mus musculus
gaagtggcctgatatacttatagct

SEQ ID NO: 433388 - DNA, 25 bp, Mus musculus
gaagtggccttaagtagtgtacaaa

SEQ ID NO: 433389 - DNA, 25 bp, Mus musculus
gaagtggccttatgtagtgtacaaa

SEQ ID NO: 433390 - DNA, 25 bp, Mus musculus
gaagtggccttcagcttgggagcca

SEQ ID NO: 433391 - DNA, 25 bp, Mus musculus
gaagtggccttctgcttgggagcca

SEQ ID NO: 433392 - DNA, 25 bp, Mus musculus
gaagtggccttgcacattaagttga

SEQ ID NO: 433393 - DNA, 25 bp, Mus musculus
gaagtggccttggacattaagttga

SEQ ID NO: 433394 - DNA, 25 bp, Mus musculus
gaagtggcctttacccgagatgcgg

SEQ ID NO: 433395 - DNA, 25 bp, Mus musculus
gaagtggccttttcccgagatgcgg

SEQ ID NO: 433396 - DNA, 25 bp, Mus musculus
gaagtggctatcacctacaacggaa

SEQ ID NO: 433397 - DNA, 25 bp, Mus musculus
gaagtggctatctcctacaacggaa

SEQ ID NO: 433398 - DNA, 25 bp, Mus musculus
gaagtggctctaccagctgctggat

SEQ ID NO: 433399 - DNA, 25 bp, Mus musculus
gaagtggctctagcagctgctggat

SEQ ID NO: 433400 - DNA, 25 bp, Mus musculus
gaagtggctctgaggtaaatcaggt

SEQ ID NO: 433401 - DNA, 25 bp, Mus musculus
gaagtggctctgtggtaaatcaggt

SEQ ID NO: 433402 - DNA, 25 bp, Mus musculus
gaagtggctcttccctgatacactc

SEQ ID NO: 433403 - DNA, 25 bp, Mus musculus
gaagtggctcttgcctgatacactc

SEQ ID NO: 433404 - DNA, 25 bp, Mus musculus
gaagtggctgaaccctttgagcatc

SEQ ID NO: 433405 - DNA, 25 bp, Mus musculus
gaagtggctgaagcctttgagcatc

SEQ ID NO: 433406 - DNA, 25 bp, Mus musculus
gaagtggctgctcggtactgccaca

SEQ ID NO: 433407 - DNA, 25 bp, Mus musculus
gaagtggctgctgggtactgccaca

SEQ ID NO: 433408 - DNA, 25 bp, Mus musculus
gaagtggcttccaaggtgacatgga

SEQ ID NO: 433409 - DNA, 25 bp, Mus musculus
gaagtggcttcctaggtgacatgga

SEQ ID NO: 433410 - DNA, 25 bp, Mus musculus
gaagtggcttctaagcgtcctgggt

SEQ ID NO: 433411 - DNA, 25 bp, Mus musculus
gaagtggcttcttagcgtcctgggt

SEQ ID NO: 433412 - DNA, 25 bp, Mus musculus
gaagtggcttgtacttacagtgaaa

SEQ ID NO: 433413 - DNA, 25 bp, Mus musculus
gaagtggcttgttcttacagtgaaa

SEQ ID NO: 433414 - DNA, 25 bp, Mus musculus
gaagtggcttttaagtttgtacatt

SEQ ID NO: 433415 - DNA, 25 bp, Mus musculus
gaagtggctttttagtttgtacatt

SEQ ID NO: 433416 - DNA, 25 bp, Mus musculus
gaagtgggaacaaaccttcttaggt

SEQ ID NO: 433417 - DNA, 25 bp, Mus musculus
gaagtgggaacaccggctcccattt

SEQ ID NO: 433418 - DNA, 25 bp, Mus musculus
gaagtgggaacagcggctcccattt

SEQ ID NO: 433419 - DNA, 25 bp, Mus musculus
gaagtgggaacataccttcttaggt

SEQ ID NO: 433420 - DNA, 25 bp, Mus musculus
gaagtgggaactaaagggttctctg

SEQ ID NO: 433421 - DNA, 25 bp, Mus musculus
gaagtgggaacttaagggttctctg

SEQ ID NO: 433422 - DNA, 25 bp, Mus musculus
gaagtgggaatcctggctacctcac

SEQ ID NO: 433423 - DNA, 25 bp, Mus musculus
gaagtgggaatcgtggctacctcac

SEQ ID NO: 433424 - DNA, 25 bp, Mus musculus
gaagtgggacacaccaagcacattc

SEQ ID NO: 433425 - DNA, 25 bp, Mus musculus
gaagtgggacactccaagcacattc

SEQ ID NO: 433426 - DNA, 25 bp, Mus musculus
gaagtgggacgcagaaggcctatct

SEQ ID NO: 433427 - DNA, 25 bp, Mus musculus
gaagtgggacgctgaaggcctatct

SEQ ID NO: 433428 - DNA, 25 bp, Mus musculus
gaagtgggcactcactacagcaggt

SEQ ID NO: 433429 - DNA, 25 bp, Mus musculus
gaagtgggcactgactacagcaggt

SEQ ID NO: 433430 - DNA, 25 bp, Mus musculus
gaagtgggcagaaagatcagttcat

SEQ ID NO: 433431 - DNA, 25 bp, Mus musculus
gaagtgggcagatagatcagttcat

SEQ ID NO: 433432 - DNA, 25 bp, Mus musculus
gaagtgggcccaagggaaccctcag

SEQ ID NO: 433433 - DNA, 25 bp, Mus musculus
gaagtgggcccatgggaaccctcag

SEQ ID NO: 433434 - DNA, 25 bp, Mus musculus
gaagtgggcctgactttaatccagc

SEQ ID NO: 433435 - DNA, 25 bp, Mus musculus
gaagtgggcctgtctttaatccagc

SEQ ID NO: 433436 - DNA, 25 bp, Mus musculus
gaagtgggtctgagttttctctaac

SEQ ID NO: 433437 - DNA, 25 bp, Mus musculus
gaagtgggtctgtgttttctctaac

SEQ ID NO: 433438 - DNA, 25 bp, Mus musculus
gaagtgggtggtcccattcccattt

SEQ ID NO: 433439 - DNA, 25 bp, Mus musculus
gaagtgggtggtgccattcccattt

SEQ ID NO: 433440 - DNA, 25 bp, Mus musculus
gaagtggtagcaagctctgttgact

SEQ ID NO: 433441 - DNA, 25 bp, Mus musculus
gaagtggtagcatgctctgttgact

SEQ ID NO: 433442 - DNA, 25 bp, Mus musculus
gaagtggtatagagccctgcctgac

SEQ ID NO: 433443 - DNA, 25 bp, Mus musculus
gaagtggtatagctggcacccagat

SEQ ID NO: 433444 - DNA, 25 bp, Mus musculus
gaagtggtataggtggcacccagat

SEQ ID NO: 433445 - DNA, 25 bp, Mus musculus
gaagtggtatagtgccctgcctgac

SEQ ID NO: 433446 - DNA, 25 bp, Mus musculus
gaagtggtatctcctgaaggctgaa

SEQ ID NO: 433447 - DNA, 25 bp, Mus musculus
gaagtggtatctgctgaaggctgaa

SEQ ID NO: 433448 - DNA, 25 bp, Mus musculus
gaagtggtcagcagctgttcctagc

SEQ ID NO: 433449 - DNA, 25 bp, Mus musculus
gaagtggtcagctgctgttcctagc

SEQ ID NO: 433450 - DNA, 25 bp, Mus musculus
gaagtggtcatcaagtcctaccaga

SEQ ID NO: 433451 - DNA, 25 bp, Mus musculus
gaagtggtcatctagtcctaccaga

SEQ ID NO: 433452 - DNA, 25 bp, Mus musculus
gaagtggtctttctctcaagttcat

SEQ ID NO: 433453 - DNA, 25 bp, Mus musculus
gaagtggtctttgtctcaagttcat

SEQ ID NO: 433454 - DNA, 25 bp, Mus musculus
gaagtggtgaccacatttttcctta

SEQ ID NO: 433455 - DNA, 25 bp, Mus musculus
gaagtggtgacctcatttttcctta

SEQ ID NO: 433456 - DNA, 25 bp, Mus musculus
gaagtggtgataatcctgtgtatat

SEQ ID NO: 433457 - DNA, 25 bp, Mus musculus
gaagtggtgatattcctgtgtatat

SEQ ID NO: 433458 - DNA, 25 bp, Mus musculus
gaagtggtgcccagagcaagccctg

SEQ ID NO: 433459 - DNA, 25 bp, Mus musculus
gaagtggtgccctgagcaagccctg

SEQ ID NO: 433460 - DNA, 25 bp, Mus musculus
gaagtggtgcctattcctatgagat

SEQ ID NO: 433461 - DNA, 25 bp, Mus musculus
gaagtggtgccttttcctatgagat

SEQ ID NO: 433462 - DNA, 25 bp, Mus musculus
gaagtggttagcatcgatggccttt

SEQ ID NO: 433463 - DNA, 25 bp, Mus musculus
gaagtggttagcttcgatggccttt

SEQ ID NO: 433464 - DNA, 25 bp, Mus musculus
gaagtggttgcaagtcagaacacaa

SEQ ID NO: 433465 - DNA, 25 bp, Mus musculus
gaagtggttgcatgtcagaacacaa

SEQ ID NO: 433466 - DNA, 25 bp, Mus musculus
gaagtggttggcaccattgaggaca

SEQ ID NO: 433467 - DNA, 25 bp, Mus musculus
gaagtggttggctccattgaggaca

SEQ ID NO: 433468 - DNA, 25 bp, Mus musculus
gaagtggtttatatctttagcttat

SEQ ID NO: 433469 - DNA, 25 bp, Mus musculus
gaagtggtttatcctgaattttcct

SEQ ID NO: 433470 - DNA, 25 bp, Mus musculus
gaagtggtttatgctgaattttcct

SEQ ID NO: 433471 - DNA, 25 bp, Mus musculus
gaagtggtttatttctttagcttat

SEQ ID NO: 433472 - DNA, 25 bp, Mus musculus
gaagtggtttccagggtaagccctg

SEQ ID NO: 433473 - DNA, 25 bp, Mus musculus
gaagtggtttcctgggtaagccctg

SEQ ID NO: 433474 - DNA, 25 bp, Mus musculus
gaagtggtttgccttccatagatta

SEQ ID NO: 433475 - DNA, 25 bp, Mus musculus
gaagtggtttgcgttccatagatta

SEQ ID NO: 433476 - DNA, 25 bp, Mus musculus
gaagtgtaaaccagcccatgacagt

SEQ ID NO: 433477 - DNA, 25 bp, Mus musculus
gaagtgtaaacctgcccatgacagt

SEQ ID NO: 433478 - DNA, 25 bp, Mus musculus
gaagtgtaaattccgcctgtgtgat

SEQ ID NO: 433479 - DNA, 25 bp, Mus musculus
gaagtgtaaattgcgcctgtgtgat

SEQ ID NO: 433480 - DNA, 25 bp, Mus musculus
gaagtgtaacaaccgcagagaattt

SEQ ID NO: 433481 - DNA, 25 bp, Mus musculus
gaagtgtaacaagcgcagagaattt

SEQ ID NO: 433482 - DNA, 25 bp, Mus musculus
gaagtgtaatctattccagttgctt

SEQ ID NO: 433483 - DNA, 25 bp, Mus musculus
gaagtgtaatcttttccagttgctt

SEQ ID NO: 433484 - DNA, 25 bp, Mus musculus
gaagtgtacagactgcagtcttaga

SEQ ID NO: 433485 - DNA, 25 bp, Mus musculus
gaagtgtacagagtgcagtcttaga

SEQ ID NO: 433486 - DNA, 25 bp, Mus musculus
gaagtgtaccaacgcatgtgtgaga

SEQ ID NO: 433487 - DNA, 25 bp, Mus musculus
gaagtgtaccaaggcatgtgtgaga

SEQ ID NO: 433488 - DNA, 25 bp, Mus musculus
gaagtgtacctaaaacagaccccat

SEQ ID NO: 433489 - DNA, 25 bp, Mus musculus
gaagtgtacctataacagaccccat

SEQ ID NO: 433490 - DNA, 25 bp, Mus musculus
gaagtgtacgcaacagacactgctt

SEQ ID NO: 433491 - DNA, 25 bp, Mus musculus
gaagtgtacgcatcagacactgctt

SEQ ID NO: 433492 - DNA, 25 bp, Mus musculus
gaagtgtagcacatgataattttta

SEQ ID NO: 433493 - DNA, 25 bp, Mus musculus
gaagtgtagcacttgataattttta

SEQ ID NO: 433494 - DNA, 25 bp, Mus musculus
gaagtgtagcatattccccaggatg

SEQ ID NO: 433495 - DNA, 25 bp, Mus musculus
gaagtgtagcatctgtcacattcca

SEQ ID NO: 433496 - DNA, 25 bp, Mus musculus
gaagtgtagcatgtgtcacattcca

SEQ ID NO: 433497 - DNA, 25 bp, Mus musculus
gaagtgtagcattttccccaggatg

SEQ ID NO: 433498 - DNA, 25 bp, Mus musculus
gaagtgtagttccttattgatcaca

SEQ ID NO: 433499 - DNA, 25 bp, Mus musculus
gaagtgtagttcgttattgatcaca

SEQ ID NO: 433500 - DNA, 25 bp, Mus musculus
gaagtgtagttgactgaaaactgca

SEQ ID NO: 433501 - DNA, 25 bp, Mus musculus
gaagtgtagttgtctgaaaactgca

SEQ ID NO: 433502 - DNA, 25 bp, Mus musculus
gaagtgtatcacagagggccggttt

SEQ ID NO: 433503 - DNA, 25 bp, Mus musculus
gaagtgtatcactgagggccggttt

SEQ ID NO: 433504 - DNA, 25 bp, Mus musculus
gaagtgtatccaagcgtgcacccac

SEQ ID NO: 433505 - DNA, 25 bp, Mus musculus
gaagtgtatccatgcgtgcacccac

SEQ ID NO: 433506 - DNA, 25 bp, Mus musculus
gaagtgtattcaatgaccgcagcta

SEQ ID NO: 433507 - DNA, 25 bp, Mus musculus
gaagtgtattcattgaccgcagcta

SEQ ID NO: 433508 - DNA, 25 bp, Mus musculus
gaagtgtattccataccgtcaaaga

SEQ ID NO: 433509 - DNA, 25 bp, Mus musculus
gaagtgtattccttaccgtcaaaga

SEQ ID NO: 433510 - DNA, 25 bp, Mus musculus
gaagtgtatttaaatctccagtaga

SEQ ID NO: 433511 - DNA, 25 bp, Mus musculus
gaagtgtatttatatctccagtaga

SEQ ID NO: 433512 - DNA, 25 bp, Mus musculus
gaagtgtattttccacagcgagaac

SEQ ID NO: 433513 - DNA, 25 bp, Mus musculus
gaagtgtattttgcacagcgagaac

SEQ ID NO: 433514 - DNA, 25 bp, Mus musculus
gaagtgtcacagcagtcgccacaaa

SEQ ID NO: 433515 - DNA, 25 bp, Mus musculus
gaagtgtcacaggagtcgccacaaa

SEQ ID NO: 433516 - DNA, 25 bp, Mus musculus
gaagtgtcagctaccagacttgctg

SEQ ID NO: 433517 - DNA, 25 bp, Mus musculus
gaagtgtcagcttccagacttgctg

SEQ ID NO: 433518 - DNA, 25 bp, Mus musculus
gaagtgtcaggaaacggagctcatg

SEQ ID NO: 433519 - DNA, 25 bp, Mus musculus
gaagtgtcaggatacggagctcatg

SEQ ID NO: 433520 - DNA, 25 bp, Mus musculus
gaagtgtcagttcccacagagatga

SEQ ID NO: 433521 - DNA, 25 bp, Mus musculus
gaagtgtcagttgccacagagatga

SEQ ID NO: 433522 - DNA, 25 bp, Mus musculus
gaagtgtcatgtattgaccatgctc

SEQ ID NO: 433523 - DNA, 25 bp, Mus musculus
gaagtgtcatgttttgaccatgctc

SEQ ID NO: 433524 - DNA, 25 bp, Mus musculus
gaagtgtccagactagtgtcttaat

SEQ ID NO: 433525 - DNA, 25 bp, Mus musculus
gaagtgtccagagtagtgtcttaat

SEQ ID NO: 433526 - DNA, 25 bp, Mus musculus
gaagtgtccagtagagatgctctgc

SEQ ID NO: 433527 - DNA, 25 bp, Mus musculus
gaagtgtccagttgagatgctctgc

SEQ ID NO: 433528 - DNA, 25 bp, Mus musculus
gaagtgtcccaacgcagcacagcat

SEQ ID NO: 433529 - DNA, 25 bp, Mus musculus
gaagtgtcccaaggcagcacagcat

SEQ ID NO: 433530 - DNA, 25 bp, Mus musculus
gaagtgtcccagataccttgcagac

SEQ ID NO: 433531 - DNA, 25 bp, Mus musculus
gaagtgtcccagttaccttgcagac

SEQ ID NO: 433532 - DNA, 25 bp, Mus musculus
gaagtgtccctcagttattgtcaag

SEQ ID NO: 433533 - DNA, 25 bp, Mus musculus
gaagtgtccctctgttattgtcaag

SEQ ID NO: 433534 - DNA, 25 bp, Mus musculus
gaagtgtccggtctgcttttgaaaa

SEQ ID NO: 433535 - DNA, 25 bp, Mus musculus
gaagtgtccggtgtgcttttgaaaa

SEQ ID NO: 433536 - DNA, 25 bp, Mus musculus
gaagtgtcctaaacctacatgtgag

SEQ ID NO: 433537 - DNA, 25 bp, Mus musculus
gaagtgtcctaaactctgtagagtg

SEQ ID NO: 433538 - DNA, 25 bp, Mus musculus
gaagtgtcctaatcctacatgtgag

SEQ ID NO: 433539 - DNA, 25 bp, Mus musculus
gaagtgtcctaatctctgtagagtg

SEQ ID NO: 433540 - DNA, 25 bp, Mus musculus
gaagtgtccttcctgattcacaacc

SEQ ID NO: 433541 - DNA, 25 bp, Mus musculus
gaagtgtccttcgtgattcacaacc

SEQ ID NO: 433542 - DNA, 25 bp, Mus musculus
gaagtgtctcatactactactcaca

SEQ ID NO: 433543 - DNA, 25 bp, Mus musculus
gaagtgtctcattctactactcaca

SEQ ID NO: 433544 - DNA, 25 bp, Mus musculus
gaagtgtctctaccttcaaactggg

SEQ ID NO: 433545 - DNA, 25 bp, Mus musculus
gaagtgtctctagcttcaaactggg

SEQ ID NO: 433546 - DNA, 25 bp, Mus musculus
gaagtgtctgcaaggcgtcctgagt

SEQ ID NO: 433547 - DNA, 25 bp, Mus musculus
gaagtgtctgcatggcgtcctgagt

SEQ ID NO: 433548 - DNA, 25 bp, Mus musculus
gaagtgtctgtcagtcttgtttaat

SEQ ID NO: 433549 - DNA, 25 bp, Mus musculus
gaagtgtctgtctgtcttgtttaat

SEQ ID NO: 433550 - DNA, 25 bp, Mus musculus
gaagtgtcttacacgcactcgggaa

SEQ ID NO: 433551 - DNA, 25 bp, Mus musculus
gaagtgtcttactcgcactcgggaa

SEQ ID NO: 433552 - DNA, 25 bp, Mus musculus
gaagtgtcttataccgtgactacgg

SEQ ID NO: 433553 - DNA, 25 bp, Mus musculus
gaagtgtcttatactaccactgtaa

SEQ ID NO: 433554 - DNA, 25 bp, Mus musculus
gaagtgtcttattccgtgactacgg

SEQ ID NO: 433555 - DNA, 25 bp, Mus musculus
gaagtgtcttattctaccactgtaa

SEQ ID NO: 433556 - DNA, 25 bp, Mus musculus
gaagtgtcttggagatttactgaaa

SEQ ID NO: 433557 - DNA, 25 bp, Mus musculus
gaagtgtcttggtgatttactgaaa

SEQ ID NO: 433558 - DNA, 25 bp, Mus musculus
gaagtgtcttgtctacgtagcgttt

SEQ ID NO: 433559 - DNA, 25 bp, Mus musculus
gaagtgtcttgtgtacgtagcgttt

SEQ ID NO: 433560 - DNA, 25 bp, Mus musculus
gaagtgtgaagacaagaccagcctc

SEQ ID NO: 433561 - DNA, 25 bp, Mus musculus
gaagtgtgaagagaagaccagcctc

SEQ ID NO: 433562 - DNA, 25 bp, Mus musculus
gaagtgtgaagtactctgctcagat

SEQ ID NO: 433563 - DNA, 25 bp, Mus musculus
gaagtgtgaagttctctgctcagat

SEQ ID NO: 433564 - DNA, 25 bp, Mus musculus
gaagtgtgacccacgtcatggcaaa

SEQ ID NO: 433565 - DNA, 25 bp, Mus musculus
gaagtgtgaccctcgtcatggcaaa

SEQ ID NO: 433566 - DNA, 25 bp, Mus musculus
gaagtgtgagccactttgatgcagg

SEQ ID NO: 433567 - DNA, 25 bp, Mus musculus
gaagtgtgagccagcgctgcatacc

SEQ ID NO: 433568 - DNA, 25 bp, Mus musculus
gaagtgtgagcctctttgatgcagg

SEQ ID NO: 433569 - DNA, 25 bp, Mus musculus
gaagtgtgagcctgcgctgcatacc

SEQ ID NO: 433570 - DNA, 25 bp, Mus musculus
gaagtgtgattgcaattaggttaac

SEQ ID NO: 433571 - DNA, 25 bp, Mus musculus
gaagtgtgattggaattaggttaac

SEQ ID NO: 433572 - DNA, 25 bp, Mus musculus
gaagtgtgatttctgcttttgtttc

SEQ ID NO: 433573 - DNA, 25 bp, Mus musculus
gaagtgtgatttgtgcttttgtttc

SEQ ID NO: 433574 - DNA, 25 bp, Mus musculus
gaagtgtgcctcatactgcaatgat

SEQ ID NO: 433575 - DNA, 25 bp, Mus musculus
gaagtgtgcctcttactgcaatgat

SEQ ID NO: 433576 - DNA, 25 bp, Mus musculus
gaagtgtgcggtatctttccctcct

SEQ ID NO: 433577 - DNA, 25 bp, Mus musculus
gaagtgtgcggtttctttccctcct

SEQ ID NO: 433578 - DNA, 25 bp, Mus musculus
gaagtgtgctgtctttcctttaccc

SEQ ID NO: 433579 - DNA, 25 bp, Mus musculus
gaagtgtgctgtgtttcctttaccc

SEQ ID NO: 433580 - DNA, 25 bp, Mus musculus
gaagtgtgcttcctacaaaatctct

SEQ ID NO: 433581 - DNA, 25 bp, Mus musculus
gaagtgtgcttcgtacaaaatctct

SEQ ID NO: 433582 - DNA, 25 bp, Mus musculus
gaagtgtggactagttcctgaccca

SEQ ID NO: 433583 - DNA, 25 bp, Mus musculus
gaagtgtggacttgttcctgaccca

SEQ ID NO: 433584 - DNA, 25 bp, Mus musculus
gaagtgtggcaaacccctattgaga

SEQ ID NO: 433585 - DNA, 25 bp, Mus musculus
gaagtgtggcaatcccctattgaga

SEQ ID NO: 433586 - DNA, 25 bp, Mus musculus
gaagtgtggccactgtaactgccta

SEQ ID NO: 433587 - DNA, 25 bp, Mus musculus
gaagtgtggccagtgtaactgccta

SEQ ID NO: 433588 - DNA, 25 bp, Mus musculus
gaagtgtggcccaagaatgtaacca

SEQ ID NO: 433589 - DNA, 25 bp, Mus musculus
gaagtgtggccctagaatgtaacca

SEQ ID NO: 433590 - DNA, 25 bp, Mus musculus
gaagtgtggcctatttatcctccct

SEQ ID NO: 433591 - DNA, 25 bp, Mus musculus
gaagtgtggcctttttatcctccct

SEQ ID NO: 433592 - DNA, 25 bp, Mus musculus
gaagtgtggtatatcgtgctcctca

SEQ ID NO: 433593 - DNA, 25 bp, Mus musculus
gaagtgtggtatttcgtgctcctca

SEQ ID NO: 433594 - DNA, 25 bp, Mus musculus
gaagtgtgtccaagacgctgtacac

SEQ ID NO: 433595 - DNA, 25 bp, Mus musculus
gaagtgtgtccatgacgctgtacac

SEQ ID NO: 433596 - DNA, 25 bp, Mus musculus
gaagtgtgtcctaatgtccttagat

SEQ ID NO: 433597 - DNA, 25 bp, Mus musculus
gaagtgtgtccttatgtccttagat

SEQ ID NO: 433598 - DNA, 25 bp, Mus musculus
gaagtgtgtctcctgaatcaccagc

SEQ ID NO: 433599 - DNA, 25 bp, Mus musculus
gaagtgtgtctcgtgaatcaccagc

SEQ ID NO: 433600 - DNA, 25 bp, Mus musculus
gaagtgtgtggaccctttttgatag

SEQ ID NO: 433601 - DNA, 25 bp, Mus musculus
gaagtgtgtggagcctttttgatag

SEQ ID NO: 433602 - DNA, 25 bp, Mus musculus
gaagtgttaaatcctgcttttgtga

SEQ ID NO: 433603 - DNA, 25 bp, Mus musculus
gaagtgttaaatgctgcttttgtga

SEQ ID NO: 433604 - DNA, 25 bp, Mus musculus
gaagtgttaccactgtaatcaagag

SEQ ID NO: 433605 - DNA, 25 bp, Mus musculus
gaagtgttaccagtgtaatcaagag

SEQ ID NO: 433606 - DNA, 25 bp, Mus musculus
gaagtgttacccacatctttgctat

SEQ ID NO: 433607 - DNA, 25 bp, Mus musculus
gaagtgttaccctcatctttgctat

SEQ ID NO: 433608 - DNA, 25 bp, Mus musculus
gaagtgttactacagctacatgtga

SEQ ID NO: 433609 - DNA, 25 bp, Mus musculus
gaagtgttactagagctacatgtga

SEQ ID NO: 433610 - DNA, 25 bp, Mus musculus
gaagtgttagctagaacaataagac

SEQ ID NO: 433611 - DNA, 25 bp, Mus musculus
gaagtgttagcttgaacaataagac

SEQ ID NO: 433612 - DNA, 25 bp, Mus musculus
gaagtgttagttccagccatgcaat

SEQ ID NO: 433613 - DNA, 25 bp, Mus musculus
gaagtgttagttgcagccatgcaat

SEQ ID NO: 433614 - DNA, 25 bp, Mus musculus
gaagtgttatcactgcagttgttac

SEQ ID NO: 433615 - DNA, 25 bp, Mus musculus
gaagtgttatcagtgcagttgttac

SEQ ID NO: 433616 - DNA, 25 bp, Mus musculus
gaagtgttatgtaagtcatgggcaa

SEQ ID NO: 433617 - DNA, 25 bp, Mus musculus
gaagtgttatgttagtcatgggcaa

SEQ ID NO: 433618 - DNA, 25 bp, Mus musculus
gaagtgttcaccacgcatgtgttat

SEQ ID NO: 433619 - DNA, 25 bp, Mus musculus
gaagtgttcacctcgcatgtgttat

SEQ ID NO: 433620 - DNA, 25 bp, Mus musculus
gaagtgttcaggacatttggcatta

SEQ ID NO: 433621 - DNA, 25 bp, Mus musculus
gaagtgttcaggtcatttggcatta

SEQ ID NO: 433622 - DNA, 25 bp, Mus musculus
gaagtgttcccacaacacagactgt

SEQ ID NO: 433623 - DNA, 25 bp, Mus musculus
gaagtgttcccaccatttggattta

SEQ ID NO: 433624 - DNA, 25 bp, Mus musculus
gaagtgttcccagaacacagactgt

SEQ ID NO: 433625 - DNA, 25 bp, Mus musculus
gaagtgttcccagcatttggattta

SEQ ID NO: 433626 - DNA, 25 bp, Mus musculus
gaagtgttcctgaccttatgttaaa

SEQ ID NO: 433627 - DNA, 25 bp, Mus musculus
gaagtgttcctgtccttatgttaaa

SEQ ID NO: 433628 - DNA, 25 bp, Mus musculus
gaagtgttccttatgtaccacagtc

SEQ ID NO: 433629 - DNA, 25 bp, Mus musculus
gaagtgttccttcatccattacaat

SEQ ID NO: 433630 - DNA, 25 bp, Mus musculus
gaagtgttccttgatccattacaat

SEQ ID NO: 433631 - DNA, 25 bp, Mus musculus
gaagtgttccttttgtaccacagtc

SEQ ID NO: 433632 - DNA, 25 bp, Mus musculus
gaagtgttctgacgcctgtagtgca

SEQ ID NO: 433633 - DNA, 25 bp, Mus musculus
gaagtgttctgaggcctgtagtgca

SEQ ID NO: 433634 - DNA, 25 bp, Mus musculus
gaagtgttcttaatccatgtattga

SEQ ID NO: 433635 - DNA, 25 bp, Mus musculus
gaagtgttcttattccatgtattga

SEQ ID NO: 433636 - DNA, 25 bp, Mus musculus
gaagtgttcttcaaacccttcaggt

SEQ ID NO: 433637 - DNA, 25 bp, Mus musculus
gaagtgttcttccctaacattttat

SEQ ID NO: 433638 - DNA, 25 bp, Mus musculus
gaagtgttcttcgctaacattttat

SEQ ID NO: 433639 - DNA, 25 bp, Mus musculus
gaagtgttcttctaacccttcaggt

SEQ ID NO: 433640 - DNA, 25 bp, Mus musculus
gaagtgttctttctgcatctagtgc

SEQ ID NO: 433641 - DNA, 25 bp, Mus musculus
gaagtgttctttgtgcatctagtgc

SEQ ID NO: 433642 - DNA, 25 bp, Mus musculus
gaagtgttgaccaaagtgagtgagt

SEQ ID NO: 433643 - DNA, 25 bp, Mus musculus
gaagtgttgacctaagtgagtgagt

SEQ ID NO: 433644 - DNA, 25 bp, Mus musculus
gaagtgttgactctctgctgaaatc

SEQ ID NO: 433645 - DNA, 25 bp, Mus musculus
gaagtgttgactgtctgctgaaatc

SEQ ID NO: 433646 - DNA, 25 bp, Mus musculus
gaagtgttgcctagttgaacaaagc

SEQ ID NO: 433647 - DNA, 25 bp, Mus musculus
gaagtgttgccttgttgaacaaagc

SEQ ID NO: 433648 - DNA, 25 bp, Mus musculus
gaagtgttgtacagtgtcagaggca

SEQ ID NO: 433649 - DNA, 25 bp, Mus musculus
gaagtgttgtactgtgtcagaggca

SEQ ID NO: 433650 - DNA, 25 bp, Mus musculus
gaagtgttgtagagggtctgaaccc

SEQ ID NO: 433651 - DNA, 25 bp, Mus musculus
gaagtgttgtagtgggtctgaaccc

SEQ ID NO: 433652 - DNA, 25 bp, Mus musculus
gaagtgtttacaaaggccctcaaat

SEQ ID NO: 433653 - DNA, 25 bp, Mus musculus
gaagtgtttacaatcctgtcattat

SEQ ID NO: 433654 - DNA, 25 bp, Mus musculus
gaagtgtttacataggccctcaaat

SEQ ID NO: 433655 - DNA, 25 bp, Mus musculus
gaagtgtttacattcctgtcattat

SEQ ID NO: 433656 - DNA, 25 bp, Mus musculus
gaagtgtttagcaatttctgctcat

SEQ ID NO: 433657 - DNA, 25 bp, Mus musculus
gaagtgtttagctatttctgctcat

SEQ ID NO: 433658 - DNA, 25 bp, Mus musculus
gaagtgtttcgacctcatatcacat

SEQ ID NO: 433659 - DNA, 25 bp, Mus musculus
gaagtgtttcgagctcatatcacat

SEQ ID NO: 433660 - DNA, 25 bp, Mus musculus
gaagtgtttctgattgtaagccctg

SEQ ID NO: 433661 - DNA, 25 bp, Mus musculus
gaagtgtttctgtttgtaagccctg

SEQ ID NO: 433662 - DNA, 25 bp, Mus musculus
gaagtgtttcttcctattctgataa

SEQ ID NO: 433663 - DNA, 25 bp, Mus musculus
gaagtgtttcttgctattctgataa

SEQ ID NO: 433664 - DNA, 25 bp, Mus musculus
gaagtgttttatatcgccggtcata

SEQ ID NO: 433665 - DNA, 25 bp, Mus musculus
gaagtgttttatttcgccggtcata

SEQ ID NO: 433666 - DNA, 25 bp, Mus musculus
gaagtgttttctaaagttcttactg

SEQ ID NO: 433667 - DNA, 25 bp, Mus musculus
gaagtgttttcttaagttcttactg

SEQ ID NO: 433668 - DNA, 25 bp, Mus musculus
gaagtgttttgaagaccatctgcct

SEQ ID NO: 433669 - DNA, 25 bp, Mus musculus
gaagtgttttgatgaccatctgcct

SEQ ID NO: 433670 - DNA, 25 bp, Mus musculus
gaagtgttttggctttgaggtttca

SEQ ID NO: 433671 - DNA, 25 bp, Mus musculus
gaagtgttttgggtttgaggtttca

SEQ ID NO: 433672 - DNA, 25 bp, Mus musculus
gaagtgtttttgcacttgtctgtta

SEQ ID NO: 433673 - DNA, 25 bp, Mus musculus
gaagtgtttttggacttgtctgtta

SEQ ID NO: 433674 - DNA, 25 bp, Mus musculus
gaagttaaaatccaggtcccgatcg

SEQ ID NO: 433675 - DNA, 25 bp, Mus musculus
gaagttaaaatcgaggtcccgatcg

SEQ ID NO: 433676 - DNA, 25 bp, Mus musculus
gaagttaaagtaacattatttccaa

SEQ ID NO: 433677 - DNA, 25 bp, Mus musculus
gaagttaaagtatcattatttccaa

SEQ ID NO: 433678 - DNA, 25 bp, Mus musculus
gaagttaaagtcactggctggtcag

SEQ ID NO: 433679 - DNA, 25 bp, Mus musculus
gaagttaaagtctctggctggtcag

SEQ ID NO: 433680 - DNA, 25 bp, Mus musculus
gaagttaaagttaggcccctgcaca

SEQ ID NO: 433681 - DNA, 25 bp, Mus musculus
gaagttaaagtttggcccctgcaca

SEQ ID NO: 433682 - DNA, 25 bp, Mus musculus
gaagttaacactcaagccaagacag

SEQ ID NO: 433683 - DNA, 25 bp, Mus musculus
gaagttaacactgaagccaagacag

SEQ ID NO: 433684 - DNA, 25 bp, Mus musculus
gaagttaactatcccactttggtgg

SEQ ID NO: 433685 - DNA, 25 bp, Mus musculus
gaagttaactatgccactttggtgg

SEQ ID NO: 433686 - DNA, 25 bp, Mus musculus
gaagttaagagtcttgccttctctt

SEQ ID NO: 433687 - DNA, 25 bp, Mus musculus
gaagttaagagtgttgccttctctt

SEQ ID NO: 433688 - DNA, 25 bp, Mus musculus
gaagttaagcaccttaccaagttat

SEQ ID NO: 433689 - DNA, 25 bp, Mus musculus
gaagttaagcacgttaccaagttat

SEQ ID NO: 433690 - DNA, 25 bp, Mus musculus
gaagttaagggccactgcctgcact

SEQ ID NO: 433691 - DNA, 25 bp, Mus musculus
gaagttaagggcgactgcctgcact

SEQ ID NO: 433692 - DNA, 25 bp, Mus musculus
gaagttaagtagaccagtctcaccc

SEQ ID NO: 433693 - DNA, 25 bp, Mus musculus
gaagttaagtagtccagtctcaccc

SEQ ID NO: 433694 - DNA, 25 bp, Mus musculus
gaagttaatcgaagcccgcagcaag

SEQ ID NO: 433695 - DNA, 25 bp, Mus musculus
gaagttaatcgatgcccgcagcaag

SEQ ID NO: 433696 - DNA, 25 bp, Mus musculus
gaagttaatgcgcaaaacagacaga

SEQ ID NO: 433697 - DNA, 25 bp, Mus musculus
gaagttaatgcggaaaacagacaga

SEQ ID NO: 433698 - DNA, 25 bp, Mus musculus
gaagttaattgtacctttacagtat

SEQ ID NO: 433699 - DNA, 25 bp, Mus musculus
gaagttaattgttcctttacagtat

SEQ ID NO: 433700 - DNA, 25 bp, Mus musculus
gaagttacaagtacaatttcctgga

SEQ ID NO: 433701 - DNA, 25 bp, Mus musculus
gaagttacaagttcaatttcctgga

SEQ ID NO: 433702 - DNA, 25 bp, Mus musculus
gaagttacacgcaggtgcacttttc

SEQ ID NO: 433703 - DNA, 25 bp, Mus musculus
gaagttacacgctggtgcacttttc

SEQ ID NO: 433704 - DNA, 25 bp, Mus musculus
gaagttacagcgctaattccctgat

SEQ ID NO: 433705 - DNA, 25 bp, Mus musculus
gaagttacagcggtaattccctgat

SEQ ID NO: 433706 - DNA, 25 bp, Mus musculus
gaagttacatcccatagcacaggac

SEQ ID NO: 433707 - DNA, 25 bp, Mus musculus
gaagttacatccgatagcacaggac

SEQ ID NO: 433708 - DNA, 25 bp, Mus musculus
gaagttacatgaattagtcacaaaa

SEQ ID NO: 433709 - DNA, 25 bp, Mus musculus
gaagttacatgatttagtcacaaaa

SEQ ID NO: 433710 - DNA, 25 bp, Mus musculus
gaagttacatgcataaaagggtcaa

SEQ ID NO: 433711 - DNA, 25 bp, Mus musculus
gaagttacatgcttaaaagggtcaa

SEQ ID NO: 433712 - DNA, 25 bp, Mus musculus
gaagttacatggaccaagccgggca

SEQ ID NO: 433713 - DNA, 25 bp, Mus musculus
gaagttacatggtccaagccgggca

SEQ ID NO: 433714 - DNA, 25 bp, Mus musculus
gaagttaccagcatctggaggctcc

SEQ ID NO: 433715 - DNA, 25 bp, Mus musculus
gaagttaccagcttctggaggctcc

SEQ ID NO: 433716 - DNA, 25 bp, Mus musculus
gaagttacctccagctacatcaact

SEQ ID NO: 433717 - DNA, 25 bp, Mus musculus
gaagttacctcctgctacatcaact

SEQ ID NO: 433718 - DNA, 25 bp, Mus musculus
gaagttacctctcctatgtatgtga

SEQ ID NO: 433719 - DNA, 25 bp, Mus musculus
gaagttacctctgctatgtatgtga

SEQ ID NO: 433720 - DNA, 25 bp, Mus musculus
gaagttacctgcagggaggaatcct

SEQ ID NO: 433721 - DNA, 25 bp, Mus musculus
gaagttacctgctgggaggaatcct

SEQ ID NO: 433722 - DNA, 25 bp, Mus musculus
gaagttaccttcagttgccaactcc

SEQ ID NO: 433723 - DNA, 25 bp, Mus musculus
gaagttaccttctgttgccaactcc

SEQ ID NO: 433724 - DNA, 25 bp, Mus musculus
gaagttacctttagatgattgattt

SEQ ID NO: 433725 - DNA, 25 bp, Mus musculus
gaagttaccttttgatgattgattt

SEQ ID NO: 433726 - DNA, 25 bp, Mus musculus
gaagttacgagactacatctggaac

SEQ ID NO: 433727 - DNA, 25 bp, Mus musculus
gaagttacgagagtacatctggaac

SEQ ID NO: 433728 - DNA, 25 bp, Mus musculus
gaagttacgccaaaccctagagtct

SEQ ID NO: 433729 - DNA, 25 bp, Mus musculus
gaagttacgccataccctagagtct

SEQ ID NO: 433730 - DNA, 25 bp, Mus musculus
gaagttactgacagatgctgggttg

SEQ ID NO: 433731 - DNA, 25 bp, Mus musculus
gaagttactgactgatgctgggttg

SEQ ID NO: 433732 - DNA, 25 bp, Mus musculus
gaagttactggaacccagctgcatt

SEQ ID NO: 433733 - DNA, 25 bp, Mus musculus
gaagttactggatcccagctgcatt

SEQ ID NO: 433734 - DNA, 25 bp, Mus musculus
gaagttactgtaataatgaccttat

SEQ ID NO: 433735 - DNA, 25 bp, Mus musculus
gaagttactgtattaatgaccttat

SEQ ID NO: 433736 - DNA, 25 bp, Mus musculus
gaagttacttccatcggactttgac

SEQ ID NO: 433737 - DNA, 25 bp, Mus musculus
gaagttacttccattgttttggcac

SEQ ID NO: 433738 - DNA, 25 bp, Mus musculus
gaagttacttccttcggactttgac

SEQ ID NO: 433739 - DNA, 25 bp, Mus musculus
gaagttacttcctttgttttggcac

SEQ ID NO: 433740 - DNA, 25 bp, Mus musculus
gaagttagaatcagaacccaggact

SEQ ID NO: 433741 - DNA, 25 bp, Mus musculus
gaagttagaatctgaacccaggact

SEQ ID NO: 433742 - DNA, 25 bp, Mus musculus
gaagttagagtcatctttcagtttt

SEQ ID NO: 433743 - DNA, 25 bp, Mus musculus
gaagttagagtcttctttcagtttt

SEQ ID NO: 433744 - DNA, 25 bp, Mus musculus
gaagttagccagcaccttgaaaagc

SEQ ID NO: 433745 - DNA, 25 bp, Mus musculus
gaagttagccaggaccttgaaaagc

SEQ ID NO: 433746 - DNA, 25 bp, Mus musculus
gaagttagccttagtcaatgaggat

SEQ ID NO: 433747 - DNA, 25 bp, Mus musculus
gaagttagccttcacaagcctttgt

SEQ ID NO: 433748 - DNA, 25 bp, Mus musculus
gaagttagccttgacaagcctttgt

SEQ ID NO: 433749 - DNA, 25 bp, Mus musculus
gaagttagcctttgtcaatgaggat

SEQ ID NO: 433750 - DNA, 25 bp, Mus musculus
gaagttagcttcagtattgagggtt

SEQ ID NO: 433751 - DNA, 25 bp, Mus musculus
gaagttagcttctgtattgagggtt

SEQ ID NO: 433752 - DNA, 25 bp, Mus musculus
gaagttaggagacacagggcccatc

SEQ ID NO: 433753 - DNA, 25 bp, Mus musculus
gaagttaggagagacagggcccatc

SEQ ID NO: 433754 - DNA, 25 bp, Mus musculus
gaagttaggctgagttggcctcact

SEQ ID NO: 433755 - DNA, 25 bp, Mus musculus
gaagttaggctgtgttggcctcact

SEQ ID NO: 433756 - DNA, 25 bp, Mus musculus
gaagttagggaaacacatctttcat

SEQ ID NO: 433757 - DNA, 25 bp, Mus musculus
gaagttagggaatcacatctttcat

SEQ ID NO: 433758 - DNA, 25 bp, Mus musculus
gaagttagtaggatgtcagcctcta

SEQ ID NO: 433759 - DNA, 25 bp, Mus musculus
gaagttagtaggttgtcagcctcta

SEQ ID NO: 433760 - DNA, 25 bp, Mus musculus
gaagttagtagtcacttaccccaca

SEQ ID NO: 433761 - DNA, 25 bp, Mus musculus
gaagttagtagtgacttaccccaca

SEQ ID NO: 433762 - DNA, 25 bp, Mus musculus
gaagttagtataaaggttcctcaga

SEQ ID NO: 433763 - DNA, 25 bp, Mus musculus
gaagttagtatataggttcctcaga

SEQ ID NO: 433764 - DNA, 25 bp, Mus musculus
gaagttagtcacatgctcctactag

SEQ ID NO: 433765 - DNA, 25 bp, Mus musculus
gaagttagtcacttgctcctactag

SEQ ID NO: 433766 - DNA, 25 bp, Mus musculus
gaagttagtcgcataccacagcaga

SEQ ID NO: 433767 - DNA, 25 bp, Mus musculus
gaagttagtcgcttaccacagcaga

SEQ ID NO: 433768 - DNA, 25 bp, Mus musculus
gaagttatagagacctgacagagct

SEQ ID NO: 433769 - DNA, 25 bp, Mus musculus
gaagttatagagtcctgacagagct

SEQ ID NO: 433770 - DNA, 25 bp, Mus musculus
gaagttatatagaccctgttttgag

SEQ ID NO: 433771 - DNA, 25 bp, Mus musculus
gaagttatatagtccctgttttgag

SEQ ID NO: 433772 - DNA, 25 bp, Mus musculus
gaagttatcaagaacctgagccgaa

SEQ ID NO: 433773 - DNA, 25 bp, Mus musculus
gaagttatcaagtacctgagccgaa

SEQ ID NO: 433774 - DNA, 25 bp, Mus musculus
gaagttatcacaagtccccgtccct

SEQ ID NO: 433775 - DNA, 25 bp, Mus musculus
gaagttatcacatgtccccgtccct

SEQ ID NO: 433776 - DNA, 25 bp, Mus musculus
gaagttatcagtaagcggctccttt

SEQ ID NO: 433777 - DNA, 25 bp, Mus musculus
gaagttatcagttagcggctccttt

SEQ ID NO: 433778 - DNA, 25 bp, Mus musculus
gaagttatccttctttgcagatgat

SEQ ID NO: 433779 - DNA, 25 bp, Mus musculus
gaagttatccttgtttgcagatgat

SEQ ID NO: 433780 - DNA, 25 bp, Mus musculus
gaagttatcgctatctaccggacac

SEQ ID NO: 433781 - DNA, 25 bp, Mus musculus
gaagttatcgctttctaccggacac

SEQ ID NO: 433782 - DNA, 25 bp, Mus musculus
gaagttatctccctttttggtgtgg

SEQ ID NO: 433783 - DNA, 25 bp, Mus musculus
gaagttatctccgtttttggtgtgg

SEQ ID NO: 433784 - DNA, 25 bp, Mus musculus
gaagttatcttgaccaaatggccta

SEQ ID NO: 433785 - DNA, 25 bp, Mus musculus
gaagttatcttgtccaaatggccta

SEQ ID NO: 433786 - DNA, 25 bp, Mus musculus
gaagttatgaataacaggtcctaaa

SEQ ID NO: 433787 - DNA, 25 bp, Mus musculus
gaagttatgaattacaggtcctaaa

SEQ ID NO: 433788 - DNA, 25 bp, Mus musculus
gaagttatgaccattgtaactccaa

SEQ ID NO: 433789 - DNA, 25 bp, Mus musculus
gaagttatgacctttgtaactccaa

SEQ ID NO: 433790 - DNA, 25 bp, Mus musculus
gaagttatgagtccggtaattagag

SEQ ID NO: 433791 - DNA, 25 bp, Mus musculus
gaagttatgagtgcggtaattagag

SEQ ID NO: 433792 - DNA, 25 bp, Mus musculus
gaagttatgtccacgattcttggct

SEQ ID NO: 433793 - DNA, 25 bp, Mus musculus
gaagttatgtcctcgattcttggct

SEQ ID NO: 433794 - DNA, 25 bp, Mus musculus
gaagttatgtgactgcttagtttaa

SEQ ID NO: 433795 - DNA, 25 bp, Mus musculus
gaagttatgtgagtgcttagtttaa

SEQ ID NO: 433796 - DNA, 25 bp, Mus musculus
gaagttattccgcaacacgagtttg

SEQ ID NO: 433797 - DNA, 25 bp, Mus musculus
gaagttattccggaacacgagtttg

SEQ ID NO: 433798 - DNA, 25 bp, Mus musculus
gaagttattctgatatactaatttg

SEQ ID NO: 433799 - DNA, 25 bp, Mus musculus
gaagttattctgttatactaatttg

SEQ ID NO: 433800 - DNA, 25 bp, Mus musculus
gaagttatttctatcttgttgagta

SEQ ID NO: 433801 - DNA, 25 bp, Mus musculus
gaagttatttctttcttgttgagta

SEQ ID NO: 433802 - DNA, 25 bp, Mus musculus
gaagttcaaaagaatgcagtgtatt

SEQ ID NO: 433803 - DNA, 25 bp, Mus musculus
gaagttcaaaagtatgcagtgtatt

SEQ ID NO: 433804 - DNA, 25 bp, Mus musculus
gaagttcaacgaagctctccgagaa

SEQ ID NO: 433805 - DNA, 25 bp, Mus musculus
gaagttcaacgatgctctccgagaa

SEQ ID NO: 433806 - DNA, 25 bp, Mus musculus
gaagttcaatgacactgctctgact

SEQ ID NO: 433807 - DNA, 25 bp, Mus musculus
gaagttcaatgagactgctctgact

SEQ ID NO: 433808 - DNA, 25 bp, Mus musculus
gaagttcaattgagccttttctttg

SEQ ID NO: 433809 - DNA, 25 bp, Mus musculus
gaagttcaattgtgccttttctttg

SEQ ID NO: 433810 - DNA, 25 bp, Mus musculus
gaagttcacaccagttaatccaaga

SEQ ID NO: 433811 - DNA, 25 bp, Mus musculus
gaagttcacaccattacatgaagct

SEQ ID NO: 433812 - DNA, 25 bp, Mus musculus
gaagttcacacctgttaatccaaga

SEQ ID NO: 433813 - DNA, 25 bp, Mus musculus
gaagttcacacctttacatgaagct

SEQ ID NO: 433814 - DNA, 25 bp, Mus musculus
gaagttcacagaacagcttactgaa

SEQ ID NO: 433815 - DNA, 25 bp, Mus musculus
gaagttcacagatcagcttactgaa

SEQ ID NO: 433816 - DNA, 25 bp, Mus musculus
gaagttcaccaccaagagtcagttt

SEQ ID NO: 433817 - DNA, 25 bp, Mus musculus
gaagttcaccacgaagagtcagttt

SEQ ID NO: 433818 - DNA, 25 bp, Mus musculus
gaagttcaccagagtaggttattat

SEQ ID NO: 433819 - DNA, 25 bp, Mus musculus
gaagttcaccagtgtaggttattat

SEQ ID NO: 433820 - DNA, 25 bp, Mus musculus
gaagttcaccctaaaggctgggcag

SEQ ID NO: 433821 - DNA, 25 bp, Mus musculus
gaagttcacccttaaggctgggcag

SEQ ID NO: 433822 - DNA, 25 bp, Mus musculus
gaagttcacgcgagtgctgctcaca

SEQ ID NO: 433823 - DNA, 25 bp, Mus musculus
gaagttcacgcgtgtgctgctcaca

SEQ ID NO: 433824 - DNA, 25 bp, Mus musculus
gaagttcactacctagccaggctgg

SEQ ID NO: 433825 - DNA, 25 bp, Mus musculus
gaagttcactacgtagccaggctgg

SEQ ID NO: 433826 - DNA, 25 bp, Mus musculus
gaagttcactctaggtactgtgggt

SEQ ID NO: 433827 - DNA, 25 bp, Mus musculus
gaagttcactcttggtactgtgggt

SEQ ID NO: 433828 - DNA, 25 bp, Mus musculus
gaagttcactgaaactaaggtacat

SEQ ID NO: 433829 - DNA, 25 bp, Mus musculus
gaagttcactgatactaaggtacat

SEQ ID NO: 433830 - DNA, 25 bp, Mus musculus
gaagttcactgtaaagctgctgata

SEQ ID NO: 433831 - DNA, 25 bp, Mus musculus
gaagttcactgtcttactacagaag

SEQ ID NO: 433832 - DNA, 25 bp, Mus musculus
gaagttcactgtgttactacagaag

SEQ ID NO: 433833 - DNA, 25 bp, Mus musculus
gaagttcactgttaagctgctgata

SEQ ID NO: 433834 - DNA, 25 bp, Mus musculus
gaagttcagaaaaaatggcgccagt

SEQ ID NO: 433835 - DNA, 25 bp, Mus musculus
gaagttcagaaataatggcgccagt

SEQ ID NO: 433836 - DNA, 25 bp, Mus musculus
gaagttcagagtaatcctctgcaca

SEQ ID NO: 433837 - DNA, 25 bp, Mus musculus
gaagttcagagttatcctctgcaca

SEQ ID NO: 433838 - DNA, 25 bp, Mus musculus
gaagttcagatacggcacagccatt

SEQ ID NO: 433839 - DNA, 25 bp, Mus musculus
gaagttcagatagggcacagccatt

SEQ ID NO: 433840 - DNA, 25 bp, Mus musculus
gaagttcagatgacagcacagggaa

SEQ ID NO: 433841 - DNA, 25 bp, Mus musculus
gaagttcagatgtcagcacagggaa

SEQ ID NO: 433842 - DNA, 25 bp, Mus musculus
gaagttcagtctatcagtctcatta

SEQ ID NO: 433843 - DNA, 25 bp, Mus musculus
gaagttcagtctttcagtctcatta

SEQ ID NO: 433844 - DNA, 25 bp, Mus musculus
gaagttcataatctgtgctcagcac

SEQ ID NO: 433845 - DNA, 25 bp, Mus musculus
gaagttcataatgtgtgctcagcac

SEQ ID NO: 433846 - DNA, 25 bp, Mus musculus
gaagttcatagtcgttttctggtga

SEQ ID NO: 433847 - DNA, 25 bp, Mus musculus
gaagttcatagtggttttctggtga

SEQ ID NO: 433848 - DNA, 25 bp, Mus musculus
gaagttcatcacacccaaagtggta

SEQ ID NO: 433849 - DNA, 25 bp, Mus musculus
gaagttcatcactcccaaagtggta

SEQ ID NO: 433850 - DNA, 25 bp, Mus musculus
gaagttcatcctcccagcagaacta

SEQ ID NO: 433851 - DNA, 25 bp, Mus musculus
gaagttcatcctgccagcagaacta

SEQ ID NO: 433852 - DNA, 25 bp, Mus musculus
gaagttcatgaccaaccgtctgctt

SEQ ID NO: 433853 - DNA, 25 bp, Mus musculus
gaagttcatgacgaaccgtctgctt

SEQ ID NO: 433854 - DNA, 25 bp, Mus musculus
gaagttcattagatgtgctgcgaag

SEQ ID NO: 433855 - DNA, 25 bp, Mus musculus
gaagttcattagttgtgctgcgaag

SEQ ID NO: 433856 - DNA, 25 bp, Mus musculus
gaagttccaaacagaaggctcaagc

SEQ ID NO: 433857 - DNA, 25 bp, Mus musculus
gaagttccaaactgaaggctcaagc

SEQ ID NO: 433858 - DNA, 25 bp, Mus musculus
gaagttccaagaccccagatggact

SEQ ID NO: 433859 - DNA, 25 bp, Mus musculus
gaagttccaagagcccagatggact

SEQ ID NO: 433860 - DNA, 25 bp, Mus musculus
gaagttccacttcaacactctgcag

SEQ ID NO: 433861 - DNA, 25 bp, Mus musculus
gaagttccacttgaacactctgcag

SEQ ID NO: 433862 - DNA, 25 bp, Mus musculus
gaagttccagaaaagctcagcagcc

SEQ ID NO: 433863 - DNA, 25 bp, Mus musculus
gaagttccagaaccagaggccagca

SEQ ID NO: 433864 - DNA, 25 bp, Mus musculus
gaagttccagaagcagaggccagca

SEQ ID NO: 433865 - DNA, 25 bp, Mus musculus
gaagttccagaatagctcagcagcc

SEQ ID NO: 433866 - DNA, 25 bp, Mus musculus
gaagttccagcaatcactttgaggg

SEQ ID NO: 433867 - DNA, 25 bp, Mus musculus
gaagttccagcacaatgactgcttc

SEQ ID NO: 433868 - DNA, 25 bp, Mus musculus
gaagttccagcacattttgcgagta

SEQ ID NO: 433869 - DNA, 25 bp, Mus musculus
gaagttccagcagaatgactgcttc

SEQ ID NO: 433870 - DNA, 25 bp, Mus musculus
gaagttccagcagattttgcgagta

SEQ ID NO: 433871 - DNA, 25 bp, Mus musculus
gaagttccagcattcactttgaggg

SEQ ID NO: 433872 - DNA, 25 bp, Mus musculus
gaagttccagtgagtctatgatgtt

SEQ ID NO: 433873 - DNA, 25 bp, Mus musculus
gaagttccagtgtgtctatgatgtt

SEQ ID NO: 433874 - DNA, 25 bp, Mus musculus
gaagttcccatgattgtttgctgtt

SEQ ID NO: 433875 - DNA, 25 bp, Mus musculus
gaagttcccatgtttgtttgctgtt

SEQ ID NO: 433876 - DNA, 25 bp, Mus musculus
gaagttcccgaacctctgagataga

SEQ ID NO: 433877 - DNA, 25 bp, Mus musculus
gaagttcccgaagctctgagataga

SEQ ID NO: 433878 - DNA, 25 bp, Mus musculus
gaagttcccttgatggtttccagca

SEQ ID NO: 433879 - DNA, 25 bp, Mus musculus
gaagttcccttgttggtttccagca

SEQ ID NO: 433880 - DNA, 25 bp, Mus musculus
gaagttccctttagctagtttggat

SEQ ID NO: 433881 - DNA, 25 bp, Mus musculus
gaagttcccttttgctagtttggat

SEQ ID NO: 433882 - DNA, 25 bp, Mus musculus
gaagttccggagatatctctcagtg

SEQ ID NO: 433883 - DNA, 25 bp, Mus musculus
gaagttccggagttatctctcagtg

SEQ ID NO: 433884 - DNA, 25 bp, Mus musculus
gaagttcctaacagatgcaatttgg

SEQ ID NO: 433885 - DNA, 25 bp, Mus musculus
gaagttcctaactgatgcaatttgg

SEQ ID NO: 433886 - DNA, 25 bp, Mus musculus
gaagttcctcatagggccagaaggg

SEQ ID NO: 433887 - DNA, 25 bp, Mus musculus
gaagttcctcattgggccagaaggg

SEQ ID NO: 433888 - DNA, 25 bp, Mus musculus
gaagttcctccacataccagactgg

SEQ ID NO: 433889 - DNA, 25 bp, Mus musculus
gaagttcctccagataccagactgg

SEQ ID NO: 433890 - DNA, 25 bp, Mus musculus
gaagttcctgacctcatcaacagca

SEQ ID NO: 433891 - DNA, 25 bp, Mus musculus
gaagttcctgacgtcatcaacagca

SEQ ID NO: 433892 - DNA, 25 bp, Mus musculus
gaagttcctgcacgagcccttagta

SEQ ID NO: 433893 - DNA, 25 bp, Mus musculus
gaagttcctgcaggagcccttagta

SEQ ID NO: 433894 - DNA, 25 bp, Mus musculus
gaagttcctgccaataaacctctaa

SEQ ID NO: 433895 - DNA, 25 bp, Mus musculus
gaagttcctgcctataaacctctaa

SEQ ID NO: 433896 - DNA, 25 bp, Mus musculus
gaagttcctgctacaagctactgtg

SEQ ID NO: 433897 - DNA, 25 bp, Mus musculus
gaagttcctgctataataatgcttt

SEQ ID NO: 433898 - DNA, 25 bp, Mus musculus
gaagttcctgcttcaagctactgtg

SEQ ID NO: 433899 - DNA, 25 bp, Mus musculus
gaagttcctgctttaataatgcttt

SEQ ID NO: 433900 - DNA, 25 bp, Mus musculus
gaagttcctggcagaggtttgatgt

SEQ ID NO: 433901 - DNA, 25 bp, Mus musculus
gaagttcctggctgaggtttgatgt

SEQ ID NO: 433902 - DNA, 25 bp, Mus musculus
gaagttcctggtatatgttgccaac

SEQ ID NO: 433903 - DNA, 25 bp, Mus musculus
gaagttcctggtttatgttgccaac

SEQ ID NO: 433904 - DNA, 25 bp, Mus musculus
gaagttccttaaatgattctcacaa

SEQ ID NO: 433905 - DNA, 25 bp, Mus musculus
gaagttccttaattgattctcacaa

SEQ ID NO: 433906 - DNA, 25 bp, Mus musculus
gaagttccttgtaagctgtgcttgt

SEQ ID NO: 433907 - DNA, 25 bp, Mus musculus
gaagttccttgttagctgtgcttgt

SEQ ID NO: 433908 - DNA, 25 bp, Mus musculus
gaagttcctttgactagtgacttta

SEQ ID NO: 433909 - DNA, 25 bp, Mus musculus
gaagttcctttgtctagtgacttta

SEQ ID NO: 433910 - DNA, 25 bp, Mus musculus
gaagttcgactccaggctacactgc

SEQ ID NO: 433911 - DNA, 25 bp, Mus musculus
gaagttcgactcgaggctacactgc

SEQ ID NO: 433912 - DNA, 25 bp, Mus musculus
gaagttcgatggaccttgtgacccc

SEQ ID NO: 433913 - DNA, 25 bp, Mus musculus
gaagttcgatggtccttgtgacccc

SEQ ID NO: 433914 - DNA, 25 bp, Mus musculus
gaagttcgcttactttctcccaaga

SEQ ID NO: 433915 - DNA, 25 bp, Mus musculus
gaagttcgcttagtttctcccaaga

SEQ ID NO: 433916 - DNA, 25 bp, Mus musculus
gaagttcggaatctttagtgactca

SEQ ID NO: 433917 - DNA, 25 bp, Mus musculus
gaagttcggaatgtttagtgactca

SEQ ID NO: 433918 - DNA, 25 bp, Mus musculus
gaagttcggccacggttcccgctct

SEQ ID NO: 433919 - DNA, 25 bp, Mus musculus
gaagttcggccagggttcccgctct

SEQ ID NO: 433920 - DNA, 25 bp, Mus musculus
gaagttcgggaaccctttgacctct

SEQ ID NO: 433921 - DNA, 25 bp, Mus musculus
gaagttcgggaagcctttgacctct

SEQ ID NO: 433922 - DNA, 25 bp, Mus musculus
gaagttcgtgccaggcgcgccaccg

SEQ ID NO: 433923 - DNA, 25 bp, Mus musculus
gaagttcgtgcctggcgcgccaccg

SEQ ID NO: 433924 - DNA, 25 bp, Mus musculus
gaagttcgtgtgaaagttttcctgg

SEQ ID NO: 433925 - DNA, 25 bp, Mus musculus
gaagttcgtgtgtaagttttcctgg

SEQ ID NO: 433926 - DNA, 25 bp, Mus musculus
gaagttctaataacctccaaagaca

SEQ ID NO: 433927 - DNA, 25 bp, Mus musculus
gaagttctaatatcctccaaagaca

SEQ ID NO: 433928 - DNA, 25 bp, Mus musculus
gaagttctagaacctacagccactg

SEQ ID NO: 433929 - DNA, 25 bp, Mus musculus
gaagttctagaagctacagccactg

SEQ ID NO: 433930 - DNA, 25 bp, Mus musculus
gaagttctaggtaggctctccttac

SEQ ID NO: 433931 - DNA, 25 bp, Mus musculus
gaagttctaggtccacaagctccat

SEQ ID NO: 433932 - DNA, 25 bp, Mus musculus
gaagttctaggtgcacaagctccat

SEQ ID NO: 433933 - DNA, 25 bp, Mus musculus
gaagttctaggttggctctccttac

SEQ ID NO: 433934 - DNA, 25 bp, Mus musculus
gaagttctcaagatcacccgttagg

SEQ ID NO: 433935 - DNA, 25 bp, Mus musculus
gaagttctcaagttcacccgttagg

SEQ ID NO: 433936 - DNA, 25 bp, Mus musculus
gaagttctcagcaacgtcgcaaagc

SEQ ID NO: 433937 - DNA, 25 bp, Mus musculus
gaagttctcagctacgtcgcaaagc

SEQ ID NO: 433938 - DNA, 25 bp, Mus musculus
gaagttctccaaattcagctcgatg

SEQ ID NO: 433939 - DNA, 25 bp, Mus musculus
gaagttctccaatttcagctcgatg

SEQ ID NO: 433940 - DNA, 25 bp, Mus musculus
gaagttctccacattttccaaatga

SEQ ID NO: 433941 - DNA, 25 bp, Mus musculus
gaagttctccactttttccaaatga

SEQ ID NO: 433942 - DNA, 25 bp, Mus musculus
gaagttctccctcgtggaaatttgt

SEQ ID NO: 433943 - DNA, 25 bp, Mus musculus
gaagttctccctggtggaaatttgt

SEQ ID NO: 433944 - DNA, 25 bp, Mus musculus
gaagttctccttcactagggatctc

SEQ ID NO: 433945 - DNA, 25 bp, Mus musculus
gaagttctccttgactagggatctc

SEQ ID NO: 433946 - DNA, 25 bp, Mus musculus
gaagttctcgtcagtggaagccacc

SEQ ID NO: 433947 - DNA, 25 bp, Mus musculus
gaagttctcgtctgtggaagccacc

SEQ ID NO: 433948 - DNA, 25 bp, Mus musculus
gaagttctcttacatgctttagctt

SEQ ID NO: 433949 - DNA, 25 bp, Mus musculus
gaagttctcttagatgctttagctt

SEQ ID NO: 433950 - DNA, 25 bp, Mus musculus
gaagttctgaaacctcaaataccct

SEQ ID NO: 433951 - DNA, 25 bp, Mus musculus
gaagttctgaaagctcaaataccct

SEQ ID NO: 433952 - DNA, 25 bp, Mus musculus
gaagttctgaagacttagtatcata

SEQ ID NO: 433953 - DNA, 25 bp, Mus musculus
gaagttctgaagtcttagtatcata

SEQ ID NO: 433954 - DNA, 25 bp, Mus musculus
gaagttctgagtcgcatccgtgaca

SEQ ID NO: 433955 - DNA, 25 bp, Mus musculus
gaagttctgagtggcatccgtgaca

SEQ ID NO: 433956 - DNA, 25 bp, Mus musculus
gaagttctgcagctatcccatagga

SEQ ID NO: 433957 - DNA, 25 bp, Mus musculus
gaagttctgcaggtatcccatagga

SEQ ID NO: 433958 - DNA, 25 bp, Mus musculus
gaagttctgccaataagtgaacagt

SEQ ID NO: 433959 - DNA, 25 bp, Mus musculus
gaagttctgccattaagtgaacagt

SEQ ID NO: 433960 - DNA, 25 bp, Mus musculus
gaagttctgccgcaaggactatgcg

SEQ ID NO: 433961 - DNA, 25 bp, Mus musculus
gaagttctgccggaaggactatgcg

SEQ ID NO: 433962 - DNA, 25 bp, Mus musculus
gaagttctgctgatgtggattcaaa

SEQ ID NO: 433963 - DNA, 25 bp, Mus musculus
gaagttctgctgttgtggattcaaa

SEQ ID NO: 433964 - DNA, 25 bp, Mus musculus
gaagttctggaactggattacacac

SEQ ID NO: 433965 - DNA, 25 bp, Mus musculus
gaagttctggaagtggattacacac

SEQ ID NO: 433966 - DNA, 25 bp, Mus musculus
gaagttctgggaaacgcggtcctca

SEQ ID NO: 433967 - DNA, 25 bp, Mus musculus
gaagttctgggatacgcggtcctca

SEQ ID NO: 433968 - DNA, 25 bp, Mus musculus
gaagttctggttactaccttgatgt

SEQ ID NO: 433969 - DNA, 25 bp, Mus musculus
gaagttctggtttctaccttgatgt

SEQ ID NO: 433970 - DNA, 25 bp, Mus musculus
gaagttcttacaatctctgacacga

SEQ ID NO: 433971 - DNA, 25 bp, Mus musculus
gaagttcttacattctctgacacga

SEQ ID NO: 433972 - DNA, 25 bp, Mus musculus
gaagttcttcagcaaatagacatga

SEQ ID NO: 433973 - DNA, 25 bp, Mus musculus
gaagttcttcaggaaatagacatga

SEQ ID NO: 433974 - DNA, 25 bp, Mus musculus
gaagttcttccacctagatatgtca

SEQ ID NO: 433975 - DNA, 25 bp, Mus musculus
gaagttcttccagctagatatgtca

SEQ ID NO: 433976 - DNA, 25 bp, Mus musculus
gaagttcttgacattcacaacattg

SEQ ID NO: 433977 - DNA, 25 bp, Mus musculus
gaagttcttgactttcacaacattg

SEQ ID NO: 433978 - DNA, 25 bp, Mus musculus
gaagttctttcacatcttatcccaa

SEQ ID NO: 433979 - DNA, 25 bp, Mus musculus
gaagttctttcagatcttatcccaa

SEQ ID NO: 433980 - DNA, 25 bp, Mus musculus
gaagttctttctcattctctttcac

SEQ ID NO: 433981 - DNA, 25 bp, Mus musculus
gaagttctttctgattctctttcac

SEQ ID NO: 433982 - DNA, 25 bp, Mus musculus
gaagttcttttcaggcaactgtcac

SEQ ID NO: 433983 - DNA, 25 bp, Mus musculus
gaagttcttttcattgtcaattttg

SEQ ID NO: 433984 - DNA, 25 bp, Mus musculus
gaagttcttttctggcaactgtcac

SEQ ID NO: 433985 - DNA, 25 bp, Mus musculus
gaagttcttttctttgtcaattttg

SEQ ID NO: 433986 - DNA, 25 bp, Mus musculus
gaagttctttttcaagcgctacctg

SEQ ID NO: 433987 - DNA, 25 bp, Mus musculus
gaagttctttttccagaagccatca

SEQ ID NO: 433988 - DNA, 25 bp, Mus musculus
gaagttctttttgaagcgctacctg

SEQ ID NO: 433989 - DNA, 25 bp, Mus musculus
gaagttctttttgcagaagccatca

SEQ ID NO: 433990 - DNA, 25 bp, Mus musculus
gaagttgaaaatctcctcccggata

SEQ ID NO: 433991 - DNA, 25 bp, Mus musculus
gaagttgaaaatgtcctcccggata

SEQ ID NO: 433992 - DNA, 25 bp, Mus musculus
gaagttgaaagaacccctccagcca

SEQ ID NO: 433993 - DNA, 25 bp, Mus musculus
gaagttgaaagatcccctccagcca

SEQ ID NO: 433994 - DNA, 25 bp, Mus musculus
gaagttgaacgcaaggccccaaaca

SEQ ID NO: 433995 - DNA, 25 bp, Mus musculus
gaagttgaacgctaggccccaaaca

SEQ ID NO: 433996 - DNA, 25 bp, Mus musculus
gaagttgaactccatagagtttgct

SEQ ID NO: 433997 - DNA, 25 bp, Mus musculus
gaagttgaactcgatagagtttgct

SEQ ID NO: 433998 - DNA, 25 bp, Mus musculus
gaagttgaagctatgaccctattca

SEQ ID NO: 433999 - DNA, 25 bp, Mus musculus
gaagttgaagctttgaccctattca

SEQ ID NO: 434000 - DNA, 25 bp, Mus musculus
gaagttgaaggtatatggcccctat

SEQ ID NO: 434001 - DNA, 25 bp, Mus musculus
gaagttgaaggtttatggcccctat

SEQ ID NO: 434002 - DNA, 25 bp, Mus musculus
gaagttgacaacagatctcctcaaa

SEQ ID NO: 434003 - DNA, 25 bp, Mus musculus
gaagttgacaactgatctcctcaaa

SEQ ID NO: 434004 - DNA, 25 bp, Mus musculus
gaagttgacacaactccgtctttct

SEQ ID NO: 434005 - DNA, 25 bp, Mus musculus
gaagttgacacatctccgtctttct

SEQ ID NO: 434006 - DNA, 25 bp, Mus musculus
gaagttgaccagaacacacatcgtt

SEQ ID NO: 434007 - DNA, 25 bp, Mus musculus
gaagttgaccagtacacacatcgtt

SEQ ID NO: 434008 - DNA, 25 bp, Mus musculus
gaagttgacccgctcagtgataaag

SEQ ID NO: 434009 - DNA, 25 bp, Mus musculus
gaagttgacccggtcagtgataaag

SEQ ID NO: 434010 - DNA, 25 bp, Mus musculus
gaagttgacgttcccttttaagcct

SEQ ID NO: 434011 - DNA, 25 bp, Mus musculus
gaagttgacgttgccttttaagcct

SEQ ID NO: 434012 - DNA, 25 bp, Mus musculus
gaagttgacttcctaggataatttt

SEQ ID NO: 434013 - DNA, 25 bp, Mus musculus
gaagttgacttcgtaggataatttt

SEQ ID NO: 434014 - DNA, 25 bp, Mus musculus
gaagttgacttgctatctgcagtta

SEQ ID NO: 434015 - DNA, 25 bp, Mus musculus
gaagttgacttggtatctgcagtta

SEQ ID NO: 434016 - DNA, 25 bp, Mus musculus
gaagttgactttatgcgtccattgt

SEQ ID NO: 434017 - DNA, 25 bp, Mus musculus
gaagttgactttttgcgtccattgt

SEQ ID NO: 434018 - DNA, 25 bp, Mus musculus
gaagttgagattcacaggacgagct

SEQ ID NO: 434019 - DNA, 25 bp, Mus musculus
gaagttgagattgacaggacgagct

SEQ ID NO: 434020 - DNA, 25 bp, Mus musculus
gaagttgagcctagttagtgtgcaa

SEQ ID NO: 434021 - DNA, 25 bp, Mus musculus
gaagttgagccttgttagtgtgcaa

SEQ ID NO: 434022 - DNA, 25 bp, Mus musculus
gaagttgagcttcacagcctgtgat

SEQ ID NO: 434023 - DNA, 25 bp, Mus musculus
gaagttgagcttgacagcctgtgat

SEQ ID NO: 434024 - DNA, 25 bp, Mus musculus
gaagttgaggctcaggcaccctttc

SEQ ID NO: 434025 - DNA, 25 bp, Mus musculus
gaagttgaggctgaggcaccctttc

SEQ ID NO: 434026 - DNA, 25 bp, Mus musculus
gaagttgataaccattaattgctaa

SEQ ID NO: 434027 - DNA, 25 bp, Mus musculus
gaagttgataacgattaattgctaa

SEQ ID NO: 434028 - DNA, 25 bp, Mus musculus
gaagttgatactattcctctaattg

SEQ ID NO: 434029 - DNA, 25 bp, Mus musculus
gaagttgatacttttcctctaattg

SEQ ID NO: 434030 - DNA, 25 bp, Mus musculus
gaagttgatatcagacatctttctc

SEQ ID NO: 434031 - DNA, 25 bp, Mus musculus
gaagttgatatctgacatctttctc

SEQ ID NO: 434032 - DNA, 25 bp, Mus musculus
gaagttgatcctctctacattttgt

SEQ ID NO: 434033 - DNA, 25 bp, Mus musculus
gaagttgatcctgtctacattttgt

SEQ ID NO: 434034 - DNA, 25 bp, Mus musculus
gaagttgatggcagacactgctttt

SEQ ID NO: 434035 - DNA, 25 bp, Mus musculus
gaagttgatggctgacactgctttt

SEQ ID NO: 434036 - DNA, 25 bp, Mus musculus
gaagttgattacagtgcagaaagca

SEQ ID NO: 434037 - DNA, 25 bp, Mus musculus
gaagttgattactgtgcagaaagca

SEQ ID NO: 434038 - DNA, 25 bp, Mus musculus
gaagttgattccactgattcagtcg

SEQ ID NO: 434039 - DNA, 25 bp, Mus musculus
gaagttgattcctctgattcagtcg

SEQ ID NO: 434040 - DNA, 25 bp, Mus musculus
gaagttgattgtcagtgtgccctgt

SEQ ID NO: 434041 - DNA, 25 bp, Mus musculus
gaagttgattgtgagtgtgccctgt

SEQ ID NO: 434042 - DNA, 25 bp, Mus musculus
gaagttgcaactaaacctggaggat

SEQ ID NO: 434043 - DNA, 25 bp, Mus musculus
gaagttgcaacttaacctggaggat

SEQ ID NO: 434044 - DNA, 25 bp, Mus musculus
gaagttgcagacatcaccctgtact

SEQ ID NO: 434045 - DNA, 25 bp, Mus musculus
gaagttgcagacttcaccctgtact

SEQ ID NO: 434046 - DNA, 25 bp, Mus musculus
gaagttgcaggacagctcgctcacc

SEQ ID NO: 434047 - DNA, 25 bp, Mus musculus
gaagttgcaggagagctcgctcacc

SEQ ID NO: 434048 - DNA, 25 bp, Mus musculus
gaagttgcagggacacacagatgtt

SEQ ID NO: 434049 - DNA, 25 bp, Mus musculus
gaagttgcagggtcacacagatgtt

SEQ ID NO: 434050 - DNA, 25 bp, Mus musculus
gaagttgcataacgacccgtgtttc

SEQ ID NO: 434051 - DNA, 25 bp, Mus musculus
gaagttgcataaggacccgtgtttc

SEQ ID NO: 434052 - DNA, 25 bp, Mus musculus
gaagttgcatggacactacagtcga

SEQ ID NO: 434053 - DNA, 25 bp, Mus musculus
gaagttgcatggtcactacagtcga

SEQ ID NO: 434054 - DNA, 25 bp, Mus musculus
gaagttgccattcgctactgcttgg

SEQ ID NO: 434055 - DNA, 25 bp, Mus musculus
gaagttgccattggctactgcttgg

SEQ ID NO: 434056 - DNA, 25 bp, Mus musculus
gaagttgcccgcagggtccagagca

SEQ ID NO: 434057 - DNA, 25 bp, Mus musculus
gaagttgcccgctgggtccagagca

SEQ ID NO: 434058 - DNA, 25 bp, Mus musculus
gaagttgccgcccaattatgaaccc

SEQ ID NO: 434059 - DNA, 25 bp, Mus musculus
gaagttgccgccgaattatgaaccc

SEQ ID NO: 434060 - DNA, 25 bp, Mus musculus
gaagttgcgtacaccagacatgcaa

SEQ ID NO: 434061 - DNA, 25 bp, Mus musculus
gaagttgcgtactccagacatgcaa

SEQ ID NO: 434062 - DNA, 25 bp, Mus musculus
gaagttgctacaacgaaagttggaa

SEQ ID NO: 434063 - DNA, 25 bp, Mus musculus
gaagttgctacaatacctcggacat

SEQ ID NO: 434064 - DNA, 25 bp, Mus musculus
gaagttgctacacggctttgtcaag

SEQ ID NO: 434065 - DNA, 25 bp, Mus musculus
gaagttgctacagggctttgtcaag

SEQ ID NO: 434066 - DNA, 25 bp, Mus musculus
gaagttgctacatcgaaagttggaa

SEQ ID NO: 434067 - DNA, 25 bp, Mus musculus
gaagttgctacattacctcggacat

SEQ ID NO: 434068 - DNA, 25 bp, Mus musculus
gaagttgctactactccatgatgag

SEQ ID NO: 434069 - DNA, 25 bp, Mus musculus
gaagttgctacttctccatgatgag

SEQ ID NO: 434070 - DNA, 25 bp, Mus musculus
gaagttgctcacactttgtaaggaa

SEQ ID NO: 434071 - DNA, 25 bp, Mus musculus
gaagttgctcactctttgtaaggaa

SEQ ID NO: 434072 - DNA, 25 bp, Mus musculus
gaagttgctggcaaaattcccatca

SEQ ID NO: 434073 - DNA, 25 bp, Mus musculus
gaagttgctggcattcagccatgct

SEQ ID NO: 434074 - DNA, 25 bp, Mus musculus
gaagttgctggctaaattcccatca

SEQ ID NO: 434075 - DNA, 25 bp, Mus musculus
gaagttgctggctttcagccatgct

SEQ ID NO: 434076 - DNA, 25 bp, Mus musculus
gaagttgctgtacccacgttgttga

SEQ ID NO: 434077 - DNA, 25 bp, Mus musculus
gaagttgctgtagccacgttgttga

SEQ ID NO: 434078 - DNA, 25 bp, Mus musculus
gaagttgctgtgcaaccggcttaaa

SEQ ID NO: 434079 - DNA, 25 bp, Mus musculus
gaagttgctgtggaaccggcttaaa

SEQ ID NO: 434080 - DNA, 25 bp, Mus musculus
gaagttgcttcacagtttcttgaga

SEQ ID NO: 434081 - DNA, 25 bp, Mus musculus
gaagttgcttcagagtttcttgaga

SEQ ID NO: 434082 - DNA, 25 bp, Mus musculus
gaagttgcttcgagaccagctgagc

SEQ ID NO: 434083 - DNA, 25 bp, Mus musculus
gaagttgcttcgtgaccagctgagc

SEQ ID NO: 434084 - DNA, 25 bp, Mus musculus
gaagttgcttctcattcacaaatag

SEQ ID NO: 434085 - DNA, 25 bp, Mus musculus
gaagttgcttctgattcacaaatag

SEQ ID NO: 434086 - DNA, 25 bp, Mus musculus
gaagttgcttgtcattttaccctct

SEQ ID NO: 434087 - DNA, 25 bp, Mus musculus
gaagttgcttgtgattttaccctct

SEQ ID NO: 434088 - DNA, 25 bp, Mus musculus
gaagttggaccaacatcctgggtaa

SEQ ID NO: 434089 - DNA, 25 bp, Mus musculus
gaagttggaccatcatcctgggtaa

SEQ ID NO: 434090 - DNA, 25 bp, Mus musculus
gaagttggacccactgagggctttg

SEQ ID NO: 434091 - DNA, 25 bp, Mus musculus
gaagttggaccctctgagggctttg

SEQ ID NO: 434092 - DNA, 25 bp, Mus musculus
gaagttggattactttcctccccag

SEQ ID NO: 434093 - DNA, 25 bp, Mus musculus
gaagttggattagtttcctccccag

SEQ ID NO: 434094 - DNA, 25 bp, Mus musculus
gaagttggcactactattttttcca

SEQ ID NO: 434095 - DNA, 25 bp, Mus musculus
gaagttggcacttctattttttcca

SEQ ID NO: 434096 - DNA, 25 bp, Mus musculus
gaagttggcagaagtggacaaggat

SEQ ID NO: 434097 - DNA, 25 bp, Mus musculus
gaagttggcagatgtggacaaggat

SEQ ID NO: 434098 - DNA, 25 bp, Mus musculus
gaagttggccagactgcacttcagc

SEQ ID NO: 434099 - DNA, 25 bp, Mus musculus
gaagttggccagtctgcacttcagc

SEQ ID NO: 434100 - DNA, 25 bp, Mus musculus
gaagttggcccacttcattgaaaaa

SEQ ID NO: 434101 - DNA, 25 bp, Mus musculus
gaagttggcccagttcattgaaaaa

SEQ ID NO: 434102 - DNA, 25 bp, Mus musculus
gaagttggctgcatgatttaccaaa

SEQ ID NO: 434103 - DNA, 25 bp, Mus musculus
gaagttggctgcttgatttaccaaa

SEQ ID NO: 434104 - DNA, 25 bp, Mus musculus
gaagttggctttcaatccagagcat

SEQ ID NO: 434105 - DNA, 25 bp, Mus musculus
gaagttggctttgaatccagagcat

SEQ ID NO: 434106 - DNA, 25 bp, Mus musculus
gaagttgggcagatccgttcctagc

SEQ ID NO: 434107 - DNA, 25 bp, Mus musculus
gaagttgggcagttccgttcctagc

SEQ ID NO: 434108 - DNA, 25 bp, Mus musculus
gaagttgggtccactcaaataacaa

SEQ ID NO: 434109 - DNA, 25 bp, Mus musculus
gaagttgggtcctctcaaataacaa

SEQ ID NO: 434110 - DNA, 25 bp, Mus musculus
gaagttggtgatcccatccgagctg

SEQ ID NO: 434111 - DNA, 25 bp, Mus musculus
gaagttggtgatgccatccgagctg

SEQ ID NO: 434112 - DNA, 25 bp, Mus musculus
gaagttggtggtcaggccctgggca

SEQ ID NO: 434113 - DNA, 25 bp, Mus musculus
gaagttggtggtgaggccctgggca

SEQ ID NO: 434114 - DNA, 25 bp, Mus musculus
gaagttggttcacctccacacttta

SEQ ID NO: 434115 - DNA, 25 bp, Mus musculus
gaagttggttcagctccacacttta

SEQ ID NO: 434116 - DNA, 25 bp, Mus musculus
gaagttgtaatcatctaatcatctg

SEQ ID NO: 434117 - DNA, 25 bp, Mus musculus
gaagttgtaatcttctaatcatctg

SEQ ID NO: 434118 - DNA, 25 bp, Mus musculus
gaagttgtactcattgtcactgttg

SEQ ID NO: 434119 - DNA, 25 bp, Mus musculus
gaagttgtactctttgtcactgttg

SEQ ID NO: 434120 - DNA, 25 bp, Mus musculus
gaagttgtacttaattcaaggcacc

SEQ ID NO: 434121 - DNA, 25 bp, Mus musculus
gaagttgtactttattcaaggcacc

SEQ ID NO: 434122 - DNA, 25 bp, Mus musculus
gaagttgtagccatcctgcactgag

SEQ ID NO: 434123 - DNA, 25 bp, Mus musculus
gaagttgtagccttcctgcactgag

SEQ ID NO: 434124 - DNA, 25 bp, Mus musculus
gaagttgtagtaagttgtccaaaca

SEQ ID NO: 434125 - DNA, 25 bp, Mus musculus
gaagttgtagtatgttgtccaaaca

SEQ ID NO: 434126 - DNA, 25 bp, Mus musculus
gaagttgtatacattcagttttcac

SEQ ID NO: 434127 - DNA, 25 bp, Mus musculus
gaagttgtatactttcagttttcac

SEQ ID NO: 434128 - DNA, 25 bp, Mus musculus
gaagttgtattcatatctaccaaat

SEQ ID NO: 434129 - DNA, 25 bp, Mus musculus
gaagttgtattcttatctaccaaat

SEQ ID NO: 434130 - DNA, 25 bp, Mus musculus
gaagttgtcaccagatgctctgaac

SEQ ID NO: 434131 - DNA, 25 bp, Mus musculus
gaagttgtcacctgatgctctgaac

SEQ ID NO: 434132 - DNA, 25 bp, Mus musculus
gaagttgtcactctcttgatttaga

SEQ ID NO: 434133 - DNA, 25 bp, Mus musculus
gaagttgtcactgtcttgatttaga

SEQ ID NO: 434134 - DNA, 25 bp, Mus musculus
gaagttgtcagcaatctttccggga

SEQ ID NO: 434135 - DNA, 25 bp, Mus musculus
gaagttgtcagctatctttccggga

SEQ ID NO: 434136 - DNA, 25 bp, Mus musculus
gaagttgtcccacgccaaagactgt

SEQ ID NO: 434137 - DNA, 25 bp, Mus musculus
gaagttgtcccaggccaaagactgt

SEQ ID NO: 434138 - DNA, 25 bp, Mus musculus
gaagttgtctatcagcattcacagg

SEQ ID NO: 434139 - DNA, 25 bp, Mus musculus
gaagttgtctatgagcattcacagg

SEQ ID NO: 434140 - DNA, 25 bp, Mus musculus
gaagttgtctcgctgatatattttt

SEQ ID NO: 434141 - DNA, 25 bp, Mus musculus
gaagttgtctcggtgatatattttt

SEQ ID NO: 434142 - DNA, 25 bp, Mus musculus
gaagttgtcttcagttttgctaatc

SEQ ID NO: 434143 - DNA, 25 bp, Mus musculus
gaagttgtcttctgttttgctaatc

SEQ ID NO: 434144 - DNA, 25 bp, Mus musculus
gaagttgtgccgagcttacgttatt

SEQ ID NO: 434145 - DNA, 25 bp, Mus musculus
gaagttgtgccgtgcttacgttatt

SEQ ID NO: 434146 - DNA, 25 bp, Mus musculus
gaagttgtgctaatgattgctctgt

SEQ ID NO: 434147 - DNA, 25 bp, Mus musculus
gaagttgtgctattgattgctctgt

SEQ ID NO: 434148 - DNA, 25 bp, Mus musculus
gaagttgtggtcatgtcatctttca

SEQ ID NO: 434149 - DNA, 25 bp, Mus musculus
gaagttgtggtcttgtcatctttca

SEQ ID NO: 434150 - DNA, 25 bp, Mus musculus
gaagttgttaccatggttctctttt

SEQ ID NO: 434151 - DNA, 25 bp, Mus musculus
gaagttgttaccttggttctctttt

SEQ ID NO: 434152 - DNA, 25 bp, Mus musculus
gaagttgttagaactgaacggccaa

SEQ ID NO: 434153 - DNA, 25 bp, Mus musculus
gaagttgttagatctgaacggccaa

SEQ ID NO: 434154 - DNA, 25 bp, Mus musculus
gaagttgttagcacacggtgttctg

SEQ ID NO: 434155 - DNA, 25 bp, Mus musculus
gaagttgttagctcacggtgttctg

SEQ ID NO: 434156 - DNA, 25 bp, Mus musculus
gaagttgttatgatccaaggagtga

SEQ ID NO: 434157 - DNA, 25 bp, Mus musculus
gaagttgttatgttccaaggagtga

SEQ ID NO: 434158 - DNA, 25 bp, Mus musculus
gaagttgttcaacaagcacacgact

SEQ ID NO: 434159 - DNA, 25 bp, Mus musculus
gaagttgttcaagaagcacacgact

SEQ ID NO: 434160 - DNA, 25 bp, Mus musculus
gaagttgttcatctcgagtctctcc

SEQ ID NO: 434161 - DNA, 25 bp, Mus musculus
gaagttgttcatgtcgagtctctcc

SEQ ID NO: 434162 - DNA, 25 bp, Mus musculus
gaagttgttcttagtacctttgcag

SEQ ID NO: 434163 - DNA, 25 bp, Mus musculus
gaagttgttctttgtacctttgcag

SEQ ID NO: 434164 - DNA, 25 bp, Mus musculus
gaagttgttgttcccagtgttctgg

SEQ ID NO: 434165 - DNA, 25 bp, Mus musculus
gaagttgttgttctagccacagact

SEQ ID NO: 434166 - DNA, 25 bp, Mus musculus
gaagttgttgttgccagtgttctgg

SEQ ID NO: 434167 - DNA, 25 bp, Mus musculus
gaagttgttgttgtagccacagact

SEQ ID NO: 434168 - DNA, 25 bp, Mus musculus
gaagttgtttccagaccaccagaga

SEQ ID NO: 434169 - DNA, 25 bp, Mus musculus
gaagttgtttcctgaccaccagaga

SEQ ID NO: 434170 - DNA, 25 bp, Mus musculus
gaagttgtttctcttgaggtcttcc

SEQ ID NO: 434171 - DNA, 25 bp, Mus musculus
gaagttgtttctgttgaggtcttcc

SEQ ID NO: 434172 - DNA, 25 bp, Mus musculus
gaagttgttttaacagtacacaaag

SEQ ID NO: 434173 - DNA, 25 bp, Mus musculus
gaagttgttttatcagtacacaaag

SEQ ID NO: 434174 - DNA, 25 bp, Mus musculus
gaagttgttttcaacatttccatgg

SEQ ID NO: 434175 - DNA, 25 bp, Mus musculus
gaagttgttttctacatttccatgg

SEQ ID NO: 434176 - DNA, 25 bp, Mus musculus
gaagtttaaacactgccctacagag

SEQ ID NO: 434177 - DNA, 25 bp, Mus musculus
gaagtttaaacagtgccctacagag

SEQ ID NO: 434178 - DNA, 25 bp, Mus musculus
gaagtttaacgtatctcagaggcct

SEQ ID NO: 434179 - DNA, 25 bp, Mus musculus
gaagtttaacgtttctcagaggcct

SEQ ID NO: 434180 - DNA, 25 bp, Mus musculus
gaagtttaactacattcatgtgagg

SEQ ID NO: 434181 - DNA, 25 bp, Mus musculus
gaagtttaactagattcatgtgagg

SEQ ID NO: 434182 - DNA, 25 bp, Mus musculus
gaagtttaatcgagcaacaaatttc

SEQ ID NO: 434183 - DNA, 25 bp, Mus musculus
gaagtttaatcgtgcaacaaatttc

SEQ ID NO: 434184 - DNA, 25 bp, Mus musculus
gaagtttaatctcttcccttgtttg

SEQ ID NO: 434185 - DNA, 25 bp, Mus musculus
gaagtttaatctgttcccttgtttg

SEQ ID NO: 434186 - DNA, 25 bp, Mus musculus
gaagtttacaagctattaatgttat

SEQ ID NO: 434187 - DNA, 25 bp, Mus musculus
gaagtttacaaggtattaatgttat

SEQ ID NO: 434188 - DNA, 25 bp, Mus musculus
gaagtttaccagcagtaaaccactg

SEQ ID NO: 434189 - DNA, 25 bp, Mus musculus
gaagtttaccagcatggctgtcccc

SEQ ID NO: 434190 - DNA, 25 bp, Mus musculus
gaagtttaccaggagtaaaccactg

SEQ ID NO: 434191 - DNA, 25 bp, Mus musculus
gaagtttaccaggatggctgtcccc

SEQ ID NO: 434192 - DNA, 25 bp, Mus musculus
gaagtttacctcatcagtcctgaca

SEQ ID NO: 434193 - DNA, 25 bp, Mus musculus
gaagtttacctcttcagtcctgaca

SEQ ID NO: 434194 - DNA, 25 bp, Mus musculus
gaagtttactgtcagccgggcgttt

SEQ ID NO: 434195 - DNA, 25 bp, Mus musculus
gaagtttactgtgagccgggcgttt

SEQ ID NO: 434196 - DNA, 25 bp, Mus musculus
gaagtttacttaagtttcatgcaca

SEQ ID NO: 434197 - DNA, 25 bp, Mus musculus
gaagtttacttatgtttcatgcaca

SEQ ID NO: 434198 - DNA, 25 bp, Mus musculus
gaagtttagatcctcttgccatcat

SEQ ID NO: 434199 - DNA, 25 bp, Mus musculus
gaagtttagatcgtcttgccatcat

SEQ ID NO: 434200 - DNA, 25 bp, Mus musculus
gaagtttagcaacccgtgttcgatt

SEQ ID NO: 434201 - DNA, 25 bp, Mus musculus
gaagtttagcaagccgtgttcgatt

SEQ ID NO: 434202 - DNA, 25 bp, Mus musculus
gaagtttagctcctggtattttcat

SEQ ID NO: 434203 - DNA, 25 bp, Mus musculus
gaagtttagctcgtggtattttcat

SEQ ID NO: 434204 - DNA, 25 bp, Mus musculus
gaagtttagtgaattgcccagtcat

SEQ ID NO: 434205 - DNA, 25 bp, Mus musculus
gaagtttagtgatttgcccagtcat

SEQ ID NO: 434206 - DNA, 25 bp, Mus musculus
gaagtttagtgcagtgccatggagc

SEQ ID NO: 434207 - DNA, 25 bp, Mus musculus
gaagtttagtgctgtgccatggagc

SEQ ID NO: 434208 - DNA, 25 bp, Mus musculus
gaagtttatactaaggtgcagacct

SEQ ID NO: 434209 - DNA, 25 bp, Mus musculus
gaagtttatacttaggtgcagacct

SEQ ID NO: 434210 - DNA, 25 bp, Mus musculus
gaagtttatcccaagtcaccttcct

SEQ ID NO: 434211 - DNA, 25 bp, Mus musculus
gaagtttatccctagtcaccttcct

SEQ ID NO: 434212 - DNA, 25 bp, Mus musculus
gaagtttatctcagatataccctat

SEQ ID NO: 434213 - DNA, 25 bp, Mus musculus
gaagtttatctctgatataccctat

SEQ ID NO: 434214 - DNA, 25 bp, Mus musculus
gaagtttatggcactatcctaacac

SEQ ID NO: 434215 - DNA, 25 bp, Mus musculus
gaagtttatggctctatcctaacac

SEQ ID NO: 434216 - DNA, 25 bp, Mus musculus
gaagtttattccaccacaagtttat

SEQ ID NO: 434217 - DNA, 25 bp, Mus musculus
gaagtttattcctccacaagtttat

SEQ ID NO: 434218 - DNA, 25 bp, Mus musculus
gaagtttattctagccactgggttc

SEQ ID NO: 434219 - DNA, 25 bp, Mus musculus
gaagtttattcttgccactgggttc

SEQ ID NO: 434220 - DNA, 25 bp, Mus musculus
gaagtttattttcatgcctagttaa

SEQ ID NO: 434221 - DNA, 25 bp, Mus musculus
gaagtttattttgatgcctagttaa

SEQ ID NO: 434222 - DNA, 25 bp, Mus musculus
gaagtttcaaggagccctcctgacc

SEQ ID NO: 434223 - DNA, 25 bp, Mus musculus
gaagtttcaaggtgccctcctgacc

SEQ ID NO: 434224 - DNA, 25 bp, Mus musculus
gaagtttcacaacgtaccactcctg

SEQ ID NO: 434225 - DNA, 25 bp, Mus musculus
gaagtttcacaaggtaccactcctg

SEQ ID NO: 434226 - DNA, 25 bp, Mus musculus
gaagtttcacgtacttgagtgacag

SEQ ID NO: 434227 - DNA, 25 bp, Mus musculus
gaagtttcacgttcttgagtgacag

SEQ ID NO: 434228 - DNA, 25 bp, Mus musculus
gaagtttcactgaaatcctgaggaa

SEQ ID NO: 434229 - DNA, 25 bp, Mus musculus
gaagtttcactgtaatcctgaggaa

SEQ ID NO: 434230 - DNA, 25 bp, Mus musculus
gaagtttcagacactttggctgtaa

SEQ ID NO: 434231 - DNA, 25 bp, Mus musculus
gaagtttcagactctttggctgtaa

SEQ ID NO: 434232 - DNA, 25 bp, Mus musculus
gaagtttcagatctcaggccatgca

SEQ ID NO: 434233 - DNA, 25 bp, Mus musculus
gaagtttcagatgtcaggccatgca

SEQ ID NO: 434234 - DNA, 25 bp, Mus musculus
gaagtttcagctctgcactatttat

SEQ ID NO: 434235 - DNA, 25 bp, Mus musculus
gaagtttcagctgtgcactatttat

SEQ ID NO: 434236 - DNA, 25 bp, Mus musculus
gaagtttcatgcaaccatttttcct

SEQ ID NO: 434237 - DNA, 25 bp, Mus musculus
gaagtttcatgctaccatttttcct

SEQ ID NO: 434238 - DNA, 25 bp, Mus musculus
gaagtttccaataccttacattaga

SEQ ID NO: 434239 - DNA, 25 bp, Mus musculus
gaagtttccaattccttacattaga

SEQ ID NO: 434240 - DNA, 25 bp, Mus musculus
gaagtttccactacagaggttcagt

SEQ ID NO: 434241 - DNA, 25 bp, Mus musculus
gaagtttccacttcagaggttcagt

SEQ ID NO: 434242 - DNA, 25 bp, Mus musculus
gaagtttccaggacagatccaccaa

SEQ ID NO: 434243 - DNA, 25 bp, Mus musculus
gaagtttccaggtcagatccaccaa

SEQ ID NO: 434244 - DNA, 25 bp, Mus musculus
gaagtttccatactgtgaagccaca

SEQ ID NO: 434245 - DNA, 25 bp, Mus musculus
gaagtttccatagtgtgaagccaca

SEQ ID NO: 434246 - DNA, 25 bp, Mus musculus
gaagtttccatgatgttggttcaaa

SEQ ID NO: 434247 - DNA, 25 bp, Mus musculus
gaagtttccatgattccacctaaaa

SEQ ID NO: 434248 - DNA, 25 bp, Mus musculus
gaagtttccatgttgttggttcaaa

SEQ ID NO: 434249 - DNA, 25 bp, Mus musculus
gaagtttccatgtttccacctaaaa

SEQ ID NO: 434250 - DNA, 25 bp, Mus musculus
gaagtttcccctactggcagtaagg

SEQ ID NO: 434251 - DNA, 25 bp, Mus musculus
gaagtttccccttctggcagtaagg

SEQ ID NO: 434252 - DNA, 25 bp, Mus musculus
gaagtttccctaatagtgcatttct

SEQ ID NO: 434253 - DNA, 25 bp, Mus musculus
gaagtttccctattagtgcatttct

SEQ ID NO: 434254 - DNA, 25 bp, Mus musculus
gaagtttcctgaaaggctcgctgat

SEQ ID NO: 434255 - DNA, 25 bp, Mus musculus
gaagtttcctgataggctcgctgat

SEQ ID NO: 434256 - DNA, 25 bp, Mus musculus
gaagtttcctgccatgcgatgctgt

SEQ ID NO: 434257 - DNA, 25 bp, Mus musculus
gaagtttcctgcgatgcgatgctgt

SEQ ID NO: 434258 - DNA, 25 bp, Mus musculus
gaagtttccttcatctacagcgagg

SEQ ID NO: 434259 - DNA, 25 bp, Mus musculus
gaagtttccttcttctacagcgagg

SEQ ID NO: 434260 - DNA, 25 bp, Mus musculus
gaagtttcgaaaatcctctgtcgca

SEQ ID NO: 434261 - DNA, 25 bp, Mus musculus
gaagtttcgaaattcctctgtcgca

SEQ ID NO: 434262 - DNA, 25 bp, Mus musculus
gaagtttcggctagttttcttctag

SEQ ID NO: 434263 - DNA, 25 bp, Mus musculus
gaagtttcggcttgttttcttctag

SEQ ID NO: 434264 - DNA, 25 bp, Mus musculus
gaagtttcgggtcagactttatgta

SEQ ID NO: 434265 - DNA, 25 bp, Mus musculus
gaagtttcgggtgagactttatgta

SEQ ID NO: 434266 - DNA, 25 bp, Mus musculus
gaagtttctattacctgtggcccaa

SEQ ID NO: 434267 - DNA, 25 bp, Mus musculus
gaagtttctatttcctgtggcccaa

SEQ ID NO: 434268 - DNA, 25 bp, Mus musculus
gaagtttctcttaaatgttatcatt

SEQ ID NO: 434269 - DNA, 25 bp, Mus musculus
gaagtttctctttaatgttatcatt

SEQ ID NO: 434270 - DNA, 25 bp, Mus musculus
gaagtttctgcactggaggtagact

SEQ ID NO: 434271 - DNA, 25 bp, Mus musculus
gaagtttctgcagtggaggtagact

SEQ ID NO: 434272 - DNA, 25 bp, Mus musculus
gaagtttctggtacaccaggtctct

SEQ ID NO: 434273 - DNA, 25 bp, Mus musculus
gaagtttctggtacctcaacatcat

SEQ ID NO: 434274 - DNA, 25 bp, Mus musculus
gaagtttctggtacttcagccaaag

SEQ ID NO: 434275 - DNA, 25 bp, Mus musculus
gaagtttctggttcaccaggtctct

SEQ ID NO: 434276 - DNA, 25 bp, Mus musculus
gaagtttctggttcctcaacatcat

SEQ ID NO: 434277 - DNA, 25 bp, Mus musculus
gaagtttctggttcttcagccaaag

SEQ ID NO: 434278 - DNA, 25 bp, Mus musculus
gaagtttctgttactccttaagaga

SEQ ID NO: 434279 - DNA, 25 bp, Mus musculus
gaagtttctgtttctccttaagaga

SEQ ID NO: 434280 - DNA, 25 bp, Mus musculus
gaagtttgaaacagggctcctacta

SEQ ID NO: 434281 - DNA, 25 bp, Mus musculus
gaagtttgaaactgggctcctacta

SEQ ID NO: 434282 - DNA, 25 bp, Mus musculus
gaagtttgaacccaaatctggctgg

SEQ ID NO: 434283 - DNA, 25 bp, Mus musculus
gaagtttgaaccgaaatctggctgg

SEQ ID NO: 434284 - DNA, 25 bp, Mus musculus
gaagtttgaactcaatgatgcttat

SEQ ID NO: 434285 - DNA, 25 bp, Mus musculus
gaagtttgaactgaatgatgcttat

SEQ ID NO: 434286 - DNA, 25 bp, Mus musculus
gaagtttgacacacggttcttacca

SEQ ID NO: 434287 - DNA, 25 bp, Mus musculus
gaagtttgacactcggttcttacca

SEQ ID NO: 434288 - DNA, 25 bp, Mus musculus
gaagtttgactgactggcacattct

SEQ ID NO: 434289 - DNA, 25 bp, Mus musculus
gaagtttgactgtctggcacattct

SEQ ID NO: 434290 - DNA, 25 bp, Mus musculus
gaagtttgagtaccgctccacacca

SEQ ID NO: 434291 - DNA, 25 bp, Mus musculus
gaagtttgagtagcgctccacacca

SEQ ID NO: 434292 - DNA, 25 bp, Mus musculus
gaagtttgcagtctgtgacatccct

SEQ ID NO: 434293 - DNA, 25 bp, Mus musculus
gaagtttgcagtgtgtgacatccct

SEQ ID NO: 434294 - DNA, 25 bp, Mus musculus
gaagtttgccaaagaacgacaactg

SEQ ID NO: 434295 - DNA, 25 bp, Mus musculus
gaagtttgccaatgaacgacaactg

SEQ ID NO: 434296 - DNA, 25 bp, Mus musculus
gaagtttgccagatgctttagtgat

SEQ ID NO: 434297 - DNA, 25 bp, Mus musculus
gaagtttgccagttgctttagtgat

SEQ ID NO: 434298 - DNA, 25 bp, Mus musculus
gaagtttgccgaagtgtgaccctca

SEQ ID NO: 434299 - DNA, 25 bp, Mus musculus
gaagtttgccgatgtgtgaccctca

SEQ ID NO: 434300 - DNA, 25 bp, Mus musculus
gaagtttgccggctgttttcagcat

SEQ ID NO: 434301 - DNA, 25 bp, Mus musculus
gaagtttgccgggtgttttcagcat

SEQ ID NO: 434302 - DNA, 25 bp, Mus musculus
gaagtttgcgcccaccaggcctgag

SEQ ID NO: 434303 - DNA, 25 bp, Mus musculus
gaagtttgcgccgaccaggcctgag

SEQ ID NO: 434304 - DNA, 25 bp, Mus musculus
gaagtttgctagacagggcctgtgc

SEQ ID NO: 434305 - DNA, 25 bp, Mus musculus
gaagtttgctagtcagggcctgtgc

SEQ ID NO: 434306 - DNA, 25 bp, Mus musculus
gaagtttgctatcagatttttgtct

SEQ ID NO: 434307 - DNA, 25 bp, Mus musculus
gaagtttgctatgagatttttgtct

SEQ ID NO: 434308 - DNA, 25 bp, Mus musculus
gaagtttgctgtactggcaataaac

SEQ ID NO: 434309 - DNA, 25 bp, Mus musculus
gaagtttgctgttctggcaataaac

SEQ ID NO: 434310 - DNA, 25 bp, Mus musculus
gaagtttgctttacagtcctcacca

SEQ ID NO: 434311 - DNA, 25 bp, Mus musculus
gaagtttgcttttcagtcctcacca

SEQ ID NO: 434312 - DNA, 25 bp, Mus musculus
gaagtttggaatcccgttccgcaca

SEQ ID NO: 434313 - DNA, 25 bp, Mus musculus
gaagtttggaatgccgttccgcaca

SEQ ID NO: 434314 - DNA, 25 bp, Mus musculus
gaagtttggactagattcctcctct

SEQ ID NO: 434315 - DNA, 25 bp, Mus musculus
gaagtttggacttgattcctcctct

SEQ ID NO: 434316 - DNA, 25 bp, Mus musculus
gaagtttggattacagacccttgtt

SEQ ID NO: 434317 - DNA, 25 bp, Mus musculus
gaagtttggatttcagacccttgtt

SEQ ID NO: 434318 - DNA, 25 bp, Mus musculus
gaagtttgggaactggccctagcta

SEQ ID NO: 434319 - DNA, 25 bp, Mus musculus
gaagtttgggaagtggccctagcta

SEQ ID NO: 434320 - DNA, 25 bp, Mus musculus
gaagtttgggttagctttctgtgtt

SEQ ID NO: 434321 - DNA, 25 bp, Mus musculus
gaagtttgggtttgctttctgtgtt

SEQ ID NO: 434322 - DNA, 25 bp, Mus musculus
gaagtttggtgtattataccatcct

SEQ ID NO: 434323 - DNA, 25 bp, Mus musculus
gaagtttggtgttttataccatcct

SEQ ID NO: 434324 - DNA, 25 bp, Mus musculus
gaagtttgtaatcctatcccagagt

SEQ ID NO: 434325 - DNA, 25 bp, Mus musculus
gaagtttgtaatgctatcccagagt

SEQ ID NO: 434326 - DNA, 25 bp, Mus musculus
gaagtttgtattatcacctgccaat

SEQ ID NO: 434327 - DNA, 25 bp, Mus musculus
gaagtttgtattttcacctgccaat

SEQ ID NO: 434328 - DNA, 25 bp, Mus musculus
gaagtttgtcatacggaacattgta

SEQ ID NO: 434329 - DNA, 25 bp, Mus musculus
gaagtttgtcattcggaacattgta

SEQ ID NO: 434330 - DNA, 25 bp, Mus musculus
gaagtttgtcccaacagactgtccc

SEQ ID NO: 434331 - DNA, 25 bp, Mus musculus
gaagtttgtcccattgaagaccttg

SEQ ID NO: 434332 - DNA, 25 bp, Mus musculus
gaagtttgtccctacagactgtccc

SEQ ID NO: 434333 - DNA, 25 bp, Mus musculus
gaagtttgtccctttgaagaccttg

SEQ ID NO: 434334 - DNA, 25 bp, Mus musculus
gaagtttgtctaactgtaattgcta

SEQ ID NO: 434335 - DNA, 25 bp, Mus musculus
gaagtttgtctatctgtaattgcta

SEQ ID NO: 434336 - DNA, 25 bp, Mus musculus
gaagtttgtcttatttggtcagcac

SEQ ID NO: 434337 - DNA, 25 bp, Mus musculus
gaagtttgtcttttttggtcagcac

SEQ ID NO: 434338 - DNA, 25 bp, Mus musculus
gaagtttgtgaacatcctgatgtgc

SEQ ID NO: 434339 - DNA, 25 bp, Mus musculus
gaagtttgtgaagatcctgatgtgc

SEQ ID NO: 434340 - DNA, 25 bp, Mus musculus
gaagtttgtgagaaatgcttaccca

SEQ ID NO: 434341 - DNA, 25 bp, Mus musculus
gaagtttgtgagtaatgcttaccca

SEQ ID NO: 434342 - DNA, 25 bp, Mus musculus
gaagtttgtgcgatttttatgtgtt

SEQ ID NO: 434343 - DNA, 25 bp, Mus musculus
gaagtttgtgcgttttttatgtgtt

SEQ ID NO: 434344 - DNA, 25 bp, Mus musculus
gaagtttgtttacatttcccattag

SEQ ID NO: 434345 - DNA, 25 bp, Mus musculus
gaagtttgtttagatttcccattag

SEQ ID NO: 434346 - DNA, 25 bp, Mus musculus
gaagtttgttttatcttgtctctga

SEQ ID NO: 434347 - DNA, 25 bp, Mus musculus
gaagtttgttttctcgtgtgttcgt

SEQ ID NO: 434348 - DNA, 25 bp, Mus musculus
gaagtttgttttgtcgtgtgttcgt

SEQ ID NO: 434349 - DNA, 25 bp, Mus musculus
gaagtttgttttttcttgtctctga

SEQ ID NO: 434350 - DNA, 25 bp, Mus musculus
gaagttttacagatggagcccgaca

SEQ ID NO: 434351 - DNA, 25 bp, Mus musculus
gaagttttacagttggagcccgaca

SEQ ID NO: 434352 - DNA, 25 bp, Mus musculus
gaagttttaccaagcagtggctgct

SEQ ID NO: 434353 - DNA, 25 bp, Mus musculus
gaagttttaccatgcagtggctgct

SEQ ID NO: 434354 - DNA, 25 bp, Mus musculus
gaagttttaccgattctcagacacg

SEQ ID NO: 434355 - DNA, 25 bp, Mus musculus
gaagttttaccgtttctcagacacg

SEQ ID NO: 434356 - DNA, 25 bp, Mus musculus
gaagttttactcattgacagcagca

SEQ ID NO: 434357 - DNA, 25 bp, Mus musculus
gaagttttactctttgacagcagca

SEQ ID NO: 434358 - DNA, 25 bp, Mus musculus
gaagttttagtgactcagaggcaag

SEQ ID NO: 434359 - DNA, 25 bp, Mus musculus
gaagttttagtgtctcagaggcaag

SEQ ID NO: 434360 - DNA, 25 bp, Mus musculus
gaagttttatcacagtcaggcctaa

SEQ ID NO: 434361 - DNA, 25 bp, Mus musculus
gaagttttatcagagtcaggcctaa

SEQ ID NO: 434362 - DNA, 25 bp, Mus musculus
gaagttttatctacagtctggaagc

SEQ ID NO: 434363 - DNA, 25 bp, Mus musculus
gaagttttatcttcagtctggaagc

SEQ ID NO: 434364 - DNA, 25 bp, Mus musculus
gaagttttatgtctttcaggtttat

SEQ ID NO: 434365 - DNA, 25 bp, Mus musculus
gaagttttatgtgtttcaggtttat

SEQ ID NO: 434366 - DNA, 25 bp, Mus musculus
gaagttttcaaaagctgctgtcaca

SEQ ID NO: 434367 - DNA, 25 bp, Mus musculus
gaagttttcaaatgctgctgtcaca

SEQ ID NO: 434368 - DNA, 25 bp, Mus musculus
gaagttttcacaaacctggaagtag

SEQ ID NO: 434369 - DNA, 25 bp, Mus musculus
gaagttttcacaaagcagggtaatc

SEQ ID NO: 434370 - DNA, 25 bp, Mus musculus
gaagttttcacatacctggaagtag

SEQ ID NO: 434371 - DNA, 25 bp, Mus musculus
gaagttttcacatagcagggtaatc

SEQ ID NO: 434372 - DNA, 25 bp, Mus musculus
gaagttttcacgcagaagctagagg

SEQ ID NO: 434373 - DNA, 25 bp, Mus musculus
gaagttttcacggagaagctagagg

SEQ ID NO: 434374 - DNA, 25 bp, Mus musculus
gaagttttcagcagcacgcttgaaa

SEQ ID NO: 434375 - DNA, 25 bp, Mus musculus
gaagttttcagctgcacgcttgaaa

SEQ ID NO: 434376 - DNA, 25 bp, Mus musculus
gaagttttcatcacccctaatgtaa

SEQ ID NO: 434377 - DNA, 25 bp, Mus musculus
gaagttttcatctcccctaatgtaa

SEQ ID NO: 434378 - DNA, 25 bp, Mus musculus
gaagttttcattaactctagatcac

SEQ ID NO: 434379 - DNA, 25 bp, Mus musculus
gaagttttcatttactctagatcac

SEQ ID NO: 434380 - DNA, 25 bp, Mus musculus
gaagttttccagactcacgttgttg

SEQ ID NO: 434381 - DNA, 25 bp, Mus musculus
gaagttttccagaggcatcacatgt

SEQ ID NO: 434382 - DNA, 25 bp, Mus musculus
gaagttttccagtctcacgttgttg

SEQ ID NO: 434383 - DNA, 25 bp, Mus musculus
gaagttttccagtggcatcacatgt

SEQ ID NO: 434384 - DNA, 25 bp, Mus musculus
gaagttttccttcagcaccatgact

SEQ ID NO: 434385 - DNA, 25 bp, Mus musculus
gaagttttccttgagcaccatgact

SEQ ID NO: 434386 - DNA, 25 bp, Mus musculus
gaagttttctcaatttccagactat

SEQ ID NO: 434387 - DNA, 25 bp, Mus musculus
gaagttttctcattttccagactat

SEQ ID NO: 434388 - DNA, 25 bp, Mus musculus
gaagttttctgtatcacatcttgtt

SEQ ID NO: 434389 - DNA, 25 bp, Mus musculus
gaagttttctgtttcacatcttgtt

SEQ ID NO: 434390 - DNA, 25 bp, Mus musculus
gaagttttgaaaatctccccgatga

SEQ ID NO: 434391 - DNA, 25 bp, Mus musculus
gaagttttgaaattctccccgatga

SEQ ID NO: 434392 - DNA, 25 bp, Mus musculus
gaagttttgaacactggcttgtgca

SEQ ID NO: 434393 - DNA, 25 bp, Mus musculus
gaagttttgaactctggcttgtgca

SEQ ID NO: 434394 - DNA, 25 bp, Mus musculus
gaagttttgccaagtctgctggcat

SEQ ID NO: 434395 - DNA, 25 bp, Mus musculus
gaagttttgccatgtctgctggcat

SEQ ID NO: 434396 - DNA, 25 bp, Mus musculus
gaagttttgctgataatgccagaac

SEQ ID NO: 434397 - DNA, 25 bp, Mus musculus
gaagttttgctgttaatgccagaac

SEQ ID NO: 434398 - DNA, 25 bp, Mus musculus
gaagttttgtcaatttttgcccagt

SEQ ID NO: 434399 - DNA, 25 bp, Mus musculus
gaagttttgtcattttttgcccagt

SEQ ID NO: 434400 - DNA, 25 bp, Mus musculus
gaagttttgtgcagttttgttcata

SEQ ID NO: 434401 - DNA, 25 bp, Mus musculus
gaagttttgtgctgttttgttcata

SEQ ID NO: 434402 - DNA, 25 bp, Mus musculus
gaagtttttaccaaatcattatttg

SEQ ID NO: 434403 - DNA, 25 bp, Mus musculus
gaagtttttacctaatcattatttg

SEQ ID NO: 434404 - DNA, 25 bp, Mus musculus
gaagtttttagtcgattttttgcat

SEQ ID NO: 434405 - DNA, 25 bp, Mus musculus
gaagtttttagtggattttttgcat

SEQ ID NO: 434406 - DNA, 25 bp, Mus musculus
gaagtttttatcactgtgtgttaca

SEQ ID NO: 434407 - DNA, 25 bp, Mus musculus
gaagtttttatctctgtgtgttaca

SEQ ID NO: 434408 - DNA, 25 bp, Mus musculus
gaagtttttatgatctcccaacctg

SEQ ID NO: 434409 - DNA, 25 bp, Mus musculus
gaagtttttatgttctcccaacctg

SEQ ID NO: 434410 - DNA, 25 bp, Mus musculus
gaagtttttccacctcaaactacac

SEQ ID NO: 434411 - DNA, 25 bp, Mus musculus
gaagtttttccagctcaaactacac

SEQ ID NO: 434412 - DNA, 25 bp, Mus musculus
gaagtttttcttagtgagctcacag

SEQ ID NO: 434413 - DNA, 25 bp, Mus musculus
gaagtttttctttgtgagctcacag

SEQ ID NO: 434414 - DNA, 25 bp, Mus musculus
gaagtttttgccatgccaagtctaa

SEQ ID NO: 434415 - DNA, 25 bp, Mus musculus
gaagtttttgccttgccaagtctaa

SEQ ID NO: 434416 - DNA, 25 bp, Mus musculus
gaagtttttgtacaggcagatgctc

SEQ ID NO: 434417 - DNA, 25 bp, Mus musculus
gaagtttttgtagaggcagatgctc

SEQ ID NO: 434418 - DNA, 25 bp, Mus musculus
gaagttttttgtctcttggtccaca

SEQ ID NO: 434419 - DNA, 25 bp, Mus musculus
gaagttttttgtgtcttggtccaca

SEQ ID NO: 434420 - DNA, 25 bp, Mus musculus
gaataaaaaccacatagcatagaga

SEQ ID NO: 434421 - DNA, 25 bp, Mus musculus
gaataaaaaccagatagcatagaga

SEQ ID NO: 434422 - DNA, 25 bp, Mus musculus
gaataaaacagtactcacggagatt

SEQ ID NO: 434423 - DNA, 25 bp, Mus musculus
gaataaaacagttctcacggagatt

SEQ ID NO: 434424 - DNA, 25 bp, Mus musculus
gaataaaaccgcaccggtacaagcg

SEQ ID NO: 434425 - DNA, 25 bp, Mus musculus
gaataaaaccgctccggtacaagcg

SEQ ID NO: 434426 - DNA, 25 bp, Mus musculus
gaataaaaccttcattgttctctca

SEQ ID NO: 434427 - DNA, 25 bp, Mus musculus
gaataaaaccttgattgttctctca

SEQ ID NO: 434428 - DNA, 25 bp, Mus musculus
gaataaaagaacatatcaccagcac

SEQ ID NO: 434429 - DNA, 25 bp, Mus musculus
gaataaaagaacttatcaccagcac

SEQ ID NO: 434430 - DNA, 25 bp, Mus musculus
gaataaaataacatgtcatgtgatg

SEQ ID NO: 434431 - DNA, 25 bp, Mus musculus
gaataaaataacttgtcatgtgatg

SEQ ID NO: 434432 - DNA, 25 bp, Mus musculus
gaataaaatcttcactgaccctaga

SEQ ID NO: 434433 - DNA, 25 bp, Mus musculus
gaataaaatcttgactgaccctaga

SEQ ID NO: 434434 - DNA, 25 bp, Mus musculus
gaataaaattgcatggactttgaaa

SEQ ID NO: 434435 - DNA, 25 bp, Mus musculus
gaataaaattgcttggactttgaaa

SEQ ID NO: 434436 - DNA, 25 bp, Mus musculus
gaataaacaaatcggctgggcactg

SEQ ID NO: 434437 - DNA, 25 bp, Mus musculus
gaataaacaaatgggctgggcactg

SEQ ID NO: 434438 - DNA, 25 bp, Mus musculus
gaataaacactacgcatcaaaaata

SEQ ID NO: 434439 - DNA, 25 bp, Mus musculus
gaataaacactaggcatcaaaaata

SEQ ID NO: 434440 - DNA, 25 bp, Mus musculus
gaataaacagttactcagaggcagg

SEQ ID NO: 434441 - DNA, 25 bp, Mus musculus
gaataaacagtttctcagaggcagg

SEQ ID NO: 434442 - DNA, 25 bp, Mus musculus
gaataaaccactctaccacctagag

SEQ ID NO: 434443 - DNA, 25 bp, Mus musculus
gaataaaccactgtaccacctagag

SEQ ID NO: 434444 - DNA, 25 bp, Mus musculus
gaataaaccatgattccttctaggt

SEQ ID NO: 434445 - DNA, 25 bp, Mus musculus
gaataaaccatgtttccttctaggt

SEQ ID NO: 434446 - DNA, 25 bp, Mus musculus
gaataaacccaaagagccgcccaag

SEQ ID NO: 434447 - DNA, 25 bp, Mus musculus
gaataaacccaatgagccgcccaag

SEQ ID NO: 434448 - DNA, 25 bp, Mus musculus
gaataaaccgctatgcagacttttc

SEQ ID NO: 434449 - DNA, 25 bp, Mus musculus
gaataaaccgctttgcagacttttc

SEQ ID NO: 434450 - DNA, 25 bp, Mus musculus
gaataaacctttagcatgtactgga

SEQ ID NO: 434451 - DNA, 25 bp, Mus musculus
gaataaaccttttgcatgtactgga

SEQ ID NO: 434452 - DNA, 25 bp, Mus musculus
gaataaacgtttagcacatacatgt

SEQ ID NO: 434453 - DNA, 25 bp, Mus musculus
gaataaacgttttgcacatacatgt

SEQ ID NO: 434454 - DNA, 25 bp, Mus musculus
gaataaactctgaataatgtcatca

SEQ ID NO: 434455 - DNA, 25 bp, Mus musculus
gaataaactctgtataatgtcatca

SEQ ID NO: 434456 - DNA, 25 bp, Mus musculus
gaataaactggcatgtctgctctgc

SEQ ID NO: 434457 - DNA, 25 bp, Mus musculus
gaataaactggcttgtctgctctgc

SEQ ID NO: 434458 - DNA, 25 bp, Mus musculus
gaataaacttgccaccgccacgtgt

SEQ ID NO: 434459 - DNA, 25 bp, Mus musculus
gaataaacttgcgaccgccacgtgt

SEQ ID NO: 434460 - DNA, 25 bp, Mus musculus
gaataaagacctcacagccaacaca

SEQ ID NO: 434461 - DNA, 25 bp, Mus musculus
gaataaagacctcgcacagctctcc

SEQ ID NO: 434462 - DNA, 25 bp, Mus musculus
gaataaagacctgacagccaacaca

SEQ ID NO: 434463 - DNA, 25 bp, Mus musculus
gaataaagacctggcacagctctcc

SEQ ID NO: 434464 - DNA, 25 bp, Mus musculus
gaataaagacggctcaccccgggag

SEQ ID NO: 434465 - DNA, 25 bp, Mus musculus
gaataaagacgggtcaccccgggag

SEQ ID NO: 434466 - DNA, 25 bp, Mus musculus
gaataaagagctccctctacatcca

SEQ ID NO: 434467 - DNA, 25 bp, Mus musculus
gaataaagagctgcctctacatcca

SEQ ID NO: 434468 - DNA, 25 bp, Mus musculus
gaataaagcaccctaatcgtccctg

SEQ ID NO: 434469 - DNA, 25 bp, Mus musculus
gaataaagcaccgtaatcgtccctg

SEQ ID NO: 434470 - DNA, 25 bp, Mus musculus
gaataaagccccagattttccagaa

SEQ ID NO: 434471 - DNA, 25 bp, Mus musculus
gaataaagcccctgattttccagaa

SEQ ID NO: 434472 - DNA, 25 bp, Mus musculus
gaataaagctcccatcaggcctaga

SEQ ID NO: 434473 - DNA, 25 bp, Mus musculus
gaataaagctccgatcaggcctaga

SEQ ID NO: 434474 - DNA, 25 bp, Mus musculus
gaataaagtgtgactcaggctggta

SEQ ID NO: 434475 - DNA, 25 bp, Mus musculus
gaataaagtgtgtctcaggctggta

SEQ ID NO: 434476 - DNA, 25 bp, Mus musculus
gaataaagttggatttgcctctggg

SEQ ID NO: 434477 - DNA, 25 bp, Mus musculus
gaataaagttggttttgcctctggg

SEQ ID NO: 434478 - DNA, 25 bp, Mus musculus
gaataaatccaaactatcaataata

SEQ ID NO: 434479 - DNA, 25 bp, Mus musculus
gaataaatccaatctatcaataata

SEQ ID NO: 434480 - DNA, 25 bp, Mus musculus
gaataaatccatacactgcatgtgc

SEQ ID NO: 434481 - DNA, 25 bp, Mus musculus
gaataaatccattcactgcatgtgc

SEQ ID NO: 434482 - DNA, 25 bp, Mus musculus
gaataaatcccgcatgtgaaagttt

SEQ ID NO: 434483 - DNA, 25 bp, Mus musculus
gaataaatcccggatgtgaaagttt

SEQ ID NO: 434484 - DNA, 25 bp, Mus musculus
gaataaatcctcagtacctccaaga

SEQ ID NO: 434485 - DNA, 25 bp, Mus musculus
gaataaatcctctgtacctccaaga

SEQ ID NO: 434486 - DNA, 25 bp, Mus musculus
gaataaatgctccagggctccacaa

SEQ ID NO: 434487 - DNA, 25 bp, Mus musculus
gaataaatgctcgagggctccacaa

SEQ ID NO: 434488 - DNA, 25 bp, Mus musculus
gaataaatggctctttctcacctta

SEQ ID NO: 434489 - DNA, 25 bp, Mus musculus
gaataaatggctgtttctcacctta

SEQ ID NO: 434490 - DNA, 25 bp, Mus musculus
gaataaatttcacctgccttttggg

SEQ ID NO: 434491 - DNA, 25 bp, Mus musculus
gaataaatttcagctgccttttggg

SEQ ID NO: 434492 - DNA, 25 bp, Mus musculus
gaataacaatgactggggctctgtg

SEQ ID NO: 434493 - DNA, 25 bp, Mus musculus
gaataacaatgagtggggctctgtg

SEQ ID NO: 434494 - DNA, 25 bp, Mus musculus
gaataacacacaatctaaagactag

SEQ ID NO: 434495 - DNA, 25 bp, Mus musculus
gaataacacacattctaaagactag

SEQ ID NO: 434496 - DNA, 25 bp, Mus musculus
gaataacacctgcactgagccatcc

SEQ ID NO: 434497 - DNA, 25 bp, Mus musculus
gaataacacctggactgagccatcc

SEQ ID NO: 434498 - DNA, 25 bp, Mus musculus
gaataacacgttatcggcccatctc

SEQ ID NO: 434499 - DNA, 25 bp, Mus musculus
gaataacacgttttcggcccatctc

SEQ ID NO: 434500 - DNA, 25 bp, Mus musculus
gaataacagaacaggcatctctcct

SEQ ID NO: 434501 - DNA, 25 bp, Mus musculus
gaataacagaactggcatctctcct

SEQ ID NO: 434502 - DNA, 25 bp, Mus musculus
gaataacagctcatgctctcatgga

SEQ ID NO: 434503 - DNA, 25 bp, Mus musculus
gaataacagctcttgctctcatgga

SEQ ID NO: 434504 - DNA, 25 bp, Mus musculus
gaataacagtcaaggtttcgtcaat

SEQ ID NO: 434505 - DNA, 25 bp, Mus musculus
gaataacagtcatggtttcgtcaat

SEQ ID NO: 434506 - DNA, 25 bp, Mus musculus
gaataacatattcgcccagttccgg

SEQ ID NO: 434507 - DNA, 25 bp, Mus musculus
gaataacatattggcccagttccgg

SEQ ID NO: 434508 - DNA, 25 bp, Mus musculus
gaataacattaactcccctaccagc

SEQ ID NO: 434509 - DNA, 25 bp, Mus musculus
gaataacattaagtcccctaccagc

SEQ ID NO: 434510 - DNA, 25 bp, Mus musculus
gaataacattctaaattgagctgag

SEQ ID NO: 434511 - DNA, 25 bp, Mus musculus
gaataacattcttaattgagctgag

SEQ ID NO: 434512 - DNA, 25 bp, Mus musculus
gaataaccaacacacaggcccgatg

SEQ ID NO: 434513 - DNA, 25 bp, Mus musculus
gaataaccaacagacaggcccgatg

SEQ ID NO: 434514 - DNA, 25 bp, Mus musculus
gaataaccacacagtactataccag

SEQ ID NO: 434515 - DNA, 25 bp, Mus musculus
gaataaccacactgtactataccag

SEQ ID NO: 434516 - DNA, 25 bp, Mus musculus
gaataaccacggctcaaagattgag

SEQ ID NO: 434517 - DNA, 25 bp, Mus musculus
gaataaccacgggtcaaagattgag

SEQ ID NO: 434518 - DNA, 25 bp, Mus musculus
gaataaccagaccttgtacttgttt

SEQ ID NO: 434519 - DNA, 25 bp, Mus musculus
gaataaccagacgttgtacttgttt

SEQ ID NO: 434520 - DNA, 25 bp, Mus musculus
gaataaccagtgacccacgctcatt

SEQ ID NO: 434521 - DNA, 25 bp, Mus musculus
gaataaccagtgtcccacgctcatt

SEQ ID NO: 434522 - DNA, 25 bp, Mus musculus
gaataacccaacaagtggcccaaga

SEQ ID NO: 434523 - DNA, 25 bp, Mus musculus
gaataacccaactagtggcccaaga

SEQ ID NO: 434524 - DNA, 25 bp, Mus musculus
gaataacccagacctgctgttagga

SEQ ID NO: 434525 - DNA, 25 bp, Mus musculus
gaataacccagagctgctgttagga

SEQ ID NO: 434526 - DNA, 25 bp, Mus musculus
gaataacccagtcagggctctgatc

SEQ ID NO: 434527 - DNA, 25 bp, Mus musculus
gaataacccagtgagggctctgatc

SEQ ID NO: 434528 - DNA, 25 bp, Mus musculus
gaataacccctgctagttaatcata

SEQ ID NO: 434529 - DNA, 25 bp, Mus musculus
gaataacccctgcttattagtttgg

SEQ ID NO: 434530 - DNA, 25 bp, Mus musculus
gaataacccctggtagttaatcata

SEQ ID NO: 434531 - DNA, 25 bp, Mus musculus
gaataacccctggttattagtttgg

SEQ ID NO: 434532 - DNA, 25 bp, Mus musculus
gaataaccctgcactttagaagaca

SEQ ID NO: 434533 - DNA, 25 bp, Mus musculus
gaataaccctgccactgaaagattt

SEQ ID NO: 434534 - DNA, 25 bp, Mus musculus
gaataaccctgcgactgaaagattt

SEQ ID NO: 434535 - DNA, 25 bp, Mus musculus
gaataaccctgctctttagaagaca

SEQ ID NO: 434536 - DNA, 25 bp, Mus musculus
gaataaccctttagatttgtggcat

SEQ ID NO: 434537 - DNA, 25 bp, Mus musculus
gaataacccttttgatttgtggcat

SEQ ID NO: 434538 - DNA, 25 bp, Mus musculus
gaataaccgagtcatcgtgagtagt

SEQ ID NO: 434539 - DNA, 25 bp, Mus musculus
gaataaccgagtgatcgtgagtagt

SEQ ID NO: 434540 - DNA, 25 bp, Mus musculus
gaataacctcacagtttcttttcat

SEQ ID NO: 434541 - DNA, 25 bp, Mus musculus
gaataacctcactgtttcttttcat

SEQ ID NO: 434542 - DNA, 25 bp, Mus musculus
gaataacctctcattataggcccag

SEQ ID NO: 434543 - DNA, 25 bp, Mus musculus
gaataacctctctttataggcccag

SEQ ID NO: 434544 - DNA, 25 bp, Mus musculus
gaataacctgcaatatagctggaat

SEQ ID NO: 434545 - DNA, 25 bp, Mus musculus
gaataacctgcattatagctggaat

SEQ ID NO: 434546 - DNA, 25 bp, Mus musculus
gaataaccttcgattgcactgagaa

SEQ ID NO: 434547 - DNA, 25 bp, Mus musculus
gaataaccttcgtttgcactgagaa

SEQ ID NO: 434548 - DNA, 25 bp, Mus musculus
gaataacctttaaccctttcaagct

SEQ ID NO: 434549 - DNA, 25 bp, Mus musculus
gaataacctttatccctttcaagct

SEQ ID NO: 434550 - DNA, 25 bp, Mus musculus
gaataacggacaaagtagccacatt

SEQ ID NO: 434551 - DNA, 25 bp, Mus musculus
gaataacggacatagtagccacatt

SEQ ID NO: 434552 - DNA, 25 bp, Mus musculus
gaataacggtgactcactgcccagc

SEQ ID NO: 434553 - DNA, 25 bp, Mus musculus
gaataacggtgagtcactgcccagc

SEQ ID NO: 434554 - DNA, 25 bp, Mus musculus
gaataacggttccaattgcctctga

SEQ ID NO: 434555 - DNA, 25 bp, Mus musculus
gaataacggttcgaattgcctctga

SEQ ID NO: 434556 - DNA, 25 bp, Mus musculus
gaataacgttttctgttactcctga

SEQ ID NO: 434557 - DNA, 25 bp, Mus musculus
gaataacgttttgtgttactcctga

SEQ ID NO: 434558 - DNA, 25 bp, Mus musculus
gaataactaagtcactccctcagcc

SEQ ID NO: 434559 - DNA, 25 bp, Mus musculus
gaataactaagtgactccctcagcc

SEQ ID NO: 434560 - DNA, 25 bp, Mus musculus
gaataactcatgcagcctgtgctgt

SEQ ID NO: 434561 - DNA, 25 bp, Mus musculus
gaataactcatggagcctgtgctgt

SEQ ID NO: 434562 - DNA, 25 bp, Mus musculus
gaataactccagagcactgtggtgt

SEQ ID NO: 434563 - DNA, 25 bp, Mus musculus
gaataactccagtgcactgtggtgt

SEQ ID NO: 434564 - DNA, 25 bp, Mus musculus
gaataactccttcacatatccatat

SEQ ID NO: 434565 - DNA, 25 bp, Mus musculus
gaataactccttgacatatccatat

SEQ ID NO: 434566 - DNA, 25 bp, Mus musculus
gaataactctctctacatgtctgta

SEQ ID NO: 434567 - DNA, 25 bp, Mus musculus
gaataactctctgtacatgtctgta

SEQ ID NO: 434568 - DNA, 25 bp, Mus musculus
gaataactgcaacgccgaagtgtgg

SEQ ID NO: 434569 - DNA, 25 bp, Mus musculus
gaataactgcaaggccgaagtgtgg

SEQ ID NO: 434570 - DNA, 25 bp, Mus musculus
gaataactgcccctcatcaaaacaa

SEQ ID NO: 434571 - DNA, 25 bp, Mus musculus
gaataactgcccgtcatcaaaacaa

SEQ ID NO: 434572 - DNA, 25 bp, Mus musculus
gaataactgtgcaggaatgtaaaac

SEQ ID NO: 434573 - DNA, 25 bp, Mus musculus
gaataactgtgctggaatgtaaaac

SEQ ID NO: 434574 - DNA, 25 bp, Mus musculus
gaataacttccacctgcttttgtga

SEQ ID NO: 434575 - DNA, 25 bp, Mus musculus
gaataacttccagctgcttttgtga

SEQ ID NO: 434576 - DNA, 25 bp, Mus musculus
gaataacttctcagtgggcttgact

SEQ ID NO: 434577 - DNA, 25 bp, Mus musculus
gaataacttctctgtgggcttgact

SEQ ID NO: 434578 - DNA, 25 bp, Mus musculus
gaataacttgacatgcgttgatctt

SEQ ID NO: 434579 - DNA, 25 bp, Mus musculus
gaataacttgacttgcgttgatctt

SEQ ID NO: 434580 - DNA, 25 bp, Mus musculus
gaataacttggcctagttcatgtaa

SEQ ID NO: 434581 - DNA, 25 bp, Mus musculus
gaataacttggcgtagttcatgtaa

SEQ ID NO: 434582 - DNA, 25 bp, Mus musculus
gaataacttggtcactttatgaagg

SEQ ID NO: 434583 - DNA, 25 bp, Mus musculus
gaataacttggtgactttatgaagg

SEQ ID NO: 434584 - DNA, 25 bp, Mus musculus
gaataacttttcatactcctttcct

SEQ ID NO: 434585 - DNA, 25 bp, Mus musculus
gaataacttttcttactcctttcct

SEQ ID NO: 434586 - DNA, 25 bp, Mus musculus
gaataagaaagtcaagccccgctac

SEQ ID NO: 434587 - DNA, 25 bp, Mus musculus
gaataagaaagtgaagccccgctac

SEQ ID NO: 434588 - DNA, 25 bp, Mus musculus
gaataagaaccgacaggagcctcct

SEQ ID NO: 434589 - DNA, 25 bp, Mus musculus
gaataagaaccgtcaggagcctcct

SEQ ID NO: 434590 - DNA, 25 bp, Mus musculus
gaataagaacctagctgttgttaaa

SEQ ID NO: 434591 - DNA, 25 bp, Mus musculus
gaataagaaccttgctgttgttaaa

SEQ ID NO: 434592 - DNA, 25 bp, Mus musculus
gaataagaagccactctatcaaggg

SEQ ID NO: 434593 - DNA, 25 bp, Mus musculus
gaataagaagccctggaccacccaa

SEQ ID NO: 434594 - DNA, 25 bp, Mus musculus
gaataagaagccgtggaccacccaa

SEQ ID NO: 434595 - DNA, 25 bp, Mus musculus
gaataagaagcctctctatcaaggg

SEQ ID NO: 434596 - DNA, 25 bp, Mus musculus
gaataagacacactcagcgcaggcc

SEQ ID NO: 434597 - DNA, 25 bp, Mus musculus
gaataagacacagtcagcgcaggcc

SEQ ID NO: 434598 - DNA, 25 bp, Mus musculus
gaataagactcaactacaccgtcct

SEQ ID NO: 434599 - DNA, 25 bp, Mus musculus
gaataagactcatctacaccgtcct

SEQ ID NO: 434600 - DNA, 25 bp, Mus musculus
gaataagacttaacttggtggtgac

SEQ ID NO: 434601 - DNA, 25 bp, Mus musculus
gaataagacttatcttggtggtgac

SEQ ID NO: 434602 - DNA, 25 bp, Mus musculus
gaataagatgccaggcttcctctgt

SEQ ID NO: 434603 - DNA, 25 bp, Mus musculus
gaataagatgcctggcttcctctgt

SEQ ID NO: 434604 - DNA, 25 bp, Mus musculus
gaataagattccatcctatagggaa

SEQ ID NO: 434605 - DNA, 25 bp, Mus musculus
gaataagattccttcctatagggaa

SEQ ID NO: 434606 - DNA, 25 bp, Mus musculus
gaataagattttcagcagcgtccag

SEQ ID NO: 434607 - DNA, 25 bp, Mus musculus
gaataagattttgagcagcgtccag

SEQ ID NO: 434608 - DNA, 25 bp, Mus musculus
gaataagcaactagcagcaacttgc

SEQ ID NO: 434609 - DNA, 25 bp, Mus musculus
gaataagcaacttgcagcaacttgc

SEQ ID NO: 434610 - DNA, 25 bp, Mus musculus
gaataagcaatgattatctcctctt

SEQ ID NO: 434611 - DNA, 25 bp, Mus musculus
gaataagcaatgtttatctcctctt

SEQ ID NO: 434612 - DNA, 25 bp, Mus musculus
gaataagcaattctcccttccagat

SEQ ID NO: 434613 - DNA, 25 bp, Mus musculus
gaataagcaattgtcccttccagat

SEQ ID NO: 434614 - DNA, 25 bp, Mus musculus
gaataagcagcaatgtcaccacaga

SEQ ID NO: 434615 - DNA, 25 bp, Mus musculus
gaataagcagcattgtcaccacaga

SEQ ID NO: 434616 - DNA, 25 bp, Mus musculus
gaataagcagggagtccctctcatg

SEQ ID NO: 434617 - DNA, 25 bp, Mus musculus
gaataagcagggtgtccctctcatg

SEQ ID NO: 434618 - DNA, 25 bp, Mus musculus
gaataagcagtcaccgtggtggttg

SEQ ID NO: 434619 - DNA, 25 bp, Mus musculus
gaataagcagtctccgtggtggttg

SEQ ID NO: 434620 - DNA, 25 bp, Mus musculus
gaataagcatttattcccctgcctt

SEQ ID NO: 434621 - DNA, 25 bp, Mus musculus
gaataagcattttttcccctgcctt

SEQ ID NO: 434622 - DNA, 25 bp, Mus musculus
gaataagccaggctgcacagattag

SEQ ID NO: 434623 - DNA, 25 bp, Mus musculus
gaataagccagggtgcacagattag

SEQ ID NO: 434624 - DNA, 25 bp, Mus musculus
gaataagccggaacacctgaccaag

SEQ ID NO: 434625 - DNA, 25 bp, Mus musculus
gaataagccggatcacctgaccaag

SEQ ID NO: 434626 - DNA, 25 bp, Mus musculus
gaataagcctgtaagcagcaccctg

SEQ ID NO: 434627 - DNA, 25 bp, Mus musculus
gaataagcctgtacagtgtctctag

SEQ ID NO: 434628 - DNA, 25 bp, Mus musculus
gaataagcctgttagcagcaccctg

SEQ ID NO: 434629 - DNA, 25 bp, Mus musculus
gaataagcctgttcagtgtctctag

SEQ ID NO: 434630 - DNA, 25 bp, Mus musculus
gaataagccttcaccatgtcagtat

SEQ ID NO: 434631 - DNA, 25 bp, Mus musculus
gaataagccttctccatgtcagtat

SEQ ID NO: 434632 - DNA, 25 bp, Mus musculus
gaataagccttgctcctatccagaa

SEQ ID NO: 434633 - DNA, 25 bp, Mus musculus
gaataagccttggtcctatccagaa

SEQ ID NO: 434634 - DNA, 25 bp, Mus musculus
gaataagctgctcttcttttacccc

SEQ ID NO: 434635 - DNA, 25 bp, Mus musculus
gaataagctgctgttcttttacccc

SEQ ID NO: 434636 - DNA, 25 bp, Mus musculus
gaataaggaatgagccataccgaat

SEQ ID NO: 434637 - DNA, 25 bp, Mus musculus
gaataaggaatgtgccataccgaat

SEQ ID NO: 434638 - DNA, 25 bp, Mus musculus
gaataaggtccaataaaggctgcag

SEQ ID NO: 434639 - DNA, 25 bp, Mus musculus
gaataaggtccattaaaggctgcag

SEQ ID NO: 434640 - DNA, 25 bp, Mus musculus
gaataaggtgatcccactctgacct

SEQ ID NO: 434641 - DNA, 25 bp, Mus musculus
gaataaggtgatgccactctgacct

SEQ ID NO: 434642 - DNA, 25 bp, Mus musculus
gaataaggtgttctccagcacataa

SEQ ID NO: 434643 - DNA, 25 bp, Mus musculus
gaataaggtgttgtccagcacataa

SEQ ID NO: 434644 - DNA, 25 bp, Mus musculus
gaataagtacctaaagcagggccct

SEQ ID NO: 434645 - DNA, 25 bp, Mus musculus
gaataagtaccttaagcagggccct

SEQ ID NO: 434646 - DNA, 25 bp, Mus musculus
gaataagtaggtatccaattggcta

SEQ ID NO: 434647 - DNA, 25 bp, Mus musculus
gaataagtaggtttccaattggcta

SEQ ID NO: 434648 - DNA, 25 bp, Mus musculus
gaataagtcaacacttgccctgttt

SEQ ID NO: 434649 - DNA, 25 bp, Mus musculus
gaataagtcaactcttgccctgttt

SEQ ID NO: 434650 - DNA, 25 bp, Mus musculus
gaataagtctagcttcctgatcatg

SEQ ID NO: 434651 - DNA, 25 bp, Mus musculus
gaataagtctaggttcctgatcatg

SEQ ID NO: 434652 - DNA, 25 bp, Mus musculus
gaataagtctccagtgtgtacatta

SEQ ID NO: 434653 - DNA, 25 bp, Mus musculus
gaataagtctcctgtgtgtacatta

SEQ ID NO: 434654 - DNA, 25 bp, Mus musculus
gaataagtgtttctccagtctgcca

SEQ ID NO: 434655 - DNA, 25 bp, Mus musculus
gaataagtgtttgtccagtctgcca

SEQ ID NO: 434656 - DNA, 25 bp, Mus musculus
gaataagttagtaccactctactat

SEQ ID NO: 434657 - DNA, 25 bp, Mus musculus
gaataagttagttccactctactat

SEQ ID NO: 434658 - DNA, 25 bp, Mus musculus
gaataagttgttagactgtaaccca

SEQ ID NO: 434659 - DNA, 25 bp, Mus musculus
gaataagttgtttgactgtaaccca

SEQ ID NO: 434660 - DNA, 25 bp, Mus musculus
gaataagtttgtaccctgaccacac

SEQ ID NO: 434661 - DNA, 25 bp, Mus musculus
gaataagtttgttccctgaccacac

SEQ ID NO: 434662 - DNA, 25 bp, Mus musculus
gaataagttttcatcataacccatt

SEQ ID NO: 434663 - DNA, 25 bp, Mus musculus
gaataagttttcttcataacccatt

SEQ ID NO: 434664 - DNA, 25 bp, Mus musculus
gaataataatctcccaaagtctcta

SEQ ID NO: 434665 - DNA, 25 bp, Mus musculus
gaataataatctgccaaagtctcta

SEQ ID NO: 434666 - DNA, 25 bp, Mus musculus
gaataataatgccacatcttgcctt

SEQ ID NO: 434667 - DNA, 25 bp, Mus musculus
gaataataatgcgacatcttgcctt

SEQ ID NO: 434668 - DNA, 25 bp, Mus musculus
gaataataatggagggcgcctcctt

SEQ ID NO: 434669 - DNA, 25 bp, Mus musculus
gaataataatggtgggcgcctcctt

SEQ ID NO: 434670 - DNA, 25 bp, Mus musculus
gaataatacatgactatgcactaaa

SEQ ID NO: 434671 - DNA, 25 bp, Mus musculus
gaataatacatgtctatgcactaaa

SEQ ID NO: 434672 - DNA, 25 bp, Mus musculus
gaataatacctgaaaatgggtggaa

SEQ ID NO: 434673 - DNA, 25 bp, Mus musculus
gaataatacctgtaaatgggtggaa

SEQ ID NO: 434674 - DNA, 25 bp, Mus musculus
gaataatattgtccccaccagaggg

SEQ ID NO: 434675 - DNA, 25 bp, Mus musculus
gaataatattgtgcccaccagaggg

SEQ ID NO: 434676 - DNA, 25 bp, Mus musculus
gaataatcatccaataatctagaga

SEQ ID NO: 434677 - DNA, 25 bp, Mus musculus
gaataatcatcctataatctagaga

SEQ ID NO: 434678 - DNA, 25 bp, Mus musculus
gaataatcattcctggcgctataga

SEQ ID NO: 434679 - DNA, 25 bp, Mus musculus
gaataatcattcgtggcgctataga

SEQ ID NO: 434680 - DNA, 25 bp, Mus musculus
gaataatcctatatgccgcatggca

SEQ ID NO: 434681 - DNA, 25 bp, Mus musculus
gaataatcctatttgccgcatggca

SEQ ID NO: 434682 - DNA, 25 bp, Mus musculus
gaataatctatgatcatctctgtgc

SEQ ID NO: 434683 - DNA, 25 bp, Mus musculus
gaataatctatgttcatctctgtgc

SEQ ID NO: 434684 - DNA, 25 bp, Mus musculus
gaataatctgctctgtaggtcggtt

SEQ ID NO: 434685 - DNA, 25 bp, Mus musculus
gaataatctgctgtgtaggtcggtt

SEQ ID NO: 434686 - DNA, 25 bp, Mus musculus
gaataatctgtccaagtacctccgt

SEQ ID NO: 434687 - DNA, 25 bp, Mus musculus
gaataatctgtcgaagtacctccgt

SEQ ID NO: 434688 - DNA, 25 bp, Mus musculus
gaataatctttcagtggctcttgct

SEQ ID NO: 434689 - DNA, 25 bp, Mus musculus
gaataatctttctgtggctcttgct

SEQ ID NO: 434690 - DNA, 25 bp, Mus musculus
gaataatgaagcaggacccctgccc

SEQ ID NO: 434691 - DNA, 25 bp, Mus musculus
gaataatgaagctggacccctgccc

SEQ ID NO: 434692 - DNA, 25 bp, Mus musculus
gaataatgatttagccaccttcctt

SEQ ID NO: 434693 - DNA, 25 bp, Mus musculus
gaataatgattttgccaccttcctt

SEQ ID NO: 434694 - DNA, 25 bp, Mus musculus
gaataatgcaaaccgcgctgagaac

SEQ ID NO: 434695 - DNA, 25 bp, Mus musculus
gaataatgcaaagcgcgctgagaac

SEQ ID NO: 434696 - DNA, 25 bp, Mus musculus
gaataatggacaacttgccctgagt

SEQ ID NO: 434697 - DNA, 25 bp, Mus musculus
gaataatggacatcttgccctgagt

SEQ ID NO: 434698 - DNA, 25 bp, Mus musculus
gaataatggtttccttttcaagcaa

SEQ ID NO: 434699 - DNA, 25 bp, Mus musculus
gaataatggtttgcttttcaagcaa

SEQ ID NO: 434700 - DNA, 25 bp, Mus musculus
gaataatgtcacaattggtctagta

SEQ ID NO: 434701 - DNA, 25 bp, Mus musculus
gaataatgtcacctgtacccgaaca

SEQ ID NO: 434702 - DNA, 25 bp, Mus musculus
gaataatgtcacgtgtacccgaaca

SEQ ID NO: 434703 - DNA, 25 bp, Mus musculus
gaataatgtcactattggtctagta

SEQ ID NO: 434704 - DNA, 25 bp, Mus musculus
gaataatgtcatagcctccaactga

SEQ ID NO: 434705 - DNA, 25 bp, Mus musculus
gaataatgtcattgcctccaactga

SEQ ID NO: 434706 - DNA, 25 bp, Mus musculus
gaataatgtcgcacatcttttctcc

SEQ ID NO: 434707 - DNA, 25 bp, Mus musculus
gaataatgtcgctcatcttttctcc

SEQ ID NO: 434708 - DNA, 25 bp, Mus musculus
gaataatgtttacaatttgcctcaa

SEQ ID NO: 434709 - DNA, 25 bp, Mus musculus
gaataatgtttagaatttgcctcaa

SEQ ID NO: 434710 - DNA, 25 bp, Mus musculus
gaataatgttttactctctatcata

SEQ ID NO: 434711 - DNA, 25 bp, Mus musculus
gaataatgttttccttctcatcaaa

SEQ ID NO: 434712 - DNA, 25 bp, Mus musculus
gaataatgttttgcttctcatcaaa

SEQ ID NO: 434713 - DNA, 25 bp, Mus musculus
gaataatgtttttctctctatcata

SEQ ID NO: 434714 - DNA, 25 bp, Mus musculus
gaataattagatatcttcttccctc

SEQ ID NO: 434715 - DNA, 25 bp, Mus musculus
gaataattagatttcttcttccctc

SEQ ID NO: 434716 - DNA, 25 bp, Mus musculus
gaataattattcactcctctgcact

SEQ ID NO: 434717 - DNA, 25 bp, Mus musculus
gaataattattctctcctctgcact

SEQ ID NO: 434718 - DNA, 25 bp, Mus musculus
gaataattatttctgcacagaactg

SEQ ID NO: 434719 - DNA, 25 bp, Mus musculus
gaataattatttgtgcacagaactg

SEQ ID NO: 434720 - DNA, 25 bp, Mus musculus
gaataattcataactccagttgaca

SEQ ID NO: 434721 - DNA, 25 bp, Mus musculus
gaataattcatatctccagttgaca

SEQ ID NO: 434722 - DNA, 25 bp, Mus musculus
gaataattctagcatccaacgcgtg

SEQ ID NO: 434723 - DNA, 25 bp, Mus musculus
gaataattctaggatccaacgcgtg

SEQ ID NO: 434724 - DNA, 25 bp, Mus musculus
gaataattcttaactgagccacatc

SEQ ID NO: 434725 - DNA, 25 bp, Mus musculus
gaataattcttatctgagccacatc

SEQ ID NO: 434726 - DNA, 25 bp, Mus musculus
gaataattgttgaatgcttaaccat

SEQ ID NO: 434727 - DNA, 25 bp, Mus musculus
gaataattgttgtatgcttaaccat

SEQ ID NO: 434728 - DNA, 25 bp, Mus musculus
gaataatttaagcatctaagcatag

SEQ ID NO: 434729 - DNA, 25 bp, Mus musculus
gaataatttaaggatctaagcatag

SEQ ID NO: 434730 - DNA, 25 bp, Mus musculus
gaataatttacacccacatacaaag

SEQ ID NO: 434731 - DNA, 25 bp, Mus musculus
gaataatttacagccacatacaaag

SEQ ID NO: 434732 - DNA, 25 bp, Mus musculus
gaataatttcttccatcccatcagg

SEQ ID NO: 434733 - DNA, 25 bp, Mus musculus
gaataatttcttgcatcccatcagg

SEQ ID NO: 434734 - DNA, 25 bp, Mus musculus
gaataatttgctagcatgggcacat

SEQ ID NO: 434735 - DNA, 25 bp, Mus musculus
gaataatttgcttgcatgggcacat

SEQ ID NO: 434736 - DNA, 25 bp, Mus musculus
gaatacaaacgcctgcacatactat

SEQ ID NO: 434737 - DNA, 25 bp, Mus musculus
gaatacaaacgcgtgcacatactat

SEQ ID NO: 434738 - DNA, 25 bp, Mus musculus
gaatacaaactgaagagcctcaagg

SEQ ID NO: 434739 - DNA, 25 bp, Mus musculus
gaatacaaactgtagagcctcaagg

SEQ ID NO: 434740 - DNA, 25 bp, Mus musculus
gaatacaaagcaaagtctcacaagg

SEQ ID NO: 434741 - DNA, 25 bp, Mus musculus
gaatacaaagcatagtctcacaagg

SEQ ID NO: 434742 - DNA, 25 bp, Mus musculus
gaatacaacacacacaatcctagaa

SEQ ID NO: 434743 - DNA, 25 bp, Mus musculus
gaatacaacacagacaatcctagaa

SEQ ID NO: 434744 - DNA, 25 bp, Mus musculus
gaatacaactctacctgtccatgat

SEQ ID NO: 434745 - DNA, 25 bp, Mus musculus
gaatacaactcttcctgtccatgat

SEQ ID NO: 434746 - DNA, 25 bp, Mus musculus
gaatacaactgcatacagcacttgg

SEQ ID NO: 434747 - DNA, 25 bp, Mus musculus
gaatacaactgcttacagcacttgg

SEQ ID NO: 434748 - DNA, 25 bp, Mus musculus
gaatacaacttaattccacagctga

SEQ ID NO: 434749 - DNA, 25 bp, Mus musculus
gaatacaacttatttccacagctga

SEQ ID NO: 434750 - DNA, 25 bp, Mus musculus
gaatacaagcatagcttcgggcaaa

SEQ ID NO: 434751 - DNA, 25 bp, Mus musculus
gaatacaagcattgcttcgggcaaa

SEQ ID NO: 434752 - DNA, 25 bp, Mus musculus
gaatacaagccacagacaatcccaa

SEQ ID NO: 434753 - DNA, 25 bp, Mus musculus
gaatacaagccagagacaatcccaa

SEQ ID NO: 434754 - DNA, 25 bp, Mus musculus
gaatacaaggagaccgtttccctgg

SEQ ID NO: 434755 - DNA, 25 bp, Mus musculus
gaatacaaggagtccgtttccctgg

SEQ ID NO: 434756 - DNA, 25 bp, Mus musculus
gaatacaaggttcaccctgagactt

SEQ ID NO: 434757 - DNA, 25 bp, Mus musculus
gaatacaaggttgaccctgagactt

SEQ ID NO: 434758 - DNA, 25 bp, Mus musculus
gaatacaatcctcgcgaggctcgct

SEQ ID NO: 434759 - DNA, 25 bp, Mus musculus
gaatacaatcctggcgaggctcgct

SEQ ID NO: 434760 - DNA, 25 bp, Mus musculus
gaatacaatgcactttcctcagtaa

SEQ ID NO: 434761 - DNA, 25 bp, Mus musculus
gaatacaatgcagtttcctcagtaa

SEQ ID NO: 434762 - DNA, 25 bp, Mus musculus
gaatacaatggcaaagacagtgcac

SEQ ID NO: 434763 - DNA, 25 bp, Mus musculus
gaatacaatggctaagacagtgcac

SEQ ID NO: 434764 - DNA, 25 bp, Mus musculus
gaatacacagctcttatgaatggga

SEQ ID NO: 434765 - DNA, 25 bp, Mus musculus
gaatacacagctgttatgaatggga

SEQ ID NO: 434766 - DNA, 25 bp, Mus musculus
gaatacacagtaaccagcctggaga

SEQ ID NO: 434767 - DNA, 25 bp, Mus musculus
gaatacacagtatccagcctggaga

SEQ ID NO: 434768 - DNA, 25 bp, Mus musculus
gaatacacagttcactttgagtccg

SEQ ID NO: 434769 - DNA, 25 bp, Mus musculus
gaatacacagttgactttgagtccg

SEQ ID NO: 434770 - DNA, 25 bp, Mus musculus
gaatacacccaaatacttcgtttga

SEQ ID NO: 434771 - DNA, 25 bp, Mus musculus
gaatacacccaattacttcgtttga

SEQ ID NO: 434772 - DNA, 25 bp, Mus musculus
gaatacaccctgaattaagagcaaa

SEQ ID NO: 434773 - DNA, 25 bp, Mus musculus
gaatacaccctgtattaagagcaaa

SEQ ID NO: 434774 - DNA, 25 bp, Mus musculus
gaatacaccttaaacacgctgagat

SEQ ID NO: 434775 - DNA, 25 bp, Mus musculus
gaatacaccttatacacgctgagat

SEQ ID NO: 434776 - DNA, 25 bp, Mus musculus
gaatacactatacgctcatagccat

SEQ ID NO: 434777 - DNA, 25 bp, Mus musculus
gaatacactataggctcatagccat

SEQ ID NO: 434778 - DNA, 25 bp, Mus musculus
gaatacactgatcacaatgcgctca

SEQ ID NO: 434779 - DNA, 25 bp, Mus musculus
gaatacactgatgacaatgcgctca

SEQ ID NO: 434780 - DNA, 25 bp, Mus musculus
gaatacactggacaccaaggccaag

SEQ ID NO: 434781 - DNA, 25 bp, Mus musculus
gaatacactggagaccaaggccaag

SEQ ID NO: 434782 - DNA, 25 bp, Mus musculus
gaatacacttccaatacttctgtaa

SEQ ID NO: 434783 - DNA, 25 bp, Mus musculus
gaatacacttcctatacttctgtaa

SEQ ID NO: 434784 - DNA, 25 bp, Mus musculus
gaatacagatccacagggtacctcc

SEQ ID NO: 434785 - DNA, 25 bp, Mus musculus
gaatacagatcctcagggtacctcc

SEQ ID NO: 434786 - DNA, 25 bp, Mus musculus
gaatacagatgcatgtttagacaca

SEQ ID NO: 434787 - DNA, 25 bp, Mus musculus
gaatacagatgcttgtttagacaca

SEQ ID NO: 434788 - DNA, 25 bp, Mus musculus
gaatacagcaagataaatacccagg

SEQ ID NO: 434789 - DNA, 25 bp, Mus musculus
gaatacagcaagttaaatacccagg

SEQ ID NO: 434790 - DNA, 25 bp, Mus musculus
gaatacagcagaagcgttcacatct

SEQ ID NO: 434791 - DNA, 25 bp, Mus musculus
gaatacagcagatgcgttcacatct

SEQ ID NO: 434792 - DNA, 25 bp, Mus musculus
gaatacagcaggaattagcacaact

SEQ ID NO: 434793 - DNA, 25 bp, Mus musculus
gaatacagcaggtattagcacaact

SEQ ID NO: 434794 - DNA, 25 bp, Mus musculus
gaatacagcataagttgatcctatt

SEQ ID NO: 434795 - DNA, 25 bp, Mus musculus
gaatacagcatatgttgatcctatt

SEQ ID NO: 434796 - DNA, 25 bp, Mus musculus
gaatacagccagactgccaaggatg

SEQ ID NO: 434797 - DNA, 25 bp, Mus musculus
gaatacagccagtctgccaaggatg

SEQ ID NO: 434798 - DNA, 25 bp, Mus musculus
gaatacagcctaaacatcggacaat

SEQ ID NO: 434799 - DNA, 25 bp, Mus musculus
gaatacagcctatacatcggacaat

SEQ ID NO: 434800 - DNA, 25 bp, Mus musculus
gaatacagcctcagttgaagatgca

SEQ ID NO: 434801 - DNA, 25 bp, Mus musculus
gaatacagcctctgttgaagatgca

SEQ ID NO: 434802 - DNA, 25 bp, Mus musculus
gaatacagcctgcttgtctacacac

SEQ ID NO: 434803 - DNA, 25 bp, Mus musculus
gaatacagcctggttgtctacacac

SEQ ID NO: 434804 - DNA, 25 bp, Mus musculus
gaatacagctgccacacctgttggc

SEQ ID NO: 434805 - DNA, 25 bp, Mus musculus
gaatacagctgcgacacctgttggc

SEQ ID NO: 434806 - DNA, 25 bp, Mus musculus
gaatacagcttcatgtacttgtaat

SEQ ID NO: 434807 - DNA, 25 bp, Mus musculus
gaatacagcttcttgtacttgtaat

SEQ ID NO: 434808 - DNA, 25 bp, Mus musculus
gaatacaggcgtaccttatgacggc

SEQ ID NO: 434809 - DNA, 25 bp, Mus musculus
gaatacaggcgttccttatgacggc

SEQ ID NO: 434810 - DNA, 25 bp, Mus musculus
gaatacagggacatctatgcacgcc

SEQ ID NO: 434811 - DNA, 25 bp, Mus musculus
gaatacagggacttctatgcacgcc

SEQ ID NO: 434812 - DNA, 25 bp, Mus musculus
gaatacagggcccaagctgaccaaa

SEQ ID NO: 434813 - DNA, 25 bp, Mus musculus
gaatacagggccgaagctgaccaaa

SEQ ID NO: 434814 - DNA, 25 bp, Mus musculus
gaatacaggtccaagttcttacaca

SEQ ID NO: 434815 - DNA, 25 bp, Mus musculus
gaatacaggtcctagttcttacaca

SEQ ID NO: 434816 - DNA, 25 bp, Mus musculus
gaatacaggttcatcttgtgcatcc

SEQ ID NO: 434817 - DNA, 25 bp, Mus musculus
gaatacaggttcttcttgtgcatcc

SEQ ID NO: 434818 - DNA, 25 bp, Mus musculus
gaatacagtcaaagctgtgggcaga

SEQ ID NO: 434819 - DNA, 25 bp, Mus musculus
gaatacagtcaatgctgtgggcaga

SEQ ID NO: 434820 - DNA, 25 bp, Mus musculus
gaatacagtgacagtgagcatggct

SEQ ID NO: 434821 - DNA, 25 bp, Mus musculus
gaatacagtgactgtgagcatggct

SEQ ID NO: 434822 - DNA, 25 bp, Mus musculus
gaatacagtgttcgcctcattgtca

SEQ ID NO: 434823 - DNA, 25 bp, Mus musculus
gaatacagtgttggcctcattgtca

SEQ ID NO: 434824 - DNA, 25 bp, Mus musculus
gaatacagtttcacacactgcagta

SEQ ID NO: 434825 - DNA, 25 bp, Mus musculus
gaatacagtttctcacactgcagta

SEQ ID NO: 434826 - DNA, 25 bp, Mus musculus
gaatacataagcacccttccctggc

SEQ ID NO: 434827 - DNA, 25 bp, Mus musculus
gaatacataagctcccttccctggc

SEQ ID NO: 434828 - DNA, 25 bp, Mus musculus
gaatacatacacacctcgtgaggct

SEQ ID NO: 434829 - DNA, 25 bp, Mus musculus
gaatacatacactcctcgtgaggct

SEQ ID NO: 434830 - DNA, 25 bp, Mus musculus
gaatacataccgcaagggctactat

SEQ ID NO: 434831 - DNA, 25 bp, Mus musculus
gaatacataccggaagggctactat

SEQ ID NO: 434832 - DNA, 25 bp, Mus musculus
gaatacatactcataaccacaacat

SEQ ID NO: 434833 - DNA, 25 bp, Mus musculus
gaatacatactcttaaccacaacat

SEQ ID NO: 434834 - DNA, 25 bp, Mus musculus
gaatacatagtcaaccactgagcca

SEQ ID NO: 434835 - DNA, 25 bp, Mus musculus
gaatacatagtctaccactgagcca

SEQ ID NO: 434836 - DNA, 25 bp, Mus musculus
gaatacatatagattgacagaatca

SEQ ID NO: 434837 - DNA, 25 bp, Mus musculus
gaatacatatagtttgacagaatca

SEQ ID NO: 434838 - DNA, 25 bp, Mus musculus
gaatacatatcaaagcagctttgga

SEQ ID NO: 434839 - DNA, 25 bp, Mus musculus
gaatacatatcatagcagctttgga

SEQ ID NO: 434840 - DNA, 25 bp, Mus musculus
gaatacatatggcttggcttccgct

SEQ ID NO: 434841 - DNA, 25 bp, Mus musculus
gaatacatatgggttggcttccgct

SEQ ID NO: 434842 - DNA, 25 bp, Mus musculus
gaatacatcaaacgctatgccagat

SEQ ID NO: 434843 - DNA, 25 bp, Mus musculus
gaatacatcaaaggctatgccagat

SEQ ID NO: 434844 - DNA, 25 bp, Mus musculus
gaatacatcacaatatcaagagttt

SEQ ID NO: 434845 - DNA, 25 bp, Mus musculus
gaatacatcacattatcaagagttt

SEQ ID NO: 434846 - DNA, 25 bp, Mus musculus
gaatacatcactcacctggaactga

SEQ ID NO: 434847 - DNA, 25 bp, Mus musculus
gaatacatcactgacctggaactga

SEQ ID NO: 434848 - DNA, 25 bp, Mus musculus
gaatacatgcaactcctacacgtgg

SEQ ID NO: 434849 - DNA, 25 bp, Mus musculus
gaatacatgcaagtcctacacgtgg

SEQ ID NO: 434850 - DNA, 25 bp, Mus musculus
gaatacatgcacattggtttcttat

SEQ ID NO: 434851 - DNA, 25 bp, Mus musculus
gaatacatgcactttggtttcttat

SEQ ID NO: 434852 - DNA, 25 bp, Mus musculus
gaatacattagtaaagctctgtctt

SEQ ID NO: 434853 - DNA, 25 bp, Mus musculus
gaatacattagttaagctctgtctt

SEQ ID NO: 434854 - DNA, 25 bp, Mus musculus
gaatacattccacgttgtccttaaa

SEQ ID NO: 434855 - DNA, 25 bp, Mus musculus
gaatacattccaggttgtccttaaa

SEQ ID NO: 434856 - DNA, 25 bp, Mus musculus
gaatacatttatagccaggcctgtg

SEQ ID NO: 434857 - DNA, 25 bp, Mus musculus
gaatacatttatccactggcatctt

SEQ ID NO: 434858 - DNA, 25 bp, Mus musculus
gaatacatttatgcactggcatctt

SEQ ID NO: 434859 - DNA, 25 bp, Mus musculus
gaatacatttattgccaggcctgtg

SEQ ID NO: 434860 - DNA, 25 bp, Mus musculus
gaatacatttccaacatagctgctt

SEQ ID NO: 434861 - DNA, 25 bp, Mus musculus
gaatacatttcctacatagctgctt

SEQ ID NO: 434862 - DNA, 25 bp, Mus musculus
gaatacatttgtcactgctcatgca

SEQ ID NO: 434863 - DNA, 25 bp, Mus musculus
gaatacatttgtgactgctcatgca

SEQ ID NO: 434864 - DNA, 25 bp, Mus musculus
gaatacattttccttctcctgtgaa

SEQ ID NO: 434865 - DNA, 25 bp, Mus musculus
gaatacattttcgttctcctgtgaa

SEQ ID NO: 434866 - DNA, 25 bp, Mus musculus
gaatacatttttccgggctggtgag

SEQ ID NO: 434867 - DNA, 25 bp, Mus musculus
gaatacatttttgcgggctggtgag

SEQ ID NO: 434868 - DNA, 25 bp, Mus musculus
gaataccaaaacacctggattcatt

SEQ ID NO: 434869 - DNA, 25 bp, Mus musculus
gaataccaaaactcctggattcatt

SEQ ID NO: 434870 - DNA, 25 bp, Mus musculus
gaataccaaaataacctcgtctact

SEQ ID NO: 434871 - DNA, 25 bp, Mus musculus
gaataccaaaattacctcgtctact

SEQ ID NO: 434872 - DNA, 25 bp, Mus musculus
gaataccaacagatctcaatttttt

SEQ ID NO: 434873 - DNA, 25 bp, Mus musculus
gaataccaacagttctcaatttttt

SEQ ID NO: 434874 - DNA, 25 bp, Mus musculus
gaataccaagatacagtgcatcctt

SEQ ID NO: 434875 - DNA, 25 bp, Mus musculus
gaataccaagattcagtgcatcctt

SEQ ID NO: 434876 - DNA, 25 bp, Mus musculus
gaataccaagttaaggcagccaaag

SEQ ID NO: 434877 - DNA, 25 bp, Mus musculus
gaataccaagtttaggcagccaaag

SEQ ID NO: 434878 - DNA, 25 bp, Mus musculus
gaataccaatagctcagattctaag

SEQ ID NO: 434879 - DNA, 25 bp, Mus musculus
gaataccaataggtcagattctaag

SEQ ID NO: 434880 - DNA, 25 bp, Mus musculus
gaataccacagaccagagcatctat

SEQ ID NO: 434881 - DNA, 25 bp, Mus musculus
gaataccacagagcagagcatctat

SEQ ID NO: 434882 - DNA, 25 bp, Mus musculus
gaataccaccaccttacgaggactt

SEQ ID NO: 434883 - DNA, 25 bp, Mus musculus
gaataccaccacgttacgaggactt

SEQ ID NO: 434884 - DNA, 25 bp, Mus musculus
gaataccacgttatcatttaaatag

SEQ ID NO: 434885 - DNA, 25 bp, Mus musculus
gaataccacgttttcatttaaatag

SEQ ID NO: 434886 - DNA, 25 bp, Mus musculus
gaataccagatgagttcctgctgcc

SEQ ID NO: 434887 - DNA, 25 bp, Mus musculus
gaataccagatgtgttcctgctgcc

SEQ ID NO: 434888 - DNA, 25 bp, Mus musculus
gaataccagcgcatgatctgatctt

SEQ ID NO: 434889 - DNA, 25 bp, Mus musculus
gaataccagcgcttgatctgatctt

SEQ ID NO: 434890 - DNA, 25 bp, Mus musculus
gaataccagggacaagaacattacc

SEQ ID NO: 434891 - DNA, 25 bp, Mus musculus
gaataccagggagaagaacattacc

SEQ ID NO: 434892 - DNA, 25 bp, Mus musculus
gaataccagggtcattttagctaat

SEQ ID NO: 434893 - DNA, 25 bp, Mus musculus
gaataccagggtgattttagctaat

SEQ ID NO: 434894 - DNA, 25 bp, Mus musculus
gaataccaggtcacttgcctatcag

SEQ ID NO: 434895 - DNA, 25 bp, Mus musculus
gaataccaggtctcttgcctatcag

SEQ ID NO: 434896 - DNA, 25 bp, Mus musculus
gaataccatcctcacctaggagtct

SEQ ID NO: 434897 - DNA, 25 bp, Mus musculus
gaataccatcctgacctaggagtct

SEQ ID NO: 434898 - DNA, 25 bp, Mus musculus
gaataccatcggctgcaccttgcaa

SEQ ID NO: 434899 - DNA, 25 bp, Mus musculus
gaataccatcgggtgcaccttgcaa

SEQ ID NO: 434900 - DNA, 25 bp, Mus musculus
gaataccatcttcacttacacaggg

SEQ ID NO: 434901 - DNA, 25 bp, Mus musculus
gaataccatcttgacttacacaggg

SEQ ID NO: 434902 - DNA, 25 bp, Mus musculus
gaataccattagattggctgaggtt

SEQ ID NO: 434903 - DNA, 25 bp, Mus musculus
gaataccattagtttggctgaggtt

SEQ ID NO: 434904 - DNA, 25 bp, Mus musculus
gaataccattgtagctggaggtctt

SEQ ID NO: 434905 - DNA, 25 bp, Mus musculus
gaataccattgttgctggaggtctt

SEQ ID NO: 434906 - DNA, 25 bp, Mus musculus
gaataccattttagtgagctgtgac

SEQ ID NO: 434907 - DNA, 25 bp, Mus musculus
gaataccatttttgtgagctgtgac

SEQ ID NO: 434908 - DNA, 25 bp, Mus musculus
gaatacccaacacgatacacaaatg

SEQ ID NO: 434909 - DNA, 25 bp, Mus musculus
gaatacccaacaggatacacaaatg

SEQ ID NO: 434910 - DNA, 25 bp, Mus musculus
gaatacccaagcctgtgggcctgga

SEQ ID NO: 434911 - DNA, 25 bp, Mus musculus
gaatacccaagcgtgtgggcctgga

SEQ ID NO: 434912 - DNA, 25 bp, Mus musculus
gaatacccacagacaatggtgttag

SEQ ID NO: 434913 - DNA, 25 bp, Mus musculus
gaatacccacagtcaatggtgttag

SEQ ID NO: 434914 - DNA, 25 bp, Mus musculus
gaatacccacccaaatgagttagag

SEQ ID NO: 434915 - DNA, 25 bp, Mus musculus
gaatacccacccattggattttcat

SEQ ID NO: 434916 - DNA, 25 bp, Mus musculus
gaatacccaccctaatgagttagag

SEQ ID NO: 434917 - DNA, 25 bp, Mus musculus
gaatacccaccctttggattttcat

SEQ ID NO: 434918 - DNA, 25 bp, Mus musculus
gaatacccagatcagctccagtgtg

SEQ ID NO: 434919 - DNA, 25 bp, Mus musculus
gaatacccagatgagctccagtgtg

SEQ ID NO: 434920 - DNA, 25 bp, Mus musculus
gaatacccagtgaagtagccagcca

SEQ ID NO: 434921 - DNA, 25 bp, Mus musculus
gaatacccagtgtagtagccagcca

SEQ ID NO: 434922 - DNA, 25 bp, Mus musculus
gaatacccatggactggttaaagta

SEQ ID NO: 434923 - DNA, 25 bp, Mus musculus
gaatacccatggtctggttaaagta

SEQ ID NO: 434924 - DNA, 25 bp, Mus musculus
gaatacccatgtctgtacctgcagc

SEQ ID NO: 434925 - DNA, 25 bp, Mus musculus
gaatacccatgtgtgtacctgcagc

SEQ ID NO: 434926 - DNA, 25 bp, Mus musculus
gaatacccgaggctgcatgatttat

SEQ ID NO: 434927 - DNA, 25 bp, Mus musculus
gaatacccgagggtgcatgatttat

SEQ ID NO: 434928 - DNA, 25 bp, Mus musculus
gaatacccgggtcaggtagtctcta

SEQ ID NO: 434929 - DNA, 25 bp, Mus musculus
gaatacccgggtgaggtagtctcta

SEQ ID NO: 434930 - DNA, 25 bp, Mus musculus
gaataccctcttccctgggtggatg

SEQ ID NO: 434931 - DNA, 25 bp, Mus musculus
gaataccctcttgcctgggtggatg

SEQ ID NO: 434932 - DNA, 25 bp, Mus musculus
gaataccgaatcaccccaaggaatt

SEQ ID NO: 434933 - DNA, 25 bp, Mus musculus
gaataccgaatctccccaaggaatt

SEQ ID NO: 434934 - DNA, 25 bp, Mus musculus
gaataccgatgacaaacacctcaaa

SEQ ID NO: 434935 - DNA, 25 bp, Mus musculus
gaataccgatgagaaacacctcaaa

SEQ ID NO: 434936 - DNA, 25 bp, Mus musculus
gaataccgttcgcatgatctactct

SEQ ID NO: 434937 - DNA, 25 bp, Mus musculus
gaataccgttcggatgatctactct

SEQ ID NO: 434938 - DNA, 25 bp, Mus musculus
gaataccgtttaccctcgttggtag

SEQ ID NO: 434939 - DNA, 25 bp, Mus musculus
gaataccgtttagcctcgttggtag

SEQ ID NO: 434940 - DNA, 25 bp, Mus musculus
gaatacctaaagatttgcacctgca

SEQ ID NO: 434941 - DNA, 25 bp, Mus musculus
gaatacctaaagttttgcacctgca

SEQ ID NO: 434942 - DNA, 25 bp, Mus musculus
gaatacctatgacccatcattcaat

SEQ ID NO: 434943 - DNA, 25 bp, Mus musculus
gaatacctatgagccatcattcaat

SEQ ID NO: 434944 - DNA, 25 bp, Mus musculus
gaatacctattcatacccagcgtgt

SEQ ID NO: 434945 - DNA, 25 bp, Mus musculus
gaatacctattcttacccagcgtgt

SEQ ID NO: 434946 - DNA, 25 bp, Mus musculus
gaatacctcagactttcttgacagt

SEQ ID NO: 434947 - DNA, 25 bp, Mus musculus
gaatacctcagagtttcttgacagt

SEQ ID NO: 434948 - DNA, 25 bp, Mus musculus
gaatacctcaggcacacaggcagct

SEQ ID NO: 434949 - DNA, 25 bp, Mus musculus
gaatacctcagggacacaggcagct

SEQ ID NO: 434950 - DNA, 25 bp, Mus musculus
gaatacctcatgagtaaatacagtg

SEQ ID NO: 434951 - DNA, 25 bp, Mus musculus
gaatacctcatgtgtaaatacagtg

SEQ ID NO: 434952 - DNA, 25 bp, Mus musculus
gaatacctctgtactacccagaagg

SEQ ID NO: 434953 - DNA, 25 bp, Mus musculus
gaatacctctgttctacccagaagg

SEQ ID NO: 434954 - DNA, 25 bp, Mus musculus
gaatacctgaggctagtcccagcca

SEQ ID NO: 434955 - DNA, 25 bp, Mus musculus
gaatacctgagggtagtcccagcca

SEQ ID NO: 434956 - DNA, 25 bp, Mus musculus
gaatacctgcacaaaatgctccaaa

SEQ ID NO: 434957 - DNA, 25 bp, Mus musculus
gaatacctgcactaaatgctccaaa

SEQ ID NO: 434958 - DNA, 25 bp, Mus musculus
gaatacctgctaacctaagtctgtt

SEQ ID NO: 434959 - DNA, 25 bp, Mus musculus
gaatacctgctatcctaagtctgtt

SEQ ID NO: 434960 - DNA, 25 bp, Mus musculus
gaatacctgggacctataaagcaat

SEQ ID NO: 434961 - DNA, 25 bp, Mus musculus
gaatacctgggagctataaagcaat

SEQ ID NO: 434962 - DNA, 25 bp, Mus musculus
gaatacctgtggatcatcaccttca

SEQ ID NO: 434963 - DNA, 25 bp, Mus musculus
gaatacctgtggttcatcaccttca

SEQ ID NO: 434964 - DNA, 25 bp, Mus musculus
gaataccttctaacgttgtaaatga

SEQ ID NO: 434965 - DNA, 25 bp, Mus musculus
gaataccttctatcgttgtaaatga

SEQ ID NO: 434966 - DNA, 25 bp, Mus musculus
gaataccttgaaattcctgccatgc

SEQ ID NO: 434967 - DNA, 25 bp, Mus musculus
gaataccttgaatttcctgccatgc

SEQ ID NO: 434968 - DNA, 25 bp, Mus musculus
gaataccttgagaactttgtgacat

SEQ ID NO: 434969 - DNA, 25 bp, Mus musculus
gaataccttgagtactttgtgacat

SEQ ID NO: 434970 - DNA, 25 bp, Mus musculus
gaataccttgtacaaatatgctctt

SEQ ID NO: 434971 - DNA, 25 bp, Mus musculus
gaataccttgtacagtccatggaag

SEQ ID NO: 434972 - DNA, 25 bp, Mus musculus
gaataccttgtagaaatatgctctt

SEQ ID NO: 434973 - DNA, 25 bp, Mus musculus
gaataccttgtagagtccatggaag

SEQ ID NO: 434974 - DNA, 25 bp, Mus musculus
gaatacctttatcccactgaatgag

SEQ ID NO: 434975 - DNA, 25 bp, Mus musculus
gaatacctttatgccactgaatgag

SEQ ID NO: 434976 - DNA, 25 bp, Mus musculus
gaatacgaagctcttgtggcccatg

SEQ ID NO: 434977 - DNA, 25 bp, Mus musculus
gaatacgaagctgttgtggcccatg

SEQ ID NO: 434978 - DNA, 25 bp, Mus musculus
gaatacgacagaagattcgccatat

SEQ ID NO: 434979 - DNA, 25 bp, Mus musculus
gaatacgacagatgattcgccatat

SEQ ID NO: 434980 - DNA, 25 bp, Mus musculus
gaatacgacgaacctgggccctcca

SEQ ID NO: 434981 - DNA, 25 bp, Mus musculus
gaatacgacgaagctgggccctcca

SEQ ID NO: 434982 - DNA, 25 bp, Mus musculus
gaatacgagccaatttaagaataat

SEQ ID NO: 434983 - DNA, 25 bp, Mus musculus
gaatacgagccattttaagaataat

SEQ ID NO: 434984 - DNA, 25 bp, Mus musculus
gaatacgatgagacggcttaaacct

SEQ ID NO: 434985 - DNA, 25 bp, Mus musculus
gaatacgatgagtcggcttaaacct

SEQ ID NO: 434986 - DNA, 25 bp, Mus musculus
gaatacgcaaatcaaccctttagga

SEQ ID NO: 434987 - DNA, 25 bp, Mus musculus
gaatacgcaaatgaaccctttagga

SEQ ID NO: 434988 - DNA, 25 bp, Mus musculus
gaatacgctggcacatgccagccca

SEQ ID NO: 434989 - DNA, 25 bp, Mus musculus
gaatacgctggctcatgccagccca

SEQ ID NO: 434990 - DNA, 25 bp, Mus musculus
gaatacgcttacatcagtttgtcac

SEQ ID NO: 434991 - DNA, 25 bp, Mus musculus
gaatacgcttacttcagtttgtcac

SEQ ID NO: 434992 - DNA, 25 bp, Mus musculus
gaatacggacacattgggtttacag

SEQ ID NO: 434993 - DNA, 25 bp, Mus musculus
gaatacggacactttgggtttacag

SEQ ID NO: 434994 - DNA, 25 bp, Mus musculus
gaatacggaggacacctgtccgtct

SEQ ID NO: 434995 - DNA, 25 bp, Mus musculus
gaatacggaggagacctgtccgtct

SEQ ID NO: 434996 - DNA, 25 bp, Mus musculus
gaatacggcttgctggctcaccttt

SEQ ID NO: 434997 - DNA, 25 bp, Mus musculus
gaatacggcttggtggctcaccttt

SEQ ID NO: 434998 - DNA, 25 bp, Mus musculus
gaatacgggatcctgactggcttga

SEQ ID NO: 434999 - DNA, 25 bp, Mus musculus
gaatacgggatcgtgactggcttga

SEQ ID NO: 435000 - DNA, 25 bp, Mus musculus
gaatacgttatcaccaagtgcattt

SEQ ID NO: 435001 - DNA, 25 bp, Mus musculus
gaatacgttatctccaagtgcattt

SEQ ID NO: 435002 - DNA, 25 bp, Mus musculus
gaatacgttgtacttttctgcattt

SEQ ID NO: 435003 - DNA, 25 bp, Mus musculus
gaatacgttgtagttttctgcattt

SEQ ID NO: 435004 - DNA, 25 bp, Mus musculus
gaatactaaagcagtgcaaatgtta

SEQ ID NO: 435005 - DNA, 25 bp, Mus musculus
gaatactaaagctgtgcaaatgtta

SEQ ID NO: 435006 - DNA, 25 bp, Mus musculus
gaatactaacgtctgtcagtcctta

SEQ ID NO: 435007 - DNA, 25 bp, Mus musculus
gaatactaacgtgtgtcagtcctta

SEQ ID NO: 435008 - DNA, 25 bp, Mus musculus
gaatactaatgcagggaatcatgac

SEQ ID NO: 435009 - DNA, 25 bp, Mus musculus
gaatactaatgctgggaatcatgac

SEQ ID NO: 435010 - DNA, 25 bp, Mus musculus
gaatactacaacagtgtgtctccca

SEQ ID NO: 435011 - DNA, 25 bp, Mus musculus
gaatactacaactgtgtgtctccca

SEQ ID NO: 435012 - DNA, 25 bp, Mus musculus
gaatactaccctcaaatagagatgg

SEQ ID NO: 435013 - DNA, 25 bp, Mus musculus
gaatactaccctgaaatagagatgg

SEQ ID NO: 435014 - DNA, 25 bp, Mus musculus
gaatactacctcatgcagataaagc

SEQ ID NO: 435015 - DNA, 25 bp, Mus musculus
gaatactacctcttgcagataaagc

SEQ ID NO: 435016 - DNA, 25 bp, Mus musculus
gaatactagactagaatccttctaa

SEQ ID NO: 435017 - DNA, 25 bp, Mus musculus
gaatactagacttgaatccttctaa

SEQ ID NO: 435018 - DNA, 25 bp, Mus musculus
gaatactaggaccacgtctcggaag

SEQ ID NO: 435019 - DNA, 25 bp, Mus musculus
gaatactaggacgacgtctcggaag

SEQ ID NO: 435020 - DNA, 25 bp, Mus musculus
gaatactagtagcaagccaggacca

SEQ ID NO: 435021 - DNA, 25 bp, Mus musculus
gaatactagtaggaagccaggacca

SEQ ID NO: 435022 - DNA, 25 bp, Mus musculus
gaatactatcccacaatggcaagaa

SEQ ID NO: 435023 - DNA, 25 bp, Mus musculus
gaatactatccctcaatggcaagaa

SEQ ID NO: 435024 - DNA, 25 bp, Mus musculus
gaatactatcgtccattcaaacata

SEQ ID NO: 435025 - DNA, 25 bp, Mus musculus
gaatactatcgtgcattcaaacata

SEQ ID NO: 435026 - DNA, 25 bp, Mus musculus
gaatactatgatagcagctggaagt

SEQ ID NO: 435027 - DNA, 25 bp, Mus musculus
gaatactatgattgcagctggaagt

SEQ ID NO: 435028 - DNA, 25 bp, Mus musculus
gaatactatgtcatgcttgtggccc

SEQ ID NO: 435029 - DNA, 25 bp, Mus musculus
gaatactatgtcttgcttgtggccc

SEQ ID NO: 435030 - DNA, 25 bp, Mus musculus
gaatactattgaaaaggacagcctt

SEQ ID NO: 435031 - DNA, 25 bp, Mus musculus
gaatactattgataaggacagcctt

SEQ ID NO: 435032 - DNA, 25 bp, Mus musculus
gaatactcaaatagaactgggccga

SEQ ID NO: 435033 - DNA, 25 bp, Mus musculus
gaatactcaaattgaactgggccga

SEQ ID NO: 435034 - DNA, 25 bp, Mus musculus
gaatactcacacaagaccaggaatg

SEQ ID NO: 435035 - DNA, 25 bp, Mus musculus
gaatactcacactagaccaggaatg

SEQ ID NO: 435036 - DNA, 25 bp, Mus musculus
gaatactcagaaaccaatgccaatt

SEQ ID NO: 435037 - DNA, 25 bp, Mus musculus
gaatactcagaatccaatgccaatt

SEQ ID NO: 435038 - DNA, 25 bp, Mus musculus
gaatactcagcaaagcaggtcttca

SEQ ID NO: 435039 - DNA, 25 bp, Mus musculus
gaatactcagcatagcaggtcttca

SEQ ID NO: 435040 - DNA, 25 bp, Mus musculus
gaatactcagctaagtgacgcgcaa

SEQ ID NO: 435041 - DNA, 25 bp, Mus musculus
gaatactcagcttagtgacgcgcaa

SEQ ID NO: 435042 - DNA, 25 bp, Mus musculus
gaatactcatatccttgccacacat

SEQ ID NO: 435043 - DNA, 25 bp, Mus musculus
gaatactcatatgcttgccacacat

SEQ ID NO: 435044 - DNA, 25 bp, Mus musculus
gaatactcattgctactgtttatca

SEQ ID NO: 435045 - DNA, 25 bp, Mus musculus
gaatactcattggtactgtttatca

SEQ ID NO: 435046 - DNA, 25 bp, Mus musculus
gaatactcatttcatttcctttgaa

SEQ ID NO: 435047 - DNA, 25 bp, Mus musculus
gaatactcatttgatttcctttgaa

SEQ ID NO: 435048 - DNA, 25 bp, Mus musculus
gaatactccaagattctgcagcagg

SEQ ID NO: 435049 - DNA, 25 bp, Mus musculus
gaatactccaagtttctgcagcagg

SEQ ID NO: 435050 - DNA, 25 bp, Mus musculus
gaatactccataatttgtgggaact

SEQ ID NO: 435051 - DNA, 25 bp, Mus musculus
gaatactccatattttgtgggaact

SEQ ID NO: 435052 - DNA, 25 bp, Mus musculus
gaatactccatgcaagcgaagatga

SEQ ID NO: 435053 - DNA, 25 bp, Mus musculus
gaatactccatggaagcgaagatga

SEQ ID NO: 435054 - DNA, 25 bp, Mus musculus
gaatactctcacaataatgatggtg

SEQ ID NO: 435055 - DNA, 25 bp, Mus musculus
gaatactctcactataatgatggtg

SEQ ID NO: 435056 - DNA, 25 bp, Mus musculus
gaatactcttcaagactctttggta

SEQ ID NO: 435057 - DNA, 25 bp, Mus musculus
gaatactcttcatgactctttggta

SEQ ID NO: 435058 - DNA, 25 bp, Mus musculus
gaatactgacacaaaggagccattt

SEQ ID NO: 435059 - DNA, 25 bp, Mus musculus
gaatactgacactaaggagccattt

SEQ ID NO: 435060 - DNA, 25 bp, Mus musculus
gaatactgactaccctttatggaca

SEQ ID NO: 435061 - DNA, 25 bp, Mus musculus
gaatactgactagcctttatggaca

SEQ ID NO: 435062 - DNA, 25 bp, Mus musculus
gaatactgaggcaagagtgccatat

SEQ ID NO: 435063 - DNA, 25 bp, Mus musculus
gaatactgaggctagagtgccatat

SEQ ID NO: 435064 - DNA, 25 bp, Mus musculus
gaatactgaggtatcttggtaatgc

SEQ ID NO: 435065 - DNA, 25 bp, Mus musculus
gaatactgaggtttcttggtaatgc

SEQ ID NO: 435066 - DNA, 25 bp, Mus musculus
gaatactgagttctgtgcataaaat

SEQ ID NO: 435067 - DNA, 25 bp, Mus musculus
gaatactgagttgtgtgcataaaat

SEQ ID NO: 435068 - DNA, 25 bp, Mus musculus
gaatactgatgtagcatggttgcta

SEQ ID NO: 435069 - DNA, 25 bp, Mus musculus
gaatactgatgttgcatggttgcta

SEQ ID NO: 435070 - DNA, 25 bp, Mus musculus
gaatactgcctaaactccaaactgc

SEQ ID NO: 435071 - DNA, 25 bp, Mus musculus
gaatactgcctatactccaaactgc

SEQ ID NO: 435072 - DNA, 25 bp, Mus musculus
gaatactgcgctccattcgtgaaca

SEQ ID NO: 435073 - DNA, 25 bp, Mus musculus
gaatactgcgctgcattcgtgaaca

SEQ ID NO: 435074 - DNA, 25 bp, Mus musculus
gaatactgcgtaataccacatccta

SEQ ID NO: 435075 - DNA, 25 bp, Mus musculus
gaatactgcgtattaccacatccta

SEQ ID NO: 435076 - DNA, 25 bp, Mus musculus
gaatactgctaccacaacatccact

SEQ ID NO: 435077 - DNA, 25 bp, Mus musculus
gaatactgctacgacaacatccact

SEQ ID NO: 435078 - DNA, 25 bp, Mus musculus
gaatactgcttaaaaactggtttgt

SEQ ID NO: 435079 - DNA, 25 bp, Mus musculus
gaatactgcttataaactggtttgt

SEQ ID NO: 435080 - DNA, 25 bp, Mus musculus
gaatactgctttcccaatcctggat

SEQ ID NO: 435081 - DNA, 25 bp, Mus musculus
gaatactgctttgccaatcctggat

SEQ ID NO: 435082 - DNA, 25 bp, Mus musculus
gaatactggatgaacacagactaca

SEQ ID NO: 435083 - DNA, 25 bp, Mus musculus
gaatactggatgtacacagactaca

SEQ ID NO: 435084 - DNA, 25 bp, Mus musculus
gaatactgggatatagtatccaacc

SEQ ID NO: 435085 - DNA, 25 bp, Mus musculus
gaatactgggatttagtatccaacc

SEQ ID NO: 435086 - DNA, 25 bp, Mus musculus
gaatactgggcgaatttctgaaacc

SEQ ID NO: 435087 - DNA, 25 bp, Mus musculus
gaatactgggcgtatttctgaaacc

SEQ ID NO: 435088 - DNA, 25 bp, Mus musculus
gaatactggtccacataactgacag

SEQ ID NO: 435089 - DNA, 25 bp, Mus musculus
gaatactggtcctcataactgacag

SEQ ID NO: 435090 - DNA, 25 bp, Mus musculus
gaatactggttcattagatcactaa

SEQ ID NO: 435091 - DNA, 25 bp, Mus musculus
gaatactggttctttagatcactaa

SEQ ID NO: 435092 - DNA, 25 bp, Mus musculus
gaatactgtattagctcccttctga

SEQ ID NO: 435093 - DNA, 25 bp, Mus musculus
gaatactgtatttgctcccttctga

SEQ ID NO: 435094 - DNA, 25 bp, Mus musculus
gaatactgtctcaccttggactgat

SEQ ID NO: 435095 - DNA, 25 bp, Mus musculus
gaatactgtctcctctgaaagcaca

SEQ ID NO: 435096 - DNA, 25 bp, Mus musculus
gaatactgtctcgtctgaaagcaca

SEQ ID NO: 435097 - DNA, 25 bp, Mus musculus
gaatactgtctctccttggactgat

SEQ ID NO: 435098 - DNA, 25 bp, Mus musculus
gaatactgtgacaactactgctaag

SEQ ID NO: 435099 - DNA, 25 bp, Mus musculus
gaatactgtgactactactgctaag

SEQ ID NO: 435100 - DNA, 25 bp, Mus musculus
gaatacttaccacttcaggctgctg

SEQ ID NO: 435101 - DNA, 25 bp, Mus musculus
gaatacttaccagttcaggctgctg

SEQ ID NO: 435102 - DNA, 25 bp, Mus musculus
gaatacttacgtacatagccacaga

SEQ ID NO: 435103 - DNA, 25 bp, Mus musculus
gaatacttacgtatacctcactggt

SEQ ID NO: 435104 - DNA, 25 bp, Mus musculus
gaatacttacgttcatagccacaga

SEQ ID NO: 435105 - DNA, 25 bp, Mus musculus
gaatacttacgtttacctcactggt

SEQ ID NO: 435106 - DNA, 25 bp, Mus musculus
gaatacttacttctgtttaccaaag

SEQ ID NO: 435107 - DNA, 25 bp, Mus musculus
gaatacttacttgtgtttaccaaag

SEQ ID NO: 435108 - DNA, 25 bp, Mus musculus
gaatacttagagattgtggaggaaa

SEQ ID NO: 435109 - DNA, 25 bp, Mus musculus
gaatacttagagtttgtggaggaaa

SEQ ID NO: 435110 - DNA, 25 bp, Mus musculus
gaatacttatctctgagtccagggc

SEQ ID NO: 435111 - DNA, 25 bp, Mus musculus
gaatacttatctgtgagtccagggc

SEQ ID NO: 435112 - DNA, 25 bp, Mus musculus
gaatacttatgacccaatacttgtt

SEQ ID NO: 435113 - DNA, 25 bp, Mus musculus
gaatacttatgagccaatacttgtt

SEQ ID NO: 435114 - DNA, 25 bp, Mus musculus
gaatacttcaatagtgcctctcaat

SEQ ID NO: 435115 - DNA, 25 bp, Mus musculus
gaatacttcaattgtgcctctcaat

SEQ ID NO: 435116 - DNA, 25 bp, Mus musculus
gaatacttcattctatcctacctta

SEQ ID NO: 435117 - DNA, 25 bp, Mus musculus
gaatacttcattgtatcctacctta

SEQ ID NO: 435118 - DNA, 25 bp, Mus musculus
gaatacttccaacagacccaggttc

SEQ ID NO: 435119 - DNA, 25 bp, Mus musculus
gaatacttccaaccttaatcacaat

SEQ ID NO: 435120 - DNA, 25 bp, Mus musculus
gaatacttccaagagacccaggttc

SEQ ID NO: 435121 - DNA, 25 bp, Mus musculus
gaatacttccaagcttaatcacaat

SEQ ID NO: 435122 - DNA, 25 bp, Mus musculus
gaatacttccagagtaatgcctaaa

SEQ ID NO: 435123 - DNA, 25 bp, Mus musculus
gaatacttccagtgtaatgcctaaa

SEQ ID NO: 435124 - DNA, 25 bp, Mus musculus
gaatacttctctcttttcatatata

SEQ ID NO: 435125 - DNA, 25 bp, Mus musculus
gaatacttctctgttttcatatata

SEQ ID NO: 435126 - DNA, 25 bp, Mus musculus
gaatacttgaaaaccctgccaagca

SEQ ID NO: 435127 - DNA, 25 bp, Mus musculus
gaatacttgaaacgccctcctgagt

SEQ ID NO: 435128 - DNA, 25 bp, Mus musculus
gaatacttgaaactccgttagttga

SEQ ID NO: 435129 - DNA, 25 bp, Mus musculus
gaatacttgaaaggccctcctgagt

SEQ ID NO: 435130 - DNA, 25 bp, Mus musculus
gaatacttgaaagtccgttagttga

SEQ ID NO: 435131 - DNA, 25 bp, Mus musculus
gaatacttgaaatccctgccaagca

SEQ ID NO: 435132 - DNA, 25 bp, Mus musculus
gaatacttgcctaatttgaacgttt

SEQ ID NO: 435133 - DNA, 25 bp, Mus musculus
gaatacttgcctatttctacctgag

SEQ ID NO: 435134 - DNA, 25 bp, Mus musculus
gaatacttgccttatttgaacgttt

SEQ ID NO: 435135 - DNA, 25 bp, Mus musculus
gaatacttgcctttttctacctgag

SEQ ID NO: 435136 - DNA, 25 bp, Mus musculus
gaatacttggctaccagtcgttgga

SEQ ID NO: 435137 - DNA, 25 bp, Mus musculus
gaatacttggcttccagtcgttgga

SEQ ID NO: 435138 - DNA, 25 bp, Mus musculus
gaatacttgttcagggctgccatgc

SEQ ID NO: 435139 - DNA, 25 bp, Mus musculus
gaatacttgttctgggctgccatgc

SEQ ID NO: 435140 - DNA, 25 bp, Mus musculus
gaatactttcacacgatttcccagg

SEQ ID NO: 435141 - DNA, 25 bp, Mus musculus
gaatactttcactcgatttcccagg

SEQ ID NO: 435142 - DNA, 25 bp, Mus musculus
gaatactttccgagtatttcctggg

SEQ ID NO: 435143 - DNA, 25 bp, Mus musculus
gaatactttccgtgtatttcctggg

SEQ ID NO: 435144 - DNA, 25 bp, Mus musculus
gaatactttcctctatacctcattg

SEQ ID NO: 435145 - DNA, 25 bp, Mus musculus
gaatactttcctgtatacctcattg

SEQ ID NO: 435146 - DNA, 25 bp, Mus musculus
gaatactttctgaatctgaccagta

SEQ ID NO: 435147 - DNA, 25 bp, Mus musculus
gaatactttctgcaatcacaagctg

SEQ ID NO: 435148 - DNA, 25 bp, Mus musculus
gaatactttctggaatcacaagctg

SEQ ID NO: 435149 - DNA, 25 bp, Mus musculus
gaatactttctgtatctgaccagta

SEQ ID NO: 435150 - DNA, 25 bp, Mus musculus
gaatacttttggcagcacccttact

SEQ ID NO: 435151 - DNA, 25 bp, Mus musculus
gaatacttttgggagcacccttact

SEQ ID NO: 435152 - DNA, 25 bp, Mus musculus
gaatactttttgaaggcgagtcaga

SEQ ID NO: 435153 - DNA, 25 bp, Mus musculus
gaatactttttgtaggcgagtcaga

SEQ ID NO: 435154 - DNA, 25 bp, Mus musculus
gaatagaaagaaagcttcgcctcag

SEQ ID NO: 435155 - DNA, 25 bp, Mus musculus
gaatagaaagaatgcttcgcctcag

SEQ ID NO: 435156 - DNA, 25 bp, Mus musculus
gaatagaaatcgaccataagcgata

SEQ ID NO: 435157 - DNA, 25 bp, Mus musculus
gaatagaaatcgtccataagcgata

SEQ ID NO: 435158 - DNA, 25 bp, Mus musculus
gaatagaaatgcagtctggctcaag

SEQ ID NO: 435159 - DNA, 25 bp, Mus musculus
gaatagaaatgctgtctggctcaag

SEQ ID NO: 435160 - DNA, 25 bp, Mus musculus
gaatagaaccagacaccacgcatac

SEQ ID NO: 435161 - DNA, 25 bp, Mus musculus
gaatagaaccagtcaccacgcatac

SEQ ID NO: 435162 - DNA, 25 bp, Mus musculus
gaatagaaccataccattacttttt

SEQ ID NO: 435163 - DNA, 25 bp, Mus musculus
gaatagaaccattccattacttttt

SEQ ID NO: 435164 - DNA, 25 bp, Mus musculus
gaatagaagctgactgccacccatg

SEQ ID NO: 435165 - DNA, 25 bp, Mus musculus
gaatagaagctgtctgccacccatg

SEQ ID NO: 435166 - DNA, 25 bp, Mus musculus
gaatagaagtccaaccttccttcca

SEQ ID NO: 435167 - DNA, 25 bp, Mus musculus
gaatagaagtcctaccttccttcca

SEQ ID NO: 435168 - DNA, 25 bp, Mus musculus
gaatagaataccagcctagcttgta

SEQ ID NO: 435169 - DNA, 25 bp, Mus musculus
gaatagaatacctgcctagcttgta

SEQ ID NO: 435170 - DNA, 25 bp, Mus musculus
gaatagaatcccacgagttcctgga

SEQ ID NO: 435171 - DNA, 25 bp, Mus musculus
gaatagaatccctcgagttcctgga

SEQ ID NO: 435172 - DNA, 25 bp, Mus musculus
gaatagaatctgatcgttccacctc

SEQ ID NO: 435173 - DNA, 25 bp, Mus musculus
gaatagaatctgttcgttccacctc

SEQ ID NO: 435174 - DNA, 25 bp, Mus musculus
gaatagaatgctcggcttcgggacc

SEQ ID NO: 435175 - DNA, 25 bp, Mus musculus
gaatagaatgctgggcttcgggacc

SEQ ID NO: 435176 - DNA, 25 bp, Mus musculus
gaatagacatccagattatttttgg

SEQ ID NO: 435177 - DNA, 25 bp, Mus musculus
gaatagacatcctgattatttttgg

SEQ ID NO: 435178 - DNA, 25 bp, Mus musculus
gaatagaccatgaccggagagcgat

SEQ ID NO: 435179 - DNA, 25 bp, Mus musculus
gaatagaccatgatctatactagac

SEQ ID NO: 435180 - DNA, 25 bp, Mus musculus
gaatagaccatgtccggagagcgat

SEQ ID NO: 435181 - DNA, 25 bp, Mus musculus
gaatagaccatgttctatactagac

SEQ ID NO: 435182 - DNA, 25 bp, Mus musculus
gaatagacctctcttgttgaccctt

SEQ ID NO: 435183 - DNA, 25 bp, Mus musculus
gaatagacctctgttgttgaccctt

SEQ ID NO: 435184 - DNA, 25 bp, Mus musculus
gaatagacctgtcactcaaggctct

SEQ ID NO: 435185 - DNA, 25 bp, Mus musculus
gaatagacctgtgactcaaggctct

SEQ ID NO: 435186 - DNA, 25 bp, Mus musculus
gaatagaccttaacaagctctgtct

SEQ ID NO: 435187 - DNA, 25 bp, Mus musculus
gaatagaccttatcaagctctgtct

SEQ ID NO: 435188 - DNA, 25 bp, Mus musculus
gaatagactatgctcacttcctcct

SEQ ID NO: 435189 - DNA, 25 bp, Mus musculus
gaatagactatggtcacttcctcct

SEQ ID NO: 435190 - DNA, 25 bp, Mus musculus
gaatagactattaccttgattatta

SEQ ID NO: 435191 - DNA, 25 bp, Mus musculus
gaatagactatttccttgattatta

SEQ ID NO: 435192 - DNA, 25 bp, Mus musculus
gaatagactcatcagtatatttttg

SEQ ID NO: 435193 - DNA, 25 bp, Mus musculus
gaatagactcatgagtatatttttg

SEQ ID NO: 435194 - DNA, 25 bp, Mus musculus
gaatagacttctatcactagagttc

SEQ ID NO: 435195 - DNA, 25 bp, Mus musculus
gaatagacttctttcactagagttc

SEQ ID NO: 435196 - DNA, 25 bp, Mus musculus
gaatagagaacaccagcactgacac

SEQ ID NO: 435197 - DNA, 25 bp, Mus musculus
gaatagagaacagcagcactgacac

SEQ ID NO: 435198 - DNA, 25 bp, Mus musculus
gaatagagcattaaccagtggtcga

SEQ ID NO: 435199 - DNA, 25 bp, Mus musculus
gaatagagcatttaccagtggtcga

SEQ ID NO: 435200 - DNA, 25 bp, Mus musculus
gaatagagccggcacccaggactgt

SEQ ID NO: 435201 - DNA, 25 bp, Mus musculus
gaatagagccgggacccaggactgt

SEQ ID NO: 435202 - DNA, 25 bp, Mus musculus
gaatagagcctcagccaaggagctg

SEQ ID NO: 435203 - DNA, 25 bp, Mus musculus
gaatagagcctctgccaaggagctg

SEQ ID NO: 435204 - DNA, 25 bp, Mus musculus
gaatagaggcccacagtgcctgtgt

SEQ ID NO: 435205 - DNA, 25 bp, Mus musculus
gaatagaggccctcagtgcctgtgt

SEQ ID NO: 435206 - DNA, 25 bp, Mus musculus
gaatagagggtgatctgccacccca

SEQ ID NO: 435207 - DNA, 25 bp, Mus musculus
gaatagagggtgttctgccacccca

SEQ ID NO: 435208 - DNA, 25 bp, Mus musculus
gaatagatagcaactttcatatacc

SEQ ID NO: 435209 - DNA, 25 bp, Mus musculus
gaatagatagcatctttcatatacc

SEQ ID NO: 435210 - DNA, 25 bp, Mus musculus
gaatagattgccacagcagctctgt

SEQ ID NO: 435211 - DNA, 25 bp, Mus musculus
gaatagattgcctcagcagctctgt

SEQ ID NO: 435212 - DNA, 25 bp, Mus musculus
gaatagcaaaagatccctttcccca

SEQ ID NO: 435213 - DNA, 25 bp, Mus musculus
gaatagcaaaagttccctttcccca

SEQ ID NO: 435214 - DNA, 25 bp, Mus musculus
gaatagcaacacagaatactgtaga

SEQ ID NO: 435215 - DNA, 25 bp, Mus musculus
gaatagcaacactgaatactgtaga

SEQ ID NO: 435216 - DNA, 25 bp, Mus musculus
gaatagcaagctaaacctgcagaac

SEQ ID NO: 435217 - DNA, 25 bp, Mus musculus
gaatagcaagctccaagcaaccaat

SEQ ID NO: 435218 - DNA, 25 bp, Mus musculus
gaatagcaagctgcaagcaaccaat

SEQ ID NO: 435219 - DNA, 25 bp, Mus musculus
gaatagcaagcttaacctgcagaac

SEQ ID NO: 435220 - DNA, 25 bp, Mus musculus
gaatagcaattacgatattggttat

SEQ ID NO: 435221 - DNA, 25 bp, Mus musculus
gaatagcaattaggatattggttat

SEQ ID NO: 435222 - DNA, 25 bp, Mus musculus
gaatagcaccaactgagttacatgt

SEQ ID NO: 435223 - DNA, 25 bp, Mus musculus
gaatagcaccaagtgagttacatgt

SEQ ID NO: 435224 - DNA, 25 bp, Mus musculus
gaatagcaccagacagtattgtata

SEQ ID NO: 435225 - DNA, 25 bp, Mus musculus
gaatagcaccagtcagtattgtata

SEQ ID NO: 435226 - DNA, 25 bp, Mus musculus
gaatagcaccggactgtggaactca

SEQ ID NO: 435227 - DNA, 25 bp, Mus musculus
gaatagcaccggtctgtggaactca

SEQ ID NO: 435228 - DNA, 25 bp, Mus musculus
gaatagcacgatccataccctctgt

SEQ ID NO: 435229 - DNA, 25 bp, Mus musculus
gaatagcacgatgcataccctctgt

SEQ ID NO: 435230 - DNA, 25 bp, Mus musculus
gaatagcatctccatgtgcattaaa

SEQ ID NO: 435231 - DNA, 25 bp, Mus musculus
gaatagcatctcgatgtgcattaaa

SEQ ID NO: 435232 - DNA, 25 bp, Mus musculus
gaatagccaagtccatactctgggc

SEQ ID NO: 435233 - DNA, 25 bp, Mus musculus
gaatagccaagtgcatactctgggc

SEQ ID NO: 435234 - DNA, 25 bp, Mus musculus
gaatagccagagatgaggcatgata

SEQ ID NO: 435235 - DNA, 25 bp, Mus musculus
gaatagccagagttgaggcatgata

SEQ ID NO: 435236 - DNA, 25 bp, Mus musculus
gaatagccatagaacgtcctaagag

SEQ ID NO: 435237 - DNA, 25 bp, Mus musculus
gaatagccatagtacgtcctaagag

SEQ ID NO: 435238 - DNA, 25 bp, Mus musculus
gaatagccattcacatttcggcaag

SEQ ID NO: 435239 - DNA, 25 bp, Mus musculus
gaatagccattctcatttcggcaag

SEQ ID NO: 435240 - DNA, 25 bp, Mus musculus
gaatagccatttagcaaacctttat

SEQ ID NO: 435241 - DNA, 25 bp, Mus musculus
gaatagccattttgcaaacctttat

SEQ ID NO: 435242 - DNA, 25 bp, Mus musculus
gaatagcctactctggcaatccctt

SEQ ID NO: 435243 - DNA, 25 bp, Mus musculus
gaatagcctactgtggcaatccctt

SEQ ID NO: 435244 - DNA, 25 bp, Mus musculus
gaatagcctccaacagacagatgaa

SEQ ID NO: 435245 - DNA, 25 bp, Mus musculus
gaatagcctccatcagacagatgaa

SEQ ID NO: 435246 - DNA, 25 bp, Mus musculus
gaatagcctctgcttgtgtcccatt

SEQ ID NO: 435247 - DNA, 25 bp, Mus musculus
gaatagcctctggttgtgtcccatt

SEQ ID NO: 435248 - DNA, 25 bp, Mus musculus
gaatagcgaagtcatcagccatact

SEQ ID NO: 435249 - DNA, 25 bp, Mus musculus
gaatagcgaagtgatcagccatact

SEQ ID NO: 435250 - DNA, 25 bp, Mus musculus
gaatagcgtcacagatactactcac

SEQ ID NO: 435251 - DNA, 25 bp, Mus musculus
gaatagcgtcactgatactactcac

SEQ ID NO: 435252 - DNA, 25 bp, Mus musculus
gaatagcgtcatactggctttaaag

SEQ ID NO: 435253 - DNA, 25 bp, Mus musculus
gaatagcgtcattctggctttaaag

SEQ ID NO: 435254 - DNA, 25 bp, Mus musculus
gaatagcgtgatccctgctggctgt

SEQ ID NO: 435255 - DNA, 25 bp, Mus musculus
gaatagcgtgatgcctgctggctgt

SEQ ID NO: 435256 - DNA, 25 bp, Mus musculus
gaatagctacacaaataactgttat

SEQ ID NO: 435257 - DNA, 25 bp, Mus musculus
gaatagctacactaataactgttat

SEQ ID NO: 435258 - DNA, 25 bp, Mus musculus
gaatagctaggcaactgtgagacca

SEQ ID NO: 435259 - DNA, 25 bp, Mus musculus
gaatagctaggctactgtgagacca

SEQ ID NO: 435260 - DNA, 25 bp, Mus musculus
gaatagctcaaactaagcttaccca

SEQ ID NO: 435261 - DNA, 25 bp, Mus musculus
gaatagctcaaagtaagcttaccca

SEQ ID NO: 435262 - DNA, 25 bp, Mus musculus
gaatagctcaacaagtccagcatat

SEQ ID NO: 435263 - DNA, 25 bp, Mus musculus
gaatagctcaactagtccagcatat

SEQ ID NO: 435264 - DNA, 25 bp, Mus musculus
gaatagctcacaatcatcgtttttg

SEQ ID NO: 435265 - DNA, 25 bp, Mus musculus
gaatagctcacattcatcgtttttg

SEQ ID NO: 435266 - DNA, 25 bp, Mus musculus
gaatagctcactccagaagttacac

SEQ ID NO: 435267 - DNA, 25 bp, Mus musculus
gaatagctcactgcagaagttacac

SEQ ID NO: 435268 - DNA, 25 bp, Mus musculus
gaatagctcccactagataagcaat

SEQ ID NO: 435269 - DNA, 25 bp, Mus musculus
gaatagctcccagtagataagcaat

SEQ ID NO: 435270 - DNA, 25 bp, Mus musculus
gaatagctctaaacatacatcacac

SEQ ID NO: 435271 - DNA, 25 bp, Mus musculus
gaatagctctaatcatacatcacac

SEQ ID NO: 435272 - DNA, 25 bp, Mus musculus
gaatagctctacatatggactgggt

SEQ ID NO: 435273 - DNA, 25 bp, Mus musculus
gaatagctctacttatggactgggt

SEQ ID NO: 435274 - DNA, 25 bp, Mus musculus
gaatagctgacgatccttgggcagt

SEQ ID NO: 435275 - DNA, 25 bp, Mus musculus
gaatagctgacgttccttgggcagt

SEQ ID NO: 435276 - DNA, 25 bp, Mus musculus
gaatagctgactacccagggagcca

SEQ ID NO: 435277 - DNA, 25 bp, Mus musculus
gaatagctgacttcccagggagcca

SEQ ID NO: 435278 - DNA, 25 bp, Mus musculus
gaatagctgcatagaacactaccat

SEQ ID NO: 435279 - DNA, 25 bp, Mus musculus
gaatagctgcattgaacactaccat

SEQ ID NO: 435280 - DNA, 25 bp, Mus musculus
gaatagctgctgataacactgttac

SEQ ID NO: 435281 - DNA, 25 bp, Mus musculus
gaatagctgctgttaacactgttac

SEQ ID NO: 435282 - DNA, 25 bp, Mus musculus
gaatagctgtataataacacactgt

SEQ ID NO: 435283 - DNA, 25 bp, Mus musculus
gaatagctgtattataacacactgt

SEQ ID NO: 435284 - DNA, 25 bp, Mus musculus
gaatagctgtgcctgtatgtttttt

SEQ ID NO: 435285 - DNA, 25 bp, Mus musculus
gaatagctgtgcgtgtatgtttttt

SEQ ID NO: 435286 - DNA, 25 bp, Mus musculus
gaatagcttaacatttaacatctag

SEQ ID NO: 435287 - DNA, 25 bp, Mus musculus
gaatagcttaacttttaacatctag

SEQ ID NO: 435288 - DNA, 25 bp, Mus musculus
gaatagcttagacctaggtttttgt

SEQ ID NO: 435289 - DNA, 25 bp, Mus musculus
gaatagcttagagctaggtttttgt

SEQ ID NO: 435290 - DNA, 25 bp, Mus musculus
gaatagcttatacacacttacattg

SEQ ID NO: 435291 - DNA, 25 bp, Mus musculus
gaatagcttatagacacttacattg

SEQ ID NO: 435292 - DNA, 25 bp, Mus musculus
gaatagcttattacacgtgcattgg

SEQ ID NO: 435293 - DNA, 25 bp, Mus musculus
gaatagcttatttcacgtgcattgg

SEQ ID NO: 435294 - DNA, 25 bp, Mus musculus
gaatagcttcagatgtctgcaggaa

SEQ ID NO: 435295 - DNA, 25 bp, Mus musculus
gaatagcttcagttgtctgcaggaa

SEQ ID NO: 435296 - DNA, 25 bp, Mus musculus
gaatagcttccacaatttagcaaca

SEQ ID NO: 435297 - DNA, 25 bp, Mus musculus
gaatagcttccagaatttagcaaca

SEQ ID NO: 435298 - DNA, 25 bp, Mus musculus
gaatagcttcctaattaagtcggtt

SEQ ID NO: 435299 - DNA, 25 bp, Mus musculus
gaatagcttccttattaagtcggtt

SEQ ID NO: 435300 - DNA, 25 bp, Mus musculus
gaatagcttcggagtcatcccaagc

SEQ ID NO: 435301 - DNA, 25 bp, Mus musculus
gaatagcttcggtgtcatcccaagc

SEQ ID NO: 435302 - DNA, 25 bp, Mus musculus
gaatagcttcttcaacctagcccat

SEQ ID NO: 435303 - DNA, 25 bp, Mus musculus
gaatagcttcttgaacctagcccat

SEQ ID NO: 435304 - DNA, 25 bp, Mus musculus
gaatagcttgtcatcaggtgccttt

SEQ ID NO: 435305 - DNA, 25 bp, Mus musculus
gaatagcttgtcttcaggtgccttt

SEQ ID NO: 435306 - DNA, 25 bp, Mus musculus
gaatagctttatactggatctctca

SEQ ID NO: 435307 - DNA, 25 bp, Mus musculus
gaatagctttatctactctgtaatg

SEQ ID NO: 435308 - DNA, 25 bp, Mus musculus
gaatagctttatgtactctgtaatg

SEQ ID NO: 435309 - DNA, 25 bp, Mus musculus
gaatagctttattctggatctctca

SEQ ID NO: 435310 - DNA, 25 bp, Mus musculus
gaatagctttgaaccttagccacgt

SEQ ID NO: 435311 - DNA, 25 bp, Mus musculus
gaatagctttgatccttagccacgt

SEQ ID NO: 435312 - DNA, 25 bp, Mus musculus
gaatagcttttaaccacatttccct

SEQ ID NO: 435313 - DNA, 25 bp, Mus musculus
gaatagcttttatccacatttccct

SEQ ID NO: 435314 - DNA, 25 bp, Mus musculus
gaataggaaatcactcgcttctctg

SEQ ID NO: 435315 - DNA, 25 bp, Mus musculus
gaataggaaatctctcgcttctctg

SEQ ID NO: 435316 - DNA, 25 bp, Mus musculus
gaataggacaatcgctccctcagaa

SEQ ID NO: 435317 - DNA, 25 bp, Mus musculus
gaataggacaatggctccctcagaa

SEQ ID NO: 435318 - DNA, 25 bp, Mus musculus
gaataggactgacgccccagaagaa

SEQ ID NO: 435319 - DNA, 25 bp, Mus musculus
gaataggactgactggataccaaat

SEQ ID NO: 435320 - DNA, 25 bp, Mus musculus
gaataggactgaggccccagaagaa

SEQ ID NO: 435321 - DNA, 25 bp, Mus musculus
gaataggactgagtggataccaaat

SEQ ID NO: 435322 - DNA, 25 bp, Mus musculus
gaataggaggcgagttccctaccgc

SEQ ID NO: 435323 - DNA, 25 bp, Mus musculus
gaataggaggcgtgttccctaccgc

SEQ ID NO: 435324 - DNA, 25 bp, Mus musculus
gaataggatgtcctcatggacgcga

SEQ ID NO: 435325 - DNA, 25 bp, Mus musculus
gaataggatgtcgtcatggacgcga

SEQ ID NO: 435326 - DNA, 25 bp, Mus musculus
gaataggcaactatcttcccttcca

SEQ ID NO: 435327 - DNA, 25 bp, Mus musculus
gaataggcaactttcttcccttcca

SEQ ID NO: 435328 - DNA, 25 bp, Mus musculus
gaataggcccccatcccagtaccca

SEQ ID NO: 435329 - DNA, 25 bp, Mus musculus
gaataggcccccttcccagtaccca

SEQ ID NO: 435330 - DNA, 25 bp, Mus musculus
gaataggccctcacagtaaagtcag

SEQ ID NO: 435331 - DNA, 25 bp, Mus musculus
gaataggccctctcagtaaagtcag

SEQ ID NO: 435332 - DNA, 25 bp, Mus musculus
gaataggctaagatgatctgtcacg

SEQ ID NO: 435333 - DNA, 25 bp, Mus musculus
gaataggctaagttgatctgtcacg

SEQ ID NO: 435334 - DNA, 25 bp, Mus musculus
gaataggctacgcaagcccacactg

SEQ ID NO: 435335 - DNA, 25 bp, Mus musculus
gaataggctacggaagcccacactg

SEQ ID NO: 435336 - DNA, 25 bp, Mus musculus
gaataggctattcgagtgcactcac

SEQ ID NO: 435337 - DNA, 25 bp, Mus musculus
gaataggctattggagtgcactcac

SEQ ID NO: 435338 - DNA, 25 bp, Mus musculus
gaataggctcatagacataggacaa

SEQ ID NO: 435339 - DNA, 25 bp, Mus musculus
gaataggctcattgacataggacaa

SEQ ID NO: 435340 - DNA, 25 bp, Mus musculus
gaataggctggcacaactgcggtac

SEQ ID NO: 435341 - DNA, 25 bp, Mus musculus
gaataggctggctcaactgcggtac

SEQ ID NO: 435342 - DNA, 25 bp, Mus musculus
gaataggctgtaccatcaacataat

SEQ ID NO: 435343 - DNA, 25 bp, Mus musculus
gaataggctgtagcatcaacataat

SEQ ID NO: 435344 - DNA, 25 bp, Mus musculus
gaatagggccttcgattaatgtcaa

SEQ ID NO: 435345 - DNA, 25 bp, Mus musculus
gaatagggccttggattaatgtcaa

SEQ ID NO: 435346 - DNA, 25 bp, Mus musculus
gaataggttgatattccatttaaag

SEQ ID NO: 435347 - DNA, 25 bp, Mus musculus
gaataggttgattttccatttaaag

SEQ ID NO: 435348 - DNA, 25 bp, Mus musculus
gaatagtagctcagactcggaccct

SEQ ID NO: 435349 - DNA, 25 bp, Mus musculus
gaatagtagctctgactcggaccct

SEQ ID NO: 435350 - DNA, 25 bp, Mus musculus
gaatagtagtgccttagccatccta

SEQ ID NO: 435351 - DNA, 25 bp, Mus musculus
gaatagtagtgcgttagccatccta

SEQ ID NO: 435352 - DNA, 25 bp, Mus musculus
gaatagtatcgtagtcatccccata

SEQ ID NO: 435353 - DNA, 25 bp, Mus musculus
gaatagtatcgttgtcatccccata

SEQ ID NO: 435354 - DNA, 25 bp, Mus musculus
gaatagtattaactcctggtgcttt

SEQ ID NO: 435355 - DNA, 25 bp, Mus musculus
gaatagtattaagtcctggtgcttt

SEQ ID NO: 435356 - DNA, 25 bp, Mus musculus
gaatagtatttacctccccagtatg

SEQ ID NO: 435357 - DNA, 25 bp, Mus musculus
gaatagtatttagctccccagtatg

SEQ ID NO: 435358 - DNA, 25 bp, Mus musculus
gaatagtcacatcagccattatggg

SEQ ID NO: 435359 - DNA, 25 bp, Mus musculus
gaatagtcacatgagccattatggg

SEQ ID NO: 435360 - DNA, 25 bp, Mus musculus
gaatagtcatgtccttgctttccct

SEQ ID NO: 435361 - DNA, 25 bp, Mus musculus
gaatagtcatgtgcttgctttccct

SEQ ID NO: 435362 - DNA, 25 bp, Mus musculus
gaatagtcccttaagcaatcatccc

SEQ ID NO: 435363 - DNA, 25 bp, Mus musculus
gaatagtccctttagcaatcatccc

SEQ ID NO: 435364 - DNA, 25 bp, Mus musculus
gaatagtccgatacatcacatccca

SEQ ID NO: 435365 - DNA, 25 bp, Mus musculus
gaatagtccgattcatcacatccca

SEQ ID NO: 435366 - DNA, 25 bp, Mus musculus
gaatagtcctgtcggttgtctctgc

SEQ ID NO: 435367 - DNA, 25 bp, Mus musculus
gaatagtcctgtgggttgtctctgc

SEQ ID NO: 435368 - DNA, 25 bp, Mus musculus
gaatagtctcacatacttagaggca

SEQ ID NO: 435369 - DNA, 25 bp, Mus musculus
gaatagtctcacttacttagaggca

SEQ ID NO: 435370 - DNA, 25 bp, Mus musculus
gaatagtgcagcagtgtgttcctga

SEQ ID NO: 435371 - DNA, 25 bp, Mus musculus
gaatagtgcagccagtgacaagcca

SEQ ID NO: 435372 - DNA, 25 bp, Mus musculus
gaatagtgcagcgagtgacaagcca

SEQ ID NO: 435373 - DNA, 25 bp, Mus musculus
gaatagtgcagctgtgtgttcctga

SEQ ID NO: 435374 - DNA, 25 bp, Mus musculus
gaatagtgccagcacttctgtttta

SEQ ID NO: 435375 - DNA, 25 bp, Mus musculus
gaatagtgccaggacttctgtttta

SEQ ID NO: 435376 - DNA, 25 bp, Mus musculus
gaatagtgccgcacactgtgggctc

SEQ ID NO: 435377 - DNA, 25 bp, Mus musculus
gaatagtgccgctcactgtgggctc

SEQ ID NO: 435378 - DNA, 25 bp, Mus musculus
gaatagtgcctgactcaatcggact

SEQ ID NO: 435379 - DNA, 25 bp, Mus musculus
gaatagtgcctgtctcaatcggact

SEQ ID NO: 435380 - DNA, 25 bp, Mus musculus
gaatagtgctccctagtctgtctct

SEQ ID NO: 435381 - DNA, 25 bp, Mus musculus
gaatagtgctccgtagtctgtctct

SEQ ID NO: 435382 - DNA, 25 bp, Mus musculus
gaatagtgtacccatgataatgttc

SEQ ID NO: 435383 - DNA, 25 bp, Mus musculus
gaatagtgtaccgatgataatgttc

SEQ ID NO: 435384 - DNA, 25 bp, Mus musculus
gaatagtgtcttctgccttgtcagc

SEQ ID NO: 435385 - DNA, 25 bp, Mus musculus
gaatagtgtcttgtgccttgtcagc

SEQ ID NO: 435386 - DNA, 25 bp, Mus musculus
gaatagtgtggacagtgacgactta

SEQ ID NO: 435387 - DNA, 25 bp, Mus musculus
gaatagtgtggagagtgacgactta

SEQ ID NO: 435388 - DNA, 25 bp, Mus musculus
gaatagtgtggcagtccttcagacc

SEQ ID NO: 435389 - DNA, 25 bp, Mus musculus
gaatagtgtggctgtccttcagacc

SEQ ID NO: 435390 - DNA, 25 bp, Mus musculus
gaatagtgttctactagggccttat

SEQ ID NO: 435391 - DNA, 25 bp, Mus musculus
gaatagtgttcttctagggccttat

SEQ ID NO: 435392 - DNA, 25 bp, Mus musculus
gaatagttacctattctcttttcat

SEQ ID NO: 435393 - DNA, 25 bp, Mus musculus
gaatagttaccttttctcttttcat

SEQ ID NO: 435394 - DNA, 25 bp, Mus musculus
gaatagttatggcttccttccctta

SEQ ID NO: 435395 - DNA, 25 bp, Mus musculus
gaatagttatgggttccttccctta

SEQ ID NO: 435396 - DNA, 25 bp, Mus musculus
gaatagttatttctgcggtttctta

SEQ ID NO: 435397 - DNA, 25 bp, Mus musculus
gaatagttatttgtgcggtttctta

SEQ ID NO: 435398 - DNA, 25 bp, Mus musculus
gaatagttccagcactgcaagcctc

SEQ ID NO: 435399 - DNA, 25 bp, Mus musculus
gaatagttccaggactgcaagcctc

SEQ ID NO: 435400 - DNA, 25 bp, Mus musculus
gaatagttctacatcaagacccagc

SEQ ID NO: 435401 - DNA, 25 bp, Mus musculus
gaatagttctacttcaagacccagc

SEQ ID NO: 435402 - DNA, 25 bp, Mus musculus
gaatagttcttgaatctaaacgtct

SEQ ID NO: 435403 - DNA, 25 bp, Mus musculus
gaatagttcttgtatctaaacgtct

SEQ ID NO: 435404 - DNA, 25 bp, Mus musculus
gaatagttgaggcacatccttcaga

SEQ ID NO: 435405 - DNA, 25 bp, Mus musculus
gaatagttgagggacatccttcaga

SEQ ID NO: 435406 - DNA, 25 bp, Mus musculus
gaatagttgctaatcttcctttaga

SEQ ID NO: 435407 - DNA, 25 bp, Mus musculus
gaatagttgctattcttcctttaga

SEQ ID NO: 435408 - DNA, 25 bp, Mus musculus
gaatagtttatgatccacagccgct

SEQ ID NO: 435409 - DNA, 25 bp, Mus musculus
gaatagtttatgttccacagccgct

SEQ ID NO: 435410 - DNA, 25 bp, Mus musculus
gaatagtttgctactatctttgtca

SEQ ID NO: 435411 - DNA, 25 bp, Mus musculus
gaatagtttgcttctatctttgtca

SEQ ID NO: 435412 - DNA, 25 bp, Mus musculus
gaatagttttatctcggcctacaga

SEQ ID NO: 435413 - DNA, 25 bp, Mus musculus
gaatagttttatgtcggcctacaga

SEQ ID NO: 435414 - DNA, 25 bp, Mus musculus
gaatagttttcacgacttttcgatt

SEQ ID NO: 435415 - DNA, 25 bp, Mus musculus
gaatagttttcaggacttttcgatt

SEQ ID NO: 435416 - DNA, 25 bp, Mus musculus
gaatagtttttccagtatccagatt

SEQ ID NO: 435417 - DNA, 25 bp, Mus musculus
gaatagtttttcgagtatccagatt

SEQ ID NO: 435418 - DNA, 25 bp, Mus musculus
gaatataaacttagttgccaggatt

SEQ ID NO: 435419 - DNA, 25 bp, Mus musculus
gaatataaactttgttgccaggatt

SEQ ID NO: 435420 - DNA, 25 bp, Mus musculus
gaatataaagtcacagtcctggccc

SEQ ID NO: 435421 - DNA, 25 bp, Mus musculus
gaatataaagtctcagtcctggccc

SEQ ID NO: 435422 - DNA, 25 bp, Mus musculus
gaatataacagtcgccatctcacct

SEQ ID NO: 435423 - DNA, 25 bp, Mus musculus
gaatataacagtggccatctcacct

SEQ ID NO: 435424 - DNA, 25 bp, Mus musculus
gaatataacattagcttgaataagt

SEQ ID NO: 435425 - DNA, 25 bp, Mus musculus
gaatataacatttgcttgaataagt

SEQ ID NO: 435426 - DNA, 25 bp, Mus musculus
gaatataacgaaacattgctctaca

SEQ ID NO: 435427 - DNA, 25 bp, Mus musculus
gaatataacgaatcattgctctaca

SEQ ID NO: 435428 - DNA, 25 bp, Mus musculus
gaatataacttcacagcatctcaca

SEQ ID NO: 435429 - DNA, 25 bp, Mus musculus
gaatataacttctcagcatctcaca

SEQ ID NO: 435430 - DNA, 25 bp, Mus musculus
gaatataagaaactcctcaccagga

SEQ ID NO: 435431 - DNA, 25 bp, Mus musculus
gaatataagaaagtcctcaccagga

SEQ ID NO: 435432 - DNA, 25 bp, Mus musculus
gaatataagagtagccctgcttggc

SEQ ID NO: 435433 - DNA, 25 bp, Mus musculus
gaatataagagttgccctgcttggc

SEQ ID NO: 435434 - DNA, 25 bp, Mus musculus
gaatataagccaactcctgtcaaca

SEQ ID NO: 435435 - DNA, 25 bp, Mus musculus
gaatataagccacttcattttctct

SEQ ID NO: 435436 - DNA, 25 bp, Mus musculus
gaatataagccagttcattttctct

SEQ ID NO: 435437 - DNA, 25 bp, Mus musculus
gaatataagccatctcctgtcaaca

SEQ ID NO: 435438 - DNA, 25 bp, Mus musculus
gaatataagtgcattttgcatttca

SEQ ID NO: 435439 - DNA, 25 bp, Mus musculus
gaatataagtgctttttgcatttca

SEQ ID NO: 435440 - DNA, 25 bp, Mus musculus
gaatataatgctccctttgtggccc

SEQ ID NO: 435441 - DNA, 25 bp, Mus musculus
gaatataatgctgcctttgtggccc

SEQ ID NO: 435442 - DNA, 25 bp, Mus musculus
gaatatacagcacccggcacattct

SEQ ID NO: 435443 - DNA, 25 bp, Mus musculus
gaatatacagcagccggcacattct

SEQ ID NO: 435444 - DNA, 25 bp, Mus musculus
gaatataccatgctgtgtctgttgt

SEQ ID NO: 435445 - DNA, 25 bp, Mus musculus
gaatataccatggtgtgtctgttgt

SEQ ID NO: 435446 - DNA, 25 bp, Mus musculus
gaatatacccatctctggatgcttt

SEQ ID NO: 435447 - DNA, 25 bp, Mus musculus
gaatatacccatgtctggatgcttt

SEQ ID NO: 435448 - DNA, 25 bp, Mus musculus
gaatataccctgaaacataggagtc

SEQ ID NO: 435449 - DNA, 25 bp, Mus musculus
gaatataccctgtaacataggagtc

SEQ ID NO: 435450 - DNA, 25 bp, Mus musculus
gaatataccttcatacctcatgtta

SEQ ID NO: 435451 - DNA, 25 bp, Mus musculus
gaatataccttcttacctcatgtta

SEQ ID NO: 435452 - DNA, 25 bp, Mus musculus
gaatatacgtatattgttccttaag

SEQ ID NO: 435453 - DNA, 25 bp, Mus musculus
gaatatacgtattttgttccttaag

SEQ ID NO: 435454 - DNA, 25 bp, Mus musculus
gaatatactacaagcacctcaagaa

SEQ ID NO: 435455 - DNA, 25 bp, Mus musculus
gaatatactacatgcacctcaagaa

SEQ ID NO: 435456 - DNA, 25 bp, Mus musculus
gaatatactcatcacagcaacactg

SEQ ID NO: 435457 - DNA, 25 bp, Mus musculus
gaatatactcatgacagcaacactg

SEQ ID NO: 435458 - DNA, 25 bp, Mus musculus
gaatatactcgcaatttcctttttg

SEQ ID NO: 435459 - DNA, 25 bp, Mus musculus
gaatatactcgctatttcctttttg

SEQ ID NO: 435460 - DNA, 25 bp, Mus musculus
gaatatactcttcccatggagagag

SEQ ID NO: 435461 - DNA, 25 bp, Mus musculus
gaatatactcttgccatggagagag

SEQ ID NO: 435462 - DNA, 25 bp, Mus musculus
gaatatacttccacagtttttcaat

SEQ ID NO: 435463 - DNA, 25 bp, Mus musculus
gaatatacttcctcagtttttcaat

SEQ ID NO: 435464 - DNA, 25 bp, Mus musculus
gaatatacttggaaggagcatctcc

SEQ ID NO: 435465 - DNA, 25 bp, Mus musculus
gaatatacttggtaggagcatctcc

SEQ ID NO: 435466 - DNA, 25 bp, Mus musculus
gaatatagaaaaacccttactcaat

SEQ ID NO: 435467 - DNA, 25 bp, Mus musculus
gaatatagaaaatcccttactcaat

SEQ ID NO: 435468 - DNA, 25 bp, Mus musculus
gaatatagaacgatcaccctcctac

SEQ ID NO: 435469 - DNA, 25 bp, Mus musculus
gaatatagaacgttcaccctcctac

SEQ ID NO: 435470 - DNA, 25 bp, Mus musculus
gaatatagcaaccaatggcacatta

SEQ ID NO: 435471 - DNA, 25 bp, Mus musculus
gaatatagcaacgaatggcacatta

SEQ ID NO: 435472 - DNA, 25 bp, Mus musculus
gaatatagtagccactgaagccact

SEQ ID NO: 435473 - DNA, 25 bp, Mus musculus
gaatatagtagcgactgaagccact

SEQ ID NO: 435474 - DNA, 25 bp, Mus musculus
gaatatagtggccttaccggctcct

SEQ ID NO: 435475 - DNA, 25 bp, Mus musculus
gaatatagtggcgttaccggctcct

SEQ ID NO: 435476 - DNA, 25 bp, Mus musculus
gaatatagtttgagctttttgggag

SEQ ID NO: 435477 - DNA, 25 bp, Mus musculus
gaatatagtttgtgctttttgggag

SEQ ID NO: 435478 - DNA, 25 bp, Mus musculus
gaatatatacttcgcatcacacagc

SEQ ID NO: 435479 - DNA, 25 bp, Mus musculus
gaatatatacttggcatcacacagc

SEQ ID NO: 435480 - DNA, 25 bp, Mus musculus
gaatatatatgtcgcatctcccaga

SEQ ID NO: 435481 - DNA, 25 bp, Mus musculus
gaatatatatgtggcatctcccaga

SEQ ID NO: 435482 - DNA, 25 bp, Mus musculus
gaatatatattaacctctccctgaa

SEQ ID NO: 435483 - DNA, 25 bp, Mus musculus
gaatatatattatcctctccctgaa

SEQ ID NO: 435484 - DNA, 25 bp, Mus musculus
gaatatatcaaaaactgagtcctct

SEQ ID NO: 435485 - DNA, 25 bp, Mus musculus
gaatatatcaaatactgagtcctct

SEQ ID NO: 435486 - DNA, 25 bp, Mus musculus
gaatatatcacacacccagcagggt

SEQ ID NO: 435487 - DNA, 25 bp, Mus musculus
gaatatatcacagacccagcagggt

SEQ ID NO: 435488 - DNA, 25 bp, Mus musculus
gaatatatcagaccacgacggagcg

SEQ ID NO: 435489 - DNA, 25 bp, Mus musculus
gaatatatcagagcacgacggagcg

SEQ ID NO: 435490 - DNA, 25 bp, Mus musculus
gaatatatcctaaaatatcttctag

SEQ ID NO: 435491 - DNA, 25 bp, Mus musculus
gaatatatcctataatatcttctag

SEQ ID NO: 435492 - DNA, 25 bp, Mus musculus
gaatatatccttatttaccaatgaa

SEQ ID NO: 435493 - DNA, 25 bp, Mus musculus
gaatatatccttttttaccaatgaa

SEQ ID NO: 435494 - DNA, 25 bp, Mus musculus
gaatatatctggctcattgactcct

SEQ ID NO: 435495 - DNA, 25 bp, Mus musculus
gaatatatctgggtcattgactcct

SEQ ID NO: 435496 - DNA, 25 bp, Mus musculus
gaatatatgaacctgcaagccttgt

SEQ ID NO: 435497 - DNA, 25 bp, Mus musculus
gaatatatgaacgtgcaagccttgt

SEQ ID NO: 435498 - DNA, 25 bp, Mus musculus
gaatatatgaccacgctcacccgca

SEQ ID NO: 435499 - DNA, 25 bp, Mus musculus
gaatatatgacctcgctcacccgca

SEQ ID NO: 435500 - DNA, 25 bp, Mus musculus
gaatatatgccaagatgtcttcaaa

SEQ ID NO: 435501 - DNA, 25 bp, Mus musculus
gaatatatgccatgatgtcttcaaa

SEQ ID NO: 435502 - DNA, 25 bp, Mus musculus
gaatatatgtgcagctcacttgagc

SEQ ID NO: 435503 - DNA, 25 bp, Mus musculus
gaatatatgtgctgctcacttgagc

SEQ ID NO: 435504 - DNA, 25 bp, Mus musculus
gaatatattaatcacttgcttggtg

SEQ ID NO: 435505 - DNA, 25 bp, Mus musculus
gaatatattaatgacttgcttggtg

SEQ ID NO: 435506 - DNA, 25 bp, Mus musculus
gaatatattcatccaacttaatttt

SEQ ID NO: 435507 - DNA, 25 bp, Mus musculus
gaatatattcatgcaacttaatttt

SEQ ID NO: 435508 - DNA, 25 bp, Mus musculus
gaatatattgcaaaattggccacag

SEQ ID NO: 435509 - DNA, 25 bp, Mus musculus
gaatatattgcataattggccacag

SEQ ID NO: 435510 - DNA, 25 bp, Mus musculus
gaatatattggtcttccgactgcaa

SEQ ID NO: 435511 - DNA, 25 bp, Mus musculus
gaatatattggtgttccgactgcaa

SEQ ID NO: 435512 - DNA, 25 bp, Mus musculus
gaatatattgttcttccccttgtga

SEQ ID NO: 435513 - DNA, 25 bp, Mus musculus
gaatatattgttgttccccttgtga

SEQ ID NO: 435514 - DNA, 25 bp, Mus musculus
gaatatatttccactgaatccagaa

SEQ ID NO: 435515 - DNA, 25 bp, Mus musculus
gaatatatttcctctgaatccagaa

SEQ ID NO: 435516 - DNA, 25 bp, Mus musculus
gaatatattttcaggctcggccaga

SEQ ID NO: 435517 - DNA, 25 bp, Mus musculus
gaatatattttctggctcggccaga

SEQ ID NO: 435518 - DNA, 25 bp, Mus musculus
gaatatcaaacaccttgcttataag

SEQ ID NO: 435519 - DNA, 25 bp, Mus musculus
gaatatcaaacagcttgcttataag

SEQ ID NO: 435520 - DNA, 25 bp, Mus musculus
gaatatcaaccgcaagctctctgct

SEQ ID NO: 435521 - DNA, 25 bp, Mus musculus
gaatatcaaccggaagctctctgct

SEQ ID NO: 435522 - DNA, 25 bp, Mus musculus
gaatatcaagttacctttggcaaga

SEQ ID NO: 435523 - DNA, 25 bp, Mus musculus
gaatatcaagtttcctttggcaaga

SEQ ID NO: 435524 - DNA, 25 bp, Mus musculus
gaatatcaatccatttacacaactg

SEQ ID NO: 435525 - DNA, 25 bp, Mus musculus
gaatatcaatccttttacacaactg

SEQ ID NO: 435526 - DNA, 25 bp, Mus musculus
gaatatcacactcgtcaaagaaacc

SEQ ID NO: 435527 - DNA, 25 bp, Mus musculus
gaatatcacactggtcaaagaaacc

SEQ ID NO: 435528 - DNA, 25 bp, Mus musculus
gaatatcacatcctgatgctcccaa

SEQ ID NO: 435529 - DNA, 25 bp, Mus musculus
gaatatcacatcgtgatgctcccaa

SEQ ID NO: 435530 - DNA, 25 bp, Mus musculus
gaatatcacctgctcccagggccaa

SEQ ID NO: 435531 - DNA, 25 bp, Mus musculus
gaatatcacctggtcccagggccaa

SEQ ID NO: 435532 - DNA, 25 bp, Mus musculus
gaatatcactccaattttgtgtcta

SEQ ID NO: 435533 - DNA, 25 bp, Mus musculus
gaatatcactcctattttgtgtcta

SEQ ID NO: 435534 - DNA, 25 bp, Mus musculus
gaatatcagactatctcccaagttg

SEQ ID NO: 435535 - DNA, 25 bp, Mus musculus
gaatatcagactttctcccaagttg

SEQ ID NO: 435536 - DNA, 25 bp, Mus musculus
gaatatcagcatagtgtccattaaa

SEQ ID NO: 435537 - DNA, 25 bp, Mus musculus
gaatatcagcatccaggttctatgt

SEQ ID NO: 435538 - DNA, 25 bp, Mus musculus
gaatatcagcatgcaggttctatgt

SEQ ID NO: 435539 - DNA, 25 bp, Mus musculus
gaatatcagcattgtgtccattaaa

SEQ ID NO: 435540 - DNA, 25 bp, Mus musculus
gaatatcaggagacctacgacaagt

SEQ ID NO: 435541 - DNA, 25 bp, Mus musculus
gaatatcaggagtcctacgacaagt

SEQ ID NO: 435542 - DNA, 25 bp, Mus musculus
gaatatcaggctaagacttctggta

SEQ ID NO: 435543 - DNA, 25 bp, Mus musculus
gaatatcaggcttagacttctggta

SEQ ID NO: 435544 - DNA, 25 bp, Mus musculus
gaatatcagggcagcatcctaggat

SEQ ID NO: 435545 - DNA, 25 bp, Mus musculus
gaatatcagggctgcatcctaggat

SEQ ID NO: 435546 - DNA, 25 bp, Mus musculus
gaatatcagtggctaacctgtgaga

SEQ ID NO: 435547 - DNA, 25 bp, Mus musculus
gaatatcagtgggtaacctgtgaga

SEQ ID NO: 435548 - DNA, 25 bp, Mus musculus
gaatatcagtgtatcgaccaggcct

SEQ ID NO: 435549 - DNA, 25 bp, Mus musculus
gaatatcagtgtttcgaccaggcct

SEQ ID NO: 435550 - DNA, 25 bp, Mus musculus
gaatatcatcaaaacgcatgcctgc

SEQ ID NO: 435551 - DNA, 25 bp, Mus musculus
gaatatcatcaatacgcatgcctgc

SEQ ID NO: 435552 - DNA, 25 bp, Mus musculus
gaatatcatcttaacacacagccca

SEQ ID NO: 435553 - DNA, 25 bp, Mus musculus
gaatatcatctttacacacagccca

SEQ ID NO: 435554 - DNA, 25 bp, Mus musculus
gaatatcatggtatagcaaatcctt

SEQ ID NO: 435555 - DNA, 25 bp, Mus musculus
gaatatcatggtttagcaaatcctt

SEQ ID NO: 435556 - DNA, 25 bp, Mus musculus
gaatatcatttcagatgacttcatc

SEQ ID NO: 435557 - DNA, 25 bp, Mus musculus
gaatatcatttctgatgacttcatc

SEQ ID NO: 435558 - DNA, 25 bp, Mus musculus
gaatatccaaacataactctagctt

SEQ ID NO: 435559 - DNA, 25 bp, Mus musculus
gaatatccaaacttaactctagctt

SEQ ID NO: 435560 - DNA, 25 bp, Mus musculus
gaatatccagggatctctgacctgc

SEQ ID NO: 435561 - DNA, 25 bp, Mus musculus
gaatatccagggttctctgacctgc

SEQ ID NO: 435562 - DNA, 25 bp, Mus musculus
gaatatccagtaaggctatatccag

SEQ ID NO: 435563 - DNA, 25 bp, Mus musculus
gaatatccagtatggctatatccag

SEQ ID NO: 435564 - DNA, 25 bp, Mus musculus
gaatatccagttcgtacttatatgc

SEQ ID NO: 435565 - DNA, 25 bp, Mus musculus
gaatatccagttggtacttatatgc

SEQ ID NO: 435566 - DNA, 25 bp, Mus musculus
gaatatccataccagtgacagccat

SEQ ID NO: 435567 - DNA, 25 bp, Mus musculus
gaatatccatacgagtgacagccat

SEQ ID NO: 435568 - DNA, 25 bp, Mus musculus
gaatatccatggatcttttacttat

SEQ ID NO: 435569 - DNA, 25 bp, Mus musculus
gaatatccatggttcttttacttat

SEQ ID NO: 435570 - DNA, 25 bp, Mus musculus
gaatatccatgtcattaatactttt

SEQ ID NO: 435571 - DNA, 25 bp, Mus musculus
gaatatccatgtgattaatactttt

SEQ ID NO: 435572 - DNA, 25 bp, Mus musculus
gaatatccattccagcgtactcaac

SEQ ID NO: 435573 - DNA, 25 bp, Mus musculus
gaatatccattcgagcgtactcaac

SEQ ID NO: 435574 - DNA, 25 bp, Mus musculus
gaatatcccactatcactgaggaaa

SEQ ID NO: 435575 - DNA, 25 bp, Mus musculus
gaatatcccactttcactgaggaaa

SEQ ID NO: 435576 - DNA, 25 bp, Mus musculus
gaatatccccatcctcagaagtaaa

SEQ ID NO: 435577 - DNA, 25 bp, Mus musculus
gaatatccccatgctcagaagtaaa

SEQ ID NO: 435578 - DNA, 25 bp, Mus musculus
gaatatcccttcataaatctctgca

SEQ ID NO: 435579 - DNA, 25 bp, Mus musculus
gaatatcccttcttaaatctctgca

SEQ ID NO: 435580 - DNA, 25 bp, Mus musculus
gaatatccctttactgatgaatttt

SEQ ID NO: 435581 - DNA, 25 bp, Mus musculus
gaatatcccttttctgatgaatttt

SEQ ID NO: 435582 - DNA, 25 bp, Mus musculus
gaatatccgaacacacctgaaacac

SEQ ID NO: 435583 - DNA, 25 bp, Mus musculus
gaatatccgaactcacctgaaacac

SEQ ID NO: 435584 - DNA, 25 bp, Mus musculus
gaatatccgcttagtgtttgctgct

SEQ ID NO: 435585 - DNA, 25 bp, Mus musculus
gaatatccgctttgtgtttgctgct

SEQ ID NO: 435586 - DNA, 25 bp, Mus musculus
gaatatcctaatatcacccgtcttt

SEQ ID NO: 435587 - DNA, 25 bp, Mus musculus
gaatatcctaatttcacccgtcttt

SEQ ID NO: 435588 - DNA, 25 bp, Mus musculus
gaatatcctgctcgatgaacgaggt

SEQ ID NO: 435589 - DNA, 25 bp, Mus musculus
gaatatcctgctggatgaacgaggt

SEQ ID NO: 435590 - DNA, 25 bp, Mus musculus
gaatatcctgttatctcttaaacct

SEQ ID NO: 435591 - DNA, 25 bp, Mus musculus
gaatatcctgttttctcttaaacct

SEQ ID NO: 435592 - DNA, 25 bp, Mus musculus
gaatatccttacatcattgctccta

SEQ ID NO: 435593 - DNA, 25 bp, Mus musculus
gaatatccttacttcattgctccta

SEQ ID NO: 435594 - DNA, 25 bp, Mus musculus
gaatatccttccatcagggtttgat

SEQ ID NO: 435595 - DNA, 25 bp, Mus musculus
gaatatccttccttcagggtttgat

SEQ ID NO: 435596 - DNA, 25 bp, Mus musculus
gaatatcgaaccatctttgtatccg

SEQ ID NO: 435597 - DNA, 25 bp, Mus musculus
gaatatcgaaccttctttgtatccg

SEQ ID NO: 435598 - DNA, 25 bp, Mus musculus
gaatatcgagtcagcgctgagctgc

SEQ ID NO: 435599 - DNA, 25 bp, Mus musculus
gaatatcgagtctgcgctgagctgc

SEQ ID NO: 435600 - DNA, 25 bp, Mus musculus
gaatatcgcctcacagatacggaaa

SEQ ID NO: 435601 - DNA, 25 bp, Mus musculus
gaatatcgcctctcagatacggaaa

SEQ ID NO: 435602 - DNA, 25 bp, Mus musculus
gaatatcggaatatgcggctaacat

SEQ ID NO: 435603 - DNA, 25 bp, Mus musculus
gaatatcggaatttgcggctaacat

SEQ ID NO: 435604 - DNA, 25 bp, Mus musculus
gaatatcgtaaaaaagcccaacata

SEQ ID NO: 435605 - DNA, 25 bp, Mus musculus
gaatatcgtaaataagcccaacata

SEQ ID NO: 435606 - DNA, 25 bp, Mus musculus
gaatatcgtcccatgtctgaggaaa

SEQ ID NO: 435607 - DNA, 25 bp, Mus musculus
gaatatcgtcccttgtctgaggaaa

SEQ ID NO: 435608 - DNA, 25 bp, Mus musculus
gaatatctaataactttttaggcaa

SEQ ID NO: 435609 - DNA, 25 bp, Mus musculus
gaatatctaatatctttttaggcaa

SEQ ID NO: 435610 - DNA, 25 bp, Mus musculus
gaatatctacatcgctcagtatgag

SEQ ID NO: 435611 - DNA, 25 bp, Mus musculus
gaatatctacatggctcagtatgag

SEQ ID NO: 435612 - DNA, 25 bp, Mus musculus
gaatatctactaagcaaacggctta

SEQ ID NO: 435613 - DNA, 25 bp, Mus musculus
gaatatctactatgcaaacggctta

SEQ ID NO: 435614 - DNA, 25 bp, Mus musculus
gaatatctactgcaggtgcacacat

SEQ ID NO: 435615 - DNA, 25 bp, Mus musculus
gaatatctactggaggtgcacacat

SEQ ID NO: 435616 - DNA, 25 bp, Mus musculus
gaatatctatatcgcttttccttta

SEQ ID NO: 435617 - DNA, 25 bp, Mus musculus
gaatatctatatggcttttccttta

SEQ ID NO: 435618 - DNA, 25 bp, Mus musculus
gaatatctcaacattgaacttgttc

SEQ ID NO: 435619 - DNA, 25 bp, Mus musculus
gaatatctcaactttgaacttgttc

SEQ ID NO: 435620 - DNA, 25 bp, Mus musculus
gaatatctccggactaggatacatc

SEQ ID NO: 435621 - DNA, 25 bp, Mus musculus
gaatatctccggtctaggatacatc

SEQ ID NO: 435622 - DNA, 25 bp, Mus musculus
gaatatctcctgattatgttcacat

SEQ ID NO: 435623 - DNA, 25 bp, Mus musculus
gaatatctcctgtttatgttcacat

SEQ ID NO: 435624 - DNA, 25 bp, Mus musculus
gaatatctccttccatttttgtaat

SEQ ID NO: 435625 - DNA, 25 bp, Mus musculus
gaatatctccttgcatttttgtaat

SEQ ID NO: 435626 - DNA, 25 bp, Mus musculus
gaatatctctccagtcgtaagttag

SEQ ID NO: 435627 - DNA, 25 bp, Mus musculus
gaatatctctcctgtcgtaagttag

SEQ ID NO: 435628 - DNA, 25 bp, Mus musculus
gaatatctgagtcgccggagcatcc

SEQ ID NO: 435629 - DNA, 25 bp, Mus musculus
gaatatctgagtggccggagcatcc

SEQ ID NO: 435630 - DNA, 25 bp, Mus musculus
gaatatctggctaggctctctatcc

SEQ ID NO: 435631 - DNA, 25 bp, Mus musculus
gaatatctggcttggctctctatcc

SEQ ID NO: 435632 - DNA, 25 bp, Mus musculus
gaatatctgggtagctcttctgagc

SEQ ID NO: 435633 - DNA, 25 bp, Mus musculus
gaatatctgggttgctcttctgagc

SEQ ID NO: 435634 - DNA, 25 bp, Mus musculus
gaatatctgtgcatctctaaatctg

SEQ ID NO: 435635 - DNA, 25 bp, Mus musculus
gaatatctgtgccttctctaagaag

SEQ ID NO: 435636 - DNA, 25 bp, Mus musculus
gaatatctgtgcgttctctaagaag

SEQ ID NO: 435637 - DNA, 25 bp, Mus musculus
gaatatctgtgcttctctaaatctg

SEQ ID NO: 435638 - DNA, 25 bp, Mus musculus
gaatatcttattctgcacttatgca

SEQ ID NO: 435639 - DNA, 25 bp, Mus musculus
gaatatcttattgtgcacttatgca

SEQ ID NO: 435640 - DNA, 25 bp, Mus musculus
gaatatcttcaactccactttgtag

SEQ ID NO: 435641 - DNA, 25 bp, Mus musculus
gaatatcttcaagtccactttgtag

SEQ ID NO: 435642 - DNA, 25 bp, Mus musculus
gaatatctttaacctttgttcctag

SEQ ID NO: 435643 - DNA, 25 bp, Mus musculus
gaatatctttaagctttgttcctag

SEQ ID NO: 435644 - DNA, 25 bp, Mus musculus
gaatatctttcccagtgagcagacg

SEQ ID NO: 435645 - DNA, 25 bp, Mus musculus
gaatatctttccgagtgagcagacg

SEQ ID NO: 435646 - DNA, 25 bp, Mus musculus
gaatatgaaatgaggccttttcctc

SEQ ID NO: 435647 - DNA, 25 bp, Mus musculus
gaatatgaaatgtggccttttcctc

SEQ ID NO: 435648 - DNA, 25 bp, Mus musculus
gaatatgaacctcacaccaacgcaa

SEQ ID NO: 435649 - DNA, 25 bp, Mus musculus
gaatatgaacctgacaccaacgcaa

SEQ ID NO: 435650 - DNA, 25 bp, Mus musculus
gaatatgaacttaaccgggtcgtct

SEQ ID NO: 435651 - DNA, 25 bp, Mus musculus
gaatatgaacttctgactttctggg

SEQ ID NO: 435652 - DNA, 25 bp, Mus musculus
gaatatgaacttgtgactttctggg

SEQ ID NO: 435653 - DNA, 25 bp, Mus musculus
gaatatgaactttaccgggtcgtct

SEQ ID NO: 435654 - DNA, 25 bp, Mus musculus
gaatatgaagccctcttgaacatca

SEQ ID NO: 435655 - DNA, 25 bp, Mus musculus
gaatatgaagccgtcttgaacatca

SEQ ID NO: 435656 - DNA, 25 bp, Mus musculus
gaatatgaaggactcctctctccat

SEQ ID NO: 435657 - DNA, 25 bp, Mus musculus
gaatatgaaggagtcctctctccat

SEQ ID NO: 435658 - DNA, 25 bp, Mus musculus
gaatatgaatgcatctttcgtgtgt

SEQ ID NO: 435659 - DNA, 25 bp, Mus musculus
gaatatgaatgcttctttcgtgtgt

SEQ ID NO: 435660 - DNA, 25 bp, Mus musculus
gaatatgaattcatctcctgaatat

SEQ ID NO: 435661 - DNA, 25 bp, Mus musculus
gaatatgaattcttctcctgaatat

SEQ ID NO: 435662 - DNA, 25 bp, Mus musculus
gaatatgacaaaacttccctgtact

SEQ ID NO: 435663 - DNA, 25 bp, Mus musculus
gaatatgacaaacccaatacccagg

SEQ ID NO: 435664 - DNA, 25 bp, Mus musculus
gaatatgacaaagccaatacccagg

SEQ ID NO: 435665 - DNA, 25 bp, Mus musculus
gaatatgacaaatcttccctgtact

SEQ ID NO: 435666 - DNA, 25 bp, Mus musculus
gaatatgacaggacggcatcccttt

SEQ ID NO: 435667 - DNA, 25 bp, Mus musculus
gaatatgacaggtcggcatcccttt

SEQ ID NO: 435668 - DNA, 25 bp, Mus musculus
gaatatgacgaccatccagttaccc

SEQ ID NO: 435669 - DNA, 25 bp, Mus musculus
gaatatgacgacgatccagttaccc

SEQ ID NO: 435670 - DNA, 25 bp, Mus musculus
gaatatgacgtcagtgccatctgtc

SEQ ID NO: 435671 - DNA, 25 bp, Mus musculus
gaatatgacgtctgtgccatctgtc

SEQ ID NO: 435672 - DNA, 25 bp, Mus musculus
gaatatgactagatgctacctcatt

SEQ ID NO: 435673 - DNA, 25 bp, Mus musculus
gaatatgactagttgctacctcatt

SEQ ID NO: 435674 - DNA, 25 bp, Mus musculus
gaatatgactccacgtagcatgaaa

SEQ ID NO: 435675 - DNA, 25 bp, Mus musculus
gaatatgactcctcgtagcatgaaa

SEQ ID NO: 435676 - DNA, 25 bp, Mus musculus
gaatatgactctcactggtgacaag

SEQ ID NO: 435677 - DNA, 25 bp, Mus musculus
gaatatgactctgactggtgacaag

SEQ ID NO: 435678 - DNA, 25 bp, Mus musculus
gaatatgactggatctggccttgag

SEQ ID NO: 435679 - DNA, 25 bp, Mus musculus
gaatatgactggttctggccttgag

SEQ ID NO: 435680 - DNA, 25 bp, Mus musculus
gaatatgagacactgcagtcactga

SEQ ID NO: 435681 - DNA, 25 bp, Mus musculus
gaatatgagacagtgcagtcactga

SEQ ID NO: 435682 - DNA, 25 bp, Mus musculus
gaatatgagcaactctcttctgaag

SEQ ID NO: 435683 - DNA, 25 bp, Mus musculus
gaatatgagcaagtctcttctgaag

SEQ ID NO: 435684 - DNA, 25 bp, Mus musculus
gaatatgagcctacgatgttgcaag

SEQ ID NO: 435685 - DNA, 25 bp, Mus musculus
gaatatgagccttcgatgttgcaag

SEQ ID NO: 435686 - DNA, 25 bp, Mus musculus
gaatatgataagagctttaccttga

SEQ ID NO: 435687 - DNA, 25 bp, Mus musculus
gaatatgataagtgctttaccttga

SEQ ID NO: 435688 - DNA, 25 bp, Mus musculus
gaatatgataccctataacccagat

SEQ ID NO: 435689 - DNA, 25 bp, Mus musculus
gaatatgataccgtataacccagat

SEQ ID NO: 435690 - DNA, 25 bp, Mus musculus
gaatatgatcatcacctccctataa

SEQ ID NO: 435691 - DNA, 25 bp, Mus musculus
gaatatgatcatgacctccctataa

SEQ ID NO: 435692 - DNA, 25 bp, Mus musculus
gaatatgattttacccagccgtaca

SEQ ID NO: 435693 - DNA, 25 bp, Mus musculus
gaatatgatttttcccagccgtaca

SEQ ID NO: 435694 - DNA, 25 bp, Mus musculus
gaatatgcaaatagtcggccccgcc

SEQ ID NO: 435695 - DNA, 25 bp, Mus musculus
gaatatgcaaattgtcggccccgcc

SEQ ID NO: 435696 - DNA, 25 bp, Mus musculus
gaatatgcacttcctaaaaaggcca

SEQ ID NO: 435697 - DNA, 25 bp, Mus musculus
gaatatgcacttgctaaaaaggcca

SEQ ID NO: 435698 - DNA, 25 bp, Mus musculus
gaatatgcagccaagtcaatttcca

SEQ ID NO: 435699 - DNA, 25 bp, Mus musculus
gaatatgcagcctagtcaatttcca

SEQ ID NO: 435700 - DNA, 25 bp, Mus musculus
gaatatgcaggtctgtgggcacata

SEQ ID NO: 435701 - DNA, 25 bp, Mus musculus
gaatatgcaggtgtgtgggcacata

SEQ ID NO: 435702 - DNA, 25 bp, Mus musculus
gaatatgcagtcacttcttggccag

SEQ ID NO: 435703 - DNA, 25 bp, Mus musculus
gaatatgcagtctcttcttggccag

SEQ ID NO: 435704 - DNA, 25 bp, Mus musculus
gaatatgcatcgctcttagccatga

SEQ ID NO: 435705 - DNA, 25 bp, Mus musculus
gaatatgcatcggtcttagccatga

SEQ ID NO: 435706 - DNA, 25 bp, Mus musculus
gaatatgccgacatcagactgggtt

SEQ ID NO: 435707 - DNA, 25 bp, Mus musculus
gaatatgccgacttcagactgggtt

SEQ ID NO: 435708 - DNA, 25 bp, Mus musculus
gaatatgcctgcatccagaagcaca

SEQ ID NO: 435709 - DNA, 25 bp, Mus musculus
gaatatgcctgcttccagaagcaca

SEQ ID NO: 435710 - DNA, 25 bp, Mus musculus
gaatatgcctggacttgtgacttgg

SEQ ID NO: 435711 - DNA, 25 bp, Mus musculus
gaatatgcctggtcttgtgacttgg

SEQ ID NO: 435712 - DNA, 25 bp, Mus musculus
gaatatgcggttcctgtccagtctg

SEQ ID NO: 435713 - DNA, 25 bp, Mus musculus
gaatatgcggttgctgtccagtctg

SEQ ID NO: 435714 - DNA, 25 bp, Mus musculus
gaatatgctacaactggtccggtca

SEQ ID NO: 435715 - DNA, 25 bp, Mus musculus
gaatatgctacatctggtccggtca

SEQ ID NO: 435716 - DNA, 25 bp, Mus musculus
gaatatgctctactttcagtcagac

SEQ ID NO: 435717 - DNA, 25 bp, Mus musculus
gaatatgctctagtttcagtcagac

SEQ ID NO: 435718 - DNA, 25 bp, Mus musculus
gaatatgctctcaagttccctacat

SEQ ID NO: 435719 - DNA, 25 bp, Mus musculus
gaatatgctctctagttccctacat

SEQ ID NO: 435720 - DNA, 25 bp, Mus musculus
gaatatgctgcaacatctatgtcta

SEQ ID NO: 435721 - DNA, 25 bp, Mus musculus
gaatatgctgcatcatctatgtcta

SEQ ID NO: 435722 - DNA, 25 bp, Mus musculus
gaatatgctgctaatcacacctggt

SEQ ID NO: 435723 - DNA, 25 bp, Mus musculus
gaatatgctgcttatcacacctggt

SEQ ID NO: 435724 - DNA, 25 bp, Mus musculus
gaatatgcttcactgacagagccca

SEQ ID NO: 435725 - DNA, 25 bp, Mus musculus
gaatatgcttcagtgacagagccca

SEQ ID NO: 435726 - DNA, 25 bp, Mus musculus
gaatatggaaccaacagctcatgaa

SEQ ID NO: 435727 - DNA, 25 bp, Mus musculus
gaatatggaacctacagctcatgaa

SEQ ID NO: 435728 - DNA, 25 bp, Mus musculus
gaatatggaccaccagacagcagtg

SEQ ID NO: 435729 - DNA, 25 bp, Mus musculus
gaatatggaccacgcacataccagg

SEQ ID NO: 435730 - DNA, 25 bp, Mus musculus
gaatatggaccagcagacagcagtg

SEQ ID NO: 435731 - DNA, 25 bp, Mus musculus
gaatatggaccaggcacataccagg

SEQ ID NO: 435732 - DNA, 25 bp, Mus musculus
gaatatggatcaagtgcaatacacg

SEQ ID NO: 435733 - DNA, 25 bp, Mus musculus
gaatatggatcatgtgcaatacacg

SEQ ID NO: 435734 - DNA, 25 bp, Mus musculus
gaatatggatctcactttaacaata

SEQ ID NO: 435735 - DNA, 25 bp, Mus musculus
gaatatggatctgactttaacaata

SEQ ID NO: 435736 - DNA, 25 bp, Mus musculus
gaatatggattcctgcccaatccag

SEQ ID NO: 435737 - DNA, 25 bp, Mus musculus
gaatatggattcgtgcccaatccag

SEQ ID NO: 435738 - DNA, 25 bp, Mus musculus
gaatatggccttctttgggctcact

SEQ ID NO: 435739 - DNA, 25 bp, Mus musculus
gaatatggccttgtttgggctcact

SEQ ID NO: 435740 - DNA, 25 bp, Mus musculus
gaatatggcgacaaactcctaggag

SEQ ID NO: 435741 - DNA, 25 bp, Mus musculus
gaatatggcgactaactcctaggag

SEQ ID NO: 435742 - DNA, 25 bp, Mus musculus
gaatatggctacctaccaagtgcaa

SEQ ID NO: 435743 - DNA, 25 bp, Mus musculus
gaatatggctacgtaccaagtgcaa

SEQ ID NO: 435744 - DNA, 25 bp, Mus musculus
gaatatggctgcacagataccggaa

SEQ ID NO: 435745 - DNA, 25 bp, Mus musculus
gaatatggctgctcagataccggaa

SEQ ID NO: 435746 - DNA, 25 bp, Mus musculus
gaatatggcttgctgggccatccag

SEQ ID NO: 435747 - DNA, 25 bp, Mus musculus
gaatatggcttggtgggccatccag

SEQ ID NO: 435748 - DNA, 25 bp, Mus musculus
gaatatgggagcaagctacaacccc

SEQ ID NO: 435749 - DNA, 25 bp, Mus musculus
gaatatgggagctagctacaacccc

SEQ ID NO: 435750 - DNA, 25 bp, Mus musculus
gaatatgggcagctcaccttgacac

SEQ ID NO: 435751 - DNA, 25 bp, Mus musculus
gaatatgggcaggtcaccttgacac

SEQ ID NO: 435752 - DNA, 25 bp, Mus musculus
gaatatgggtgcacccggaccggca

SEQ ID NO: 435753 - DNA, 25 bp, Mus musculus
gaatatgggtgctcccggaccggca

SEQ ID NO: 435754 - DNA, 25 bp, Mus musculus
gaatatggtaaaccccgtgatctcc

SEQ ID NO: 435755 - DNA, 25 bp, Mus musculus
gaatatggtaaagcccgtgatctcc

SEQ ID NO: 435756 - DNA, 25 bp, Mus musculus
gaatatggtcatagggtcaaggccc

SEQ ID NO: 435757 - DNA, 25 bp, Mus musculus
gaatatggtcatctatctatcgcct

SEQ ID NO: 435758 - DNA, 25 bp, Mus musculus
gaatatggtcatgtatctatcgcct

SEQ ID NO: 435759 - DNA, 25 bp, Mus musculus
gaatatggtcattgggtcaaggccc

SEQ ID NO: 435760 - DNA, 25 bp, Mus musculus
gaatatggtgcacagaaattcaggc

SEQ ID NO: 435761 - DNA, 25 bp, Mus musculus
gaatatggtgcagagaaattcaggc

SEQ ID NO: 435762 - DNA, 25 bp, Mus musculus
gaatatggtggacccgagcattcct

SEQ ID NO: 435763 - DNA, 25 bp, Mus musculus
gaatatggtggagccgagcattcct

SEQ ID NO: 435764 - DNA, 25 bp, Mus musculus
gaatatggtggccagacctgtcatc

SEQ ID NO: 435765 - DNA, 25 bp, Mus musculus
gaatatggtggcgagacctgtcatc

SEQ ID NO: 435766 - DNA, 25 bp, Mus musculus
gaatatgtaacgcacctctggattt

SEQ ID NO: 435767 - DNA, 25 bp, Mus musculus
gaatatgtaacggacctctggattt

SEQ ID NO: 435768 - DNA, 25 bp, Mus musculus
gaatatgtagctcaagccctggaaa

SEQ ID NO: 435769 - DNA, 25 bp, Mus musculus
gaatatgtagctgaagccctggaaa

SEQ ID NO: 435770 - DNA, 25 bp, Mus musculus
gaatatgtatccatagtcccagaaa

SEQ ID NO: 435771 - DNA, 25 bp, Mus musculus
gaatatgtatccttagtcccagaaa

SEQ ID NO: 435772 - DNA, 25 bp, Mus musculus
gaatatgtatgtcacaccggaacat

SEQ ID NO: 435773 - DNA, 25 bp, Mus musculus
gaatatgtatgtgacaccggaacat

SEQ ID NO: 435774 - DNA, 25 bp, Mus musculus
gaatatgtcattagccctttttctg

SEQ ID NO: 435775 - DNA, 25 bp, Mus musculus
gaatatgtcatttgccctttttctg

SEQ ID NO: 435776 - DNA, 25 bp, Mus musculus
gaatatgtccaactttgtagtctac

SEQ ID NO: 435777 - DNA, 25 bp, Mus musculus
gaatatgtccaagtttgtagtctac

SEQ ID NO: 435778 - DNA, 25 bp, Mus musculus
gaatatgtccggcattatccccggg

SEQ ID NO: 435779 - DNA, 25 bp, Mus musculus
gaatatgtccgggattatccccggg

SEQ ID NO: 435780 - DNA, 25 bp, Mus musculus
gaatatgtctccacagattggcttt

SEQ ID NO: 435781 - DNA, 25 bp, Mus musculus
gaatatgtctcctcagattggcttt

SEQ ID NO: 435782 - DNA, 25 bp, Mus musculus
gaatatgtctctacagccttggaaa

SEQ ID NO: 435783 - DNA, 25 bp, Mus musculus
gaatatgtctcttcagccttggaaa

SEQ ID NO: 435784 - DNA, 25 bp, Mus musculus
gaatatgtctgtcgagtggcacctc

SEQ ID NO: 435785 - DNA, 25 bp, Mus musculus
gaatatgtctgtggagtggcacctc

SEQ ID NO: 435786 - DNA, 25 bp, Mus musculus
gaatatgtgaataacttgacttgcg

SEQ ID NO: 435787 - DNA, 25 bp, Mus musculus
gaatatgtgaattacttgacttgcg

SEQ ID NO: 435788 - DNA, 25 bp, Mus musculus
gaatatgtgcagaaggtacttccta

SEQ ID NO: 435789 - DNA, 25 bp, Mus musculus
gaatatgtgcagtaggtacttccta

SEQ ID NO: 435790 - DNA, 25 bp, Mus musculus
gaatatgtgtatatgaagccctcta

SEQ ID NO: 435791 - DNA, 25 bp, Mus musculus
gaatatgtgtatttgaagccctcta

SEQ ID NO: 435792 - DNA, 25 bp, Mus musculus
gaatatgtgtggacccagtcaggga

SEQ ID NO: 435793 - DNA, 25 bp, Mus musculus
gaatatgtgtggtcccagtcaggga

SEQ ID NO: 435794 - DNA, 25 bp, Mus musculus
gaatatgtgtttcacctcttacaag

SEQ ID NO: 435795 - DNA, 25 bp, Mus musculus
gaatatgtgtttgacctcttacaag

SEQ ID NO: 435796 - DNA, 25 bp, Mus musculus
gaatatgttaaaccctcctctttga

SEQ ID NO: 435797 - DNA, 25 bp, Mus musculus
gaatatgttaaactgcctctggctg

SEQ ID NO: 435798 - DNA, 25 bp, Mus musculus
gaatatgttaaagcctcctctttga

SEQ ID NO: 435799 - DNA, 25 bp, Mus musculus
gaatatgttaaagtgcctctggctg

SEQ ID NO: 435800 - DNA, 25 bp, Mus musculus
gaatatgttcacattgtatgtaggt

SEQ ID NO: 435801 - DNA, 25 bp, Mus musculus
gaatatgttcacctctgtcaagatc

SEQ ID NO: 435802 - DNA, 25 bp, Mus musculus
gaatatgttcacgtctgtcaagatc

SEQ ID NO: 435803 - DNA, 25 bp, Mus musculus
gaatatgttcactttgtatgtaggt

SEQ ID NO: 435804 - DNA, 25 bp, Mus musculus
gaatatgttcctcgcaagtcaatcc

SEQ ID NO: 435805 - DNA, 25 bp, Mus musculus
gaatatgttcctggcaagtcaatcc

SEQ ID NO: 435806 - DNA, 25 bp, Mus musculus
gaatatgttctgagcgggctatgag

SEQ ID NO: 435807 - DNA, 25 bp, Mus musculus
gaatatgttctgtgcgggctatgag

SEQ ID NO: 435808 - DNA, 25 bp, Mus musculus
gaatatgttcttatcttgggatttc

SEQ ID NO: 435809 - DNA, 25 bp, Mus musculus
gaatatgttcttttcttgggatttc

SEQ ID NO: 435810 - DNA, 25 bp, Mus musculus
gaatatgtttatccagaagccagag

SEQ ID NO: 435811 - DNA, 25 bp, Mus musculus
gaatatgtttatgcagaagccagag

SEQ ID NO: 435812 - DNA, 25 bp, Mus musculus
gaatatgttttcagaactttccaat

SEQ ID NO: 435813 - DNA, 25 bp, Mus musculus
gaatatgttttctgaactttccaat

SEQ ID NO: 435814 - DNA, 25 bp, Mus musculus
gaatattaacccatcttcctcgcag

SEQ ID NO: 435815 - DNA, 25 bp, Mus musculus
gaatattaacccttcttcctcgcag

SEQ ID NO: 435816 - DNA, 25 bp, Mus musculus
gaatattaactcacgccagcaggtg

SEQ ID NO: 435817 - DNA, 25 bp, Mus musculus
gaatattaactctcgccagcaggtg

SEQ ID NO: 435818 - DNA, 25 bp, Mus musculus
gaatattaacttaccatgtgctgcc

SEQ ID NO: 435819 - DNA, 25 bp, Mus musculus
gaatattaactttccatgtgctgcc

SEQ ID NO: 435820 - DNA, 25 bp, Mus musculus
gaatattaaggactcttgacccaaa

SEQ ID NO: 435821 - DNA, 25 bp, Mus musculus
gaatattaaggagtcttgacccaaa

SEQ ID NO: 435822 - DNA, 25 bp, Mus musculus
gaatattaatccacccgcagaagca

SEQ ID NO: 435823 - DNA, 25 bp, Mus musculus
gaatattaatcctcccgcagaagca

SEQ ID NO: 435824 - DNA, 25 bp, Mus musculus
gaatattacaggctcatttcctaat

SEQ ID NO: 435825 - DNA, 25 bp, Mus musculus
gaatattacagggtcatttcctaat

SEQ ID NO: 435826 - DNA, 25 bp, Mus musculus
gaatattacattacgcactcaggtg

SEQ ID NO: 435827 - DNA, 25 bp, Mus musculus
gaatattacatttcgcactcaggtg

SEQ ID NO: 435828 - DNA, 25 bp, Mus musculus
gaatattacctcagcccctatcagg

SEQ ID NO: 435829 - DNA, 25 bp, Mus musculus
gaatattacctctgcccctatcagg

SEQ ID NO: 435830 - DNA, 25 bp, Mus musculus
gaatattaccttacagatggcataa

SEQ ID NO: 435831 - DNA, 25 bp, Mus musculus
gaatattacctttcagatggcataa

SEQ ID NO: 435832 - DNA, 25 bp, Mus musculus
gaatattactccactttgtactaag

SEQ ID NO: 435833 - DNA, 25 bp, Mus musculus
gaatattactcctctttgtactaag

SEQ ID NO: 435834 - DNA, 25 bp, Mus musculus
gaatattacttcattgacaccaaca

SEQ ID NO: 435835 - DNA, 25 bp, Mus musculus
gaatattacttctttgacaccaaca

SEQ ID NO: 435836 - DNA, 25 bp, Mus musculus
gaatattagcttcatcctttgatgt

SEQ ID NO: 435837 - DNA, 25 bp, Mus musculus
gaatattagcttgatcctttgatgt

SEQ ID NO: 435838 - DNA, 25 bp, Mus musculus
gaatattagtctcctgaacctgata

SEQ ID NO: 435839 - DNA, 25 bp, Mus musculus
gaatattagtctgctgaacctgata

SEQ ID NO: 435840 - DNA, 25 bp, Mus musculus
gaatattataaacgagtgcagttct

SEQ ID NO: 435841 - DNA, 25 bp, Mus musculus
gaatattataaaggagtgcagttct

SEQ ID NO: 435842 - DNA, 25 bp, Mus musculus
gaatattcaaatctgtgctgtgtca

SEQ ID NO: 435843 - DNA, 25 bp, Mus musculus
gaatattcaaatgtgtgctgtgtca

SEQ ID NO: 435844 - DNA, 25 bp, Mus musculus
gaatattcaaccactggtccacact

SEQ ID NO: 435845 - DNA, 25 bp, Mus musculus
gaatattcaacctctggtccacact

SEQ ID NO: 435846 - DNA, 25 bp, Mus musculus
gaatattcaatcacttacgcatgat

SEQ ID NO: 435847 - DNA, 25 bp, Mus musculus
gaatattcaatctcttacgcatgat

SEQ ID NO: 435848 - DNA, 25 bp, Mus musculus
gaatattcagatatcgaggatgtcg

SEQ ID NO: 435849 - DNA, 25 bp, Mus musculus
gaatattcagatttcgaggatgtcg

SEQ ID NO: 435850 - DNA, 25 bp, Mus musculus
gaatattcagttactcccttaggta

SEQ ID NO: 435851 - DNA, 25 bp, Mus musculus
gaatattcagtttctcccttaggta

SEQ ID NO: 435852 - DNA, 25 bp, Mus musculus
gaatattcatcaccctggtgaggga

SEQ ID NO: 435853 - DNA, 25 bp, Mus musculus
gaatattcatcagcctggtgaggga

SEQ ID NO: 435854 - DNA, 25 bp, Mus musculus
gaatattccatgacaactgtcttgg

SEQ ID NO: 435855 - DNA, 25 bp, Mus musculus
gaatattccatgtcaactgtcttgg

SEQ ID NO: 435856 - DNA, 25 bp, Mus musculus
gaatattcccgtaaatagtgagatc

SEQ ID NO: 435857 - DNA, 25 bp, Mus musculus
gaatattcccgttaatagtgagatc

SEQ ID NO: 435858 - DNA, 25 bp, Mus musculus
gaatattccttgctaaacgctggtt

SEQ ID NO: 435859 - DNA, 25 bp, Mus musculus
gaatattccttggtaaacgctggtt

SEQ ID NO: 435860 - DNA, 25 bp, Mus musculus
gaatattctactacatggttggaac

SEQ ID NO: 435861 - DNA, 25 bp, Mus musculus
gaatattctactcaaacactggaaa

SEQ ID NO: 435862 - DNA, 25 bp, Mus musculus
gaatattctactgaaacactggaaa

SEQ ID NO: 435863 - DNA, 25 bp, Mus musculus
gaatattctacttcatggttggaac

SEQ ID NO: 435864 - DNA, 25 bp, Mus musculus
gaatattctctcagcatagtatact

SEQ ID NO: 435865 - DNA, 25 bp, Mus musculus
gaatattctctctgcatagtatact

SEQ ID NO: 435866 - DNA, 25 bp, Mus musculus
gaatattctgaaacgcagtcctccc

SEQ ID NO: 435867 - DNA, 25 bp, Mus musculus
gaatattctgaatcgcagtcctccc

SEQ ID NO: 435868 - DNA, 25 bp, Mus musculus
gaatattctgtcaggcatgtgcaag

SEQ ID NO: 435869 - DNA, 25 bp, Mus musculus
gaatattctgtctggcatgtgcaag

SEQ ID NO: 435870 - DNA, 25 bp, Mus musculus
gaatattctttgcaatgcctctcaa

SEQ ID NO: 435871 - DNA, 25 bp, Mus musculus
gaatattctttgcatctaactgcca

SEQ ID NO: 435872 - DNA, 25 bp, Mus musculus
gaatattctttggaatgcctctcaa

SEQ ID NO: 435873 - DNA, 25 bp, Mus musculus
gaatattctttggatctaactgcca

SEQ ID NO: 435874 - DNA, 25 bp, Mus musculus
gaatattgaataaacgttagcaggt

SEQ ID NO: 435875 - DNA, 25 bp, Mus musculus
gaatattgaatatacgttagcaggt

SEQ ID NO: 435876 - DNA, 25 bp, Mus musculus
gaatattgacttatttagcacaagc

SEQ ID NO: 435877 - DNA, 25 bp, Mus musculus
gaatattgacttttttagcacaagc

SEQ ID NO: 435878 - DNA, 25 bp, Mus musculus
gaatattgatctcttccggtataaa

SEQ ID NO: 435879 - DNA, 25 bp, Mus musculus
gaatattgatctgttccggtataaa

SEQ ID NO: 435880 - DNA, 25 bp, Mus musculus
gaatattgcagaattacctctgaca

SEQ ID NO: 435881 - DNA, 25 bp, Mus musculus
gaatattgcagatttacctctgaca

SEQ ID NO: 435882 - DNA, 25 bp, Mus musculus
gaatattgcttacacatccattttt

SEQ ID NO: 435883 - DNA, 25 bp, Mus musculus
gaatattgcttagacatccattttt

SEQ ID NO: 435884 - DNA, 25 bp, Mus musculus
gaatattggagaagcctagactata

SEQ ID NO: 435885 - DNA, 25 bp, Mus musculus
gaatattggagatgcctagactata

SEQ ID NO: 435886 - DNA, 25 bp, Mus musculus
gaatattggcccagtgtggctacca

SEQ ID NO: 435887 - DNA, 25 bp, Mus musculus
gaatattggccctgtgtggctacca

SEQ ID NO: 435888 - DNA, 25 bp, Mus musculus
gaatattggctgcttccactttgag

SEQ ID NO: 435889 - DNA, 25 bp, Mus musculus
gaatattggctggttccactttgag

SEQ ID NO: 435890 - DNA, 25 bp, Mus musculus
gaatattgtagacttcttttccctc

SEQ ID NO: 435891 - DNA, 25 bp, Mus musculus
gaatattgtagagttcttttccctc

SEQ ID NO: 435892 - DNA, 25 bp, Mus musculus
gaatattgtctcaccatatgcatct

SEQ ID NO: 435893 - DNA, 25 bp, Mus musculus
gaatattgtctctccatatgcatct

SEQ ID NO: 435894 - DNA, 25 bp, Mus musculus
gaatattgttttagcaccagaggag

SEQ ID NO: 435895 - DNA, 25 bp, Mus musculus
gaatattgtttttgcaccagaggag

SEQ ID NO: 435896 - DNA, 25 bp, Mus musculus
gaatatttattcagtccatttttca

SEQ ID NO: 435897 - DNA, 25 bp, Mus musculus
gaatatttattctgtccatttttca

SEQ ID NO: 435898 - DNA, 25 bp, Mus musculus
gaatatttccgtaaagtcttgaaca

SEQ ID NO: 435899 - DNA, 25 bp, Mus musculus
gaatatttccgttaagtcttgaaca

SEQ ID NO: 435900 - DNA, 25 bp, Mus musculus
gaatatttctctcgctttgctttga

SEQ ID NO: 435901 - DNA, 25 bp, Mus musculus
gaatatttctctggctttgctttga

SEQ ID NO: 435902 - DNA, 25 bp, Mus musculus
gaatatttctgtctccccaaaaaga

SEQ ID NO: 435903 - DNA, 25 bp, Mus musculus
gaatatttctgtgtccccaaaaaga

SEQ ID NO: 435904 - DNA, 25 bp, Mus musculus
gaatatttgcctatttgaggtacta

SEQ ID NO: 435905 - DNA, 25 bp, Mus musculus
gaatatttgcctttttgaggtacta

SEQ ID NO: 435906 - DNA, 25 bp, Mus musculus
gaatatttgcttaacatgtcaccca

SEQ ID NO: 435907 - DNA, 25 bp, Mus musculus
gaatatttgctttacatgtcaccca

SEQ ID NO: 435908 - DNA, 25 bp, Mus musculus
gaatatttggaaacgtaccctgtga

SEQ ID NO: 435909 - DNA, 25 bp, Mus musculus
gaatatttggaatcgtaccctgtga

SEQ ID NO: 435910 - DNA, 25 bp, Mus musculus
gaatatttggatccctctactaaac

SEQ ID NO: 435911 - DNA, 25 bp, Mus musculus
gaatatttggatgcctctactaaac

SEQ ID NO: 435912 - DNA, 25 bp, Mus musculus
gaatatttggtgcatatcgctggga

SEQ ID NO: 435913 - DNA, 25 bp, Mus musculus
gaatatttggtggatatcgctggga

SEQ ID NO: 435914 - DNA, 25 bp, Mus musculus
gaatattttcacatgcctattttca

SEQ ID NO: 435915 - DNA, 25 bp, Mus musculus
gaatattttcacttgcctattttca

SEQ ID NO: 435916 - DNA, 25 bp, Mus musculus
gaatattttccaagctctgagtgta

SEQ ID NO: 435917 - DNA, 25 bp, Mus musculus
gaatattttccatgctctgagtgta

SEQ ID NO: 435918 - DNA, 25 bp, Mus musculus
gaatattttccgagacttccgggag

SEQ ID NO: 435919 - DNA, 25 bp, Mus musculus
gaatattttccgtgacttccgggag

SEQ ID NO: 435920 - DNA, 25 bp, Mus musculus
gaatattttcctacaatgtggctgt

SEQ ID NO: 435921 - DNA, 25 bp, Mus musculus
gaatattttccttcaatgtggctgt

SEQ ID NO: 435922 - DNA, 25 bp, Mus musculus
gaatattttcgtcagactgctttta

SEQ ID NO: 435923 - DNA, 25 bp, Mus musculus
gaatattttcgtgagactgctttta

SEQ ID NO: 435924 - DNA, 25 bp, Mus musculus
gaatattttgccagcatggatgcat

SEQ ID NO: 435925 - DNA, 25 bp, Mus musculus
gaatattttgcctgcatggatgcat

SEQ ID NO: 435926 - DNA, 25 bp, Mus musculus
gaatattttgctacaatagacacag

SEQ ID NO: 435927 - DNA, 25 bp, Mus musculus
gaatattttgcttcaatagacacag

SEQ ID NO: 435928 - DNA, 25 bp, Mus musculus
gaatattttgttatcctgatggaac

SEQ ID NO: 435929 - DNA, 25 bp, Mus musculus
gaatattttgttattggccttttct

SEQ ID NO: 435930 - DNA, 25 bp, Mus musculus
gaatattttgttcatccatacgaaa

SEQ ID NO: 435931 - DNA, 25 bp, Mus musculus
gaatattttgttgatccatacgaaa

SEQ ID NO: 435932 - DNA, 25 bp, Mus musculus
gaatattttgttttcctgatggaac

SEQ ID NO: 435933 - DNA, 25 bp, Mus musculus
gaatattttgtttttggccttttct

SEQ ID NO: 435934 - DNA, 25 bp, Mus musculus
gaatatttttacctctgtattagac

SEQ ID NO: 435935 - DNA, 25 bp, Mus musculus
gaatatttttacgtctgtattagac

SEQ ID NO: 435936 - DNA, 25 bp, Mus musculus
gaatatttttatcgaattaccacat

SEQ ID NO: 435937 - DNA, 25 bp, Mus musculus
gaatatttttatggaattaccacat

SEQ ID NO: 435938 - DNA, 25 bp, Mus musculus
gaatattttttaaccataccttgaa

SEQ ID NO: 435939 - DNA, 25 bp, Mus musculus
gaatattttttaatccttcagacct

SEQ ID NO: 435940 - DNA, 25 bp, Mus musculus
gaatattttttatccataccttgaa

SEQ ID NO: 435941 - DNA, 25 bp, Mus musculus
gaatattttttattccttcagacct

SEQ ID NO: 435942 - DNA, 25 bp, Mus musculus
gaatcaaaaagcaagtcctagccct

SEQ ID NO: 435943 - DNA, 25 bp, Mus musculus
gaatcaaaaagctagtcctagccct

SEQ ID NO: 435944 - DNA, 25 bp, Mus musculus
gaatcaaaatcgaccgtaggccaca

SEQ ID NO: 435945 - DNA, 25 bp, Mus musculus
gaatcaaaatcgtccgtaggccaca

SEQ ID NO: 435946 - DNA, 25 bp, Mus musculus
gaatcaaaatgcaccggcctaggcc

SEQ ID NO: 435947 - DNA, 25 bp, Mus musculus
gaatcaaaatgctccggcctaggcc

SEQ ID NO: 435948 - DNA, 25 bp, Mus musculus
gaatcaaacaagacctcaagttcat

SEQ ID NO: 435949 - DNA, 25 bp, Mus musculus
gaatcaaacaagtcctcaagttcat

SEQ ID NO: 435950 - DNA, 25 bp, Mus musculus
gaatcaaaccgacagacatgacact

SEQ ID NO: 435951 - DNA, 25 bp, Mus musculus
gaatcaaaccgagagacatgacact

SEQ ID NO: 435952 - DNA, 25 bp, Mus musculus
gaatcaaacgagacgacctaacttt

SEQ ID NO: 435953 - DNA, 25 bp, Mus musculus
gaatcaaacgagtcgacctaacttt

SEQ ID NO: 435954 - DNA, 25 bp, Mus musculus
gaatcaaactgaagcatttaacgtg

SEQ ID NO: 435955 - DNA, 25 bp, Mus musculus
gaatcaaactgatgcatttaacgtg

SEQ ID NO: 435956 - DNA, 25 bp, Mus musculus
gaatcaaactggacataccactaat

SEQ ID NO: 435957 - DNA, 25 bp, Mus musculus
gaatcaaactggtcataccactaat

SEQ ID NO: 435958 - DNA, 25 bp, Mus musculus
gaatcaaagacgacaatttacaggt

SEQ ID NO: 435959 - DNA, 25 bp, Mus musculus
gaatcaaagacgtcaatttacaggt

SEQ ID NO: 435960 - DNA, 25 bp, Mus musculus
gaatcaaagcctatcctaagcgtaa

SEQ ID NO: 435961 - DNA, 25 bp, Mus musculus
gaatcaaagcctttcctaagcgtaa

SEQ ID NO: 435962 - DNA, 25 bp, Mus musculus
gaatcaaaggctataccttcagttt

SEQ ID NO: 435963 - DNA, 25 bp, Mus musculus
gaatcaaaggctttaccttcagttt

SEQ ID NO: 435964 - DNA, 25 bp, Mus musculus
gaatcaaaggtcaagccagcccaag

SEQ ID NO: 435965 - DNA, 25 bp, Mus musculus
gaatcaaaggtctagccagcccaag

SEQ ID NO: 435966 - DNA, 25 bp, Mus musculus
gaatcaaaggtgcaacattcaaccc

SEQ ID NO: 435967 - DNA, 25 bp, Mus musculus
gaatcaaaggtggaacattcaaccc

SEQ ID NO: 435968 - DNA, 25 bp, Mus musculus
gaatcaaatccactgtcctgtctaa

SEQ ID NO: 435969 - DNA, 25 bp, Mus musculus
gaatcaaatccagtgtcctgtctaa

SEQ ID NO: 435970 - DNA, 25 bp, Mus musculus
gaatcaaatccccagcatgtcagta

SEQ ID NO: 435971 - DNA, 25 bp, Mus musculus
gaatcaaatcccgagcatgtcagta

SEQ ID NO: 435972 - DNA, 25 bp, Mus musculus
gaatcaaatttgagtattctcagtt

SEQ ID NO: 435973 - DNA, 25 bp, Mus musculus
gaatcaaatttgtgtattctcagtt

SEQ ID NO: 435974 - DNA, 25 bp, Mus musculus
gaatcaacaacaaccttgctaactg

SEQ ID NO: 435975 - DNA, 25 bp, Mus musculus
gaatcaacaacacggactgagactt

SEQ ID NO: 435976 - DNA, 25 bp, Mus musculus
gaatcaacaacagggactgagactt

SEQ ID NO: 435977 - DNA, 25 bp, Mus musculus
gaatcaacaacatccttgctaactg

SEQ ID NO: 435978 - DNA, 25 bp, Mus musculus
gaatcaacagataacaaacccacca

SEQ ID NO: 435979 - DNA, 25 bp, Mus musculus
gaatcaacagattacaaacccacca

SEQ ID NO: 435980 - DNA, 25 bp, Mus musculus
gaatcaacatctattccttctgtcc

SEQ ID NO: 435981 - DNA, 25 bp, Mus musculus
gaatcaacatcttttccttctgtcc

SEQ ID NO: 435982 - DNA, 25 bp, Mus musculus
gaatcaacattcactgggccactga

SEQ ID NO: 435983 - DNA, 25 bp, Mus musculus
gaatcaacattctctgggccactga

SEQ ID NO: 435984 - DNA, 25 bp, Mus musculus
gaatcaacggttacagtcttttgga

SEQ ID NO: 435985 - DNA, 25 bp, Mus musculus
gaatcaacggtttcagtcttttgga

SEQ ID NO: 435986 - DNA, 25 bp, Mus musculus
gaatcaactaaccttggcacataga

SEQ ID NO: 435987 - DNA, 25 bp, Mus musculus
gaatcaactaacgttggcacataga

SEQ ID NO: 435988 - DNA, 25 bp, Mus musculus
gaatcaactagtactaggttcagtg

SEQ ID NO: 435989 - DNA, 25 bp, Mus musculus
gaatcaactagttctaggttcagtg

SEQ ID NO: 435990 - DNA, 25 bp, Mus musculus
gaatcaactattcagcccagggagg

SEQ ID NO: 435991 - DNA, 25 bp, Mus musculus
gaatcaactattgagcccagggagg

SEQ ID NO: 435992 - DNA, 25 bp, Mus musculus
gaatcaactcccataggttatcctc

SEQ ID NO: 435993 - DNA, 25 bp, Mus musculus
gaatcaactcccttaggttatcctc

SEQ ID NO: 435994 - DNA, 25 bp, Mus musculus
gaatcaactcctattaaggaggcca

SEQ ID NO: 435995 - DNA, 25 bp, Mus musculus
gaatcaactccttttaaggaggcca

SEQ ID NO: 435996 - DNA, 25 bp, Mus musculus
gaatcaactgatctgtacgtcctcc

SEQ ID NO: 435997 - DNA, 25 bp, Mus musculus
gaatcaactgatgtgtacgtcctcc

SEQ ID NO: 435998 - DNA, 25 bp, Mus musculus
gaatcaactggacacacacctgtgg

SEQ ID NO: 435999 - DNA, 25 bp, Mus musculus
gaatcaactggagacacacctgtgg

SEQ ID NO: 436000 - DNA, 25 bp, Mus musculus
gaatcaactgtaaaacactaaactc

SEQ ID NO: 436001 - DNA, 25 bp, Mus musculus
gaatcaactgtataacactaaactc

SEQ ID NO: 436002 - DNA, 25 bp, Mus musculus
gaatcaacttcaaggtctaccagcc

SEQ ID NO: 436003 - DNA, 25 bp, Mus musculus
gaatcaacttcatggtctaccagcc

SEQ ID NO: 436004 - DNA, 25 bp, Mus musculus
gaatcaacttctattgtccaggcag

SEQ ID NO: 436005 - DNA, 25 bp, Mus musculus
gaatcaacttcttttgtccaggcag

SEQ ID NO: 436006 - DNA, 25 bp, Mus musculus
gaatcaagaagaagtcccctgcgac

SEQ ID NO: 436007 - DNA, 25 bp, Mus musculus
gaatcaagaagatgtcccctgcgac

SEQ ID NO: 436008 - DNA, 25 bp, Mus musculus
gaatcaagagctcagggcattgacc

SEQ ID NO: 436009 - DNA, 25 bp, Mus musculus
gaatcaagagctgagggcattgacc

SEQ ID NO: 436010 - DNA, 25 bp, Mus musculus
gaatcaagagtacaaatggcttcaa

SEQ ID NO: 436011 - DNA, 25 bp, Mus musculus
gaatcaagagtagaaatggcttcaa

SEQ ID NO: 436012 - DNA, 25 bp, Mus musculus
gaatcaagatgtcaatgtccccttt

SEQ ID NO: 436013 - DNA, 25 bp, Mus musculus
gaatcaagatgtgaatgtccccttt

SEQ ID NO: 436014 - DNA, 25 bp, Mus musculus
gaatcaagcaggaggccctgtcctt

SEQ ID NO: 436015 - DNA, 25 bp, Mus musculus
gaatcaagcaggtggccctgtcctt

SEQ ID NO: 436016 - DNA, 25 bp, Mus musculus
gaatcaagcatgaagccagcctcca

SEQ ID NO: 436017 - DNA, 25 bp, Mus musculus
gaatcaagcatgtagccagcctcca

SEQ ID NO: 436018 - DNA, 25 bp, Mus musculus
gaatcaagtcagactgagaggctgt

SEQ ID NO: 436019 - DNA, 25 bp, Mus musculus
gaatcaagtcagtctgagaggctgt

SEQ ID NO: 436020 - DNA, 25 bp, Mus musculus
gaatcaagtcatcaacagtcactgg

SEQ ID NO: 436021 - DNA, 25 bp, Mus musculus
gaatcaagtcatgaacagtcactgg

SEQ ID NO: 436022 - DNA, 25 bp, Mus musculus
gaatcaagtctacatttggcacaga

SEQ ID NO: 436023 - DNA, 25 bp, Mus musculus
gaatcaagtctagatttggcacaga

SEQ ID NO: 436024 - DNA, 25 bp, Mus musculus
gaatcaagtctccttccagtgaggg

SEQ ID NO: 436025 - DNA, 25 bp, Mus musculus
gaatcaagtctcgttccagtgaggg

SEQ ID NO: 436026 - DNA, 25 bp, Mus musculus
gaatcaagtgagacacctgctggta

SEQ ID NO: 436027 - DNA, 25 bp, Mus musculus
gaatcaagtgagtcacctgctggta

SEQ ID NO: 436028 - DNA, 25 bp, Mus musculus
gaatcaagttagctttagttacata

SEQ ID NO: 436029 - DNA, 25 bp, Mus musculus
gaatcaagttaggtttagttacata

SEQ ID NO: 436030 - DNA, 25 bp, Mus musculus
gaatcaagttccacaggacgagttt

SEQ ID NO: 436031 - DNA, 25 bp, Mus musculus
gaatcaagttcctcaggacgagttt

SEQ ID NO: 436032 - DNA, 25 bp, Mus musculus
gaatcaagtttgaacctttctccca

SEQ ID NO: 436033 - DNA, 25 bp, Mus musculus
gaatcaagtttgtacctttctccca

SEQ ID NO: 436034 - DNA, 25 bp, Mus musculus
gaatcaataaaaagcagctcctgcc

SEQ ID NO: 436035 - DNA, 25 bp, Mus musculus
gaatcaataaaatgcagctcctgcc

SEQ ID NO: 436036 - DNA, 25 bp, Mus musculus
gaatcaataccaatacccttggttt

SEQ ID NO: 436037 - DNA, 25 bp, Mus musculus
gaatcaataccattacccttggttt

SEQ ID NO: 436038 - DNA, 25 bp, Mus musculus
gaatcaatactccaagctttcctcc

SEQ ID NO: 436039 - DNA, 25 bp, Mus musculus
gaatcaatactcgaagctttcctcc

SEQ ID NO: 436040 - DNA, 25 bp, Mus musculus
gaatcaatagatatccagccctcca

SEQ ID NO: 436041 - DNA, 25 bp, Mus musculus
gaatcaatagatttccagccctcca

SEQ ID NO: 436042 - DNA, 25 bp, Mus musculus
gaatcaatagttatggttcttacca

SEQ ID NO: 436043 - DNA, 25 bp, Mus musculus
gaatcaatagttttggttcttacca

SEQ ID NO: 436044 - DNA, 25 bp, Mus musculus
gaatcaatccctcgcactaatttta

SEQ ID NO: 436045 - DNA, 25 bp, Mus musculus
gaatcaatccctggcactaatttta

SEQ ID NO: 436046 - DNA, 25 bp, Mus musculus
gaatcaatctgaacaatgtaatcat

SEQ ID NO: 436047 - DNA, 25 bp, Mus musculus
gaatcaatctgatcaatgtaatcat

SEQ ID NO: 436048 - DNA, 25 bp, Mus musculus
gaatcaatctgtacaacaggttcat

SEQ ID NO: 436049 - DNA, 25 bp, Mus musculus
gaatcaatctgttcaacaggttcat

SEQ ID NO: 436050 - DNA, 25 bp, Mus musculus
gaatcaatctttaggtaggcaaact

SEQ ID NO: 436051 - DNA, 25 bp, Mus musculus
gaatcaatcttttggtaggcaaact

SEQ ID NO: 436052 - DNA, 25 bp, Mus musculus
gaatcaatgcatacgtagtacacag

SEQ ID NO: 436053 - DNA, 25 bp, Mus musculus
gaatcaatgcattcgtagtacacag

SEQ ID NO: 436054 - DNA, 25 bp, Mus musculus
gaatcaatgcctcgacattgcaatt

SEQ ID NO: 436055 - DNA, 25 bp, Mus musculus
gaatcaatgcctggacattgcaatt

SEQ ID NO: 436056 - DNA, 25 bp, Mus musculus
gaatcaattaaaaactctgcacttg

SEQ ID NO: 436057 - DNA, 25 bp, Mus musculus
gaatcaattaaatactctgcacttg

SEQ ID NO: 436058 - DNA, 25 bp, Mus musculus
gaatcaattcctaaaagtctaggta

SEQ ID NO: 436059 - DNA, 25 bp, Mus musculus
gaatcaattccttaaagtctaggta

SEQ ID NO: 436060 - DNA, 25 bp, Mus musculus
gaatcacaaagcctgtaacctggag

SEQ ID NO: 436061 - DNA, 25 bp, Mus musculus
gaatcacaaagcgtgtaacctggag

SEQ ID NO: 436062 - DNA, 25 bp, Mus musculus
gaatcacaacacatagtagcagaga

SEQ ID NO: 436063 - DNA, 25 bp, Mus musculus
gaatcacaacacttagtagcagaga

SEQ ID NO: 436064 - DNA, 25 bp, Mus musculus
gaatcacaacataacgggactctat

SEQ ID NO: 436065 - DNA, 25 bp, Mus musculus
gaatcacaacatctcatgatcacga

SEQ ID NO: 436066 - DNA, 25 bp, Mus musculus
gaatcacaacatgtcatgatcacga

SEQ ID NO: 436067 - DNA, 25 bp, Mus musculus
gaatcacaacattacgggactctat

SEQ ID NO: 436068 - DNA, 25 bp, Mus musculus
gaatcacaagatcgccttttgctgt

SEQ ID NO: 436069 - DNA, 25 bp, Mus musculus
gaatcacaagatggccttttgctgt

SEQ ID NO: 436070 - DNA, 25 bp, Mus musculus
gaatcacaataaccattttatgcca

SEQ ID NO: 436071 - DNA, 25 bp, Mus musculus
gaatcacaataagcattttatgcca

SEQ ID NO: 436072 - DNA, 25 bp, Mus musculus
gaatcacacacgatcctagaggcca

SEQ ID NO: 436073 - DNA, 25 bp, Mus musculus
gaatcacacacgttcctagaggcca

SEQ ID NO: 436074 - DNA, 25 bp, Mus musculus
gaatcacacagaccttggactttcc

SEQ ID NO: 436075 - DNA, 25 bp, Mus musculus
gaatcacacagagcttggactttcc

SEQ ID NO: 436076 - DNA, 25 bp, Mus musculus
gaatcacacatgcaattccttagat

SEQ ID NO: 436077 - DNA, 25 bp, Mus musculus
gaatcacacatggaattccttagat

SEQ ID NO: 436078 - DNA, 25 bp, Mus musculus
gaatcacacgaaaggaagctaggtt

SEQ ID NO: 436079 - DNA, 25 bp, Mus musculus
gaatcacacgaatggaagctaggtt

SEQ ID NO: 436080 - DNA, 25 bp, Mus musculus
gaatcacactgacggcagtcacata

SEQ ID NO: 436081 - DNA, 25 bp, Mus musculus
gaatcacactgagggcagtcacata

SEQ ID NO: 436082 - DNA, 25 bp, Mus musculus
gaatcacactttaactgtggctgaa

SEQ ID NO: 436083 - DNA, 25 bp, Mus musculus
gaatcacacttttactgtggctgaa

SEQ ID NO: 436084 - DNA, 25 bp, Mus musculus
gaatcacagataaggtcaaagcaac

SEQ ID NO: 436085 - DNA, 25 bp, Mus musculus
gaatcacagatatggtcaaagcaac

SEQ ID NO: 436086 - DNA, 25 bp, Mus musculus
gaatcacagatgagcttgtccccac

SEQ ID NO: 436087 - DNA, 25 bp, Mus musculus
gaatcacagatgtgcttgtccccac

SEQ ID NO: 436088 - DNA, 25 bp, Mus musculus
gaatcacagattaagcagctcctag

SEQ ID NO: 436089 - DNA, 25 bp, Mus musculus
gaatcacagatttagcagctcctag

SEQ ID NO: 436090 - DNA, 25 bp, Mus musculus
gaatcacagcaccataaaatccttg

SEQ ID NO: 436091 - DNA, 25 bp, Mus musculus
gaatcacagcacgataaaatccttg

SEQ ID NO: 436092 - DNA, 25 bp, Mus musculus
gaatcacagccccaactgggaacct

SEQ ID NO: 436093 - DNA, 25 bp, Mus musculus
gaatcacagcccgaactgggaacct

SEQ ID NO: 436094 - DNA, 25 bp, Mus musculus
gaatcacagcttcttagtcacctga

SEQ ID NO: 436095 - DNA, 25 bp, Mus musculus
gaatcacagcttgttagtcacctga

SEQ ID NO: 436096 - DNA, 25 bp, Mus musculus
gaatcacagggtagaacaagcaaga

SEQ ID NO: 436097 - DNA, 25 bp, Mus musculus
gaatcacagggttgaacaagcaaga

SEQ ID NO: 436098 - DNA, 25 bp, Mus musculus
gaatcacaggttccattatagtatt

SEQ ID NO: 436099 - DNA, 25 bp, Mus musculus
gaatcacaggttgcattatagtatt

SEQ ID NO: 436100 - DNA, 25 bp, Mus musculus
gaatcacagtctccgtctatagagg

SEQ ID NO: 436101 - DNA, 25 bp, Mus musculus
gaatcacagtctgcgtctatagagg

SEQ ID NO: 436102 - DNA, 25 bp, Mus musculus
gaatcacagttgacatcagcccaag

SEQ ID NO: 436103 - DNA, 25 bp, Mus musculus
gaatcacagttgtcatcagcccaag

SEQ ID NO: 436104 - DNA, 25 bp, Mus musculus
gaatcacatcaacacttagcttccc

SEQ ID NO: 436105 - DNA, 25 bp, Mus musculus
gaatcacatcaagacttagcttccc

SEQ ID NO: 436106 - DNA, 25 bp, Mus musculus
gaatcacatccaataagtgtcacat

SEQ ID NO: 436107 - DNA, 25 bp, Mus musculus
gaatcacatccattaagtgtcacat

SEQ ID NO: 436108 - DNA, 25 bp, Mus musculus
gaatcacatgcaccttgtctgctgt

SEQ ID NO: 436109 - DNA, 25 bp, Mus musculus
gaatcacatgcagcttgtctgctgt

SEQ ID NO: 436110 - DNA, 25 bp, Mus musculus
gaatcacatgggagttgcagtcaaa

SEQ ID NO: 436111 - DNA, 25 bp, Mus musculus
gaatcacatgggtgttgcagtcaaa

SEQ ID NO: 436112 - DNA, 25 bp, Mus musculus
gaatcacattatcccatcaggagtt

SEQ ID NO: 436113 - DNA, 25 bp, Mus musculus
gaatcacattatgccatcaggagtt

SEQ ID NO: 436114 - DNA, 25 bp, Mus musculus
gaatcacattcacaactcgcatagg

SEQ ID NO: 436115 - DNA, 25 bp, Mus musculus
gaatcacattcagaactcgcatagg

SEQ ID NO: 436116 - DNA, 25 bp, Mus musculus
gaatcacatttcaccttctggttgg

SEQ ID NO: 436117 - DNA, 25 bp, Mus musculus
gaatcacatttctccttctggttgg

SEQ ID NO: 436118 - DNA, 25 bp, Mus musculus
gaatcacattttctatccactcaaa

SEQ ID NO: 436119 - DNA, 25 bp, Mus musculus
gaatcacattttgtatccactcaaa

SEQ ID NO: 436120 - DNA, 25 bp, Mus musculus
gaatcaccaagaacagcagatgttg

SEQ ID NO: 436121 - DNA, 25 bp, Mus musculus
gaatcaccaagaatgcaggcctcac

SEQ ID NO: 436122 - DNA, 25 bp, Mus musculus
gaatcaccaagatcagcagatgttg

SEQ ID NO: 436123 - DNA, 25 bp, Mus musculus
gaatcaccaagattgcaggcctcac

SEQ ID NO: 436124 - DNA, 25 bp, Mus musculus
gaatcaccactcagtctattttatg

SEQ ID NO: 436125 - DNA, 25 bp, Mus musculus
gaatcaccactctgtctattttatg

SEQ ID NO: 436126 - DNA, 25 bp, Mus musculus
gaatcaccagagattctcttctggc

SEQ ID NO: 436127 - DNA, 25 bp, Mus musculus
gaatcaccagagtttctcttctggc

SEQ ID NO: 436128 - DNA, 25 bp, Mus musculus
gaatcaccatctctctgagcagtta

SEQ ID NO: 436129 - DNA, 25 bp, Mus musculus
gaatcaccatctgtctgagcagtta

SEQ ID NO: 436130 - DNA, 25 bp, Mus musculus
gaatcaccatttcctggtgtctcga

SEQ ID NO: 436131 - DNA, 25 bp, Mus musculus
gaatcaccatttgctggtgtctcga

SEQ ID NO: 436132 - DNA, 25 bp, Mus musculus
gaatcacccagcacagagcaccagg

SEQ ID NO: 436133 - DNA, 25 bp, Mus musculus
gaatcacccagctcagagcaccagg

SEQ ID NO: 436134 - DNA, 25 bp, Mus musculus
gaatcaccccggagaatgagcacca

SEQ ID NO: 436135 - DNA, 25 bp, Mus musculus
gaatcaccccggtgaatgagcacca

SEQ ID NO: 436136 - DNA, 25 bp, Mus musculus
gaatcacccgctccccaacatcaaa

SEQ ID NO: 436137 - DNA, 25 bp, Mus musculus
gaatcacccgctgcccaacatcaaa

SEQ ID NO: 436138 - DNA, 25 bp, Mus musculus
gaatcaccctacatccagagaagtg

SEQ ID NO: 436139 - DNA, 25 bp, Mus musculus
gaatcaccctacttccagagaagtg

SEQ ID NO: 436140 - DNA, 25 bp, Mus musculus
gaatcaccctagaggaaataggcaa

SEQ ID NO: 436141 - DNA, 25 bp, Mus musculus
gaatcaccctagtggaaataggcaa

SEQ ID NO: 436142 - DNA, 25 bp, Mus musculus
gaatcaccgaatactcttcgatgtt

SEQ ID NO: 436143 - DNA, 25 bp, Mus musculus
gaatcaccgaattctcttcgatgtt

SEQ ID NO: 436144 - DNA, 25 bp, Mus musculus
gaatcaccggatagtcaggaatttg

SEQ ID NO: 436145 - DNA, 25 bp, Mus musculus
gaatcaccggattgtcaggaatttg

SEQ ID NO: 436146 - DNA, 25 bp, Mus musculus
gaatcacctagcaaatttccataag

SEQ ID NO: 436147 - DNA, 25 bp, Mus musculus
gaatcacctagctaatttccataag

SEQ ID NO: 436148 - DNA, 25 bp, Mus musculus
gaatcacctcacatgttacaaacta

SEQ ID NO: 436149 - DNA, 25 bp, Mus musculus
gaatcacctcacttgttacaaacta

SEQ ID NO: 436150 - DNA, 25 bp, Mus musculus
gaatcacctctgagcatatgtttat

SEQ ID NO: 436151 - DNA, 25 bp, Mus musculus
gaatcacctctgtgcatatgtttat

SEQ ID NO: 436152 - DNA, 25 bp, Mus musculus
gaatcacctgatcatgttatgataa

SEQ ID NO: 436153 - DNA, 25 bp, Mus musculus
gaatcacctgatgatgttatgataa

SEQ ID NO: 436154 - DNA, 25 bp, Mus musculus
gaatcacctgcaatgaggttcctgt

SEQ ID NO: 436155 - DNA, 25 bp, Mus musculus
gaatcacctgcattgaggttcctgt

SEQ ID NO: 436156 - DNA, 25 bp, Mus musculus
gaatcacctgcccagttgtttttgt

SEQ ID NO: 436157 - DNA, 25 bp, Mus musculus
gaatcacctgccgagttgtttttgt

SEQ ID NO: 436158 - DNA, 25 bp, Mus musculus
gaatcacctggcattagtttgtaca

SEQ ID NO: 436159 - DNA, 25 bp, Mus musculus
gaatcacctggctttagtttgtaca

SEQ ID NO: 436160 - DNA, 25 bp, Mus musculus
gaatcacctggtctataggctctat

SEQ ID NO: 436161 - DNA, 25 bp, Mus musculus
gaatcacctggtgtataggctctat

SEQ ID NO: 436162 - DNA, 25 bp, Mus musculus
gaatcacctgtgactatgatccact

SEQ ID NO: 436163 - DNA, 25 bp, Mus musculus
gaatcacctgtgtctatgatccact

SEQ ID NO: 436164 - DNA, 25 bp, Mus musculus
gaatcacctgttagcccagggtgga

SEQ ID NO: 436165 - DNA, 25 bp, Mus musculus
gaatcacctgtttgcccagggtgga

SEQ ID NO: 436166 - DNA, 25 bp, Mus musculus
gaatcaccttaaaaccactggagta

SEQ ID NO: 436167 - DNA, 25 bp, Mus musculus
gaatcaccttaataccactggagta

SEQ ID NO: 436168 - DNA, 25 bp, Mus musculus
gaatcaccttgaactagtctctgct

SEQ ID NO: 436169 - DNA, 25 bp, Mus musculus
gaatcaccttgatctagtctctgct

SEQ ID NO: 436170 - DNA, 25 bp, Mus musculus
gaatcaccttgcagagattgccctg

SEQ ID NO: 436171 - DNA, 25 bp, Mus musculus
gaatcaccttgctgagattgccctg

SEQ ID NO: 436172 - DNA, 25 bp, Mus musculus
gaatcacctttccagttaactatta

SEQ ID NO: 436173 - DNA, 25 bp, Mus musculus
gaatcacctttcgagttaactatta

SEQ ID NO: 436174 - DNA, 25 bp, Mus musculus
gaatcacgacgcataacaggaagtt

SEQ ID NO: 436175 - DNA, 25 bp, Mus musculus
gaatcacgacgcttaacaggaagtt

SEQ ID NO: 436176 - DNA, 25 bp, Mus musculus
gaatcacgccaacgctcgagtcaag

SEQ ID NO: 436177 - DNA, 25 bp, Mus musculus
gaatcacgccaaggctcgagtcaag

SEQ ID NO: 436178 - DNA, 25 bp, Mus musculus
gaatcacgccagcagagcgacccag

SEQ ID NO: 436179 - DNA, 25 bp, Mus musculus
gaatcacgccaggagagcgacccag

SEQ ID NO: 436180 - DNA, 25 bp, Mus musculus
gaatcacgctccaatgcaggtcact

SEQ ID NO: 436181 - DNA, 25 bp, Mus musculus
gaatcacgctcctatgcaggtcact

SEQ ID NO: 436182 - DNA, 25 bp, Mus musculus
gaatcacgctgtcgttgtgtcaccc

SEQ ID NO: 436183 - DNA, 25 bp, Mus musculus
gaatcacgctgtggttgtgtcaccc

SEQ ID NO: 436184 - DNA, 25 bp, Mus musculus
gaatcacggacaccacttaatctta

SEQ ID NO: 436185 - DNA, 25 bp, Mus musculus
gaatcacggacagcacttaatctta

SEQ ID NO: 436186 - DNA, 25 bp, Mus musculus
gaatcacggagacgcaatcctgacc

SEQ ID NO: 436187 - DNA, 25 bp, Mus musculus
gaatcacggagaggcaatcctgacc

SEQ ID NO: 436188 - DNA, 25 bp, Mus musculus
gaatcacggggcattaaaccttttg

SEQ ID NO: 436189 - DNA, 25 bp, Mus musculus
gaatcacggggctttaaaccttttg

SEQ ID NO: 436190 - DNA, 25 bp, Mus musculus
gaatcacgtgtaaccaagccagtta

SEQ ID NO: 436191 - DNA, 25 bp, Mus musculus
gaatcacgtgtatccaagccagtta

SEQ ID NO: 436192 - DNA, 25 bp, Mus musculus
gaatcacgtgtgagttacctgaggt

SEQ ID NO: 436193 - DNA, 25 bp, Mus musculus
gaatcacgtgtgtgttacctgaggt

SEQ ID NO: 436194 - DNA, 25 bp, Mus musculus
gaatcacgttgcagttaccgttgga

SEQ ID NO: 436195 - DNA, 25 bp, Mus musculus
gaatcacgttgctgttaccgttgga

SEQ ID NO: 436196 - DNA, 25 bp, Mus musculus
gaatcactaagtatcccagctggcc

SEQ ID NO: 436197 - DNA, 25 bp, Mus musculus
gaatcactaagtttcccagctggcc

SEQ ID NO: 436198 - DNA, 25 bp, Mus musculus
gaatcactacatataccaggcattt

SEQ ID NO: 436199 - DNA, 25 bp, Mus musculus
gaatcactacatttaccaggcattt

SEQ ID NO: 436200 - DNA, 25 bp, Mus musculus
gaatcactaccaagtgctccagttt

SEQ ID NO: 436201 - DNA, 25 bp, Mus musculus
gaatcactaccatgtgctccagttt

SEQ ID NO: 436202 - DNA, 25 bp, Mus musculus
gaatcactataacagtgaggtatgt

SEQ ID NO: 436203 - DNA, 25 bp, Mus musculus
gaatcactataagagtgaggtatgt

SEQ ID NO: 436204 - DNA, 25 bp, Mus musculus
gaatcactatcaaccttacatcttt

SEQ ID NO: 436205 - DNA, 25 bp, Mus musculus
gaatcactatcatccttacatcttt

SEQ ID NO: 436206 - DNA, 25 bp, Mus musculus
gaatcactcaagatcttccactttc

SEQ ID NO: 436207 - DNA, 25 bp, Mus musculus
gaatcactcaagttcttccactttc

SEQ ID NO: 436208 - DNA, 25 bp, Mus musculus
gaatcactcacgatctgttgtgtgg

SEQ ID NO: 436209 - DNA, 25 bp, Mus musculus
gaatcactcacgttctgttgtgtgg

SEQ ID NO: 436210 - DNA, 25 bp, Mus musculus
gaatcactccatagttcgtgttgct

SEQ ID NO: 436211 - DNA, 25 bp, Mus musculus
gaatcactccattgttcgtgttgct

SEQ ID NO: 436212 - DNA, 25 bp, Mus musculus
gaatcactccctcaaaacaaaaaag

SEQ ID NO: 436213 - DNA, 25 bp, Mus musculus
gaatcactccctgaaaacaaaaaag

SEQ ID NO: 436214 - DNA, 25 bp, Mus musculus
gaatcactctctagatagatagata

SEQ ID NO: 436215 - DNA, 25 bp, Mus musculus
gaatcactctctctgtccagtactc

SEQ ID NO: 436216 - DNA, 25 bp, Mus musculus
gaatcactctctgtgtccagtactc

SEQ ID NO: 436217 - DNA, 25 bp, Mus musculus
gaatcactctcttgatagatagata

SEQ ID NO: 436218 - DNA, 25 bp, Mus musculus
gaatcactcttcaatgtcgtgagtc

SEQ ID NO: 436219 - DNA, 25 bp, Mus musculus
gaatcactcttctatgtcgtgagtc

SEQ ID NO: 436220 - DNA, 25 bp, Mus musculus
gaatcactgaatcgcagagcactct

SEQ ID NO: 436221 - DNA, 25 bp, Mus musculus
gaatcactgaatggcagagcactct

SEQ ID NO: 436222 - DNA, 25 bp, Mus musculus
gaatcactgactattcaggaccctg

SEQ ID NO: 436223 - DNA, 25 bp, Mus musculus
gaatcactgactccagggtccagag

SEQ ID NO: 436224 - DNA, 25 bp, Mus musculus
gaatcactgactgcagggtccagag

SEQ ID NO: 436225 - DNA, 25 bp, Mus musculus
gaatcactgacttttcaggaccctg

SEQ ID NO: 436226 - DNA, 25 bp, Mus musculus
gaatcactgatgagtaagggaccca

SEQ ID NO: 436227 - DNA, 25 bp, Mus musculus
gaatcactgatgtgtaagggaccca

SEQ ID NO: 436228 - DNA, 25 bp, Mus musculus
gaatcactgcggcagaatttcttct

SEQ ID NO: 436229 - DNA, 25 bp, Mus musculus
gaatcactgcgggagaatttcttct

SEQ ID NO: 436230 - DNA, 25 bp, Mus musculus
gaatcactgcttatacctacattgg

SEQ ID NO: 436231 - DNA, 25 bp, Mus musculus
gaatcactgcttttacctacattgg

SEQ ID NO: 436232 - DNA, 25 bp, Mus musculus
gaatcactggttaagctcttagtca

SEQ ID NO: 436233 - DNA, 25 bp, Mus musculus
gaatcactggtttagctcttagtca

SEQ ID NO: 436234 - DNA, 25 bp, Mus musculus
gaatcactgtccaagacggtgcaga

SEQ ID NO: 436235 - DNA, 25 bp, Mus musculus
gaatcactgtcctagacggtgcaga

SEQ ID NO: 436236 - DNA, 25 bp, Mus musculus
gaatcactgtgaaaggcttccattt

SEQ ID NO: 436237 - DNA, 25 bp, Mus musculus
gaatcactgtgataggcttccattt

SEQ ID NO: 436238 - DNA, 25 bp, Mus musculus
gaatcactgttacgctatatcaaag

SEQ ID NO: 436239 - DNA, 25 bp, Mus musculus
gaatcactgttaggctatatcaaag

SEQ ID NO: 436240 - DNA, 25 bp, Mus musculus
gaatcactgttgattttgaagcacc

SEQ ID NO: 436241 - DNA, 25 bp, Mus musculus
gaatcactgttgtttttgaagcacc

SEQ ID NO: 436242 - DNA, 25 bp, Mus musculus
gaatcacttatcctaaagctgccaa

SEQ ID NO: 436243 - DNA, 25 bp, Mus musculus
gaatcacttatcgtaaagctgccaa

SEQ ID NO: 436244 - DNA, 25 bp, Mus musculus
gaatcacttcaactaaaagctgctg

SEQ ID NO: 436245 - DNA, 25 bp, Mus musculus
gaatcacttcaagtaaaagctgctg

SEQ ID NO: 436246 - DNA, 25 bp, Mus musculus
gaatcacttcagcatcctatcatca

SEQ ID NO: 436247 - DNA, 25 bp, Mus musculus
gaatcacttcaggatcctatcatca

SEQ ID NO: 436248 - DNA, 25 bp, Mus musculus
gaatcacttgacacagcccacttat

SEQ ID NO: 436249 - DNA, 25 bp, Mus musculus
gaatcacttgactcagcccacttat

SEQ ID NO: 436250 - DNA, 25 bp, Mus musculus
gaatcacttgggatgccccaggatg

SEQ ID NO: 436251 - DNA, 25 bp, Mus musculus
gaatcacttgggttgccccaggatg

SEQ ID NO: 436252 - DNA, 25 bp, Mus musculus
gaatcactttaaactcacttgacag

SEQ ID NO: 436253 - DNA, 25 bp, Mus musculus
gaatcactttaatctcacttgacag

SEQ ID NO: 436254 - DNA, 25 bp, Mus musculus
gaatcactttcacagtaaccggatc

SEQ ID NO: 436255 - DNA, 25 bp, Mus musculus
gaatcactttcagagtaaccggatc

SEQ ID NO: 436256 - DNA, 25 bp, Mus musculus
gaatcacttttcactaggccataga

SEQ ID NO: 436257 - DNA, 25 bp, Mus musculus
gaatcacttttctctaggccataga

SEQ ID NO: 436258 - DNA, 25 bp, Mus musculus
gaatcagaacacataggcgcaaaaa

SEQ ID NO: 436259 - DNA, 25 bp, Mus musculus
gaatcagaacacttaggcgcaaaaa

SEQ ID NO: 436260 - DNA, 25 bp, Mus musculus
gaatcagaacccagatttagaaagc

SEQ ID NO: 436261 - DNA, 25 bp, Mus musculus
gaatcagaaccctgatttagaaagc

SEQ ID NO: 436262 - DNA, 25 bp, Mus musculus
gaatcagaagagaggcaggtcctac

SEQ ID NO: 436263 - DNA, 25 bp, Mus musculus
gaatcagaagagtggcaggtcctac

SEQ ID NO: 436264 - DNA, 25 bp, Mus musculus
gaatcagaagccctggaattgcaat

SEQ ID NO: 436265 - DNA, 25 bp, Mus musculus
gaatcagaagccgtggaattgcaat

SEQ ID NO: 436266 - DNA, 25 bp, Mus musculus
gaatcagacaatagggaagctcatc

SEQ ID NO: 436267 - DNA, 25 bp, Mus musculus
gaatcagacaattgggaagctcatc

SEQ ID NO: 436268 - DNA, 25 bp, Mus musculus
gaatcagacagtcacctgccatgtg

SEQ ID NO: 436269 - DNA, 25 bp, Mus musculus
gaatcagacagtccttgtgttgtaa

SEQ ID NO: 436270 - DNA, 25 bp, Mus musculus
gaatcagacagtgacctgccatgtg

SEQ ID NO: 436271 - DNA, 25 bp, Mus musculus
gaatcagacagtgcttgtgttgtaa

SEQ ID NO: 436272 - DNA, 25 bp, Mus musculus
gaatcagaccacaggctagaaccac

SEQ ID NO: 436273 - DNA, 25 bp, Mus musculus
gaatcagaccactggctagaaccac

SEQ ID NO: 436274 - DNA, 25 bp, Mus musculus
gaatcagacgtcaccttggcaaaga

SEQ ID NO: 436275 - DNA, 25 bp, Mus musculus
gaatcagacgtctccttggcaaaga

SEQ ID NO: 436276 - DNA, 25 bp, Mus musculus
gaatcagagaacctgccctttagtt

SEQ ID NO: 436277 - DNA, 25 bp, Mus musculus
gaatcagagaacgtgccctttagtt

SEQ ID NO: 436278 - DNA, 25 bp, Mus musculus
gaatcagagctacccagagcactct

SEQ ID NO: 436279 - DNA, 25 bp, Mus musculus
gaatcagagctagccagagcactct

SEQ ID NO: 436280 - DNA, 25 bp, Mus musculus
gaatcagagtccagttaaaccttac

SEQ ID NO: 436281 - DNA, 25 bp, Mus musculus
gaatcagagtcctgttaaaccttac

SEQ ID NO: 436282 - DNA, 25 bp, Mus musculus
gaatcagagtctcacatccccaggg

SEQ ID NO: 436283 - DNA, 25 bp, Mus musculus
gaatcagagtctgacatccccaggg

SEQ ID NO: 436284 - DNA, 25 bp, Mus musculus
gaatcagagtgcatttctaatagaa

SEQ ID NO: 436285 - DNA, 25 bp, Mus musculus
gaatcagagtgcttttctaatagaa

SEQ ID NO: 436286 - DNA, 25 bp, Mus musculus
gaatcagataatcaccaggctacca

SEQ ID NO: 436287 - DNA, 25 bp, Mus musculus
gaatcagataatgaccaggctacca

SEQ ID NO: 436288 - DNA, 25 bp, Mus musculus
gaatcagatctcaggctcataaatg

SEQ ID NO: 436289 - DNA, 25 bp, Mus musculus
gaatcagatctctggctcataaatg

SEQ ID NO: 436290 - DNA, 25 bp, Mus musculus
gaatcagcaccactgttaccacagt

SEQ ID NO: 436291 - DNA, 25 bp, Mus musculus
gaatcagcaccagtgttaccacagt

SEQ ID NO: 436292 - DNA, 25 bp, Mus musculus
gaatcagcatttaggttttttcaca

SEQ ID NO: 436293 - DNA, 25 bp, Mus musculus
gaatcagcattttggttttttcaca

SEQ ID NO: 436294 - DNA, 25 bp, Mus musculus
gaatcagccgttcatttctgaaggc

SEQ ID NO: 436295 - DNA, 25 bp, Mus musculus
gaatcagccgttgatttctgaaggc

SEQ ID NO: 436296 - DNA, 25 bp, Mus musculus
gaatcagcgcttaaacatccacaac

SEQ ID NO: 436297 - DNA, 25 bp, Mus musculus
gaatcagcgctttaacatccacaac

SEQ ID NO: 436298 - DNA, 25 bp, Mus musculus
gaatcagcggcactaacttgaacca

SEQ ID NO: 436299 - DNA, 25 bp, Mus musculus
gaatcagcggcagtaacttgaacca

SEQ ID NO: 436300 - DNA, 25 bp, Mus musculus
gaatcagcggtacttggaggccctc

SEQ ID NO: 436301 - DNA, 25 bp, Mus musculus
gaatcagcggtagttggaggccctc

SEQ ID NO: 436302 - DNA, 25 bp, Mus musculus
gaatcagctataatgtctttaattt

SEQ ID NO: 436303 - DNA, 25 bp, Mus musculus
gaatcagctatattgtctttaattt

SEQ ID NO: 436304 - DNA, 25 bp, Mus musculus
gaatcagctctcatagacagtcaac

SEQ ID NO: 436305 - DNA, 25 bp, Mus musculus
gaatcagctctcttagacagtcaac

SEQ ID NO: 436306 - DNA, 25 bp, Mus musculus
gaatcagctgttaagccatcctcgt

SEQ ID NO: 436307 - DNA, 25 bp, Mus musculus
gaatcagctgtttagccatcctcgt

SEQ ID NO: 436308 - DNA, 25 bp, Mus musculus
gaatcagcttgtctagtctccacat

SEQ ID NO: 436309 - DNA, 25 bp, Mus musculus
gaatcagcttgtgtagtctccacat

SEQ ID NO: 436310 - DNA, 25 bp, Mus musculus
gaatcagctttcatagaattatttg

SEQ ID NO: 436311 - DNA, 25 bp, Mus musculus
gaatcagctttcttagaattatttg

SEQ ID NO: 436312 - DNA, 25 bp, Mus musculus
gaatcaggaccccagtttattacca

SEQ ID NO: 436313 - DNA, 25 bp, Mus musculus
gaatcaggacccgagtttattacca

SEQ ID NO: 436314 - DNA, 25 bp, Mus musculus
gaatcaggacttcacttaatcaggt

SEQ ID NO: 436315 - DNA, 25 bp, Mus musculus
gaatcaggacttgacttaatcaggt

SEQ ID NO: 436316 - DNA, 25 bp, Mus musculus
gaatcaggagttaagggtcgccttt

SEQ ID NO: 436317 - DNA, 25 bp, Mus musculus
gaatcaggagtttagggtcgccttt

SEQ ID NO: 436318 - DNA, 25 bp, Mus musculus
gaatcaggcaccattaggcttccta

SEQ ID NO: 436319 - DNA, 25 bp, Mus musculus
gaatcaggcacctttaggcttccta

SEQ ID NO: 436320 - DNA, 25 bp, Mus musculus
gaatcaggcatcactatacttacat

SEQ ID NO: 436321 - DNA, 25 bp, Mus musculus
gaatcaggcatctctatacttacat

SEQ ID NO: 436322 - DNA, 25 bp, Mus musculus
gaatcaggccttaatgtcctggata

SEQ ID NO: 436323 - DNA, 25 bp, Mus musculus
gaatcaggcctttatgtcctggata

SEQ ID NO: 436324 - DNA, 25 bp, Mus musculus
gaatcaggctacatcggtgtctcgt

SEQ ID NO: 436325 - DNA, 25 bp, Mus musculus
gaatcaggctacttcggtgtctcgt

SEQ ID NO: 436326 - DNA, 25 bp, Mus musculus
gaatcaggctctaggagttttgcat

SEQ ID NO: 436327 - DNA, 25 bp, Mus musculus
gaatcaggctcttggagttttgcat

SEQ ID NO: 436328 - DNA, 25 bp, Mus musculus
gaatcaggcttacgtcttcaaattt

SEQ ID NO: 436329 - DNA, 25 bp, Mus musculus
gaatcaggcttaggtcttcaaattt

SEQ ID NO: 436330 - DNA, 25 bp, Mus musculus
gaatcaggctttccatgctgctcca

SEQ ID NO: 436331 - DNA, 25 bp, Mus musculus
gaatcaggctttgcatgctgctcca

SEQ ID NO: 436332 - DNA, 25 bp, Mus musculus
gaatcagggcagcttggttgttttt

SEQ ID NO: 436333 - DNA, 25 bp, Mus musculus
gaatcagggcaggttggttgttttt

SEQ ID NO: 436334 - DNA, 25 bp, Mus musculus
gaatcagggctacggcaaatactgg

SEQ ID NO: 436335 - DNA, 25 bp, Mus musculus
gaatcagggctagggcaaatactgg

SEQ ID NO: 436336 - DNA, 25 bp, Mus musculus
gaatcaggtccgaatcttatcagca

SEQ ID NO: 436337 - DNA, 25 bp, Mus musculus
gaatcaggtccgtatcttatcagca

SEQ ID NO: 436338 - DNA, 25 bp, Mus musculus
gaatcaggtcgcaagtgttcacctt

SEQ ID NO: 436339 - DNA, 25 bp, Mus musculus
gaatcaggtcgctagtgttcacctt

SEQ ID NO: 436340 - DNA, 25 bp, Mus musculus
gaatcaggtgctaagctatctctcc

SEQ ID NO: 436341 - DNA, 25 bp, Mus musculus
gaatcaggtgcttagctatctctcc

SEQ ID NO: 436342 - DNA, 25 bp, Mus musculus
gaatcaggtgttcttgtccatctat

SEQ ID NO: 436343 - DNA, 25 bp, Mus musculus
gaatcaggtgttgttgtccatctat

SEQ ID NO: 436344 - DNA, 25 bp, Mus musculus
gaatcaggttctatgcattttagca

SEQ ID NO: 436345 - DNA, 25 bp, Mus musculus
gaatcaggttctttgcattttagca

SEQ ID NO: 436346 - DNA, 25 bp, Mus musculus
gaatcagtaactcgtcctggctgct

SEQ ID NO: 436347 - DNA, 25 bp, Mus musculus
gaatcagtaactggtcctggctgct

SEQ ID NO: 436348 - DNA, 25 bp, Mus musculus
gaatcagtaccaatatagtcaaacc

SEQ ID NO: 436349 - DNA, 25 bp, Mus musculus
gaatcagtaccattatagtcaaacc

SEQ ID NO: 436350 - DNA, 25 bp, Mus musculus
gaatcagtagcccttgagccattaa

SEQ ID NO: 436351 - DNA, 25 bp, Mus musculus
gaatcagtagccgttgagccattaa

SEQ ID NO: 436352 - DNA, 25 bp, Mus musculus
gaatcagtagttcgcaaaatttcta

SEQ ID NO: 436353 - DNA, 25 bp, Mus musculus
gaatcagtagttggcaaaatttcta

SEQ ID NO: 436354 - DNA, 25 bp, Mus musculus
gaatcagtcagaacatagcttaaga

SEQ ID NO: 436355 - DNA, 25 bp, Mus musculus
gaatcagtcagatcatagcttaaga

SEQ ID NO: 436356 - DNA, 25 bp, Mus musculus
gaatcagtcatcatcccatgtgtga

SEQ ID NO: 436357 - DNA, 25 bp, Mus musculus
gaatcagtcatcttcccatgtgtga

SEQ ID NO: 436358 - DNA, 25 bp, Mus musculus
gaatcagtccccagaagttgtatcc

SEQ ID NO: 436359 - DNA, 25 bp, Mus musculus
gaatcagtcccctgaagttgtatcc

SEQ ID NO: 436360 - DNA, 25 bp, Mus musculus
gaatcagtcccgaagcctcttcttt

SEQ ID NO: 436361 - DNA, 25 bp, Mus musculus
gaatcagtcccgtagcctcttcttt

SEQ ID NO: 436362 - DNA, 25 bp, Mus musculus
gaatcagtctctcacagaaatggat

SEQ ID NO: 436363 - DNA, 25 bp, Mus musculus
gaatcagtctctgacagaaatggat

SEQ ID NO: 436364 - DNA, 25 bp, Mus musculus
gaatcagtgattagttctccttgag

SEQ ID NO: 436365 - DNA, 25 bp, Mus musculus
gaatcagtgattcgctcccagaggc

SEQ ID NO: 436366 - DNA, 25 bp, Mus musculus
gaatcagtgattggctcccagaggc

SEQ ID NO: 436367 - DNA, 25 bp, Mus musculus
gaatcagtgatttgttctccttgag

SEQ ID NO: 436368 - DNA, 25 bp, Mus musculus
gaatcagtgcatatgaacccctatg

SEQ ID NO: 436369 - DNA, 25 bp, Mus musculus
gaatcagtgcatttgaacccctatg

SEQ ID NO: 436370 - DNA, 25 bp, Mus musculus
gaatcagtgcttagggtgttctgta

SEQ ID NO: 436371 - DNA, 25 bp, Mus musculus
gaatcagtgcttcgcaatcgtcctt

SEQ ID NO: 436372 - DNA, 25 bp, Mus musculus
gaatcagtgcttggcaatcgtcctt

SEQ ID NO: 436373 - DNA, 25 bp, Mus musculus
gaatcagtgctttgggtgttctgta

SEQ ID NO: 436374 - DNA, 25 bp, Mus musculus
gaatcagtgtaacctctgggctcca

SEQ ID NO: 436375 - DNA, 25 bp, Mus musculus
gaatcagtgtaaccttgggctcttt

SEQ ID NO: 436376 - DNA, 25 bp, Mus musculus
gaatcagtgtaagctctgggctcca

SEQ ID NO: 436377 - DNA, 25 bp, Mus musculus
gaatcagtgtaagcttgggctcttt

SEQ ID NO: 436378 - DNA, 25 bp, Mus musculus
gaatcagttcaaatcaccggcacac

SEQ ID NO: 436379 - DNA, 25 bp, Mus musculus
gaatcagttcaattcaccggcacac

SEQ ID NO: 436380 - DNA, 25 bp, Mus musculus
gaatcagttcctctaagttgtcctc

SEQ ID NO: 436381 - DNA, 25 bp, Mus musculus
gaatcagttcctgtaagttgtcctc

SEQ ID NO: 436382 - DNA, 25 bp, Mus musculus
gaatcagttcggatgacctgggagt

SEQ ID NO: 436383 - DNA, 25 bp, Mus musculus
gaatcagttcggttgacctgggagt

SEQ ID NO: 436384 - DNA, 25 bp, Mus musculus
gaatcagttgagcttcagtgttgaa

SEQ ID NO: 436385 - DNA, 25 bp, Mus musculus
gaatcagttgaggttcagtgttgaa

SEQ ID NO: 436386 - DNA, 25 bp, Mus musculus
gaatcagtttcaatcaccgacaatg

SEQ ID NO: 436387 - DNA, 25 bp, Mus musculus
gaatcagtttcattcaccgacaatg

SEQ ID NO: 436388 - DNA, 25 bp, Mus musculus
gaatcagtttccctgtattccaaga

SEQ ID NO: 436389 - DNA, 25 bp, Mus musculus
gaatcagtttccgtgtattccaaga

SEQ ID NO: 436390 - DNA, 25 bp, Mus musculus
gaatcagtttgacttctcctggtct

SEQ ID NO: 436391 - DNA, 25 bp, Mus musculus
gaatcagtttgagttctcctggtct

SEQ ID NO: 436392 - DNA, 25 bp, Mus musculus
gaatcagtttgcctcccggagcagc

SEQ ID NO: 436393 - DNA, 25 bp, Mus musculus
gaatcagtttgcgtcccggagcagc

SEQ ID NO: 436394 - DNA, 25 bp, Mus musculus
gaatcagttttgaacttgatcatgt

SEQ ID NO: 436395 - DNA, 25 bp, Mus musculus
gaatcagttttgtacttgatcatgt

SEQ ID NO: 436396 - DNA, 25 bp, Mus musculus
gaatcataaagccagtctcttcaga

SEQ ID NO: 436397 - DNA, 25 bp, Mus musculus
gaatcataaagcgagtctcttcaga

SEQ ID NO: 436398 - DNA, 25 bp, Mus musculus
gaatcataactgacttaacctctct

SEQ ID NO: 436399 - DNA, 25 bp, Mus musculus
gaatcataactgtcttaacctctct

SEQ ID NO: 436400 - DNA, 25 bp, Mus musculus
gaatcataccaaaaccaatcgtttt

SEQ ID NO: 436401 - DNA, 25 bp, Mus musculus
gaatcataccaataccaatcgtttt

SEQ ID NO: 436402 - DNA, 25 bp, Mus musculus
gaatcatagtgccagactgcttaaa

SEQ ID NO: 436403 - DNA, 25 bp, Mus musculus
gaatcatagtgcgagactgcttaaa

SEQ ID NO: 436404 - DNA, 25 bp, Mus musculus
gaatcatatagtatcttcaatcata

SEQ ID NO: 436405 - DNA, 25 bp, Mus musculus
gaatcatatagtttcttcaatcata

SEQ ID NO: 436406 - DNA, 25 bp, Mus musculus
gaatcatatcttccactgcctggaa

SEQ ID NO: 436407 - DNA, 25 bp, Mus musculus
gaatcatatcttgcactgcctggaa

SEQ ID NO: 436408 - DNA, 25 bp, Mus musculus
gaatcatatttccattgtgagcata

SEQ ID NO: 436409 - DNA, 25 bp, Mus musculus
gaatcatatttcgattgtgagcata

SEQ ID NO: 436410 - DNA, 25 bp, Mus musculus
gaatcatcaaccagtgtgagaactc

SEQ ID NO: 436411 - DNA, 25 bp, Mus musculus
gaatcatcaacctgtgtgagaactc

SEQ ID NO: 436412 - DNA, 25 bp, Mus musculus
gaatcatcaagtatattttagggtt

SEQ ID NO: 436413 - DNA, 25 bp, Mus musculus
gaatcatcaagtttattttagggtt

SEQ ID NO: 436414 - DNA, 25 bp, Mus musculus
gaatcatcagaaccctagtcagtgc

SEQ ID NO: 436415 - DNA, 25 bp, Mus musculus
gaatcatcagaagcctagtcagtgc

SEQ ID NO: 436416 - DNA, 25 bp, Mus musculus
gaatcatcagccctctttgaacaaa

SEQ ID NO: 436417 - DNA, 25 bp, Mus musculus
gaatcatcagccgtctttgaacaaa

SEQ ID NO: 436418 - DNA, 25 bp, Mus musculus
gaatcatcataacccttctgttagg

SEQ ID NO: 436419 - DNA, 25 bp, Mus musculus
gaatcatcataagccttctgttagg

SEQ ID NO: 436420 - DNA, 25 bp, Mus musculus
gaatcatcatccattgtggtcgcta

SEQ ID NO: 436421 - DNA, 25 bp, Mus musculus
gaatcatcatcctttgtggtcgcta

SEQ ID NO: 436422 - DNA, 25 bp, Mus musculus
gaatcatcatttcctaattttcaga

SEQ ID NO: 436423 - DNA, 25 bp, Mus musculus
gaatcatcatttgctaattttcaga

SEQ ID NO: 436424 - DNA, 25 bp, Mus musculus
gaatcatccagaacttggctagggt

SEQ ID NO: 436425 - DNA, 25 bp, Mus musculus
gaatcatccagacgaaggccctgca

SEQ ID NO: 436426 - DNA, 25 bp, Mus musculus
gaatcatccagaggaaggccctgca

SEQ ID NO: 436427 - DNA, 25 bp, Mus musculus
gaatcatccagatcttggctagggt

SEQ ID NO: 436428 - DNA, 25 bp, Mus musculus
gaatcatccatgacctggcccaggt

SEQ ID NO: 436429 - DNA, 25 bp, Mus musculus
gaatcatccatgtcctggcccaggt

SEQ ID NO: 436430 - DNA, 25 bp, Mus musculus
gaatcatccttcctgatggagctat

SEQ ID NO: 436431 - DNA, 25 bp, Mus musculus
gaatcatccttcgtgatggagctat

SEQ ID NO: 436432 - DNA, 25 bp, Mus musculus
gaatcatcgctactttattttcagt

SEQ ID NO: 436433 - DNA, 25 bp, Mus musculus
gaatcatcgctagtttattttcagt

SEQ ID NO: 436434 - DNA, 25 bp, Mus musculus
gaatcatctaagaactctggtggcc

SEQ ID NO: 436435 - DNA, 25 bp, Mus musculus
gaatcatctaagtactctggtggcc

SEQ ID NO: 436436 - DNA, 25 bp, Mus musculus
gaatcatctacaatcagtacagaac

SEQ ID NO: 436437 - DNA, 25 bp, Mus musculus
gaatcatctacattcagtacagaac

SEQ ID NO: 436438 - DNA, 25 bp, Mus musculus
gaatcatctcacaaggcctggaaat

SEQ ID NO: 436439 - DNA, 25 bp, Mus musculus
gaatcatctcacagtattttaaatg

SEQ ID NO: 436440 - DNA, 25 bp, Mus musculus
gaatcatctcactaggcctggaaat

SEQ ID NO: 436441 - DNA, 25 bp, Mus musculus
gaatcatctcactgtattttaaatg

SEQ ID NO: 436442 - DNA, 25 bp, Mus musculus
gaatcatctctcagcacagggtgtt

SEQ ID NO: 436443 - DNA, 25 bp, Mus musculus
gaatcatctctcatactactagtac

SEQ ID NO: 436444 - DNA, 25 bp, Mus musculus
gaatcatctctctgcacagggtgtt

SEQ ID NO: 436445 - DNA, 25 bp, Mus musculus
gaatcatctctcttactactagtac

SEQ ID NO: 436446 - DNA, 25 bp, Mus musculus
gaatcatctgacacttgaaatccca

SEQ ID NO: 436447 - DNA, 25 bp, Mus musculus
gaatcatctgactcttgaaatccca

SEQ ID NO: 436448 - DNA, 25 bp, Mus musculus
gaatcatctgcaattgttacctctc

SEQ ID NO: 436449 - DNA, 25 bp, Mus musculus
gaatcatctgcatttgttacctctc

SEQ ID NO: 436450 - DNA, 25 bp, Mus musculus
gaatcatcttcgaagtgagtcttta

SEQ ID NO: 436451 - DNA, 25 bp, Mus musculus
gaatcatcttcgtagtgagtcttta

SEQ ID NO: 436452 - DNA, 25 bp, Mus musculus
gaatcatcttgcagcatgccatcta

SEQ ID NO: 436453 - DNA, 25 bp, Mus musculus
gaatcatcttgctgcatgccatcta

SEQ ID NO: 436454 - DNA, 25 bp, Mus musculus
gaatcatcttgtatgttggcctcca

SEQ ID NO: 436455 - DNA, 25 bp, Mus musculus
gaatcatcttgtttgttggcctcca

SEQ ID NO: 436456 - DNA, 25 bp, Mus musculus
gaatcatctttcaattttagtgaaa

SEQ ID NO: 436457 - DNA, 25 bp, Mus musculus
gaatcatctttctattttagtgaaa

SEQ ID NO: 436458 - DNA, 25 bp, Mus musculus
gaatcatctttgcatttagtcttac

SEQ ID NO: 436459 - DNA, 25 bp, Mus musculus
gaatcatctttggatttagtcttac

SEQ ID NO: 436460 - DNA, 25 bp, Mus musculus
gaatcatgaactctagtcactgaga

SEQ ID NO: 436461 - DNA, 25 bp, Mus musculus
gaatcatgaactgtagtcactgaga

SEQ ID NO: 436462 - DNA, 25 bp, Mus musculus
gaatcatgaagacccaactccagaa

SEQ ID NO: 436463 - DNA, 25 bp, Mus musculus
gaatcatgaagagccaactccagaa

SEQ ID NO: 436464 - DNA, 25 bp, Mus musculus
gaatcatgacctacagagtctagtt

SEQ ID NO: 436465 - DNA, 25 bp, Mus musculus
gaatcatgaccttcagagtctagtt

SEQ ID NO: 436466 - DNA, 25 bp, Mus musculus
gaatcatgatcgcagaatttggaat

SEQ ID NO: 436467 - DNA, 25 bp, Mus musculus
gaatcatgatcggagaatttggaat

SEQ ID NO: 436468 - DNA, 25 bp, Mus musculus
gaatcatgccacaagttcatacttt

SEQ ID NO: 436469 - DNA, 25 bp, Mus musculus
gaatcatgccactagttcatacttt

SEQ ID NO: 436470 - DNA, 25 bp, Mus musculus
gaatcatgccttaggtgtcacagct

SEQ ID NO: 436471 - DNA, 25 bp, Mus musculus
gaatcatgcctttggtgtcacagct

SEQ ID NO: 436472 - DNA, 25 bp, Mus musculus
gaatcatgcgagaaatcatcataga

SEQ ID NO: 436473 - DNA, 25 bp, Mus musculus
gaatcatgcgagtaatcatcataga

SEQ ID NO: 436474 - DNA, 25 bp, Mus musculus
gaatcatgctgaattgctaccatca

SEQ ID NO: 436475 - DNA, 25 bp, Mus musculus
gaatcatgctgatttgctaccatca

SEQ ID NO: 436476 - DNA, 25 bp, Mus musculus
gaatcatggaaacggcttcttcgaa

SEQ ID NO: 436477 - DNA, 25 bp, Mus musculus
gaatcatggaaagggcttcttcgaa

SEQ ID NO: 436478 - DNA, 25 bp, Mus musculus
gaatcatggacacgatactctttca

SEQ ID NO: 436479 - DNA, 25 bp, Mus musculus
gaatcatggacaggatactctttca

SEQ ID NO: 436480 - DNA, 25 bp, Mus musculus
gaatcatggaggagggctagactaa

SEQ ID NO: 436481 - DNA, 25 bp, Mus musculus
gaatcatggaggtgggctagactaa

SEQ ID NO: 436482 - DNA, 25 bp, Mus musculus
gaatcatggagtacctcttgagcta

SEQ ID NO: 436483 - DNA, 25 bp, Mus musculus
gaatcatggagttcctcttgagcta

SEQ ID NO: 436484 - DNA, 25 bp, Mus musculus
gaatcatggtgcatccaaggccaag

SEQ ID NO: 436485 - DNA, 25 bp, Mus musculus
gaatcatggtgcttccaaggccaag

SEQ ID NO: 436486 - DNA, 25 bp, Mus musculus
gaatcatggttgaagctgcaccgtt

SEQ ID NO: 436487 - DNA, 25 bp, Mus musculus
gaatcatggttgtagctgcaccgtt

SEQ ID NO: 436488 - DNA, 25 bp, Mus musculus
gaatcatgtgataagccttcctcct

SEQ ID NO: 436489 - DNA, 25 bp, Mus musculus
gaatcatgtgattagccttcctcct

SEQ ID NO: 436490 - DNA, 25 bp, Mus musculus
gaatcatgtggtccgaggtgtaaat

SEQ ID NO: 436491 - DNA, 25 bp, Mus musculus
gaatcatgtggtgcgaggtgtaaat

SEQ ID NO: 436492 - DNA, 25 bp, Mus musculus
gaatcatgtgtgacagcattaccac

SEQ ID NO: 436493 - DNA, 25 bp, Mus musculus
gaatcatgtgtgtcagcattaccac

SEQ ID NO: 436494 - DNA, 25 bp, Mus musculus
gaatcatgttacactttttgtacaa

SEQ ID NO: 436495 - DNA, 25 bp, Mus musculus
gaatcatgttactctttttgtacaa

SEQ ID NO: 436496 - DNA, 25 bp, Mus musculus
gaatcatgttcgcaagtctgccatt

SEQ ID NO: 436497 - DNA, 25 bp, Mus musculus
gaatcatgttcggaagtctgccatt

SEQ ID NO: 436498 - DNA, 25 bp, Mus musculus
gaatcattaccccagggacttttat

SEQ ID NO: 436499 - DNA, 25 bp, Mus musculus
gaatcattacccgagggacttttat

SEQ ID NO: 436500 - DNA, 25 bp, Mus musculus
gaatcattatacctaaccttcctcc

SEQ ID NO: 436501 - DNA, 25 bp, Mus musculus
gaatcattatacgtaaccttcctcc

SEQ ID NO: 436502 - DNA, 25 bp, Mus musculus
gaatcattatcaatatttgggtggt

SEQ ID NO: 436503 - DNA, 25 bp, Mus musculus
gaatcattatcattatttgggtggt

SEQ ID NO: 436504 - DNA, 25 bp, Mus musculus
gaatcattatgcctactggctccta

SEQ ID NO: 436505 - DNA, 25 bp, Mus musculus
gaatcattatgcgtactggctccta

SEQ ID NO: 436506 - DNA, 25 bp, Mus musculus
gaatcattatgtagcacacttttgc

SEQ ID NO: 436507 - DNA, 25 bp, Mus musculus
gaatcattatgttgcacacttttgc

SEQ ID NO: 436508 - DNA, 25 bp, Mus musculus
gaatcattcaccctcaagtacaaca

SEQ ID NO: 436509 - DNA, 25 bp, Mus musculus
gaatcattcaccgtcaagtacaaca

SEQ ID NO: 436510 - DNA, 25 bp, Mus musculus
gaatcattcattacatggaatccac

SEQ ID NO: 436511 - DNA, 25 bp, Mus musculus
gaatcattcatttcatggaatccac

SEQ ID NO: 436512 - DNA, 25 bp, Mus musculus
gaatcattccagaaggcttatttct

SEQ ID NO: 436513 - DNA, 25 bp, Mus musculus
gaatcattccagcaacactgaccaa

SEQ ID NO: 436514 - DNA, 25 bp, Mus musculus
gaatcattccaggaacactgaccaa

SEQ ID NO: 436515 - DNA, 25 bp, Mus musculus
gaatcattccagtaggcttatttct

SEQ ID NO: 436516 - DNA, 25 bp, Mus musculus
gaatcattcctgcagtagcttctac

SEQ ID NO: 436517 - DNA, 25 bp, Mus musculus
gaatcattcctggagtagcttctac

SEQ ID NO: 436518 - DNA, 25 bp, Mus musculus
gaatcattccttacgtgatttacct

SEQ ID NO: 436519 - DNA, 25 bp, Mus musculus
gaatcattcctttcgtgatttacct

SEQ ID NO: 436520 - DNA, 25 bp, Mus musculus
gaatcattcgctcgctgagtgactt

SEQ ID NO: 436521 - DNA, 25 bp, Mus musculus
gaatcattcgctggctgagtgactt

SEQ ID NO: 436522 - DNA, 25 bp, Mus musculus
gaatcattctgaattctttaggaca

SEQ ID NO: 436523 - DNA, 25 bp, Mus musculus
gaatcattctgatttctttaggaca

SEQ ID NO: 436524 - DNA, 25 bp, Mus musculus
gaatcattctgcagctcgttgccgg

SEQ ID NO: 436525 - DNA, 25 bp, Mus musculus
gaatcattctgcatttgatgggcta

SEQ ID NO: 436526 - DNA, 25 bp, Mus musculus
gaatcattctgctgctcgttgccgg

SEQ ID NO: 436527 - DNA, 25 bp, Mus musculus
gaatcattctgcttttgatgggcta

SEQ ID NO: 436528 - DNA, 25 bp, Mus musculus
gaatcattgacaatcccagtcttca

SEQ ID NO: 436529 - DNA, 25 bp, Mus musculus
gaatcattgacattcccagtcttca

SEQ ID NO: 436530 - DNA, 25 bp, Mus musculus
gaatcattgcagagtccgaaacaga

SEQ ID NO: 436531 - DNA, 25 bp, Mus musculus
gaatcattgcagtgtccgaaacaga

SEQ ID NO: 436532 - DNA, 25 bp, Mus musculus
gaatcattgctcaacagtccagaag

SEQ ID NO: 436533 - DNA, 25 bp, Mus musculus
gaatcattgctctacagtccagaag

SEQ ID NO: 436534 - DNA, 25 bp, Mus musculus
gaatcattggagcttgtcaactcaa

SEQ ID NO: 436535 - DNA, 25 bp, Mus musculus
gaatcattggaggttgtcaactcaa

SEQ ID NO: 436536 - DNA, 25 bp, Mus musculus
gaatcattggtaatgagcgccggat

SEQ ID NO: 436537 - DNA, 25 bp, Mus musculus
gaatcattggtattgagcgccggat

SEQ ID NO: 436538 - DNA, 25 bp, Mus musculus
gaatcattgtctaggatctgtgcaa

SEQ ID NO: 436539 - DNA, 25 bp, Mus musculus
gaatcattgtcttggatctgtgcaa

SEQ ID NO: 436540 - DNA, 25 bp, Mus musculus
gaatcattgtgtaatcttcccggtc

SEQ ID NO: 436541 - DNA, 25 bp, Mus musculus
gaatcattgtgttatcttcccggtc

SEQ ID NO: 436542 - DNA, 25 bp, Mus musculus
gaatcattgtttatgggtctctgta

SEQ ID NO: 436543 - DNA, 25 bp, Mus musculus
gaatcattgtttttgggtctctgta

SEQ ID NO: 436544 - DNA, 25 bp, Mus musculus
gaatcatttaatagttcttccttag

SEQ ID NO: 436545 - DNA, 25 bp, Mus musculus
gaatcatttaattgttcttccttag

SEQ ID NO: 436546 - DNA, 25 bp, Mus musculus
gaatcatttactctcaaccttggca

SEQ ID NO: 436547 - DNA, 25 bp, Mus musculus
gaatcatttactgtcaaccttggca

SEQ ID NO: 436548 - DNA, 25 bp, Mus musculus
gaatcatttctaagctaagttagcc

SEQ ID NO: 436549 - DNA, 25 bp, Mus musculus
gaatcatttctatgctaagttagcc

SEQ ID NO: 436550 - DNA, 25 bp, Mus musculus
gaatcatttcttatgacttgtgttt

SEQ ID NO: 436551 - DNA, 25 bp, Mus musculus
gaatcatttcttttgacttgtgttt

SEQ ID NO: 436552 - DNA, 25 bp, Mus musculus
gaatcatttgatatgcaagcctctt

SEQ ID NO: 436553 - DNA, 25 bp, Mus musculus
gaatcatttgatttgcaagcctctt

SEQ ID NO: 436554 - DNA, 25 bp, Mus musculus
gaatcatttgcactgtgaggcagga

SEQ ID NO: 436555 - DNA, 25 bp, Mus musculus
gaatcatttgcagtgtgaggcagga

SEQ ID NO: 436556 - DNA, 25 bp, Mus musculus
gaatcattttctctcactcatttaa

SEQ ID NO: 436557 - DNA, 25 bp, Mus musculus
gaatcattttctgtcactcatttaa

SEQ ID NO: 436558 - DNA, 25 bp, Mus musculus
gaatcattttgcagaagtgactgac

SEQ ID NO: 436559 - DNA, 25 bp, Mus musculus
gaatcattttgctgaagtgactgac

SEQ ID NO: 436560 - DNA, 25 bp, Mus musculus
gaatccaaaaatagttcagctcatg

SEQ ID NO: 436561 - DNA, 25 bp, Mus musculus
gaatccaaaaattgttcagctcatg

SEQ ID NO: 436562 - DNA, 25 bp, Mus musculus
gaatccaaaatcactctgtttctgt

SEQ ID NO: 436563 - DNA, 25 bp, Mus musculus
gaatccaaaatctctctgtttctgt

SEQ ID NO: 436564 - DNA, 25 bp, Mus musculus
gaatccaaagtgaacgggtgagcaa

SEQ ID NO: 436565 - DNA, 25 bp, Mus musculus
gaatccaaagtgtacgggtgagcaa

SEQ ID NO: 436566 - DNA, 25 bp, Mus musculus
gaatccaaattcaacttgagcctca

SEQ ID NO: 436567 - DNA, 25 bp, Mus musculus
gaatccaaattcaatctacagctat

SEQ ID NO: 436568 - DNA, 25 bp, Mus musculus
gaatccaaattctacttgagcctca

SEQ ID NO: 436569 - DNA, 25 bp, Mus musculus
gaatccaaattctatctacagctat

SEQ ID NO: 436570 - DNA, 25 bp, Mus musculus
gaatccaaatttctgtcattcagta

SEQ ID NO: 436571 - DNA, 25 bp, Mus musculus
gaatccaaatttgtgtcattcagta

SEQ ID NO: 436572 - DNA, 25 bp, Mus musculus
gaatccaactagcaggaccccaagg

SEQ ID NO: 436573 - DNA, 25 bp, Mus musculus
gaatccaactaggaggaccccaagg

SEQ ID NO: 436574 - DNA, 25 bp, Mus musculus
gaatccaactgtcaagaactcagga

SEQ ID NO: 436575 - DNA, 25 bp, Mus musculus
gaatccaactgtgaagaactcagga

SEQ ID NO: 436576 - DNA, 25 bp, Mus musculus
gaatccaagaacaccaacccagagt

SEQ ID NO: 436577 - DNA, 25 bp, Mus musculus
gaatccaagaactccaacccagagt

SEQ ID NO: 436578 - DNA, 25 bp, Mus musculus
gaatccaagaagctgatgcgtctgt

SEQ ID NO: 436579 - DNA, 25 bp, Mus musculus
gaatccaagaaggtgatgcgtctgt

SEQ ID NO: 436580 - DNA, 25 bp, Mus musculus
gaatccaagcatcaagtacctttct

SEQ ID NO: 436581 - DNA, 25 bp, Mus musculus
gaatccaagcatgaagtacctttct

SEQ ID NO: 436582 - DNA, 25 bp, Mus musculus
gaatccaagcctatagaataattta

SEQ ID NO: 436583 - DNA, 25 bp, Mus musculus
gaatccaagcctttagaataattta

SEQ ID NO: 436584 - DNA, 25 bp, Mus musculus
gaatccaagcgaccagaacagcagt

SEQ ID NO: 436585 - DNA, 25 bp, Mus musculus
gaatccaagcgagcagaacagcagt

SEQ ID NO: 436586 - DNA, 25 bp, Mus musculus
gaatccaaggagcagaccccgggca

SEQ ID NO: 436587 - DNA, 25 bp, Mus musculus
gaatccaaggaggagaccccgggca

SEQ ID NO: 436588 - DNA, 25 bp, Mus musculus
gaatccaaggtaattgctgagctgt

SEQ ID NO: 436589 - DNA, 25 bp, Mus musculus
gaatccaaggtatttgctgagctgt

SEQ ID NO: 436590 - DNA, 25 bp, Mus musculus
gaatccaaggtcactttattgagct

SEQ ID NO: 436591 - DNA, 25 bp, Mus musculus
gaatccaaggtctctttattgagct

SEQ ID NO: 436592 - DNA, 25 bp, Mus musculus
gaatccaaggtgcagaaaagccctt

SEQ ID NO: 436593 - DNA, 25 bp, Mus musculus
gaatccaaggtggagaaaagccctt

SEQ ID NO: 436594 - DNA, 25 bp, Mus musculus
gaatccaatcgaacgtgttcacttc

SEQ ID NO: 436595 - DNA, 25 bp, Mus musculus
gaatccaatcgatcgtgttcacttc

SEQ ID NO: 436596 - DNA, 25 bp, Mus musculus
gaatccaatctcctgacacatgagc

SEQ ID NO: 436597 - DNA, 25 bp, Mus musculus
gaatccaatctcgtgacacatgagc

SEQ ID NO: 436598 - DNA, 25 bp, Mus musculus
gaatccaatgacagggccaccggct

SEQ ID NO: 436599 - DNA, 25 bp, Mus musculus
gaatccaatgactgggccaccggct

SEQ ID NO: 436600 - DNA, 25 bp, Mus musculus
gaatccaattctcattcaccttttc

SEQ ID NO: 436601 - DNA, 25 bp, Mus musculus
gaatccaattctctttaagccataa

SEQ ID NO: 436602 - DNA, 25 bp, Mus musculus
gaatccaattctgattcaccttttc

SEQ ID NO: 436603 - DNA, 25 bp, Mus musculus
gaatccaattctgtttaagccataa

SEQ ID NO: 436604 - DNA, 25 bp, Mus musculus
gaatccacaaagaacatctcctgaa

SEQ ID NO: 436605 - DNA, 25 bp, Mus musculus
gaatccacaaagtacatctcctgaa

SEQ ID NO: 436606 - DNA, 25 bp, Mus musculus
gaatccacagaaattctcacctggt

SEQ ID NO: 436607 - DNA, 25 bp, Mus musculus
gaatccacagaatttctcacctggt

SEQ ID NO: 436608 - DNA, 25 bp, Mus musculus
gaatccacagttctgacttcctggg

SEQ ID NO: 436609 - DNA, 25 bp, Mus musculus
gaatccacagttgtgacttcctggg

SEQ ID NO: 436610 - DNA, 25 bp, Mus musculus
gaatccacataaccttcttgacttc

SEQ ID NO: 436611 - DNA, 25 bp, Mus musculus
gaatccacataagcttcttgacttc

SEQ ID NO: 436612 - DNA, 25 bp, Mus musculus
gaatccacccagaagtgttctaaaa

SEQ ID NO: 436613 - DNA, 25 bp, Mus musculus
gaatccacccagtagtgttctaaaa

SEQ ID NO: 436614 - DNA, 25 bp, Mus musculus
gaatccacgagccagcgaaaccttt

SEQ ID NO: 436615 - DNA, 25 bp, Mus musculus
gaatccacgagcgagcgaaaccttt

SEQ ID NO: 436616 - DNA, 25 bp, Mus musculus
gaatccacggagatctcagtcactc

SEQ ID NO: 436617 - DNA, 25 bp, Mus musculus
gaatccacggagttctcagtcactc

SEQ ID NO: 436618 - DNA, 25 bp, Mus musculus
gaatccacgtcacgtagcgcaaagt

SEQ ID NO: 436619 - DNA, 25 bp, Mus musculus
gaatccacgtcaggtagcgcaaagt

SEQ ID NO: 436620 - DNA, 25 bp, Mus musculus
gaatccacgtggcagaagccccaag

SEQ ID NO: 436621 - DNA, 25 bp, Mus musculus
gaatccacgtgggagaagccccaag

SEQ ID NO: 436622 - DNA, 25 bp, Mus musculus
gaatccacgttcaagattggccgtt

SEQ ID NO: 436623 - DNA, 25 bp, Mus musculus
gaatccacgttctagattggccgtt

SEQ ID NO: 436624 - DNA, 25 bp, Mus musculus
gaatccactggcacagtgtgtgtaa

SEQ ID NO: 436625 - DNA, 25 bp, Mus musculus
gaatccactggctcagtgtgtgtaa

SEQ ID NO: 436626 - DNA, 25 bp, Mus musculus
gaatccactgttacggtttatcccg

SEQ ID NO: 436627 - DNA, 25 bp, Mus musculus
gaatccactgtttcggtttatcccg

SEQ ID NO: 436628 - DNA, 25 bp, Mus musculus
gaatccacttgcagttcctggagag

SEQ ID NO: 436629 - DNA, 25 bp, Mus musculus
gaatccacttgctgttcctggagag

SEQ ID NO: 436630 - DNA, 25 bp, Mus musculus
gaatccagaactaggtctaccttag

SEQ ID NO: 436631 - DNA, 25 bp, Mus musculus
gaatccagaacttggtctaccttag

SEQ ID NO: 436632 - DNA, 25 bp, Mus musculus
gaatccagacacagcgacccattta

SEQ ID NO: 436633 - DNA, 25 bp, Mus musculus
gaatccagacactgcgacccattta

SEQ ID NO: 436634 - DNA, 25 bp, Mus musculus
gaatccagacctacaaatatgctag

SEQ ID NO: 436635 - DNA, 25 bp, Mus musculus
gaatccagaccttcaaatatgctag

SEQ ID NO: 436636 - DNA, 25 bp, Mus musculus
gaatccagacttagtgtgtatgttt

SEQ ID NO: 436637 - DNA, 25 bp, Mus musculus
gaatccagactttgtgtgtatgttt

SEQ ID NO: 436638 - DNA, 25 bp, Mus musculus
gaatccagagacctgtttattcctc

SEQ ID NO: 436639 - DNA, 25 bp, Mus musculus
gaatccagagacgtgtttattcctc

SEQ ID NO: 436640 - DNA, 25 bp, Mus musculus
gaatccagagcacgtggtgacaccc

SEQ ID NO: 436641 - DNA, 25 bp, Mus musculus
gaatccagagcaggtggtgacaccc

SEQ ID NO: 436642 - DNA, 25 bp, Mus musculus
gaatccagaggcctttgatgcattt

SEQ ID NO: 436643 - DNA, 25 bp, Mus musculus
gaatccagaggcgtttgatgcattt

SEQ ID NO: 436644 - DNA, 25 bp, Mus musculus
gaatccagaggtaatggccatgtct

SEQ ID NO: 436645 - DNA, 25 bp, Mus musculus
gaatccagaggttatggccatgtct

SEQ ID NO: 436646 - DNA, 25 bp, Mus musculus
gaatccagagtccagatcagcaagc

SEQ ID NO: 436647 - DNA, 25 bp, Mus musculus
gaatccagagtcgagatcagcaagc

SEQ ID NO: 436648 - DNA, 25 bp, Mus musculus
gaatccagatgcaggcaagcacagc

SEQ ID NO: 436649 - DNA, 25 bp, Mus musculus
gaatccagatgcatttctcatgtgg

SEQ ID NO: 436650 - DNA, 25 bp, Mus musculus
gaatccagatgctggcaagcacagc

SEQ ID NO: 436651 - DNA, 25 bp, Mus musculus
gaatccagatgcttttctcatgtgg

SEQ ID NO: 436652 - DNA, 25 bp, Mus musculus
gaatccagatgtacatctggcccag

SEQ ID NO: 436653 - DNA, 25 bp, Mus musculus
gaatccagatgtcgcatcacaccct

SEQ ID NO: 436654 - DNA, 25 bp, Mus musculus
gaatccagatgtggcatcacaccct

SEQ ID NO: 436655 - DNA, 25 bp, Mus musculus
gaatccagatgttcatctggcccag

SEQ ID NO: 436656 - DNA, 25 bp, Mus musculus
gaatccagcaaaacctcaactacat

SEQ ID NO: 436657 - DNA, 25 bp, Mus musculus
gaatccagcaaacagccaaagttgt

SEQ ID NO: 436658 - DNA, 25 bp, Mus musculus
gaatccagcaaagagccaaagttgt

SEQ ID NO: 436659 - DNA, 25 bp, Mus musculus
gaatccagcaaatcctcaactacat

SEQ ID NO: 436660 - DNA, 25 bp, Mus musculus
gaatccagcatactagatttcatgt

SEQ ID NO: 436661 - DNA, 25 bp, Mus musculus
gaatccagcatagtagatttcatgt

SEQ ID NO: 436662 - DNA, 25 bp, Mus musculus
gaatccagcatgaattttcccagaa

SEQ ID NO: 436663 - DNA, 25 bp, Mus musculus
gaatccagcatgtattttcccagaa

SEQ ID NO: 436664 - DNA, 25 bp, Mus musculus
gaatccagccagctgcaatcaggtt

SEQ ID NO: 436665 - DNA, 25 bp, Mus musculus
gaatccagccaggtgcaatcaggtt

SEQ ID NO: 436666 - DNA, 25 bp, Mus musculus
gaatccagcgctcccttgcaagctt

SEQ ID NO: 436667 - DNA, 25 bp, Mus musculus
gaatccagcgctgccttgcaagctt

SEQ ID NO: 436668 - DNA, 25 bp, Mus musculus
gaatccagctgacgcgcacgcatca

SEQ ID NO: 436669 - DNA, 25 bp, Mus musculus
gaatccagctgaggcgcacgcatca

SEQ ID NO: 436670 - DNA, 25 bp, Mus musculus
gaatccaggaagacggctgggcttc

SEQ ID NO: 436671 - DNA, 25 bp, Mus musculus
gaatccaggaagtcggctgggcttc

SEQ ID NO: 436672 - DNA, 25 bp, Mus musculus
gaatccaggagcacattaatgcagt

SEQ ID NO: 436673 - DNA, 25 bp, Mus musculus
gaatccaggagctcattaatgcagt

SEQ ID NO: 436674 - DNA, 25 bp, Mus musculus
gaatccagggacatatcctcttcat

SEQ ID NO: 436675 - DNA, 25 bp, Mus musculus
gaatccagggacttatcctcttcat

SEQ ID NO: 436676 - DNA, 25 bp, Mus musculus
gaatccagggcgcaggctagagctg

SEQ ID NO: 436677 - DNA, 25 bp, Mus musculus
gaatccagggcggaggctagagctg

SEQ ID NO: 436678 - DNA, 25 bp, Mus musculus
gaatccagggtaaagtgtattaaaa

SEQ ID NO: 436679 - DNA, 25 bp, Mus musculus
gaatccagggtatagtgtattaaaa

SEQ ID NO: 436680 - DNA, 25 bp, Mus musculus
gaatccagggtcactcggaacttat

SEQ ID NO: 436681 - DNA, 25 bp, Mus musculus
gaatccagggtctctcggaacttat

SEQ ID NO: 436682 - DNA, 25 bp, Mus musculus
gaatccaggtctcggatctgttatc

SEQ ID NO: 436683 - DNA, 25 bp, Mus musculus
gaatccaggtctgggatctgttatc

SEQ ID NO: 436684 - DNA, 25 bp, Mus musculus
gaatccagtacaaaagagcccttgc

SEQ ID NO: 436685 - DNA, 25 bp, Mus musculus
gaatccagtacataagagcccttgc

SEQ ID NO: 436686 - DNA, 25 bp, Mus musculus
gaatccagtccaattctggtgaaca

SEQ ID NO: 436687 - DNA, 25 bp, Mus musculus
gaatccagtccatttctggtgaaca

SEQ ID NO: 436688 - DNA, 25 bp, Mus musculus
gaatccagtgacatctgtggaggac

SEQ ID NO: 436689 - DNA, 25 bp, Mus musculus
gaatccagtgacttctgtggaggac

SEQ ID NO: 436690 - DNA, 25 bp, Mus musculus
gaatccagtgagactagagtttcta

SEQ ID NO: 436691 - DNA, 25 bp, Mus musculus
gaatccagtgagtctagagtttcta

SEQ ID NO: 436692 - DNA, 25 bp, Mus musculus
gaatccagtggaccccaaagtccta

SEQ ID NO: 436693 - DNA, 25 bp, Mus musculus
gaatccagtggagcccaaagtccta

SEQ ID NO: 436694 - DNA, 25 bp, Mus musculus
gaatccagtgtgattctgactgcac

SEQ ID NO: 436695 - DNA, 25 bp, Mus musculus
gaatccagtgtgtttctgactgcac

SEQ ID NO: 436696 - DNA, 25 bp, Mus musculus
gaatccagttgcagaacttttcaga

SEQ ID NO: 436697 - DNA, 25 bp, Mus musculus
gaatccagttgctgaacttttcaga

SEQ ID NO: 436698 - DNA, 25 bp, Mus musculus
gaatccagtttgagagtcccactta

SEQ ID NO: 436699 - DNA, 25 bp, Mus musculus
gaatccagtttgatgctgtgtccca

SEQ ID NO: 436700 - DNA, 25 bp, Mus musculus
gaatccagtttgtgagtcccactta

SEQ ID NO: 436701 - DNA, 25 bp, Mus musculus
gaatccagtttgttgctgtgtccca

SEQ ID NO: 436702 - DNA, 25 bp, Mus musculus
gaatccataacacgcagctagctca

SEQ ID NO: 436703 - DNA, 25 bp, Mus musculus
gaatccataacaggcagctagctca

SEQ ID NO: 436704 - DNA, 25 bp, Mus musculus
gaatccatacgcatgaagcgctaca

SEQ ID NO: 436705 - DNA, 25 bp, Mus musculus
gaatccatacgcttgaagcgctaca

SEQ ID NO: 436706 - DNA, 25 bp, Mus musculus
gaatccatagataccgccagaataa

SEQ ID NO: 436707 - DNA, 25 bp, Mus musculus
gaatccatagattccgccagaataa

SEQ ID NO: 436708 - DNA, 25 bp, Mus musculus
gaatccatcataaaggcatttcccg

SEQ ID NO: 436709 - DNA, 25 bp, Mus musculus
gaatccatcatataggcatttcccg

SEQ ID NO: 436710 - DNA, 25 bp, Mus musculus
gaatccatccagatcaaaatccctt

SEQ ID NO: 436711 - DNA, 25 bp, Mus musculus
gaatccatccagttcaaaatccctt

SEQ ID NO: 436712 - DNA, 25 bp, Mus musculus
gaatccatcccacagtgaatctgtt

SEQ ID NO: 436713 - DNA, 25 bp, Mus musculus
gaatccatcccagagtgaatctgtt

SEQ ID NO: 436714 - DNA, 25 bp, Mus musculus
gaatccatcccgctgtcaggcgaag

SEQ ID NO: 436715 - DNA, 25 bp, Mus musculus
gaatccatcccggtgtcaggcgaag

SEQ ID NO: 436716 - DNA, 25 bp, Mus musculus
gaatccatgaacagtgaggccttta

SEQ ID NO: 436717 - DNA, 25 bp, Mus musculus
gaatccatgaactgtgaggccttta

SEQ ID NO: 436718 - DNA, 25 bp, Mus musculus
gaatccatgaatcagcctgcgaaaa

SEQ ID NO: 436719 - DNA, 25 bp, Mus musculus
gaatccatgaatgagcctgcgaaaa

SEQ ID NO: 436720 - DNA, 25 bp, Mus musculus
gaatccatgagcctctgtagctaaa

SEQ ID NO: 436721 - DNA, 25 bp, Mus musculus
gaatccatgagcctcttttttattt

SEQ ID NO: 436722 - DNA, 25 bp, Mus musculus
gaatccatgagcgtctgtagctaaa

SEQ ID NO: 436723 - DNA, 25 bp, Mus musculus
gaatccatgagcgtcttttttattt

SEQ ID NO: 436724 - DNA, 25 bp, Mus musculus
gaatccatgaggagctatctggcag

SEQ ID NO: 436725 - DNA, 25 bp, Mus musculus
gaatccatgaggtgctatctggcag

SEQ ID NO: 436726 - DNA, 25 bp, Mus musculus
gaatccatgatccattttattactc

SEQ ID NO: 436727 - DNA, 25 bp, Mus musculus
gaatccatgatcgattttattactc

SEQ ID NO: 436728 - DNA, 25 bp, Mus musculus
gaatccatgcacagccaagtttcag

SEQ ID NO: 436729 - DNA, 25 bp, Mus musculus
gaatccatgcactgccaagtttcag

SEQ ID NO: 436730 - DNA, 25 bp, Mus musculus
gaatccatgcagaacaccacagaaa

SEQ ID NO: 436731 - DNA, 25 bp, Mus musculus
gaatccatgcagtacaccacagaaa

SEQ ID NO: 436732 - DNA, 25 bp, Mus musculus
gaatccatgggcacttaggtccctg

SEQ ID NO: 436733 - DNA, 25 bp, Mus musculus
gaatccatgggctcttaggtccctg

SEQ ID NO: 436734 - DNA, 25 bp, Mus musculus
gaatccatggtcatctctatgtcaa

SEQ ID NO: 436735 - DNA, 25 bp, Mus musculus
gaatccatggtcttctctatgtcaa

SEQ ID NO: 436736 - DNA, 25 bp, Mus musculus
gaatccatgtctagaatgttgtcct

SEQ ID NO: 436737 - DNA, 25 bp, Mus musculus
gaatccatgtctctcgaaaattgtt

SEQ ID NO: 436738 - DNA, 25 bp, Mus musculus
gaatccatgtctgtcgaaaattgtt

SEQ ID NO: 436739 - DNA, 25 bp, Mus musculus
gaatccatgtcttgaatgttgtcct

SEQ ID NO: 436740 - DNA, 25 bp, Mus musculus
gaatccattcaacgtcgcttagtcc

SEQ ID NO: 436741 - DNA, 25 bp, Mus musculus
gaatccattcaaggtcgcttagtcc

SEQ ID NO: 436742 - DNA, 25 bp, Mus musculus
gaatccattcagatctcatcctcgc

SEQ ID NO: 436743 - DNA, 25 bp, Mus musculus
gaatccattcagttctcatcctcgc

SEQ ID NO: 436744 - DNA, 25 bp, Mus musculus
gaatccattcctctttggaaggcaa

SEQ ID NO: 436745 - DNA, 25 bp, Mus musculus
gaatccattcctgtttggaaggcaa

SEQ ID NO: 436746 - DNA, 25 bp, Mus musculus
gaatccattgagctgacatgcccca

SEQ ID NO: 436747 - DNA, 25 bp, Mus musculus
gaatccattgaggtgacatgcccca

SEQ ID NO: 436748 - DNA, 25 bp, Mus musculus
gaatccattgccatctaaaatccag

SEQ ID NO: 436749 - DNA, 25 bp, Mus musculus
gaatccattgccttctaaaatccag

SEQ ID NO: 436750 - DNA, 25 bp, Mus musculus
gaatccattgcgacctaacaacagt

SEQ ID NO: 436751 - DNA, 25 bp, Mus musculus
gaatccattgcgtcctaacaacagt

SEQ ID NO: 436752 - DNA, 25 bp, Mus musculus
gaatccattgtcacacgactttctt

SEQ ID NO: 436753 - DNA, 25 bp, Mus musculus
gaatccattgtctcacgactttctt

SEQ ID NO: 436754 - DNA, 25 bp, Mus musculus
gaatccattgttcacgtatccattt

SEQ ID NO: 436755 - DNA, 25 bp, Mus musculus
gaatccattgttgacgtatccattt

SEQ ID NO: 436756 - DNA, 25 bp, Mus musculus
gaatccatttcaaaacctatctttg

SEQ ID NO: 436757 - DNA, 25 bp, Mus musculus
gaatccatttcataacctatctttg

SEQ ID NO: 436758 - DNA, 25 bp, Mus musculus
gaatccatttggagcatcctgtatg

SEQ ID NO: 436759 - DNA, 25 bp, Mus musculus
gaatccatttggtgcatcctgtatg

SEQ ID NO: 436760 - DNA, 25 bp, Mus musculus
gaatccatttgtcaattacgagctg

SEQ ID NO: 436761 - DNA, 25 bp, Mus musculus
gaatccatttgtcacctaatgaatt

SEQ ID NO: 436762 - DNA, 25 bp, Mus musculus
gaatccatttgtgaattacgagctg

SEQ ID NO: 436763 - DNA, 25 bp, Mus musculus
gaatccatttgtgacctaatgaatt

SEQ ID NO: 436764 - DNA, 25 bp, Mus musculus
gaatcccaaaagctaggtactgtag

SEQ ID NO: 436765 - DNA, 25 bp, Mus musculus
gaatcccaaaaggtaggtactgtag

SEQ ID NO: 436766 - DNA, 25 bp, Mus musculus
gaatcccaaaggagtctctctgtgc

SEQ ID NO: 436767 - DNA, 25 bp, Mus musculus
gaatcccaaaggtgtctctctgtgc

SEQ ID NO: 436768 - DNA, 25 bp, Mus musculus
gaatcccaaccactgaagatccata

SEQ ID NO: 436769 - DNA, 25 bp, Mus musculus
gaatcccaaccagtgaagatccata

SEQ ID NO: 436770 - DNA, 25 bp, Mus musculus
gaatcccaacccaaagtgaatagtg

SEQ ID NO: 436771 - DNA, 25 bp, Mus musculus
gaatcccaacccctacaggatttct

SEQ ID NO: 436772 - DNA, 25 bp, Mus musculus
gaatcccaacccgtacaggatttct

SEQ ID NO: 436773 - DNA, 25 bp, Mus musculus
gaatcccaaccctaagtgaatagtg

SEQ ID NO: 436774 - DNA, 25 bp, Mus musculus
gaatcccaactcagtgaagtgcaag

SEQ ID NO: 436775 - DNA, 25 bp, Mus musculus
gaatcccaactctgtgaagtgcaag

SEQ ID NO: 436776 - DNA, 25 bp, Mus musculus
gaatcccaactgctctatatttctt

SEQ ID NO: 436777 - DNA, 25 bp, Mus musculus
gaatcccaactggtctatatttctt

SEQ ID NO: 436778 - DNA, 25 bp, Mus musculus
gaatcccaaggcactattgtattaa

SEQ ID NO: 436779 - DNA, 25 bp, Mus musculus
gaatcccaaggctctattgtattaa

SEQ ID NO: 436780 - DNA, 25 bp, Mus musculus
gaatcccaagtgagtactaccaacc

SEQ ID NO: 436781 - DNA, 25 bp, Mus musculus
gaatcccaagtgtgtactaccaacc

SEQ ID NO: 436782 - DNA, 25 bp, Mus musculus
gaatcccaagttaccataaagaagt

SEQ ID NO: 436783 - DNA, 25 bp, Mus musculus
gaatcccaagttagaccttgcttat

SEQ ID NO: 436784 - DNA, 25 bp, Mus musculus
gaatcccaagtttccataaagaagt

SEQ ID NO: 436785 - DNA, 25 bp, Mus musculus
gaatcccaagtttgaccttgcttat

SEQ ID NO: 436786 - DNA, 25 bp, Mus musculus
gaatcccaatttaacctataagctg

SEQ ID NO: 436787 - DNA, 25 bp, Mus musculus
gaatcccaattttacctataagctg

SEQ ID NO: 436788 - DNA, 25 bp, Mus musculus
gaatcccaccttccaagcatgtgga

SEQ ID NO: 436789 - DNA, 25 bp, Mus musculus
gaatcccaccttgcaagcatgtgga

SEQ ID NO: 436790 - DNA, 25 bp, Mus musculus
gaatcccagaatcacctgatgatgt

SEQ ID NO: 436791 - DNA, 25 bp, Mus musculus
gaatcccagaatgacctgatgatgt

SEQ ID NO: 436792 - DNA, 25 bp, Mus musculus
gaatcccagagaccaggcgatggca

SEQ ID NO: 436793 - DNA, 25 bp, Mus musculus
gaatcccagagagcaggcgatggca

SEQ ID NO: 436794 - DNA, 25 bp, Mus musculus
gaatcccagcaaagtgctccagcag

SEQ ID NO: 436795 - DNA, 25 bp, Mus musculus
gaatcccagcaatgtgctccagcag

SEQ ID NO: 436796 - DNA, 25 bp, Mus musculus
gaatcccagcgcagtcggatcaaat

SEQ ID NO: 436797 - DNA, 25 bp, Mus musculus
gaatcccagcgctgtcggatcaaat

SEQ ID NO: 436798 - DNA, 25 bp, Mus musculus
gaatcccagctcaaaaaacttgcca

SEQ ID NO: 436799 - DNA, 25 bp, Mus musculus
gaatcccagctcatggtagataaaa

SEQ ID NO: 436800 - DNA, 25 bp, Mus musculus
gaatcccagctctaaaaacttgcca

SEQ ID NO: 436801 - DNA, 25 bp, Mus musculus
gaatcccagctcttggtagataaaa

SEQ ID NO: 436802 - DNA, 25 bp, Mus musculus
gaatcccaggagctgagtctgccat

SEQ ID NO: 436803 - DNA, 25 bp, Mus musculus
gaatcccaggaggtgagtctgccat

SEQ ID NO: 436804 - DNA, 25 bp, Mus musculus
gaatcccaggatctttgtctacaaa

SEQ ID NO: 436805 - DNA, 25 bp, Mus musculus
gaatcccaggatgtttgtctacaaa

SEQ ID NO: 436806 - DNA, 25 bp, Mus musculus
gaatcccagggaactcaggaccatt

SEQ ID NO: 436807 - DNA, 25 bp, Mus musculus
gaatcccagggatctcaggaccatt

SEQ ID NO: 436808 - DNA, 25 bp, Mus musculus
gaatcccagtgaagacttgtagtct

SEQ ID NO: 436809 - DNA, 25 bp, Mus musculus
gaatcccagtgatgacttgtagtct

SEQ ID NO: 436810 - DNA, 25 bp, Mus musculus
gaatcccatacacagtgtcttctgt

SEQ ID NO: 436811 - DNA, 25 bp, Mus musculus
gaatcccatacagagtgtcttctgt

SEQ ID NO: 436812 - DNA, 25 bp, Mus musculus
gaatcccataggaatgcgcacatca

SEQ ID NO: 436813 - DNA, 25 bp, Mus musculus
gaatcccataggtatgcgcacatca

SEQ ID NO: 436814 - DNA, 25 bp, Mus musculus
gaatcccatgaaattcccctgcagg

SEQ ID NO: 436815 - DNA, 25 bp, Mus musculus
gaatcccatgaatttcccctgcagg

SEQ ID NO: 436816 - DNA, 25 bp, Mus musculus
gaatcccatgtgcttgaacagtgaa

SEQ ID NO: 436817 - DNA, 25 bp, Mus musculus
gaatcccatgtggttgaacagtgaa

SEQ ID NO: 436818 - DNA, 25 bp, Mus musculus
gaatcccattccatggacacaataa

SEQ ID NO: 436819 - DNA, 25 bp, Mus musculus
gaatcccattccttggacacaataa

SEQ ID NO: 436820 - DNA, 25 bp, Mus musculus
gaatcccattggatttgaacagcgc

SEQ ID NO: 436821 - DNA, 25 bp, Mus musculus
gaatcccattggttttgaacagcgc

SEQ ID NO: 436822 - DNA, 25 bp, Mus musculus
gaatcccatttcaacagtaacagag

SEQ ID NO: 436823 - DNA, 25 bp, Mus musculus
gaatcccatttctacagtaacagag

SEQ ID NO: 436824 - DNA, 25 bp, Mus musculus
gaatccccaggaacccaaagatgtt

SEQ ID NO: 436825 - DNA, 25 bp, Mus musculus
gaatccccaggatcccaaagatgtt

SEQ ID NO: 436826 - DNA, 25 bp, Mus musculus
gaatccccatggataggtgctataa

SEQ ID NO: 436827 - DNA, 25 bp, Mus musculus
gaatccccatggttaggtgctataa

SEQ ID NO: 436828 - DNA, 25 bp, Mus musculus
gaatccccgagtatattgatccctt

SEQ ID NO: 436829 - DNA, 25 bp, Mus musculus
gaatccccgagtttattgatccctt

SEQ ID NO: 436830 - DNA, 25 bp, Mus musculus
gaatccccggcacatttacaatttg

SEQ ID NO: 436831 - DNA, 25 bp, Mus musculus
gaatccccggcagatttacaatttg

SEQ ID NO: 436832 - DNA, 25 bp, Mus musculus
gaatcccctaatatacagtctgaga

SEQ ID NO: 436833 - DNA, 25 bp, Mus musculus
gaatcccctaatttacagtctgaga

SEQ ID NO: 436834 - DNA, 25 bp, Mus musculus
gaatcccctataaccctagcacttg

SEQ ID NO: 436835 - DNA, 25 bp, Mus musculus
gaatcccctatatccctagcacttg

SEQ ID NO: 436836 - DNA, 25 bp, Mus musculus
gaatcccctcctcgtttaagaatca

SEQ ID NO: 436837 - DNA, 25 bp, Mus musculus
gaatcccctcctggtttaagaatca

SEQ ID NO: 436838 - DNA, 25 bp, Mus musculus
gaatcccctgtaaggatggaagcca

SEQ ID NO: 436839 - DNA, 25 bp, Mus musculus
gaatcccctgtatggatggaagcca

SEQ ID NO: 436840 - DNA, 25 bp, Mus musculus
gaatcccctgtgatctagagttgct

SEQ ID NO: 436841 - DNA, 25 bp, Mus musculus
gaatcccctgtgttctagagttgct

SEQ ID NO: 436842 - DNA, 25 bp, Mus musculus
gaatccccttaacaaatctgttgtc

SEQ ID NO: 436843 - DNA, 25 bp, Mus musculus
gaatccccttaagaaatctgttgtc

SEQ ID NO: 436844 - DNA, 25 bp, Mus musculus
gaatcccgaaacctttaacacacag

SEQ ID NO: 436845 - DNA, 25 bp, Mus musculus
gaatcccgaaacgtttaacacacag

SEQ ID NO: 436846 - DNA, 25 bp, Mus musculus
gaatcccgacaacatcatggtttca

SEQ ID NO: 436847 - DNA, 25 bp, Mus musculus
gaatcccgacaagatcatggtttca

SEQ ID NO: 436848 - DNA, 25 bp, Mus musculus
gaatcccggaagaacgtgcggcgta

SEQ ID NO: 436849 - DNA, 25 bp, Mus musculus
gaatcccggaagtacgtgcggcgta

SEQ ID NO: 436850 - DNA, 25 bp, Mus musculus
gaatcccgggaaaagctcttcaagg

SEQ ID NO: 436851 - DNA, 25 bp, Mus musculus
gaatcccgggaatagctcttcaagg

SEQ ID NO: 436852 - DNA, 25 bp, Mus musculus
gaatcccgtcagaacacaaacagct

SEQ ID NO: 436853 - DNA, 25 bp, Mus musculus
gaatcccgtcagtacacaaacagct

SEQ ID NO: 436854 - DNA, 25 bp, Mus musculus
gaatcccgtgatcactactgtatgt

SEQ ID NO: 436855 - DNA, 25 bp, Mus musculus
gaatcccgtgatgactactgtatgt

SEQ ID NO: 436856 - DNA, 25 bp, Mus musculus
gaatcccgttctatcctgaggttag

SEQ ID NO: 436857 - DNA, 25 bp, Mus musculus
gaatcccgttctttcctgaggttag

SEQ ID NO: 436858 - DNA, 25 bp, Mus musculus
gaatccctaatcagtccaagactgt

SEQ ID NO: 436859 - DNA, 25 bp, Mus musculus
gaatccctaatctgtccaagactgt

SEQ ID NO: 436860 - DNA, 25 bp, Mus musculus
gaatccctacttaccatagcagtgg

SEQ ID NO: 436861 - DNA, 25 bp, Mus musculus
gaatccctactttccatagcagtgg

SEQ ID NO: 436862 - DNA, 25 bp, Mus musculus
gaatccctagaaaaacttgcagctt

SEQ ID NO: 436863 - DNA, 25 bp, Mus musculus
gaatccctagaataacttgcagctt

SEQ ID NO: 436864 - DNA, 25 bp, Mus musculus
gaatccctcctgactttgtacagaa

SEQ ID NO: 436865 - DNA, 25 bp, Mus musculus
gaatccctcctgtctttgtacagaa

SEQ ID NO: 436866 - DNA, 25 bp, Mus musculus
gaatccctcgtgaggatgctgctta

SEQ ID NO: 436867 - DNA, 25 bp, Mus musculus
gaatccctcgtgtggatgctgctta

SEQ ID NO: 436868 - DNA, 25 bp, Mus musculus
gaatccctgaaaagaagcctacttg

SEQ ID NO: 436869 - DNA, 25 bp, Mus musculus
gaatccctgaaatgaagcctacttg

SEQ ID NO: 436870 - DNA, 25 bp, Mus musculus
gaatccctgaacactagtctgtgta

SEQ ID NO: 436871 - DNA, 25 bp, Mus musculus
gaatccctgaactctagtctgtgta

SEQ ID NO: 436872 - DNA, 25 bp, Mus musculus
gaatccctgagactgcgacatgctt

SEQ ID NO: 436873 - DNA, 25 bp, Mus musculus
gaatccctgagagtgcgacatgctt

SEQ ID NO: 436874 - DNA, 25 bp, Mus musculus
gaatccctgagcacggaaatgttat

SEQ ID NO: 436875 - DNA, 25 bp, Mus musculus
gaatccctgagctcggaaatgttat

SEQ ID NO: 436876 - DNA, 25 bp, Mus musculus
gaatccctgcaactggccgagagta

SEQ ID NO: 436877 - DNA, 25 bp, Mus musculus
gaatccctgcaagtggccgagagta

SEQ ID NO: 436878 - DNA, 25 bp, Mus musculus
gaatccctggacacgggatcttcaa

SEQ ID NO: 436879 - DNA, 25 bp, Mus musculus
gaatccctggactcgggatcttcaa

SEQ ID NO: 436880 - DNA, 25 bp, Mus musculus
gaatccctggatcaaagctaaacta

SEQ ID NO: 436881 - DNA, 25 bp, Mus musculus
gaatccctggatgaaagctaaacta

SEQ ID NO: 436882 - DNA, 25 bp, Mus musculus
gaatccctgtacatcgttttacgtg

SEQ ID NO: 436883 - DNA, 25 bp, Mus musculus
gaatccctgtacttcgttttacgtg

SEQ ID NO: 436884 - DNA, 25 bp, Mus musculus
gaatcccttataagcatcacctgtc

SEQ ID NO: 436885 - DNA, 25 bp, Mus musculus
gaatcccttatatgcatcacctgtc

SEQ ID NO: 436886 - DNA, 25 bp, Mus musculus
gaatcccttggaccctgacaaagat

SEQ ID NO: 436887 - DNA, 25 bp, Mus musculus
gaatcccttggagcctgacaaagat

SEQ ID NO: 436888 - DNA, 25 bp, Mus musculus
gaatcccttggtcattaatgttgag

SEQ ID NO: 436889 - DNA, 25 bp, Mus musculus
gaatcccttggtgattaatgttgag

SEQ ID NO: 436890 - DNA, 25 bp, Mus musculus
gaatcccttgttaggctaagagcct

SEQ ID NO: 436891 - DNA, 25 bp, Mus musculus
gaatcccttgtttggctaagagcct

SEQ ID NO: 436892 - DNA, 25 bp, Mus musculus
gaatccgagagtagcttcttcagca

SEQ ID NO: 436893 - DNA, 25 bp, Mus musculus
gaatccgagagttgcttcttcagca

SEQ ID NO: 436894 - DNA, 25 bp, Mus musculus
gaatccgagattatcggtcttcgct

SEQ ID NO: 436895 - DNA, 25 bp, Mus musculus
gaatccgagattttcggtcttcgct

SEQ ID NO: 436896 - DNA, 25 bp, Mus musculus
gaatccgaggatatgtcacagacag

SEQ ID NO: 436897 - DNA, 25 bp, Mus musculus
gaatccgaggatttgtcacagacag

SEQ ID NO: 436898 - DNA, 25 bp, Mus musculus
gaatccgaggtgagttccagctgaa

SEQ ID NO: 436899 - DNA, 25 bp, Mus musculus
gaatccgaggtgtgttccagctgaa

SEQ ID NO: 436900 - DNA, 25 bp, Mus musculus
gaatccgatcatacacaaattcctt

SEQ ID NO: 436901 - DNA, 25 bp, Mus musculus
gaatccgatcattcacaaattcctt

SEQ ID NO: 436902 - DNA, 25 bp, Mus musculus
gaatccgcaagtagatcttcaggct

SEQ ID NO: 436903 - DNA, 25 bp, Mus musculus
gaatccgcaagtatgtcttcagccg

SEQ ID NO: 436904 - DNA, 25 bp, Mus musculus
gaatccgcaagttgatcttcaggct

SEQ ID NO: 436905 - DNA, 25 bp, Mus musculus
gaatccgcaagtttgtcttcagccg

SEQ ID NO: 436906 - DNA, 25 bp, Mus musculus
gaatccgcacgaatccggtttagag

SEQ ID NO: 436907 - DNA, 25 bp, Mus musculus
gaatccgcacgattccggtttagag

SEQ ID NO: 436908 - DNA, 25 bp, Mus musculus
gaatccggacagagtcacacagtga

SEQ ID NO: 436909 - DNA, 25 bp, Mus musculus
gaatccggacagtgtcacacagtga

SEQ ID NO: 436910 - DNA, 25 bp, Mus musculus
gaatccggactcagaaactttgttg

SEQ ID NO: 436911 - DNA, 25 bp, Mus musculus
gaatccggactctgaaactttgttg

SEQ ID NO: 436912 - DNA, 25 bp, Mus musculus
gaatccggccatcgatcaataagaa

SEQ ID NO: 436913 - DNA, 25 bp, Mus musculus
gaatccggccatggatcaataagaa

SEQ ID NO: 436914 - DNA, 25 bp, Mus musculus
gaatccggctgaagatggtcaagtg

SEQ ID NO: 436915 - DNA, 25 bp, Mus musculus
gaatccggctgatgatggtcaagtg

SEQ ID NO: 436916 - DNA, 25 bp, Mus musculus
gaatccgggataagcctgaagagca

SEQ ID NO: 436917 - DNA, 25 bp, Mus musculus
gaatccgggatatgcctgaagagca

SEQ ID NO: 436918 - DNA, 25 bp, Mus musculus
gaatccggtgtacttttcttattga

SEQ ID NO: 436919 - DNA, 25 bp, Mus musculus
gaatccggtgtagttttcttattga

SEQ ID NO: 436920 - DNA, 25 bp, Mus musculus
gaatccgtagagcaatctatgcaat

SEQ ID NO: 436921 - DNA, 25 bp, Mus musculus
gaatccgtagaggaatctatgcaat

SEQ ID NO: 436922 - DNA, 25 bp, Mus musculus
gaatccgtagttagtgggtatcagt

SEQ ID NO: 436923 - DNA, 25 bp, Mus musculus
gaatccgtagtttgtgggtatcagt

SEQ ID NO: 436924 - DNA, 25 bp, Mus musculus
gaatccgtcaggagcatactgcact

SEQ ID NO: 436925 - DNA, 25 bp, Mus musculus
gaatccgtcaggtgcatactgcact

SEQ ID NO: 436926 - DNA, 25 bp, Mus musculus
gaatccgtgagacagtgcctgcaca

SEQ ID NO: 436927 - DNA, 25 bp, Mus musculus
gaatccgtgagagagtgcctgcaca

SEQ ID NO: 436928 - DNA, 25 bp, Mus musculus
gaatccgtggtcacccaggcattaa

SEQ ID NO: 436929 - DNA, 25 bp, Mus musculus
gaatccgtggtctcccaggcattaa

SEQ ID NO: 436930 - DNA, 25 bp, Mus musculus
gaatccgttgatctttatgcttttg

SEQ ID NO: 436931 - DNA, 25 bp, Mus musculus
gaatccgttgatgtttatgcttttg

SEQ ID NO: 436932 - DNA, 25 bp, Mus musculus
gaatccgtttcgagtatattgcttt

SEQ ID NO: 436933 - DNA, 25 bp, Mus musculus
gaatccgtttcgtgtatattgcttt

SEQ ID NO: 436934 - DNA, 25 bp, Mus musculus
gaatcctaaagaagcctgcctttgc

SEQ ID NO: 436935 - DNA, 25 bp, Mus musculus
gaatcctaaagatgcctgcctttgc

SEQ ID NO: 436936 - DNA, 25 bp, Mus musculus
gaatcctaaagcaatagagcttttt

SEQ ID NO: 436937 - DNA, 25 bp, Mus musculus
gaatcctaaagctatagagcttttt

SEQ ID NO: 436938 - DNA, 25 bp, Mus musculus
gaatcctaacggcagaggcactgta

SEQ ID NO: 436939 - DNA, 25 bp, Mus musculus
gaatcctaacgggagaggcactgta

SEQ ID NO: 436940 - DNA, 25 bp, Mus musculus
gaatcctaagggacaaacccagctc

SEQ ID NO: 436941 - DNA, 25 bp, Mus musculus
gaatcctaagggtcaaacccagctc

SEQ ID NO: 436942 - DNA, 25 bp, Mus musculus
gaatcctaaggtcaaaactggccca

SEQ ID NO: 436943 - DNA, 25 bp, Mus musculus
gaatcctaaggtgaaaactggccca

SEQ ID NO: 436944 - DNA, 25 bp, Mus musculus
gaatcctaagtaattcttactgggt

SEQ ID NO: 436945 - DNA, 25 bp, Mus musculus
gaatcctaagtatttcttactgggt

SEQ ID NO: 436946 - DNA, 25 bp, Mus musculus
gaatcctaattcactgcagtttggg

SEQ ID NO: 436947 - DNA, 25 bp, Mus musculus
gaatcctaattctctgcagtttggg

SEQ ID NO: 436948 - DNA, 25 bp, Mus musculus
gaatcctacagaccacttgagccca

SEQ ID NO: 436949 - DNA, 25 bp, Mus musculus
gaatcctacagagcacttgagccca

SEQ ID NO: 436950 - DNA, 25 bp, Mus musculus
gaatcctacaggctgtcaacagtta

SEQ ID NO: 436951 - DNA, 25 bp, Mus musculus
gaatcctacagggtgtcaacagtta

SEQ ID NO: 436952 - DNA, 25 bp, Mus musculus
gaatcctaccccacttaacaaagtg

SEQ ID NO: 436953 - DNA, 25 bp, Mus musculus
gaatcctacccctcttaacaaagtg

SEQ ID NO: 436954 - DNA, 25 bp, Mus musculus
gaatcctacggacagcagttttttg

SEQ ID NO: 436955 - DNA, 25 bp, Mus musculus
gaatcctacggagagcagttttttg

SEQ ID NO: 436956 - DNA, 25 bp, Mus musculus
gaatcctacggtagaatatatgaat

SEQ ID NO: 436957 - DNA, 25 bp, Mus musculus
gaatcctacggttgaatatatgaat

SEQ ID NO: 436958 - DNA, 25 bp, Mus musculus
gaatcctactgtaaaccttagagtg

SEQ ID NO: 436959 - DNA, 25 bp, Mus musculus
gaatcctactgttaaccttagagtg

SEQ ID NO: 436960 - DNA, 25 bp, Mus musculus
gaatcctacttacaactggcaatac

SEQ ID NO: 436961 - DNA, 25 bp, Mus musculus
gaatcctacttagaactggcaatac

SEQ ID NO: 436962 - DNA, 25 bp, Mus musculus
gaatcctacttgaggtttgaagaga

SEQ ID NO: 436963 - DNA, 25 bp, Mus musculus
gaatcctacttgtggtttgaagaga

SEQ ID NO: 436964 - DNA, 25 bp, Mus musculus
gaatcctactttccacgtgttatta

SEQ ID NO: 436965 - DNA, 25 bp, Mus musculus
gaatcctactttgcacgtgttatta

SEQ ID NO: 436966 - DNA, 25 bp, Mus musculus
gaatcctaggaaatactgagccaag

SEQ ID NO: 436967 - DNA, 25 bp, Mus musculus
gaatcctaggaattactgagccaag

SEQ ID NO: 436968 - DNA, 25 bp, Mus musculus
gaatcctatattcctgttattagag

SEQ ID NO: 436969 - DNA, 25 bp, Mus musculus
gaatcctatattgctgttattagag

SEQ ID NO: 436970 - DNA, 25 bp, Mus musculus
gaatcctatgccctatgaccattgt

SEQ ID NO: 436971 - DNA, 25 bp, Mus musculus
gaatcctatgccgtatgaccattgt

SEQ ID NO: 436972 - DNA, 25 bp, Mus musculus
gaatcctatggtccaagaagctata

SEQ ID NO: 436973 - DNA, 25 bp, Mus musculus
gaatcctatggtgcaagaagctata

SEQ ID NO: 436974 - DNA, 25 bp, Mus musculus
gaatcctattagaagacctccactg

SEQ ID NO: 436975 - DNA, 25 bp, Mus musculus
gaatcctattagtagacctccactg

SEQ ID NO: 436976 - DNA, 25 bp, Mus musculus
gaatcctattcaatacatttgctgg

SEQ ID NO: 436977 - DNA, 25 bp, Mus musculus
gaatcctattcattacatttgctgg

SEQ ID NO: 436978 - DNA, 25 bp, Mus musculus
gaatcctcaacacatgccgctgtaa

SEQ ID NO: 436979 - DNA, 25 bp, Mus musculus
gaatcctcaacagatgccgctgtaa

SEQ ID NO: 436980 - DNA, 25 bp, Mus musculus
gaatcctcaactaagtggtttgcta

SEQ ID NO: 436981 - DNA, 25 bp, Mus musculus
gaatcctcaacttagtggtttgcta

SEQ ID NO: 436982 - DNA, 25 bp, Mus musculus
gaatcctcaagaagccttgtcaagt

SEQ ID NO: 436983 - DNA, 25 bp, Mus musculus
gaatcctcaagatgccttgtcaagt

SEQ ID NO: 436984 - DNA, 25 bp, Mus musculus
gaatcctcaagtagcccaaagagcc

SEQ ID NO: 436985 - DNA, 25 bp, Mus musculus
gaatcctcaagttgcccaaagagcc

SEQ ID NO: 436986 - DNA, 25 bp, Mus musculus
gaatcctcagctaaggacctgcttt

SEQ ID NO: 436987 - DNA, 25 bp, Mus musculus
gaatcctcagcttaggacctgcttt

SEQ ID NO: 436988 - DNA, 25 bp, Mus musculus
gaatcctcattacagtcacttatgg

SEQ ID NO: 436989 - DNA, 25 bp, Mus musculus
gaatcctcattagagtcacttatgg

SEQ ID NO: 436990 - DNA, 25 bp, Mus musculus
gaatcctcattgactattctgcatg

SEQ ID NO: 436991 - DNA, 25 bp, Mus musculus
gaatcctcattgtctattctgcatg

SEQ ID NO: 436992 - DNA, 25 bp, Mus musculus
gaatcctccagaaatactgaacgac

SEQ ID NO: 436993 - DNA, 25 bp, Mus musculus
gaatcctccagatatactgaacgac

SEQ ID NO: 436994 - DNA, 25 bp, Mus musculus
gaatcctccagtcttcattgtgtga

SEQ ID NO: 436995 - DNA, 25 bp, Mus musculus
gaatcctccagtgttcattgtgtga

SEQ ID NO: 436996 - DNA, 25 bp, Mus musculus
gaatcctcctggataggtaggcaca

SEQ ID NO: 436997 - DNA, 25 bp, Mus musculus
gaatcctcctggttaggtaggcaca

SEQ ID NO: 436998 - DNA, 25 bp, Mus musculus
gaatcctcgagtagtttgtggaaac

SEQ ID NO: 436999 - DNA, 25 bp, Mus musculus
gaatcctcgagttgtttgtggaaac

SEQ ID NO: 437000 - DNA, 25 bp, Mus musculus
gaatcctcgctcagcgggagtttga

SEQ ID NO: 437001 - DNA, 25 bp, Mus musculus
gaatcctcgctctgcgggagtttga

SEQ ID NO: 437002 - DNA, 25 bp, Mus musculus
gaatcctctagcatcaaggcttatt

SEQ ID NO: 437003 - DNA, 25 bp, Mus musculus
gaatcctctagcttcaaggcttatt

SEQ ID NO: 437004 - DNA, 25 bp, Mus musculus
gaatcctctataacgcaagctggcc

SEQ ID NO: 437005 - DNA, 25 bp, Mus musculus
gaatcctctatatcgcaagctggcc

SEQ ID NO: 437006 - DNA, 25 bp, Mus musculus
gaatcctctctcactattgtatgaa

SEQ ID NO: 437007 - DNA, 25 bp, Mus musculus
gaatcctctctctctattgtatgaa

SEQ ID NO: 437008 - DNA, 25 bp, Mus musculus
gaatcctctgatctatacactcttc

SEQ ID NO: 437009 - DNA, 25 bp, Mus musculus
gaatcctctgatgtatacactcttc

SEQ ID NO: 437010 - DNA, 25 bp, Mus musculus
gaatcctctgcacgcccagactgat

SEQ ID NO: 437011 - DNA, 25 bp, Mus musculus
gaatcctctgcaggcccagactgat

SEQ ID NO: 437012 - DNA, 25 bp, Mus musculus
gaatcctctgtgctagggtcaacaa

SEQ ID NO: 437013 - DNA, 25 bp, Mus musculus
gaatcctctgtggtagggtcaacaa

SEQ ID NO: 437014 - DNA, 25 bp, Mus musculus
gaatcctcttcaactacggagtcat

SEQ ID NO: 437015 - DNA, 25 bp, Mus musculus
gaatcctcttcatctacggagtcat

SEQ ID NO: 437016 - DNA, 25 bp, Mus musculus
gaatcctcttccatcagttcatttc

SEQ ID NO: 437017 - DNA, 25 bp, Mus musculus
gaatcctcttccttcagttcatttc

SEQ ID NO: 437018 - DNA, 25 bp, Mus musculus
gaatcctcttctaacctctaaataa

SEQ ID NO: 437019 - DNA, 25 bp, Mus musculus
gaatcctcttcttacctctaaataa

SEQ ID NO: 437020 - DNA, 25 bp, Mus musculus
gaatcctgaactcgttactctgcaa

SEQ ID NO: 437021 - DNA, 25 bp, Mus musculus
gaatcctgaactctacgtgtagttt

SEQ ID NO: 437022 - DNA, 25 bp, Mus musculus
gaatcctgaactggttactctgcaa

SEQ ID NO: 437023 - DNA, 25 bp, Mus musculus
gaatcctgaactgtacgtgtagttt

SEQ ID NO: 437024 - DNA, 25 bp, Mus musculus
gaatcctgaaggatgccaagcccaa

SEQ ID NO: 437025 - DNA, 25 bp, Mus musculus
gaatcctgaaggttgccaagcccaa

SEQ ID NO: 437026 - DNA, 25 bp, Mus musculus
gaatcctgacagatggaggaccaga

SEQ ID NO: 437027 - DNA, 25 bp, Mus musculus
gaatcctgacagttggaggaccaga

SEQ ID NO: 437028 - DNA, 25 bp, Mus musculus
gaatcctgagacctttgaccctgaa

SEQ ID NO: 437029 - DNA, 25 bp, Mus musculus
gaatcctgagacgtttgaccctgaa

SEQ ID NO: 437030 - DNA, 25 bp, Mus musculus
gaatcctgagccagcttctgacaac

SEQ ID NO: 437031 - DNA, 25 bp, Mus musculus
gaatcctgagcctgcttctgacaac

SEQ ID NO: 437032 - DNA, 25 bp, Mus musculus
gaatcctgaggcacctgctgttgaa

SEQ ID NO: 437033 - DNA, 25 bp, Mus musculus
gaatcctgaggctcctgctgttgaa

SEQ ID NO: 437034 - DNA, 25 bp, Mus musculus
gaatcctgaggtacatctgctgcat

SEQ ID NO: 437035 - DNA, 25 bp, Mus musculus
gaatcctgaggttcatctgctgcat

SEQ ID NO: 437036 - DNA, 25 bp, Mus musculus
gaatcctgcaaaatatatgacctcc

SEQ ID NO: 437037 - DNA, 25 bp, Mus musculus
gaatcctgcaaattatatgacctcc

SEQ ID NO: 437038 - DNA, 25 bp, Mus musculus
gaatcctgcactatttgtttactcg

SEQ ID NO: 437039 - DNA, 25 bp, Mus musculus
gaatcctgcactttttgtttactcg

SEQ ID NO: 437040 - DNA, 25 bp, Mus musculus
gaatcctgcatcatcctaagtaggg

SEQ ID NO: 437041 - DNA, 25 bp, Mus musculus
gaatcctgcatcttcctaagtaggg

SEQ ID NO: 437042 - DNA, 25 bp, Mus musculus
gaatcctgccctcggcttcttaata

SEQ ID NO: 437043 - DNA, 25 bp, Mus musculus
gaatcctgccctgggcttcttaata

SEQ ID NO: 437044 - DNA, 25 bp, Mus musculus
gaatcctgcgggagatctggcgcac

SEQ ID NO: 437045 - DNA, 25 bp, Mus musculus
gaatcctgcgggtgatctggcgcac

SEQ ID NO: 437046 - DNA, 25 bp, Mus musculus
gaatcctgctccatacattgggtgt

SEQ ID NO: 437047 - DNA, 25 bp, Mus musculus
gaatcctgctccttacattgggtgt

SEQ ID NO: 437048 - DNA, 25 bp, Mus musculus
gaatcctgctctcgcattaggagtt

SEQ ID NO: 437049 - DNA, 25 bp, Mus musculus
gaatcctgctctggcattaggagtt

SEQ ID NO: 437050 - DNA, 25 bp, Mus musculus
gaatcctgcttcataccaacatgga

SEQ ID NO: 437051 - DNA, 25 bp, Mus musculus
gaatcctgcttcttaccaacatgga

SEQ ID NO: 437052 - DNA, 25 bp, Mus musculus
gaatcctggaagaaccttgcgttta

SEQ ID NO: 437053 - DNA, 25 bp, Mus musculus
gaatcctggaagtaccttgcgttta

SEQ ID NO: 437054 - DNA, 25 bp, Mus musculus
gaatcctggaggacgttaccttagt

SEQ ID NO: 437055 - DNA, 25 bp, Mus musculus
gaatcctggaggctttttctgacta

SEQ ID NO: 437056 - DNA, 25 bp, Mus musculus
gaatcctggagggtttttctgacta

SEQ ID NO: 437057 - DNA, 25 bp, Mus musculus
gaatcctggaggtcgttaccttagt

SEQ ID NO: 437058 - DNA, 25 bp, Mus musculus
gaatcctggatcagagacttgtcac

SEQ ID NO: 437059 - DNA, 25 bp, Mus musculus
gaatcctggatctgagacttgtcac

SEQ ID NO: 437060 - DNA, 25 bp, Mus musculus
gaatcctggattaggagttacagtt

SEQ ID NO: 437061 - DNA, 25 bp, Mus musculus
gaatcctggatttggagttacagtt

SEQ ID NO: 437062 - DNA, 25 bp, Mus musculus
gaatcctggcagcttgaattgtgta

SEQ ID NO: 437063 - DNA, 25 bp, Mus musculus
gaatcctggcaggttgaattgtgta

SEQ ID NO: 437064 - DNA, 25 bp, Mus musculus
gaatcctggccacactctcagaaaa

SEQ ID NO: 437065 - DNA, 25 bp, Mus musculus
gaatcctggccagactctcagaaaa

SEQ ID NO: 437066 - DNA, 25 bp, Mus musculus
gaatcctggctaaatcaagctccga

SEQ ID NO: 437067 - DNA, 25 bp, Mus musculus
gaatcctggctatatcaagctccga

SEQ ID NO: 437068 - DNA, 25 bp, Mus musculus
gaatcctggcttcgagatacattat

SEQ ID NO: 437069 - DNA, 25 bp, Mus musculus
gaatcctggcttggagatacattat

SEQ ID NO: 437070 - DNA, 25 bp, Mus musculus
gaatcctgggatacacacacctagc

SEQ ID NO: 437071 - DNA, 25 bp, Mus musculus
gaatcctgggattcacacacctagc

SEQ ID NO: 437072 - DNA, 25 bp, Mus musculus
gaatcctgggtgagtgtctcacgac

SEQ ID NO: 437073 - DNA, 25 bp, Mus musculus
gaatcctgggtgtgtgtctcacgac

SEQ ID NO: 437074 - DNA, 25 bp, Mus musculus
gaatcctgggttccaacctctgaag

SEQ ID NO: 437075 - DNA, 25 bp, Mus musculus
gaatcctgggttgcaacctctgaag

SEQ ID NO: 437076 - DNA, 25 bp, Mus musculus
gaatcctggtgcattctccactgtg

SEQ ID NO: 437077 - DNA, 25 bp, Mus musculus
gaatcctggtgctttctccactgtg

SEQ ID NO: 437078 - DNA, 25 bp, Mus musculus
gaatcctgtaaccacgaaaccagtg

SEQ ID NO: 437079 - DNA, 25 bp, Mus musculus
gaatcctgtaacgacgaaaccagtg

SEQ ID NO: 437080 - DNA, 25 bp, Mus musculus
gaatcctgtaggctggcactatgtt

SEQ ID NO: 437081 - DNA, 25 bp, Mus musculus
gaatcctgtagggtggcactatgtt

SEQ ID NO: 437082 - DNA, 25 bp, Mus musculus
gaatcctgtataatccaacactgtg

SEQ ID NO: 437083 - DNA, 25 bp, Mus musculus
gaatcctgtatattccaacactgtg

SEQ ID NO: 437084 - DNA, 25 bp, Mus musculus
gaatcctgtatcagctgtggtcacc

SEQ ID NO: 437085 - DNA, 25 bp, Mus musculus
gaatcctgtatctgctgtggtcacc

SEQ ID NO: 437086 - DNA, 25 bp, Mus musculus
gaatcctgtcagctattctagactt

SEQ ID NO: 437087 - DNA, 25 bp, Mus musculus
gaatcctgtcaggtattctagactt

SEQ ID NO: 437088 - DNA, 25 bp, Mus musculus
gaatcctgtcatcataattgctgta

SEQ ID NO: 437089 - DNA, 25 bp, Mus musculus
gaatcctgtcatgataattgctgta

SEQ ID NO: 437090 - DNA, 25 bp, Mus musculus
gaatcctgtgagagcatccaactgt

SEQ ID NO: 437091 - DNA, 25 bp, Mus musculus
gaatcctgtgagtgcatccaactgt

SEQ ID NO: 437092 - DNA, 25 bp, Mus musculus
gaatcctgtgccaaccagaagtgga

SEQ ID NO: 437093 - DNA, 25 bp, Mus musculus
gaatcctgtgcctaccagaagtgga

SEQ ID NO: 437094 - DNA, 25 bp, Mus musculus
gaatcctgtgggacaatgtactaat

SEQ ID NO: 437095 - DNA, 25 bp, Mus musculus
gaatcctgtgggtcaatgtactaat

SEQ ID NO: 437096 - DNA, 25 bp, Mus musculus
gaatcctgttgtcgcatctcacttg

SEQ ID NO: 437097 - DNA, 25 bp, Mus musculus
gaatcctgttgtggcatctcacttg

SEQ ID NO: 437098 - DNA, 25 bp, Mus musculus
gaatcctgttttaaccccagtactg

SEQ ID NO: 437099 - DNA, 25 bp, Mus musculus
gaatcctgtttttaccccagtactg

SEQ ID NO: 437100 - DNA, 25 bp, Mus musculus
gaatccttaatcctttacattgaac

SEQ ID NO: 437101 - DNA, 25 bp, Mus musculus
gaatccttaatcgtttacattgaac

SEQ ID NO: 437102 - DNA, 25 bp, Mus musculus
gaatccttacaccaaagctcatggg

SEQ ID NO: 437103 - DNA, 25 bp, Mus musculus
gaatccttacacgaaagctcatggg

SEQ ID NO: 437104 - DNA, 25 bp, Mus musculus
gaatccttagaactgtgccgctagt

SEQ ID NO: 437105 - DNA, 25 bp, Mus musculus
gaatccttagaagtgtgccgctagt

SEQ ID NO: 437106 - DNA, 25 bp, Mus musculus
gaatccttagtcatctcaagcttgg

SEQ ID NO: 437107 - DNA, 25 bp, Mus musculus
gaatccttagtcttctcaagcttgg

SEQ ID NO: 437108 - DNA, 25 bp, Mus musculus
gaatccttatctctagcttcgtttt

SEQ ID NO: 437109 - DNA, 25 bp, Mus musculus
gaatccttatctgtagcttcgtttt

SEQ ID NO: 437110 - DNA, 25 bp, Mus musculus
gaatccttcagcactacaccattga

SEQ ID NO: 437111 - DNA, 25 bp, Mus musculus
gaatccttcagctctacaccattga

SEQ ID NO: 437112 - DNA, 25 bp, Mus musculus
gaatccttctcaacgatatgggaat

SEQ ID NO: 437113 - DNA, 25 bp, Mus musculus
gaatccttctcatcgatatgggaat

SEQ ID NO: 437114 - DNA, 25 bp, Mus musculus
gaatccttctgaaaggccactgacg

SEQ ID NO: 437115 - DNA, 25 bp, Mus musculus
gaatccttctgataggccactgacg

SEQ ID NO: 437116 - DNA, 25 bp, Mus musculus
gaatccttctgtatcaggctttcgc

SEQ ID NO: 437117 - DNA, 25 bp, Mus musculus
gaatccttctgtttcaggctttcgc

SEQ ID NO: 437118 - DNA, 25 bp, Mus musculus
gaatccttgaacaggcactttttgc

SEQ ID NO: 437119 - DNA, 25 bp, Mus musculus
gaatccttgaactggcactttttgc

SEQ ID NO: 437120 - DNA, 25 bp, Mus musculus
gaatccttgaggagaatgctacgtt

SEQ ID NO: 437121 - DNA, 25 bp, Mus musculus
gaatccttgaggtgaatgctacgtt

SEQ ID NO: 437122 - DNA, 25 bp, Mus musculus
gaatccttgagtcgttgcttcctag

SEQ ID NO: 437123 - DNA, 25 bp, Mus musculus
gaatccttgagtggttgcttcctag

SEQ ID NO: 437124 - DNA, 25 bp, Mus musculus
gaatccttgcctctgagaataaaag

SEQ ID NO: 437125 - DNA, 25 bp, Mus musculus
gaatccttgcctgtgagaataaaag

SEQ ID NO: 437126 - DNA, 25 bp, Mus musculus
gaatccttgctgagttggcatctct

SEQ ID NO: 437127 - DNA, 25 bp, Mus musculus
gaatccttgctgctcagacacagaa

SEQ ID NO: 437128 - DNA, 25 bp, Mus musculus
gaatccttgctggtcagacacagaa

SEQ ID NO: 437129 - DNA, 25 bp, Mus musculus
gaatccttgctgtgttggcatctct

SEQ ID NO: 437130 - DNA, 25 bp, Mus musculus
gaatccttggagaccactgttgaga

SEQ ID NO: 437131 - DNA, 25 bp, Mus musculus
gaatccttggagtccactgttgaga

SEQ ID NO: 437132 - DNA, 25 bp, Mus musculus
gaatccttggatatcttactcgttt

SEQ ID NO: 437133 - DNA, 25 bp, Mus musculus
gaatccttggatttcttactcgttt

SEQ ID NO: 437134 - DNA, 25 bp, Mus musculus
gaatcctttatcctgccaaactggc

SEQ ID NO: 437135 - DNA, 25 bp, Mus musculus
gaatcctttatcgtgccaaactggc

SEQ ID NO: 437136 - DNA, 25 bp, Mus musculus
gaatcctttcaccagctagtagagc

SEQ ID NO: 437137 - DNA, 25 bp, Mus musculus
gaatcctttcacgagctagtagagc

SEQ ID NO: 437138 - DNA, 25 bp, Mus musculus
gaatcctttcctactatggtgtaga

SEQ ID NO: 437139 - DNA, 25 bp, Mus musculus
gaatcctttccttctatggtgtaga

SEQ ID NO: 437140 - DNA, 25 bp, Mus musculus
gaatcctttcgaatgaccaacctgg

SEQ ID NO: 437141 - DNA, 25 bp, Mus musculus
gaatcctttcgattgaccaacctgg

SEQ ID NO: 437142 - DNA, 25 bp, Mus musculus
gaatcctttctcattcagagttctg

SEQ ID NO: 437143 - DNA, 25 bp, Mus musculus
gaatcctttctctttcagagttctg

SEQ ID NO: 437144 - DNA, 25 bp, Mus musculus
gaatcctttcttagatttcctccag

SEQ ID NO: 437145 - DNA, 25 bp, Mus musculus
gaatcctttctttgatttcctccag

SEQ ID NO: 437146 - DNA, 25 bp, Mus musculus
gaatcctttgccacagttccaagac

SEQ ID NO: 437147 - DNA, 25 bp, Mus musculus
gaatcctttgcctcagttccaagac

SEQ ID NO: 437148 - DNA, 25 bp, Mus musculus
gaatccttttctcaagcctgtggaa

SEQ ID NO: 437149 - DNA, 25 bp, Mus musculus
gaatccttttctgaagcctgtggaa

SEQ ID NO: 437150 - DNA, 25 bp, Mus musculus
gaatcgaaaacaagctgtcactgga

SEQ ID NO: 437151 - DNA, 25 bp, Mus musculus
gaatcgaaaacatgctgtcactgga

SEQ ID NO: 437152 - DNA, 25 bp, Mus musculus
gaatcgaaacatcagctgtcctact

SEQ ID NO: 437153 - DNA, 25 bp, Mus musculus
gaatcgaaacatgagctgtcctact

SEQ ID NO: 437154 - DNA, 25 bp, Mus musculus
gaatcgaacgctatctgaggtatgt

SEQ ID NO: 437155 - DNA, 25 bp, Mus musculus
gaatcgaacgctttctgaggtatgt

SEQ ID NO: 437156 - DNA, 25 bp, Mus musculus
gaatcgaatgcaccagagcagatcc

SEQ ID NO: 437157 - DNA, 25 bp, Mus musculus
gaatcgaatgcagcagagcagatcc

SEQ ID NO: 437158 - DNA, 25 bp, Mus musculus
gaatcgacaacgacaagctgagtca

SEQ ID NO: 437159 - DNA, 25 bp, Mus musculus
gaatcgacaacgtcaagctgagtca

SEQ ID NO: 437160 - DNA, 25 bp, Mus musculus
gaatcgacacccactgtctgtgaaa

SEQ ID NO: 437161 - DNA, 25 bp, Mus musculus
gaatcgacaccctctgtctgtgaaa

SEQ ID NO: 437162 - DNA, 25 bp, Mus musculus
gaatcgacagcaaccccaatacttt

SEQ ID NO: 437163 - DNA, 25 bp, Mus musculus
gaatcgacagcatccccaatacttt

SEQ ID NO: 437164 - DNA, 25 bp, Mus musculus
gaatcgacgatgcaagctgctgccc

SEQ ID NO: 437165 - DNA, 25 bp, Mus musculus
gaatcgacgatggaagctgctgccc

SEQ ID NO: 437166 - DNA, 25 bp, Mus musculus
gaatcgacggtaatgcggcactgat

SEQ ID NO: 437167 - DNA, 25 bp, Mus musculus
gaatcgacggtattgcggcactgat

SEQ ID NO: 437168 - DNA, 25 bp, Mus musculus
gaatcgacggtcaggcaggaaagct

SEQ ID NO: 437169 - DNA, 25 bp, Mus musculus
gaatcgacggtcagttgcggttcct

SEQ ID NO: 437170 - DNA, 25 bp, Mus musculus
gaatcgacggtctggcaggaaagct

SEQ ID NO: 437171 - DNA, 25 bp, Mus musculus
gaatcgacggtctgttgcggttcct

SEQ ID NO: 437172 - DNA, 25 bp, Mus musculus
gaatcgactgataatcctgcacttg

SEQ ID NO: 437173 - DNA, 25 bp, Mus musculus
gaatcgactgattatcctgcacttg

SEQ ID NO: 437174 - DNA, 25 bp, Mus musculus
gaatcgagaggaagtccacgaaact

SEQ ID NO: 437175 - DNA, 25 bp, Mus musculus
gaatcgagaggatgtccacgaaact

SEQ ID NO: 437176 - DNA, 25 bp, Mus musculus
gaatcgagagtcacgtcatcacctg

SEQ ID NO: 437177 - DNA, 25 bp, Mus musculus
gaatcgagagtctcgtcatcacctg

SEQ ID NO: 437178 - DNA, 25 bp, Mus musculus
gaatcgagctataagtttgcctgtc

SEQ ID NO: 437179 - DNA, 25 bp, Mus musculus
gaatcgagctattagtttgcctgtc

SEQ ID NO: 437180 - DNA, 25 bp, Mus musculus
gaatcgagctctagaagaagcagaa

SEQ ID NO: 437181 - DNA, 25 bp, Mus musculus
gaatcgagctcttgaagaagcagaa

SEQ ID NO: 437182 - DNA, 25 bp, Mus musculus
gaatcgagtcctcgctatggagcat

SEQ ID NO: 437183 - DNA, 25 bp, Mus musculus
gaatcgagtcctggctatggagcat

SEQ ID NO: 437184 - DNA, 25 bp, Mus musculus
gaatcgagtttcagcacacaggact

SEQ ID NO: 437185 - DNA, 25 bp, Mus musculus
gaatcgagtttctgcacacaggact

SEQ ID NO: 437186 - DNA, 25 bp, Mus musculus
gaatcgattccaccttatccagtgt

SEQ ID NO: 437187 - DNA, 25 bp, Mus musculus
gaatcgattccagcttatccagtgt

SEQ ID NO: 437188 - DNA, 25 bp, Mus musculus
gaatcgcaacgacatccaaaggctc

SEQ ID NO: 437189 - DNA, 25 bp, Mus musculus
gaatcgcaacgagatccaaaggctc

SEQ ID NO: 437190 - DNA, 25 bp, Mus musculus
gaatcgcactgactgtttttgtggg

SEQ ID NO: 437191 - DNA, 25 bp, Mus musculus
gaatcgcactgagtgtttttgtggg

SEQ ID NO: 437192 - DNA, 25 bp, Mus musculus
gaatcgcaggctcctatttgtacag

SEQ ID NO: 437193 - DNA, 25 bp, Mus musculus
gaatcgcaggctgctatttgtacag

SEQ ID NO: 437194 - DNA, 25 bp, Mus musculus
gaatcgcagtgaactgtgtccagaa

SEQ ID NO: 437195 - DNA, 25 bp, Mus musculus
gaatcgcagtgatctgtgtccagaa

SEQ ID NO: 437196 - DNA, 25 bp, Mus musculus
gaatcgcatcaaaaaagccgtggct

SEQ ID NO: 437197 - DNA, 25 bp, Mus musculus
gaatcgcatcaataaagccgtggct

SEQ ID NO: 437198 - DNA, 25 bp, Mus musculus
gaatcgccgtgaaggcatgtttgga

SEQ ID NO: 437199 - DNA, 25 bp, Mus musculus
gaatcgccgtgatggcatgtttgga

SEQ ID NO: 437200 - DNA, 25 bp, Mus musculus
gaatcgcctattaatgtcatttgta

SEQ ID NO: 437201 - DNA, 25 bp, Mus musculus
gaatcgcctatttatgtcatttgta

SEQ ID NO: 437202 - DNA, 25 bp, Mus musculus
gaatcgcctttgcatcttaagcttt

SEQ ID NO: 437203 - DNA, 25 bp, Mus musculus
gaatcgcctttggatcttaagcttt

SEQ ID NO: 437204 - DNA, 25 bp, Mus musculus
gaatcgctaaggatccacggtttga

SEQ ID NO: 437205 - DNA, 25 bp, Mus musculus
gaatcgctaaggttccacggtttga

SEQ ID NO: 437206 - DNA, 25 bp, Mus musculus
gaatcgctaggcagagcccagcaat

SEQ ID NO: 437207 - DNA, 25 bp, Mus musculus
gaatcgctaggctgagcccagcaat

SEQ ID NO: 437208 - DNA, 25 bp, Mus musculus
gaatcgctatttctgataccaccac

SEQ ID NO: 437209 - DNA, 25 bp, Mus musculus
gaatcgctatttgtgataccaccac

SEQ ID NO: 437210 - DNA, 25 bp, Mus musculus
gaatcgctctcacaaatctcggcat

SEQ ID NO: 437211 - DNA, 25 bp, Mus musculus
gaatcgctctcagaaatctcggcat

SEQ ID NO: 437212 - DNA, 25 bp, Mus musculus
gaatcgcttcagatctatacaagtg

SEQ ID NO: 437213 - DNA, 25 bp, Mus musculus
gaatcgcttcagttctatacaagtg

SEQ ID NO: 437214 - DNA, 25 bp, Mus musculus
gaatcgcttcttctccgataaacag

SEQ ID NO: 437215 - DNA, 25 bp, Mus musculus
gaatcgcttcttgtccgataaacag

SEQ ID NO: 437216 - DNA, 25 bp, Mus musculus
gaatcggaaacccttgcaactgtct

SEQ ID NO: 437217 - DNA, 25 bp, Mus musculus
gaatcggaaaccgttgcaactgtct

SEQ ID NO: 437218 - DNA, 25 bp, Mus musculus
gaatcggaacaaactgcgccggcag

SEQ ID NO: 437219 - DNA, 25 bp, Mus musculus
gaatcggaacaatctgcgccggcag

SEQ ID NO: 437220 - DNA, 25 bp, Mus musculus
gaatcggaacagacttgcagcagga

SEQ ID NO: 437221 - DNA, 25 bp, Mus musculus
gaatcggaacagtcttgcagcagga

SEQ ID NO: 437222 - DNA, 25 bp, Mus musculus
gaatcggaagctcggcaagcctgat

SEQ ID NO: 437223 - DNA, 25 bp, Mus musculus
gaatcggaagctgggcaagcctgat

SEQ ID NO: 437224 - DNA, 25 bp, Mus musculus
gaatcggacgtacaccattagtgct

SEQ ID NO: 437225 - DNA, 25 bp, Mus musculus
gaatcggacgtagaccattagtgct

SEQ ID NO: 437226 - DNA, 25 bp, Mus musculus
gaatcggactaacttacagatgtgt

SEQ ID NO: 437227 - DNA, 25 bp, Mus musculus
gaatcggactaagttacagatgtgt

SEQ ID NO: 437228 - DNA, 25 bp, Mus musculus
gaatcggactttctggagaagccag

SEQ ID NO: 437229 - DNA, 25 bp, Mus musculus
gaatcggactttgtggagaagccag

SEQ ID NO: 437230 - DNA, 25 bp, Mus musculus
gaatcggaggagacggtgcccaacc

SEQ ID NO: 437231 - DNA, 25 bp, Mus musculus
gaatcggaggagtcggtgcccaacc

SEQ ID NO: 437232 - DNA, 25 bp, Mus musculus
gaatcggatgatcctttgactcaca

SEQ ID NO: 437233 - DNA, 25 bp, Mus musculus
gaatcggatgatgctttgactcaca

SEQ ID NO: 437234 - DNA, 25 bp, Mus musculus
gaatcggattgacttcttctgaaca

SEQ ID NO: 437235 - DNA, 25 bp, Mus musculus
gaatcggattgagttcttctgaaca

SEQ ID NO: 437236 - DNA, 25 bp, Mus musculus
gaatcggcaactacacaagtccgta

SEQ ID NO: 437237 - DNA, 25 bp, Mus musculus
gaatcggcaacttcacaagtccgta

SEQ ID NO: 437238 - DNA, 25 bp, Mus musculus
gaatcggcaagccgcttaacagagg

SEQ ID NO: 437239 - DNA, 25 bp, Mus musculus
gaatcggcaagcggcttaacagagg

SEQ ID NO: 437240 - DNA, 25 bp, Mus musculus
gaatcggcccctcaatggtggatca

SEQ ID NO: 437241 - DNA, 25 bp, Mus musculus
gaatcggcccctgaatggtggatca

SEQ ID NO: 437242 - DNA, 25 bp, Mus musculus
gaatcggccctgaaagtatccaaga

SEQ ID NO: 437243 - DNA, 25 bp, Mus musculus
gaatcggccctgtaagtatccaaga

SEQ ID NO: 437244 - DNA, 25 bp, Mus musculus
gaatcggctgcgcaggcgttaccta

SEQ ID NO: 437245 - DNA, 25 bp, Mus musculus
gaatcggctgcggaggcgttaccta

SEQ ID NO: 437246 - DNA, 25 bp, Mus musculus
gaatcggcttgtcctgttagaatac

SEQ ID NO: 437247 - DNA, 25 bp, Mus musculus
gaatcggcttgtgctgttagaatac

SEQ ID NO: 437248 - DNA, 25 bp, Mus musculus
gaatcgggccagatctgtagatcct

SEQ ID NO: 437249 - DNA, 25 bp, Mus musculus
gaatcgggccagttctgtagatcct

SEQ ID NO: 437250 - DNA, 25 bp, Mus musculus
gaatcgggcctgaactcagcaggct

SEQ ID NO: 437251 - DNA, 25 bp, Mus musculus
gaatcgggcctgtactcagcaggct

SEQ ID NO: 437252 - DNA, 25 bp, Mus musculus
gaatcgggctctcgatccgacttca

SEQ ID NO: 437253 - DNA, 25 bp, Mus musculus
gaatcgggctctggatccgacttca

SEQ ID NO: 437254 - DNA, 25 bp, Mus musculus
gaatcgggctggaaggcttgaatct

SEQ ID NO: 437255 - DNA, 25 bp, Mus musculus
gaatcgggctggattccaaacagaa

SEQ ID NO: 437256 - DNA, 25 bp, Mus musculus
gaatcgggctggtaggcttgaatct

SEQ ID NO: 437257 - DNA, 25 bp, Mus musculus
gaatcgggctggtttccaaacagaa

SEQ ID NO: 437258 - DNA, 25 bp, Mus musculus
gaatcgggtaccactcgtggcagtg

SEQ ID NO: 437259 - DNA, 25 bp, Mus musculus
gaatcgggtacctctcgtggcagtg

SEQ ID NO: 437260 - DNA, 25 bp, Mus musculus
gaatcggtagccacagcatctgaca

SEQ ID NO: 437261 - DNA, 25 bp, Mus musculus
gaatcggtagcctcagcatctgaca

SEQ ID NO: 437262 - DNA, 25 bp, Mus musculus
gaatcggtcactcgattttcacatc

SEQ ID NO: 437263 - DNA, 25 bp, Mus musculus
gaatcggtcactggattttcacatc

SEQ ID NO: 437264 - DNA, 25 bp, Mus musculus
gaatcggtgagcacacaccgggaga

SEQ ID NO: 437265 - DNA, 25 bp, Mus musculus
gaatcggtgagctcacaccgggaga

SEQ ID NO: 437266 - DNA, 25 bp, Mus musculus
gaatcggtgcataggcaacactcgt

SEQ ID NO: 437267 - DNA, 25 bp, Mus musculus
gaatcggtgcattggcaacactcgt

SEQ ID NO: 437268 - DNA, 25 bp, Mus musculus
gaatcggtgcgacgtccaggtcaat

SEQ ID NO: 437269 - DNA, 25 bp, Mus musculus
gaatcggtgcgaggtccaggtcaat

SEQ ID NO: 437270 - DNA, 25 bp, Mus musculus
gaatcggtgtatacgtttggtacaa

SEQ ID NO: 437271 - DNA, 25 bp, Mus musculus
gaatcggtgtattcgtttggtacaa

SEQ ID NO: 437272 - DNA, 25 bp, Mus musculus
gaatcggttggtaggtgacccaaga

SEQ ID NO: 437273 - DNA, 25 bp, Mus musculus
gaatcggttggttggtgacccaaga

SEQ ID NO: 437274 - DNA, 25 bp, Mus musculus
gaatcggtttttctcagccctattt

SEQ ID NO: 437275 - DNA, 25 bp, Mus musculus
gaatcggtttttgtcagccctattt

SEQ ID NO: 437276 - DNA, 25 bp, Mus musculus
gaatcgtaatgacgcgagcgccgcc

SEQ ID NO: 437277 - DNA, 25 bp, Mus musculus
gaatcgtaatgaggcgagcgccgcc

SEQ ID NO: 437278 - DNA, 25 bp, Mus musculus
gaatcgtcagacaactcgttatcat

SEQ ID NO: 437279 - DNA, 25 bp, Mus musculus
gaatcgtcagactactcgttatcat

SEQ ID NO: 437280 - DNA, 25 bp, Mus musculus
gaatcgtccggcaggctttgcaggt

SEQ ID NO: 437281 - DNA, 25 bp, Mus musculus
gaatcgtccggctggctttgcaggt

SEQ ID NO: 437282 - DNA, 25 bp, Mus musculus
gaatcgtcgtaaacatagcaagcct

SEQ ID NO: 437283 - DNA, 25 bp, Mus musculus
gaatcgtcgtaatcatagcaagcct

SEQ ID NO: 437284 - DNA, 25 bp, Mus musculus
gaatcgtcttctaggtcatcaacag

SEQ ID NO: 437285 - DNA, 25 bp, Mus musculus
gaatcgtcttcttggtcatcaacag

SEQ ID NO: 437286 - DNA, 25 bp, Mus musculus
gaatcgtgcacgcaatctgctgcca

SEQ ID NO: 437287 - DNA, 25 bp, Mus musculus
gaatcgtgcacggaatctgctgcca

SEQ ID NO: 437288 - DNA, 25 bp, Mus musculus
gaatcgtgcagtagctttgatgcta

SEQ ID NO: 437289 - DNA, 25 bp, Mus musculus
gaatcgtgcagttgctttgatgcta

SEQ ID NO: 437290 - DNA, 25 bp, Mus musculus
gaatcgttcagactcttctcgaagt

SEQ ID NO: 437291 - DNA, 25 bp, Mus musculus
gaatcgttcagagtcttctcgaagt

SEQ ID NO: 437292 - DNA, 25 bp, Mus musculus
gaatcgttcttgctttattgctggt

SEQ ID NO: 437293 - DNA, 25 bp, Mus musculus
gaatcgttcttggtttattgctggt

SEQ ID NO: 437294 - DNA, 25 bp, Mus musculus
gaatcgtttaaaattaatgccctat

SEQ ID NO: 437295 - DNA, 25 bp, Mus musculus
gaatcgtttaaatttaatgccctat

SEQ ID NO: 437296 - DNA, 25 bp, Mus musculus
gaatcgtttttcagtcatgtctatt

SEQ ID NO: 437297 - DNA, 25 bp, Mus musculus
gaatcgtttttctgtcatgtctatt

SEQ ID NO: 437298 - DNA, 25 bp, Mus musculus
gaatctaaaatcaacctttgccacg

SEQ ID NO: 437299 - DNA, 25 bp, Mus musculus
gaatctaaaatctacctttgccacg

SEQ ID NO: 437300 - DNA, 25 bp, Mus musculus
gaatctaaacccatttgagtgtaca

SEQ ID NO: 437301 - DNA, 25 bp, Mus musculus
gaatctaaacccttttgagtgtaca

SEQ ID NO: 437302 - DNA, 25 bp, Mus musculus
gaatctaaactgaatagcactttgt

SEQ ID NO: 437303 - DNA, 25 bp, Mus musculus
gaatctaaactgtatagcactttgt

SEQ ID NO: 437304 - DNA, 25 bp, Mus musculus
gaatctaaagacaaacttgcctttt

SEQ ID NO: 437305 - DNA, 25 bp, Mus musculus
gaatctaaagactaacttgcctttt

SEQ ID NO: 437306 - DNA, 25 bp, Mus musculus
gaatctaacaccaaccaaatcctct

SEQ ID NO: 437307 - DNA, 25 bp, Mus musculus
gaatctaacaccatcttgttgcctc

SEQ ID NO: 437308 - DNA, 25 bp, Mus musculus
gaatctaacacctaccaaatcctct

SEQ ID NO: 437309 - DNA, 25 bp, Mus musculus
gaatctaacaccttcttgttgcctc

SEQ ID NO: 437310 - DNA, 25 bp, Mus musculus
gaatctaaccttccgagcatgaagt

SEQ ID NO: 437311 - DNA, 25 bp, Mus musculus
gaatctaaccttcgacaatggccat

SEQ ID NO: 437312 - DNA, 25 bp, Mus musculus
gaatctaaccttgcgagcatgaagt

SEQ ID NO: 437313 - DNA, 25 bp, Mus musculus
gaatctaaccttggacaatggccat

SEQ ID NO: 437314 - DNA, 25 bp, Mus musculus
gaatctaactaaccctccagtctga

SEQ ID NO: 437315 - DNA, 25 bp, Mus musculus
gaatctaactaagcctccagtctga

SEQ ID NO: 437316 - DNA, 25 bp, Mus musculus
gaatctaagaccattcatctggccg

SEQ ID NO: 437317 - DNA, 25 bp, Mus musculus
gaatctaagaccattttcggcttgt

SEQ ID NO: 437318 - DNA, 25 bp, Mus musculus
gaatctaagacctttcatctggccg

SEQ ID NO: 437319 - DNA, 25 bp, Mus musculus
gaatctaagacctttttcggcttgt

SEQ ID NO: 437320 - DNA, 25 bp, Mus musculus
gaatctaagcacagcttctctctag

SEQ ID NO: 437321 - DNA, 25 bp, Mus musculus
gaatctaagcactgcttctctctag

SEQ ID NO: 437322 - DNA, 25 bp, Mus musculus
gaatctaagcatcccaggaccgtga

SEQ ID NO: 437323 - DNA, 25 bp, Mus musculus
gaatctaagcatgccaggaccgtga

SEQ ID NO: 437324 - DNA, 25 bp, Mus musculus
gaatctaagcccattacaagtcata

SEQ ID NO: 437325 - DNA, 25 bp, Mus musculus
gaatctaagccctttacaagtcata

SEQ ID NO: 437326 - DNA, 25 bp, Mus musculus
gaatctaagcggcagccagacaacc

SEQ ID NO: 437327 - DNA, 25 bp, Mus musculus
gaatctaagcgggagccagacaacc

SEQ ID NO: 437328 - DNA, 25 bp, Mus musculus
gaatctaagtggcatttaaaacagt

SEQ ID NO: 437329 - DNA, 25 bp, Mus musculus
gaatctaagtgggatttaaaacagt

SEQ ID NO: 437330 - DNA, 25 bp, Mus musculus
gaatctaatgatctgctcggtgtaa

SEQ ID NO: 437331 - DNA, 25 bp, Mus musculus
gaatctaatgatgtgctcggtgtaa

SEQ ID NO: 437332 - DNA, 25 bp, Mus musculus
gaatctacacacaatgacaaaatca

SEQ ID NO: 437333 - DNA, 25 bp, Mus musculus
gaatctacacactatgacaaaatca

SEQ ID NO: 437334 - DNA, 25 bp, Mus musculus
gaatctacaggcaactcttcatctc

SEQ ID NO: 437335 - DNA, 25 bp, Mus musculus
gaatctacaggctactcttcatctc

SEQ ID NO: 437336 - DNA, 25 bp, Mus musculus
gaatctacccacacacatttaagga

SEQ ID NO: 437337 - DNA, 25 bp, Mus musculus
gaatctacccacagagtgtctactt

SEQ ID NO: 437338 - DNA, 25 bp, Mus musculus
gaatctacccactcacatttaagga

SEQ ID NO: 437339 - DNA, 25 bp, Mus musculus
gaatctacccactgagtgtctactt

SEQ ID NO: 437340 - DNA, 25 bp, Mus musculus
gaatctaccctcattcgtgagtggg

SEQ ID NO: 437341 - DNA, 25 bp, Mus musculus
gaatctaccctctttcgtgagtggg

SEQ ID NO: 437342 - DNA, 25 bp, Mus musculus
gaatctaccttaataacatttgcat

SEQ ID NO: 437343 - DNA, 25 bp, Mus musculus
gaatctaccttattaacatttgcat

SEQ ID NO: 437344 - DNA, 25 bp, Mus musculus
gaatctactaatagctcctggcctt

SEQ ID NO: 437345 - DNA, 25 bp, Mus musculus
gaatctactaattgctcctggcctt

SEQ ID NO: 437346 - DNA, 25 bp, Mus musculus
gaatctactctgatgggcgttatgg

SEQ ID NO: 437347 - DNA, 25 bp, Mus musculus
gaatctactctgttgggcgttatgg

SEQ ID NO: 437348 - DNA, 25 bp, Mus musculus
gaatctactgacacacctagacatg

SEQ ID NO: 437349 - DNA, 25 bp, Mus musculus
gaatctactgactcacctagacatg

SEQ ID NO: 437350 - DNA, 25 bp, Mus musculus
gaatctactgagattgtatttaaga

SEQ ID NO: 437351 - DNA, 25 bp, Mus musculus
gaatctactgagtttgtatttaaga

SEQ ID NO: 437352 - DNA, 25 bp, Mus musculus
gaatctactgatctccccaatggat

SEQ ID NO: 437353 - DNA, 25 bp, Mus musculus
gaatctactgatgtccccaatggat

SEQ ID NO: 437354 - DNA, 25 bp, Mus musculus
gaatctactgttcctactgaacggc

SEQ ID NO: 437355 - DNA, 25 bp, Mus musculus
gaatctactgttgctactgaacggc

SEQ ID NO: 437356 - DNA, 25 bp, Mus musculus
gaatctactttcaaatccataaccc

SEQ ID NO: 437357 - DNA, 25 bp, Mus musculus
gaatctactttctaatccataaccc

SEQ ID NO: 437358 - DNA, 25 bp, Mus musculus
gaatctagacaacgcccggcaggct

SEQ ID NO: 437359 - DNA, 25 bp, Mus musculus
gaatctagacaaggcccggcaggct

SEQ ID NO: 437360 - DNA, 25 bp, Mus musculus
gaatctagagaaccccatatttcaa

SEQ ID NO: 437361 - DNA, 25 bp, Mus musculus
gaatctagagaagcccatatttcaa

SEQ ID NO: 437362 - DNA, 25 bp, Mus musculus
gaatctagagatagtccagctgtct

SEQ ID NO: 437363 - DNA, 25 bp, Mus musculus
gaatctagagattgtccagctgtct

SEQ ID NO: 437364 - DNA, 25 bp, Mus musculus
gaatctagagttctgacactccctg

SEQ ID NO: 437365 - DNA, 25 bp, Mus musculus
gaatctagagttgtgacactccctg

SEQ ID NO: 437366 - DNA, 25 bp, Mus musculus
gaatctagatgccatccatcacgtc

SEQ ID NO: 437367 - DNA, 25 bp, Mus musculus
gaatctagatgcgatccatcacgtc

SEQ ID NO: 437368 - DNA, 25 bp, Mus musculus
gaatctagcaaacaaagcacgcctc

SEQ ID NO: 437369 - DNA, 25 bp, Mus musculus
gaatctagcaaagaaagcacgcctc

SEQ ID NO: 437370 - DNA, 25 bp, Mus musculus
gaatctagcaagcaccctttcatgt

SEQ ID NO: 437371 - DNA, 25 bp, Mus musculus
gaatctagcaaggaccctttcatgt

SEQ ID NO: 437372 - DNA, 25 bp, Mus musculus
gaatctagcaatcatgaagtcatat

SEQ ID NO: 437373 - DNA, 25 bp, Mus musculus
gaatctagcaatgatgaagtcatat

SEQ ID NO: 437374 - DNA, 25 bp, Mus musculus
gaatctagcataacgcatttggttt

SEQ ID NO: 437375 - DNA, 25 bp, Mus musculus
gaatctagcatatcgcatttggttt

SEQ ID NO: 437376 - DNA, 25 bp, Mus musculus
gaatctagccacagcaccatgggtt

SEQ ID NO: 437377 - DNA, 25 bp, Mus musculus
gaatctagccacagcgggttctcac

SEQ ID NO: 437378 - DNA, 25 bp, Mus musculus
gaatctagccactgcaccatgggtt

SEQ ID NO: 437379 - DNA, 25 bp, Mus musculus
gaatctagccactgcgggttctcac

SEQ ID NO: 437380 - DNA, 25 bp, Mus musculus
gaatctagctacataagcactttta

SEQ ID NO: 437381 - DNA, 25 bp, Mus musculus
gaatctagctacttaagcactttta

SEQ ID NO: 437382 - DNA, 25 bp, Mus musculus
gaatctagctcaatggttcagcccc

SEQ ID NO: 437383 - DNA, 25 bp, Mus musculus
gaatctagctcattggttcagcccc

SEQ ID NO: 437384 - DNA, 25 bp, Mus musculus
gaatctaggcttacatgttctggta

SEQ ID NO: 437385 - DNA, 25 bp, Mus musculus
gaatctaggctttcatgttctggta

SEQ ID NO: 437386 - DNA, 25 bp, Mus musculus
gaatctagggtcatggtgtttctcc

SEQ ID NO: 437387 - DNA, 25 bp, Mus musculus
gaatctagggtcttggtgtttctcc

SEQ ID NO: 437388 - DNA, 25 bp, Mus musculus
gaatctagtcaactgactcctgcca

SEQ ID NO: 437389 - DNA, 25 bp, Mus musculus
gaatctagtcaagtgactcctgcca

SEQ ID NO: 437390 - DNA, 25 bp, Mus musculus
gaatctagtgccctgtggtgagttt

SEQ ID NO: 437391 - DNA, 25 bp, Mus musculus
gaatctagtgccgtgtggtgagttt

SEQ ID NO: 437392 - DNA, 25 bp, Mus musculus
gaatctataacacctccatcatgac

SEQ ID NO: 437393 - DNA, 25 bp, Mus musculus
gaatctataacagctccatcatgac

SEQ ID NO: 437394 - DNA, 25 bp, Mus musculus
gaatctataatcatcccatcgaatt

SEQ ID NO: 437395 - DNA, 25 bp, Mus musculus
gaatctataatcttcccatcgaatt

SEQ ID NO: 437396 - DNA, 25 bp, Mus musculus
gaatctatagtgatgccatttggtc

SEQ ID NO: 437397 - DNA, 25 bp, Mus musculus
gaatctatagtgttgccatttggtc

SEQ ID NO: 437398 - DNA, 25 bp, Mus musculus
gaatctatattccattaccatcagc

SEQ ID NO: 437399 - DNA, 25 bp, Mus musculus
gaatctatattcgattaccatcagc

SEQ ID NO: 437400 - DNA, 25 bp, Mus musculus
gaatctatcccaactgaagacacca

SEQ ID NO: 437401 - DNA, 25 bp, Mus musculus
gaatctatcccatctgaagacacca

SEQ ID NO: 437402 - DNA, 25 bp, Mus musculus
gaatctatccttaggaaccactaca

SEQ ID NO: 437403 - DNA, 25 bp, Mus musculus
gaatctatcctttggaaccactaca

SEQ ID NO: 437404 - DNA, 25 bp, Mus musculus
gaatctatggccagtgaacctttaa

SEQ ID NO: 437405 - DNA, 25 bp, Mus musculus
gaatctatggcctgtgaacctttaa

SEQ ID NO: 437406 - DNA, 25 bp, Mus musculus
gaatctattcagagttcaaattgga

SEQ ID NO: 437407 - DNA, 25 bp, Mus musculus
gaatctattcagtgttcaaattgga

SEQ ID NO: 437408 - DNA, 25 bp, Mus musculus
gaatctattgctcatcagctttatt

SEQ ID NO: 437409 - DNA, 25 bp, Mus musculus
gaatctattgctgatcagctttatt

SEQ ID NO: 437410 - DNA, 25 bp, Mus musculus
gaatctattgtcctagccttacctg

SEQ ID NO: 437411 - DNA, 25 bp, Mus musculus
gaatctattgtcgtagccttacctg

SEQ ID NO: 437412 - DNA, 25 bp, Mus musculus
gaatctatttaacgcgctgcgcggc

SEQ ID NO: 437413 - DNA, 25 bp, Mus musculus
gaatctatttaaggcgctgcgcggc

SEQ ID NO: 437414 - DNA, 25 bp, Mus musculus
gaatctatttgaatcaacctttcta

SEQ ID NO: 437415 - DNA, 25 bp, Mus musculus
gaatctatttgattcaacctttcta

SEQ ID NO: 437416 - DNA, 25 bp, Mus musculus
gaatctatttttacatttactacag

SEQ ID NO: 437417 - DNA, 25 bp, Mus musculus
gaatctattttttcatttactacag

SEQ ID NO: 437418 - DNA, 25 bp, Mus musculus
gaatctcaaactaatgtaccccaat

SEQ ID NO: 437419 - DNA, 25 bp, Mus musculus
gaatctcaaactcaaagcatgctgg

SEQ ID NO: 437420 - DNA, 25 bp, Mus musculus
gaatctcaaactgaaagcatgctgg

SEQ ID NO: 437421 - DNA, 25 bp, Mus musculus
gaatctcaaacttatgtaccccaat

SEQ ID NO: 437422 - DNA, 25 bp, Mus musculus
gaatctcaacaactgtttgcagcag

SEQ ID NO: 437423 - DNA, 25 bp, Mus musculus
gaatctcaacaagtgtttgcagcag

SEQ ID NO: 437424 - DNA, 25 bp, Mus musculus
gaatctcaacctcctgtaagatcag

SEQ ID NO: 437425 - DNA, 25 bp, Mus musculus
gaatctcaacctgctgtaagatcag

SEQ ID NO: 437426 - DNA, 25 bp, Mus musculus
gaatctcaatgtcatgccagtgctg

SEQ ID NO: 437427 - DNA, 25 bp, Mus musculus
gaatctcaatgtgatgccagtgctg

SEQ ID NO: 437428 - DNA, 25 bp, Mus musculus
gaatctcacgagagcgatcaaatgt

SEQ ID NO: 437429 - DNA, 25 bp, Mus musculus
gaatctcacgagtgcgatcaaatgt

SEQ ID NO: 437430 - DNA, 25 bp, Mus musculus
gaatctcacgataaagttttaccag

SEQ ID NO: 437431 - DNA, 25 bp, Mus musculus
gaatctcacgattaagttttaccag

SEQ ID NO: 437432 - DNA, 25 bp, Mus musculus
gaatctcacttcatctaaatgaaac

SEQ ID NO: 437433 - DNA, 25 bp, Mus musculus
gaatctcacttcttctaaatgaaac

SEQ ID NO: 437434 - DNA, 25 bp, Mus musculus
gaatctcacttgcactatctttccc

SEQ ID NO: 437435 - DNA, 25 bp, Mus musculus
gaatctcacttggactatctttccc

SEQ ID NO: 437436 - DNA, 25 bp, Mus musculus
gaatctcagagacaggcagcctaac

SEQ ID NO: 437437 - DNA, 25 bp, Mus musculus
gaatctcagagagaggcagcctaac

SEQ ID NO: 437438 - DNA, 25 bp, Mus musculus
gaatctcagatgagttagccattta

SEQ ID NO: 437439 - DNA, 25 bp, Mus musculus
gaatctcagatgtgttagccattta

SEQ ID NO: 437440 - DNA, 25 bp, Mus musculus
gaatctcagcaaatgtgttcctaca

SEQ ID NO: 437441 - DNA, 25 bp, Mus musculus
gaatctcagcaattgtgttcctaca

SEQ ID NO: 437442 - DNA, 25 bp, Mus musculus
gaatctcagctactctgtagactca

SEQ ID NO: 437443 - DNA, 25 bp, Mus musculus
gaatctcagctagtctgtagactca

SEQ ID NO: 437444 - DNA, 25 bp, Mus musculus
gaatctcagcttctagcttgccaaa

SEQ ID NO: 437445 - DNA, 25 bp, Mus musculus
gaatctcagcttgtagcttgccaaa

SEQ ID NO: 437446 - DNA, 25 bp, Mus musculus
gaatctcagggtaaaaggcactagc

SEQ ID NO: 437447 - DNA, 25 bp, Mus musculus
gaatctcagggttaaaggcactagc

SEQ ID NO: 437448 - DNA, 25 bp, Mus musculus
gaatctcagtggagatcatcatcta

SEQ ID NO: 437449 - DNA, 25 bp, Mus musculus
gaatctcagtggtgatcatcatcta

SEQ ID NO: 437450 - DNA, 25 bp, Mus musculus
gaatctcagtgtcgagttgtctaca

SEQ ID NO: 437451 - DNA, 25 bp, Mus musculus
gaatctcagtgtggagttgtctaca

SEQ ID NO: 437452 - DNA, 25 bp, Mus musculus
gaatctcagttcagttttactccgc

SEQ ID NO: 437453 - DNA, 25 bp, Mus musculus
gaatctcagttctgttttactccgc

SEQ ID NO: 437454 - DNA, 25 bp, Mus musculus
gaatctcatacccagaccttactct

SEQ ID NO: 437455 - DNA, 25 bp, Mus musculus
gaatctcataccgagaccttactct

SEQ ID NO: 437456 - DNA, 25 bp, Mus musculus
gaatctcatctaagttggtttgcaa

SEQ ID NO: 437457 - DNA, 25 bp, Mus musculus
gaatctcatctatgttggtttgcaa

SEQ ID NO: 437458 - DNA, 25 bp, Mus musculus
gaatctcatgcaaataccctgttcc

SEQ ID NO: 437459 - DNA, 25 bp, Mus musculus
gaatctcatgcatataccctgttcc

SEQ ID NO: 437460 - DNA, 25 bp, Mus musculus
gaatctcatggtctgtctaatgcct

SEQ ID NO: 437461 - DNA, 25 bp, Mus musculus
gaatctcatggtgtgtctaatgcct

SEQ ID NO: 437462 - DNA, 25 bp, Mus musculus
gaatctcattccatgatatcaactg

SEQ ID NO: 437463 - DNA, 25 bp, Mus musculus
gaatctcattccttgatatcaactg

SEQ ID NO: 437464 - DNA, 25 bp, Mus musculus
gaatctcattcgaattggtctggca

SEQ ID NO: 437465 - DNA, 25 bp, Mus musculus
gaatctcattcgtattggtctggca

SEQ ID NO: 437466 - DNA, 25 bp, Mus musculus
gaatctcatttccagacatcactat

SEQ ID NO: 437467 - DNA, 25 bp, Mus musculus
gaatctcatttcgagacatcactat

SEQ ID NO: 437468 - DNA, 25 bp, Mus musculus
gaatctcattttctgcttacatctg

SEQ ID NO: 437469 - DNA, 25 bp, Mus musculus
gaatctcattttgtgcttacatctg

SEQ ID NO: 437470 - DNA, 25 bp, Mus musculus
gaatctccaaccagggatcttatta

SEQ ID NO: 437471 - DNA, 25 bp, Mus musculus
gaatctccaacctgggatcttatta

SEQ ID NO: 437472 - DNA, 25 bp, Mus musculus
gaatctccagaacggtggctttctc

SEQ ID NO: 437473 - DNA, 25 bp, Mus musculus
gaatctccagaagggtggctttctc

SEQ ID NO: 437474 - DNA, 25 bp, Mus musculus
gaatctccagtcatttctgtttatc

SEQ ID NO: 437475 - DNA, 25 bp, Mus musculus
gaatctccagtcttttctgtttatc

SEQ ID NO: 437476 - DNA, 25 bp, Mus musculus
gaatctcccgaaatacctgaaagca

SEQ ID NO: 437477 - DNA, 25 bp, Mus musculus
gaatctcccgaattacctgaaagca

SEQ ID NO: 437478 - DNA, 25 bp, Mus musculus
gaatctcccgagatctaggcctggt

SEQ ID NO: 437479 - DNA, 25 bp, Mus musculus
gaatctcccgagttctaggcctggt

SEQ ID NO: 437480 - DNA, 25 bp, Mus musculus
gaatctccctgacagcttgttagcc

SEQ ID NO: 437481 - DNA, 25 bp, Mus musculus
gaatctccctgagagcttgttagcc

SEQ ID NO: 437482 - DNA, 25 bp, Mus musculus
gaatctccgctgatgcaagaacata

SEQ ID NO: 437483 - DNA, 25 bp, Mus musculus
gaatctccgctgttgcaagaacata

SEQ ID NO: 437484 - DNA, 25 bp, Mus musculus
gaatctccgtggataaggacactgg

SEQ ID NO: 437485 - DNA, 25 bp, Mus musculus
gaatctccgtggttaaggacactgg

SEQ ID NO: 437486 - DNA, 25 bp, Mus musculus
gaatctcctaacagtatattgtcat

SEQ ID NO: 437487 - DNA, 25 bp, Mus musculus
gaatctcctaactgtatattgtcat

SEQ ID NO: 437488 - DNA, 25 bp, Mus musculus
gaatctcctacaaaaatgatgccta

SEQ ID NO: 437489 - DNA, 25 bp, Mus musculus
gaatctcctacataaatgatgccta

SEQ ID NO: 437490 - DNA, 25 bp, Mus musculus
gaatctcctagcctgaagcgtctga

SEQ ID NO: 437491 - DNA, 25 bp, Mus musculus
gaatctcctagcgtgaagcgtctga

SEQ ID NO: 437492 - DNA, 25 bp, Mus musculus
gaatctcctcaccaagagcgggtgt

SEQ ID NO: 437493 - DNA, 25 bp, Mus musculus
gaatctcctcacgaagagcgggtgt

SEQ ID NO: 437494 - DNA, 25 bp, Mus musculus
gaatctcctctaaggttcggatcat

SEQ ID NO: 437495 - DNA, 25 bp, Mus musculus
gaatctcctctatggttcggatcat

SEQ ID NO: 437496 - DNA, 25 bp, Mus musculus
gaatctcctgtaaatgcacctctta

SEQ ID NO: 437497 - DNA, 25 bp, Mus musculus
gaatctcctgtatatgcacctctta

SEQ ID NO: 437498 - DNA, 25 bp, Mus musculus
gaatctccttgaaactcctggctct

SEQ ID NO: 437499 - DNA, 25 bp, Mus musculus
gaatctccttgatactcctggctct

SEQ ID NO: 437500 - DNA, 25 bp, Mus musculus
gaatctcgactgatctatctaactt

SEQ ID NO: 437501 - DNA, 25 bp, Mus musculus
gaatctcgactgttctatctaactt

SEQ ID NO: 437502 - DNA, 25 bp, Mus musculus
gaatctcgcggccatgcagaagatg

SEQ ID NO: 437503 - DNA, 25 bp, Mus musculus
gaatctcgcggcgatgcagaagatg

SEQ ID NO: 437504 - DNA, 25 bp, Mus musculus
gaatctcgtagcaatgtcgtgtccc

SEQ ID NO: 437505 - DNA, 25 bp, Mus musculus
gaatctcgtagctatgtcgtgtccc

SEQ ID NO: 437506 - DNA, 25 bp, Mus musculus
gaatctcgtgaacatctccgtttag

SEQ ID NO: 437507 - DNA, 25 bp, Mus musculus
gaatctcgtgaagatctccgtttag

SEQ ID NO: 437508 - DNA, 25 bp, Mus musculus
gaatctcgtggtcgttagctaggca

SEQ ID NO: 437509 - DNA, 25 bp, Mus musculus
gaatctcgtggtggttagctaggca

SEQ ID NO: 437510 - DNA, 25 bp, Mus musculus
gaatctctactgattgtgtgccagt

SEQ ID NO: 437511 - DNA, 25 bp, Mus musculus
gaatctctactgtttgtgtgccagt

SEQ ID NO: 437512 - DNA, 25 bp, Mus musculus
gaatctctagaactttctggccagc

SEQ ID NO: 437513 - DNA, 25 bp, Mus musculus
gaatctctagaagtttctggccagc

SEQ ID NO: 437514 - DNA, 25 bp, Mus musculus
gaatctctagcaaccacataaaagt

SEQ ID NO: 437515 - DNA, 25 bp, Mus musculus
gaatctctagcatccacataaaagt

SEQ ID NO: 437516 - DNA, 25 bp, Mus musculus
gaatctctaggaccttcatattaaa

SEQ ID NO: 437517 - DNA, 25 bp, Mus musculus
gaatctctaggagcttcatattaaa

SEQ ID NO: 437518 - DNA, 25 bp, Mus musculus
gaatctctatagagtctctgccaga

SEQ ID NO: 437519 - DNA, 25 bp, Mus musculus
gaatctctatagtgtctctgccaga

SEQ ID NO: 437520 - DNA, 25 bp, Mus musculus
gaatctctatcgcaaacctattggg

SEQ ID NO: 437521 - DNA, 25 bp, Mus musculus
gaatctctatcggaaacctattggg

SEQ ID NO: 437522 - DNA, 25 bp, Mus musculus
gaatctctatgcacatgtactgtaa

SEQ ID NO: 437523 - DNA, 25 bp, Mus musculus
gaatctctatgctcatgtactgtaa

SEQ ID NO: 437524 - DNA, 25 bp, Mus musculus
gaatctctatggagtatttgggcag

SEQ ID NO: 437525 - DNA, 25 bp, Mus musculus
gaatctctatggtgtatttgggcag

SEQ ID NO: 437526 - DNA, 25 bp, Mus musculus
gaatctctcaagactgtgtttatag

SEQ ID NO: 437527 - DNA, 25 bp, Mus musculus
gaatctctcaagtctgtgtttatag

SEQ ID NO: 437528 - DNA, 25 bp, Mus musculus
gaatctctcacaccagcccttgaag

SEQ ID NO: 437529 - DNA, 25 bp, Mus musculus
gaatctctcacagcagcccttgaag

SEQ ID NO: 437530 - DNA, 25 bp, Mus musculus
gaatctctcccacctttgaattttt

SEQ ID NO: 437531 - DNA, 25 bp, Mus musculus
gaatctctcccagctttgaattttt

SEQ ID NO: 437532 - DNA, 25 bp, Mus musculus
gaatctctccctacagacaggaggg

SEQ ID NO: 437533 - DNA, 25 bp, Mus musculus
gaatctctcccttcagacaggaggg

SEQ ID NO: 437534 - DNA, 25 bp, Mus musculus
gaatctctccgaaagaactcagcca

SEQ ID NO: 437535 - DNA, 25 bp, Mus musculus
gaatctctccgatagaactcagcca

SEQ ID NO: 437536 - DNA, 25 bp, Mus musculus
gaatctctctaaaatctgcactaca

SEQ ID NO: 437537 - DNA, 25 bp, Mus musculus
gaatctctctaatatctgcactaca

SEQ ID NO: 437538 - DNA, 25 bp, Mus musculus
gaatctctgaaaagccacatcctaa

SEQ ID NO: 437539 - DNA, 25 bp, Mus musculus
gaatctctgaaatgccacatcctaa

SEQ ID NO: 437540 - DNA, 25 bp, Mus musculus
gaatctctgaagagcttaactcact

SEQ ID NO: 437541 - DNA, 25 bp, Mus musculus
gaatctctgaagtgcttaactcact

SEQ ID NO: 437542 - DNA, 25 bp, Mus musculus
gaatctctgaccaggtctatataga

SEQ ID NO: 437543 - DNA, 25 bp, Mus musculus
gaatctctgacctggtctatataga

SEQ ID NO: 437544 - DNA, 25 bp, Mus musculus
gaatctctgaggatttaactgctca

SEQ ID NO: 437545 - DNA, 25 bp, Mus musculus
gaatctctgaggttttaactgctca

SEQ ID NO: 437546 - DNA, 25 bp, Mus musculus
gaatctctggctcactacatcaccg

SEQ ID NO: 437547 - DNA, 25 bp, Mus musculus
gaatctctggctgactacatcaccg

SEQ ID NO: 437548 - DNA, 25 bp, Mus musculus
gaatctctgggaaccattggacctt

SEQ ID NO: 437549 - DNA, 25 bp, Mus musculus
gaatctctgggacctttctgaggca

SEQ ID NO: 437550 - DNA, 25 bp, Mus musculus
gaatctctgggagctttctgaggca

SEQ ID NO: 437551 - DNA, 25 bp, Mus musculus
gaatctctgggatccattggacctt

SEQ ID NO: 437552 - DNA, 25 bp, Mus musculus
gaatctctgggcatcagggtctgga

SEQ ID NO: 437553 - DNA, 25 bp, Mus musculus
gaatctctgggcttcagggtctgga

SEQ ID NO: 437554 - DNA, 25 bp, Mus musculus
gaatctctggtcacttttgaaggaa

SEQ ID NO: 437555 - DNA, 25 bp, Mus musculus
gaatctctggtctcttttgaaggaa

SEQ ID NO: 437556 - DNA, 25 bp, Mus musculus
gaatctctggtgatgtatgacacgc

SEQ ID NO: 437557 - DNA, 25 bp, Mus musculus
gaatctctggtgttgtatgacacgc

SEQ ID NO: 437558 - DNA, 25 bp, Mus musculus
gaatctctggttcattttctctcca

SEQ ID NO: 437559 - DNA, 25 bp, Mus musculus
gaatctctggttgattttctctcca

SEQ ID NO: 437560 - DNA, 25 bp, Mus musculus
gaatctctgtatattacaccctgtg

SEQ ID NO: 437561 - DNA, 25 bp, Mus musculus
gaatctctgtatccatgttgaaagt

SEQ ID NO: 437562 - DNA, 25 bp, Mus musculus
gaatctctgtatcttgtaggctcaa

SEQ ID NO: 437563 - DNA, 25 bp, Mus musculus
gaatctctgtatgcatgttgaaagt

SEQ ID NO: 437564 - DNA, 25 bp, Mus musculus
gaatctctgtatgttgtaggctcaa

SEQ ID NO: 437565 - DNA, 25 bp, Mus musculus
gaatctctgtattttacaccctgtg

SEQ ID NO: 437566 - DNA, 25 bp, Mus musculus
gaatctctgtctacctactttatct

SEQ ID NO: 437567 - DNA, 25 bp, Mus musculus
gaatctctgtcttcctactttatct

SEQ ID NO: 437568 - DNA, 25 bp, Mus musculus
gaatctctgtggctggatcatcctc

SEQ ID NO: 437569 - DNA, 25 bp, Mus musculus
gaatctctgtgggtggatcatcctc

SEQ ID NO: 437570 - DNA, 25 bp, Mus musculus
gaatctctgttactctgaggctagc

SEQ ID NO: 437571 - DNA, 25 bp, Mus musculus
gaatctctgttagtctgaggctagc

SEQ ID NO: 437572 - DNA, 25 bp, Mus musculus
gaatctcttattatccttgccagac

SEQ ID NO: 437573 - DNA, 25 bp, Mus musculus
gaatctcttattttccttgccagac

SEQ ID NO: 437574 - DNA, 25 bp, Mus musculus
gaatctcttcctaaccttgtcaaaa

SEQ ID NO: 437575 - DNA, 25 bp, Mus musculus
gaatctcttccttaccttgtcaaaa

SEQ ID NO: 437576 - DNA, 25 bp, Mus musculus
gaatctcttctaccaagtttgcact

SEQ ID NO: 437577 - DNA, 25 bp, Mus musculus
gaatctcttctacccagtctgaaac

SEQ ID NO: 437578 - DNA, 25 bp, Mus musculus
gaatctcttctagcaagtttgcact

SEQ ID NO: 437579 - DNA, 25 bp, Mus musculus
gaatctcttctagccagtctgaaac

SEQ ID NO: 437580 - DNA, 25 bp, Mus musculus
gaatctcttgaaatcttaacccacc

SEQ ID NO: 437581 - DNA, 25 bp, Mus musculus
gaatctcttgaattcttaacccacc

SEQ ID NO: 437582 - DNA, 25 bp, Mus musculus
gaatctcttgagacatctgcatcgt

SEQ ID NO: 437583 - DNA, 25 bp, Mus musculus
gaatctcttgagtcatctgcatcgt

SEQ ID NO: 437584 - DNA, 25 bp, Mus musculus
gaatctctttagatcctggagaggt

SEQ ID NO: 437585 - DNA, 25 bp, Mus musculus
gaatctctttagttcctggagaggt

SEQ ID NO: 437586 - DNA, 25 bp, Mus musculus
gaatctctttcacatatgtcactta

SEQ ID NO: 437587 - DNA, 25 bp, Mus musculus
gaatctctttcagatatgtcactta

SEQ ID NO: 437588 - DNA, 25 bp, Mus musculus
gaatctctttctaatgcctatactg

SEQ ID NO: 437589 - DNA, 25 bp, Mus musculus
gaatctctttctagatactgcagcc

SEQ ID NO: 437590 - DNA, 25 bp, Mus musculus
gaatctctttcttatgcctatactg

SEQ ID NO: 437591 - DNA, 25 bp, Mus musculus
gaatctctttcttgatactgcagcc

SEQ ID NO: 437592 - DNA, 25 bp, Mus musculus
gaatctctttgcacttcagtgcagg

SEQ ID NO: 437593 - DNA, 25 bp, Mus musculus
gaatctctttgctcttcagtgcagg

SEQ ID NO: 437594 - DNA, 25 bp, Mus musculus
gaatctcttttcaattcacagccct

SEQ ID NO: 437595 - DNA, 25 bp, Mus musculus
gaatctcttttctattcacagccct

SEQ ID NO: 437596 - DNA, 25 bp, Mus musculus
gaatctgaaactcggctaagggctg

SEQ ID NO: 437597 - DNA, 25 bp, Mus musculus
gaatctgaaactgggctaagggctg

SEQ ID NO: 437598 - DNA, 25 bp, Mus musculus
gaatctgaaatgaacctggaggctt

SEQ ID NO: 437599 - DNA, 25 bp, Mus musculus
gaatctgaaatgtacctggaggctt

SEQ ID NO: 437600 - DNA, 25 bp, Mus musculus
gaatctgaagccattcacgacgcga

SEQ ID NO: 437601 - DNA, 25 bp, Mus musculus
gaatctgaagcctttcacgacgcga

SEQ ID NO: 437602 - DNA, 25 bp, Mus musculus
gaatctgaagttatgaccgccttgt

SEQ ID NO: 437603 - DNA, 25 bp, Mus musculus
gaatctgaagttttgaccgccttgt

SEQ ID NO: 437604 - DNA, 25 bp, Mus musculus
gaatctgaatatatggctgaggcca

SEQ ID NO: 437605 - DNA, 25 bp, Mus musculus
gaatctgaatatttggctgaggcca

SEQ ID NO: 437606 - DNA, 25 bp, Mus musculus
gaatctgaatgaacaacttttgcaa

SEQ ID NO: 437607 - DNA, 25 bp, Mus musculus
gaatctgaatgatcaacttttgcaa

SEQ ID NO: 437608 - DNA, 25 bp, Mus musculus
gaatctgacaaacacgaaatcaact

SEQ ID NO: 437609 - DNA, 25 bp, Mus musculus
gaatctgacaaagacgaaatcaact

SEQ ID NO: 437610 - DNA, 25 bp, Mus musculus
gaatctgacttactagcaagcctgc

SEQ ID NO: 437611 - DNA, 25 bp, Mus musculus
gaatctgacttagtagcaagcctgc

SEQ ID NO: 437612 - DNA, 25 bp, Mus musculus
gaatctgacttcattggacacgagg

SEQ ID NO: 437613 - DNA, 25 bp, Mus musculus
gaatctgacttctttggacacgagg

SEQ ID NO: 437614 - DNA, 25 bp, Mus musculus
gaatctgactttagcatggactgtg

SEQ ID NO: 437615 - DNA, 25 bp, Mus musculus
gaatctgacttttgcatggactgtg

SEQ ID NO: 437616 - DNA, 25 bp, Mus musculus
gaatctgagagtactttgtgtcaaa

SEQ ID NO: 437617 - DNA, 25 bp, Mus musculus
gaatctgagagttctttgtgtcaaa

SEQ ID NO: 437618 - DNA, 25 bp, Mus musculus
gaatctgagatcacaacgacaggtt

SEQ ID NO: 437619 - DNA, 25 bp, Mus musculus
gaatctgagatctcaacgacaggtt

SEQ ID NO: 437620 - DNA, 25 bp, Mus musculus
gaatctgagcgacgccagctgggcc

SEQ ID NO: 437621 - DNA, 25 bp, Mus musculus
gaatctgagcgaggccagctgggcc

SEQ ID NO: 437622 - DNA, 25 bp, Mus musculus
gaatctgaggccagatgacatgaca

SEQ ID NO: 437623 - DNA, 25 bp, Mus musculus
gaatctgaggcctgatgacatgaca

SEQ ID NO: 437624 - DNA, 25 bp, Mus musculus
gaatctgaggtcagtctacctacat

SEQ ID NO: 437625 - DNA, 25 bp, Mus musculus
gaatctgaggtctgtctacctacat

SEQ ID NO: 437626 - DNA, 25 bp, Mus musculus
gaatctgaggtgagttcttttgcct

SEQ ID NO: 437627 - DNA, 25 bp, Mus musculus
gaatctgaggtgtgttcttttgcct

SEQ ID NO: 437628 - DNA, 25 bp, Mus musculus
gaatctgagtgtcaactacttgacc

SEQ ID NO: 437629 - DNA, 25 bp, Mus musculus
gaatctgagtgtgaactacttgacc

SEQ ID NO: 437630 - DNA, 25 bp, Mus musculus
gaatctgagtttacacggagtccct

SEQ ID NO: 437631 - DNA, 25 bp, Mus musculus
gaatctgagttttcacggagtccct

SEQ ID NO: 437632 - DNA, 25 bp, Mus musculus
gaatctgatggacttctttttagcc

SEQ ID NO: 437633 - DNA, 25 bp, Mus musculus
gaatctgatggagttctttttagcc

SEQ ID NO: 437634 - DNA, 25 bp, Mus musculus
gaatctgatgggatttgactgtgga

SEQ ID NO: 437635 - DNA, 25 bp, Mus musculus
gaatctgatgggttttgactgtgga

SEQ ID NO: 437636 - DNA, 25 bp, Mus musculus
gaatctgatgttacgtgccttcact

SEQ ID NO: 437637 - DNA, 25 bp, Mus musculus
gaatctgatgttatttgtgaccaac

SEQ ID NO: 437638 - DNA, 25 bp, Mus musculus
gaatctgatgtttcgtgccttcact

SEQ ID NO: 437639 - DNA, 25 bp, Mus musculus
gaatctgatgttttttgtgaccaac

SEQ ID NO: 437640 - DNA, 25 bp, Mus musculus
gaatctgcaacactaaccagtcatc

SEQ ID NO: 437641 - DNA, 25 bp, Mus musculus
gaatctgcaacagtaaccagtcatc

SEQ ID NO: 437642 - DNA, 25 bp, Mus musculus
gaatctgcacctagtttgtcacgga

SEQ ID NO: 437643 - DNA, 25 bp, Mus musculus
gaatctgcaccttgtttgtcacgga

SEQ ID NO: 437644 - DNA, 25 bp, Mus musculus
gaatctgcacgaagggcccagccgt

SEQ ID NO: 437645 - DNA, 25 bp, Mus musculus
gaatctgcacgatgggcccagccgt

SEQ ID NO: 437646 - DNA, 25 bp, Mus musculus
gaatctgcagagctctatgccgagg

SEQ ID NO: 437647 - DNA, 25 bp, Mus musculus
gaatctgcagaggtctatgccgagg

SEQ ID NO: 437648 - DNA, 25 bp, Mus musculus
gaatctgcagtaccgaggagcttgt

SEQ ID NO: 437649 - DNA, 25 bp, Mus musculus
gaatctgcagtagcgaggagcttgt

SEQ ID NO: 437650 - DNA, 25 bp, Mus musculus
gaatctgcagtgatgtcatggcaca

SEQ ID NO: 437651 - DNA, 25 bp, Mus musculus
gaatctgcagtgttgtcatggcaca

SEQ ID NO: 437652 - DNA, 25 bp, Mus musculus
gaatctgcatcaccctgagagtagg

SEQ ID NO: 437653 - DNA, 25 bp, Mus musculus
gaatctgcatcagcctgagagtagg

SEQ ID NO: 437654 - DNA, 25 bp, Mus musculus
gaatctgccattatcttctactgca

SEQ ID NO: 437655 - DNA, 25 bp, Mus musculus
gaatctgccattttcttctactgca

SEQ ID NO: 437656 - DNA, 25 bp, Mus musculus
gaatctgcccctaatataaatgcat

SEQ ID NO: 437657 - DNA, 25 bp, Mus musculus
gaatctgccccttatataaatgcat

SEQ ID NO: 437658 - DNA, 25 bp, Mus musculus
gaatctgcctggattttctttatag

SEQ ID NO: 437659 - DNA, 25 bp, Mus musculus
gaatctgcctggtttttctttatag

SEQ ID NO: 437660 - DNA, 25 bp, Mus musculus
gaatctgctaagaagggtgctcact

SEQ ID NO: 437661 - DNA, 25 bp, Mus musculus
gaatctgctaagtagggtgctcact

SEQ ID NO: 437662 - DNA, 25 bp, Mus musculus
gaatctgctatgaggcttaactgct

SEQ ID NO: 437663 - DNA, 25 bp, Mus musculus
gaatctgctatgtggcttaactgct

SEQ ID NO: 437664 - DNA, 25 bp, Mus musculus
gaatctgctcctcgcttaggaatgt

SEQ ID NO: 437665 - DNA, 25 bp, Mus musculus
gaatctgctcctggcttaggaatgt

SEQ ID NO: 437666 - DNA, 25 bp, Mus musculus
gaatctgctgtcctttcctttaaaa

SEQ ID NO: 437667 - DNA, 25 bp, Mus musculus
gaatctgctgtcgtttcctttaaaa

SEQ ID NO: 437668 - DNA, 25 bp, Mus musculus
gaatctgctgtgcatgcgttgtcaa

SEQ ID NO: 437669 - DNA, 25 bp, Mus musculus
gaatctgctgtggatgcgttgtcaa

SEQ ID NO: 437670 - DNA, 25 bp, Mus musculus
gaatctgcttatagctaggacattg

SEQ ID NO: 437671 - DNA, 25 bp, Mus musculus
gaatctgcttattgctaggacattg

SEQ ID NO: 437672 - DNA, 25 bp, Mus musculus
gaatctgcttccctttaacctcaga

SEQ ID NO: 437673 - DNA, 25 bp, Mus musculus
gaatctgcttccgtttaacctcaga

SEQ ID NO: 437674 - DNA, 25 bp, Mus musculus
gaatctgcttctctcgtatggatca

SEQ ID NO: 437675 - DNA, 25 bp, Mus musculus
gaatctgcttctgtcgtatggatca

SEQ ID NO: 437676 - DNA, 25 bp, Mus musculus
gaatctgcttgtacatgggttggga

SEQ ID NO: 437677 - DNA, 25 bp, Mus musculus
gaatctgcttgttcatgggttggga

SEQ ID NO: 437678 - DNA, 25 bp, Mus musculus
gaatctggacccattgtccaggtta

SEQ ID NO: 437679 - DNA, 25 bp, Mus musculus
gaatctggaccctttgtccaggtta

SEQ ID NO: 437680 - DNA, 25 bp, Mus musculus
gaatctggacttaatgagaactcta

SEQ ID NO: 437681 - DNA, 25 bp, Mus musculus
gaatctggactttatgagaactcta

SEQ ID NO: 437682 - DNA, 25 bp, Mus musculus
gaatctggagatagtgtctgtcctg

SEQ ID NO: 437683 - DNA, 25 bp, Mus musculus
gaatctggagattgtgtctgtcctg

SEQ ID NO: 437684 - DNA, 25 bp, Mus musculus
gaatctggaggcagtgaacacttat

SEQ ID NO: 437685 - DNA, 25 bp, Mus musculus
gaatctggaggctgtgaacacttat

SEQ ID NO: 437686 - DNA, 25 bp, Mus musculus
gaatctggatctcatctctttggtt

SEQ ID NO: 437687 - DNA, 25 bp, Mus musculus
gaatctggatctgatctctttggtt

SEQ ID NO: 437688 - DNA, 25 bp, Mus musculus
gaatctggatgtcaactttattgtt

SEQ ID NO: 437689 - DNA, 25 bp, Mus musculus
gaatctggatgtgaactttattgtt

SEQ ID NO: 437690 - DNA, 25 bp, Mus musculus
gaatctggcaaactgaacactggta

SEQ ID NO: 437691 - DNA, 25 bp, Mus musculus
gaatctggcaaagtgaacactggta

SEQ ID NO: 437692 - DNA, 25 bp, Mus musculus
gaatctggcattcctgtactacaaa

SEQ ID NO: 437693 - DNA, 25 bp, Mus musculus
gaatctggcattgctgtactacaaa

SEQ ID NO: 437694 - DNA, 25 bp, Mus musculus
gaatctggccagagttcatcaaggt

SEQ ID NO: 437695 - DNA, 25 bp, Mus musculus
gaatctggccagatctctgccttgg

SEQ ID NO: 437696 - DNA, 25 bp, Mus musculus
gaatctggccagcagtcatgtttga

SEQ ID NO: 437697 - DNA, 25 bp, Mus musculus
gaatctggccaggagtcatgtttga

SEQ ID NO: 437698 - DNA, 25 bp, Mus musculus
gaatctggccagtgttcatcaaggt

SEQ ID NO: 437699 - DNA, 25 bp, Mus musculus
gaatctggccagttctctgccttgg

SEQ ID NO: 437700 - DNA, 25 bp, Mus musculus
gaatctggccatcgtctgttggctt

SEQ ID NO: 437701 - DNA, 25 bp, Mus musculus
gaatctggccatggtctgttggctt

SEQ ID NO: 437702 - DNA, 25 bp, Mus musculus
gaatctggctaacacttatcttcta

SEQ ID NO: 437703 - DNA, 25 bp, Mus musculus
gaatctggctaagacttatcttcta

SEQ ID NO: 437704 - DNA, 25 bp, Mus musculus
gaatctggctctcatgtcctttggg

SEQ ID NO: 437705 - DNA, 25 bp, Mus musculus
gaatctggctctgatgtcctttggg

SEQ ID NO: 437706 - DNA, 25 bp, Mus musculus
gaatctggctgcatatttggtcctg

SEQ ID NO: 437707 - DNA, 25 bp, Mus musculus
gaatctggctgcttatttggtcctg

SEQ ID NO: 437708 - DNA, 25 bp, Mus musculus
gaatctggctgtcttctgagaagct

SEQ ID NO: 437709 - DNA, 25 bp, Mus musculus
gaatctggctgtgttctgagaagct

SEQ ID NO: 437710 - DNA, 25 bp, Mus musculus
gaatctgggactcttcatacacaga

SEQ ID NO: 437711 - DNA, 25 bp, Mus musculus
gaatctgggactgttcatacacaga

SEQ ID NO: 437712 - DNA, 25 bp, Mus musculus
gaatctgggatgaatgctcctaccc

SEQ ID NO: 437713 - DNA, 25 bp, Mus musculus
gaatctgggatgtatgctcctaccc

SEQ ID NO: 437714 - DNA, 25 bp, Mus musculus
gaatctgggcaccttggactctgat

SEQ ID NO: 437715 - DNA, 25 bp, Mus musculus
gaatctgggcacgttggactctgat

SEQ ID NO: 437716 - DNA, 25 bp, Mus musculus
gaatctgggcggcatttctcatgca

SEQ ID NO: 437717 - DNA, 25 bp, Mus musculus
gaatctgggcgggatttctcatgca

SEQ ID NO: 437718 - DNA, 25 bp, Mus musculus
gaatctgggcttcccgtgtgctcgc

SEQ ID NO: 437719 - DNA, 25 bp, Mus musculus
gaatctgggcttgccgtgtgctcgc

SEQ ID NO: 437720 - DNA, 25 bp, Mus musculus
gaatctgggtttcttctccttttat

SEQ ID NO: 437721 - DNA, 25 bp, Mus musculus
gaatctgggtttgttctccttttat

SEQ ID NO: 437722 - DNA, 25 bp, Mus musculus
gaatctggtactatggtctcatgtt

SEQ ID NO: 437723 - DNA, 25 bp, Mus musculus
gaatctggtactttggtctcatgtt

SEQ ID NO: 437724 - DNA, 25 bp, Mus musculus
gaatctggtccgcatatgccttggt

SEQ ID NO: 437725 - DNA, 25 bp, Mus musculus
gaatctggtccggatatgccttggt

SEQ ID NO: 437726 - DNA, 25 bp, Mus musculus
gaatctggtgtacacttctgggtgt

SEQ ID NO: 437727 - DNA, 25 bp, Mus musculus
gaatctggtgtagacttctgggtgt

SEQ ID NO: 437728 - DNA, 25 bp, Mus musculus
gaatctggtgtgatcatgtttcctt

SEQ ID NO: 437729 - DNA, 25 bp, Mus musculus
gaatctggtgtgttcatgtttcctt

SEQ ID NO: 437730 - DNA, 25 bp, Mus musculus
gaatctggttcaagtatttttcctt

SEQ ID NO: 437731 - DNA, 25 bp, Mus musculus
gaatctggttcatgtatttttcctt

SEQ ID NO: 437732 - DNA, 25 bp, Mus musculus
gaatctggttctctctgccatcatt

SEQ ID NO: 437733 - DNA, 25 bp, Mus musculus
gaatctggttctgtctgccatcatt

SEQ ID NO: 437734 - DNA, 25 bp, Mus musculus
gaatctggtttgatctcacacttgc

SEQ ID NO: 437735 - DNA, 25 bp, Mus musculus
gaatctggtttgctcatgcactatt

SEQ ID NO: 437736 - DNA, 25 bp, Mus musculus
gaatctggtttggtcatgcactatt

SEQ ID NO: 437737 - DNA, 25 bp, Mus musculus
gaatctggtttgttctcacacttgc

SEQ ID NO: 437738 - DNA, 25 bp, Mus musculus
gaatctgtaaaaaccccacgtatgc

SEQ ID NO: 437739 - DNA, 25 bp, Mus musculus
gaatctgtaaaatccccacgtatgc

SEQ ID NO: 437740 - DNA, 25 bp, Mus musculus
gaatctgtaaacacacatatgcata

SEQ ID NO: 437741 - DNA, 25 bp, Mus musculus
gaatctgtaaactcacatatgcata

SEQ ID NO: 437742 - DNA, 25 bp, Mus musculus
gaatctgtaacgacttgagctctat

SEQ ID NO: 437743 - DNA, 25 bp, Mus musculus
gaatctgtaacgtcttgagctctat

SEQ ID NO: 437744 - DNA, 25 bp, Mus musculus
gaatctgtactacataatcctagat

SEQ ID NO: 437745 - DNA, 25 bp, Mus musculus
gaatctgtactagataatcctagat

SEQ ID NO: 437746 - DNA, 25 bp, Mus musculus
gaatctgtactcatgtttggtgtgt

SEQ ID NO: 437747 - DNA, 25 bp, Mus musculus
gaatctgtactcttgtttggtgtgt

SEQ ID NO: 437748 - DNA, 25 bp, Mus musculus
gaatctgtacttactaactcagtga

SEQ ID NO: 437749 - DNA, 25 bp, Mus musculus
gaatctgtacttcgtattgcaaggc

SEQ ID NO: 437750 - DNA, 25 bp, Mus musculus
gaatctgtacttggtattgcaaggc

SEQ ID NO: 437751 - DNA, 25 bp, Mus musculus
gaatctgtactttctaactcagtga

SEQ ID NO: 437752 - DNA, 25 bp, Mus musculus
gaatctgtagacatagcatggtttt

SEQ ID NO: 437753 - DNA, 25 bp, Mus musculus
gaatctgtagaccaagttcctgttt

SEQ ID NO: 437754 - DNA, 25 bp, Mus musculus
gaatctgtagacgaagttcctgttt

SEQ ID NO: 437755 - DNA, 25 bp, Mus musculus
gaatctgtagacttagcatggtttt

SEQ ID NO: 437756 - DNA, 25 bp, Mus musculus
gaatctgtaggcatacttagcataa

SEQ ID NO: 437757 - DNA, 25 bp, Mus musculus
gaatctgtaggcttacttagcataa

SEQ ID NO: 437758 - DNA, 25 bp, Mus musculus
gaatctgtcaacatacactcttttc

SEQ ID NO: 437759 - DNA, 25 bp, Mus musculus
gaatctgtcaacttacactcttttc

SEQ ID NO: 437760 - DNA, 25 bp, Mus musculus
gaatctgtcacaccttagccctcag

SEQ ID NO: 437761 - DNA, 25 bp, Mus musculus
gaatctgtcacagcttagccctcag

SEQ ID NO: 437762 - DNA, 25 bp, Mus musculus
gaatctgtcaggcagtcacttttct

SEQ ID NO: 437763 - DNA, 25 bp, Mus musculus
gaatctgtcagggagtcacttttct

SEQ ID NO: 437764 - DNA, 25 bp, Mus musculus
gaatctgtcattaagtaactgtgat

SEQ ID NO: 437765 - DNA, 25 bp, Mus musculus
gaatctgtcatttagtaactgtgat

SEQ ID NO: 437766 - DNA, 25 bp, Mus musculus
gaatctgtccacatccactaggcag

SEQ ID NO: 437767 - DNA, 25 bp, Mus musculus
gaatctgtccacttccactaggcag

SEQ ID NO: 437768 - DNA, 25 bp, Mus musculus
gaatctgtcccaagttctgtcaaga

SEQ ID NO: 437769 - DNA, 25 bp, Mus musculus
gaatctgtcccatgttctgtcaaga

SEQ ID NO: 437770 - DNA, 25 bp, Mus musculus
gaatctgtccctactagatcaactg

SEQ ID NO: 437771 - DNA, 25 bp, Mus musculus
gaatctgtcccttctagatcaactg

SEQ ID NO: 437772 - DNA, 25 bp, Mus musculus
gaatctgtctcaacccaggtaggag

SEQ ID NO: 437773 - DNA, 25 bp, Mus musculus
gaatctgtctcatcccaggtaggag

SEQ ID NO: 437774 - DNA, 25 bp, Mus musculus
gaatctgtctgcactgtcaggatat

SEQ ID NO: 437775 - DNA, 25 bp, Mus musculus
gaatctgtctgctctgtcaggatat

SEQ ID NO: 437776 - DNA, 25 bp, Mus musculus
gaatctgtctggagatgggcccaca

SEQ ID NO: 437777 - DNA, 25 bp, Mus musculus
gaatctgtctggtgatgggcccaca

SEQ ID NO: 437778 - DNA, 25 bp, Mus musculus
gaatctgtcttccaatacaaacatg

SEQ ID NO: 437779 - DNA, 25 bp, Mus musculus
gaatctgtcttcgaatacaaacatg

SEQ ID NO: 437780 - DNA, 25 bp, Mus musculus
gaatctgtgaaacgctccctgaccg

SEQ ID NO: 437781 - DNA, 25 bp, Mus musculus
gaatctgtgaaaggctccctgaccg

SEQ ID NO: 437782 - DNA, 25 bp, Mus musculus
gaatctgtgaatcatgaatactctc

SEQ ID NO: 437783 - DNA, 25 bp, Mus musculus
gaatctgtgaatctctttatgagca

SEQ ID NO: 437784 - DNA, 25 bp, Mus musculus
gaatctgtgaatgatgaatactctc

SEQ ID NO: 437785 - DNA, 25 bp, Mus musculus
gaatctgtgaatgtctttatgagca

SEQ ID NO: 437786 - DNA, 25 bp, Mus musculus
gaatctgtgagtaaatcgcctggga

SEQ ID NO: 437787 - DNA, 25 bp, Mus musculus
gaatctgtgagttaatcgcctggga

SEQ ID NO: 437788 - DNA, 25 bp, Mus musculus
gaatctgtgatccaggtgtctggca

SEQ ID NO: 437789 - DNA, 25 bp, Mus musculus
gaatctgtgatcgaggtgtctggca

SEQ ID NO: 437790 - DNA, 25 bp, Mus musculus
gaatctgtgcacctccatacaagtg

SEQ ID NO: 437791 - DNA, 25 bp, Mus musculus
gaatctgtgcacgtccatacaagtg

SEQ ID NO: 437792 - DNA, 25 bp, Mus musculus
gaatctgtgcatccaagctcatcct

SEQ ID NO: 437793 - DNA, 25 bp, Mus musculus
gaatctgtgcatgcaagctcatcct

SEQ ID NO: 437794 - DNA, 25 bp, Mus musculus
gaatctgtgcgcctactcaagggag

SEQ ID NO: 437795 - DNA, 25 bp, Mus musculus
gaatctgtgcgcgtactcaagggag

SEQ ID NO: 437796 - DNA, 25 bp, Mus musculus
gaatctgtgctaaagcaacccagag

SEQ ID NO: 437797 - DNA, 25 bp, Mus musculus
gaatctgtgctatagcaacccagag

SEQ ID NO: 437798 - DNA, 25 bp, Mus musculus
gaatctgtgctcaaaccagttgaat

SEQ ID NO: 437799 - DNA, 25 bp, Mus musculus
gaatctgtgctcagggttcatgctt

SEQ ID NO: 437800 - DNA, 25 bp, Mus musculus
gaatctgtgctctaaccagttgaat

SEQ ID NO: 437801 - DNA, 25 bp, Mus musculus
gaatctgtgctctgggttcatgctt

SEQ ID NO: 437802 - DNA, 25 bp, Mus musculus
gaatctgtgcttcactctagtatgt

SEQ ID NO: 437803 - DNA, 25 bp, Mus musculus
gaatctgtgcttgactctagtatgt

SEQ ID NO: 437804 - DNA, 25 bp, Mus musculus
gaatctgtgtgacttgggcattgta

SEQ ID NO: 437805 - DNA, 25 bp, Mus musculus
gaatctgtgtgagttgggcattgta

SEQ ID NO: 437806 - DNA, 25 bp, Mus musculus
gaatctgttagcactggtgggccca

SEQ ID NO: 437807 - DNA, 25 bp, Mus musculus
gaatctgttagctctggtgggccca

SEQ ID NO: 437808 - DNA, 25 bp, Mus musculus
gaatctgttattatcttccatcctc

SEQ ID NO: 437809 - DNA, 25 bp, Mus musculus
gaatctgttattttcttccatcctc

SEQ ID NO: 437810 - DNA, 25 bp, Mus musculus
gaatctgttcgtatgttaggtgcac

SEQ ID NO: 437811 - DNA, 25 bp, Mus musculus
gaatctgttcgtttgttaggtgcac

SEQ ID NO: 437812 - DNA, 25 bp, Mus musculus
gaatctgttctcaccttctgtatgg

SEQ ID NO: 437813 - DNA, 25 bp, Mus musculus
gaatctgttctctccttctgtatgg

SEQ ID NO: 437814 - DNA, 25 bp, Mus musculus
gaatctgttgctcttagtggcttta

SEQ ID NO: 437815 - DNA, 25 bp, Mus musculus
gaatctgttgctgttagtggcttta

SEQ ID NO: 437816 - DNA, 25 bp, Mus musculus
gaatctgttggcacccttaataacg

SEQ ID NO: 437817 - DNA, 25 bp, Mus musculus
gaatctgttggctcccttaataacg

SEQ ID NO: 437818 - DNA, 25 bp, Mus musculus
gaatctgttgttactgcatcattta

SEQ ID NO: 437819 - DNA, 25 bp, Mus musculus
gaatctgttgttatctggcccatca

SEQ ID NO: 437820 - DNA, 25 bp, Mus musculus
gaatctgttgtttctgcatcattta

SEQ ID NO: 437821 - DNA, 25 bp, Mus musculus
gaatctgttgttttctggcccatca

SEQ ID NO: 437822 - DNA, 25 bp, Mus musculus
gaatctgtttcaaagggttcctgtg

SEQ ID NO: 437823 - DNA, 25 bp, Mus musculus
gaatctgtttcatagggttcctgtg

SEQ ID NO: 437824 - DNA, 25 bp, Mus musculus
gaatcttaacttagtcatctcctag

SEQ ID NO: 437825 - DNA, 25 bp, Mus musculus
gaatcttaactttgtcatctcctag

SEQ ID NO: 437826 - DNA, 25 bp, Mus musculus
gaatcttaagttcctctgttacact

SEQ ID NO: 437827 - DNA, 25 bp, Mus musculus
gaatcttaagttgctctgttacact

SEQ ID NO: 437828 - DNA, 25 bp, Mus musculus
gaatcttaatctagtgtcctgctta

SEQ ID NO: 437829 - DNA, 25 bp, Mus musculus
gaatcttaatcttgtgtcctgctta

SEQ ID NO: 437830 - DNA, 25 bp, Mus musculus
gaatcttaattcagcttgctaataa

SEQ ID NO: 437831 - DNA, 25 bp, Mus musculus
gaatcttaattctgcttgctaataa

SEQ ID NO: 437832 - DNA, 25 bp, Mus musculus
gaatcttacaaaatccagaactcgg

SEQ ID NO: 437833 - DNA, 25 bp, Mus musculus
gaatcttacaaattccagaactcgg

SEQ ID NO: 437834 - DNA, 25 bp, Mus musculus
gaatcttacactcaaacttctggag

SEQ ID NO: 437835 - DNA, 25 bp, Mus musculus
gaatcttacactgaaacttctggag

SEQ ID NO: 437836 - DNA, 25 bp, Mus musculus
gaatcttacagtcacaaccctttta

SEQ ID NO: 437837 - DNA, 25 bp, Mus musculus
gaatcttacagtgacaaccctttta

SEQ ID NO: 437838 - DNA, 25 bp, Mus musculus
gaatcttaccaaaggctggccgtga

SEQ ID NO: 437839 - DNA, 25 bp, Mus musculus
gaatcttaccaatggctggccgtga

SEQ ID NO: 437840 - DNA, 25 bp, Mus musculus
gaatcttagaccagtgtgaaccctt

SEQ ID NO: 437841 - DNA, 25 bp, Mus musculus
gaatcttagacctgtgtgaaccctt

SEQ ID NO: 437842 - DNA, 25 bp, Mus musculus
gaatcttaggcaatctgcctctagg

SEQ ID NO: 437843 - DNA, 25 bp, Mus musculus
gaatcttaggcattctgcctctagg

SEQ ID NO: 437844 - DNA, 25 bp, Mus musculus
gaatcttagtcaatgaagcgccggt

SEQ ID NO: 437845 - DNA, 25 bp, Mus musculus
gaatcttagtcattgaagcgccggt

SEQ ID NO: 437846 - DNA, 25 bp, Mus musculus
gaatcttataaaacctgttatccag

SEQ ID NO: 437847 - DNA, 25 bp, Mus musculus
gaatcttataaaagtgttacttcat

SEQ ID NO: 437848 - DNA, 25 bp, Mus musculus
gaatcttataaatcctgttatccag

SEQ ID NO: 437849 - DNA, 25 bp, Mus musculus
gaatcttataaatgtgttacttcat

SEQ ID NO: 437850 - DNA, 25 bp, Mus musculus
gaatcttatcagcatcatggagcag

SEQ ID NO: 437851 - DNA, 25 bp, Mus musculus
gaatcttatcaggatcatggagcag

SEQ ID NO: 437852 - DNA, 25 bp, Mus musculus
gaatcttatctcacattctggagga

SEQ ID NO: 437853 - DNA, 25 bp, Mus musculus
gaatcttatctctcattctggagga

SEQ ID NO: 437854 - DNA, 25 bp, Mus musculus
gaatcttcaacaacctttcccaaga

SEQ ID NO: 437855 - DNA, 25 bp, Mus musculus
gaatcttcaacacctataggattta

SEQ ID NO: 437856 - DNA, 25 bp, Mus musculus
gaatcttcaacagctataggattta

SEQ ID NO: 437857 - DNA, 25 bp, Mus musculus
gaatcttcaacatcctttcccaaga

SEQ ID NO: 437858 - DNA, 25 bp, Mus musculus
gaatcttcaagtcggtgcctgtggt

SEQ ID NO: 437859 - DNA, 25 bp, Mus musculus
gaatcttcaagtgggtgcctgtggt

SEQ ID NO: 437860 - DNA, 25 bp, Mus musculus
gaatcttcaattacagggaatccag

SEQ ID NO: 437861 - DNA, 25 bp, Mus musculus
gaatcttcaatttcagggaatccag

SEQ ID NO: 437862 - DNA, 25 bp, Mus musculus
gaatcttcacctaactgaagcatgt

SEQ ID NO: 437863 - DNA, 25 bp, Mus musculus
gaatcttcaccttactgaagcatgt

SEQ ID NO: 437864 - DNA, 25 bp, Mus musculus
gaatcttcagcgacaaaagtgcact

SEQ ID NO: 437865 - DNA, 25 bp, Mus musculus
gaatcttcagcgtcaaaagtgcact

SEQ ID NO: 437866 - DNA, 25 bp, Mus musculus
gaatcttcaggcattcctggaggga

SEQ ID NO: 437867 - DNA, 25 bp, Mus musculus
gaatcttcaggctttcctggaggga

SEQ ID NO: 437868 - DNA, 25 bp, Mus musculus
gaatcttcaggtcattttctccctc

SEQ ID NO: 437869 - DNA, 25 bp, Mus musculus
gaatcttcaggtgattttctccctc

SEQ ID NO: 437870 - DNA, 25 bp, Mus musculus
gaatcttcatggcatccttcgggac

SEQ ID NO: 437871 - DNA, 25 bp, Mus musculus
gaatcttcatgggatccttcgggac

SEQ ID NO: 437872 - DNA, 25 bp, Mus musculus
gaatcttcatgtattcgtctttagg

SEQ ID NO: 437873 - DNA, 25 bp, Mus musculus
gaatcttcatgttttcgtctttagg

SEQ ID NO: 437874 - DNA, 25 bp, Mus musculus
gaatcttcatttagcacgaactctt

SEQ ID NO: 437875 - DNA, 25 bp, Mus musculus
gaatcttcattttgcacgaactctt

SEQ ID NO: 437876 - DNA, 25 bp, Mus musculus
gaatcttccaatcattctctcacct

SEQ ID NO: 437877 - DNA, 25 bp, Mus musculus
gaatcttccaatgattctctcacct

SEQ ID NO: 437878 - DNA, 25 bp, Mus musculus
gaatcttccagacaatgcccaaggc

SEQ ID NO: 437879 - DNA, 25 bp, Mus musculus
gaatcttccagacgtaccacttgtt

SEQ ID NO: 437880 - DNA, 25 bp, Mus musculus
gaatcttccagagaatgcccaaggc

SEQ ID NO: 437881 - DNA, 25 bp, Mus musculus
gaatcttccagaggtaccacttgtt

SEQ ID NO: 437882 - DNA, 25 bp, Mus musculus
gaatcttccatcatgaaatgaggga

SEQ ID NO: 437883 - DNA, 25 bp, Mus musculus
gaatcttccatcttgaaatgaggga

SEQ ID NO: 437884 - DNA, 25 bp, Mus musculus
gaatcttcccaaactcaatccaagg

SEQ ID NO: 437885 - DNA, 25 bp, Mus musculus
gaatcttcccaatctcaatccaagg

SEQ ID NO: 437886 - DNA, 25 bp, Mus musculus
gaatcttcccaccttccagataggg

SEQ ID NO: 437887 - DNA, 25 bp, Mus musculus
gaatcttcccacgttccagataggg

SEQ ID NO: 437888 - DNA, 25 bp, Mus musculus
gaatcttcccctatggttaatttct

SEQ ID NO: 437889 - DNA, 25 bp, Mus musculus
gaatcttcccctttggttaatttct

SEQ ID NO: 437890 - DNA, 25 bp, Mus musculus
gaatcttcccgaactctgagccaaa

SEQ ID NO: 437891 - DNA, 25 bp, Mus musculus
gaatcttcccgatctctgagccaaa

SEQ ID NO: 437892 - DNA, 25 bp, Mus musculus
gaatcttcctgtaaatgtgcggtgg

SEQ ID NO: 437893 - DNA, 25 bp, Mus musculus
gaatcttcctgttaatgtgcggtgg

SEQ ID NO: 437894 - DNA, 25 bp, Mus musculus
gaatcttccttaagtttggcggtca

SEQ ID NO: 437895 - DNA, 25 bp, Mus musculus
gaatcttccttatgtttggcggtca

SEQ ID NO: 437896 - DNA, 25 bp, Mus musculus
gaatcttccttccttaacctctcat

SEQ ID NO: 437897 - DNA, 25 bp, Mus musculus
gaatcttccttcgttaacctctcat

SEQ ID NO: 437898 - DNA, 25 bp, Mus musculus
gaatcttccttgatacttatgcata

SEQ ID NO: 437899 - DNA, 25 bp, Mus musculus
gaatcttccttgttacttatgcata

SEQ ID NO: 437900 - DNA, 25 bp, Mus musculus
gaatcttcgaaacctgtaaggctct

SEQ ID NO: 437901 - DNA, 25 bp, Mus musculus
gaatcttcgaaagctgtaaggctct

SEQ ID NO: 437902 - DNA, 25 bp, Mus musculus
gaatcttcggaaacttgcacaaaca

SEQ ID NO: 437903 - DNA, 25 bp, Mus musculus
gaatcttcggaatcttgcacaaaca

SEQ ID NO: 437904 - DNA, 25 bp, Mus musculus
gaatcttcggccacgaagttcagct

SEQ ID NO: 437905 - DNA, 25 bp, Mus musculus
gaatcttcggcctcgaagttcagct

SEQ ID NO: 437906 - DNA, 25 bp, Mus musculus
gaatcttcggcgctctgacacagag

SEQ ID NO: 437907 - DNA, 25 bp, Mus musculus
gaatcttcggcggtctgacacagag

SEQ ID NO: 437908 - DNA, 25 bp, Mus musculus
gaatcttctccccttgctttaagaa

SEQ ID NO: 437909 - DNA, 25 bp, Mus musculus
gaatcttctcccgttgctttaagaa

SEQ ID NO: 437910 - DNA, 25 bp, Mus musculus
gaatcttctgctcatgagcctattg

SEQ ID NO: 437911 - DNA, 25 bp, Mus musculus
gaatcttctgctgatgagcctattg

SEQ ID NO: 437912 - DNA, 25 bp, Mus musculus
gaatcttctggaagctcaggatgct

SEQ ID NO: 437913 - DNA, 25 bp, Mus musculus
gaatcttctggatgctcaggatgct

SEQ ID NO: 437914 - DNA, 25 bp, Mus musculus
gaatcttctgtcattacccaaggtg

SEQ ID NO: 437915 - DNA, 25 bp, Mus musculus
gaatcttctgtctttacccaaggtg

SEQ ID NO: 437916 - DNA, 25 bp, Mus musculus
gaatcttctgttcaccttggtggaa

SEQ ID NO: 437917 - DNA, 25 bp, Mus musculus
gaatcttctgttgaccttggtggaa

SEQ ID NO: 437918 - DNA, 25 bp, Mus musculus
gaatcttcttatacaaactcagtct

SEQ ID NO: 437919 - DNA, 25 bp, Mus musculus
gaatcttcttatagcacatgtcctg

SEQ ID NO: 437920 - DNA, 25 bp, Mus musculus
gaatcttcttattcaaactcagtct

SEQ ID NO: 437921 - DNA, 25 bp, Mus musculus
gaatcttcttattgcacatgtcctg

SEQ ID NO: 437922 - DNA, 25 bp, Mus musculus
gaatcttcttcacagaacatcaata

SEQ ID NO: 437923 - DNA, 25 bp, Mus musculus
gaatcttcttcagagaacatcaata

SEQ ID NO: 437924 - DNA, 25 bp, Mus musculus
gaatcttcttccacaacagtgggat

SEQ ID NO: 437925 - DNA, 25 bp, Mus musculus
gaatcttcttcctcaacagtgggat

SEQ ID NO: 437926 - DNA, 25 bp, Mus musculus
gaatcttcttttagatcctctgctt

SEQ ID NO: 437927 - DNA, 25 bp, Mus musculus
gaatcttcttttctcatgcggagtg

SEQ ID NO: 437928 - DNA, 25 bp, Mus musculus
gaatcttcttttgtcatgcggagtg

SEQ ID NO: 437929 - DNA, 25 bp, Mus musculus
gaatcttctttttgatcctctgctt

SEQ ID NO: 437930 - DNA, 25 bp, Mus musculus
gaatcttgaactatcagcttttgcc

SEQ ID NO: 437931 - DNA, 25 bp, Mus musculus
gaatcttgaactttcagcttttgcc

SEQ ID NO: 437932 - DNA, 25 bp, Mus musculus
gaatcttgacatcgccacctcagag

SEQ ID NO: 437933 - DNA, 25 bp, Mus musculus
gaatcttgacatggccacctcagag

SEQ ID NO: 437934 - DNA, 25 bp, Mus musculus
gaatcttgaccactcaattacatgg

SEQ ID NO: 437935 - DNA, 25 bp, Mus musculus
gaatcttgaccagtcaattacatgg

SEQ ID NO: 437936 - DNA, 25 bp, Mus musculus
gaatcttgagagacccttacctaaa

SEQ ID NO: 437937 - DNA, 25 bp, Mus musculus
gaatcttgagagtcccttacctaaa

SEQ ID NO: 437938 - DNA, 25 bp, Mus musculus
gaatcttgattcattaacccagcat

SEQ ID NO: 437939 - DNA, 25 bp, Mus musculus
gaatcttgattctttaacccagcat

SEQ ID NO: 437940 - DNA, 25 bp, Mus musculus
gaatcttgccttcgttgatcagaca

SEQ ID NO: 437941 - DNA, 25 bp, Mus musculus
gaatcttgccttggttgatcagaca

SEQ ID NO: 437942 - DNA, 25 bp, Mus musculus
gaatcttgctggcttgagggactaa

SEQ ID NO: 437943 - DNA, 25 bp, Mus musculus
gaatcttgctgggttgagggactaa

SEQ ID NO: 437944 - DNA, 25 bp, Mus musculus
gaatcttggagcaccatttgcacat

SEQ ID NO: 437945 - DNA, 25 bp, Mus musculus
gaatcttggagctccatttgcacat

SEQ ID NO: 437946 - DNA, 25 bp, Mus musculus
gaatcttggcacaaagactatttat

SEQ ID NO: 437947 - DNA, 25 bp, Mus musculus
gaatcttggcactaagactatttat

SEQ ID NO: 437948 - DNA, 25 bp, Mus musculus
gaatcttggctgcatgtctttgcct

SEQ ID NO: 437949 - DNA, 25 bp, Mus musculus
gaatcttggctggatgtctttgcct

SEQ ID NO: 437950 - DNA, 25 bp, Mus musculus
gaatcttggcttaggtaccttatca

SEQ ID NO: 437951 - DNA, 25 bp, Mus musculus
gaatcttggctttggtaccttatca

SEQ ID NO: 437952 - DNA, 25 bp, Mus musculus
gaatcttgggccaggttcatgtgga

SEQ ID NO: 437953 - DNA, 25 bp, Mus musculus
gaatcttgggcctggttcatgtgga

SEQ ID NO: 437954 - DNA, 25 bp, Mus musculus
gaatcttgggttcccttgcccccat

SEQ ID NO: 437955 - DNA, 25 bp, Mus musculus
gaatcttgggttgccttgcccccat

SEQ ID NO: 437956 - DNA, 25 bp, Mus musculus
gaatcttggtacaataaacatcttg

SEQ ID NO: 437957 - DNA, 25 bp, Mus musculus
gaatcttggtacatacctagcccga

SEQ ID NO: 437958 - DNA, 25 bp, Mus musculus
gaatcttggtactataaacatcttg

SEQ ID NO: 437959 - DNA, 25 bp, Mus musculus
gaatcttggtacttacctagcccga

SEQ ID NO: 437960 - DNA, 25 bp, Mus musculus
gaatcttgtatcaggaactcacact

SEQ ID NO: 437961 - DNA, 25 bp, Mus musculus
gaatcttgtatctggaactcacact

SEQ ID NO: 437962 - DNA, 25 bp, Mus musculus
gaatcttgtcctacttttttactgc

SEQ ID NO: 437963 - DNA, 25 bp, Mus musculus
gaatcttgtccttcttttttactgc

SEQ ID NO: 437964 - DNA, 25 bp, Mus musculus
gaatcttgtctcaatgctcataacg

SEQ ID NO: 437965 - DNA, 25 bp, Mus musculus
gaatcttgtctctatgctcataacg

SEQ ID NO: 437966 - DNA, 25 bp, Mus musculus
gaatcttgtgaaaacattgcctctt

SEQ ID NO: 437967 - DNA, 25 bp, Mus musculus
gaatcttgtgaatacattgcctctt

SEQ ID NO: 437968 - DNA, 25 bp, Mus musculus
gaatcttgtgggaagttgctcctaa

SEQ ID NO: 437969 - DNA, 25 bp, Mus musculus
gaatcttgtgggtagttgctcctaa

SEQ ID NO: 437970 - DNA, 25 bp, Mus musculus
gaatcttgttatctgctttgacact

SEQ ID NO: 437971 - DNA, 25 bp, Mus musculus
gaatcttgttatgtgctttgacact

SEQ ID NO: 437972 - DNA, 25 bp, Mus musculus
gaatcttgttggaacctgttggcca

SEQ ID NO: 437973 - DNA, 25 bp, Mus musculus
gaatcttgttggtacctgttggcca

SEQ ID NO: 437974 - DNA, 25 bp, Mus musculus
gaatcttgtttaaagcttggtcgct

SEQ ID NO: 437975 - DNA, 25 bp, Mus musculus
gaatcttgtttatagcttggtcgct

SEQ ID NO: 437976 - DNA, 25 bp, Mus musculus
gaatcttgtttcctattaagctcag

SEQ ID NO: 437977 - DNA, 25 bp, Mus musculus
gaatcttgtttcgtattaagctcag

SEQ ID NO: 437978 - DNA, 25 bp, Mus musculus
gaatctttaatgcacttcatcggct

SEQ ID NO: 437979 - DNA, 25 bp, Mus musculus
gaatctttaatggacttcatcggct

SEQ ID NO: 437980 - DNA, 25 bp, Mus musculus
gaatctttacaacatccatcgtcac

SEQ ID NO: 437981 - DNA, 25 bp, Mus musculus
gaatctttacaagatccatcgtcac

SEQ ID NO: 437982 - DNA, 25 bp, Mus musculus
gaatctttacacatagagcagctaa

SEQ ID NO: 437983 - DNA, 25 bp, Mus musculus
gaatctttacacttagagcagctaa

SEQ ID NO: 437984 - DNA, 25 bp, Mus musculus
gaatctttagggagctttactctaa

SEQ ID NO: 437985 - DNA, 25 bp, Mus musculus
gaatctttagggtgctttactctaa

SEQ ID NO: 437986 - DNA, 25 bp, Mus musculus
gaatctttatccaggtgagtcaaat

SEQ ID NO: 437987 - DNA, 25 bp, Mus musculus
gaatctttatcctggtgagtcaaat

SEQ ID NO: 437988 - DNA, 25 bp, Mus musculus
gaatctttatctagaagaccccatg

SEQ ID NO: 437989 - DNA, 25 bp, Mus musculus
gaatctttatctatatccatgtcca

SEQ ID NO: 437990 - DNA, 25 bp, Mus musculus
gaatctttatcttgaagaccccatg

SEQ ID NO: 437991 - DNA, 25 bp, Mus musculus
gaatctttatctttatccatgtcca

SEQ ID NO: 437992 - DNA, 25 bp, Mus musculus
gaatctttcaggaacttgtctgcag

SEQ ID NO: 437993 - DNA, 25 bp, Mus musculus
gaatctttcaggtacttgtctgcag

SEQ ID NO: 437994 - DNA, 25 bp, Mus musculus
gaatctttcagtctctatcgttcat

SEQ ID NO: 437995 - DNA, 25 bp, Mus musculus
gaatctttcagtgtctatcgttcat

SEQ ID NO: 437996 - DNA, 25 bp, Mus musculus
gaatctttccagacatgcatcaaaa

SEQ ID NO: 437997 - DNA, 25 bp, Mus musculus
gaatctttccagtcatgcatcaaaa

SEQ ID NO: 437998 - DNA, 25 bp, Mus musculus
gaatctttcctaagtcttcattcct

SEQ ID NO: 437999 - DNA, 25 bp, Mus musculus
gaatctttcctatgtcttcattcct

SEQ ID NO: 438000 - DNA, 25 bp, Mus musculus
gaatctttccttctatatttagtta

SEQ ID NO: 438001 - DNA, 25 bp, Mus musculus
gaatctttccttgtatatttagtta

SEQ ID NO: 438002 - DNA, 25 bp, Mus musculus
gaatctttcgaaacatgttgatcct

SEQ ID NO: 438003 - DNA, 25 bp, Mus musculus
gaatctttcgaatcatgttgatcct

SEQ ID NO: 438004 - DNA, 25 bp, Mus musculus
gaatctttcggcattatcatctata

SEQ ID NO: 438005 - DNA, 25 bp, Mus musculus
gaatctttcggctttatcatctata

SEQ ID NO: 438006 - DNA, 25 bp, Mus musculus
gaatctttcgttatcccggtgaatg

SEQ ID NO: 438007 - DNA, 25 bp, Mus musculus
gaatctttcgttttcccggtgaatg

SEQ ID NO: 438008 - DNA, 25 bp, Mus musculus
gaatctttctacaatttgggccgtg

SEQ ID NO: 438009 - DNA, 25 bp, Mus musculus
gaatctttctactatttgggccgtg

SEQ ID NO: 438010 - DNA, 25 bp, Mus musculus
gaatctttctcgaaacttcctgttg

SEQ ID NO: 438011 - DNA, 25 bp, Mus musculus
gaatctttctcgtaacttcctgttg

SEQ ID NO: 438012 - DNA, 25 bp, Mus musculus
gaatctttcttaacataaggctctt

SEQ ID NO: 438013 - DNA, 25 bp, Mus musculus
gaatctttcttatcataaggctctt

SEQ ID NO: 438014 - DNA, 25 bp, Mus musculus
gaatctttctttctgagctgtcgat

SEQ ID NO: 438015 - DNA, 25 bp, Mus musculus
gaatctttctttgtgagctgtcgat

SEQ ID NO: 438016 - DNA, 25 bp, Mus musculus
gaatctttgagaatgtcacatcatg

SEQ ID NO: 438017 - DNA, 25 bp, Mus musculus
gaatctttgagattgtcacatcatg

SEQ ID NO: 438018 - DNA, 25 bp, Mus musculus
gaatctttgattacccctgtatgaa

SEQ ID NO: 438019 - DNA, 25 bp, Mus musculus
gaatctttgatttcccctgtatgaa

SEQ ID NO: 438020 - DNA, 25 bp, Mus musculus
gaatctttgcaaattagcctggaaa

SEQ ID NO: 438021 - DNA, 25 bp, Mus musculus
gaatctttgcaatttagcctggaaa

SEQ ID NO: 438022 - DNA, 25 bp, Mus musculus
gaatctttgtagctgctcggatcta

SEQ ID NO: 438023 - DNA, 25 bp, Mus musculus
gaatctttgtaggtgctcggatcta

SEQ ID NO: 438024 - DNA, 25 bp, Mus musculus
gaatctttgttcctgctcgcaataa

SEQ ID NO: 438025 - DNA, 25 bp, Mus musculus
gaatctttgttcgtgctcgcaataa

SEQ ID NO: 438026 - DNA, 25 bp, Mus musculus
gaatctttgtttagcacttcagtta

SEQ ID NO: 438027 - DNA, 25 bp, Mus musculus
gaatctttgttttgcacttcagtta

SEQ ID NO: 438028 - DNA, 25 bp, Mus musculus
gaatcttttaatcggtctcctacag

SEQ ID NO: 438029 - DNA, 25 bp, Mus musculus
gaatcttttaatgggtctcctacag

SEQ ID NO: 438030 - DNA, 25 bp, Mus musculus
gaatcttttagtactacctacctct

SEQ ID NO: 438031 - DNA, 25 bp, Mus musculus
gaatcttttagtcacatcacctcag

SEQ ID NO: 438032 - DNA, 25 bp, Mus musculus
gaatcttttagtgacatcacctcag

SEQ ID NO: 438033 - DNA, 25 bp, Mus musculus
gaatcttttagttctacctacctct

SEQ ID NO: 438034 - DNA, 25 bp, Mus musculus
gaatcttttatcatcgagcgttgct

SEQ ID NO: 438035 - DNA, 25 bp, Mus musculus
gaatcttttatcttcgagcgttgct

SEQ ID NO: 438036 - DNA, 25 bp, Mus musculus
gaatcttttatgataacacctcttt

SEQ ID NO: 438037 - DNA, 25 bp, Mus musculus
gaatcttttatgttaacacctcttt

SEQ ID NO: 438038 - DNA, 25 bp, Mus musculus
gaatcttttcacctctgaagtccat

SEQ ID NO: 438039 - DNA, 25 bp, Mus musculus
gaatcttttcacgtctgaagtccat

SEQ ID NO: 438040 - DNA, 25 bp, Mus musculus
gaatcttttccaaaagttctttgtg

SEQ ID NO: 438041 - DNA, 25 bp, Mus musculus
gaatcttttccacacgagggcagag

SEQ ID NO: 438042 - DNA, 25 bp, Mus musculus
gaatcttttccagacgagggcagag

SEQ ID NO: 438043 - DNA, 25 bp, Mus musculus
gaatcttttccataagttctttgtg

SEQ ID NO: 438044 - DNA, 25 bp, Mus musculus
gaatcttttcccaatgcacttggtg

SEQ ID NO: 438045 - DNA, 25 bp, Mus musculus
gaatcttttccctatgcacttggtg

SEQ ID NO: 438046 - DNA, 25 bp, Mus musculus
gaatcttttcgaagctccagtatag

SEQ ID NO: 438047 - DNA, 25 bp, Mus musculus
gaatcttttcgatgctccagtatag

SEQ ID NO: 438048 - DNA, 25 bp, Mus musculus
gaatcttttctgattttgagcaaaa

SEQ ID NO: 438049 - DNA, 25 bp, Mus musculus
gaatcttttctgtttttgagcaaaa

SEQ ID NO: 438050 - DNA, 25 bp, Mus musculus
gaatcttttcttccgtgatcaggtt

SEQ ID NO: 438051 - DNA, 25 bp, Mus musculus
gaatcttttcttgcgtgatcaggtt

SEQ ID NO: 438052 - DNA, 25 bp, Mus musculus
gaatcttttgaaccgatttccagct

SEQ ID NO: 438053 - DNA, 25 bp, Mus musculus
gaatcttttgaagcgatttccagct

SEQ ID NO: 438054 - DNA, 25 bp, Mus musculus
gaatctttttcaccgtgcactttca

SEQ ID NO: 438055 - DNA, 25 bp, Mus musculus
gaatctttttcagcgtgcactttca

SEQ ID NO: 438056 - DNA, 25 bp, Mus musculus
gaatctttttctacgtcttggtgcc

SEQ ID NO: 438057 - DNA, 25 bp, Mus musculus
gaatctttttcttcgtcttggtgcc

SEQ ID NO: 438058 - DNA, 25 bp, Mus musculus
gaatcttttttcatggacagtcttt

SEQ ID NO: 438059 - DNA, 25 bp, Mus musculus
gaatcttttttcttggacagtcttt

SEQ ID NO: 438060 - DNA, 25 bp, Mus musculus
gaatgaaaagtactcccagtctctt

SEQ ID NO: 438061 - DNA, 25 bp, Mus musculus
gaatgaaaagtagtcccagtctctt

SEQ ID NO: 438062 - DNA, 25 bp, Mus musculus
gaatgaaaccttcaccaggctgtca

SEQ ID NO: 438063 - DNA, 25 bp, Mus musculus
gaatgaaaccttccaggtcctgcca

SEQ ID NO: 438064 - DNA, 25 bp, Mus musculus
gaatgaaaccttgaccaggctgtca

SEQ ID NO: 438065 - DNA, 25 bp, Mus musculus
gaatgaaaccttgcaggtcctgcca

SEQ ID NO: 438066 - DNA, 25 bp, Mus musculus
gaatgaaactctaacctggctcttc

SEQ ID NO: 438067 - DNA, 25 bp, Mus musculus
gaatgaaactcttacctggctcttc

SEQ ID NO: 438068 - DNA, 25 bp, Mus musculus
gaatgaaactgaccactgcatgcaa

SEQ ID NO: 438069 - DNA, 25 bp, Mus musculus
gaatgaaactgagcactgcatgcaa

SEQ ID NO: 438070 - DNA, 25 bp, Mus musculus
gaatgaaagctacgttttcaggtag

SEQ ID NO: 438071 - DNA, 25 bp, Mus musculus
gaatgaaagctaggttttcaggtag

SEQ ID NO: 438072 - DNA, 25 bp, Mus musculus
gaatgaaatatactcctctgggaga

SEQ ID NO: 438073 - DNA, 25 bp, Mus musculus
gaatgaaatatagtcctctgggaga

SEQ ID NO: 438074 - DNA, 25 bp, Mus musculus
gaatgaaatcctcctgggacttgac

SEQ ID NO: 438075 - DNA, 25 bp, Mus musculus
gaatgaaatcctgctgggacttgac

SEQ ID NO: 438076 - DNA, 25 bp, Mus musculus
gaatgaaatctacacacggcacctg

SEQ ID NO: 438077 - DNA, 25 bp, Mus musculus
gaatgaaatctagacacggcacctg

SEQ ID NO: 438078 - DNA, 25 bp, Mus musculus
gaatgaaatggtatggtctcccttt

SEQ ID NO: 438079 - DNA, 25 bp, Mus musculus
gaatgaaatggtttggtctcccttt

SEQ ID NO: 438080 - DNA, 25 bp, Mus musculus
gaatgaaatgttatcctgaagcctg

SEQ ID NO: 438081 - DNA, 25 bp, Mus musculus
gaatgaaatgttttcctgaagcctg

SEQ ID NO: 438082 - DNA, 25 bp, Mus musculus
gaatgaaattcacccttaatgcaga

SEQ ID NO: 438083 - DNA, 25 bp, Mus musculus
gaatgaaattcagccttaatgcaga

SEQ ID NO: 438084 - DNA, 25 bp, Mus musculus
gaatgaacagttctcctgctacaga

SEQ ID NO: 438085 - DNA, 25 bp, Mus musculus
gaatgaacagttgtcctgctacaga

SEQ ID NO: 438086 - DNA, 25 bp, Mus musculus
gaatgaacatctaaggcccacaggt

SEQ ID NO: 438087 - DNA, 25 bp, Mus musculus
gaatgaacatcttaggcccacaggt

SEQ ID NO: 438088 - DNA, 25 bp, Mus musculus
gaatgaacattgacactgcagattg

SEQ ID NO: 438089 - DNA, 25 bp, Mus musculus
gaatgaacattgtcactgcagattg

SEQ ID NO: 438090 - DNA, 25 bp, Mus musculus
gaatgaacatttctggaaggttaac

SEQ ID NO: 438091 - DNA, 25 bp, Mus musculus
gaatgaacatttgtggaaggttaac

SEQ ID NO: 438092 - DNA, 25 bp, Mus musculus
gaatgaaccagacatacccggccct

SEQ ID NO: 438093 - DNA, 25 bp, Mus musculus
gaatgaaccagagatacccggccct

SEQ ID NO: 438094 - DNA, 25 bp, Mus musculus
gaatgaacccgacctgaacctaaca

SEQ ID NO: 438095 - DNA, 25 bp, Mus musculus
gaatgaacccgagctgaacctaaca

SEQ ID NO: 438096 - DNA, 25 bp, Mus musculus
gaatgaaccgagcaccctgaacaag

SEQ ID NO: 438097 - DNA, 25 bp, Mus musculus
gaatgaaccgaggaccctgaacaag

SEQ ID NO: 438098 - DNA, 25 bp, Mus musculus
gaatgaacctccctgtcctgagagg

SEQ ID NO: 438099 - DNA, 25 bp, Mus musculus
gaatgaacctccgtgtcctgagagg

SEQ ID NO: 438100 - DNA, 25 bp, Mus musculus
gaatgaaccttcattactccgacca

SEQ ID NO: 438101 - DNA, 25 bp, Mus musculus
gaatgaaccttctttactccgacca

SEQ ID NO: 438102 - DNA, 25 bp, Mus musculus
gaatgaaccttgactctttataaat

SEQ ID NO: 438103 - DNA, 25 bp, Mus musculus
gaatgaaccttgtctctttataaat

SEQ ID NO: 438104 - DNA, 25 bp, Mus musculus
gaatgaacgcatagggaagacccag

SEQ ID NO: 438105 - DNA, 25 bp, Mus musculus
gaatgaacgcattgggaagacccag

SEQ ID NO: 438106 - DNA, 25 bp, Mus musculus
gaatgaacgccaagctgttttcact

SEQ ID NO: 438107 - DNA, 25 bp, Mus musculus
gaatgaacgccatgctgttttcact

SEQ ID NO: 438108 - DNA, 25 bp, Mus musculus
gaatgaactactatctccgctaaag

SEQ ID NO: 438109 - DNA, 25 bp, Mus musculus
gaatgaactactttctccgctaaag

SEQ ID NO: 438110 - DNA, 25 bp, Mus musculus
gaatgaactccaacctagaaggact

SEQ ID NO: 438111 - DNA, 25 bp, Mus musculus
gaatgaactccatcctagaaggact

SEQ ID NO: 438112 - DNA, 25 bp, Mus musculus
gaatgaactggaatggaatgccatg

SEQ ID NO: 438113 - DNA, 25 bp, Mus musculus
gaatgaactggattggaatgccatg

SEQ ID NO: 438114 - DNA, 25 bp, Mus musculus
gaatgaactggtacaactcccctta

SEQ ID NO: 438115 - DNA, 25 bp, Mus musculus
gaatgaactggttcaactcccctta

SEQ ID NO: 438116 - DNA, 25 bp, Mus musculus
gaatgaactgtcactttaatcccaa

SEQ ID NO: 438117 - DNA, 25 bp, Mus musculus
gaatgaactgtcctggcaaccacgt

SEQ ID NO: 438118 - DNA, 25 bp, Mus musculus
gaatgaactgtcgtggcaaccacgt

SEQ ID NO: 438119 - DNA, 25 bp, Mus musculus
gaatgaactgtctctttaatcccaa

SEQ ID NO: 438120 - DNA, 25 bp, Mus musculus
gaatgaagacatacctattctagat

SEQ ID NO: 438121 - DNA, 25 bp, Mus musculus
gaatgaagacattcctattctagat

SEQ ID NO: 438122 - DNA, 25 bp, Mus musculus
gaatgaagagcccagccacagagtg

SEQ ID NO: 438123 - DNA, 25 bp, Mus musculus
gaatgaagagccgagccacagagtg

SEQ ID NO: 438124 - DNA, 25 bp, Mus musculus
gaatgaagagtgcacgctgttcccc

SEQ ID NO: 438125 - DNA, 25 bp, Mus musculus
gaatgaagagtggacgctgttcccc

SEQ ID NO: 438126 - DNA, 25 bp, Mus musculus
gaatgaagcactagtccctcagata

SEQ ID NO: 438127 - DNA, 25 bp, Mus musculus
gaatgaagcacttgtccctcagata

SEQ ID NO: 438128 - DNA, 25 bp, Mus musculus
gaatgaagccataggtccctggact

SEQ ID NO: 438129 - DNA, 25 bp, Mus musculus
gaatgaagccattggtccctggact

SEQ ID NO: 438130 - DNA, 25 bp, Mus musculus
gaatgaagccggatcctttttccaa

SEQ ID NO: 438131 - DNA, 25 bp, Mus musculus
gaatgaagccggttcctttttccaa

SEQ ID NO: 438132 - DNA, 25 bp, Mus musculus
gaatgaagctacagctcagacgggc

SEQ ID NO: 438133 - DNA, 25 bp, Mus musculus
gaatgaagctactgctcagacgggc

SEQ ID NO: 438134 - DNA, 25 bp, Mus musculus
gaatgaaggacaaccaccttgttcc

SEQ ID NO: 438135 - DNA, 25 bp, Mus musculus
gaatgaaggacaattctcccatttt

SEQ ID NO: 438136 - DNA, 25 bp, Mus musculus
gaatgaaggacatccaccttgttcc

SEQ ID NO: 438137 - DNA, 25 bp, Mus musculus
gaatgaaggacatttctcccatttt

SEQ ID NO: 438138 - DNA, 25 bp, Mus musculus
gaatgaaggtgaacacatctgtatg

SEQ ID NO: 438139 - DNA, 25 bp, Mus musculus
gaatgaaggtgatcacatctgtatg

SEQ ID NO: 438140 - DNA, 25 bp, Mus musculus
gaatgaagtaccaagagtgtcagat

SEQ ID NO: 438141 - DNA, 25 bp, Mus musculus
gaatgaagtacctagagtgtcagat

SEQ ID NO: 438142 - DNA, 25 bp, Mus musculus
gaatgaagtcctctgagtagtccta

SEQ ID NO: 438143 - DNA, 25 bp, Mus musculus
gaatgaagtcctgtgagtagtccta

SEQ ID NO: 438144 - DNA, 25 bp, Mus musculus
gaatgaagtctcagcaagccatgcc

SEQ ID NO: 438145 - DNA, 25 bp, Mus musculus
gaatgaagtctctgcaagccatgcc

SEQ ID NO: 438146 - DNA, 25 bp, Mus musculus
gaatgaagttctaacctacattaaa

SEQ ID NO: 438147 - DNA, 25 bp, Mus musculus
gaatgaagttcttacctacattaaa

SEQ ID NO: 438148 - DNA, 25 bp, Mus musculus
gaatgaatacatcctctcaactgag

SEQ ID NO: 438149 - DNA, 25 bp, Mus musculus
gaatgaatacatgctctcaactgag

SEQ ID NO: 438150 - DNA, 25 bp, Mus musculus
gaatgaatagaactcgcatccaaaa

SEQ ID NO: 438151 - DNA, 25 bp, Mus musculus
gaatgaatagaagtcgcatccaaaa

SEQ ID NO: 438152 - DNA, 25 bp, Mus musculus
gaatgaatattcctacaccacccag

SEQ ID NO: 438153 - DNA, 25 bp, Mus musculus
gaatgaatattcgtacaccacccag

SEQ ID NO: 438154 - DNA, 25 bp, Mus musculus
gaatgaatctctatagtctacaaaa

SEQ ID NO: 438155 - DNA, 25 bp, Mus musculus
gaatgaatctctttagtctacaaaa

SEQ ID NO: 438156 - DNA, 25 bp, Mus musculus
gaatgaatgaacatccctgctccaa

SEQ ID NO: 438157 - DNA, 25 bp, Mus musculus
gaatgaatgaacttccctgctccaa

SEQ ID NO: 438158 - DNA, 25 bp, Mus musculus
gaatgaatgcaacttagagctatat

SEQ ID NO: 438159 - DNA, 25 bp, Mus musculus
gaatgaatgcaagttagagctatat

SEQ ID NO: 438160 - DNA, 25 bp, Mus musculus
gaatgaatgcacagacgatccacgt

SEQ ID NO: 438161 - DNA, 25 bp, Mus musculus
gaatgaatgcactgacgatccacgt

SEQ ID NO: 438162 - DNA, 25 bp, Mus musculus
gaatgaatgccaaccgagaagaaac

SEQ ID NO: 438163 - DNA, 25 bp, Mus musculus
gaatgaatgccatccgagaagaaac

SEQ ID NO: 438164 - DNA, 25 bp, Mus musculus
gaatgaatggacagcacacctcagc

SEQ ID NO: 438165 - DNA, 25 bp, Mus musculus
gaatgaatggactgcacacctcagc

SEQ ID NO: 438166 - DNA, 25 bp, Mus musculus
gaatgaatggctatatccaccgagc

SEQ ID NO: 438167 - DNA, 25 bp, Mus musculus
gaatgaatggctttatccaccgagc

SEQ ID NO: 438168 - DNA, 25 bp, Mus musculus
gaatgaatggtcagtggtctattta

SEQ ID NO: 438169 - DNA, 25 bp, Mus musculus
gaatgaatggtctgtggtctattta

SEQ ID NO: 438170 - DNA, 25 bp, Mus musculus
gaatgaattactaagcagctttacc

SEQ ID NO: 438171 - DNA, 25 bp, Mus musculus
gaatgaattacttagcagctttacc

SEQ ID NO: 438172 - DNA, 25 bp, Mus musculus
gaatgaattccaatgtgctactatg

SEQ ID NO: 438173 - DNA, 25 bp, Mus musculus
gaatgaattccattgtgctactatg

SEQ ID NO: 438174 - DNA, 25 bp, Mus musculus
gaatgaattgctcatcagctgctcc

SEQ ID NO: 438175 - DNA, 25 bp, Mus musculus
gaatgaattgctgatcagctgctcc

SEQ ID NO: 438176 - DNA, 25 bp, Mus musculus
gaatgaatttttccccttaagatta

SEQ ID NO: 438177 - DNA, 25 bp, Mus musculus
gaatgaatttttgcccttaagatta

SEQ ID NO: 438178 - DNA, 25 bp, Mus musculus
gaatgacaaactcacttgcgtacag

SEQ ID NO: 438179 - DNA, 25 bp, Mus musculus
gaatgacaaactcggctacggctcc

SEQ ID NO: 438180 - DNA, 25 bp, Mus musculus
gaatgacaaactgacttgcgtacag

SEQ ID NO: 438181 - DNA, 25 bp, Mus musculus
gaatgacaaactgggctacggctcc

SEQ ID NO: 438182 - DNA, 25 bp, Mus musculus
gaatgacaaccaaccatgccttgag

SEQ ID NO: 438183 - DNA, 25 bp, Mus musculus
gaatgacaaccatccatgccttgag

SEQ ID NO: 438184 - DNA, 25 bp, Mus musculus
gaatgacaacccaaatggccaggcc

SEQ ID NO: 438185 - DNA, 25 bp, Mus musculus
gaatgacaaccctaatggccaggcc

SEQ ID NO: 438186 - DNA, 25 bp, Mus musculus
gaatgacaactcacagtggctttcc

SEQ ID NO: 438187 - DNA, 25 bp, Mus musculus
gaatgacaactctcagtggctttcc

SEQ ID NO: 438188 - DNA, 25 bp, Mus musculus
gaatgacaagaccagtttctctaat

SEQ ID NO: 438189 - DNA, 25 bp, Mus musculus
gaatgacaagacgagtttctctaat

SEQ ID NO: 438190 - DNA, 25 bp, Mus musculus
gaatgacacagcagatttgacaatg

SEQ ID NO: 438191 - DNA, 25 bp, Mus musculus
gaatgacacagctgatttgacaatg

SEQ ID NO: 438192 - DNA, 25 bp, Mus musculus
gaatgacacagtaaccatccggacc

SEQ ID NO: 438193 - DNA, 25 bp, Mus musculus
gaatgacacagttaccatccggacc

SEQ ID NO: 438194 - DNA, 25 bp, Mus musculus
gaatgacacctgatttaaagccctg

SEQ ID NO: 438195 - DNA, 25 bp, Mus musculus
gaatgacacctgttttaaagccctg

SEQ ID NO: 438196 - DNA, 25 bp, Mus musculus
gaatgacaccttctgttgctggtct

SEQ ID NO: 438197 - DNA, 25 bp, Mus musculus
gaatgacaccttgtgttgctggtct

SEQ ID NO: 438198 - DNA, 25 bp, Mus musculus
gaatgacactaaaggcctctggctc

SEQ ID NO: 438199 - DNA, 25 bp, Mus musculus
gaatgacactaatggcctctggctc

SEQ ID NO: 438200 - DNA, 25 bp, Mus musculus
gaatgacagctgatgtccatgacag

SEQ ID NO: 438201 - DNA, 25 bp, Mus musculus
gaatgacagctgttgtccatgacag

SEQ ID NO: 438202 - DNA, 25 bp, Mus musculus
gaatgacagggcatgctagcaggtc

SEQ ID NO: 438203 - DNA, 25 bp, Mus musculus
gaatgacagggcttgctagcaggtc

SEQ ID NO: 438204 - DNA, 25 bp, Mus musculus
gaatgacaggtcaccaaagaacagt

SEQ ID NO: 438205 - DNA, 25 bp, Mus musculus
gaatgacaggtctccaaagaacagt

SEQ ID NO: 438206 - DNA, 25 bp, Mus musculus
gaatgacagttgctcctctgtttga

SEQ ID NO: 438207 - DNA, 25 bp, Mus musculus
gaatgacagttggtcctctgtttga

SEQ ID NO: 438208 - DNA, 25 bp, Mus musculus
gaatgacatagacatctttgagatc

SEQ ID NO: 438209 - DNA, 25 bp, Mus musculus
gaatgacatagagatctttgagatc

SEQ ID NO: 438210 - DNA, 25 bp, Mus musculus
gaatgacatcatccttctgcagctg

SEQ ID NO: 438211 - DNA, 25 bp, Mus musculus
gaatgacatcatcgctagctcaagt

SEQ ID NO: 438212 - DNA, 25 bp, Mus musculus
gaatgacatcatgcttctgcagctg

SEQ ID NO: 438213 - DNA, 25 bp, Mus musculus
gaatgacatcatggctagctcaagt

SEQ ID NO: 438214 - DNA, 25 bp, Mus musculus
gaatgacatgctacaccatggaaaa

SEQ ID NO: 438215 - DNA, 25 bp, Mus musculus
gaatgacatgcttcaccatggaaaa

SEQ ID NO: 438216 - DNA, 25 bp, Mus musculus
gaatgacatgtcatgctctggaact

SEQ ID NO: 438217 - DNA, 25 bp, Mus musculus
gaatgacatgtcttgctctggaact

SEQ ID NO: 438218 - DNA, 25 bp, Mus musculus
gaatgacatttaagcttcaggctta

SEQ ID NO: 438219 - DNA, 25 bp, Mus musculus
gaatgacatttatgcttcaggctta

SEQ ID NO: 438220 - DNA, 25 bp, Mus musculus
gaatgacattttctctcctgtggaa

SEQ ID NO: 438221 - DNA, 25 bp, Mus musculus
gaatgacattttgtctcctgtggaa

SEQ ID NO: 438222 - DNA, 25 bp, Mus musculus
gaatgaccaacgatgtaaaactcga

SEQ ID NO: 438223 - DNA, 25 bp, Mus musculus
gaatgaccaacgttgtaaaactcga

SEQ ID NO: 438224 - DNA, 25 bp, Mus musculus
gaatgaccaccacgcccagatctag

SEQ ID NO: 438225 - DNA, 25 bp, Mus musculus
gaatgaccaccaggcccagatctag

SEQ ID NO: 438226 - DNA, 25 bp, Mus musculus
gaatgaccactaattcttgaggaag

SEQ ID NO: 438227 - DNA, 25 bp, Mus musculus
gaatgaccactatttcttgaggaag

SEQ ID NO: 438228 - DNA, 25 bp, Mus musculus
gaatgaccactgctcaaactttctg

SEQ ID NO: 438229 - DNA, 25 bp, Mus musculus
gaatgaccactggtcaaactttctg

SEQ ID NO: 438230 - DNA, 25 bp, Mus musculus
gaatgaccaggtagatgtgcacgtg

SEQ ID NO: 438231 - DNA, 25 bp, Mus musculus
gaatgaccaggttgatgtgcacgtg

SEQ ID NO: 438232 - DNA, 25 bp, Mus musculus
gaatgaccatgaccttgctttcctt

SEQ ID NO: 438233 - DNA, 25 bp, Mus musculus
gaatgaccatgagcttgctttcctt

SEQ ID NO: 438234 - DNA, 25 bp, Mus musculus
gaatgacccactcgatcatgacctt

SEQ ID NO: 438235 - DNA, 25 bp, Mus musculus
gaatgacccactggatcatgacctt

SEQ ID NO: 438236 - DNA, 25 bp, Mus musculus
gaatgacccagaccagtagcagcaa

SEQ ID NO: 438237 - DNA, 25 bp, Mus musculus
gaatgacccagagcagtagcagcaa

SEQ ID NO: 438238 - DNA, 25 bp, Mus musculus
gaatgaccccataatgaagtgcagt

SEQ ID NO: 438239 - DNA, 25 bp, Mus musculus
gaatgaccccattatgaagtgcagt

SEQ ID NO: 438240 - DNA, 25 bp, Mus musculus
gaatgacccccgagctcgcatggac

SEQ ID NO: 438241 - DNA, 25 bp, Mus musculus
gaatgacccccgtgctcgcatggac

SEQ ID NO: 438242 - DNA, 25 bp, Mus musculus
gaatgaccccgtcccaagagtgctt

SEQ ID NO: 438243 - DNA, 25 bp, Mus musculus
gaatgaccccgtgccaagagtgctt

SEQ ID NO: 438244 - DNA, 25 bp, Mus musculus
gaatgaccctagaaactaagcagat

SEQ ID NO: 438245 - DNA, 25 bp, Mus musculus
gaatgaccctagtaactaagcagat

SEQ ID NO: 438246 - DNA, 25 bp, Mus musculus
gaatgacctatcatgtcagttggag

SEQ ID NO: 438247 - DNA, 25 bp, Mus musculus
gaatgacctatcttgtcagttggag

SEQ ID NO: 438248 - DNA, 25 bp, Mus musculus
gaatgacctcctctcatgatcaaaa

SEQ ID NO: 438249 - DNA, 25 bp, Mus musculus
gaatgacctcctgtcatgatcaaaa

SEQ ID NO: 438250 - DNA, 25 bp, Mus musculus
gaatgacctctgaagatactgttgt

SEQ ID NO: 438251 - DNA, 25 bp, Mus musculus
gaatgacctctgtagatactgttgt

SEQ ID NO: 438252 - DNA, 25 bp, Mus musculus
gaatgacctgacaacaagattaatc

SEQ ID NO: 438253 - DNA, 25 bp, Mus musculus
gaatgacctgactacaagattaatc

SEQ ID NO: 438254 - DNA, 25 bp, Mus musculus
gaatgacctgggaacacgcacagca

SEQ ID NO: 438255 - DNA, 25 bp, Mus musculus
gaatgacctgggtacacgcacagca

SEQ ID NO: 438256 - DNA, 25 bp, Mus musculus
gaatgacctggtccttcgtaattac

SEQ ID NO: 438257 - DNA, 25 bp, Mus musculus
gaatgacctggtgcttcgtaattac

SEQ ID NO: 438258 - DNA, 25 bp, Mus musculus
gaatgacctgttacgaatatttgaa

SEQ ID NO: 438259 - DNA, 25 bp, Mus musculus
gaatgacctgtttcgaatatttgaa

SEQ ID NO: 438260 - DNA, 25 bp, Mus musculus
gaatgaccttacatactgactgaca

SEQ ID NO: 438261 - DNA, 25 bp, Mus musculus
gaatgaccttacttactgactgaca

SEQ ID NO: 438262 - DNA, 25 bp, Mus musculus
gaatgaccttcaattgccagatgat

SEQ ID NO: 438263 - DNA, 25 bp, Mus musculus
gaatgaccttcatttgccagatgat

SEQ ID NO: 438264 - DNA, 25 bp, Mus musculus
gaatgaccttctctaccacagataa

SEQ ID NO: 438265 - DNA, 25 bp, Mus musculus
gaatgaccttctgtaccacagataa

SEQ ID NO: 438266 - DNA, 25 bp, Mus musculus
gaatgaccttggagttctgggcaca

SEQ ID NO: 438267 - DNA, 25 bp, Mus musculus
gaatgaccttggtgttctgggcaca

SEQ ID NO: 438268 - DNA, 25 bp, Mus musculus
gaatgaccttttctttctaagtgaa

SEQ ID NO: 438269 - DNA, 25 bp, Mus musculus
gaatgaccttttgtttctaagtgaa

SEQ ID NO: 438270 - DNA, 25 bp, Mus musculus
gaatgacgcattaaactcctgcaga

SEQ ID NO: 438271 - DNA, 25 bp, Mus musculus
gaatgacgcatttaactcctgcaga

SEQ ID NO: 438272 - DNA, 25 bp, Mus musculus
gaatgacgctgcatatgttgacttc

SEQ ID NO: 438273 - DNA, 25 bp, Mus musculus
gaatgacgctgcttatgttgacttc

SEQ ID NO: 438274 - DNA, 25 bp, Mus musculus
gaatgacgtcacagagccactaaag

SEQ ID NO: 438275 - DNA, 25 bp, Mus musculus
gaatgacgtcactgagccactaaag

SEQ ID NO: 438276 - DNA, 25 bp, Mus musculus
gaatgacgtttcactgctcttgatg

SEQ ID NO: 438277 - DNA, 25 bp, Mus musculus
gaatgacgtttctctgctcttgatg

SEQ ID NO: 438278 - DNA, 25 bp, Mus musculus
gaatgactaaacctgtactttggga

SEQ ID NO: 438279 - DNA, 25 bp, Mus musculus
gaatgactaaacgtgtactttggga

SEQ ID NO: 438280 - DNA, 25 bp, Mus musculus
gaatgactaacactctccttgaatt

SEQ ID NO: 438281 - DNA, 25 bp, Mus musculus
gaatgactaacagtctccttgaatt

SEQ ID NO: 438282 - DNA, 25 bp, Mus musculus
gaatgactaagtagctctcagcaat

SEQ ID NO: 438283 - DNA, 25 bp, Mus musculus
gaatgactaagttgctctcagcaat

SEQ ID NO: 438284 - DNA, 25 bp, Mus musculus
gaatgactacagaaaccttaaagtt

SEQ ID NO: 438285 - DNA, 25 bp, Mus musculus
gaatgactacagtaaccttaaagtt

SEQ ID NO: 438286 - DNA, 25 bp, Mus musculus
gaatgactacgtctgagttccttcc

SEQ ID NO: 438287 - DNA, 25 bp, Mus musculus
gaatgactacgtgtgagttccttcc

SEQ ID NO: 438288 - DNA, 25 bp, Mus musculus
gaatgactactgatcagatcaagca

SEQ ID NO: 438289 - DNA, 25 bp, Mus musculus
gaatgactactgttcagatcaagca

SEQ ID NO: 438290 - DNA, 25 bp, Mus musculus
gaatgactaggtatggtcccattgc

SEQ ID NO: 438291 - DNA, 25 bp, Mus musculus
gaatgactaggtttggtcccattgc

SEQ ID NO: 438292 - DNA, 25 bp, Mus musculus
gaatgactatctaacatctgtagag

SEQ ID NO: 438293 - DNA, 25 bp, Mus musculus
gaatgactatcttacatctgtagag

SEQ ID NO: 438294 - DNA, 25 bp, Mus musculus
gaatgactatgaagcagagtctggt

SEQ ID NO: 438295 - DNA, 25 bp, Mus musculus
gaatgactatgatgcagagtctggt

SEQ ID NO: 438296 - DNA, 25 bp, Mus musculus
gaatgactcaacattgccttcactt

SEQ ID NO: 438297 - DNA, 25 bp, Mus musculus
gaatgactcaactttgccttcactt

SEQ ID NO: 438298 - DNA, 25 bp, Mus musculus
gaatgactcatcaggcacaaattca

SEQ ID NO: 438299 - DNA, 25 bp, Mus musculus
gaatgactcatctggcacaaattca

SEQ ID NO: 438300 - DNA, 25 bp, Mus musculus
gaatgactcctaatgttcagggtga

SEQ ID NO: 438301 - DNA, 25 bp, Mus musculus
gaatgactcctattgttcagggtga

SEQ ID NO: 438302 - DNA, 25 bp, Mus musculus
gaatgactcggtcggagctgaaaca

SEQ ID NO: 438303 - DNA, 25 bp, Mus musculus
gaatgactcggtgggagctgaaaca

SEQ ID NO: 438304 - DNA, 25 bp, Mus musculus
gaatgactctgtcaatgcctgcaga

SEQ ID NO: 438305 - DNA, 25 bp, Mus musculus
gaatgactctgtgaatgcctgcaga

SEQ ID NO: 438306 - DNA, 25 bp, Mus musculus
gaatgactgatgagaccttgaatgc

SEQ ID NO: 438307 - DNA, 25 bp, Mus musculus
gaatgactgatgtgaccttgaatgc

SEQ ID NO: 438308 - DNA, 25 bp, Mus musculus
gaatgactgcttataatgaccttta

SEQ ID NO: 438309 - DNA, 25 bp, Mus musculus
gaatgactgcttttaatgaccttta

SEQ ID NO: 438310 - DNA, 25 bp, Mus musculus
gaatgactggagatttggtattcag

SEQ ID NO: 438311 - DNA, 25 bp, Mus musculus
gaatgactggagttttggtattcag

SEQ ID NO: 438312 - DNA, 25 bp, Mus musculus
gaatgactggcgatcgagcacatgc

SEQ ID NO: 438313 - DNA, 25 bp, Mus musculus
gaatgactggcgttcgagcacatgc

SEQ ID NO: 438314 - DNA, 25 bp, Mus musculus
gaatgactggctcttttatgtttca

SEQ ID NO: 438315 - DNA, 25 bp, Mus musculus
gaatgactggctgttttatgtttca

SEQ ID NO: 438316 - DNA, 25 bp, Mus musculus
gaatgactgggacagcacccaggct

SEQ ID NO: 438317 - DNA, 25 bp, Mus musculus
gaatgactgggagagcacccaggct

SEQ ID NO: 438318 - DNA, 25 bp, Mus musculus
gaatgactgtgacactgtcatcctc

SEQ ID NO: 438319 - DNA, 25 bp, Mus musculus
gaatgactgtgagactgtcatcctc

SEQ ID NO: 438320 - DNA, 25 bp, Mus musculus
gaatgacttaaaactatgtggcttg

SEQ ID NO: 438321 - DNA, 25 bp, Mus musculus
gaatgacttaaatctatgtggcttg

SEQ ID NO: 438322 - DNA, 25 bp, Mus musculus
gaatgacttataacggcagatctct

SEQ ID NO: 438323 - DNA, 25 bp, Mus musculus
gaatgacttatatcggcagatctct

SEQ ID NO: 438324 - DNA, 25 bp, Mus musculus
gaatgacttcagacctaaggccagc

SEQ ID NO: 438325 - DNA, 25 bp, Mus musculus
gaatgacttcagtcctaaggccagc

SEQ ID NO: 438326 - DNA, 25 bp, Mus musculus
gaatgacttccacaggcttatctat

SEQ ID NO: 438327 - DNA, 25 bp, Mus musculus
gaatgacttccagaggcttatctat

SEQ ID NO: 438328 - DNA, 25 bp, Mus musculus
gaatgacttctacgtcagctggcct

SEQ ID NO: 438329 - DNA, 25 bp, Mus musculus
gaatgacttctaggtcagctggcct

SEQ ID NO: 438330 - DNA, 25 bp, Mus musculus
gaatgacttctgaccaacagtgcca

SEQ ID NO: 438331 - DNA, 25 bp, Mus musculus
gaatgacttctgtccaacagtgcca

SEQ ID NO: 438332 - DNA, 25 bp, Mus musculus
gaatgacttcttcctggtagcgtgt

SEQ ID NO: 438333 - DNA, 25 bp, Mus musculus
gaatgacttcttgctggtagcgtgt

SEQ ID NO: 438334 - DNA, 25 bp, Mus musculus
gaatgactttcacgtgttttcaact

SEQ ID NO: 438335 - DNA, 25 bp, Mus musculus
gaatgactttcaggtgttttcaact

SEQ ID NO: 438336 - DNA, 25 bp, Mus musculus
gaatgactttgaccattgcttgagt

SEQ ID NO: 438337 - DNA, 25 bp, Mus musculus
gaatgactttgagcattgcttgagt

SEQ ID NO: 438338 - DNA, 25 bp, Mus musculus
gaatgactttgtacaggagcctggc

SEQ ID NO: 438339 - DNA, 25 bp, Mus musculus
gaatgactttgttcaggagcctggc

SEQ ID NO: 438340 - DNA, 25 bp, Mus musculus
gaatgacttttgatgacggtgttaa

SEQ ID NO: 438341 - DNA, 25 bp, Mus musculus
gaatgacttttgttgacggtgttaa

SEQ ID NO: 438342 - DNA, 25 bp, Mus musculus
gaatgagaacctctgcattcctcag

SEQ ID NO: 438343 - DNA, 25 bp, Mus musculus
gaatgagaacctgtgcattcctcag

SEQ ID NO: 438344 - DNA, 25 bp, Mus musculus
gaatgagaatgtcctccacgggctc

SEQ ID NO: 438345 - DNA, 25 bp, Mus musculus
gaatgagaatgtgctccacgggctc

SEQ ID NO: 438346 - DNA, 25 bp, Mus musculus
gaatgagacctcctgtaatgtcgca

SEQ ID NO: 438347 - DNA, 25 bp, Mus musculus
gaatgagacctcgtgtaatgtcgca

SEQ ID NO: 438348 - DNA, 25 bp, Mus musculus
gaatgagactgtcggctttttcacc

SEQ ID NO: 438349 - DNA, 25 bp, Mus musculus
gaatgagactgtgggctttttcacc

SEQ ID NO: 438350 - DNA, 25 bp, Mus musculus
gaatgagacttacttcaacacaggt

SEQ ID NO: 438351 - DNA, 25 bp, Mus musculus
gaatgagacttagttcaacacaggt

SEQ ID NO: 438352 - DNA, 25 bp, Mus musculus
gaatgagagcacacatatgcgccag

SEQ ID NO: 438353 - DNA, 25 bp, Mus musculus
gaatgagagcactcatatgcgccag

SEQ ID NO: 438354 - DNA, 25 bp, Mus musculus
gaatgagagcatccaccttttgttt

SEQ ID NO: 438355 - DNA, 25 bp, Mus musculus
gaatgagagcatgcaccttttgttt

SEQ ID NO: 438356 - DNA, 25 bp, Mus musculus
gaatgagagccacctccacagagct

SEQ ID NO: 438357 - DNA, 25 bp, Mus musculus
gaatgagagccagctccacagagct

SEQ ID NO: 438358 - DNA, 25 bp, Mus musculus
gaatgagaggcacccatggaccaca

SEQ ID NO: 438359 - DNA, 25 bp, Mus musculus
gaatgagaggcagccatggaccaca

SEQ ID NO: 438360 - DNA, 25 bp, Mus musculus
gaatgagagggaacaacgtttgctg

SEQ ID NO: 438361 - DNA, 25 bp, Mus musculus
gaatgagagggatcaacgtttgctg

SEQ ID NO: 438362 - DNA, 25 bp, Mus musculus
gaatgagagggtaccttcctggcag

SEQ ID NO: 438363 - DNA, 25 bp, Mus musculus
gaatgagagggttccttcctggcag

SEQ ID NO: 438364 - DNA, 25 bp, Mus musculus
gaatgagataccatccaggagacca

SEQ ID NO: 438365 - DNA, 25 bp, Mus musculus
gaatgagataccttccaggagacca

SEQ ID NO: 438366 - DNA, 25 bp, Mus musculus
gaatgagatagaagcatcaccttcc

SEQ ID NO: 438367 - DNA, 25 bp, Mus musculus
gaatgagatagatgcatcaccttcc

SEQ ID NO: 438368 - DNA, 25 bp, Mus musculus
gaatgagatcatcgaaaccctgaaa

SEQ ID NO: 438369 - DNA, 25 bp, Mus musculus
gaatgagatcatggaaaccctgaaa

SEQ ID NO: 438370 - DNA, 25 bp, Mus musculus
gaatgagatcccatttatcagtttt

SEQ ID NO: 438371 - DNA, 25 bp, Mus musculus
gaatgagatcccttttatcagtttt

SEQ ID NO: 438372 - DNA, 25 bp, Mus musculus
gaatgagatctcagcgcggcacagt

SEQ ID NO: 438373 - DNA, 25 bp, Mus musculus
gaatgagatctctgcgcggcacagt

SEQ ID NO: 438374 - DNA, 25 bp, Mus musculus
gaatgagatcttcagcacttcctgc

SEQ ID NO: 438375 - DNA, 25 bp, Mus musculus
gaatgagatcttgagcacttcctgc

SEQ ID NO: 438376 - DNA, 25 bp, Mus musculus
gaatgagatgcgctgtgcttacgaa

SEQ ID NO: 438377 - DNA, 25 bp, Mus musculus
gaatgagatgcggtgtgcttacgaa

SEQ ID NO: 438378 - DNA, 25 bp, Mus musculus
gaatgagatggccacagcagcttca

SEQ ID NO: 438379 - DNA, 25 bp, Mus musculus
gaatgagatggcgacagcagcttca

SEQ ID NO: 438380 - DNA, 25 bp, Mus musculus
gaatgagattcccacacacgtttta

SEQ ID NO: 438381 - DNA, 25 bp, Mus musculus
gaatgagattccgacacacgtttta

SEQ ID NO: 438382 - DNA, 25 bp, Mus musculus
gaatgagattctatagccaaagcag

SEQ ID NO: 438383 - DNA, 25 bp, Mus musculus
gaatgagattctttagccaaagcag

SEQ ID NO: 438384 - DNA, 25 bp, Mus musculus
gaatgagattggatcggtttgtcaa

SEQ ID NO: 438385 - DNA, 25 bp, Mus musculus
gaatgagattggttcggtttgtcaa

SEQ ID NO: 438386 - DNA, 25 bp, Mus musculus
gaatgagcaactagacctgccttat

SEQ ID NO: 438387 - DNA, 25 bp, Mus musculus
gaatgagcaacttgacctgccttat

SEQ ID NO: 438388 - DNA, 25 bp, Mus musculus
gaatgagcaccactatcgttgatct

SEQ ID NO: 438389 - DNA, 25 bp, Mus musculus
gaatgagcaccagtatcgttgatct

SEQ ID NO: 438390 - DNA, 25 bp, Mus musculus
gaatgagcaccgaaggatccacacg

SEQ ID NO: 438391 - DNA, 25 bp, Mus musculus
gaatgagcaccgtaggatccacacg

SEQ ID NO: 438392 - DNA, 25 bp, Mus musculus
gaatgagcactcaaggactcttgca

SEQ ID NO: 438393 - DNA, 25 bp, Mus musculus
gaatgagcactctaggactcttgca

SEQ ID NO: 438394 - DNA, 25 bp, Mus musculus
gaatgagcactgaagtgcccctgac

SEQ ID NO: 438395 - DNA, 25 bp, Mus musculus
gaatgagcactgtagtgcccctgac

SEQ ID NO: 438396 - DNA, 25 bp, Mus musculus
gaatgagcatcactatgttgcctga

SEQ ID NO: 438397 - DNA, 25 bp, Mus musculus
gaatgagcatcagtatgttgcctga

SEQ ID NO: 438398 - DNA, 25 bp, Mus musculus
gaatgagcatgtcacccaatagtct

SEQ ID NO: 438399 - DNA, 25 bp, Mus musculus
gaatgagcatgtgacccaatagtct

SEQ ID NO: 438400 - DNA, 25 bp, Mus musculus
gaatgagccaaccatgaactaccat

SEQ ID NO: 438401 - DNA, 25 bp, Mus musculus
gaatgagccaacgatgaactaccat

SEQ ID NO: 438402 - DNA, 25 bp, Mus musculus
gaatgagcccggcaatccctttggc

SEQ ID NO: 438403 - DNA, 25 bp, Mus musculus
gaatgagcccgggaatccctttggc

SEQ ID NO: 438404 - DNA, 25 bp, Mus musculus
gaatgagccgccactcaaaggtggc

SEQ ID NO: 438405 - DNA, 25 bp, Mus musculus
gaatgagccgcctctcaaaggtggc

SEQ ID NO: 438406 - DNA, 25 bp, Mus musculus
gaatgagcctacatttgcagccagt

SEQ ID NO: 438407 - DNA, 25 bp, Mus musculus
gaatgagcctacttttgcagccagt

SEQ ID NO: 438408 - DNA, 25 bp, Mus musculus
gaatgagcctccaggcctttcccag

SEQ ID NO: 438409 - DNA, 25 bp, Mus musculus
gaatgagcctcctggcctttcccag

SEQ ID NO: 438410 - DNA, 25 bp, Mus musculus
gaatgagccttacagatatcatgta

SEQ ID NO: 438411 - DNA, 25 bp, Mus musculus
gaatgagccttagagatatcatgta

SEQ ID NO: 438412 - DNA, 25 bp, Mus musculus
gaatgagcgactcagcactaggcct

SEQ ID NO: 438413 - DNA, 25 bp, Mus musculus
gaatgagcgactgagcactaggcct

SEQ ID NO: 438414 - DNA, 25 bp, Mus musculus
gaatgagctattactatctaagatc

SEQ ID NO: 438415 - DNA, 25 bp, Mus musculus
gaatgagctatttctatctaagatc

SEQ ID NO: 438416 - DNA, 25 bp, Mus musculus
gaatgagctcatagaattataacaa

SEQ ID NO: 438417 - DNA, 25 bp, Mus musculus
gaatgagctcattgaattataacaa

SEQ ID NO: 438418 - DNA, 25 bp, Mus musculus
gaatgagctccacagtttatcaagt

SEQ ID NO: 438419 - DNA, 25 bp, Mus musculus
gaatgagctccagagtttatcaagt

SEQ ID NO: 438420 - DNA, 25 bp, Mus musculus
gaatgagctgctagagctgacctgt

SEQ ID NO: 438421 - DNA, 25 bp, Mus musculus
gaatgagctgctaggttggctttta

SEQ ID NO: 438422 - DNA, 25 bp, Mus musculus
gaatgagctgcttgagctgacctgt

SEQ ID NO: 438423 - DNA, 25 bp, Mus musculus
gaatgagctgcttggttggctttta

SEQ ID NO: 438424 - DNA, 25 bp, Mus musculus
gaatgagctggtctcaaaagcaatg

SEQ ID NO: 438425 - DNA, 25 bp, Mus musculus
gaatgagctggtgtcaaaagcaatg

SEQ ID NO: 438426 - DNA, 25 bp, Mus musculus
gaatgagcttagctcgttcacagat

SEQ ID NO: 438427 - DNA, 25 bp, Mus musculus
gaatgagcttaggtcgttcacagat

SEQ ID NO: 438428 - DNA, 25 bp, Mus musculus
gaatgaggaacgagacagcgagtaa

SEQ ID NO: 438429 - DNA, 25 bp, Mus musculus
gaatgaggaacgtgacagcgagtaa

SEQ ID NO: 438430 - DNA, 25 bp, Mus musculus
gaatgaggacttatttgatgcatga

SEQ ID NO: 438431 - DNA, 25 bp, Mus musculus
gaatgaggacttttttgatgcatga

SEQ ID NO: 438432 - DNA, 25 bp, Mus musculus
gaatgaggagacatagagcctttat

SEQ ID NO: 438433 - DNA, 25 bp, Mus musculus
gaatgaggagacttagagcctttat

SEQ ID NO: 438434 - DNA, 25 bp, Mus musculus
gaatgaggaggtactggagataaac

SEQ ID NO: 438435 - DNA, 25 bp, Mus musculus
gaatgaggaggttctggagataaac

SEQ ID NO: 438436 - DNA, 25 bp, Mus musculus
gaatgaggatatccacaggctggaa

SEQ ID NO: 438437 - DNA, 25 bp, Mus musculus
gaatgaggatatgcacaggctggaa

SEQ ID NO: 438438 - DNA, 25 bp, Mus musculus
gaatgaggcagcacttgagccttta

SEQ ID NO: 438439 - DNA, 25 bp, Mus musculus
gaatgaggcagctcttgagccttta

SEQ ID NO: 438440 - DNA, 25 bp, Mus musculus
gaatgaggccagatttcctgggcac

SEQ ID NO: 438441 - DNA, 25 bp, Mus musculus
gaatgaggccagttttcctgggcac

SEQ ID NO: 438442 - DNA, 25 bp, Mus musculus
gaatgaggcgtcatgccaacactgc

SEQ ID NO: 438443 - DNA, 25 bp, Mus musculus
gaatgaggcgtcttgccaacactgc

SEQ ID NO: 438444 - DNA, 25 bp, Mus musculus
gaatgaggctacatgccagctctaa

SEQ ID NO: 438445 - DNA, 25 bp, Mus musculus
gaatgaggctacttgccagctctaa

SEQ ID NO: 438446 - DNA, 25 bp, Mus musculus
gaatgaggctcaaagggactgcata

SEQ ID NO: 438447 - DNA, 25 bp, Mus musculus
gaatgaggctcatagggactgcata

SEQ ID NO: 438448 - DNA, 25 bp, Mus musculus
gaatgaggctgactgtgccaccgta

SEQ ID NO: 438449 - DNA, 25 bp, Mus musculus
gaatgaggctgagtgtgccaccgta

SEQ ID NO: 438450 - DNA, 25 bp, Mus musculus
gaatgaggcttgcagcatcctctgg

SEQ ID NO: 438451 - DNA, 25 bp, Mus musculus
gaatgaggcttggagcatcctctgg

SEQ ID NO: 438452 - DNA, 25 bp, Mus musculus
gaatgaggctttctcgtaaagtact

SEQ ID NO: 438453 - DNA, 25 bp, Mus musculus
gaatgaggctttgtcgtaaagtact

SEQ ID NO: 438454 - DNA, 25 bp, Mus musculus
gaatgagggatcaggaggtctccat

SEQ ID NO: 438455 - DNA, 25 bp, Mus musculus
gaatgagggatctggaggtctccat

SEQ ID NO: 438456 - DNA, 25 bp, Mus musculus
gaatgagggcacagtctgacgatac

SEQ ID NO: 438457 - DNA, 25 bp, Mus musculus
gaatgagggcactgtctgacgatac

SEQ ID NO: 438458 - DNA, 25 bp, Mus musculus
gaatgagggcttagcttctgtcctt

SEQ ID NO: 438459 - DNA, 25 bp, Mus musculus
gaatgagggctttgcttctgtcctt

SEQ ID NO: 438460 - DNA, 25 bp, Mus musculus
gaatgaggtaaaacttgtctaatat

SEQ ID NO: 438461 - DNA, 25 bp, Mus musculus
gaatgaggtaaatcttgtctaatat

SEQ ID NO: 438462 - DNA, 25 bp, Mus musculus
gaatgaggtagactatttgataact

SEQ ID NO: 438463 - DNA, 25 bp, Mus musculus
gaatgaggtagagtatttgataact

SEQ ID NO: 438464 - DNA, 25 bp, Mus musculus
gaatgaggtcatcctaactcctccc

SEQ ID NO: 438465 - DNA, 25 bp, Mus musculus
gaatgaggtcatgctaactcctccc

SEQ ID NO: 438466 - DNA, 25 bp, Mus musculus
gaatgaggtcttatgaacccttccc

SEQ ID NO: 438467 - DNA, 25 bp, Mus musculus
gaatgaggtcttcaccatagacgac

SEQ ID NO: 438468 - DNA, 25 bp, Mus musculus
gaatgaggtcttgaccatagacgac

SEQ ID NO: 438469 - DNA, 25 bp, Mus musculus
gaatgaggtcttttgaacccttccc

SEQ ID NO: 438470 - DNA, 25 bp, Mus musculus
gaatgaggtgatacctggctttttt

SEQ ID NO: 438471 - DNA, 25 bp, Mus musculus
gaatgaggtgatccaatccttttaa

SEQ ID NO: 438472 - DNA, 25 bp, Mus musculus
gaatgaggtgatgcaatccttttaa

SEQ ID NO: 438473 - DNA, 25 bp, Mus musculus
gaatgaggtgattcctggctttttt

SEQ ID NO: 438474 - DNA, 25 bp, Mus musculus
gaatgagtaattcccagtggtcttt

SEQ ID NO: 438475 - DNA, 25 bp, Mus musculus
gaatgagtaattgccagtggtcttt

SEQ ID NO: 438476 - DNA, 25 bp, Mus musculus
gaatgagtatgactcccgcagcctt

SEQ ID NO: 438477 - DNA, 25 bp, Mus musculus
gaatgagtatgagtcccgcagcctt

SEQ ID NO: 438478 - DNA, 25 bp, Mus musculus
gaatgagtcacaaacttttcaggta

SEQ ID NO: 438479 - DNA, 25 bp, Mus musculus
gaatgagtcacatacttttcaggta

SEQ ID NO: 438480 - DNA, 25 bp, Mus musculus
gaatgagtccagcatctttcacatc

SEQ ID NO: 438481 - DNA, 25 bp, Mus musculus
gaatgagtccaggatctttcacatc

SEQ ID NO: 438482 - DNA, 25 bp, Mus musculus
gaatgagtcgctactctacgctgag

SEQ ID NO: 438483 - DNA, 25 bp, Mus musculus
gaatgagtcgcttctctacgctgag

SEQ ID NO: 438484 - DNA, 25 bp, Mus musculus
gaatgagtgaccaccttaaaggtat

SEQ ID NO: 438485 - DNA, 25 bp, Mus musculus
gaatgagtgacctccttaaaggtat

SEQ ID NO: 438486 - DNA, 25 bp, Mus musculus
gaatgagtgactaaccttctgcttg

SEQ ID NO: 438487 - DNA, 25 bp, Mus musculus
gaatgagtgactctcatgctatagc

SEQ ID NO: 438488 - DNA, 25 bp, Mus musculus
gaatgagtgactgtcatgctatagc

SEQ ID NO: 438489 - DNA, 25 bp, Mus musculus
gaatgagtgacttaccttctgcttg

SEQ ID NO: 438490 - DNA, 25 bp, Mus musculus
gaatgagtggatctagactagactt

SEQ ID NO: 438491 - DNA, 25 bp, Mus musculus
gaatgagtggatgtagactagactt

SEQ ID NO: 438492 - DNA, 25 bp, Mus musculus
gaatgagtgtctaggcaggacctgt

SEQ ID NO: 438493 - DNA, 25 bp, Mus musculus
gaatgagtgtcttggcaggacctgt

SEQ ID NO: 438494 - DNA, 25 bp, Mus musculus
gaatgagttcagagtccagaaccta

SEQ ID NO: 438495 - DNA, 25 bp, Mus musculus
gaatgagttcagtgtccagaaccta

SEQ ID NO: 438496 - DNA, 25 bp, Mus musculus
gaatgagttcttctctggtaaaatt

SEQ ID NO: 438497 - DNA, 25 bp, Mus musculus
gaatgagttcttgtctggtaaaatt

SEQ ID NO: 438498 - DNA, 25 bp, Mus musculus
gaatgagttgttatgagttggttat

SEQ ID NO: 438499 - DNA, 25 bp, Mus musculus
gaatgagttgttttgagttggttat

SEQ ID NO: 438500 - DNA, 25 bp, Mus musculus
gaatgataacaaaaccaaggacaag

SEQ ID NO: 438501 - DNA, 25 bp, Mus musculus
gaatgataacaataccaaggacaag

SEQ ID NO: 438502 - DNA, 25 bp, Mus musculus
gaatgatacaaaccctagttacagg

SEQ ID NO: 438503 - DNA, 25 bp, Mus musculus
gaatgatacaaagcctagttacagg

SEQ ID NO: 438504 - DNA, 25 bp, Mus musculus
gaatgatacataactggcctgctga

SEQ ID NO: 438505 - DNA, 25 bp, Mus musculus
gaatgatacatatctggcctgctga

SEQ ID NO: 438506 - DNA, 25 bp, Mus musculus
gaatgatacttcctaccacgtgttc

SEQ ID NO: 438507 - DNA, 25 bp, Mus musculus
gaatgatacttcgtaccacgtgttc

SEQ ID NO: 438508 - DNA, 25 bp, Mus musculus
gaatgatagactcttcaccaaacca

SEQ ID NO: 438509 - DNA, 25 bp, Mus musculus
gaatgatagactgttcaccaaacca

SEQ ID NO: 438510 - DNA, 25 bp, Mus musculus
gaatgatagatcacagagcagctga

SEQ ID NO: 438511 - DNA, 25 bp, Mus musculus
gaatgatagatctcagagcagctga

SEQ ID NO: 438512 - DNA, 25 bp, Mus musculus
gaatgatagccaagctctcggcagc

SEQ ID NO: 438513 - DNA, 25 bp, Mus musculus
gaatgatagccatgctctcggcagc

SEQ ID NO: 438514 - DNA, 25 bp, Mus musculus
gaatgatagggacaacagacctcct

SEQ ID NO: 438515 - DNA, 25 bp, Mus musculus
gaatgatagggagaacagacctcct

SEQ ID NO: 438516 - DNA, 25 bp, Mus musculus
gaatgatatagtcgtgttcctcacc

SEQ ID NO: 438517 - DNA, 25 bp, Mus musculus
gaatgatatagtggtgttcctcacc

SEQ ID NO: 438518 - DNA, 25 bp, Mus musculus
gaatgatatgatacactgtggctct

SEQ ID NO: 438519 - DNA, 25 bp, Mus musculus
gaatgatatgattcactgtggctct

SEQ ID NO: 438520 - DNA, 25 bp, Mus musculus
gaatgatattccattgtcacagcct

SEQ ID NO: 438521 - DNA, 25 bp, Mus musculus
gaatgatattcctttgtcacagcct

SEQ ID NO: 438522 - DNA, 25 bp, Mus musculus
gaatgatatttgacccgaaccttta

SEQ ID NO: 438523 - DNA, 25 bp, Mus musculus
gaatgatatttgtcccgaaccttta

SEQ ID NO: 438524 - DNA, 25 bp, Mus musculus
gaatgatcaggcctttagagcgatg

SEQ ID NO: 438525 - DNA, 25 bp, Mus musculus
gaatgatcaggcgtttagagcgatg

SEQ ID NO: 438526 - DNA, 25 bp, Mus musculus
gaatgatcatctaggaaggattcca

SEQ ID NO: 438527 - DNA, 25 bp, Mus musculus
gaatgatcatcttggaaggattcca

SEQ ID NO: 438528 - DNA, 25 bp, Mus musculus
gaatgatccattacagcctttccca

SEQ ID NO: 438529 - DNA, 25 bp, Mus musculus
gaatgatccatttcagcctttccca

SEQ ID NO: 438530 - DNA, 25 bp, Mus musculus
gaatgatcccatatcaggaatacta

SEQ ID NO: 438531 - DNA, 25 bp, Mus musculus
gaatgatcccatttcaggaatacta

SEQ ID NO: 438532 - DNA, 25 bp, Mus musculus
gaatgatccccaaggtagttgctaa

SEQ ID NO: 438533 - DNA, 25 bp, Mus musculus
gaatgatccccatggtagttgctaa

SEQ ID NO: 438534 - DNA, 25 bp, Mus musculus
gaatgatccctgagtcttaggtaca

SEQ ID NO: 438535 - DNA, 25 bp, Mus musculus
gaatgatccctgtgtcttaggtaca

SEQ ID NO: 438536 - DNA, 25 bp, Mus musculus
gaatgatccgagatcctttggcttc

SEQ ID NO: 438537 - DNA, 25 bp, Mus musculus
gaatgatccgagttcctttggcttc

SEQ ID NO: 438538 - DNA, 25 bp, Mus musculus
gaatgatccgcaccatcctttgggt

SEQ ID NO: 438539 - DNA, 25 bp, Mus musculus
gaatgatccgcagcatcctttgggt

SEQ ID NO: 438540 - DNA, 25 bp, Mus musculus
gaatgatcgaaaagacctgccagtt

SEQ ID NO: 438541 - DNA, 25 bp, Mus musculus
gaatgatcgaaatgacctgccagtt

SEQ ID NO: 438542 - DNA, 25 bp, Mus musculus
gaatgatcggcccttggaactgttc

SEQ ID NO: 438543 - DNA, 25 bp, Mus musculus
gaatgatcggccgttggaactgttc

SEQ ID NO: 438544 - DNA, 25 bp, Mus musculus
gaatgatcgtggctccaggccagtc

SEQ ID NO: 438545 - DNA, 25 bp, Mus musculus
gaatgatcgtgggtccaggccagtc

SEQ ID NO: 438546 - DNA, 25 bp, Mus musculus
gaatgatcgtgtattattcttaata

SEQ ID NO: 438547 - DNA, 25 bp, Mus musculus
gaatgatcgtgttttattcttaata

SEQ ID NO: 438548 - DNA, 25 bp, Mus musculus
gaatgatctgctaaacgtctgtgca

SEQ ID NO: 438549 - DNA, 25 bp, Mus musculus
gaatgatctgctctggtcaaatcct

SEQ ID NO: 438550 - DNA, 25 bp, Mus musculus
gaatgatctgctgtggtcaaatcct

SEQ ID NO: 438551 - DNA, 25 bp, Mus musculus
gaatgatctgcttaacgtctgtgca

SEQ ID NO: 438552 - DNA, 25 bp, Mus musculus
gaatgatctgtcacagagtcctcaa

SEQ ID NO: 438553 - DNA, 25 bp, Mus musculus
gaatgatctgtcattcttcctgtca

SEQ ID NO: 438554 - DNA, 25 bp, Mus musculus
gaatgatctgtctcagagtcctcaa

SEQ ID NO: 438555 - DNA, 25 bp, Mus musculus
gaatgatctgtctttcttcctgtca

SEQ ID NO: 438556 - DNA, 25 bp, Mus musculus
gaatgatcttgcactggactgttgt

SEQ ID NO: 438557 - DNA, 25 bp, Mus musculus
gaatgatcttgctctggactgttgt

SEQ ID NO: 438558 - DNA, 25 bp, Mus musculus
gaatgatgacacagccgacagggac

SEQ ID NO: 438559 - DNA, 25 bp, Mus musculus
gaatgatgacacctctcaaaccaac

SEQ ID NO: 438560 - DNA, 25 bp, Mus musculus
gaatgatgacacgtctcaaaccaac

SEQ ID NO: 438561 - DNA, 25 bp, Mus musculus
gaatgatgacactgccgacagggac

SEQ ID NO: 438562 - DNA, 25 bp, Mus musculus
gaatgatgacatcccgcaacctaag

SEQ ID NO: 438563 - DNA, 25 bp, Mus musculus
gaatgatgacatgccgcaacctaag

SEQ ID NO: 438564 - DNA, 25 bp, Mus musculus
gaatgatgaccacggaactatttac

SEQ ID NO: 438565 - DNA, 25 bp, Mus musculus
gaatgatgaccagggaactatttac

SEQ ID NO: 438566 - DNA, 25 bp, Mus musculus
gaatgatgaccgaataccctggaga

SEQ ID NO: 438567 - DNA, 25 bp, Mus musculus
gaatgatgaccgtataccctggaga

SEQ ID NO: 438568 - DNA, 25 bp, Mus musculus
gaatgatgacgaagattcccctcat

SEQ ID NO: 438569 - DNA, 25 bp, Mus musculus
gaatgatgacgatgattcccctcat

SEQ ID NO: 438570 - DNA, 25 bp, Mus musculus
gaatgatgatgcactttgttacaca

SEQ ID NO: 438571 - DNA, 25 bp, Mus musculus
gaatgatgatgcaggaatcctatcc

SEQ ID NO: 438572 - DNA, 25 bp, Mus musculus
gaatgatgatgctctttgttacaca

SEQ ID NO: 438573 - DNA, 25 bp, Mus musculus
gaatgatgatgctggaatcctatcc

SEQ ID NO: 438574 - DNA, 25 bp, Mus musculus
gaatgatgcaaacccttgaggacga

SEQ ID NO: 438575 - DNA, 25 bp, Mus musculus
gaatgatgcaaagccttgaggacga

SEQ ID NO: 438576 - DNA, 25 bp, Mus musculus
gaatgatgcaacaatgagccttgaa

SEQ ID NO: 438577 - DNA, 25 bp, Mus musculus
gaatgatgcaactatgagccttgaa

SEQ ID NO: 438578 - DNA, 25 bp, Mus musculus
gaatgatgcaccatgtaccaatgag

SEQ ID NO: 438579 - DNA, 25 bp, Mus musculus
gaatgatgcaccttgtaccaatgag

SEQ ID NO: 438580 - DNA, 25 bp, Mus musculus
gaatgatgcattacgtcctttttaa

SEQ ID NO: 438581 - DNA, 25 bp, Mus musculus
gaatgatgcatttcgtcctttttaa

SEQ ID NO: 438582 - DNA, 25 bp, Mus musculus
gaatgatgccatacatgaagttgtt

SEQ ID NO: 438583 - DNA, 25 bp, Mus musculus
gaatgatgccattcatgaagttgtt

SEQ ID NO: 438584 - DNA, 25 bp, Mus musculus
gaatgatgcgctcattatagccaaa

SEQ ID NO: 438585 - DNA, 25 bp, Mus musculus
gaatgatgcgctgattatagccaaa

SEQ ID NO: 438586 - DNA, 25 bp, Mus musculus
gaatgatgctggcttcactttgtcc

SEQ ID NO: 438587 - DNA, 25 bp, Mus musculus
gaatgatgctgggttcactttgtcc

SEQ ID NO: 438588 - DNA, 25 bp, Mus musculus
gaatgatggagcccagtctacccct

SEQ ID NO: 438589 - DNA, 25 bp, Mus musculus
gaatgatggagcgcagtctacccct

SEQ ID NO: 438590 - DNA, 25 bp, Mus musculus
gaatgatggatacagcagggacaat

SEQ ID NO: 438591 - DNA, 25 bp, Mus musculus
gaatgatggatagagcagggacaat

SEQ ID NO: 438592 - DNA, 25 bp, Mus musculus
gaatgatggcccagtcagccgagag

SEQ ID NO: 438593 - DNA, 25 bp, Mus musculus
gaatgatggccctgtcagccgagag

SEQ ID NO: 438594 - DNA, 25 bp, Mus musculus
gaatgatgtagtatccccaaagcat

SEQ ID NO: 438595 - DNA, 25 bp, Mus musculus
gaatgatgtagtttccccaaagcat

SEQ ID NO: 438596 - DNA, 25 bp, Mus musculus
gaatgatgtattcaccatcctcagt

SEQ ID NO: 438597 - DNA, 25 bp, Mus musculus
gaatgatgtattgaccatcctcagt

SEQ ID NO: 438598 - DNA, 25 bp, Mus musculus
gaatgatgtcaaccttcttgtcctc

SEQ ID NO: 438599 - DNA, 25 bp, Mus musculus
gaatgatgtcaagcttcttgtcctc

SEQ ID NO: 438600 - DNA, 25 bp, Mus musculus
gaatgatgtcgtcgcggaaccctgc

SEQ ID NO: 438601 - DNA, 25 bp, Mus musculus
gaatgatgtcgtggcggaaccctgc

SEQ ID NO: 438602 - DNA, 25 bp, Mus musculus
gaatgatgtctccaagcctttacag

SEQ ID NO: 438603 - DNA, 25 bp, Mus musculus
gaatgatgtctcgaagcctttacag

SEQ ID NO: 438604 - DNA, 25 bp, Mus musculus
gaatgatgtcttcaagggttccttg

SEQ ID NO: 438605 - DNA, 25 bp, Mus musculus
gaatgatgtcttgaagggttccttg

SEQ ID NO: 438606 - DNA, 25 bp, Mus musculus
gaatgatgtgcaacactccgtgcgc

SEQ ID NO: 438607 - DNA, 25 bp, Mus musculus
gaatgatgtgcatcactccgtgcgc

SEQ ID NO: 438608 - DNA, 25 bp, Mus musculus
gaatgatgtgttcaagttattacca

SEQ ID NO: 438609 - DNA, 25 bp, Mus musculus
gaatgatgtgttgaagttattacca

SEQ ID NO: 438610 - DNA, 25 bp, Mus musculus
gaatgatgttctctctctgtctagt

SEQ ID NO: 438611 - DNA, 25 bp, Mus musculus
gaatgatgttctgtctctgtctagt

SEQ ID NO: 438612 - DNA, 25 bp, Mus musculus
gaatgatgttgccttccactttaac

SEQ ID NO: 438613 - DNA, 25 bp, Mus musculus
gaatgatgttgcgttccactttaac

SEQ ID NO: 438614 - DNA, 25 bp, Mus musculus
gaatgatgttgtacgggttctcccc

SEQ ID NO: 438615 - DNA, 25 bp, Mus musculus
gaatgatgttgttcgggttctcccc

SEQ ID NO: 438616 - DNA, 25 bp, Mus musculus
gaatgattagggaacctccctgtat

SEQ ID NO: 438617 - DNA, 25 bp, Mus musculus
gaatgattagggtacctccctgtat

SEQ ID NO: 438618 - DNA, 25 bp, Mus musculus
gaatgattattgctttctgcttaaa

SEQ ID NO: 438619 - DNA, 25 bp, Mus musculus
gaatgattattggtttctgcttaaa

SEQ ID NO: 438620 - DNA, 25 bp, Mus musculus
gaatgattatttcggccctcgaaga

SEQ ID NO: 438621 - DNA, 25 bp, Mus musculus
gaatgattatttgggccctcgaaga

SEQ ID NO: 438622 - DNA, 25 bp, Mus musculus
gaatgattcactagcctacaatagt

SEQ ID NO: 438623 - DNA, 25 bp, Mus musculus
gaatgattcacttgcctacaatagt

SEQ ID NO: 438624 - DNA, 25 bp, Mus musculus
gaatgattccatacccattagagaa

SEQ ID NO: 438625 - DNA, 25 bp, Mus musculus
gaatgattccattcccattagagaa

SEQ ID NO: 438626 - DNA, 25 bp, Mus musculus
gaatgattctagcaccatctctctg

SEQ ID NO: 438627 - DNA, 25 bp, Mus musculus
gaatgattctaggaccatctctctg

SEQ ID NO: 438628 - DNA, 25 bp, Mus musculus
gaatgattcttacccaacacaaatg

SEQ ID NO: 438629 - DNA, 25 bp, Mus musculus
gaatgattcttagccaacacaaatg

SEQ ID NO: 438630 - DNA, 25 bp, Mus musculus
gaatgattgacaacagtccccttta

SEQ ID NO: 438631 - DNA, 25 bp, Mus musculus
gaatgattgacatcagtccccttta

SEQ ID NO: 438632 - DNA, 25 bp, Mus musculus
gaatgattgattctgtggccctttt

SEQ ID NO: 438633 - DNA, 25 bp, Mus musculus
gaatgattgattgtgtggccctttt

SEQ ID NO: 438634 - DNA, 25 bp, Mus musculus
gaatgattgcttcttggttgagaca

SEQ ID NO: 438635 - DNA, 25 bp, Mus musculus
gaatgattgcttgttggttgagaca

SEQ ID NO: 438636 - DNA, 25 bp, Mus musculus
gaatgattggatagtggccccaccc

SEQ ID NO: 438637 - DNA, 25 bp, Mus musculus
gaatgattggattgtggccccaccc

SEQ ID NO: 438638 - DNA, 25 bp, Mus musculus
gaatgattgtatagtctcctcccat

SEQ ID NO: 438639 - DNA, 25 bp, Mus musculus
gaatgattgtattgtctcctcccat

SEQ ID NO: 438640 - DNA, 25 bp, Mus musculus
gaatgatttactcatgcaaccaagg

SEQ ID NO: 438641 - DNA, 25 bp, Mus musculus
gaatgatttactgatgcaaccaagg

SEQ ID NO: 438642 - DNA, 25 bp, Mus musculus
gaatgatttagcattaacagtttgt

SEQ ID NO: 438643 - DNA, 25 bp, Mus musculus
gaatgatttagctttaacagtttgt

SEQ ID NO: 438644 - DNA, 25 bp, Mus musculus
gaatgatttatcctgagatctttga

SEQ ID NO: 438645 - DNA, 25 bp, Mus musculus
gaatgatttatcgtgagatctttga

SEQ ID NO: 438646 - DNA, 25 bp, Mus musculus
gaatgatttgagcatccctaagaat

SEQ ID NO: 438647 - DNA, 25 bp, Mus musculus
gaatgatttgaggatccctaagaat

SEQ ID NO: 438648 - DNA, 25 bp, Mus musculus
gaatgatttgctattgacaggataa

SEQ ID NO: 438649 - DNA, 25 bp, Mus musculus
gaatgatttgcttttgacaggataa

SEQ ID NO: 438650 - DNA, 25 bp, Mus musculus
gaatgattttaaccaacaggagaag

SEQ ID NO: 438651 - DNA, 25 bp, Mus musculus
gaatgattttaagcaacaggagaag

SEQ ID NO: 438652 - DNA, 25 bp, Mus musculus
gaatgattttggaggttgctttggt

SEQ ID NO: 438653 - DNA, 25 bp, Mus musculus
gaatgattttggtggttgctttggt

SEQ ID NO: 438654 - DNA, 25 bp, Mus musculus
gaatgcaaacggcactttatccaag

SEQ ID NO: 438655 - DNA, 25 bp, Mus musculus
gaatgcaaacgggactttatccaag

SEQ ID NO: 438656 - DNA, 25 bp, Mus musculus
gaatgcaaagacctgaggtaaacac

SEQ ID NO: 438657 - DNA, 25 bp, Mus musculus
gaatgcaaagacgtgaggtaaacac

SEQ ID NO: 438658 - DNA, 25 bp, Mus musculus
gaatgcaaagcaccccagaaggagg

SEQ ID NO: 438659 - DNA, 25 bp, Mus musculus
gaatgcaaagcagcccagaaggagg

SEQ ID NO: 438660 - DNA, 25 bp, Mus musculus
gaatgcaacatgaccagcatccagt

SEQ ID NO: 438661 - DNA, 25 bp, Mus musculus
gaatgcaacatgtccagcatccagt

SEQ ID NO: 438662 - DNA, 25 bp, Mus musculus
gaatgcaacctgcagtgtgtgcctg

SEQ ID NO: 438663 - DNA, 25 bp, Mus musculus
gaatgcaacctggagtgtgtgcctg

SEQ ID NO: 438664 - DNA, 25 bp, Mus musculus
gaatgcaactgacagggtcttcctg

SEQ ID NO: 438665 - DNA, 25 bp, Mus musculus
gaatgcaactgagagggtcttcctg

SEQ ID NO: 438666 - DNA, 25 bp, Mus musculus
gaatgcaacttcacacatggaacaa

SEQ ID NO: 438667 - DNA, 25 bp, Mus musculus
gaatgcaacttctcacatggaacaa

SEQ ID NO: 438668 - DNA, 25 bp, Mus musculus
gaatgcaagaaacctttccaccaga

SEQ ID NO: 438669 - DNA, 25 bp, Mus musculus
gaatgcaagaaagctttccaccaga

SEQ ID NO: 438670 - DNA, 25 bp, Mus musculus
gaatgcaagacacctacaaacttct

SEQ ID NO: 438671 - DNA, 25 bp, Mus musculus
gaatgcaagacagctacaaacttct

SEQ ID NO: 438672 - DNA, 25 bp, Mus musculus
gaatgcaagaccagtcctcagaact

SEQ ID NO: 438673 - DNA, 25 bp, Mus musculus
gaatgcaagacctgtcctcagaact

SEQ ID NO: 438674 - DNA, 25 bp, Mus musculus
gaatgcaagatcatctaaaccccaa

SEQ ID NO: 438675 - DNA, 25 bp, Mus musculus
gaatgcaagatcttctaaaccccaa

SEQ ID NO: 438676 - DNA, 25 bp, Mus musculus
gaatgcaagatgacctggtccgggc

SEQ ID NO: 438677 - DNA, 25 bp, Mus musculus
gaatgcaagatgtcctggtccgggc

SEQ ID NO: 438678 - DNA, 25 bp, Mus musculus
gaatgcaagcatacacatgcactag

SEQ ID NO: 438679 - DNA, 25 bp, Mus musculus
gaatgcaagcattcacatgcactag

SEQ ID NO: 438680 - DNA, 25 bp, Mus musculus
gaatgcaaggaaataggatgtactc

SEQ ID NO: 438681 - DNA, 25 bp, Mus musculus
gaatgcaaggaattaggatgtactc

SEQ ID NO: 438682 - DNA, 25 bp, Mus musculus
gaatgcaataccctctttttgtata

SEQ ID NO: 438683 - DNA, 25 bp, Mus musculus
gaatgcaataccgtctttttgtata

SEQ ID NO: 438684 - DNA, 25 bp, Mus musculus
gaatgcaatcttaatttgcctgtgt

SEQ ID NO: 438685 - DNA, 25 bp, Mus musculus
gaatgcaatctttatttgcctgtgt

SEQ ID NO: 438686 - DNA, 25 bp, Mus musculus
gaatgcaattagctcgtcacgtcat

SEQ ID NO: 438687 - DNA, 25 bp, Mus musculus
gaatgcaattaggtcgtcacgtcat

SEQ ID NO: 438688 - DNA, 25 bp, Mus musculus
gaatgcaattgtagtccttgtccct

SEQ ID NO: 438689 - DNA, 25 bp, Mus musculus
gaatgcaattgttgtccttgtccct

SEQ ID NO: 438690 - DNA, 25 bp, Mus musculus
gaatgcacaacgattgctctgtttt

SEQ ID NO: 438691 - DNA, 25 bp, Mus musculus
gaatgcacaacgtttgctctgtttt

SEQ ID NO: 438692 - DNA, 25 bp, Mus musculus
gaatgcacacccagccccttgaggg

SEQ ID NO: 438693 - DNA, 25 bp, Mus musculus
gaatgcacaccctgccccttgaggg

SEQ ID NO: 438694 - DNA, 25 bp, Mus musculus
gaatgcacaccgctcgctgaacgtg

SEQ ID NO: 438695 - DNA, 25 bp, Mus musculus
gaatgcacaccggtcgctgaacgtg

SEQ ID NO: 438696 - DNA, 25 bp, Mus musculus
gaatgcacacctctgttttccaagg

SEQ ID NO: 438697 - DNA, 25 bp, Mus musculus
gaatgcacacctgtgttttccaagg

SEQ ID NO: 438698 - DNA, 25 bp, Mus musculus
gaatgcacacgcacattggttagca

SEQ ID NO: 438699 - DNA, 25 bp, Mus musculus
gaatgcacacgctcattggttagca

SEQ ID NO: 438700 - DNA, 25 bp, Mus musculus
gaatgcacactaaacacaattttgt

SEQ ID NO: 438701 - DNA, 25 bp, Mus musculus
gaatgcacactatacacaattttgt

SEQ ID NO: 438702 - DNA, 25 bp, Mus musculus
gaatgcacagacagacccttgacac

SEQ ID NO: 438703 - DNA, 25 bp, Mus musculus
gaatgcacagacagctgcaaaggct

SEQ ID NO: 438704 - DNA, 25 bp, Mus musculus
gaatgcacagactgacccttgacac

SEQ ID NO: 438705 - DNA, 25 bp, Mus musculus
gaatgcacagactgctgcaaaggct

SEQ ID NO: 438706 - DNA, 25 bp, Mus musculus
gaatgcacagcacacaagaccaacc

SEQ ID NO: 438707 - DNA, 25 bp, Mus musculus
gaatgcacagcagacaagaccaacc

SEQ ID NO: 438708 - DNA, 25 bp, Mus musculus
gaatgcacatcccttactcataaat

SEQ ID NO: 438709 - DNA, 25 bp, Mus musculus
gaatgcacatccgttactcataaat

SEQ ID NO: 438710 - DNA, 25 bp, Mus musculus
gaatgcacatttagaagctgtccag

SEQ ID NO: 438711 - DNA, 25 bp, Mus musculus
gaatgcacatttagatacttttgga

SEQ ID NO: 438712 - DNA, 25 bp, Mus musculus
gaatgcacattttgaagctgtccag

SEQ ID NO: 438713 - DNA, 25 bp, Mus musculus
gaatgcacattttgatacttttgga

SEQ ID NO: 438714 - DNA, 25 bp, Mus musculus
gaatgcaccaacatccttaatcagt

SEQ ID NO: 438715 - DNA, 25 bp, Mus musculus
gaatgcaccaacttccttaatcagt

SEQ ID NO: 438716 - DNA, 25 bp, Mus musculus
gaatgcaccaggatttataatagtg

SEQ ID NO: 438717 - DNA, 25 bp, Mus musculus
gaatgcaccaggttttataatagtg

SEQ ID NO: 438718 - DNA, 25 bp, Mus musculus
gaatgcaccataattgctgtatgaa

SEQ ID NO: 438719 - DNA, 25 bp, Mus musculus
gaatgcaccatatttgctgtatgaa

SEQ ID NO: 438720 - DNA, 25 bp, Mus musculus
gaatgcaccgtgacttttaagtctg

SEQ ID NO: 438721 - DNA, 25 bp, Mus musculus
gaatgcaccgtgtcttttaagtctg

SEQ ID NO: 438722 - DNA, 25 bp, Mus musculus
gaatgcacctccattggtccagtgg

SEQ ID NO: 438723 - DNA, 25 bp, Mus musculus
gaatgcacctcctttggtccagtgg

SEQ ID NO: 438724 - DNA, 25 bp, Mus musculus
gaatgcacgagaccttctgaacacc

SEQ ID NO: 438725 - DNA, 25 bp, Mus musculus
gaatgcacgagagcttctgaacacc

SEQ ID NO: 438726 - DNA, 25 bp, Mus musculus
gaatgcactattactgacacccggc

SEQ ID NO: 438727 - DNA, 25 bp, Mus musculus
gaatgcactattcagagacccctat

SEQ ID NO: 438728 - DNA, 25 bp, Mus musculus
gaatgcactattgagagacccctat

SEQ ID NO: 438729 - DNA, 25 bp, Mus musculus
gaatgcactatttctgacacccggc

SEQ ID NO: 438730 - DNA, 25 bp, Mus musculus
gaatgcactcttcgagtctctcctt

SEQ ID NO: 438731 - DNA, 25 bp, Mus musculus
gaatgcactcttggagtctctcctt

SEQ ID NO: 438732 - DNA, 25 bp, Mus musculus
gaatgcactgagacctctggtgtca

SEQ ID NO: 438733 - DNA, 25 bp, Mus musculus
gaatgcactgagtcctctggtgtca

SEQ ID NO: 438734 - DNA, 25 bp, Mus musculus
gaatgcactggacgcaccttgggaa

SEQ ID NO: 438735 - DNA, 25 bp, Mus musculus
gaatgcactggaggcaccttgggaa

SEQ ID NO: 438736 - DNA, 25 bp, Mus musculus
gaatgcacttgacataggctcttta

SEQ ID NO: 438737 - DNA, 25 bp, Mus musculus
gaatgcacttgagataggctcttta

SEQ ID NO: 438738 - DNA, 25 bp, Mus musculus
gaatgcactttaaatgagagcccat

SEQ ID NO: 438739 - DNA, 25 bp, Mus musculus
gaatgcactttatatgagagcccat

SEQ ID NO: 438740 - DNA, 25 bp, Mus musculus
gaatgcactttcagcttgcaatgcc

SEQ ID NO: 438741 - DNA, 25 bp, Mus musculus
gaatgcactttctgcttgcaatgcc

SEQ ID NO: 438742 - DNA, 25 bp, Mus musculus
gaatgcagaagacttgcagccatat

SEQ ID NO: 438743 - DNA, 25 bp, Mus musculus
gaatgcagaagagttgcagccatat

SEQ ID NO: 438744 - DNA, 25 bp, Mus musculus
gaatgcagacaactgactctagatg

SEQ ID NO: 438745 - DNA, 25 bp, Mus musculus
gaatgcagacaagtgactctagatg

SEQ ID NO: 438746 - DNA, 25 bp, Mus musculus
gaatgcagaggcaagcaggaaacta

SEQ ID NO: 438747 - DNA, 25 bp, Mus musculus
gaatgcagaggctagcaggaaacta

SEQ ID NO: 438748 - DNA, 25 bp, Mus musculus
gaatgcagcaagcagggctcacact

SEQ ID NO: 438749 - DNA, 25 bp, Mus musculus
gaatgcagcaaggagggctcacact

SEQ ID NO: 438750 - DNA, 25 bp, Mus musculus
gaatgcagcagacccttaggcttgg

SEQ ID NO: 438751 - DNA, 25 bp, Mus musculus
gaatgcagcagactggcgtctttct

SEQ ID NO: 438752 - DNA, 25 bp, Mus musculus
gaatgcagcagagccttaggcttgg

SEQ ID NO: 438753 - DNA, 25 bp, Mus musculus
gaatgcagcagagtggcgtctttct

SEQ ID NO: 438754 - DNA, 25 bp, Mus musculus
gaatgcagcaggagtgtgattttca

SEQ ID NO: 438755 - DNA, 25 bp, Mus musculus
gaatgcagcaggctctatctcagag

SEQ ID NO: 438756 - DNA, 25 bp, Mus musculus
gaatgcagcagggtctatctcagag

SEQ ID NO: 438757 - DNA, 25 bp, Mus musculus
gaatgcagcaggtgtgtgattttca

SEQ ID NO: 438758 - DNA, 25 bp, Mus musculus
gaatgcagcagtctactcttgaagt

SEQ ID NO: 438759 - DNA, 25 bp, Mus musculus
gaatgcagcagtgtactcttgaagt

SEQ ID NO: 438760 - DNA, 25 bp, Mus musculus
gaatgcagcatacctctctaggaaa

SEQ ID NO: 438761 - DNA, 25 bp, Mus musculus
gaatgcagcatagctctctaggaaa

SEQ ID NO: 438762 - DNA, 25 bp, Mus musculus
gaatgcagcatccaggtaattaact

SEQ ID NO: 438763 - DNA, 25 bp, Mus musculus
gaatgcagcatcgaggtaattaact

SEQ ID NO: 438764 - DNA, 25 bp, Mus musculus
gaatgcagccacatgttgcaaggac

SEQ ID NO: 438765 - DNA, 25 bp, Mus musculus
gaatgcagccacttgttgcaaggac

SEQ ID NO: 438766 - DNA, 25 bp, Mus musculus
gaatgcagccttagagatgacgtta

SEQ ID NO: 438767 - DNA, 25 bp, Mus musculus
gaatgcagccttcgtgatgagatta

SEQ ID NO: 438768 - DNA, 25 bp, Mus musculus
gaatgcagccttggtgatgagatta

SEQ ID NO: 438769 - DNA, 25 bp, Mus musculus
gaatgcagcctttgagatgacgtta

SEQ ID NO: 438770 - DNA, 25 bp, Mus musculus
gaatgcagcgacacatctcagcttt

SEQ ID NO: 438771 - DNA, 25 bp, Mus musculus
gaatgcagcgactcatctcagcttt

SEQ ID NO: 438772 - DNA, 25 bp, Mus musculus
gaatgcagcgatactcctaaaacat

SEQ ID NO: 438773 - DNA, 25 bp, Mus musculus
gaatgcagcgattctcctaaaacat

SEQ ID NO: 438774 - DNA, 25 bp, Mus musculus
gaatgcagcgtgactcttaggtgat

SEQ ID NO: 438775 - DNA, 25 bp, Mus musculus
gaatgcagcgtgtctcttaggtgat

SEQ ID NO: 438776 - DNA, 25 bp, Mus musculus
gaatgcagcttgctttgactgacat

SEQ ID NO: 438777 - DNA, 25 bp, Mus musculus
gaatgcagcttggtttgactgacat

SEQ ID NO: 438778 - DNA, 25 bp, Mus musculus
gaatgcagctttattggaatcttct

SEQ ID NO: 438779 - DNA, 25 bp, Mus musculus
gaatgcagcttttttggaatcttct

SEQ ID NO: 438780 - DNA, 25 bp, Mus musculus
gaatgcagtaaaccccacagtagtg

SEQ ID NO: 438781 - DNA, 25 bp, Mus musculus
gaatgcagtaaagcccacagtagtg

SEQ ID NO: 438782 - DNA, 25 bp, Mus musculus
gaatgcagtacaaccggcgctttgt

SEQ ID NO: 438783 - DNA, 25 bp, Mus musculus
gaatgcagtacatccggcgctttgt

SEQ ID NO: 438784 - DNA, 25 bp, Mus musculus
gaatgcagtcggatcctgatggtaa

SEQ ID NO: 438785 - DNA, 25 bp, Mus musculus
gaatgcagtcggttcctgatggtaa

SEQ ID NO: 438786 - DNA, 25 bp, Mus musculus
gaatgcagtggtacacactttggga

SEQ ID NO: 438787 - DNA, 25 bp, Mus musculus
gaatgcagtggttcacactttggga

SEQ ID NO: 438788 - DNA, 25 bp, Mus musculus
gaatgcagttctcttccactgactc

SEQ ID NO: 438789 - DNA, 25 bp, Mus musculus
gaatgcagttctgttccactgactc

SEQ ID NO: 438790 - DNA, 25 bp, Mus musculus
gaatgcataattcccgagccaccgg

SEQ ID NO: 438791 - DNA, 25 bp, Mus musculus
gaatgcataattgccgagccaccgg

SEQ ID NO: 438792 - DNA, 25 bp, Mus musculus
gaatgcatacaaaccagacttttta

SEQ ID NO: 438793 - DNA, 25 bp, Mus musculus
gaatgcatacaatccagacttttta

SEQ ID NO: 438794 - DNA, 25 bp, Mus musculus
gaatgcatagatactgagactcctg

SEQ ID NO: 438795 - DNA, 25 bp, Mus musculus
gaatgcatagattctgagactcctg

SEQ ID NO: 438796 - DNA, 25 bp, Mus musculus
gaatgcatagccaggcactgttcac

SEQ ID NO: 438797 - DNA, 25 bp, Mus musculus
gaatgcatagccaggtcgcagatat

SEQ ID NO: 438798 - DNA, 25 bp, Mus musculus
gaatgcatagcctggcactgttcac

SEQ ID NO: 438799 - DNA, 25 bp, Mus musculus
gaatgcatagcctggtcgcagatat

SEQ ID NO: 438800 - DNA, 25 bp, Mus musculus
gaatgcatagctcaactcagtccgg

SEQ ID NO: 438801 - DNA, 25 bp, Mus musculus
gaatgcatagctgaactcagtccgg

SEQ ID NO: 438802 - DNA, 25 bp, Mus musculus
gaatgcatcagtacgctgctgcggg

SEQ ID NO: 438803 - DNA, 25 bp, Mus musculus
gaatgcatcagttcgctgctgcggg

SEQ ID NO: 438804 - DNA, 25 bp, Mus musculus
gaatgcatccagatggtcttccaga

SEQ ID NO: 438805 - DNA, 25 bp, Mus musculus
gaatgcatccagttggtcttccaga

SEQ ID NO: 438806 - DNA, 25 bp, Mus musculus
gaatgcatccttctgagaggtcaga

SEQ ID NO: 438807 - DNA, 25 bp, Mus musculus
gaatgcatccttgtgagaggtcaga

SEQ ID NO: 438808 - DNA, 25 bp, Mus musculus
gaatgcatgccgctaatgtatttta

SEQ ID NO: 438809 - DNA, 25 bp, Mus musculus
gaatgcatgccggtaatgtatttta

SEQ ID NO: 438810 - DNA, 25 bp, Mus musculus
gaatgcatggtaaaacggcagtgtt

SEQ ID NO: 438811 - DNA, 25 bp, Mus musculus
gaatgcatggtataacggcagtgtt

SEQ ID NO: 438812 - DNA, 25 bp, Mus musculus
gaatgcatgtatatctcccttgctt

SEQ ID NO: 438813 - DNA, 25 bp, Mus musculus
gaatgcatgtatttctcccttgctt

SEQ ID NO: 438814 - DNA, 25 bp, Mus musculus
gaatgcatgtgcaatttatttagaa

SEQ ID NO: 438815 - DNA, 25 bp, Mus musculus
gaatgcatgtgctatttatttagaa

SEQ ID NO: 438816 - DNA, 25 bp, Mus musculus
gaatgcatgttccagcttcacagtg

SEQ ID NO: 438817 - DNA, 25 bp, Mus musculus
gaatgcatgttcgagcttcacagtg

SEQ ID NO: 438818 - DNA, 25 bp, Mus musculus
gaatgcattaagcaagtccctgagc

SEQ ID NO: 438819 - DNA, 25 bp, Mus musculus
gaatgcattaaggaagtccctgagc

SEQ ID NO: 438820 - DNA, 25 bp, Mus musculus
gaatgcattaatcgtctcggatgga

SEQ ID NO: 438821 - DNA, 25 bp, Mus musculus
gaatgcattaatggtctcggatgga

SEQ ID NO: 438822 - DNA, 25 bp, Mus musculus
gaatgcattagtctttggttcagca

SEQ ID NO: 438823 - DNA, 25 bp, Mus musculus
gaatgcattagtgtttggttcagca

SEQ ID NO: 438824 - DNA, 25 bp, Mus musculus
gaatgcattccaagtattctgcgct

SEQ ID NO: 438825 - DNA, 25 bp, Mus musculus
gaatgcattccatgtattctgcgct

SEQ ID NO: 438826 - DNA, 25 bp, Mus musculus
gaatgcattcttaaggcgcaccgat

SEQ ID NO: 438827 - DNA, 25 bp, Mus musculus
gaatgcattctttaggcgcaccgat

SEQ ID NO: 438828 - DNA, 25 bp, Mus musculus
gaatgcattgaaacagtccctatgg

SEQ ID NO: 438829 - DNA, 25 bp, Mus musculus
gaatgcattgaatcagtccctatgg

SEQ ID NO: 438830 - DNA, 25 bp, Mus musculus
gaatgcattgcacccggtgtgcgca

SEQ ID NO: 438831 - DNA, 25 bp, Mus musculus
gaatgcattgcagccggtgtgcgca

SEQ ID NO: 438832 - DNA, 25 bp, Mus musculus
gaatgcattgctcagctcagccaac

SEQ ID NO: 438833 - DNA, 25 bp, Mus musculus
gaatgcattgctgagctcagccaac

SEQ ID NO: 438834 - DNA, 25 bp, Mus musculus
gaatgcattgtacatattatgttaa

SEQ ID NO: 438835 - DNA, 25 bp, Mus musculus
gaatgcattgtagatattatgttaa

SEQ ID NO: 438836 - DNA, 25 bp, Mus musculus
gaatgcattgtcaccaaggaggctt

SEQ ID NO: 438837 - DNA, 25 bp, Mus musculus
gaatgcattgtctccaaggaggctt

SEQ ID NO: 438838 - DNA, 25 bp, Mus musculus
gaatgcatttatattagacacaaag

SEQ ID NO: 438839 - DNA, 25 bp, Mus musculus
gaatgcatttattttagacacaaag

SEQ ID NO: 438840 - DNA, 25 bp, Mus musculus
gaatgcatttctatccagtgggtgt

SEQ ID NO: 438841 - DNA, 25 bp, Mus musculus
gaatgcatttctttccagtgggtgt

SEQ ID NO: 438842 - DNA, 25 bp, Mus musculus
gaatgcatttgtcaaccactgccaa

SEQ ID NO: 438843 - DNA, 25 bp, Mus musculus
gaatgcatttgtgaaccactgccaa

SEQ ID NO: 438844 - DNA, 25 bp, Mus musculus
gaatgcattttaatggtacaagact

SEQ ID NO: 438845 - DNA, 25 bp, Mus musculus
gaatgcattttattggtacaagact

SEQ ID NO: 438846 - DNA, 25 bp, Mus musculus
gaatgccaacaacaccagagtccaa

SEQ ID NO: 438847 - DNA, 25 bp, Mus musculus
gaatgccaacaacgtgcttttaaca

SEQ ID NO: 438848 - DNA, 25 bp, Mus musculus
gaatgccaacaagaccagagtccaa

SEQ ID NO: 438849 - DNA, 25 bp, Mus musculus
gaatgccaacaaggtgcttttaaca

SEQ ID NO: 438850 - DNA, 25 bp, Mus musculus
gaatgccaacttacagacggagccc

SEQ ID NO: 438851 - DNA, 25 bp, Mus musculus
gaatgccaactttcagacggagccc

SEQ ID NO: 438852 - DNA, 25 bp, Mus musculus
gaatgccaagaaagtcccaagctga

SEQ ID NO: 438853 - DNA, 25 bp, Mus musculus
gaatgccaagaatgtcccaagctga

SEQ ID NO: 438854 - DNA, 25 bp, Mus musculus
gaatgccaagaccacatgtatgctg

SEQ ID NO: 438855 - DNA, 25 bp, Mus musculus
gaatgccaagacgacatgtatgctg

SEQ ID NO: 438856 - DNA, 25 bp, Mus musculus
gaatgccaagtaactgtcccttgca

SEQ ID NO: 438857 - DNA, 25 bp, Mus musculus
gaatgccaagtatctgtcccttgca

SEQ ID NO: 438858 - DNA, 25 bp, Mus musculus
gaatgccacagactgagttcactct

SEQ ID NO: 438859 - DNA, 25 bp, Mus musculus
gaatgccacagagtgagttcactct

SEQ ID NO: 438860 - DNA, 25 bp, Mus musculus
gaatgccacccgacagctggaatgg

SEQ ID NO: 438861 - DNA, 25 bp, Mus musculus
gaatgccacccgtcagctggaatgg

SEQ ID NO: 438862 - DNA, 25 bp, Mus musculus
gaatgccaccttccactgttgggtt

SEQ ID NO: 438863 - DNA, 25 bp, Mus musculus
gaatgccaccttcttcaatctaagg

SEQ ID NO: 438864 - DNA, 25 bp, Mus musculus
gaatgccaccttgcactgttgggtt

SEQ ID NO: 438865 - DNA, 25 bp, Mus musculus
gaatgccaccttgttcaatctaagg

SEQ ID NO: 438866 - DNA, 25 bp, Mus musculus
gaatgccacggaaacactaaggatt

SEQ ID NO: 438867 - DNA, 25 bp, Mus musculus
gaatgccacggatacactaaggatt

SEQ ID NO: 438868 - DNA, 25 bp, Mus musculus
gaatgccactacaagggagacaagc

SEQ ID NO: 438869 - DNA, 25 bp, Mus musculus
gaatgccactactagggagacaagc

SEQ ID NO: 438870 - DNA, 25 bp, Mus musculus
gaatgccactcacactgcgagggtg

SEQ ID NO: 438871 - DNA, 25 bp, Mus musculus
gaatgccactcagactgcgagggtg

SEQ ID NO: 438872 - DNA, 25 bp, Mus musculus
gaatgccactggctcactgttaacc

SEQ ID NO: 438873 - DNA, 25 bp, Mus musculus
gaatgccactgggtcactgttaacc

SEQ ID NO: 438874 - DNA, 25 bp, Mus musculus
gaatgccagagtctgcttttcagct

SEQ ID NO: 438875 - DNA, 25 bp, Mus musculus
gaatgccagagtgtgcttttcagct

SEQ ID NO: 438876 - DNA, 25 bp, Mus musculus
gaatgccagcatagttctacagaga

SEQ ID NO: 438877 - DNA, 25 bp, Mus musculus
gaatgccagcattgttctacagaga

SEQ ID NO: 438878 - DNA, 25 bp, Mus musculus
gaatgccagccaacttcacattgca

SEQ ID NO: 438879 - DNA, 25 bp, Mus musculus
gaatgccagccatcttcacattgca

SEQ ID NO: 438880 - DNA, 25 bp, Mus musculus
gaatgccagccgcagcctatacgaa

SEQ ID NO: 438881 - DNA, 25 bp, Mus musculus
gaatgccagccggagcctatacgaa

SEQ ID NO: 438882 - DNA, 25 bp, Mus musculus
gaatgccagcggaagggcccaaatt

SEQ ID NO: 438883 - DNA, 25 bp, Mus musculus
gaatgccagcggtagggcccaaatt

SEQ ID NO: 438884 - DNA, 25 bp, Mus musculus
gaatgccagctccatatcacaggat

SEQ ID NO: 438885 - DNA, 25 bp, Mus musculus
gaatgccagctcgatatcacaggat

SEQ ID NO: 438886 - DNA, 25 bp, Mus musculus
gaatgccagctgacgctgaacatta

SEQ ID NO: 438887 - DNA, 25 bp, Mus musculus
gaatgccagctgtcgctgaacatta

SEQ ID NO: 438888 - DNA, 25 bp, Mus musculus
gaatgccaggtgataccaactccct

SEQ ID NO: 438889 - DNA, 25 bp, Mus musculus
gaatgccaggtgattctcttccttg

SEQ ID NO: 438890 - DNA, 25 bp, Mus musculus
gaatgccaggtgttaccaactccct

SEQ ID NO: 438891 - DNA, 25 bp, Mus musculus
gaatgccaggtgtttctcttccttg

SEQ ID NO: 438892 - DNA, 25 bp, Mus musculus
gaatgccagttgctttctaagccca

SEQ ID NO: 438893 - DNA, 25 bp, Mus musculus
gaatgccagttggtttctaagccca

SEQ ID NO: 438894 - DNA, 25 bp, Mus musculus
gaatgccatcacagaagttttacac

SEQ ID NO: 438895 - DNA, 25 bp, Mus musculus
gaatgccatcactgaagttttacac

SEQ ID NO: 438896 - DNA, 25 bp, Mus musculus
gaatgccatccaaacatgagtcatg

SEQ ID NO: 438897 - DNA, 25 bp, Mus musculus
gaatgccatccatacatgagtcatg

SEQ ID NO: 438898 - DNA, 25 bp, Mus musculus
gaatgccatcccatctaatagtatt

SEQ ID NO: 438899 - DNA, 25 bp, Mus musculus
gaatgccatcccttctaatagtatt

SEQ ID NO: 438900 - DNA, 25 bp, Mus musculus
gaatgccatcgcaaacgcgtcgacg

SEQ ID NO: 438901 - DNA, 25 bp, Mus musculus
gaatgccatcgctaacgcgtcgacg

SEQ ID NO: 438902 - DNA, 25 bp, Mus musculus
gaatgccatcgtctttgcctacgga

SEQ ID NO: 438903 - DNA, 25 bp, Mus musculus
gaatgccatcgtgtttgcctacgga

SEQ ID NO: 438904 - DNA, 25 bp, Mus musculus
gaatgccatgaaattcccctgcagg

SEQ ID NO: 438905 - DNA, 25 bp, Mus musculus
gaatgccatgaatttcccctgcagg

SEQ ID NO: 438906 - DNA, 25 bp, Mus musculus
gaatgccatgcgagtgtcactggat

SEQ ID NO: 438907 - DNA, 25 bp, Mus musculus
gaatgccatgcgtgtgtcactggat

SEQ ID NO: 438908 - DNA, 25 bp, Mus musculus
gaatgccatggaattggaccagaca

SEQ ID NO: 438909 - DNA, 25 bp, Mus musculus
gaatgccatggatttggaccagaca

SEQ ID NO: 438910 - DNA, 25 bp, Mus musculus
gaatgccatgtgaaaagcccaccta

SEQ ID NO: 438911 - DNA, 25 bp, Mus musculus
gaatgccatgtgtaaagcccaccta

SEQ ID NO: 438912 - DNA, 25 bp, Mus musculus
gaatgccatgttcatttctgcaatg

SEQ ID NO: 438913 - DNA, 25 bp, Mus musculus
gaatgccatgttgatttctgcaatg

SEQ ID NO: 438914 - DNA, 25 bp, Mus musculus
gaatgccattgaacggtggtcccgc

SEQ ID NO: 438915 - DNA, 25 bp, Mus musculus
gaatgccattgatcggtggtcccgc

SEQ ID NO: 438916 - DNA, 25 bp, Mus musculus
gaatgccattgtattcctagtacat

SEQ ID NO: 438917 - DNA, 25 bp, Mus musculus
gaatgccattgttttcctagtacat

SEQ ID NO: 438918 - DNA, 25 bp, Mus musculus
gaatgccattttagtgaaggatctt

SEQ ID NO: 438919 - DNA, 25 bp, Mus musculus
gaatgccattttatactccaagtga

SEQ ID NO: 438920 - DNA, 25 bp, Mus musculus
gaatgccatttttgtgaaggatctt

SEQ ID NO: 438921 - DNA, 25 bp, Mus musculus
gaatgccattttttactccaagtga

SEQ ID NO: 438922 - DNA, 25 bp, Mus musculus
gaatgcccaaatcgacatgtcgtaa

SEQ ID NO: 438923 - DNA, 25 bp, Mus musculus
gaatgcccaaatggacatgtcgtaa

SEQ ID NO: 438924 - DNA, 25 bp, Mus musculus
gaatgcccaacaagccagaaacggc

SEQ ID NO: 438925 - DNA, 25 bp, Mus musculus
gaatgcccaacatgccagaaacggc

SEQ ID NO: 438926 - DNA, 25 bp, Mus musculus
gaatgcccagaaacagcgaatgaag

SEQ ID NO: 438927 - DNA, 25 bp, Mus musculus
gaatgcccagaatcagcgaatgaag

SEQ ID NO: 438928 - DNA, 25 bp, Mus musculus
gaatgcccattgctttgctggattt

SEQ ID NO: 438929 - DNA, 25 bp, Mus musculus
gaatgcccattggtttgctggattt

SEQ ID NO: 438930 - DNA, 25 bp, Mus musculus
gaatgccccataactcttggaagac

SEQ ID NO: 438931 - DNA, 25 bp, Mus musculus
gaatgccccatatctcttggaagac

SEQ ID NO: 438932 - DNA, 25 bp, Mus musculus
gaatgccccatcactgaaccaggag

SEQ ID NO: 438933 - DNA, 25 bp, Mus musculus
gaatgccccatcctgagacaaagaa

SEQ ID NO: 438934 - DNA, 25 bp, Mus musculus
gaatgccccatcgtgagacaaagaa

SEQ ID NO: 438935 - DNA, 25 bp, Mus musculus
gaatgccccatctctgaaccaggag

SEQ ID NO: 438936 - DNA, 25 bp, Mus musculus
gaatgcccctagacctaataacagt

SEQ ID NO: 438937 - DNA, 25 bp, Mus musculus
gaatgcccctagtcctaataacagt

SEQ ID NO: 438938 - DNA, 25 bp, Mus musculus
gaatgcccctgcacaggatacagga

SEQ ID NO: 438939 - DNA, 25 bp, Mus musculus
gaatgcccctgctcaggatacagga

SEQ ID NO: 438940 - DNA, 25 bp, Mus musculus
gaatgcccgcaaacccagaactggg

SEQ ID NO: 438941 - DNA, 25 bp, Mus musculus
gaatgcccgcaatcccagaactggg

SEQ ID NO: 438942 - DNA, 25 bp, Mus musculus
gaatgccctagaattgttgcagcaa

SEQ ID NO: 438943 - DNA, 25 bp, Mus musculus
gaatgccctagatttgttgcagcaa

SEQ ID NO: 438944 - DNA, 25 bp, Mus musculus
gaatgccctctgatcaagctacttt

SEQ ID NO: 438945 - DNA, 25 bp, Mus musculus
gaatgccctctgttcaagctacttt

SEQ ID NO: 438946 - DNA, 25 bp, Mus musculus
gaatgccctgtaatttgttaacatg

SEQ ID NO: 438947 - DNA, 25 bp, Mus musculus
gaatgccctgtattttgttaacatg

SEQ ID NO: 438948 - DNA, 25 bp, Mus musculus
gaatgcccttatctaaagatctgtt

SEQ ID NO: 438949 - DNA, 25 bp, Mus musculus
gaatgcccttatgtaaagatctgtt

SEQ ID NO: 438950 - DNA, 25 bp, Mus musculus
gaatgccgaatgaacagtcactgag

SEQ ID NO: 438951 - DNA, 25 bp, Mus musculus
gaatgccgaatgtacagtcactgag

SEQ ID NO: 438952 - DNA, 25 bp, Mus musculus
gaatgccgactcctctgtgcagtta

SEQ ID NO: 438953 - DNA, 25 bp, Mus musculus
gaatgccgactcgtctgtgcagtta

SEQ ID NO: 438954 - DNA, 25 bp, Mus musculus
gaatgccgagatatctcagtagcag

SEQ ID NO: 438955 - DNA, 25 bp, Mus musculus
gaatgccgagatttctcagtagcag

SEQ ID NO: 438956 - DNA, 25 bp, Mus musculus
gaatgccgagttctaagccagtgat

SEQ ID NO: 438957 - DNA, 25 bp, Mus musculus
gaatgccgagttgtaagccagtgat

SEQ ID NO: 438958 - DNA, 25 bp, Mus musculus
gaatgccgcagaagagctgagaaca

SEQ ID NO: 438959 - DNA, 25 bp, Mus musculus
gaatgccgcagatgagctgagaaca

SEQ ID NO: 438960 - DNA, 25 bp, Mus musculus
gaatgccgccataaatgaactcaat

SEQ ID NO: 438961 - DNA, 25 bp, Mus musculus
gaatgccgccattaatgaactcaat

SEQ ID NO: 438962 - DNA, 25 bp, Mus musculus
gaatgccgccgaaattgtagccaaa

SEQ ID NO: 438963 - DNA, 25 bp, Mus musculus
gaatgccgccgatattgtagccaaa

SEQ ID NO: 438964 - DNA, 25 bp, Mus musculus
gaatgccggagccacaggtctatgc

SEQ ID NO: 438965 - DNA, 25 bp, Mus musculus
gaatgccggagcgacaggtctatgc

SEQ ID NO: 438966 - DNA, 25 bp, Mus musculus
gaatgccggatacactgcttttctc

SEQ ID NO: 438967 - DNA, 25 bp, Mus musculus
gaatgccggatagactgcttttctc

SEQ ID NO: 438968 - DNA, 25 bp, Mus musculus
gaatgccgggaaagctctaagccac

SEQ ID NO: 438969 - DNA, 25 bp, Mus musculus
gaatgccgggaatgctctaagccac

SEQ ID NO: 438970 - DNA, 25 bp, Mus musculus
gaatgccgggagaagactataacat

SEQ ID NO: 438971 - DNA, 25 bp, Mus musculus
gaatgccgggagtagactataacat

SEQ ID NO: 438972 - DNA, 25 bp, Mus musculus
gaatgccgtagactctgtgcagtac

SEQ ID NO: 438973 - DNA, 25 bp, Mus musculus
gaatgccgtagagtctgtgcagtac

SEQ ID NO: 438974 - DNA, 25 bp, Mus musculus
gaatgccgtcttctgagtgtgctgt

SEQ ID NO: 438975 - DNA, 25 bp, Mus musculus
gaatgccgtcttgtgagtgtgctgt

SEQ ID NO: 438976 - DNA, 25 bp, Mus musculus
gaatgccgttgacttcagttgagtt

SEQ ID NO: 438977 - DNA, 25 bp, Mus musculus
gaatgccgttgagttcagttgagtt

SEQ ID NO: 438978 - DNA, 25 bp, Mus musculus
gaatgccgttggaatatcctcctaa

SEQ ID NO: 438979 - DNA, 25 bp, Mus musculus
gaatgccgttggtatatcctcctaa

SEQ ID NO: 438980 - DNA, 25 bp, Mus musculus
gaatgcctaatgacacgccatgctt

SEQ ID NO: 438981 - DNA, 25 bp, Mus musculus
gaatgcctaatgtcacgccatgctt

SEQ ID NO: 438982 - DNA, 25 bp, Mus musculus
gaatgcctacctcgaacgcatgggt

SEQ ID NO: 438983 - DNA, 25 bp, Mus musculus
gaatgcctacctggaacgcatgggt

SEQ ID NO: 438984 - DNA, 25 bp, Mus musculus
gaatgcctactcatatcctgattat

SEQ ID NO: 438985 - DNA, 25 bp, Mus musculus
gaatgcctactcttatcctgattat

SEQ ID NO: 438986 - DNA, 25 bp, Mus musculus
gaatgcctatccaacaattactcca

SEQ ID NO: 438987 - DNA, 25 bp, Mus musculus
gaatgcctatccaataataactcct

SEQ ID NO: 438988 - DNA, 25 bp, Mus musculus
gaatgcctatcctacaattactcca

SEQ ID NO: 438989 - DNA, 25 bp, Mus musculus
gaatgcctatcctataataactcct

SEQ ID NO: 438990 - DNA, 25 bp, Mus musculus
gaatgcctcactatgacatgacttg

SEQ ID NO: 438991 - DNA, 25 bp, Mus musculus
gaatgcctcactttgacatgacttg

SEQ ID NO: 438992 - DNA, 25 bp, Mus musculus
gaatgcctcaggatctggatcttga

SEQ ID NO: 438993 - DNA, 25 bp, Mus musculus
gaatgcctcaggttctggatcttga

SEQ ID NO: 438994 - DNA, 25 bp, Mus musculus
gaatgcctcagtcaccttatttatt

SEQ ID NO: 438995 - DNA, 25 bp, Mus musculus
gaatgcctcagtgaccttatttatt

SEQ ID NO: 438996 - DNA, 25 bp, Mus musculus
gaatgcctcatcatagccttgggaa

SEQ ID NO: 438997 - DNA, 25 bp, Mus musculus
gaatgcctcatcttagccttgggaa

SEQ ID NO: 438998 - DNA, 25 bp, Mus musculus
gaatgcctcctcagatgagctttat

SEQ ID NO: 438999 - DNA, 25 bp, Mus musculus
gaatgcctcctctgatgagctttat

SEQ ID NO: 439000 - DNA, 25 bp, Mus musculus
gaatgcctcggtccctaggaaccaa

SEQ ID NO: 439001 - DNA, 25 bp, Mus musculus
gaatgcctcggtgcctaggaaccaa

SEQ ID NO: 439002 - DNA, 25 bp, Mus musculus
gaatgcctctggaagcatcttctta

SEQ ID NO: 439003 - DNA, 25 bp, Mus musculus
gaatgcctctggtagcatcttctta

SEQ ID NO: 439004 - DNA, 25 bp, Mus musculus
gaatgcctcttcaaccaaagtaatc

SEQ ID NO: 439005 - DNA, 25 bp, Mus musculus
gaatgcctcttctaccaaagtaatc

SEQ ID NO: 439006 - DNA, 25 bp, Mus musculus
gaatgcctgaagaatatcgggccca

SEQ ID NO: 439007 - DNA, 25 bp, Mus musculus
gaatgcctgaagtatatcgggccca

SEQ ID NO: 439008 - DNA, 25 bp, Mus musculus
gaatgcctgaggatacttcataaga

SEQ ID NO: 439009 - DNA, 25 bp, Mus musculus
gaatgcctgaggttacttcataaga

SEQ ID NO: 439010 - DNA, 25 bp, Mus musculus
gaatgcctgatccttaaatacacaa

SEQ ID NO: 439011 - DNA, 25 bp, Mus musculus
gaatgcctgatcgttaaatacacaa

SEQ ID NO: 439012 - DNA, 25 bp, Mus musculus
gaatgcctgcctaggaaacagaccc

SEQ ID NO: 439013 - DNA, 25 bp, Mus musculus
gaatgcctgcctatgtttaaatgct

SEQ ID NO: 439014 - DNA, 25 bp, Mus musculus
gaatgcctgccttggaaacagaccc

SEQ ID NO: 439015 - DNA, 25 bp, Mus musculus
gaatgcctgcctttgtttaaatgct

SEQ ID NO: 439016 - DNA, 25 bp, Mus musculus
gaatgcctggtcactaccacaaaat

SEQ ID NO: 439017 - DNA, 25 bp, Mus musculus
gaatgcctggtctctaccacaaaat

SEQ ID NO: 439018 - DNA, 25 bp, Mus musculus
gaatgcctggttatattcacattta

SEQ ID NO: 439019 - DNA, 25 bp, Mus musculus
gaatgcctggttttattcacattta

SEQ ID NO: 439020 - DNA, 25 bp, Mus musculus
gaatgcctgtggaacctgtggtttc

SEQ ID NO: 439021 - DNA, 25 bp, Mus musculus
gaatgcctgtggtacctgtggtttc

SEQ ID NO: 439022 - DNA, 25 bp, Mus musculus
gaatgccttaaacctaaagttggct

SEQ ID NO: 439023 - DNA, 25 bp, Mus musculus
gaatgccttaaagctaaagttggct

SEQ ID NO: 439024 - DNA, 25 bp, Mus musculus
gaatgccttagccaggcatgtcctg

SEQ ID NO: 439025 - DNA, 25 bp, Mus musculus
gaatgccttagcgaggcatgtcctg

SEQ ID NO: 439026 - DNA, 25 bp, Mus musculus
gaatgccttaggctaatgcctactg

SEQ ID NO: 439027 - DNA, 25 bp, Mus musculus
gaatgccttagggtaatgcctactg

SEQ ID NO: 439028 - DNA, 25 bp, Mus musculus
gaatgccttataaacctgcagggtc

SEQ ID NO: 439029 - DNA, 25 bp, Mus musculus
gaatgccttatatacctgcagggtc

SEQ ID NO: 439030 - DNA, 25 bp, Mus musculus
gaatgccttcataaagaaatcagag

SEQ ID NO: 439031 - DNA, 25 bp, Mus musculus
gaatgccttcattaagaaatcagag

SEQ ID NO: 439032 - DNA, 25 bp, Mus musculus
gaatgccttcctatatacgtggtag

SEQ ID NO: 439033 - DNA, 25 bp, Mus musculus
gaatgccttcctttatacgtggtag

SEQ ID NO: 439034 - DNA, 25 bp, Mus musculus
gaatgccttgagaaatcgctatcgg

SEQ ID NO: 439035 - DNA, 25 bp, Mus musculus
gaatgccttgagtaatcgctatcgg

SEQ ID NO: 439036 - DNA, 25 bp, Mus musculus
gaatgccttgtgacagtgtagcacg

SEQ ID NO: 439037 - DNA, 25 bp, Mus musculus
gaatgccttgtgtcagtgtagcacg

SEQ ID NO: 439038 - DNA, 25 bp, Mus musculus
gaatgcctttaaataactctgagac

SEQ ID NO: 439039 - DNA, 25 bp, Mus musculus
gaatgcctttaattaactctgagac

SEQ ID NO: 439040 - DNA, 25 bp, Mus musculus
gaatgcctttgcaagtgttatcctc

SEQ ID NO: 439041 - DNA, 25 bp, Mus musculus
gaatgcctttgctagtgttatcctc

SEQ ID NO: 439042 - DNA, 25 bp, Mus musculus
gaatgcgaacttctatagccacttt

SEQ ID NO: 439043 - DNA, 25 bp, Mus musculus
gaatgcgaacttgtatagccacttt

SEQ ID NO: 439044 - DNA, 25 bp, Mus musculus
gaatgcgacaaaagcttactgacaa

SEQ ID NO: 439045 - DNA, 25 bp, Mus musculus
gaatgcgacaaatgcttactgacaa

SEQ ID NO: 439046 - DNA, 25 bp, Mus musculus
gaatgcgaccagcactgttgtcaga

SEQ ID NO: 439047 - DNA, 25 bp, Mus musculus
gaatgcgaccaggactgttgtcaga

SEQ ID NO: 439048 - DNA, 25 bp, Mus musculus
gaatgcgagaagacgttcagccaac

SEQ ID NO: 439049 - DNA, 25 bp, Mus musculus
gaatgcgagaagtcgttcagccaac

SEQ ID NO: 439050 - DNA, 25 bp, Mus musculus
gaatgcgagccaatcacttcatgtt

SEQ ID NO: 439051 - DNA, 25 bp, Mus musculus
gaatgcgagccattcacttcatgtt

SEQ ID NO: 439052 - DNA, 25 bp, Mus musculus
gaatgcgagttgctcaaggtcataa

SEQ ID NO: 439053 - DNA, 25 bp, Mus musculus
gaatgcgagttggtcaaggtcataa

SEQ ID NO: 439054 - DNA, 25 bp, Mus musculus
gaatgcgcaggtacgtttaattttt

SEQ ID NO: 439055 - DNA, 25 bp, Mus musculus
gaatgcgcaggttcgtttaattttt

SEQ ID NO: 439056 - DNA, 25 bp, Mus musculus
gaatgcgcatctattatagcccaca

SEQ ID NO: 439057 - DNA, 25 bp, Mus musculus
gaatgcgcatcttttatagcccaca

SEQ ID NO: 439058 - DNA, 25 bp, Mus musculus
gaatgcgccacaagaaaaccatctg

SEQ ID NO: 439059 - DNA, 25 bp, Mus musculus
gaatgcgccacatgaaaaccatctg

SEQ ID NO: 439060 - DNA, 25 bp, Mus musculus
gaatgcgccctgcaaacctggcccc

SEQ ID NO: 439061 - DNA, 25 bp, Mus musculus
gaatgcgccctggaaacctggcccc

SEQ ID NO: 439062 - DNA, 25 bp, Mus musculus
gaatgcgcccttagaatggattttc

SEQ ID NO: 439063 - DNA, 25 bp, Mus musculus
gaatgcgccctttgaatggattttc

SEQ ID NO: 439064 - DNA, 25 bp, Mus musculus
gaatgcgctcctcgaagcaaggata

SEQ ID NO: 439065 - DNA, 25 bp, Mus musculus
gaatgcgctcctggaagcaaggata

SEQ ID NO: 439066 - DNA, 25 bp, Mus musculus
gaatgcgctgtgacccatgaagtgg

SEQ ID NO: 439067 - DNA, 25 bp, Mus musculus
gaatgcgctgtgtcccatgaagtgg

SEQ ID NO: 439068 - DNA, 25 bp, Mus musculus
gaatgcggacagaccctgaatgtaa

SEQ ID NO: 439069 - DNA, 25 bp, Mus musculus
gaatgcggacagtccctgaatgtaa

SEQ ID NO: 439070 - DNA, 25 bp, Mus musculus
gaatgcggatgaaactttacaaggt

SEQ ID NO: 439071 - DNA, 25 bp, Mus musculus
gaatgcggatgatactttacaaggt

SEQ ID NO: 439072 - DNA, 25 bp, Mus musculus
gaatgcggcctgcagacctggccca

SEQ ID NO: 439073 - DNA, 25 bp, Mus musculus
gaatgcggcctggagacctggccca

SEQ ID NO: 439074 - DNA, 25 bp, Mus musculus
gaatgcggcgcgctcattcaatccg

SEQ ID NO: 439075 - DNA, 25 bp, Mus musculus
gaatgcggcgcggtcattcaatccg

SEQ ID NO: 439076 - DNA, 25 bp, Mus musculus
gaatgcggctgtccttcccgcagtt

SEQ ID NO: 439077 - DNA, 25 bp, Mus musculus
gaatgcggctgtgcttcccgcagtt

SEQ ID NO: 439078 - DNA, 25 bp, Mus musculus
gaatgcgggatgcatagtttatcag

SEQ ID NO: 439079 - DNA, 25 bp, Mus musculus
gaatgcgggatggatagtttatcag

SEQ ID NO: 439080 - DNA, 25 bp, Mus musculus
gaatgcggtcatatttgggcccgaa

SEQ ID NO: 439081 - DNA, 25 bp, Mus musculus
gaatgcggtcatttttgggcccgaa

SEQ ID NO: 439082 - DNA, 25 bp, Mus musculus
gaatgcggtgacaattttcattttt

SEQ ID NO: 439083 - DNA, 25 bp, Mus musculus
gaatgcggtgactattttcattttt

SEQ ID NO: 439084 - DNA, 25 bp, Mus musculus
gaatgcgtccaaatgagccctgtaa

SEQ ID NO: 439085 - DNA, 25 bp, Mus musculus
gaatgcgtccaattgagccctgtaa

SEQ ID NO: 439086 - DNA, 25 bp, Mus musculus
gaatgcgtgcagctacttcatttat

SEQ ID NO: 439087 - DNA, 25 bp, Mus musculus
gaatgcgtgcaggtacttcatttat

SEQ ID NO: 439088 - DNA, 25 bp, Mus musculus
gaatgcgtgcatacttgttgctcag

SEQ ID NO: 439089 - DNA, 25 bp, Mus musculus
gaatgcgtgcattcttgttgctcag

SEQ ID NO: 439090 - DNA, 25 bp, Mus musculus
gaatgcgtgcttacctggatcatag

SEQ ID NO: 439091 - DNA, 25 bp, Mus musculus
gaatgcgtgctttcctggatcatag

SEQ ID NO: 439092 - DNA, 25 bp, Mus musculus
gaatgcgttctgcagaaggtgccaa

SEQ ID NO: 439093 - DNA, 25 bp, Mus musculus
gaatgcgttctggagaaggtgccaa

SEQ ID NO: 439094 - DNA, 25 bp, Mus musculus
gaatgcgtttgccaggccccgtgct

SEQ ID NO: 439095 - DNA, 25 bp, Mus musculus
gaatgcgtttgcgaggccccgtgct

SEQ ID NO: 439096 - DNA, 25 bp, Mus musculus
gaatgctaaagccaccactgagaag

SEQ ID NO: 439097 - DNA, 25 bp, Mus musculus
gaatgctaaagcgaccactgagaag

SEQ ID NO: 439098 - DNA, 25 bp, Mus musculus
gaatgctaacagctcacttgcagtg

SEQ ID NO: 439099 - DNA, 25 bp, Mus musculus
gaatgctaacaggtcacttgcagtg

SEQ ID NO: 439100 - DNA, 25 bp, Mus musculus
gaatgctaaccactctgaaaagtac

SEQ ID NO: 439101 - DNA, 25 bp, Mus musculus
gaatgctaaccagtctgaaaagtac

SEQ ID NO: 439102 - DNA, 25 bp, Mus musculus
gaatgctaagctcttctgacacatg

SEQ ID NO: 439103 - DNA, 25 bp, Mus musculus
gaatgctaagctgttctgacacatg

SEQ ID NO: 439104 - DNA, 25 bp, Mus musculus
gaatgctaatgactaagccagtgca

SEQ ID NO: 439105 - DNA, 25 bp, Mus musculus
gaatgctaatgagtaagccagtgca

SEQ ID NO: 439106 - DNA, 25 bp, Mus musculus
gaatgctaatgtattctgattttta

SEQ ID NO: 439107 - DNA, 25 bp, Mus musculus
gaatgctaatgttttctgattttta

SEQ ID NO: 439108 - DNA, 25 bp, Mus musculus
gaatgctacatcatatcagatctat

SEQ ID NO: 439109 - DNA, 25 bp, Mus musculus
gaatgctacatcttatcagatctat

SEQ ID NO: 439110 - DNA, 25 bp, Mus musculus
gaatgctaccagctaccggttacat

SEQ ID NO: 439111 - DNA, 25 bp, Mus musculus
gaatgctaccaggtaccggttacat

SEQ ID NO: 439112 - DNA, 25 bp, Mus musculus
gaatgctaccttcagctttgtgtag

SEQ ID NO: 439113 - DNA, 25 bp, Mus musculus
gaatgctaccttgagctttgtgtag

SEQ ID NO: 439114 - DNA, 25 bp, Mus musculus
gaatgctagacaagctctctctctt

SEQ ID NO: 439115 - DNA, 25 bp, Mus musculus
gaatgctagacatgctctctctctt

SEQ ID NO: 439116 - DNA, 25 bp, Mus musculus
gaatgctagcataactcattgcctg

SEQ ID NO: 439117 - DNA, 25 bp, Mus musculus
gaatgctagcattactcattgcctg

SEQ ID NO: 439118 - DNA, 25 bp, Mus musculus
gaatgctaggatcgaagatatttca

SEQ ID NO: 439119 - DNA, 25 bp, Mus musculus
gaatgctaggatggaagatatttca

SEQ ID NO: 439120 - DNA, 25 bp, Mus musculus
gaatgctataatctcccagtgcggg

SEQ ID NO: 439121 - DNA, 25 bp, Mus musculus
gaatgctataatgtcccagtgcggg

SEQ ID NO: 439122 - DNA, 25 bp, Mus musculus
gaatgctatatcacagggagaagcc

SEQ ID NO: 439123 - DNA, 25 bp, Mus musculus
gaatgctatatctcagggagaagcc

SEQ ID NO: 439124 - DNA, 25 bp, Mus musculus
gaatgctatccacccacgatggatg

SEQ ID NO: 439125 - DNA, 25 bp, Mus musculus
gaatgctatccagccacgatggatg

SEQ ID NO: 439126 - DNA, 25 bp, Mus musculus
gaatgctatgaacatgaacttgcag

SEQ ID NO: 439127 - DNA, 25 bp, Mus musculus
gaatgctatgaagatgaacttgcag

SEQ ID NO: 439128 - DNA, 25 bp, Mus musculus
gaatgctatgagcattacaagatac

SEQ ID NO: 439129 - DNA, 25 bp, Mus musculus
gaatgctatgaggattacaagatac

SEQ ID NO: 439130 - DNA, 25 bp, Mus musculus
gaatgctatgcaagaggcctgtcaa

SEQ ID NO: 439131 - DNA, 25 bp, Mus musculus
gaatgctatgcatgaggcctgtcaa

SEQ ID NO: 439132 - DNA, 25 bp, Mus musculus
gaatgctatttgactcctaagtgtt

SEQ ID NO: 439133 - DNA, 25 bp, Mus musculus
gaatgctatttgtctcctaagtgtt

SEQ ID NO: 439134 - DNA, 25 bp, Mus musculus
gaatgctattttactaggctgaact

SEQ ID NO: 439135 - DNA, 25 bp, Mus musculus
gaatgctatttttctaggctgaact

SEQ ID NO: 439136 - DNA, 25 bp, Mus musculus
gaatgctcaactctttggtacacat

SEQ ID NO: 439137 - DNA, 25 bp, Mus musculus
gaatgctcaactgtttggtacacat

SEQ ID NO: 439138 - DNA, 25 bp, Mus musculus
gaatgctcacagacttttaatgcct

SEQ ID NO: 439139 - DNA, 25 bp, Mus musculus
gaatgctcacagtcttttaatgcct

SEQ ID NO: 439140 - DNA, 25 bp, Mus musculus
gaatgctcagacagcaagaaaactt

SEQ ID NO: 439141 - DNA, 25 bp, Mus musculus
gaatgctcagactgcaagaaaactt

SEQ ID NO: 439142 - DNA, 25 bp, Mus musculus
gaatgctcattcacctgactctgga

SEQ ID NO: 439143 - DNA, 25 bp, Mus musculus
gaatgctcattctcctgactctgga

SEQ ID NO: 439144 - DNA, 25 bp, Mus musculus
gaatgctccatacttgtattttaat

SEQ ID NO: 439145 - DNA, 25 bp, Mus musculus
gaatgctccatagttgtattttaat

SEQ ID NO: 439146 - DNA, 25 bp, Mus musculus
gaatgctccattagcatggcagcaa

SEQ ID NO: 439147 - DNA, 25 bp, Mus musculus
gaatgctccatttgcatggcagcaa

SEQ ID NO: 439148 - DNA, 25 bp, Mus musculus
gaatgctcccagatcccaagaatac

SEQ ID NO: 439149 - DNA, 25 bp, Mus musculus
gaatgctcccagttcccaagaatac

SEQ ID NO: 439150 - DNA, 25 bp, Mus musculus
gaatgctcctatctataacctggtt

SEQ ID NO: 439151 - DNA, 25 bp, Mus musculus
gaatgctcctatgtataacctggtt

SEQ ID NO: 439152 - DNA, 25 bp, Mus musculus
gaatgctcgcctatggacaggaact

SEQ ID NO: 439153 - DNA, 25 bp, Mus musculus
gaatgctcgcctttggacaggaact

SEQ ID NO: 439154 - DNA, 25 bp, Mus musculus
gaatgctcgctcagtaaattgcagt

SEQ ID NO: 439155 - DNA, 25 bp, Mus musculus
gaatgctcgctctgtaaattgcagt

SEQ ID NO: 439156 - DNA, 25 bp, Mus musculus
gaatgctcggccatcagagacagag

SEQ ID NO: 439157 - DNA, 25 bp, Mus musculus
gaatgctcggccttcagagacagag

SEQ ID NO: 439158 - DNA, 25 bp, Mus musculus
gaatgctcggctataatcttcccgt

SEQ ID NO: 439159 - DNA, 25 bp, Mus musculus
gaatgctcggctttaatcttcccgt

SEQ ID NO: 439160 - DNA, 25 bp, Mus musculus
gaatgctctcaaagactctccttaa

SEQ ID NO: 439161 - DNA, 25 bp, Mus musculus
gaatgctctcaatgactctccttaa

SEQ ID NO: 439162 - DNA, 25 bp, Mus musculus
gaatgctctcatcatatccatttgg

SEQ ID NO: 439163 - DNA, 25 bp, Mus musculus
gaatgctctcatgatatccatttgg

SEQ ID NO: 439164 - DNA, 25 bp, Mus musculus
gaatgctctctaaacctgtgaagag

SEQ ID NO: 439165 - DNA, 25 bp, Mus musculus
gaatgctctctatacctgtgaagag

SEQ ID NO: 439166 - DNA, 25 bp, Mus musculus
gaatgctctgatcgttgtacataca

SEQ ID NO: 439167 - DNA, 25 bp, Mus musculus
gaatgctctgatggttgtacataca

SEQ ID NO: 439168 - DNA, 25 bp, Mus musculus
gaatgctctgcacgaaatccaggaa

SEQ ID NO: 439169 - DNA, 25 bp, Mus musculus
gaatgctctgcaggaaatccaggaa

SEQ ID NO: 439170 - DNA, 25 bp, Mus musculus
gaatgctcttatattcattaactag

SEQ ID NO: 439171 - DNA, 25 bp, Mus musculus
gaatgctcttattttcattaactag

SEQ ID NO: 439172 - DNA, 25 bp, Mus musculus
gaatgctgaattattgccaactaaa

SEQ ID NO: 439173 - DNA, 25 bp, Mus musculus
gaatgctgaatttttgccaactaaa

SEQ ID NO: 439174 - DNA, 25 bp, Mus musculus
gaatgctgacaacaaatcactgtat

SEQ ID NO: 439175 - DNA, 25 bp, Mus musculus
gaatgctgacaagaaatcactgtat

SEQ ID NO: 439176 - DNA, 25 bp, Mus musculus
gaatgctgaccaaatgctgatgcca

SEQ ID NO: 439177 - DNA, 25 bp, Mus musculus
gaatgctgaccatatgctgatgcca

SEQ ID NO: 439178 - DNA, 25 bp, Mus musculus
gaatgctgactgaaacttctgttgg

SEQ ID NO: 439179 - DNA, 25 bp, Mus musculus
gaatgctgactgatggagtccgctc

SEQ ID NO: 439180 - DNA, 25 bp, Mus musculus
gaatgctgactgtaacttctgttgg

SEQ ID NO: 439181 - DNA, 25 bp, Mus musculus
gaatgctgactgttggagtccgctc

SEQ ID NO: 439182 - DNA, 25 bp, Mus musculus
gaatgctgagcactggtcactttgg

SEQ ID NO: 439183 - DNA, 25 bp, Mus musculus
gaatgctgagcagtggtcactttgg

SEQ ID NO: 439184 - DNA, 25 bp, Mus musculus
gaatgctgagtcagtatatgtctgt

SEQ ID NO: 439185 - DNA, 25 bp, Mus musculus
gaatgctgagtctgtatatgtctgt

SEQ ID NO: 439186 - DNA, 25 bp, Mus musculus
gaatgctgagtgactttaccctgta

SEQ ID NO: 439187 - DNA, 25 bp, Mus musculus
gaatgctgagtgtctttaccctgta

SEQ ID NO: 439188 - DNA, 25 bp, Mus musculus
gaatgctgatcaagcaccacacagt

SEQ ID NO: 439189 - DNA, 25 bp, Mus musculus
gaatgctgatcatgcaccacacagt

SEQ ID NO: 439190 - DNA, 25 bp, Mus musculus
gaatgctgcaatagtgtcagcttca

SEQ ID NO: 439191 - DNA, 25 bp, Mus musculus
gaatgctgcaattgtgtcagcttca

SEQ ID NO: 439192 - DNA, 25 bp, Mus musculus
gaatgctgcagactgcacacactgc

SEQ ID NO: 439193 - DNA, 25 bp, Mus musculus
gaatgctgcagagtgcacacactgc

SEQ ID NO: 439194 - DNA, 25 bp, Mus musculus
gaatgctgcatgcaacactgttgaa

SEQ ID NO: 439195 - DNA, 25 bp, Mus musculus
gaatgctgcatggaacactgttgaa

SEQ ID NO: 439196 - DNA, 25 bp, Mus musculus
gaatgctgcattactcagctgggca

SEQ ID NO: 439197 - DNA, 25 bp, Mus musculus
gaatgctgcatttctcagctgggca

SEQ ID NO: 439198 - DNA, 25 bp, Mus musculus
gaatgctgcccaaggtcagtggaaa

SEQ ID NO: 439199 - DNA, 25 bp, Mus musculus
gaatgctgcccatggtcagtggaaa

SEQ ID NO: 439200 - DNA, 25 bp, Mus musculus
gaatgctgctcactctcagaaagtt

SEQ ID NO: 439201 - DNA, 25 bp, Mus musculus
gaatgctgctcagtctcagaaagtt

SEQ ID NO: 439202 - DNA, 25 bp, Mus musculus
gaatgctggaccacccaggatactt

SEQ ID NO: 439203 - DNA, 25 bp, Mus musculus
gaatgctggacctcccaggatactt

SEQ ID NO: 439204 - DNA, 25 bp, Mus musculus
gaatgctggagaacgcggctgtttc

SEQ ID NO: 439205 - DNA, 25 bp, Mus musculus
gaatgctggagatcgcggctgtttc

SEQ ID NO: 439206 - DNA, 25 bp, Mus musculus
gaatgctggagtcacaccatgcagt

SEQ ID NO: 439207 - DNA, 25 bp, Mus musculus
gaatgctggagtcgcagatcgctat

SEQ ID NO: 439208 - DNA, 25 bp, Mus musculus
gaatgctggagtgacaccatgcagt

SEQ ID NO: 439209 - DNA, 25 bp, Mus musculus
gaatgctggagtggcagatcgctat

SEQ ID NO: 439210 - DNA, 25 bp, Mus musculus
gaatgctggcatctgaattttttca

SEQ ID NO: 439211 - DNA, 25 bp, Mus musculus
gaatgctggcatgtgaattttttca

SEQ ID NO: 439212 - DNA, 25 bp, Mus musculus
gaatgctggctgaactttataatgg

SEQ ID NO: 439213 - DNA, 25 bp, Mus musculus
gaatgctggctgtactttataatgg

SEQ ID NO: 439214 - DNA, 25 bp, Mus musculus
gaatgctgggtacacactcactgaa

SEQ ID NO: 439215 - DNA, 25 bp, Mus musculus
gaatgctgggtagacactcactgaa

SEQ ID NO: 439216 - DNA, 25 bp, Mus musculus
gaatgctgggttagcttcaacacca

SEQ ID NO: 439217 - DNA, 25 bp, Mus musculus
gaatgctgggtttgcttcaacacca

SEQ ID NO: 439218 - DNA, 25 bp, Mus musculus
gaatgctgtattctttttccgaaca

SEQ ID NO: 439219 - DNA, 25 bp, Mus musculus
gaatgctgtattgtttttccgaaca

SEQ ID NO: 439220 - DNA, 25 bp, Mus musculus
gaatgctgtctgaactgagcatagc

SEQ ID NO: 439221 - DNA, 25 bp, Mus musculus
gaatgctgtctgtactgagcatagc

SEQ ID NO: 439222 - DNA, 25 bp, Mus musculus
gaatgctgtgcgcaacgtccttgat

SEQ ID NO: 439223 - DNA, 25 bp, Mus musculus
gaatgctgtgcggaacgtccttgat

SEQ ID NO: 439224 - DNA, 25 bp, Mus musculus
gaatgctgtggtatgcccaacccta

SEQ ID NO: 439225 - DNA, 25 bp, Mus musculus
gaatgctgtggtttgcccaacccta

SEQ ID NO: 439226 - DNA, 25 bp, Mus musculus
gaatgctgtgttaggatctcacgct

SEQ ID NO: 439227 - DNA, 25 bp, Mus musculus
gaatgctgtgttagtcacactcaag

SEQ ID NO: 439228 - DNA, 25 bp, Mus musculus
gaatgctgtgtttggatctcacgct

SEQ ID NO: 439229 - DNA, 25 bp, Mus musculus
gaatgctgtgtttgtcacactcaag

SEQ ID NO: 439230 - DNA, 25 bp, Mus musculus
gaatgctgttgcattcagatttaaa

SEQ ID NO: 439231 - DNA, 25 bp, Mus musculus
gaatgctgttgctttcagatttaaa

SEQ ID NO: 439232 - DNA, 25 bp, Mus musculus
gaatgctgttgtccgaaacactcag

SEQ ID NO: 439233 - DNA, 25 bp, Mus musculus
gaatgctgttgtgcgaaacactcag

SEQ ID NO: 439234 - DNA, 25 bp, Mus musculus
gaatgctgtttcaagattctgctga

SEQ ID NO: 439235 - DNA, 25 bp, Mus musculus
gaatgctgtttctagattctgctga

SEQ ID NO: 439236 - DNA, 25 bp, Mus musculus
gaatgctgttttacccttatatcat

SEQ ID NO: 439237 - DNA, 25 bp, Mus musculus
gaatgctgtttttcccttatatcat

SEQ ID NO: 439238 - DNA, 25 bp, Mus musculus
gaatgcttaaacactctccatgtgg

SEQ ID NO: 439239 - DNA, 25 bp, Mus musculus
gaatgcttaaactctctccatgtgg

SEQ ID NO: 439240 - DNA, 25 bp, Mus musculus
gaatgcttaaccattgtaaacacaa

SEQ ID NO: 439241 - DNA, 25 bp, Mus musculus
gaatgcttaacctttgtaaacacaa

SEQ ID NO: 439242 - DNA, 25 bp, Mus musculus
gaatgcttaagcacagccaactgtt

SEQ ID NO: 439243 - DNA, 25 bp, Mus musculus
gaatgcttaagctcagccaactgtt

SEQ ID NO: 439244 - DNA, 25 bp, Mus musculus
gaatgcttactcacaacctgatttc

SEQ ID NO: 439245 - DNA, 25 bp, Mus musculus
gaatgcttactctcaacctgatttc

SEQ ID NO: 439246 - DNA, 25 bp, Mus musculus
gaatgcttattcatggttgtttcct

SEQ ID NO: 439247 - DNA, 25 bp, Mus musculus
gaatgcttattcttggttgtttcct

SEQ ID NO: 439248 - DNA, 25 bp, Mus musculus
gaatgcttattgctatcagtacttg

SEQ ID NO: 439249 - DNA, 25 bp, Mus musculus
gaatgcttattggtatcagtacttg

SEQ ID NO: 439250 - DNA, 25 bp, Mus musculus
gaatgcttcatcacaggtttccaaa

SEQ ID NO: 439251 - DNA, 25 bp, Mus musculus
gaatgcttcatcatccatctaagat

SEQ ID NO: 439252 - DNA, 25 bp, Mus musculus
gaatgcttcatctcaggtttccaaa

SEQ ID NO: 439253 - DNA, 25 bp, Mus musculus
gaatgcttcatcttccatctaagat

SEQ ID NO: 439254 - DNA, 25 bp, Mus musculus
gaatgcttccacaagaggctaccaa

SEQ ID NO: 439255 - DNA, 25 bp, Mus musculus
gaatgcttccactagaggctaccaa

SEQ ID NO: 439256 - DNA, 25 bp, Mus musculus
gaatgcttccagactgatacctaaa

SEQ ID NO: 439257 - DNA, 25 bp, Mus musculus
gaatgcttccagtctgatacctaaa

SEQ ID NO: 439258 - DNA, 25 bp, Mus musculus
gaatgcttccttaagacctcactta

SEQ ID NO: 439259 - DNA, 25 bp, Mus musculus
gaatgcttcctttagacctcactta

SEQ ID NO: 439260 - DNA, 25 bp, Mus musculus
gaatgcttcggtcggctgtcttcag

SEQ ID NO: 439261 - DNA, 25 bp, Mus musculus
gaatgcttcggtgggctgtcttcag

SEQ ID NO: 439262 - DNA, 25 bp, Mus musculus
gaatgcttctaaaaggcagctaaat

SEQ ID NO: 439263 - DNA, 25 bp, Mus musculus
gaatgcttctaactccaactgtcag

SEQ ID NO: 439264 - DNA, 25 bp, Mus musculus
gaatgcttctaagtccaactgtcag

SEQ ID NO: 439265 - DNA, 25 bp, Mus musculus
gaatgcttctaataggcagctaaat

SEQ ID NO: 439266 - DNA, 25 bp, Mus musculus
gaatgcttctgtacaagtcactagc

SEQ ID NO: 439267 - DNA, 25 bp, Mus musculus
gaatgcttctgttcaagtcactagc

SEQ ID NO: 439268 - DNA, 25 bp, Mus musculus
gaatgcttgaagcaaatgcatgctg

SEQ ID NO: 439269 - DNA, 25 bp, Mus musculus
gaatgcttgaaggaaatgcatgctg

SEQ ID NO: 439270 - DNA, 25 bp, Mus musculus
gaatgcttgaatacattatccctga

SEQ ID NO: 439271 - DNA, 25 bp, Mus musculus
gaatgcttgaattcattatccctga

SEQ ID NO: 439272 - DNA, 25 bp, Mus musculus
gaatgcttgcagaacactttttgta

SEQ ID NO: 439273 - DNA, 25 bp, Mus musculus
gaatgcttgcagtacactttttgta

SEQ ID NO: 439274 - DNA, 25 bp, Mus musculus
gaatgcttgccactttattttataa

SEQ ID NO: 439275 - DNA, 25 bp, Mus musculus
gaatgcttgccagtttattttataa

SEQ ID NO: 439276 - DNA, 25 bp, Mus musculus
gaatgcttgcttcgtgtatgtctgt

SEQ ID NO: 439277 - DNA, 25 bp, Mus musculus
gaatgcttgcttggtgtatgtctgt

SEQ ID NO: 439278 - DNA, 25 bp, Mus musculus
gaatgcttggaaaatctgctctatg

SEQ ID NO: 439279 - DNA, 25 bp, Mus musculus
gaatgcttggaaacaaccctcagct

SEQ ID NO: 439280 - DNA, 25 bp, Mus musculus
gaatgcttggaatatctgctctatg

SEQ ID NO: 439281 - DNA, 25 bp, Mus musculus
gaatgcttggaatcaaccctcagct

SEQ ID NO: 439282 - DNA, 25 bp, Mus musculus
gaatgcttgggaccgtaatcgctca

SEQ ID NO: 439283 - DNA, 25 bp, Mus musculus
gaatgcttgggacttcactgagagt

SEQ ID NO: 439284 - DNA, 25 bp, Mus musculus
gaatgcttgggagcgtaatcgctca

SEQ ID NO: 439285 - DNA, 25 bp, Mus musculus
gaatgcttgggagttcactgagagt

SEQ ID NO: 439286 - DNA, 25 bp, Mus musculus
gaatgcttgtagctctgatgtgtaa

SEQ ID NO: 439287 - DNA, 25 bp, Mus musculus
gaatgcttgtaggtctgatgtgtaa

SEQ ID NO: 439288 - DNA, 25 bp, Mus musculus
gaatgcttgtccaactacattatct

SEQ ID NO: 439289 - DNA, 25 bp, Mus musculus
gaatgcttgtcctactacattatct

SEQ ID NO: 439290 - DNA, 25 bp, Mus musculus
gaatgcttgtctcgctgtgtaaccg

SEQ ID NO: 439291 - DNA, 25 bp, Mus musculus
gaatgcttgtctggctgtgtaaccg

SEQ ID NO: 439292 - DNA, 25 bp, Mus musculus
gaatgcttgtttcgtcacacagaat

SEQ ID NO: 439293 - DNA, 25 bp, Mus musculus
gaatgcttgtttggtcacacagaat

SEQ ID NO: 439294 - DNA, 25 bp, Mus musculus
gaatgctttaaaatctgtcccaaga

SEQ ID NO: 439295 - DNA, 25 bp, Mus musculus
gaatgctttaaaccctaaacctctg

SEQ ID NO: 439296 - DNA, 25 bp, Mus musculus
gaatgctttaaagcctaaacctctg

SEQ ID NO: 439297 - DNA, 25 bp, Mus musculus
gaatgctttaaattctgtcccaaga

SEQ ID NO: 439298 - DNA, 25 bp, Mus musculus
gaatgctttaggatctgtagtccat

SEQ ID NO: 439299 - DNA, 25 bp, Mus musculus
gaatgctttaggttctgtagtccat

SEQ ID NO: 439300 - DNA, 25 bp, Mus musculus
gaatgctttattcagcttaccctta

SEQ ID NO: 439301 - DNA, 25 bp, Mus musculus
gaatgctttattgagcttaccctta

SEQ ID NO: 439302 - DNA, 25 bp, Mus musculus
gaatgctttcccagctaaacataaa

SEQ ID NO: 439303 - DNA, 25 bp, Mus musculus
gaatgctttccctgctaaacataaa

SEQ ID NO: 439304 - DNA, 25 bp, Mus musculus
gaatgctttctcattagctaacgtg

SEQ ID NO: 439305 - DNA, 25 bp, Mus musculus
gaatgctttctctttagctaacgtg

SEQ ID NO: 439306 - DNA, 25 bp, Mus musculus
gaatgctttgtcaggatggcttgaa

SEQ ID NO: 439307 - DNA, 25 bp, Mus musculus
gaatgctttgtcctgaagcagccat

SEQ ID NO: 439308 - DNA, 25 bp, Mus musculus
gaatgctttgtcgtgaagcagccat

SEQ ID NO: 439309 - DNA, 25 bp, Mus musculus
gaatgctttgtctggatggcttgaa

SEQ ID NO: 439310 - DNA, 25 bp, Mus musculus
gaatgcttttacagcactcggaagg

SEQ ID NO: 439311 - DNA, 25 bp, Mus musculus
gaatgcttttactgcactcggaagg

SEQ ID NO: 439312 - DNA, 25 bp, Mus musculus
gaatgcttttatatccgttcaaaca

SEQ ID NO: 439313 - DNA, 25 bp, Mus musculus
gaatgcttttatctggctgggacca

SEQ ID NO: 439314 - DNA, 25 bp, Mus musculus
gaatgcttttatgtggctgggacca

SEQ ID NO: 439315 - DNA, 25 bp, Mus musculus
gaatgcttttatttccgttcaaaca

SEQ ID NO: 439316 - DNA, 25 bp, Mus musculus
gaatgcttttggctacctagcggag

SEQ ID NO: 439317 - DNA, 25 bp, Mus musculus
gaatgcttttgggtacctagcggag

SEQ ID NO: 439318 - DNA, 25 bp, Mus musculus
gaatgctttttcagtgatccactac

SEQ ID NO: 439319 - DNA, 25 bp, Mus musculus
gaatgctttttctgtgatccactac

SEQ ID NO: 439320 - DNA, 25 bp, Mus musculus
gaatggaaaaccagcatgttgtcag

SEQ ID NO: 439321 - DNA, 25 bp, Mus musculus
gaatggaaaacctgcatgttgtcag

SEQ ID NO: 439322 - DNA, 25 bp, Mus musculus
gaatggaaagatcccttcatccaga

SEQ ID NO: 439323 - DNA, 25 bp, Mus musculus
gaatggaaagatgccttcatccaga

SEQ ID NO: 439324 - DNA, 25 bp, Mus musculus
gaatggaaagcacgccccaaagtgt

SEQ ID NO: 439325 - DNA, 25 bp, Mus musculus
gaatggaaagcaggccccaaagtgt

SEQ ID NO: 439326 - DNA, 25 bp, Mus musculus
gaatggaaataacagggccccatcc

SEQ ID NO: 439327 - DNA, 25 bp, Mus musculus
gaatggaaataagagggccccatcc

SEQ ID NO: 439328 - DNA, 25 bp, Mus musculus
gaatggaacacacagtccccaatga

SEQ ID NO: 439329 - DNA, 25 bp, Mus musculus
gaatggaacacagagtccccaatga

SEQ ID NO: 439330 - DNA, 25 bp, Mus musculus
gaatggaacatcacaattccctgaa

SEQ ID NO: 439331 - DNA, 25 bp, Mus musculus
gaatggaacatcctgccttggcaat

SEQ ID NO: 439332 - DNA, 25 bp, Mus musculus
gaatggaacatcgtgccttggcaat

SEQ ID NO: 439333 - DNA, 25 bp, Mus musculus
gaatggaacatctcaattccctgaa

SEQ ID NO: 439334 - DNA, 25 bp, Mus musculus
gaatggaacccacacccgttagaag

SEQ ID NO: 439335 - DNA, 25 bp, Mus musculus
gaatggaacccagacccgttagaag

SEQ ID NO: 439336 - DNA, 25 bp, Mus musculus
gaatggaacctgactcatcttttct

SEQ ID NO: 439337 - DNA, 25 bp, Mus musculus
gaatggaacctgtctcatcttttct

SEQ ID NO: 439338 - DNA, 25 bp, Mus musculus
gaatggaactgaactctggcatata

SEQ ID NO: 439339 - DNA, 25 bp, Mus musculus
gaatggaactgatctctggcatata

SEQ ID NO: 439340 - DNA, 25 bp, Mus musculus
gaatggaagcaaactcttttctgat

SEQ ID NO: 439341 - DNA, 25 bp, Mus musculus
gaatggaagcaatctcttttctgat

SEQ ID NO: 439342 - DNA, 25 bp, Mus musculus
gaatggaagcctcaaagccctccgt

SEQ ID NO: 439343 - DNA, 25 bp, Mus musculus
gaatggaagcctgaaagccctccgt

SEQ ID NO: 439344 - DNA, 25 bp, Mus musculus
gaatggaagcttactcagcagacaa

SEQ ID NO: 439345 - DNA, 25 bp, Mus musculus
gaatggaagctttctcagcagacaa

SEQ ID NO: 439346 - DNA, 25 bp, Mus musculus
gaatggaatcaaatctatgctctag

SEQ ID NO: 439347 - DNA, 25 bp, Mus musculus
gaatggaatcaattctatgctctag

SEQ ID NO: 439348 - DNA, 25 bp, Mus musculus
gaatggaatcatctgcagcctcatg

SEQ ID NO: 439349 - DNA, 25 bp, Mus musculus
gaatggaatcatgtgcagcctcatg

SEQ ID NO: 439350 - DNA, 25 bp, Mus musculus
gaatggaatccaccacagtcagtcc

SEQ ID NO: 439351 - DNA, 25 bp, Mus musculus
gaatggaatccagcacagtcagtcc

SEQ ID NO: 439352 - DNA, 25 bp, Mus musculus
gaatggaatgagatccctctctcaa

SEQ ID NO: 439353 - DNA, 25 bp, Mus musculus
gaatggaatgagttccctctctcaa

SEQ ID NO: 439354 - DNA, 25 bp, Mus musculus
gaatggaatgcccaccaggccgagt

SEQ ID NO: 439355 - DNA, 25 bp, Mus musculus
gaatggaatgcccagatttctcagt

SEQ ID NO: 439356 - DNA, 25 bp, Mus musculus
gaatggaatgccgaccaggccgagt

SEQ ID NO: 439357 - DNA, 25 bp, Mus musculus
gaatggaatgccgagatttctcagt

SEQ ID NO: 439358 - DNA, 25 bp, Mus musculus
gaatggacacaaaatgtttgtttgc

SEQ ID NO: 439359 - DNA, 25 bp, Mus musculus
gaatggacacaatatgtttgtttgc

SEQ ID NO: 439360 - DNA, 25 bp, Mus musculus
gaatggacaccaactctgcagcact

SEQ ID NO: 439361 - DNA, 25 bp, Mus musculus
gaatggacaccatctctgcagcact

SEQ ID NO: 439362 - DNA, 25 bp, Mus musculus
gaatggacacttccagtctcaagga

SEQ ID NO: 439363 - DNA, 25 bp, Mus musculus
gaatggacacttgcagtctcaagga

SEQ ID NO: 439364 - DNA, 25 bp, Mus musculus
gaatggacagcaccagtctttccta

SEQ ID NO: 439365 - DNA, 25 bp, Mus musculus
gaatggacagcagcagtctttccta

SEQ ID NO: 439366 - DNA, 25 bp, Mus musculus
gaatggacatggatcctcagataac

SEQ ID NO: 439367 - DNA, 25 bp, Mus musculus
gaatggacatggttcctcagataac

SEQ ID NO: 439368 - DNA, 25 bp, Mus musculus
gaatggacattaccagaagggttaa

SEQ ID NO: 439369 - DNA, 25 bp, Mus musculus
gaatggacattagcagaagggttaa

SEQ ID NO: 439370 - DNA, 25 bp, Mus musculus
gaatggacatttcataacccctcga

SEQ ID NO: 439371 - DNA, 25 bp, Mus musculus
gaatggacatttgataacccctcga

SEQ ID NO: 439372 - DNA, 25 bp, Mus musculus
gaatggaccacaatccttcacagtg

SEQ ID NO: 439373 - DNA, 25 bp, Mus musculus
gaatggaccacattccttcacagtg

SEQ ID NO: 439374 - DNA, 25 bp, Mus musculus
gaatggacccaaaggctaatgctac

SEQ ID NO: 439375 - DNA, 25 bp, Mus musculus
gaatggacccaatggctaatgctac

SEQ ID NO: 439376 - DNA, 25 bp, Mus musculus
gaatggacccacagcaactggtcag

SEQ ID NO: 439377 - DNA, 25 bp, Mus musculus
gaatggacccactgcaactggtcag

SEQ ID NO: 439378 - DNA, 25 bp, Mus musculus
gaatggacccagaggcgacaatcac

SEQ ID NO: 439379 - DNA, 25 bp, Mus musculus
gaatggacccagtggcgacaatcac

SEQ ID NO: 439380 - DNA, 25 bp, Mus musculus
gaatggaccccgctcgtacgcgcgt

SEQ ID NO: 439381 - DNA, 25 bp, Mus musculus
gaatggaccccggtcgtacgcgcgt

SEQ ID NO: 439382 - DNA, 25 bp, Mus musculus
gaatggacccttccagtggcttgac

SEQ ID NO: 439383 - DNA, 25 bp, Mus musculus
gaatggacccttgcagtggcttgac

SEQ ID NO: 439384 - DNA, 25 bp, Mus musculus
gaatggaccgttactggacttctcc

SEQ ID NO: 439385 - DNA, 25 bp, Mus musculus
gaatggaccgtttctggacttctcc

SEQ ID NO: 439386 - DNA, 25 bp, Mus musculus
gaatggacctccaaccctgagagca

SEQ ID NO: 439387 - DNA, 25 bp, Mus musculus
gaatggacctcctaccctgagagca

SEQ ID NO: 439388 - DNA, 25 bp, Mus musculus
gaatggacctctattgctatggctc

SEQ ID NO: 439389 - DNA, 25 bp, Mus musculus
gaatggacctcttttgctatggctc

SEQ ID NO: 439390 - DNA, 25 bp, Mus musculus
gaatggacctggaagagcccgagaa

SEQ ID NO: 439391 - DNA, 25 bp, Mus musculus
gaatggacctggtagagcccgagaa

SEQ ID NO: 439392 - DNA, 25 bp, Mus musculus
gaatggacctgtctttgcaaaagca

SEQ ID NO: 439393 - DNA, 25 bp, Mus musculus
gaatggacctgtgtttgcaaaagca

SEQ ID NO: 439394 - DNA, 25 bp, Mus musculus
gaatggaccttgatggatctggaca

SEQ ID NO: 439395 - DNA, 25 bp, Mus musculus
gaatggaccttgttggatctggaca

SEQ ID NO: 439396 - DNA, 25 bp, Mus musculus
gaatggacgagtactcccgcgggaa

SEQ ID NO: 439397 - DNA, 25 bp, Mus musculus
gaatggacgagttctcccgcgggaa

SEQ ID NO: 439398 - DNA, 25 bp, Mus musculus
gaatggacgtctccagccagtgcag

SEQ ID NO: 439399 - DNA, 25 bp, Mus musculus
gaatggacgtctgcagccagtgcag

SEQ ID NO: 439400 - DNA, 25 bp, Mus musculus
gaatggactccgaaggttgtctccc

SEQ ID NO: 439401 - DNA, 25 bp, Mus musculus
gaatggactccgactggctaatggg

SEQ ID NO: 439402 - DNA, 25 bp, Mus musculus
gaatggactccgtaggttgtctccc

SEQ ID NO: 439403 - DNA, 25 bp, Mus musculus
gaatggactccgtctggctaatggg

SEQ ID NO: 439404 - DNA, 25 bp, Mus musculus
gaatggactcttcatgtcaacttct

SEQ ID NO: 439405 - DNA, 25 bp, Mus musculus
gaatggactcttccaaattgtcctc

SEQ ID NO: 439406 - DNA, 25 bp, Mus musculus
gaatggactcttgatgtcaacttct

SEQ ID NO: 439407 - DNA, 25 bp, Mus musculus
gaatggactcttgcaaattgtcctc

SEQ ID NO: 439408 - DNA, 25 bp, Mus musculus
gaatggactgagactggagccccag

SEQ ID NO: 439409 - DNA, 25 bp, Mus musculus
gaatggactgagtctggagccccag

SEQ ID NO: 439410 - DNA, 25 bp, Mus musculus
gaatggacttcgaacactgtggcct

SEQ ID NO: 439411 - DNA, 25 bp, Mus musculus
gaatggacttcgtacactgtggcct

SEQ ID NO: 439412 - DNA, 25 bp, Mus musculus
gaatggactttgctcgtgtgcatag

SEQ ID NO: 439413 - DNA, 25 bp, Mus musculus
gaatggactttggtcgtgtgcatag

SEQ ID NO: 439414 - DNA, 25 bp, Mus musculus
gaatggacttttcatgacctcttaa

SEQ ID NO: 439415 - DNA, 25 bp, Mus musculus
gaatggacttttgatgacctcttaa

SEQ ID NO: 439416 - DNA, 25 bp, Mus musculus
gaatggagaacgacagcctctctgc

SEQ ID NO: 439417 - DNA, 25 bp, Mus musculus
gaatggagaacgtcagcctctctgc

SEQ ID NO: 439418 - DNA, 25 bp, Mus musculus
gaatggagacaacccttttctcttc

SEQ ID NO: 439419 - DNA, 25 bp, Mus musculus
gaatggagacaagccttttctcttc

SEQ ID NO: 439420 - DNA, 25 bp, Mus musculus
gaatggagattgcagtttgacagta

SEQ ID NO: 439421 - DNA, 25 bp, Mus musculus
gaatggagattggagtttgacagta

SEQ ID NO: 439422 - DNA, 25 bp, Mus musculus
gaatggagcacaacaaagtacacag

SEQ ID NO: 439423 - DNA, 25 bp, Mus musculus
gaatggagcacatcaaagtacacag

SEQ ID NO: 439424 - DNA, 25 bp, Mus musculus
gaatggagcagactacgctgtttat

SEQ ID NO: 439425 - DNA, 25 bp, Mus musculus
gaatggagcagagtacgctgtttat

SEQ ID NO: 439426 - DNA, 25 bp, Mus musculus
gaatggagcagtatcctcatctggc

SEQ ID NO: 439427 - DNA, 25 bp, Mus musculus
gaatggagcagtttcctcatctggc

SEQ ID NO: 439428 - DNA, 25 bp, Mus musculus
gaatggagccaacctagtcatggtg

SEQ ID NO: 439429 - DNA, 25 bp, Mus musculus
gaatggagccaagctagtcatggtg

SEQ ID NO: 439430 - DNA, 25 bp, Mus musculus
gaatggagccagaaggtactgaaca

SEQ ID NO: 439431 - DNA, 25 bp, Mus musculus
gaatggagccagtaggtactgaaca

SEQ ID NO: 439432 - DNA, 25 bp, Mus musculus
gaatggagccatacctcggctacat

SEQ ID NO: 439433 - DNA, 25 bp, Mus musculus
gaatggagccattcctcggctacat

SEQ ID NO: 439434 - DNA, 25 bp, Mus musculus
gaatggagcccaaatgccgaccaaa

SEQ ID NO: 439435 - DNA, 25 bp, Mus musculus
gaatggagcccatatgccgaccaaa

SEQ ID NO: 439436 - DNA, 25 bp, Mus musculus
gaatggagcctcagcacgaaagatt

SEQ ID NO: 439437 - DNA, 25 bp, Mus musculus
gaatggagcctctgcacgaaagatt

SEQ ID NO: 439438 - DNA, 25 bp, Mus musculus
gaatggagcgccctgtctcctcatg

SEQ ID NO: 439439 - DNA, 25 bp, Mus musculus
gaatggagcgccgtgtctcctcatg

SEQ ID NO: 439440 - DNA, 25 bp, Mus musculus
gaatggaggctacaagtcccaactt

SEQ ID NO: 439441 - DNA, 25 bp, Mus musculus
gaatggaggctagaagtcccaactt

SEQ ID NO: 439442 - DNA, 25 bp, Mus musculus
gaatggaggctgatcgacttcggaa

SEQ ID NO: 439443 - DNA, 25 bp, Mus musculus
gaatggaggctgttcgacttcggaa

SEQ ID NO: 439444 - DNA, 25 bp, Mus musculus
gaatggagggacagccatacccaac

SEQ ID NO: 439445 - DNA, 25 bp, Mus musculus
gaatggagggactgccatacccaac

SEQ ID NO: 439446 - DNA, 25 bp, Mus musculus
gaatggaggttacgctcaccatcca

SEQ ID NO: 439447 - DNA, 25 bp, Mus musculus
gaatggaggttaggctcaccatcca

SEQ ID NO: 439448 - DNA, 25 bp, Mus musculus
gaatggagtctgaaatcttggcact

SEQ ID NO: 439449 - DNA, 25 bp, Mus musculus
gaatggagtctgctgcctccaaagg

SEQ ID NO: 439450 - DNA, 25 bp, Mus musculus
gaatggagtctggtgcctccaaagg

SEQ ID NO: 439451 - DNA, 25 bp, Mus musculus
gaatggagtctgtaatcttggcact

SEQ ID NO: 439452 - DNA, 25 bp, Mus musculus
gaatggagtgtgcaacaatttcaag

SEQ ID NO: 439453 - DNA, 25 bp, Mus musculus
gaatggagtgtgcttccctcatctc

SEQ ID NO: 439454 - DNA, 25 bp, Mus musculus
gaatggagtgtggaacaatttcaag

SEQ ID NO: 439455 - DNA, 25 bp, Mus musculus
gaatggagtgtggttccctcatctc

SEQ ID NO: 439456 - DNA, 25 bp, Mus musculus
gaatggagttcactccccttagaaa

SEQ ID NO: 439457 - DNA, 25 bp, Mus musculus
gaatggagttcagtccccttagaaa

SEQ ID NO: 439458 - DNA, 25 bp, Mus musculus
gaatggagttgcactcgccagaaga

SEQ ID NO: 439459 - DNA, 25 bp, Mus musculus
gaatggagttgctctcgccagaaga

SEQ ID NO: 439460 - DNA, 25 bp, Mus musculus
gaatggataagcatgctcttctcct

SEQ ID NO: 439461 - DNA, 25 bp, Mus musculus
gaatggataagcttgctcttctcct

SEQ ID NO: 439462 - DNA, 25 bp, Mus musculus
gaatggatagctattgtataacaaa

SEQ ID NO: 439463 - DNA, 25 bp, Mus musculus
gaatggatagcttttgtataacaaa

SEQ ID NO: 439464 - DNA, 25 bp, Mus musculus
gaatggatcactcaccttggagctt

SEQ ID NO: 439465 - DNA, 25 bp, Mus musculus
gaatggatcactgaccttggagctt

SEQ ID NO: 439466 - DNA, 25 bp, Mus musculus
gaatggatcattatgctctgtgaaa

SEQ ID NO: 439467 - DNA, 25 bp, Mus musculus
gaatggatcattttgctctgtgaaa

SEQ ID NO: 439468 - DNA, 25 bp, Mus musculus
gaatggatccctcaaaggactaaat

SEQ ID NO: 439469 - DNA, 25 bp, Mus musculus
gaatggatccctccgataaactctc

SEQ ID NO: 439470 - DNA, 25 bp, Mus musculus
gaatggatccctgaaaggactaaat

SEQ ID NO: 439471 - DNA, 25 bp, Mus musculus
gaatggatccctgcgataaactctc

SEQ ID NO: 439472 - DNA, 25 bp, Mus musculus
gaatggatcgtgcagcagctgggtc

SEQ ID NO: 439473 - DNA, 25 bp, Mus musculus
gaatggatcgtggagcagctgggtc

SEQ ID NO: 439474 - DNA, 25 bp, Mus musculus
gaatggatgaaaccctggccaccag

SEQ ID NO: 439475 - DNA, 25 bp, Mus musculus
gaatggatgaaagcctggccaccag

SEQ ID NO: 439476 - DNA, 25 bp, Mus musculus
gaatggatgccaacgtgcttttcct

SEQ ID NO: 439477 - DNA, 25 bp, Mus musculus
gaatggatgccatcgtgcttttcct

SEQ ID NO: 439478 - DNA, 25 bp, Mus musculus
gaatggatggatcccaccgtgtcga

SEQ ID NO: 439479 - DNA, 25 bp, Mus musculus
gaatggatggatgccaccgtgtcga

SEQ ID NO: 439480 - DNA, 25 bp, Mus musculus
gaatggattcctacaagagtcatgg

SEQ ID NO: 439481 - DNA, 25 bp, Mus musculus
gaatggattcctacctataaggtct

SEQ ID NO: 439482 - DNA, 25 bp, Mus musculus
gaatggattccttcaagagtcatgg

SEQ ID NO: 439483 - DNA, 25 bp, Mus musculus
gaatggattccttcctataaggtct

SEQ ID NO: 439484 - DNA, 25 bp, Mus musculus
gaatggattcgtacaactgctattt

SEQ ID NO: 439485 - DNA, 25 bp, Mus musculus
gaatggattcgtcacaaatttacca

SEQ ID NO: 439486 - DNA, 25 bp, Mus musculus
gaatggattcgtgacaaatttacca

SEQ ID NO: 439487 - DNA, 25 bp, Mus musculus
gaatggattcgttcaactgctattt

SEQ ID NO: 439488 - DNA, 25 bp, Mus musculus
gaatggatttaaaactgtctggaat

SEQ ID NO: 439489 - DNA, 25 bp, Mus musculus
gaatggatttaatactgtctggaat

SEQ ID NO: 439490 - DNA, 25 bp, Mus musculus
gaatggatttccatctggtggagag

SEQ ID NO: 439491 - DNA, 25 bp, Mus musculus
gaatggatttccttctggtggagag

SEQ ID NO: 439492 - DNA, 25 bp, Mus musculus
gaatggattttgcagccatgcccca

SEQ ID NO: 439493 - DNA, 25 bp, Mus musculus
gaatggattttggagccatgcccca

SEQ ID NO: 439494 - DNA, 25 bp, Mus musculus
gaatggcaaactatttctctcaagc

SEQ ID NO: 439495 - DNA, 25 bp, Mus musculus
gaatggcaaactttttctctcaagc

SEQ ID NO: 439496 - DNA, 25 bp, Mus musculus
gaatggcaaagcattccctgtgcgt

SEQ ID NO: 439497 - DNA, 25 bp, Mus musculus
gaatggcaaagctttccctgtgcgt

SEQ ID NO: 439498 - DNA, 25 bp, Mus musculus
gaatggcaagacctcccaataccgt

SEQ ID NO: 439499 - DNA, 25 bp, Mus musculus
gaatggcaagacctgcccagtccct

SEQ ID NO: 439500 - DNA, 25 bp, Mus musculus
gaatggcaagacgtcccaataccgt

SEQ ID NO: 439501 - DNA, 25 bp, Mus musculus
gaatggcaagacgtgcccagtccct

SEQ ID NO: 439502 - DNA, 25 bp, Mus musculus
gaatggcaagctccaggccggcatt

SEQ ID NO: 439503 - DNA, 25 bp, Mus musculus
gaatggcaagctgcaggccggcatt

SEQ ID NO: 439504 - DNA, 25 bp, Mus musculus
gaatggcaatacatgttagctcttt

SEQ ID NO: 439505 - DNA, 25 bp, Mus musculus
gaatggcaatacttgttagctcttt

SEQ ID NO: 439506 - DNA, 25 bp, Mus musculus
gaatggcaatggatctggagtcctt

SEQ ID NO: 439507 - DNA, 25 bp, Mus musculus
gaatggcaatggttctggagtcctt

SEQ ID NO: 439508 - DNA, 25 bp, Mus musculus
gaatggcacaatcctggcctgggcc

SEQ ID NO: 439509 - DNA, 25 bp, Mus musculus
gaatggcacaatgctggcctgggcc

SEQ ID NO: 439510 - DNA, 25 bp, Mus musculus
gaatggcacagaagttccccggctc

SEQ ID NO: 439511 - DNA, 25 bp, Mus musculus
gaatggcacagatgttccccggctc

SEQ ID NO: 439512 - DNA, 25 bp, Mus musculus
gaatggcaccatatccaaggctgga

SEQ ID NO: 439513 - DNA, 25 bp, Mus musculus
gaatggcaccatttccaaggctgga

SEQ ID NO: 439514 - DNA, 25 bp, Mus musculus
gaatggcaccctaatggttcagaga

SEQ ID NO: 439515 - DNA, 25 bp, Mus musculus
gaatggcaccctattgcaaggaagg

SEQ ID NO: 439516 - DNA, 25 bp, Mus musculus
gaatggcacccttatggttcagaga

SEQ ID NO: 439517 - DNA, 25 bp, Mus musculus
gaatggcacccttttgcaaggaagg

SEQ ID NO: 439518 - DNA, 25 bp, Mus musculus
gaatggcactagagtcttccccaag

SEQ ID NO: 439519 - DNA, 25 bp, Mus musculus
gaatggcactagtgtcttccccaag

SEQ ID NO: 439520 - DNA, 25 bp, Mus musculus
gaatggcagccgaaacacgtacctg

SEQ ID NO: 439521 - DNA, 25 bp, Mus musculus
gaatggcagccgtaacacgtacctg

SEQ ID NO: 439522 - DNA, 25 bp, Mus musculus
gaatggcagctactctgaaagggaa

SEQ ID NO: 439523 - DNA, 25 bp, Mus musculus
gaatggcagctagtctgaaagggaa

SEQ ID NO: 439524 - DNA, 25 bp, Mus musculus
gaatggcagcttaattttgggaggc

SEQ ID NO: 439525 - DNA, 25 bp, Mus musculus
gaatggcagctttattttgggaggc

SEQ ID NO: 439526 - DNA, 25 bp, Mus musculus
gaatggcagggaagctacctctata

SEQ ID NO: 439527 - DNA, 25 bp, Mus musculus
gaatggcagggatgctacctctata

SEQ ID NO: 439528 - DNA, 25 bp, Mus musculus
gaatggcagggcattctcctggtct

SEQ ID NO: 439529 - DNA, 25 bp, Mus musculus
gaatggcagggctttctcctggtct

SEQ ID NO: 439530 - DNA, 25 bp, Mus musculus
gaatggcagtacaccctgttttaag

SEQ ID NO: 439531 - DNA, 25 bp, Mus musculus
gaatggcagtactccctgttttaag

SEQ ID NO: 439532 - DNA, 25 bp, Mus musculus
gaatggcagtcactacagctactca

SEQ ID NO: 439533 - DNA, 25 bp, Mus musculus
gaatggcagtcagtacagctactca

SEQ ID NO: 439534 - DNA, 25 bp, Mus musculus
gaatggcagtccacacactgtggca

SEQ ID NO: 439535 - DNA, 25 bp, Mus musculus
gaatggcagtcctcacactgtggca

SEQ ID NO: 439536 - DNA, 25 bp, Mus musculus
gaatggcagtgacttccctgttaat

SEQ ID NO: 439537 - DNA, 25 bp, Mus musculus
gaatggcagtgagttccctgttaat

SEQ ID NO: 439538 - DNA, 25 bp, Mus musculus
gaatggcagttcaaggcacctctgt

SEQ ID NO: 439539 - DNA, 25 bp, Mus musculus
gaatggcagttcctttgcaatgtta

SEQ ID NO: 439540 - DNA, 25 bp, Mus musculus
gaatggcagttcgtttgcaatgtta

SEQ ID NO: 439541 - DNA, 25 bp, Mus musculus
gaatggcagttctaggcacctctgt

SEQ ID NO: 439542 - DNA, 25 bp, Mus musculus
gaatggcatcaaagaagtatggaaa

SEQ ID NO: 439543 - DNA, 25 bp, Mus musculus
gaatggcatcaatgaagtatggaaa

SEQ ID NO: 439544 - DNA, 25 bp, Mus musculus
gaatggcatcacatcactgtctgca

SEQ ID NO: 439545 - DNA, 25 bp, Mus musculus
gaatggcatcacttcactgtctgca

SEQ ID NO: 439546 - DNA, 25 bp, Mus musculus
gaatggcatcctctgaaaatactct

SEQ ID NO: 439547 - DNA, 25 bp, Mus musculus
gaatggcatcctgtgaaaatactct

SEQ ID NO: 439548 - DNA, 25 bp, Mus musculus
gaatggcatctgacactcttagttt

SEQ ID NO: 439549 - DNA, 25 bp, Mus musculus
gaatggcatctgtcactcttagttt

SEQ ID NO: 439550 - DNA, 25 bp, Mus musculus
gaatggcatgtacctttcttagagt

SEQ ID NO: 439551 - DNA, 25 bp, Mus musculus
gaatggcatgtagctttcttagagt

SEQ ID NO: 439552 - DNA, 25 bp, Mus musculus
gaatggcattctatcacttcaaggc

SEQ ID NO: 439553 - DNA, 25 bp, Mus musculus
gaatggcattctttcacttcaaggc

SEQ ID NO: 439554 - DNA, 25 bp, Mus musculus
gaatggcattgtcatcgcttcatct

SEQ ID NO: 439555 - DNA, 25 bp, Mus musculus
gaatggcattgtctgctgtgtatca

SEQ ID NO: 439556 - DNA, 25 bp, Mus musculus
gaatggcattgtgatcgcttcatct

SEQ ID NO: 439557 - DNA, 25 bp, Mus musculus
gaatggcattgtgtgctgtgtatca

SEQ ID NO: 439558 - DNA, 25 bp, Mus musculus
gaatggccaaacatactgcagagtg

SEQ ID NO: 439559 - DNA, 25 bp, Mus musculus
gaatggccaaacttactgcagagtg

SEQ ID NO: 439560 - DNA, 25 bp, Mus musculus
gaatggccaacaacccgaagaaaac

SEQ ID NO: 439561 - DNA, 25 bp, Mus musculus
gaatggccaacatcccgaagaaaac

SEQ ID NO: 439562 - DNA, 25 bp, Mus musculus
gaatggccaaggcttacctcacttg

SEQ ID NO: 439563 - DNA, 25 bp, Mus musculus
gaatggccaagggttacctcacttg

SEQ ID NO: 439564 - DNA, 25 bp, Mus musculus
gaatggccacccagtgttgtgggaa

SEQ ID NO: 439565 - DNA, 25 bp, Mus musculus
gaatggccaccctgtgttgtgggaa

SEQ ID NO: 439566 - DNA, 25 bp, Mus musculus
gaatggccacgccttgtagacggaa

SEQ ID NO: 439567 - DNA, 25 bp, Mus musculus
gaatggccacgcgttgtagacggaa

SEQ ID NO: 439568 - DNA, 25 bp, Mus musculus
gaatggccaggcatctcagctctta

SEQ ID NO: 439569 - DNA, 25 bp, Mus musculus
gaatggccaggcttctcagctctta

SEQ ID NO: 439570 - DNA, 25 bp, Mus musculus
gaatggccagtaagccctctcttaa

SEQ ID NO: 439571 - DNA, 25 bp, Mus musculus
gaatggccagtatgccctctcttaa

SEQ ID NO: 439572 - DNA, 25 bp, Mus musculus
gaatggccattcaacccagataggt

SEQ ID NO: 439573 - DNA, 25 bp, Mus musculus
gaatggccattcagctcacacatta

SEQ ID NO: 439574 - DNA, 25 bp, Mus musculus
gaatggccattcaggtgatgtcata

SEQ ID NO: 439575 - DNA, 25 bp, Mus musculus
gaatggccattctacccagataggt

SEQ ID NO: 439576 - DNA, 25 bp, Mus musculus
gaatggccattctgctcacacatta

SEQ ID NO: 439577 - DNA, 25 bp, Mus musculus
gaatggccattctggtgatgtcata

SEQ ID NO: 439578 - DNA, 25 bp, Mus musculus
gaatggcccacaaaataggttttct

SEQ ID NO: 439579 - DNA, 25 bp, Mus musculus
gaatggcccacataataggttttct

SEQ ID NO: 439580 - DNA, 25 bp, Mus musculus
gaatggcccagtcagagcatatttg

SEQ ID NO: 439581 - DNA, 25 bp, Mus musculus
gaatggcccagtgagagcatatttg

SEQ ID NO: 439582 - DNA, 25 bp, Mus musculus
gaatggccccaaactttgcaggata

SEQ ID NO: 439583 - DNA, 25 bp, Mus musculus
gaatggccccaatctttgcaggata

SEQ ID NO: 439584 - DNA, 25 bp, Mus musculus
gaatggcccctgacatccagatgac

SEQ ID NO: 439585 - DNA, 25 bp, Mus musculus
gaatggcccctgtcatccagatgac

SEQ ID NO: 439586 - DNA, 25 bp, Mus musculus
gaatggccctgtcgtcacagagctg

SEQ ID NO: 439587 - DNA, 25 bp, Mus musculus
gaatggccctgtggtcacagagctg

SEQ ID NO: 439588 - DNA, 25 bp, Mus musculus
gaatggccgcatcggctctgtagcc

SEQ ID NO: 439589 - DNA, 25 bp, Mus musculus
gaatggccgcatgggctctgtagcc

SEQ ID NO: 439590 - DNA, 25 bp, Mus musculus
gaatggccgctaagcatccagatgg

SEQ ID NO: 439591 - DNA, 25 bp, Mus musculus
gaatggccgctatgcatccagatgg

SEQ ID NO: 439592 - DNA, 25 bp, Mus musculus
gaatggccggcccatcagagccatt

SEQ ID NO: 439593 - DNA, 25 bp, Mus musculus
gaatggccggccgatcagagccatt

SEQ ID NO: 439594 - DNA, 25 bp, Mus musculus
gaatggcctcctcacttgccgttgg

SEQ ID NO: 439595 - DNA, 25 bp, Mus musculus
gaatggcctcctgacttgccgttgg

SEQ ID NO: 439596 - DNA, 25 bp, Mus musculus
gaatggccttgacccttggagataa

SEQ ID NO: 439597 - DNA, 25 bp, Mus musculus
gaatggccttgagccttggagataa

SEQ ID NO: 439598 - DNA, 25 bp, Mus musculus
gaatggcctttgcactagaggaagt

SEQ ID NO: 439599 - DNA, 25 bp, Mus musculus
gaatggcctttggactagaggaagt

SEQ ID NO: 439600 - DNA, 25 bp, Mus musculus
gaatggcgaatgactgctgacctcc

SEQ ID NO: 439601 - DNA, 25 bp, Mus musculus
gaatggcgaatgtctgctgacctcc

SEQ ID NO: 439602 - DNA, 25 bp, Mus musculus
gaatggcgaccacagcactcatttc

SEQ ID NO: 439603 - DNA, 25 bp, Mus musculus
gaatggcgaccagagcactcatttc

SEQ ID NO: 439604 - DNA, 25 bp, Mus musculus
gaatggcgagttcaacctgttgagc

SEQ ID NO: 439605 - DNA, 25 bp, Mus musculus
gaatggcgagttgaacctgttgagc

SEQ ID NO: 439606 - DNA, 25 bp, Mus musculus
gaatggcgcataaaggctgatctct

SEQ ID NO: 439607 - DNA, 25 bp, Mus musculus
gaatggcgcatataggctgatctct

SEQ ID NO: 439608 - DNA, 25 bp, Mus musculus
gaatggcgccaaatgggtcacggat

SEQ ID NO: 439609 - DNA, 25 bp, Mus musculus
gaatggcgccaattgggtcacggat

SEQ ID NO: 439610 - DNA, 25 bp, Mus musculus
gaatggcgccacatgcctctgatct

SEQ ID NO: 439611 - DNA, 25 bp, Mus musculus
gaatggcgccacttgcctctgatct

SEQ ID NO: 439612 - DNA, 25 bp, Mus musculus
gaatggcgcctaataaatgctgtcc

SEQ ID NO: 439613 - DNA, 25 bp, Mus musculus
gaatggcgcctattaaatgctgtcc

SEQ ID NO: 439614 - DNA, 25 bp, Mus musculus
gaatggcgcgtcaatttcactgcac

SEQ ID NO: 439615 - DNA, 25 bp, Mus musculus
gaatggcgcgtctatttcactgcac

SEQ ID NO: 439616 - DNA, 25 bp, Mus musculus
gaatggcggccaacctaaccaataa

SEQ ID NO: 439617 - DNA, 25 bp, Mus musculus
gaatggcggccatcctaaccaataa

SEQ ID NO: 439618 - DNA, 25 bp, Mus musculus
gaatggctaaggattcctgcgaact

SEQ ID NO: 439619 - DNA, 25 bp, Mus musculus
gaatggctaaggtttcctgcgaact

SEQ ID NO: 439620 - DNA, 25 bp, Mus musculus
gaatggctacaccaaaggacaccag

SEQ ID NO: 439621 - DNA, 25 bp, Mus musculus
gaatggctacacgaaaggacaccag

SEQ ID NO: 439622 - DNA, 25 bp, Mus musculus
gaatggctatagacttaccaccact

SEQ ID NO: 439623 - DNA, 25 bp, Mus musculus
gaatggctatagtcttaccaccact

SEQ ID NO: 439624 - DNA, 25 bp, Mus musculus
gaatggctcaccagagtcaggctga

SEQ ID NO: 439625 - DNA, 25 bp, Mus musculus
gaatggctcacctgagtcaggctga

SEQ ID NO: 439626 - DNA, 25 bp, Mus musculus
gaatggctcagtcaaccctggaaat

SEQ ID NO: 439627 - DNA, 25 bp, Mus musculus
gaatggctcagtgaaccctggaaat

SEQ ID NO: 439628 - DNA, 25 bp, Mus musculus
gaatggctcataatttggtgcagtg

SEQ ID NO: 439629 - DNA, 25 bp, Mus musculus
gaatggctcatattttggtgcagtg

SEQ ID NO: 439630 - DNA, 25 bp, Mus musculus
gaatggctccaacgtgaagtactct

SEQ ID NO: 439631 - DNA, 25 bp, Mus musculus
gaatggctccaaggtgaagtactct

SEQ ID NO: 439632 - DNA, 25 bp, Mus musculus
gaatggctccaccttggtgccagcc

SEQ ID NO: 439633 - DNA, 25 bp, Mus musculus
gaatggctccacgttggtgccagcc

SEQ ID NO: 439634 - DNA, 25 bp, Mus musculus
gaatggctcccaaaggctcatctat

SEQ ID NO: 439635 - DNA, 25 bp, Mus musculus
gaatggctcccataggctcatctat

SEQ ID NO: 439636 - DNA, 25 bp, Mus musculus
gaatggctccctctctttagaaaga

SEQ ID NO: 439637 - DNA, 25 bp, Mus musculus
gaatggctccctgtctttagaaaga

SEQ ID NO: 439638 - DNA, 25 bp, Mus musculus
gaatggctcctcaggcagggctcag

SEQ ID NO: 439639 - DNA, 25 bp, Mus musculus
gaatggctcctctggcagggctcag

SEQ ID NO: 439640 - DNA, 25 bp, Mus musculus
gaatggctctcaatagacttcattg

SEQ ID NO: 439641 - DNA, 25 bp, Mus musculus
gaatggctctcattagacttcattg

SEQ ID NO: 439642 - DNA, 25 bp, Mus musculus
gaatggctctccattcaaagcttta

SEQ ID NO: 439643 - DNA, 25 bp, Mus musculus
gaatggctctcctttcaaagcttta

SEQ ID NO: 439644 - DNA, 25 bp, Mus musculus
gaatggctctgacttgtgttgtgta

SEQ ID NO: 439645 - DNA, 25 bp, Mus musculus
gaatggctctgagttgtgttgtgta

SEQ ID NO: 439646 - DNA, 25 bp, Mus musculus
gaatggctctttcgttgaaatccga

SEQ ID NO: 439647 - DNA, 25 bp, Mus musculus
gaatggctctttggttgaaatccga

SEQ ID NO: 439648 - DNA, 25 bp, Mus musculus
gaatggctgacaatccagggaaaac

SEQ ID NO: 439649 - DNA, 25 bp, Mus musculus
gaatggctgacattccagggaaaac

SEQ ID NO: 439650 - DNA, 25 bp, Mus musculus
gaatggctgaccacagcaatgacca

SEQ ID NO: 439651 - DNA, 25 bp, Mus musculus
gaatggctgacctcagcaatgacca

SEQ ID NO: 439652 - DNA, 25 bp, Mus musculus
gaatggctgagactttgctcatgaa

SEQ ID NO: 439653 - DNA, 25 bp, Mus musculus
gaatggctgagagtttgctcatgaa

SEQ ID NO: 439654 - DNA, 25 bp, Mus musculus
gaatggctgggcaacccacctcaga

SEQ ID NO: 439655 - DNA, 25 bp, Mus musculus
gaatggctgggctacccacctcaga

SEQ ID NO: 439656 - DNA, 25 bp, Mus musculus
gaatggctggttcgtgtcccctctt

SEQ ID NO: 439657 - DNA, 25 bp, Mus musculus
gaatggctggttggtgtcccctctt

SEQ ID NO: 439658 - DNA, 25 bp, Mus musculus
gaatggctgtacacacgactcacag

SEQ ID NO: 439659 - DNA, 25 bp, Mus musculus
gaatggctgtactcacgactcacag

SEQ ID NO: 439660 - DNA, 25 bp, Mus musculus
gaatggctgtctacattgttagaca

SEQ ID NO: 439661 - DNA, 25 bp, Mus musculus
gaatggctgtcttcattgttagaca

SEQ ID NO: 439662 - DNA, 25 bp, Mus musculus
gaatggcttactaatggactcttta

SEQ ID NO: 439663 - DNA, 25 bp, Mus musculus
gaatggcttactacacttaacatga

SEQ ID NO: 439664 - DNA, 25 bp, Mus musculus
gaatggcttacttatggactcttta

SEQ ID NO: 439665 - DNA, 25 bp, Mus musculus
gaatggcttacttcacttaacatga

SEQ ID NO: 439666 - DNA, 25 bp, Mus musculus
gaatggcttataacaagaactcaag

SEQ ID NO: 439667 - DNA, 25 bp, Mus musculus
gaatggcttatatcaagaactcaag

SEQ ID NO: 439668 - DNA, 25 bp, Mus musculus
gaatggcttcagataatcaaaccct

SEQ ID NO: 439669 - DNA, 25 bp, Mus musculus
gaatggcttcagttaatcaaaccct

SEQ ID NO: 439670 - DNA, 25 bp, Mus musculus
gaatggcttcctctaaagataactt

SEQ ID NO: 439671 - DNA, 25 bp, Mus musculus
gaatggcttcctctatctaatgacc

SEQ ID NO: 439672 - DNA, 25 bp, Mus musculus
gaatggcttcctgtaaagataactt

SEQ ID NO: 439673 - DNA, 25 bp, Mus musculus
gaatggcttcctgtatctaatgacc

SEQ ID NO: 439674 - DNA, 25 bp, Mus musculus
gaatggcttctcagactggttgtct

SEQ ID NO: 439675 - DNA, 25 bp, Mus musculus
gaatggcttctctgactggttgtct

SEQ ID NO: 439676 - DNA, 25 bp, Mus musculus
gaatggcttctgcaccatttggtta

SEQ ID NO: 439677 - DNA, 25 bp, Mus musculus
gaatggcttctggaccatttggtta

SEQ ID NO: 439678 - DNA, 25 bp, Mus musculus
gaatggcttgacaccctagagtgtc

SEQ ID NO: 439679 - DNA, 25 bp, Mus musculus
gaatggcttgactccctagagtgtc

SEQ ID NO: 439680 - DNA, 25 bp, Mus musculus
gaatggcttggtagcgtacaaagat

SEQ ID NO: 439681 - DNA, 25 bp, Mus musculus
gaatggcttggttgcgtacaaagat

SEQ ID NO: 439682 - DNA, 25 bp, Mus musculus
gaatggctttacacaaactccaaga

SEQ ID NO: 439683 - DNA, 25 bp, Mus musculus
gaatggctttactcaaactccaaga

SEQ ID NO: 439684 - DNA, 25 bp, Mus musculus
gaatggctttataggcacacacacg

SEQ ID NO: 439685 - DNA, 25 bp, Mus musculus
gaatggctttattggcacacacacg

SEQ ID NO: 439686 - DNA, 25 bp, Mus musculus
gaatggctttcaaatcggcatgaag

SEQ ID NO: 439687 - DNA, 25 bp, Mus musculus
gaatggctttcatatcggcatgaag

SEQ ID NO: 439688 - DNA, 25 bp, Mus musculus
gaatggctttcgaggttgcttgaat

SEQ ID NO: 439689 - DNA, 25 bp, Mus musculus
gaatggctttcgtggttgcttgaat

SEQ ID NO: 439690 - DNA, 25 bp, Mus musculus
gaatggctttggaagacttgaacat

SEQ ID NO: 439691 - DNA, 25 bp, Mus musculus
gaatggctttggtagacttgaacat

SEQ ID NO: 439692 - DNA, 25 bp, Mus musculus
gaatggcttttgaagtcagtatatt

SEQ ID NO: 439693 - DNA, 25 bp, Mus musculus
gaatggcttttgtagtcagtatatt

SEQ ID NO: 439694 - DNA, 25 bp, Mus musculus
gaatgggaaacaccacatcgtcgtt

SEQ ID NO: 439695 - DNA, 25 bp, Mus musculus
gaatgggaaacagcacatcgtcgtt

SEQ ID NO: 439696 - DNA, 25 bp, Mus musculus
gaatgggaaaggacatctttgtttt

SEQ ID NO: 439697 - DNA, 25 bp, Mus musculus
gaatgggaaaggtcatctttgtttt

SEQ ID NO: 439698 - DNA, 25 bp, Mus musculus
gaatgggaacccaaggcttgcctgt

SEQ ID NO: 439699 - DNA, 25 bp, Mus musculus
gaatgggaaccctaggcttgcctgt

SEQ ID NO: 439700 - DNA, 25 bp, Mus musculus
gaatgggaactgaatctcctggcct

SEQ ID NO: 439701 - DNA, 25 bp, Mus musculus
gaatgggaactgtatctcctggcct

SEQ ID NO: 439702 - DNA, 25 bp, Mus musculus
gaatgggaattcatgtgttatctag

SEQ ID NO: 439703 - DNA, 25 bp, Mus musculus
gaatgggaattcttgtgttatctag

SEQ ID NO: 439704 - DNA, 25 bp, Mus musculus
gaatgggaatttcaggccccatcct

SEQ ID NO: 439705 - DNA, 25 bp, Mus musculus
gaatgggaatttgaggccccatcct

SEQ ID NO: 439706 - DNA, 25 bp, Mus musculus
gaatgggacaacatcttggtactat

SEQ ID NO: 439707 - DNA, 25 bp, Mus musculus
gaatgggacaacttcttggtactat

SEQ ID NO: 439708 - DNA, 25 bp, Mus musculus
gaatgggacagaaatccccgctagc

SEQ ID NO: 439709 - DNA, 25 bp, Mus musculus
gaatgggacagatatccccgctagc

SEQ ID NO: 439710 - DNA, 25 bp, Mus musculus
gaatgggacattatggacctccaag

SEQ ID NO: 439711 - DNA, 25 bp, Mus musculus
gaatgggacattttggacctccaag

SEQ ID NO: 439712 - DNA, 25 bp, Mus musculus
gaatgggaccaccaatccttctgta

SEQ ID NO: 439713 - DNA, 25 bp, Mus musculus
gaatgggaccacgaatccttctgta

SEQ ID NO: 439714 - DNA, 25 bp, Mus musculus
gaatgggaccatccatggacattcc

SEQ ID NO: 439715 - DNA, 25 bp, Mus musculus
gaatgggaccatgcatggacattcc

SEQ ID NO: 439716 - DNA, 25 bp, Mus musculus
gaatgggacctcacacagcctgggt

SEQ ID NO: 439717 - DNA, 25 bp, Mus musculus
gaatgggacctctcacagcctgggt

SEQ ID NO: 439718 - DNA, 25 bp, Mus musculus
gaatgggacctgaatggctctcctt

SEQ ID NO: 439719 - DNA, 25 bp, Mus musculus
gaatgggacctgtatggctctcctt

SEQ ID NO: 439720 - DNA, 25 bp, Mus musculus
gaatgggacgagaccttggcattta

SEQ ID NO: 439721 - DNA, 25 bp, Mus musculus
gaatgggacgagtccttggcattta

SEQ ID NO: 439722 - DNA, 25 bp, Mus musculus
gaatgggacggcactatttggctgt

SEQ ID NO: 439723 - DNA, 25 bp, Mus musculus
gaatgggacggctctatttggctgt

SEQ ID NO: 439724 - DNA, 25 bp, Mus musculus
gaatgggactgtacacctgtacctg

SEQ ID NO: 439725 - DNA, 25 bp, Mus musculus
gaatgggactgttcacctgtacctg

SEQ ID NO: 439726 - DNA, 25 bp, Mus musculus
gaatgggagcacagtcatcgcagat

SEQ ID NO: 439727 - DNA, 25 bp, Mus musculus
gaatgggagcactgtcatcgcagat

SEQ ID NO: 439728 - DNA, 25 bp, Mus musculus
gaatgggagctgaactacccacaga

SEQ ID NO: 439729 - DNA, 25 bp, Mus musculus
gaatgggagctgtactacccacaga

SEQ ID NO: 439730 - DNA, 25 bp, Mus musculus
gaatgggaggtgcacacccacgcca

SEQ ID NO: 439731 - DNA, 25 bp, Mus musculus
gaatgggaggtggacacccacgcca

SEQ ID NO: 439732 - DNA, 25 bp, Mus musculus
gaatgggagtctactgctgccgcag

SEQ ID NO: 439733 - DNA, 25 bp, Mus musculus
gaatgggagtcttctgctgccgcag

SEQ ID NO: 439734 - DNA, 25 bp, Mus musculus
gaatgggatccacttgcatctcaaa

SEQ ID NO: 439735 - DNA, 25 bp, Mus musculus
gaatgggatccagttgcatctcaaa

SEQ ID NO: 439736 - DNA, 25 bp, Mus musculus
gaatgggatctcacaaaaacctata

SEQ ID NO: 439737 - DNA, 25 bp, Mus musculus
gaatgggatctctcaaaaacctata

SEQ ID NO: 439738 - DNA, 25 bp, Mus musculus
gaatgggatgacaccacactcagct

SEQ ID NO: 439739 - DNA, 25 bp, Mus musculus
gaatgggatgactccacactcagct

SEQ ID NO: 439740 - DNA, 25 bp, Mus musculus
gaatgggattaacttctgtacactg

SEQ ID NO: 439741 - DNA, 25 bp, Mus musculus
gaatgggattaagttctgtacactg

SEQ ID NO: 439742 - DNA, 25 bp, Mus musculus
gaatgggattctaggctgccttgac

SEQ ID NO: 439743 - DNA, 25 bp, Mus musculus
gaatgggattcttggctgccttgac

SEQ ID NO: 439744 - DNA, 25 bp, Mus musculus
gaatgggcacaaacttcacttttaa

SEQ ID NO: 439745 - DNA, 25 bp, Mus musculus
gaatgggcacaatcttcacttttaa

SEQ ID NO: 439746 - DNA, 25 bp, Mus musculus
gaatgggcacctcagtagcttctga

SEQ ID NO: 439747 - DNA, 25 bp, Mus musculus
gaatgggcacctgagtagcttctga

SEQ ID NO: 439748 - DNA, 25 bp, Mus musculus
gaatgggcagcccatagctccattg

SEQ ID NO: 439749 - DNA, 25 bp, Mus musculus
gaatgggcagccgatagctccattg

SEQ ID NO: 439750 - DNA, 25 bp, Mus musculus
gaatgggcagttagacggacacgtc

SEQ ID NO: 439751 - DNA, 25 bp, Mus musculus
gaatgggcagtttgacggacacgtc

SEQ ID NO: 439752 - DNA, 25 bp, Mus musculus
gaatgggcattacctcttcagagac

SEQ ID NO: 439753 - DNA, 25 bp, Mus musculus
gaatgggcattagctcttcagagac

SEQ ID NO: 439754 - DNA, 25 bp, Mus musculus
gaatgggccaagctatgacaattaa

SEQ ID NO: 439755 - DNA, 25 bp, Mus musculus
gaatgggccaaggtatgacaattaa

SEQ ID NO: 439756 - DNA, 25 bp, Mus musculus
gaatgggccctgattattttgacat

SEQ ID NO: 439757 - DNA, 25 bp, Mus musculus
gaatgggccctgtttattttgacat

SEQ ID NO: 439758 - DNA, 25 bp, Mus musculus
gaatgggcctgcaccaaatgtcagc

SEQ ID NO: 439759 - DNA, 25 bp, Mus musculus
gaatgggcctgctccaaatgtcagc

SEQ ID NO: 439760 - DNA, 25 bp, Mus musculus
gaatgggcctttcttgtttctccgg

SEQ ID NO: 439761 - DNA, 25 bp, Mus musculus
gaatgggcctttgttgtttctccgg

SEQ ID NO: 439762 - DNA, 25 bp, Mus musculus
gaatgggcgggtctagaccaaccac

SEQ ID NO: 439763 - DNA, 25 bp, Mus musculus
gaatgggcgggtgtagaccaaccac

SEQ ID NO: 439764 - DNA, 25 bp, Mus musculus
gaatgggcggtcacgacagaacctt

SEQ ID NO: 439765 - DNA, 25 bp, Mus musculus
gaatgggcggtctcgacagaacctt

SEQ ID NO: 439766 - DNA, 25 bp, Mus musculus
gaatgggctccgaaggaagctcaag

SEQ ID NO: 439767 - DNA, 25 bp, Mus musculus
gaatgggctccgtaggaagctcaag

SEQ ID NO: 439768 - DNA, 25 bp, Mus musculus
gaatgggctgagacatgctgaaacc

SEQ ID NO: 439769 - DNA, 25 bp, Mus musculus
gaatgggctgagtcatgctgaaacc

SEQ ID NO: 439770 - DNA, 25 bp, Mus musculus
gaatgggctgcaataccttactaca

SEQ ID NO: 439771 - DNA, 25 bp, Mus musculus
gaatgggctgcattaccttactaca

SEQ ID NO: 439772 - DNA, 25 bp, Mus musculus
gaatgggctgctacctgcatgtttg

SEQ ID NO: 439773 - DNA, 25 bp, Mus musculus
gaatgggctgcttcctgcatgtttg

SEQ ID NO: 439774 - DNA, 25 bp, Mus musculus
gaatgggcttcgagtgaatgtggca

SEQ ID NO: 439775 - DNA, 25 bp, Mus musculus
gaatgggcttcgtgtgaatgtggca

SEQ ID NO: 439776 - DNA, 25 bp, Mus musculus
gaatgggctttaactctggtggcag

SEQ ID NO: 439777 - DNA, 25 bp, Mus musculus
gaatgggctttatctctggtggcag

SEQ ID NO: 439778 - DNA, 25 bp, Mus musculus
gaatgggctttgagcatctcaccaa

SEQ ID NO: 439779 - DNA, 25 bp, Mus musculus
gaatgggctttgtgcatctcaccaa

SEQ ID NO: 439780 - DNA, 25 bp, Mus musculus
gaatgggtaccgaggcttcaccaaa

SEQ ID NO: 439781 - DNA, 25 bp, Mus musculus
gaatgggtaccgtggcttcaccaaa

SEQ ID NO: 439782 - DNA, 25 bp, Mus musculus
gaatgggtagctctcctttagtttt

SEQ ID NO: 439783 - DNA, 25 bp, Mus musculus
gaatgggtagctgtcctttagtttt

SEQ ID NO: 439784 - DNA, 25 bp, Mus musculus
gaatgggtcactccatggtggttct

SEQ ID NO: 439785 - DNA, 25 bp, Mus musculus
gaatgggtcactgcatggtggttct

SEQ ID NO: 439786 - DNA, 25 bp, Mus musculus
gaatgggtcagtaaagccctattaa

SEQ ID NO: 439787 - DNA, 25 bp, Mus musculus
gaatgggtcagttaagccctattaa

SEQ ID NO: 439788 - DNA, 25 bp, Mus musculus
gaatgggtcccaatgaccatgtgtt

SEQ ID NO: 439789 - DNA, 25 bp, Mus musculus
gaatgggtcccacaactaaaccaca

SEQ ID NO: 439790 - DNA, 25 bp, Mus musculus
gaatgggtcccagaactaaaccaca

SEQ ID NO: 439791 - DNA, 25 bp, Mus musculus
gaatgggtcccattgaccatgtgtt

SEQ ID NO: 439792 - DNA, 25 bp, Mus musculus
gaatgggtctcactgccaggacgat

SEQ ID NO: 439793 - DNA, 25 bp, Mus musculus
gaatgggtctcagtgccaggacgat

SEQ ID NO: 439794 - DNA, 25 bp, Mus musculus
gaatgggtcttaaatggcagctctg

SEQ ID NO: 439795 - DNA, 25 bp, Mus musculus
gaatgggtcttatatggcagctctg

SEQ ID NO: 439796 - DNA, 25 bp, Mus musculus
gaatgggtggacatgactctctcac

SEQ ID NO: 439797 - DNA, 25 bp, Mus musculus
gaatgggtggaccagaactccccag

SEQ ID NO: 439798 - DNA, 25 bp, Mus musculus
gaatgggtggacgagaactccccag

SEQ ID NO: 439799 - DNA, 25 bp, Mus musculus
gaatgggtggacttgactctctcac

SEQ ID NO: 439800 - DNA, 25 bp, Mus musculus
gaatgggtgtatattctcccagaga

SEQ ID NO: 439801 - DNA, 25 bp, Mus musculus
gaatgggtgtattttctcccagaga

SEQ ID NO: 439802 - DNA, 25 bp, Mus musculus
gaatgggttaaacctcctccagcca

SEQ ID NO: 439803 - DNA, 25 bp, Mus musculus
gaatgggttaaagctcctccagcca

SEQ ID NO: 439804 - DNA, 25 bp, Mus musculus
gaatgggttaatcgcctcgcatcca

SEQ ID NO: 439805 - DNA, 25 bp, Mus musculus
gaatgggttaatggcctcgcatcca

SEQ ID NO: 439806 - DNA, 25 bp, Mus musculus
gaatgggtttatagaccagatcgat

SEQ ID NO: 439807 - DNA, 25 bp, Mus musculus
gaatgggtttatattagcttttgat

SEQ ID NO: 439808 - DNA, 25 bp, Mus musculus
gaatgggtttattgaccagatcgat

SEQ ID NO: 439809 - DNA, 25 bp, Mus musculus
gaatgggtttattttagcttttgat

SEQ ID NO: 439810 - DNA, 25 bp, Mus musculus
gaatgggtttctaggttctaccatg

SEQ ID NO: 439811 - DNA, 25 bp, Mus musculus
gaatgggtttcttggttctaccatg

SEQ ID NO: 439812 - DNA, 25 bp, Mus musculus
gaatgggttttcaaatgtgcacgca

SEQ ID NO: 439813 - DNA, 25 bp, Mus musculus
gaatgggttttctaatgtgcacgca

SEQ ID NO: 439814 - DNA, 25 bp, Mus musculus
gaatggtaagagagttgtcacaaag

SEQ ID NO: 439815 - DNA, 25 bp, Mus musculus
gaatggtaagagtgttgtcacaaag

SEQ ID NO: 439816 - DNA, 25 bp, Mus musculus
gaatggtaggctaccacctctgtgg

SEQ ID NO: 439817 - DNA, 25 bp, Mus musculus
gaatggtaggcttccacctctgtgg

SEQ ID NO: 439818 - DNA, 25 bp, Mus musculus
gaatggtagtttacttgactctcac

SEQ ID NO: 439819 - DNA, 25 bp, Mus musculus
gaatggtagttttcttgactctcac

SEQ ID NO: 439820 - DNA, 25 bp, Mus musculus
gaatggtatttaatggaacccaaca

SEQ ID NO: 439821 - DNA, 25 bp, Mus musculus
gaatggtatttattggaacccaaca

SEQ ID NO: 439822 - DNA, 25 bp, Mus musculus
gaatggtcaaaacaatgtcctttca

SEQ ID NO: 439823 - DNA, 25 bp, Mus musculus
gaatggtcaaaagaatgtcctttca

SEQ ID NO: 439824 - DNA, 25 bp, Mus musculus
gaatggtcaacacaattctgcagtg

SEQ ID NO: 439825 - DNA, 25 bp, Mus musculus
gaatggtcaacagaattctgcagtg

SEQ ID NO: 439826 - DNA, 25 bp, Mus musculus
gaatggtcacatcttcttatatggt

SEQ ID NO: 439827 - DNA, 25 bp, Mus musculus
gaatggtcacatgttcttatatggt

SEQ ID NO: 439828 - DNA, 25 bp, Mus musculus
gaatggtcacctctttatccagaac

SEQ ID NO: 439829 - DNA, 25 bp, Mus musculus
gaatggtcacctgtttatccagaac

SEQ ID NO: 439830 - DNA, 25 bp, Mus musculus
gaatggtcagccagggaaaatccct

SEQ ID NO: 439831 - DNA, 25 bp, Mus musculus
gaatggtcagcctgggaaaatccct

SEQ ID NO: 439832 - DNA, 25 bp, Mus musculus
gaatggtcagcgctcctgtcctgat

SEQ ID NO: 439833 - DNA, 25 bp, Mus musculus
gaatggtcagcggtcctgtcctgat

SEQ ID NO: 439834 - DNA, 25 bp, Mus musculus
gaatggtcagtgattgcatctttgt

SEQ ID NO: 439835 - DNA, 25 bp, Mus musculus
gaatggtcagtgtttgcatctttgt

SEQ ID NO: 439836 - DNA, 25 bp, Mus musculus
gaatggtcatcacacttggctagta

SEQ ID NO: 439837 - DNA, 25 bp, Mus musculus
gaatggtcatcagacttggctagta

SEQ ID NO: 439838 - DNA, 25 bp, Mus musculus
gaatggtccagcatttttgtgctga

SEQ ID NO: 439839 - DNA, 25 bp, Mus musculus
gaatggtccagcttttttgtgctga

SEQ ID NO: 439840 - DNA, 25 bp, Mus musculus
gaatggtccagtcattaggagcctg

SEQ ID NO: 439841 - DNA, 25 bp, Mus musculus
gaatggtccagtgattaggagcctg

SEQ ID NO: 439842 - DNA, 25 bp, Mus musculus
gaatggtcccatctgccgtgaaaag

SEQ ID NO: 439843 - DNA, 25 bp, Mus musculus
gaatggtcccatgtgccgtgaaaag

SEQ ID NO: 439844 - DNA, 25 bp, Mus musculus
gaatggtccccacaggtcacgggca

SEQ ID NO: 439845 - DNA, 25 bp, Mus musculus
gaatggtccccagaggtcacgggca

SEQ ID NO: 439846 - DNA, 25 bp, Mus musculus
gaatggtccgacactgttgctgtga

SEQ ID NO: 439847 - DNA, 25 bp, Mus musculus
gaatggtccgactctgttgctgtga

SEQ ID NO: 439848 - DNA, 25 bp, Mus musculus
gaatggtcctcaaagaccaacatgg

SEQ ID NO: 439849 - DNA, 25 bp, Mus musculus
gaatggtcctcatagaccaacatgg

SEQ ID NO: 439850 - DNA, 25 bp, Mus musculus
gaatggtcctgaaatacacccttta

SEQ ID NO: 439851 - DNA, 25 bp, Mus musculus
gaatggtcctgatatacacccttta

SEQ ID NO: 439852 - DNA, 25 bp, Mus musculus
gaatggtcctgcacacagtgatctt

SEQ ID NO: 439853 - DNA, 25 bp, Mus musculus
gaatggtcctgctcacagtgatctt

SEQ ID NO: 439854 - DNA, 25 bp, Mus musculus
gaatggtctcaacatttgttctaca

SEQ ID NO: 439855 - DNA, 25 bp, Mus musculus
gaatggtctcaagatttgttctaca

SEQ ID NO: 439856 - DNA, 25 bp, Mus musculus
gaatggtctggtcttcaaggatgct

SEQ ID NO: 439857 - DNA, 25 bp, Mus musculus
gaatggtctggtgttcaaggatgct

SEQ ID NO: 439858 - DNA, 25 bp, Mus musculus
gaatggtctgtacctactgggaaat

SEQ ID NO: 439859 - DNA, 25 bp, Mus musculus
gaatggtctgtagctactgggaaat

SEQ ID NO: 439860 - DNA, 25 bp, Mus musculus
gaatggtcttacacagatcttgctg

SEQ ID NO: 439861 - DNA, 25 bp, Mus musculus
gaatggtcttactcagatcttgctg

SEQ ID NO: 439862 - DNA, 25 bp, Mus musculus
gaatggtcttctatttggacggaca

SEQ ID NO: 439863 - DNA, 25 bp, Mus musculus
gaatggtcttctttttggacggaca

SEQ ID NO: 439864 - DNA, 25 bp, Mus musculus
gaatggtgaccaatctgagctgact

SEQ ID NO: 439865 - DNA, 25 bp, Mus musculus
gaatggtgaccattctgagctgact

SEQ ID NO: 439866 - DNA, 25 bp, Mus musculus
gaatggtgacgacagctctatcttg

SEQ ID NO: 439867 - DNA, 25 bp, Mus musculus
gaatggtgacgagagctctatcttg

SEQ ID NO: 439868 - DNA, 25 bp, Mus musculus
gaatggtgagagctcccagccactg

SEQ ID NO: 439869 - DNA, 25 bp, Mus musculus
gaatggtgagaggtcccagccactg

SEQ ID NO: 439870 - DNA, 25 bp, Mus musculus
gaatggtgcaatccttgccttgcta

SEQ ID NO: 439871 - DNA, 25 bp, Mus musculus
gaatggtgcaatgcttgccttgcta

SEQ ID NO: 439872 - DNA, 25 bp, Mus musculus
gaatggtgcagcacctgactgttca

SEQ ID NO: 439873 - DNA, 25 bp, Mus musculus
gaatggtgcagctcctgactgttca

SEQ ID NO: 439874 - DNA, 25 bp, Mus musculus
gaatggtgccctcgtctaagcatgt

SEQ ID NO: 439875 - DNA, 25 bp, Mus musculus
gaatggtgccctggtctaagcatgt

SEQ ID NO: 439876 - DNA, 25 bp, Mus musculus
gaatggtgcctgagtgccaagctca

SEQ ID NO: 439877 - DNA, 25 bp, Mus musculus
gaatggtgcctgtgtgccaagctca

SEQ ID NO: 439878 - DNA, 25 bp, Mus musculus
gaatggtggaaaaatgtccccactg

SEQ ID NO: 439879 - DNA, 25 bp, Mus musculus
gaatggtggaaatatgtccccactg

SEQ ID NO: 439880 - DNA, 25 bp, Mus musculus
gaatggtggtaacagctgacatatt

SEQ ID NO: 439881 - DNA, 25 bp, Mus musculus
gaatggtggtaagagctgacatatt

SEQ ID NO: 439882 - DNA, 25 bp, Mus musculus
gaatggtggtgccaccttaccctac

SEQ ID NO: 439883 - DNA, 25 bp, Mus musculus
gaatggtggtgcgaccttaccctac

SEQ ID NO: 439884 - DNA, 25 bp, Mus musculus
gaatggtgtctcatgctgtttataa

SEQ ID NO: 439885 - DNA, 25 bp, Mus musculus
gaatggtgtctcttgctgtttataa

SEQ ID NO: 439886 - DNA, 25 bp, Mus musculus
gaatggtgtctgagttccctaggcc

SEQ ID NO: 439887 - DNA, 25 bp, Mus musculus
gaatggtgtctgtgttccctaggcc

SEQ ID NO: 439888 - DNA, 25 bp, Mus musculus
gaatggtgtgaaatcaaacctcgtt

SEQ ID NO: 439889 - DNA, 25 bp, Mus musculus
gaatggtgtgaattcaaacctcgtt

SEQ ID NO: 439890 - DNA, 25 bp, Mus musculus
gaatggtgttgccagttggctcctc

SEQ ID NO: 439891 - DNA, 25 bp, Mus musculus
gaatggtgttgcgagttggctcctc

SEQ ID NO: 439892 - DNA, 25 bp, Mus musculus
gaatggtgttttacattgtctcact

SEQ ID NO: 439893 - DNA, 25 bp, Mus musculus
gaatggtgtttttcattgtctcact

SEQ ID NO: 439894 - DNA, 25 bp, Mus musculus
gaatggttaagtatcaggcctaaca

SEQ ID NO: 439895 - DNA, 25 bp, Mus musculus
gaatggttaagtttcaggcctaaca

SEQ ID NO: 439896 - DNA, 25 bp, Mus musculus
gaatggttactccaagccctagaaa

SEQ ID NO: 439897 - DNA, 25 bp, Mus musculus
gaatggttactcgaagccctagaaa

SEQ ID NO: 439898 - DNA, 25 bp, Mus musculus
gaatggttatccaccagtatccttg

SEQ ID NO: 439899 - DNA, 25 bp, Mus musculus
gaatggttatcctccagtatccttg

SEQ ID NO: 439900 - DNA, 25 bp, Mus musculus
gaatggttccttagctgctacttca

SEQ ID NO: 439901 - DNA, 25 bp, Mus musculus
gaatggttcctttgctgctacttca

SEQ ID NO: 439902 - DNA, 25 bp, Mus musculus
gaatggttcgctagcaggtcccgga

SEQ ID NO: 439903 - DNA, 25 bp, Mus musculus
gaatggttcgcttgcaggtcccgga

SEQ ID NO: 439904 - DNA, 25 bp, Mus musculus
gaatggttctagagccggagctgaa

SEQ ID NO: 439905 - DNA, 25 bp, Mus musculus
gaatggttctagtgccggagctgaa

SEQ ID NO: 439906 - DNA, 25 bp, Mus musculus
gaatggttctgcacactcttatgca

SEQ ID NO: 439907 - DNA, 25 bp, Mus musculus
gaatggttctgctcactcttatgca

SEQ ID NO: 439908 - DNA, 25 bp, Mus musculus
gaatggttgagtatgccggaagcac

SEQ ID NO: 439909 - DNA, 25 bp, Mus musculus
gaatggttgagtttgccggaagcac

SEQ ID NO: 439910 - DNA, 25 bp, Mus musculus
gaatggttggcaatgctcttatcta

SEQ ID NO: 439911 - DNA, 25 bp, Mus musculus
gaatggttggcattgctcttatcta

SEQ ID NO: 439912 - DNA, 25 bp, Mus musculus
gaatggttggcccagtagacccaga

SEQ ID NO: 439913 - DNA, 25 bp, Mus musculus
gaatggttggccgagtagacccaga

SEQ ID NO: 439914 - DNA, 25 bp, Mus musculus
gaatggttggtgaaaattgcccctc

SEQ ID NO: 439915 - DNA, 25 bp, Mus musculus
gaatggttggtgtaaattgcccctc

SEQ ID NO: 439916 - DNA, 25 bp, Mus musculus
gaatggttgtgtacttcagcagctc

SEQ ID NO: 439917 - DNA, 25 bp, Mus musculus
gaatggttgtgttcttcagcagctc

SEQ ID NO: 439918 - DNA, 25 bp, Mus musculus
gaatggttgtttccttcacatgaaa

SEQ ID NO: 439919 - DNA, 25 bp, Mus musculus
gaatggttgtttgcttcacatgaaa

SEQ ID NO: 439920 - DNA, 25 bp, Mus musculus
gaatggtttactccccacatcatac

SEQ ID NO: 439921 - DNA, 25 bp, Mus musculus
gaatggtttactgcccacatcatac

SEQ ID NO: 439922 - DNA, 25 bp, Mus musculus
gaatggtttccgcacaagcaagatt

SEQ ID NO: 439923 - DNA, 25 bp, Mus musculus
gaatggtttccggacaagcaagatt

SEQ ID NO: 439924 - DNA, 25 bp, Mus musculus
gaatggtttgacacctttccctaat

SEQ ID NO: 439925 - DNA, 25 bp, Mus musculus
gaatggtttgactcctttccctaat

SEQ ID NO: 439926 - DNA, 25 bp, Mus musculus
gaatggttttagactctgacctatt

SEQ ID NO: 439927 - DNA, 25 bp, Mus musculus
gaatggttttagtctctgacctatt

SEQ ID NO: 439928 - DNA, 25 bp, Mus musculus
gaatgtaaaaatcccacctcactct

SEQ ID NO: 439929 - DNA, 25 bp, Mus musculus
gaatgtaaaaatcccagttttctgt

SEQ ID NO: 439930 - DNA, 25 bp, Mus musculus
gaatgtaaaaatgccacctcactct

SEQ ID NO: 439931 - DNA, 25 bp, Mus musculus
gaatgtaaaaatgccagttttctgt

SEQ ID NO: 439932 - DNA, 25 bp, Mus musculus
gaatgtaaaaccatagcttaaggct

SEQ ID NO: 439933 - DNA, 25 bp, Mus musculus
gaatgtaaaaccttagcttaaggct

SEQ ID NO: 439934 - DNA, 25 bp, Mus musculus
gaatgtaaaagtcgtggctctcctt

SEQ ID NO: 439935 - DNA, 25 bp, Mus musculus
gaatgtaaaagtggtggctctcctt

SEQ ID NO: 439936 - DNA, 25 bp, Mus musculus
gaatgtaaacaacccttaatcagtg

SEQ ID NO: 439937 - DNA, 25 bp, Mus musculus
gaatgtaaacaagccttaatcagtg

SEQ ID NO: 439938 - DNA, 25 bp, Mus musculus
gaatgtaaactcacgggacagggac

SEQ ID NO: 439939 - DNA, 25 bp, Mus musculus
gaatgtaaactctcgggacagggac

SEQ ID NO: 439940 - DNA, 25 bp, Mus musculus
gaatgtaaactgctatccataccag

SEQ ID NO: 439941 - DNA, 25 bp, Mus musculus
gaatgtaaactggtatccataccag

SEQ ID NO: 439942 - DNA, 25 bp, Mus musculus
gaatgtaacaccattttagttcact

SEQ ID NO: 439943 - DNA, 25 bp, Mus musculus
gaatgtaacacctttttagttcact

SEQ ID NO: 439944 - DNA, 25 bp, Mus musculus
gaatgtaacattaacctctgctggg

SEQ ID NO: 439945 - DNA, 25 bp, Mus musculus
gaatgtaacatttacctctgctggg

SEQ ID NO: 439946 - DNA, 25 bp, Mus musculus
gaatgtaaccgaaggcagtactgag

SEQ ID NO: 439947 - DNA, 25 bp, Mus musculus
gaatgtaaccgatggcagtactgag

SEQ ID NO: 439948 - DNA, 25 bp, Mus musculus
gaatgtaaccttagggttgcttggg

SEQ ID NO: 439949 - DNA, 25 bp, Mus musculus
gaatgtaacctttgggttgcttggg

SEQ ID NO: 439950 - DNA, 25 bp, Mus musculus
gaatgtaagacaactatgggctaaa

SEQ ID NO: 439951 - DNA, 25 bp, Mus musculus
gaatgtaagacatctatgggctaaa

SEQ ID NO: 439952 - DNA, 25 bp, Mus musculus
gaatgtaagaccatgaactgttttt

SEQ ID NO: 439953 - DNA, 25 bp, Mus musculus
gaatgtaagaccttgaactgttttt

SEQ ID NO: 439954 - DNA, 25 bp, Mus musculus
gaatgtaagactactagttctgtat

SEQ ID NO: 439955 - DNA, 25 bp, Mus musculus
gaatgtaagacttctagttctgtat

SEQ ID NO: 439956 - DNA, 25 bp, Mus musculus
gaatgtaaggaaagtcggaaaacct

SEQ ID NO: 439957 - DNA, 25 bp, Mus musculus
gaatgtaaggaatgtcggaaaacct

SEQ ID NO: 439958 - DNA, 25 bp, Mus musculus
gaatgtaaggacagctactcagaga

SEQ ID NO: 439959 - DNA, 25 bp, Mus musculus
gaatgtaaggactgctactcagaga

SEQ ID NO: 439960 - DNA, 25 bp, Mus musculus
gaatgtaagtgtattttagcctgga

SEQ ID NO: 439961 - DNA, 25 bp, Mus musculus
gaatgtaagtgttttttagcctgga

SEQ ID NO: 439962 - DNA, 25 bp, Mus musculus
gaatgtaatcacaccaacgtcacca

SEQ ID NO: 439963 - DNA, 25 bp, Mus musculus
gaatgtaatcactccaacgtcacca

SEQ ID NO: 439964 - DNA, 25 bp, Mus musculus
gaatgtaatcagagtttcccctgga

SEQ ID NO: 439965 - DNA, 25 bp, Mus musculus
gaatgtaatcagtgtttcccctgga

SEQ ID NO: 439966 - DNA, 25 bp, Mus musculus
gaatgtaatcccatccttgtaagtt

SEQ ID NO: 439967 - DNA, 25 bp, Mus musculus
gaatgtaatcccttccttgtaagtt

SEQ ID NO: 439968 - DNA, 25 bp, Mus musculus
gaatgtaattttccttcctggttgt

SEQ ID NO: 439969 - DNA, 25 bp, Mus musculus
gaatgtaattttgcttcctggttgt

SEQ ID NO: 439970 - DNA, 25 bp, Mus musculus
gaatgtacacagcacttttcctata

SEQ ID NO: 439971 - DNA, 25 bp, Mus musculus
gaatgtacacaggacttttcctata

SEQ ID NO: 439972 - DNA, 25 bp, Mus musculus
gaatgtacacgtcgagcaggctctt

SEQ ID NO: 439973 - DNA, 25 bp, Mus musculus
gaatgtacacgtggagcaggctctt

SEQ ID NO: 439974 - DNA, 25 bp, Mus musculus
gaatgtacagacagatgacctgcac

SEQ ID NO: 439975 - DNA, 25 bp, Mus musculus
gaatgtacagactgatgacctgcac

SEQ ID NO: 439976 - DNA, 25 bp, Mus musculus
gaatgtacaggaactagcttttatt

SEQ ID NO: 439977 - DNA, 25 bp, Mus musculus
gaatgtacaggatctagcttttatt

SEQ ID NO: 439978 - DNA, 25 bp, Mus musculus
gaatgtacagtaacagaccggtggt

SEQ ID NO: 439979 - DNA, 25 bp, Mus musculus
gaatgtacagtatcagaccggtggt

SEQ ID NO: 439980 - DNA, 25 bp, Mus musculus
gaatgtacatcactacttgtcctga

SEQ ID NO: 439981 - DNA, 25 bp, Mus musculus
gaatgtacatcagtacttgtcctga

SEQ ID NO: 439982 - DNA, 25 bp, Mus musculus
gaatgtacatgtatatgttggaaaa

SEQ ID NO: 439983 - DNA, 25 bp, Mus musculus
gaatgtacatgtttatgttggaaaa

SEQ ID NO: 439984 - DNA, 25 bp, Mus musculus
gaatgtacattcactttgttgactt

SEQ ID NO: 439985 - DNA, 25 bp, Mus musculus
gaatgtacattctctttgttgactt

SEQ ID NO: 439986 - DNA, 25 bp, Mus musculus
gaatgtacatttccaacccttagtg

SEQ ID NO: 439987 - DNA, 25 bp, Mus musculus
gaatgtacatttgcaacccttagtg

SEQ ID NO: 439988 - DNA, 25 bp, Mus musculus
gaatgtaccaagctgctgacacggt

SEQ ID NO: 439989 - DNA, 25 bp, Mus musculus
gaatgtaccaaggtgctgacacggt

SEQ ID NO: 439990 - DNA, 25 bp, Mus musculus
gaatgtaccaccataagcggttttg

SEQ ID NO: 439991 - DNA, 25 bp, Mus musculus
gaatgtaccaccttaagcggttttg

SEQ ID NO: 439992 - DNA, 25 bp, Mus musculus
gaatgtaccagcagatctgtggtga

SEQ ID NO: 439993 - DNA, 25 bp, Mus musculus
gaatgtaccagctgatctgtggtga

SEQ ID NO: 439994 - DNA, 25 bp, Mus musculus
gaatgtaccctcacagtttatagta

SEQ ID NO: 439995 - DNA, 25 bp, Mus musculus
gaatgtaccctctcagtttatagta

SEQ ID NO: 439996 - DNA, 25 bp, Mus musculus
gaatgtaccctgagcatgaaaatca

SEQ ID NO: 439997 - DNA, 25 bp, Mus musculus
gaatgtaccctgtgcatgaaaatca

SEQ ID NO: 439998 - DNA, 25 bp, Mus musculus
gaatgtacctgtatacgtttcaaaa

SEQ ID NO: 439999 - DNA, 25 bp, Mus musculus
gaatgtacctgtttacgtttcaaaa

SEQ ID NO: 440000 - DNA, 25 bp, Mus musculus
gaatgtacgaataggcgcacagaat

SEQ ID NO: 440001 - DNA, 25 bp, Mus musculus
gaatgtacgaattggcgcacagaat

SEQ ID NO: 440002 - DNA, 25 bp, Mus musculus
gaatgtacgcaacccactgagtata

SEQ ID NO: 440003 - DNA, 25 bp, Mus musculus
gaatgtacgcaagccactgagtata

SEQ ID NO: 440004 - DNA, 25 bp, Mus musculus
gaatgtacgctacataaaacttggg

SEQ ID NO: 440005 - DNA, 25 bp, Mus musculus
gaatgtacgctagataaaacttggg

SEQ ID NO: 440006 - DNA, 25 bp, Mus musculus
gaatgtactaccacccataagttga

SEQ ID NO: 440007 - DNA, 25 bp, Mus musculus
gaatgtactacctcccataagttga

SEQ ID NO: 440008 - DNA, 25 bp, Mus musculus
gaatgtactagacccgagaatcccc

SEQ ID NO: 440009 - DNA, 25 bp, Mus musculus
gaatgtactagagccgagaatcccc

SEQ ID NO: 440010 - DNA, 25 bp, Mus musculus
gaatgtactaggatcagcttttgac

SEQ ID NO: 440011 - DNA, 25 bp, Mus musculus
gaatgtactaggttcagcttttgac

SEQ ID NO: 440012 - DNA, 25 bp, Mus musculus
gaatgtactcatatcagatccaata

SEQ ID NO: 440013 - DNA, 25 bp, Mus musculus
gaatgtactcatttcagatccaata

SEQ ID NO: 440014 - DNA, 25 bp, Mus musculus
gaatgtactgtgatgtcaataaaac

SEQ ID NO: 440015 - DNA, 25 bp, Mus musculus
gaatgtactgtgttgtcaataaaac

SEQ ID NO: 440016 - DNA, 25 bp, Mus musculus
gaatgtacttgaccttagccacaca

SEQ ID NO: 440017 - DNA, 25 bp, Mus musculus
gaatgtacttgagcttagccacaca

SEQ ID NO: 440018 - DNA, 25 bp, Mus musculus
gaatgtagaatgaatcgcccttccc

SEQ ID NO: 440019 - DNA, 25 bp, Mus musculus
gaatgtagaatgtatcgcccttccc

SEQ ID NO: 440020 - DNA, 25 bp, Mus musculus
gaatgtagagttcccggccagcctg

SEQ ID NO: 440021 - DNA, 25 bp, Mus musculus
gaatgtagagttgccggccagcctg

SEQ ID NO: 440022 - DNA, 25 bp, Mus musculus
gaatgtagatgtaattgtccctcaa

SEQ ID NO: 440023 - DNA, 25 bp, Mus musculus
gaatgtagatgtctcctaggcctcc

SEQ ID NO: 440024 - DNA, 25 bp, Mus musculus
gaatgtagatgtgtcctaggcctcc

SEQ ID NO: 440025 - DNA, 25 bp, Mus musculus
gaatgtagatgttattgtccctcaa

SEQ ID NO: 440026 - DNA, 25 bp, Mus musculus
gaatgtagcaaccagtctaagccaa

SEQ ID NO: 440027 - DNA, 25 bp, Mus musculus
gaatgtagcaacgagtctaagccaa

SEQ ID NO: 440028 - DNA, 25 bp, Mus musculus
gaatgtagcaccactgctgtggctt

SEQ ID NO: 440029 - DNA, 25 bp, Mus musculus
gaatgtagcacctctgctgtggctt

SEQ ID NO: 440030 - DNA, 25 bp, Mus musculus
gaatgtagcatcaggcaactttatt

SEQ ID NO: 440031 - DNA, 25 bp, Mus musculus
gaatgtagcatctggcaactttatt

SEQ ID NO: 440032 - DNA, 25 bp, Mus musculus
gaatgtagccagaacactgctgctg

SEQ ID NO: 440033 - DNA, 25 bp, Mus musculus
gaatgtagccagtacactgctgctg

SEQ ID NO: 440034 - DNA, 25 bp, Mus musculus
gaatgtagcctaccttcagtgtatg

SEQ ID NO: 440035 - DNA, 25 bp, Mus musculus
gaatgtagcctagcttcagtgtatg

SEQ ID NO: 440036 - DNA, 25 bp, Mus musculus
gaatgtagctgaactcttatggagg

SEQ ID NO: 440037 - DNA, 25 bp, Mus musculus
gaatgtagctgatctcttatggagg

SEQ ID NO: 440038 - DNA, 25 bp, Mus musculus
gaatgtaggctcacctaagaggctg

SEQ ID NO: 440039 - DNA, 25 bp, Mus musculus
gaatgtaggctctcctaagaggctg

SEQ ID NO: 440040 - DNA, 25 bp, Mus musculus
gaatgtagtaatagcagcgccctag

SEQ ID NO: 440041 - DNA, 25 bp, Mus musculus
gaatgtagtaattgcagcgccctag

SEQ ID NO: 440042 - DNA, 25 bp, Mus musculus
gaatgtagtattcaggctccatgca

SEQ ID NO: 440043 - DNA, 25 bp, Mus musculus
gaatgtagtattgaggctccatgca

SEQ ID NO: 440044 - DNA, 25 bp, Mus musculus
gaatgtagtcctctcaccagttaga

SEQ ID NO: 440045 - DNA, 25 bp, Mus musculus
gaatgtagtcctgtcaccagttaga

SEQ ID NO: 440046 - DNA, 25 bp, Mus musculus
gaatgtagtctgcaggttcaggctc

SEQ ID NO: 440047 - DNA, 25 bp, Mus musculus
gaatgtagtctggaggttcaggctc

SEQ ID NO: 440048 - DNA, 25 bp, Mus musculus
gaatgtagtttccatgggttttggt

SEQ ID NO: 440049 - DNA, 25 bp, Mus musculus
gaatgtagtttcgatgggttttggt

SEQ ID NO: 440050 - DNA, 25 bp, Mus musculus
gaatgtataacaaggtccccttctt

SEQ ID NO: 440051 - DNA, 25 bp, Mus musculus
gaatgtataacatggtccccttctt

SEQ ID NO: 440052 - DNA, 25 bp, Mus musculus
gaatgtataaccctgctgtgtcaac

SEQ ID NO: 440053 - DNA, 25 bp, Mus musculus
gaatgtataaccgtgctgtgtcaac

SEQ ID NO: 440054 - DNA, 25 bp, Mus musculus
gaatgtatataaagcaaaccctttt

SEQ ID NO: 440055 - DNA, 25 bp, Mus musculus
gaatgtatataatgcaaaccctttt

SEQ ID NO: 440056 - DNA, 25 bp, Mus musculus
gaatgtatatttatctaactttctt

SEQ ID NO: 440057 - DNA, 25 bp, Mus musculus
gaatgtatatttcatgcctcataaa

SEQ ID NO: 440058 - DNA, 25 bp, Mus musculus
gaatgtatatttgatgcctcataaa

SEQ ID NO: 440059 - DNA, 25 bp, Mus musculus
gaatgtatatttttctaactttctt

SEQ ID NO: 440060 - DNA, 25 bp, Mus musculus
gaatgtatccctctactttggtgga

SEQ ID NO: 440061 - DNA, 25 bp, Mus musculus
gaatgtatccctgtactttggtgga

SEQ ID NO: 440062 - DNA, 25 bp, Mus musculus
gaatgtatctggcaaatttctagac

SEQ ID NO: 440063 - DNA, 25 bp, Mus musculus
gaatgtatctgggaaatttctagac

SEQ ID NO: 440064 - DNA, 25 bp, Mus musculus
gaatgtatgactcccttatgcccag

SEQ ID NO: 440065 - DNA, 25 bp, Mus musculus
gaatgtatgactgccttatgcccag

SEQ ID NO: 440066 - DNA, 25 bp, Mus musculus
gaatgtatgctcagcaagaatcaca

SEQ ID NO: 440067 - DNA, 25 bp, Mus musculus
gaatgtatgctctgcaagaatcaca

SEQ ID NO: 440068 - DNA, 25 bp, Mus musculus
gaatgtatggctactaaggagttaa

SEQ ID NO: 440069 - DNA, 25 bp, Mus musculus
gaatgtatggcttctaaggagttaa

SEQ ID NO: 440070 - DNA, 25 bp, Mus musculus
gaatgtatgtacagtaacaatccat

SEQ ID NO: 440071 - DNA, 25 bp, Mus musculus
gaatgtatgtactgtaacaatccat

SEQ ID NO: 440072 - DNA, 25 bp, Mus musculus
gaatgtattgccattctgaatcgga

SEQ ID NO: 440073 - DNA, 25 bp, Mus musculus
gaatgtattgcctttctgaatcgga

SEQ ID NO: 440074 - DNA, 25 bp, Mus musculus
gaatgtattgtaaccaaggcctttg

SEQ ID NO: 440075 - DNA, 25 bp, Mus musculus
gaatgtattgtatccaaggcctttg

SEQ ID NO: 440076 - DNA, 25 bp, Mus musculus
gaatgtattgtgcactaacctagaa

SEQ ID NO: 440077 - DNA, 25 bp, Mus musculus
gaatgtattgtggactaacctagaa

SEQ ID NO: 440078 - DNA, 25 bp, Mus musculus
gaatgtatttcaaatagctagccac

SEQ ID NO: 440079 - DNA, 25 bp, Mus musculus
gaatgtatttcaaggtcctttctat

SEQ ID NO: 440080 - DNA, 25 bp, Mus musculus
gaatgtatttcatatagctagccac

SEQ ID NO: 440081 - DNA, 25 bp, Mus musculus
gaatgtatttcatggtcctttctat

SEQ ID NO: 440082 - DNA, 25 bp, Mus musculus
gaatgtatttttcttacctcggcat

SEQ ID NO: 440083 - DNA, 25 bp, Mus musculus
gaatgtatttttgttacctcggcat

SEQ ID NO: 440084 - DNA, 25 bp, Mus musculus
gaatgtcaaaccactagctctgcca

SEQ ID NO: 440085 - DNA, 25 bp, Mus musculus
gaatgtcaaacctctagctctgcca

SEQ ID NO: 440086 - DNA, 25 bp, Mus musculus
gaatgtcaaactactgttggtacat

SEQ ID NO: 440087 - DNA, 25 bp, Mus musculus
gaatgtcaaacttctgttggtacat

SEQ ID NO: 440088 - DNA, 25 bp, Mus musculus
gaatgtcaaagcagtcgtcttggta

SEQ ID NO: 440089 - DNA, 25 bp, Mus musculus
gaatgtcaaagctgtcgtcttggta

SEQ ID NO: 440090 - DNA, 25 bp, Mus musculus
gaatgtcaaagtatctctctagcaa

SEQ ID NO: 440091 - DNA, 25 bp, Mus musculus
gaatgtcaaagtttctctctagcaa

SEQ ID NO: 440092 - DNA, 25 bp, Mus musculus
gaatgtcaacggctcgtacacatgt

SEQ ID NO: 440093 - DNA, 25 bp, Mus musculus
gaatgtcaacgggtcgtacacatgt

SEQ ID NO: 440094 - DNA, 25 bp, Mus musculus
gaatgtcaacttctagagtcacgtt

SEQ ID NO: 440095 - DNA, 25 bp, Mus musculus
gaatgtcaacttgtagagtcacgtt

SEQ ID NO: 440096 - DNA, 25 bp, Mus musculus
gaatgtcaagacaattcttttccaa

SEQ ID NO: 440097 - DNA, 25 bp, Mus musculus
gaatgtcaagactattcttttccaa

SEQ ID NO: 440098 - DNA, 25 bp, Mus musculus
gaatgtcaaggaagttcctccctgc

SEQ ID NO: 440099 - DNA, 25 bp, Mus musculus
gaatgtcaaggatgttcctccctgc

SEQ ID NO: 440100 - DNA, 25 bp, Mus musculus
gaatgtcaaggcaagctagtaacaa

SEQ ID NO: 440101 - DNA, 25 bp, Mus musculus
gaatgtcaaggctagctagtaacaa

SEQ ID NO: 440102 - DNA, 25 bp, Mus musculus
gaatgtcaagtcatagaccagctaa

SEQ ID NO: 440103 - DNA, 25 bp, Mus musculus
gaatgtcaagtcttagaccagctaa

SEQ ID NO: 440104 - DNA, 25 bp, Mus musculus
gaatgtcaatagctgagtcactcag

SEQ ID NO: 440105 - DNA, 25 bp, Mus musculus
gaatgtcaataggtgagtcactcag

SEQ ID NO: 440106 - DNA, 25 bp, Mus musculus
gaatgtcacaggctccagggtactt

SEQ ID NO: 440107 - DNA, 25 bp, Mus musculus
gaatgtcacagggtccagggtactt

SEQ ID NO: 440108 - DNA, 25 bp, Mus musculus
gaatgtcacatgagcttctaggaaa

SEQ ID NO: 440109 - DNA, 25 bp, Mus musculus
gaatgtcacatgtgcttctaggaaa

SEQ ID NO: 440110 - DNA, 25 bp, Mus musculus
gaatgtcaccaacaacctcaagtct

SEQ ID NO: 440111 - DNA, 25 bp, Mus musculus
gaatgtcaccaagaacctcaagtct

SEQ ID NO: 440112 - DNA, 25 bp, Mus musculus
gaatgtcacccacaggttctggcat

SEQ ID NO: 440113 - DNA, 25 bp, Mus musculus
gaatgtcacccagaggttctggcat

SEQ ID NO: 440114 - DNA, 25 bp, Mus musculus
gaatgtcaccttaatctcaggtcgg

SEQ ID NO: 440115 - DNA, 25 bp, Mus musculus
gaatgtcaccttattgtaaatggga

SEQ ID NO: 440116 - DNA, 25 bp, Mus musculus
gaatgtcacctttatctcaggtcgg

SEQ ID NO: 440117 - DNA, 25 bp, Mus musculus
gaatgtcacctttttgtaaatggga

SEQ ID NO: 440118 - DNA, 25 bp, Mus musculus
gaatgtcacgctatacaggtgcaac

SEQ ID NO: 440119 - DNA, 25 bp, Mus musculus
gaatgtcacgctcggcaggcacaaa

SEQ ID NO: 440120 - DNA, 25 bp, Mus musculus
gaatgtcacgctgggcaggcacaaa

SEQ ID NO: 440121 - DNA, 25 bp, Mus musculus
gaatgtcacgctttacaggtgcaac

SEQ ID NO: 440122 - DNA, 25 bp, Mus musculus
gaatgtcacggacatgagcctcaga

SEQ ID NO: 440123 - DNA, 25 bp, Mus musculus
gaatgtcacggagatgagcctcaga

SEQ ID NO: 440124 - DNA, 25 bp, Mus musculus
gaatgtcacgtacgacgccttgtat

SEQ ID NO: 440125 - DNA, 25 bp, Mus musculus
gaatgtcacgtaggacgccttgtat

SEQ ID NO: 440126 - DNA, 25 bp, Mus musculus
gaatgtcactaaagaggtctacaca

SEQ ID NO: 440127 - DNA, 25 bp, Mus musculus
gaatgtcactaatgaggtctacaca

SEQ ID NO: 440128 - DNA, 25 bp, Mus musculus
gaatgtcagactatcaagttcactg

SEQ ID NO: 440129 - DNA, 25 bp, Mus musculus
gaatgtcagactttcaagttcactg

SEQ ID NO: 440130 - DNA, 25 bp, Mus musculus
gaatgtcagaggcacacttttctcc

SEQ ID NO: 440131 - DNA, 25 bp, Mus musculus
gaatgtcagagggacacttttctcc

SEQ ID NO: 440132 - DNA, 25 bp, Mus musculus
gaatgtcagcacagattccttctct

SEQ ID NO: 440133 - DNA, 25 bp, Mus musculus
gaatgtcagcactgattccttctct

SEQ ID NO: 440134 - DNA, 25 bp, Mus musculus
gaatgtcaggtacctaccgctgaag

SEQ ID NO: 440135 - DNA, 25 bp, Mus musculus
gaatgtcaggtagctaccgctgaag

SEQ ID NO: 440136 - DNA, 25 bp, Mus musculus
gaatgtcaggtccaagattggctct

SEQ ID NO: 440137 - DNA, 25 bp, Mus musculus
gaatgtcaggtcgaagattggctct

SEQ ID NO: 440138 - DNA, 25 bp, Mus musculus
gaatgtcagtgactgttatgcaatg

SEQ ID NO: 440139 - DNA, 25 bp, Mus musculus
gaatgtcagtgagtgttatgcaatg

SEQ ID NO: 440140 - DNA, 25 bp, Mus musculus
gaatgtcagtgtcaatgcctcggct

SEQ ID NO: 440141 - DNA, 25 bp, Mus musculus
gaatgtcagtgtgaatgcctcggct

SEQ ID NO: 440142 - DNA, 25 bp, Mus musculus
gaatgtcagttaagcactctcccac

SEQ ID NO: 440143 - DNA, 25 bp, Mus musculus
gaatgtcagttatgcactctcccac

SEQ ID NO: 440144 - DNA, 25 bp, Mus musculus
gaatgtcatactctgtggttctctg

SEQ ID NO: 440145 - DNA, 25 bp, Mus musculus
gaatgtcatactgtgtggttctctg

SEQ ID NO: 440146 - DNA, 25 bp, Mus musculus
gaatgtcatagcaaagtcactgttg

SEQ ID NO: 440147 - DNA, 25 bp, Mus musculus
gaatgtcatagctaagtcactgttg

SEQ ID NO: 440148 - DNA, 25 bp, Mus musculus
gaatgtcatgtaatccttggaggaa

SEQ ID NO: 440149 - DNA, 25 bp, Mus musculus
gaatgtcatgtattccttggaggaa

SEQ ID NO: 440150 - DNA, 25 bp, Mus musculus
gaatgtcatttcacgtctgtagttt

SEQ ID NO: 440151 - DNA, 25 bp, Mus musculus
gaatgtcatttctcgtctgtagttt

SEQ ID NO: 440152 - DNA, 25 bp, Mus musculus
gaatgtcattttcccctcaatcttg

SEQ ID NO: 440153 - DNA, 25 bp, Mus musculus
gaatgtcattttgccctcaatcttg

SEQ ID NO: 440154 - DNA, 25 bp, Mus musculus
gaatgtccaccaagaacagcggcag

SEQ ID NO: 440155 - DNA, 25 bp, Mus musculus
gaatgtccaccatgaacagcggcag

SEQ ID NO: 440156 - DNA, 25 bp, Mus musculus
gaatgtccacctaccaacagatgaa

SEQ ID NO: 440157 - DNA, 25 bp, Mus musculus
gaatgtccaccttccaacagatgaa

SEQ ID NO: 440158 - DNA, 25 bp, Mus musculus
gaatgtccacgaagtcgctctcgga

SEQ ID NO: 440159 - DNA, 25 bp, Mus musculus
gaatgtccacgatgtcgctctcgga

SEQ ID NO: 440160 - DNA, 25 bp, Mus musculus
gaatgtccacgcagtgtcagttgaa

SEQ ID NO: 440161 - DNA, 25 bp, Mus musculus
gaatgtccacgccatgagctctttc

SEQ ID NO: 440162 - DNA, 25 bp, Mus musculus
gaatgtccacgcgatgagctctttc

SEQ ID NO: 440163 - DNA, 25 bp, Mus musculus
gaatgtccacgctgtgtcagttgaa

SEQ ID NO: 440164 - DNA, 25 bp, Mus musculus
gaatgtccacggcactttcaccaag

SEQ ID NO: 440165 - DNA, 25 bp, Mus musculus
gaatgtccacgggactttcaccaag

SEQ ID NO: 440166 - DNA, 25 bp, Mus musculus
gaatgtccactaagtccaacaagca

SEQ ID NO: 440167 - DNA, 25 bp, Mus musculus
gaatgtccactatgtccaacaagca

SEQ ID NO: 440168 - DNA, 25 bp, Mus musculus
gaatgtccagagactaccaccaaga

SEQ ID NO: 440169 - DNA, 25 bp, Mus musculus
gaatgtccagagtctaccaccaaga

SEQ ID NO: 440170 - DNA, 25 bp, Mus musculus
gaatgtccatagcattataatcgct

SEQ ID NO: 440171 - DNA, 25 bp, Mus musculus
gaatgtccataggattataatcgct

SEQ ID NO: 440172 - DNA, 25 bp, Mus musculus
gaatgtccatctctctttaatccat

SEQ ID NO: 440173 - DNA, 25 bp, Mus musculus
gaatgtccatctgtctttaatccat

SEQ ID NO: 440174 - DNA, 25 bp, Mus musculus
gaatgtcccaccagtatgtatttgt

SEQ ID NO: 440175 - DNA, 25 bp, Mus musculus
gaatgtcccacctgtatgtatttgt

SEQ ID NO: 440176 - DNA, 25 bp, Mus musculus
gaatgtccccaactgtctacgtctt

SEQ ID NO: 440177 - DNA, 25 bp, Mus musculus
gaatgtccccaagtgtctacgtctt

SEQ ID NO: 440178 - DNA, 25 bp, Mus musculus
gaatgtcccgggatctcgagactcg

SEQ ID NO: 440179 - DNA, 25 bp, Mus musculus
gaatgtcccgggttctcgagactcg

SEQ ID NO: 440180 - DNA, 25 bp, Mus musculus
gaatgtccctccaaacagatggtct

SEQ ID NO: 440181 - DNA, 25 bp, Mus musculus
gaatgtccctcctaacagatggtct

SEQ ID NO: 440182 - DNA, 25 bp, Mus musculus
gaatgtccctggcaccagagaaggt

SEQ ID NO: 440183 - DNA, 25 bp, Mus musculus
gaatgtccctgggaccagagaaggt

SEQ ID NO: 440184 - DNA, 25 bp, Mus musculus
gaatgtcccttccaacttttatatt

SEQ ID NO: 440185 - DNA, 25 bp, Mus musculus
gaatgtcccttcgaacttttatatt

SEQ ID NO: 440186 - DNA, 25 bp, Mus musculus
gaatgtcccttgatagaggtactta

SEQ ID NO: 440187 - DNA, 25 bp, Mus musculus
gaatgtcccttgttagaggtactta

SEQ ID NO: 440188 - DNA, 25 bp, Mus musculus
gaatgtcctactacaggaatggcct

SEQ ID NO: 440189 - DNA, 25 bp, Mus musculus
gaatgtcctacttcaggaatggcct

SEQ ID NO: 440190 - DNA, 25 bp, Mus musculus
gaatgtcctagcactcttgaatatg

SEQ ID NO: 440191 - DNA, 25 bp, Mus musculus
gaatgtcctagctctcttgaatatg

SEQ ID NO: 440192 - DNA, 25 bp, Mus musculus
gaatgtcctcacaatgaactggtaa

SEQ ID NO: 440193 - DNA, 25 bp, Mus musculus
gaatgtcctcactatgaactggtaa

SEQ ID NO: 440194 - DNA, 25 bp, Mus musculus
gaatgtcctccccaagaattggcat

SEQ ID NO: 440195 - DNA, 25 bp, Mus musculus
gaatgtcctcccgaagaattggcat

SEQ ID NO: 440196 - DNA, 25 bp, Mus musculus
gaatgtcctcggatgatcgcagatc

SEQ ID NO: 440197 - DNA, 25 bp, Mus musculus
gaatgtcctcggttgatcgcagatc

SEQ ID NO: 440198 - DNA, 25 bp, Mus musculus
gaatgtcctgaaatctgtgtttgtg

SEQ ID NO: 440199 - DNA, 25 bp, Mus musculus
gaatgtcctgaacatcagcgacttt

SEQ ID NO: 440200 - DNA, 25 bp, Mus musculus
gaatgtcctgaagatcagcgacttt

SEQ ID NO: 440201 - DNA, 25 bp, Mus musculus
gaatgtcctgaattctgtgtttgtg

SEQ ID NO: 440202 - DNA, 25 bp, Mus musculus
gaatgtcctgatattccagacaagt

SEQ ID NO: 440203 - DNA, 25 bp, Mus musculus
gaatgtcctgattttccagacaagt

SEQ ID NO: 440204 - DNA, 25 bp, Mus musculus
gaatgtcctgcgaggctgtggaatt

SEQ ID NO: 440205 - DNA, 25 bp, Mus musculus
gaatgtcctgcgtggctgtggaatt

SEQ ID NO: 440206 - DNA, 25 bp, Mus musculus
gaatgtccttggcatcactgtgatg

SEQ ID NO: 440207 - DNA, 25 bp, Mus musculus
gaatgtccttgggatcactgtgatg

SEQ ID NO: 440208 - DNA, 25 bp, Mus musculus
gaatgtcgaattcattgtgataaaa

SEQ ID NO: 440209 - DNA, 25 bp, Mus musculus
gaatgtcgaattgattgtgataaaa

SEQ ID NO: 440210 - DNA, 25 bp, Mus musculus
gaatgtcgaggtcccagtgactctg

SEQ ID NO: 440211 - DNA, 25 bp, Mus musculus
gaatgtcgaggtgccagtgactctg

SEQ ID NO: 440212 - DNA, 25 bp, Mus musculus
gaatgtcgcattacagtctgatcag

SEQ ID NO: 440213 - DNA, 25 bp, Mus musculus
gaatgtcgcattcctaggtgcaagt

SEQ ID NO: 440214 - DNA, 25 bp, Mus musculus
gaatgtcgcattgctaggtgcaagt

SEQ ID NO: 440215 - DNA, 25 bp, Mus musculus
gaatgtcgcatttcagtctgatcag

SEQ ID NO: 440216 - DNA, 25 bp, Mus musculus
gaatgtcgtaatctccgaatggagg

SEQ ID NO: 440217 - DNA, 25 bp, Mus musculus
gaatgtcgtaatgtccgaatggagg

SEQ ID NO: 440218 - DNA, 25 bp, Mus musculus
gaatgtcgtagcagagtgcacgcta

SEQ ID NO: 440219 - DNA, 25 bp, Mus musculus
gaatgtcgtagctgagtgcacgcta

SEQ ID NO: 440220 - DNA, 25 bp, Mus musculus
gaatgtcgtcaaagccaaacctctg

SEQ ID NO: 440221 - DNA, 25 bp, Mus musculus
gaatgtcgtcaatgccaaacctctg

SEQ ID NO: 440222 - DNA, 25 bp, Mus musculus
gaatgtctacaaagcagtgggccac

SEQ ID NO: 440223 - DNA, 25 bp, Mus musculus
gaatgtctacaatgcagtgggccac

SEQ ID NO: 440224 - DNA, 25 bp, Mus musculus
gaatgtctacacaaattccagttag

SEQ ID NO: 440225 - DNA, 25 bp, Mus musculus
gaatgtctacactaattccagttag

SEQ ID NO: 440226 - DNA, 25 bp, Mus musculus
gaatgtctagagaaatgtacccaca

SEQ ID NO: 440227 - DNA, 25 bp, Mus musculus
gaatgtctagagtaatgtacccaca

SEQ ID NO: 440228 - DNA, 25 bp, Mus musculus
gaatgtctagcaccggctttatgcc

SEQ ID NO: 440229 - DNA, 25 bp, Mus musculus
gaatgtctagcagcggctttatgcc

SEQ ID NO: 440230 - DNA, 25 bp, Mus musculus
gaatgtctagcgaacagcacaacag

SEQ ID NO: 440231 - DNA, 25 bp, Mus musculus
gaatgtctagcgtacagcacaacag

SEQ ID NO: 440232 - DNA, 25 bp, Mus musculus
gaatgtctaggcatgacccaggaaa

SEQ ID NO: 440233 - DNA, 25 bp, Mus musculus
gaatgtctaggcttgacccaggaaa

SEQ ID NO: 440234 - DNA, 25 bp, Mus musculus
gaatgtctagtgaacagtggagcct

SEQ ID NO: 440235 - DNA, 25 bp, Mus musculus
gaatgtctagtgtacagtggagcct

SEQ ID NO: 440236 - DNA, 25 bp, Mus musculus
gaatgtctagttcaggcagccagca

SEQ ID NO: 440237 - DNA, 25 bp, Mus musculus
gaatgtctagttgaggcagccagca

SEQ ID NO: 440238 - DNA, 25 bp, Mus musculus
gaatgtctcaccagagttttgactg

SEQ ID NO: 440239 - DNA, 25 bp, Mus musculus
gaatgtctcacctgagttttgactg

SEQ ID NO: 440240 - DNA, 25 bp, Mus musculus
gaatgtctcagaagtgctcagaata

SEQ ID NO: 440241 - DNA, 25 bp, Mus musculus
gaatgtctcagatgtgctcagaata

SEQ ID NO: 440242 - DNA, 25 bp, Mus musculus
gaatgtctcatcacgagcttccagg

SEQ ID NO: 440243 - DNA, 25 bp, Mus musculus
gaatgtctcatctcgagcttccagg

SEQ ID NO: 440244 - DNA, 25 bp, Mus musculus
gaatgtctcatgaaggttcctgtct

SEQ ID NO: 440245 - DNA, 25 bp, Mus musculus
gaatgtctcatgtaggttcctgtct

SEQ ID NO: 440246 - DNA, 25 bp, Mus musculus
gaatgtctccacaaagaaccatttc

SEQ ID NO: 440247 - DNA, 25 bp, Mus musculus
gaatgtctccaccattgatagcata

SEQ ID NO: 440248 - DNA, 25 bp, Mus musculus
gaatgtctccacgattgatagcata

SEQ ID NO: 440249 - DNA, 25 bp, Mus musculus
gaatgtctccactaagaaccatttc

SEQ ID NO: 440250 - DNA, 25 bp, Mus musculus
gaatgtctccatatctgcttatcat

SEQ ID NO: 440251 - DNA, 25 bp, Mus musculus
gaatgtctccatttctgcttatcat

SEQ ID NO: 440252 - DNA, 25 bp, Mus musculus
gaatgtctctaaagaagcttggatt

SEQ ID NO: 440253 - DNA, 25 bp, Mus musculus
gaatgtctctaatgaagcttggatt

SEQ ID NO: 440254 - DNA, 25 bp, Mus musculus
gaatgtctctcccagtgaatgggta

SEQ ID NO: 440255 - DNA, 25 bp, Mus musculus
gaatgtctctccgagtgaatgggta

SEQ ID NO: 440256 - DNA, 25 bp, Mus musculus
gaatgtctctgaagtgccagcgtcg

SEQ ID NO: 440257 - DNA, 25 bp, Mus musculus
gaatgtctctgatgtgccagcgtcg

SEQ ID NO: 440258 - DNA, 25 bp, Mus musculus
gaatgtctctgccataagtattcca

SEQ ID NO: 440259 - DNA, 25 bp, Mus musculus
gaatgtctctgcgataagtattcca

SEQ ID NO: 440260 - DNA, 25 bp, Mus musculus
gaatgtctctttatctcaggcaaaa

SEQ ID NO: 440261 - DNA, 25 bp, Mus musculus
gaatgtctctttttctcaggcaaaa

SEQ ID NO: 440262 - DNA, 25 bp, Mus musculus
gaatgtctgaatcgtctgtgctcat

SEQ ID NO: 440263 - DNA, 25 bp, Mus musculus
gaatgtctgaatggtctgtgctcat

SEQ ID NO: 440264 - DNA, 25 bp, Mus musculus
gaatgtctgcaaaacacttccaggt

SEQ ID NO: 440265 - DNA, 25 bp, Mus musculus
gaatgtctgcaaagtgtttctattt

SEQ ID NO: 440266 - DNA, 25 bp, Mus musculus
gaatgtctgcaatacacttccaggt

SEQ ID NO: 440267 - DNA, 25 bp, Mus musculus
gaatgtctgcaatgtgtttctattt

SEQ ID NO: 440268 - DNA, 25 bp, Mus musculus
gaatgtctgcacatgcctacaggtt

SEQ ID NO: 440269 - DNA, 25 bp, Mus musculus
gaatgtctgcacttgcctacaggtt

SEQ ID NO: 440270 - DNA, 25 bp, Mus musculus
gaatgtctgcagatacctcaataaa

SEQ ID NO: 440271 - DNA, 25 bp, Mus musculus
gaatgtctgcagttacctcaataaa

SEQ ID NO: 440272 - DNA, 25 bp, Mus musculus
gaatgtctgccccaggccatgaaca

SEQ ID NO: 440273 - DNA, 25 bp, Mus musculus
gaatgtctgcccgaggccatgaaca

SEQ ID NO: 440274 - DNA, 25 bp, Mus musculus
gaatgtctggacactttagccctac

SEQ ID NO: 440275 - DNA, 25 bp, Mus musculus
gaatgtctggactctttagccctac

SEQ ID NO: 440276 - DNA, 25 bp, Mus musculus
gaatgtctggagatcacctgcattt

SEQ ID NO: 440277 - DNA, 25 bp, Mus musculus
gaatgtctggagttcacctgcattt

SEQ ID NO: 440278 - DNA, 25 bp, Mus musculus
gaatgtctggtgaatggcccacttt

SEQ ID NO: 440279 - DNA, 25 bp, Mus musculus
gaatgtctggtgtatggcccacttt

SEQ ID NO: 440280 - DNA, 25 bp, Mus musculus
gaatgtctgtgtcggtgcccatgca

SEQ ID NO: 440281 - DNA, 25 bp, Mus musculus
gaatgtctgtgtgggtgcccatgca

SEQ ID NO: 440282 - DNA, 25 bp, Mus musculus
gaatgtcttaataatagcctgcagg

SEQ ID NO: 440283 - DNA, 25 bp, Mus musculus
gaatgtcttaattatagcctgcagg

SEQ ID NO: 440284 - DNA, 25 bp, Mus musculus
gaatgtcttagcatctactgttttt

SEQ ID NO: 440285 - DNA, 25 bp, Mus musculus
gaatgtcttagcttctactgttttt

SEQ ID NO: 440286 - DNA, 25 bp, Mus musculus
gaatgtcttcacaaaagctgctgga

SEQ ID NO: 440287 - DNA, 25 bp, Mus musculus
gaatgtcttcactaaagctgctgga

SEQ ID NO: 440288 - DNA, 25 bp, Mus musculus
gaatgtcttcataggtagtgtataa

SEQ ID NO: 440289 - DNA, 25 bp, Mus musculus
gaatgtcttcattggtagtgtataa

SEQ ID NO: 440290 - DNA, 25 bp, Mus musculus
gaatgtcttccaagctttgtcacca

SEQ ID NO: 440291 - DNA, 25 bp, Mus musculus
gaatgtcttccatgctttgtcacca

SEQ ID NO: 440292 - DNA, 25 bp, Mus musculus
gaatgtcttcttatatagatcatag

SEQ ID NO: 440293 - DNA, 25 bp, Mus musculus
gaatgtcttcttttatagatcatag

SEQ ID NO: 440294 - DNA, 25 bp, Mus musculus
gaatgtcttgaccttctctgagaag

SEQ ID NO: 440295 - DNA, 25 bp, Mus musculus
gaatgtcttgacgttctctgagaag

SEQ ID NO: 440296 - DNA, 25 bp, Mus musculus
gaatgtcttgcactgtgggtgcact

SEQ ID NO: 440297 - DNA, 25 bp, Mus musculus
gaatgtcttgcagtgtgggtgcact

SEQ ID NO: 440298 - DNA, 25 bp, Mus musculus
gaatgtctttaaccctgccaacaat

SEQ ID NO: 440299 - DNA, 25 bp, Mus musculus
gaatgtctttaagcctgccaacaat

SEQ ID NO: 440300 - DNA, 25 bp, Mus musculus
gaatgtctttgaactcttatctggc

SEQ ID NO: 440301 - DNA, 25 bp, Mus musculus
gaatgtctttgatctcttatctggc

SEQ ID NO: 440302 - DNA, 25 bp, Mus musculus
gaatgtctttggaggtgaccccttg

SEQ ID NO: 440303 - DNA, 25 bp, Mus musculus
gaatgtctttggtggtgaccccttg

SEQ ID NO: 440304 - DNA, 25 bp, Mus musculus
gaatgtcttttaaaccctgcactgg

SEQ ID NO: 440305 - DNA, 25 bp, Mus musculus
gaatgtcttttataccctgcactgg

SEQ ID NO: 440306 - DNA, 25 bp, Mus musculus
gaatgtcttttcatgtgtaggtcat

SEQ ID NO: 440307 - DNA, 25 bp, Mus musculus
gaatgtcttttcttgtgtaggtcat

SEQ ID NO: 440308 - DNA, 25 bp, Mus musculus
gaatgtgaacaccactcttcagtta

SEQ ID NO: 440309 - DNA, 25 bp, Mus musculus
gaatgtgaacacgactcttcagtta

SEQ ID NO: 440310 - DNA, 25 bp, Mus musculus
gaatgtgaacagaagtctgtgttcc

SEQ ID NO: 440311 - DNA, 25 bp, Mus musculus
gaatgtgaacagtagtctgtgttcc

SEQ ID NO: 440312 - DNA, 25 bp, Mus musculus
gaatgtgaaccaaggacccacctgc

SEQ ID NO: 440313 - DNA, 25 bp, Mus musculus
gaatgtgaaccaaggctgcatcctg

SEQ ID NO: 440314 - DNA, 25 bp, Mus musculus
gaatgtgaaccatggacccacctgc

SEQ ID NO: 440315 - DNA, 25 bp, Mus musculus
gaatgtgaaccatggctgcatcctg

SEQ ID NO: 440316 - DNA, 25 bp, Mus musculus
gaatgtgaacgcaaagacatctctt

SEQ ID NO: 440317 - DNA, 25 bp, Mus musculus
gaatgtgaacgcatggctactccag

SEQ ID NO: 440318 - DNA, 25 bp, Mus musculus
gaatgtgaacgctaagacatctctt

SEQ ID NO: 440319 - DNA, 25 bp, Mus musculus
gaatgtgaacgcttggctactccag

SEQ ID NO: 440320 - DNA, 25 bp, Mus musculus
gaatgtgaagggactctcttctcag

SEQ ID NO: 440321 - DNA, 25 bp, Mus musculus
gaatgtgaagggtctctcttctcag

SEQ ID NO: 440322 - DNA, 25 bp, Mus musculus
gaatgtgaagtaaatctgagggaga

SEQ ID NO: 440323 - DNA, 25 bp, Mus musculus
gaatgtgaagtatatctgagggaga

SEQ ID NO: 440324 - DNA, 25 bp, Mus musculus
gaatgtgaagtcacatgtagtgcct

SEQ ID NO: 440325 - DNA, 25 bp, Mus musculus
gaatgtgaagtctcatgtagtgcct

SEQ ID NO: 440326 - DNA, 25 bp, Mus musculus
gaatgtgaagttaatagctagcctg

SEQ ID NO: 440327 - DNA, 25 bp, Mus musculus
gaatgtgaagtttatagctagcctg

SEQ ID NO: 440328 - DNA, 25 bp, Mus musculus
gaatgtgaattcattctaccgctct

SEQ ID NO: 440329 - DNA, 25 bp, Mus musculus
gaatgtgaattctttctaccgctct

SEQ ID NO: 440330 - DNA, 25 bp, Mus musculus
gaatgtgaattgctgtccacgttac

SEQ ID NO: 440331 - DNA, 25 bp, Mus musculus
gaatgtgaattggtgtccacgttac

SEQ ID NO: 440332 - DNA, 25 bp, Mus musculus
gaatgtgacaacacgggctcagttc

SEQ ID NO: 440333 - DNA, 25 bp, Mus musculus
gaatgtgacaactcgggctcagttc

SEQ ID NO: 440334 - DNA, 25 bp, Mus musculus
gaatgtgacagcatgaggccaccaa

SEQ ID NO: 440335 - DNA, 25 bp, Mus musculus
gaatgtgacagcttgaggccaccaa

SEQ ID NO: 440336 - DNA, 25 bp, Mus musculus
gaatgtgacatactcccaacagaat

SEQ ID NO: 440337 - DNA, 25 bp, Mus musculus
gaatgtgacatactgagcagccaca

SEQ ID NO: 440338 - DNA, 25 bp, Mus musculus
gaatgtgacatagtcccaacagaat

SEQ ID NO: 440339 - DNA, 25 bp, Mus musculus
gaatgtgacatagtgagcagccaca

SEQ ID NO: 440340 - DNA, 25 bp, Mus musculus
gaatgtgacatgagctttacctaaa

SEQ ID NO: 440341 - DNA, 25 bp, Mus musculus
gaatgtgacatgattgcaaagttga

SEQ ID NO: 440342 - DNA, 25 bp, Mus musculus
gaatgtgacatgcacaaattgttct

SEQ ID NO: 440343 - DNA, 25 bp, Mus musculus
gaatgtgacatgcatgctgttaacc

SEQ ID NO: 440344 - DNA, 25 bp, Mus musculus
gaatgtgacatggacaaattgttct

SEQ ID NO: 440345 - DNA, 25 bp, Mus musculus
gaatgtgacatggatgctgttaacc

SEQ ID NO: 440346 - DNA, 25 bp, Mus musculus
gaatgtgacatgtgctttacctaaa

SEQ ID NO: 440347 - DNA, 25 bp, Mus musculus
gaatgtgacatgtttgcaaagttga

SEQ ID NO: 440348 - DNA, 25 bp, Mus musculus
gaatgtgacccaacctcaggaaact

SEQ ID NO: 440349 - DNA, 25 bp, Mus musculus
gaatgtgacccatcctcaggaaact

SEQ ID NO: 440350 - DNA, 25 bp, Mus musculus
gaatgtgaccctagccgtggtaaat

SEQ ID NO: 440351 - DNA, 25 bp, Mus musculus
gaatgtgacccttgccgtggtaaat

SEQ ID NO: 440352 - DNA, 25 bp, Mus musculus
gaatgtgactctccgctgcgatgat

SEQ ID NO: 440353 - DNA, 25 bp, Mus musculus
gaatgtgactctgcgctgcgatgat

SEQ ID NO: 440354 - DNA, 25 bp, Mus musculus
gaatgtgactgtcctgatgctgcca

SEQ ID NO: 440355 - DNA, 25 bp, Mus musculus
gaatgtgactgtgctgatgctgcca

SEQ ID NO: 440356 - DNA, 25 bp, Mus musculus
gaatgtgagattcttcttgcttatg

SEQ ID NO: 440357 - DNA, 25 bp, Mus musculus
gaatgtgagattgttcttgcttatg

SEQ ID NO: 440358 - DNA, 25 bp, Mus musculus
gaatgtgagccccagcccgtctgta

SEQ ID NO: 440359 - DNA, 25 bp, Mus musculus
gaatgtgagcccgagcccgtctgta

SEQ ID NO: 440360 - DNA, 25 bp, Mus musculus
gaatgtgagcggctgctacagaaac

SEQ ID NO: 440361 - DNA, 25 bp, Mus musculus
gaatgtgagcgggtgctacagaaac

SEQ ID NO: 440362 - DNA, 25 bp, Mus musculus
gaatgtgagcttcatgagagcagac

SEQ ID NO: 440363 - DNA, 25 bp, Mus musculus
gaatgtgagcttgatgagagcagac

SEQ ID NO: 440364 - DNA, 25 bp, Mus musculus
gaatgtgaggcacatgcacatgata

SEQ ID NO: 440365 - DNA, 25 bp, Mus musculus
gaatgtgaggcagatgcacatgata

SEQ ID NO: 440366 - DNA, 25 bp, Mus musculus
gaatgtgaggtgatcaagcttccaa

SEQ ID NO: 440367 - DNA, 25 bp, Mus musculus
gaatgtgaggtgatccctgcctttg

SEQ ID NO: 440368 - DNA, 25 bp, Mus musculus
gaatgtgaggtgttcaagcttccaa

SEQ ID NO: 440369 - DNA, 25 bp, Mus musculus
gaatgtgaggtgttccctgcctttg

SEQ ID NO: 440370 - DNA, 25 bp, Mus musculus
gaatgtgagtttctttggtggacaa

SEQ ID NO: 440371 - DNA, 25 bp, Mus musculus
gaatgtgagtttgtttggtggacaa

SEQ ID NO: 440372 - DNA, 25 bp, Mus musculus
gaatgtgatacaatctagggctact

SEQ ID NO: 440373 - DNA, 25 bp, Mus musculus
gaatgtgatacattctagggctact

SEQ ID NO: 440374 - DNA, 25 bp, Mus musculus
gaatgtgatcctccatcttcagtat

SEQ ID NO: 440375 - DNA, 25 bp, Mus musculus
gaatgtgatcctgcatcttcagtat

SEQ ID NO: 440376 - DNA, 25 bp, Mus musculus
gaatgtgatctgagaagtctacctt

SEQ ID NO: 440377 - DNA, 25 bp, Mus musculus
gaatgtgatctgtgaagtctacctt

SEQ ID NO: 440378 - DNA, 25 bp, Mus musculus
gaatgtgatgcaagacgtccctgaa

SEQ ID NO: 440379 - DNA, 25 bp, Mus musculus
gaatgtgatgcatgacgtccctgaa

SEQ ID NO: 440380 - DNA, 25 bp, Mus musculus
gaatgtgatgctcgatcttactaaa

SEQ ID NO: 440381 - DNA, 25 bp, Mus musculus
gaatgtgatgctggatcttactaaa

SEQ ID NO: 440382 - DNA, 25 bp, Mus musculus
gaatgtgattaaaactaccctcata

SEQ ID NO: 440383 - DNA, 25 bp, Mus musculus
gaatgtgattaatactaccctcata

SEQ ID NO: 440384 - DNA, 25 bp, Mus musculus
gaatgtgatttcactgaagtctagt

SEQ ID NO: 440385 - DNA, 25 bp, Mus musculus
gaatgtgatttctctgaagtctagt

SEQ ID NO: 440386 - DNA, 25 bp, Mus musculus
gaatgtgcacataatcgtgagctgg

SEQ ID NO: 440387 - DNA, 25 bp, Mus musculus
gaatgtgcacattatcgtgagctgg

SEQ ID NO: 440388 - DNA, 25 bp, Mus musculus
gaatgtgcagggattaatccccaga

SEQ ID NO: 440389 - DNA, 25 bp, Mus musculus
gaatgtgcagggtttaatccccaga

SEQ ID NO: 440390 - DNA, 25 bp, Mus musculus
gaatgtgcatgaaatttcctggcaa

SEQ ID NO: 440391 - DNA, 25 bp, Mus musculus
gaatgtgcatgatatttcctggcaa

SEQ ID NO: 440392 - DNA, 25 bp, Mus musculus
gaatgtgcattaatcagcagcctat

SEQ ID NO: 440393 - DNA, 25 bp, Mus musculus
gaatgtgcattattcagcagcctat

SEQ ID NO: 440394 - DNA, 25 bp, Mus musculus
gaatgtgcatttcgaccatacgcaa

SEQ ID NO: 440395 - DNA, 25 bp, Mus musculus
gaatgtgcatttggaccatacgcaa

SEQ ID NO: 440396 - DNA, 25 bp, Mus musculus
gaatgtgccacaaacaggttttgta

SEQ ID NO: 440397 - DNA, 25 bp, Mus musculus
gaatgtgccacatacaggttttgta

SEQ ID NO: 440398 - DNA, 25 bp, Mus musculus
gaatgtgccaggattctaacaatga

SEQ ID NO: 440399 - DNA, 25 bp, Mus musculus
gaatgtgccaggtttctaacaatga

SEQ ID NO: 440400 - DNA, 25 bp, Mus musculus
gaatgtgccataccgaatccgtgtg

SEQ ID NO: 440401 - DNA, 25 bp, Mus musculus
gaatgtgccatagcgaatccgtgtg

SEQ ID NO: 440402 - DNA, 25 bp, Mus musculus
gaatgtgcccatcaactatagcaaa

SEQ ID NO: 440403 - DNA, 25 bp, Mus musculus
gaatgtgcccatgaactatagcaaa

SEQ ID NO: 440404 - DNA, 25 bp, Mus musculus
gaatgtgccccacgtagaagccatc

SEQ ID NO: 440405 - DNA, 25 bp, Mus musculus
gaatgtgccccaggtagaagccatc

SEQ ID NO: 440406 - DNA, 25 bp, Mus musculus
gaatgtgccctcctcaggaatagag

SEQ ID NO: 440407 - DNA, 25 bp, Mus musculus
gaatgtgccctcgtcaggaatagag

SEQ ID NO: 440408 - DNA, 25 bp, Mus musculus
gaatgtgcctccctgatcgccgcga

SEQ ID NO: 440409 - DNA, 25 bp, Mus musculus
gaatgtgcctccgtgatcgccgcga

SEQ ID NO: 440410 - DNA, 25 bp, Mus musculus
gaatgtgctaatagatgtgagaacc

SEQ ID NO: 440411 - DNA, 25 bp, Mus musculus
gaatgtgctaattgatgtgagaacc

SEQ ID NO: 440412 - DNA, 25 bp, Mus musculus
gaatgtgctagtctgaggctccttt

SEQ ID NO: 440413 - DNA, 25 bp, Mus musculus
gaatgtgctagtgtgaggctccttt

SEQ ID NO: 440414 - DNA, 25 bp, Mus musculus
gaatgtgctcataaacctctattat

SEQ ID NO: 440415 - DNA, 25 bp, Mus musculus
gaatgtgctcattaacctctattat

SEQ ID NO: 440416 - DNA, 25 bp, Mus musculus
gaatgtgctctcagggatctatata

SEQ ID NO: 440417 - DNA, 25 bp, Mus musculus
gaatgtgctctctgggatctatata

SEQ ID NO: 440418 - DNA, 25 bp, Mus musculus
gaatgtgctctgaacttgtctttaa

SEQ ID NO: 440419 - DNA, 25 bp, Mus musculus
gaatgtgctctgtacttgtctttaa

SEQ ID NO: 440420 - DNA, 25 bp, Mus musculus
gaatgtgctgaccacaatcgggaag

SEQ ID NO: 440421 - DNA, 25 bp, Mus musculus
gaatgtgctgacgacaatcgggaag

SEQ ID NO: 440422 - DNA, 25 bp, Mus musculus
gaatgtgctggtacctgctttgctt

SEQ ID NO: 440423 - DNA, 25 bp, Mus musculus
gaatgtgctggttcctgctttgctt

SEQ ID NO: 440424 - DNA, 25 bp, Mus musculus
gaatgtgctgtcacgaggcaccagc

SEQ ID NO: 440425 - DNA, 25 bp, Mus musculus
gaatgtgctgtctcgaggcaccagc

SEQ ID NO: 440426 - DNA, 25 bp, Mus musculus
gaatgtgctgtgacacaccaaagat

SEQ ID NO: 440427 - DNA, 25 bp, Mus musculus
gaatgtgctgtgctcgttgctcttc

SEQ ID NO: 440428 - DNA, 25 bp, Mus musculus
gaatgtgctgtggtcgttgctcttc

SEQ ID NO: 440429 - DNA, 25 bp, Mus musculus
gaatgtgctgtgtcacaccaaagat

SEQ ID NO: 440430 - DNA, 25 bp, Mus musculus
gaatgtgctgttagctttgaatcac

SEQ ID NO: 440431 - DNA, 25 bp, Mus musculus
gaatgtgctgttccctcagttcaga

SEQ ID NO: 440432 - DNA, 25 bp, Mus musculus
gaatgtgctgttgcctcagttcaga

SEQ ID NO: 440433 - DNA, 25 bp, Mus musculus
gaatgtgctgtttgctttgaatcac

SEQ ID NO: 440434 - DNA, 25 bp, Mus musculus
gaatgtgcttcaatgtcactgccgc

SEQ ID NO: 440435 - DNA, 25 bp, Mus musculus
gaatgtgcttcattgtcactgccgc

SEQ ID NO: 440436 - DNA, 25 bp, Mus musculus
gaatgtgcttctagttgtcaggaat

SEQ ID NO: 440437 - DNA, 25 bp, Mus musculus
gaatgtgcttcttgttgtcaggaat

SEQ ID NO: 440438 - DNA, 25 bp, Mus musculus
gaatgtggaacactcgcctgacctg

SEQ ID NO: 440439 - DNA, 25 bp, Mus musculus
gaatgtggaacagtcgcctgacctg

SEQ ID NO: 440440 - DNA, 25 bp, Mus musculus
gaatgtggacagagccagccggaaa

SEQ ID NO: 440441 - DNA, 25 bp, Mus musculus
gaatgtggacagtgccagccggaaa

SEQ ID NO: 440442 - DNA, 25 bp, Mus musculus
gaatgtggacatcctctggcaagct

SEQ ID NO: 440443 - DNA, 25 bp, Mus musculus
gaatgtggacatgctctggcaagct

SEQ ID NO: 440444 - DNA, 25 bp, Mus musculus
gaatgtggacctatgctacttgtat

SEQ ID NO: 440445 - DNA, 25 bp, Mus musculus
gaatgtggacctttgctacttgtat

SEQ ID NO: 440446 - DNA, 25 bp, Mus musculus
gaatgtggacgacgctttagccaga

SEQ ID NO: 440447 - DNA, 25 bp, Mus musculus
gaatgtggacgaggctttagccaga

SEQ ID NO: 440448 - DNA, 25 bp, Mus musculus
gaatgtggactcatgactaggcctc

SEQ ID NO: 440449 - DNA, 25 bp, Mus musculus
gaatgtggactcttgactaggcctc

SEQ ID NO: 440450 - DNA, 25 bp, Mus musculus
gaatgtggagctcccaatacactgt

SEQ ID NO: 440451 - DNA, 25 bp, Mus musculus
gaatgtggagctgccaatacactgt

SEQ ID NO: 440452 - DNA, 25 bp, Mus musculus
gaatgtggatatccccatgcttgac

SEQ ID NO: 440453 - DNA, 25 bp, Mus musculus
gaatgtggatatgcccatgcttgac

SEQ ID NO: 440454 - DNA, 25 bp, Mus musculus
gaatgtggatctaatctgtccagag

SEQ ID NO: 440455 - DNA, 25 bp, Mus musculus
gaatgtggatcttatctgtccagag

SEQ ID NO: 440456 - DNA, 25 bp, Mus musculus
gaatgtggatttagatgctcccttg

SEQ ID NO: 440457 - DNA, 25 bp, Mus musculus
gaatgtggattttgatgctcccttg

SEQ ID NO: 440458 - DNA, 25 bp, Mus musculus
gaatgtggcaaaacacttactacat

SEQ ID NO: 440459 - DNA, 25 bp, Mus musculus
gaatgtggcaaatcacttactacat

SEQ ID NO: 440460 - DNA, 25 bp, Mus musculus
gaatgtggcaacatgcttatgccta

SEQ ID NO: 440461 - DNA, 25 bp, Mus musculus
gaatgtggcaacttgcttatgccta

SEQ ID NO: 440462 - DNA, 25 bp, Mus musculus
gaatgtggcagaacaaatgtccctt

SEQ ID NO: 440463 - DNA, 25 bp, Mus musculus
gaatgtggcagatcaaatgtccctt

SEQ ID NO: 440464 - DNA, 25 bp, Mus musculus
gaatgtggccagacttagcctgcgt

SEQ ID NO: 440465 - DNA, 25 bp, Mus musculus
gaatgtggccagtcttagcctgcgt

SEQ ID NO: 440466 - DNA, 25 bp, Mus musculus
gaatgtggcctcagatttcttctag

SEQ ID NO: 440467 - DNA, 25 bp, Mus musculus
gaatgtggcctctgatttcttctag

SEQ ID NO: 440468 - DNA, 25 bp, Mus musculus
gaatgtggccttagtgataataaaa

SEQ ID NO: 440469 - DNA, 25 bp, Mus musculus
gaatgtggcctttgtgataataaaa

SEQ ID NO: 440470 - DNA, 25 bp, Mus musculus
gaatgtggctccacggctgcgtgtc

SEQ ID NO: 440471 - DNA, 25 bp, Mus musculus
gaatgtggctcctcggctgcgtgtc

SEQ ID NO: 440472 - DNA, 25 bp, Mus musculus
gaatgtggcttcattatgggtgaaa

SEQ ID NO: 440473 - DNA, 25 bp, Mus musculus
gaatgtggcttctttatgggtgaaa

SEQ ID NO: 440474 - DNA, 25 bp, Mus musculus
gaatgtggctttcgtttacccacct

SEQ ID NO: 440475 - DNA, 25 bp, Mus musculus
gaatgtggctttggtttacccacct

SEQ ID NO: 440476 - DNA, 25 bp, Mus musculus
gaatgtgggaaactgcttactctgc

SEQ ID NO: 440477 - DNA, 25 bp, Mus musculus
gaatgtgggaaagtgcttactctgc

SEQ ID NO: 440478 - DNA, 25 bp, Mus musculus
gaatgtgggaatccgtttgcccgca

SEQ ID NO: 440479 - DNA, 25 bp, Mus musculus
gaatgtgggaatgcgtttgcccgca

SEQ ID NO: 440480 - DNA, 25 bp, Mus musculus
gaatgtgggagaccaggcgccgcct

SEQ ID NO: 440481 - DNA, 25 bp, Mus musculus
gaatgtgggagagcaggcgccgcct

SEQ ID NO: 440482 - DNA, 25 bp, Mus musculus
gaatgtgggttaagttcttctatcc

SEQ ID NO: 440483 - DNA, 25 bp, Mus musculus
gaatgtgggttatgttcttctatcc

SEQ ID NO: 440484 - DNA, 25 bp, Mus musculus
gaatgtgggtttcttacattggttt

SEQ ID NO: 440485 - DNA, 25 bp, Mus musculus
gaatgtgggtttgttacattggttt

SEQ ID NO: 440486 - DNA, 25 bp, Mus musculus
gaatgtggtactcatactcatctca

SEQ ID NO: 440487 - DNA, 25 bp, Mus musculus
gaatgtggtactgatactcatctca

SEQ ID NO: 440488 - DNA, 25 bp, Mus musculus
gaatgtggtagcatactcctgcaat

SEQ ID NO: 440489 - DNA, 25 bp, Mus musculus
gaatgtggtagcttactcctgcaat

SEQ ID NO: 440490 - DNA, 25 bp, Mus musculus
gaatgtggtccccatgagctacatg

SEQ ID NO: 440491 - DNA, 25 bp, Mus musculus
gaatgtggtcccgatgagctacatg

SEQ ID NO: 440492 - DNA, 25 bp, Mus musculus
gaatgtggtgtgagccatagcaccc

SEQ ID NO: 440493 - DNA, 25 bp, Mus musculus
gaatgtggtgtgtgccatagcaccc

SEQ ID NO: 440494 - DNA, 25 bp, Mus musculus
gaatgtgtacaaacttcgatgcagg

SEQ ID NO: 440495 - DNA, 25 bp, Mus musculus
gaatgtgtacaatcttcgatgcagg

SEQ ID NO: 440496 - DNA, 25 bp, Mus musculus
gaatgtgtattcacagtacttgcat

SEQ ID NO: 440497 - DNA, 25 bp, Mus musculus
gaatgtgtattctcagtacttgcat

SEQ ID NO: 440498 - DNA, 25 bp, Mus musculus
gaatgtgtcaaaacagcccatcctg

SEQ ID NO: 440499 - DNA, 25 bp, Mus musculus
gaatgtgtcaaatcagcccatcctg

SEQ ID NO: 440500 - DNA, 25 bp, Mus musculus
gaatgtgtccagatcaattgtgaag

SEQ ID NO: 440501 - DNA, 25 bp, Mus musculus
gaatgtgtccagcatggtgagtctc

SEQ ID NO: 440502 - DNA, 25 bp, Mus musculus
gaatgtgtccaggatggtgagtctc

SEQ ID NO: 440503 - DNA, 25 bp, Mus musculus
gaatgtgtccagttcaattgtgaag

SEQ ID NO: 440504 - DNA, 25 bp, Mus musculus
gaatgtgtctatcagctctgggtct

SEQ ID NO: 440505 - DNA, 25 bp, Mus musculus
gaatgtgtctatgagctctgggtct

SEQ ID NO: 440506 - DNA, 25 bp, Mus musculus
gaatgtgtctgtaccttgaatatca

SEQ ID NO: 440507 - DNA, 25 bp, Mus musculus
gaatgtgtctgtctacatctgaaga

SEQ ID NO: 440508 - DNA, 25 bp, Mus musculus
gaatgtgtctgtgtacatctgaaga

SEQ ID NO: 440509 - DNA, 25 bp, Mus musculus
gaatgtgtctgttccttgaatatca

SEQ ID NO: 440510 - DNA, 25 bp, Mus musculus
gaatgtgtgaaactcactttctctt

SEQ ID NO: 440511 - DNA, 25 bp, Mus musculus
gaatgtgtgaaagtcactttctctt

SEQ ID NO: 440512 - DNA, 25 bp, Mus musculus
gaatgtgtgatgctccagtgtacca

SEQ ID NO: 440513 - DNA, 25 bp, Mus musculus
gaatgtgtgatggtccagtgtacca

SEQ ID NO: 440514 - DNA, 25 bp, Mus musculus
gaatgtgtgctacgcccttagtgtc

SEQ ID NO: 440515 - DNA, 25 bp, Mus musculus
gaatgtgtgctaggcccttagtgtc

SEQ ID NO: 440516 - DNA, 25 bp, Mus musculus
gaatgtgtgcttactgtacgtaaaa

SEQ ID NO: 440517 - DNA, 25 bp, Mus musculus
gaatgtgtgctttctgtacgtaaaa

SEQ ID NO: 440518 - DNA, 25 bp, Mus musculus
gaatgtgtggaaaccccttgtgagg

SEQ ID NO: 440519 - DNA, 25 bp, Mus musculus
gaatgtgtggaatccccttgtgagg

SEQ ID NO: 440520 - DNA, 25 bp, Mus musculus
gaatgtgtggcaagcgttctcatct

SEQ ID NO: 440521 - DNA, 25 bp, Mus musculus
gaatgtgtggcatgcgttctcatct

SEQ ID NO: 440522 - DNA, 25 bp, Mus musculus
gaatgtgtggctagctcagttgaag

SEQ ID NO: 440523 - DNA, 25 bp, Mus musculus
gaatgtgtggcttgctcagttgaag

SEQ ID NO: 440524 - DNA, 25 bp, Mus musculus
gaatgtgtggtgagctccgacaaga

SEQ ID NO: 440525 - DNA, 25 bp, Mus musculus
gaatgtgtggtgtgctccgacaaga

SEQ ID NO: 440526 - DNA, 25 bp, Mus musculus
gaatgtgtggttacaacttcctaaa

SEQ ID NO: 440527 - DNA, 25 bp, Mus musculus
gaatgtgtggtttcaacttcctaaa

SEQ ID NO: 440528 - DNA, 25 bp, Mus musculus
gaatgtgtgtataactggcacccta

SEQ ID NO: 440529 - DNA, 25 bp, Mus musculus
gaatgtgtgtattactggcacccta

SEQ ID NO: 440530 - DNA, 25 bp, Mus musculus
gaatgtgtgtcactcttggagtaga

SEQ ID NO: 440531 - DNA, 25 bp, Mus musculus
gaatgtgtgtcagtcttggagtaga

SEQ ID NO: 440532 - DNA, 25 bp, Mus musculus
gaatgtgtgtctagttttcagttct

SEQ ID NO: 440533 - DNA, 25 bp, Mus musculus
gaatgtgtgtcttgttttcagttct

SEQ ID NO: 440534 - DNA, 25 bp, Mus musculus
gaatgtgtgttgaatttgtagatca

SEQ ID NO: 440535 - DNA, 25 bp, Mus musculus
gaatgtgtgttgtatttgtagatca

SEQ ID NO: 440536 - DNA, 25 bp, Mus musculus
gaatgtgttcacattatattatctt

SEQ ID NO: 440537 - DNA, 25 bp, Mus musculus
gaatgtgttcactttatattatctt

SEQ ID NO: 440538 - DNA, 25 bp, Mus musculus
gaatgtgttcccatcattaagtgat

SEQ ID NO: 440539 - DNA, 25 bp, Mus musculus
gaatgtgttcccttcattaagtgat

SEQ ID NO: 440540 - DNA, 25 bp, Mus musculus
gaatgtgttcctcagacaagctgaa

SEQ ID NO: 440541 - DNA, 25 bp, Mus musculus
gaatgtgttcctctctatgcagtcc

SEQ ID NO: 440542 - DNA, 25 bp, Mus musculus
gaatgtgttcctgagacaagctgaa

SEQ ID NO: 440543 - DNA, 25 bp, Mus musculus
gaatgtgttcctgtctatgcagtcc

SEQ ID NO: 440544 - DNA, 25 bp, Mus musculus
gaatgtgttggcctcattacaccac

SEQ ID NO: 440545 - DNA, 25 bp, Mus musculus
gaatgtgttggcgtcattacaccac

SEQ ID NO: 440546 - DNA, 25 bp, Mus musculus
gaatgtgtttacatgtgctcccttg

SEQ ID NO: 440547 - DNA, 25 bp, Mus musculus
gaatgtgtttacttgtgctcccttg

SEQ ID NO: 440548 - DNA, 25 bp, Mus musculus
gaatgtgtttgccacactggcccaa

SEQ ID NO: 440549 - DNA, 25 bp, Mus musculus
gaatgtgtttgcgacactggcccaa

SEQ ID NO: 440550 - DNA, 25 bp, Mus musculus
gaatgtgtttggagtctgccagata

SEQ ID NO: 440551 - DNA, 25 bp, Mus musculus
gaatgtgtttggtgtctgccagata

SEQ ID NO: 440552 - DNA, 25 bp, Mus musculus
gaatgttaaacaactgagtgagtca

SEQ ID NO: 440553 - DNA, 25 bp, Mus musculus
gaatgttaaacatctgagtgagtca

SEQ ID NO: 440554 - DNA, 25 bp, Mus musculus
gaatgttaagtgagccggccatgtg

SEQ ID NO: 440555 - DNA, 25 bp, Mus musculus
gaatgttaagtgtgccggccatgtg

SEQ ID NO: 440556 - DNA, 25 bp, Mus musculus
gaatgttaatagagctcatgttcat

SEQ ID NO: 440557 - DNA, 25 bp, Mus musculus
gaatgttaatagtgctcatgttcat

SEQ ID NO: 440558 - DNA, 25 bp, Mus musculus
gaatgttaatgaccccacaggctca

SEQ ID NO: 440559 - DNA, 25 bp, Mus musculus
gaatgttaatgagcccacaggctca

SEQ ID NO: 440560 - DNA, 25 bp, Mus musculus
gaatgttaccttattccatgtatgg

SEQ ID NO: 440561 - DNA, 25 bp, Mus musculus
gaatgttacctttttccatgtatgg

SEQ ID NO: 440562 - DNA, 25 bp, Mus musculus
gaatgttactccatatactctttga

SEQ ID NO: 440563 - DNA, 25 bp, Mus musculus
gaatgttactccttatactctttga

SEQ ID NO: 440564 - DNA, 25 bp, Mus musculus
gaatgttactctacaagtttgggat

SEQ ID NO: 440565 - DNA, 25 bp, Mus musculus
gaatgttactcttcaagtttgggat

SEQ ID NO: 440566 - DNA, 25 bp, Mus musculus
gaatgttactggctctggatctata

SEQ ID NO: 440567 - DNA, 25 bp, Mus musculus
gaatgttactgggtctggatctata

SEQ ID NO: 440568 - DNA, 25 bp, Mus musculus
gaatgttacttcaggaatcctatgc

SEQ ID NO: 440569 - DNA, 25 bp, Mus musculus
gaatgttacttctggaatcctatgc

SEQ ID NO: 440570 - DNA, 25 bp, Mus musculus
gaatgttagaccactggcctgtcat

SEQ ID NO: 440571 - DNA, 25 bp, Mus musculus
gaatgttagacctctggcctgtcat

SEQ ID NO: 440572 - DNA, 25 bp, Mus musculus
gaatgttatcaaatagcacactgaa

SEQ ID NO: 440573 - DNA, 25 bp, Mus musculus
gaatgttatcaattagcacactgaa

SEQ ID NO: 440574 - DNA, 25 bp, Mus musculus
gaatgttattatcatgatagtcctt

SEQ ID NO: 440575 - DNA, 25 bp, Mus musculus
gaatgttattatgatgatagtcctt

SEQ ID NO: 440576 - DNA, 25 bp, Mus musculus
gaatgttatttaccctctgactctg

SEQ ID NO: 440577 - DNA, 25 bp, Mus musculus
gaatgttatttagcctctgactctg

SEQ ID NO: 440578 - DNA, 25 bp, Mus musculus
gaatgttcacagcaaaacacctttg

SEQ ID NO: 440579 - DNA, 25 bp, Mus musculus
gaatgttcacagcactcccctggtt

SEQ ID NO: 440580 - DNA, 25 bp, Mus musculus
gaatgttcacagctgactgctcccc

SEQ ID NO: 440581 - DNA, 25 bp, Mus musculus
gaatgttcacaggaaaacacctttg

SEQ ID NO: 440582 - DNA, 25 bp, Mus musculus
gaatgttcacaggactcccctggtt

SEQ ID NO: 440583 - DNA, 25 bp, Mus musculus
gaatgttcacaggtgactgctcccc

SEQ ID NO: 440584 - DNA, 25 bp, Mus musculus
gaatgttcacggaggcttctgacgt

SEQ ID NO: 440585 - DNA, 25 bp, Mus musculus
gaatgttcacggtggcttctgacgt

SEQ ID NO: 440586 - DNA, 25 bp, Mus musculus
gaatgttcactccattagccatgta

SEQ ID NO: 440587 - DNA, 25 bp, Mus musculus
gaatgttcactcgattagccatgta

SEQ ID NO: 440588 - DNA, 25 bp, Mus musculus
gaatgttcactgacccaatttctca

SEQ ID NO: 440589 - DNA, 25 bp, Mus musculus
gaatgttcactgtcccaatttctca

SEQ ID NO: 440590 - DNA, 25 bp, Mus musculus
gaatgttcagaacgactggtgataa

SEQ ID NO: 440591 - DNA, 25 bp, Mus musculus
gaatgttcagaaggactggtgataa

SEQ ID NO: 440592 - DNA, 25 bp, Mus musculus
gaatgttcagttacaccggcttgaa

SEQ ID NO: 440593 - DNA, 25 bp, Mus musculus
gaatgttcagtttcaccggcttgaa

SEQ ID NO: 440594 - DNA, 25 bp, Mus musculus
gaatgttcataccatattcctgaag

SEQ ID NO: 440595 - DNA, 25 bp, Mus musculus
gaatgttcatacgatattcctgaag

SEQ ID NO: 440596 - DNA, 25 bp, Mus musculus
gaatgttcatcactaccatcagaga

SEQ ID NO: 440597 - DNA, 25 bp, Mus musculus
gaatgttcatcagtaccatcagaga

SEQ ID NO: 440598 - DNA, 25 bp, Mus musculus
gaatgttcatccagcgatcctgaat

SEQ ID NO: 440599 - DNA, 25 bp, Mus musculus
gaatgttcatcctgcgatcctgaat

SEQ ID NO: 440600 - DNA, 25 bp, Mus musculus
gaatgttcatctagaacctgactcc

SEQ ID NO: 440601 - DNA, 25 bp, Mus musculus
gaatgttcatcttgaacctgactcc

SEQ ID NO: 440602 - DNA, 25 bp, Mus musculus
gaatgttcatgtagatctcatatat

SEQ ID NO: 440603 - DNA, 25 bp, Mus musculus
gaatgttcatgttgatctcatatat

SEQ ID NO: 440604 - DNA, 25 bp, Mus musculus
gaatgttcattcataggtttctggg

SEQ ID NO: 440605 - DNA, 25 bp, Mus musculus
gaatgttcattcttaggtttctggg

SEQ ID NO: 440606 - DNA, 25 bp, Mus musculus
gaatgttccagcactcatagtcaaa

SEQ ID NO: 440607 - DNA, 25 bp, Mus musculus
gaatgttccagctctcatagtcaaa

SEQ ID NO: 440608 - DNA, 25 bp, Mus musculus
gaatgttccagtcagatgtcaatca

SEQ ID NO: 440609 - DNA, 25 bp, Mus musculus
gaatgttccagtgagatgtcaatca

SEQ ID NO: 440610 - DNA, 25 bp, Mus musculus
gaatgttccattagtctgccgcttg

SEQ ID NO: 440611 - DNA, 25 bp, Mus musculus
gaatgttccatttgtctgccgcttg

SEQ ID NO: 440612 - DNA, 25 bp, Mus musculus
gaatgttcccaacacgaccagtagt

SEQ ID NO: 440613 - DNA, 25 bp, Mus musculus
gaatgttcccaagacgaccagtagt

SEQ ID NO: 440614 - DNA, 25 bp, Mus musculus
gaatgttcccggaatggtgaccaga

SEQ ID NO: 440615 - DNA, 25 bp, Mus musculus
gaatgttcccggtatggtgaccaga

SEQ ID NO: 440616 - DNA, 25 bp, Mus musculus
gaatgttcccttagatgtgctcaca

SEQ ID NO: 440617 - DNA, 25 bp, Mus musculus
gaatgttccctttgatgtgctcaca

SEQ ID NO: 440618 - DNA, 25 bp, Mus musculus
gaatgttccggcctcttagaaagca

SEQ ID NO: 440619 - DNA, 25 bp, Mus musculus
gaatgttccggcgtcttagaaagca

SEQ ID NO: 440620 - DNA, 25 bp, Mus musculus
gaatgttcctttacccctatgtaag

SEQ ID NO: 440621 - DNA, 25 bp, Mus musculus
gaatgttccttttcccctatgtaag

SEQ ID NO: 440622 - DNA, 25 bp, Mus musculus
gaatgttcgcttactggtctattat

SEQ ID NO: 440623 - DNA, 25 bp, Mus musculus
gaatgttcgctttctggtctattat

SEQ ID NO: 440624 - DNA, 25 bp, Mus musculus
gaatgttctgcaaaatcgctcctag

SEQ ID NO: 440625 - DNA, 25 bp, Mus musculus
gaatgttctgcataatcgctcctag

SEQ ID NO: 440626 - DNA, 25 bp, Mus musculus
gaatgttctggaaggagcgcttgct

SEQ ID NO: 440627 - DNA, 25 bp, Mus musculus
gaatgttctggatggagcgcttgct

SEQ ID NO: 440628 - DNA, 25 bp, Mus musculus
gaatgttctgtgctatatggctgca

SEQ ID NO: 440629 - DNA, 25 bp, Mus musculus
gaatgttctgtggtatatggctgca

SEQ ID NO: 440630 - DNA, 25 bp, Mus musculus
gaatgttcttgtccagtttagccct

SEQ ID NO: 440631 - DNA, 25 bp, Mus musculus
gaatgttcttgtgcagtttagccct

SEQ ID NO: 440632 - DNA, 25 bp, Mus musculus
gaatgttgaaccatttgaattagtt

SEQ ID NO: 440633 - DNA, 25 bp, Mus musculus
gaatgttgaaccttttgaattagtt

SEQ ID NO: 440634 - DNA, 25 bp, Mus musculus
gaatgttgaatgacaccgtatgcgt

SEQ ID NO: 440635 - DNA, 25 bp, Mus musculus
gaatgttgaatgtcaccgtatgcgt

SEQ ID NO: 440636 - DNA, 25 bp, Mus musculus
gaatgttgacaacactcccagaccc

SEQ ID NO: 440637 - DNA, 25 bp, Mus musculus
gaatgttgacaagactcccagaccc

SEQ ID NO: 440638 - DNA, 25 bp, Mus musculus
gaatgttgacatagtagtacttctc

SEQ ID NO: 440639 - DNA, 25 bp, Mus musculus
gaatgttgacattgtagtacttctc

SEQ ID NO: 440640 - DNA, 25 bp, Mus musculus
gaatgttgacggaatccacctttcc

SEQ ID NO: 440641 - DNA, 25 bp, Mus musculus
gaatgttgacggtatccacctttcc

SEQ ID NO: 440642 - DNA, 25 bp, Mus musculus
gaatgttgactaactgacaggtgac

SEQ ID NO: 440643 - DNA, 25 bp, Mus musculus
gaatgttgactatctgacaggtgac

SEQ ID NO: 440644 - DNA, 25 bp, Mus musculus
gaatgttgatgcaccgggcatcgac

SEQ ID NO: 440645 - DNA, 25 bp, Mus musculus
gaatgttgatgctccgggcatcgac

SEQ ID NO: 440646 - DNA, 25 bp, Mus musculus
gaatgttgcaacacagaactcttag

SEQ ID NO: 440647 - DNA, 25 bp, Mus musculus
gaatgttgcaactcagaactcttag

SEQ ID NO: 440648 - DNA, 25 bp, Mus musculus
gaatgttgccaaaacaactctgtag

SEQ ID NO: 440649 - DNA, 25 bp, Mus musculus
gaatgttgccaatacaactctgtag

SEQ ID NO: 440650 - DNA, 25 bp, Mus musculus
gaatgttgccagatgtaggctcact

SEQ ID NO: 440651 - DNA, 25 bp, Mus musculus
gaatgttgccagttgtaggctcact

SEQ ID NO: 440652 - DNA, 25 bp, Mus musculus
gaatgttgccgaaatgttatgtgtt

SEQ ID NO: 440653 - DNA, 25 bp, Mus musculus
gaatgttgccgatatgttatgtgtt

SEQ ID NO: 440654 - DNA, 25 bp, Mus musculus
gaatgttgcctacatagtgcttctt

SEQ ID NO: 440655 - DNA, 25 bp, Mus musculus
gaatgttgcctagatagtgcttctt

SEQ ID NO: 440656 - DNA, 25 bp, Mus musculus
gaatgttgctataatttccatgaaa

SEQ ID NO: 440657 - DNA, 25 bp, Mus musculus
gaatgttgctattatttccatgaaa

SEQ ID NO: 440658 - DNA, 25 bp, Mus musculus
gaatgttgcttactgtcacactagg

SEQ ID NO: 440659 - DNA, 25 bp, Mus musculus
gaatgttgcttagtgtcacactagg

SEQ ID NO: 440660 - DNA, 25 bp, Mus musculus
gaatgttgcttgagtctgttcatca

SEQ ID NO: 440661 - DNA, 25 bp, Mus musculus
gaatgttgcttgtgtctgttcatca

SEQ ID NO: 440662 - DNA, 25 bp, Mus musculus
gaatgttggataatatttcactgtc

SEQ ID NO: 440663 - DNA, 25 bp, Mus musculus
gaatgttggatattatttcactgtc

SEQ ID NO: 440664 - DNA, 25 bp, Mus musculus
gaatgttggcaaactcagaggcaaa

SEQ ID NO: 440665 - DNA, 25 bp, Mus musculus
gaatgttggcaatctcagaggcaaa

SEQ ID NO: 440666 - DNA, 25 bp, Mus musculus
gaatgttggcagagtgtgcagaaaa

SEQ ID NO: 440667 - DNA, 25 bp, Mus musculus
gaatgttggcagatttatttttagt

SEQ ID NO: 440668 - DNA, 25 bp, Mus musculus
gaatgttggcagtgtgtgcagaaaa

SEQ ID NO: 440669 - DNA, 25 bp, Mus musculus
gaatgttggcagttttatttttagt

SEQ ID NO: 440670 - DNA, 25 bp, Mus musculus
gaatgttggcatccggtgccttcac

SEQ ID NO: 440671 - DNA, 25 bp, Mus musculus
gaatgttggcatgcggtgccttcac

SEQ ID NO: 440672 - DNA, 25 bp, Mus musculus
gaatgttggccacttttgtttagtt

SEQ ID NO: 440673 - DNA, 25 bp, Mus musculus
gaatgttggccagttttgtttagtt

SEQ ID NO: 440674 - DNA, 25 bp, Mus musculus
gaatgttggtcaagctcacctggga

SEQ ID NO: 440675 - DNA, 25 bp, Mus musculus
gaatgttggtcatgctcacctggga

SEQ ID NO: 440676 - DNA, 25 bp, Mus musculus
gaatgttggtttcatgtcggttcaa

SEQ ID NO: 440677 - DNA, 25 bp, Mus musculus
gaatgttggtttgatgtcggttcaa

SEQ ID NO: 440678 - DNA, 25 bp, Mus musculus
gaatgttgtcctctggttttattat

SEQ ID NO: 440679 - DNA, 25 bp, Mus musculus
gaatgttgtcctgtggttttattat

SEQ ID NO: 440680 - DNA, 25 bp, Mus musculus
gaatgttgtcggacggcaaatccac

SEQ ID NO: 440681 - DNA, 25 bp, Mus musculus
gaatgttgtcggtcggcaaatccac

SEQ ID NO: 440682 - DNA, 25 bp, Mus musculus
gaatgttgtgctagtatgaccatga

SEQ ID NO: 440683 - DNA, 25 bp, Mus musculus
gaatgttgtgcttgtatgaccatga

SEQ ID NO: 440684 - DNA, 25 bp, Mus musculus
gaatgttgtgttagcctgaggagat

SEQ ID NO: 440685 - DNA, 25 bp, Mus musculus
gaatgttgtgtttgcctgaggagat

SEQ ID NO: 440686 - DNA, 25 bp, Mus musculus
gaatgttgttctatccttgggacat

SEQ ID NO: 440687 - DNA, 25 bp, Mus musculus
gaatgttgttctttccttgggacat

SEQ ID NO: 440688 - DNA, 25 bp, Mus musculus
gaatgttgttttctatgcccaaaga

SEQ ID NO: 440689 - DNA, 25 bp, Mus musculus
gaatgttgttttgtatgcccaaaga

SEQ ID NO: 440690 - DNA, 25 bp, Mus musculus
gaatgtttacatcccacacagaatg

SEQ ID NO: 440691 - DNA, 25 bp, Mus musculus
gaatgtttacatccctatccatagg

SEQ ID NO: 440692 - DNA, 25 bp, Mus musculus
gaatgtttacatgccacacagaatg

SEQ ID NO: 440693 - DNA, 25 bp, Mus musculus
gaatgtttacatgcctatccatagg

SEQ ID NO: 440694 - DNA, 25 bp, Mus musculus
gaatgtttacttataattttgactc

SEQ ID NO: 440695 - DNA, 25 bp, Mus musculus
gaatgtttacttttaattttgactc

SEQ ID NO: 440696 - DNA, 25 bp, Mus musculus
gaatgtttagtgactcagagagcac

SEQ ID NO: 440697 - DNA, 25 bp, Mus musculus
gaatgtttagtgtctcagagagcac

SEQ ID NO: 440698 - DNA, 25 bp, Mus musculus
gaatgtttagttatctgagccagat

SEQ ID NO: 440699 - DNA, 25 bp, Mus musculus
gaatgtttagttttctgagccagat

SEQ ID NO: 440700 - DNA, 25 bp, Mus musculus
gaatgtttattcaacagtccaagga

SEQ ID NO: 440701 - DNA, 25 bp, Mus musculus
gaatgtttattctacagtccaagga

SEQ ID NO: 440702 - DNA, 25 bp, Mus musculus
gaatgtttcaaacccatcagctgta

SEQ ID NO: 440703 - DNA, 25 bp, Mus musculus
gaatgtttcaaagccatcagctgta

SEQ ID NO: 440704 - DNA, 25 bp, Mus musculus
gaatgtttcaacaggccagatgtat

SEQ ID NO: 440705 - DNA, 25 bp, Mus musculus
gaatgtttcaactggccagatgtat

SEQ ID NO: 440706 - DNA, 25 bp, Mus musculus
gaatgtttcagtcgtttccaatgtt

SEQ ID NO: 440707 - DNA, 25 bp, Mus musculus
gaatgtttcagtggtttccaatgtt

SEQ ID NO: 440708 - DNA, 25 bp, Mus musculus
gaatgtttccaaacaaggcacctcc

SEQ ID NO: 440709 - DNA, 25 bp, Mus musculus
gaatgtttccaatcaaggcacctcc

SEQ ID NO: 440710 - DNA, 25 bp, Mus musculus
gaatgtttcctaaaatactccaaag

SEQ ID NO: 440711 - DNA, 25 bp, Mus musculus
gaatgtttcctaacatcccatctat

SEQ ID NO: 440712 - DNA, 25 bp, Mus musculus
gaatgtttcctataatactccaaag

SEQ ID NO: 440713 - DNA, 25 bp, Mus musculus
gaatgtttcctatcatcccatctat

SEQ ID NO: 440714 - DNA, 25 bp, Mus musculus
gaatgtttcctgaaaatgacaatca

SEQ ID NO: 440715 - DNA, 25 bp, Mus musculus
gaatgtttcctgtaaatgacaatca

SEQ ID NO: 440716 - DNA, 25 bp, Mus musculus
gaatgtttccttagacaagtcacca

SEQ ID NO: 440717 - DNA, 25 bp, Mus musculus
gaatgtttcctttgacaagtcacca

SEQ ID NO: 440718 - DNA, 25 bp, Mus musculus
gaatgtttcgttcttctgaccatga

SEQ ID NO: 440719 - DNA, 25 bp, Mus musculus
gaatgtttcgttgttctgaccatga

SEQ ID NO: 440720 - DNA, 25 bp, Mus musculus
gaatgtttctaacatgtttcttccc

SEQ ID NO: 440721 - DNA, 25 bp, Mus musculus
gaatgtttctaactgctgctgtaac

SEQ ID NO: 440722 - DNA, 25 bp, Mus musculus
gaatgtttctaagatgtttcttccc

SEQ ID NO: 440723 - DNA, 25 bp, Mus musculus
gaatgtttctaagtgctgctgtaac

SEQ ID NO: 440724 - DNA, 25 bp, Mus musculus
gaatgtttctagaaagtgacgtcag

SEQ ID NO: 440725 - DNA, 25 bp, Mus musculus
gaatgtttctagatcgctgacttaa

SEQ ID NO: 440726 - DNA, 25 bp, Mus musculus
gaatgtttctagtaagtgacgtcag

SEQ ID NO: 440727 - DNA, 25 bp, Mus musculus
gaatgtttctagttcgctgacttaa

SEQ ID NO: 440728 - DNA, 25 bp, Mus musculus
gaatgtttctcgaggtttgtacaga

SEQ ID NO: 440729 - DNA, 25 bp, Mus musculus
gaatgtttctcgtggtttgtacaga

SEQ ID NO: 440730 - DNA, 25 bp, Mus musculus
gaatgtttctgtcatggcagcacct

SEQ ID NO: 440731 - DNA, 25 bp, Mus musculus
gaatgtttctgtgatggcagcacct

SEQ ID NO: 440732 - DNA, 25 bp, Mus musculus
gaatgtttcttcagagtaaaggcta

SEQ ID NO: 440733 - DNA, 25 bp, Mus musculus
gaatgtttcttctgagtaaaggcta

SEQ ID NO: 440734 - DNA, 25 bp, Mus musculus
gaatgtttgattatagaaaggtcgt

SEQ ID NO: 440735 - DNA, 25 bp, Mus musculus
gaatgtttgattttagaaaggtcgt

SEQ ID NO: 440736 - DNA, 25 bp, Mus musculus
gaatgtttgcagaatctctcctgat

SEQ ID NO: 440737 - DNA, 25 bp, Mus musculus
gaatgtttgcagactggatcccctg

SEQ ID NO: 440738 - DNA, 25 bp, Mus musculus
gaatgtttgcagcagacatttctaa

SEQ ID NO: 440739 - DNA, 25 bp, Mus musculus
gaatgtttgcaggagacatttctaa

SEQ ID NO: 440740 - DNA, 25 bp, Mus musculus
gaatgtttgcagtatctctcctgat

SEQ ID NO: 440741 - DNA, 25 bp, Mus musculus
gaatgtttgcagtctggatcccctg

SEQ ID NO: 440742 - DNA, 25 bp, Mus musculus
gaatgtttgctgagttgtagcccgt

SEQ ID NO: 440743 - DNA, 25 bp, Mus musculus
gaatgtttgctgtgttgtagcccgt

SEQ ID NO: 440744 - DNA, 25 bp, Mus musculus
gaatgtttgcttacttccgacgcaa

SEQ ID NO: 440745 - DNA, 25 bp, Mus musculus
gaatgtttgctttcttccgacgcaa

SEQ ID NO: 440746 - DNA, 25 bp, Mus musculus
gaatgtttggtcatcacgcgtttga

SEQ ID NO: 440747 - DNA, 25 bp, Mus musculus
gaatgtttggtcttcacgcgtttga

SEQ ID NO: 440748 - DNA, 25 bp, Mus musculus
gaatgtttgtccagtctccctacac

SEQ ID NO: 440749 - DNA, 25 bp, Mus musculus
gaatgtttgtcctgtctccctacac

SEQ ID NO: 440750 - DNA, 25 bp, Mus musculus
gaatgtttgttactgtgtctcggca

SEQ ID NO: 440751 - DNA, 25 bp, Mus musculus
gaatgtttgttagtgtgtctcggca

SEQ ID NO: 440752 - DNA, 25 bp, Mus musculus
gaatgttttccaaatctgattgtca

SEQ ID NO: 440753 - DNA, 25 bp, Mus musculus
gaatgttttccatatctgattgtca

SEQ ID NO: 440754 - DNA, 25 bp, Mus musculus
gaatgttttcctaaagctaagacaa

SEQ ID NO: 440755 - DNA, 25 bp, Mus musculus
gaatgttttccttaagctaagacaa

SEQ ID NO: 440756 - DNA, 25 bp, Mus musculus
gaatgttttcgtcacttaaacctag

SEQ ID NO: 440757 - DNA, 25 bp, Mus musculus
gaatgttttcgtgacttaaacctag

SEQ ID NO: 440758 - DNA, 25 bp, Mus musculus
gaatgttttggacttctctttcctg

SEQ ID NO: 440759 - DNA, 25 bp, Mus musculus
gaatgttttggagttctctttcctg

SEQ ID NO: 440760 - DNA, 25 bp, Mus musculus
gaatgttttggtacgagttgggatt

SEQ ID NO: 440761 - DNA, 25 bp, Mus musculus
gaatgttttggttcgagttgggatt

SEQ ID NO: 440762 - DNA, 25 bp, Mus musculus
gaatgttttgtcagcgtggtcaact

SEQ ID NO: 440763 - DNA, 25 bp, Mus musculus
gaatgttttgtctgcgtggtcaact

SEQ ID NO: 440764 - DNA, 25 bp, Mus musculus
gaatgttttgttagctaatccctag

SEQ ID NO: 440765 - DNA, 25 bp, Mus musculus
gaatgttttgtttgctaatccctag

SEQ ID NO: 440766 - DNA, 25 bp, Mus musculus
gaatgtttttatagcaagatttcac

SEQ ID NO: 440767 - DNA, 25 bp, Mus musculus
gaatgtttttattgcaagatttcac

SEQ ID NO: 440768 - DNA, 25 bp, Mus musculus
gaatgtttttggaggcttggatgac

SEQ ID NO: 440769 - DNA, 25 bp, Mus musculus
gaatgtttttggtggcttggatgac

SEQ ID NO: 440770 - DNA, 25 bp, Mus musculus
gaattaaaacatcgaatgcaaggta

SEQ ID NO: 440771 - DNA, 25 bp, Mus musculus
gaattaaaacatggaatgcaaggta

SEQ ID NO: 440772 - DNA, 25 bp, Mus musculus
gaattaaaatttcccatcagtgaac

SEQ ID NO: 440773 - DNA, 25 bp, Mus musculus
gaattaaaatttgccatcagtgaac

SEQ ID NO: 440774 - DNA, 25 bp, Mus musculus
gaattaaaccgtagcctttgaagat

SEQ ID NO: 440775 - DNA, 25 bp, Mus musculus
gaattaaaccgttgcctttgaagat

SEQ ID NO: 440776 - DNA, 25 bp, Mus musculus
gaattaaaggcgagcctggctctct

SEQ ID NO: 440777 - DNA, 25 bp, Mus musculus
gaattaaaggcgtgcctggctctct

SEQ ID NO: 440778 - DNA, 25 bp, Mus musculus
gaattaaatcccaaacacagaaggg

SEQ ID NO: 440779 - DNA, 25 bp, Mus musculus
gaattaaatccctaacacagaaggg

SEQ ID NO: 440780 - DNA, 25 bp, Mus musculus
gaattaaatggtacacagtgtcagc

SEQ ID NO: 440781 - DNA, 25 bp, Mus musculus
gaattaaatggttcacagtgtcagc

SEQ ID NO: 440782 - DNA, 25 bp, Mus musculus
gaattaaattgcctctctacattta

SEQ ID NO: 440783 - DNA, 25 bp, Mus musculus
gaattaaattgcgtctctacattta

SEQ ID NO: 440784 - DNA, 25 bp, Mus musculus
gaattaaattgtctctacatagcct

SEQ ID NO: 440785 - DNA, 25 bp, Mus musculus
gaattaaattgtgtctacatagcct

SEQ ID NO: 440786 - DNA, 25 bp, Mus musculus
gaattaacactcaccaaatgaactt

SEQ ID NO: 440787 - DNA, 25 bp, Mus musculus
gaattaacactctccaaatgaactt

SEQ ID NO: 440788 - DNA, 25 bp, Mus musculus
gaattaacagatctctacggaaatt

SEQ ID NO: 440789 - DNA, 25 bp, Mus musculus
gaattaacagatgtctacggaaatt

SEQ ID NO: 440790 - DNA, 25 bp, Mus musculus
gaattaaccatgacagcgagtgtca

SEQ ID NO: 440791 - DNA, 25 bp, Mus musculus
gaattaaccatgtcagcgagtgtca

SEQ ID NO: 440792 - DNA, 25 bp, Mus musculus
gaattaacggtgcaacaggtcactg

SEQ ID NO: 440793 - DNA, 25 bp, Mus musculus
gaattaacggtggaacaggtcactg

SEQ ID NO: 440794 - DNA, 25 bp, Mus musculus
gaattaactcccaccaagaatctga

SEQ ID NO: 440795 - DNA, 25 bp, Mus musculus
gaattaactccccttcagtctgtta

SEQ ID NO: 440796 - DNA, 25 bp, Mus musculus
gaattaactcccgttcagtctgtta

SEQ ID NO: 440797 - DNA, 25 bp, Mus musculus
gaattaactccctccaagaatctga

SEQ ID NO: 440798 - DNA, 25 bp, Mus musculus
gaattaactcttagattctcagaat

SEQ ID NO: 440799 - DNA, 25 bp, Mus musculus
gaattaactctttgattctcagaat

SEQ ID NO: 440800 - DNA, 25 bp, Mus musculus
gaattaacttagaataccaggcaac

SEQ ID NO: 440801 - DNA, 25 bp, Mus musculus
gaattaacttagtataccaggcaac

SEQ ID NO: 440802 - DNA, 25 bp, Mus musculus
gaattaacttatcctgtacccagtc

SEQ ID NO: 440803 - DNA, 25 bp, Mus musculus
gaattaacttatgctgtacccagtc

SEQ ID NO: 440804 - DNA, 25 bp, Mus musculus
gaattaacttgtaagaccagtcata

SEQ ID NO: 440805 - DNA, 25 bp, Mus musculus
gaattaacttgttagaccagtcata

SEQ ID NO: 440806 - DNA, 25 bp, Mus musculus
gaattaaggatcacttccatatttc

SEQ ID NO: 440807 - DNA, 25 bp, Mus musculus
gaattaaggatctcttccatatttc

SEQ ID NO: 440808 - DNA, 25 bp, Mus musculus
gaattaaggcagatacctctgtaga

SEQ ID NO: 440809 - DNA, 25 bp, Mus musculus
gaattaaggcagttacctctgtaga

SEQ ID NO: 440810 - DNA, 25 bp, Mus musculus
gaattaaggcgcacactcagcgtgc

SEQ ID NO: 440811 - DNA, 25 bp, Mus musculus
gaattaaggcgctcactcagcgtgc

SEQ ID NO: 440812 - DNA, 25 bp, Mus musculus
gaattaagggtgctcgctgttcttc

SEQ ID NO: 440813 - DNA, 25 bp, Mus musculus
gaattaagggtggtcgctgttcttc

SEQ ID NO: 440814 - DNA, 25 bp, Mus musculus
gaattaagtcccagaagctgattta

SEQ ID NO: 440815 - DNA, 25 bp, Mus musculus
gaattaagtccctgaagctgattta

SEQ ID NO: 440816 - DNA, 25 bp, Mus musculus
gaattaagtcctctagaccttacct

SEQ ID NO: 440817 - DNA, 25 bp, Mus musculus
gaattaagtcctgtagaccttacct

SEQ ID NO: 440818 - DNA, 25 bp, Mus musculus
gaattaatctgaaatgtacaagccc

SEQ ID NO: 440819 - DNA, 25 bp, Mus musculus
gaattaatctgatatgtacaagccc

SEQ ID NO: 440820 - DNA, 25 bp, Mus musculus
gaattaatcttcacctcgtatggta

SEQ ID NO: 440821 - DNA, 25 bp, Mus musculus
gaattaatcttctcctcgtatggta

SEQ ID NO: 440822 - DNA, 25 bp, Mus musculus
gaattaatgcctagacccttcatcc

SEQ ID NO: 440823 - DNA, 25 bp, Mus musculus
gaattaatgccttgacccttcatcc

SEQ ID NO: 440824 - DNA, 25 bp, Mus musculus
gaattaatttccaagctcattacct

SEQ ID NO: 440825 - DNA, 25 bp, Mus musculus
gaattaatttccatgcttatgcgca

SEQ ID NO: 440826 - DNA, 25 bp, Mus musculus
gaattaatttcctagctcattacct

SEQ ID NO: 440827 - DNA, 25 bp, Mus musculus
gaattaatttccttgcttatgcgca

SEQ ID NO: 440828 - DNA, 25 bp, Mus musculus
gaattaatttctcacacctcgtatg

SEQ ID NO: 440829 - DNA, 25 bp, Mus musculus
gaattaatttctgacacctcgtatg

SEQ ID NO: 440830 - DNA, 25 bp, Mus musculus
gaattacaagctcatgtgctgctaa

SEQ ID NO: 440831 - DNA, 25 bp, Mus musculus
gaattacaagctgatgtgctgctaa

SEQ ID NO: 440832 - DNA, 25 bp, Mus musculus
gaattacacaccagacttcatagag

SEQ ID NO: 440833 - DNA, 25 bp, Mus musculus
gaattacacacctgacttcatagag

SEQ ID NO: 440834 - DNA, 25 bp, Mus musculus
gaattacaccacaaatctgacccac

SEQ ID NO: 440835 - DNA, 25 bp, Mus musculus
gaattacaccactaatctgacccac

SEQ ID NO: 440836 - DNA, 25 bp, Mus musculus
gaattacaccatattcatcctttta

SEQ ID NO: 440837 - DNA, 25 bp, Mus musculus
gaattacaccattttcatcctttta

SEQ ID NO: 440838 - DNA, 25 bp, Mus musculus
gaattacacgacaccatttcatctc

SEQ ID NO: 440839 - DNA, 25 bp, Mus musculus
gaattacacgactccatttcatctc

SEQ ID NO: 440840 - DNA, 25 bp, Mus musculus
gaattacactagcaagcgaccatgt

SEQ ID NO: 440841 - DNA, 25 bp, Mus musculus
gaattacactaggaagcgaccatgt

SEQ ID NO: 440842 - DNA, 25 bp, Mus musculus
gaattacactccatcaaatgtcccg

SEQ ID NO: 440843 - DNA, 25 bp, Mus musculus
gaattacactccttcaaatgtcccg

SEQ ID NO: 440844 - DNA, 25 bp, Mus musculus
gaattacagacaacataccatttta

SEQ ID NO: 440845 - DNA, 25 bp, Mus musculus
gaattacagacacgcactcaacagc

SEQ ID NO: 440846 - DNA, 25 bp, Mus musculus
gaattacagacaggcactcaacagc

SEQ ID NO: 440847 - DNA, 25 bp, Mus musculus
gaattacagacatcataccatttta

SEQ ID NO: 440848 - DNA, 25 bp, Mus musculus
gaattacagcatcattttctgatta

SEQ ID NO: 440849 - DNA, 25 bp, Mus musculus
gaattacagcatgattttctgatta

SEQ ID NO: 440850 - DNA, 25 bp, Mus musculus
gaattacagctgcaatacccgatat

SEQ ID NO: 440851 - DNA, 25 bp, Mus musculus
gaattacagctggaatacccgatat

SEQ ID NO: 440852 - DNA, 25 bp, Mus musculus
gaattacaggctaataccaccttgt

SEQ ID NO: 440853 - DNA, 25 bp, Mus musculus
gaattacaggcttataccaccttgt

SEQ ID NO: 440854 - DNA, 25 bp, Mus musculus
gaattacaggtcactgccactatac

SEQ ID NO: 440855 - DNA, 25 bp, Mus musculus
gaattacaggtctctgccactatac

SEQ ID NO: 440856 - DNA, 25 bp, Mus musculus
gaattacagtatacgtcaccccaga

SEQ ID NO: 440857 - DNA, 25 bp, Mus musculus
gaattacagtattcgtcaccccaga

SEQ ID NO: 440858 - DNA, 25 bp, Mus musculus
gaattacagtctagtgtatccaaaa

SEQ ID NO: 440859 - DNA, 25 bp, Mus musculus
gaattacagtcttgtgtatccaaaa

SEQ ID NO: 440860 - DNA, 25 bp, Mus musculus
gaattacatctaattcaaggatccc

SEQ ID NO: 440861 - DNA, 25 bp, Mus musculus
gaattacatctatttcaaggatccc

SEQ ID NO: 440862 - DNA, 25 bp, Mus musculus
gaattacatctgacagtgacttaaa

SEQ ID NO: 440863 - DNA, 25 bp, Mus musculus
gaattacatctgtcagtgacttaaa

SEQ ID NO: 440864 - DNA, 25 bp, Mus musculus
gaattacatgcaccattgcccgggc

SEQ ID NO: 440865 - DNA, 25 bp, Mus musculus
gaattacatgcagcattgcccgggc

SEQ ID NO: 440866 - DNA, 25 bp, Mus musculus
gaattacatggtctgaccctgtctc

SEQ ID NO: 440867 - DNA, 25 bp, Mus musculus
gaattacatggtgtgaccctgtctc

SEQ ID NO: 440868 - DNA, 25 bp, Mus musculus
gaattacattacattcccctggtct

SEQ ID NO: 440869 - DNA, 25 bp, Mus musculus
gaattacattactttcccctggtct

SEQ ID NO: 440870 - DNA, 25 bp, Mus musculus
gaattacattgccatctttcttttt

SEQ ID NO: 440871 - DNA, 25 bp, Mus musculus
gaattacattgcgatctttcttttt

SEQ ID NO: 440872 - DNA, 25 bp, Mus musculus
gaattacattgtactgctaccagag

SEQ ID NO: 440873 - DNA, 25 bp, Mus musculus
gaattacattgttctgctaccagag

SEQ ID NO: 440874 - DNA, 25 bp, Mus musculus
gaattaccaggaccagagcccttca

SEQ ID NO: 440875 - DNA, 25 bp, Mus musculus
gaattaccaggagcagagcccttca

SEQ ID NO: 440876 - DNA, 25 bp, Mus musculus
gaattaccatagctcactgggactg

SEQ ID NO: 440877 - DNA, 25 bp, Mus musculus
gaattaccataggtcactgggactg

SEQ ID NO: 440878 - DNA, 25 bp, Mus musculus
gaattaccatcacggactttcttta

SEQ ID NO: 440879 - DNA, 25 bp, Mus musculus
gaattaccatcagggactttcttta

SEQ ID NO: 440880 - DNA, 25 bp, Mus musculus
gaattaccatttcctgtactttcta

SEQ ID NO: 440881 - DNA, 25 bp, Mus musculus
gaattaccatttgctgtactttcta

SEQ ID NO: 440882 - DNA, 25 bp, Mus musculus
gaattaccccagattttgtgtgtgc

SEQ ID NO: 440883 - DNA, 25 bp, Mus musculus
gaattaccccagtttttgtgtgtgc

SEQ ID NO: 440884 - DNA, 25 bp, Mus musculus
gaattaccctccactatgctagtaa

SEQ ID NO: 440885 - DNA, 25 bp, Mus musculus
gaattaccctcctctatgctagtaa

SEQ ID NO: 440886 - DNA, 25 bp, Mus musculus
gaattacctggaccgtttcttggct

SEQ ID NO: 440887 - DNA, 25 bp, Mus musculus
gaattacctggagcgtttcttggct

SEQ ID NO: 440888 - DNA, 25 bp, Mus musculus
gaattacgcatgagtctgtaggaaa

SEQ ID NO: 440889 - DNA, 25 bp, Mus musculus
gaattacgcatgtgtctgtaggaaa

SEQ ID NO: 440890 - DNA, 25 bp, Mus musculus
gaattacggagtctttagctttcct

SEQ ID NO: 440891 - DNA, 25 bp, Mus musculus
gaattacggagtgtttagctttcct

SEQ ID NO: 440892 - DNA, 25 bp, Mus musculus
gaattacgggtgagtgttaccactg

SEQ ID NO: 440893 - DNA, 25 bp, Mus musculus
gaattacgggtgtgtgttaccactg

SEQ ID NO: 440894 - DNA, 25 bp, Mus musculus
gaattacgtcacacacatgtacctg

SEQ ID NO: 440895 - DNA, 25 bp, Mus musculus
gaattacgtcactcacatgtacctg

SEQ ID NO: 440896 - DNA, 25 bp, Mus musculus
gaattacgttgtatctctctggaga

SEQ ID NO: 440897 - DNA, 25 bp, Mus musculus
gaattacgttgtttctctctggaga

SEQ ID NO: 440898 - DNA, 25 bp, Mus musculus
gaattactaattacgatttgcttat

SEQ ID NO: 440899 - DNA, 25 bp, Mus musculus
gaattactaatttcgatttgcttat

SEQ ID NO: 440900 - DNA, 25 bp, Mus musculus
gaattactactgctctatgtgtttg

SEQ ID NO: 440901 - DNA, 25 bp, Mus musculus
gaattactactggtctatgtgtttg

SEQ ID NO: 440902 - DNA, 25 bp, Mus musculus
gaattactagttccataggttgagt

SEQ ID NO: 440903 - DNA, 25 bp, Mus musculus
gaattactagttgcataggttgagt

SEQ ID NO: 440904 - DNA, 25 bp, Mus musculus
gaattactatgcattttcccactaa

SEQ ID NO: 440905 - DNA, 25 bp, Mus musculus
gaattactatgctttttcccactaa

SEQ ID NO: 440906 - DNA, 25 bp, Mus musculus
gaattactcactcgtgtcagcacag

SEQ ID NO: 440907 - DNA, 25 bp, Mus musculus
gaattactcactggtgtcagcacag

SEQ ID NO: 440908 - DNA, 25 bp, Mus musculus
gaattactcagtctctgggaaacca

SEQ ID NO: 440909 - DNA, 25 bp, Mus musculus
gaattactcagtgtctgggaaacca

SEQ ID NO: 440910 - DNA, 25 bp, Mus musculus
gaattactcatgaagagtctcactg

SEQ ID NO: 440911 - DNA, 25 bp, Mus musculus
gaattactcatgtagagtctcactg

SEQ ID NO: 440912 - DNA, 25 bp, Mus musculus
gaattactccatcaagggttttctg

SEQ ID NO: 440913 - DNA, 25 bp, Mus musculus
gaattactccatgaagggttttctg

SEQ ID NO: 440914 - DNA, 25 bp, Mus musculus
gaattactctaacatctggctccag

SEQ ID NO: 440915 - DNA, 25 bp, Mus musculus
gaattactctaagatctggctccag

SEQ ID NO: 440916 - DNA, 25 bp, Mus musculus
gaattactctagctgtcctagcact

SEQ ID NO: 440917 - DNA, 25 bp, Mus musculus
gaattactctaggtgtcctagcact

SEQ ID NO: 440918 - DNA, 25 bp, Mus musculus
gaattactctgaccattgcttcttg

SEQ ID NO: 440919 - DNA, 25 bp, Mus musculus
gaattactctgagcattgcttcttg

SEQ ID NO: 440920 - DNA, 25 bp, Mus musculus
gaattactctggcacttagagctga

SEQ ID NO: 440921 - DNA, 25 bp, Mus musculus
gaattactctgggacttagagctga

SEQ ID NO: 440922 - DNA, 25 bp, Mus musculus
gaattactctgtattgacaagtaca

SEQ ID NO: 440923 - DNA, 25 bp, Mus musculus
gaattactctgttttgacaagtaca

SEQ ID NO: 440924 - DNA, 25 bp, Mus musculus
gaattactgagtaatatgacccaaa

SEQ ID NO: 440925 - DNA, 25 bp, Mus musculus
gaattactgagttatatgacccaaa

SEQ ID NO: 440926 - DNA, 25 bp, Mus musculus
gaattactgattcactgtcttgact

SEQ ID NO: 440927 - DNA, 25 bp, Mus musculus
gaattactgattgactgtcttgact

SEQ ID NO: 440928 - DNA, 25 bp, Mus musculus
gaattactggtcctgtttccttcat

SEQ ID NO: 440929 - DNA, 25 bp, Mus musculus
gaattactggtcgtgtttccttcat

SEQ ID NO: 440930 - DNA, 25 bp, Mus musculus
gaattactgtccattctcattagct

SEQ ID NO: 440931 - DNA, 25 bp, Mus musculus
gaattactgtcctttctcattagct

SEQ ID NO: 440932 - DNA, 25 bp, Mus musculus
gaattactgttcctatctttagtca

SEQ ID NO: 440933 - DNA, 25 bp, Mus musculus
gaattactgttcgtatctttagtca

SEQ ID NO: 440934 - DNA, 25 bp, Mus musculus
gaattactgtttatgtcctgtctct

SEQ ID NO: 440935 - DNA, 25 bp, Mus musculus
gaattactgtttttgtcctgtctct

SEQ ID NO: 440936 - DNA, 25 bp, Mus musculus
gaattacttcaacccactgacagaa

SEQ ID NO: 440937 - DNA, 25 bp, Mus musculus
gaattacttcaagccactgacagaa

SEQ ID NO: 440938 - DNA, 25 bp, Mus musculus
gaattacttcacatgctcgagtctc

SEQ ID NO: 440939 - DNA, 25 bp, Mus musculus
gaattacttcacttgctcgagtctc

SEQ ID NO: 440940 - DNA, 25 bp, Mus musculus
gaattacttcatcagcatatggtca

SEQ ID NO: 440941 - DNA, 25 bp, Mus musculus
gaattacttcatgagcatatggtca

SEQ ID NO: 440942 - DNA, 25 bp, Mus musculus
gaattacttcccaggagcatcggtt

SEQ ID NO: 440943 - DNA, 25 bp, Mus musculus
gaattacttccctggagcatcggtt

SEQ ID NO: 440944 - DNA, 25 bp, Mus musculus
gaattactttctccttgcttgtctc

SEQ ID NO: 440945 - DNA, 25 bp, Mus musculus
gaattactttctgcttgcttgtctc

SEQ ID NO: 440946 - DNA, 25 bp, Mus musculus
gaattagaaatacttctatcacctt

SEQ ID NO: 440947 - DNA, 25 bp, Mus musculus
gaattagaaatagttctatcacctt

SEQ ID NO: 440948 - DNA, 25 bp, Mus musculus
gaattagaactaacagggccaactg

SEQ ID NO: 440949 - DNA, 25 bp, Mus musculus
gaattagaactatcagggccaactg

SEQ ID NO: 440950 - DNA, 25 bp, Mus musculus
gaattagaactgagctgccttccat

SEQ ID NO: 440951 - DNA, 25 bp, Mus musculus
gaattagaactgtgctgccttccat

SEQ ID NO: 440952 - DNA, 25 bp, Mus musculus
gaattagacccacttttctagaggg

SEQ ID NO: 440953 - DNA, 25 bp, Mus musculus
gaattagacccagttttctagaggg

SEQ ID NO: 440954 - DNA, 25 bp, Mus musculus
gaattagagaatattccagtagtca

SEQ ID NO: 440955 - DNA, 25 bp, Mus musculus
gaattagagaattttccagtagtca

SEQ ID NO: 440956 - DNA, 25 bp, Mus musculus
gaattagagtagataacgttcatcc

SEQ ID NO: 440957 - DNA, 25 bp, Mus musculus
gaattagagtagttaacgttcatcc

SEQ ID NO: 440958 - DNA, 25 bp, Mus musculus
gaattagataatctcggcctctccc

SEQ ID NO: 440959 - DNA, 25 bp, Mus musculus
gaattagataatgtcggcctctccc

SEQ ID NO: 440960 - DNA, 25 bp, Mus musculus
gaattagatcaacggcttcctacat

SEQ ID NO: 440961 - DNA, 25 bp, Mus musculus
gaattagatcaagggcttcctacat

SEQ ID NO: 440962 - DNA, 25 bp, Mus musculus
gaattagatccccaaggcttacgtg

SEQ ID NO: 440963 - DNA, 25 bp, Mus musculus
gaattagatcccgaaggcttacgtg

SEQ ID NO: 440964 - DNA, 25 bp, Mus musculus
gaattagcaatgatttccttcttga

SEQ ID NO: 440965 - DNA, 25 bp, Mus musculus
gaattagcaatgttttccttcttga

SEQ ID NO: 440966 - DNA, 25 bp, Mus musculus
gaattagcattccacagtttccctg

SEQ ID NO: 440967 - DNA, 25 bp, Mus musculus
gaattagcattcctgttacgttcag

SEQ ID NO: 440968 - DNA, 25 bp, Mus musculus
gaattagcattcgacagtttccctg

SEQ ID NO: 440969 - DNA, 25 bp, Mus musculus
gaattagcattcgtgttacgttcag

SEQ ID NO: 440970 - DNA, 25 bp, Mus musculus
gaattagccatcaggactcagttta

SEQ ID NO: 440971 - DNA, 25 bp, Mus musculus
gaattagccatctggactcagttta

SEQ ID NO: 440972 - DNA, 25 bp, Mus musculus
gaattagccctcattgaaccctgaa

SEQ ID NO: 440973 - DNA, 25 bp, Mus musculus
gaattagccctctttgaaccctgaa

SEQ ID NO: 440974 - DNA, 25 bp, Mus musculus
gaattagctaggaatgttaacacac

SEQ ID NO: 440975 - DNA, 25 bp, Mus musculus
gaattagctaggtatgttaacacac

SEQ ID NO: 440976 - DNA, 25 bp, Mus musculus
gaattagctctgcaattgctgcctg

SEQ ID NO: 440977 - DNA, 25 bp, Mus musculus
gaattagctctggaattgctgcctg

SEQ ID NO: 440978 - DNA, 25 bp, Mus musculus
gaattagctcttactttgttttaca

SEQ ID NO: 440979 - DNA, 25 bp, Mus musculus
gaattagctctttctttgttttaca

SEQ ID NO: 440980 - DNA, 25 bp, Mus musculus
gaattagctggaaattctcagatac

SEQ ID NO: 440981 - DNA, 25 bp, Mus musculus
gaattagctggatattctcagatac

SEQ ID NO: 440982 - DNA, 25 bp, Mus musculus
gaattagctgtcatcctaagtatag

SEQ ID NO: 440983 - DNA, 25 bp, Mus musculus
gaattagctgtcttcctaagtatag

SEQ ID NO: 440984 - DNA, 25 bp, Mus musculus
gaattagcttcgattgttcttcgga

SEQ ID NO: 440985 - DNA, 25 bp, Mus musculus
gaattagcttcgtttgttcttcgga

SEQ ID NO: 440986 - DNA, 25 bp, Mus musculus
gaattagctttacaggcaaggccct

SEQ ID NO: 440987 - DNA, 25 bp, Mus musculus
gaattagctttagaggcaaggccct

SEQ ID NO: 440988 - DNA, 25 bp, Mus musculus
gaattaggcaccagtgcatgctcag

SEQ ID NO: 440989 - DNA, 25 bp, Mus musculus
gaattaggcacccagtactcagcag

SEQ ID NO: 440990 - DNA, 25 bp, Mus musculus
gaattaggcaccgagtactcagcag

SEQ ID NO: 440991 - DNA, 25 bp, Mus musculus
gaattaggcacctgtgcatgctcag

SEQ ID NO: 440992 - DNA, 25 bp, Mus musculus
gaattaggcactctttcattgacaa

SEQ ID NO: 440993 - DNA, 25 bp, Mus musculus
gaattaggcactgtttcattgacaa

SEQ ID NO: 440994 - DNA, 25 bp, Mus musculus
gaattaggcctcacactcattaccg

SEQ ID NO: 440995 - DNA, 25 bp, Mus musculus
gaattaggcctctcactcattaccg

SEQ ID NO: 440996 - DNA, 25 bp, Mus musculus
gaattaggctagaagctgaacctgc

SEQ ID NO: 440997 - DNA, 25 bp, Mus musculus
gaattaggctagtagctgaacctgc

SEQ ID NO: 440998 - DNA, 25 bp, Mus musculus
gaattaggctggaacatagctcagt

SEQ ID NO: 440999 - DNA, 25 bp, Mus musculus
gaattaggctggtacatagctcagt

SEQ ID NO: 441000 - DNA, 25 bp, Mus musculus
gaattaggtcacagcaactaatttg

SEQ ID NO: 441001 - DNA, 25 bp, Mus musculus
gaattaggtcactgcaactaatttg

SEQ ID NO: 441002 - DNA, 25 bp, Mus musculus
gaattagtacgaacctcctgttttg

SEQ ID NO: 441003 - DNA, 25 bp, Mus musculus
gaattagtacgatcctcctgttttg

SEQ ID NO: 441004 - DNA, 25 bp, Mus musculus
gaattagtcggcatcttgaaagagt

SEQ ID NO: 441005 - DNA, 25 bp, Mus musculus
gaattagtcggcttcttgaaagagt

SEQ ID NO: 441006 - DNA, 25 bp, Mus musculus
gaattagtggtcaccctgatgccca

SEQ ID NO: 441007 - DNA, 25 bp, Mus musculus
gaattagtggtctccctgatgccca

SEQ ID NO: 441008 - DNA, 25 bp, Mus musculus
gaattagttcatagcactccttccc

SEQ ID NO: 441009 - DNA, 25 bp, Mus musculus
gaattagttcattgcactccttccc

SEQ ID NO: 441010 - DNA, 25 bp, Mus musculus
gaattagtttctaggttcggctgtt

SEQ ID NO: 441011 - DNA, 25 bp, Mus musculus
gaattagtttcttggttcggctgtt

SEQ ID NO: 441012 - DNA, 25 bp, Mus musculus
gaattagtttttacagtgctgggca

SEQ ID NO: 441013 - DNA, 25 bp, Mus musculus
gaattagttttttcagtgctgggca

SEQ ID NO: 441014 - DNA, 25 bp, Mus musculus
gaattataaattcctgcgttaatgt

SEQ ID NO: 441015 - DNA, 25 bp, Mus musculus
gaattataaattgctgcgttaatgt

SEQ ID NO: 441016 - DNA, 25 bp, Mus musculus
gaattataagctactgtgagtcatc

SEQ ID NO: 441017 - DNA, 25 bp, Mus musculus
gaattataagcttctgtgagtcatc

SEQ ID NO: 441018 - DNA, 25 bp, Mus musculus
gaattataccccaaagtcccatgta

SEQ ID NO: 441019 - DNA, 25 bp, Mus musculus
gaattatacccctaagtcccatgta

SEQ ID NO: 441020 - DNA, 25 bp, Mus musculus
gaattatactgtctccttggaagat

SEQ ID NO: 441021 - DNA, 25 bp, Mus musculus
gaattatactgtgtccttggaagat

SEQ ID NO: 441022 - DNA, 25 bp, Mus musculus
gaattatattttccccaagccagaa

SEQ ID NO: 441023 - DNA, 25 bp, Mus musculus
gaattatattttgcccaagccagaa

SEQ ID NO: 441024 - DNA, 25 bp, Mus musculus
gaattatcaagcctaatcactctaa

SEQ ID NO: 441025 - DNA, 25 bp, Mus musculus
gaattatcaagcgtaatcactctaa

SEQ ID NO: 441026 - DNA, 25 bp, Mus musculus
gaattatcagcaaatgtctggctac

SEQ ID NO: 441027 - DNA, 25 bp, Mus musculus
gaattatcagcatatgtctggctac

SEQ ID NO: 441028 - DNA, 25 bp, Mus musculus
gaattatcagttagaagtgccacag

SEQ ID NO: 441029 - DNA, 25 bp, Mus musculus
gaattatcagtttgaagtgccacag

SEQ ID NO: 441030 - DNA, 25 bp, Mus musculus
gaattatcatttatcctacccaaaa

SEQ ID NO: 441031 - DNA, 25 bp, Mus musculus
gaattatcatttttcctacccaaaa

SEQ ID NO: 441032 - DNA, 25 bp, Mus musculus
gaattatccaacagaccctcctctt

SEQ ID NO: 441033 - DNA, 25 bp, Mus musculus
gaattatccaactgaccctcctctt

SEQ ID NO: 441034 - DNA, 25 bp, Mus musculus
gaattatccagcactcaagactcta

SEQ ID NO: 441035 - DNA, 25 bp, Mus musculus
gaattatccagctctcaagactcta

SEQ ID NO: 441036 - DNA, 25 bp, Mus musculus
gaattatccagtcaatgccccacat

SEQ ID NO: 441037 - DNA, 25 bp, Mus musculus
gaattatccagtgaatgccccacat

SEQ ID NO: 441038 - DNA, 25 bp, Mus musculus
gaattatccatcacaacaactgcta

SEQ ID NO: 441039 - DNA, 25 bp, Mus musculus
gaattatccatctcaacaactgcta

SEQ ID NO: 441040 - DNA, 25 bp, Mus musculus
gaattatcctgcaaagccggtgctt

SEQ ID NO: 441041 - DNA, 25 bp, Mus musculus
gaattatcctgctaagccggtgctt

SEQ ID NO: 441042 - DNA, 25 bp, Mus musculus
gaattatcctggactatgaggtcaa

SEQ ID NO: 441043 - DNA, 25 bp, Mus musculus
gaattatcctggtctatgaggtcaa

SEQ ID NO: 441044 - DNA, 25 bp, Mus musculus
gaattatccttgatgcaccctgcag

SEQ ID NO: 441045 - DNA, 25 bp, Mus musculus
gaattatccttgttgcaccctgcag

SEQ ID NO: 441046 - DNA, 25 bp, Mus musculus
gaattatcgccccaaggacccagaa

SEQ ID NO: 441047 - DNA, 25 bp, Mus musculus
gaattatcgcccgaaggacccagaa

SEQ ID NO: 441048 - DNA, 25 bp, Mus musculus
gaattatctactacttaaatctcca

SEQ ID NO: 441049 - DNA, 25 bp, Mus musculus
gaattatctacttcttaaatctcca

SEQ ID NO: 441050 - DNA, 25 bp, Mus musculus
gaattatctatccatgctgactgca

SEQ ID NO: 441051 - DNA, 25 bp, Mus musculus
gaattatctatcgatgctgactgca

SEQ ID NO: 441052 - DNA, 25 bp, Mus musculus
gaattatctcctctcatgtctagca

SEQ ID NO: 441053 - DNA, 25 bp, Mus musculus
gaattatctcctgtcatgtctagca

SEQ ID NO: 441054 - DNA, 25 bp, Mus musculus
gaattatctctaatcgaccctgacc

SEQ ID NO: 441055 - DNA, 25 bp, Mus musculus
gaattatctctattcgaccctgacc

SEQ ID NO: 441056 - DNA, 25 bp, Mus musculus
gaattatctctgctatcactttatg

SEQ ID NO: 441057 - DNA, 25 bp, Mus musculus
gaattatctctggtatcactttatg

SEQ ID NO: 441058 - DNA, 25 bp, Mus musculus
gaattatctgaacgcaactgtcgca

SEQ ID NO: 441059 - DNA, 25 bp, Mus musculus
gaattatctgaaggcaactgtcgca

SEQ ID NO: 441060 - DNA, 25 bp, Mus musculus
gaattatctgccctagtattgttat

SEQ ID NO: 441061 - DNA, 25 bp, Mus musculus
gaattatctgccgtagtattgttat

SEQ ID NO: 441062 - DNA, 25 bp, Mus musculus
gaattatctggcctgaagggttatt

SEQ ID NO: 441063 - DNA, 25 bp, Mus musculus
gaattatctggcgtgaagggttatt

SEQ ID NO: 441064 - DNA, 25 bp, Mus musculus
gaattatctttcatatgctgtgtta

SEQ ID NO: 441065 - DNA, 25 bp, Mus musculus
gaattatctttcttatgctgtgtta

SEQ ID NO: 441066 - DNA, 25 bp, Mus musculus
gaattatgaattactgtcccctcct

SEQ ID NO: 441067 - DNA, 25 bp, Mus musculus
gaattatgaatttctgtcccctcct

SEQ ID NO: 441068 - DNA, 25 bp, Mus musculus
gaattatgactcagctctgtccatc

SEQ ID NO: 441069 - DNA, 25 bp, Mus musculus
gaattatgactctgctctgtccatc

SEQ ID NO: 441070 - DNA, 25 bp, Mus musculus
gaattatgcagcatttccttgttct

SEQ ID NO: 441071 - DNA, 25 bp, Mus musculus
gaattatgcagcttttccttgttct

SEQ ID NO: 441072 - DNA, 25 bp, Mus musculus
gaattatgccagcttatcttgtatt

SEQ ID NO: 441073 - DNA, 25 bp, Mus musculus
gaattatgccaggttatcttgtatt

SEQ ID NO: 441074 - DNA, 25 bp, Mus musculus
gaattatggagcaacacaacttcat

SEQ ID NO: 441075 - DNA, 25 bp, Mus musculus
gaattatggagctacacaacttcat

SEQ ID NO: 441076 - DNA, 25 bp, Mus musculus
gaattatgtattacccccaacttca

SEQ ID NO: 441077 - DNA, 25 bp, Mus musculus
gaattatgtatttcccccaacttca

SEQ ID NO: 441078 - DNA, 25 bp, Mus musculus
gaattatgtggtcagtgcattgttt

SEQ ID NO: 441079 - DNA, 25 bp, Mus musculus
gaattatgtggtgagtgcattgttt

SEQ ID NO: 441080 - DNA, 25 bp, Mus musculus
gaattatgtgtaaaagctcttcgct

SEQ ID NO: 441081 - DNA, 25 bp, Mus musculus
gaattatgtgtataagctcttcgct

SEQ ID NO: 441082 - DNA, 25 bp, Mus musculus
gaattatgttccaccaaaacctgct

SEQ ID NO: 441083 - DNA, 25 bp, Mus musculus
gaattatgttcctccaaaacctgct

SEQ ID NO: 441084 - DNA, 25 bp, Mus musculus
gaattatgttctcttgtgacaggaa

SEQ ID NO: 441085 - DNA, 25 bp, Mus musculus
gaattatgttctgttgtgacaggaa

SEQ ID NO: 441086 - DNA, 25 bp, Mus musculus
gaattattacctatgtcccctttgt

SEQ ID NO: 441087 - DNA, 25 bp, Mus musculus
gaattattacctttgtcccctttgt

SEQ ID NO: 441088 - DNA, 25 bp, Mus musculus
gaattattactaccatcagtgaagc

SEQ ID NO: 441089 - DNA, 25 bp, Mus musculus
gaattattactagcatcagtgaagc

SEQ ID NO: 441090 - DNA, 25 bp, Mus musculus
gaattattatctattcctcctgtct

SEQ ID NO: 441091 - DNA, 25 bp, Mus musculus
gaattattatcttttcctcctgtct

SEQ ID NO: 441092 - DNA, 25 bp, Mus musculus
gaattattatgcagaatcctatggg

SEQ ID NO: 441093 - DNA, 25 bp, Mus musculus
gaattattatgctgaatcctatggg

SEQ ID NO: 441094 - DNA, 25 bp, Mus musculus
gaattattcattctcagccactgtg

SEQ ID NO: 441095 - DNA, 25 bp, Mus musculus
gaattattcattgtcagccactgtg

SEQ ID NO: 441096 - DNA, 25 bp, Mus musculus
gaattattcctcactcagggactgc

SEQ ID NO: 441097 - DNA, 25 bp, Mus musculus
gaattattcctctctcagggactgc

SEQ ID NO: 441098 - DNA, 25 bp, Mus musculus
gaattattgaagctgatgattatca

SEQ ID NO: 441099 - DNA, 25 bp, Mus musculus
gaattattgaaggtgatgattatca

SEQ ID NO: 441100 - DNA, 25 bp, Mus musculus
gaattattgcataattatcttgttt

SEQ ID NO: 441101 - DNA, 25 bp, Mus musculus
gaattattgcattattatcttgttt

SEQ ID NO: 441102 - DNA, 25 bp, Mus musculus
gaattattgcctctattctagaaaa

SEQ ID NO: 441103 - DNA, 25 bp, Mus musculus
gaattattgcctgtattctagaaaa

SEQ ID NO: 441104 - DNA, 25 bp, Mus musculus
gaattattggatctccctggttcct

SEQ ID NO: 441105 - DNA, 25 bp, Mus musculus
gaattattggatgtccctggttcct

SEQ ID NO: 441106 - DNA, 25 bp, Mus musculus
gaattattgggtacagtacaaccga

SEQ ID NO: 441107 - DNA, 25 bp, Mus musculus
gaattattgggttcagtacaaccga

SEQ ID NO: 441108 - DNA, 25 bp, Mus musculus
gaattattgtccaagacttgaggtg

SEQ ID NO: 441109 - DNA, 25 bp, Mus musculus
gaattattgtccattattccctgta

SEQ ID NO: 441110 - DNA, 25 bp, Mus musculus
gaattattgtcctagacttgaggtg

SEQ ID NO: 441111 - DNA, 25 bp, Mus musculus
gaattattgtcctttattccctgta

SEQ ID NO: 441112 - DNA, 25 bp, Mus musculus
gaattattgtgcaacctcaaaggta

SEQ ID NO: 441113 - DNA, 25 bp, Mus musculus
gaattattgtgctacctcaaaggta

SEQ ID NO: 441114 - DNA, 25 bp, Mus musculus
gaattatttaaacactcctcacaag

SEQ ID NO: 441115 - DNA, 25 bp, Mus musculus
gaattatttaaagactcctcacaag

SEQ ID NO: 441116 - DNA, 25 bp, Mus musculus
gaattatttcatacttttcatggta

SEQ ID NO: 441117 - DNA, 25 bp, Mus musculus
gaattatttcattcttttcatggta

SEQ ID NO: 441118 - DNA, 25 bp, Mus musculus
gaattatttccacttctgtgccttg

SEQ ID NO: 441119 - DNA, 25 bp, Mus musculus
gaattatttccagttctgtgccttg

SEQ ID NO: 441120 - DNA, 25 bp, Mus musculus
gaattatttggccttttctgaaaca

SEQ ID NO: 441121 - DNA, 25 bp, Mus musculus
gaattatttggcgttttctgaaaca

SEQ ID NO: 441122 - DNA, 25 bp, Mus musculus
gaattatttgttctacctatgccac

SEQ ID NO: 441123 - DNA, 25 bp, Mus musculus
gaattatttgttctgcgcttagcat

SEQ ID NO: 441124 - DNA, 25 bp, Mus musculus
gaattatttgttgtacctatgccac

SEQ ID NO: 441125 - DNA, 25 bp, Mus musculus
gaattatttgttgtgcgcttagcat

SEQ ID NO: 441126 - DNA, 25 bp, Mus musculus
gaattattttatcatgcggttgctg

SEQ ID NO: 441127 - DNA, 25 bp, Mus musculus
gaattattttatgatgcggttgctg

SEQ ID NO: 441128 - DNA, 25 bp, Mus musculus
gaattattttctccgtgcacagcct

SEQ ID NO: 441129 - DNA, 25 bp, Mus musculus
gaattattttctgcgtgcacagcct

SEQ ID NO: 441130 - DNA, 25 bp, Mus musculus
gaattattttttcttgttcaagcct

SEQ ID NO: 441131 - DNA, 25 bp, Mus musculus
gaattattttttgttgttcaagcct

SEQ ID NO: 441132 - DNA, 25 bp, Mus musculus
gaattcaaaagcagccgttcggctc

SEQ ID NO: 441133 - DNA, 25 bp, Mus musculus
gaattcaaaagctgccgttcggctc

SEQ ID NO: 441134 - DNA, 25 bp, Mus musculus
gaattcaaaattcagctctaggccc

SEQ ID NO: 441135 - DNA, 25 bp, Mus musculus
gaattcaaaattgagctctaggccc

SEQ ID NO: 441136 - DNA, 25 bp, Mus musculus
gaattcaaacccctggagatattac

SEQ ID NO: 441137 - DNA, 25 bp, Mus musculus
gaattcaaacccgtggagatattac

SEQ ID NO: 441138 - DNA, 25 bp, Mus musculus
gaattcaaattcctccatgctttct

SEQ ID NO: 441139 - DNA, 25 bp, Mus musculus
gaattcaaattcgtccatgctttct

SEQ ID NO: 441140 - DNA, 25 bp, Mus musculus
gaattcaaatttccattgcctcttg

SEQ ID NO: 441141 - DNA, 25 bp, Mus musculus
gaattcaaatttgcattgcctcttg

SEQ ID NO: 441142 - DNA, 25 bp, Mus musculus
gaattcaacagtccttgcaaccttg

SEQ ID NO: 441143 - DNA, 25 bp, Mus musculus
gaattcaacagtgcttgcaaccttg

SEQ ID NO: 441144 - DNA, 25 bp, Mus musculus
gaattcaacgtaaccataaacctta

SEQ ID NO: 441145 - DNA, 25 bp, Mus musculus
gaattcaacgtatccataaacctta

SEQ ID NO: 441146 - DNA, 25 bp, Mus musculus
gaattcaactctagtctctagtata

SEQ ID NO: 441147 - DNA, 25 bp, Mus musculus
gaattcaactcttgtctctagtata

SEQ ID NO: 441148 - DNA, 25 bp, Mus musculus
gaattcaactggcaagttatcaaat

SEQ ID NO: 441149 - DNA, 25 bp, Mus musculus
gaattcaactgggaagttatcaaat

SEQ ID NO: 441150 - DNA, 25 bp, Mus musculus
gaattcaagcaaacactggcaaacg

SEQ ID NO: 441151 - DNA, 25 bp, Mus musculus
gaattcaagcaatcactggcaaacg

SEQ ID NO: 441152 - DNA, 25 bp, Mus musculus
gaattcaaggaacctttctccctat

SEQ ID NO: 441153 - DNA, 25 bp, Mus musculus
gaattcaaggaagctttctccctat

SEQ ID NO: 441154 - DNA, 25 bp, Mus musculus
gaattcaagggcagtcagagctaca

SEQ ID NO: 441155 - DNA, 25 bp, Mus musculus
gaattcaagggctgtcagagctaca

SEQ ID NO: 441156 - DNA, 25 bp, Mus musculus
gaattcaagtaaccaactctccatt

SEQ ID NO: 441157 - DNA, 25 bp, Mus musculus
gaattcaagtaagcaactctccatt

SEQ ID NO: 441158 - DNA, 25 bp, Mus musculus
gaattcaatcctaaactcttagacc

SEQ ID NO: 441159 - DNA, 25 bp, Mus musculus
gaattcaatccttaactcttagacc

SEQ ID NO: 441160 - DNA, 25 bp, Mus musculus
gaattcaatctaacaggatgttcat

SEQ ID NO: 441161 - DNA, 25 bp, Mus musculus
gaattcaatctatcaggatgttcat

SEQ ID NO: 441162 - DNA, 25 bp, Mus musculus
gaattcaatgccaacctgagagaca

SEQ ID NO: 441163 - DNA, 25 bp, Mus musculus
gaattcaatgccacagcataccctg

SEQ ID NO: 441164 - DNA, 25 bp, Mus musculus
gaattcaatgcctacctgagagaca

SEQ ID NO: 441165 - DNA, 25 bp, Mus musculus
gaattcaatgcctcagcataccctg

SEQ ID NO: 441166 - DNA, 25 bp, Mus musculus
gaattcaatttccagtgcccacacg

SEQ ID NO: 441167 - DNA, 25 bp, Mus musculus
gaattcaatttcgagtgcccacacg

SEQ ID NO: 441168 - DNA, 25 bp, Mus musculus
gaattcaatttgaccctccaagttc

SEQ ID NO: 441169 - DNA, 25 bp, Mus musculus
gaattcaatttgtccctccaagttc

SEQ ID NO: 441170 - DNA, 25 bp, Mus musculus
gaattcacaacactacttgtgcccc

SEQ ID NO: 441171 - DNA, 25 bp, Mus musculus
gaattcacaacagtacttgtgcccc

SEQ ID NO: 441172 - DNA, 25 bp, Mus musculus
gaattcacaccgacaaaaacatccc

SEQ ID NO: 441173 - DNA, 25 bp, Mus musculus
gaattcacaccgtcaaaaacatccc

SEQ ID NO: 441174 - DNA, 25 bp, Mus musculus
gaattcacagacaaactaaatacct

SEQ ID NO: 441175 - DNA, 25 bp, Mus musculus
gaattcacagactaactaaatacct

SEQ ID NO: 441176 - DNA, 25 bp, Mus musculus
gaattcacagagctggttgcccgac

SEQ ID NO: 441177 - DNA, 25 bp, Mus musculus
gaattcacagaggtggttgcccgac

SEQ ID NO: 441178 - DNA, 25 bp, Mus musculus
gaattcacatcccacttcaatccaa

SEQ ID NO: 441179 - DNA, 25 bp, Mus musculus
gaattcacatccgacttcaatccaa

SEQ ID NO: 441180 - DNA, 25 bp, Mus musculus
gaattcacattcaggctctcaagga

SEQ ID NO: 441181 - DNA, 25 bp, Mus musculus
gaattcacattctggctctcaagga

SEQ ID NO: 441182 - DNA, 25 bp, Mus musculus
gaattcacatttacagtgctgttac

SEQ ID NO: 441183 - DNA, 25 bp, Mus musculus
gaattcacattttcagtgctgttac

SEQ ID NO: 441184 - DNA, 25 bp, Mus musculus
gaattcaccaaccatatgggctatg

SEQ ID NO: 441185 - DNA, 25 bp, Mus musculus
gaattcaccaacgatatgggctatg

SEQ ID NO: 441186 - DNA, 25 bp, Mus musculus
gaattcacccaacaaagcacacacg

SEQ ID NO: 441187 - DNA, 25 bp, Mus musculus
gaattcacccaagaaagcacacacg

SEQ ID NO: 441188 - DNA, 25 bp, Mus musculus
gaattcaccccacaggtgcaggctg

SEQ ID NO: 441189 - DNA, 25 bp, Mus musculus
gaattcaccccagaggtgcaggctg

SEQ ID NO: 441190 - DNA, 25 bp, Mus musculus
gaattcacccctaagttggagcact

SEQ ID NO: 441191 - DNA, 25 bp, Mus musculus
gaattcaccccttagttggagcact

SEQ ID NO: 441192 - DNA, 25 bp, Mus musculus
gaattcacccttatcgggtgcattt

SEQ ID NO: 441193 - DNA, 25 bp, Mus musculus
gaattcacccttttcgggtgcattt

SEQ ID NO: 441194 - DNA, 25 bp, Mus musculus
gaattcaccgttaaggccagactgc

SEQ ID NO: 441195 - DNA, 25 bp, Mus musculus
gaattcaccgtttaggccagactgc

SEQ ID NO: 441196 - DNA, 25 bp, Mus musculus
gaattcacctagcataggctctttg

SEQ ID NO: 441197 - DNA, 25 bp, Mus musculus
gaattcacctaggataggctctttg

SEQ ID NO: 441198 - DNA, 25 bp, Mus musculus
gaattcacctatccctgagagctgc

SEQ ID NO: 441199 - DNA, 25 bp, Mus musculus
gaattcacctatgcctgagagctgc

SEQ ID NO: 441200 - DNA, 25 bp, Mus musculus
gaattcaccttacattgtttctatg

SEQ ID NO: 441201 - DNA, 25 bp, Mus musculus
gaattcaccttagattgtttctatg

SEQ ID NO: 441202 - DNA, 25 bp, Mus musculus
gaattcacgtgcagtgtcttcttca

SEQ ID NO: 441203 - DNA, 25 bp, Mus musculus
gaattcacgtgctgtgtcttcttca

SEQ ID NO: 441204 - DNA, 25 bp, Mus musculus
gaattcactactatgtggttatagt

SEQ ID NO: 441205 - DNA, 25 bp, Mus musculus
gaattcactactttgtggttatagt

SEQ ID NO: 441206 - DNA, 25 bp, Mus musculus
gaattcactcaactcgtaagagaat

SEQ ID NO: 441207 - DNA, 25 bp, Mus musculus
gaattcactcaagtcgtaagagaat

SEQ ID NO: 441208 - DNA, 25 bp, Mus musculus
gaattcactcagctgcactgttgta

SEQ ID NO: 441209 - DNA, 25 bp, Mus musculus
gaattcactcaggtgcactgttgta

SEQ ID NO: 441210 - DNA, 25 bp, Mus musculus
gaattcactcataggttcttcctga

SEQ ID NO: 441211 - DNA, 25 bp, Mus musculus
gaattcactcatccaaagtggacat

SEQ ID NO: 441212 - DNA, 25 bp, Mus musculus
gaattcactcatgcaaagtggacat

SEQ ID NO: 441213 - DNA, 25 bp, Mus musculus
gaattcactcattggttcttcctga

SEQ ID NO: 441214 - DNA, 25 bp, Mus musculus
gaattcactttcattggcttcatcc

SEQ ID NO: 441215 - DNA, 25 bp, Mus musculus
gaattcactttctttggcttcatcc

SEQ ID NO: 441216 - DNA, 25 bp, Mus musculus
gaattcactttgaatgccagactag

SEQ ID NO: 441217 - DNA, 25 bp, Mus musculus
gaattcactttgtatgccagactag

SEQ ID NO: 441218 - DNA, 25 bp, Mus musculus
gaattcagaaccatgaacagctgga

SEQ ID NO: 441219 - DNA, 25 bp, Mus musculus
gaattcagaaccttgaacagctgga

SEQ ID NO: 441220 - DNA, 25 bp, Mus musculus
gaattcagagacctattctcctatg

SEQ ID NO: 441221 - DNA, 25 bp, Mus musculus
gaattcagagaccttctccaccatg

SEQ ID NO: 441222 - DNA, 25 bp, Mus musculus
gaattcagagacgtattctcctatg

SEQ ID NO: 441223 - DNA, 25 bp, Mus musculus
gaattcagagacgttctccaccatg

SEQ ID NO: 441224 - DNA, 25 bp, Mus musculus
gaattcagagcacggaactttccaa

SEQ ID NO: 441225 - DNA, 25 bp, Mus musculus
gaattcagagcactcgtccgatgtt

SEQ ID NO: 441226 - DNA, 25 bp, Mus musculus
gaattcagagcagggaactttccaa

SEQ ID NO: 441227 - DNA, 25 bp, Mus musculus
gaattcagagcagtcgtccgatgtt

SEQ ID NO: 441228 - DNA, 25 bp, Mus musculus
gaattcagagctacagtcactttaa

SEQ ID NO: 441229 - DNA, 25 bp, Mus musculus
gaattcagagcttcagtcactttaa

SEQ ID NO: 441230 - DNA, 25 bp, Mus musculus
gaattcagagtgagggtctggtcaa

SEQ ID NO: 441231 - DNA, 25 bp, Mus musculus
gaattcagagtgtgggtctggtcaa

SEQ ID NO: 441232 - DNA, 25 bp, Mus musculus
gaattcagatacaacctgtctgtgt

SEQ ID NO: 441233 - DNA, 25 bp, Mus musculus
gaattcagatactacctgtctgtgt

SEQ ID NO: 441234 - DNA, 25 bp, Mus musculus
gaattcagccgacgtgtgactgatc

SEQ ID NO: 441235 - DNA, 25 bp, Mus musculus
gaattcagccgactttaccatggcg

SEQ ID NO: 441236 - DNA, 25 bp, Mus musculus
gaattcagccgaggtgtgactgatc

SEQ ID NO: 441237 - DNA, 25 bp, Mus musculus
gaattcagccgagtttaccatggcg

SEQ ID NO: 441238 - DNA, 25 bp, Mus musculus
gaattcagcctcaaggaccaaccat

SEQ ID NO: 441239 - DNA, 25 bp, Mus musculus
gaattcagcctctaggaccaaccat

SEQ ID NO: 441240 - DNA, 25 bp, Mus musculus
gaattcagcctgagtccagaataga

SEQ ID NO: 441241 - DNA, 25 bp, Mus musculus
gaattcagcctgtgtccagaataga

SEQ ID NO: 441242 - DNA, 25 bp, Mus musculus
gaattcagcgcaaatctcgaatgcc

SEQ ID NO: 441243 - DNA, 25 bp, Mus musculus
gaattcagcgcatatctcgaatgcc

SEQ ID NO: 441244 - DNA, 25 bp, Mus musculus
gaattcagcgtaactcatgcctttg

SEQ ID NO: 441245 - DNA, 25 bp, Mus musculus
gaattcagcgtatctcatgcctttg

SEQ ID NO: 441246 - DNA, 25 bp, Mus musculus
gaattcagctaccttctcttttagt

SEQ ID NO: 441247 - DNA, 25 bp, Mus musculus
gaattcagctacgttctcttttagt

SEQ ID NO: 441248 - DNA, 25 bp, Mus musculus
gaattcagctctcaacagtttaaag

SEQ ID NO: 441249 - DNA, 25 bp, Mus musculus
gaattcagctctgaacagtttaaag

SEQ ID NO: 441250 - DNA, 25 bp, Mus musculus
gaattcaggcccacgtgttggcaaa

SEQ ID NO: 441251 - DNA, 25 bp, Mus musculus
gaattcaggccctcgtgttggcaaa

SEQ ID NO: 441252 - DNA, 25 bp, Mus musculus
gaattcaggctacctggtgtcagtt

SEQ ID NO: 441253 - DNA, 25 bp, Mus musculus
gaattcaggctagctggtgtcagtt

SEQ ID NO: 441254 - DNA, 25 bp, Mus musculus
gaattcaggctcaagtaggttccaa

SEQ ID NO: 441255 - DNA, 25 bp, Mus musculus
gaattcaggctctagtaggttccaa

SEQ ID NO: 441256 - DNA, 25 bp, Mus musculus
gaattcagggaaagtctcacgtttc

SEQ ID NO: 441257 - DNA, 25 bp, Mus musculus
gaattcagggaatgtctcacgtttc

SEQ ID NO: 441258 - DNA, 25 bp, Mus musculus
gaattcagggccatatacacactaa

SEQ ID NO: 441259 - DNA, 25 bp, Mus musculus
gaattcagggccttatacacactaa

SEQ ID NO: 441260 - DNA, 25 bp, Mus musculus
gaattcagggtcaccaggcaagcgc

SEQ ID NO: 441261 - DNA, 25 bp, Mus musculus
gaattcagggtcatacctttcttac

SEQ ID NO: 441262 - DNA, 25 bp, Mus musculus
gaattcagggtctccaggcaagcgc

SEQ ID NO: 441263 - DNA, 25 bp, Mus musculus
gaattcagggtcttacctttcttac

SEQ ID NO: 441264 - DNA, 25 bp, Mus musculus
gaattcaggtccattattcttttca

SEQ ID NO: 441265 - DNA, 25 bp, Mus musculus
gaattcaggtccctgttgagcatcc

SEQ ID NO: 441266 - DNA, 25 bp, Mus musculus
gaattcaggtccgtgttgagcatcc

SEQ ID NO: 441267 - DNA, 25 bp, Mus musculus
gaattcaggtcctttattcttttca

SEQ ID NO: 441268 - DNA, 25 bp, Mus musculus
gaattcaggtgtaagtaccagctgt

SEQ ID NO: 441269 - DNA, 25 bp, Mus musculus
gaattcaggtgttagtaccagctgt

SEQ ID NO: 441270 - DNA, 25 bp, Mus musculus
gaattcagtaccacagctatcttgc

SEQ ID NO: 441271 - DNA, 25 bp, Mus musculus
gaattcagtacctcagctatcttgc

SEQ ID NO: 441272 - DNA, 25 bp, Mus musculus
gaattcagtattatctgtagctgga

SEQ ID NO: 441273 - DNA, 25 bp, Mus musculus
gaattcagtattttctgtagctgga

SEQ ID NO: 441274 - DNA, 25 bp, Mus musculus
gaattcagtcacagcatagggattt

SEQ ID NO: 441275 - DNA, 25 bp, Mus musculus
gaattcagtcactgcatagggattt

SEQ ID NO: 441276 - DNA, 25 bp, Mus musculus
gaattcagtgacacatctcgaaaag

SEQ ID NO: 441277 - DNA, 25 bp, Mus musculus
gaattcagtgactcatctcgaaaag

SEQ ID NO: 441278 - DNA, 25 bp, Mus musculus
gaattcagtgctcttgtcactgcaa

SEQ ID NO: 441279 - DNA, 25 bp, Mus musculus
gaattcagtgctgttgtcactgcaa

SEQ ID NO: 441280 - DNA, 25 bp, Mus musculus
gaattcagtgtcacatcagtcatta

SEQ ID NO: 441281 - DNA, 25 bp, Mus musculus
gaattcagtgtctcatcagtcatta

SEQ ID NO: 441282 - DNA, 25 bp, Mus musculus
gaattcagttacatgccactgtggg

SEQ ID NO: 441283 - DNA, 25 bp, Mus musculus
gaattcagttacttgccactgtggg

SEQ ID NO: 441284 - DNA, 25 bp, Mus musculus
gaattcagttccatttctacaagat

SEQ ID NO: 441285 - DNA, 25 bp, Mus musculus
gaattcagttccttttctacaagat

SEQ ID NO: 441286 - DNA, 25 bp, Mus musculus
gaattcagttgtcgactgtggccat

SEQ ID NO: 441287 - DNA, 25 bp, Mus musculus
gaattcagttgtggactgtggccat

SEQ ID NO: 441288 - DNA, 25 bp, Mus musculus
gaattcatacatcggctgtctcctg

SEQ ID NO: 441289 - DNA, 25 bp, Mus musculus
gaattcatacatgggctgtctcctg

SEQ ID NO: 441290 - DNA, 25 bp, Mus musculus
gaattcatacccatgttgggctgca

SEQ ID NO: 441291 - DNA, 25 bp, Mus musculus
gaattcatacccttgttgggctgca

SEQ ID NO: 441292 - DNA, 25 bp, Mus musculus
gaattcatatcgaagaggacgcctt

SEQ ID NO: 441293 - DNA, 25 bp, Mus musculus
gaattcatatcgtagaggacgcctt

SEQ ID NO: 441294 - DNA, 25 bp, Mus musculus
gaattcatatgtactcaccttttta

SEQ ID NO: 441295 - DNA, 25 bp, Mus musculus
gaattcatatgttctcaccttttta

SEQ ID NO: 441296 - DNA, 25 bp, Mus musculus
gaattcatcaaactgttaagcttca

SEQ ID NO: 441297 - DNA, 25 bp, Mus musculus
gaattcatcaaagtgttaagcttca

SEQ ID NO: 441298 - DNA, 25 bp, Mus musculus
gaattcatcagtctgcctgtaccag

SEQ ID NO: 441299 - DNA, 25 bp, Mus musculus
gaattcatcagtgtgcctgtaccag

SEQ ID NO: 441300 - DNA, 25 bp, Mus musculus
gaattcatcccaaacacagttacca

SEQ ID NO: 441301 - DNA, 25 bp, Mus musculus
gaattcatcccatacacagttacca

SEQ ID NO: 441302 - DNA, 25 bp, Mus musculus
gaattcatcgcaatccaggcttgca

SEQ ID NO: 441303 - DNA, 25 bp, Mus musculus
gaattcatcgcattccaggcttgca

SEQ ID NO: 441304 - DNA, 25 bp, Mus musculus
gaattcatcttcattcaacggagac

SEQ ID NO: 441305 - DNA, 25 bp, Mus musculus
gaattcatcttctttcaacggagac

SEQ ID NO: 441306 - DNA, 25 bp, Mus musculus
gaattcatgcatatgggttacagcc

SEQ ID NO: 441307 - DNA, 25 bp, Mus musculus
gaattcatgcatttgggttacagcc

SEQ ID NO: 441308 - DNA, 25 bp, Mus musculus
gaattcatgccccagaacttagcct

SEQ ID NO: 441309 - DNA, 25 bp, Mus musculus
gaattcatgcccgagaacttagcct

SEQ ID NO: 441310 - DNA, 25 bp, Mus musculus
gaattcatggacacacaaacccaaa

SEQ ID NO: 441311 - DNA, 25 bp, Mus musculus
gaattcatggactcacaaacccaaa

SEQ ID NO: 441312 - DNA, 25 bp, Mus musculus
gaattcatggatcacaccagccgct

SEQ ID NO: 441313 - DNA, 25 bp, Mus musculus
gaattcatggatgacaccagccgct

SEQ ID NO: 441314 - DNA, 25 bp, Mus musculus
gaattcatgggaactctttagcagt

SEQ ID NO: 441315 - DNA, 25 bp, Mus musculus
gaattcatgggatctctttagcagt

SEQ ID NO: 441316 - DNA, 25 bp, Mus musculus
gaattcatgtggaaacatccttttg

SEQ ID NO: 441317 - DNA, 25 bp, Mus musculus
gaattcatgtggtaacatccttttg

SEQ ID NO: 441318 - DNA, 25 bp, Mus musculus
gaattcatgttcaaacaaaactaga

SEQ ID NO: 441319 - DNA, 25 bp, Mus musculus
gaattcatgttctaacaaaactaga

SEQ ID NO: 441320 - DNA, 25 bp, Mus musculus
gaattcatgtttacagctaggctgg

SEQ ID NO: 441321 - DNA, 25 bp, Mus musculus
gaattcatgttttcagctaggctgg

SEQ ID NO: 441322 - DNA, 25 bp, Mus musculus
gaattcattaatccccttacctgac

SEQ ID NO: 441323 - DNA, 25 bp, Mus musculus
gaattcattaatgcccttacctgac

SEQ ID NO: 441324 - DNA, 25 bp, Mus musculus
gaattcattactacttcctgatggg

SEQ ID NO: 441325 - DNA, 25 bp, Mus musculus
gaattcattacttcttcctgatggg

SEQ ID NO: 441326 - DNA, 25 bp, Mus musculus
gaattcattccacatttccactgta

SEQ ID NO: 441327 - DNA, 25 bp, Mus musculus
gaattcattccagatttccactgta

SEQ ID NO: 441328 - DNA, 25 bp, Mus musculus
gaattcattgaacgagtgtctcagt

SEQ ID NO: 441329 - DNA, 25 bp, Mus musculus
gaattcattgaaggagtgtctcagt

SEQ ID NO: 441330 - DNA, 25 bp, Mus musculus
gaattcattgtcagacctgcctatt

SEQ ID NO: 441331 - DNA, 25 bp, Mus musculus
gaattcattgtccttgccatcaggg

SEQ ID NO: 441332 - DNA, 25 bp, Mus musculus
gaattcattgtcgttgccatcaggg

SEQ ID NO: 441333 - DNA, 25 bp, Mus musculus
gaattcattgtctgacctgcctatt

SEQ ID NO: 441334 - DNA, 25 bp, Mus musculus
gaattcattgtgatctatatccttt

SEQ ID NO: 441335 - DNA, 25 bp, Mus musculus
gaattcattgtgttctatatccttt

SEQ ID NO: 441336 - DNA, 25 bp, Mus musculus
gaattcattgttatacctgaccagc

SEQ ID NO: 441337 - DNA, 25 bp, Mus musculus
gaattcattgttttacctgaccagc

SEQ ID NO: 441338 - DNA, 25 bp, Mus musculus
gaattcatttcaaggcagcatcaaa

SEQ ID NO: 441339 - DNA, 25 bp, Mus musculus
gaattcatttcatggcagcatcaaa

SEQ ID NO: 441340 - DNA, 25 bp, Mus musculus
gaattcatttttacaccgaccaagt

SEQ ID NO: 441341 - DNA, 25 bp, Mus musculus
gaattcattttttcaccgaccaagt

SEQ ID NO: 441342 - DNA, 25 bp, Mus musculus
gaattccaaaggctttgctcaccta

SEQ ID NO: 441343 - DNA, 25 bp, Mus musculus
gaattccaaagggtttgctcaccta

SEQ ID NO: 441344 - DNA, 25 bp, Mus musculus
gaattccaaccaactaaccggacaa

SEQ ID NO: 441345 - DNA, 25 bp, Mus musculus
gaattccaaccatctaaccggacaa

SEQ ID NO: 441346 - DNA, 25 bp, Mus musculus
gaattccaagcaacgtcttcaacgg

SEQ ID NO: 441347 - DNA, 25 bp, Mus musculus
gaattccaagcatcgtcttcaacgg

SEQ ID NO: 441348 - DNA, 25 bp, Mus musculus
gaattccaaggccaagtccagtcta

SEQ ID NO: 441349 - DNA, 25 bp, Mus musculus
gaattccaaggcgaagtccagtcta

SEQ ID NO: 441350 - DNA, 25 bp, Mus musculus
gaattccaagtcaccggaagaacat

SEQ ID NO: 441351 - DNA, 25 bp, Mus musculus
gaattccaagtcctcattccaaagg

SEQ ID NO: 441352 - DNA, 25 bp, Mus musculus
gaattccaagtcgtcattccaaagg

SEQ ID NO: 441353 - DNA, 25 bp, Mus musculus
gaattccaagtctccggaagaacat

SEQ ID NO: 441354 - DNA, 25 bp, Mus musculus
gaattccacaagagtcacggcactc

SEQ ID NO: 441355 - DNA, 25 bp, Mus musculus
gaattccacaagtgtcacggcactc

SEQ ID NO: 441356 - DNA, 25 bp, Mus musculus
gaattccacatacggcagagcttga

SEQ ID NO: 441357 - DNA, 25 bp, Mus musculus
gaattccacatagggcagagcttga

SEQ ID NO: 441358 - DNA, 25 bp, Mus musculus
gaattccactggctcttggctctga

SEQ ID NO: 441359 - DNA, 25 bp, Mus musculus
gaattccactgggtcttggctctga

SEQ ID NO: 441360 - DNA, 25 bp, Mus musculus
gaattccacttcagatcagagccct

SEQ ID NO: 441361 - DNA, 25 bp, Mus musculus
gaattccacttctgatcagagccct

SEQ ID NO: 441362 - DNA, 25 bp, Mus musculus
gaattccagacaagactagcttggt

SEQ ID NO: 441363 - DNA, 25 bp, Mus musculus
gaattccagacacttgtagtccaaa

SEQ ID NO: 441364 - DNA, 25 bp, Mus musculus
gaattccagacagttgtagtccaaa

SEQ ID NO: 441365 - DNA, 25 bp, Mus musculus
gaattccagacatgactagcttggt

SEQ ID NO: 441366 - DNA, 25 bp, Mus musculus
gaattccagaccagtgtcatttccc

SEQ ID NO: 441367 - DNA, 25 bp, Mus musculus
gaattccagacctgtgtcatttccc

SEQ ID NO: 441368 - DNA, 25 bp, Mus musculus
gaattccagactagccagacttacc

SEQ ID NO: 441369 - DNA, 25 bp, Mus musculus
gaattccagacttgccagacttacc

SEQ ID NO: 441370 - DNA, 25 bp, Mus musculus
gaattccagagactccatgtacata

SEQ ID NO: 441371 - DNA, 25 bp, Mus musculus
gaattccagagagtccatgtacata

SEQ ID NO: 441372 - DNA, 25 bp, Mus musculus
gaattccagctaatgcaactgtttg

SEQ ID NO: 441373 - DNA, 25 bp, Mus musculus
gaattccagctattgcaactgtttg

SEQ ID NO: 441374 - DNA, 25 bp, Mus musculus
gaattccagctgaagctaacccttt

SEQ ID NO: 441375 - DNA, 25 bp, Mus musculus
gaattccagctgtagctaacccttt

SEQ ID NO: 441376 - DNA, 25 bp, Mus musculus
gaattccaggatcagagccagcttt

SEQ ID NO: 441377 - DNA, 25 bp, Mus musculus
gaattccaggatgagagccagcttt

SEQ ID NO: 441378 - DNA, 25 bp, Mus musculus
gaattccagtttagagctgcaccaa

SEQ ID NO: 441379 - DNA, 25 bp, Mus musculus
gaattccagttttgagctgcaccaa

SEQ ID NO: 441380 - DNA, 25 bp, Mus musculus
gaattccataaacctctactctaaa

SEQ ID NO: 441381 - DNA, 25 bp, Mus musculus
gaattccataaagctctactctaaa

SEQ ID NO: 441382 - DNA, 25 bp, Mus musculus
gaattccataggaggtatacccaaa

SEQ ID NO: 441383 - DNA, 25 bp, Mus musculus
gaattccataggtggtatacccaaa

SEQ ID NO: 441384 - DNA, 25 bp, Mus musculus
gaattccatatgatcctgagttatt

SEQ ID NO: 441385 - DNA, 25 bp, Mus musculus
gaattccatatgttcctgagttatt

SEQ ID NO: 441386 - DNA, 25 bp, Mus musculus
gaattccatcttcaaacccacatgc

SEQ ID NO: 441387 - DNA, 25 bp, Mus musculus
gaattccatcttgaaacccacatgc

SEQ ID NO: 441388 - DNA, 25 bp, Mus musculus
gaattccatgttagggcagtaagac

SEQ ID NO: 441389 - DNA, 25 bp, Mus musculus
gaattccatgtttgggcagtaagac

SEQ ID NO: 441390 - DNA, 25 bp, Mus musculus
gaattccattcacttttggcaaaga

SEQ ID NO: 441391 - DNA, 25 bp, Mus musculus
gaattccattcagttttggcaaaga

SEQ ID NO: 441392 - DNA, 25 bp, Mus musculus
gaattccattctagatactcccact

SEQ ID NO: 441393 - DNA, 25 bp, Mus musculus
gaattccattcttgatactcccact

SEQ ID NO: 441394 - DNA, 25 bp, Mus musculus
gaattccattgtcctactatggata

SEQ ID NO: 441395 - DNA, 25 bp, Mus musculus
gaattccattgtgctactatggata

SEQ ID NO: 441396 - DNA, 25 bp, Mus musculus
gaattccatttcctttgggctgctg

SEQ ID NO: 441397 - DNA, 25 bp, Mus musculus
gaattccatttcgtttgggctgctg

SEQ ID NO: 441398 - DNA, 25 bp, Mus musculus
gaattcccaaatcagaagtgtgtgg

SEQ ID NO: 441399 - DNA, 25 bp, Mus musculus
gaattcccaaatgagaagtgtgtgg

SEQ ID NO: 441400 - DNA, 25 bp, Mus musculus
gaattcccaacgaaatccctgccaa

SEQ ID NO: 441401 - DNA, 25 bp, Mus musculus
gaattcccaacgtaatccctgccaa

SEQ ID NO: 441402 - DNA, 25 bp, Mus musculus
gaattcccaagactgagcttccttc

SEQ ID NO: 441403 - DNA, 25 bp, Mus musculus
gaattcccaagagtgagcttccttc

SEQ ID NO: 441404 - DNA, 25 bp, Mus musculus
gaattcccagatctatgtacataaa

SEQ ID NO: 441405 - DNA, 25 bp, Mus musculus
gaattcccagatgtatgtacataaa

SEQ ID NO: 441406 - DNA, 25 bp, Mus musculus
gaattcccagtgctagaaacgcaga

SEQ ID NO: 441407 - DNA, 25 bp, Mus musculus
gaattcccagtggtagaaacgcaga

SEQ ID NO: 441408 - DNA, 25 bp, Mus musculus
gaattcccatatccatttatgcttg

SEQ ID NO: 441409 - DNA, 25 bp, Mus musculus
gaattcccatatgcatttatgcttg

SEQ ID NO: 441410 - DNA, 25 bp, Mus musculus
gaattccccaagagtccctaaaatg

SEQ ID NO: 441411 - DNA, 25 bp, Mus musculus
gaattccccaagtgtccctaaaatg

SEQ ID NO: 441412 - DNA, 25 bp, Mus musculus
gaattccccataatctgctgaatga

SEQ ID NO: 441413 - DNA, 25 bp, Mus musculus
gaattccccatattctgctgaatga

SEQ ID NO: 441414 - DNA, 25 bp, Mus musculus
gaattccccggaacgcggcgaactg

SEQ ID NO: 441415 - DNA, 25 bp, Mus musculus
gaattccccggatcgcggcgaactg

SEQ ID NO: 441416 - DNA, 25 bp, Mus musculus
gaattccccgtcaaaagattcatga

SEQ ID NO: 441417 - DNA, 25 bp, Mus musculus
gaattccccgtctaaagattcatga

SEQ ID NO: 441418 - DNA, 25 bp, Mus musculus
gaattcccgctcagtagatctgtcg

SEQ ID NO: 441419 - DNA, 25 bp, Mus musculus
gaattcccgctctgtagatctgtcg

SEQ ID NO: 441420 - DNA, 25 bp, Mus musculus
gaattccctaacatttcttatggca

SEQ ID NO: 441421 - DNA, 25 bp, Mus musculus
gaattccctaacttttcttatggca

SEQ ID NO: 441422 - DNA, 25 bp, Mus musculus
gaattccctactctctaattatcct

SEQ ID NO: 441423 - DNA, 25 bp, Mus musculus
gaattccctactgtctaattatcct

SEQ ID NO: 441424 - DNA, 25 bp, Mus musculus
gaattccctagaagcctattcattt

SEQ ID NO: 441425 - DNA, 25 bp, Mus musculus
gaattccctagatgcctattcattt

SEQ ID NO: 441426 - DNA, 25 bp, Mus musculus
gaattccctatgaatatggcccaga

SEQ ID NO: 441427 - DNA, 25 bp, Mus musculus
gaattccctatgtatatggcccaga

SEQ ID NO: 441428 - DNA, 25 bp, Mus musculus
gaattccctattatcagtggttatt

SEQ ID NO: 441429 - DNA, 25 bp, Mus musculus
gaattccctattttcagtggttatt

SEQ ID NO: 441430 - DNA, 25 bp, Mus musculus
gaattccctcaaagattgcttcaag

SEQ ID NO: 441431 - DNA, 25 bp, Mus musculus
gaattccctcaatgattgcttcaag

SEQ ID NO: 441432 - DNA, 25 bp, Mus musculus
gaattccctcacaaaaagcttaagc

SEQ ID NO: 441433 - DNA, 25 bp, Mus musculus
gaattccctcactaaaagcttaagc

SEQ ID NO: 441434 - DNA, 25 bp, Mus musculus
gaattccctctcactataggattgg

SEQ ID NO: 441435 - DNA, 25 bp, Mus musculus
gaattccctctctctataggattgg

SEQ ID NO: 441436 - DNA, 25 bp, Mus musculus
gaattccctctgctgaacgtacaac

SEQ ID NO: 441437 - DNA, 25 bp, Mus musculus
gaattccctctggtgaacgtacaac

SEQ ID NO: 441438 - DNA, 25 bp, Mus musculus
gaattccctgagaccgtggattttt

SEQ ID NO: 441439 - DNA, 25 bp, Mus musculus
gaattccctgagtccgtggattttt

SEQ ID NO: 441440 - DNA, 25 bp, Mus musculus
gaattccctgcacagttgtggtctt

SEQ ID NO: 441441 - DNA, 25 bp, Mus musculus
gaattccctgcagagttgtggtctt

SEQ ID NO: 441442 - DNA, 25 bp, Mus musculus
gaattccctgcgcagaagaacagtt

SEQ ID NO: 441443 - DNA, 25 bp, Mus musculus
gaattccctgcggagaagaacagtt

SEQ ID NO: 441444 - DNA, 25 bp, Mus musculus
gaattccctgggagttagatcctga

SEQ ID NO: 441445 - DNA, 25 bp, Mus musculus
gaattccctgggtgttagatcctga

SEQ ID NO: 441446 - DNA, 25 bp, Mus musculus
gaattccctgtacgacatggcccgg

SEQ ID NO: 441447 - DNA, 25 bp, Mus musculus
gaattccctgtaggacatggcccgg

SEQ ID NO: 441448 - DNA, 25 bp, Mus musculus
gaattcccttataaatccactgatt

SEQ ID NO: 441449 - DNA, 25 bp, Mus musculus
gaattcccttattaatccactgatt

SEQ ID NO: 441450 - DNA, 25 bp, Mus musculus
gaattcccttgccagtcttggaaaa

SEQ ID NO: 441451 - DNA, 25 bp, Mus musculus
gaattcccttgcgagtcttggaaaa

SEQ ID NO: 441452 - DNA, 25 bp, Mus musculus
gaattccgagtgagcagaaccgaca

SEQ ID NO: 441453 - DNA, 25 bp, Mus musculus
gaattccgagtgtgcagaaccgaca

SEQ ID NO: 441454 - DNA, 25 bp, Mus musculus
gaattccgctctacacaaggtggct

SEQ ID NO: 441455 - DNA, 25 bp, Mus musculus
gaattccgctcttcacaaggtggct

SEQ ID NO: 441456 - DNA, 25 bp, Mus musculus
gaattccgtcggacaggactagagg

SEQ ID NO: 441457 - DNA, 25 bp, Mus musculus
gaattccgtcggtcaggactagagg

SEQ ID NO: 441458 - DNA, 25 bp, Mus musculus
gaattccgtcttacacctattgtag

SEQ ID NO: 441459 - DNA, 25 bp, Mus musculus
gaattccgtctttcacctattgtag

SEQ ID NO: 441460 - DNA, 25 bp, Mus musculus
gaattccgtttcagagacagactta

SEQ ID NO: 441461 - DNA, 25 bp, Mus musculus
gaattccgtttcatccttaaacctg

SEQ ID NO: 441462 - DNA, 25 bp, Mus musculus
gaattccgtttctgagacagactta

SEQ ID NO: 441463 - DNA, 25 bp, Mus musculus
gaattccgtttcttccttaaacctg

SEQ ID NO: 441464 - DNA, 25 bp, Mus musculus
gaattccgttttattgttctgatgc

SEQ ID NO: 441465 - DNA, 25 bp, Mus musculus
gaattccgtttttttgttctgatgc

SEQ ID NO: 441466 - DNA, 25 bp, Mus musculus
gaattcctaaatctactgtgagtaa

SEQ ID NO: 441467 - DNA, 25 bp, Mus musculus
gaattcctaaatgtactgtgagtaa

SEQ ID NO: 441468 - DNA, 25 bp, Mus musculus
gaattcctaccccagagaggtcatg

SEQ ID NO: 441469 - DNA, 25 bp, Mus musculus
gaattcctacccgagagaggtcatg

SEQ ID NO: 441470 - DNA, 25 bp, Mus musculus
gaattcctaccgagagtatctgtga

SEQ ID NO: 441471 - DNA, 25 bp, Mus musculus
gaattcctaccgtgagtatctgtga

SEQ ID NO: 441472 - DNA, 25 bp, Mus musculus
gaattcctacgcagtattttcttct

SEQ ID NO: 441473 - DNA, 25 bp, Mus musculus
gaattcctacgctgtattttcttct

SEQ ID NO: 441474 - DNA, 25 bp, Mus musculus
gaattcctactccaggttagaaggg

SEQ ID NO: 441475 - DNA, 25 bp, Mus musculus
gaattcctactcgaggttagaaggg

SEQ ID NO: 441476 - DNA, 25 bp, Mus musculus
gaattcctaggtcgcctgaagcgtg

SEQ ID NO: 441477 - DNA, 25 bp, Mus musculus
gaattcctaggtggcctgaagcgtg

SEQ ID NO: 441478 - DNA, 25 bp, Mus musculus
gaattcctatccagactgtgttgca

SEQ ID NO: 441479 - DNA, 25 bp, Mus musculus
gaattcctatcctgactgtgttgca

SEQ ID NO: 441480 - DNA, 25 bp, Mus musculus
gaattcctatctcattgcttgtcag

SEQ ID NO: 441481 - DNA, 25 bp, Mus musculus
gaattcctatctgattgcttgtcag

SEQ ID NO: 441482 - DNA, 25 bp, Mus musculus
gaattcctcacaatccagcgctttc

SEQ ID NO: 441483 - DNA, 25 bp, Mus musculus
gaattcctcacattccagcgctttc

SEQ ID NO: 441484 - DNA, 25 bp, Mus musculus
gaattcctcaggacactggaaacct

SEQ ID NO: 441485 - DNA, 25 bp, Mus musculus
gaattcctcaggtcactggaaacct

SEQ ID NO: 441486 - DNA, 25 bp, Mus musculus
gaattcctcatccttttgcaaatgc

SEQ ID NO: 441487 - DNA, 25 bp, Mus musculus
gaattcctcatcgttttgcaaatgc

SEQ ID NO: 441488 - DNA, 25 bp, Mus musculus
gaattcctcctgaacgactcttcaa

SEQ ID NO: 441489 - DNA, 25 bp, Mus musculus
gaattcctcctgtacgactcttcaa

SEQ ID NO: 441490 - DNA, 25 bp, Mus musculus
gaattcctctgacctttgacagtgg

SEQ ID NO: 441491 - DNA, 25 bp, Mus musculus
gaattcctctgagctttgacagtgg

SEQ ID NO: 441492 - DNA, 25 bp, Mus musculus
gaattcctgagcatcggcagatcat

SEQ ID NO: 441493 - DNA, 25 bp, Mus musculus
gaattcctgagcttcggcagatcat

SEQ ID NO: 441494 - DNA, 25 bp, Mus musculus
gaattcctgattatgctgcctctat

SEQ ID NO: 441495 - DNA, 25 bp, Mus musculus
gaattcctgattttgctgcctctat

SEQ ID NO: 441496 - DNA, 25 bp, Mus musculus
gaattcctgcacaactttcacacag

SEQ ID NO: 441497 - DNA, 25 bp, Mus musculus
gaattcctgcactactttcacacag

SEQ ID NO: 441498 - DNA, 25 bp, Mus musculus
gaattcctgccaatcatgtttaaac

SEQ ID NO: 441499 - DNA, 25 bp, Mus musculus
gaattcctgccattcatgtttaaac

SEQ ID NO: 441500 - DNA, 25 bp, Mus musculus
gaattcctgccccagtaatatctga

SEQ ID NO: 441501 - DNA, 25 bp, Mus musculus
gaattcctgcccgagtaatatctga

SEQ ID NO: 441502 - DNA, 25 bp, Mus musculus
gaattcctgctgcttcggtaagaac

SEQ ID NO: 441503 - DNA, 25 bp, Mus musculus
gaattcctgctggttcggtaagaac

SEQ ID NO: 441504 - DNA, 25 bp, Mus musculus
gaattcctggagcttgttgactgtc

SEQ ID NO: 441505 - DNA, 25 bp, Mus musculus
gaattcctggaggttgttgactgtc

SEQ ID NO: 441506 - DNA, 25 bp, Mus musculus
gaattcctgtctaaatatctactga

SEQ ID NO: 441507 - DNA, 25 bp, Mus musculus
gaattcctgtcttaatatctactga

SEQ ID NO: 441508 - DNA, 25 bp, Mus musculus
gaattcctgtgccatatctgtgtgg

SEQ ID NO: 441509 - DNA, 25 bp, Mus musculus
gaattcctgtgcgatatctgtgtgg

SEQ ID NO: 441510 - DNA, 25 bp, Mus musculus
gaattcctgttcataccatttatta

SEQ ID NO: 441511 - DNA, 25 bp, Mus musculus
gaattcctgttcttaccatttatta

SEQ ID NO: 441512 - DNA, 25 bp, Mus musculus
gaattcctgtttccgttcagggagc

SEQ ID NO: 441513 - DNA, 25 bp, Mus musculus
gaattcctgtttctagcaactagct

SEQ ID NO: 441514 - DNA, 25 bp, Mus musculus
gaattcctgtttgcgttcagggagc

SEQ ID NO: 441515 - DNA, 25 bp, Mus musculus
gaattcctgtttgtagcaactagct

SEQ ID NO: 441516 - DNA, 25 bp, Mus musculus
gaattccttcagactagcaaagagg

SEQ ID NO: 441517 - DNA, 25 bp, Mus musculus
gaattccttcagtctagcaaagagg

SEQ ID NO: 441518 - DNA, 25 bp, Mus musculus
gaattccttcataggtgtcgccagg

SEQ ID NO: 441519 - DNA, 25 bp, Mus musculus
gaattccttcattggtgtcgccagg

SEQ ID NO: 441520 - DNA, 25 bp, Mus musculus
gaattccttctactggttttcactt

SEQ ID NO: 441521 - DNA, 25 bp, Mus musculus
gaattccttctagtggttttcactt

SEQ ID NO: 441522 - DNA, 25 bp, Mus musculus
gaattccttgagaacagaagttcaa

SEQ ID NO: 441523 - DNA, 25 bp, Mus musculus
gaattccttgagatcgacctcagat

SEQ ID NO: 441524 - DNA, 25 bp, Mus musculus
gaattccttgagtacagaagttcaa

SEQ ID NO: 441525 - DNA, 25 bp, Mus musculus
gaattccttgagttcgacctcagat

SEQ ID NO: 441526 - DNA, 25 bp, Mus musculus
gaattccttgcaaagatgctctagt

SEQ ID NO: 441527 - DNA, 25 bp, Mus musculus
gaattccttgcatagatgctctagt

SEQ ID NO: 441528 - DNA, 25 bp, Mus musculus
gaattccttgctaatccttatgttg

SEQ ID NO: 441529 - DNA, 25 bp, Mus musculus
gaattccttgcttatccttatgttg

SEQ ID NO: 441530 - DNA, 25 bp, Mus musculus
gaattccttggactgactgtatgct

SEQ ID NO: 441531 - DNA, 25 bp, Mus musculus
gaattccttggagtgactgtatgct

SEQ ID NO: 441532 - DNA, 25 bp, Mus musculus
gaattcctttaacatgtttccagca

SEQ ID NO: 441533 - DNA, 25 bp, Mus musculus
gaattcctttaagatgtttccagca

SEQ ID NO: 441534 - DNA, 25 bp, Mus musculus
gaattcctttccatcatgaacacag

SEQ ID NO: 441535 - DNA, 25 bp, Mus musculus
gaattcctttccttcatgaacacag

SEQ ID NO: 441536 - DNA, 25 bp, Mus musculus
gaattcgaaaacaccactagcaaga

SEQ ID NO: 441537 - DNA, 25 bp, Mus musculus
gaattcgaaaactccactagcaaga

SEQ ID NO: 441538 - DNA, 25 bp, Mus musculus
gaattcgaacagaatctgccctttg

SEQ ID NO: 441539 - DNA, 25 bp, Mus musculus
gaattcgaacagtatctgccctttg

SEQ ID NO: 441540 - DNA, 25 bp, Mus musculus
gaattcgaaccacccatttggtgtt

SEQ ID NO: 441541 - DNA, 25 bp, Mus musculus
gaattcgaaccagccatttggtgtt

SEQ ID NO: 441542 - DNA, 25 bp, Mus musculus
gaattcgaaccccagttcatttttg

SEQ ID NO: 441543 - DNA, 25 bp, Mus musculus
gaattcgaacccgagttcatttttg

SEQ ID NO: 441544 - DNA, 25 bp, Mus musculus
gaattcgacccaaggactctatatg

SEQ ID NO: 441545 - DNA, 25 bp, Mus musculus
gaattcgacccatggactctatatg

SEQ ID NO: 441546 - DNA, 25 bp, Mus musculus
gaattcgacgttatattctgactta

SEQ ID NO: 441547 - DNA, 25 bp, Mus musculus
gaattcgacgttttattctgactta

SEQ ID NO: 441548 - DNA, 25 bp, Mus musculus
gaattcgacttcactgttcacaaat

SEQ ID NO: 441549 - DNA, 25 bp, Mus musculus
gaattcgacttctctgttcacaaat

SEQ ID NO: 441550 - DNA, 25 bp, Mus musculus
gaattcgaggctacttttttggagg

SEQ ID NO: 441551 - DNA, 25 bp, Mus musculus
gaattcgaggcttcttttttggagg

SEQ ID NO: 441552 - DNA, 25 bp, Mus musculus
gaattcgagtcacccgggatattta

SEQ ID NO: 441553 - DNA, 25 bp, Mus musculus
gaattcgagtcagccgggatattta

SEQ ID NO: 441554 - DNA, 25 bp, Mus musculus
gaattcgatctcaaagaccctagct

SEQ ID NO: 441555 - DNA, 25 bp, Mus musculus
gaattcgatctctaagaccctagct

SEQ ID NO: 441556 - DNA, 25 bp, Mus musculus
gaattcgatgacacttgctgaagta

SEQ ID NO: 441557 - DNA, 25 bp, Mus musculus
gaattcgatgactcttgctgaagta

SEQ ID NO: 441558 - DNA, 25 bp, Mus musculus
gaattcgcaatcagaacccaagtga

SEQ ID NO: 441559 - DNA, 25 bp, Mus musculus
gaattcgcaatctgaacccaagtga

SEQ ID NO: 441560 - DNA, 25 bp, Mus musculus
gaattcgcttttccactggtttcga

SEQ ID NO: 441561 - DNA, 25 bp, Mus musculus
gaattcgcttttgcactggtttcga

SEQ ID NO: 441562 - DNA, 25 bp, Mus musculus
gaattcggaaacctggactttgagc

SEQ ID NO: 441563 - DNA, 25 bp, Mus musculus
gaattcggaaacgtggactttgagc

SEQ ID NO: 441564 - DNA, 25 bp, Mus musculus
gaattcgggaccagggagctaccac

SEQ ID NO: 441565 - DNA, 25 bp, Mus musculus
gaattcgggacctgggagctaccac

SEQ ID NO: 441566 - DNA, 25 bp, Mus musculus
gaattcggtatacatgagaccctaa

SEQ ID NO: 441567 - DNA, 25 bp, Mus musculus
gaattcggtatagatgagaccctaa

SEQ ID NO: 441568 - DNA, 25 bp, Mus musculus
gaattcggttctctgaagcctcaaa

SEQ ID NO: 441569 - DNA, 25 bp, Mus musculus
gaattcggttctgtgaagcctcaaa

SEQ ID NO: 441570 - DNA, 25 bp, Mus musculus
gaattcgtatacattccctccttga

SEQ ID NO: 441571 - DNA, 25 bp, Mus musculus
gaattcgtatactttccctccttga

SEQ ID NO: 441572 - DNA, 25 bp, Mus musculus
gaattcgtccgcacccgaggctgag

SEQ ID NO: 441573 - DNA, 25 bp, Mus musculus
gaattcgtccgctcccgaggctgag

SEQ ID NO: 441574 - DNA, 25 bp, Mus musculus
gaattcgtgacactcctttcagcaa

SEQ ID NO: 441575 - DNA, 25 bp, Mus musculus
gaattcgtgacagtcctttcagcaa

SEQ ID NO: 441576 - DNA, 25 bp, Mus musculus
gaattcgtggtcctttctacaacat

SEQ ID NO: 441577 - DNA, 25 bp, Mus musculus
gaattcgtggtcgtttctacaacat

SEQ ID NO: 441578 - DNA, 25 bp, Mus musculus
gaattcgttcctcctggcctctcct

SEQ ID NO: 441579 - DNA, 25 bp, Mus musculus
gaattcgttcctgctggcctctcct

SEQ ID NO: 441580 - DNA, 25 bp, Mus musculus
gaattcgttttcagggctttttgat

SEQ ID NO: 441581 - DNA, 25 bp, Mus musculus
gaattcgttttctgggctttttgat

SEQ ID NO: 441582 - DNA, 25 bp, Mus musculus
gaattctaaacgcatgtgcctgggt

SEQ ID NO: 441583 - DNA, 25 bp, Mus musculus
gaattctaaacggatgtgcctgggt

SEQ ID NO: 441584 - DNA, 25 bp, Mus musculus
gaattctaaagtactgtccggattt

SEQ ID NO: 441585 - DNA, 25 bp, Mus musculus
gaattctaaagttctgtccggattt

SEQ ID NO: 441586 - DNA, 25 bp, Mus musculus
gaattctaagtcaattggtcctgca

SEQ ID NO: 441587 - DNA, 25 bp, Mus musculus
gaattctaagtctattggtcctgca

SEQ ID NO: 441588 - DNA, 25 bp, Mus musculus
gaattctaagttaatgagcatgcct

SEQ ID NO: 441589 - DNA, 25 bp, Mus musculus
gaattctaagtttatgagcatgcct

SEQ ID NO: 441590 - DNA, 25 bp, Mus musculus
gaattctaatgactatctccacttg

SEQ ID NO: 441591 - DNA, 25 bp, Mus musculus
gaattctaatgagtatctccacttg

SEQ ID NO: 441592 - DNA, 25 bp, Mus musculus
gaattctaccagaagttggctatga

SEQ ID NO: 441593 - DNA, 25 bp, Mus musculus
gaattctaccagtagttggctatga

SEQ ID NO: 441594 - DNA, 25 bp, Mus musculus
gaattctaccctaacactcttatgt

SEQ ID NO: 441595 - DNA, 25 bp, Mus musculus
gaattctacccttacactcttatgt

SEQ ID NO: 441596 - DNA, 25 bp, Mus musculus
gaattctacctaaaggtctccctgc

SEQ ID NO: 441597 - DNA, 25 bp, Mus musculus
gaattctacctataggtctccctgc

SEQ ID NO: 441598 - DNA, 25 bp, Mus musculus
gaattctacgcgactcaacctttca

SEQ ID NO: 441599 - DNA, 25 bp, Mus musculus
gaattctacgcgtctcaacctttca

SEQ ID NO: 441600 - DNA, 25 bp, Mus musculus
gaattctactgaactgaaagcccac

SEQ ID NO: 441601 - DNA, 25 bp, Mus musculus
gaattctactgatctgaaagcccac

SEQ ID NO: 441602 - DNA, 25 bp, Mus musculus
gaattctacttgacaggcataacct

SEQ ID NO: 441603 - DNA, 25 bp, Mus musculus
gaattctacttgtcaggcataacct

SEQ ID NO: 441604 - DNA, 25 bp, Mus musculus
gaattctagaacattctcgctctca

SEQ ID NO: 441605 - DNA, 25 bp, Mus musculus
gaattctagaactttctcgctctca

SEQ ID NO: 441606 - DNA, 25 bp, Mus musculus
gaattctagattaggaccttttcta

SEQ ID NO: 441607 - DNA, 25 bp, Mus musculus
gaattctagatttggaccttttcta

SEQ ID NO: 441608 - DNA, 25 bp, Mus musculus
gaattctagcctacatgagaccaag

SEQ ID NO: 441609 - DNA, 25 bp, Mus musculus
gaattctagcctagacactttccag

SEQ ID NO: 441610 - DNA, 25 bp, Mus musculus
gaattctagccttcatgagaccaag

SEQ ID NO: 441611 - DNA, 25 bp, Mus musculus
gaattctagccttgacactttccag

SEQ ID NO: 441612 - DNA, 25 bp, Mus musculus
gaattctaggccagcatggcctctc

SEQ ID NO: 441613 - DNA, 25 bp, Mus musculus
gaattctaggcctgcatggcctctc

SEQ ID NO: 441614 - DNA, 25 bp, Mus musculus
gaattctagggacggtagaagccca

SEQ ID NO: 441615 - DNA, 25 bp, Mus musculus
gaattctagggagggtagaagccca

SEQ ID NO: 441616 - DNA, 25 bp, Mus musculus
gaattctaggtaaacatgaatggaa

SEQ ID NO: 441617 - DNA, 25 bp, Mus musculus
gaattctaggtatacatgaatggaa

SEQ ID NO: 441618 - DNA, 25 bp, Mus musculus
gaattctagtggagagatccagtct

SEQ ID NO: 441619 - DNA, 25 bp, Mus musculus
gaattctagtggtgagatccagtct

SEQ ID NO: 441620 - DNA, 25 bp, Mus musculus
gaattctataccctctgacctcttt

SEQ ID NO: 441621 - DNA, 25 bp, Mus musculus
gaattctataccgtctgacctcttt

SEQ ID NO: 441622 - DNA, 25 bp, Mus musculus
gaattctatacgattgcaaacccca

SEQ ID NO: 441623 - DNA, 25 bp, Mus musculus
gaattctatacgtttgcaaacccca

SEQ ID NO: 441624 - DNA, 25 bp, Mus musculus
gaattctatactacagccaaggctg

SEQ ID NO: 441625 - DNA, 25 bp, Mus musculus
gaattctatacttcagccaaggctg

SEQ ID NO: 441626 - DNA, 25 bp, Mus musculus
gaattctatatccattccgatagcc

SEQ ID NO: 441627 - DNA, 25 bp, Mus musculus
gaattctatatcgattccgatagcc

SEQ ID NO: 441628 - DNA, 25 bp, Mus musculus
gaattctatcataccaggaatctgt

SEQ ID NO: 441629 - DNA, 25 bp, Mus musculus
gaattctatcattccaggaatctgt

SEQ ID NO: 441630 - DNA, 25 bp, Mus musculus
gaattctatgagctcgttaccaccc

SEQ ID NO: 441631 - DNA, 25 bp, Mus musculus
gaattctatgaggtcgttaccaccc

SEQ ID NO: 441632 - DNA, 25 bp, Mus musculus
gaattctatggacctattctgaaaa

SEQ ID NO: 441633 - DNA, 25 bp, Mus musculus
gaattctatggagctattctgaaaa

SEQ ID NO: 441634 - DNA, 25 bp, Mus musculus
gaattctattccatcatcttttcta

SEQ ID NO: 441635 - DNA, 25 bp, Mus musculus
gaattctattccttcatcttttcta

SEQ ID NO: 441636 - DNA, 25 bp, Mus musculus
gaattctcaaagacctgtggctagc

SEQ ID NO: 441637 - DNA, 25 bp, Mus musculus
gaattctcaaagtcctgtggctagc

SEQ ID NO: 441638 - DNA, 25 bp, Mus musculus
gaattctcaagactcgaaccctgaa

SEQ ID NO: 441639 - DNA, 25 bp, Mus musculus
gaattctcaagagtcgaaccctgaa

SEQ ID NO: 441640 - DNA, 25 bp, Mus musculus
gaattctcaatgagcctctaaccta

SEQ ID NO: 441641 - DNA, 25 bp, Mus musculus
gaattctcaatgtgcctctaaccta

SEQ ID NO: 441642 - DNA, 25 bp, Mus musculus
gaattctcacttctggatttccttt

SEQ ID NO: 441643 - DNA, 25 bp, Mus musculus
gaattctcacttgtggatttccttt

SEQ ID NO: 441644 - DNA, 25 bp, Mus musculus
gaattctcagcacagtaactcaaca

SEQ ID NO: 441645 - DNA, 25 bp, Mus musculus
gaattctcagcagagtaactcaaca

SEQ ID NO: 441646 - DNA, 25 bp, Mus musculus
gaattctcagccagcatccaaataa

SEQ ID NO: 441647 - DNA, 25 bp, Mus musculus
gaattctcagcctgcatccaaataa

SEQ ID NO: 441648 - DNA, 25 bp, Mus musculus
gaattctcagctcccataacactgg

SEQ ID NO: 441649 - DNA, 25 bp, Mus musculus
gaattctcagctgccataacactgg

SEQ ID NO: 441650 - DNA, 25 bp, Mus musculus
gaattctcaggtcaactttccagtt

SEQ ID NO: 441651 - DNA, 25 bp, Mus musculus
gaattctcaggtgaactttccagtt

SEQ ID NO: 441652 - DNA, 25 bp, Mus musculus
gaattctcagtgaaataagccaggc

SEQ ID NO: 441653 - DNA, 25 bp, Mus musculus
gaattctcagtgtaataagccaggc

SEQ ID NO: 441654 - DNA, 25 bp, Mus musculus
gaattctcatggcatttaactcttt

SEQ ID NO: 441655 - DNA, 25 bp, Mus musculus
gaattctcatgggatttaactcttt

SEQ ID NO: 441656 - DNA, 25 bp, Mus musculus
gaattctccaaactctcctaaagtg

SEQ ID NO: 441657 - DNA, 25 bp, Mus musculus
gaattctccaaagtctcctaaagtg

SEQ ID NO: 441658 - DNA, 25 bp, Mus musculus
gaattctccagaaaggtttgggaat

SEQ ID NO: 441659 - DNA, 25 bp, Mus musculus
gaattctccagataggtttgggaat

SEQ ID NO: 441660 - DNA, 25 bp, Mus musculus
gaattctccctgaaaaactggcaag

SEQ ID NO: 441661 - DNA, 25 bp, Mus musculus
gaattctccctgtaaaactggcaag

SEQ ID NO: 441662 - DNA, 25 bp, Mus musculus
gaattctccgctactggatctagat

SEQ ID NO: 441663 - DNA, 25 bp, Mus musculus
gaattctccgcttctggatctagat

SEQ ID NO: 441664 - DNA, 25 bp, Mus musculus
gaattctccttacagttctgacctt

SEQ ID NO: 441665 - DNA, 25 bp, Mus musculus
gaattctccttagagttctgacctt

SEQ ID NO: 441666 - DNA, 25 bp, Mus musculus
gaattctcgaggacatgttgtagtg

SEQ ID NO: 441667 - DNA, 25 bp, Mus musculus
gaattctcgaggtcatgttgtagtg

SEQ ID NO: 441668 - DNA, 25 bp, Mus musculus
gaattctcggtgctatagcctttca

SEQ ID NO: 441669 - DNA, 25 bp, Mus musculus
gaattctcggtggtatagcctttca

SEQ ID NO: 441670 - DNA, 25 bp, Mus musculus
gaattctcgtcgctgaactttgtag

SEQ ID NO: 441671 - DNA, 25 bp, Mus musculus
gaattctcgtcggtgaactttgtag

SEQ ID NO: 441672 - DNA, 25 bp, Mus musculus
gaattctctcccatggaggctttag

SEQ ID NO: 441673 - DNA, 25 bp, Mus musculus
gaattctctcccttggaggctttag

SEQ ID NO: 441674 - DNA, 25 bp, Mus musculus
gaattctctctcaagagctgcgtgc

SEQ ID NO: 441675 - DNA, 25 bp, Mus musculus
gaattctctctctagagctgcgtgc

SEQ ID NO: 441676 - DNA, 25 bp, Mus musculus
gaattctctgtaattgctgacccaa

SEQ ID NO: 441677 - DNA, 25 bp, Mus musculus
gaattctctgtatttgctgacccaa

SEQ ID NO: 441678 - DNA, 25 bp, Mus musculus
gaattctctgtcatttgtgtctatt

SEQ ID NO: 441679 - DNA, 25 bp, Mus musculus
gaattctctgtcttttgtgtctatt

SEQ ID NO: 441680 - DNA, 25 bp, Mus musculus
gaattctctgtgcagaacactacag

SEQ ID NO: 441681 - DNA, 25 bp, Mus musculus
gaattctctgtggagaacactacag

SEQ ID NO: 441682 - DNA, 25 bp, Mus musculus
gaattctcttaacgtgcatagtaaa

SEQ ID NO: 441683 - DNA, 25 bp, Mus musculus
gaattctcttaaggtgcatagtaaa

SEQ ID NO: 441684 - DNA, 25 bp, Mus musculus
gaattctcttcaactgtggtggagt

SEQ ID NO: 441685 - DNA, 25 bp, Mus musculus
gaattctcttcatctgtggtggagt

SEQ ID NO: 441686 - DNA, 25 bp, Mus musculus
gaattctcttctatcaatttggagc

SEQ ID NO: 441687 - DNA, 25 bp, Mus musculus
gaattctcttctcaccgatttccac

SEQ ID NO: 441688 - DNA, 25 bp, Mus musculus
gaattctcttctgaccgatttccac

SEQ ID NO: 441689 - DNA, 25 bp, Mus musculus
gaattctcttctttcaatttggagc

SEQ ID NO: 441690 - DNA, 25 bp, Mus musculus
gaattctctttacactcttgtgttt

SEQ ID NO: 441691 - DNA, 25 bp, Mus musculus
gaattctctttagactcttgtgttt

SEQ ID NO: 441692 - DNA, 25 bp, Mus musculus
gaattctctttgcaaactatgccag

SEQ ID NO: 441693 - DNA, 25 bp, Mus musculus
gaattctctttggaaactatgccag

SEQ ID NO: 441694 - DNA, 25 bp, Mus musculus
gaattctgaaacatgtgacaaggca

SEQ ID NO: 441695 - DNA, 25 bp, Mus musculus
gaattctgaaacttgtgacaaggca

SEQ ID NO: 441696 - DNA, 25 bp, Mus musculus
gaattctgaatcactttatgtaaga

SEQ ID NO: 441697 - DNA, 25 bp, Mus musculus
gaattctgaatccatagttttcagt

SEQ ID NO: 441698 - DNA, 25 bp, Mus musculus
gaattctgaatcctaccaagcactg

SEQ ID NO: 441699 - DNA, 25 bp, Mus musculus
gaattctgaatcgatagttttcagt

SEQ ID NO: 441700 - DNA, 25 bp, Mus musculus
gaattctgaatcgtaccaagcactg

SEQ ID NO: 441701 - DNA, 25 bp, Mus musculus
gaattctgaatctctttatgtaaga

SEQ ID NO: 441702 - DNA, 25 bp, Mus musculus
gaattctgaattacctgtcatactt

SEQ ID NO: 441703 - DNA, 25 bp, Mus musculus
gaattctgaatttcctgtcatactt

SEQ ID NO: 441704 - DNA, 25 bp, Mus musculus
gaattctgactcacacaaccaatga

SEQ ID NO: 441705 - DNA, 25 bp, Mus musculus
gaattctgactctcacaaccaatga

SEQ ID NO: 441706 - DNA, 25 bp, Mus musculus
gaattctgactgctggtacttgtat

SEQ ID NO: 441707 - DNA, 25 bp, Mus musculus
gaattctgactggtggtacttgtat

SEQ ID NO: 441708 - DNA, 25 bp, Mus musculus
gaattctgagctactgtcttataca

SEQ ID NO: 441709 - DNA, 25 bp, Mus musculus
gaattctgagcttctgtcttataca

SEQ ID NO: 441710 - DNA, 25 bp, Mus musculus
gaattctgcactcaaagactgtcta

SEQ ID NO: 441711 - DNA, 25 bp, Mus musculus
gaattctgcactgaaagactgtcta

SEQ ID NO: 441712 - DNA, 25 bp, Mus musculus
gaattctgcagacgtgtgttcttcc

SEQ ID NO: 441713 - DNA, 25 bp, Mus musculus
gaattctgcagaggtgtgttcttcc

SEQ ID NO: 441714 - DNA, 25 bp, Mus musculus
gaattctgccttaacacttctttga

SEQ ID NO: 441715 - DNA, 25 bp, Mus musculus
gaattctgccttagggtgacaaatg

SEQ ID NO: 441716 - DNA, 25 bp, Mus musculus
gaattctgccttctctatttattat

SEQ ID NO: 441717 - DNA, 25 bp, Mus musculus
gaattctgccttgtctatttattat

SEQ ID NO: 441718 - DNA, 25 bp, Mus musculus
gaattctgcctttacacttctttga

SEQ ID NO: 441719 - DNA, 25 bp, Mus musculus
gaattctgcctttgggtgacaaatg

SEQ ID NO: 441720 - DNA, 25 bp, Mus musculus
gaattctgcgtactcactcggtaac

SEQ ID NO: 441721 - DNA, 25 bp, Mus musculus
gaattctgcgtagtcactcggtaac

SEQ ID NO: 441722 - DNA, 25 bp, Mus musculus
gaattctgctatatttgaccttggc

SEQ ID NO: 441723 - DNA, 25 bp, Mus musculus
gaattctgctatttttgaccttggc

SEQ ID NO: 441724 - DNA, 25 bp, Mus musculus
gaattctggaatcttgatttcttaa

SEQ ID NO: 441725 - DNA, 25 bp, Mus musculus
gaattctggaatgttgatttcttaa

SEQ ID NO: 441726 - DNA, 25 bp, Mus musculus
gaattctggattattacttcctgtg

SEQ ID NO: 441727 - DNA, 25 bp, Mus musculus
gaattctggatttttacttcctgtg

SEQ ID NO: 441728 - DNA, 25 bp, Mus musculus
gaattctggcccacactattgagca

SEQ ID NO: 441729 - DNA, 25 bp, Mus musculus
gaattctggccctcactattgagca

SEQ ID NO: 441730 - DNA, 25 bp, Mus musculus
gaattctggcctacagagttggttt

SEQ ID NO: 441731 - DNA, 25 bp, Mus musculus
gaattctggccttcagagttggttt

SEQ ID NO: 441732 - DNA, 25 bp, Mus musculus
gaattctgggacactccgttcagcg

SEQ ID NO: 441733 - DNA, 25 bp, Mus musculus
gaattctgggactctccgttcagcg

SEQ ID NO: 441734 - DNA, 25 bp, Mus musculus
gaattctgggccaattttagctgaa

SEQ ID NO: 441735 - DNA, 25 bp, Mus musculus
gaattctgggcctattttagctgaa

SEQ ID NO: 441736 - DNA, 25 bp, Mus musculus
gaattctggtttcgcgtgatcctgc

SEQ ID NO: 441737 - DNA, 25 bp, Mus musculus
gaattctggtttggcgtgatcctgc

SEQ ID NO: 441738 - DNA, 25 bp, Mus musculus
gaattctgtacgaccttcttaatcc

SEQ ID NO: 441739 - DNA, 25 bp, Mus musculus
gaattctgtacgtccttcttaatcc

SEQ ID NO: 441740 - DNA, 25 bp, Mus musculus
gaattctgtagcacacctcataggt

SEQ ID NO: 441741 - DNA, 25 bp, Mus musculus
gaattctgtagctcacctcataggt

SEQ ID NO: 441742 - DNA, 25 bp, Mus musculus
gaattctgtcaaagttccatagatg

SEQ ID NO: 441743 - DNA, 25 bp, Mus musculus
gaattctgtcaatgttccatagatg

SEQ ID NO: 441744 - DNA, 25 bp, Mus musculus
gaattctgtcatctatttgttttta

SEQ ID NO: 441745 - DNA, 25 bp, Mus musculus
gaattctgtcatgtatttgttttta

SEQ ID NO: 441746 - DNA, 25 bp, Mus musculus
gaattctgtcctcggaatctgggaa

SEQ ID NO: 441747 - DNA, 25 bp, Mus musculus
gaattctgtcctgggaatctgggaa

SEQ ID NO: 441748 - DNA, 25 bp, Mus musculus
gaattctgtgaacagtcgggccaga

SEQ ID NO: 441749 - DNA, 25 bp, Mus musculus
gaattctgtgaacccgcatttgtgg

SEQ ID NO: 441750 - DNA, 25 bp, Mus musculus
gaattctgtgaagagtcgggccaga

SEQ ID NO: 441751 - DNA, 25 bp, Mus musculus
gaattctgtgaagccgcatttgtgg

SEQ ID NO: 441752 - DNA, 25 bp, Mus musculus
gaattctgtgcaaaaggacttaagt

SEQ ID NO: 441753 - DNA, 25 bp, Mus musculus
gaattctgtgcataaggacttaagt

SEQ ID NO: 441754 - DNA, 25 bp, Mus musculus
gaattctgtggcactccgaagaacc

SEQ ID NO: 441755 - DNA, 25 bp, Mus musculus
gaattctgtggcagtcctctcagga

SEQ ID NO: 441756 - DNA, 25 bp, Mus musculus
gaattctgtggctctccgaagaacc

SEQ ID NO: 441757 - DNA, 25 bp, Mus musculus
gaattctgtggctgtcctctcagga

SEQ ID NO: 441758 - DNA, 25 bp, Mus musculus
gaattctgtgttaaaggagctcttg

SEQ ID NO: 441759 - DNA, 25 bp, Mus musculus
gaattctgtgtttaaggagctcttg

SEQ ID NO: 441760 - DNA, 25 bp, Mus musculus
gaattctgttcacctctgtgatcca

SEQ ID NO: 441761 - DNA, 25 bp, Mus musculus
gaattctgttcagctctgtgatcca

SEQ ID NO: 441762 - DNA, 25 bp, Mus musculus
gaattctgttgtccaaatgtctcct

SEQ ID NO: 441763 - DNA, 25 bp, Mus musculus
gaattctgttgtgcaaatgtctcct

SEQ ID NO: 441764 - DNA, 25 bp, Mus musculus
gaattctgtttcctaggcaaatact

SEQ ID NO: 441765 - DNA, 25 bp, Mus musculus
gaattctgtttcgtaggcaaatact

SEQ ID NO: 441766 - DNA, 25 bp, Mus musculus
gaattcttaactctatttagcaact

SEQ ID NO: 441767 - DNA, 25 bp, Mus musculus
gaattcttaactgtatttagcaact

SEQ ID NO: 441768 - DNA, 25 bp, Mus musculus
gaattcttacatctttcctgttcag

SEQ ID NO: 441769 - DNA, 25 bp, Mus musculus
gaattcttacatgtttcctgttcag

SEQ ID NO: 441770 - DNA, 25 bp, Mus musculus
gaattcttacccaaatgcagcatcc

SEQ ID NO: 441771 - DNA, 25 bp, Mus musculus
gaattcttaccctaatgcagcatcc

SEQ ID NO: 441772 - DNA, 25 bp, Mus musculus
gaattcttagatatgattatcccag

SEQ ID NO: 441773 - DNA, 25 bp, Mus musculus
gaattcttagatttgattatcccag

SEQ ID NO: 441774 - DNA, 25 bp, Mus musculus
gaattcttaggtattcattgcgctt

SEQ ID NO: 441775 - DNA, 25 bp, Mus musculus
gaattcttaggttttcattgcgctt

SEQ ID NO: 441776 - DNA, 25 bp, Mus musculus
gaattcttagtcacttgtgctgtgc

SEQ ID NO: 441777 - DNA, 25 bp, Mus musculus
gaattcttagtctcttgtgctgtgc

SEQ ID NO: 441778 - DNA, 25 bp, Mus musculus
gaattcttagtgatcacgttcccac

SEQ ID NO: 441779 - DNA, 25 bp, Mus musculus
gaattcttagtgttcacgttcccac

SEQ ID NO: 441780 - DNA, 25 bp, Mus musculus
gaattcttagttatcagggagggtc

SEQ ID NO: 441781 - DNA, 25 bp, Mus musculus
gaattcttagttttcagggagggtc

SEQ ID NO: 441782 - DNA, 25 bp, Mus musculus
gaattcttatacatatggacctcag

SEQ ID NO: 441783 - DNA, 25 bp, Mus musculus
gaattcttatacttatggacctcag

SEQ ID NO: 441784 - DNA, 25 bp, Mus musculus
gaattcttattcaaccctagcactt

SEQ ID NO: 441785 - DNA, 25 bp, Mus musculus
gaattcttattctaccctagcactt

SEQ ID NO: 441786 - DNA, 25 bp, Mus musculus
gaattcttcaaaactccctgatctc

SEQ ID NO: 441787 - DNA, 25 bp, Mus musculus
gaattcttcaaatctccctgatctc

SEQ ID NO: 441788 - DNA, 25 bp, Mus musculus
gaattcttcctaccaggtgtttttt

SEQ ID NO: 441789 - DNA, 25 bp, Mus musculus
gaattcttcctagcaggtgtttttt

SEQ ID NO: 441790 - DNA, 25 bp, Mus musculus
gaattcttcctgacaaggtactcat

SEQ ID NO: 441791 - DNA, 25 bp, Mus musculus
gaattcttcctgtcaaggtactcat

SEQ ID NO: 441792 - DNA, 25 bp, Mus musculus
gaattcttcgaaagtctgaccctga

SEQ ID NO: 441793 - DNA, 25 bp, Mus musculus
gaattcttcgaatgtctgaccctga

SEQ ID NO: 441794 - DNA, 25 bp, Mus musculus
gaattcttctaaccactcaatcatg

SEQ ID NO: 441795 - DNA, 25 bp, Mus musculus
gaattcttctaagcactcaatcatg

SEQ ID NO: 441796 - DNA, 25 bp, Mus musculus
gaattcttctatataagcactttcg

SEQ ID NO: 441797 - DNA, 25 bp, Mus musculus
gaattcttctatcttgggctctttg

SEQ ID NO: 441798 - DNA, 25 bp, Mus musculus
gaattcttctatgttgggctctttg

SEQ ID NO: 441799 - DNA, 25 bp, Mus musculus
gaattcttctatttaagcactttcg

SEQ ID NO: 441800 - DNA, 25 bp, Mus musculus
gaattcttctcaatctgtaaacaga

SEQ ID NO: 441801 - DNA, 25 bp, Mus musculus
gaattcttctcattctgtaaacaga

SEQ ID NO: 441802 - DNA, 25 bp, Mus musculus
gaattcttctgtacaatgttacgtg

SEQ ID NO: 441803 - DNA, 25 bp, Mus musculus
gaattcttctgtactttatagacaa

SEQ ID NO: 441804 - DNA, 25 bp, Mus musculus
gaattcttctgttcaatgttacgtg

SEQ ID NO: 441805 - DNA, 25 bp, Mus musculus
gaattcttctgttctttatagacaa

SEQ ID NO: 441806 - DNA, 25 bp, Mus musculus
gaattcttgatcaaggatgcctgta

SEQ ID NO: 441807 - DNA, 25 bp, Mus musculus
gaattcttgatctaggatgcctgta

SEQ ID NO: 441808 - DNA, 25 bp, Mus musculus
gaattcttgcagctgattggctaca

SEQ ID NO: 441809 - DNA, 25 bp, Mus musculus
gaattcttgcaggtgattggctaca

SEQ ID NO: 441810 - DNA, 25 bp, Mus musculus
gaattcttgctactgttacggcggc

SEQ ID NO: 441811 - DNA, 25 bp, Mus musculus
gaattcttgctagtgttacggcggc

SEQ ID NO: 441812 - DNA, 25 bp, Mus musculus
gaattcttgctgaggagcccaggct

SEQ ID NO: 441813 - DNA, 25 bp, Mus musculus
gaattcttgctgtggagcccaggct

SEQ ID NO: 441814 - DNA, 25 bp, Mus musculus
gaattcttgcttaaacaaagtgaaa

SEQ ID NO: 441815 - DNA, 25 bp, Mus musculus
gaattcttgcttcctgcatggtgca

SEQ ID NO: 441816 - DNA, 25 bp, Mus musculus
gaattcttgcttgctgcatggtgca

SEQ ID NO: 441817 - DNA, 25 bp, Mus musculus
gaattcttgctttaacaaagtgaaa

SEQ ID NO: 441818 - DNA, 25 bp, Mus musculus
gaattcttggatcgcgaaggacgca

SEQ ID NO: 441819 - DNA, 25 bp, Mus musculus
gaattcttggatggcgaaggacgca

SEQ ID NO: 441820 - DNA, 25 bp, Mus musculus
gaattcttgggaactggtacccact

SEQ ID NO: 441821 - DNA, 25 bp, Mus musculus
gaattcttgggacctcttcattaag

SEQ ID NO: 441822 - DNA, 25 bp, Mus musculus
gaattcttgggagctcttcattaag

SEQ ID NO: 441823 - DNA, 25 bp, Mus musculus
gaattcttgggatctggtacccact

SEQ ID NO: 441824 - DNA, 25 bp, Mus musculus
gaattcttggtacgactttgctagt

SEQ ID NO: 441825 - DNA, 25 bp, Mus musculus
gaattcttggtaggactttgctagt

SEQ ID NO: 441826 - DNA, 25 bp, Mus musculus
gaattcttggtcactacacaccgaa

SEQ ID NO: 441827 - DNA, 25 bp, Mus musculus
gaattcttggtcatgtaggtcatca

SEQ ID NO: 441828 - DNA, 25 bp, Mus musculus
gaattcttggtctctacacaccgaa

SEQ ID NO: 441829 - DNA, 25 bp, Mus musculus
gaattcttggtcttgtaggtcatca

SEQ ID NO: 441830 - DNA, 25 bp, Mus musculus
gaattctttaacagtggtcccttgg

SEQ ID NO: 441831 - DNA, 25 bp, Mus musculus
gaattctttaactgtggtcccttgg

SEQ ID NO: 441832 - DNA, 25 bp, Mus musculus
gaattctttaagatgtgaccttggc

SEQ ID NO: 441833 - DNA, 25 bp, Mus musculus
gaattctttaagttgtgaccttggc

SEQ ID NO: 441834 - DNA, 25 bp, Mus musculus
gaattctttacactatactctacta

SEQ ID NO: 441835 - DNA, 25 bp, Mus musculus
gaattctttacagtatactctacta

SEQ ID NO: 441836 - DNA, 25 bp, Mus musculus
gaattctttataaactgtggacatg

SEQ ID NO: 441837 - DNA, 25 bp, Mus musculus
gaattctttatatactgtggacatg

SEQ ID NO: 441838 - DNA, 25 bp, Mus musculus
gaattctttatccatggtagccata

SEQ ID NO: 441839 - DNA, 25 bp, Mus musculus
gaattctttatcgatggtagccata

SEQ ID NO: 441840 - DNA, 25 bp, Mus musculus
gaattctttattctctcagggttag

SEQ ID NO: 441841 - DNA, 25 bp, Mus musculus
gaattctttattgtctcagggttag

SEQ ID NO: 441842 - DNA, 25 bp, Mus musculus
gaattctttcacacttttgcagaaa

SEQ ID NO: 441843 - DNA, 25 bp, Mus musculus
gaattctttcactcttttgcagaaa

SEQ ID NO: 441844 - DNA, 25 bp, Mus musculus
gaattctttcgacccactgagcagg

SEQ ID NO: 441845 - DNA, 25 bp, Mus musculus
gaattctttcgagccactgagcagg

SEQ ID NO: 441846 - DNA, 25 bp, Mus musculus
gaattctttctaccgctcttattta

SEQ ID NO: 441847 - DNA, 25 bp, Mus musculus
gaattctttctagcgctcttattta

SEQ ID NO: 441848 - DNA, 25 bp, Mus musculus
gaattctttgcaagttcagagtaga

SEQ ID NO: 441849 - DNA, 25 bp, Mus musculus
gaattctttgcatgttcagagtaga

SEQ ID NO: 441850 - DNA, 25 bp, Mus musculus
gaattctttggaatgcgctccaaag

SEQ ID NO: 441851 - DNA, 25 bp, Mus musculus
gaattctttggattgcgctccaaag

SEQ ID NO: 441852 - DNA, 25 bp, Mus musculus
gaattctttggcaggttcttaagta

SEQ ID NO: 441853 - DNA, 25 bp, Mus musculus
gaattctttggctggttcttaagta

SEQ ID NO: 441854 - DNA, 25 bp, Mus musculus
gaattctttgttcttgccagtgctc

SEQ ID NO: 441855 - DNA, 25 bp, Mus musculus
gaattctttgttgttgccagtgctc

SEQ ID NO: 441856 - DNA, 25 bp, Mus musculus
gaattcttttgccaagtccattgag

SEQ ID NO: 441857 - DNA, 25 bp, Mus musculus
gaattcttttgcgaagtccattgag

SEQ ID NO: 441858 - DNA, 25 bp, Mus musculus
gaattctttttccatctgagagaca

SEQ ID NO: 441859 - DNA, 25 bp, Mus musculus
gaattctttttcctggtgatctcta

SEQ ID NO: 441860 - DNA, 25 bp, Mus musculus
gaattctttttcgatctgagagaca

SEQ ID NO: 441861 - DNA, 25 bp, Mus musculus
gaattctttttcgtggtgatctcta

SEQ ID NO: 441862 - DNA, 25 bp, Mus musculus
gaattgaaaagtagccagtctcaaa

SEQ ID NO: 441863 - DNA, 25 bp, Mus musculus
gaattgaaaagttgccagtctcaaa

SEQ ID NO: 441864 - DNA, 25 bp, Mus musculus
gaattgaaaatgatggtgctggaga

SEQ ID NO: 441865 - DNA, 25 bp, Mus musculus
gaattgaaaatgttggtgctggaga

SEQ ID NO: 441866 - DNA, 25 bp, Mus musculus
gaattgaaacctactaatacataga

SEQ ID NO: 441867 - DNA, 25 bp, Mus musculus
gaattgaaacctctcccatctgtag

SEQ ID NO: 441868 - DNA, 25 bp, Mus musculus
gaattgaaacctgtcccatctgtag

SEQ ID NO: 441869 - DNA, 25 bp, Mus musculus
gaattgaaaccttctaatacataga

SEQ ID NO: 441870 - DNA, 25 bp, Mus musculus
gaattgaaacttccagtctgtgagc

SEQ ID NO: 441871 - DNA, 25 bp, Mus musculus
gaattgaaacttgcagtctgtgagc

SEQ ID NO: 441872 - DNA, 25 bp, Mus musculus
gaattgaaaggactcgtgattgtta

SEQ ID NO: 441873 - DNA, 25 bp, Mus musculus
gaattgaaaggagtcgtgattgtta

SEQ ID NO: 441874 - DNA, 25 bp, Mus musculus
gaattgaaagttcctagacagccgg

SEQ ID NO: 441875 - DNA, 25 bp, Mus musculus
gaattgaaagttgctagacagccgg

SEQ ID NO: 441876 - DNA, 25 bp, Mus musculus
gaattgaacagcactactttgaaga

SEQ ID NO: 441877 - DNA, 25 bp, Mus musculus
gaattgaacagctctactttgaaga

SEQ ID NO: 441878 - DNA, 25 bp, Mus musculus
gaattgaacccccttctctgtgaca

SEQ ID NO: 441879 - DNA, 25 bp, Mus musculus
gaattgaaccccgttctctgtgaca

SEQ ID NO: 441880 - DNA, 25 bp, Mus musculus
gaattgaacgctagcctgggcaact

SEQ ID NO: 441881 - DNA, 25 bp, Mus musculus
gaattgaacgcttgcctgggcaact

SEQ ID NO: 441882 - DNA, 25 bp, Mus musculus
gaattgaacggcatcagcatctcct

SEQ ID NO: 441883 - DNA, 25 bp, Mus musculus
gaattgaacggcttcagcatctcct

SEQ ID NO: 441884 - DNA, 25 bp, Mus musculus
gaattgaactttctaggtggagtca

SEQ ID NO: 441885 - DNA, 25 bp, Mus musculus
gaattgaactttgtaggtggagtca

SEQ ID NO: 441886 - DNA, 25 bp, Mus musculus
gaattgaagaatcccatcctgcaca

SEQ ID NO: 441887 - DNA, 25 bp, Mus musculus
gaattgaagaatgccatcctgcaca

SEQ ID NO: 441888 - DNA, 25 bp, Mus musculus
gaattgaagagaaccctgtatgccc

SEQ ID NO: 441889 - DNA, 25 bp, Mus musculus
gaattgaagagatccctgtatgccc

SEQ ID NO: 441890 - DNA, 25 bp, Mus musculus
gaattgaaggcaatccttgttttta

SEQ ID NO: 441891 - DNA, 25 bp, Mus musculus
gaattgaaggcattccttgttttta

SEQ ID NO: 441892 - DNA, 25 bp, Mus musculus
gaattgaataccacctgtgacacgt

SEQ ID NO: 441893 - DNA, 25 bp, Mus musculus
gaattgaatacctcctgtgacacgt

SEQ ID NO: 441894 - DNA, 25 bp, Mus musculus
gaattgaatggtactccttctgatg

SEQ ID NO: 441895 - DNA, 25 bp, Mus musculus
gaattgaatggttctccttctgatg

SEQ ID NO: 441896 - DNA, 25 bp, Mus musculus
gaattgacaactcggcttcgtgcga

SEQ ID NO: 441897 - DNA, 25 bp, Mus musculus
gaattgacaactgggcttcgtgcga

SEQ ID NO: 441898 - DNA, 25 bp, Mus musculus
gaattgacaattcgctccttcccta

SEQ ID NO: 441899 - DNA, 25 bp, Mus musculus
gaattgacaattggctccttcccta

SEQ ID NO: 441900 - DNA, 25 bp, Mus musculus
gaattgacacggagaggcccatcat

SEQ ID NO: 441901 - DNA, 25 bp, Mus musculus
gaattgacacggtgaggcccatcat

SEQ ID NO: 441902 - DNA, 25 bp, Mus musculus
gaattgacagctatatgcattcata

SEQ ID NO: 441903 - DNA, 25 bp, Mus musculus
gaattgacagctttatgcattcata

SEQ ID NO: 441904 - DNA, 25 bp, Mus musculus
gaattgaccagaatgctagcagaag

SEQ ID NO: 441905 - DNA, 25 bp, Mus musculus
gaattgaccagacctactaaaccat

SEQ ID NO: 441906 - DNA, 25 bp, Mus musculus
gaattgaccagagctactaaaccat

SEQ ID NO: 441907 - DNA, 25 bp, Mus musculus
gaattgaccagattgctagcagaag

SEQ ID NO: 441908 - DNA, 25 bp, Mus musculus
gaattgaccatgctcatttttgata

SEQ ID NO: 441909 - DNA, 25 bp, Mus musculus
gaattgaccatggtcatttttgata

SEQ ID NO: 441910 - DNA, 25 bp, Mus musculus
gaattgaccctaaccactgaagaag

SEQ ID NO: 441911 - DNA, 25 bp, Mus musculus
gaattgaccctatccactgaagaag

SEQ ID NO: 441912 - DNA, 25 bp, Mus musculus
gaattgacggaacggcaccaccagg

SEQ ID NO: 441913 - DNA, 25 bp, Mus musculus
gaattgacggaagggcaccaccagg

SEQ ID NO: 441914 - DNA, 25 bp, Mus musculus
gaattgacgttaatgtgttttcact

SEQ ID NO: 441915 - DNA, 25 bp, Mus musculus
gaattgacgttattgtgttttcact

SEQ ID NO: 441916 - DNA, 25 bp, Mus musculus
gaattgactccaataggagtgaaat

SEQ ID NO: 441917 - DNA, 25 bp, Mus musculus
gaattgactccattaggagtgaaat

SEQ ID NO: 441918 - DNA, 25 bp, Mus musculus
gaattgactcggacgcacagaggct

SEQ ID NO: 441919 - DNA, 25 bp, Mus musculus
gaattgactcggtcgcacagaggct

SEQ ID NO: 441920 - DNA, 25 bp, Mus musculus
gaattgactcttacggagctgcatg

SEQ ID NO: 441921 - DNA, 25 bp, Mus musculus
gaattgactctttcggagctgcatg

SEQ ID NO: 441922 - DNA, 25 bp, Mus musculus
gaattgactgagagcgcccagtctt

SEQ ID NO: 441923 - DNA, 25 bp, Mus musculus
gaattgactgagtgcgcccagtctt

SEQ ID NO: 441924 - DNA, 25 bp, Mus musculus
gaattgacttcaaccggtaagcgtt

SEQ ID NO: 441925 - DNA, 25 bp, Mus musculus
gaattgacttcatccggtaagcgtt

SEQ ID NO: 441926 - DNA, 25 bp, Mus musculus
gaattgacttcccagaacttgctaa

SEQ ID NO: 441927 - DNA, 25 bp, Mus musculus
gaattgacttccgagaacttgctaa

SEQ ID NO: 441928 - DNA, 25 bp, Mus musculus
gaattgactttcacaggtggctttt

SEQ ID NO: 441929 - DNA, 25 bp, Mus musculus
gaattgactttctcaggtggctttt

SEQ ID NO: 441930 - DNA, 25 bp, Mus musculus
gaattgagaaacacgcccgcattga

SEQ ID NO: 441931 - DNA, 25 bp, Mus musculus
gaattgagaaactcgcccgcattga

SEQ ID NO: 441932 - DNA, 25 bp, Mus musculus
gaattgagaagccagctctgagcag

SEQ ID NO: 441933 - DNA, 25 bp, Mus musculus
gaattgagaagcgagctctgagcag

SEQ ID NO: 441934 - DNA, 25 bp, Mus musculus
gaattgagacttacactctttcagg

SEQ ID NO: 441935 - DNA, 25 bp, Mus musculus
gaattgagactttcactctttcagg

SEQ ID NO: 441936 - DNA, 25 bp, Mus musculus
gaattgagattcaaccccaggtgat

SEQ ID NO: 441937 - DNA, 25 bp, Mus musculus
gaattgagattctaccccaggtgat

SEQ ID NO: 441938 - DNA, 25 bp, Mus musculus
gaattgagccatatgctctcttgtt

SEQ ID NO: 441939 - DNA, 25 bp, Mus musculus
gaattgagccatttgctctcttgtt

SEQ ID NO: 441940 - DNA, 25 bp, Mus musculus
gaattgagccttcgacttctcctgt

SEQ ID NO: 441941 - DNA, 25 bp, Mus musculus
gaattgagccttggacttctcctgt

SEQ ID NO: 441942 - DNA, 25 bp, Mus musculus
gaattgagctgtcatttgtacattt

SEQ ID NO: 441943 - DNA, 25 bp, Mus musculus
gaattgagctgtgatttgtacattt

SEQ ID NO: 441944 - DNA, 25 bp, Mus musculus
gaattgagcttcatgtcaaaacgga

SEQ ID NO: 441945 - DNA, 25 bp, Mus musculus
gaattgagcttcttgtcaaaacgga

SEQ ID NO: 441946 - DNA, 25 bp, Mus musculus
gaattgaggtttcccagcgatctct

SEQ ID NO: 441947 - DNA, 25 bp, Mus musculus
gaattgaggtttgccagcgatctct

SEQ ID NO: 441948 - DNA, 25 bp, Mus musculus
gaattgatacttccccttgtattaa

SEQ ID NO: 441949 - DNA, 25 bp, Mus musculus
gaattgatacttgcccttgtattaa

SEQ ID NO: 441950 - DNA, 25 bp, Mus musculus
gaattgatcaatcctcttggcttgt

SEQ ID NO: 441951 - DNA, 25 bp, Mus musculus
gaattgatcaatgctcttggcttgt

SEQ ID NO: 441952 - DNA, 25 bp, Mus musculus
gaattgatcctaacccagtggactc

SEQ ID NO: 441953 - DNA, 25 bp, Mus musculus
gaattgatcctatcccagtggactc

SEQ ID NO: 441954 - DNA, 25 bp, Mus musculus
gaattgatctcacagcctcgtatat

SEQ ID NO: 441955 - DNA, 25 bp, Mus musculus
gaattgatctcagagcctcgtatat

SEQ ID NO: 441956 - DNA, 25 bp, Mus musculus
gaattgatcttccttttgatactga

SEQ ID NO: 441957 - DNA, 25 bp, Mus musculus
gaattgatcttcgttttgatactga

SEQ ID NO: 441958 - DNA, 25 bp, Mus musculus
gaattgatgatgactcttgcagccc

SEQ ID NO: 441959 - DNA, 25 bp, Mus musculus
gaattgatgatgtctcttgcagccc

SEQ ID NO: 441960 - DNA, 25 bp, Mus musculus
gaattgatgtgtaccactaagccca

SEQ ID NO: 441961 - DNA, 25 bp, Mus musculus
gaattgatgtgttccactaagccca

SEQ ID NO: 441962 - DNA, 25 bp, Mus musculus
gaattgattccgagatacctagtta

SEQ ID NO: 441963 - DNA, 25 bp, Mus musculus
gaattgattccgtgatacctagtta

SEQ ID NO: 441964 - DNA, 25 bp, Mus musculus
gaattgattcttactgtggtacaag

SEQ ID NO: 441965 - DNA, 25 bp, Mus musculus
gaattgattctttctgtggtacaag

SEQ ID NO: 441966 - DNA, 25 bp, Mus musculus
gaattgattgctactctgaggtccc

SEQ ID NO: 441967 - DNA, 25 bp, Mus musculus
gaattgattgcttctctgaggtccc

SEQ ID NO: 441968 - DNA, 25 bp, Mus musculus
gaattgattgttactggcactaaga

SEQ ID NO: 441969 - DNA, 25 bp, Mus musculus
gaattgattgtttctggcactaaga

SEQ ID NO: 441970 - DNA, 25 bp, Mus musculus
gaattgatttacactgttctctgaa

SEQ ID NO: 441971 - DNA, 25 bp, Mus musculus
gaattgatttactctgttctctgaa

SEQ ID NO: 441972 - DNA, 25 bp, Mus musculus
gaattgcaaaccatcagtaactttt

SEQ ID NO: 441973 - DNA, 25 bp, Mus musculus
gaattgcaaaccttcagtaactttt

SEQ ID NO: 441974 - DNA, 25 bp, Mus musculus
gaattgcaaggaaccgtgggtgcca

SEQ ID NO: 441975 - DNA, 25 bp, Mus musculus
gaattgcaaggatccgtgggtgcca

SEQ ID NO: 441976 - DNA, 25 bp, Mus musculus
gaattgcaccgcaaacgatacggat

SEQ ID NO: 441977 - DNA, 25 bp, Mus musculus
gaattgcaccgctaacgatacggat

SEQ ID NO: 441978 - DNA, 25 bp, Mus musculus
gaattgcacctccaatgtttagttg

SEQ ID NO: 441979 - DNA, 25 bp, Mus musculus
gaattgcacctcgaatgtttagttg

SEQ ID NO: 441980 - DNA, 25 bp, Mus musculus
gaattgcacgtacctggtctccgat

SEQ ID NO: 441981 - DNA, 25 bp, Mus musculus
gaattgcacgtagctggtctccgat

SEQ ID NO: 441982 - DNA, 25 bp, Mus musculus
gaattgcacttaaccaaaactattg

SEQ ID NO: 441983 - DNA, 25 bp, Mus musculus
gaattgcacttatccaaaactattg

SEQ ID NO: 441984 - DNA, 25 bp, Mus musculus
gaattgcagaatacttccccagggc

SEQ ID NO: 441985 - DNA, 25 bp, Mus musculus
gaattgcagaattcttccccagggc

SEQ ID NO: 441986 - DNA, 25 bp, Mus musculus
gaattgcagacacctcctaaaatat

SEQ ID NO: 441987 - DNA, 25 bp, Mus musculus
gaattgcagacagctcctaaaatat

SEQ ID NO: 441988 - DNA, 25 bp, Mus musculus
gaattgcagcacactattcctgtgt

SEQ ID NO: 441989 - DNA, 25 bp, Mus musculus
gaattgcagcacaggtcccaatgga

SEQ ID NO: 441990 - DNA, 25 bp, Mus musculus
gaattgcagcactctattcctgtgt

SEQ ID NO: 441991 - DNA, 25 bp, Mus musculus
gaattgcagcactggtcccaatgga

SEQ ID NO: 441992 - DNA, 25 bp, Mus musculus
gaattgcagcatcaatctagagatc

SEQ ID NO: 441993 - DNA, 25 bp, Mus musculus
gaattgcagcatgaatctagagatc

SEQ ID NO: 441994 - DNA, 25 bp, Mus musculus
gaattgcaggcgaatgacatcacac

SEQ ID NO: 441995 - DNA, 25 bp, Mus musculus
gaattgcaggcgtatgacatcacac

SEQ ID NO: 441996 - DNA, 25 bp, Mus musculus
gaattgcagtgcctgcagcgctaca

SEQ ID NO: 441997 - DNA, 25 bp, Mus musculus
gaattgcagtgcgtgcagcgctaca

SEQ ID NO: 441998 - DNA, 25 bp, Mus musculus
gaattgcagtgtcctcacaagccaa

SEQ ID NO: 441999 - DNA, 25 bp, Mus musculus
gaattgcagtgtgctcacaagccaa

SEQ ID NO: 442000 - DNA, 25 bp, Mus musculus
gaattgcatcagctacctgtgggta

SEQ ID NO: 442001 - DNA, 25 bp, Mus musculus
gaattgcatcaggtacctgtgggta

SEQ ID NO: 442002 - DNA, 25 bp, Mus musculus
gaattgcatccaacgcaggcagcat

SEQ ID NO: 442003 - DNA, 25 bp, Mus musculus
gaattgcatccatcgcaggcagcat

SEQ ID NO: 442004 - DNA, 25 bp, Mus musculus
gaattgcatctaatctttgtgtgtt

SEQ ID NO: 442005 - DNA, 25 bp, Mus musculus
gaattgcatctattctttgtgtgtt

SEQ ID NO: 442006 - DNA, 25 bp, Mus musculus
gaattgcatttaatgcttggcatca

SEQ ID NO: 442007 - DNA, 25 bp, Mus musculus
gaattgcatttattgcttggcatca

SEQ ID NO: 442008 - DNA, 25 bp, Mus musculus
gaattgccaagtcatgctctgtgac

SEQ ID NO: 442009 - DNA, 25 bp, Mus musculus
gaattgccaagtgatgctctgtgac

SEQ ID NO: 442010 - DNA, 25 bp, Mus musculus
gaattgccaatcaagaccgccagga

SEQ ID NO: 442011 - DNA, 25 bp, Mus musculus
gaattgccaatctagaccgccagga

SEQ ID NO: 442012 - DNA, 25 bp, Mus musculus
gaattgccacaacagtctcatcaag

SEQ ID NO: 442013 - DNA, 25 bp, Mus musculus
gaattgccacaagagtctcatcaag

SEQ ID NO: 442014 - DNA, 25 bp, Mus musculus
gaattgccacttctagggctagaca

SEQ ID NO: 442015 - DNA, 25 bp, Mus musculus
gaattgccacttgtagggctagaca

SEQ ID NO: 442016 - DNA, 25 bp, Mus musculus
gaattgccatcaccagaggactata

SEQ ID NO: 442017 - DNA, 25 bp, Mus musculus
gaattgccatcagcagaggactata

SEQ ID NO: 442018 - DNA, 25 bp, Mus musculus
gaattgccattccaggatgtttgga

SEQ ID NO: 442019 - DNA, 25 bp, Mus musculus
gaattgccattcgaggatgtttgga

SEQ ID NO: 442020 - DNA, 25 bp, Mus musculus
gaattgcccatcaatataattggtt

SEQ ID NO: 442021 - DNA, 25 bp, Mus musculus
gaattgcccatctatataattggtt

SEQ ID NO: 442022 - DNA, 25 bp, Mus musculus
gaattgcccattctgcagaaaccag

SEQ ID NO: 442023 - DNA, 25 bp, Mus musculus
gaattgcccattgtgcagaaaccag

SEQ ID NO: 442024 - DNA, 25 bp, Mus musculus
gaattgcccgaaatacattgttgat

SEQ ID NO: 442025 - DNA, 25 bp, Mus musculus
gaattgcccgaattacattgttgat

SEQ ID NO: 442026 - DNA, 25 bp, Mus musculus
gaattgcccgttaataacctttgct

SEQ ID NO: 442027 - DNA, 25 bp, Mus musculus
gaattgcccgtttataacctttgct

SEQ ID NO: 442028 - DNA, 25 bp, Mus musculus
gaattgcccttgaccaccggaaaga

SEQ ID NO: 442029 - DNA, 25 bp, Mus musculus
gaattgcccttgtccaccggaaaga

SEQ ID NO: 442030 - DNA, 25 bp, Mus musculus
gaattgcctatgagagctttccaag

SEQ ID NO: 442031 - DNA, 25 bp, Mus musculus
gaattgcctatgtgagctttccaag

SEQ ID NO: 442032 - DNA, 25 bp, Mus musculus
gaattgcctcataggaaatggaatt

SEQ ID NO: 442033 - DNA, 25 bp, Mus musculus
gaattgcctcattggaaatggaatt

SEQ ID NO: 442034 - DNA, 25 bp, Mus musculus
gaattgcctctcagtatgcgagctg

SEQ ID NO: 442035 - DNA, 25 bp, Mus musculus
gaattgcctctctgtatgcgagctg

SEQ ID NO: 442036 - DNA, 25 bp, Mus musculus
gaattgcctgatctctctgagttta

SEQ ID NO: 442037 - DNA, 25 bp, Mus musculus
gaattgcctgatcttaagaatgttt

SEQ ID NO: 442038 - DNA, 25 bp, Mus musculus
gaattgcctgatgtctctgagttta

SEQ ID NO: 442039 - DNA, 25 bp, Mus musculus
gaattgcctgatgttaagaatgttt

SEQ ID NO: 442040 - DNA, 25 bp, Mus musculus
gaattgcctgctctgttttctcaaa

SEQ ID NO: 442041 - DNA, 25 bp, Mus musculus
gaattgcctgctgtgttttctcaaa

SEQ ID NO: 442042 - DNA, 25 bp, Mus musculus
gaattgcctgtaagggtaatactta

SEQ ID NO: 442043 - DNA, 25 bp, Mus musculus
gaattgcctgtatgggtaatactta

SEQ ID NO: 442044 - DNA, 25 bp, Mus musculus
gaattgcctgttcatgaggacctta

SEQ ID NO: 442045 - DNA, 25 bp, Mus musculus
gaattgcctgttgatgaggacctta

SEQ ID NO: 442046 - DNA, 25 bp, Mus musculus
gaattgccttatcatcctacttcaa

SEQ ID NO: 442047 - DNA, 25 bp, Mus musculus
gaattgccttatgatcctacttcaa

SEQ ID NO: 442048 - DNA, 25 bp, Mus musculus
gaattgccttttactcacattgtct

SEQ ID NO: 442049 - DNA, 25 bp, Mus musculus
gaattgcctttttctcacattgtct

SEQ ID NO: 442050 - DNA, 25 bp, Mus musculus
gaattgcgatttatctttcacggga

SEQ ID NO: 442051 - DNA, 25 bp, Mus musculus
gaattgcgatttttctttcacggga

SEQ ID NO: 442052 - DNA, 25 bp, Mus musculus
gaattgcgccttctgtttggataca

SEQ ID NO: 442053 - DNA, 25 bp, Mus musculus
gaattgcgccttgtgtttggataca

SEQ ID NO: 442054 - DNA, 25 bp, Mus musculus
gaattgcggcttctgcttaaggaca

SEQ ID NO: 442055 - DNA, 25 bp, Mus musculus
gaattgcggcttgtgcttaaggaca

SEQ ID NO: 442056 - DNA, 25 bp, Mus musculus
gaattgctacacatttaacttctat

SEQ ID NO: 442057 - DNA, 25 bp, Mus musculus
gaattgctacacttttaacttctat

SEQ ID NO: 442058 - DNA, 25 bp, Mus musculus
gaattgctagcaattgattgtattt

SEQ ID NO: 442059 - DNA, 25 bp, Mus musculus
gaattgctagcatttgattgtattt

SEQ ID NO: 442060 - DNA, 25 bp, Mus musculus
gaattgctcaagatgtcctgcggct

SEQ ID NO: 442061 - DNA, 25 bp, Mus musculus
gaattgctcaagttgtcctgcggct

SEQ ID NO: 442062 - DNA, 25 bp, Mus musculus
gaattgctcacacaaataatgtttg

SEQ ID NO: 442063 - DNA, 25 bp, Mus musculus
gaattgctcacagaaataatgtttg

SEQ ID NO: 442064 - DNA, 25 bp, Mus musculus
gaattgctcccacaaaatgagtaag

SEQ ID NO: 442065 - DNA, 25 bp, Mus musculus
gaattgctcccagaaaatgagtaag

SEQ ID NO: 442066 - DNA, 25 bp, Mus musculus
gaattgctgggccttcaaaggttcc

SEQ ID NO: 442067 - DNA, 25 bp, Mus musculus
gaattgctgggcgttcaaaggttcc

SEQ ID NO: 442068 - DNA, 25 bp, Mus musculus
gaattgctgtccaaagctgtgagtt

SEQ ID NO: 442069 - DNA, 25 bp, Mus musculus
gaattgctgtcctaagctgtgagtt

SEQ ID NO: 442070 - DNA, 25 bp, Mus musculus
gaattgctgtgcatacatcttgcct

SEQ ID NO: 442071 - DNA, 25 bp, Mus musculus
gaattgctgtgcttacatcttgcct

SEQ ID NO: 442072 - DNA, 25 bp, Mus musculus
gaattgcttaacattcagctcagac

SEQ ID NO: 442073 - DNA, 25 bp, Mus musculus
gaattgcttaactttcagctcagac

SEQ ID NO: 442074 - DNA, 25 bp, Mus musculus
gaattgcttcgcataagctatagaa

SEQ ID NO: 442075 - DNA, 25 bp, Mus musculus
gaattgcttcgcttaagctatagaa

SEQ ID NO: 442076 - DNA, 25 bp, Mus musculus
gaattgcttctaagggttccatttt

SEQ ID NO: 442077 - DNA, 25 bp, Mus musculus
gaattgcttctatgggttccatttt

SEQ ID NO: 442078 - DNA, 25 bp, Mus musculus
gaattgcttgctatgccaaatgcta

SEQ ID NO: 442079 - DNA, 25 bp, Mus musculus
gaattgcttgctttgccaaatgcta

SEQ ID NO: 442080 - DNA, 25 bp, Mus musculus
gaattgctttggctacctgtggact

SEQ ID NO: 442081 - DNA, 25 bp, Mus musculus
gaattgctttgggtacctgtggact

SEQ ID NO: 442082 - DNA, 25 bp, Mus musculus
gaattggaaactagccttaagaagg

SEQ ID NO: 442083 - DNA, 25 bp, Mus musculus
gaattggaaacttgccttaagaagg

SEQ ID NO: 442084 - DNA, 25 bp, Mus musculus
gaattggaacagacccacttgacaa

SEQ ID NO: 442085 - DNA, 25 bp, Mus musculus
gaattggaacagtcccacttgacaa

SEQ ID NO: 442086 - DNA, 25 bp, Mus musculus
gaattggaaggaagcacatagaagc

SEQ ID NO: 442087 - DNA, 25 bp, Mus musculus
gaattggaaggatgcacatagaagc

SEQ ID NO: 442088 - DNA, 25 bp, Mus musculus
gaattggaaggcagtacccctgtgc

SEQ ID NO: 442089 - DNA, 25 bp, Mus musculus
gaattggaaggcatgttccatctgc

SEQ ID NO: 442090 - DNA, 25 bp, Mus musculus
gaattggaaggctgtacccctgtgc

SEQ ID NO: 442091 - DNA, 25 bp, Mus musculus
gaattggaaggcttgttccatctgc

SEQ ID NO: 442092 - DNA, 25 bp, Mus musculus
gaattggacctgaccctacattatt

SEQ ID NO: 442093 - DNA, 25 bp, Mus musculus
gaattggacctgtccctacattatt

SEQ ID NO: 442094 - DNA, 25 bp, Mus musculus
gaattggactccaagtgtagcatcc

SEQ ID NO: 442095 - DNA, 25 bp, Mus musculus
gaattggactcctagtgtagcatcc

SEQ ID NO: 442096 - DNA, 25 bp, Mus musculus
gaattggactggataccactgtcat

SEQ ID NO: 442097 - DNA, 25 bp, Mus musculus
gaattggactggttaccactgtcat

SEQ ID NO: 442098 - DNA, 25 bp, Mus musculus
gaattggagcctcagaaggacttcg

SEQ ID NO: 442099 - DNA, 25 bp, Mus musculus
gaattggagcctgagaaggacttcg

SEQ ID NO: 442100 - DNA, 25 bp, Mus musculus
gaattggataccactgacttccgac

SEQ ID NO: 442101 - DNA, 25 bp, Mus musculus
gaattggatacctctgacttccgac

SEQ ID NO: 442102 - DNA, 25 bp, Mus musculus
gaattggatcctcgtacccaagtaa

SEQ ID NO: 442103 - DNA, 25 bp, Mus musculus
gaattggatcctggtacccaagtaa

SEQ ID NO: 442104 - DNA, 25 bp, Mus musculus
gaattggatgttaaggaccgtgccc

SEQ ID NO: 442105 - DNA, 25 bp, Mus musculus
gaattggatgtttaggaccgtgccc

SEQ ID NO: 442106 - DNA, 25 bp, Mus musculus
gaattggcagagcaacgttcacgtt

SEQ ID NO: 442107 - DNA, 25 bp, Mus musculus
gaattggcagaggaacgttcacgtt

SEQ ID NO: 442108 - DNA, 25 bp, Mus musculus
gaattggcaggcacttaactatgaa

SEQ ID NO: 442109 - DNA, 25 bp, Mus musculus
gaattggcaggctcttaactatgaa

SEQ ID NO: 442110 - DNA, 25 bp, Mus musculus
gaattggccaggcataattgcacat

SEQ ID NO: 442111 - DNA, 25 bp, Mus musculus
gaattggccagggataattgcacat

SEQ ID NO: 442112 - DNA, 25 bp, Mus musculus
gaattggccatgcatgaagctctac

SEQ ID NO: 442113 - DNA, 25 bp, Mus musculus
gaattggccatggatgaagctctac

SEQ ID NO: 442114 - DNA, 25 bp, Mus musculus
gaattggcccagctgcaatcaaacc

SEQ ID NO: 442115 - DNA, 25 bp, Mus musculus
gaattggcccaggtgcaatcaaacc

SEQ ID NO: 442116 - DNA, 25 bp, Mus musculus
gaattggcctatccccaagaccaga

SEQ ID NO: 442117 - DNA, 25 bp, Mus musculus
gaattggcctatgcccaagaccaga

SEQ ID NO: 442118 - DNA, 25 bp, Mus musculus
gaattggcctcgctgtgtcctttgt

SEQ ID NO: 442119 - DNA, 25 bp, Mus musculus
gaattggcctcggtgtgtcctttgt

SEQ ID NO: 442120 - DNA, 25 bp, Mus musculus
gaattggcgaccaaatgctagcagc

SEQ ID NO: 442121 - DNA, 25 bp, Mus musculus
gaattggcgacctaatgctagcagc

SEQ ID NO: 442122 - DNA, 25 bp, Mus musculus
gaattggctatccatacccacgtgg

SEQ ID NO: 442123 - DNA, 25 bp, Mus musculus
gaattggctatcgatacccacgtgg

SEQ ID NO: 442124 - DNA, 25 bp, Mus musculus
gaattggctcctaaaaagctgccct

SEQ ID NO: 442125 - DNA, 25 bp, Mus musculus
gaattggctccttaaaagctgccct

SEQ ID NO: 442126 - DNA, 25 bp, Mus musculus
gaattggctctgacccttacctagg

SEQ ID NO: 442127 - DNA, 25 bp, Mus musculus
gaattggctctgtcccttacctagg

SEQ ID NO: 442128 - DNA, 25 bp, Mus musculus
gaattggctgccatttgacaggctt

SEQ ID NO: 442129 - DNA, 25 bp, Mus musculus
gaattggctgccttttgacaggctt

SEQ ID NO: 442130 - DNA, 25 bp, Mus musculus
gaattggcttctcctaaatggctga

SEQ ID NO: 442131 - DNA, 25 bp, Mus musculus
gaattggcttctgctaaatggctga

SEQ ID NO: 442132 - DNA, 25 bp, Mus musculus
gaattgggaagcctctgacccgcca

SEQ ID NO: 442133 - DNA, 25 bp, Mus musculus
gaattgggaagcgtctgacccgcca

SEQ ID NO: 442134 - DNA, 25 bp, Mus musculus
gaattgggacctcgccttctgagtc

SEQ ID NO: 442135 - DNA, 25 bp, Mus musculus
gaattgggacctggccttctgagtc

SEQ ID NO: 442136 - DNA, 25 bp, Mus musculus
gaattgggcactctaatcatgtcga

SEQ ID NO: 442137 - DNA, 25 bp, Mus musculus
gaattgggcactgtaatcatgtcga

SEQ ID NO: 442138 - DNA, 25 bp, Mus musculus
gaattgggctacactgcacgccgtg

SEQ ID NO: 442139 - DNA, 25 bp, Mus musculus
gaattgggctactctgcacgccgtg

SEQ ID NO: 442140 - DNA, 25 bp, Mus musculus
gaattgggtcatctgccatgtatgt

SEQ ID NO: 442141 - DNA, 25 bp, Mus musculus
gaattgggtcatgtgccatgtatgt

SEQ ID NO: 442142 - DNA, 25 bp, Mus musculus
gaattgggtcgtacccaagagcgca

SEQ ID NO: 442143 - DNA, 25 bp, Mus musculus
gaattgggtcgttcccaagagcgca

SEQ ID NO: 442144 - DNA, 25 bp, Mus musculus
gaattgggtcttccttgtagcccag

SEQ ID NO: 442145 - DNA, 25 bp, Mus musculus
gaattgggtcttgcttgtagcccag

SEQ ID NO: 442146 - DNA, 25 bp, Mus musculus
gaattgggttctcgtaaatcatact

SEQ ID NO: 442147 - DNA, 25 bp, Mus musculus
gaattgggttctggtaaatcatact

SEQ ID NO: 442148 - DNA, 25 bp, Mus musculus
gaattggtaaagacaccatgagtaa

SEQ ID NO: 442149 - DNA, 25 bp, Mus musculus
gaattggtaaagtcaccatgagtaa

SEQ ID NO: 442150 - DNA, 25 bp, Mus musculus
gaattggtacatccttacgattata

SEQ ID NO: 442151 - DNA, 25 bp, Mus musculus
gaattggtacatgcttacgattata

SEQ ID NO: 442152 - DNA, 25 bp, Mus musculus
gaattggtaccaaccgttgttggag

SEQ ID NO: 442153 - DNA, 25 bp, Mus musculus
gaattggtaccatccgttgttggag

SEQ ID NO: 442154 - DNA, 25 bp, Mus musculus
gaattggtacctcacacttttggct

SEQ ID NO: 442155 - DNA, 25 bp, Mus musculus
gaattggtacctgacacttttggct

SEQ ID NO: 442156 - DNA, 25 bp, Mus musculus
gaattggtcactccatcctttatgg

SEQ ID NO: 442157 - DNA, 25 bp, Mus musculus
gaattggtcactgcatcctttatgg

SEQ ID NO: 442158 - DNA, 25 bp, Mus musculus
gaattggtccctcttattatagtat

SEQ ID NO: 442159 - DNA, 25 bp, Mus musculus
gaattggtccctgttattatagtat

SEQ ID NO: 442160 - DNA, 25 bp, Mus musculus
gaattggtccttctaaccttcacca

SEQ ID NO: 442161 - DNA, 25 bp, Mus musculus
gaattggtccttgtaaccttcacca

SEQ ID NO: 442162 - DNA, 25 bp, Mus musculus
gaattggtctatccaatgccagttt

SEQ ID NO: 442163 - DNA, 25 bp, Mus musculus
gaattggtctatgcaatgccagttt

SEQ ID NO: 442164 - DNA, 25 bp, Mus musculus
gaattggtgaggcactctgcactag

SEQ ID NO: 442165 - DNA, 25 bp, Mus musculus
gaattggtgagggactctgcactag

SEQ ID NO: 442166 - DNA, 25 bp, Mus musculus
gaattggtgtttaccttctggtcac

SEQ ID NO: 442167 - DNA, 25 bp, Mus musculus
gaattggtgtttctgtcggtctgca

SEQ ID NO: 442168 - DNA, 25 bp, Mus musculus
gaattggtgtttgtgtcggtctgca

SEQ ID NO: 442169 - DNA, 25 bp, Mus musculus
gaattggtgttttccttctggtcac

SEQ ID NO: 442170 - DNA, 25 bp, Mus musculus
gaattggttccactccgacagtaga

SEQ ID NO: 442171 - DNA, 25 bp, Mus musculus
gaattggttccagtccgacagtaga

SEQ ID NO: 442172 - DNA, 25 bp, Mus musculus
gaattggttcccacataaagcaaag

SEQ ID NO: 442173 - DNA, 25 bp, Mus musculus
gaattggttccctcataaagcaaag

SEQ ID NO: 442174 - DNA, 25 bp, Mus musculus
gaattggttgccagctgactgccag

SEQ ID NO: 442175 - DNA, 25 bp, Mus musculus
gaattggttgcctgctgactgccag

SEQ ID NO: 442176 - DNA, 25 bp, Mus musculus
gaattggttggtactgttcagttta

SEQ ID NO: 442177 - DNA, 25 bp, Mus musculus
gaattggttggttctgttcagttta

SEQ ID NO: 442178 - DNA, 25 bp, Mus musculus
gaattgtaaaccattcaccatagtt

SEQ ID NO: 442179 - DNA, 25 bp, Mus musculus
gaattgtaaacctttcaccatagtt

SEQ ID NO: 442180 - DNA, 25 bp, Mus musculus
gaattgtaaattatactctcgctat

SEQ ID NO: 442181 - DNA, 25 bp, Mus musculus
gaattgtaaattccagcctggtaag

SEQ ID NO: 442182 - DNA, 25 bp, Mus musculus
gaattgtaaattgcagcctggtaag

SEQ ID NO: 442183 - DNA, 25 bp, Mus musculus
gaattgtaaattttactctcgctat

SEQ ID NO: 442184 - DNA, 25 bp, Mus musculus
gaattgtaacatcaataaacacaag

SEQ ID NO: 442185 - DNA, 25 bp, Mus musculus
gaattgtaacatgaataaacacaag

SEQ ID NO: 442186 - DNA, 25 bp, Mus musculus
gaattgtaaccacctcacaaatgga

SEQ ID NO: 442187 - DNA, 25 bp, Mus musculus
gaattgtaaccagctcacaaatgga

SEQ ID NO: 442188 - DNA, 25 bp, Mus musculus
gaattgtaacctcatctgaagctca

SEQ ID NO: 442189 - DNA, 25 bp, Mus musculus
gaattgtaacctgatctgaagctca

SEQ ID NO: 442190 - DNA, 25 bp, Mus musculus
gaattgtaagcccacacctgaatga

SEQ ID NO: 442191 - DNA, 25 bp, Mus musculus
gaattgtaagccgacacctgaatga

SEQ ID NO: 442192 - DNA, 25 bp, Mus musculus
gaattgtacacccaaagtgctttac

SEQ ID NO: 442193 - DNA, 25 bp, Mus musculus
gaattgtacaccgaaagtgctttac

SEQ ID NO: 442194 - DNA, 25 bp, Mus musculus
gaattgtacctaaaaccaggtgcag

SEQ ID NO: 442195 - DNA, 25 bp, Mus musculus
gaattgtacctataaccaggtgcag

SEQ ID NO: 442196 - DNA, 25 bp, Mus musculus
gaattgtacctcctctcatggagag

SEQ ID NO: 442197 - DNA, 25 bp, Mus musculus
gaattgtacctcgtctcatggagag

SEQ ID NO: 442198 - DNA, 25 bp, Mus musculus
gaattgtactggctgttgaccacca

SEQ ID NO: 442199 - DNA, 25 bp, Mus musculus
gaattgtactgggtgttgaccacca

SEQ ID NO: 442200 - DNA, 25 bp, Mus musculus
gaattgtactgtacttaaaggataa

SEQ ID NO: 442201 - DNA, 25 bp, Mus musculus
gaattgtactgttcttaaaggataa

SEQ ID NO: 442202 - DNA, 25 bp, Mus musculus
gaattgtacttaatgtgatttctct

SEQ ID NO: 442203 - DNA, 25 bp, Mus musculus
gaattgtacttattgtgatttctct

SEQ ID NO: 442204 - DNA, 25 bp, Mus musculus
gaattgtactttctaactctgcaaa

SEQ ID NO: 442205 - DNA, 25 bp, Mus musculus
gaattgtactttgtaactctgcaaa

SEQ ID NO: 442206 - DNA, 25 bp, Mus musculus
gaattgtagctgatccttctgatat

SEQ ID NO: 442207 - DNA, 25 bp, Mus musculus
gaattgtagctgttccttctgatat

SEQ ID NO: 442208 - DNA, 25 bp, Mus musculus
gaattgtatacactggtgagcctcc

SEQ ID NO: 442209 - DNA, 25 bp, Mus musculus
gaattgtatacagtggtgagcctcc

SEQ ID NO: 442210 - DNA, 25 bp, Mus musculus
gaattgtataccctgttcttagata

SEQ ID NO: 442211 - DNA, 25 bp, Mus musculus
gaattgtataccgtgttcttagata

SEQ ID NO: 442212 - DNA, 25 bp, Mus musculus
gaattgtatatacgacctctgctcg

SEQ ID NO: 442213 - DNA, 25 bp, Mus musculus
gaattgtatataggacctctgctcg

SEQ ID NO: 442214 - DNA, 25 bp, Mus musculus
gaattgtatcacatctaaacagcat

SEQ ID NO: 442215 - DNA, 25 bp, Mus musculus
gaattgtatcacttctaaacagcat

SEQ ID NO: 442216 - DNA, 25 bp, Mus musculus
gaattgtatcatctcctggaagaaa

SEQ ID NO: 442217 - DNA, 25 bp, Mus musculus
gaattgtatcatctctctttccaag

SEQ ID NO: 442218 - DNA, 25 bp, Mus musculus
gaattgtatcatgtcctggaagaaa

SEQ ID NO: 442219 - DNA, 25 bp, Mus musculus
gaattgtatcatgtctctttccaag

SEQ ID NO: 442220 - DNA, 25 bp, Mus musculus
gaattgtatcgccttcttagcagaa

SEQ ID NO: 442221 - DNA, 25 bp, Mus musculus
gaattgtatcgcgttcttagcagaa

SEQ ID NO: 442222 - DNA, 25 bp, Mus musculus
gaattgtatgctcttcttgccaagc

SEQ ID NO: 442223 - DNA, 25 bp, Mus musculus
gaattgtatgctgttcttgccaagc

SEQ ID NO: 442224 - DNA, 25 bp, Mus musculus
gaattgtattcactccagaattact

SEQ ID NO: 442225 - DNA, 25 bp, Mus musculus
gaattgtattcagtccagaattact

SEQ ID NO: 442226 - DNA, 25 bp, Mus musculus
gaattgtattctcactcagcttgtc

SEQ ID NO: 442227 - DNA, 25 bp, Mus musculus
gaattgtattctgactcagcttgtc

SEQ ID NO: 442228 - DNA, 25 bp, Mus musculus
gaattgtcaaaaaagctgatatgct

SEQ ID NO: 442229 - DNA, 25 bp, Mus musculus
gaattgtcaaaatagctgatatgct

SEQ ID NO: 442230 - DNA, 25 bp, Mus musculus
gaattgtcaccacctacatcaggga

SEQ ID NO: 442231 - DNA, 25 bp, Mus musculus
gaattgtcaccagctacatcaggga

SEQ ID NO: 442232 - DNA, 25 bp, Mus musculus
gaattgtcacctctcaagtcatcga

SEQ ID NO: 442233 - DNA, 25 bp, Mus musculus
gaattgtcacctgtcaagtcatcga

SEQ ID NO: 442234 - DNA, 25 bp, Mus musculus
gaattgtcacttctatgtcagcaga

SEQ ID NO: 442235 - DNA, 25 bp, Mus musculus
gaattgtcacttgtatgtcagcaga

SEQ ID NO: 442236 - DNA, 25 bp, Mus musculus
gaattgtcagtaactggctccaggc

SEQ ID NO: 442237 - DNA, 25 bp, Mus musculus
gaattgtcagtatctggctccaggc

SEQ ID NO: 442238 - DNA, 25 bp, Mus musculus
gaattgtcctttacaagccaggcat

SEQ ID NO: 442239 - DNA, 25 bp, Mus musculus
gaattgtccttttcaagccaggcat

SEQ ID NO: 442240 - DNA, 25 bp, Mus musculus
gaattgtctcatatttcacacattt

SEQ ID NO: 442241 - DNA, 25 bp, Mus musculus
gaattgtctcatttttcacacattt

SEQ ID NO: 442242 - DNA, 25 bp, Mus musculus
gaattgtctctgagtagctcatcac

SEQ ID NO: 442243 - DNA, 25 bp, Mus musculus
gaattgtctctgtgtagctcatcac

SEQ ID NO: 442244 - DNA, 25 bp, Mus musculus
gaattgtctgcaaggtcacgaagga

SEQ ID NO: 442245 - DNA, 25 bp, Mus musculus
gaattgtctgcatggtcacgaagga

SEQ ID NO: 442246 - DNA, 25 bp, Mus musculus
gaattgtctgccattacagggtcaa

SEQ ID NO: 442247 - DNA, 25 bp, Mus musculus
gaattgtctgccctccacaatgaaa

SEQ ID NO: 442248 - DNA, 25 bp, Mus musculus
gaattgtctgccgtccacaatgaaa

SEQ ID NO: 442249 - DNA, 25 bp, Mus musculus
gaattgtctgcctttacagggtcaa

SEQ ID NO: 442250 - DNA, 25 bp, Mus musculus
gaattgtctgtaatagtgcaatgca

SEQ ID NO: 442251 - DNA, 25 bp, Mus musculus
gaattgtctgtattagtgcaatgca

SEQ ID NO: 442252 - DNA, 25 bp, Mus musculus
gaattgtctgttatggtggcgttca

SEQ ID NO: 442253 - DNA, 25 bp, Mus musculus
gaattgtctgttttggtggcgttca

SEQ ID NO: 442254 - DNA, 25 bp, Mus musculus
gaattgtcttcaacctaatactttt

SEQ ID NO: 442255 - DNA, 25 bp, Mus musculus
gaattgtcttcatcctaatactttt

SEQ ID NO: 442256 - DNA, 25 bp, Mus musculus
gaattgtcttccactaatgtcttgt

SEQ ID NO: 442257 - DNA, 25 bp, Mus musculus
gaattgtcttcctctaatgtcttgt

SEQ ID NO: 442258 - DNA, 25 bp, Mus musculus
gaattgtctttacttataatggcat

SEQ ID NO: 442259 - DNA, 25 bp, Mus musculus
gaattgtctttagttataatggcat

SEQ ID NO: 442260 - DNA, 25 bp, Mus musculus
gaattgtctttcacctatggtacag

SEQ ID NO: 442261 - DNA, 25 bp, Mus musculus
gaattgtctttctcctatggtacag

SEQ ID NO: 442262 - DNA, 25 bp, Mus musculus
gaattgtgacagctaactggaggta

SEQ ID NO: 442263 - DNA, 25 bp, Mus musculus
gaattgtgacaggtaactggaggta

SEQ ID NO: 442264 - DNA, 25 bp, Mus musculus
gaattgtgacatcagcactgctggg

SEQ ID NO: 442265 - DNA, 25 bp, Mus musculus
gaattgtgacatgagcactgctggg

SEQ ID NO: 442266 - DNA, 25 bp, Mus musculus
gaattgtgacccagcattagctctg

SEQ ID NO: 442267 - DNA, 25 bp, Mus musculus
gaattgtgaccccagagcttgtata

SEQ ID NO: 442268 - DNA, 25 bp, Mus musculus
gaattgtgacccgagagcttgtata

SEQ ID NO: 442269 - DNA, 25 bp, Mus musculus
gaattgtgaccctgcattagctctg

SEQ ID NO: 442270 - DNA, 25 bp, Mus musculus
gaattgtgaggccatccgatctaca

SEQ ID NO: 442271 - DNA, 25 bp, Mus musculus
gaattgtgaggcgatccgatctaca

SEQ ID NO: 442272 - DNA, 25 bp, Mus musculus
gaattgtgagtgatcatctccatga

SEQ ID NO: 442273 - DNA, 25 bp, Mus musculus
gaattgtgagtgttcatctccatga

SEQ ID NO: 442274 - DNA, 25 bp, Mus musculus
gaattgtgcatcaccttaaccaact

SEQ ID NO: 442275 - DNA, 25 bp, Mus musculus
gaattgtgcatctccttaaccaact

SEQ ID NO: 442276 - DNA, 25 bp, Mus musculus
gaattgtgccttccgttaggaggac

SEQ ID NO: 442277 - DNA, 25 bp, Mus musculus
gaattgtgccttgcgttaggaggac

SEQ ID NO: 442278 - DNA, 25 bp, Mus musculus
gaattgtgctccatttctgcactag

SEQ ID NO: 442279 - DNA, 25 bp, Mus musculus
gaattgtgctccttttctgcactag

SEQ ID NO: 442280 - DNA, 25 bp, Mus musculus
gaattgtggataaacttctttcttc

SEQ ID NO: 442281 - DNA, 25 bp, Mus musculus
gaattgtggatatacttctttcttc

SEQ ID NO: 442282 - DNA, 25 bp, Mus musculus
gaattgtggcccagaacgcccacac

SEQ ID NO: 442283 - DNA, 25 bp, Mus musculus
gaattgtggccctgaacgcccacac

SEQ ID NO: 442284 - DNA, 25 bp, Mus musculus
gaattgtggcctattctgaagccag

SEQ ID NO: 442285 - DNA, 25 bp, Mus musculus
gaattgtggccttttctgaagccag

SEQ ID NO: 442286 - DNA, 25 bp, Mus musculus
gaattgtgggatatcctatggtaaa

SEQ ID NO: 442287 - DNA, 25 bp, Mus musculus
gaattgtgggatttcctatggtaaa

SEQ ID NO: 442288 - DNA, 25 bp, Mus musculus
gaattgtggtgactttacatttgaa

SEQ ID NO: 442289 - DNA, 25 bp, Mus musculus
gaattgtggtgagtttacatttgaa

SEQ ID NO: 442290 - DNA, 25 bp, Mus musculus
gaattgtgtaaactgactcttccga

SEQ ID NO: 442291 - DNA, 25 bp, Mus musculus
gaattgtgtaaagtgactcttccga

SEQ ID NO: 442292 - DNA, 25 bp, Mus musculus
gaattgtgtgctatcaccaacaccc

SEQ ID NO: 442293 - DNA, 25 bp, Mus musculus
gaattgtgtgctttcaccaacaccc

SEQ ID NO: 442294 - DNA, 25 bp, Mus musculus
gaattgtgtggcacaagggtcatgt

SEQ ID NO: 442295 - DNA, 25 bp, Mus musculus
gaattgtgtggctcaagggtcatgt

SEQ ID NO: 442296 - DNA, 25 bp, Mus musculus
gaattgtgttatcaagctgccttat

SEQ ID NO: 442297 - DNA, 25 bp, Mus musculus
gaattgtgttatgaagctgccttat

SEQ ID NO: 442298 - DNA, 25 bp, Mus musculus
gaattgtgtttcactagtaagctat

SEQ ID NO: 442299 - DNA, 25 bp, Mus musculus
gaattgtgtttctctagtaagctat

SEQ ID NO: 442300 - DNA, 25 bp, Mus musculus
gaattgttacctatctttgtgtaat

SEQ ID NO: 442301 - DNA, 25 bp, Mus musculus
gaattgttacctttctttgtgtaat

SEQ ID NO: 442302 - DNA, 25 bp, Mus musculus
gaattgttatagattaccgtgcatt

SEQ ID NO: 442303 - DNA, 25 bp, Mus musculus
gaattgttatagtttaccgtgcatt

SEQ ID NO: 442304 - DNA, 25 bp, Mus musculus
gaattgttatttacagcctcctggt

SEQ ID NO: 442305 - DNA, 25 bp, Mus musculus
gaattgttattttcagcctcctggt

SEQ ID NO: 442306 - DNA, 25 bp, Mus musculus
gaattgttcaatcgcctctgagtcc

SEQ ID NO: 442307 - DNA, 25 bp, Mus musculus
gaattgttcaatggcctctgagtcc

SEQ ID NO: 442308 - DNA, 25 bp, Mus musculus
gaattgttcacgactgtacgcccca

SEQ ID NO: 442309 - DNA, 25 bp, Mus musculus
gaattgttcacgtctgtacgcccca

SEQ ID NO: 442310 - DNA, 25 bp, Mus musculus
gaattgttccagagattactgctat

SEQ ID NO: 442311 - DNA, 25 bp, Mus musculus
gaattgttccagtgattactgctat

SEQ ID NO: 442312 - DNA, 25 bp, Mus musculus
gaattgttctcaatgtgacttacac

SEQ ID NO: 442313 - DNA, 25 bp, Mus musculus
gaattgttctcattgtgacttacac

SEQ ID NO: 442314 - DNA, 25 bp, Mus musculus
gaattgttctctatagcttgtcccc

SEQ ID NO: 442315 - DNA, 25 bp, Mus musculus
gaattgttctctttagcttgtcccc

SEQ ID NO: 442316 - DNA, 25 bp, Mus musculus
gaattgttcttcaagagtactgaaa

SEQ ID NO: 442317 - DNA, 25 bp, Mus musculus
gaattgttcttcatgtcggatatct

SEQ ID NO: 442318 - DNA, 25 bp, Mus musculus
gaattgttcttctagagtactgaaa

SEQ ID NO: 442319 - DNA, 25 bp, Mus musculus
gaattgttcttcttgtcggatatct

SEQ ID NO: 442320 - DNA, 25 bp, Mus musculus
gaattgttgccaaacagcctgctgt

SEQ ID NO: 442321 - DNA, 25 bp, Mus musculus
gaattgttgccatacagcctgctgt

SEQ ID NO: 442322 - DNA, 25 bp, Mus musculus
gaattgttgctaatataagtgcttt

SEQ ID NO: 442323 - DNA, 25 bp, Mus musculus
gaattgttgctattataagtgcttt

SEQ ID NO: 442324 - DNA, 25 bp, Mus musculus
gaattgttggaaaggcatgctggct

SEQ ID NO: 442325 - DNA, 25 bp, Mus musculus
gaattgttggaatggcatgctggct

SEQ ID NO: 442326 - DNA, 25 bp, Mus musculus
gaattgttggacagtctggctcagc

SEQ ID NO: 442327 - DNA, 25 bp, Mus musculus
gaattgttggactgtctggctcagc

SEQ ID NO: 442328 - DNA, 25 bp, Mus musculus
gaattgttggtgactttgctggaac

SEQ ID NO: 442329 - DNA, 25 bp, Mus musculus
gaattgttggtgtctttgctggaac

SEQ ID NO: 442330 - DNA, 25 bp, Mus musculus
gaattgttgtaaacttccctagaat

SEQ ID NO: 442331 - DNA, 25 bp, Mus musculus
gaattgttgtaatcttccctagaat

SEQ ID NO: 442332 - DNA, 25 bp, Mus musculus
gaattgttgtgtccggccagcagat

SEQ ID NO: 442333 - DNA, 25 bp, Mus musculus
gaattgttgtgtgcggccagcagat

SEQ ID NO: 442334 - DNA, 25 bp, Mus musculus
gaattgtttacaatggccggtggat

SEQ ID NO: 442335 - DNA, 25 bp, Mus musculus
gaattgtttacattggccggtggat

SEQ ID NO: 442336 - DNA, 25 bp, Mus musculus
gaattgtttactcttcgggtcatct

SEQ ID NO: 442337 - DNA, 25 bp, Mus musculus
gaattgtttactgttcgggtcatct

SEQ ID NO: 442338 - DNA, 25 bp, Mus musculus
gaattgtttccaagccacccaaacg

SEQ ID NO: 442339 - DNA, 25 bp, Mus musculus
gaattgtttccactgggtcctggct

SEQ ID NO: 442340 - DNA, 25 bp, Mus musculus
gaattgtttccagtgggtcctggct

SEQ ID NO: 442341 - DNA, 25 bp, Mus musculus
gaattgtttccatgccacccaaacg

SEQ ID NO: 442342 - DNA, 25 bp, Mus musculus
gaattgtttcttccactgttggtta

SEQ ID NO: 442343 - DNA, 25 bp, Mus musculus
gaattgtttcttgcactgttggtta

SEQ ID NO: 442344 - DNA, 25 bp, Mus musculus
gaattgtttgtaccaagcgatcttg

SEQ ID NO: 442345 - DNA, 25 bp, Mus musculus
gaattgtttgtagcaagcgatcttg

SEQ ID NO: 442346 - DNA, 25 bp, Mus musculus
gaattgttttacatgtccactgccc

SEQ ID NO: 442347 - DNA, 25 bp, Mus musculus
gaattgttttacttgtccactgccc

SEQ ID NO: 442348 - DNA, 25 bp, Mus musculus
gaattgttttccctaaagtatgatt

SEQ ID NO: 442349 - DNA, 25 bp, Mus musculus
gaattgttttccgtaaagtatgatt

SEQ ID NO: 442350 - DNA, 25 bp, Mus musculus
gaattgttttctccctcaccttctt

SEQ ID NO: 442351 - DNA, 25 bp, Mus musculus
gaattgttttctgcctcaccttctt

SEQ ID NO: 442352 - DNA, 25 bp, Mus musculus
gaattgttttttcctcataccctgt

SEQ ID NO: 442353 - DNA, 25 bp, Mus musculus
gaattgttttttgctcataccctgt

SEQ ID NO: 442354 - DNA, 25 bp, Mus musculus
gaatttaaacacactgagatccttg

SEQ ID NO: 442355 - DNA, 25 bp, Mus musculus
gaatttaaacaccatcttctgcggt

SEQ ID NO: 442356 - DNA, 25 bp, Mus musculus
gaatttaaacacgatcttctgcggt

SEQ ID NO: 442357 - DNA, 25 bp, Mus musculus
gaatttaaacactctgagatccttg

SEQ ID NO: 442358 - DNA, 25 bp, Mus musculus
gaatttaaacagctctttctacaga

SEQ ID NO: 442359 - DNA, 25 bp, Mus musculus
gaatttaaacaggtctttctacaga

SEQ ID NO: 442360 - DNA, 25 bp, Mus musculus
gaatttaaacccaaggccagtgagt

SEQ ID NO: 442361 - DNA, 25 bp, Mus musculus
gaatttaaaccctaggccagtgagt

SEQ ID NO: 442362 - DNA, 25 bp, Mus musculus
gaatttaaactgaaattgcttctca

SEQ ID NO: 442363 - DNA, 25 bp, Mus musculus
gaatttaaactgtaattgcttctca

SEQ ID NO: 442364 - DNA, 25 bp, Mus musculus
gaatttaaagctaacctgtgtgcgt

SEQ ID NO: 442365 - DNA, 25 bp, Mus musculus
gaatttaaagcttacctgtgtgcgt

SEQ ID NO: 442366 - DNA, 25 bp, Mus musculus
gaatttaaatctatgtgacatgtgt

SEQ ID NO: 442367 - DNA, 25 bp, Mus musculus
gaatttaaatctttgtgacatgtgt

SEQ ID NO: 442368 - DNA, 25 bp, Mus musculus
gaatttaaatgtctcaccctctcat

SEQ ID NO: 442369 - DNA, 25 bp, Mus musculus
gaatttaaatgtgtcaccctctcat

SEQ ID NO: 442370 - DNA, 25 bp, Mus musculus
gaatttaaattaaccctggcactta

SEQ ID NO: 442371 - DNA, 25 bp, Mus musculus
gaatttaaattatccctggcactta

SEQ ID NO: 442372 - DNA, 25 bp, Mus musculus
gaatttaaccagagtagcaaagctt

SEQ ID NO: 442373 - DNA, 25 bp, Mus musculus
gaatttaaccagtgtagcaaagctt

SEQ ID NO: 442374 - DNA, 25 bp, Mus musculus
gaatttaacctgcaccttatgttgt

SEQ ID NO: 442375 - DNA, 25 bp, Mus musculus
gaatttaacctggaccttatgttgt

SEQ ID NO: 442376 - DNA, 25 bp, Mus musculus
gaatttaactaactgcccttcaggt

SEQ ID NO: 442377 - DNA, 25 bp, Mus musculus
gaatttaactaagtgcccttcaggt

SEQ ID NO: 442378 - DNA, 25 bp, Mus musculus
gaatttaactatctctgcccagcca

SEQ ID NO: 442379 - DNA, 25 bp, Mus musculus
gaatttaactatgtctgcccagcca

SEQ ID NO: 442380 - DNA, 25 bp, Mus musculus
gaatttaactccaatcagcagtgaa

SEQ ID NO: 442381 - DNA, 25 bp, Mus musculus
gaatttaactcctatcagcagtgaa

SEQ ID NO: 442382 - DNA, 25 bp, Mus musculus
gaatttaactgaactatccaagtat

SEQ ID NO: 442383 - DNA, 25 bp, Mus musculus
gaatttaactgatctatccaagtat

SEQ ID NO: 442384 - DNA, 25 bp, Mus musculus
gaatttaagcaaacgtccaagtgat

SEQ ID NO: 442385 - DNA, 25 bp, Mus musculus
gaatttaagcaactactggctgatg

SEQ ID NO: 442386 - DNA, 25 bp, Mus musculus
gaatttaagcaagtactggctgatg

SEQ ID NO: 442387 - DNA, 25 bp, Mus musculus
gaatttaagcaatcgtccaagtgat

SEQ ID NO: 442388 - DNA, 25 bp, Mus musculus
gaatttaagcacagaatcccagacc

SEQ ID NO: 442389 - DNA, 25 bp, Mus musculus
gaatttaagcactgaatcccagacc

SEQ ID NO: 442390 - DNA, 25 bp, Mus musculus
gaatttaaggtgattctgccagtac

SEQ ID NO: 442391 - DNA, 25 bp, Mus musculus
gaatttaaggtgtttctgccagtac

SEQ ID NO: 442392 - DNA, 25 bp, Mus musculus
gaatttaagtatctaatgcctcaag

SEQ ID NO: 442393 - DNA, 25 bp, Mus musculus
gaatttaagtatgtaatgcctcaag

SEQ ID NO: 442394 - DNA, 25 bp, Mus musculus
gaatttaatccccaccgctttatag

SEQ ID NO: 442395 - DNA, 25 bp, Mus musculus
gaatttaatcccgaccgctttatag

SEQ ID NO: 442396 - DNA, 25 bp, Mus musculus
gaatttaattatctgacctcattta

SEQ ID NO: 442397 - DNA, 25 bp, Mus musculus
gaatttaattatgtgacctcattta

SEQ ID NO: 442398 - DNA, 25 bp, Mus musculus
gaatttacaatacgttttctctgga

SEQ ID NO: 442399 - DNA, 25 bp, Mus musculus
gaatttacaataggttttctctgga

SEQ ID NO: 442400 - DNA, 25 bp, Mus musculus
gaatttacacatagttgattcatca

SEQ ID NO: 442401 - DNA, 25 bp, Mus musculus
gaatttacacattgttgattcatca

SEQ ID NO: 442402 - DNA, 25 bp, Mus musculus
gaatttacagtaacactccaggtta

SEQ ID NO: 442403 - DNA, 25 bp, Mus musculus
gaatttacagtatcactccaggtta

SEQ ID NO: 442404 - DNA, 25 bp, Mus musculus
gaatttacatagcagcacacaatca

SEQ ID NO: 442405 - DNA, 25 bp, Mus musculus
gaatttacataggagcacacaatca

SEQ ID NO: 442406 - DNA, 25 bp, Mus musculus
gaatttacatatctcttctaatgct

SEQ ID NO: 442407 - DNA, 25 bp, Mus musculus
gaatttacatatgtcttctaatgct

SEQ ID NO: 442408 - DNA, 25 bp, Mus musculus
gaatttacccttagcttcatctttt

SEQ ID NO: 442409 - DNA, 25 bp, Mus musculus
gaatttaccctttgcttcatctttt

SEQ ID NO: 442410 - DNA, 25 bp, Mus musculus
gaatttaccgttaaatagcaggtat

SEQ ID NO: 442411 - DNA, 25 bp, Mus musculus
gaatttaccgtttaatagcaggtat

SEQ ID NO: 442412 - DNA, 25 bp, Mus musculus
gaatttacctgcaaaactttatcta

SEQ ID NO: 442413 - DNA, 25 bp, Mus musculus
gaatttacctgcctttgtcagtagc

SEQ ID NO: 442414 - DNA, 25 bp, Mus musculus
gaatttacctgcgtttgtcagtagc

SEQ ID NO: 442415 - DNA, 25 bp, Mus musculus
gaatttacctgctaaactttatcta

SEQ ID NO: 442416 - DNA, 25 bp, Mus musculus
gaatttacgcaaatgcaacttcaga

SEQ ID NO: 442417 - DNA, 25 bp, Mus musculus
gaatttacgcaattgcaacttcaga

SEQ ID NO: 442418 - DNA, 25 bp, Mus musculus
gaatttacgcctaaatgtgtcatta

SEQ ID NO: 442419 - DNA, 25 bp, Mus musculus
gaatttacgccttaatgtgtcatta

SEQ ID NO: 442420 - DNA, 25 bp, Mus musculus
gaatttactaaccaacctcaggact

SEQ ID NO: 442421 - DNA, 25 bp, Mus musculus
gaatttactaacgaacctcaggact

SEQ ID NO: 442422 - DNA, 25 bp, Mus musculus
gaatttactatgagcatccttctgt

SEQ ID NO: 442423 - DNA, 25 bp, Mus musculus
gaatttactatgtgcatccttctgt

SEQ ID NO: 442424 - DNA, 25 bp, Mus musculus
gaatttactcacaaggaagatctta

SEQ ID NO: 442425 - DNA, 25 bp, Mus musculus
gaatttactcactaggaagatctta

SEQ ID NO: 442426 - DNA, 25 bp, Mus musculus
gaatttactgacattgtagctacac

SEQ ID NO: 442427 - DNA, 25 bp, Mus musculus
gaatttactgactttgtagctacac

SEQ ID NO: 442428 - DNA, 25 bp, Mus musculus
gaatttactgtgaaacccaacctgg

SEQ ID NO: 442429 - DNA, 25 bp, Mus musculus
gaatttactgtgtaacccaacctgg

SEQ ID NO: 442430 - DNA, 25 bp, Mus musculus
gaatttacttcccacctcaaaatca

SEQ ID NO: 442431 - DNA, 25 bp, Mus musculus
gaatttacttccgacctcaaaatca

SEQ ID NO: 442432 - DNA, 25 bp, Mus musculus
gaatttagacaacgctatatttcat

SEQ ID NO: 442433 - DNA, 25 bp, Mus musculus
gaatttagacaaggctatatttcat

SEQ ID NO: 442434 - DNA, 25 bp, Mus musculus
gaatttagactcagatttaccctga

SEQ ID NO: 442435 - DNA, 25 bp, Mus musculus
gaatttagactctgatttaccctga

SEQ ID NO: 442436 - DNA, 25 bp, Mus musculus
gaatttagaggaattccagagaatt

SEQ ID NO: 442437 - DNA, 25 bp, Mus musculus
gaatttagaggatttccagagaatt

SEQ ID NO: 442438 - DNA, 25 bp, Mus musculus
gaatttagaggcacaagcctcaggg

SEQ ID NO: 442439 - DNA, 25 bp, Mus musculus
gaatttagaggctcaagcctcaggg

SEQ ID NO: 442440 - DNA, 25 bp, Mus musculus
gaatttagatccactaggactcatg

SEQ ID NO: 442441 - DNA, 25 bp, Mus musculus
gaatttagatcctctaggactcatg

SEQ ID NO: 442442 - DNA, 25 bp, Mus musculus
gaatttagcaccctaatcctgtcct

SEQ ID NO: 442443 - DNA, 25 bp, Mus musculus
gaatttagcaccgtaatcctgtcct

SEQ ID NO: 442444 - DNA, 25 bp, Mus musculus
gaatttagccacactgcctagaaga

SEQ ID NO: 442445 - DNA, 25 bp, Mus musculus
gaatttagccactctgcctagaaga

SEQ ID NO: 442446 - DNA, 25 bp, Mus musculus
gaatttagcgacaaatcagctcaca

SEQ ID NO: 442447 - DNA, 25 bp, Mus musculus
gaatttagcgactaatcagctcaca

SEQ ID NO: 442448 - DNA, 25 bp, Mus musculus
gaatttagctagacatgttcaggaa

SEQ ID NO: 442449 - DNA, 25 bp, Mus musculus
gaatttagctagtcatgttcaggaa

SEQ ID NO: 442450 - DNA, 25 bp, Mus musculus
gaatttagctccatttgcttgagag

SEQ ID NO: 442451 - DNA, 25 bp, Mus musculus
gaatttagctccttttgcttgagag

SEQ ID NO: 442452 - DNA, 25 bp, Mus musculus
gaatttagctctagacatcgatcgt

SEQ ID NO: 442453 - DNA, 25 bp, Mus musculus
gaatttagctcttgacatcgatcgt

SEQ ID NO: 442454 - DNA, 25 bp, Mus musculus
gaatttaggagccatcagcaccccg

SEQ ID NO: 442455 - DNA, 25 bp, Mus musculus
gaatttaggagcgatcagcaccccg

SEQ ID NO: 442456 - DNA, 25 bp, Mus musculus
gaatttagggatccagaacacgtga

SEQ ID NO: 442457 - DNA, 25 bp, Mus musculus
gaatttagggatgcagaacacgtga

SEQ ID NO: 442458 - DNA, 25 bp, Mus musculus
gaatttagtaagctgttccttcctt

SEQ ID NO: 442459 - DNA, 25 bp, Mus musculus
gaatttagtaaggtgttccttcctt

SEQ ID NO: 442460 - DNA, 25 bp, Mus musculus
gaatttagtgctcattttcatttct

SEQ ID NO: 442461 - DNA, 25 bp, Mus musculus
gaatttagtgctgattttcatttct

SEQ ID NO: 442462 - DNA, 25 bp, Mus musculus
gaatttagttctattcataacgtgt

SEQ ID NO: 442463 - DNA, 25 bp, Mus musculus
gaatttagttcttttcataacgtgt

SEQ ID NO: 442464 - DNA, 25 bp, Mus musculus
gaatttagttgcctgtctcatgatg

SEQ ID NO: 442465 - DNA, 25 bp, Mus musculus
gaatttagttgcgtgtctcatgatg

SEQ ID NO: 442466 - DNA, 25 bp, Mus musculus
gaatttataaggcaagttggacttt

SEQ ID NO: 442467 - DNA, 25 bp, Mus musculus
gaatttataagggaagttggacttt

SEQ ID NO: 442468 - DNA, 25 bp, Mus musculus
gaatttatactgaccaattcagagt

SEQ ID NO: 442469 - DNA, 25 bp, Mus musculus
gaatttatactgtccaattcagagt

SEQ ID NO: 442470 - DNA, 25 bp, Mus musculus
gaatttatatctaacaaatcagaag

SEQ ID NO: 442471 - DNA, 25 bp, Mus musculus
gaatttatatcttacaaatcagaag

SEQ ID NO: 442472 - DNA, 25 bp, Mus musculus
gaatttatattacttggcctagatt

SEQ ID NO: 442473 - DNA, 25 bp, Mus musculus
gaatttatattagttggcctagatt

SEQ ID NO: 442474 - DNA, 25 bp, Mus musculus
gaatttatctagcaagctggcccaa

SEQ ID NO: 442475 - DNA, 25 bp, Mus musculus
gaatttatctaggaagctggcccaa

SEQ ID NO: 442476 - DNA, 25 bp, Mus musculus
gaatttatctgcatgatctcgtcag

SEQ ID NO: 442477 - DNA, 25 bp, Mus musculus
gaatttatctgcttgatctcgtcag

SEQ ID NO: 442478 - DNA, 25 bp, Mus musculus
gaatttatctttctgcttcagcctc

SEQ ID NO: 442479 - DNA, 25 bp, Mus musculus
gaatttatctttgtgcttcagcctc

SEQ ID NO: 442480 - DNA, 25 bp, Mus musculus
gaatttatgaagacgggcactcccc

SEQ ID NO: 442481 - DNA, 25 bp, Mus musculus
gaatttatgaagtcgggcactcccc

SEQ ID NO: 442482 - DNA, 25 bp, Mus musculus
gaatttatgactatccgaggacaca

SEQ ID NO: 442483 - DNA, 25 bp, Mus musculus
gaatttatgactttccgaggacaca

SEQ ID NO: 442484 - DNA, 25 bp, Mus musculus
gaatttatgatcattctgtttctaa

SEQ ID NO: 442485 - DNA, 25 bp, Mus musculus
gaatttatgatctttctgtttctaa

SEQ ID NO: 442486 - DNA, 25 bp, Mus musculus
gaatttatgattcctgtgctttaaa

SEQ ID NO: 442487 - DNA, 25 bp, Mus musculus
gaatttatgattgctgtgctttaaa

SEQ ID NO: 442488 - DNA, 25 bp, Mus musculus
gaatttatgccactggacattcctg

SEQ ID NO: 442489 - DNA, 25 bp, Mus musculus
gaatttatgccagtggacattcctg

SEQ ID NO: 442490 - DNA, 25 bp, Mus musculus
gaatttatggtgatagtccactatc

SEQ ID NO: 442491 - DNA, 25 bp, Mus musculus
gaatttatggtgttagtccactatc

SEQ ID NO: 442492 - DNA, 25 bp, Mus musculus
gaatttatgtcccacagtttttaag

SEQ ID NO: 442493 - DNA, 25 bp, Mus musculus
gaatttatgtccgacagtttttaag

SEQ ID NO: 442494 - DNA, 25 bp, Mus musculus
gaatttattagcacaacaggcatat

SEQ ID NO: 442495 - DNA, 25 bp, Mus musculus
gaatttattagctcaacaggcatat

SEQ ID NO: 442496 - DNA, 25 bp, Mus musculus
gaatttattattacaggcaagccat

SEQ ID NO: 442497 - DNA, 25 bp, Mus musculus
gaatttattatttcaggcaagccat

SEQ ID NO: 442498 - DNA, 25 bp, Mus musculus
gaatttattctacatgcaatgtcct

SEQ ID NO: 442499 - DNA, 25 bp, Mus musculus
gaatttattctagatgcaatgtcct

SEQ ID NO: 442500 - DNA, 25 bp, Mus musculus
gaatttatttaaacgctgaagcttt

SEQ ID NO: 442501 - DNA, 25 bp, Mus musculus
gaatttatttaatcgctgaagcttt

SEQ ID NO: 442502 - DNA, 25 bp, Mus musculus
gaatttcaaactatgccgaaccgat

SEQ ID NO: 442503 - DNA, 25 bp, Mus musculus
gaatttcaaactttgccgaaccgat

SEQ ID NO: 442504 - DNA, 25 bp, Mus musculus
gaatttcaaaggctcctgtgacaag

SEQ ID NO: 442505 - DNA, 25 bp, Mus musculus
gaatttcaaagggtcctgtgacaag

SEQ ID NO: 442506 - DNA, 25 bp, Mus musculus
gaatttcaaagtactccacattcct

SEQ ID NO: 442507 - DNA, 25 bp, Mus musculus
gaatttcaaagtcaccttcaggtac

SEQ ID NO: 442508 - DNA, 25 bp, Mus musculus
gaatttcaaagtgaccttcaggtac

SEQ ID NO: 442509 - DNA, 25 bp, Mus musculus
gaatttcaaagttctccacattcct

SEQ ID NO: 442510 - DNA, 25 bp, Mus musculus
gaatttcaagacctttcagtggaag

SEQ ID NO: 442511 - DNA, 25 bp, Mus musculus
gaatttcaagacgtttcagtggaag

SEQ ID NO: 442512 - DNA, 25 bp, Mus musculus
gaatttcaagctaccaccagcaatg

SEQ ID NO: 442513 - DNA, 25 bp, Mus musculus
gaatttcaagcttccaccagcaatg

SEQ ID NO: 442514 - DNA, 25 bp, Mus musculus
gaatttcacaatcctgctaacgata

SEQ ID NO: 442515 - DNA, 25 bp, Mus musculus
gaatttcacaatgctgctaacgata

SEQ ID NO: 442516 - DNA, 25 bp, Mus musculus
gaatttcacgtcattcttactatgg

SEQ ID NO: 442517 - DNA, 25 bp, Mus musculus
gaatttcacgtctttcttactatgg

SEQ ID NO: 442518 - DNA, 25 bp, Mus musculus
gaatttcacttcacacaaggtgcct

SEQ ID NO: 442519 - DNA, 25 bp, Mus musculus
gaatttcacttctcacaaggtgcct

SEQ ID NO: 442520 - DNA, 25 bp, Mus musculus
gaatttcagactcataaccccagta

SEQ ID NO: 442521 - DNA, 25 bp, Mus musculus
gaatttcagactgataaccccagta

SEQ ID NO: 442522 - DNA, 25 bp, Mus musculus
gaatttcagattactgccctttggg

SEQ ID NO: 442523 - DNA, 25 bp, Mus musculus
gaatttcagatttctgccctttggg

SEQ ID NO: 442524 - DNA, 25 bp, Mus musculus
gaatttcagcagactgccctgggtt

SEQ ID NO: 442525 - DNA, 25 bp, Mus musculus
gaatttcagcagtctgccctgggtt

SEQ ID NO: 442526 - DNA, 25 bp, Mus musculus
gaatttcagcttctcgttacataag

SEQ ID NO: 442527 - DNA, 25 bp, Mus musculus
gaatttcagcttgtcgttacataag

SEQ ID NO: 442528 - DNA, 25 bp, Mus musculus
gaatttcaggctatttagtcaggtc

SEQ ID NO: 442529 - DNA, 25 bp, Mus musculus
gaatttcaggctttttagtcaggtc

SEQ ID NO: 442530 - DNA, 25 bp, Mus musculus
gaatttcagggaacccaggcttgaa

SEQ ID NO: 442531 - DNA, 25 bp, Mus musculus
gaatttcagggatcccaggcttgaa

SEQ ID NO: 442532 - DNA, 25 bp, Mus musculus
gaatttcagggtctccattatcttc

SEQ ID NO: 442533 - DNA, 25 bp, Mus musculus
gaatttcagggtgtccattatcttc

SEQ ID NO: 442534 - DNA, 25 bp, Mus musculus
gaatttcaggtactccatcccagaa

SEQ ID NO: 442535 - DNA, 25 bp, Mus musculus
gaatttcaggtagtccatcccagaa

SEQ ID NO: 442536 - DNA, 25 bp, Mus musculus
gaatttcaggtgaaccccagtatcc

SEQ ID NO: 442537 - DNA, 25 bp, Mus musculus
gaatttcaggtgtaccccagtatcc

SEQ ID NO: 442538 - DNA, 25 bp, Mus musculus
gaatttcagtccatgggcacctcag

SEQ ID NO: 442539 - DNA, 25 bp, Mus musculus
gaatttcagtccttgggcacctcag

SEQ ID NO: 442540 - DNA, 25 bp, Mus musculus
gaatttcagtctacgtccaagcttt

SEQ ID NO: 442541 - DNA, 25 bp, Mus musculus
gaatttcagtcttcgtccaagcttt

SEQ ID NO: 442542 - DNA, 25 bp, Mus musculus
gaatttcatactcggacaggcttgg

SEQ ID NO: 442543 - DNA, 25 bp, Mus musculus
gaatttcatactgggacaggcttgg

SEQ ID NO: 442544 - DNA, 25 bp, Mus musculus
gaatttcatagaagtcaagttccat

SEQ ID NO: 442545 - DNA, 25 bp, Mus musculus
gaatttcatagatgtcaagttccat

SEQ ID NO: 442546 - DNA, 25 bp, Mus musculus
gaatttcatattatggtgtcgctat

SEQ ID NO: 442547 - DNA, 25 bp, Mus musculus
gaatttcatattttggtgtcgctat

SEQ ID NO: 442548 - DNA, 25 bp, Mus musculus
gaatttcatgaacacttgcacagca

SEQ ID NO: 442549 - DNA, 25 bp, Mus musculus
gaatttcatgaagacttgcacagca

SEQ ID NO: 442550 - DNA, 25 bp, Mus musculus
gaatttcatgccaatatataatgcc

SEQ ID NO: 442551 - DNA, 25 bp, Mus musculus
gaatttcatgcctatatataatgcc

SEQ ID NO: 442552 - DNA, 25 bp, Mus musculus
gaatttcatgtaccacttggccctg

SEQ ID NO: 442553 - DNA, 25 bp, Mus musculus
gaatttcatgtagcacttggccctg

SEQ ID NO: 442554 - DNA, 25 bp, Mus musculus
gaatttcattttctaatgtacccca

SEQ ID NO: 442555 - DNA, 25 bp, Mus musculus
gaatttcattttctctgacatcaat

SEQ ID NO: 442556 - DNA, 25 bp, Mus musculus
gaatttcattttgtaatgtacccca

SEQ ID NO: 442557 - DNA, 25 bp, Mus musculus
gaatttcattttgtctgacatcaat

SEQ ID NO: 442558 - DNA, 25 bp, Mus musculus
gaatttccaaaaatgcaccccgacg

SEQ ID NO: 442559 - DNA, 25 bp, Mus musculus
gaatttccaaaattgcaccccgacg

SEQ ID NO: 442560 - DNA, 25 bp, Mus musculus
gaatttccaaatcctcctgaaaaga

SEQ ID NO: 442561 - DNA, 25 bp, Mus musculus
gaatttccaaatgctcctgaaaaga

SEQ ID NO: 442562 - DNA, 25 bp, Mus musculus
gaatttccacatacaccttgtcatg

SEQ ID NO: 442563 - DNA, 25 bp, Mus musculus
gaatttccacatctatatgtttcac

SEQ ID NO: 442564 - DNA, 25 bp, Mus musculus
gaatttccacatgtatatgtttcac

SEQ ID NO: 442565 - DNA, 25 bp, Mus musculus
gaatttccacattcaccttgtcatg

SEQ ID NO: 442566 - DNA, 25 bp, Mus musculus
gaatttccacctaagggcaagaacg

SEQ ID NO: 442567 - DNA, 25 bp, Mus musculus
gaatttccaccttagggcaagaacg

SEQ ID NO: 442568 - DNA, 25 bp, Mus musculus
gaatttccacttaatttctgctaat

SEQ ID NO: 442569 - DNA, 25 bp, Mus musculus
gaatttccactttatttctgctaat

SEQ ID NO: 442570 - DNA, 25 bp, Mus musculus
gaatttccagacatttagctgagct

SEQ ID NO: 442571 - DNA, 25 bp, Mus musculus
gaatttccagacttttagctgagct

SEQ ID NO: 442572 - DNA, 25 bp, Mus musculus
gaatttccataaaccttggaggtca

SEQ ID NO: 442573 - DNA, 25 bp, Mus musculus
gaatttccataatccttggaggtca

SEQ ID NO: 442574 - DNA, 25 bp, Mus musculus
gaatttccatctctggcatcttaac

SEQ ID NO: 442575 - DNA, 25 bp, Mus musculus
gaatttccatctgtggcatcttaac

SEQ ID NO: 442576 - DNA, 25 bp, Mus musculus
gaatttccattccagcatcagacaa

SEQ ID NO: 442577 - DNA, 25 bp, Mus musculus
gaatttccattcgagcatcagacaa

SEQ ID NO: 442578 - DNA, 25 bp, Mus musculus
gaatttcccaagctattgccaccaa

SEQ ID NO: 442579 - DNA, 25 bp, Mus musculus
gaatttcccaaggtattgccaccaa

SEQ ID NO: 442580 - DNA, 25 bp, Mus musculus
gaatttcccacgctagaagaccatg

SEQ ID NO: 442581 - DNA, 25 bp, Mus musculus
gaatttcccacggtagaagaccatg

SEQ ID NO: 442582 - DNA, 25 bp, Mus musculus
gaatttcccagtaacacgtcttgtc

SEQ ID NO: 442583 - DNA, 25 bp, Mus musculus
gaatttcccagttacacgtcttgtc

SEQ ID NO: 442584 - DNA, 25 bp, Mus musculus
gaatttccccataagtcaggcttgg

SEQ ID NO: 442585 - DNA, 25 bp, Mus musculus
gaatttccccattagtcaggcttgg

SEQ ID NO: 442586 - DNA, 25 bp, Mus musculus
gaatttccctataaagctatgacag

SEQ ID NO: 442587 - DNA, 25 bp, Mus musculus
gaatttccctattaagctatgacag

SEQ ID NO: 442588 - DNA, 25 bp, Mus musculus
gaatttccggaacccaccagggaag

SEQ ID NO: 442589 - DNA, 25 bp, Mus musculus
gaatttccggaagccaccagggaag

SEQ ID NO: 442590 - DNA, 25 bp, Mus musculus
gaatttccgtttatactcttatgct

SEQ ID NO: 442591 - DNA, 25 bp, Mus musculus
gaatttccgtttttactcttatgct

SEQ ID NO: 442592 - DNA, 25 bp, Mus musculus
gaatttcctactcaggtaaaatcaa

SEQ ID NO: 442593 - DNA, 25 bp, Mus musculus
gaatttcctactgaggtaaaatcaa

SEQ ID NO: 442594 - DNA, 25 bp, Mus musculus
gaatttcctatcagggatatcccaa

SEQ ID NO: 442595 - DNA, 25 bp, Mus musculus
gaatttcctatctgggatatcccaa

SEQ ID NO: 442596 - DNA, 25 bp, Mus musculus
gaatttcctcctcatgttgttatta

SEQ ID NO: 442597 - DNA, 25 bp, Mus musculus
gaatttcctcctgatgttgttatta

SEQ ID NO: 442598 - DNA, 25 bp, Mus musculus
gaatttcctgacagctgatgctaat

SEQ ID NO: 442599 - DNA, 25 bp, Mus musculus
gaatttcctgactgctgatgctaat

SEQ ID NO: 442600 - DNA, 25 bp, Mus musculus
gaatttcctgcaaatcaatcctgga

SEQ ID NO: 442601 - DNA, 25 bp, Mus musculus
gaatttcctgcatatcaatcctgga

SEQ ID NO: 442602 - DNA, 25 bp, Mus musculus
gaatttcctgccatgcttatggaat

SEQ ID NO: 442603 - DNA, 25 bp, Mus musculus
gaatttcctgccttgcttatggaat

SEQ ID NO: 442604 - DNA, 25 bp, Mus musculus
gaatttcctggtagatatataagct

SEQ ID NO: 442605 - DNA, 25 bp, Mus musculus
gaatttcctggttgatatataagct

SEQ ID NO: 442606 - DNA, 25 bp, Mus musculus
gaatttccttgactacatgaaccat

SEQ ID NO: 442607 - DNA, 25 bp, Mus musculus
gaatttccttgagtacatgaaccat

SEQ ID NO: 442608 - DNA, 25 bp, Mus musculus
gaatttcgaaacataacctcgctga

SEQ ID NO: 442609 - DNA, 25 bp, Mus musculus
gaatttcgaaacttaacctcgctga

SEQ ID NO: 442610 - DNA, 25 bp, Mus musculus
gaatttcgacaacccagtgtacagg

SEQ ID NO: 442611 - DNA, 25 bp, Mus musculus
gaatttcgacaagccagtgtacagg

SEQ ID NO: 442612 - DNA, 25 bp, Mus musculus
gaatttcgagtacaactgacagtta

SEQ ID NO: 442613 - DNA, 25 bp, Mus musculus
gaatttcgagtagaactgacagtta

SEQ ID NO: 442614 - DNA, 25 bp, Mus musculus
gaatttcgatcaagttttcaacacc

SEQ ID NO: 442615 - DNA, 25 bp, Mus musculus
gaatttcgatcatgttttcaacacc

SEQ ID NO: 442616 - DNA, 25 bp, Mus musculus
gaatttcgatgaagaatttacccct

SEQ ID NO: 442617 - DNA, 25 bp, Mus musculus
gaatttcgatgatgaatttacccct

SEQ ID NO: 442618 - DNA, 25 bp, Mus musculus
gaatttcgatttctgcccagtgata

SEQ ID NO: 442619 - DNA, 25 bp, Mus musculus
gaatttcgatttgtgcccagtgata

SEQ ID NO: 442620 - DNA, 25 bp, Mus musculus
gaatttcgggcacatccatggtata

SEQ ID NO: 442621 - DNA, 25 bp, Mus musculus
gaatttcgggcagatccatggtata

SEQ ID NO: 442622 - DNA, 25 bp, Mus musculus
gaatttcgtccaattcttttagatt

SEQ ID NO: 442623 - DNA, 25 bp, Mus musculus
gaatttcgtccatttcttttagatt

SEQ ID NO: 442624 - DNA, 25 bp, Mus musculus
gaatttcgtggtatgtaagctttat

SEQ ID NO: 442625 - DNA, 25 bp, Mus musculus
gaatttcgtggtttgtaagctttat

SEQ ID NO: 442626 - DNA, 25 bp, Mus musculus
gaatttctaagaccgtgacctccta

SEQ ID NO: 442627 - DNA, 25 bp, Mus musculus
gaatttctaagagcgtgacctccta

SEQ ID NO: 442628 - DNA, 25 bp, Mus musculus
gaatttctaagtcctgtttgattgg

SEQ ID NO: 442629 - DNA, 25 bp, Mus musculus
gaatttctaagtgctgtttgattgg

SEQ ID NO: 442630 - DNA, 25 bp, Mus musculus
gaatttctaatacttcaccagtgga

SEQ ID NO: 442631 - DNA, 25 bp, Mus musculus
gaatttctaatagttcaccagtgga

SEQ ID NO: 442632 - DNA, 25 bp, Mus musculus
gaatttctactgaactgactacaac

SEQ ID NO: 442633 - DNA, 25 bp, Mus musculus
gaatttctactgtactgactacaac

SEQ ID NO: 442634 - DNA, 25 bp, Mus musculus
gaatttctagccatgaataccactg

SEQ ID NO: 442635 - DNA, 25 bp, Mus musculus
gaatttctagccttgaataccactg

SEQ ID NO: 442636 - DNA, 25 bp, Mus musculus
gaatttctcacaagtttgttagcta

SEQ ID NO: 442637 - DNA, 25 bp, Mus musculus
gaatttctcacatgtttgttagcta

SEQ ID NO: 442638 - DNA, 25 bp, Mus musculus
gaatttctcagtataggtcctttga

SEQ ID NO: 442639 - DNA, 25 bp, Mus musculus
gaatttctcagtttaggtcctttga

SEQ ID NO: 442640 - DNA, 25 bp, Mus musculus
gaatttctcccaagtactctttaag

SEQ ID NO: 442641 - DNA, 25 bp, Mus musculus
gaatttctcccatgtactctttaag

SEQ ID NO: 442642 - DNA, 25 bp, Mus musculus
gaatttctcctactgttttcttcag

SEQ ID NO: 442643 - DNA, 25 bp, Mus musculus
gaatttctcctactttacactctct

SEQ ID NO: 442644 - DNA, 25 bp, Mus musculus
gaatttctcctagtgttttcttcag

SEQ ID NO: 442645 - DNA, 25 bp, Mus musculus
gaatttctcctagtttacactctct

SEQ ID NO: 442646 - DNA, 25 bp, Mus musculus
gaatttctcggtatgtggcctacag

SEQ ID NO: 442647 - DNA, 25 bp, Mus musculus
gaatttctcggtttgtggcctacag

SEQ ID NO: 442648 - DNA, 25 bp, Mus musculus
gaatttctctctactgacttttttg

SEQ ID NO: 442649 - DNA, 25 bp, Mus musculus
gaatttctctctcagacatcatctg

SEQ ID NO: 442650 - DNA, 25 bp, Mus musculus
gaatttctctctgagacatcatctg

SEQ ID NO: 442651 - DNA, 25 bp, Mus musculus
gaatttctctcttctgacttttttg

SEQ ID NO: 442652 - DNA, 25 bp, Mus musculus
gaatttctctttatagcaatcttac

SEQ ID NO: 442653 - DNA, 25 bp, Mus musculus
gaatttctctttttagcaatcttac

SEQ ID NO: 442654 - DNA, 25 bp, Mus musculus
gaatttctgattaattactggactt

SEQ ID NO: 442655 - DNA, 25 bp, Mus musculus
gaatttctgatttattactggactt

SEQ ID NO: 442656 - DNA, 25 bp, Mus musculus
gaatttctgcggcataggctcttca

SEQ ID NO: 442657 - DNA, 25 bp, Mus musculus
gaatttctgcgggataggctcttca

SEQ ID NO: 442658 - DNA, 25 bp, Mus musculus
gaatttctgctacgcatagagggca

SEQ ID NO: 442659 - DNA, 25 bp, Mus musculus
gaatttctgctaggcatagagggca

SEQ ID NO: 442660 - DNA, 25 bp, Mus musculus
gaatttctgcttacagttctaggtt

SEQ ID NO: 442661 - DNA, 25 bp, Mus musculus
gaatttctgctttcagttctaggtt

SEQ ID NO: 442662 - DNA, 25 bp, Mus musculus
gaatttctgggtaatgctggttgca

SEQ ID NO: 442663 - DNA, 25 bp, Mus musculus
gaatttctgggttatgctggttgca

SEQ ID NO: 442664 - DNA, 25 bp, Mus musculus
gaatttctgtagacctgagacataa

SEQ ID NO: 442665 - DNA, 25 bp, Mus musculus
gaatttctgtagtcctgagacataa

SEQ ID NO: 442666 - DNA, 25 bp, Mus musculus
gaatttctgttacccagctttggga

SEQ ID NO: 442667 - DNA, 25 bp, Mus musculus
gaatttctgttagccagctttggga

SEQ ID NO: 442668 - DNA, 25 bp, Mus musculus
gaatttcttaccacaaaagcactgt

SEQ ID NO: 442669 - DNA, 25 bp, Mus musculus
gaatttcttacctcaaaagcactgt

SEQ ID NO: 442670 - DNA, 25 bp, Mus musculus
gaatttcttactctttcaaaatgag

SEQ ID NO: 442671 - DNA, 25 bp, Mus musculus
gaatttcttactgtttcaaaatgag

SEQ ID NO: 442672 - DNA, 25 bp, Mus musculus
gaatttcttagtacctcgttcaatg

SEQ ID NO: 442673 - DNA, 25 bp, Mus musculus
gaatttcttagttcctcgttcaatg

SEQ ID NO: 442674 - DNA, 25 bp, Mus musculus
gaatttcttatccatttagcattta

SEQ ID NO: 442675 - DNA, 25 bp, Mus musculus
gaatttcttatcgatttagcattta

SEQ ID NO: 442676 - DNA, 25 bp, Mus musculus
gaatttcttattctagactgcccca

SEQ ID NO: 442677 - DNA, 25 bp, Mus musculus
gaatttcttattgtagactgcccca

SEQ ID NO: 442678 - DNA, 25 bp, Mus musculus
gaatttcttcataattggcttttta

SEQ ID NO: 442679 - DNA, 25 bp, Mus musculus
gaatttcttcattattggcttttta

SEQ ID NO: 442680 - DNA, 25 bp, Mus musculus
gaatttcttcgaatcgcaccatgcc

SEQ ID NO: 442681 - DNA, 25 bp, Mus musculus
gaatttcttcgattcgcaccatgcc

SEQ ID NO: 442682 - DNA, 25 bp, Mus musculus
gaatttcttctcaaccatgaccgag

SEQ ID NO: 442683 - DNA, 25 bp, Mus musculus
gaatttcttctctaccatgaccgag

SEQ ID NO: 442684 - DNA, 25 bp, Mus musculus
gaatttcttgagatggaaggccaaa

SEQ ID NO: 442685 - DNA, 25 bp, Mus musculus
gaatttcttgagttggaaggccaaa

SEQ ID NO: 442686 - DNA, 25 bp, Mus musculus
gaatttcttgttctacctctgcata

SEQ ID NO: 442687 - DNA, 25 bp, Mus musculus
gaatttcttgttgtacctctgcata

SEQ ID NO: 442688 - DNA, 25 bp, Mus musculus
gaatttctttcgaatccaaaacagt

SEQ ID NO: 442689 - DNA, 25 bp, Mus musculus
gaatttctttcgtatccaaaacagt

SEQ ID NO: 442690 - DNA, 25 bp, Mus musculus
gaatttgaaattacaccagaaggaa

SEQ ID NO: 442691 - DNA, 25 bp, Mus musculus
gaatttgaaatttcaccagaaggaa

SEQ ID NO: 442692 - DNA, 25 bp, Mus musculus
gaatttgaacaaacgcttcgagaat

SEQ ID NO: 442693 - DNA, 25 bp, Mus musculus
gaatttgaacaatcgcttcgagaat

SEQ ID NO: 442694 - DNA, 25 bp, Mus musculus
gaatttgaacagacttggagttttt

SEQ ID NO: 442695 - DNA, 25 bp, Mus musculus
gaatttgaacagtcttggagttttt

SEQ ID NO: 442696 - DNA, 25 bp, Mus musculus
gaatttgaacccatctttattttag

SEQ ID NO: 442697 - DNA, 25 bp, Mus musculus
gaatttgaacccttctttattttag

SEQ ID NO: 442698 - DNA, 25 bp, Mus musculus
gaatttgaacctcccagatttctaa

SEQ ID NO: 442699 - DNA, 25 bp, Mus musculus
gaatttgaacctgccagatttctaa

SEQ ID NO: 442700 - DNA, 25 bp, Mus musculus
gaatttgaagccatctactattttt

SEQ ID NO: 442701 - DNA, 25 bp, Mus musculus
gaatttgaagccttctactattttt

SEQ ID NO: 442702 - DNA, 25 bp, Mus musculus
gaatttgaagctctctgtgactgtt

SEQ ID NO: 442703 - DNA, 25 bp, Mus musculus
gaatttgaagctgtctgtgactgtt

SEQ ID NO: 442704 - DNA, 25 bp, Mus musculus
gaatttgaagtgagaggctgagaaa

SEQ ID NO: 442705 - DNA, 25 bp, Mus musculus
gaatttgaagtgtgaggctgagaaa

SEQ ID NO: 442706 - DNA, 25 bp, Mus musculus
gaatttgaatgcatgaccccaggaa

SEQ ID NO: 442707 - DNA, 25 bp, Mus musculus
gaatttgaatgcttgaccccaggaa

SEQ ID NO: 442708 - DNA, 25 bp, Mus musculus
gaatttgacaaacccgctgaggagg

SEQ ID NO: 442709 - DNA, 25 bp, Mus musculus
gaatttgacaaagccgctgaggagg

SEQ ID NO: 442710 - DNA, 25 bp, Mus musculus
gaatttgacactactagaatgtcct

SEQ ID NO: 442711 - DNA, 25 bp, Mus musculus
gaatttgacacttctagaatgtcct

SEQ ID NO: 442712 - DNA, 25 bp, Mus musculus
gaatttgacccaatgctggatgaga

SEQ ID NO: 442713 - DNA, 25 bp, Mus musculus
gaatttgacccattgctggatgaga

SEQ ID NO: 442714 - DNA, 25 bp, Mus musculus
gaatttgactaaacctttatccaag

SEQ ID NO: 442715 - DNA, 25 bp, Mus musculus
gaatttgactaatcctttatccaag

SEQ ID NO: 442716 - DNA, 25 bp, Mus musculus
gaatttgactgacttttgcctagaa

SEQ ID NO: 442717 - DNA, 25 bp, Mus musculus
gaatttgactgagttttgcctagaa

SEQ ID NO: 442718 - DNA, 25 bp, Mus musculus
gaatttgacttcatccacttagcag

SEQ ID NO: 442719 - DNA, 25 bp, Mus musculus
gaatttgacttcctgtcagtccttt

SEQ ID NO: 442720 - DNA, 25 bp, Mus musculus
gaatttgacttcgtgtcagtccttt

SEQ ID NO: 442721 - DNA, 25 bp, Mus musculus
gaatttgacttcttccacttagcag

SEQ ID NO: 442722 - DNA, 25 bp, Mus musculus
gaatttgacttgaggagcaatctaa

SEQ ID NO: 442723 - DNA, 25 bp, Mus musculus
gaatttgacttgtggagcaatctaa

SEQ ID NO: 442724 - DNA, 25 bp, Mus musculus
gaatttgagaagacccctccagcag

SEQ ID NO: 442725 - DNA, 25 bp, Mus musculus
gaatttgagaagtcccctccagcag

SEQ ID NO: 442726 - DNA, 25 bp, Mus musculus
gaatttgagaccaatctgatttgcc

SEQ ID NO: 442727 - DNA, 25 bp, Mus musculus
gaatttgagacctatctgatttgcc

SEQ ID NO: 442728 - DNA, 25 bp, Mus musculus
gaatttgagactcagtcacctactt

SEQ ID NO: 442729 - DNA, 25 bp, Mus musculus
gaatttgagactgagtcacctactt

SEQ ID NO: 442730 - DNA, 25 bp, Mus musculus
gaatttgagataatccagactcgta

SEQ ID NO: 442731 - DNA, 25 bp, Mus musculus
gaatttgagatattccagactcgta

SEQ ID NO: 442732 - DNA, 25 bp, Mus musculus
gaatttgagcaacgtttccttccca

SEQ ID NO: 442733 - DNA, 25 bp, Mus musculus
gaatttgagcaaggtttccttccca

SEQ ID NO: 442734 - DNA, 25 bp, Mus musculus
gaatttgagcccagactatggaaag

SEQ ID NO: 442735 - DNA, 25 bp, Mus musculus
gaatttgagccctgactatggaaag

SEQ ID NO: 442736 - DNA, 25 bp, Mus musculus
gaatttgagcctacgactggctttt

SEQ ID NO: 442737 - DNA, 25 bp, Mus musculus
gaatttgagccttcgactggctttt

SEQ ID NO: 442738 - DNA, 25 bp, Mus musculus
gaatttgagcttatggtttggttgt

SEQ ID NO: 442739 - DNA, 25 bp, Mus musculus
gaatttgagcttcaggacccatatt

SEQ ID NO: 442740 - DNA, 25 bp, Mus musculus
gaatttgagcttctacctgcatctt

SEQ ID NO: 442741 - DNA, 25 bp, Mus musculus
gaatttgagcttgaggacccatatt

SEQ ID NO: 442742 - DNA, 25 bp, Mus musculus
gaatttgagcttgtacctgcatctt

SEQ ID NO: 442743 - DNA, 25 bp, Mus musculus
gaatttgagcttttggtttggttgt

SEQ ID NO: 442744 - DNA, 25 bp, Mus musculus
gaatttgaggacactcagcccatac

SEQ ID NO: 442745 - DNA, 25 bp, Mus musculus
gaatttgaggactctcagcccatac

SEQ ID NO: 442746 - DNA, 25 bp, Mus musculus
gaatttgaggatctccgtagcctat

SEQ ID NO: 442747 - DNA, 25 bp, Mus musculus
gaatttgaggatgtccgtagcctat

SEQ ID NO: 442748 - DNA, 25 bp, Mus musculus
gaatttgagggcactgggcagtaaa

SEQ ID NO: 442749 - DNA, 25 bp, Mus musculus
gaatttgagggctctgggcagtaaa

SEQ ID NO: 442750 - DNA, 25 bp, Mus musculus
gaatttgagggtagctgtctctgca

SEQ ID NO: 442751 - DNA, 25 bp, Mus musculus
gaatttgagggttgctgtctctgca

SEQ ID NO: 442752 - DNA, 25 bp, Mus musculus
gaatttgaggtgaggaatctagcaa

SEQ ID NO: 442753 - DNA, 25 bp, Mus musculus
gaatttgaggtgtggaatctagcaa

SEQ ID NO: 442754 - DNA, 25 bp, Mus musculus
gaatttgatcccagaagtttgtgtg

SEQ ID NO: 442755 - DNA, 25 bp, Mus musculus
gaatttgatcccaggcacgaagccc

SEQ ID NO: 442756 - DNA, 25 bp, Mus musculus
gaatttgatccccaggacgcaacct

SEQ ID NO: 442757 - DNA, 25 bp, Mus musculus
gaatttgatcccgaggacgcaacct

SEQ ID NO: 442758 - DNA, 25 bp, Mus musculus
gaatttgatccctgaagtttgtgtg

SEQ ID NO: 442759 - DNA, 25 bp, Mus musculus
gaatttgatccctggcacgaagccc

SEQ ID NO: 442760 - DNA, 25 bp, Mus musculus
gaatttgatccgcaatgactacgaa

SEQ ID NO: 442761 - DNA, 25 bp, Mus musculus
gaatttgatccggaatgactacgaa

SEQ ID NO: 442762 - DNA, 25 bp, Mus musculus
gaatttgatctcaggaactcaccta

SEQ ID NO: 442763 - DNA, 25 bp, Mus musculus
gaatttgatctctggaactcaccta

SEQ ID NO: 442764 - DNA, 25 bp, Mus musculus
gaatttgatgtgaccttcccagacg

SEQ ID NO: 442765 - DNA, 25 bp, Mus musculus
gaatttgatgtgtccttcccagacg

SEQ ID NO: 442766 - DNA, 25 bp, Mus musculus
gaatttgcaaaaccacaactgcagt

SEQ ID NO: 442767 - DNA, 25 bp, Mus musculus
gaatttgcaaaagcacaactgcagt

SEQ ID NO: 442768 - DNA, 25 bp, Mus musculus
gaatttgcaagaactctcagcccgt

SEQ ID NO: 442769 - DNA, 25 bp, Mus musculus
gaatttgcaagatctctcagcccgt

SEQ ID NO: 442770 - DNA, 25 bp, Mus musculus
gaatttgcacctcttcatttgtcct

SEQ ID NO: 442771 - DNA, 25 bp, Mus musculus
gaatttgcacctgttcatttgtcct

SEQ ID NO: 442772 - DNA, 25 bp, Mus musculus
gaatttgcactccataccaaccagt

SEQ ID NO: 442773 - DNA, 25 bp, Mus musculus
gaatttgcactcgataccaaccagt

SEQ ID NO: 442774 - DNA, 25 bp, Mus musculus
gaatttgcagccagggcacttccct

SEQ ID NO: 442775 - DNA, 25 bp, Mus musculus
gaatttgcagcctgggcacttccct

SEQ ID NO: 442776 - DNA, 25 bp, Mus musculus
gaatttgcaggcatgcgacaccata

SEQ ID NO: 442777 - DNA, 25 bp, Mus musculus
gaatttgcaggcttgcgacaccata

SEQ ID NO: 442778 - DNA, 25 bp, Mus musculus
gaatttgcatccacaggtgaacctg

SEQ ID NO: 442779 - DNA, 25 bp, Mus musculus
gaatttgcatcctcaggtgaacctg

SEQ ID NO: 442780 - DNA, 25 bp, Mus musculus
gaatttgcatctatctggctttcgc

SEQ ID NO: 442781 - DNA, 25 bp, Mus musculus
gaatttgcatctttctggctttcgc

SEQ ID NO: 442782 - DNA, 25 bp, Mus musculus
gaatttgcatttacacttagacact

SEQ ID NO: 442783 - DNA, 25 bp, Mus musculus
gaatttgcatttacattccaaaagc

SEQ ID NO: 442784 - DNA, 25 bp, Mus musculus
gaatttgcattttcacttagacact

SEQ ID NO: 442785 - DNA, 25 bp, Mus musculus
gaatttgcattttcattccaaaagc

SEQ ID NO: 442786 - DNA, 25 bp, Mus musculus
gaatttgccaatattcaggactttg

SEQ ID NO: 442787 - DNA, 25 bp, Mus musculus
gaatttgccaattttcaggactttg

SEQ ID NO: 442788 - DNA, 25 bp, Mus musculus
gaatttgccaccacttttatgacag

SEQ ID NO: 442789 - DNA, 25 bp, Mus musculus
gaatttgccacctcttttatgacag

SEQ ID NO: 442790 - DNA, 25 bp, Mus musculus
gaatttgccacgctcacagattgag

SEQ ID NO: 442791 - DNA, 25 bp, Mus musculus
gaatttgccacggtcacagattgag

SEQ ID NO: 442792 - DNA, 25 bp, Mus musculus
gaatttgccagtatcctgtgttcag

SEQ ID NO: 442793 - DNA, 25 bp, Mus musculus
gaatttgccagtttcctgtgttcag

SEQ ID NO: 442794 - DNA, 25 bp, Mus musculus
gaatttgccgagagctgactttctt

SEQ ID NO: 442795 - DNA, 25 bp, Mus musculus
gaatttgccgagtgctgactttctt

SEQ ID NO: 442796 - DNA, 25 bp, Mus musculus
gaatttgccgttaactggagaggta

SEQ ID NO: 442797 - DNA, 25 bp, Mus musculus
gaatttgccgtttactggagaggta

SEQ ID NO: 442798 - DNA, 25 bp, Mus musculus
gaatttgcctgccttgatttttata

SEQ ID NO: 442799 - DNA, 25 bp, Mus musculus
gaatttgcctgcgttgatttttata

SEQ ID NO: 442800 - DNA, 25 bp, Mus musculus
gaatttgctaatacttgtggcttaa

SEQ ID NO: 442801 - DNA, 25 bp, Mus musculus
gaatttgctaattcttgtggcttaa

SEQ ID NO: 442802 - DNA, 25 bp, Mus musculus
gaatttgctgaacacctcaaaggga

SEQ ID NO: 442803 - DNA, 25 bp, Mus musculus
gaatttgctgaagacctcaaaggga

SEQ ID NO: 442804 - DNA, 25 bp, Mus musculus
gaatttgctgacctgttttttacta

SEQ ID NO: 442805 - DNA, 25 bp, Mus musculus
gaatttgctgacgtgttttttacta

SEQ ID NO: 442806 - DNA, 25 bp, Mus musculus
gaatttgctgccacagccggcagta

SEQ ID NO: 442807 - DNA, 25 bp, Mus musculus
gaatttgctgcctcagccggcagta

SEQ ID NO: 442808 - DNA, 25 bp, Mus musculus
gaatttgctggacacgccagaccgt

SEQ ID NO: 442809 - DNA, 25 bp, Mus musculus
gaatttgctggagacgccagaccgt

SEQ ID NO: 442810 - DNA, 25 bp, Mus musculus
gaatttgctggcaagtcactgttag

SEQ ID NO: 442811 - DNA, 25 bp, Mus musculus
gaatttgctggctagtcactgttag

SEQ ID NO: 442812 - DNA, 25 bp, Mus musculus
gaatttgctgtaactttcacattgt

SEQ ID NO: 442813 - DNA, 25 bp, Mus musculus
gaatttgctgtatctttcacattgt

SEQ ID NO: 442814 - DNA, 25 bp, Mus musculus
gaatttgcttgcataaactctgttg

SEQ ID NO: 442815 - DNA, 25 bp, Mus musculus
gaatttgcttgcttaaactctgttg

SEQ ID NO: 442816 - DNA, 25 bp, Mus musculus
gaatttgcttggatcagtccttcag

SEQ ID NO: 442817 - DNA, 25 bp, Mus musculus
gaatttgcttggttcagtccttcag

SEQ ID NO: 442818 - DNA, 25 bp, Mus musculus
gaatttgcttttcctggtaacaggg

SEQ ID NO: 442819 - DNA, 25 bp, Mus musculus
gaatttgcttttgctggtaacaggg

SEQ ID NO: 442820 - DNA, 25 bp, Mus musculus
gaatttggaagacccctgagcattg

SEQ ID NO: 442821 - DNA, 25 bp, Mus musculus
gaatttggaagagccctgagcattg

SEQ ID NO: 442822 - DNA, 25 bp, Mus musculus
gaatttggacccatttactgaccct

SEQ ID NO: 442823 - DNA, 25 bp, Mus musculus
gaatttggacccttttactgaccct

SEQ ID NO: 442824 - DNA, 25 bp, Mus musculus
gaatttggaggcatgtaagagaaca

SEQ ID NO: 442825 - DNA, 25 bp, Mus musculus
gaatttggaggcttgtaagagaaca

SEQ ID NO: 442826 - DNA, 25 bp, Mus musculus
gaatttggcaaaagcagccgtctga

SEQ ID NO: 442827 - DNA, 25 bp, Mus musculus
gaatttggcaaatgcagccgtctga

SEQ ID NO: 442828 - DNA, 25 bp, Mus musculus
gaatttggcaagactactaccttca

SEQ ID NO: 442829 - DNA, 25 bp, Mus musculus
gaatttggcaagtctactaccttca

SEQ ID NO: 442830 - DNA, 25 bp, Mus musculus
gaatttggcagaacatattacagaa

SEQ ID NO: 442831 - DNA, 25 bp, Mus musculus
gaatttggcagatcatattacagaa

SEQ ID NO: 442832 - DNA, 25 bp, Mus musculus
gaatttggccaaaatttctgtaata

SEQ ID NO: 442833 - DNA, 25 bp, Mus musculus
gaatttggccaaccatgcagcttct

SEQ ID NO: 442834 - DNA, 25 bp, Mus musculus
gaatttggccaagcatgcagcttct

SEQ ID NO: 442835 - DNA, 25 bp, Mus musculus
gaatttggccaatatttctgtaata

SEQ ID NO: 442836 - DNA, 25 bp, Mus musculus
gaatttggccacactctgggtctga

SEQ ID NO: 442837 - DNA, 25 bp, Mus musculus
gaatttggccactctctgggtctga

SEQ ID NO: 442838 - DNA, 25 bp, Mus musculus
gaatttggcctaataagtcagtgca

SEQ ID NO: 442839 - DNA, 25 bp, Mus musculus
gaatttggcctattaagtcagtgca

SEQ ID NO: 442840 - DNA, 25 bp, Mus musculus
gaatttgggtccacgatgcttgcaa

SEQ ID NO: 442841 - DNA, 25 bp, Mus musculus
gaatttgggtcctcgatgcttgcaa

SEQ ID NO: 442842 - DNA, 25 bp, Mus musculus
gaatttgggttcagtccttgatgga

SEQ ID NO: 442843 - DNA, 25 bp, Mus musculus
gaatttgggttctgtccttgatgga

SEQ ID NO: 442844 - DNA, 25 bp, Mus musculus
gaatttggtcagaggcagtacttga

SEQ ID NO: 442845 - DNA, 25 bp, Mus musculus
gaatttggtcagtggcagtacttga

SEQ ID NO: 442846 - DNA, 25 bp, Mus musculus
gaatttggtccacatcattacccac

SEQ ID NO: 442847 - DNA, 25 bp, Mus musculus
gaatttggtccagatcattacccac

SEQ ID NO: 442848 - DNA, 25 bp, Mus musculus
gaatttggtcctacagctgtcgtac

SEQ ID NO: 442849 - DNA, 25 bp, Mus musculus
gaatttggtccttcagctgtcgtac

SEQ ID NO: 442850 - DNA, 25 bp, Mus musculus
gaatttggtctaagccaggcgtggt

SEQ ID NO: 442851 - DNA, 25 bp, Mus musculus
gaatttggtctaagcttgtccacca

SEQ ID NO: 442852 - DNA, 25 bp, Mus musculus
gaatttggtctatgccaggcgtggt

SEQ ID NO: 442853 - DNA, 25 bp, Mus musculus
gaatttggtctatgcttgtccacca

SEQ ID NO: 442854 - DNA, 25 bp, Mus musculus
gaatttggtgctcatgttttatata

SEQ ID NO: 442855 - DNA, 25 bp, Mus musculus
gaatttggtgctcgaacctgctgtt

SEQ ID NO: 442856 - DNA, 25 bp, Mus musculus
gaatttggtgctgatgttttatata

SEQ ID NO: 442857 - DNA, 25 bp, Mus musculus
gaatttggtgctggaacctgctgtt

SEQ ID NO: 442858 - DNA, 25 bp, Mus musculus
gaatttggtgttcttcttacagcat

SEQ ID NO: 442859 - DNA, 25 bp, Mus musculus
gaatttggtgttgttcttacagcat

SEQ ID NO: 442860 - DNA, 25 bp, Mus musculus
gaatttggttctaggacagcctctg

SEQ ID NO: 442861 - DNA, 25 bp, Mus musculus
gaatttggttctatacatcattatt

SEQ ID NO: 442862 - DNA, 25 bp, Mus musculus
gaatttggttcttggacagcctctg

SEQ ID NO: 442863 - DNA, 25 bp, Mus musculus
gaatttggttctttacatcattatt

SEQ ID NO: 442864 - DNA, 25 bp, Mus musculus
gaatttggttgcctttttcgacctg

SEQ ID NO: 442865 - DNA, 25 bp, Mus musculus
gaatttggttgcgtttttcgacctg

SEQ ID NO: 442866 - DNA, 25 bp, Mus musculus
gaatttgtaaatctcccttgcagta

SEQ ID NO: 442867 - DNA, 25 bp, Mus musculus
gaatttgtaaatgtcccttgcagta

SEQ ID NO: 442868 - DNA, 25 bp, Mus musculus
gaatttgtaagtcatgtcctgctag

SEQ ID NO: 442869 - DNA, 25 bp, Mus musculus
gaatttgtaagtgatgtcctgctag

SEQ ID NO: 442870 - DNA, 25 bp, Mus musculus
gaatttgtacctcttagtctgtaac

SEQ ID NO: 442871 - DNA, 25 bp, Mus musculus
gaatttgtacctgttagtctgtaac

SEQ ID NO: 442872 - DNA, 25 bp, Mus musculus
gaatttgtactgagagcccatgatg

SEQ ID NO: 442873 - DNA, 25 bp, Mus musculus
gaatttgtactgtgagcccatgatg

SEQ ID NO: 442874 - DNA, 25 bp, Mus musculus
gaatttgtagtgacagtggcaagta

SEQ ID NO: 442875 - DNA, 25 bp, Mus musculus
gaatttgtagtgtcagtggcaagta

SEQ ID NO: 442876 - DNA, 25 bp, Mus musculus
gaatttgtataacaaactggtccat

SEQ ID NO: 442877 - DNA, 25 bp, Mus musculus
gaatttgtataagaaactggtccat

SEQ ID NO: 442878 - DNA, 25 bp, Mus musculus
gaatttgtcagaaggcagcagcgtc

SEQ ID NO: 442879 - DNA, 25 bp, Mus musculus
gaatttgtcagatggcagcagcgtc

SEQ ID NO: 442880 - DNA, 25 bp, Mus musculus
gaatttgtcagtcctgtgtgttggc

SEQ ID NO: 442881 - DNA, 25 bp, Mus musculus
gaatttgtcagtgctgtgtgttggc

SEQ ID NO: 442882 - DNA, 25 bp, Mus musculus
gaatttgtcccacgttgtggctttc

SEQ ID NO: 442883 - DNA, 25 bp, Mus musculus
gaatttgtcccaggttgtggctttc

SEQ ID NO: 442884 - DNA, 25 bp, Mus musculus
gaatttgtccttaagtgtggcatct

SEQ ID NO: 442885 - DNA, 25 bp, Mus musculus
gaatttgtcctttagtgtggcatct

SEQ ID NO: 442886 - DNA, 25 bp, Mus musculus
gaatttgtctctctgttctctgtat

SEQ ID NO: 442887 - DNA, 25 bp, Mus musculus
gaatttgtctctgtgttctctgtat

SEQ ID NO: 442888 - DNA, 25 bp, Mus musculus
gaatttgtgacaaagaacttgaaac

SEQ ID NO: 442889 - DNA, 25 bp, Mus musculus
gaatttgtgacatagaacttgaaac

SEQ ID NO: 442890 - DNA, 25 bp, Mus musculus
gaatttgtgagccagttctacaggg
